United States Patent 7,312,035 (METHODS OF GENETIC ANALYSIS OF YEAST) - sequence listing, part 3

SEQ ID NO: 77507 - DNA, 25 bp, S. pombe
aagcgtgctagttatggtcattcca

SEQ ID NO: 77508 - DNA, 25 bp, S. pombe
aagcggccagtctgtatatacacat

SEQ ID NO: 77509 - DNA, 25 bp, S. pombe
aagccaacgattatcacttctcaag

SEQ ID NO: 77510 - DNA, 25 bp, S. pombe
aagctttagagctcggcgacgatcg

SEQ ID NO: 77511 - DNA, 25 bp, S. pombe
aagcctttcaaggaatctgccacca

SEQ ID NO: 77512 - DNA, 25 bp, S. pombe
aagctgggtttaatgctacctcctc

SEQ ID NO: 77513 - DNA, 25 bp, S. pombe
aaccagcagcctttgtcttttataa

SEQ ID NO: 77514 - DNA, 25 bp, S. pombe
aagccaagccaactgtctttcaata

SEQ ID NO: 77515 - DNA, 25 bp, S. pombe
aaccatttttcaaactgttagactg

SEQ ID NO: 77516 - DNA, 25 bp, S. pombe
aagcctttgatatctcagttttacg

SEQ ID NO: 77517 - DNA, 25 bp, S. pombe
aagcttttaaatgaggctgatctaa

SEQ ID NO: 77518 - DNA, 25 bp, S. pombe
aagcgtttcaactttggtactacat

SEQ ID NO: 77519 - DNA, 25 bp, S. pombe
aagccttttcgcatcttttggtata

SEQ ID NO: 77520 - DNA, 25 bp, S. pombe
aagcgcgcttttctcgagttttgct

SEQ ID NO: 77521 - DNA, 25 bp, S. pombe
aagccatcctttgtacgcttgttgt

SEQ ID NO: 77522 - DNA, 25 bp, S. pombe
aagctttcagtcgtgatcaacccta

SEQ ID NO: 77523 - DNA, 25 bp, S. pombe
aagctgttgacgttgccaaccctaa

SEQ ID NO: 77524 - DNA, 25 bp, S. pombe
aagcgtcgacgtcaaatcccaatat

SEQ ID NO: 77525 - DNA, 25 bp, S. pombe
aagcctaacgttaaatctgcgcaaa

SEQ ID NO: 77526 - DNA, 25 bp, S. pombe
aagcccaattcgaatctggtccaag

SEQ ID NO: 77527 - DNA, 25 bp, S. pombe
aagcgctatatgctgaacgttcgaa

SEQ ID NO: 77528 - DNA, 25 bp, S. pombe
aagcctgccatgaaactggtatcta

SEQ ID NO: 77529 - DNA, 25 bp, S. pombe
aagccacgatgcgatgacgaggaca

SEQ ID NO: 77530 - DNA, 25 bp, S. pombe
aaccatcgggctcctatgttagttc

SEQ ID NO: 77531 - DNA, 25 bp, S. pombe
aaccatcctggacctatttcatgtt

SEQ ID NO: 77532 - DNA, 25 bp, S. pombe
aaccatcctggacgctgtttcaaaa

SEQ ID NO: 77533 - DNA, 25 bp, S. pombe
aagccttctgaaactcttaacaaga

SEQ ID NO: 77534 - DNA, 25 bp, S. pombe
aagcctttcgtgctgttgccgaagg

SEQ ID NO: 77535 - DNA, 25 bp, S. pombe
aagccttcctgaattgattgaccgg

SEQ ID NO: 77536 - DNA, 25 bp, S. pombe
aagcgcttgcgcctttcaagagcat

SEQ ID NO: 77537 - DNA, 25 bp, S. pombe
aagctttgcgctacctaatggaata

SEQ ID NO: 77538 - DNA, 25 bp, S. pombe
aagcctgctgctagacaacgtgaag

SEQ ID NO: 77539 - DNA, 25 bp, S. pombe
aagcctgctgatagccagatcttta

SEQ ID NO: 77540 - DNA, 25 bp, S. pombe
aagccctcttgccagatttgaacaa

SEQ ID NO: 77541 - DNA, 25 bp, S. pombe
aagctcgcctttctttaactgttca

SEQ ID NO: 77542 - DNA, 25 bp, S. pombe
aagctggttcttgttttggtatgtc

SEQ ID NO: 77543 - DNA, 25 bp, S. pombe
aagccggtcaatctttttctcacat

SEQ ID NO: 77544 - DNA, 25 bp, S. pombe
aagccggccaatgtcttctaattac

SEQ ID NO: 77545 - DNA, 25 bp, S. pombe
aagccgacctgtgatgcatccaaat

SEQ ID NO: 77546 - DNA, 25 bp, S. pombe
aagcgcgcgactacatccagagaac

SEQ ID NO: 77547 - DNA, 25 bp, S. pombe
aagctggttctacacgattcgctag

SEQ ID NO: 77548 - DNA, 25 bp, S. pombe
aagctgttggcgaaaccactgaaaa

SEQ ID NO: 77549 - DNA, 25 bp, S. pombe
aagcttttggaacctccatcacaga

SEQ ID NO: 77550 - DNA, 25 bp, S. pombe
aagcctcttggcactatgacagaag

SEQ ID NO: 77551 - DNA, 25 bp, S. pombe
aagcgccttggcagtgatcctaata

SEQ ID NO: 77552 - DNA, 25 bp, S. pombe
aagcgctgccccttacgaagtggag

SEQ ID NO: 77553 - DNA, 25 bp, S. pombe
aagccatatcttcgagtttcctgtt

SEQ ID NO: 77554 - DNA, 25 bp, S. pombe
aagcgaatctttgtttcatcatgtt

SEQ ID NO: 77555 - DNA, 25 bp, S. pombe
aagcctaatttactacgccatgatg

SEQ ID NO: 77556 - DNA, 25 bp, S. pombe
aagccctttgaagaaccaattgctg

SEQ ID NO: 77557 - DNA, 25 bp, S. pombe
aagtttttgacagaggccgttgcag

SEQ ID NO: 77558 - DNA, 25 bp, S. pombe
aagctttcttaactatgtcccgtca

SEQ ID NO: 77559 - DNA, 25 bp, S. pombe
aagtgttcgaagaggtgcccctaat

SEQ ID NO: 77560 - DNA, 25 bp, S. pombe
aagctgttaatttgggcggtgaaga

SEQ ID NO: 77561 - DNA, 25 bp, S. pombe
aagccttggaattgccctcatggaa

SEQ ID NO: 77562 - DNA, 25 bp, S. pombe
aagccttcagctttacgtttacaca

SEQ ID NO: 77563 - DNA, 25 bp, S. pombe
aagccgaagctttgcgcctttaata

SEQ ID NO: 77564 - DNA, 25 bp, S. pombe
aagccgcaagctgtggtctttatgt

SEQ ID NO: 77565 - DNA, 25 bp, S. pombe
aagctgcgcaggttattgtgtaatc

SEQ ID NO: 77566 - DNA, 25 bp, S. pombe
aagccctgtgttattgatatattta

SEQ ID NO: 77567 - DNA, 25 bp, S. pombe
aagcccggtatgattgtcaccttcg

SEQ ID NO: 77568 - DNA, 25 bp, S. pombe
aagcggcagcgtactgtttaccgaa

SEQ ID NO: 77569 - DNA, 25 bp, S. pombe
aagcgctggcttatattttcccaaa

SEQ ID NO: 77570 - DNA, 25 bp, S. pombe
aagcctggtttgttgtctatggcca

SEQ ID NO: 77571 - DNA, 25 bp, S. pombe
aagcgttttgatgcccaaaccggtg

SEQ ID NO: 77572 - DNA, 25 bp, S. pombe
aagcgaatttatgtcccagtccgtg

SEQ ID NO: 77573 - DNA, 25 bp, S. pombe
aagcgaaatttttgcaacaccggat

SEQ ID NO: 77574 - DNA, 25 bp, S. pombe
aagcctagtgatattccagagtctg

SEQ ID NO: 77575 - DNA, 25 bp, S. pombe
aagccattgatttagctgccaaact

SEQ ID NO: 77576 - DNA, 25 bp, S. pombe
aagctttgatggcaactggttctcc

SEQ ID NO: 77577 - DNA, 25 bp, S. pombe
aagctttgctggcagttttaccacc

SEQ ID NO: 77578 - DNA, 25 bp, S. pombe
aagcttctttggcagtactttctga

SEQ ID NO: 77579 - DNA, 25 bp, S. pombe
aagcgtcgtaaatttcctacttctg

SEQ ID NO: 77580 - DNA, 25 bp, S. pombe
aagcgagcgaagacgtccttcccga

SEQ ID NO: 77581 - DNA, 25 bp, S. pombe
aagcgacgaaggataaggccactac

SEQ ID NO: 77582 - DNA, 25 bp, S. pombe
aagccaaacttggacgtgctgtcta

SEQ ID NO: 77583 - DNA, 25 bp, S. pombe
aagccatgaccttcaacttggatgc

SEQ ID NO: 77584 - DNA, 25 bp, S. pombe
aagctctctgaggaacttgatcatt

SEQ ID NO: 77585 - DNA, 25 bp, S. pombe
aagcctgtgtcttacttcaattcaa

SEQ ID NO: 77586 - DNA, 25 bp, S. pombe
aagccgatgtctattccaagtcaac

SEQ ID NO: 77587 - DNA, 25 bp, S. pombe
aagcctttgatgaagctatctccga

SEQ ID NO: 77588 - DNA, 25 bp, S. pombe
aagcgcatttccaatggttctccaa

SEQ ID NO: 77589 - DNA, 25 bp, S. pombe
aagccattgtaaatgctcttcgcaa

SEQ ID NO: 77590 - DNA, 25 bp, S. pombe
aagctgatgttacttttgtcgcaag

SEQ ID NO: 77591 - DNA, 25 bp, S. pombe
aagctctgtcaggtgttattcccat

SEQ ID NO: 77592 - DNA, 25 bp, S. pombe
aagcatgtatttgtctaaacccgaa

SEQ ID NO: 77593 - DNA, 25 bp, S. pombe
aagcagtctttactcaacacccaaa

SEQ ID NO: 77594 - DNA, 25 bp, S. pombe
aagctgctaatcactgatgatccat

SEQ ID NO: 77595 - DNA, 25 bp, S. pombe
aagcacgatcacatcgttcagccga

SEQ ID NO: 77596 - DNA, 25 bp, S. pombe
aagccatcggtgttgtacctcagga

SEQ ID NO: 77597 - DNA, 25 bp, S. pombe
aagccatcgcattaatttcccgaga

SEQ ID NO: 77598 - DNA, 25 bp, S. pombe
aagcggcagctctattgatgtttca

SEQ ID NO: 77599 - DNA, 25 bp, S. pombe
aagcgcagatgcctcttgaacttaa

SEQ ID NO: 77600 - DNA, 25 bp, S. pombe
aagcggcagcaatagtttcagagtc

SEQ ID NO: 77601 - DNA, 25 bp, S. pombe
aagctggcgtaattgtcattcgtga

SEQ ID NO: 77602 - DNA, 25 bp, S. pombe
aagcggcatcgaactccattggtga

SEQ ID NO: 77603 - DNA, 25 bp, S. pombe
aagccgctttatcccttgagtgatg

SEQ ID NO: 77604 - DNA, 25 bp, S. pombe
aagctgcagcttgattgtccgggtg

SEQ ID NO: 77605 - DNA, 25 bp, S. pombe
aagcgaatcttgtgctgaacgtatt

SEQ ID NO: 77606 - DNA, 25 bp, S. pombe
aagcgtctcagttccaaagatcgtt

SEQ ID NO: 77607 - DNA, 25 bp, S. pombe
aagcctggctggctccagtaattaa

SEQ ID NO: 77608 - DNA, 25 bp, S. pombe
aagcgcaacttgctcgtctcagtta

SEQ ID NO: 77609 - DNA, 25 bp, S. pombe
aagctatgactgttcctggtatgat

SEQ ID NO: 77610 - DNA, 25 bp, S. pombe
aagctagctttatcgggcatgcatc

SEQ ID NO: 77611 - DNA, 25 bp, S. pombe
aagcctgtgtgttcgcaccagcgaa

SEQ ID NO: 77612 - DNA, 25 bp, S. pombe
aagccattggtctcagcctgtatga

SEQ ID NO: 77613 - DNA, 25 bp, S. pombe
aagctttcacggaagctgcacgcgt

SEQ ID NO: 77614 - DNA, 25 bp, S. pombe
aagcttcctggaacgcaatcgacaa

SEQ ID NO: 77615 - DNA, 25 bp, S. pombe
aagatttggaggcagcgacgaaaac

SEQ ID NO: 77616 - DNA, 25 bp, S. pombe
aagcactctggcgtggatgcgacaa

SEQ ID NO: 77617 - DNA, 25 bp, S. pombe
aagcccgtattggtctacctgatga

SEQ ID NO: 77618 - DNA, 25 bp, S. pombe
aagcctgctgatttggcttcccaaa

SEQ ID NO: 77619 - DNA, 25 bp, S. pombe
aagcgtctgcaacgtgtcgctaaaa

SEQ ID NO: 77620 - DNA, 25 bp, S. pombe
aagcgtgccaatgctgggttaacat

SEQ ID NO: 77621 - DNA, 25 bp, S. pombe
caaacgcctttagcttcagtgggaa

SEQ ID NO: 77622 - DNA, 25 bp, S. pombe
aagcctttgcttcaacttgggactt

SEQ ID NO: 77623 - DNA, 25 bp, S. pombe
aagcgcattctcgtattatttggga

SEQ ID NO: 77624 - DNA, 25 bp, S. pombe
aagcgtcgccgaaaatggatgtctt

SEQ ID NO: 77625 - DNA, 25 bp, S. pombe
aagcgcctgccgaagttggtgccat

SEQ ID NO: 77626 - DNA, 25 bp, S. pombe
aagcctttggattgtggtgtccatc

SEQ ID NO: 77627 - DNA, 25 bp, S. pombe
aagcgcacctattttactcttgtct

SEQ ID NO: 77628 - DNA, 25 bp, S. pombe
aagctgctcctcttgccgaaagtaa

SEQ ID NO: 77629 - DNA, 25 bp, S. pombe
aagcgtccattcgagcaagcaattc

SEQ ID NO: 77630 - DNA, 25 bp, S. pombe
aagcagacttacagcatccacattg

SEQ ID NO: 77631 - DNA, 25 bp, S. pombe
aagtcgtttacgtgagccagtgcaa

SEQ ID NO: 77632 - DNA, 25 bp, S. pombe
aagctcgtagtgatgttgaccgtaa

SEQ ID NO: 77633 - DNA, 25 bp, S. pombe
aagccgtctgctttggaatcctcta

SEQ ID NO: 77634 - DNA, 25 bp, S. pombe
aagcggttgtattatcattccctaa

SEQ ID NO: 77635 - DNA, 25 bp, S. pombe
aagccgctatgttgggcattccagt

SEQ ID NO: 77636 - DNA, 25 bp, S. pombe
aagccctcattaagcgacatccagt

SEQ ID NO: 77637 - DNA, 25 bp, S. pombe
aagcctgacattatggagcctgtat

SEQ ID NO: 77638 - DNA, 25 bp, S. pombe
aagctatgggatcgcttacaaccaa

SEQ ID NO: 77639 - DNA, 25 bp, S. pombe
aagcttggtctgctaagcatcctta

SEQ ID NO: 77640 - DNA, 25 bp, S. pombe
aagcttctgtgcctcatcaagactt

SEQ ID NO: 77641 - DNA, 25 bp, S. pombe
aagctcatcagcgttatatcactcg

SEQ ID NO: 77642 - DNA, 25 bp, S. pombe
aagcttgcggtgaagaactgcgaca

SEQ ID NO: 77643 - DNA, 25 bp, S. pombe
aagctcttgttcactcctacaaagt

SEQ ID NO: 77644 - DNA, 25 bp, S. pombe
aagccgctgtttacttctcaaaggt

SEQ ID NO: 77645 - DNA, 25 bp, S. pombe
aagcgtttctatccaaccagactgg

SEQ ID NO: 77646 - DNA, 25 bp, S. pombe
aagcgatgcttcacaacacgagtca

SEQ ID NO: 77647 - DNA, 25 bp, S. pombe
aagctcccacttatcattgtttata

SEQ ID NO: 77648 - DNA, 25 bp, S. pombe
aagctttctttcaatatcggcctcc

SEQ ID NO: 77649 - DNA, 25 bp, S. pombe
aagcttccgtacatatggtcactat

SEQ ID NO: 77650 - DNA, 25 bp, S. pombe
aagcttccggatcttagttatcttg

SEQ ID NO: 77651 - DNA, 25 bp, S. pombe
aagcgtcatcccaagtttttgtctt

SEQ ID NO: 77652 - DNA, 25 bp, S. pombe
aagcgtcagcaacttttttctgtac

SEQ ID NO: 77653 - DNA, 25 bp, S. pombe
aagcttcgtgctttggttgatgcct

SEQ ID NO: 77654 - DNA, 25 bp, S. pombe
aagcgcgagtgtttgattcttcctc

SEQ ID NO: 77655 - DNA, 25 bp, S. pombe
aagcccgtgatgttactactactgc

SEQ ID NO: 77656 - DNA, 25 bp, S. pombe
aagactgcgttgtttcaacttccct

SEQ ID NO: 77657 - DNA, 25 bp, S. pombe
aagcacatggtttctttacgcggtc

SEQ ID NO: 77658 - DNA, 25 bp, S. pombe
aagcgtcttgccaagcgcaagtcta

SEQ ID NO: 77659 - DNA, 25 bp, S. pombe
aagctgaagcttgatgccgcaactg

SEQ ID NO: 77660 - DNA, 25 bp, S. pombe
aagatcaaatttacaccccgcataa

SEQ ID NO: 77661 - DNA, 25 bp, S. pombe
ggagtaagggcatcccgccgagttt

SEQ ID NO: 77662 - DNA, 25 bp, S. pombe
aatgtaattgcctcgcctgaagggt

SEQ ID NO: 77663 - DNA, 25 bp, S. pombe
aagcttttagtatcctatgcccgga

SEQ ID NO: 77664 - DNA, 25 bp, S. pombe
aagctggcgcagaggacatagtcaa

SEQ ID NO: 77665 - DNA, 25 bp, S. pombe
aagcgatggctggtttggttatata

SEQ ID NO: 77666 - DNA, 25 bp, S. pombe
aagcgattgctgttgatgccttaaa

SEQ ID NO: 77667 - DNA, 25 bp, S. pombe
aagcgactgattacaggccttcgga

SEQ ID NO: 77668 - DNA, 25 bp, S. pombe
aagaagcggaagatccctttagcgg

SEQ ID NO: 77669 - DNA, 25 bp, S. pombe
aagccgctggtaatatctatgttca

SEQ ID NO: 77670 - DNA, 25 bp, S. pombe
aagcgcgtcctgatattactcatca

SEQ ID NO: 77671 - DNA, 25 bp, S. pombe
aagcgctttgcgatttacctgagtg

SEQ ID NO: 77672 - DNA, 25 bp, S. pombe
aagctgctttatctttacgtgttga

SEQ ID NO: 77673 - DNA, 25 bp, S. pombe
aagcgtatgtatcctttaccttgcg

SEQ ID NO: 77674 - DNA, 25 bp, S. pombe
aagcccatgtatcatgttcaacctc

SEQ ID NO: 77675 - DNA, 25 bp, S. pombe
aagctgcaaagtacagtcgcccatg

SEQ ID NO: 77676 - DNA, 25 bp, S. pombe
aagcaacagtgttgttcccgttttg

SEQ ID NO: 77677 - DNA, 25 bp, S. pombe
aagcccaaagtgaagccctctagtg

SEQ ID NO: 77678 - DNA, 25 bp, S. pombe
aagcccacaaggttcaaagcatagt

SEQ ID NO: 77679 - DNA, 25 bp, S. pombe
aagcttaaaagcatccctctcttgt

SEQ ID NO: 77680 - DNA, 25 bp, S. pombe
aagctagctcttcaatgttccgaaa

SEQ ID NO: 77681 - DNA, 25 bp, S. pombe
aagctacatctacgagcatgggtct

SEQ ID NO: 77682 - DNA, 25 bp, S. pombe
aagcgtatcataccagcggttgcgt

SEQ ID NO: 77683 - DNA, 25 bp, S. pombe
aagcggactctgaccgtgttcaaaa

SEQ ID NO: 77684 - DNA, 25 bp, S. pombe
aagtcgactagaacaggtgaaagca

SEQ ID NO: 77685 - DNA, 25 bp, S. pombe
aagaataccacgtctctgtcagttc

SEQ ID NO: 77686 - DNA, 25 bp, S. pombe
aagtcaactccgaaaatctccttct

SEQ ID NO: 77687 - DNA, 25 bp, S. pombe
aagcattttatggtggacctcctat

SEQ ID NO: 77688 - DNA, 25 bp, S. pombe
aagcgtttcctatgcatcctttgat

SEQ ID NO: 77689 - DNA, 25 bp, S. pombe
aagcgaggtcctactgatgtctttg

SEQ ID NO: 77690 - DNA, 25 bp, S. pombe
aagctcggtccccatatggaacatg

SEQ ID NO: 77691 - DNA, 25 bp, S. pombe
aagctggttgatccggtttccctag

SEQ ID NO: 77692 - DNA, 25 bp, S. pombe
aagcttgtatgtccgtctttacgaa

SEQ ID NO: 77693 - DNA, 25 bp, S. pombe
aagctttacagcgttgaacccgtca

SEQ ID NO: 77694 - DNA, 25 bp, S. pombe
aagaatctcagttctcggacctgac

SEQ ID NO: 77695 - DNA, 25 bp, S. pombe
aagaattattagcatggatcaagac

SEQ ID NO: 77696 - DNA, 25 bp, S. pombe
aagcgcttatatcgatttgcaacaa

SEQ ID NO: 77697 - DNA, 25 bp, S. pombe
aagcgcttcttcgttggcaagcaac

SEQ ID NO: 77698 - DNA, 25 bp, S. pombe
aagctgcttctcattctggcaaggg

SEQ ID NO: 77699 - DNA, 25 bp, S. pombe
aagctctcttggtttagcagccgga

SEQ ID NO: 77700 - DNA, 25 bp, S. pombe
aagcgcatcattttctttgatctct

SEQ ID NO: 77701 - DNA, 25 bp, S. pombe
aagctgctactattgcttcggcttg

SEQ ID NO: 77702 - DNA, 25 bp, S. pombe
aagcggtgacccatctatgattgat

SEQ ID NO: 77703 - DNA, 25 bp, S. pombe
aagcgatgagcaggcctatctaatt

SEQ ID NO: 77704 - DNA, 25 bp, S. pombe
aagcgtaagcaactcataagcatta

SEQ ID NO: 77705 - DNA, 25 bp, S. pombe
aagcgttagcgtcgagactgctgaa

SEQ ID NO: 77706 - DNA, 25 bp, S. pombe
aagcgtttgcgtcgtatcgttgaaa

SEQ ID NO: 77707 - DNA, 25 bp, S. pombe
aagcgttgtcgttgtcactttcaaa

SEQ ID NO: 77708 - DNA, 25 bp, S. pombe
aagcgtgttatttgcccatttctaa

SEQ ID NO: 77709 - DNA, 25 bp, S. pombe
aagcgtgtgtattgaccgttgtgta

SEQ ID NO: 77710 - DNA, 25 bp, S. pombe
aagctggtcgtaaccgtgctggtca

SEQ ID NO: 77711 - DNA, 25 bp, S. pombe
aagctttagctcgagtttggcgtga

SEQ ID NO: 77712 - DNA, 25 bp, S. pombe
aagcttagaaaaccttgaggatgat

SEQ ID NO: 77713 - DNA, 25 bp, S. pombe
aagcatgatataccacttccaccag

SEQ ID NO: 77714 - DNA, 25 bp, S. pombe
aagctgttgaagacttgcgctccaa

SEQ ID NO: 77715 - DNA, 25 bp, S. pombe
aagctcttgaaactgctgctggcac

SEQ ID NO: 77716 - DNA, 25 bp, S. pombe
aagctaatgtttctcgcgccaaggc

SEQ ID NO: 77717 - DNA, 25 bp, S. pombe
aagctacagttgcatcttctacctt

SEQ ID NO: 77718 - DNA, 25 bp, S. pombe
aagctggacgctggcaccgatgaac

SEQ ID NO: 77719 - DNA, 25 bp, S. pombe
aagcgtgagcttgccactggtgtcc

SEQ ID NO: 77720 - DNA, 25 bp, S. pombe
aagcttagctatcttgatgcccgtt

SEQ ID NO: 77721 - DNA, 25 bp, S. pombe
aagcttgcagttttgcaggcccagt

SEQ ID NO: 77722 - DNA, 25 bp, S. pombe
aagcgtgacatctatgcttccgatg

SEQ ID NO: 77723 - DNA, 25 bp, S. pombe
aagcgtgctcgcaagcttgccaaga

SEQ ID NO: 77724 - DNA, 25 bp, S. pombe
aagctcttcagcagtttcacgacct

SEQ ID NO: 77725 - DNA, 25 bp, S. pombe
aagctctctgagaagtttcgacaac

SEQ ID NO: 77726 - DNA, 25 bp, S. pombe
aagctcctgagcttggttcgccaat

SEQ ID NO: 77727 - DNA, 25 bp, S. pombe
aagctgactatgttggctgctcgcc

SEQ ID NO: 77728 - DNA, 25 bp, S. pombe
aagcgtgctcattctgttgtgcgga

SEQ ID NO: 77729 - DNA, 25 bp, S. pombe
aagcgatcagcttcttgttgagcga

SEQ ID NO: 77730 - DNA, 25 bp, S. pombe
aagcagacgttcttgcattgggcaa

SEQ ID NO: 77731 - DNA, 25 bp, S. pombe
aagctgcctgttacgttggctgaca

SEQ ID NO: 77732 - DNA, 25 bp, S. pombe
aagctgctcctggtcgtagtgtacg

SEQ ID NO: 77733 - DNA, 25 bp, S. pombe
aagctctctgctgtcgatatgtgcg

SEQ ID NO: 77734 - DNA, 25 bp, S. pombe
aagctactccagacaatccttttgg

SEQ ID NO: 77735 - DNA, 25 bp, S. pombe
aagctacgcgcattgaatcccttta

SEQ ID NO: 77736 - DNA, 25 bp, S. pombe
aagcgattctgctgaacccaatcaa

SEQ ID NO: 77737 - DNA, 25 bp, S. pombe
aagcgagaccgatacaccacacaat

SEQ ID NO: 77738 - DNA, 25 bp, S. pombe
aagctcaatgttgtccatgtctatg

SEQ ID NO: 77739 - DNA, 25 bp, S. pombe
aagctttcgcactaatttttgttag

SEQ ID NO: 77740 - DNA, 25 bp, S. pombe
aagcttttcgcagatgcctgtgtag

SEQ ID NO: 77741 - DNA, 25 bp, S. pombe
aagcttcaaacaaagcctctataga

SEQ ID NO: 77742 - DNA, 25 bp, S. pombe
aagcttccgaaaatgcctctgataa

SEQ ID NO: 77743 - DNA, 25 bp, S. pombe
aagcgtcatcagctatttccgttga

SEQ ID NO: 77744 - DNA, 25 bp, S. pombe
aagcgtgacgcacttattcaccgta

SEQ ID NO: 77745 - DNA, 25 bp, S. pombe
aagcgagacagccaacttgcccagt

SEQ ID NO: 77746 - DNA, 25 bp, S. pombe
aagcgtgcccgcaaattggccaaga

SEQ ID NO: 77747 - DNA, 25 bp, S. pombe
aagctcgtaggcttgctgatgccaa

SEQ ID NO: 77748 - DNA, 25 bp, S. pombe
aagctatcaacgctgctgagcagaa

SEQ ID NO: 77749 - DNA, 25 bp, S. pombe
aagctgtgcgctttactactacaaa

SEQ ID NO: 77750 - DNA, 25 bp, S. pombe
aagctcgtgtttttgatgccgaaaa

SEQ ID NO: 77751 - DNA, 25 bp, S. pombe
aagctcctcttttatgcgtggaaaa

SEQ ID NO: 77752 - DNA, 25 bp, S. pombe
aagcatctctgggtatcacgggaac

SEQ ID NO: 77753 - DNA, 25 bp, S. pombe
aagctcttggcataacagtcgcgtc

SEQ ID NO: 77754 - DNA, 25 bp, S. pombe
aagcgtggtacatcagtgcttccca

SEQ ID NO: 77755 - DNA, 25 bp, S. pombe
aagcgatttaccgattttgctccct

SEQ ID NO: 77756 - DNA, 25 bp, S. pombe
aagcttcataactctcgtaatcccg

SEQ ID NO: 77757 - DNA, 25 bp, S. pombe
aagcttgatgaattttccttgatca

SEQ ID NO: 77758 - DNA, 25 bp, S. pombe
aagctcgcatattaacccaattcct

SEQ ID NO: 77759 - DNA, 25 bp, S. pombe
aagctattcagcgacagcactcgac

SEQ ID NO: 77760 - DNA, 25 bp, S. pombe
aagcatggttctaatacgccctccg

SEQ ID NO: 77761 - DNA, 25 bp, S. pombe
aagcatgggagcttgcatattcccc

SEQ ID NO: 77762 - DNA, 25 bp, S. pombe
aagcggctacagatttttccctgac

SEQ ID NO: 77763 - DNA, 25 bp, S. pombe
aagcgatatcttggttgctgatcct

SEQ ID NO: 77764 - DNA, 25 bp, S. pombe
aagcaacaagttcaatccctccaag

SEQ ID NO: 77765 - DNA, 25 bp, S. pombe
aagcaaacaaattcgaccacccata

SEQ ID NO: 77766 - DNA, 25 bp, S. pombe
aagcaaattacttccatccacatcg

SEQ ID NO: 77767 - DNA, 25 bp, S. pombe
aagttggctagcaccatcgagagct

SEQ ID NO: 77768 - DNA, 25 bp, S. pombe
aagagttaccgacagggcttctaca

SEQ ID NO: 77769 - DNA, 25 bp, S. pombe
aaggttattcgtctggacatgttac

SEQ ID NO: 77770 - DNA, 25 bp, S. pombe
aagcgtcttctctatgttcgtcgtt

SEQ ID NO: 77771 - DNA, 25 bp, S. pombe
aagcgtcttctctatgttcgtcgtt

SEQ ID NO: 77772 - DNA, 25 bp, S. pombe
aagcttttggccattgcatcttgtt

SEQ ID NO: 77773 - DNA, 25 bp, S. pombe
aagctgttttccaaatccctgttga

SEQ ID NO: 77774 - DNA, 25 bp, S. pombe
aatgcacgcctacgtaaccttgttg

SEQ ID NO: 77775 - DNA, 25 bp, S. pombe
aagctagcgaattccgagccttcta

SEQ ID NO: 77776 - DNA, 25 bp, S. pombe
aagcaactggcctactatgaccgaa

SEQ ID NO: 77777 - DNA, 25 bp, S. pombe
aagacatcagtatattcaagcctaa

SEQ ID NO: 77778 - DNA, 25 bp, S. pombe
aagcatctaaagcattcggtgccaa

SEQ ID NO: 77779 - DNA, 25 bp, S. pombe
aagagcaaaatcgtcctggcagcaa

SEQ ID NO: 77780 - DNA, 25 bp, S. pombe
aagctatctgatggccattgggaac

SEQ ID NO: 77781 - DNA, 25 bp, S. pombe
aatccaatgaatctcgagaccccga

SEQ ID NO: 77782 - DNA, 25 bp, S. pombe
aatcgcaagggcgtcgttacccatg

SEQ ID NO: 77783 - DNA, 25 bp, S. pombe
aagagaagggctgcgctttccggat

SEQ ID NO: 77784 - DNA, 25 bp, S. pombe
aagcttttcaggactttcaaattct

SEQ ID NO: 77785 - DNA, 25 bp, S. pombe
aagcttttcagttctttgaccgtct

SEQ ID NO: 77786 - DNA, 25 bp, S. pombe
aagcttttgctgtgtatgtctggca

SEQ ID NO: 77787 - DNA, 25 bp, S. pombe
aagctatttcttatgcagtcttgca

SEQ ID NO: 77788 - DNA, 25 bp, S. pombe
aagcttgttcttcttggtgattccg

SEQ ID NO: 77789 - DNA, 25 bp, S. pombe
aagctggtctctgtattggtgatga

SEQ ID NO: 77790 - DNA, 25 bp, S. pombe
aagctttgtctacttctgacgagga

SEQ ID NO: 77791 - DNA, 25 bp, S. pombe
aagctttggcggtttattgatggca

SEQ ID NO: 77792 - DNA, 25 bp, S. pombe
aagcttcgtcgtttgttcatatcca

SEQ ID NO: 77793 - DNA, 25 bp, S. pombe
aagcggcggaatttattgataccat

SEQ ID NO: 77794 - DNA, 25 bp, S. pombe
aagcgtgcactcttctcataagcaa

SEQ ID NO: 77795 - DNA, 25 bp, S. pombe
aagctggtgcgcctgatcttaaaaa

SEQ ID NO: 77796 - DNA, 25 bp, S. pombe
aagctcgggacattcttatgacaga

SEQ ID NO: 77797 - DNA, 25 bp, S. pombe
aagcttggccaaacatcgatacagt

SEQ ID NO: 77798 - DNA, 25 bp, S. pombe
aagctgggccatatacgttcgagaa

SEQ ID NO: 77799 - DNA, 25 bp, S. pombe
aagctgcgtttaaatctgttcgaaa

SEQ ID NO: 77800 - DNA, 25 bp, S. pombe
aagctgctgcttccaaatcatcaac

SEQ ID NO: 77801 - DNA, 25 bp, S. pombe
aagctcatgcttccagtgttacagg

SEQ ID NO: 77802 - DNA, 25 bp, S. pombe
aagcatggtcttctatcgggtacta

SEQ ID NO: 77803 - DNA, 25 bp, S. pombe
aagcaggtgcttcgtatttttaatg

SEQ ID NO: 77804 - DNA, 25 bp, S. pombe
aagctggccttcctggacatgaatg

SEQ ID NO: 77805 - DNA, 25 bp, S. pombe
aagcttgactgtttctcttagcgag

SEQ ID NO: 77806 - DNA, 25 bp, S. pombe
aagcttgtattttctctgtatcgag

SEQ ID NO: 77807 - DNA, 25 bp, S. pombe
aagcatttgcttccattatggccaa

SEQ ID NO: 77808 - DNA, 25 bp, S. pombe
aagcattttatgtttcagcagccaa

SEQ ID NO: 77809 - DNA, 25 bp, S. pombe
aagctgttcgtgctcgtgttcaaga

SEQ ID NO: 77810 - DNA, 25 bp, S. pombe
aagcacaattggctcgtgactcaag

SEQ ID NO: 77811 - DNA, 25 bp, S. pombe
aagcagcaactacgtgggcttgcaa

SEQ ID NO: 77812 - DNA, 25 bp, S. pombe
aagcagttctacatcggctgaagat

SEQ ID NO: 77813 - DNA, 25 bp, S. pombe
aagctgctcgcgagttacgacgtca

SEQ ID NO: 77814 - DNA, 25 bp, S. pombe
aagctgcatttgttgcttcagctaa

SEQ ID NO: 77815 - DNA, 25 bp, S. pombe
aagctgcagtgtacttcttatgtta

SEQ ID NO: 77816 - DNA, 25 bp, S. pombe
aagctatggttttttgtgcctcatc

SEQ ID NO: 77817 - DNA, 25 bp, S. pombe
aagacggatcattccatggttccac

SEQ ID NO: 77818 - DNA, 25 bp, S. pombe
caggaggttttagcaaaggccgact

SEQ ID NO: 77819 - DNA, 25 bp, S. pombe
aaggcggcttttgccaaacttcgtg

SEQ ID NO: 77820 - DNA, 25 bp, S. pombe
aagcacgtttttggacaaccgctcg

SEQ ID NO: 77821 - DNA, 25 bp, S. pombe
aagcatcagctgtctattgtgtcaa

SEQ ID NO: 77822 - DNA, 25 bp, S. pombe
aagcttatcaagcatatcttccatt

SEQ ID NO: 77823 - DNA, 25 bp, S. pombe
aagctcttatgcctgatattctcca

SEQ ID NO: 77824 - DNA, 25 bp, S. pombe
aagcttggtcttgagtcatctgtca

SEQ ID NO: 77825 - DNA, 25 bp, S. pombe
aagcttgcagttttagttcgtgatc

SEQ ID NO: 77826 - DNA, 25 bp, S. pombe
aagcatgggcttcaagtcgcgatct

SEQ ID NO: 77827 - DNA, 25 bp, S. pombe
taagtagacttagagtccgaccgaa

SEQ ID NO: 77828 - DNA, 25 bp, S. pombe
aagctcaattgttcgtgtgtgtccc

SEQ ID NO: 77829 - DNA, 25 bp, S. pombe
aagcacatggattggcctcacgatg

SEQ ID NO: 77830 - DNA, 25 bp, S. pombe
aagctgagcaactgactcttctgta

SEQ ID NO: 77831 - DNA, 25 bp, S. pombe
aagctcagtacgttgctcttcttca

SEQ ID NO: 77832 - DNA, 25 bp, S. pombe
aagctaaacatctctcttttcaaag

SEQ ID NO: 77833 - DNA, 25 bp, S. pombe
aagacgagcgtgactgggtactcaa

SEQ ID NO: 77834 - DNA, 25 bp, S. pombe
aagcatattcagttagttctatcca

SEQ ID NO: 77835 - DNA, 25 bp, S. pombe
aagctgctgttgacttgataattca

SEQ ID NO: 77836 - DNA, 25 bp, S. pombe
aagctcagcttccatttaattctcg

SEQ ID NO: 77837 - DNA, 25 bp, S. pombe
aagctgattctgattctggttctac

SEQ ID NO: 77838 - DNA, 25 bp, S. pombe
aagctttgcattttggtttctcact

SEQ ID NO: 77839 - DNA, 25 bp, S. pombe
aagcttgtcattctggatatcccca

SEQ ID NO: 77840 - DNA, 25 bp, S. pombe
aagctttatgctcagttgacttcta

SEQ ID NO: 77841 - DNA, 25 bp, S. pombe
aagaggccgatgtcaaggctaagga

SEQ ID NO: 77842 - DNA, 25 bp, S. pombe
aagcattcgccttcgggtcaggaga

SEQ ID NO: 77843 - DNA, 25 bp, S. pombe
aagctactgcctctgaatctttcaa

SEQ ID NO: 77844 - DNA, 25 bp, S. pombe
aagctagtcctgatggtcattctga

SEQ ID NO: 77845 - DNA, 25 bp, S. pombe
aagctagccgcaaagtctattctga

SEQ ID NO: 77846 - DNA, 25 bp, S. pombe
aagcttttgctcatcatctttccat

SEQ ID NO: 77847 - DNA, 25 bp, S. pombe
aagctgctttgggattctttcctga

SEQ ID NO: 77848 - DNA, 25 bp, S. pombe
aagaatacatgtcccctattaaaag

SEQ ID NO: 77849 - DNA, 25 bp, S. pombe
aagcaggaatggctctcgccgaata

SEQ ID NO: 77850 - DNA, 25 bp, S. pombe
aagcatcctcttgctagaccatgga

SEQ ID NO: 77851 - DNA, 25 bp, S. pombe
aagcatagccttccagtaactgata

SEQ ID NO: 77852 - DNA, 25 bp, S. pombe
aagctagccttcgagacagtcatga

SEQ ID NO: 77853 - DNA, 25 bp, S. pombe
aagctctactatcgcgagcatacag

SEQ ID NO: 77854 - DNA, 25 bp, S. pombe
aagctcagccagttagcaagccgaa

SEQ ID NO: 77855 - DNA, 25 bp, S. pombe
aagctgctgtctacacaagtcgaat

SEQ ID NO: 77856 - DNA, 25 bp, S. pombe
aagcatctgtcccacaactatggat

SEQ ID NO: 77857 - DNA, 25 bp, S. pombe
aagcacttgatgttccaactgatag

SEQ ID NO: 77858 - DNA, 25 bp, S. pombe
aagcatttggttgacagtgatacgt

SEQ ID NO: 77859 - DNA, 25 bp, S. pombe
aagcattctggtagtggaggccact

SEQ ID NO: 77860 - DNA, 25 bp, S. pombe
aagcatattgtgattatgaggccag

SEQ ID NO: 77861 - DNA, 25 bp, S. pombe
aagcatattgtgattatgaggccag

SEQ ID NO: 77862 - DNA, 25 bp, S. pombe
aagcatatcaggaggcatacgccaa

SEQ ID NO: 77863 - DNA, 25 bp, S. pombe
aagctgctcagtatcgttcttcgat

SEQ ID NO: 77864 - DNA, 25 bp, S. pombe
aagcatctaaattccttctgtcaga

SEQ ID NO: 77865 - DNA, 25 bp, S. pombe
aagctaatgactgcctatcacgaag

SEQ ID NO: 77866 - DNA, 25 bp, S. pombe
aatggacccgtagtactaatcgtgt

SEQ ID NO: 77867 - DNA, 25 bp, S. pombe
aagactcccattttaccagaggttg

SEQ ID NO: 77868 - DNA, 25 bp, S. pombe
aagagtacctggaacgccaaggccg

SEQ ID NO: 77869 - DNA, 25 bp, S. pombe
aagcattccgtgattattcaaccaa

SEQ ID NO: 77870 - DNA, 25 bp, S. pombe
aagcaggtcggcattcatggaacta

SEQ ID NO: 77871 - DNA, 25 bp, S. pombe
aagcttgttgctgagactgttgatc

SEQ ID NO: 77872 - DNA, 25 bp, S. pombe
aagcagcatcaaatttcacccagtc

SEQ ID NO: 77873 - DNA, 25 bp, S. pombe
aagcatgtcaaacatcccatcatct

SEQ ID NO: 77874 - DNA, 25 bp, S. pombe
aagcattcactaccgttcatcattt

SEQ ID NO: 77875 - DNA, 25 bp, S. pombe
aagcagttcccgtgcacaggagtat

SEQ ID NO: 77876 - DNA, 25 bp, S. pombe
ctagggtaccatctgaagtcgctta

SEQ ID NO: 77877 - DNA, 25 bp, S. pombe
ctaagagtcgtctggtaggccctaa

SEQ ID NO: 77878 - DNA, 25 bp, S. pombe
ctcaaagtcggaggcgaaagcccct

SEQ ID NO: 77879 - DNA, 25 bp, S. pombe
aagcaactcttgtcttggcatcccc

SEQ ID NO: 77880 - DNA, 25 bp, S. pombe
aagcaatctacgtattggccggccc

SEQ ID NO: 77881 - DNA, 25 bp, S. pombe
aagcatatctgaaaactaccgcata

SEQ ID NO: 77882 - DNA, 25 bp, S. pombe
aagcatcaagtcgtttaccgtcttc

SEQ ID NO: 77883 - DNA, 25 bp, S. pombe
aagaccgtagcaggatccatcgact

SEQ ID NO: 77884 - DNA, 25 bp, S. pombe
aagactttcgactttcgtaggcact

SEQ ID NO: 77885 - DNA, 25 bp, S. pombe
aagcagatgattaccactttttcgg

SEQ ID NO: 77886 - DNA, 25 bp, S. pombe
aagaagtattcactccttttcgcgc

SEQ ID NO: 77887 - DNA, 25 bp, S. pombe
aagaagtctcttcccgatattgttg

SEQ ID NO: 77888 - DNA, 25 bp, S. pombe
aagaggtacttgagcgattctctaa

SEQ ID NO: 77889 - DNA, 25 bp, S. pombe
aagcaggaccttcagtgtctttgcc

SEQ ID NO: 77890 - DNA, 25 bp, S. pombe
aagcaataccttcctgagatgtccg

SEQ ID NO: 77891 - DNA, 25 bp, S. pombe
aagcaataccgcattcgagttcaat

SEQ ID NO: 77892 - DNA, 25 bp, S. pombe
aagcttaagcgtgtctcgtctcaat

SEQ ID NO: 77893 - DNA, 25 bp, S. pombe
aagcattccagggttcatcgtcttt

SEQ ID NO: 77894 - DNA, 25 bp, S. pombe
aagcttctaatcttgttcgctcttc

SEQ ID NO: 77895 - DNA, 25 bp, S. pombe
aagcttctgaagttgaccgtcgtga

SEQ ID NO: 77896 - DNA, 25 bp, S. pombe
aagcttgctggtttaccgcctgtag

SEQ ID NO: 77897 - DNA, 25 bp, S. pombe
aagtatcactgaagtaccctcgtcc

SEQ ID NO: 77898 - DNA, 25 bp, S. pombe
aagactcagtaccatgacttctgcc

SEQ ID NO: 77899 - DNA, 25 bp, S. pombe
aagaccgtaagtgctagctccaact

SEQ ID NO: 77900 - DNA, 25 bp, S. pombe
aagcaatcagttcaagccagtttaa

SEQ ID NO: 77901 - DNA, 25 bp, S. pombe
aagaaccttgtacgcatgctttgct

SEQ ID NO: 77902 - DNA, 25 bp, S. pombe
aagaacctacattgtcgagacacta

SEQ ID NO: 77903 - DNA, 25 bp, S. pombe
aagacacagggcaaggttccgcgct

SEQ ID NO: 77904 - DNA, 25 bp, S. pombe
aagtactacgcgagtcggacttgaa

SEQ ID NO: 77905 - DNA, 25 bp, S. pombe
aagcacaattcggtcgacacgactt

SEQ ID NO: 77906 - DNA, 25 bp, S. pombe
aagcacagaacgtgagccatacgag

SEQ ID NO: 77907 - DNA, 25 bp, S. pombe
aagcacggactgctactcagcaaag

SEQ ID NO: 77908 - DNA, 25 bp, S. pombe
aagaattgctttcgcttggaaggca

SEQ ID NO: 77909 - DNA, 25 bp, S. pombe
aagcaatcttggaggctcgtggccg

SEQ ID NO: 77910 - DNA, 25 bp, S. pombe
aagaacgtcgaatccatgatggcca

SEQ ID NO: 77911 - DNA, 25 bp, S. pombe
aagaattctactttggatagcccca

SEQ ID NO: 77912 - DNA, 25 bp, S. pombe
aagcaaaagcagaccgtgaacgaat

SEQ ID NO: 77913 - DNA, 25 bp, S. pombe
aagcagaatcgttattgcctattat

SEQ ID NO: 77914 - DNA, 25 bp, S. pombe
aagcaaacggttcgccaatttctgg

SEQ ID NO: 77915 - DNA, 25 bp, S. pombe
aatgataactttcgccgttacggag

SEQ ID NO: 77916 - DNA, 25 bp, S. pombe
cagcaaaaatcactcccttacttgg

SEQ ID NO: 77917 - DNA, 25 bp, S. pombe
aagaaagacagttccttacctccag

SEQ ID NO: 77918 - DNA, 25 bp, S. pombe
aagaaaccacttctactccctgaag

SEQ ID NO: 77919 - DNA, 25 bp, S. pombe
aagaagactcctcagtgggcatcgc

SEQ ID NO: 77920 - DNA, 25 bp, S. pombe
aagagaactcttgtggcggctggct

SEQ ID NO: 77921 - DNA, 25 bp, S. pombe
aagcatgtcacagatcagaggtaaa

SEQ ID NO: 77922 - DNA, 25 bp, S. pombe
aagagcagctcataaccgccgaaac

SEQ ID NO: 77923 - DNA, 25 bp, S. pombe
aagaagctgctacccatgagcctgg

SEQ ID NO: 77924 - DNA, 25 bp, S. pombe
aagaaatccttcaggcctggaactg

SEQ ID NO: 77925 - DNA, 25 bp, S. pombe
aagactttcccaaacctggtgacag

SEQ ID NO: 77926 - DNA, 25 bp, S. pombe
aagaggttccgcgtagttccgacag

SEQ ID NO: 77927 - DNA, 25 bp, S. pombe
aagaggttgtcttgggcttacttcg

SEQ ID NO: 77928 - DNA, 25 bp, S. pombe
aagaagcgtactttcaccactgttg

SEQ ID NO: 77929 - DNA, 25 bp, S. pombe
aagaaggttttgtcacgcctcgtat

SEQ ID NO: 77930 - DNA, 25 bp, S. pombe
aagaatggtattctgatccccgctc

SEQ ID NO: 77931 - DNA, 25 bp, S. pombe
aagaagtggcttctccaaccgctgt

SEQ ID NO: 77932 - DNA, 25 bp, S. pombe
aagaatctcgctccaacttacgaaa

SEQ ID NO: 77933 - DNA, 25 bp, S. pombe
aagaatatatctgccgtcccaatcg

SEQ ID NO: 77934 - DNA, 25 bp, S. pombe
aagcagcgtatctcctgtcaaagct

SEQ ID NO: 77935 - DNA, 25 bp, S. pombe
aagcatctttcaactttcgacatgt

SEQ ID NO: 77936 - DNA, 25 bp, S. pombe
aagcattttcatacttctctcaagt

SEQ ID NO: 77937 - DNA, 25 bp, S. pombe
aagcatttgctcttctttgaggcgt

SEQ ID NO: 77938 - DNA, 25 bp, S. pombe
aagcaattcgtactatctagcggat

SEQ ID NO: 77939 - DNA, 25 bp, S. pombe
aagacataccaaccattctacggac

SEQ ID NO: 77940 - DNA, 25 bp, S. pombe
aagaatttacctaagctcctcacag

SEQ ID NO: 77941 - DNA, 25 bp, S. pombe
aagaaaacgctctgtcattctccat

SEQ ID NO: 77942 - DNA, 25 bp, S. pombe
aagagaagcccaagcagcccaaggg

SEQ ID NO: 77943 - DNA, 25 bp, S. pombe
aagagaagcccaagcagcccaaggg

SEQ ID NO: 77944 - DNA, 25 bp, S. pombe
aatgaagaaactgccgccggttgga

SEQ ID NO: 77945 - DNA, 25 bp, S. pombe
aagagaacacccaccggaagatact

SEQ ID NO: 77946 - DNA, 25 bp, S. pombe
aagagtgacggacccgatgcttgca

SEQ ID NO: 77947 - DNA, 25 bp, S. pombe
aagcattgcacacgagtccgcgaat

SEQ ID NO: 77948 - DNA, 25 bp, S. pombe
aagcatatcgactttgctctttcct

SEQ ID NO: 77949 - DNA, 25 bp, S. pombe
aagcagatcgtctttacttccctag

SEQ ID NO: 77950 - DNA, 25 bp, S. pombe
aagcattgagtggtatccttcccta

SEQ ID NO: 77951 - DNA, 25 bp, S. pombe
aagcatgtgatcttgatccacggag

SEQ ID NO: 77952 - DNA, 25 bp, S. pombe
aagcactgccgattatcgctacgaa

SEQ ID NO: 77953 - DNA, 25 bp, S. pombe
caaacaactcgagaacgggtcgcaa

SEQ ID NO: 77954 - DNA, 25 bp, S. pombe
aagaacggcttcatcctggacggtt

SEQ ID NO: 77955 - DNA, 25 bp, S. pombe
aagaatccgttcatcgagcagcctg

SEQ ID NO: 77956 - DNA, 25 bp, S. pombe
aagcacctttatggctcatgcaacg

SEQ ID NO: 77957 - DNA, 25 bp, S. pombe
aagcagccatcgtagccatagcaaa

SEQ ID NO: 77958 - DNA, 25 bp, S. pombe
aagcaagctatctacacacgtgtac

SEQ ID NO: 77959 - DNA, 25 bp, S. pombe
aagaacctattgtctcggcagatga

SEQ ID NO: 77960 - DNA, 25 bp, S. pombe
aagaatcctaagcatcggcacgacc

SEQ ID NO: 77961 - DNA, 25 bp, S. pombe
aagagctcggcattaaacatacccc

SEQ ID NO: 77962 - DNA, 25 bp, S. pombe
aagagtcggattgtagctccgctcg

SEQ ID NO: 77963 - DNA, 25 bp, S. pombe
aagcaagtcggtgttggtcgtctct

SEQ ID NO: 77964 - DNA, 25 bp, S. pombe
aagcaagtccgttgactggtcaagt

SEQ ID NO: 77965 - DNA, 25 bp, S. pombe
aagcaagcccgaattgctggctaaa

SEQ ID NO: 77966 - DNA, 25 bp, S. pombe
aagcaatctcccgaagctgttgaaa

SEQ ID NO: 77967 - DNA, 25 bp, S. pombe
aagcagaggcaggtccttttctcgc

SEQ ID NO: 77968 - DNA, 25 bp, S. pombe
aagcatatattcctactgtactcag

SEQ ID NO: 77969 - DNA, 25 bp, S. pombe
aagcattgcgttatcgtgcagatca

SEQ ID NO: 77970 - DNA, 25 bp, S. pombe
aagcacggtgctagtcgtcatgagt

SEQ ID NO: 77971 - DNA, 25 bp, S. pombe
aagcaaggtgcaatcttacatgaaa

SEQ ID NO: 77972 - DNA, 25 bp, S. pombe
aagcacgttctctattctttgcccg

SEQ ID NO: 77973 - DNA, 25 bp, S. pombe
aagcatctttgttttattccctcgc

SEQ ID NO: 77974 - DNA, 25 bp, S. pombe
aagcaattacactctttcgaccttg

SEQ ID NO: 77975 - DNA, 25 bp, S. pombe
aagcatcttacagactcttcgttct

SEQ ID NO: 77976 - DNA, 25 bp, S. pombe
aagaactatggcgtaaccttccctg

SEQ ID NO: 77977 - DNA, 25 bp, S. pombe
aagcaaaagcgtgttgtcgtccctg

SEQ ID NO: 77978 - DNA, 25 bp, S. pombe
aagcaaaagcgtgtcgttgtccccg

SEQ ID NO: 77979 - DNA, 25 bp, S. pombe
aagcagaaagcgttgtcgttgtcac

SEQ ID NO: 77980 - DNA, 25 bp, S. pombe
aagcattgttcgttgcaccttgttc

SEQ ID NO: 77981 - DNA, 25 bp, S. pombe
caaaattatgattccaccgttcccg

SEQ ID NO: 77982 - DNA, 25 bp, S. pombe
aagaaggacgccattttcctcttgg

SEQ ID NO: 77983 - DNA, 25 bp, S. pombe
aagaagtaccccattgtctccattg

SEQ ID NO: 77984 - DNA, 25 bp, S. pombe
aatgaaggaacccactttctccatc

SEQ ID NO: 77985 - DNA, 25 bp, S. pombe
aagaaacgtctgagtccttgccctc

SEQ ID NO: 77986 - DNA, 25 bp, S. pombe
aagaaaccgatgagtctcttcgcct

SEQ ID NO: 77987 - DNA, 25 bp, S. pombe
aagaataatgactcgtcctcagcct

SEQ ID NO: 77988 - DNA, 25 bp, S. pombe
aagaatagtgcttggcgtctcaatt

SEQ ID NO: 77989 - DNA, 25 bp, S. pombe
aagaggagatcccatccaatgccag

SEQ ID NO: 77990 - DNA, 25 bp, S. pombe
aagcaaaatcccgacgcagtgtatt

SEQ ID NO: 77991 - DNA, 25 bp, S. pombe
aagagaattacctaccgctgttcgt

SEQ ID NO: 77992 - DNA, 25 bp, S. pombe
aagcaagcttgtccagccagggtgt

SEQ ID NO: 77993 - DNA, 25 bp, S. pombe
aagcaacttggccttgagcgtatta

SEQ ID NO: 77994 - DNA, 25 bp, S. pombe
aagcagctccttctatagcttctga

SEQ ID NO: 77995 - DNA, 25 bp, S. pombe
aagcactctctccttcagaatgtat

SEQ ID NO: 77996 - DNA, 25 bp, S. pombe
aagagcacgggcacaaggtccttct

SEQ ID NO: 77997 - DNA, 25 bp, S. pombe
aagacactgggtccatggaggccct

SEQ ID NO: 77998 - DNA, 25 bp, S. pombe
aagcaacatcggcaagcagaccttc

SEQ ID NO: 77999 - DNA, 25 bp, S. pombe
aagcacttatcccatatccttgatt

SEQ ID NO: 78000 - DNA, 25 bp, S. pombe
aagcacatcttttgccgagaacgca

SEQ ID NO: 78001 - DNA, 25 bp, S. pombe
aagcacatttcaatgaagcccaccc

SEQ ID NO: 78002 - DNA, 25 bp, S. pombe
aagaggttttccgtactgcactcga

SEQ ID NO: 78003 - DNA, 25 bp, S. pombe
aagaatctcttcctgctttcgaaaa

SEQ ID NO: 78004 - DNA, 25 bp, S. pombe
aagcaagctttgacatctacgggag

SEQ ID NO: 78005 - DNA, 25 bp, S. pombe
aagcactggtgggttaggactcgat

SEQ ID NO: 78006 - DNA, 25 bp, S. pombe
aagacttgtgccgaaagggccgcta

SEQ ID NO: 78007 - DNA, 25 bp, S. pombe
aagcacatttgttacaagggtccga

SEQ ID NO: 78008 - DNA, 25 bp, S. pombe
aagcactgcgtttacaatgccgtca

SEQ ID NO: 78009 - DNA, 25 bp, S. pombe
aagcagcctttatctatgtcagtta

SEQ ID NO: 78010 - DNA, 25 bp, S. pombe
aagcaggtgtcgtactctctttgta

SEQ ID NO: 78011 - DNA, 25 bp, S. pombe
aagcaactgctcgaactctttggga

SEQ ID NO: 78012 - DNA, 25 bp, S. pombe
aagcagacgatcacccatcattggg

SEQ ID NO: 78013 - DNA, 25 bp, S. pombe
aagaataccgtcgtcatcttggcgc

SEQ ID NO: 78014 - DNA, 25 bp, S. pombe
aagacctcacgaacgattactctga

SEQ ID NO: 78015 - DNA, 25 bp, S. pombe
aagcacgcagtcgacttcagtatga

SEQ ID NO: 78016 - DNA, 25 bp, S. pombe
aagcacgtcgtatgtatccttacag

SEQ ID NO: 78017 - DNA, 25 bp, S. pombe
aagaagcgggcttgttcctgagacg

SEQ ID NO: 78018 - DNA, 25 bp, S. pombe
tagtatggccggcttacctgagaag

SEQ ID NO: 78019 - DNA, 25 bp, S. pombe
aagcaggctctggtgtttacaaata

SEQ ID NO: 78020 - DNA, 25 bp, S. pombe
aagcactatttctcctattgttatc

SEQ ID NO: 78021 - DNA, 25 bp, S. pombe
aagttcacttgctctgttgttttcc

SEQ ID NO: 78022 - DNA, 25 bp, S. pombe
taaaacagtagctctttgggacctc

SEQ ID NO: 78023 - DNA, 25 bp, S. pombe
aagaacactagcactttatgaacgt

SEQ ID NO: 78024 - DNA, 25 bp, S. pombe
aagaccccaagcaggctgatacgat

SEQ ID NO: 78025 - DNA, 25 bp, S. pombe
aagcagtgggatcctcttcgaaatc

SEQ ID NO: 78026 - DNA, 25 bp, S. pombe
aagcagtcggacttttgccaactac

SEQ ID NO: 78027 - DNA, 25 bp, S. pombe
aagagatatcccaatgccgcttgta

SEQ ID NO: 78028 - DNA, 25 bp, S. pombe
aagagtttgttgctgaatttcgaca

SEQ ID NO: 78029 - DNA, 25 bp, S. pombe
aagacatctcaatttcccaaaccct

SEQ ID NO: 78030 - DNA, 25 bp, S. pombe
aagcacaccagtttctacagaacct

SEQ ID NO: 78031 - DNA, 25 bp, S. pombe
aagcacctgcggattttgaattttt

SEQ ID NO: 78032 - DNA, 25 bp, S. pombe
aagacttcgcagctttaccagttta

SEQ ID NO: 78033 - DNA, 25 bp, S. pombe
aagacaaattaccagctcgttgccg

SEQ ID NO: 78034 - DNA, 25 bp, S. pombe
aagaaaccatttctcaggtccgagt

SEQ ID NO: 78035 - DNA, 25 bp, S. pombe
aagaccacctttttcacgtgacgag

SEQ ID NO: 78036 - DNA, 25 bp, S. pombe
aagaccacatttcttctatagccct

SEQ ID NO: 78037 - DNA, 25 bp, S. pombe
aagacaatcgttattctctccttct

SEQ ID NO: 78038 - DNA, 25 bp, S. pombe
aagcacaacctcaagtcatcttttg

SEQ ID NO: 78039 - DNA, 25 bp, S. pombe
aagagaaactcattcctcgtgccgt

SEQ ID NO: 78040 - DNA, 25 bp, S. pombe
aagaaatcttatcacccaacatcct

SEQ ID NO: 78041 - DNA, 25 bp, S. pombe
aagaatttgttgagccaccttccaa

SEQ ID NO: 78042 - DNA, 25 bp, S. pombe
aagaattctttcaactgcagccagt

SEQ ID NO: 78043 - DNA, 25 bp, S. pombe
aagaacgctggccaggtctcaaaaa

SEQ ID NO: 78044 - DNA, 25 bp, S. pombe
aagaccgcggtcagtatgcaggaat

SEQ ID NO: 78045 - DNA, 25 bp, S. pombe
aagaccgtgtgtgggctttagcttc

SEQ ID NO: 78046 - DNA, 25 bp, S. pombe
aagcacggtctgctgtttttgcagt

SEQ ID NO: 78047 - DNA, 25 bp, S. pombe
aagaaggcttgtcgtttcagtcgcg

SEQ ID NO: 78048 - DNA, 25 bp, S. pombe
aagaaggttctcgtactagtctccg

SEQ ID NO: 78049 - DNA, 25 bp, S. pombe
aagcaagccttgacctatatactcc

SEQ ID NO: 78050 - DNA, 25 bp, S. pombe
aagaagactcttcgctaatcaatga

SEQ ID NO: 78051 - DNA, 25 bp, S. pombe
aagcaaccctgtcgtcgatttagga

SEQ ID NO: 78052 - DNA, 25 bp, S. pombe
aagagtccattgatgtcgttcgatg

SEQ ID NO: 78053 - DNA, 25 bp, S. pombe
aagagtacaagcatattgtgattat

SEQ ID NO: 78054 - DNA, 25 bp, S. pombe
aagaatctttcggtcgcttttctcg

SEQ ID NO: 78055 - DNA, 25 bp, S. pombe
aagaggtgcgttatccttttctcga

SEQ ID NO: 78056 - DNA, 25 bp, S. pombe
aagaagcttggtatccacgtcaccg

SEQ ID NO: 78057 - DNA, 25 bp, S. pombe
aagaagttggtttgccagggatgat

SEQ ID NO: 78058 - DNA, 25 bp, S. pombe
aagacagtttcagcacttatggact

SEQ ID NO: 78059 - DNA, 25 bp, S. pombe
aagagcatgtttcggtgcctcgcga

SEQ ID NO: 78060 - DNA, 25 bp, S. pombe
aagcaattcttggagatcgctcgca

SEQ ID NO: 78061 - DNA, 25 bp, S. pombe
aagacttgatgtgcagacgccaaat

SEQ ID NO: 78062 - DNA, 25 bp, S. pombe
aagaatgctgattcggaagccaatt

SEQ ID NO: 78063 - DNA, 25 bp, S. pombe
aagcaacatttcctttatgtacagt

SEQ ID NO: 78064 - DNA, 25 bp, S. pombe
aagactgttacatctttggatgttg

SEQ ID NO: 78065 - DNA, 25 bp, S. pombe
aagacctttcatatttggcgccttt

SEQ ID NO: 78066 - DNA, 25 bp, S. pombe
aagaactgtcatgactttccctctt

SEQ ID NO: 78067 - DNA, 25 bp, S. pombe
aagactcggtacttgttgggcgtag

SEQ ID NO: 78068 - DNA, 25 bp, S. pombe
aaggtcggtcccaatttgcacggtg

SEQ ID NO: 78069 - DNA, 25 bp, S. pombe
aagttaaaggctgctgctggccctt

SEQ ID NO: 78070 - DNA, 25 bp, S. pombe
aagaacgtgagaggcaacttcagga

SEQ ID NO: 78071 - DNA, 25 bp, S. pombe
aagagccctcgtacacttaacggtg

SEQ ID NO: 78072 - DNA, 25 bp, S. pombe
aagacaccgcacactgaattacaga

SEQ ID NO: 78073 - DNA, 25 bp, S. pombe
aagaagtctattccagctgaaacag

SEQ ID NO: 78074 - DNA, 25 bp, S. pombe
aagagtccactcttcacttggttct

SEQ ID NO: 78075 - DNA, 25 bp, S. pombe
aagagcccgcttacaaggagtatca

SEQ ID NO: 78076 - DNA, 25 bp, S. pombe
aagaatgactccacagcaagctgct

SEQ ID NO: 78077 - DNA, 25 bp, S. pombe
aagacatccatcctgagctatatta

SEQ ID NO: 78078 - DNA, 25 bp, S. pombe
aagaagcctgtatctccttactcat

SEQ ID NO: 78079 - DNA, 25 bp, S. pombe
aagaagcgttatgcgtctactccat

SEQ ID NO: 78080 - DNA, 25 bp, S. pombe
aagcaattaccacagagccagcaag

SEQ ID NO: 78081 - DNA, 25 bp, S. pombe
aagaattgcgtcgtcaacttccagt

SEQ ID NO: 78082 - DNA, 25 bp, S. pombe
aagaagtgcgccgtattttccaata

SEQ ID NO: 78083 - DNA, 25 bp, S. pombe
aagcaatatcagtactcctcttcca

SEQ ID NO: 78084 - DNA, 25 bp, S. pombe
aagaatgtcaatcctcttctacctc

SEQ ID NO: 78085 - DNA, 25 bp, S. pombe
aagaatgaggctttcttctcccgac

SEQ ID NO: 78086 - DNA, 25 bp, S. pombe
aagcaagtttgttacctctctctga

SEQ ID NO: 78087 - DNA, 25 bp, S. pombe
aagaagctttaaatgccgcctctca

SEQ ID NO: 78088 - DNA, 25 bp, S. pombe
aagagagttccatgactttgcgaaa

SEQ ID NO: 78089 - DNA, 25 bp, S. pombe
aagaatttccttcatctggcaataa

SEQ ID NO: 78090 - DNA, 25 bp, S. pombe
aagcaatttcctgttcttcagtgga

SEQ ID NO: 78091 - DNA, 25 bp, S. pombe
aagaatttgccttgcttttcactgc

SEQ ID NO: 78092 - DNA, 25 bp, S. pombe
aagaagcttgctggcgctatcagat

SEQ ID NO: 78093 - DNA, 25 bp, S. pombe
aagagggcttttgtgcatggttaca

SEQ ID NO: 78094 - DNA, 25 bp, S. pombe
aagaacttgccatgcgcggtgaaga

SEQ ID NO: 78095 - DNA, 25 bp, S. pombe
aagacacaatctcagtcgggccttt

SEQ ID NO: 78096 - DNA, 25 bp, S. pombe
aagaatcttgctcctgttgaccgta

SEQ ID NO: 78097 - DNA, 25 bp, S. pombe
aagaatcatgcgagcttctggccgt

SEQ ID NO: 78098 - DNA, 25 bp, S. pombe
aagaacactgaggttgctcccgtca

SEQ ID NO: 78099 - DNA, 25 bp, S. pombe
aagaaggatgatggtgctgctcccg

SEQ ID NO: 78100 - DNA, 25 bp, S. pombe
aagaaccagatcctgcttcagctgc

SEQ ID NO: 78101 - DNA, 25 bp, S. pombe
aagaatagtgctgcatctgctcctg

SEQ ID NO: 78102 - DNA, 25 bp, S. pombe
aagaacagtctgaggccatgctaag

SEQ ID NO: 78103 - DNA, 25 bp, S. pombe
aagaacaccctgacttgaagccaac

SEQ ID NO: 78104 - DNA, 25 bp, S. pombe
aagaactccgatggctctgaagctt

SEQ ID NO: 78105 - DNA, 25 bp, S. pombe
aagaatctgaaagcactcacccttc

SEQ ID NO: 78106 - DNA, 25 bp, S. pombe
aagagtctgacacaggccaggctct

SEQ ID NO: 78107 - DNA, 25 bp, S. pombe
aagaacatattttgtcacctgacgt

SEQ ID NO: 78108 - DNA, 25 bp, S. pombe
aagaagaagttcgaccctcgtgtct

SEQ ID NO: 78109 - DNA, 25 bp, S. pombe
aagaaagtttggacgcctctgccta

SEQ ID NO: 78110 - DNA, 25 bp, S. pombe
aagaaacttgctagcgcggtcggcc

SEQ ID NO: 78111 - DNA, 25 bp, S. pombe
aagaatcattgatacccgacgccac

SEQ ID NO: 78112 - DNA, 25 bp, S. pombe
aagaaattatcagccgtgctcacga

SEQ ID NO: 78113 - DNA, 25 bp, S. pombe
aagaaacaacgcctgctgaaccagc

SEQ ID NO: 78114 - DNA, 25 bp, S. pombe
aagaaacaactccttcgcacgaagt

SEQ ID NO: 78115 - DNA, 25 bp, S. pombe
aagacttcgtcctttcgacaaagct

SEQ ID NO: 78116 - DNA, 25 bp, S. pombe
aagagctttatatacccacggaatc

SEQ ID NO: 78117 - DNA, 25 bp, S. pombe
aagagcactggcttcctgagtacat

SEQ ID NO: 78118 - DNA, 25 bp, S. pombe
aagagacaacagacgcatttacatt

SEQ ID NO: 78119 - DNA, 25 bp, S. pombe
aagaaacagctgaccatttatcata

SEQ ID NO: 78120 - DNA, 25 bp, S. pombe
aagacctttgatccccatcagaagt

SEQ ID NO: 78121 - DNA, 25 bp, S. pombe
aagacaactctactgactttgcctc

SEQ ID NO: 78122 - DNA, 25 bp, S. pombe
aagaaacttactctcctgcaatgga

SEQ ID NO: 78123 - DNA, 25 bp, S. pombe
aagaatccttgattgaatctgccaa

SEQ ID NO: 78124 - DNA, 25 bp, S. pombe
aagaatgtcttgatatcgtccacaa

SEQ ID NO: 78125 - DNA, 25 bp, S. pombe
aagaagtccaccgatactgccgtta

SEQ ID NO: 78126 - DNA, 25 bp, S. pombe
aagaatgctgcccaaaacgctaaag

SEQ ID NO: 78127 - DNA, 25 bp, S. pombe
aagaaacttgtcacccttgcagaac

SEQ ID NO: 78128 - DNA, 25 bp, S. pombe
aagaagacctggatctcctcggcaa

SEQ ID NO: 78129 - DNA, 25 bp, S. pombe
aagaaacgccttttgtggagccagc

SEQ ID NO: 78130 - DNA, 25 bp, S. pombe
aagaaatccgatctctggctgcaaa

SEQ ID NO: 78131 - DNA, 25 bp, S. pombe
aagaagtccttcttcgtggatctca

SEQ ID NO: 78132 - DNA, 25 bp, S. pombe
aagaagcattctctcatcggtatcc

SEQ ID NO: 78133 - DNA, 25 bp, S. pombe
aagagctgttcccttctataatggc

SEQ ID NO: 78134 - DNA, 25 bp, S. pombe
aagacattcacttctactgtaaatc

SEQ ID NO: 78135 - DNA, 25 bp, S. pombe
aagactttcatccacgtatgcacat

SEQ ID NO: 78136 - DNA, 25 bp, S. pombe
aagacgttgcgattgctcataatgc

SEQ ID NO: 78137 - DNA, 25 bp, S. pombe
aagacagcgaagttccaacagattg

SEQ ID NO: 78138 - DNA, 25 bp, S. pombe
aagagccttctagtaatgccaataa

SEQ ID NO: 78139 - DNA, 25 bp, S. pombe
aagagcgccttagatgcttattacg

SEQ ID NO: 78140 - DNA, 25 bp, S. pombe
aagaggatcttactacttcaagaag

SEQ ID NO: 78141 - DNA, 25 bp, S. pombe
aagacatcccacctaatacgttggc

SEQ ID NO: 78142 - DNA, 25 bp, S. pombe
aagacctacactctagtcatgtcgc

SEQ ID NO: 78143 - DNA, 25 bp, S. pombe
aagactgcgtccaagattgcgttag

SEQ ID NO: 78144 - DNA, 25 bp, S. pombe
aagaccgtttcgtcatcagcggagg

SEQ ID NO: 78145 - DNA, 25 bp, S. pombe
aagatcgatcacaagccgaaggtgt

SEQ ID NO: 78146 - DNA, 25 bp, S. pombe
aagaagcatcactacatcgccggtg

SEQ ID NO: 78147 - DNA, 25 bp, S. pombe
aagatagcaatgctcctggtgctgc

SEQ ID NO: 78148 - DNA, 25 bp, S. pombe
aagaggctgcttctcctaagaaaaa

SEQ ID NO: 78149 - DNA, 25 bp, S. pombe
aagaacgcttctcctgttttagacg

SEQ ID NO: 78150 - DNA, 25 bp, S. pombe
aagaaatggtcgctttgcactcgca

SEQ ID NO: 78151 - DNA, 25 bp, S. pombe
aagacactgcttactccgttcattg

SEQ ID NO: 78152 - DNA, 25 bp, S. pombe
aagaagctcttctgctgactggtca

SEQ ID NO: 78153 - DNA, 25 bp, S. pombe
aagaagctctcgtgctagctctatc

SEQ ID NO: 78154 - DNA, 25 bp, S. pombe
aagaaccatcgctgattcttcgtgc

SEQ ID NO: 78155 - DNA, 25 bp, S. pombe
aagaacctgcagttgcatcttccga

SEQ ID NO: 78156 - DNA, 25 bp, S. pombe
aagaacagctatcgagctctcgtcg

SEQ ID NO: 78157 - DNA, 25 bp, S. pombe
aagaaatacttccattcaccacgcc

SEQ ID NO: 78158 - DNA, 25 bp, S. pombe
aagacaatacttcactagccgtcgc

SEQ ID NO: 78159 - DNA, 25 bp, S. pombe
aagacgttgcttgggtggccccagt

SEQ ID NO: 78160 - DNA, 25 bp, S. pombe
aagagcttcgagacggatggcccaa

SEQ ID NO: 78161 - DNA, 25 bp, S. pombe
aagagcgctcgtaagactgggccca

SEQ ID NO: 78162 - DNA, 25 bp, S. pombe
aagaggccgataaatctcgtgcaaa

SEQ ID NO: 78163 - DNA, 25 bp, S. pombe
aagagagcttctcgcgtagttatcg

SEQ ID NO: 78164 - DNA, 25 bp, S. pombe
aagatggttcatccgtacgcattac

SEQ ID NO: 78165 - DNA, 25 bp, S. pombe
aagatgttcccgctaagatttcctc

SEQ ID NO: 78166 - DNA, 25 bp, S. pombe
aagagttacgccctgtggtatttgt

SEQ ID NO: 78167 - DNA, 25 bp, S. pombe
cactgcttttcctcctaattttatt

SEQ ID NO: 78168 - DNA, 25 bp, S. pombe
aagttccccaatgttttcgctatcg

SEQ ID NO: 78169 - DNA, 25 bp, S. pombe
aagagagcattcaccgtatatttaa

SEQ ID NO: 78170 - DNA, 25 bp, S. pombe
aagtacattcgtcctgaagatgtta

SEQ ID NO: 78171 - DNA, 25 bp, S. pombe
aagacattagcaccttccgagcgat

SEQ ID NO: 78172 - DNA, 25 bp, S. pombe
aagacttcattttgcctgacgctga

SEQ ID NO: 78173 - DNA, 25 bp, S. pombe
aagacctttgtgtcctacactgatt

SEQ ID NO: 78174 - DNA, 25 bp, S. pombe
aagacgaatgtcttatcctcctgct

SEQ ID NO: 78175 - DNA, 25 bp, S. pombe
aagaaacagatcctgatgcctcctc

SEQ ID NO: 78176 - DNA, 25 bp, S. pombe
aagacattaaccatgccaccataag

SEQ ID NO: 78177 - DNA, 25 bp, S. pombe
aagagcttacccacttagctaagca

SEQ ID NO: 78178 - DNA, 25 bp, S. pombe
aagtcgttggagacactcttgttta

SEQ ID NO: 78179 - DNA, 25 bp, S. pombe
aagagctttcgccaacttgttttag

SEQ ID NO: 78180 - DNA, 25 bp, S. pombe
aagagtttccattccaacttcttcg

SEQ ID NO: 78181 - DNA, 25 bp, S. pombe
aagagtttacttgtttctcctcgtg

SEQ ID NO: 78182 - DNA, 25 bp, S. pombe
aagactttgatcatccctacttgga

SEQ ID NO: 78183 - DNA, 25 bp, S. pombe
aagaaatgcagttacctaccgctcc

SEQ ID NO: 78184 - DNA, 25 bp, S. pombe
aagaaagagatccaccttctccgtt

SEQ ID NO: 78185 - DNA, 25 bp, S. pombe
aagacggtgtcgacaactctcacgt

SEQ ID NO: 78186 - DNA, 25 bp, S. pombe
aagacacggatctactccttcagtg

SEQ ID NO: 78187 - DNA, 25 bp, S. pombe
aagaaactggctcagctcgctgaac

SEQ ID NO: 78188 - DNA, 25 bp, S. pombe
aagacttttgcttttcgttcatcag

SEQ ID NO: 78189 - DNA, 25 bp, S. pombe
aagagttccaatcaacacggctgcc

SEQ ID NO: 78190 - DNA, 25 bp, S. pombe
aagacattcctttaacattcctgcc

SEQ ID NO: 78191 - DNA, 25 bp, S. pombe
aagacaatgcctatcaagcgtccct

SEQ ID NO: 78192 - DNA, 25 bp, S. pombe
aagacaacatcgcatttccaacatc

SEQ ID NO: 78193 - DNA, 25 bp, S. pombe
aagactgcttctggcctgggtaaat

SEQ ID NO: 78194 - DNA, 25 bp, S. pombe
aagagcagccttccggagaggccat

SEQ ID NO: 78195 - DNA, 25 bp, S. pombe
aagactccttattgccaagctcggc

SEQ ID NO: 78196 - DNA, 25 bp, S. pombe
aagagcctcgtcttctcgaaactta

SEQ ID NO: 78197 - DNA, 25 bp, S. pombe
aagacgttgagcgtttgcagtctca

SEQ ID NO: 78198 - DNA, 25 bp, S. pombe
aagagctttccctttgcattgaaaa

SEQ ID NO: 78199 - DNA, 25 bp, S. pombe
aagggatcgggattcacgacagcaa

SEQ ID NO: 78200 - DNA, 25 bp, S. pombe
aagagtgctcttcaacacggccaat

SEQ ID NO: 78201 - DNA, 25 bp, S. pombe
aagagcctgctgagttgaaggcgaa

SEQ ID NO: 78202 - DNA, 25 bp, S. pombe
aagagctttggtagccatccgtgat

SEQ ID NO: 78203 - DNA, 25 bp, S. pombe
aagactcccaaaactgcatgctgtg

SEQ ID NO: 78204 - DNA, 25 bp, S. pombe
aagagtgccccagctttttgatcgc

SEQ ID NO: 78205 - DNA, 25 bp, S. pombe
aagagggtcctgtttcatttactgc

SEQ ID NO: 78206 - DNA, 25 bp, S. pombe
aagagctagctttggattatttaat

SEQ ID NO: 78207 - DNA, 25 bp, S. pombe
aagagtcgcttttgctacttattat

SEQ ID NO: 78208 - DNA, 25 bp, S. pombe
aagacatgtcctggatccacgatgt

SEQ ID NO: 78209 - DNA, 25 bp, S. pombe
aagagcttgcacaacattgacgaac

SEQ ID NO: 78210 - DNA, 25 bp, S. pombe
aagagtctgacctatctgatccaac

SEQ ID NO: 78211 - DNA, 25 bp, S. pombe
aagagactttatcgacgcaggtaac

SEQ ID NO: 78212 - DNA, 25 bp, S. pombe
aagactgctagcactgacgactcta

SEQ ID NO: 78213 - DNA, 25 bp, S. pombe
aagactctatgttgcctaatttgaa

SEQ ID NO: 78214 - DNA, 25 bp, S. pombe
aatgacagtaatgaatccctccctt

SEQ ID NO: 78215 - DNA, 25 bp, S. pombe
aagacgtgcaaggagctaccttcct

SEQ ID NO: 78216 - DNA, 25 bp, S. pombe
aagacgtctgcttcgtatgtcacat

SEQ ID NO: 78217 - DNA, 25 bp, S. pombe
aagagcattcttcccttgtacatgt

SEQ ID NO: 78218 - DNA, 25 bp, S. pombe
aagaccaatccgcagtgtacgaatt

SEQ ID NO: 78219 - DNA, 25 bp, S. pombe
aagacgaattcacacagctacccat

SEQ ID NO: 78220 - DNA, 25 bp, S. pombe
aagaccagcctttctcatactataa

SEQ ID NO: 78221 - DNA, 25 bp, S. pombe
aagacattcctggtttactcagcaa

SEQ ID NO: 78222 - DNA, 25 bp, S. pombe
aagacgccgccatggatcaagcaat

SEQ ID NO: 78223 - DNA, 25 bp, S. pombe
aagaggctactgctaggcgcttatt

SEQ ID NO: 78224 - DNA, 25 bp, S. pombe
aagaggtactgcatttgtggtttat

SEQ ID NO: 78225 - DNA, 25 bp, S. pombe
aagatgcgtactattaagcgtctgc

SEQ ID NO: 78226 - DNA, 25 bp, S. pombe
aagatgaatttgatggcggccttca

SEQ ID NO: 78227 - DNA, 25 bp, S. pombe
aagacgctcgttctcatctattaaa

SEQ ID NO: 78228 - DNA, 25 bp, S. pombe
aagactctgggtgcagcatctgcca

SEQ ID NO: 78229 - DNA, 25 bp, S. pombe
aagactttgattgccaccattactc

SEQ ID NO: 78230 - DNA, 25 bp, S. pombe
aagactttgtttcccactaatcgtg

SEQ ID NO: 78231 - DNA, 25 bp, S. pombe
aagagatgcttgtcctcatccaaat

SEQ ID NO: 78232 - DNA, 25 bp, S. pombe
aagagcatttggtcacgcatcaagt

SEQ ID NO: 78233 - DNA, 25 bp, S. pombe
aagagcttctgaggacgatcgacaa

SEQ ID NO: 78234 - DNA, 25 bp, S. pombe
aagagcttcaattccgttgtcagca

SEQ ID NO: 78235 - DNA, 25 bp, S. pombe
aagagtccagtaggcgttccatcag

SEQ ID NO: 78236 - DNA, 25 bp, S. pombe
aagactctggtgtaggttcttcaga

SEQ ID NO: 78237 - DNA, 25 bp, S. pombe
aagagccgttggatttgttagacat

SEQ ID NO: 78238 - DNA, 25 bp, S. pombe
aagacgctttagcttctgttacact

SEQ ID NO: 78239 - DNA, 25 bp, S. pombe
aagagtctgtcctgctcaattgtac

SEQ ID NO: 78240 - DNA, 25 bp, S. pombe
aagaggctgacgaagctccacggac

SEQ ID NO: 78241 - DNA, 25 bp, S. pombe
aagacgctggtttgcttcaacatca

SEQ ID NO: 78242 - DNA, 25 bp, S. pombe
aagagactggctttcttccattagc

SEQ ID NO: 78243 - DNA, 25 bp, S. pombe
aagagctcggttcctgctagcattg

SEQ ID NO: 78244 - DNA, 25 bp, S. pombe
aagactgtcgttctttgattgccga

SEQ ID NO: 78245 - DNA, 25 bp, S. pombe
aagactctctttcatttggctgttg

SEQ ID NO: 78246 - DNA, 25 bp, S. pombe
aagagttccttcgtcaagtctggtc

SEQ ID NO: 78247 - DNA, 25 bp, S. pombe
aagagtcccactaccaattctgtta

SEQ ID NO: 78248 - DNA, 25 bp, S. pombe
aagagcacctgcatcgtccgaagat

SEQ ID NO: 78249 - DNA, 25 bp, S. pombe
aagacgctttagctgctgttgagct

SEQ ID NO: 78250 - DNA, 25 bp, S. pombe
aagaccttgggaggcgctggattct

SEQ ID NO: 78251 - DNA, 25 bp, S. pombe
aagactcttcaacggatgctcactg

SEQ ID NO: 78252 - DNA, 25 bp, S. pombe
aatgttgggcgccagtaaccctctg

SEQ ID NO: 78253 - DNA, 25 bp, S. pombe
aagactgtcacttctttggacgttg

SEQ ID NO: 78254 - DNA, 25 bp, S. pombe
aagactgttcatttttgggctcctg

SEQ ID NO: 78255 - DNA, 25 bp, S. pombe
aagtattttaataatcgtcatctgc

SEQ ID NO: 78256 - DNA, 25 bp, S. pombe
tatggttttaaatccgtcaagtcgt

SEQ ID NO: 78257 - DNA, 25 bp, S. pombe
gaagtttgtaacaccttgaaggcgt

SEQ ID NO: 78258 - DNA, 25 bp, S. pombe
aagtctgaattacctccttgggagg

SEQ ID NO: 78259 - DNA, 25 bp, S. pombe
aagtttaacggcacgagcccatcag

SEQ ID NO: 78260 - DNA, 25 bp, S. pombe
aagatttattagatccggcccgctc

SEQ ID NO: 78261 - DNA, 25 bp, S. pombe
aagaggttccgtaaggcccgctgct

SEQ ID NO: 78262 - DNA, 25 bp, S. pombe
aagaggttcacgctgagatccgcaa

SEQ ID NO: 78263 - DNA, 25 bp, S. pombe
aagatccttcgtgacaatattcaag

SEQ ID NO: 78264 - DNA, 25 bp, S. pombe
aagaccctcgtcaacttgcagctat

SEQ ID NO: 78265 - DNA, 25 bp, S. pombe
aagacctcatacctcaaggcacgat

SEQ ID NO: 78266 - DNA, 25 bp, S. pombe
aagaccgtcatttcaactggcagca

SEQ ID NO: 78267 - DNA, 25 bp, S. pombe
aagaccctgctttcagagacgaggt

SEQ ID NO: 78268 - DNA, 25 bp, S. pombe
aagactggccatcactctgaaaggt

SEQ ID NO: 78269 - DNA, 25 bp, S. pombe
aagatgggcacaggctgcgaccgct

SEQ ID NO: 78270 - DNA, 25 bp, S. pombe
aagaggtgcagagtccgagtcgatc

SEQ ID NO: 78271 - DNA, 25 bp, S. pombe
aagagtcacattgtcgatcacgtcg

SEQ ID NO: 78272 - DNA, 25 bp, S. pombe
aagttcgttcagttggacgccttgt

SEQ ID NO: 78273 - DNA, 25 bp, S. pombe
aagttagtccatattccatccttct

SEQ ID NO: 78274 - DNA, 25 bp, S. pombe
aagttggttgtcgttgcgacttcgc

SEQ ID NO: 78275 - DNA, 25 bp, S. pombe
aagagttctagtgcttgccgctacc

SEQ ID NO: 78276 - DNA, 25 bp, S. pombe
aagatcacatttccacctcatttag

SEQ ID NO: 78277 - DNA, 25 bp, S. pombe
aagacccatggaacgctattattgc

SEQ ID NO: 78278 - DNA, 25 bp, S. pombe
aagacctcgtgctgcctttaagcag

SEQ ID NO: 78279 - DNA, 25 bp, S. pombe
aagacggctgccacgattgagcaaa

SEQ ID NO: 78280 - DNA, 25 bp, S. pombe
aagactggccgcattgagctggaac

SEQ ID NO: 78281 - DNA, 25 bp, S. pombe
aagagacacttcctgttcttaacgc

SEQ ID NO: 78282 - DNA, 25 bp, S. pombe
aagatgtcatttctctacattcccc

SEQ ID NO: 78283 - DNA, 25 bp, S. pombe
aagatatcccatcttctgctgaagc

SEQ ID NO: 78284 - DNA, 25 bp, S. pombe
aagagctcctcaattgttgcctttg

SEQ ID NO: 78285 - DNA, 25 bp, S. pombe
aagaccgtattttctgcctacatgg

SEQ ID NO: 78286 - DNA, 25 bp, S. pombe
aagagctttccttgattcgcagcta

SEQ ID NO: 78287 - DNA, 25 bp, S. pombe
aagagctgttgccaagatcgctgaa

SEQ ID NO: 78288 - DNA, 25 bp, S. pombe
aagagcagttggtatcacgatgata

SEQ ID NO: 78289 - DNA, 25 bp, S. pombe
aagagacttcgttgagcatgattga

SEQ ID NO: 78290 - DNA, 25 bp, S. pombe
aagagcactacgagtctgtcatgta

SEQ ID NO: 78291 - DNA, 25 bp, S. pombe
aagagggtgttcgttttagctgcaa

SEQ ID NO: 78292 - DNA, 25 bp, S. pombe
aagacggttgtgtcccttgaatcat

SEQ ID NO: 78293 - DNA, 25 bp, S. pombe
aagaccgagttagtggcattgcaac

SEQ ID NO: 78294 - DNA, 25 bp, S. pombe
aagaccaactgtacttgcatgtgca

SEQ ID NO: 78295 - DNA, 25 bp, S. pombe
aagacctgtctgcttatttcctata

SEQ ID NO: 78296 - DNA, 25 bp, S. pombe
aagacgctgctgacttgattgccga

SEQ ID NO: 78297 - DNA, 25 bp, S. pombe
aagaggctgctgagtttgctcaact

SEQ ID NO: 78298 - DNA, 25 bp, S. pombe
aagaccgtgattatctcgtggccaa

SEQ ID NO: 78299 - DNA, 25 bp, S. pombe
aagaccgctagtacttctgttcttc

SEQ ID NO: 78300 - DNA, 25 bp, S. pombe
aagaccagctacatcctttgttgtc

SEQ ID NO: 78301 - DNA, 25 bp, S. pombe
aagaccttgacaatcctgaagttga

SEQ ID NO: 78302 - DNA, 25 bp, S. pombe
aagtttgaacatgccgacagtgata

SEQ ID NO: 78303 - DNA, 25 bp, S. pombe
aagagcaatgccatctcaccagagc

SEQ ID NO: 78304 - DNA, 25 bp, S. pombe
aagagatggactcctgaccaggcga

SEQ ID NO: 78305 - DNA, 25 bp, S. pombe
aagagctatacctaacttccaatta

SEQ ID NO: 78306 - DNA, 25 bp, S. pombe
aaggtaatccaaacgctgtagtcta

SEQ ID NO: 78307 - DNA, 25 bp, S. pombe
aagagtttcctaaagcttacgcttg

SEQ ID NO: 78308 - DNA, 25 bp, S. pombe
aagttacttggtctcctagcttatc

SEQ ID NO: 78309 - DNA, 25 bp, S. pombe
aagttagctttcagttcgaccttct

SEQ ID NO: 78310 - DNA, 25 bp, S. pombe
aagattttagtctcccgaggtctct

SEQ ID NO: 78311 - DNA, 25 bp, S. pombe
aagttattacttctcgctgggcgtt

SEQ ID NO: 78312 - DNA, 25 bp, S. pombe
aagttgtcgacttggaggctgcctc

SEQ ID NO: 78313 - DNA, 25 bp, S. pombe
aagatcttcgaatacgggccttgga

SEQ ID NO: 78314 - DNA, 25 bp, S. pombe
aagagctattaagccgagcccgtga

SEQ ID NO: 78315 - DNA, 25 bp, S. pombe
aagagtagttgaagcctctcccact

SEQ ID NO: 78316 - DNA, 25 bp, S. pombe
aagatcgatgtctccggtgtctctg

SEQ ID NO: 78317 - DNA, 25 bp, S. pombe
aagatggatcgcagcaagggtctca

SEQ ID NO: 78318 - DNA, 25 bp, S. pombe
aagaggctgctgatcggtggtccaa

SEQ ID NO: 78319 - DNA, 25 bp, S. pombe
aagaggcgcttttatggagtcaaac

SEQ ID NO: 78320 - DNA, 25 bp, S. pombe
aagagggcttgaacttcaccggcaa

SEQ ID NO: 78321 - DNA, 25 bp, S. pombe
aagaggcagttgttttaccgagtca

SEQ ID NO: 78322 - DNA, 25 bp, S. pombe
aagaggcactttttcacccgagtat

SEQ ID NO: 78323 - DNA, 25 bp, S. pombe
aagggccaggcatctttgaaggtac

SEQ ID NO: 78324 - DNA, 25 bp, S. pombe
aaggctggaaagtacggaagtgatc

SEQ ID NO: 78325 - DNA, 25 bp, S. pombe
aagatattgaaccttcggaagcttc

SEQ ID NO: 78326 - DNA, 25 bp, S. pombe
aagtgctcaaaaacccatgtctgcc

SEQ ID NO: 78327 - DNA, 25 bp, S. pombe
aagttcaatcaatccagctactggt

SEQ ID NO: 78328 - DNA, 25 bp, S. pombe
aagtctcaattctccgattctcgtg

SEQ ID NO: 78329 - DNA, 25 bp, S. pombe
aagatgtaactgacgccgttcctga

SEQ ID NO: 78330 - DNA, 25 bp, S. pombe
aagagcctgttgttgatgctgccca

SEQ ID NO: 78331 - DNA, 25 bp, S. pombe
aagagactacccattttcagcttct

SEQ ID NO: 78332 - DNA, 25 bp, S. pombe
aatgcaattccctcttttagctttt

SEQ ID NO: 78333 - DNA, 25 bp, S. pombe
aagatattggcctttctgtcgacga

SEQ ID NO: 78334 - DNA, 25 bp, S. pombe
aagtgccgacgtttccgctgaggaa

SEQ ID NO: 78335 - DNA, 25 bp, S. pombe
aagttgacctacttggctcttttca

SEQ ID NO: 78336 - DNA, 25 bp, S. pombe
aagggtatcaacttccgggcatttg

SEQ ID NO: 78337 - DNA, 25 bp, S. pombe
aagagtgctccacctttaagtgtgc

SEQ ID NO: 78338 - DNA, 25 bp, S. pombe
aagagaaccaacctttgcctgagca

SEQ ID NO: 78339 - DNA, 25 bp, S. pombe
aagaccttcgaagatcttgcgctca

SEQ ID NO: 78340 - DNA, 25 bp, S. pombe
aagagcccttgatatatgtcgtcgt

SEQ ID NO: 78341 - DNA, 25 bp, S. pombe
aatgtccgacgccaagtacgttttg

SEQ ID NO: 78342 - DNA, 25 bp, S. pombe
aatgtctcgatctcaagaacccgtt

SEQ ID NO: 78343 - DNA, 25 bp, S. pombe
aagagcttgctcgtaagcaccctgg

SEQ ID NO: 78344 - DNA, 25 bp, S. pombe
aagagcttcctgataatcctcctag

SEQ ID NO: 78345 - DNA, 25 bp, S. pombe
aagtttcccaaagatccaccagtcg

SEQ ID NO: 78346 - DNA, 25 bp, S. pombe
aagattggtcctgatccttctgtag

SEQ ID NO: 78347 - DNA, 25 bp, S. pombe
aagatctggttgcttcctttgatga

SEQ ID NO: 78348 - DNA, 25 bp, S. pombe
aagattccagcttcaaaccagagaa

SEQ ID NO: 78349 - DNA, 25 bp, S. pombe
aagttgcgtgctcaacaccgcgatg

SEQ ID NO: 78350 - DNA, 25 bp, S. pombe
aagttggttccatcgtctgagtcga

SEQ ID NO: 78351 - DNA, 25 bp, S. pombe
aagtctagtcaacaacgttcggcaa

SEQ ID NO: 78352 - DNA, 25 bp, S. pombe
aatgctctggaaaaacggttcggat

SEQ ID NO: 78353 - DNA, 25 bp, S. pombe
aagtaggactggaccgtgttcgaga

SEQ ID NO: 78354 - DNA, 25 bp, S. pombe
aagagctcggattacgctgtcgacc

SEQ ID NO: 78355 - DNA, 25 bp, S. pombe
aagtaccgtcttgtaatgcctcctg

SEQ ID NO: 78356 - DNA, 25 bp, S. pombe
aagatagacgtttcttacgctcccg

SEQ ID NO: 78357 - DNA, 25 bp, S. pombe
aagtcaaagcctgtcatttcttccc

SEQ ID NO: 78358 - DNA, 25 bp, S. pombe
aagtaccagtggatctgtttcctcc

SEQ ID NO: 78359 - DNA, 25 bp, S. pombe
aaggcaccactgctattgaggacct

SEQ ID NO: 78360 - DNA, 25 bp, S. pombe
aagttgctactgctattcgtggtgc

SEQ ID NO: 78361 - DNA, 25 bp, S. pombe
aagtagtctctgcttacggtacggt

SEQ ID NO: 78362 - DNA, 25 bp, S. pombe
aagtagggcatatctctcagcttcc

SEQ ID NO: 78363 - DNA, 25 bp, S. pombe
aagataaggtcttccgccaagccat

SEQ ID NO: 78364 - DNA, 25 bp, S. pombe
aagagcaatggttcctccatctttg

SEQ ID NO: 78365 - DNA, 25 bp, S. pombe
aagaggcagagcttcccactatatt

SEQ ID NO: 78366 - DNA, 25 bp, S. pombe
aagatgacttggcagctgctactcc

SEQ ID NO: 78367 - DNA, 25 bp, S. pombe
aagatgactccatatcgtactccgg

SEQ ID NO: 78368 - DNA, 25 bp, S. pombe
aagagactgcatttctactttcccg

SEQ ID NO: 78369 - DNA, 25 bp, S. pombe
aagttttcgtagtgcatctccaaag

SEQ ID NO: 78370 - DNA, 25 bp, S. pombe
aagatgggtttttcgcagcgctaga

SEQ ID NO: 78371 - DNA, 25 bp, S. pombe
aagagacgtcttgcttacgaagaaa

SEQ ID NO: 78372 - DNA, 25 bp, S. pombe
aagtttcacccatgcattggacggt

SEQ ID NO: 78373 - DNA, 25 bp, S. pombe
aagttgattcccaaacggtctgcaa

SEQ ID NO: 78374 - DNA, 25 bp, S. pombe
aagatgaacctgctcgtctttcgat

SEQ ID NO: 78375 - DNA, 25 bp, S. pombe
aagtagtctcgttcttcgattcgtt

SEQ ID NO: 78376 - DNA, 25 bp, S. pombe
aagatggctccgtttccagatacga

SEQ ID NO: 78377 - DNA, 25 bp, S. pombe
aagattcactgcgatgccaattacc

SEQ ID NO: 78378 - DNA, 25 bp, S. pombe
aagagtctttttcttgaggcaggac

SEQ ID NO: 78379 - DNA, 25 bp, S. pombe
aagttcgttttgctcgcttatggac

SEQ ID NO: 78380 - DNA, 25 bp, S. pombe
aagtttgtaatcgtacagcttctga

SEQ ID NO: 78381 - DNA, 25 bp, S. pombe
aagttggacaacgtactgttcttga

SEQ ID NO: 78382 - DNA, 25 bp, S. pombe
aagttcgcacaatgttttccttcca

SEQ ID NO: 78383 - DNA, 25 bp, S. pombe
aagttttcttccgattctcctaatg

SEQ ID NO: 78384 - DNA, 25 bp, S. pombe
aagatatttctaacagtgaccctga

SEQ ID NO: 78385 - DNA, 25 bp, S. pombe
aagatgctgtggataccgttgctgc

SEQ ID NO: 78386 - DNA, 25 bp, S. pombe
aagagatcggtttcatccttgcgca

SEQ ID NO: 78387 - DNA, 25 bp, S. pombe
aagagtcgtggcgtcatccttcaaa

SEQ ID NO: 78388 - DNA, 25 bp, S. pombe
aagttgcagcggctaattctcggtc

SEQ ID NO: 78389 - DNA, 25 bp, S. pombe
aagattcacggctgctgatttggct

SEQ ID NO: 78390 - DNA, 25 bp, S. pombe
aagatgttccaagtgctaggcctaa

SEQ ID NO: 78391 - DNA, 25 bp, S. pombe
aagagttcgtcgacttgttcgcagg

SEQ ID NO: 78392 - DNA, 25 bp, S. pombe
aagatgttcgctcttctttacatgc

SEQ ID NO: 78393 - DNA, 25 bp, S. pombe
aagtaacgcttctattgccgaggtt

SEQ ID NO: 78394 - DNA, 25 bp, S. pombe
aatgaacctgtttttgccggcttgg

SEQ ID NO: 78395 - DNA, 25 bp, S. pombe
aagtccattggtttggcctggtatc

SEQ ID NO: 78396 - DNA, 25 bp, S. pombe
aagtcactgcggtcagtttttcaag

SEQ ID NO: 78397 - DNA, 25 bp, S. pombe
aagttcctcttgttgccggtaccat

SEQ ID NO: 78398 - DNA, 25 bp, S. pombe
aagtccttcgtcttcgtggtaacat

SEQ ID NO: 78399 - DNA, 25 bp, S. pombe
aagatccattttctgctgcatgtct

SEQ ID NO: 78400 - DNA, 25 bp, S. pombe
aagagtctgctcttccagtagcaag

SEQ ID NO: 78401 - DNA, 25 bp, S. pombe
aagagatatctctgctggtgaacag

SEQ ID NO: 78402 - DNA, 25 bp, S. pombe
aagagtctcagcttgggtgctactg

SEQ ID NO: 78403 - DNA, 25 bp, S. pombe
aagagatgcacctcatgctgggcta

SEQ ID NO: 78404 - DNA, 25 bp, S. pombe
aagaggcacctgtcgagaagtcaat

SEQ ID NO: 78405 - DNA, 25 bp, S. pombe
aagagattgctctcgcttgccgtga

SEQ ID NO: 78406 - DNA, 25 bp, S. pombe
aagattcgtacttctatccctaatt

SEQ ID NO: 78407 - DNA, 25 bp, S. pombe
aagatacctctgatttagcggtaga

SEQ ID NO: 78408 - DNA, 25 bp, S. pombe
aagttccagctgaagttcgcggtac

SEQ ID NO: 78409 - DNA, 25 bp, S. pombe
aagtacggtgtacgctacggtgcat

SEQ ID NO: 78410 - DNA, 25 bp, S. pombe
aagtcacttggttggctgatacgga

SEQ ID NO: 78411 - DNA, 25 bp, S. pombe
aagatacatttttggcgacagatgg

SEQ ID NO: 78412 - DNA, 25 bp, S. pombe
aagtacggatcctcattcaatagta

SEQ ID NO: 78413 - DNA, 25 bp, S. pombe
aagtcggcgattttgctggaatttc

SEQ ID NO: 78414 - DNA, 25 bp, S. pombe
aagatttgaggaaccatcacggaaa

SEQ ID NO: 78415 - DNA, 25 bp, S. pombe
aagattttgagccatccgcaggcct

SEQ ID NO: 78416 - DNA, 25 bp, S. pombe
aagatgatttccaacccgagctatt

SEQ ID NO: 78417 - DNA, 25 bp, S. pombe
aagatgagcttcgtgacgcgctttt

SEQ ID NO: 78418 - DNA, 25 bp, S. pombe
aagatttcatgtgtcggccttagcg

SEQ ID NO: 78419 - DNA, 25 bp, S. pombe
aagtactgcaggatcggcttctttg

SEQ ID NO: 78420 - DNA, 25 bp, S. pombe
aagagtggtctctgttcttacttca

SEQ ID NO: 78421 - DNA, 25 bp, S. pombe
aagaggttttatcacagcatcccaa

SEQ ID NO: 78422 - DNA, 25 bp, S. pombe
aagagtgatcttgatgccccgaggg

SEQ ID NO: 78423 - DNA, 25 bp, S. pombe
aagatgtcgctcgtgtttgccatgc

SEQ ID NO: 78424 - DNA, 25 bp, S. pombe
aagagttgatatggcgctctcgcct

SEQ ID NO: 78425 - DNA, 25 bp, S. pombe
aagttccatgcaatgccacctatga

SEQ ID NO: 78426 - DNA, 25 bp, S. pombe
aagtcagcgctttggacctatagcc

SEQ ID NO: 78427 - DNA, 25 bp, S. pombe
aagttcttcaatggcactgttcatg

SEQ ID NO: 78428 - DNA, 25 bp, S. pombe
aagagtcttgattcctctgtttctc

SEQ ID NO: 78429 - DNA, 25 bp, S. pombe
aagagtgctggttccctaagtatca

SEQ ID NO: 78430 - DNA, 25 bp, S. pombe
aagagtcttttgcatctacagatac

SEQ ID NO: 78431 - DNA, 25 bp, S. pombe
aagaggcttatgctcgtgccgttaa

SEQ ID NO: 78432 - DNA, 25 bp, S. pombe
aagtcgctaatggataacctttcag

SEQ ID NO: 78433 - DNA, 25 bp, S. pombe
aagtcgtgcagacaatacctcttcc

SEQ ID NO: 78434 - DNA, 25 bp, S. pombe
aagattctaatgcagctgcttacca

SEQ ID NO: 78435 - DNA, 25 bp, S. pombe
aagatcctcctgctggagtttcagc

SEQ ID NO: 78436 - DNA, 25 bp, S. pombe
aagtccatcaccctggaggtcagag

SEQ ID NO: 78437 - DNA, 25 bp, S. pombe
aagatcttgcaagtggtgttccctc

SEQ ID NO: 78438 - DNA, 25 bp, S. pombe
aagttgacaacgtgcgccagactct

SEQ ID NO: 78439 - DNA, 25 bp, S. pombe
aagatttttggcttgggctctgtcc

SEQ ID NO: 78440 - DNA, 25 bp, S. pombe
aagatttggtccctatttctcattc

SEQ ID NO: 78441 - DNA, 25 bp, S. pombe
aagataaagcgctccaacagtcacc

SEQ ID NO: 78442 - DNA, 25 bp, S. pombe
aagatggaatttatcgccctcctcg

SEQ ID NO: 78443 - DNA, 25 bp, S. pombe
aagtacattggctggtgccgacaat

SEQ ID NO: 78444 - DNA, 25 bp, S. pombe
aagtaatgcggctccttcaaattta

SEQ ID NO: 78445 - DNA, 25 bp, S. pombe
aagattatggcgtgctcgtgaatac

SEQ ID NO: 78446 - DNA, 25 bp, S. pombe
aagtttgccggtgttgacattcgtg

SEQ ID NO: 78447 - DNA, 25 bp, S. pombe
aagattctgttgatcctgcatcgat

SEQ ID NO: 78448 - DNA, 25 bp, S. pombe
aagttggcatacatggcgtgtctat

SEQ ID NO: 78449 - DNA, 25 bp, S. pombe
aatcgactgtcctggtatagtccca

SEQ ID NO: 78450 - DNA, 25 bp, S. pombe
aagatgactggtctgcctggactca

SEQ ID NO: 78451 - DNA, 25 bp, S. pombe
aagttgcgggatgtgttgccagcac

SEQ ID NO: 78452 - DNA, 25 bp, S. pombe
aagatgtcgggttctgcttcaacta

SEQ ID NO: 78453 - DNA, 25 bp, S. pombe
aagatgctctcgatccttttactat

SEQ ID NO: 78454 - DNA, 25 bp, S. pombe
aagatcctcgatctcctggacgata

SEQ ID NO: 78455 - DNA, 25 bp, S. pombe
aagatccagtgcaaccttttggaga

SEQ ID NO: 78456 - DNA, 25 bp, S. pombe
aagtctaggacagcttgcttcagga

SEQ ID NO: 78457 - DNA, 25 bp, S. pombe
aagtgcaacgtcgtttggtctgcga

SEQ ID NO: 78458 - DNA, 25 bp, S. pombe
aagttccctatgctatgggtgccct

SEQ ID NO: 78459 - DNA, 25 bp, S. pombe
aagttccccatgaaggtccgatgtg

SEQ ID NO: 78460 - DNA, 25 bp, S. pombe
aagatttgtttattcgtggtagcgt

SEQ ID NO: 78461 - DNA, 25 bp, S. pombe
aagtttatccgtattgaagcagcca

SEQ ID NO: 78462 - DNA, 25 bp, S. pombe
aagttgaagttgaggctgccgctcc

SEQ ID NO: 78463 - DNA, 25 bp, S. pombe
aagttagactttcattcctcttcct

SEQ ID NO: 78464 - DNA, 25 bp, S. pombe
aagattttttatctccctccaccat

SEQ ID NO: 78465 - DNA, 25 bp, S. pombe
aatacttaatttctcaacgcgcacc

SEQ ID NO: 78466 - DNA, 25 bp, S. pombe
aagttgttatttcctctaccgcacg

SEQ ID NO: 78467 - DNA, 25 bp, S. pombe
aagttaaacttgttgctcctccact

SEQ ID NO: 78468 - DNA, 25 bp, S. pombe
aagttttacacttcgctactctact

SEQ ID NO: 78469 - DNA, 25 bp, S. pombe
aagatgtcttggctcgtgtcaacag

SEQ ID NO: 78470 - DNA, 25 bp, S. pombe
aagatttgctgagttcaatgccaaa

SEQ ID NO: 78471 - DNA, 25 bp, S. pombe
aagttgtctgctgatgctgatgctc

SEQ ID NO: 78472 - DNA, 25 bp, S. pombe
aagatcgtgctcagagtgctgtgca

SEQ ID NO: 78473 - DNA, 25 bp, S. pombe
aagatgcctccatgtcacttttatg

SEQ ID NO: 78474 - DNA, 25 bp, S. pombe
aagttgccatctgaccttttacaat

SEQ ID NO: 78475 - DNA, 25 bp, S. pombe
aagtatgcacttgacgctcttttca

SEQ ID NO: 78476 - DNA, 25 bp, S. pombe
aagtttagttccacgatcttctcta

SEQ ID NO: 78477 - DNA, 25 bp, S. pombe
aagtttcgttgctaaccatcagcct

SEQ ID NO: 78478 - DNA, 25 bp, S. pombe
aagtttctttcggagcttcagcact

SEQ ID NO: 78479 - DNA, 25 bp, S. pombe
aagtttctgttcagctttagcgcga

SEQ ID NO: 78480 - DNA, 25 bp, S. pombe
aagattttgttcaccttggaagcag

SEQ ID NO: 78481 - DNA, 25 bp, S. pombe
aagatctattgctagtgcccaacaa

SEQ ID NO: 78482 - DNA, 25 bp, S. pombe
aagatcttcaatttcgccatcgatg

SEQ ID NO: 78483 - DNA, 25 bp, S. pombe
aagtttccatttgagctcgatgcag

SEQ ID NO: 78484 - DNA, 25 bp, S. pombe
aagttgttcatgcttcagccgctaa

SEQ ID NO: 78485 - DNA, 25 bp, S. pombe
aagatgaggacccttatgcttcctc

SEQ ID NO: 78486 - DNA, 25 bp, S. pombe
aagtacgcatacttcttttcctgct

SEQ ID NO: 78487 - DNA, 25 bp, S. pombe
aagttcgacaattcgtttctccgat

SEQ ID NO: 78488 - DNA, 25 bp, S. pombe
aagttcccattcatgttgttcagtc

SEQ ID NO: 78489 - DNA, 25 bp, S. pombe
aagatctcgtatatcgccgttttct

SEQ ID NO: 78490 - DNA, 25 bp, S. pombe
aagatcctgtcgaatcacctgttgt

SEQ ID NO: 78491 - DNA, 25 bp, S. pombe
aagatctcgtcgttctgctggtatg

SEQ ID NO: 78492 - DNA, 25 bp, S. pombe
aagatgctctcattgaccctattca

SEQ ID NO: 78493 - DNA, 25 bp, S. pombe
aagatctgtcattgatccctcaaag

SEQ ID NO: 78494 - DNA, 25 bp, S. pombe
aagatgaggctctactggctgaaag

SEQ ID NO: 78495 - DNA, 25 bp, S. pombe
aagataccaggttgctcccagagtt

SEQ ID NO: 78496 - DNA, 25 bp, S. pombe
aatccggtggtcacttctgtacgaa

SEQ ID NO: 78497 - DNA, 25 bp, S. pombe
aagtccgagactgccattttcaaaa

SEQ ID NO: 78498 - DNA, 25 bp, S. pombe
aagatgttcacgctaattcaccctc

SEQ ID NO: 78499 - DNA, 25 bp, S. pombe
aagatactcgtttacttcctgcgtc

SEQ ID NO: 78500 - DNA, 25 bp, S. pombe
aagatacttttcctcttctggatga

SEQ ID NO: 78501 - DNA, 25 bp, S. pombe
aagatgagctttctgctcttgcggg

SEQ ID NO: 78502 - DNA, 25 bp, S. pombe
aagatgacggtgacttcctgcaagt

SEQ ID NO: 78503 - DNA, 25 bp, S. pombe
aagtgaaggatatctctttggttga

SEQ ID NO: 78504 - DNA, 25 bp, S. pombe
aagtcttgtagaagcccgtggttca

SEQ ID NO: 78505 - DNA, 25 bp, S. pombe
aagtcgttaatagcaccggtcctgt

SEQ ID NO: 78506 - DNA, 25 bp, S. pombe
aagggcctgggaactcctgaacaat

SEQ ID NO: 78507 - DNA, 25 bp, S. pombe
aagttactcaggtttctcgaatact

SEQ ID NO: 78508 - DNA, 25 bp, S. pombe
aagttttctcattcttctagaagtc

SEQ ID NO: 78509 - DNA, 25 bp, S. pombe
aagatcttcccattgtcgctaaaac

SEQ ID NO: 78510 - DNA, 25 bp, S. pombe
aagtcaagcttgttcgcgttcacta

SEQ ID NO: 78511 - DNA, 25 bp, S. pombe
aagtctatgcttgatgcttgtgtca

SEQ ID NO: 78512 - DNA, 25 bp, S. pombe
aagttgaatatgcaaccccttctcc

SEQ ID NO: 78513 - DNA, 25 bp, S. pombe
aagattttcatggatacccctccta

SEQ ID NO: 78514 - DNA, 25 bp, S. pombe
aagattatgtgtggtttccctgcca

SEQ ID NO: 78515 - DNA, 25 bp, S. pombe
aagatttttggtactgcctctcaag

SEQ ID NO: 78516 - DNA, 25 bp, S. pombe
aagttattctcattactggcgtcgc

SEQ ID NO: 78517 - DNA, 25 bp, S. pombe
aagtcttttcttgaggttcatccaa

SEQ ID NO: 78518 - DNA, 25 bp, S. pombe
aagtggtactttctggattctccaa

SEQ ID NO: 78519 - DNA, 25 bp, S. pombe
aagttgtttcttgtggcattctagc

SEQ ID NO: 78520 - DNA, 25 bp, S. pombe
aagtttttcttcctggagtgcttct

SEQ ID NO: 78521 - DNA, 25 bp, S. pombe
aagtattgttgcaccagtaatggct

SEQ ID NO: 78522 - DNA, 25 bp, S. pombe
aagatcgttgtgtatcagcgtgaaa

SEQ ID NO: 78523 - DNA, 25 bp, S. pombe
aagttactgcgccagaagtaccaga

SEQ ID NO: 78524 - DNA, 25 bp, S. pombe
aagatactcttgcttctatccctga

SEQ ID NO: 78525 - DNA, 25 bp, S. pombe
aagatatctgactgttttacctaaa

SEQ ID NO: 78526 - DNA, 25 bp, S. pombe
aagtttcgcttttgggccctgatca

SEQ ID NO: 78527 - DNA, 25 bp, S. pombe
aagttgaccgtgctgaggccttgaa

SEQ ID NO: 78528 - DNA, 25 bp, S. pombe
aagttactttggacatagccggtat

SEQ ID NO: 78529 - DNA, 25 bp, S. pombe
aagttagtttcaggtggcacggata

SEQ ID NO: 78530 - DNA, 25 bp, S. pombe
aagattcctcttccaggtcaaggta

SEQ ID NO: 78531 - DNA, 25 bp, S. pombe
aagtccgtacagttcgattagtgag

SEQ ID NO: 78532 - DNA, 25 bp, S. pombe
aagatttatctcagcttggtcgtaa

SEQ ID NO: 78533 - DNA, 25 bp, S. pombe
aagatttaccaagtagctcgcgaga

SEQ ID NO: 78534 - DNA, 25 bp, S. pombe
aagtcaatccaatccttttcggcta

SEQ ID NO: 78535 - DNA, 25 bp, S. pombe
aagatcttccgaccgtttatcagtt

SEQ ID NO: 78536 - DNA, 25 bp, S. pombe
aagatttccaccgtttctgatactg

SEQ ID NO: 78537 - DNA, 25 bp, S. pombe
aagattttcggagcttttcagcggt

SEQ ID NO: 78538 - DNA, 25 bp, S. pombe
aagatcttcctgttagcgttattag

SEQ ID NO: 78539 - DNA, 25 bp, S. pombe
aagtattccggttgtgtacagccac

SEQ ID NO: 78540 - DNA, 25 bp, S. pombe
aagtatcttcgtctttaccaactca

SEQ ID NO: 78541 - DNA, 25 bp, S. pombe
aagttcttcttctatatccaccagc

SEQ ID NO: 78542 - DNA, 25 bp, S. pombe
aagttcccaacgttgactattccag

SEQ ID NO: 78543 - DNA, 25 bp, S. pombe
aagttggccaaattcgacgtgttcg

SEQ ID NO: 78544 - DNA, 25 bp, S. pombe
aagttagacaacttcgatcgcgata

SEQ ID NO: 78545 - DNA, 25 bp, S. pombe
aagattgtcgacatgtctacctcca

SEQ ID NO: 78546 - DNA, 25 bp, S. pombe
aagatcttctgctgtgttttccaaa

SEQ ID NO: 78547 - DNA, 25 bp, S. pombe
aagtttggcatcatgtttctgcaaa

SEQ ID NO: 78548 - DNA, 25 bp, S. pombe
aagttggacctgaattctcatgaga

SEQ ID NO: 78549 - DNA, 25 bp, S. pombe
aagttgcaccgctagtatcttcaaa

SEQ ID NO: 78550 - DNA, 25 bp, S. pombe
aagtcatctcttttggtgacgctta

SEQ ID NO: 78551 - DNA, 25 bp, S. pombe
aagtcctcctaatcattcggtgtat

SEQ ID NO: 78552 - DNA, 25 bp, S. pombe
aagtcattacaaacgatggtcgcgt

SEQ ID NO: 78553 - DNA, 25 bp, S. pombe
aagtctaatcttgcgatggctagcg

SEQ ID NO: 78554 - DNA, 25 bp, S. pombe
aagtcttcactgtacgaccttgcgt

SEQ ID NO: 78555 - DNA, 25 bp, S. pombe
aagattatcctctgatgcctccaaa

SEQ ID NO: 78556 - DNA, 25 bp, S. pombe
aagttgtcagctttaatccccaaat

SEQ ID NO: 78557 - DNA, 25 bp, S. pombe
aagttgtaccaaatcacgactcccg

SEQ ID NO: 78558 - DNA, 25 bp, S. pombe
aagatttcaccagctccaagttgag

SEQ ID NO: 78559 - DNA, 25 bp, S. pombe
aagattggcagcctcttatggccag

SEQ ID NO: 78560 - DNA, 25 bp, S. pombe
aagttcaactcttgtcccagatggc

SEQ ID NO: 78561 - DNA, 25 bp, S. pombe
aagtgaagattttccgcctgtacgt

SEQ ID NO: 78562 - DNA, 25 bp, S. pombe
aagtcaactttcacatcgttccgtt

SEQ ID NO: 78563 - DNA, 25 bp, S. pombe
aatgttgagctatacctgcgttcgg

SEQ ID NO: 78564 - DNA, 25 bp, S. pombe
aagtctgaagaatcaccgttcgaga

SEQ ID NO: 78565 - DNA, 25 bp, S. pombe
aagtctgattgctcaacctttcaaa

SEQ ID NO: 78566 - DNA, 25 bp, S. pombe
aagattggtgtcgacgccttacaag

SEQ ID NO: 78567 - DNA, 25 bp, S. pombe
aagatttggtcgagcgcactagaat

SEQ ID NO: 78568 - DNA, 25 bp, S. pombe
aagttcgactcaatacaaggccaaa

SEQ ID NO: 78569 - DNA, 25 bp, S. pombe
aagtccggctcaagaagctggtctc

SEQ ID NO: 78570 - DNA, 25 bp, S. pombe
aagtccgatgttattgccgagcccg

SEQ ID NO: 78571 - DNA, 25 bp, S. pombe
aagttgcaactagttctcgcgtgga

SEQ ID NO: 78572 - DNA, 25 bp, S. pombe
aagttttgggttctgcttgcattga

SEQ ID NO: 78573 - DNA, 25 bp, S. pombe
aagttgttgacgttgttgctccatc

SEQ ID NO: 78574 - DNA, 25 bp, S. pombe
aagtcagcttgacgatcgtcttcct

SEQ ID NO: 78575 - DNA, 25 bp, S. pombe
aagtagcagtgttagcgctcctcct

SEQ ID NO: 78576 - DNA, 25 bp, S. pombe
aagatagaggtcatctgcctgccca

SEQ ID NO: 78577 - DNA, 25 bp, S. pombe
aagtcccagagaggccagagcagca

SEQ ID NO: 78578 - DNA, 25 bp, S. pombe
aagtacgcgtaaaatgtatgcctga

SEQ ID NO: 78579 - DNA, 25 bp, S. pombe
aagtcacgtttgaagtcgatgccaa

SEQ ID NO: 78580 - DNA, 25 bp, S. pombe
aagttcgttagacctgagcatccag

SEQ ID NO: 78581 - DNA, 25 bp, S. pombe
aagttggctaattcctattcacaga

SEQ ID NO: 78582 - DNA, 25 bp, S. pombe
aagattggtatcatgccttcgcaca

SEQ ID NO: 78583 - DNA, 25 bp, S. pombe
aagatttgatatcctggcttccaga

SEQ ID NO: 78584 - DNA, 25 bp, S. pombe
aagatattgtcagcggttccaacgt

SEQ ID NO: 78585 - DNA, 25 bp, S. pombe
aagtcaagcttttttacgctggcaa

SEQ ID NO: 78586 - DNA, 25 bp, S. pombe
aagtagcgcccttgaatacctagaa

SEQ ID NO: 78587 - DNA, 25 bp, S. pombe
aagtttccgctcactatcttaggga

SEQ ID NO: 78588 - DNA, 25 bp, S. pombe
aagtttatccccttatcgattgtgg

SEQ ID NO: 78589 - DNA, 25 bp, S. pombe
aagtttgagccccattatcgtcttg

SEQ ID NO: 78590 - DNA, 25 bp, S. pombe
aagttgcttccgcaattggctttgt

SEQ ID NO: 78591 - DNA, 25 bp, S. pombe
aagtccttccttacttagtacgcag

SEQ ID NO: 78592 - DNA, 25 bp, S. pombe
aagtacctatgcgttttattcaaat

SEQ ID NO: 78593 - DNA, 25 bp, S. pombe
aagtagcattggtctccagcgtgga

SEQ ID NO: 78594 - DNA, 25 bp, S. pombe
aagttgactatttctggtgagcgta

SEQ ID NO: 78595 - DNA, 25 bp, S. pombe
aagattatttccaatgtttcgcaga

SEQ ID NO: 78596 - DNA, 25 bp, S. pombe
aagtctcttccgatgaatatgctag

SEQ ID NO: 78597 - DNA, 25 bp, S. pombe
aagttgtctcaggatctctggctaa

SEQ ID NO: 78598 - DNA, 25 bp, S. pombe
aagttttagctatcgcatctcgagg

SEQ ID NO: 78599 - DNA, 25 bp, S. pombe
aagttttatatctgtgctcgcggac

SEQ ID NO: 78600 - DNA, 25 bp, S. pombe
aagttcttttgctactaggttctag

SEQ ID NO: 78601 - DNA, 25 bp, S. pombe
aagtctttaaaacaatattctccag

SEQ ID NO: 78602 - DNA, 25 bp, S. pombe
aagtctttacaagccgattcctcta

SEQ ID NO: 78603 - DNA, 25 bp, S. pombe
aagttgctaaaacctgccttggtgc

SEQ ID NO: 78604 - DNA, 25 bp, S. pombe
aaggaccgtttcttcttggagatca

SEQ ID NO: 78605 - DNA, 25 bp, S. pombe
aagggccgccgtgttttgaatgtcg

SEQ ID NO: 78606 - DNA, 25 bp, S. pombe
aagttgagcctttggtctcagggta

SEQ ID NO: 78607 - DNA, 25 bp, S. pombe
aagttacagctacttcctcatactg

SEQ ID NO: 78608 - DNA, 25 bp, S. pombe
aagtttagatcctcatcatgctcga

SEQ ID NO: 78609 - DNA, 25 bp, S. pombe
aagttctcgatcgatttctctctga

SEQ ID NO: 78610 - DNA, 25 bp, S. pombe
aagtatttcactgcttttccagcga

SEQ ID NO: 78611 - DNA, 25 bp, S. pombe
aagttctcttctgcttgtacacacg

SEQ ID NO: 78612 - DNA, 25 bp, S. pombe
aagttcatctcggtttcagtccttg

SEQ ID NO: 78613 - DNA, 25 bp, S. pombe
aagtttctggtctttacggcattgt

SEQ ID NO: 78614 - DNA, 25 bp, S. pombe
aagtttgctctttatttccgttgtg

SEQ ID NO: 78615 - DNA, 25 bp, S. pombe
aagttggtggatttcttctcctgac

SEQ ID NO: 78616 - DNA, 25 bp, S. pombe
aagttgctcgttgtcttcattctac

SEQ ID NO: 78617 - DNA, 25 bp, S. pombe
aagttgccgttattgaattcgcgag

SEQ ID NO: 78618 - DNA, 25 bp, S. pombe
aagtttgcaccccaagcgtattctt

SEQ ID NO: 78619 - DNA, 25 bp, S. pombe
aagattacacctggcaagcgtgctc

SEQ ID NO: 78620 - DNA, 25 bp, S. pombe
aagattcatcccgattagcgagcat

SEQ ID NO: 78621 - DNA, 25 bp, S. pombe
aagattgcatctgccaaagctgcct

SEQ ID NO: 78622 - DNA, 25 bp, S. pombe
aagattctgtcgaacagtctgcctc

SEQ ID NO: 78623 - DNA, 25 bp, S. pombe
aagattggtcttgatgttgcctcct

SEQ ID NO: 78624 - DNA, 25 bp, S. pombe
aagttgttcttctttctgccaccat

SEQ ID NO: 78625 - DNA, 25 bp, S. pombe
aagttggttctcattgccagcgatg

SEQ ID NO: 78626 - DNA, 25 bp, S. pombe
aagttgactcaacgtctctctcgac

SEQ ID NO: 78627 - DNA, 25 bp, S. pombe
aagtatcaccatttcgcattcacag

SEQ ID NO: 78628 - DNA, 25 bp, S. pombe
aagtctcaccttcatatccgtaaag

SEQ ID NO: 78629 - DNA, 25 bp, S. pombe
aagttccttctccatttcctgaaga

SEQ ID NO: 78630 - DNA, 25 bp, S. pombe
aagttcttaagcctgttttggcagc

SEQ ID NO: 78631 - DNA, 25 bp, S. pombe
aagtatttgtatcgcgccattgttc

SEQ ID NO: 78632 - DNA, 25 bp, S. pombe
aagttcattgtctggcacggatctc

SEQ ID NO: 78633 - DNA, 25 bp, S. pombe
aagttctcaaccagcagtaatgtgt

SEQ ID NO: 78634 - DNA, 25 bp, S. pombe
aagttcctcttggacgtatgggaca

SEQ ID NO: 78635 - DNA, 25 bp, S. pombe
aagtcgttggtatggctaatgctat

SEQ ID NO: 78636 - DNA, 25 bp, S. pombe
aagtcataggactcatggtcattac

SEQ ID NO: 78637 - DNA, 25 bp, S. pombe
aagtattggtctcagcacaccggga

SEQ ID NO: 78638 - DNA, 25 bp, S. pombe
gaaggacgtgtctgaactcccggac

SEQ ID NO: 78639 - DNA, 25 bp, S. pombe
aaggcttaagactactccacgtact

SEQ ID NO: 78640 - DNA, 25 bp, S. pombe
aagtgcttcaagactagctcaggat

SEQ ID NO: 78641 - DNA, 25 bp, S. pombe
aagtctgctcaagtgctgtcgatga

SEQ ID NO: 78642 - DNA, 25 bp, S. pombe
aagtgttgcagctgcttcagtggaa

SEQ ID NO: 78643 - DNA, 25 bp, S. pombe
aaggttgcttgtatcggtgcttggc

SEQ ID NO: 78644 - DNA, 25 bp, S. pombe
aaggtattgctcctaagaagcggga

SEQ ID NO: 78645 - DNA, 25 bp, S. pombe
aaggtaatccttgcgaatggtggca

SEQ ID NO: 78646 - DNA, 25 bp, S. pombe
aatggtattcctgtcgatgtaaacg

SEQ ID NO: 78647 - DNA, 25 bp, S. pombe
aaggccgtacttaccagtcaaactg

SEQ ID NO: 78648 - DNA, 25 bp, S. pombe
aagttcgttctttctcatggtcagt

SEQ ID NO: 78649 - DNA, 25 bp, S. pombe
aagttggttctgacacttcggttct

SEQ ID NO: 78650 - DNA, 25 bp, S. pombe
aagttgcgttcatgacttcgctttc

SEQ ID NO: 78651 - DNA, 25 bp, S. pombe
aagtttgatgcttacgcgtctggta

SEQ ID NO: 78652 - DNA, 25 bp, S. pombe
aagttatgtctttcctgatttgatg

SEQ ID NO: 78653 - DNA, 25 bp, S. pombe
aagttattcagttcattatcagcgc

SEQ ID NO: 78654 - DNA, 25 bp, S. pombe
aagtcgattcgtttatcagcacgta

SEQ ID NO: 78655 - DNA, 25 bp, S. pombe
aagtcctccatatgtacgcacttag

SEQ ID NO: 78656 - DNA, 25 bp, S. pombe
aagtcctcagcttttacgcgatttg

SEQ ID NO: 78657 - DNA, 25 bp, S. pombe
aagtccgctgccagttccgctcgtg

SEQ ID NO: 78658 - DNA, 25 bp, S. pombe
aagtccgaataacacctccttgact

SEQ ID NO: 78659 - DNA, 25 bp, S. pombe
aagtccaggacacatttgcaagtat

SEQ ID NO: 78660 - DNA, 25 bp, S. pombe
aagtccaacatcctcttctaatttt

SEQ ID NO: 78661 - DNA, 25 bp, S. pombe
aatgtacacaatgcttcccgttttt

SEQ ID NO: 78662 - DNA, 25 bp, S. pombe
aagttcattatccttcacacctatt

SEQ ID NO: 78663 - DNA, 25 bp, S. pombe
aagtcatctatgcagttcttacaaa

SEQ ID NO: 78664 - DNA, 25 bp, S. pombe
aagttatatcgtcctgctctgcaaa

SEQ ID NO: 78665 - DNA, 25 bp, S. pombe
aagttcaactgcttcatcatctgct

SEQ ID NO: 78666 - DNA, 25 bp, S. pombe
aagttgaggctcttcatacgccatg

SEQ ID NO: 78667 - DNA, 25 bp, S. pombe
aagtgggaattcgacacctgctatg

SEQ ID NO: 78668 - DNA, 25 bp, S. pombe
aagggaatcaatcgcctacttcatg

SEQ ID NO: 78669 - DNA, 25 bp, S. pombe
aagtcgctacatctaatgacatcac

SEQ ID NO: 78670 - DNA, 25 bp, S. pombe
aagtactgcactgttggtcgtctct

SEQ ID NO: 78671 - DNA, 25 bp, S. pombe
aagtctctacttctggtcctcgtga

SEQ ID NO: 78672 - DNA, 25 bp, S. pombe
aatgtcctacctttaatcacacctt

SEQ ID NO: 78673 - DNA, 25 bp, S. pombe
aagttactttgtgcgttgctagccg

SEQ ID NO: 78674 - DNA, 25 bp, S. pombe
aagtttatcttcatcgtgttggtcg

SEQ ID NO: 78675 - DNA, 25 bp, S. pombe
aagtttgttactagcgttgctcgtc

SEQ ID NO: 78676 - DNA, 25 bp, S. pombe
aagtggttgatgttcctcaccttac

SEQ ID NO: 78677 - DNA, 25 bp, S. pombe
aagttgcttgatattccccatttca

SEQ ID NO: 78678 - DNA, 25 bp, S. pombe
aagttttgaagcgtgcccttgttca

SEQ ID NO: 78679 - DNA, 25 bp, S. pombe
aagttttatagttgctcccgatgac

SEQ ID NO: 78680 - DNA, 25 bp, S. pombe
aagttgcttatcctactgtccgaga

SEQ ID NO: 78681 - DNA, 25 bp, S. pombe
aagtttggacaattgctgcagagca

SEQ ID NO: 78682 - DNA, 25 bp, S. pombe
aagttcttcacttctgctccaattt

SEQ ID NO: 78683 - DNA, 25 bp, S. pombe
aagttttatccttgcgtcaatcaaa

SEQ ID NO: 78684 - DNA, 25 bp, S. pombe
ctagtggtagctctgctcatagcag

SEQ ID NO: 78685 - DNA, 25 bp, S. pombe
aagtctgaggctcctctcaatgaga

SEQ ID NO: 78686 - DNA, 25 bp, S. pombe
aagttcgctctgtcgtcgatgagat

SEQ ID NO: 78687 - DNA, 25 bp, S. pombe
aagtatcatccagcttcgcatgtat

SEQ ID NO: 78688 - DNA, 25 bp, S. pombe
aagtattctcattctctcggtgtat

SEQ ID NO: 78689 - DNA, 25 bp, S. pombe
aagttatgtatcctctcgtgtttca

SEQ ID NO: 78690 - DNA, 25 bp, S. pombe
aagtttgctgatgttgcgtcttctc

SEQ ID NO: 78691 - DNA, 25 bp, S. pombe
aagtttattgtctggcatggctctc

SEQ ID NO: 78692 - DNA, 25 bp, S. pombe
aagtaacactgttgaggctggctca

SEQ ID NO: 78693 - DNA, 25 bp, S. pombe
aagtacagcactttgggccacatcg

SEQ ID NO: 78694 - DNA, 25 bp, S. pombe
aagttctcagatttggtcttctccc

SEQ ID NO: 78695 - DNA, 25 bp, S. pombe
aagtgccgcagtcgttcatgtgata

SEQ ID NO: 78696 - DNA, 25 bp, S. pombe
aagtcgctgagtgggcttctagctt

SEQ ID NO: 78697 - DNA, 25 bp, S. pombe
aagtgccatagtgcgtttttattgc

SEQ ID NO: 78698 - DNA, 25 bp, S. pombe
aagtactccagtctttgcatgaaaa

SEQ ID NO: 78699 - DNA, 25 bp, S. pombe
aagttacttatgagcttgacgataa

SEQ ID NO: 78700 - DNA, 25 bp, S. pombe
aagttcgctcttggactattcgtaa

SEQ ID NO: 78701 - DNA, 25 bp, S. pombe
aagttacctccgtcatttggtcaag

SEQ ID NO: 78702 - DNA, 25 bp, S. pombe
aagtcaattcttctttcggtgaaat

SEQ ID NO: 78703 - DNA, 25 bp, S. pombe
aagtagtctctgatgtcttcggtca

SEQ ID NO: 78704 - DNA, 25 bp, S. pombe
aagttcatcatcattgtccgggcgt

SEQ ID NO: 78705 - DNA, 25 bp, S. pombe
aagtttgtactgagagcccatccgg

SEQ ID NO: 78706 - DNA, 25 bp, S. pombe
gaaacgacgtttgtcgagcctttct

SEQ ID NO: 78707 - DNA, 25 bp, S. pombe
aagttttgcccttacttatgctaag

SEQ ID NO: 78708 - DNA, 25 bp, S. pombe
aagtttatcccttatctccgaagca

SEQ ID NO: 78709 - DNA, 25 bp, S. pombe
aagttttcacctgatgaccgataca

SEQ ID NO: 78710 - DNA, 25 bp, S. pombe
aagtcttcccctgcatacaaggaga

SEQ ID NO: 78711 - DNA, 25 bp, S. pombe
aagtatgatctcgactgctcaggca

SEQ ID NO: 78712 - DNA, 25 bp, S. pombe
aagtctgcatttggcatcggcacaa

SEQ ID NO: 78713 - DNA, 25 bp, S. pombe
aagtgctatctctatgagcgccaaa

SEQ ID NO: 78714 - DNA, 25 bp, S. pombe
aagtgctcaacaatgatccgctgaa

SEQ ID NO: 78715 - DNA, 25 bp, S. pombe
aagtgcacagctttgaccttgttgc

SEQ ID NO: 78716 - DNA, 25 bp, S. pombe
aagtcgtcaaattcgtcctcctatt

SEQ ID NO: 78717 - DNA, 25 bp, S. pombe
aagtctttaatttgtcaccctctgg

SEQ ID NO: 78718 - DNA, 25 bp, S. pombe
aagtcacttctttatgtccctgatt

SEQ ID NO: 78719 - DNA, 25 bp, S. pombe
aagtatacttcgcaacctgttgata

SEQ ID NO: 78720 - DNA, 25 bp, S. pombe
aagtccttccaattatgcgtctcgt

SEQ ID NO: 78721 - DNA, 25 bp, S. pombe
aagtttcttcacacatcctatcgtg

SEQ ID NO: 78722 - DNA, 25 bp, S. pombe
aagtcttcttccaaattctcttctt

SEQ ID NO: 78723 - DNA, 25 bp, S. pombe
aagtttttctgggtctcatcgttat

SEQ ID NO: 78724 - DNA, 25 bp, S. pombe
aagttttttgtcttctcatcccgat

SEQ ID NO: 78725 - DNA, 25 bp, S. pombe
aagtttacttgttcatccattcgcg

SEQ ID NO: 78726 - DNA, 25 bp, S. pombe
aagtcagtgctcagtctagtaccaa

SEQ ID NO: 78727 - DNA, 25 bp, S. pombe
aagtttgctcccattgattccgatt

SEQ ID NO: 78728 - DNA, 25 bp, S. pombe
aagtctcttcattcattttttcccg

SEQ ID NO: 78729 - DNA, 25 bp, S. pombe
aagtctgatcctttcgttgttttcg

SEQ ID NO: 78730 - DNA, 25 bp, S. pombe
aagtcagagcccttggtgctggatt

SEQ ID NO: 78731 - DNA, 25 bp, S. pombe
aagtatctccgacctctgaaaggca

SEQ ID NO: 78732 - DNA, 25 bp, S. pombe
aagtgaggctcatgaccgtagtcgt

SEQ ID NO: 78733 - DNA, 25 bp, S. pombe
aagtaccaagagacccagcggcaat

SEQ ID NO: 78734 - DNA, 25 bp, S. pombe
aatcaagaccttgcctcggtaaagc

SEQ ID NO: 78735 - DNA, 25 bp, S. pombe
aagggcccttctcagacaatcaaaa

SEQ ID NO: 78736 - DNA, 25 bp, S. pombe
aaggtccctactaagccaatttatg

SEQ ID NO: 78737 - DNA, 25 bp, S. pombe
aagtgttccgaaaagcccttctcat

SEQ ID NO: 78738 - DNA, 25 bp, S. pombe
aagtcccggtattctgtgcgttcac

SEQ ID NO: 78739 - DNA, 25 bp, S. pombe
aagtgcacttatcgcttcatctcgt

SEQ ID NO: 78740 - DNA, 25 bp, S. pombe
aagtcagtgctattcttgacgagat

SEQ ID NO: 78741 - DNA, 25 bp, S. pombe
cggtcagctttcagaatcagtcgtt

SEQ ID NO: 78742 - DNA, 25 bp, S. pombe
catggcaactttactttaccgttat

SEQ ID NO: 78743 - DNA, 25 bp, S. pombe
aatgcaactttactttcccaaccat

SEQ ID NO: 78744 - DNA, 25 bp, S. pombe
aagtatgtccaaagcacctgctaaa

SEQ ID NO: 78745 - DNA, 25 bp, S. pombe
aagtctacactctccaagctcgaaa

SEQ ID NO: 78746 - DNA, 25 bp, S. pombe
aagtcttcctttccatcgactataa

SEQ ID NO: 78747 - DNA, 25 bp, S. pombe
aagtcttgccttaccagcttcaatg

SEQ ID NO: 78748 - DNA, 25 bp, S. pombe
aagtattggctttctgctgttcaga

SEQ ID NO: 78749 - DNA, 25 bp, S. pombe
aagtttggcatccttggcttcaatc

SEQ ID NO: 78750 - DNA, 25 bp, S. pombe
aagtctttgcttgaggcgtcatatg

SEQ ID NO: 78751 - DNA, 25 bp, S. pombe
aagtcgcgactgtagatgggtatca

SEQ ID NO: 78752 - DNA, 25 bp, S. pombe
aagtttctcgcctttgtgagtatca

SEQ ID NO: 78753 - DNA, 25 bp, S. pombe
aagtcggctcttggatctttataga

SEQ ID NO: 78754 - DNA, 25 bp, S. pombe
aagtccgtgctttgcatcagctaat

SEQ ID NO: 78755 - DNA, 25 bp, S. pombe
aagtccttgcattagcacgcgcaat

SEQ ID NO: 78756 - DNA, 25 bp, S. pombe
aagtccttcatactcagcgacaagt

SEQ ID NO: 78757 - DNA, 25 bp, S. pombe
aagtagcatgacaccacgagaattg

SEQ ID NO: 78758 - DNA, 25 bp, S. pombe
aagtatccctatggctttgacctga

SEQ ID NO: 78759 - DNA, 25 bp, S. pombe
aagtgatctccaaggttggcccggt

SEQ ID NO: 78760 - DNA, 25 bp, S. pombe
aagtctgttgcgcatttaccaggtc

SEQ ID NO: 78761 - DNA, 25 bp, S. pombe
aaggagcccgtatggttagaccgat

SEQ ID NO: 78762 - DNA, 25 bp, S. pombe
aatggcctcctgaagaccgtaagtt

SEQ ID NO: 78763 - DNA, 25 bp, S. pombe
aagtctcacaatacagggcttcatt

SEQ ID NO: 78764 - DNA, 25 bp, S. pombe
aagtccacaattaagtcctctagta

SEQ ID NO: 78765 - DNA, 25 bp, S. pombe
aagtccttcgtagcttcaatctggc

SEQ ID NO: 78766 - DNA, 25 bp, S. pombe
aagtcctccgtagtcttactggtgt

SEQ ID NO: 78767 - DNA, 25 bp, S. pombe
aagtttgacattgccttcacctctg

SEQ ID NO: 78768 - DNA, 25 bp, S. pombe
aagtttgaactcacttctgctgctt

SEQ ID NO: 78769 - DNA, 25 bp, S. pombe
aagtttgctacagatcttcgctctt

SEQ ID NO: 78770 - DNA, 25 bp, S. pombe
aagtttgctactaccttcttcgact

SEQ ID NO: 78771 - DNA, 25 bp, S. pombe
aagtctctacggttctattatcagc

SEQ ID NO: 78772 - DNA, 25 bp, S. pombe
aagtcttctagctatcctttaaatg

SEQ ID NO: 78773 - DNA, 25 bp, S. pombe
aagtctgattgacccgttatttcat

SEQ ID NO: 78774 - DNA, 25 bp, S. pombe
aagtctttgcggtggattggtctcc

SEQ ID NO: 78775 - DNA, 25 bp, S. pombe
aagtatttgcggtgtttgtccttct

SEQ ID NO: 78776 - DNA, 25 bp, S. pombe
aagtccattggtcagttcttcacct

SEQ ID NO: 78777 - DNA, 25 bp, S. pombe
aagtttgttggtgttcccatcactt

SEQ ID NO: 78778 - DNA, 25 bp, S. pombe
aaggatcgtaataccccacctatgg

SEQ ID NO: 78779 - DNA, 25 bp, S. pombe
aagtagttgactttcatccgcgtgg

SEQ ID NO: 78780 - DNA, 25 bp, S. pombe
aagtatgcacattcgtttccatcag

SEQ ID NO: 78781 - DNA, 25 bp, S. pombe
aagtcacagctacagttgcagcata

SEQ ID NO: 78782 - DNA, 25 bp, S. pombe
aagtccatcattcactctgcaataa

SEQ ID NO: 78783 - DNA, 25 bp, S. pombe
aagtcgcttacgctgagactgtccg

SEQ ID NO: 78784 - DNA, 25 bp, S. pombe
aagtcattcttccagggagtttcag

SEQ ID NO: 78785 - DNA, 25 bp, S. pombe
aagtctatgcttccaccagagtttt

SEQ ID NO: 78786 - DNA, 25 bp, S. pombe
aagtcattgcttactgccaaggtga

SEQ ID NO: 78787 - DNA, 25 bp, S. pombe
aagtgctggatttcgcgcgacgtaa

SEQ ID NO: 78788 - DNA, 25 bp, S. pombe
aagtcgtcgccaaagttgtgcaact

SEQ ID NO: 78789 - DNA, 25 bp, S. pombe
aagtaagcatcgttctttctcagaa

SEQ ID NO: 78790 - DNA, 25 bp, S. pombe
aagtcaccacaggaaatggctgaga

SEQ ID NO: 78791 - DNA, 25 bp, S. pombe
aagtctactgacaaagcatgccgga

SEQ ID NO: 78792 - DNA, 25 bp, S. pombe
aagtctggttagcaccgttgtcaaa

SEQ ID NO: 78793 - DNA, 25 bp, S. pombe
aagtaacgcatacccctattgaatg

SEQ ID NO: 78794 - DNA, 25 bp, S. pombe
aagtaacctcattcttgctcttgga

SEQ ID NO: 78795 - DNA, 25 bp, S. pombe
aagtatgacgccttcattgcttccg

SEQ ID NO: 78796 - DNA, 25 bp, S. pombe
aagtcatgatccctttgttcaccgg

SEQ ID NO: 78797 - DNA, 25 bp, S. pombe
aagtctcagttttagagcccagcat

SEQ ID NO: 78798 - DNA, 25 bp, S. pombe
aagtctgcattcttaaggcctcagt

SEQ ID NO: 78799 - DNA, 25 bp, S. pombe
aaggtgctatgcttgacttgctcgg

SEQ ID NO: 78800 - DNA, 25 bp, S. pombe
aagtcgacacaattgattccatgat

SEQ ID NO: 78801 - DNA, 25 bp, S. pombe
aagtcgcacctaccattcagcatat

SEQ ID NO: 78802 - DNA, 25 bp, S. pombe
aagtcgcagcagtgtcattagatat

SEQ ID NO: 78803 - DNA, 25 bp, S. pombe
aagtccaggagcgtcatgccgatat

SEQ ID NO: 78804 - DNA, 25 bp, S. pombe
aagtacgacagcgaattctccaaga

SEQ ID NO: 78805 - DNA, 25 bp, S. pombe
aagtgcttacattttggcggctcaa

SEQ ID NO: 78806 - DNA, 25 bp, S. pombe
aagtctcgagcttctttacagcata

SEQ ID NO: 78807 - DNA, 25 bp, S. pombe
aagtctctcccgaatgcttggaagc

SEQ ID NO: 78808 - DNA, 25 bp, S. pombe
aagtgctagtacatcttcggccagt

SEQ ID NO: 78809 - DNA, 25 bp, S. pombe
aagtcatattcgatctcatcctgca

SEQ ID NO: 78810 - DNA, 25 bp, S. pombe
aagtcatattggcttccctacttga

SEQ ID NO: 78811 - DNA, 25 bp, S. pombe
aagtcagatgtgctttccctcaatt

SEQ ID NO: 78812 - DNA, 25 bp, S. pombe
aagtagccaatgtttccgacgagaa

SEQ ID NO: 78813 - DNA, 25 bp, S. pombe
aatcgccccttatcttgagcttaaa

SEQ ID NO: 78814 - DNA, 25 bp, S. pombe
aagtgggtacttgtgaatcctgcaa

SEQ ID NO: 78815 - DNA, 25 bp, S. pombe
aagtcagcgacgtagccttttgtga

SEQ ID NO: 78816 - DNA, 25 bp, S. pombe
aaggctggtcgtgctttccacaaat

SEQ ID NO: 78817 - DNA, 25 bp, S. pombe
cgaggatggtcctcgtcctttcaag

SEQ ID NO: 78818 - DNA, 25 bp, S. pombe
ctaggaggtttagggaatgcatttg

SEQ ID NO: 78819 - DNA, 25 bp, S. pombe
aagtctcaacttgagtcacgcgtcc

SEQ ID NO: 78820 - DNA, 25 bp, S. pombe
aagtctcttgcttctagtagcggat

SEQ ID NO: 78821 - DNA, 25 bp, S. pombe
aagtcttggtgaacgtttgtctcaa

SEQ ID NO: 78822 - DNA, 25 bp, S. pombe
aaggctcggtcaacgttggtgtgaa

SEQ ID NO: 78823 - DNA, 25 bp, S. pombe
aagtctcttgtcaccttggatgtta

SEQ ID NO: 78824 - DNA, 25 bp, S. pombe
aagtgccattggatgccctaatctt

SEQ ID NO: 78825 - DNA, 25 bp, S. pombe
aagtctttgtgcttgccattcaatt

SEQ ID NO: 78826 - DNA, 25 bp, S. pombe
aagtctctcttgctgatcttcaaaa

SEQ ID NO: 78827 - DNA, 25 bp, S. pombe
aagtcgcagttgcatgattatccga

SEQ ID NO: 78828 - DNA, 25 bp, S. pombe
aagtcggttacaagagcaacgcaaa

SEQ ID NO: 78829 - DNA, 25 bp, S. pombe
aagtcttgcgtttccaaatgtatgg

SEQ ID NO: 78830 - DNA, 25 bp, S. pombe
aagtcccgcgcttgtgaacatgtgg

SEQ ID NO: 78831 - DNA, 25 bp, S. pombe
aagtgctccgttcgtcaacaaaggt

SEQ ID NO: 78832 - DNA, 25 bp, S. pombe
aagtgtacctccaaccaatatggcc

SEQ ID NO: 78833 - DNA, 25 bp, S. pombe
aaggattcgtccaacaggctaaaat

SEQ ID NO: 78834 - DNA, 25 bp, S. pombe
aagtgatttttctcggcttgaaact

SEQ ID NO: 78835 - DNA, 25 bp, S. pombe
aagtcgacgttctctggctaaattc

SEQ ID NO: 78836 - DNA, 25 bp, S. pombe
aagtcgactgtttgagcaggtcaat

SEQ ID NO: 78837 - DNA, 25 bp, S. pombe
aagtgcggtgtcgtcaaggtcaaca

SEQ ID NO: 78838 - DNA, 25 bp, S. pombe
aagggttgaaactcagtctcaccgc

SEQ ID NO: 78839 - DNA, 25 bp, S. pombe
aagggtttacgcttgttgtgccgca

SEQ ID NO: 78840 - DNA, 25 bp, S. pombe
aagggattacctctgatttcggatt

SEQ ID NO: 78841 - DNA, 25 bp, S. pombe
aaggttggacctttgccttggatgt

SEQ ID NO: 78842 - DNA, 25 bp, S. pombe
aagggaacccactcttggacatatt

SEQ ID NO: 78843 - DNA, 25 bp, S. pombe
aagtggcaaccgcagcctgttaata

SEQ ID NO: 78844 - DNA, 25 bp, S. pombe
aagtcgaatctgttccaccaaagaa

SEQ ID NO: 78845 - DNA, 25 bp, S. pombe
aagggccacgagtacattcaaagca

SEQ ID NO: 78846 - DNA, 25 bp, S. pombe
aagggtccgacattttctcaatgct

SEQ ID NO: 78847 - DNA, 25 bp, S. pombe
aagtctcccgacattttcacatata

SEQ ID NO: 78848 - DNA, 25 bp, S. pombe
aagtgatcctgcgaagtttgaacaa

SEQ ID NO: 78849 - DNA, 25 bp, S. pombe
aagtcgcagctcatggttgctaatc

SEQ ID NO: 78850 - DNA, 25 bp, S. pombe
aagtctcattctttgttcatacacg

SEQ ID NO: 78851 - DNA, 25 bp, S. pombe
aagtcattcacttttatcgacgctg

SEQ ID NO: 78852 - DNA, 25 bp, S. pombe
aagtggtaatccctactgctggtac

SEQ ID NO: 78853 - DNA, 25 bp, S. pombe
aagtggatttcgctcatcttcgaag

SEQ ID NO: 78854 - DNA, 25 bp, S. pombe
aagtggtttggagttgctacgcaga

SEQ ID NO: 78855 - DNA, 25 bp, S. pombe
aagtcaccacggtttgtccgcgaga

SEQ ID NO: 78856 - DNA, 25 bp, S. pombe
aagtgacgccgtttatgccgcagaa

SEQ ID NO: 78857 - DNA, 25 bp, S. pombe
aagtggcttcacagcaaggtgccta

SEQ ID NO: 78858 - DNA, 25 bp, S. pombe
aagtggatcccagcatcagtcgtta

SEQ ID NO: 78859 - DNA, 25 bp, S. pombe
aagtctgtatcactcatctacgctc

SEQ ID NO: 78860 - DNA, 25 bp, S. pombe
aagtcgtcatctagctctatcaaag

SEQ ID NO: 78861 - DNA, 25 bp, S. pombe
aagtgcgatctctgctgccaaaaat

SEQ ID NO: 78862 - DNA, 25 bp, S. pombe
aagtgcgtcttgctgcagaattcca

SEQ ID NO: 78863 - DNA, 25 bp, S. pombe
aagtcatacttgctaacatgcctcc

SEQ ID NO: 78864 - DNA, 25 bp, S. pombe
aagtctactttgaagaccctccgct

SEQ ID NO: 78865 - DNA, 25 bp, S. pombe
aaggttcccaaggatgtctctaaga

SEQ ID NO: 78866 - DNA, 25 bp, S. pombe
aaggttaagccagccgttcatcaaa

SEQ ID NO: 78867 - DNA, 25 bp, S. pombe
aatgttttattaccctggattcagg

SEQ ID NO: 78868 - DNA, 25 bp, S. pombe
aaggctttgatagccactggttccc

SEQ ID NO: 78869 - DNA, 25 bp, S. pombe
aagtctctaagatatgtgcccattt

SEQ ID NO: 78870 - DNA, 25 bp, S. pombe
aagtcttctcttatcgcaccttgat

SEQ ID NO: 78871 - DNA, 25 bp, S. pombe
aagtctgctttaattccacgtggat

SEQ ID NO: 78872 - DNA, 25 bp, S. pombe
aagtcccttattactcatctggaag

SEQ ID NO: 78873 - DNA, 25 bp, S. pombe
aagtccaatttacttcctcaggagg

SEQ ID NO: 78874 - DNA, 25 bp, S. pombe
aagtggtttgttggccttacgatga

SEQ ID NO: 78875 - DNA, 25 bp, S. pombe
aagtggtttcactgcatccttcatg

SEQ ID NO: 78876 - DNA, 25 bp, S. pombe
aagtggtcttctcgaagcccacaag

SEQ ID NO: 78877 - DNA, 25 bp, S. pombe
aagtgatgccttgctaaccgcgaga

SEQ ID NO: 78878 - DNA, 25 bp, S. pombe
aagggtgttcgcacagcaaaagcta

SEQ ID NO: 78879 - DNA, 25 bp, S. pombe
aaggctatggccgttacaccgacgt

SEQ ID NO: 78880 - DNA, 25 bp, S. pombe
aaggaaatccctgaatccacctggt

SEQ ID NO: 78881 - DNA, 25 bp, S. pombe
aagtggtaccttgaattcactggta

SEQ ID NO: 78882 - DNA, 25 bp, S. pombe
aaggtgaacaataccccgagcttgt

SEQ ID NO: 78883 - DNA, 25 bp, S. pombe
aaggaaaccatcgttcgtgttactg

SEQ ID NO: 78884 - DNA, 25 bp, S. pombe
aaggccctcggctaagcgtattact

SEQ ID NO: 78885 - DNA, 25 bp, S. pombe
aagtgagcgtgccttccagaagcag

SEQ ID NO: 78886 - DNA, 25 bp, S. pombe
aagtgcagaaacctccagaagcgta

SEQ ID NO: 78887 - DNA, 25 bp, S. pombe
aaggtgaaacctccattagcaaaga

SEQ ID NO: 78888 - DNA, 25 bp, S. pombe
aagggcatgccgctatggatgtata

SEQ ID NO: 78889 - DNA, 25 bp, S. pombe
aaggtggccgctctggttatatcgc

SEQ ID NO: 78890 - DNA, 25 bp, S. pombe
caatgaatggtaccggttgggttct

SEQ ID NO: 78891 - DNA, 25 bp, S. pombe
aaggctattgaatccctgagtgact

SEQ ID NO: 78892 - DNA, 25 bp, S. pombe
aagggtcttttgaacgattgtctcg

SEQ ID NO: 78893 - DNA, 25 bp, S. pombe
aagtcgctggttgatgagctatcca

SEQ ID NO: 78894 - DNA, 25 bp, S. pombe
aagtccgctattgaagctgctgctc

SEQ ID NO: 78895 - DNA, 25 bp, S. pombe
aagtctgccatgtttaccatgcctg

SEQ ID NO: 78896 - DNA, 25 bp, S. pombe
aagtccagagaccatataccccttt

SEQ ID NO: 78897 - DNA, 25 bp, S. pombe
aagtcgaaacagtctacccaacaat

SEQ ID NO: 78898 - DNA, 25 bp, S. pombe
aagtctgaactcgataacgcccgta

SEQ ID NO: 78899 - DNA, 25 bp, S. pombe
aaggctacctcagtaactattcgta

SEQ ID NO: 78900 - DNA, 25 bp, S. pombe
aagggcaccattgtttacattcgaa

SEQ ID NO: 78901 - DNA, 25 bp, S. pombe
aagggcatccatttcttttacaggt

SEQ ID NO: 78902 - DNA, 25 bp, S. pombe
aagtgttccccttgatgcattggat

SEQ ID NO: 78903 - DNA, 25 bp, S. pombe
aagtgttcactgctggatacggtca

SEQ ID NO: 78904 - DNA, 25 bp, S. pombe
aaggtacattggctggtcgttcacc

SEQ ID NO: 78905 - DNA, 25 bp, S. pombe
aagtggatattgcttcccgtcttaa

SEQ ID NO: 78906 - DNA, 25 bp, S. pombe
aagtgtattgttgtccctgttatca

SEQ ID NO: 78907 - DNA, 25 bp, S. pombe
aaggtttgcaattacgcgctttacg

SEQ ID NO: 78908 - DNA, 25 bp, S. pombe
aagtgtggtcacaccaaccaacttc

SEQ ID NO: 78909 - DNA, 25 bp, S. pombe
aagtctggtagcactcgcgccaaaa

SEQ ID NO: 78910 - DNA, 25 bp, S. pombe
aagggtgcgtatgctacatcggttc

SEQ ID NO: 78911 - DNA, 25 bp, S. pombe
aaggaaggtattgatgtacgtacaa

SEQ ID NO: 78912 - DNA, 25 bp, S. pombe
aaggtaggttgtatgtactatgcaa

SEQ ID NO: 78913 - DNA, 25 bp, S. pombe
aatggatggatgctatggttactga

SEQ ID NO: 78914 - DNA, 25 bp, S. pombe
aagtgcccgcgaattgctatcaaag

SEQ ID NO: 78915 - DNA, 25 bp, S. pombe
aagtctcccatcattgctgagctca

SEQ ID NO: 78916 - DNA, 25 bp, S. pombe
aagtgggcttctcctgatagctcta

SEQ ID NO: 78917 - DNA, 25 bp, S. pombe
aagtgctcgctttgtatggaattca

SEQ ID NO: 78918 - DNA, 25 bp, S. pombe
aaggtcgtgatcgtgctagtattca

SEQ ID NO: 78919 - DNA, 25 bp, S. pombe
aagtgatatgtcgtacctgccagcc

SEQ ID NO: 78920 - DNA, 25 bp, S. pombe
aagtcgacttggatgctgatatcac

SEQ ID NO: 78921 - DNA, 25 bp, S. pombe
aagtggatcgtgttctgaggctagc

SEQ ID NO: 78922 - DNA, 25 bp, S. pombe
aagtggtgcagttgtcgcctttgcc

SEQ ID NO: 78923 - DNA, 25 bp, S. pombe
aagtggaagaatgccctgttcacat

SEQ ID NO: 78924 - DNA, 25 bp, S. pombe
aaggcctttgatgctggcttcgacg

SEQ ID NO: 78925 - DNA, 25 bp, S. pombe
aagggttctgatgctagtactcaac

SEQ ID NO: 78926 - DNA, 25 bp, S. pombe
aagtgaccctgatctagctactaat

SEQ ID NO: 78927 - DNA, 25 bp, S. pombe
aagtgaacctagtgtctactcagaa

SEQ ID NO: 78928 - DNA, 25 bp, S. pombe
aaggaagcccagagattcgcggaaa

SEQ ID NO: 78929 - DNA, 25 bp, S. pombe
aaggaatcccctgatttctggaaag

SEQ ID NO: 78930 - DNA, 25 bp, S. pombe
aagtggatttccgatctaccttgat

SEQ ID NO: 78931 - DNA, 25 bp, S. pombe
aagggttccagcgagtatgcacttg

SEQ ID NO: 78932 - DNA, 25 bp, S. pombe
aagggtgtctacgagttgcgttact

SEQ ID NO: 78933 - DNA, 25 bp, S. pombe
aagggcttctattgagtctggtgat

SEQ ID NO: 78934 - DNA, 25 bp, S. pombe
aagtgctgccctgggatttggtgat

SEQ ID NO: 78935 - DNA, 25 bp, S. pombe
aagtgcgaccttgtctatggcctat

SEQ ID NO: 78936 - DNA, 25 bp, S. pombe
aagtggctcctgtttcagaactcat

SEQ ID NO: 78937 - DNA, 25 bp, S. pombe
aagtgtgctgccgttgcgacaacta

SEQ ID NO: 78938 - DNA, 25 bp, S. pombe
aagtggtggctcttcaaactcgaaa

SEQ ID NO: 78939 - DNA, 25 bp, S. pombe
aaggagtccccatcaaaaggcttca

SEQ ID NO: 78940 - DNA, 25 bp, S. pombe
aagtccgctggagaagctaccgaat

SEQ ID NO: 78941 - DNA, 25 bp, S. pombe
aagtccatcgcaatttaccatcaag

SEQ ID NO: 78942 - DNA, 25 bp, S. pombe
aagtcctctcaattttcaccaatgt

SEQ ID NO: 78943 - DNA, 25 bp, S. pombe
aagtgcttctggtatttcccaaggc

SEQ ID NO: 78944 - DNA, 25 bp, S. pombe
aaggcttcatctcagcaaacgggca

SEQ ID NO: 78945 - DNA, 25 bp, S. pombe
aagtccttcgaccaagtttatggat

SEQ ID NO: 78946 - DNA, 25 bp, S. pombe
aagtccttgctaaacatgctttatg

SEQ ID NO: 78947 - DNA, 25 bp, S. pombe
aagtcgctcgtacaatttaagtcag

SEQ ID NO: 78948 - DNA, 25 bp, S. pombe
aagtgccttgtgcattggtttcaaa

SEQ ID NO: 78949 - DNA, 25 bp, S. pombe
aagggctatggctatgctggctcca

SEQ ID NO: 78950 - DNA, 25 bp, S. pombe
aaggtcgttccaaggaagccactgc

SEQ ID NO: 78951 - DNA, 25 bp, S. pombe
aaggtctttgcagtggtaacccatg

SEQ ID NO: 78952 - DNA, 25 bp, S. pombe
aagtggtcgtgtttacatgtctcct

SEQ ID NO: 78953 - DNA, 25 bp, S. pombe
aaggtgactcttttactgttacata

SEQ ID NO: 78954 - DNA, 25 bp, S. pombe
aatggcaacggtttgctcgtattaa

SEQ ID NO: 78955 - DNA, 25 bp, S. pombe
aaggcatttgcctcctttattcaac

SEQ ID NO: 78956 - DNA, 25 bp, S. pombe
aagggctttctgtcgaccatagatc

SEQ ID NO: 78957 - DNA, 25 bp, S. pombe
aagggatatgggtagccgctcattc

SEQ ID NO: 78958 - DNA, 25 bp, S. pombe
aagggaaaagcacgctagctcgtca

SEQ ID NO: 78959 - DNA, 25 bp, S. pombe
aaggtgctcgttctttcttcaaggg

SEQ ID NO: 78960 - DNA, 25 bp, S. pombe
aagggtcgttttactatcaaatgcg

SEQ ID NO: 78961 - DNA, 25 bp, S. pombe
aagtgaagctgcaactccatcacct

SEQ ID NO: 78962 - DNA, 25 bp, S. pombe
aagtgcatcgtgaatctgttaggtt

SEQ ID NO: 78963 - DNA, 25 bp, S. pombe
aaggacagtcattctaatcctcccg

SEQ ID NO: 78964 - DNA, 25 bp, S. pombe
aaggcatctcgtatgactacccaga

SEQ ID NO: 78965 - DNA, 25 bp, S. pombe
aagtgtggcagcttaccatttcaat

SEQ ID NO: 78966 - DNA, 25 bp, S. pombe
aagtgtccagagaacgcatttcaag

SEQ ID NO: 78967 - DNA, 25 bp, S. pombe
aagtgtctcagtaatgcgctcctat

SEQ ID NO: 78968 - DNA, 25 bp, S. pombe
aagtgccgttcagtattggatgagc

SEQ ID NO: 78969 - DNA, 25 bp, S. pombe
aagtggtgctaacatcgatgcgtgc

SEQ ID NO: 78970 - DNA, 25 bp, S. pombe
aaggtggttgtgctatcccaatcgg

SEQ ID NO: 78971 - DNA, 25 bp, S. pombe
aaggtgattcttcttcctcatttag

SEQ ID NO: 78972 - DNA, 25 bp, S. pombe
aaggtgatgtcgtctcagtgacaag

SEQ ID NO: 78973 - DNA, 25 bp, S. pombe
aaggtgttaacttctgacagcaatc

SEQ ID NO: 78974 - DNA, 25 bp, S. pombe
gaaggacgaaaacccactactcgca

SEQ ID NO: 78975 - DNA, 25 bp, S. pombe
aaggatcccgaacctagtatcgcct

SEQ ID NO: 78976 - DNA, 25 bp, S. pombe
aaggctcccaaattgtaggctttca

SEQ ID NO: 78977 - DNA, 25 bp, S. pombe
aatggcttccaaccttttctttcag

SEQ ID NO: 78978 - DNA, 25 bp, S. pombe
aagtgctgtccaggcatttggtctt

SEQ ID NO: 78979 - DNA, 25 bp, S. pombe
aaggtgtctctggtttggtcgtcga

SEQ ID NO: 78980 - DNA, 25 bp, S. pombe
aagggtttcactttggccagtcgct

SEQ ID NO: 78981 - DNA, 25 bp, S. pombe
aagggctttctttctgtaattggcg

SEQ ID NO: 78982 - DNA, 25 bp, S. pombe
aagggttttggtgctcacttggcca

SEQ ID NO: 78983 - DNA, 25 bp, S. pombe
aaggtaacgctacggccgtcgctca

SEQ ID NO: 78984 - DNA, 25 bp, S. pombe
aaggattctgttctgtttcctccca

SEQ ID NO: 78985 - DNA, 25 bp, S. pombe
aaggttctgcagttactttcccgat

SEQ ID NO: 78986 - DNA, 25 bp, S. pombe
aagggattcagcgtttctcttcctg

SEQ ID NO: 78987 - DNA, 25 bp, S. pombe
aaggaattcacgtttactcgcctca

SEQ ID NO: 78988 - DNA, 25 bp, S. pombe
aaggactctactgacgttcatcttc

SEQ ID NO: 78989 - DNA, 25 bp, S. pombe
caaggaacttcctacttcgactata

SEQ ID NO: 78990 - DNA, 25 bp, S. pombe
aaggtacccacttttgtgatctctc

SEQ ID NO: 78991 - DNA, 25 bp, S. pombe
aaggttctcagcaaattattattcg

SEQ ID NO: 78992 - DNA, 25 bp, S. pombe
aaggtccctgtgtttgatttactgc

SEQ ID NO: 78993 - DNA, 25 bp, S. pombe
aaggtgtccgtgaacttcttagcac

SEQ ID NO: 78994 - DNA, 25 bp, S. pombe
aaggctttaacgcatttttctatag

SEQ ID NO: 78995 - DNA, 25 bp, S. pombe
aaggctttgaaccagctttctgtcg

SEQ ID NO: 78996 - DNA, 25 bp, S. pombe
aaggttgtcaaggacgttgctccct

SEQ ID NO: 78997 - DNA, 25 bp, S. pombe
aaggccgttgagaaggttgcccctg

SEQ ID NO: 78998 - DNA, 25 bp, S. pombe
caaggccgttgagaaggttgcccct

SEQ ID NO: 78999 - DNA, 25 bp, S. pombe
tcaaggccgttgagaaggttgcccc

SEQ ID NO: 79000 - DNA, 25 bp, S. pombe
aagtggaggaagaaacgcgtgagac

SEQ ID NO: 79001 - DNA, 25 bp, S. pombe
aagtggcggcgatacatccgctttg

SEQ ID NO: 79002 - DNA, 25 bp, S. pombe
aagtggatattacgttgacaactca

SEQ ID NO: 79003 - DNA, 25 bp, S. pombe
aagtgagctattttttccaaccata

SEQ ID NO: 79004 - DNA, 25 bp, S. pombe
aagtgtgctgtatctttcacaaaca

SEQ ID NO: 79005 - DNA, 25 bp, S. pombe
aagggcgttctgatgaatcttctga

SEQ ID NO: 79006 - DNA, 25 bp, S. pombe
aagtggttctgcctcgacaattaaa

SEQ ID NO: 79007 - DNA, 25 bp, S. pombe
aaggatgtctttccggagtctaata

SEQ ID NO: 79008 - DNA, 25 bp, S. pombe
aagtgttgcatattccgtaggccaa

SEQ ID NO: 79009 - DNA, 25 bp, S. pombe
aagtggtgcctcaagtgctcgtcaa

SEQ ID NO: 79010 - DNA, 25 bp, S. pombe
aagggactctctaagttgactaaat

SEQ ID NO: 79011 - DNA, 25 bp, S. pombe
aaggtgcaccctatttatcaagaat

SEQ ID NO: 79012 - DNA, 25 bp, S. pombe
gaagacggtcagcaaactccatacg

SEQ ID NO: 79013 - DNA, 25 bp, S. pombe
aatgatcggtcgcagcaagtggaac

SEQ ID NO: 79014 - DNA, 25 bp, S. pombe
aaggcaactgttcccggttatgact

SEQ ID NO: 79015 - DNA, 25 bp, S. pombe
aaggaactctcttctcttttagaat

SEQ ID NO: 79016 - DNA, 25 bp, S. pombe
aaggacgcacctagctttgttagtt

SEQ ID NO: 79017 - DNA, 25 bp, S. pombe
aagtgactggcctgcgtttgtaatt

SEQ ID NO: 79018 - DNA, 25 bp, S. pombe
aaggttgtccttcgtttggaatgcg

SEQ ID NO: 79019 - DNA, 25 bp, S. pombe
aaggtttgcctatttgttgcggacg

SEQ ID NO: 79020 - DNA, 25 bp, S. pombe
aagtggtgttcactttgtcgccgac

SEQ ID NO: 79021 - DNA, 25 bp, S. pombe
gtatgggtcccataggtctttatgc

SEQ ID NO: 79022 - DNA, 25 bp, S. pombe
aagggtatccaacttgctgcctacg

SEQ ID NO: 79023 - DNA, 25 bp, S. pombe
aagggatccgatgccaatgagtctc

SEQ ID NO: 79024 - DNA, 25 bp, S. pombe
aagggacctgattccaagcttgctc

SEQ ID NO: 79025 - DNA, 25 bp, S. pombe
aagtgttgagcaccatcattgccac

SEQ ID NO: 79026 - DNA, 25 bp, S. pombe
aagggcgcagcacatttgccatatc

SEQ ID NO: 79027 - DNA, 25 bp, S. pombe
aagggcagcagacaatgcgctcaca

SEQ ID NO: 79028 - DNA, 25 bp, S. pombe
aagggagttgctgcattccaacctg

SEQ ID NO: 79029 - DNA, 25 bp, S. pombe
aagggaattcagcatctgcacgcca

SEQ ID NO: 79030 - DNA, 25 bp, S. pombe
aagtgtatattttttgctcccgctg

SEQ ID NO: 79031 - DNA, 25 bp, S. pombe
aagtgtcatctctatttttcccgat

SEQ ID NO: 79032 - DNA, 25 bp, S. pombe
aagtgttccaattttggctgccaag

SEQ ID NO: 79033 - DNA, 25 bp, S. pombe
aaggtcggaatctttgccgctcaca

SEQ ID NO: 79034 - DNA, 25 bp, S. pombe
aaggattggcattcttaggcggcaa

SEQ ID NO: 79035 - DNA, 25 bp, S. pombe
aagtggtgctggtattccccaacat

SEQ ID NO: 79036 - DNA, 25 bp, S. pombe
aagggaggtgtcttcagcggcaact

SEQ ID NO: 79037 - DNA, 25 bp, S. pombe
aaggtctagctaaacatgtagctaa

SEQ ID NO: 79038 - DNA, 25 bp, S. pombe
aaggttcgtctgagctactgtattc

SEQ ID NO: 79039 - DNA, 25 bp, S. pombe
aatcggaacctattgctcaaccaac

SEQ ID NO: 79040 - DNA, 25 bp, S. pombe
gaacggtacattatcgcaacggact

SEQ ID NO: 79041 - DNA, 25 bp, S. pombe
aagtggctaactgtcctttgtacat

SEQ ID NO: 79042 - DNA, 25 bp, S. pombe
aaggatggcttgctgctttttccac

SEQ ID NO: 79043 - DNA, 25 bp, S. pombe
taaggcatttggatttttacggcta

SEQ ID NO: 79044 - DNA, 25 bp, S. pombe
aaggtttttcttattcatgcgagga

SEQ ID NO: 79045 - DNA, 25 bp, S. pombe
aagtgtgtaaaatggctgcctgtcc

SEQ ID NO: 79046 - DNA, 25 bp, S. pombe
aagggtcttgaatcacctcagctta

SEQ ID NO: 79047 - DNA, 25 bp, S. pombe
aagggtcgtatcttggaagtctctc

SEQ ID NO: 79048 - DNA, 25 bp, S. pombe
aaggtgcacaggtcacttatcttcc

SEQ ID NO: 79049 - DNA, 25 bp, S. pombe
aagtgtgccgcagatgctcttaagt

SEQ ID NO: 79050 - DNA, 25 bp, S. pombe
aagggccgtgtagcttgcgagataa

SEQ ID NO: 79051 - DNA, 25 bp, S. pombe
taagggtaatttctacttgccaggt

SEQ ID NO: 79052 - DNA, 25 bp, S. pombe
aagggtattcccatcatcatttctg

SEQ ID NO: 79053 - DNA, 25 bp, S. pombe
aaggatgtcattgccaacgcttctt

SEQ ID NO: 79054 - DNA, 25 bp, S. pombe
aagggacgaagccacctcatggaga

SEQ ID NO: 79055 - DNA, 25 bp, S. pombe
aagggccgaacgtgtcatgcatgaa

SEQ ID NO: 79056 - DNA, 25 bp, S. pombe
aaggtgatgacctttgggcttcctc

SEQ ID NO: 79057 - DNA, 25 bp, S. pombe
aaggatacacgagcggtgtccgcac

SEQ ID NO: 79058 - DNA, 25 bp, S. pombe
aaggaggaacctactgtatcaagca

SEQ ID NO: 79059 - DNA, 25 bp, S. pombe
aatggcacaattgttcacggaacga

SEQ ID NO: 79060 - DNA, 25 bp, S. pombe
aaggacctgccttgacagcacatat

SEQ ID NO: 79061 - DNA, 25 bp, S. pombe
aagggcttcttcatcaatgttttga

SEQ ID NO: 79062 - DNA, 25 bp, S. pombe
aaggtggccctgatcaaagtcgtaa

SEQ ID NO: 79063 - DNA, 25 bp, S. pombe
aaggccctcccacagaggaattaat

SEQ ID NO: 79064 - DNA, 25 bp, S. pombe
aaggttgttactcgacgcactggat

SEQ ID NO: 79065 - DNA, 25 bp, S. pombe
aagggtttcttgtatatgacgagga

SEQ ID NO: 79066 - DNA, 25 bp, S. pombe
aagggtgattctttctggctcaagc

SEQ ID NO: 79067 - DNA, 25 bp, S. pombe
aaggctgctcagtcggtcacaagaa

SEQ ID NO: 79068 - DNA, 25 bp, S. pombe
aaggttttccatcagctattcaagt

SEQ ID NO: 79069 - DNA, 25 bp, S. pombe
aaggtcattaaagtgctcggtcgca

SEQ ID NO: 79070 - DNA, 25 bp, S. pombe
aaggtgtcaatggactcctttcgtc

SEQ ID NO: 79071 - DNA, 25 bp, S. pombe
aaggatttagatagtgccaccgctg

SEQ ID NO: 79072 - DNA, 25 bp, S. pombe
aaggtgttgccatttgccaaaccga

SEQ ID NO: 79073 - DNA, 25 bp, S. pombe
aaggtttcaattccaatcattccaa

SEQ ID NO: 79074 - DNA, 25 bp, S. pombe
aatgaggctgatctaagtattttaa

SEQ ID NO: 79075 - DNA, 25 bp, S. pombe
aaggtgcttctgttgagtttcttca

SEQ ID NO: 79076 - DNA, 25 bp, S. pombe
aaggttaacacatctcgctacggaa

SEQ ID NO: 79077 - DNA, 25 bp, S. pombe
aaggccgtacttgatgttcgacatt

SEQ ID NO: 79078 - DNA, 25 bp, S. pombe
aaggcggcccttggactttatcaga

SEQ ID NO: 79079 - DNA, 25 bp, S. pombe
aagggattccgtgaacttcatagaa

SEQ ID NO: 79080 - DNA, 25 bp, S. pombe
aaggcaaaccactttcacgcaggaa

SEQ ID NO: 79081 - DNA, 25 bp, S. pombe
aaggaaactgccttgcatgcaagac

SEQ ID NO: 79082 - DNA, 25 bp, S. pombe
aagggcagtttgatcttcacggcta

SEQ ID NO: 79083 - DNA, 25 bp, S. pombe
aagggatgtgttgctcgtctcggct

SEQ ID NO: 79084 - DNA, 25 bp, S. pombe
aaggtgaacttgactccttctgagt

SEQ ID NO: 79085 - DNA, 25 bp, S. pombe
aaggcgtgccggcagatttcagtat

SEQ ID NO: 79086 - DNA, 25 bp, S. pombe
aaggcgaaaaccatctccggacaga

SEQ ID NO: 79087 - DNA, 25 bp, S. pombe
aaggttgttgctcaactctctggtt

SEQ ID NO: 79088 - DNA, 25 bp, S. pombe
aaggcatggtgcaaacctccaggtt

SEQ ID NO: 79089 - DNA, 25 bp, S. pombe
aaggagtgtgctgacctttggcctc

SEQ ID NO: 79090 - DNA, 25 bp, S. pombe
aaggattttggagcttccatcccgg

SEQ ID NO: 79091 - DNA, 25 bp, S. pombe
aaggagtttggcgtcacccaagctc

SEQ ID NO: 79092 - DNA, 25 bp, S. pombe
aaggcggtatgacgctacttttcaa

SEQ ID NO: 79093 - DNA, 25 bp, S. pombe
aaggtcgcttgataactatttccag

SEQ ID NO: 79094 - DNA, 25 bp, S. pombe
aaggcaacggcttcaagattttcct

SEQ ID NO: 79095 - DNA, 25 bp, S. pombe
aaggcaaaggctgaagcgtcctctt

SEQ ID NO: 79096 - DNA, 25 bp, S. pombe
aaggatttctcgactacccaattat

SEQ ID NO: 79097 - DNA, 25 bp, S. pombe
aaggtcatgtatgactccccattct

SEQ ID NO: 79098 - DNA, 25 bp, S. pombe
aaggtgacgatattcttcccattcc

SEQ ID NO: 79099 - DNA, 25 bp, S. pombe
aaggtggcctctaagctaattgtta

SEQ ID NO: 79100 - DNA, 25 bp, S. pombe
aaggtgaagctgtcggccaagcatt

SEQ ID NO: 79101 - DNA, 25 bp, S. pombe
aaggcatcacttggttctacaggct

SEQ ID NO: 79102 - DNA, 25 bp, S. pombe
aaggaatggtccatgcctagcgctc

SEQ ID NO: 79103 - DNA, 25 bp, S. pombe
aaggaaggtcctacactcatcgtgc

SEQ ID NO: 79104 - DNA, 25 bp, S. pombe
aatgaaatcgctgatcaccctttgc

SEQ ID NO: 79105 - DNA, 25 bp, S. pombe
aagggtgttgagagcgcatcgctat

SEQ ID NO: 79106 - DNA, 25 bp, S. pombe
aaggcctgtcgttacaatcctagca

SEQ ID NO: 79107 - DNA, 25 bp, S. pombe
aagggttatgctttcaatcgtacag

SEQ ID NO: 79108 - DNA, 25 bp, S. pombe
aagggtattttctagccagcatcat

SEQ ID NO: 79109 - DNA, 25 bp, S. pombe
aagggttttttgtccatgctatgca

SEQ ID NO: 79110 - DNA, 25 bp, S. pombe
aagggtctttctaggtatctatcat

SEQ ID NO: 79111 - DNA, 25 bp, S. pombe
aaggatcacctttctttcactacat

SEQ ID NO: 79112 - DNA, 25 bp, S. pombe
aaggtgcccgtgtcattgtcactga

SEQ ID NO: 79113 - DNA, 25 bp, S. pombe
aaggccgttgatgctaagcttctcc

SEQ ID NO: 79114 - DNA, 25 bp, S. pombe
aatggactttctgtgaagcttccta

SEQ ID NO: 79115 - DNA, 25 bp, S. pombe
aaggccttgtccctgaagagatcca

SEQ ID NO: 79116 - DNA, 25 bp, S. pombe
aataacattagttccgttgccggct

SEQ ID NO: 79117 - DNA, 25 bp, S. pombe
aatgctagacttcgcacgtttcatg

SEQ ID NO: 79118 - DNA, 25 bp, S. pombe
aagggtcgtgcacgcatgttctcga

SEQ ID NO: 79119 - DNA, 25 bp, S. pombe
aaggaccgtgcatgtgtactcagat

SEQ ID NO: 79120 - DNA, 25 bp, S. pombe
aaggatttccgttctgaagctggca

SEQ ID NO: 79121 - DNA, 25 bp, S. pombe
aagggtactccttcagaacctgcat

SEQ ID NO: 79122 - DNA, 25 bp, S. pombe
aatgggataagcagcgcgagactat

SEQ ID NO: 79123 - DNA, 25 bp, S. pombe
aaggatactcctgttatggtcatgg

SEQ ID NO: 79124 - DNA, 25 bp, S. pombe
aaggtcaagcttgtcttggctgctt

SEQ ID NO: 79125 - DNA, 25 bp, S. pombe
aaggaagacttcctcttgacgttat

SEQ ID NO: 79126 - DNA, 25 bp, S. pombe
aaggcaccttttgtgaattcaacga

SEQ ID NO: 79127 - DNA, 25 bp, S. pombe
aaggacgagccctgtctgaaacgga

SEQ ID NO: 79128 - DNA, 25 bp, S. pombe
aatggaataccctgttcccaacgat

SEQ ID NO: 79129 - DNA, 25 bp, S. pombe
aatgaagaaccagcggctccgaacg

SEQ ID NO: 79130 - DNA, 25 bp, S. pombe
aatgtaggcccagcagaattgatta

SEQ ID NO: 79131 - DNA, 25 bp, S. pombe
aaggctcgccgaacattgaaacatg

SEQ ID NO: 79132 - DNA, 25 bp, S. pombe
aaggagttcgctgttcaagccaata

SEQ ID NO: 79133 - DNA, 25 bp, S. pombe
aagggtctcagcttatacaagggct

SEQ ID NO: 79134 - DNA, 25 bp, S. pombe
aagggtgcatacgtgatttcgcctg

SEQ ID NO: 79135 - DNA, 25 bp, S. pombe
aaggtgcggattttgatcttcacaa

SEQ ID NO: 79136 - DNA, 25 bp, S. pombe
aaggtcctgttgctgaattcactaa

SEQ ID NO: 79137 - DNA, 25 bp, S. pombe
aaggccggtgccattttatctgctc

SEQ ID NO: 79138 - DNA, 25 bp, S. pombe
aaggtgttggcttcttacaatgaca

SEQ ID NO: 79139 - DNA, 25 bp, S. pombe
aaggtgtctgtcacttggagataaa

SEQ ID NO: 79140 - DNA, 25 bp, S. pombe
aagggtgctctcactgtcgagacta

SEQ ID NO: 79141 - DNA, 25 bp, S. pombe
aaggcgttgctacacttgagcccgg

SEQ ID NO: 79142 - DNA, 25 bp, S. pombe
aaggtgttgcttcagcatctactcc

SEQ ID NO: 79143 - DNA, 25 bp, S. pombe
aaggagcgtgtctcgtcatactcga

SEQ ID NO: 79144 - DNA, 25 bp, S. pombe
aaggttacaggccaagcatcttcgt

SEQ ID NO: 79145 - DNA, 25 bp, S. pombe
aaggatcttctcgtgagcatgctgc

SEQ ID NO: 79146 - DNA, 25 bp, S. pombe
aaggactcatgacctgtctgtacgc

SEQ ID NO: 79147 - DNA, 25 bp, S. pombe
aaggactgcattctatctcaacctg

SEQ ID NO: 79148 - DNA, 25 bp, S. pombe
aaggtcgtcttgctgtagcatctga

SEQ ID NO: 79149 - DNA, 25 bp, S. pombe
aaggatcttattcgtgtggccgtcg

SEQ ID NO: 79150 - DNA, 25 bp, S. pombe
aaggatcttttggattctgtcgata

SEQ ID NO: 79151 - DNA, 25 bp, S. pombe
aaggttttgcatggacacttgttca

SEQ ID NO: 79152 - DNA, 25 bp, S. pombe
aaggcacttgctaatcatgatttac

SEQ ID NO: 79153 - DNA, 25 bp, S. pombe
aaggcaagccttgcgactgccaatc

SEQ ID NO: 79154 - DNA, 25 bp, S. pombe
aaggcaagctaaacgtgctgctcgt

SEQ ID NO: 79155 - DNA, 25 bp, S. pombe
aaggctagaaatttggctgctcgta

SEQ ID NO: 79156 - DNA, 25 bp, S. pombe
aaggctaaattcttcgctgcagtcc

SEQ ID NO: 79157 - DNA, 25 bp, S. pombe
aaggttccatgagacgttgccaaga

SEQ ID NO: 79158 - DNA, 25 bp, S. pombe
aaggttgtcaagaacgctctcaaag

SEQ ID NO: 79159 - DNA, 25 bp, S. pombe
aaggtcgtcaagatgctccaatccg

SEQ ID NO: 79160 - DNA, 25 bp, S. pombe
aaggttgctcaattctcgctcatat

SEQ ID NO: 79161 - DNA, 25 bp, S. pombe
aaggctctcgaattacttcaaacta

SEQ ID NO: 79162 - DNA, 25 bp, S. pombe
aaggaatgcgcgatcgcgttcgcat

SEQ ID NO: 79163 - DNA, 25 bp, S. pombe
aaggacatgcgtatgcgtctttgca

SEQ ID NO: 79164 - DNA, 25 bp, S. pombe
aaggcagaccaacttcttttacatg

SEQ ID NO: 79165 - DNA, 25 bp, S. pombe
aaggctagcatcactattctttcaa

SEQ ID NO: 79166 - DNA, 25 bp, S. pombe
aaggtgatgtatttccaccatccaa

SEQ ID NO: 79167 - DNA, 25 bp, S. pombe
aaggtatttttgttcctccagctga

SEQ ID NO: 79168 - DNA, 25 bp, S. pombe
aaggctcttactgtcttcgacgtat

SEQ ID NO: 79169 - DNA, 25 bp, S. pombe
aaggtttgtctgcatctccgtttga

SEQ ID NO: 79170 - DNA, 25 bp, S. pombe
aaggccattatacaattcgactcga

SEQ ID NO: 79171 - DNA, 25 bp, S. pombe
aaggcgctgttcctaattgggctgc

SEQ ID NO: 79172 - DNA, 25 bp, S. pombe
aaggcttttgaatcagcgtcggaag

SEQ ID NO: 79173 - DNA, 25 bp, S. pombe
aaggatgtctataccgattcaccga

SEQ ID NO: 79174 - DNA, 25 bp, S. pombe
aaggtactattcatggtgctcaatc

SEQ ID NO: 79175 - DNA, 25 bp, S. pombe
aaggtcccctttacttgacttgatg

SEQ ID NO: 79176 - DNA, 25 bp, S. pombe
aaggacgctttttttgagacttatg

SEQ ID NO: 79177 - DNA, 25 bp, S. pombe
aaggcattgcccttagcttgggtgc

SEQ ID NO: 79178 - DNA, 25 bp, S. pombe
aaggcttacgcctgcttcagagctg

SEQ ID NO: 79179 - DNA, 25 bp, S. pombe
aatggctaacgccttatcctacttg

SEQ ID NO: 79180 - DNA, 25 bp, S. pombe
aatggttacgtctcaactcacgata

SEQ ID NO: 79181 - DNA, 25 bp, S. pombe
aaggttcagcttcctccaagttact

SEQ ID NO: 79182 - DNA, 25 bp, S. pombe
aaggagtcgttcgtgtctgggacac

SEQ ID NO: 79183 - DNA, 25 bp, S. pombe
aaggcctttcctttagccgattctg

SEQ ID NO: 79184 - DNA, 25 bp, S. pombe
aaggagtctactcttcaccttgttc

SEQ ID NO: 79185 - DNA, 25 bp, S. pombe
aaggagtccactcttcacctcgttt

SEQ ID NO: 79186 - DNA, 25 bp, S. pombe
aaggatgccattattactgcccgcg

SEQ ID NO: 79187 - DNA, 25 bp, S. pombe
aaggaactggtagcgtctatctctc

SEQ ID NO: 79188 - DNA, 25 bp, S. pombe
aaggttgttcgttgtgtcttgccaa

SEQ ID NO: 79189 - DNA, 25 bp, S. pombe
aaggcaaacaccttttcattctcct

SEQ ID NO: 79190 - DNA, 25 bp, S. pombe
aaggctttacctatgttgcgtctcc

SEQ ID NO: 79191 - DNA, 25 bp, S. pombe
aaggcattcgtgagtttttgaattc

SEQ ID NO: 79192 - DNA, 25 bp, S. pombe
aaggcccggcgatttgtttgcaact

SEQ ID NO: 79193 - DNA, 25 bp, S. pombe
aaggctttacatggtgatccgtcta

SEQ ID NO: 79194 - DNA, 25 bp, S. pombe
aaggattttaccgtctagcagtttg

SEQ ID NO: 79195 - DNA, 25 bp, S. pombe
aaggtatcattctcactatctagtt

SEQ ID NO: 79196 - DNA, 25 bp, S. pombe
aaggccgttctttggatcaacttgg

SEQ ID NO: 79197 - DNA, 25 bp, S. pombe
aaggccagagaagcaagacgtcgac

SEQ ID NO: 79198 - DNA, 25 bp, S. pombe
aatggaggaaaaaacgcgtgcgtcg

SEQ ID NO: 79199 - DNA, 25 bp, S. pombe
aatcgggtacacaaacggtcacttg

SEQ ID NO: 79200 - DNA, 25 bp, S. pombe
aatggtcctatagagtgcgcgaaac

SEQ ID NO: 79201 - DNA, 25 bp, S. pombe
aaggtagctctcgtaatcgctaata

SEQ ID NO: 79202 - DNA, 25 bp, S. pombe
aaggtatctatcgttcctgctgaaa

SEQ ID NO: 79203 - DNA, 25 bp, S. pombe
aaggttctcctctaacatcagatca

SEQ ID NO: 79204 - DNA, 25 bp, S. pombe
aaggaatcctatcacttcagcaata

SEQ ID NO: 79205 - DNA, 25 bp, S. pombe
aaggagaccgtgttagctctgccaa

SEQ ID NO: 79206 - DNA, 25 bp, S. pombe
aaggaggcagcgtcttgcatcttgt

SEQ ID NO: 79207 - DNA, 25 bp, S. pombe
aaggaggagccatcttttgctgctg

SEQ ID NO: 79208 - DNA, 25 bp, S. pombe
aatgctaatgaggatggctactttc

SEQ ID NO: 79209 - DNA, 25 bp, S. pombe
aatgcgtcgtgacaccgtcgaaatc

SEQ ID NO: 79210 - DNA, 25 bp, S. pombe
aatcgtgtgggccatcgttcgttat

SEQ ID NO: 79211 - DNA, 25 bp, S. pombe
aaggctggtgaggttgttcgttctc

SEQ ID NO: 79212 - DNA, 25 bp, S. pombe
aaggcttggcaatttgttcgcggtc

SEQ ID NO: 79213 - DNA, 25 bp, S. pombe
aatgggccgaactatttcctggtca

SEQ ID NO: 79214 - DNA, 25 bp, S. pombe
aaggaggcagctcacctggattctt

SEQ ID NO: 79215 - DNA, 25 bp, S. pombe
aaggtttcgtagctcattttcgaca

SEQ ID NO: 79216 - DNA, 25 bp, S. pombe
aaggctgctcgtgaacttggtttga

SEQ ID NO: 79217 - DNA, 25 bp, S. pombe
aaggcatgacgattccaaggctgaa

SEQ ID NO: 79218 - DNA, 25 bp, S. pombe
aaggttcatcgtagcttcaaaaatg

SEQ ID NO: 79219 - DNA, 25 bp, S. pombe
aaggttgcgctttgtgttatccata

SEQ ID NO: 79220 - DNA, 25 bp, S. pombe
aaggccgactttttgtgcttacact

SEQ ID NO: 79221 - DNA, 25 bp, S. pombe
aaggccggtagtgctttgaatcaca

SEQ ID NO: 79222 - DNA, 25 bp, S. pombe
aaggccgaccacaacttgcgagaat

SEQ ID NO: 79223 - DNA, 25 bp, S. pombe
aaggaaactcctaacagtgatgaat

SEQ ID NO: 79224 - DNA, 25 bp, S. pombe
aaggaacctcctaaagctgctactc

SEQ ID NO: 79225 - DNA, 25 bp, S. pombe
aaggcaagcatccattaatccgagc

SEQ ID NO: 79226 - DNA, 25 bp, S. pombe
aaggaagcgtgctcacatgcctagg

SEQ ID NO: 79227 - DNA, 25 bp, S. pombe
aaggacctcttcgaagcatttgctt

SEQ ID NO: 79228 - DNA, 25 bp, S. pombe
aaggacccggtactgcaatgctttt

SEQ ID NO: 79229 - DNA, 25 bp, S. pombe
aaggttcgcgtgcagccatactttg

SEQ ID NO: 79230 - DNA, 25 bp, S. pombe
aaggctatacttgctagatatcctc

SEQ ID NO: 79231 - DNA, 25 bp, S. pombe
aaggcttcaatccttgaatacggaa

SEQ ID NO: 79232 - DNA, 25 bp, S. pombe
aaggatgtcgctagtcccgatatta

SEQ ID NO: 79233 - DNA, 25 bp, S. pombe
aaggttggctttggcagaatgtcta

SEQ ID NO: 79234 - DNA, 25 bp, S. pombe
aaggctgccaacagtagcggttctt

SEQ ID NO: 79235 - DNA, 25 bp, S. pombe
aaggctgccaaatctactgctgtac

SEQ ID NO: 79236 - DNA, 25 bp, S. pombe
aaggcaccaaagtgtctggttcctt

SEQ ID NO: 79237 - DNA, 25 bp, S. pombe
aaggacaccaagttgttcctgctcc

SEQ ID NO: 79238 - DNA, 25 bp, S. pombe
aatggatccaaagtcgattcctccc

SEQ ID NO: 79239 - DNA, 25 bp, S. pombe
aaggccaccaattgatccagtgcgt

SEQ ID NO: 79240 - DNA, 25 bp, S. pombe
aaggctcttcaaatgccgagggtaa

SEQ ID NO: 79241 - DNA, 25 bp, S. pombe
aatggctttaaagcggctcaccaca

SEQ ID NO: 79242 - DNA, 25 bp, S. pombe
aaggcctacaaaacgtgctgaccga

SEQ ID NO: 79243 - DNA, 25 bp, S. pombe
aaggatgccgccaagcaggttgaaa

SEQ ID NO: 79244 - DNA, 25 bp, S. pombe
aaggatgcttcctctaacttgaccg

SEQ ID NO: 79245 - DNA, 25 bp, S. pombe
aatggatattccaccaacttgccgc

SEQ ID NO: 79246 - DNA, 25 bp, S. pombe
aaggataccctttgcattgtctgcg

SEQ ID NO: 79247 - DNA, 25 bp, S. pombe
aaggaacaacttcctggtgctgctc

SEQ ID NO: 79248 - DNA, 25 bp, S. pombe
aaggcagataacacctctgttgctg

SEQ ID NO: 79249 - DNA, 25 bp, S. pombe
aaggcatcaaggagagcacgctagt

SEQ ID NO: 79250 - DNA, 25 bp, S. pombe
aatgacaaagcttcttgcgtctccc

SEQ ID NO: 79251 - DNA, 25 bp, S. pombe
aataaaactgtctgagtcccctcaa

SEQ ID NO: 79252 - DNA, 25 bp, S. pombe
aatagtaccttcagagccaaccatt

SEQ ID NO: 79253 - DNA, 25 bp, S. pombe
aaggatccgtgctttggagacccaa

SEQ ID NO: 79254 - DNA, 25 bp, S. pombe
aaggcttccgcaagggtgtccataa

SEQ ID NO: 79255 - DNA, 25 bp, S. pombe
aaggcttttgtctgagatggccata

SEQ ID NO: 79256 - DNA, 25 bp, S. pombe
aaggacttcttcagcaatgtttcaa

SEQ ID NO: 79257 - DNA, 25 bp, S. pombe
aaggacacggttcgcaattgtacaa

SEQ ID NO: 79258 - DNA, 25 bp, S. pombe
aatggaacaggcctccgtagttcac

SEQ ID NO: 79259 - DNA, 25 bp, S. pombe
aaggacaacgcttcacagttcgtga

SEQ ID NO: 79260 - DNA, 25 bp, S. pombe
aaggaagacgtatcattgcccaatg

SEQ ID NO: 79261 - DNA, 25 bp, S. pombe
aatgggccctttccaacatgtggtt

SEQ ID NO: 79262 - DNA, 25 bp, S. pombe
aaggcgaagcgcgtaacatcatcta

SEQ ID NO: 79263 - DNA, 25 bp, S. pombe
aatggttcctacaatatcgtcgttt

SEQ ID NO: 79264 - DNA, 25 bp, S. pombe
aaggacgtccgaatgctacaaaagc

SEQ ID NO: 79265 - DNA, 25 bp, S. pombe
aaggaggctcgagcatctgatgcat

SEQ ID NO: 79266 - DNA, 25 bp, S. pombe
aatggacttgtcgatcaggccggac

SEQ ID NO: 79267 - DNA, 25 bp, S. pombe
aaggcaattgtcgtaatccctgaat

SEQ ID NO: 79268 - DNA, 25 bp, S. pombe
aaggcaatgtttctcttacagttgg

SEQ ID NO: 79269 - DNA, 25 bp, S. pombe
aatcgctattttcactaacgctaag

SEQ ID NO: 79270 - DNA, 25 bp, S. pombe
aaggcatttttcacttcggcataag

SEQ ID NO: 79271 - DNA, 25 bp, S. pombe
aaggccgtactttctatcatgctca

SEQ ID NO: 79272 - DNA, 25 bp, S. pombe
aaggccgcttctgaaattgctaccg

SEQ ID NO: 79273 - DNA, 25 bp, S. pombe
aaggctagcgttgatcaaattcaga

SEQ ID NO: 79274 - DNA, 25 bp, S. pombe
aaggcatactggctcagcacggtaa

SEQ ID NO: 79275 - DNA, 25 bp, S. pombe
aaggaacttgccagacgagctgaaa

SEQ ID NO: 79276 - DNA, 25 bp, S. pombe
aaggagcacatctctcatcttgaaa

SEQ ID NO: 79277 - DNA, 25 bp, S. pombe
aatggcgcatattcatcatacctat

SEQ ID NO: 79278 - DNA, 25 bp, S. pombe
aaggcttctacaatcctcggacaat

SEQ ID NO: 79279 - DNA, 25 bp, S. pombe
aaggctacatgcgtacgtttggaaa

SEQ ID NO: 79280 - DNA, 25 bp, S. pombe
aaggcattggtgttgctgctgatcc

SEQ ID NO: 79281 - DNA, 25 bp, S. pombe
aaggagatcgcgcatgctcttcaga

SEQ ID NO: 79282 - DNA, 25 bp, S. pombe
aaggagttttcgttgcatatcataa

SEQ ID NO: 79283 - DNA, 25 bp, S. pombe
aatgaggttttggttgatgttctaa

SEQ ID NO: 79284 - DNA, 25 bp, S. pombe
aatgggttagttgtatcatattcaa

SEQ ID NO: 79285 - DNA, 25 bp, S. pombe
aatggcggtactttgttgacttcag

SEQ ID NO: 79286 - DNA, 25 bp, S. pombe
aaggcttaccgcgatgttgtcaagg

SEQ ID NO: 79287 - DNA, 25 bp, S. pombe
aatggtgtggcatgtctattctaac

SEQ ID NO: 79288 - DNA, 25 bp, S. pombe
aaggagctgccacttccaaggatgt

SEQ ID NO: 79289 - DNA, 25 bp, S. pombe
aatggcctacttctctaactatggt

SEQ ID NO: 79290 - DNA, 25 bp, S. pombe
aaggcgtacaagctgacattccatc

SEQ ID NO: 79291 - DNA, 25 bp, S. pombe
aaggctactcaagttgcacgccgta

SEQ ID NO: 79292 - DNA, 25 bp, S. pombe
aaggcgccaagtttagcatcgtctg

SEQ ID NO: 79293 - DNA, 25 bp, S. pombe
aaggcatgcaaagcgctcaggagtt

SEQ ID NO: 79294 - DNA, 25 bp, S. pombe
aatgactattcctatcccggtttag

SEQ ID NO: 79295 - DNA, 25 bp, S. pombe
aaggacatccagagtttagcacaga

SEQ ID NO: 79296 - DNA, 25 bp, S. pombe
aaggcctcatcttgactacttttta

SEQ ID NO: 79297 - DNA, 25 bp, S. pombe
aaggcttggtcgtgatagtcttccc

SEQ ID NO: 79298 - DNA, 25 bp, S. pombe
aatccaacgaagatacctctactaa

SEQ ID NO: 79299 - DNA, 25 bp, S. pombe
aatggcaacaactctactactacta

SEQ ID NO: 79300 - DNA, 25 bp, S. pombe
aatgcgagccgatggtactggtacc

SEQ ID NO: 79301 - DNA, 25 bp, S. pombe
aatggctccatcgacgaacaagact

SEQ ID NO: 79302 - DNA, 25 bp, S. pombe
aaggctgccattcctaaagctactg

SEQ ID NO: 79303 - DNA, 25 bp, S. pombe
aatggccaatttccaacaccagagg

SEQ ID NO: 79304 - DNA, 25 bp, S. pombe
aaggcgaaccattcaacttccaaga

SEQ ID NO: 79305 - DNA, 25 bp, S. pombe
aatggaaggcccgtctcagcgagct

SEQ ID NO: 79306 - DNA, 25 bp, S. pombe
aaggctggcacgtcacttagaagat

SEQ ID NO: 79307 - DNA, 25 bp, S. pombe
aatggacatgccttcacttaacgat

SEQ ID NO: 79308 - DNA, 25 bp, S. pombe
aatgcgacagcatcgtcagactcaa

SEQ ID NO: 79309 - DNA, 25 bp, S. pombe
aaggccgcaaggtcagcgctactga

SEQ ID NO: 79310 - DNA, 25 bp, S. pombe
aaggctcgaggcaatgacagtacta

SEQ ID NO: 79311 - DNA, 25 bp, S. pombe
aaggcatcaacagtataagctccga

SEQ ID NO: 79312 - DNA, 25 bp, S. pombe
aatggagcaaaccagcagccttatg

SEQ ID NO: 79313 - DNA, 25 bp, S. pombe
aatggaaaacgatgcctttgtccgc

SEQ ID NO: 79314 - DNA, 25 bp, S. pombe
aaggaaagtttcttcgcgtctgcaa

SEQ ID NO: 79315 - DNA, 25 bp, S. pombe
aaggaaattgttgcattcgcccaaa

SEQ ID NO: 79316 - DNA, 25 bp, S. pombe
aaggcaaattctagcccttgcacgg

SEQ ID NO: 79317 - DNA, 25 bp, S. pombe
aaggcaatcgtcaagcagctcttca

SEQ ID NO: 79318 - DNA, 25 bp, S. pombe
aaggcgcattagttactcccagtgt

SEQ ID NO: 79319 - DNA, 25 bp, S. pombe
aaggcttgtcgattgtgcagcccca

SEQ ID NO: 79320 - DNA, 25 bp, S. pombe
aatggcttgtggaagttgcaccaac

SEQ ID NO: 79321 - DNA, 25 bp, S. pombe
aatgtctaactgatggctccgtttc

SEQ ID NO: 79322 - DNA, 25 bp, S. pombe
aatggtcgcgtttgggtcaattctg

SEQ ID NO: 79323 - DNA, 25 bp, S. pombe
aatgttcctgtttcggctaattctc

SEQ ID NO: 79324 - DNA, 25 bp, S. pombe
aatgtatatttgttcggcacccctg

SEQ ID NO: 79325 - DNA, 25 bp, S. pombe
gaagtcctttggattaagtccacgt

SEQ ID NO: 79326 - DNA, 25 bp, S. pombe
aatggtttcggcattgaagccccgt

SEQ ID NO: 79327 - DNA, 25 bp, S. pombe
aatggagtaccccttgaacagcgcg

SEQ ID NO: 79328 - DNA, 25 bp, S. pombe
aatggttttttcatgcctcggagca

SEQ ID NO: 79329 - DNA, 25 bp, S. pombe
aatggtctttatattactcccaagg

SEQ ID NO: 79330 - DNA, 25 bp, S. pombe
aaggcctttcctcatcaaacgatga

SEQ ID NO: 79331 - DNA, 25 bp, S. pombe
aatgtagagctttcccctctagata

SEQ ID NO: 79332 - DNA, 25 bp, S. pombe
aaggcagggtacgagccctctgaaa

SEQ ID NO: 79333 - DNA, 25 bp, S. pombe
aatgttgcggtagaccagcctgcga

SEQ ID NO: 79334 - DNA, 25 bp, S. pombe
aatgaggttgacgtaccgcatgccg

SEQ ID NO: 79335 - DNA, 25 bp, S. pombe
aatgtgagttacgttcgtcccacta

SEQ ID NO: 79336 - DNA, 25 bp, S. pombe
aatgggtccttctcatggcgatgta

SEQ ID NO: 79337 - DNA, 25 bp, S. pombe
aaggcttgtctttacgctggtatca

SEQ ID NO: 79338 - DNA, 25 bp, S. pombe
aatgtggattctgaattccgcctcc

SEQ ID NO: 79339 - DNA, 25 bp, S. pombe
aaggcattgtcttcggttgcaaaat

SEQ ID NO: 79340 - DNA, 25 bp, S. pombe
aatgggcaggctctatgcgaagatc

SEQ ID NO: 79341 - DNA, 25 bp, S. pombe
aatggacggctcctacgtttttgag

SEQ ID NO: 79342 - DNA, 25 bp, S. pombe
aatgtcgctgaaacggatgcccctg

SEQ ID NO: 79343 - DNA, 25 bp, S. pombe
cagctgttagcaatacccaagtcga

SEQ ID NO: 79344 - DNA, 25 bp, S. pombe
cgtgtgctacttcgcccaaagaaaa

SEQ ID NO: 79345 - DNA, 25 bp, S. pombe
aatgacaccctgtacttggcaaatt

SEQ ID NO: 79346 - DNA, 25 bp, S. pombe
aaggcactcctactcattggaaaca

SEQ ID NO: 79347 - DNA, 25 bp, S. pombe
aatggcagcatcaaacttttcaaca

SEQ ID NO: 79348 - DNA, 25 bp, S. pombe
aaggcaggtcgtcttcaagtgtaca

SEQ ID NO: 79349 - DNA, 25 bp, S. pombe
aaggccgagcgtgttgccgaataca

SEQ ID NO: 79350 - DNA, 25 bp, S. pombe
aatggcgccttcacatttggcaatg

SEQ ID NO: 79351 - DNA, 25 bp, S. pombe
aaggctgccttgttggcatattcca

SEQ ID NO: 79352 - DNA, 25 bp, S. pombe
aatggccaggcgttcgtattgattt

SEQ ID NO: 79353 - DNA, 25 bp, S. pombe
aaggccatgtggtcgttgcgctcgt

SEQ ID NO: 79354 - DNA, 25 bp, S. pombe
aaggcattctgactttctggctctt

SEQ ID NO: 79355 - DNA, 25 bp, S. pombe
aaggcagatttccttcttcatcttc

SEQ ID NO: 79356 - DNA, 25 bp, S. pombe
aaggcactctttcatttgctttaca

SEQ ID NO: 79357 - DNA, 25 bp, S. pombe
aatggaccttcttattctcttctag

SEQ ID NO: 79358 - DNA, 25 bp, S. pombe
aatgtcctatccttattttgtttgg

SEQ ID NO: 79359 - DNA, 25 bp, S. pombe
aatgtatactccttaatttctttgg

SEQ ID NO: 79360 - DNA, 25 bp, S. pombe
aatgggatttcctgttactgccttg

SEQ ID NO: 79361 - DNA, 25 bp, S. pombe
aatgggtctagctacgttagccaat

SEQ ID NO: 79362 - DNA, 25 bp, S. pombe
aatgggtatacgactctatcaacaa

SEQ ID NO: 79363 - DNA, 25 bp, S. pombe
aatgaggtcctttcgggtacaaatg

SEQ ID NO: 79364 - DNA, 25 bp, S. pombe
aatgggttgctaccgtcaatcctat

SEQ ID NO: 79365 - DNA, 25 bp, S. pombe
aaggcatgcctattaactctgaccc

SEQ ID NO: 79366 - DNA, 25 bp, S. pombe
aatggtgctctatattctcgtgccg

SEQ ID NO: 79367 - DNA, 25 bp, S. pombe
aatggcattttggtgttcgctgccg

SEQ ID NO: 79368 - DNA, 25 bp, S. pombe
aatggttttgccatcggagccttta

SEQ ID NO: 79369 - DNA, 25 bp, S. pombe
aatgtttactctacccaatccttct

SEQ ID NO: 79370 - DNA, 25 bp, S. pombe
aatggcttacttactccctacttat

SEQ ID NO: 79371 - DNA, 25 bp, S. pombe
aatggctgctccgattgctagacga

SEQ ID NO: 79372 - DNA, 25 bp, S. pombe
aatggcgatgccattgctccatctg

SEQ ID NO: 79373 - DNA, 25 bp, S. pombe
aatggccattgctttgctactggta

SEQ ID NO: 79374 - DNA, 25 bp, S. pombe
aaggctaaggctatcactttccatc

SEQ ID NO: 79375 - DNA, 25 bp, S. pombe
aaggccaagtctgctgccagctctg

SEQ ID NO: 79376 - DNA, 25 bp, S. pombe
aatggatcaattgccgctagttagc

SEQ ID NO: 79377 - DNA, 25 bp, S. pombe
aatggtccacaggttgcggaacttc

SEQ ID NO: 79378 - DNA, 25 bp, S. pombe
aaggctctgcaaattctgctggata

SEQ ID NO: 79379 - DNA, 25 bp, S. pombe
aaggcatccgatcttgtgcgaatat

SEQ ID NO: 79380 - DNA, 25 bp, S. pombe
aaggcttatgatgctgttaaacaga

SEQ ID NO: 79381 - DNA, 25 bp, S. pombe
aaggccagaaacttggctgctcgca

SEQ ID NO: 79382 - DNA, 25 bp, S. pombe
aatggctatattccttcgttctact

SEQ ID NO: 79383 - DNA, 25 bp, S. pombe
aatggctttagctcatatttcggct

SEQ ID NO: 79384 - DNA, 25 bp, S. pombe
aaggctgtctttttggctacagtta

SEQ ID NO: 79385 - DNA, 25 bp, S. pombe
aaggccattacttttcttcagagtg

SEQ ID NO: 79386 - DNA, 25 bp, S. pombe
aatggccttaccgagctgttgcaga

SEQ ID NO: 79387 - DNA, 25 bp, S. pombe
aaggctgttggcgttgctcctgata

SEQ ID NO: 79388 - DNA, 25 bp, S. pombe
aaggctcttgctgtattccaatgga

SEQ ID NO: 79389 - DNA, 25 bp, S. pombe
aaggccgccatcaacatgctagtca

SEQ ID NO: 79390 - DNA, 25 bp, S. pombe
aaggctgctgtcaaacatctggctc

SEQ ID NO: 79391 - DNA, 25 bp, S. pombe
aatgggtgctcttacagccgctgga

SEQ ID NO: 79392 - DNA, 25 bp, S. pombe
aatgggctctattaaggcacactga

SEQ ID NO: 79393 - DNA, 25 bp, S. pombe
aatggcttcttctgaggaactgcct

SEQ ID NO: 79394 - DNA, 25 bp, S. pombe
aaggcttcaggccatttctgatgat

SEQ ID NO: 79395 - DNA, 25 bp, S. pombe
aaggctctcttgtttgatcgcatac

SEQ ID NO: 79396 - DNA, 25 bp, S. pombe
aaggctcgcattactagccgatcga

SEQ ID NO: 79397 - DNA, 25 bp, S. pombe
aaggctcctttcagctccattaatt

SEQ ID NO: 79398 - DNA, 25 bp, S. pombe
aaggctccgtacattatgtctgcaa

SEQ ID NO: 79399 - DNA, 25 bp, S. pombe
aaggctcctgtgacattttacttag

SEQ ID NO: 79400 - DNA, 25 bp, S. pombe
aaggcctgtgtcaagttctggatct

SEQ ID NO: 79401 - DNA, 25 bp, S. pombe
aatggtcttcctttacgtacatcag

SEQ ID NO: 79402 - DNA, 25 bp, S. pombe
aatggtagtcgtaatccctcacatg

SEQ ID NO: 79403 - DNA, 25 bp, S. pombe
aatggtatgcttcctattcctactc

SEQ ID NO: 79404 - DNA, 25 bp, S. pombe
aatggtccgtgggttcatcatcacc

SEQ ID NO: 79405 - DNA, 25 bp, S. pombe
aatggtccgacaaggcacgatcgct

SEQ ID NO: 79406 - DNA, 25 bp, S. pombe
aaggcgccgattatgactatgtgtc

SEQ ID NO: 79407 - DNA, 25 bp, S. pombe
aatggttatggtctcttctggatga

SEQ ID NO: 79408 - DNA, 25 bp, S. pombe
aatggttgcagcctttttccggcaa

SEQ ID NO: 79409 - DNA, 25 bp, S. pombe
aatggtctaactagtttctctggta

SEQ ID NO: 79410 - DNA, 25 bp, S. pombe
aaggcctctagtgtttctcggatat

SEQ ID NO: 79411 - DNA, 25 bp, S. pombe
aatggccccatgtgttttgttgaat

SEQ ID NO: 79412 - DNA, 25 bp, S. pombe
aaggccgagagctcttctcatagtg

SEQ ID NO: 79413 - DNA, 25 bp, S. pombe
aatggcgccaaatcttccaagcgga

SEQ ID NO: 79414 - DNA, 25 bp, S. pombe
aatggctacatctttactttcttta

SEQ ID NO: 79415 - DNA, 25 bp, S. pombe
aaggctagctgctgcaatcgggttt

SEQ ID NO: 79416 - DNA, 25 bp, S. pombe
aatggtcgagcatcaacgtctttct

SEQ ID NO: 79417 - DNA, 25 bp, S. pombe
aaggctcagatgtatactcgtcttt

SEQ ID NO: 79418 - DNA, 25 bp, S. pombe
aaggctcctaatgccattattcatg

SEQ ID NO: 79419 - DNA, 25 bp, S. pombe
aatggccaaacatctacttctgctg

SEQ ID NO: 79420 - DNA, 25 bp, S. pombe
aaggccacacactgctagtactgtc

SEQ ID NO: 79421 - DNA, 25 bp, S. pombe
aatggttcaccctatcatcgtttgg

SEQ ID NO: 79422 - DNA, 25 bp, S. pombe
aatggcttgcctatacatcctttgt

SEQ ID NO: 79423 - DNA, 25 bp, S. pombe
aatggttctgatgcaattccctgac

SEQ ID NO: 79424 - DNA, 25 bp, S. pombe
aatggtattgacgatttggcctata

SEQ ID NO: 79425 - DNA, 25 bp, S. pombe
aaggccatcttcatctatgtcgttg

SEQ ID NO: 79426 - DNA, 25 bp, S. pombe
aaggctctctacacttacgttcaag

SEQ ID NO: 79427 - DNA, 25 bp, S. pombe
aaggctcttgaatcgttgcagcggt

SEQ ID NO: 79428 - DNA, 25 bp, S. pombe
aaggccgttcgtagcattcaaatgg

SEQ ID NO: 79429 - DNA, 25 bp, S. pombe
aatggtgggttgactgctgaagctt

SEQ ID NO: 79430 - DNA, 25 bp, S. pombe
aaggcgttgttctcagtgactttga

SEQ ID NO: 79431 - DNA, 25 bp, S. pombe
aaggctgtttcttctagcacaactg

SEQ ID NO: 79432 - DNA, 25 bp, S. pombe
aatggtgttatcgtaatgctcacaa

SEQ ID NO: 79433 - DNA, 25 bp, S. pombe
aatggtgagtatgtacgctgacagc

SEQ ID NO: 79434 - DNA, 25 bp, S. pombe
aatgggccattgcaatccgaatagc

SEQ ID NO: 79435 - DNA, 25 bp, S. pombe
aatcggcacaggcagtcgcggaacc

SEQ ID NO: 79436 - DNA, 25 bp, S. pombe
aatggcaaggtggactctcttcaaa

SEQ ID NO: 79437 - DNA, 25 bp, S. pombe
aaggctgctcaaattcacgatcgta

SEQ ID NO: 79438 - DNA, 25 bp, S. pombe
aatggagcgcaatcctttcaggaga

SEQ ID NO: 79439 - DNA, 25 bp, S. pombe
aatgtcaggaggttttgtcgccgtc

SEQ ID NO: 79440 - DNA, 25 bp, S. pombe
aatccggaaagtctgcctggttctt

SEQ ID NO: 79441 - DNA, 25 bp, S. pombe
aatactcgacaagccatgacttttt

SEQ ID NO: 79442 - DNA, 25 bp, S. pombe
aatcttccagactcgagtttgtcaa

SEQ ID NO: 79443 - DNA, 25 bp, S. pombe
aatatcaccaacaccgttttctact

SEQ ID NO: 79444 - DNA, 25 bp, S. pombe
aatgtttccgaatcgcgcagtcgtc

SEQ ID NO: 79445 - DNA, 25 bp, S. pombe
aatgtttcgggattcaccactgagt

SEQ ID NO: 79446 - DNA, 25 bp, S. pombe
aatgggtcgaacgatcaggccgaga

SEQ ID NO: 79447 - DNA, 25 bp, S. pombe
aatgccaaacttgccttgatgactt

SEQ ID NO: 79448 - DNA, 25 bp, S. pombe
caaggacaccctttaggtcgtcaat

SEQ ID NO: 79449 - DNA, 25 bp, S. pombe
caaggaccgcctttactgtggtaga

SEQ ID NO: 79450 - DNA, 25 bp, S. pombe
aatggaccggcttctgcttgggttg

SEQ ID NO: 79451 - DNA, 25 bp, S. pombe
aatggagcaagcactacctgcgaat

SEQ ID NO: 79452 - DNA, 25 bp, S. pombe
aatggacatgctgcacctgtcttaa

SEQ ID NO: 79453 - DNA, 25 bp, S. pombe
aatggaccactgttgctgtcttgga

SEQ ID NO: 79454 - DNA, 25 bp, S. pombe
aatggcctagcttgtgtgttgtaca

SEQ ID NO: 79455 - DNA, 25 bp, S. pombe
aaggcctatgctaagatgtttcagt

SEQ ID NO: 79456 - DNA, 25 bp, S. pombe
aaggcgctatccaagattcttctat

SEQ ID NO: 79457 - DNA, 25 bp, S. pombe
aatggccatggtactgttttgttca

SEQ ID NO: 79458 - DNA, 25 bp, S. pombe
aatggctgagcctggagatcctatt

SEQ ID NO: 79459 - DNA, 25 bp, S. pombe
aatggcgagttagtggatcctgacg

SEQ ID NO: 79460 - DNA, 25 bp, S. pombe
aaggcggctagctatcgcaagcttt

SEQ ID NO: 79461 - DNA, 25 bp, S. pombe
aatggatcctgaacctagtgctctg

SEQ ID NO: 79462 - DNA, 25 bp, S. pombe
aatggcatgactctgcttggtctta

SEQ ID NO: 79463 - DNA, 25 bp, S. pombe
aatggctcgctctggtcgatttaat

SEQ ID NO: 79464 - DNA, 25 bp, S. pombe
aaggcgtttgcttatacttctgaag

SEQ ID NO: 79465 - DNA, 25 bp, S. pombe
aatggccttatatcaccgttgtaac

SEQ ID NO: 79466 - DNA, 25 bp, S. pombe
aatggcctagtactcaaccttctga

SEQ ID NO: 79467 - DNA, 25 bp, S. pombe
aaggccgtatatacttctcttggaa

SEQ ID NO: 79468 - DNA, 25 bp, S. pombe
aaggccgctattatgcgtcgtggtt

SEQ ID NO: 79469 - DNA, 25 bp, S. pombe
aaggcgttctatatcgtatggtgca

SEQ ID NO: 79470 - DNA, 25 bp, S. pombe
aatggcgttctttgggtgatgctgc

SEQ ID NO: 79471 - DNA, 25 bp, S. pombe
aaggccgcatgtctcagttgactaa

SEQ ID NO: 79472 - DNA, 25 bp, S. pombe
aatgactcctttaagcgaacgcttg

SEQ ID NO: 79473 - DNA, 25 bp, S. pombe
aatggtgccatcgatgttgccaacc

SEQ ID NO: 79474 - DNA, 25 bp, S. pombe
aatggtctaccagttcaaagctccg

SEQ ID NO: 79475 - DNA, 25 bp, S. pombe
aatgatctgctgcactccagtttaa

SEQ ID NO: 79476 - DNA, 25 bp, S. pombe
aatgtgtcgcacagctggtgttgat

SEQ ID NO: 79477 - DNA, 25 bp, S. pombe
aatgttcctcgatccggatttacat

SEQ ID NO: 79478 - DNA, 25 bp, S. pombe
aatgcacatccattgtgggtacagt

SEQ ID NO: 79479 - DNA, 25 bp, S. pombe
aatgcaatgcacttcccaagtcgaa

SEQ ID NO: 79480 - DNA, 25 bp, S. pombe
aatgactacgatcctgaagctgaac

SEQ ID NO: 79481 - DNA, 25 bp, S. pombe
aatgatactatcagtggccgagaaa

SEQ ID NO: 79482 - DNA, 25 bp, S. pombe
aatggctatccgatatgggacgaga

SEQ ID NO: 79483 - DNA, 25 bp, S. pombe
aatggctctccttcttggagggatg

SEQ ID NO: 79484 - DNA, 25 bp, S. pombe
aatggaatttttggctaacacacta

SEQ ID NO: 79485 - DNA, 25 bp, S. pombe
aatggaacattcacagggagacaaa

SEQ ID NO: 79486 - DNA, 25 bp, S. pombe
aatggaactccttccggtagcaaga

SEQ ID NO: 79487 - DNA, 25 bp, S. pombe
aatggcaacctcctactggtagtgt

SEQ ID NO: 79488 - DNA, 25 bp, S. pombe
aatcagcaaaccgaagtcacttgtg

SEQ ID NO: 79489 - DNA, 25 bp, S. pombe
aatgtggcccgatggatatcctgga

SEQ ID NO: 79490 - DNA, 25 bp, S. pombe
aatgggcccgtgagcactttgagaa

SEQ ID NO: 79491 - DNA, 25 bp, S. pombe
aatgggcctttgatcaatcttctgc

SEQ ID NO: 79492 - DNA, 25 bp, S. pombe
aatggccttttgatcttcatgcttc

SEQ ID NO: 79493 - DNA, 25 bp, S. pombe
aatgtcggtgttttgtttgttgcta

SEQ ID NO: 79494 - DNA, 25 bp, S. pombe
aatccttacgatttactagttgcct

SEQ ID NO: 79495 - DNA, 25 bp, S. pombe
aatcgcagattcactttcgtttcct

SEQ ID NO: 79496 - DNA, 25 bp, S. pombe
aatgatgattcggagctttgggctg

SEQ ID NO: 79497 - DNA, 25 bp, S. pombe
aatgaaacctactggcaagctgttg

SEQ ID NO: 79498 - DNA, 25 bp, S. pombe
aatgacgacgttgccctacaatatg

SEQ ID NO: 79499 - DNA, 25 bp, S. pombe
gaacaggaacgaccccgatggagat

SEQ ID NO: 79500 - DNA, 25 bp, S. pombe
aatgggacgctatcccgaggatgta

SEQ ID NO: 79501 - DNA, 25 bp, S. pombe
aatggattcgtcttcgcaccggaaa

SEQ ID NO: 79502 - DNA, 25 bp, S. pombe
aatggctattgttcacgcaacggat

SEQ ID NO: 79503 - DNA, 25 bp, S. pombe
tacgcctacgtccaaaagtttccag

SEQ ID NO: 79504 - DNA, 25 bp, S. pombe
caatcgacagtccaccaaaaggtaa

SEQ ID NO: 79505 - DNA, 25 bp, S. pombe
aatggactgttgctcgtgctggtaa

SEQ ID NO: 79506 - DNA, 25 bp, S. pombe
aatggactgttgatccggcagctaa

SEQ ID NO: 79507 - DNA, 25 bp, S. pombe
aatgaagcttggaccgacgcacttg

SEQ ID NO: 79508 - DNA, 25 bp, S. pombe
aatggctacacctctatggcaaaat

SEQ ID NO: 79509 - DNA, 25 bp, S. pombe
aatggtgaaagatcgcacactcaaa

SEQ ID NO: 79510 - DNA, 25 bp, S. pombe
aatggatttcaccagtttgcggtct

SEQ ID NO: 79511 - DNA, 25 bp, S. pombe
aatggatatctcaatcgtcctgaag

SEQ ID NO: 79512 - DNA, 25 bp, S. pombe
aatggctgttgcatctgacttggaa

SEQ ID NO: 79513 - DNA, 25 bp, S. pombe
aatccgctatcgtccgtatcatgaa

SEQ ID NO: 79514 - DNA, 25 bp, S. pombe
aatgcgtgcattgaacgatgtcgtt

SEQ ID NO: 79515 - DNA, 25 bp, S. pombe
aatgcgtggatcgaagtactttcta

SEQ ID NO: 79516 - DNA, 25 bp, S. pombe
aatggttctacatttctggctctcc

SEQ ID NO: 79517 - DNA, 25 bp, S. pombe
aatgggtctccattgttagcttgtg

SEQ ID NO: 79518 - DNA, 25 bp, S. pombe
aatggtgtccagcatttcagggcta

SEQ ID NO: 79519 - DNA, 25 bp, S. pombe
aatgtggaccaaatttcgcaagcta

SEQ ID NO: 79520 - DNA, 25 bp, S. pombe
aatgtggatgagtgtcttcgcggct

SEQ ID NO: 79521 - DNA, 25 bp, S. pombe
aatgtcattccttttcaacttctaa

SEQ ID NO: 79522 - DNA, 25 bp, S. pombe
aatgtcgcgcgtgcggaaattctaa

SEQ ID NO: 79523 - DNA, 25 bp, S. pombe
aatgggccgatgtcgataccgccga

SEQ ID NO: 79524 - DNA, 25 bp, S. pombe
aatgtatgcacttgttcctcattcc

SEQ ID NO: 79525 - DNA, 25 bp, S. pombe
aatgttagtagctcttcatcctctc

SEQ ID NO: 79526 - DNA, 25 bp, S. pombe
aatgttttggcaacttctcgtcttt

SEQ ID NO: 79527 - DNA, 25 bp, S. pombe
aatggtcctccactcgtgtcaatgt

SEQ ID NO: 79528 - DNA, 25 bp, S. pombe
aatgagtggctagattccttggatt

SEQ ID NO: 79529 - DNA, 25 bp, S. pombe
aatgtcgactagttccacttggatt

SEQ ID NO: 79530 - DNA, 25 bp, S. pombe
aatgtccgctattgaccgatgcagg

SEQ ID NO: 79531 - DNA, 25 bp, S. pombe
aatggcccttagttctgtgcatgaa

SEQ ID NO: 79532 - DNA, 25 bp, S. pombe
aatggccgctatattctttcaagag

SEQ ID NO: 79533 - DNA, 25 bp, S. pombe
aatggctctatcactgatgcgttac

SEQ ID NO: 79534 - DNA, 25 bp, S. pombe
aatggtttgtggtatgcgaatccgt

SEQ ID NO: 79535 - DNA, 25 bp, S. pombe
aatggtttacgaatggagtcctcct

SEQ ID NO: 79536 - DNA, 25 bp, S. pombe
aatggtttacaaatgccgcctatcc

SEQ ID NO: 79537 - DNA, 25 bp, S. pombe
aatctttaagaatccgccttcatcc

SEQ ID NO: 79538 - DNA, 25 bp, S. pombe
aatgcataaaactcccggtgacttt

SEQ ID NO: 79539 - DNA, 25 bp, S. pombe
aatgggcacaatccctctaatcatg

SEQ ID NO: 79540 - DNA, 25 bp, S. pombe
aatgggcaaatcctcctgttcagaa

SEQ ID NO: 79541 - DNA, 25 bp, S. pombe
aatggcgcaaatttgctcgcgtcaa

SEQ ID NO: 79542 - DNA, 25 bp, S. pombe
aatgaggaaggtgccgcgtcagtca

SEQ ID NO: 79543 - DNA, 25 bp, S. pombe
aatggtaatgttgcggatgctcctc

SEQ ID NO: 79544 - DNA, 25 bp, S. pombe
aatggaatattaccggtgctgcccc

SEQ ID NO: 79545 - DNA, 25 bp, S. pombe
aatggttgctcgacccatactggga

SEQ ID NO: 79546 - DNA, 25 bp, S. pombe
aatgttactgcaaaccctggcgaga

SEQ ID NO: 79547 - DNA, 25 bp, S. pombe
aatgtgtctgccacaccgtggagaa

SEQ ID NO: 79548 - DNA, 25 bp, S. pombe
aatggctatgcctcaatcgtacagt

SEQ ID NO: 79549 - DNA, 25 bp, S. pombe
aatggcaccatctcacaattacagg

SEQ ID NO: 79550 - DNA, 25 bp, S. pombe
aatgaggctcgtgctaaggatgctg

SEQ ID NO: 79551 - DNA, 25 bp, S. pombe
aatggagctcttctgacatggcatc

SEQ ID NO: 79552 - DNA, 25 bp, S. pombe
aatggttcgctgcttgagctgtgaa

SEQ ID NO: 79553 - DNA, 25 bp, S. pombe
aatggctttttttggctgtgtggtg

SEQ ID NO: 79554 - DNA, 25 bp, S. pombe
aatgtctacctttggttaggtgcaa

SEQ ID NO: 79555 - DNA, 25 bp, S. pombe
aatgtaactcttgttctcagcggca

SEQ ID NO: 79556 - DNA, 25 bp, S. pombe
aatggacaatttttctctccctgca

SEQ ID NO: 79557 - DNA, 25 bp, S. pombe
aatggataccctacagctttacaaa

SEQ ID NO: 79558 - DNA, 25 bp, S. pombe
aatggctgcttataatgcttctaaa

SEQ ID NO: 79559 - DNA, 25 bp, S. pombe
aatggctcttggtacactttgcact

SEQ ID NO: 79560 - DNA, 25 bp, S. pombe
aatgtcattggtactcaaccccatg

SEQ ID NO: 79561 - DNA, 25 bp, S. pombe
aatgtttggtgcacatgaccccgag

SEQ ID NO: 79562 - DNA, 25 bp, S. pombe
aatggtcgtattagcatctccggtc

SEQ ID NO: 79563 - DNA, 25 bp, S. pombe
aatggttgatttcccttcaagtcga

SEQ ID NO: 79564 - DNA, 25 bp, S. pombe
aatgttggattctcctgttactccc

SEQ ID NO: 79565 - DNA, 25 bp, S. pombe
aatgttggttcgtcgtgatcgcaga

SEQ ID NO: 79566 - DNA, 25 bp, S. pombe
aatgattgagtcttcacgtgccagc

SEQ ID NO: 79567 - DNA, 25 bp, S. pombe
aatggaagcatattcgcatccgccc

SEQ ID NO: 79568 - DNA, 25 bp, S. pombe
aatggcttttatgggtatcgcggct

SEQ ID NO: 79569 - DNA, 25 bp, S. pombe
aatggtgtgctattaatttccccgt

SEQ ID NO: 79570 - DNA, 25 bp, S. pombe
aatgtggtcataccaaccaactccg

SEQ ID NO: 79571 - DNA, 25 bp, S. pombe
aatggtgttcagctcatccaaaccg

SEQ ID NO: 79572 - DNA, 25 bp, S. pombe
aatggatgtgtctcttcgcaaacgg

SEQ ID NO: 79573 - DNA, 25 bp, S. pombe
aatggatcgcatttctgctcaaaaa

SEQ ID NO: 79574 - DNA, 25 bp, S. pombe
aatggattggtgactgcagctcaga

SEQ ID NO: 79575 - DNA, 25 bp, S. pombe
aatggattgcattgtctcgcacaga

SEQ ID NO: 79576 - DNA, 25 bp, S. pombe
aatggagtcagcttatgaaccgcat

SEQ ID NO: 79577 - DNA, 25 bp, S. pombe
aatggcttcaccttggacactgata

SEQ ID NO: 79578 - DNA, 25 bp, S. pombe
aatggctttctgctggatttgatat

SEQ ID NO: 79579 - DNA, 25 bp, S. pombe
aatggtattcttagagaggcagctc

SEQ ID NO: 79580 - DNA, 25 bp, S. pombe
aatggttacttacgcagccctaagg

SEQ ID NO: 79581 - DNA, 25 bp, S. pombe
aatggttattttcgcagacctgcag

SEQ ID NO: 79582 - DNA, 25 bp, S. pombe
aatgatgtattttacgcgaccgtgc

SEQ ID NO: 79583 - DNA, 25 bp, S. pombe
aatgttctttctgcagttctagctg

SEQ ID NO: 79584 - DNA, 25 bp, S. pombe
aatgtgttcgtctctggtcttcgtc

SEQ ID NO: 79585 - DNA, 25 bp, S. pombe
aatgtgttcgtcttgctcgatttga

SEQ ID NO: 79586 - DNA, 25 bp, S. pombe
aatgtttcgactaacctgtacgtga

SEQ ID NO: 79587 - DNA, 25 bp, S. pombe
aatccttgccagtgaacgaccgtat

SEQ ID NO: 79588 - DNA, 25 bp, S. pombe
aatgtgaatatctcgccagcagtat

SEQ ID NO: 79589 - DNA, 25 bp, S. pombe
aatggacatgtctacagtcgctgaa

SEQ ID NO: 79590 - DNA, 25 bp, S. pombe
aatggaatgcgctgttctcatgaac

SEQ ID NO: 79591 - DNA, 25 bp, S. pombe
aatggacacacctttattgactgaa

SEQ ID NO: 79592 - DNA, 25 bp, S. pombe
aatggaactcctcgtacttcaattc

SEQ ID NO: 79593 - DNA, 25 bp, S. pombe
aatggacctccgatcaactgaattc

SEQ ID NO: 79594 - DNA, 25 bp, S. pombe
aatgggcttcctctaatatgcaatg

SEQ ID NO: 79595 - DNA, 25 bp, S. pombe
aatggtgccggagatgcctttgctg

SEQ ID NO: 79596 - DNA, 25 bp, S. pombe
aatggagctttgacggatcttgagt

SEQ ID NO: 79597 - DNA, 25 bp, S. pombe
aatgatgactactcggctgttgggt

SEQ ID NO: 79598 - DNA, 25 bp, S. pombe
aatgataggctacatggctccccaa

SEQ ID NO: 79599 - DNA, 25 bp, S. pombe
aatggatggctgtcttttcactcta

SEQ ID NO: 79600 - DNA, 25 bp, S. pombe
aatgagccgtattggtttacctatg

SEQ ID NO: 79601 - DNA, 25 bp, S. pombe
aatgagctgagtgatcctttacctg

SEQ ID NO: 79602 - DNA, 25 bp, S. pombe
aatgagccagtgagccttgaaagtc

SEQ ID NO: 79603 - DNA, 25 bp, S. pombe
aatgtgcacggtactttgactcgtc

SEQ ID NO: 79604 - DNA, 25 bp, S. pombe
aatcgcacaacttcgtggactggta

SEQ ID NO: 79605 - DNA, 25 bp, S. pombe
aatggacatcccaggcgatgctaat

SEQ ID NO: 79606 - DNA, 25 bp, S. pombe
aatgcaacccgtcgacgcagtagat

SEQ ID NO: 79607 - DNA, 25 bp, S. pombe
aatgatgatgcccaagctagccgta

SEQ ID NO: 79608 - DNA, 25 bp, S. pombe
aatgtgattcatcgtgccagtcgtc

SEQ ID NO: 79609 - DNA, 25 bp, S. pombe
aatgttgatagagctgcaccgtcgc

SEQ ID NO: 79610 - DNA, 25 bp, S. pombe
aatgttgattgatcgtcccatccta

SEQ ID NO: 79611 - DNA, 25 bp, S. pombe
aatggaccgaagacttccagcctag

SEQ ID NO: 79612 - DNA, 25 bp, S. pombe
aatggttctgcaaaggtccagccta

SEQ ID NO: 79613 - DNA, 25 bp, S. pombe
aatgacttgccaaaggtatcaccta

SEQ ID NO: 79614 - DNA, 25 bp, S. pombe
aatgctttgatgaaaccgccgcacc

SEQ ID NO: 79615 - DNA, 25 bp, S. pombe
aatgtttaattctgcgcttgaccga

SEQ ID NO: 79616 - DNA, 25 bp, S. pombe
aatgtttgtttatggctctacgccg

SEQ ID NO: 79617 - DNA, 25 bp, S. pombe
aatgacgttctttctggcttacagc

SEQ ID NO: 79618 - DNA, 25 bp, S. pombe
aatgcacagttctttcgagctttag

SEQ ID NO: 79619 - DNA, 25 bp, S. pombe
aatgacgatgtcttcagccttgtta

SEQ ID NO: 79620 - DNA, 25 bp, S. pombe
aatggtcatatcttctcttttctaa

SEQ ID NO: 79621 - DNA, 25 bp, S. pombe
aatgattgctaatgcagctcaacaa

SEQ ID NO: 79622 - DNA, 25 bp, S. pombe
aatgtgttgattgatccctcagcaa

SEQ ID NO: 79623 - DNA, 25 bp, S. pombe
aatgtcgggataattgcgctaacgc

SEQ ID NO: 79624 - DNA, 25 bp, S. pombe
aatgactcggatgcttcactagatg

SEQ ID NO: 79625 - DNA, 25 bp, S. pombe
aatgaagttgatatccctcgcgagc

SEQ ID NO: 79626 - DNA, 25 bp, S. pombe
aatgggttcgttccatcactctttg

SEQ ID NO: 79627 - DNA, 25 bp, S. pombe
aatggttttgtttgagctgttgcac

SEQ ID NO: 79628 - DNA, 25 bp, S. pombe
aatggtgttttgactgtttcagccg

SEQ ID NO: 79629 - DNA, 25 bp, S. pombe
aatgagactcatttccgtttagaaa

SEQ ID NO: 79630 - DNA, 25 bp, S. pombe
aatgattcgtctatctgaggcccat

SEQ ID NO: 79631 - DNA, 25 bp, S. pombe
aatgttcctctaggtaggctggctt

SEQ ID NO: 79632 - DNA, 25 bp, S. pombe
aatgatgtcgttcttctttctcttg

SEQ ID NO: 79633 - DNA, 25 bp, S. pombe
aatgtgtatgttattcgttacttgg

SEQ ID NO: 79634 - DNA, 25 bp, S. pombe
aatggtgttcacaagtctgttgtca

SEQ ID NO: 79635 - DNA, 25 bp, S. pombe
aatgtttgtcattcagttgcttgat

SEQ ID NO: 79636 - DNA, 25 bp, S. pombe
aatgtcactgtcctcggtcgtaaat

SEQ ID NO: 79637 - DNA, 25 bp, S. pombe
aatgtgattgtatccctagtagatt

SEQ ID NO: 79638 - DNA, 25 bp, S. pombe
aatggtggtttcagttattcttcct

SEQ ID NO: 79639 - DNA, 25 bp, S. pombe
aatgtcgcttttatgttttcctcct

SEQ ID NO: 79640 - DNA, 25 bp, S. pombe
aatgttcgtcctaaactgtttgcct

SEQ ID NO: 79641 - DNA, 25 bp, S. pombe
aatgtttctccttatacttatcccg

SEQ ID NO: 79642 - DNA, 25 bp, S. pombe
aatgctaacccttacatgcttacgt

SEQ ID NO: 79643 - DNA, 25 bp, S. pombe
aatgtgtcggtattttctagccctt

SEQ ID NO: 79644 - DNA, 25 bp, S. pombe
aatggtggtgttttatcggcagtct

SEQ ID NO: 79645 - DNA, 25 bp, S. pombe
aatggtcgtatttctatggctggtt

SEQ ID NO: 79646 - DNA, 25 bp, S. pombe
aatgccgccaaagactctactgaac

SEQ ID NO: 79647 - DNA, 25 bp, S. pombe
aatgccaacgaatcattccctgagc

SEQ ID NO: 79648 - DNA, 25 bp, S. pombe
aatccaaatggatcgtcttctgccc

SEQ ID NO: 79649 - DNA, 25 bp, S. pombe
aatgacaaccacaagagcactatta

SEQ ID NO: 79650 - DNA, 25 bp, S. pombe
aatgatcagacctcagctcaatcgt

SEQ ID NO: 79651 - DNA, 25 bp, S. pombe
aatcctagtattgcacctggtcgtg

SEQ ID NO: 79652 - DNA, 25 bp, S. pombe
aatcctatgtgatcaaattgagtta

SEQ ID NO: 79653 - DNA, 25 bp, S. pombe
aatcgtatgccgacagcaatgctag

SEQ ID NO: 79654 - DNA, 25 bp, S. pombe
aatgaatcaggctcagttctcgaat

SEQ ID NO: 79655 - DNA, 25 bp, S. pombe
aatggtgatgccttggtcatccgaa

SEQ ID NO: 79656 - DNA, 25 bp, S. pombe
aatgtcgagcgattgatttcccttt

SEQ ID NO: 79657 - DNA, 25 bp, S. pombe
aatgtccaaatcatcattcccgttc

SEQ ID NO: 79658 - DNA, 25 bp, S. pombe
aatgtgaatcccttcgctacaagct

SEQ ID NO: 79659 - DNA, 25 bp, S. pombe
aatgaccttccgatgcatatgcagc

SEQ ID NO: 79660 - DNA, 25 bp, S. pombe
aatgtcagcgtcttcaatatttcaa

SEQ ID NO: 79661 - DNA, 25 bp, S. pombe
aatgaccgttatgcaagctatccat

SEQ ID NO: 79662 - DNA, 25 bp, S. pombe
aatgcatccggttccaaaatttctg

SEQ ID NO: 79663 - DNA, 25 bp, S. pombe
aatgtccgcagctcgtaaggttgct

SEQ ID NO: 79664 - DNA, 25 bp, S. pombe
aatctcgttccgctaaggctggttt

SEQ ID NO: 79665 - DNA, 25 bp, S. pombe
ctaccgtttctgacataagtccctt

SEQ ID NO: 79666 - DNA, 25 bp, S. pombe
catacccgtacctgaagttcaaaca

SEQ ID NO: 79667 - DNA, 25 bp, S. pombe
aatgtcccaatctccagtaattatt

SEQ ID NO: 79668 - DNA, 25 bp, S. pombe
aatgtttggaattggctctgcagaa

SEQ ID NO: 79669 - DNA, 25 bp, S. pombe
aatgatttaaagcactccatgaaag

SEQ ID NO: 79670 - DNA, 25 bp, S. pombe
aatgttggcaactggctcttgggac

SEQ ID NO: 79671 - DNA, 25 bp, S. pombe
aatgtgatagtaatgggcgccccta

SEQ ID NO: 79672 - DNA, 25 bp, S. pombe
aatgattgctggattgggtgatgcc

SEQ ID NO: 79673 - DNA, 25 bp, S. pombe
aatgttcgacaactcgctcagactg

SEQ ID NO: 79674 - DNA, 25 bp, S. pombe
aatgtttgaaatacctcgctctcct

SEQ ID NO: 79675 - DNA, 25 bp, S. pombe
aatgctttcaaatccatggtaccta

SEQ ID NO: 79676 - DNA, 25 bp, S. pombe
aatgactatcctcaacaagctcgtt

SEQ ID NO: 79677 - DNA, 25 bp, S. pombe
aatgttacactcgaagacgttgatt

SEQ ID NO: 79678 - DNA, 25 bp, S. pombe
aatcctacggcaatacaaattactg

SEQ ID NO: 79679 - DNA, 25 bp, S. pombe
aattaagcgtgcacacgggtacagt

SEQ ID NO: 79680 - DNA, 25 bp, S. pombe
aatagcaccgatggcgttaatcaag

SEQ ID NO: 79681 - DNA, 25 bp, S. pombe
aatgcagcaattttcccctcaatat

SEQ ID NO: 79682 - DNA, 25 bp, S. pombe
aatgccgcattctcctcgaaatagt

SEQ ID NO: 79683 - DNA, 25 bp, S. pombe
aatgaaccagtcttctaaagcagat

SEQ ID NO: 79684 - DNA, 25 bp, S. pombe
aatgagtctcgtcgtgtgacccagt

SEQ ID NO: 79685 - DNA, 25 bp, S. pombe
aatgatgcctctgcctgttctgaag

SEQ ID NO: 79686 - DNA, 25 bp, S. pombe
aatgatgacttaccttcctgatgag

SEQ ID NO: 79687 - DNA, 25 bp, S. pombe
aatgggtattcctcatatcgtcgtt

SEQ ID NO: 79688 - DNA, 25 bp, S. pombe
aatgggtttcatcgatttcttggta

SEQ ID NO: 79689 - DNA, 25 bp, S. pombe
aatcggtattcgtcatgttttggga

SEQ ID NO: 79690 - DNA, 25 bp, S. pombe
aatcgtgtagttgcatgcctcggcg

SEQ ID NO: 79691 - DNA, 25 bp, S. pombe
aatgtttggttggatgcatcccgtc

SEQ ID NO: 79692 - DNA, 25 bp, S. pombe
aatgactcgcattcaatggctacta

SEQ ID NO: 79693 - DNA, 25 bp, S. pombe
aatgtcatcgtctttggcttgtgca

SEQ ID NO: 79694 - DNA, 25 bp, S. pombe
aatgtcagttgtgtggtccttctta

SEQ ID NO: 79695 - DNA, 25 bp, S. pombe
aatgtacattggttgggctgcttat

SEQ ID NO: 79696 - DNA, 25 bp, S. pombe
aatgtgacttgttccgattcttcaa

SEQ ID NO: 79697 - DNA, 25 bp, S. pombe
aatgagacacttttcgttgcttatc

SEQ ID NO: 79698 - DNA, 25 bp, S. pombe
aatgtctctacagagtttcctgaag

SEQ ID NO: 79699 - DNA, 25 bp, S. pombe
aatgcatcttgactggcgatttccg

SEQ ID NO: 79700 - DNA, 25 bp, S. pombe
aatgccttcaatcccagtgattcag

SEQ ID NO: 79701 - DNA, 25 bp, S. pombe
aatgtgtttactgttgagcctggaa

SEQ ID NO: 79702 - DNA, 25 bp, S. pombe
aatgtgttattgtcctttgccatgg

SEQ ID NO: 79703 - DNA, 25 bp, S. pombe
aatgtccatttatttctcctatata

SEQ ID NO: 79704 - DNA, 25 bp, S. pombe
aatgcctttgaaaccgctttacatg

SEQ ID NO: 79705 - DNA, 25 bp, S. pombe
aatgttcctacaactcatgtcttac

SEQ ID NO: 79706 - DNA, 25 bp, S. pombe
aatgtttattttccgagagcagctc

SEQ ID NO: 79707 - DNA, 25 bp, S. pombe
aatgaggatgttttcccggactcaa

SEQ ID NO: 79708 - DNA, 25 bp, S. pombe
aatgagtattttacagccggcccag

SEQ ID NO: 79709 - DNA, 25 bp, S. pombe
aatgtctggcgcgatttttatgctg

SEQ ID NO: 79710 - DNA, 25 bp, S. pombe
aatgctcccgcaataatgtttcacc

SEQ ID NO: 79711 - DNA, 25 bp, S. pombe
aatgactcacacgtttcaaatggcg

SEQ ID NO: 79712 - DNA, 25 bp, S. pombe
aatgattgacactttctctactgaa

SEQ ID NO: 79713 - DNA, 25 bp, S. pombe
aatgtctcagactttgcatcgcaaa

SEQ ID NO: 79714 - DNA, 25 bp, S. pombe
aatgatgctgagtctcccagtgata

SEQ ID NO: 79715 - DNA, 25 bp, S. pombe
aatgactcgtctatggtgcaaggta

SEQ ID NO: 79716 - DNA, 25 bp, S. pombe
caactattgccctcactggaagtaa

SEQ ID NO: 79717 - DNA, 25 bp, S. pombe
aatgttcctgctggatacggaccaa

SEQ ID NO: 79718 - DNA, 25 bp, S. pombe
aatgatcatgccatgtggaccacct

SEQ ID NO: 79719 - DNA, 25 bp, S. pombe
aatgaatgccgccttagctagcatc

SEQ ID NO: 79720 - DNA, 25 bp, S. pombe
aatgaacttgcacctggcgatcaac

SEQ ID NO: 79721 - DNA, 25 bp, S. pombe
aatgatcgctatcggcatcgagata

SEQ ID NO: 79722 - DNA, 25 bp, S. pombe
aatgcatcttcgcaacgttgttgag

SEQ ID NO: 79723 - DNA, 25 bp, S. pombe
aatgatttcggtgctgctttttcca

SEQ ID NO: 79724 - DNA, 25 bp, S. pombe
aatgaatggcgttcctcctatgtat

SEQ ID NO: 79725 - DNA, 25 bp, S. pombe
aatgagcaagatggccgtcgatttt

SEQ ID NO: 79726 - DNA, 25 bp, S. pombe
aatgagccaacgtctgcgaattctg

SEQ ID NO: 79727 - DNA, 25 bp, S. pombe
aatgtctctgctagttcgtcggtga

SEQ ID NO: 79728 - DNA, 25 bp, S. pombe
aatgtttgccatccttgcaggtagt

SEQ ID NO: 79729 - DNA, 25 bp, S. pombe
aatgttgacgactcatcttcagtaa

SEQ ID NO: 79730 - DNA, 25 bp, S. pombe
aatgttatcactcctgagcttgctc

SEQ ID NO: 79731 - DNA, 25 bp, S. pombe
aatgttgctgcacgcgggttagata

SEQ ID NO: 79732 - DNA, 25 bp, S. pombe
aatgcatgtcatttgggttccagat

SEQ ID NO: 79733 - DNA, 25 bp, S. pombe
aatgtttttggcattcggtgctaga

SEQ ID NO: 79734 - DNA, 25 bp, S. pombe
aatgattttcgtgcttcctttgaga

SEQ ID NO: 79735 - DNA, 25 bp, S. pombe
aatgttagtggtgccctttctagac

SEQ ID NO: 79736 - DNA, 25 bp, S. pombe
aatgttttggttcagcttccggatc

SEQ ID NO: 79737 - DNA, 25 bp, S. pombe
aatgttttgttgttgcctatgggcc

SEQ ID NO: 79738 - DNA, 25 bp, S. pombe
aatcgttccaagctttgttttaatg

SEQ ID NO: 79739 - DNA, 25 bp, S. pombe
aatcgactccaagcgtaagtgttga

SEQ ID NO: 79740 - DNA, 25 bp, S. pombe
aatgcgtaccaatcgtggacgtgga

SEQ ID NO: 79741 - DNA, 25 bp, S. pombe
aatgcttacatcgtccttggaaagg

SEQ ID NO: 79742 - DNA, 25 bp, S. pombe
aatgacttccatggctactgctaca

SEQ ID NO: 79743 - DNA, 25 bp, S. pombe
aatgattcatccacttcgtgagctc

SEQ ID NO: 79744 - DNA, 25 bp, S. pombe
aatgttgcttatactgccaccgaga

SEQ ID NO: 79745 - DNA, 25 bp, S. pombe
aatgcaccatttttatccagacgtt

SEQ ID NO: 79746 - DNA, 25 bp, S. pombe
aatgactatgtacctcactaccgtt

SEQ ID NO: 79747 - DNA, 25 bp, S. pombe
gaaacttttcccattcgttatcgca

SEQ ID NO: 79748 - DNA, 25 bp, S. pombe
aatccttttccgattcgcaattcga

SEQ ID NO: 79749 - DNA, 25 bp, S. pombe
gacccttttcggcattcataatctg

SEQ ID NO: 79750 - DNA, 25 bp, S. pombe
tgaaccccggagctaaaacttggat

SEQ ID NO: 79751 - DNA, 25 bp, S. pombe
aatgtaaccacaactccaaactcta

SEQ ID NO: 79752 - DNA, 25 bp, S. pombe
aatgtacggctggtttgaagactta

SEQ ID NO: 79753 - DNA, 25 bp, S. pombe
aatgaaccagtgcttcagggtctat

SEQ ID NO: 79754 - DNA, 25 bp, S. pombe
aatgcaacttggtttcacggttctc

SEQ ID NO: 79755 - DNA, 25 bp, S. pombe
aatgctccatggctagatccgtttt

SEQ ID NO: 79756 - DNA, 25 bp, S. pombe
aatgattctgtctcgattcgtttct

SEQ ID NO: 79757 - DNA, 25 bp, S. pombe
aatgcttctgtctccattattttcc

SEQ ID NO: 79758 - DNA, 25 bp, S. pombe
aatgcattggcgcataccaggacaa

SEQ ID NO: 79759 - DNA, 25 bp, S. pombe
aatgcattttccagagacgagttgt

SEQ ID NO: 79760 - DNA, 25 bp, S. pombe
aatcagcgatttccggtagcagtca

SEQ ID NO: 79761 - DNA, 25 bp, S. pombe
aatgcatgcagtgtccgatggtgaa

SEQ ID NO: 79762 - DNA, 25 bp, S. pombe
aatgcactgtacatatgccgtggaa

SEQ ID NO: 79763 - DNA, 25 bp, S. pombe
aatgaccagcaaatcggacagttgt

SEQ ID NO: 79764 - DNA, 25 bp, S. pombe
aatgctcccaaaagtgtcgatgtga

SEQ ID NO: 79765 - DNA, 25 bp, S. pombe
aatgatgcagatcgacctttccagg

SEQ ID NO: 79766 - DNA, 25 bp, S. pombe
aatgacgatccaccgttacaagcta

SEQ ID NO: 79767 - DNA, 25 bp, S. pombe
aatgatttcagtttggtccttgcta

SEQ ID NO: 79768 - DNA, 25 bp, S. pombe
aatgttgatcaatgctttacttcca

SEQ ID NO: 79769 - DNA, 25 bp, S. pombe
aatcgaagcccctttagatactaag

SEQ ID NO: 79770 - DNA, 25 bp, S. pombe
aatgttgctccttctatgttggttg

SEQ ID NO: 79771 - DNA, 25 bp, S. pombe
aatgttgctgcagacgctattcgtg

SEQ ID NO: 79772 - DNA, 25 bp, S. pombe
aatgattcctattcctttcgtgcta

SEQ ID NO: 79773 - DNA, 25 bp, S. pombe
aatgattcacttcccaatttggttc

SEQ ID NO: 79774 - DNA, 25 bp, S. pombe
aatgaatctcatatcccacgtggat

SEQ ID NO: 79775 - DNA, 25 bp, S. pombe
aatgatgacttcatgccacctggtt

SEQ ID NO: 79776 - DNA, 25 bp, S. pombe
aatgttgatttaactttcgtcgagt

SEQ ID NO: 79777 - DNA, 25 bp, S. pombe
aatgttctcaattctttatctcaag

SEQ ID NO: 79778 - DNA, 25 bp, S. pombe
aatgttcctttgtctaatctccagt

SEQ ID NO: 79779 - DNA, 25 bp, S. pombe
aatgttttgatgttgtcgttgcccc

SEQ ID NO: 79780 - DNA, 25 bp, S. pombe
aatgaccttgtttacgattctccca

SEQ ID NO: 79781 - DNA, 25 bp, S. pombe
aatgttgctattgtgatctcaggat

SEQ ID NO: 79782 - DNA, 25 bp, S. pombe
aatgcttaagacactcagggaggct

SEQ ID NO: 79783 - DNA, 25 bp, S. pombe
aatgaacattcctccagtgtgggcc

SEQ ID NO: 79784 - DNA, 25 bp, S. pombe
aatgcaagctataactctcgcggcg

SEQ ID NO: 79785 - DNA, 25 bp, S. pombe
cttctcaagaaacagccttcgacac

SEQ ID NO: 79786 - DNA, 25 bp, S. pombe
cttccggaaacattactggcctaca

SEQ ID NO: 79787 - DNA, 25 bp, S. pombe
aatgcccaacgggtaagcgcatcaa

SEQ ID NO: 79788 - DNA, 25 bp, S. pombe
aatgcgtgcatctggcttgaagccc

SEQ ID NO: 79789 - DNA, 25 bp, S. pombe
aatgcacatcttgccaaatgcgcag

SEQ ID NO: 79790 - DNA, 25 bp, S. pombe
aatgaccttggcaaagctcttcctt

SEQ ID NO: 79791 - DNA, 25 bp, S. pombe
aatgtttctgctcgcaagcgtgttg

SEQ ID NO: 79792 - DNA, 25 bp, S. pombe
aatgtttctgcatgcgcatttgcat

SEQ ID NO: 79793 - DNA, 25 bp, S. pombe
aatgctgttctgtcgatgattgtac

SEQ ID NO: 79794 - DNA, 25 bp, S. pombe
aatgttcctgacgatgttctgattc

SEQ ID NO: 79795 - DNA, 25 bp, S. pombe
aatgctgcttatgacttggccgata

SEQ ID NO: 79796 - DNA, 25 bp, S. pombe
aatgctatttcccttcagcaacttg

SEQ ID NO: 79797 - DNA, 25 bp, S. pombe
aatgattttccgctatgtctccgat

SEQ ID NO: 79798 - DNA, 25 bp, S. pombe
aatgatttatcaccggttgtccgaa

SEQ ID NO: 79799 - DNA, 25 bp, S. pombe
aatgttggatcaccgtttagcacaa

SEQ ID NO: 79800 - DNA, 25 bp, S. pombe
aatgcattgggctgtttcgcgccaa

SEQ ID NO: 79801 - DNA, 25 bp, S. pombe
aatgcaagccagttgatcacccagc

SEQ ID NO: 79802 - DNA, 25 bp, S. pombe
aatccttctgaaacgcacaacacta

SEQ ID NO: 79803 - DNA, 25 bp, S. pombe
aatccctgccataaaggcttcttta

SEQ ID NO: 79804 - DNA, 25 bp, S. pombe
aatgattatttccatcctcttgccg

SEQ ID NO: 79805 - DNA, 25 bp, S. pombe
aatgattgatgcgtttcctcttcgt

SEQ ID NO: 79806 - DNA, 25 bp, S. pombe
aatgattgatgctattcgtcgtcgc

SEQ ID NO: 79807 - DNA, 25 bp, S. pombe
aatgatggcagctttgcttcgcatt

SEQ ID NO: 79808 - DNA, 25 bp, S. pombe
aatgcatcagcagttttcccagcaa

SEQ ID NO: 79809 - DNA, 25 bp, S. pombe
aatcccgcaaacgtggcttgtggta

SEQ ID NO: 79810 - DNA, 25 bp, S. pombe
aatcctcgtaaggttgcttggacca

SEQ ID NO: 79811 - DNA, 25 bp, S. pombe
aatactggactagacccgcttcgaa

SEQ ID NO: 79812 - DNA, 25 bp, S. pombe
aatgaattatttatctcaagatcta

SEQ ID NO: 79813 - DNA, 25 bp, S. pombe
aatgaacgtttaccgccatctaata

SEQ ID NO: 79814 - DNA, 25 bp, S. pombe
aatgatacgtattcagctccccaat

SEQ ID NO: 79815 - DNA, 25 bp, S. pombe
aatgaaagattctccctctgcacat

SEQ ID NO: 79816 - DNA, 25 bp, S. pombe
aatgctacacaacctgctcgtcaat

SEQ ID NO: 79817 - DNA, 25 bp, S. pombe
aatgcacaacaacttgagcttttga

SEQ ID NO: 79818 - DNA, 25 bp, S. pombe
aatgagcttcattcggcagttttga

SEQ ID NO: 79819 - DNA, 25 bp, S. pombe
aatgcattatccttgggcttggtag

SEQ ID NO: 79820 - DNA, 25 bp, S. pombe
aatgttgctcatctagttgggctag

SEQ ID NO: 79821 - DNA, 25 bp, S. pombe
aatgttgcttcacatggcgttcagg

SEQ ID NO: 79822 - DNA, 25 bp, S. pombe
aatgcttcatgcgattggttccaca

SEQ ID NO: 79823 - DNA, 25 bp, S. pombe
aatgatattcctacttcgcttcaaa

SEQ ID NO: 79824 - DNA, 25 bp, S. pombe
aatgcttggctttggctttggtgta

SEQ ID NO: 79825 - DNA, 25 bp, S. pombe
aatcctgggtccctttgataggaat

SEQ ID NO: 79826 - DNA, 25 bp, S. pombe
aatccttctgattctcaacgtagtg

SEQ ID NO: 79827 - DNA, 25 bp, S. pombe
aatcttccttccgaaactgtcttat

SEQ ID NO: 79828 - DNA, 25 bp, S. pombe
aatctaaccatcctaaacttcctgt

SEQ ID NO: 79829 - DNA, 25 bp, S. pombe
aattccacccgctcaattttttgag

SEQ ID NO: 79830 - DNA, 25 bp, S. pombe
aatgcaaatgctctcccttatttac

SEQ ID NO: 79831 - DNA, 25 bp, S. pombe
aatgaattctccactgcttatgttg

SEQ ID NO: 79832 - DNA, 25 bp, S. pombe
aatgaagacgccactattctgttgc

SEQ ID NO: 79833 - DNA, 25 bp, S. pombe
aatgaagctgccatcgattcctgct

SEQ ID NO: 79834 - DNA, 25 bp, S. pombe
aatgcaggcctcatggagtactgat

SEQ ID NO: 79835 - DNA, 25 bp, S. pombe
aatctggctcgcatgggtagtcatt

SEQ ID NO: 79836 - DNA, 25 bp, S. pombe
aatgaggctctctttgcttagatct

SEQ ID NO: 79837 - DNA, 25 bp, S. pombe
aatgatggctcttaccttgataatg

SEQ ID NO: 79838 - DNA, 25 bp, S. pombe
aatgaagctcatctccttgtgacat

SEQ ID NO: 79839 - DNA, 25 bp, S. pombe
aatgaagcaccttcgagttttcgaa

SEQ ID NO: 79840 - DNA, 25 bp, S. pombe
aatgaaatctattcggtattccgcc

SEQ ID NO: 79841 - DNA, 25 bp, S. pombe
aatgcaaaatcatccgtcttcctgg

SEQ ID NO: 79842 - DNA, 25 bp, S. pombe
aatgatatcaacacacctgcttctt

SEQ ID NO: 79843 - DNA, 25 bp, S. pombe
aatgatacgatctgtcctctttcta

SEQ ID NO: 79844 - DNA, 25 bp, S. pombe
aatgatctcgacagtcttgctgcta

SEQ ID NO: 79845 - DNA, 25 bp, S. pombe
aatgatgctcctatgtatcctcaac

SEQ ID NO: 79846 - DNA, 25 bp, S. pombe
aatgatccatctgttatcgtcaaga

SEQ ID NO: 79847 - DNA, 25 bp, S. pombe
aatgatgccgctgatataactgaaa

SEQ ID NO: 79848 - DNA, 25 bp, S. pombe
aatgatcctgatgttaacgtgctga

SEQ ID NO: 79849 - DNA, 25 bp, S. pombe
aatgcagtagcttttcctatcacta

SEQ ID NO: 79850 - DNA, 25 bp, S. pombe
aatgacgagtttcctactcctaagc

SEQ ID NO: 79851 - DNA, 25 bp, S. pombe
aatgatgggtattccgttccctcag

SEQ ID NO: 79852 - DNA, 25 bp, S. pombe
aatgccatctggcttgatccgaagc

SEQ ID NO: 79853 - DNA, 25 bp, S. pombe
aatgccatgatagagatgaccgaac

SEQ ID NO: 79854 - DNA, 25 bp, S. pombe
aatccagtactagtagcgctactcg

SEQ ID NO: 79855 - DNA, 25 bp, S. pombe
aatgctatatactgagcgcgctcac

SEQ ID NO: 79856 - DNA, 25 bp, S. pombe
aatgcatatatagctgccgctcttc

SEQ ID NO: 79857 - DNA, 25 bp, S. pombe
aatgatgattcttccttctttcgat

SEQ ID NO: 79858 - DNA, 25 bp, S. pombe
aatgactcttcagctatttcctcaa

SEQ ID NO: 79859 - DNA, 25 bp, S. pombe
aatgcaccttcacctggttacaata

SEQ ID NO: 79860 - DNA, 25 bp, S. pombe
aatgatgccattgactcctttaaat

SEQ ID NO: 79861 - DNA, 25 bp, S. pombe
aatgatcactatgcacgcctggatt

SEQ ID NO: 79862 - DNA, 25 bp, S. pombe
aatgcgtagagtccatggctcggct

SEQ ID NO: 79863 - DNA, 25 bp, S. pombe
aatgcgtagattttgtgctgctgcg

SEQ ID NO: 79864 - DNA, 25 bp, S. pombe
aatgctgattgcagatgcgtccctg

SEQ ID NO: 79865 - DNA, 25 bp, S. pombe
aatgctatttctcttaccgctgact

SEQ ID NO: 79866 - DNA, 25 bp, S. pombe
aatgctgatatcgtcgttaccgaca

SEQ ID NO: 79867 - DNA, 25 bp, S. pombe
aatgcatttatgtcgactacgcaaa

SEQ ID NO: 79868 - DNA, 25 bp, S. pombe
aatgatcctgtcgtgagtaccaata

SEQ ID NO: 79869 - DNA, 25 bp, S. pombe
aatgctaccgatttccatgttttgg

SEQ ID NO: 79870 - DNA, 25 bp, S. pombe
aatgctcacagttctattcgttttg

SEQ ID NO: 79871 - DNA, 25 bp, S. pombe
aatccaatggctgcacttgctggta

SEQ ID NO: 79872 - DNA, 25 bp, S. pombe
aatccacacgattggcctcaagtag

SEQ ID NO: 79873 - DNA, 25 bp, S. pombe
aatgccgctgaatctactgaagtag

SEQ ID NO: 79874 - DNA, 25 bp, S. pombe
aatgccgtcagctctacgagggaac

SEQ ID NO: 79875 - DNA, 25 bp, S. pombe
aatgacgcatcaggtcttgctagga

SEQ ID NO: 79876 - DNA, 25 bp, S. pombe
aatgagccgtcagatatctcactaa

SEQ ID NO: 79877 - DNA, 25 bp, S. pombe
aatgactcgcttgatcttgctaaaa

SEQ ID NO: 79878 - DNA, 25 bp, S. pombe
aatccgtgctaagagtggtgcagct

SEQ ID NO: 79879 - DNA, 25 bp, S. pombe
aatcctttggagtttgtgcatgcag

SEQ ID NO: 79880 - DNA, 25 bp, S. pombe
aatgctacgacttttggccttttgt

SEQ ID NO: 79881 - DNA, 25 bp, S. pombe
aatgctattggttgtatctcccgtt

SEQ ID NO: 79882 - DNA, 25 bp, S. pombe
aatgcgttggcgttttgccttcaat

SEQ ID NO: 79883 - DNA, 25 bp, S. pombe
aatgctacaccatatcttcgttctg

SEQ ID NO: 79884 - DNA, 25 bp, S. pombe
aatcttgcagactcacttcgtaatg

SEQ ID NO: 79885 - DNA, 25 bp, S. pombe
aatgcctctgaacttcttgttgggt

SEQ ID NO: 79886 - DNA, 25 bp, S. pombe
aatgccatgaagcatctcttgctga

SEQ ID NO: 79887 - DNA, 25 bp, S. pombe
aatcacttgtcctgaacttattccc

SEQ ID NO: 79888 - DNA, 25 bp, S. pombe
aatgcaatttcccagcatggctctt

SEQ ID NO: 79889 - DNA, 25 bp, S. pombe
aatgcaaaatccacatggcgcctgc

SEQ ID NO: 79890 - DNA, 25 bp, S. pombe
aatgaaccggctgatctcgtagtta

SEQ ID NO: 79891 - DNA, 25 bp, S. pombe
aatgaagccgggtcttcgtatgcca

SEQ ID NO: 79892 - DNA, 25 bp, S. pombe
aatgacccaggcgttttgattgaca

SEQ ID NO: 79893 - DNA, 25 bp, S. pombe
aatgccgccggtgatgttagtgaca

SEQ ID NO: 79894 - DNA, 25 bp, S. pombe
aatcctacggccatgactattgcgg

SEQ ID NO: 79895 - DNA, 25 bp, S. pombe
aatctcaaaaccctactactgtgca

SEQ ID NO: 79896 - DNA, 25 bp, S. pombe
aatccggaattggacctcctcctag

SEQ ID NO: 79897 - DNA, 25 bp, S. pombe
aatccgaaattgcatccttaaatag

SEQ ID NO: 79898 - DNA, 25 bp, S. pombe
aatcccaccttccaactagataatt

SEQ ID NO: 79899 - DNA, 25 bp, S. pombe
aatgctctacctgtggaatcgattt

SEQ ID NO: 79900 - DNA, 25 bp, S. pombe
aatgcatctacccaatctattcctt

SEQ ID NO: 79901 - DNA, 25 bp, S. pombe
aatcttgaaagcattaacggtgttg

SEQ ID NO: 79902 - DNA, 25 bp, S. pombe
aatcctggtcgcaagttactggttt

SEQ ID NO: 79903 - DNA, 25 bp, S. pombe
aatgcgcgatattccacttctaatg

SEQ ID NO: 79904 - DNA, 25 bp, S. pombe
aatcccgacatttcagacgttgacg

SEQ ID NO: 79905 - DNA, 25 bp, S. pombe
aatctcccaattcgcaacatttagc

SEQ ID NO: 79906 - DNA, 25 bp, S. pombe
aatgccatttcaaaagtgttctcga

SEQ ID NO: 79907 - DNA, 25 bp, S. pombe
caagccggtagcatcgttattcgac

SEQ ID NO: 79908 - DNA, 25 bp, S. pombe
cacccctgtacttcgttgtatggat

SEQ ID NO: 79909 - DNA, 25 bp, S. pombe
aatccttcaaccaggtatatcgatt

SEQ ID NO: 79910 - DNA, 25 bp, S. pombe
aatgctcttgaagccggtactgttt

SEQ ID NO: 79911 - DNA, 25 bp, S. pombe
aatgctgttaactgcgtccaacttt

SEQ ID NO: 79912 - DNA, 25 bp, S. pombe
aatgctctggaacgcgcagaatccc

SEQ ID NO: 79913 - DNA, 25 bp, S. pombe
aatgcaatggtccaaagcgccagag

SEQ ID NO: 79914 - DNA, 25 bp, S. pombe
aatgcatctttgtcaaacgctgaag

SEQ ID NO: 79915 - DNA, 25 bp, S. pombe
aatgctcttcttttggcagctgaca

SEQ ID NO: 79916 - DNA, 25 bp, S. pombe
aatgcctcatgtccaagggtttccg

SEQ ID NO: 79917 - DNA, 25 bp, S. pombe
aatgcctcggactggtatgtctgca

SEQ ID NO: 79918 - DNA, 25 bp, S. pombe
aatccagcggaactagtcagtctga

SEQ ID NO: 79919 - DNA, 25 bp, S. pombe
aatcttggccttacggacgaattag

SEQ ID NO: 79920 - DNA, 25 bp, S. pombe
aatttacacctccagtgcaagtagg

SEQ ID NO: 79921 - DNA, 25 bp, S. pombe
aatccatttcctgacgcaagtactg

SEQ ID NO: 79922 - DNA, 25 bp, S. pombe
aatcgcctcgtcttacggaagaagt

SEQ ID NO: 79923 - DNA, 25 bp, S. pombe
aatgcttgtcgctttgatgatgaaa

SEQ ID NO: 79924 - DNA, 25 bp, S. pombe
aatgctctggcggtgatatgcgaaa

SEQ ID NO: 79925 - DNA, 25 bp, S. pombe
aatgctttgagcgtgatcctgaaca

SEQ ID NO: 79926 - DNA, 25 bp, S. pombe
aatgctcgcgctctcgatgaaacag

SEQ ID NO: 79927 - DNA, 25 bp, S. pombe
aatgccgccatccttgatgtaagcg

SEQ ID NO: 79928 - DNA, 25 bp, S. pombe
aatgcaccctgtttcagaagagccc

SEQ ID NO: 79929 - DNA, 25 bp, S. pombe
aattgacgttcgtgagcccgatgaa

SEQ ID NO: 79930 - DNA, 25 bp, S. pombe
aatgccttttggaccatcgtaggta

SEQ ID NO: 79931 - DNA, 25 bp, S. pombe
aatgctcatgctaatgctcaccatc

SEQ ID NO: 79932 - DNA, 25 bp, S. pombe
aatgcacactgttctcatggctcaa

SEQ ID NO: 79933 - DNA, 25 bp, S. pombe
aatgctggtcagtatcagacatctg

SEQ ID NO: 79934 - DNA, 25 bp, S. pombe
aatgccattcgtacaatctggattg

SEQ ID NO: 79935 - DNA, 25 bp, S. pombe
aatgctccgtgtgcaacttttctaa

SEQ ID NO: 79936 - DNA, 25 bp, S. pombe
aatgctccgttttggatttgcctga

SEQ ID NO: 79937 - DNA, 25 bp, S. pombe
aatgcctacttgatggttttgtgcg

SEQ ID NO: 79938 - DNA, 25 bp, S. pombe
aatgcttgggctatcgttgttttaa

SEQ ID NO: 79939 - DNA, 25 bp, S. pombe
aatgctattgtgtttgcgcttgtac

SEQ ID NO: 79940 - DNA, 25 bp, S. pombe
aatctagttgatttggcaggttctg

SEQ ID NO: 79941 - DNA, 25 bp, S. pombe
aatgcaagttgctcagagcggcttt

SEQ ID NO: 79942 - DNA, 25 bp, S. pombe
aatgcctcctgaagaaattgctgct

SEQ ID NO: 79943 - DNA, 25 bp, S. pombe
aatgccattttaccttcatgccaaa

SEQ ID NO: 79944 - DNA, 25 bp, S. pombe
aatccactgaacctcttaccaaaag

SEQ ID NO: 79945 - DNA, 25 bp, S. pombe
aatgctttagcatgtcgttccgaaa

SEQ ID NO: 79946 - DNA, 25 bp, S. pombe
aatgctttgttcttgtttccatgga

SEQ ID NO: 79947 - DNA, 25 bp, S. pombe
aatagtgctttacgtactgacagga

SEQ ID NO: 79948 - DNA, 25 bp, S. pombe
aatcgctgctttcggtccagataat

SEQ ID NO: 79949 - DNA, 25 bp, S. pombe
aatgccgcagtagttactcttgaaa

SEQ ID NO: 79950 - DNA, 25 bp, S. pombe
aatgccgcaagctgatcatgagttt

SEQ ID NO: 79951 - DNA, 25 bp, S. pombe
aatgcttcttttgatcctgggtata

SEQ ID NO: 79952 - DNA, 25 bp, S. pombe
aatgctattttttctgccatggcgg

SEQ ID NO: 79953 - DNA, 25 bp, S. pombe
aatgctattttttcagtcggcgcca

SEQ ID NO: 79954 - DNA, 25 bp, S. pombe
aatcgaagggtctattgtgcaacgt

SEQ ID NO: 79955 - DNA, 25 bp, S. pombe
aatgctcgtcttgctatttctatcg

SEQ ID NO: 79956 - DNA, 25 bp, S. pombe
aatgctaggcctgatttgtcttctg

SEQ ID NO: 79957 - DNA, 25 bp, S. pombe
aatgccggacttatgttttctggaa

SEQ ID NO: 79958 - DNA, 25 bp, S. pombe
aatgcttgggttatttctcatcgag

SEQ ID NO: 79959 - DNA, 25 bp, S. pombe
aatgcattcggcttttcttctaaaa

SEQ ID NO: 79960 - DNA, 25 bp, S. pombe
aatgctgccgactttccttatagga

SEQ ID NO: 79961 - DNA, 25 bp, S. pombe
aatgctgcgaactattctgctttaa

SEQ ID NO: 79962 - DNA, 25 bp, S. pombe
aatgcattcctcatctagttcaaaa

SEQ ID NO: 79963 - DNA, 25 bp, S. pombe
aatgctgacttgactgcttttcaaa

SEQ ID NO: 79964 - DNA, 25 bp, S. pombe
aatgctgcacgcttggatcgtagtg

SEQ ID NO: 79965 - DNA, 25 bp, S. pombe
aatgcgctcacactggtcgtcgtct

SEQ ID NO: 79966 - DNA, 25 bp, S. pombe
aatcgaacacggaagcgagcctgat

SEQ ID NO: 79967 - DNA, 25 bp, S. pombe
aatcaatcgggttaccttctcaaat

SEQ ID NO: 79968 - DNA, 25 bp, S. pombe
aataaccgtgactataccgctcaag

SEQ ID NO: 79969 - DNA, 25 bp, S. pombe
aatctattggcaaacggctacgtga

SEQ ID NO: 79970 - DNA, 25 bp, S. pombe
aatgcattcaatgcctcgggttgcc

SEQ ID NO: 79971 - DNA, 25 bp, S. pombe
aatgctgtggctctatcttggctta

SEQ ID NO: 79972 - DNA, 25 bp, S. pombe
aatgcttcacaatacgctgaggcta

SEQ ID NO: 79973 - DNA, 25 bp, S. pombe
aatgctttcggtttgagtccatcgc

SEQ ID NO: 79974 - DNA, 25 bp, S. pombe
aatgcgtcagggattagtccagcac

SEQ ID NO: 79975 - DNA, 25 bp, S. pombe
aatcctgattgcctgttacctttaa

SEQ ID NO: 79976 - DNA, 25 bp, S. pombe
aatcttattcgtctagccaagcgta

SEQ ID NO: 79977 - DNA, 25 bp, S. pombe
gatttggttggtctcccaagactga

SEQ ID NO: 79978 - DNA, 25 bp, S. pombe
aatatggttggtttccctggacgag

SEQ ID NO: 79979 - DNA, 25 bp, S. pombe
aatgcgtgttattgttttgggatac

SEQ ID NO: 79980 - DNA, 25 bp, S. pombe
aatgctgtactctaaatttcacgat

SEQ ID NO: 79981 - DNA, 25 bp, S. pombe
aatgctgtctcaatacactggctac

SEQ ID NO: 79982 - DNA, 25 bp, S. pombe
aatccggttgcttttactcgagtgc

SEQ ID NO: 79983 - DNA, 25 bp, S. pombe
aatgcgcaggatacgtctaagtttt

SEQ ID NO: 79984 - DNA, 25 bp, S. pombe
aatcgatcgataggcctccaatttc

SEQ ID NO: 79985 - DNA, 25 bp, S. pombe
aatgcgtgcgttgcttcaatctttc

SEQ ID NO: 79986 - DNA, 25 bp, S. pombe
aatgcgtcttattgcttgatcacta

SEQ ID NO: 79987 - DNA, 25 bp, S. pombe
aatgccactcacgttttcatgtgtg

SEQ ID NO: 79988 - DNA, 25 bp, S. pombe
aatgctggtagcgttttcgttggtc

SEQ ID NO: 79989 - DNA, 25 bp, S. pombe
aatcgtggtgttggtacctcggcta

SEQ ID NO: 79990 - DNA, 25 bp, S. pombe
aatcgggtgatcgtcttactcgtgc

SEQ ID NO: 79991 - DNA, 25 bp, S. pombe
aatctgggaatctcgaggtacacta

SEQ ID NO: 79992 - DNA, 25 bp, S. pombe
aatcgacttgcggttgcggagaatc

SEQ ID NO: 79993 - DNA, 25 bp, S. pombe
aatgcgtgtcatgctcgtcaagaag

SEQ ID NO: 79994 - DNA, 25 bp, S. pombe
aatgctgttatcattggcccagcag

SEQ ID NO: 79995 - DNA, 25 bp, S. pombe
aatgcgtttcttcgagcacatggaa

SEQ ID NO: 79996 - DNA, 25 bp, S. pombe
aatgctggctgtggtgttgaaaatc

SEQ ID NO: 79997 - DNA, 25 bp, S. pombe
aatctggcattccttgggtacactt

SEQ ID NO: 79998 - DNA, 25 bp, S. pombe
aatcgcgatcattttgctcagtaca

SEQ ID NO: 79999 - DNA, 25 bp, S. pombe
aataaaaaccgctggctctgctgtt

SEQ ID NO: 80000 - DNA, 25 bp, S. pombe
aatgctttgattacgttccttcatc

SEQ ID NO: 80001 - DNA, 25 bp, S. pombe
aatgctggttgtactttcttcccaa

SEQ ID NO: 80002 - DNA, 25 bp, S. pombe
aatgcggcggatattccacctgaat

SEQ ID NO: 80003 - DNA, 25 bp, S. pombe
aatcgtcggatggatcatctcccaa

SEQ ID NO: 80004 - DNA, 25 bp, S. pombe
aatcgaagtctgttatgctactcaa

SEQ ID NO: 80005 - DNA, 25 bp, S. pombe
aatcgatggtcgtttcaatctaaag

SEQ ID NO: 80006 - DNA, 25 bp, S. pombe
aatcctctggcgatatttctaagct

SEQ ID NO: 80007 - DNA, 25 bp, S. pombe
aatccacctgaaagtttgttacacg

SEQ ID NO: 80008 - DNA, 25 bp, S. pombe
aatccagacggtactttttcacctg

SEQ ID NO: 80009 - DNA, 25 bp, S. pombe
aatgcctacgctgtttgttggaccg

SEQ ID NO: 80010 - DNA, 25 bp, S. pombe
aatgcgctactatgatttttggacc

SEQ ID NO: 80011 - DNA, 25 bp, S. pombe
aatcgctcattcctgaacctttgaa

SEQ ID NO: 80012 - DNA, 25 bp, S. pombe
aatgctaacttttatggctcctcca

SEQ ID NO: 80013 - DNA, 25 bp, S. pombe
aatcttactcttttggtcactggtg

SEQ ID NO: 80014 - DNA, 25 bp, S. pombe
aatcattagtttgcttgttccagaa

SEQ ID NO: 80015 - DNA, 25 bp, S. pombe
aatgctctcctatttatcgcgttaa

SEQ ID NO: 80016 - DNA, 25 bp, S. pombe
aatttcctgttggacgtgttcgacg

SEQ ID NO: 80017 - DNA, 25 bp, S. pombe
aatccgcctgttaaagcttttccag

SEQ ID NO: 80018 - DNA, 25 bp, S. pombe
aatccttcttctttaggtgcttcca

SEQ ID NO: 80019 - DNA, 25 bp, S. pombe
aatcctttgttctttggagaccaag

SEQ ID NO: 80020 - DNA, 25 bp, S. pombe
aatgcccctatttatctggagaaca

SEQ ID NO: 80021 - DNA, 25 bp, S. pombe
aatgcgcccgatctttgtggagagt

SEQ ID NO: 80022 - DNA, 25 bp, S. pombe
aatgccttccaccatcgtatgagac

SEQ ID NO: 80023 - DNA, 25 bp, S. pombe
aatccttgaatcaggcttctccaaa

SEQ ID NO: 80024 - DNA, 25 bp, S. pombe
aatcgtttagatattccgccttata

SEQ ID NO: 80025 - DNA, 25 bp, S. pombe
aatgctgtttatgatcctacctctc

SEQ ID NO: 80026 - DNA, 25 bp, S. pombe
aatgctgctttacaacttcgtgcca

SEQ ID NO: 80027 - DNA, 25 bp, S. pombe
aatgccgcctatccaaacgatggtt

SEQ ID NO: 80028 - DNA, 25 bp, S. pombe
aatgcgcctgctggccaaaggattc

SEQ ID NO: 80029 - DNA, 25 bp, S. pombe
aatgctgaatctgctaagggctcca

SEQ ID NO: 80030 - DNA, 25 bp, S. pombe
aatgctgtagtggtagcggcctcta

SEQ ID NO: 80031 - DNA, 25 bp, S. pombe
aatcgctactattgcaatggctgct

SEQ ID NO: 80032 - DNA, 25 bp, S. pombe
aatgctgctactgtgagtgctgctg

SEQ ID NO: 80033 - DNA, 25 bp, S. pombe
aatgctctctctatcatggtgctgt

SEQ ID NO: 80034 - DNA, 25 bp, S. pombe
aatgctgctgtcaaagctctgtctt

SEQ ID NO: 80035 - DNA, 25 bp, S. pombe
aatctattggtggtgccgttgctat

SEQ ID NO: 80036 - DNA, 25 bp, S. pombe
aatcttttggttcgagattctccca

SEQ ID NO: 80037 - DNA, 25 bp, S. pombe
aatctggttgtgtagctcatgtttc

SEQ ID NO: 80038 - DNA, 25 bp, S. pombe
aatccggaatgcatcgacaacttga

SEQ ID NO: 80039 - DNA, 25 bp, S. pombe
aatgcctttagcactgaaactgcgg

SEQ ID NO: 80040 - DNA, 25 bp, S. pombe
aatcctttcagctttggcaaatcgt

SEQ ID NO: 80041 - DNA, 25 bp, S. pombe
aatcttctgtcggttccaacatttt

SEQ ID NO: 80042 - DNA, 25 bp, S. pombe
aatcccaagttgctgagtttatttc

SEQ ID NO: 80043 - DNA, 25 bp, S. pombe
aatgccctatttgtgattctcatgt

SEQ ID NO: 80044 - DNA, 25 bp, S. pombe
aatctcgcttttcgtgacattctat

SEQ ID NO: 80045 - DNA, 25 bp, S. pombe
aatccctatgtctgttgcttttgaa

SEQ ID NO: 80046 - DNA, 25 bp, S. pombe
aatgcggtgttttgcttcctaatgg

SEQ ID NO: 80047 - DNA, 25 bp, S. pombe
aatgctcgcttattagctatccaaa

SEQ ID NO: 80048 - DNA, 25 bp, S. pombe
aatgccgctggtaacttctatatca

SEQ ID NO: 80049 - DNA, 25 bp, S. pombe
aatccacgattttctagtacaacaa

SEQ ID NO: 80050 - DNA, 25 bp, S. pombe
caacgtcaacccttttactaagcag

SEQ ID NO: 80051 - DNA, 25 bp, S. pombe
aatcttcttacctgctttctaattc

SEQ ID NO: 80052 - DNA, 25 bp, S. pombe
aatgcgtttacctgcgtattcatca

SEQ ID NO: 80053 - DNA, 25 bp, S. pombe
aatgcgaaattgacgggtttacatc

SEQ ID NO: 80054 - DNA, 25 bp, S. pombe
aatcgccgaagtttcaccaatgtat

SEQ ID NO: 80055 - DNA, 25 bp, S. pombe
aatcgacgacatttttgcttctaaa

SEQ ID NO: 80056 - DNA, 25 bp, S. pombe
aatctgtccaatcttttcctttatc

SEQ ID NO: 80057 - DNA, 25 bp, S. pombe
aatcgagtcgtctatagtcttccta

SEQ ID NO: 80058 - DNA, 25 bp, S. pombe
aatcgagatttatcgttctttacgt

SEQ ID NO: 80059 - DNA, 25 bp, S. pombe
aatcggatccaacgcgtttgtaagc

SEQ ID NO: 80060 - DNA, 25 bp, S. pombe
aatccctccaggtagatatgtcaaa

SEQ ID NO: 80061 - DNA, 25 bp, S. pombe
aatgctgttcgtgtatctatccttg

SEQ ID NO: 80062 - DNA, 25 bp, S. pombe
aatcgattcatgtctaacctccgtt

SEQ ID NO: 80063 - DNA, 25 bp, S. pombe
aatgcggacttaaagcgtctctcaa

SEQ ID NO: 80064 - DNA, 25 bp, S. pombe
aatgcggtattacaagcctctgtat

SEQ ID NO: 80065 - DNA, 25 bp, S. pombe
aatcgttaactcattttcttgcaat

SEQ ID NO: 80066 - DNA, 25 bp, S. pombe
aatcctttggacaccttatgcgcta

SEQ ID NO: 80067 - DNA, 25 bp, S. pombe
aatccgtttgatcaccactatgcga

SEQ ID NO: 80068 - DNA, 25 bp, S. pombe
aatctccgttgacaagactggcgag

SEQ ID NO: 80069 - DNA, 25 bp, S. pombe
aatcgaccccataaagcacatgctg

SEQ ID NO: 80070 - DNA, 25 bp, S. pombe
aatcccgaccttccatggtattatc

SEQ ID NO: 80071 - DNA, 25 bp, S. pombe
aatcccggcgatgatattactgctg

SEQ ID NO: 80072 - DNA, 25 bp, S. pombe
aatgcctgtgccgaacgatgaattt

SEQ ID NO: 80073 - DNA, 25 bp, S. pombe
aatccttcagcgtggtcaattttat

SEQ ID NO: 80074 - DNA, 25 bp, S. pombe
aatccttcatctcggttagtcgttg

SEQ ID NO: 80075 - DNA, 25 bp, S. pombe
aatcagattcaggagcccgaaccag

SEQ ID NO: 80076 - DNA, 25 bp, S. pombe
aatcaggagagcctacctcaagtcc

SEQ ID NO: 80077 - DNA, 25 bp, S. pombe
aatcgtggacatcgagctctgggta

SEQ ID NO: 80078 - DNA, 25 bp, S. pombe
aatcccatgatttctacccaacttt

SEQ ID NO: 80079 - DNA, 25 bp, S. pombe
aataccgcatctttcgaatcatgta

SEQ ID NO: 80080 - DNA, 25 bp, S. pombe
aatcgggtctatcatttcttcaaat

SEQ ID NO: 80081 - DNA, 25 bp, S. pombe
aatctccgacttcaattgctgttac

SEQ ID NO: 80082 - DNA, 25 bp, S. pombe
aatccctgcaatttctcattcttta

SEQ ID NO: 80083 - DNA, 25 bp, S. pombe
aatcgcattaattgtcctgccagcc

SEQ ID NO: 80084 - DNA, 25 bp, S. pombe
aatgccattgaaatctcccgcagcg

SEQ ID NO: 80085 - DNA, 25 bp, S. pombe
aatccattcgattctccagagactc

SEQ ID NO: 80086 - DNA, 25 bp, S. pombe
aatcgtatcagaatgtccaggtgct

SEQ ID NO: 80087 - DNA, 25 bp, S. pombe
aatcctttgagctatcgtggctgtc

SEQ ID NO: 80088 - DNA, 25 bp, S. pombe
aatctctttcaccatcgtggtcata

SEQ ID NO: 80089 - DNA, 25 bp, S. pombe
aatccccttagcaatgatcgaccaa

SEQ ID NO: 80090 - DNA, 25 bp, S. pombe
aatctccctagagtagttgcccgat

SEQ ID NO: 80091 - DNA, 25 bp, S. pombe
aatcatcatcaatagagccggttca

SEQ ID NO: 80092 - DNA, 25 bp, S. pombe
aatgcgctatataaatgccgttcca

SEQ ID NO: 80093 - DNA, 25 bp, S. pombe
aatgcctatttgtactttgctcctc

SEQ ID NO: 80094 - DNA, 25 bp, S. pombe
aatcctgatgttgttattgccggcg

SEQ ID NO: 80095 - DNA, 25 bp, S. pombe
aatgccgatgttgttgttgctgctg

SEQ ID NO: 80096 - DNA, 25 bp, S. pombe
aatgcctatgttggatgcacctcgt

SEQ ID NO: 80097 - DNA, 25 bp, S. pombe
aatgcctattgaattgctctcgtat

SEQ ID NO: 80098 - DNA, 25 bp, S. pombe
aatcctgcatctagcttgcctatta

SEQ ID NO: 80099 - DNA, 25 bp, S. pombe
aatgcctcgttcagcactattcaat

SEQ ID NO: 80100 - DNA, 25 bp, S. pombe
aatccacgcttctctcaattagtta

SEQ ID NO: 80101 - DNA, 25 bp, S. pombe
gaaactgggtgctctcaaggaatct

SEQ ID NO: 80102 - DNA, 25 bp, S. pombe
aataatgtgccaaggctattccgtt

SEQ ID NO: 80103 - DNA, 25 bp, S. pombe
aatagttgcaagcttgcccgttgga

SEQ ID NO: 80104 - DNA, 25 bp, S. pombe
aatcgagtctcaattgtccaagtgt

SEQ ID NO: 80105 - DNA, 25 bp, S. pombe
aatgcctcgctgttgattaactggt

SEQ ID NO: 80106 - DNA, 25 bp, S. pombe
aatgccaatggctgctcgtagagga

SEQ ID NO: 80107 - DNA, 25 bp, S. pombe
aatccgcacatccttatatatcttc

SEQ ID NO: 80108 - DNA, 25 bp, S. pombe
aattccgtgaaacctacttcagccg

SEQ ID NO: 80109 - DNA, 25 bp, S. pombe
aatatgtcccttatttggtagacct

SEQ ID NO: 80110 - DNA, 25 bp, S. pombe
aatccctataacgatgagcgtgccg

SEQ ID NO: 80111 - DNA, 25 bp, S. pombe
aatccacctgtaggaagcttctctg

SEQ ID NO: 80112 - DNA, 25 bp, S. pombe
aatcctatcctaattgaacccagta

SEQ ID NO: 80113 - DNA, 25 bp, S. pombe
aatcaaccgcgcttttactttctgt

SEQ ID NO: 80114 - DNA, 25 bp, S. pombe
aatcaatcggtatctctatcttctt

SEQ ID NO: 80115 - DNA, 25 bp, S. pombe
aatcctactatgaccattcgatcag

SEQ ID NO: 80116 - DNA, 25 bp, S. pombe
aatctgtgagcatttctgttccata

SEQ ID NO: 80117 - DNA, 25 bp, S. pombe
aatcctttatctatctcttggccta

SEQ ID NO: 80118 - DNA, 25 bp, S. pombe
aataaattactcctctcttcgatca

SEQ ID NO: 80119 - DNA, 25 bp, S. pombe
aatacaggatctacgcaatcgccca

SEQ ID NO: 80120 - DNA, 25 bp, S. pombe
aatccatctggttatgcttctgctc

SEQ ID NO: 80121 - DNA, 25 bp, S. pombe
aatccattcgtttcgtatcgggtgc

SEQ ID NO: 80122 - DNA, 25 bp, S. pombe
aatcgcattcggatcgtatcggagc

SEQ ID NO: 80123 - DNA, 25 bp, S. pombe
aatccagtatgggtgaacggcaaaa

SEQ ID NO: 80124 - DNA, 25 bp, S. pombe
aatcaccagtgggttacggctgaaa

SEQ ID NO: 80125 - DNA, 25 bp, S. pombe
aataagcctggtttcatcgagttaa

SEQ ID NO: 80126 - DNA, 25 bp, S. pombe
aatccgatcgcgtttctcaaatcag

SEQ ID NO: 80127 - DNA, 25 bp, S. pombe
aatcctgatcgttatgttttatggg

SEQ ID NO: 80128 - DNA, 25 bp, S. pombe
aatcgcttgcgcatgttgaagtgtc

SEQ ID NO: 80129 - DNA, 25 bp, S. pombe
aatctcggcttgttggtcgtggaaa

SEQ ID NO: 80130 - DNA, 25 bp, S. pombe
aatccatggcttttgactttgaata

SEQ ID NO: 80131 - DNA, 25 bp, S. pombe
aatccatcctcttctatctttgtat

SEQ ID NO: 80132 - DNA, 25 bp, S. pombe
aatcgtgcaaacttggcgtcttagt

SEQ ID NO: 80133 - DNA, 25 bp, S. pombe
aatccaaaaaagctctctctctctt

SEQ ID NO: 80134 - DNA, 25 bp, S. pombe
aatcgttggacgaagccacttttat

SEQ ID NO: 80135 - DNA, 25 bp, S. pombe
aatctttggccgaggaatggttcat

SEQ ID NO: 80136 - DNA, 25 bp, S. pombe
aatacgggactgatggagggcctct

SEQ ID NO: 80137 - DNA, 25 bp, S. pombe
aatctcggacttatcactctgactt

SEQ ID NO: 80138 - DNA, 25 bp, S. pombe
aatccgttgaagagctccaagacga

SEQ ID NO: 80139 - DNA, 25 bp, S. pombe
aatcccattgatttgtctcgaaaac

SEQ ID NO: 80140 - DNA, 25 bp, S. pombe
aatcctgacagcatcggtgttgaac

SEQ ID NO: 80141 - DNA, 25 bp, S. pombe
aatccgcaagtacggtttgaacatc

SEQ ID NO: 80142 - DNA, 25 bp, S. pombe
aatccagcagagcattttccaaacg

SEQ ID NO: 80143 - DNA, 25 bp, S. pombe
aatcccagaggaccagtttcgcatt

SEQ ID NO: 80144 - DNA, 25 bp, S. pombe
aatcccgagcttgctggtgagaaac

SEQ ID NO: 80145 - DNA, 25 bp, S. pombe
aatccccatgtctctgaggaagcta

SEQ ID NO: 80146 - DNA, 25 bp, S. pombe
aatccaccatgtcctcttgaaatta

SEQ ID NO: 80147 - DNA, 25 bp, S. pombe
aatcgtgatatgagccaacctcctc

SEQ ID NO: 80148 - DNA, 25 bp, S. pombe
aatcctgccagctattgtgccgatt

SEQ ID NO: 80149 - DNA, 25 bp, S. pombe
aatctggctgattgggcgcgtgaac

SEQ ID NO: 80150 - DNA, 25 bp, S. pombe
aatctgctggattcgaccgtatgat

SEQ ID NO: 80151 - DNA, 25 bp, S. pombe
aatctggtggcatttatccttggca

SEQ ID NO: 80152 - DNA, 25 bp, S. pombe
aatcgtcaattcaaccctctgatga

SEQ ID NO: 80153 - DNA, 25 bp, S. pombe
aatacacgagtttcctagcgagtgg

SEQ ID NO: 80154 - DNA, 25 bp, S. pombe
aatctccggtattgcctgagccaat

SEQ ID NO: 80155 - DNA, 25 bp, S. pombe
aatcccagtcattgctttaacagct

SEQ ID NO: 80156 - DNA, 25 bp, S. pombe
aatcccacatcctatgcttatacag

SEQ ID NO: 80157 - DNA, 25 bp, S. pombe
aatctcttgattcggcttacacagc

SEQ ID NO: 80158 - DNA, 25 bp, S. pombe
aatccatgcgtgaggccatgaacaa

SEQ ID NO: 80159 - DNA, 25 bp, S. pombe
aatctgcggatgatgctacatggat

SEQ ID NO: 80160 - DNA, 25 bp, S. pombe
aatctgaggctgaattccgtttgac

SEQ ID NO: 80161 - DNA, 25 bp, S. pombe
aatcaggctgctatatcgtctcttg

SEQ ID NO: 80162 - DNA, 25 bp, S. pombe
aatcgccttgatttatgctctctac

SEQ ID NO: 80163 - DNA, 25 bp, S. pombe
aatccctatatgtttgcatccgtct

SEQ ID NO: 80164 - DNA, 25 bp, S. pombe
aatcctgtttgtttgtgctttctac

SEQ ID NO: 80165 - DNA, 25 bp, S. pombe
aatctggtttggacgtctttgcaca

SEQ ID NO: 80166 - DNA, 25 bp, S. pombe
caacgtttttgtcattggcgagact

SEQ ID NO: 80167 - DNA, 25 bp, S. pombe
aatctgatttagaggcatctggtgc

SEQ ID NO: 80168 - DNA, 25 bp, S. pombe
aatcgttcatcttctgtctagttca

SEQ ID NO: 80169 - DNA, 25 bp, S. pombe
aatcctttgcttggtccttgattgc

SEQ ID NO: 80170 - DNA, 25 bp, S. pombe
aatccttcagtctagatctcttgga

SEQ ID NO: 80171 - DNA, 25 bp, S. pombe
aatcctgccagagaactgcttggtt

SEQ ID NO: 80172 - DNA, 25 bp, S. pombe
aatccgctgttgttggtgttcatga

SEQ ID NO: 80173 - DNA, 25 bp, S. pombe
aatctcgatgggtcttgcttattat

SEQ ID NO: 80174 - DNA, 25 bp, S. pombe
aatccttcatggtggcttactatgc

SEQ ID NO: 80175 - DNA, 25 bp, S. pombe
aatctcttttgatgtgttccctgct

SEQ ID NO: 80176 - DNA, 25 bp, S. pombe
aatcctgtatctgtattccttctgt

SEQ ID NO: 80177 - DNA, 25 bp, S. pombe
aatcgtcgtgttacattccaaggta

SEQ ID NO: 80178 - DNA, 25 bp, S. pombe
aatcgtcaaaatccgtttctcgcaa

SEQ ID NO: 80179 - DNA, 25 bp, S. pombe
aatcttcaacacttgtgctaccgga

SEQ ID NO: 80180 - DNA, 25 bp, S. pombe
aatcctgctaatatgttctccaata

SEQ ID NO: 80181 - DNA, 25 bp, S. pombe
aatcctgctgttttctcttcaaata

SEQ ID NO: 80182 - DNA, 25 bp, S. pombe
aatcctgtttctgcacttagtcatg

SEQ ID NO: 80183 - DNA, 25 bp, S. pombe
aatcgttgttgctcagcgcttggat

SEQ ID NO: 80184 - DNA, 25 bp, S. pombe
aatcttctagctcgatccagttgta

SEQ ID NO: 80185 - DNA, 25 bp, S. pombe
aatctatcactcttattcctctgta

SEQ ID NO: 80186 - DNA, 25 bp, S. pombe
aatctgatagtctttcacctggcga

SEQ ID NO: 80187 - DNA, 25 bp, S. pombe
aatcgggatcttattgtcacacgtg

SEQ ID NO: 80188 - DNA, 25 bp, S. pombe
aatcgagaacttcgtcttcgggtgt

SEQ ID NO: 80189 - DNA, 25 bp, S. pombe
aatcaacgacttctttctagggcta

SEQ ID NO: 80190 - DNA, 25 bp, S. pombe
gaattccttttacaaaccttgcaag

SEQ ID NO: 80191 - DNA, 25 bp, S. pombe
aatctccttttgctcaaaccttgat

SEQ ID NO: 80192 - DNA, 25 bp, S. pombe
aatccgcgtctcagtaaaccttatg

SEQ ID NO: 80193 - DNA, 25 bp, S. pombe
aatcttgggctctgtcaatagcaca

SEQ ID NO: 80194 - DNA, 25 bp, S. pombe
aatcctgacgatcctcttgtagctt

SEQ ID NO: 80195 - DNA, 25 bp, S. pombe
aatcctgacgataccattgctgaac

SEQ ID NO: 80196 - DNA, 25 bp, S. pombe
aatcagctgctggaacttcaatgga

SEQ ID NO: 80197 - DNA, 25 bp, S. pombe
aatcgccatgtcttctagcaattca

SEQ ID NO: 80198 - DNA, 25 bp, S. pombe
aatcgccatgtgtttccatgtgtgc

SEQ ID NO: 80199 - DNA, 25 bp, S. pombe
aatccgatcatgaattgcactgggc

SEQ ID NO: 80200 - DNA, 25 bp, S. pombe
aatcgcatatctaagagcccgggat

SEQ ID NO: 80201 - DNA, 25 bp, S. pombe
aatcgtttgtttgccgaggatcggt

SEQ ID NO: 80202 - DNA, 25 bp, S. pombe
caaagctttttatccgttgttgaca

SEQ ID NO: 80203 - DNA, 25 bp, S. pombe
aatacattcttgtcaccggtcgtta

SEQ ID NO: 80204 - DNA, 25 bp, S. pombe
aatacttctaaaacctctacattgg

SEQ ID NO: 80205 - DNA, 25 bp, S. pombe
aatcatgtcgtggaagcgttcattt

SEQ ID NO: 80206 - DNA, 25 bp, S. pombe
aatctgtcgtgctcacatggttgtt

SEQ ID NO: 80207 - DNA, 25 bp, S. pombe
aatcttatgagctccttgttttctg

SEQ ID NO: 80208 - DNA, 25 bp, S. pombe
aatcttttgagtgccgaattccggt

SEQ ID NO: 80209 - DNA, 25 bp, S. pombe
tcttgttaagcgtcccgaattcggt

SEQ ID NO: 80210 - DNA, 25 bp, S. pombe
ctccggcccattagaggtaatcgta

SEQ ID NO: 80211 - DNA, 25 bp, S. pombe
taaacgacgataaacctgtgcggtt

SEQ ID NO: 80212 - DNA, 25 bp, S. pombe
aatcgaggcgtatgctcaacaagat

SEQ ID NO: 80213 - DNA, 25 bp, S. pombe
aatcatggagtgcttctcgtgtcag

SEQ ID NO: 80214 - DNA, 25 bp, S. pombe
aatcgctagtgctcatctggtcata

SEQ ID NO: 80215 - DNA, 25 bp, S. pombe
caaggctgagtctcttaagtatact

SEQ ID NO: 80216 - DNA, 25 bp, S. pombe
aatcttaattttacacgcatcataa

SEQ ID NO: 80217 - DNA, 25 bp, S. pombe
aatcattttggtttgcggagacgct

SEQ ID NO: 80218 - DNA, 25 bp, S. pombe
aatcggctttgcgttctaggctcca

SEQ ID NO: 80219 - DNA, 25 bp, S. pombe
aatcgatttctcctcatttggtgta

SEQ ID NO: 80220 - DNA, 25 bp, S. pombe
aatcgcttcctccttataatggcat

SEQ ID NO: 80221 - DNA, 25 bp, S. pombe
aatcgtctcctttgttcacaggtgt

SEQ ID NO: 80222 - DNA, 25 bp, S. pombe
aatctggctctattgaccgaaacga

SEQ ID NO: 80223 - DNA, 25 bp, S. pombe
aatctggtgctattactgctggaca

SEQ ID NO: 80224 - DNA, 25 bp, S. pombe
aatctggtgtcttgactgttaccgc

SEQ ID NO: 80225 - DNA, 25 bp, S. pombe
aatccgcctattaatttagccgctt

SEQ ID NO: 80226 - DNA, 25 bp, S. pombe
caatccggtattgggttaggcgcag

SEQ ID NO: 80227 - DNA, 25 bp, S. pombe
cgatccagttactcgtgaacgacaa

SEQ ID NO: 80228 - DNA, 25 bp, S. pombe
aatcgagcaacctctggtgctttaa

SEQ ID NO: 80229 - DNA, 25 bp, S. pombe
aatcgaaactccctaatgcttctgg

SEQ ID NO: 80230 - DNA, 25 bp, S. pombe
aatcgagtacaagctcagacttctt

SEQ ID NO: 80231 - DNA, 25 bp, S. pombe
aatcgaatacaagcgtcctggcctt

SEQ ID NO: 80232 - DNA, 25 bp, S. pombe
aattgcttggcgtcacttagtaggt

SEQ ID NO: 80233 - DNA, 25 bp, S. pombe
aatcgttgatgacccttattatgga

SEQ ID NO: 80234 - DNA, 25 bp, S. pombe
aatcggtgtgaggactctactagga

SEQ ID NO: 80235 - DNA, 25 bp, S. pombe
aatcggtggatacattggctaacaa

SEQ ID NO: 80236 - DNA, 25 bp, S. pombe
aatcgtaggatcaagggaattcagt

SEQ ID NO: 80237 - DNA, 25 bp, S. pombe
aatcgtagttgcatggtttgtcaca

SEQ ID NO: 80238 - DNA, 25 bp, S. pombe
aatcggcgttacttgtatcttgctg

SEQ ID NO: 80239 - DNA, 25 bp, S. pombe
aatctggtactcagggttctcacgg

SEQ ID NO: 80240 - DNA, 25 bp, S. pombe
aatcggctattcttggatgactgaa

SEQ ID NO: 80241 - DNA, 25 bp, S. pombe
aatcggtgatgtccaagccactgaa

SEQ ID NO: 80242 - DNA, 25 bp, S. pombe
aatcttgcggatacagaccatcgaa

SEQ ID NO: 80243 - DNA, 25 bp, S. pombe
aatcactgttgaaggcagcaatggt

SEQ ID NO: 80244 - DNA, 25 bp, S. pombe
aatcgtgttattgcgacaggctaca

SEQ ID NO: 80245 - DNA, 25 bp, S. pombe
aatcgactacgactccactttatat

SEQ ID NO: 80246 - DNA, 25 bp, S. pombe
aatcaacttcggttcacttcctgaa

SEQ ID NO: 80247 - DNA, 25 bp, S. pombe
aatcaaactcggtctcagctaaatg

SEQ ID NO: 80248 - DNA, 25 bp, S. pombe
aatcaaagctcgtcttcaggaagaa

SEQ ID NO: 80249 - DNA, 25 bp, S. pombe
aatcaccgcttcaaaaggcttctac

SEQ ID NO: 80250 - DNA, 25 bp, S. pombe
aatcttcctcttcaatttcctcatt

SEQ ID NO: 80251 - DNA, 25 bp, S. pombe
aatcaatcgcttgctaaattccctc

SEQ ID NO: 80252 - DNA, 25 bp, S. pombe
aatcaaacttagctacttctcctgc

SEQ ID NO: 80253 - DNA, 25 bp, S. pombe
aatcatgaattttcggatcctaccg

SEQ ID NO: 80254 - DNA, 25 bp, S. pombe
aatctgggcttgttttctaccttca

SEQ ID NO: 80255 - DNA, 25 bp, S. pombe
aatcgggttttcttcaggatctcca

SEQ ID NO: 80256 - DNA, 25 bp, S. pombe
aatctcattaccagtcttgcatcaa

SEQ ID NO: 80257 - DNA, 25 bp, S. pombe
aatctttatcgttttcatgatcata

SEQ ID NO: 80258 - DNA, 25 bp, S. pombe
aatcgcttacgctgttgtgaatcac

SEQ ID NO: 80259 - DNA, 25 bp, S. pombe
aatcgcttctttgctctgagcataa

SEQ ID NO: 80260 - DNA, 25 bp, S. pombe
aatcttccctagacagtgtgctgac

SEQ ID NO: 80261 - DNA, 25 bp, S. pombe
aatcttcccttctaactatgtgcgt

SEQ ID NO: 80262 - DNA, 25 bp, S. pombe
aatcttccttggtatgagcttctga

SEQ ID NO: 80263 - DNA, 25 bp, S. pombe
aatcgtgttcagctttgtccattag

SEQ ID NO: 80264 - DNA, 25 bp, S. pombe
aatcgcgtctccaattttctcaaat

SEQ ID NO: 80265 - DNA, 25 bp, S. pombe
aatcgtactctaatatctggcggtg

SEQ ID NO: 80266 - DNA, 25 bp, S. pombe
aatcttccttacaatctgctgggct

SEQ ID NO: 80267 - DNA, 25 bp, S. pombe
aatctccgtttcaaagtgcaccttt

SEQ ID NO: 80268 - DNA, 25 bp, S. pombe
aataccatcgttctgatgcgggcct

SEQ ID NO: 80269 - DNA, 25 bp, S. pombe
aatacatctactggcattctgcggg

SEQ ID NO: 80270 - DNA, 25 bp, S. pombe
aatcacattccccaattgctagaac

SEQ ID NO: 80271 - DNA, 25 bp, S. pombe
aatacttccacctattttgatacgt

SEQ ID NO: 80272 - DNA, 25 bp, S. pombe
aatctgagacagcattttcgcccga

SEQ ID NO: 80273 - DNA, 25 bp, S. pombe
aatacaggaaaagccgcttccagct

SEQ ID NO: 80274 - DNA, 25 bp, S. pombe
aatacggcaagacgctcaacttctc

SEQ ID NO: 80275 - DNA, 25 bp, S. pombe
aatctgagcgtgaagccaggcgctt

SEQ ID NO: 80276 - DNA, 25 bp, S. pombe
aatctcgacgagttgtggctgtata

SEQ ID NO: 80277 - DNA, 25 bp, S. pombe
aatctcttcttcttatgcttgtacg

SEQ ID NO: 80278 - DNA, 25 bp, S. pombe
aatctcgtcctggtttagctagtgg

SEQ ID NO: 80279 - DNA, 25 bp, S. pombe
aatcggtcgatcagcttgtttttct

SEQ ID NO: 80280 - DNA, 25 bp, S. pombe
aatagcgctattgaggacattacct

SEQ ID NO: 80281 - DNA, 25 bp, S. pombe
aatacgtataccatgaccaggccgc

SEQ ID NO: 80282 - DNA, 25 bp, S. pombe
aatcgttattcagctgaacggccgt

SEQ ID NO: 80283 - DNA, 25 bp, S. pombe
aatcacaatttctccaagcaggcct

SEQ ID NO: 80284 - DNA, 25 bp, S. pombe
aatcacgttggcttccgacagtcat

SEQ ID NO: 80285 - DNA, 25 bp, S. pombe
aatcatctgcttcgcattctgaaca

SEQ ID NO: 80286 - DNA, 25 bp, S. pombe
aatcatatttccactgtcagcagct

SEQ ID NO: 80287 - DNA, 25 bp, S. pombe
aatctcttggtgtttgtattcttca

SEQ ID NO: 80288 - DNA, 25 bp, S. pombe
aatctacatatgtgagctcccgtca

SEQ ID NO: 80289 - DNA, 25 bp, S. pombe
aatctattggttcggtctgttcaca

SEQ ID NO: 80290 - DNA, 25 bp, S. pombe
aatctttttgatgggtctcttacga

SEQ ID NO: 80291 - DNA, 25 bp, S. pombe
aatcttgtttgctggacctactcaa

SEQ ID NO: 80292 - DNA, 25 bp, S. pombe
aatcttgttgggatgaccggtgcaa

SEQ ID NO: 80293 - DNA, 25 bp, S. pombe
aatcttgtttcagcgcattcgtgat

SEQ ID NO: 80294 - DNA, 25 bp, S. pombe
aatctactattcacagcctcttgag

SEQ ID NO: 80295 - DNA, 25 bp, S. pombe
aatcgttaattctgctttgctgtta

SEQ ID NO: 80296 - DNA, 25 bp, S. pombe
aatcgttatttcttgccttccattt

SEQ ID NO: 80297 - DNA, 25 bp, S. pombe
aatcgttcaccatggactatccagg

SEQ ID NO: 80298 - DNA, 25 bp, S. pombe
aatagatgtcgagcgcatgcacgat

SEQ ID NO: 80299 - DNA, 25 bp, S. pombe
aatcagattcaaaccgtcattcccg

SEQ ID NO: 80300 - DNA, 25 bp, S. pombe
aatcagttcaatgtcgttctccttg

SEQ ID NO: 80301 - DNA, 25 bp, S. pombe
aatcgtgactatgttttctccagag

SEQ ID NO: 80302 - DNA, 25 bp, S. pombe
aatcggtttgattttgccttaagca

SEQ ID NO: 80303 - DNA, 25 bp, S. pombe
aatcggtttgtcaattctttcaagc

SEQ ID NO: 80304 - DNA, 25 bp, S. pombe
aatcggttctttttcatgtcatcta

SEQ ID NO: 80305 - DNA, 25 bp, S. pombe
aatatgcttactgcgataacctcga

SEQ ID NO: 80306 - DNA, 25 bp, S. pombe
aatacttccgtgacaacaagccgaa

SEQ ID NO: 80307 - DNA, 25 bp, S. pombe
aatcaacctcagttggtgtcgccaa

SEQ ID NO: 80308 - DNA, 25 bp, S. pombe
aatcatccgcttttatgtgaccaag

SEQ ID NO: 80309 - DNA, 25 bp, S. pombe
aatcgtgcctcttttggatcgtatt

SEQ ID NO: 80310 - DNA, 25 bp, S. pombe
aatcagtccatccatttggtggttg

SEQ ID NO: 80311 - DNA, 25 bp, S. pombe
aataaaggcggtcatccttcgcgat

SEQ ID NO: 80312 - DNA, 25 bp, S. pombe
aatatacgacctggccatcgttggg

SEQ ID NO: 80313 - DNA, 25 bp, S. pombe
aataatcgtggtggtcatcctcgtg

SEQ ID NO: 80314 - DNA, 25 bp, S. pombe
cttgaggcccttcgtgtggaagtat

SEQ ID NO: 80315 - DNA, 25 bp, S. pombe
aatagcgcccttctagagacatgtt

SEQ ID NO: 80316 - DNA, 25 bp, S. pombe
aataccgggctacttagacttggag

SEQ ID NO: 80317 - DNA, 25 bp, S. pombe
aataaggacgtctctcaagcgcttg

SEQ ID NO: 80318 - DNA, 25 bp, S. pombe
aataacgccagttccaaacaagttg

SEQ ID NO: 80319 - DNA, 25 bp, S. pombe
aatcattcctcgtactttagttcag

SEQ ID NO: 80320 - DNA, 25 bp, S. pombe
aatcattaccgcttttcggatacga

SEQ ID NO: 80321 - DNA, 25 bp, S. pombe
aatcatggctactctttctggtgaa

SEQ ID NO: 80322 - DNA, 25 bp, S. pombe
aatcatgcagggttcatttcggaaa

SEQ ID NO: 80323 - DNA, 25 bp, S. pombe
aatcaggagcgacttattagagcaa

SEQ ID NO: 80324 - DNA, 25 bp, S. pombe
aatcaggcagcaaactactcaacaa

SEQ ID NO: 80325 - DNA, 25 bp, S. pombe
aatcagtaatgcgaatacacccaga

SEQ ID NO: 80326 - DNA, 25 bp, S. pombe
aatctgagttgcgtccgccaacaag

SEQ ID NO: 80327 - DNA, 25 bp, S. pombe
aatcgtggtttcttctcatactcaa

SEQ ID NO: 80328 - DNA, 25 bp, S. pombe
aatactggtgcctcttctagtcaag

SEQ ID NO: 80329 - DNA, 25 bp, S. pombe
aattactggcttgctgtcccttatg

SEQ ID NO: 80330 - DNA, 25 bp, S. pombe
aatcattcctagagctcaagccctt

SEQ ID NO: 80331 - DNA, 25 bp, S. pombe
aatcttccatctttgcaaaacgctc

SEQ ID NO: 80332 - DNA, 25 bp, S. pombe
aatcttcctccgttgtttgtattca

SEQ ID NO: 80333 - DNA, 25 bp, S. pombe
aatacccttctggatgttttcaaag

SEQ ID NO: 80334 - DNA, 25 bp, S. pombe
aatcacccttgagacttttgctttg

SEQ ID NO: 80335 - DNA, 25 bp, S. pombe
aatcattcagttcgtccttgatctc

SEQ ID NO: 80336 - DNA, 25 bp, S. pombe
aatcttattcatcatcgccgtattc

SEQ ID NO: 80337 - DNA, 25 bp, S. pombe
aatagacttgcatctggccgaactg

SEQ ID NO: 80338 - DNA, 25 bp, S. pombe
aatagacagtatccccgcattaagc

SEQ ID NO: 80339 - DNA, 25 bp, S. pombe
aataatatgctgtaccctagagagg

SEQ ID NO: 80340 - DNA, 25 bp, S. pombe
aatcaattgcgtgctcggatcgaca

SEQ ID NO: 80341 - DNA, 25 bp, S. pombe
aataatcactgtgccgtatcgcctt

SEQ ID NO: 80342 - DNA, 25 bp, S. pombe
aatagatcctgaaccgcttaagtat

SEQ ID NO: 80343 - DNA, 25 bp, S. pombe
aatactgtccccttgactcatattg

SEQ ID NO: 80344 - DNA, 25 bp, S. pombe
aatatcttgccacaataccaggagc

SEQ ID NO: 80345 - DNA, 25 bp, S. pombe
aatatcccgatcgaatacctgttat

SEQ ID NO: 80346 - DNA, 25 bp, S. pombe
aatctatttgcttctggttcttggg

SEQ ID NO: 80347 - DNA, 25 bp, S. pombe
aatctggtctcgaatttttggtgaa

SEQ ID NO: 80348 - DNA, 25 bp, S. pombe
aatctcgttcgtattcattgtctag

SEQ ID NO: 80349 - DNA, 25 bp, S. pombe
aatctggcttctgtctatattcctt

SEQ ID NO: 80350 - DNA, 25 bp, S. pombe
aatatgccctccgaaatactacttg

SEQ ID NO: 80351 - DNA, 25 bp, S. pombe
aatcaagccctcttattcagctgac

SEQ ID NO: 80352 - DNA, 25 bp, S. pombe
aataagcccgttttgcatgtacaag

SEQ ID NO: 80353 - DNA, 25 bp, S. pombe
aataagcaacatctacccatccaat

SEQ ID NO: 80354 - DNA, 25 bp, S. pombe
aataaaatcatgctccaccctgttc

SEQ ID NO: 80355 - DNA, 25 bp, S. pombe
aatcaactattcaacctgggctgca

SEQ ID NO: 80356 - DNA, 25 bp, S. pombe
aataactattcctcaagctctaaag

SEQ ID NO: 80357 - DNA, 25 bp, S. pombe
aataccatttcccttcacttgaaga

SEQ ID NO: 80358 - DNA, 25 bp, S. pombe
aatcaaaagctctgctccttctaag

SEQ ID NO: 80359 - DNA, 25 bp, S. pombe
aatacactgtccttttgaaatctga

SEQ ID NO: 80360 - DNA, 25 bp, S. pombe
aatcatactgccgtttctattctct

SEQ ID NO: 80361 - DNA, 25 bp, S. pombe
aatcaacttactactctctttcatg

SEQ ID NO: 80362 - DNA, 25 bp, S. pombe
aatcaaatctgacccacttgtatca

SEQ ID NO: 80363 - DNA, 25 bp, S. pombe
aatcatgtttggtattccgtatcag

SEQ ID NO: 80364 - DNA, 25 bp, S. pombe
aatcattggatttttgctcgcttca

SEQ ID NO: 80365 - DNA, 25 bp, S. pombe
aatctcttcttctatttgcggtgac

SEQ ID NO: 80366 - DNA, 25 bp, S. pombe
aatacattttattgtcagcagtgga

SEQ ID NO: 80367 - DNA, 25 bp, S. pombe
aatcaacatcttctgatactcagca

SEQ ID NO: 80368 - DNA, 25 bp, S. pombe
aatagcaccttctatgcaaccatca

SEQ ID NO: 80369 - DNA, 25 bp, S. pombe
aatagcaccgtattgacctttactg

SEQ ID NO: 80370 - DNA, 25 bp, S. pombe
aatacagccatgtaggcctcggtca

SEQ ID NO: 80371 - DNA, 25 bp, S. pombe
aattcgtggcgaaagcggcgtgaaa

SEQ ID NO: 80372 - DNA, 25 bp, S. pombe
aatcacgtctggaagaactgctaat

SEQ ID NO: 80373 - DNA, 25 bp, S. pombe
aatactgcagcgttacttcatgttg

SEQ ID NO: 80374 - DNA, 25 bp, S. pombe
aatacatcagcgtcttcaaaggcat

SEQ ID NO: 80375 - DNA, 25 bp, S. pombe
aataaagtcatcctccaagcagcat

SEQ ID NO: 80376 - DNA, 25 bp, S. pombe
aatctatcattttctctcgcaaagc

SEQ ID NO: 80377 - DNA, 25 bp, S. pombe
aatcaatattcagtgttcgcgcaag

SEQ ID NO: 80378 - DNA, 25 bp, S. pombe
aatcatcaactgctgttcgtcgagg

SEQ ID NO: 80379 - DNA, 25 bp, S. pombe
aatcatctttttggtggttctgcaa

SEQ ID NO: 80380 - DNA, 25 bp, S. pombe
aatacatgcctcatcgtggttccat

SEQ ID NO: 80381 - DNA, 25 bp, S. pombe
aatactgttgcccaaggaaccttgt

SEQ ID NO: 80382 - DNA, 25 bp, S. pombe
aatagaggtgcccaggaaattgttt

SEQ ID NO: 80383 - DNA, 25 bp, S. pombe
aatctaagagaggtgccgctgctcc

SEQ ID NO: 80384 - DNA, 25 bp, S. pombe
aataccggacttgcgattccaacag

SEQ ID NO: 80385 - DNA, 25 bp, S. pombe
aataacggcacgcatgtgttgcaaa

SEQ ID NO: 80386 - DNA, 25 bp, S. pombe
aatacctggctacatggttgcacat

SEQ ID NO: 80387 - DNA, 25 bp, S. pombe
aatacgggatattgctttgggaatg

SEQ ID NO: 80388 - DNA, 25 bp, S. pombe
aatacgttgtggttgctaacagcga

SEQ ID NO: 80389 - DNA, 25 bp, S. pombe
aataaatcttagacgcgtcccatcc

SEQ ID NO: 80390 - DNA, 25 bp, S. pombe
aatcaacatttgcttgtgcgcttta

SEQ ID NO: 80391 - DNA, 25 bp, S. pombe
aatcatccatttcatgttccagtgt

SEQ ID NO: 80392 - DNA, 25 bp, S. pombe
aatactaatgtatatgcgccgagag

SEQ ID NO: 80393 - DNA, 25 bp, S. pombe
aatctctcagagaacagcgcaaaag

SEQ ID NO: 80394 - DNA, 25 bp, S. pombe
aatcacaaccattcgaaacctgcta

SEQ ID NO: 80395 - DNA, 25 bp, S. pombe
aatatggtgctctacgaaactttat

SEQ ID NO: 80396 - DNA, 25 bp, S. pombe
aatcattttctttcgaacaccctgg

SEQ ID NO: 80397 - DNA, 25 bp, S. pombe
aatcaggttcttgcgaatacggcga

SEQ ID NO: 80398 - DNA, 25 bp, S. pombe
aatcaggttcaagcagaccccggag

SEQ ID NO: 80399 - DNA, 25 bp, S. pombe
aatcagttgttacagtatgccgaga

SEQ ID NO: 80400 - DNA, 25 bp, S. pombe
aatatgcctttgctgacgatgataa

SEQ ID NO: 80401 - DNA, 25 bp, S. pombe
aataccgtgctgctgagcgtgagca

SEQ ID NO: 80402 - DNA, 25 bp, S. pombe
aatagctccgatggcagcagtggct

SEQ ID NO: 80403 - DNA, 25 bp, S. pombe
aatatcgcacgaatgagcagagtca

SEQ ID NO: 80404 - DNA, 25 bp, S. pombe
aatcatgctgccaaagacgtgtaca

SEQ ID NO: 80405 - DNA, 25 bp, S. pombe
aatcattctcatgcagacggtcaac

SEQ ID NO: 80406 - DNA, 25 bp, S. pombe
aatagttcacgtcgcaagcattgca

SEQ ID NO: 80407 - DNA, 25 bp, S. pombe
aatagcactgattgcccaacactgg

SEQ ID NO: 80408 - DNA, 25 bp, S. pombe
aatatgctgctgtatcggtttgaac

SEQ ID NO: 80409 - DNA, 25 bp, S. pombe
aatcagctgctggttctcgtatgag

SEQ ID NO: 80410 - DNA, 25 bp, S. pombe
aataacttattatggccttccctcg

SEQ ID NO: 80411 - DNA, 25 bp, S. pombe
aatcatcagggtgcttcattgcttc

SEQ ID NO: 80412 - DNA, 25 bp, S. pombe
aatctttgcttctattcacgtggtc

SEQ ID NO: 80413 - DNA, 25 bp, S. pombe
aatcatttgtatgccctgagtgcag

SEQ ID NO: 80414 - DNA, 25 bp, S. pombe
aataatttctcctagtgactgcatg

SEQ ID NO: 80415 - DNA, 25 bp, S. pombe
aatatttcacccttgcatgtacata

SEQ ID NO: 80416 - DNA, 25 bp, S. pombe
aatcatttctcttcattcctaaacc

SEQ ID NO: 80417 - DNA, 25 bp, S. pombe
aatcatatttgctcctctgcttaag

SEQ ID NO: 80418 - DNA, 25 bp, S. pombe
aatcttggtcgggacttgacagtgt

SEQ ID NO: 80419 - DNA, 25 bp, S. pombe
caaccggttgacagcttggcaagca

SEQ ID NO: 80420 - DNA, 25 bp, S. pombe
aatacgttagatcagctttcaggca

SEQ ID NO: 80421 - DNA, 25 bp, S. pombe
aatatcttgggctggatcttcacgt

SEQ ID NO: 80422 - DNA, 25 bp, S. pombe
aatcattatttctgctgttaccgtt

SEQ ID NO: 80423 - DNA, 25 bp, S. pombe
aatcttttactcctttgcacgtgga

SEQ ID NO: 80424 - DNA, 25 bp, S. pombe
aatcttttcccaatgctaccttgga

SEQ ID NO: 80425 - DNA, 25 bp, S. pombe
aatcttttctttatcacatgcttgt

SEQ ID NO: 80426 - DNA, 25 bp, S. pombe
aatcattattccttagccttctaga

SEQ ID NO: 80427 - DNA, 25 bp, S. pombe
aatcagctttctttacgctctatgg

SEQ ID NO: 80428 - DNA, 25 bp, S. pombe
aatcatgccactattactgtcgctg

SEQ ID NO: 80429 - DNA, 25 bp, S. pombe
aatcacttcctcctgctcttactgt

SEQ ID NO: 80430 - DNA, 25 bp, S. pombe
aatcactttctcgtcgtattcacta

SEQ ID NO: 80431 - DNA, 25 bp, S. pombe
aatactattctcacagttcttggtg

SEQ ID NO: 80432 - DNA, 25 bp, S. pombe
aatactcaattctcgcttcctaata

SEQ ID NO: 80433 - DNA, 25 bp, S. pombe
aataattatactaccttcgcggaat

SEQ ID NO: 80434 - DNA, 25 bp, S. pombe
aatagagaccagtatccacgaccac

SEQ ID NO: 80435 - DNA, 25 bp, S. pombe
aatcaaatcctgatacttccgcgac

SEQ ID NO: 80436 - DNA, 25 bp, S. pombe
aatacaattggtggccttcgcgagt

SEQ ID NO: 80437 - DNA, 25 bp, S. pombe
aataacatacgctactacatcctcc

SEQ ID NO: 80438 - DNA, 25 bp, S. pombe
aataacaacgcttctaacaccttct

SEQ ID NO: 80439 - DNA, 25 bp, S. pombe
aataatatttcagttcggcctcccg

SEQ ID NO: 80440 - DNA, 25 bp, S. pombe
aatcaggcgttactgctagtgctat

SEQ ID NO: 80441 - DNA, 25 bp, S. pombe
aatcatcctgttttgagagcacctt

SEQ ID NO: 80442 - DNA, 25 bp, S. pombe
aatcatttcttgtcgcatagagcgc

SEQ ID NO: 80443 - DNA, 25 bp, S. pombe
aatcatttattttcacctcctcttc

SEQ ID NO: 80444 - DNA, 25 bp, S. pombe
aatattccttactcgctggtttaat

SEQ ID NO: 80445 - DNA, 25 bp, S. pombe
aatattccgaactcacccagtacga

SEQ ID NO: 80446 - DNA, 25 bp, S. pombe
caattcctgaaagtcgcccaagtac

SEQ ID NO: 80447 - DNA, 25 bp, S. pombe
aatttgggtaatgttcgtggaggct

SEQ ID NO: 80448 - DNA, 25 bp, S. pombe
caatgtttggtgctgttttggccgt

SEQ ID NO: 80449 - DNA, 25 bp, S. pombe
cacttgtcgctgtttttcttggact

SEQ ID NO: 80450 - DNA, 25 bp, S. pombe
ccttgttccttttgggaggacgcag

SEQ ID NO: 80451 - DNA, 25 bp, S. pombe
cgtcctagtcaagggagttctccta

SEQ ID NO: 80452 - DNA, 25 bp, S. pombe
cagtacttaagaccgatgtttccta

SEQ ID NO: 80453 - DNA, 25 bp, S. pombe
aatacttcaagatctagttcccctt

SEQ ID NO: 80454 - DNA, 25 bp, S. pombe
aatcacggcggtaattctacgatgc

SEQ ID NO: 80455 - DNA, 25 bp, S. pombe
caacttaacgttgctcctcatttat

SEQ ID NO: 80456 - DNA, 25 bp, S. pombe
aattatctgaactcgatcttcgtgg

SEQ ID NO: 80457 - DNA, 25 bp, S. pombe
aattgtttctcatgtgggagggaac

SEQ ID NO: 80458 - DNA, 25 bp, S. pombe
aatttttcgccaattgggtcgccat

SEQ ID NO: 80459 - DNA, 25 bp, S. pombe
aatattcccacgtgtttgtttatga

SEQ ID NO: 80460 - DNA, 25 bp, S. pombe
gaatacgttcggttgtccgtcttct

SEQ ID NO: 80461 - DNA, 25 bp, S. pombe
aataaattactcgtccgcgatcgtc

SEQ ID NO: 80462 - DNA, 25 bp, S. pombe
aatcaaaatacacctgctggtccca

SEQ ID NO: 80463 - DNA, 25 bp, S. pombe
aatatagatctttgctggagggtca

SEQ ID NO: 80464 - DNA, 25 bp, S. pombe
aatacattctgctgatgccaactcg

SEQ ID NO: 80465 - DNA, 25 bp, S. pombe
aattccctgacaagcttcctaggtt

SEQ ID NO: 80466 - DNA, 25 bp, S. pombe
aatactcgtatcactgatccagagg

SEQ ID NO: 80467 - DNA, 25 bp, S. pombe
aatcaccctgatagtattccaattg

SEQ ID NO: 80468 - DNA, 25 bp, S. pombe
aataccctccgaatggccatgaatg

SEQ ID NO: 80469 - DNA, 25 bp, S. pombe
aatacacccctcttggaatgaatgt

SEQ ID NO: 80470 - DNA, 25 bp, S. pombe
aatagccgttcttattttgatcgtg

SEQ ID NO: 80471 - DNA, 25 bp, S. pombe
aatagcctttctgtattttcagtgc

SEQ ID NO: 80472 - DNA, 25 bp, S. pombe
aatcaagttccctcattgtcaattg

SEQ ID NO: 80473 - DNA, 25 bp, S. pombe
aataagttctattcgagcccaagca

SEQ ID NO: 80474 - DNA, 25 bp, S. pombe
aataagcgtctttctaccttagaag

SEQ ID NO: 80475 - DNA, 25 bp, S. pombe
aatcacatgtgtatatcccacggta

SEQ ID NO: 80476 - DNA, 25 bp, S. pombe
aatcacttgtttgcccatctttata

SEQ ID NO: 80477 - DNA, 25 bp, S. pombe
aatacagcatgtttcgcatcgcatc

SEQ ID NO: 80478 - DNA, 25 bp, S. pombe
aatacagctttcatctgctcatggc

SEQ ID NO: 80479 - DNA, 25 bp, S. pombe
aatacacttctacctgcattaaacg

SEQ ID NO: 80480 - DNA, 25 bp, S. pombe
aatagccgccatttcaattgatggg

SEQ ID NO: 80481 - DNA, 25 bp, S. pombe
aatcacgttctttgcaagtgcacag

SEQ ID NO: 80482 - DNA, 25 bp, S. pombe
aatcacagcctatagacagcgccgt

SEQ ID NO: 80483 - DNA, 25 bp, S. pombe
aatcagcacttagcaagttgcctgt

SEQ ID NO: 80484 - DNA, 25 bp, S. pombe
aataacattcatattcgcatccagc

SEQ ID NO: 80485 - DNA, 25 bp, S. pombe
aataattctgctattcgctccggta

SEQ ID NO: 80486 - DNA, 25 bp, S. pombe
aatagtcctgtaacggcatggccgg

SEQ ID NO: 80487 - DNA, 25 bp, S. pombe
aatagatccgtctaccggtgttcga

SEQ ID NO: 80488 - DNA, 25 bp, S. pombe
aatacttagctctctgggtgttcca

SEQ ID NO: 80489 - DNA, 25 bp, S. pombe
aatagttcagcacccttagatttac

SEQ ID NO: 80490 - DNA, 25 bp, S. pombe
aatagttccccgaatgcagacgtat

SEQ ID NO: 80491 - DNA, 25 bp, S. pombe
aatacttcgggatttgccatccatt

SEQ ID NO: 80492 - DNA, 25 bp, S. pombe
aataattcctcatcattgtcacctg

SEQ ID NO: 80493 - DNA, 25 bp, S. pombe
aatactccctctgaaattgacgatg

SEQ ID NO: 80494 - DNA, 25 bp, S. pombe
aataccgtgttaagcgcaactgctg

SEQ ID NO: 80495 - DNA, 25 bp, S. pombe
aatactgtcggtgctgctagtttac

SEQ ID NO: 80496 - DNA, 25 bp, S. pombe
aatacttgcacgctttgtgtcgcca

SEQ ID NO: 80497 - DNA, 25 bp, S. pombe
aatactggattttcattcgggtcat

SEQ ID NO: 80498 - DNA, 25 bp, S. pombe
aatattccatgggtgcatttgcaga

SEQ ID NO: 80499 - DNA, 25 bp, S. pombe
aatagccccttaaacgttgcatcgt

SEQ ID NO: 80500 - DNA, 25 bp, S. pombe
aataccttgtttacatcgttgcgcc

SEQ ID NO: 80501 - DNA, 25 bp, S. pombe
aatacgtcctatatttcgagaggtg

SEQ ID NO: 80502 - DNA, 25 bp, S. pombe
aatcacactagtattgcctctttat

SEQ ID NO: 80503 - DNA, 25 bp, S. pombe
aatacaatatcctttccttctttct

SEQ ID NO: 80504 - DNA, 25 bp, S. pombe
aatacaagatccgttctcttccagt

SEQ ID NO: 80505 - DNA, 25 bp, S. pombe
aatacacttctccaactgttagcga

SEQ ID NO: 80506 - DNA, 25 bp, S. pombe
aatatccttctctcacttcaaggag

SEQ ID NO: 80507 - DNA, 25 bp, S. pombe
aataatcactgaagcgaccctgaaa

SEQ ID NO: 80508 - DNA, 25 bp, S. pombe
aatactcctgagttctggcgtcaaa

SEQ ID NO: 80509 - DNA, 25 bp, S. pombe
aatacctcttgttctgtactactga

SEQ ID NO: 80510 - DNA, 25 bp, S. pombe
aatacactccttggcttgaatttcc

SEQ ID NO: 80511 - DNA, 25 bp, S. pombe
aatcaacctagtcctttatcttctc

SEQ ID NO: 80512 - DNA, 25 bp, S. pombe
aataagcctgtccacgtttttctca

SEQ ID NO: 80513 - DNA, 25 bp, S. pombe
aattgtcttccgtgacgttgccaaa

SEQ ID NO: 80514 - DNA, 25 bp, S. pombe
aattttgagcctgggacgctagacg

SEQ ID NO: 80515 - DNA, 25 bp, S. pombe
aattttacgcattggtggcttacga

SEQ ID NO: 80516 - DNA, 25 bp, S. pombe
aatatttaggtgatggtccccgtct

SEQ ID NO: 80517 - DNA, 25 bp, S. pombe
aatagtatcggtattcgtgcccgtt

SEQ ID NO: 80518 - DNA, 25 bp, S. pombe
aatagtctcagatcgttcgttcaag

SEQ ID NO: 80519 - DNA, 25 bp, S. pombe
aatatgcctggaacttacgttgaca

SEQ ID NO: 80520 - DNA, 25 bp, S. pombe
aatactatggatccttcatctttgg

SEQ ID NO: 80521 - DNA, 25 bp, S. pombe
aatactgttaggagcttagtcatca

SEQ ID NO: 80522 - DNA, 25 bp, S. pombe
aataccgaagactgagcctctcgac

SEQ ID NO: 80523 - DNA, 25 bp, S. pombe
aatacactgtaattgctaccctcgg

SEQ ID NO: 80524 - DNA, 25 bp, S. pombe
aataatttcatctactgcacgctct

SEQ ID NO: 80525 - DNA, 25 bp, S. pombe
aataatggctatagctcgcgcgctc

SEQ ID NO: 80526 - DNA, 25 bp, S. pombe
aatcaagttttgcttccgtgtccat

SEQ ID NO: 80527 - DNA, 25 bp, S. pombe
aataagtctgacgtttccggcgcac

SEQ ID NO: 80528 - DNA, 25 bp, S. pombe
aataagtttcactcccgtcaatatc

SEQ ID NO: 80529 - DNA, 25 bp, S. pombe
aataagcatttctttgcccgtctta

SEQ ID NO: 80530 - DNA, 25 bp, S. pombe
gaattgctggttcatccctttttaa

SEQ ID NO: 80531 - DNA, 25 bp, S. pombe
aatagctttgctaactccttgtctg

SEQ ID NO: 80532 - DNA, 25 bp, S. pombe
aatagtttcacgacattttgccgaa

SEQ ID NO: 80533 - DNA, 25 bp, S. pombe
aataatgccatgtctgcgtctgctt

SEQ ID NO: 80534 - DNA, 25 bp, S. pombe
aatagattctgagtcgtcggcgttt

SEQ ID NO: 80535 - DNA, 25 bp, S. pombe
aataaattggacttgcggcagcatt

SEQ ID NO: 80536 - DNA, 25 bp, S. pombe
aataaattgaactctcctcatcctc

SEQ ID NO: 80537 - DNA, 25 bp, S. pombe
aataacttgactttcggctacgatg

SEQ ID NO: 80538 - DNA, 25 bp, S. pombe
aataagtttcatttcgctgccacgg

SEQ ID NO: 80539 - DNA, 25 bp, S. pombe
aataattctttcaacgcatccaacg

SEQ ID NO: 80540 - DNA, 25 bp, S. pombe
aatacagtccttgatctaccagaag

SEQ ID NO: 80541 - DNA, 25 bp, S. pombe
aatacgccttatcaaatttcctcac

SEQ ID NO: 80542 - DNA, 25 bp, S. pombe
aataccgtcgtggtggtcgcgatga

SEQ ID NO: 80543 - DNA, 25 bp, S. pombe
aatagccgccgttgtgttgccaagt

SEQ ID NO: 80544 - DNA, 25 bp, S. pombe
aataacatccttggctggtgcgcaa

SEQ ID NO: 80545 - DNA, 25 bp, S. pombe
aatacagtacgcatctggtcgaata

SEQ ID NO: 80546 - DNA, 25 bp, S. pombe
aatagtgctatcgttgctgcgtcta

SEQ ID NO: 80547 - DNA, 25 bp, S. pombe
aatactttagcttctgccgataatg

SEQ ID NO: 80548 - DNA, 25 bp, S. pombe
aatactctaattactgccgctatgg

SEQ ID NO: 80549 - DNA, 25 bp, S. pombe
aataatgtgtcttgccccatttgca

SEQ ID NO: 80550 - DNA, 25 bp, S. pombe
aataacttgcttccttatatcgcgc

SEQ ID NO: 80551 - DNA, 25 bp, S. pombe
aataatctctattccaattgctccc

SEQ ID NO: 80552 - DNA, 25 bp, S. pombe
aatacactttacgatgcttcctcgg

SEQ ID NO: 80553 - DNA, 25 bp, S. pombe
aatagcttctgagaggtctaatcaa

SEQ ID NO: 80554 - DNA, 25 bp, S. pombe
aatacggcttcccatcatagatcta

SEQ ID NO: 80555 - DNA, 25 bp, S. pombe
aatacagttgaacgccttgatcatt

SEQ ID NO: 80556 - DNA, 25 bp, S. pombe
aatacgttggcacgcattctgacct

SEQ ID NO: 80557 - DNA, 25 bp, S. pombe
aatacaatttcacgctttctgctgc

SEQ ID NO: 80558 - DNA, 25 bp, S. pombe
aataccgccagcatagtcgtacaag

SEQ ID NO: 80559 - DNA, 25 bp, S. pombe
aataccgtcgttctcgtgatgatgg

SEQ ID NO: 80560 - DNA, 25 bp, S. pombe
aatacccttggtgtctgatgtgaaa

SEQ ID NO: 80561 - DNA, 25 bp, S. pombe
aattccccggcgagcttatgaacta

SEQ ID NO: 80562 - DNA, 25 bp, S. pombe
aatagagagccttatgcccatagca

SEQ ID NO: 80563 - DNA, 25 bp, S. pombe
aatatgatactgctccccgaaagga

SEQ ID NO: 80564 - DNA, 25 bp, S. pombe
aataacttctccattagcacctttt

SEQ ID NO: 80565 - DNA, 25 bp, S. pombe
aatactactattccaaacgccatcg

SEQ ID NO: 80566 - DNA, 25 bp, S. pombe
aatattctcaatcaagttacttatg

SEQ ID NO: 80567 - DNA, 25 bp, S. pombe
gaagaccctattcttttaatccctg

SEQ ID NO: 80568 - DNA, 25 bp, S. pombe
aatacttcttatgttccttacctct

SEQ ID NO: 80569 - DNA, 25 bp, S. pombe
aatacttgtgcaggccattcaccag

SEQ ID NO: 80570 - DNA, 25 bp, S. pombe
aatactgggagtccatttccacgtt

SEQ ID NO: 80571 - DNA, 25 bp, S. pombe
aatacgtggttcaacttgcgcatca

SEQ ID NO: 80572 - DNA, 25 bp, S. pombe
aatacgcgtttcaagcagtccagta

SEQ ID NO: 80573 - DNA, 25 bp, S. pombe
gttccgaacttctgacttctgtaag

SEQ ID NO: 80574 - DNA, 25 bp, S. pombe
aatacgtactgtgaactgcctgctg

SEQ ID NO: 80575 - DNA, 25 bp, S. pombe
aatacttctaatggccgtgttgcta

SEQ ID NO: 80576 - DNA, 25 bp, S. pombe
aatacgtctcattgcctaggtttaa

SEQ ID NO: 80577 - DNA, 25 bp, S. pombe
aatagctttcagtctcttctttcta

SEQ ID NO: 80578 - DNA, 25 bp, S. pombe
aatatctctattcccgaatcagctc

SEQ ID NO: 80579 - DNA, 25 bp, S. pombe
aatacactacaaagcgtccagacag

SEQ ID NO: 80580 - DNA, 25 bp, S. pombe
aatacagaaatcagtgccgcccgtg

SEQ ID NO: 80581 - DNA, 25 bp, S. pombe
aatagccaattttcctcacctttag

SEQ ID NO: 80582 - DNA, 25 bp, S. pombe
aataccgttggtgatgaccctctag

SEQ ID NO: 80583 - DNA, 25 bp, S. pombe
aataaagttgccgttactcctcaga

SEQ ID NO: 80584 - DNA, 25 bp, S. pombe
aattacgttccggtgacttatcaga

SEQ ID NO: 80585 - DNA, 25 bp, S. pombe
aatttcaatcccatcgtttatcaga

SEQ ID NO: 80586 - DNA, 25 bp, S. pombe
aataaactctctgccgtgtgaatag

SEQ ID NO: 80587 - DNA, 25 bp, S. pombe
aataaactctgtgtcggatgtacga

SEQ ID NO: 80588 - DNA, 25 bp, S. pombe
aatactgagcttacttacgccattg

SEQ ID NO: 80589 - DNA, 25 bp, S. pombe
aatactgactttttagagctctcta

SEQ ID NO: 80590 - DNA, 25 bp, S. pombe
aatactcctgagaatccattgccta

SEQ ID NO: 80591 - DNA, 25 bp, S. pombe
aatacgctcgttatgccacagggca

SEQ ID NO: 80592 - DNA, 25 bp, S. pombe
aatacgaccagtatgctgccggaga

SEQ ID NO: 80593 - DNA, 25 bp, S. pombe
aatacatctgcttttttctgccaat

SEQ ID NO: 80594 - DNA, 25 bp, S. pombe
aatacatgcgcggtggcagtcttac

SEQ ID NO: 80595 - DNA, 25 bp, S. pombe
aattcgtgagtattgcagcattcca

SEQ ID NO: 80596 - DNA, 25 bp, S. pombe
aatactactgtggatgtctctcaat

SEQ ID NO: 80597 - DNA, 25 bp, S. pombe
aatactcatgcactcggtcttgcag

SEQ ID NO: 80598 - DNA, 25 bp, S. pombe
aatactatcatctttctgctccaga

SEQ ID NO: 80599 - DNA, 25 bp, S. pombe
aatactgatctctcttctgaatttg

SEQ ID NO: 80600 - DNA, 25 bp, S. pombe
aatactgctgctaagttcgctacct

SEQ ID NO: 80601 - DNA, 25 bp, S. pombe
aatattgcatgctgagcttccctca

SEQ ID NO: 80602 - DNA, 25 bp, S. pombe
aatatcctcatatggctgctgttaa

SEQ ID NO: 80603 - DNA, 25 bp, S. pombe
aatattgcgtcttcccatatacaga

SEQ ID NO: 80604 - DNA, 25 bp, S. pombe
aatatgccagcggatgcggtttcgt

SEQ ID NO: 80605 - DNA, 25 bp, S. pombe
aatacgctgttcttccagagtcgac

SEQ ID NO: 80606 - DNA, 25 bp, S. pombe
aatacggtcatctatcctggacacg

SEQ ID NO: 80607 - DNA, 25 bp, S. pombe
aatatgctgctgacacttcggtaca

SEQ ID NO: 80608 - DNA, 25 bp, S. pombe
aatacagatcattctactggtgata

SEQ ID NO: 80609 - DNA, 25 bp, S. pombe
aatacatgctattcttgctgaggta

SEQ ID NO: 80610 - DNA, 25 bp, S. pombe
aatacgctatctactctgatgggaa

SEQ ID NO: 80611 - DNA, 25 bp, S. pombe
aataccttggtgagggtccacgtat

SEQ ID NO: 80612 - DNA, 25 bp, S. pombe
aatacctatgtttttggctctacgt

SEQ ID NO: 80613 - DNA, 25 bp, S. pombe
aataccaatgttttggctctcgccg

SEQ ID NO: 80614 - DNA, 25 bp, S. pombe
gaaatctcgttggacgggacccctg

SEQ ID NO: 80615 - DNA, 25 bp, S. pombe
aatatttgtctcgacacagctcgcc

SEQ ID NO: 80616 - DNA, 25 bp, S. pombe
aatatctaatgtcccattctcgacg

SEQ ID NO: 80617 - DNA, 25 bp, S. pombe
aatttaattgaccaacatggactga

SEQ ID NO: 80618 - DNA, 25 bp, S. pombe
aatttaactgaccaacatggaatgg

SEQ ID NO: 80619 - DNA, 25 bp, S. pombe
aatttaactgaccaacatggaatgg

SEQ ID NO: 80620 - DNA, 25 bp, S. pombe
aatagggccaattgcagtccttgat

SEQ ID NO: 80621 - DNA, 25 bp, S. pombe
aatagcggacctacaaggcttgtac

SEQ ID NO: 80622 - DNA, 25 bp, S. pombe
aatagaggtccatccattccttcag

SEQ ID NO: 80623 - DNA, 25 bp, S. pombe
aatatggtcaatttccttcctcttg

SEQ ID NO: 80624 - DNA, 25 bp, S. pombe
aatagtcatcgttatcctttccttt

SEQ ID NO: 80625 - DNA, 25 bp, S. pombe
aatatccagcccatattgttgccgt

SEQ ID NO: 80626 - DNA, 25 bp, S. pombe
aattcctgcaatcaatggctccata

SEQ ID NO: 80627 - DNA, 25 bp, S. pombe
aatatccgtcatcgaatgcgtcaaa

SEQ ID NO: 80628 - DNA, 25 bp, S. pombe
aatatcactacttaccgtcaacatc

SEQ ID NO: 80629 - DNA, 25 bp, S. pombe
aatacgacgactatagcgccatctc

SEQ ID NO: 80630 - DNA, 25 bp, S. pombe
aatattgccagactatttcccatcc

SEQ ID NO: 80631 - DNA, 25 bp, S. pombe
aatattgctgaggttcaagccgaac

SEQ ID NO: 80632 - DNA, 25 bp, S. pombe
aattctcgagatagtaaggctggtc

SEQ ID NO: 80633 - DNA, 25 bp, S. pombe
caattatcgtcaattaaggaccctt

SEQ ID NO: 80634 - DNA, 25 bp, S. pombe
aattacgattttaaggccgctggct

SEQ ID NO: 80635 - DNA, 25 bp, S. pombe
aattccgattctgaagacctctctt

SEQ ID NO: 80636 - DNA, 25 bp, S. pombe
aatatcactggattcacgaccacct

SEQ ID NO: 80637 - DNA, 25 bp, S. pombe
aatactttggcttgcatctgtaaca

SEQ ID NO: 80638 - DNA, 25 bp, S. pombe
aatactctcgtctttcatgtgcatt

SEQ ID NO: 80639 - DNA, 25 bp, S. pombe
aatactgtcgtgttcatcatcgtct

SEQ ID NO: 80640 - DNA, 25 bp, S. pombe
aatttaaaaccgcagcacaccttcg

SEQ ID NO: 80641 - DNA, 25 bp, S. pombe
aatacccatcatttccagaggcttc

SEQ ID NO: 80642 - DNA, 25 bp, S. pombe
aatactcgattccattcaaggcatt

SEQ ID NO: 80643 - DNA, 25 bp, S. pombe
aatttggctgacttattattcctta

SEQ ID NO: 80644 - DNA, 25 bp, S. pombe
aatttttgccaagccaacagcccat

SEQ ID NO: 80645 - DNA, 25 bp, S. pombe
aattatggctcgttactgcttaaga

SEQ ID NO: 80646 - DNA, 25 bp, S. pombe
aattaggtcttgtcacatctggtgg

SEQ ID NO: 80647 - DNA, 25 bp, S. pombe
aattgctgtacacgtctaatacccc

SEQ ID NO: 80648 - DNA, 25 bp, S. pombe
aattttcttcgtcaacttcgcgtat

SEQ ID NO: 80649 - DNA, 25 bp, S. pombe
aattattggtttcatcctcccgata

SEQ ID NO: 80650 - DNA, 25 bp, S. pombe
aattttttgcgtgatcaatccggaa

SEQ ID NO: 80651 - DNA, 25 bp, S. pombe
aattatttatcgttctgcatgtcca

SEQ ID NO: 80652 - DNA, 25 bp, S. pombe
aatattttacgtccagcactacaag

SEQ ID NO: 80653 - DNA, 25 bp, S. pombe
aatactatcttctttgtctcgttcc

SEQ ID NO: 80654 - DNA, 25 bp, S. pombe
aatactctcgtactgatgttgcgtt

SEQ ID NO: 80655 - DNA, 25 bp, S. pombe
aatactctgcgtttgatcgatcgga

SEQ ID NO: 80656 - DNA, 25 bp, S. pombe
aatacgctagtcttgctcgtggtga

SEQ ID NO: 80657 - DNA, 25 bp, S. pombe
aatacgcttcatcttcatttgctga

SEQ ID NO: 80658 - DNA, 25 bp, S. pombe
aattagttctgctcaagtcccaatc

SEQ ID NO: 80659 - DNA, 25 bp, S. pombe
aatttgttcatagacgtccgagttt

SEQ ID NO: 80660 - DNA, 25 bp, S. pombe
aatatatctcattacggcaccgtta

SEQ ID NO: 80661 - DNA, 25 bp, S. pombe
aatttctgtcacaaaagccgggaga

SEQ ID NO: 80662 - DNA, 25 bp, S. pombe
aattcaacttggtcaaccagctgag

SEQ ID NO: 80663 - DNA, 25 bp, S. pombe
aattatatctatggccaatcgtgga

SEQ ID NO: 80664 - DNA, 25 bp, S. pombe
aatatttctgtggtcgatgcgtcga

SEQ ID NO: 80665 - DNA, 25 bp, S. pombe
aattttgctgctgctaatgtttaca

SEQ ID NO: 80666 - DNA, 25 bp, S. pombe
caataaaaccattaagcccctctcg

SEQ ID NO: 80667 - DNA, 25 bp, S. pombe
aatataccacctttgcaagccattc

SEQ ID NO: 80668 - DNA, 25 bp, S. pombe
aataccgtccttgcgtatcatttag

SEQ ID NO: 80669 - DNA, 25 bp, S. pombe
aattacgtccttctactgcaggtag

SEQ ID NO: 80670 - DNA, 25 bp, S. pombe
aatttcttccttcgtacatacgctt

SEQ ID NO: 80671 - DNA, 25 bp, S. pombe
aattacatttggcttcgactcttcg

SEQ ID NO: 80672 - DNA, 25 bp, S. pombe
aataggtgcttatggtttttgctgg

SEQ ID NO: 80673 - DNA, 25 bp, S. pombe
aatacctcgctcctgaattgctttt

SEQ ID NO: 80674 - DNA, 25 bp, S. pombe
aatattccgcatcagactatcttgg

SEQ ID NO: 80675 - DNA, 25 bp, S. pombe
aatatgtctgtctggtttacgtgaa

SEQ ID NO: 80676 - DNA, 25 bp, S. pombe
aatatttgtcatttccttacttgga

SEQ ID NO: 80677 - DNA, 25 bp, S. pombe
aatttgaaaacttggcctgcttatc

SEQ ID NO: 80678 - DNA, 25 bp, S. pombe
aatttataaagctccacctccatat

SEQ ID NO: 80679 - DNA, 25 bp, S. pombe
aattctggcttctggaggaggtact

SEQ ID NO: 80680 - DNA, 25 bp, S. pombe
aatattgatattccaccttctcctc

SEQ ID NO: 80681 - DNA, 25 bp, S. pombe
aatacgatgctgattgtttgccgat

SEQ ID NO: 80682 - DNA, 25 bp, S. pombe
aatagcaggaattgtccctccggga

SEQ ID NO: 80683 - DNA, 25 bp, S. pombe
aattgctaaggttgaccgtgccgtc

SEQ ID NO: 80684 - DNA, 25 bp, S. pombe
aatttaaggctgcagcggcttcgtc

SEQ ID NO: 80685 - DNA, 25 bp, S. pombe
gaatttacgggctgtggtttgctaa

SEQ ID NO: 80686 - DNA, 25 bp, S. pombe
aatttactgggtgctcaactgttag

SEQ ID NO: 80687 - DNA, 25 bp, S. pombe
aatttacctgttcttccgttcagag

SEQ ID NO: 80688 - DNA, 25 bp, S. pombe
aattttccgtcgtttgggtgatcag

SEQ ID NO: 80689 - DNA, 25 bp, S. pombe
aatttagcgctgtgtattgggccca

SEQ ID NO: 80690 - DNA, 25 bp, S. pombe
aattatcgacagtgtggtctgcccc

SEQ ID NO: 80691 - DNA, 25 bp, S. pombe
aattcttcaagcagtttcgccttta

SEQ ID NO: 80692 - DNA, 25 bp, S. pombe
aataccgctactttatacagttctt

SEQ ID NO: 80693 - DNA, 25 bp, S. pombe
aatacgctttatttagttgctctat

SEQ ID NO: 80694 - DNA, 25 bp, S. pombe
aatatttgtcttttcgttgccttcg

SEQ ID NO: 80695 - DNA, 25 bp, S. pombe
aatattcagcatacgattcgggcct

SEQ ID NO: 80696 - DNA, 25 bp, S. pombe
aatattgccatgtcgggtgggccca

SEQ ID NO: 80697 - DNA, 25 bp, S. pombe
aatatatatccaccgacgattccct

SEQ ID NO: 80698 - DNA, 25 bp, S. pombe
gaaggcaacctttacaactacctcg

SEQ ID NO: 80699 - DNA, 25 bp, S. pombe
aattattccttatcaactagttcaa

SEQ ID NO: 80700 - DNA, 25 bp, S. pombe
aattataccttctcaagtgcgctgg

SEQ ID NO: 80701 - DNA, 25 bp, S. pombe
aattaacgttgccaagcttcgcggc

SEQ ID NO: 80702 - DNA, 25 bp, S. pombe
aattttacgcttatcccattcttgc

SEQ ID NO: 80703 - DNA, 25 bp, S. pombe
aatatctcataagcctttggtcccc

SEQ ID NO: 80704 - DNA, 25 bp, S. pombe
aattccaatattcttttccgctctt

SEQ ID NO: 80705 - DNA, 25 bp, S. pombe
aatttccatattctagtgtcgccgc

SEQ ID NO: 80706 - DNA, 25 bp, S. pombe
aatttgccaagtacggtttctgtga

SEQ ID NO: 80707 - DNA, 25 bp, S. pombe
aatatctttcttcagaggctcaagg

SEQ ID NO: 80708 - DNA, 25 bp, S. pombe
aatattttgctactcaggccttaga

SEQ ID NO: 80709 - DNA, 25 bp, S. pombe
aatagtattctttcacgacttcagt

SEQ ID NO: 80710 - DNA, 25 bp, S. pombe
aatatggactttgatcgccttagat

SEQ ID NO: 80711 - DNA, 25 bp, S. pombe
aatatgaactttatgcctcctgaaa

SEQ ID NO: 80712 - DNA, 25 bp, S. pombe
aataccgcattttcttatgagccta

SEQ ID NO: 80713 - DNA, 25 bp, S. pombe
aatatgtctgctgttatttacccag

SEQ ID NO: 80714 - DNA, 25 bp, S. pombe
aatatgagcgttttattcgcccaat

SEQ ID NO: 80715 - DNA, 25 bp, S. pombe
aatatggcgccttttatcgtggaac

SEQ ID NO: 80716 - DNA, 25 bp, S. pombe
aataggccctaggatgacattggaa

SEQ ID NO: 80717 - DNA, 25 bp, S. pombe
aatagctgctctttgtcattttcgc

SEQ ID NO: 80718 - DNA, 25 bp, S. pombe
aatagaatgcctcaacttcgcttcg

SEQ ID NO: 80719 - DNA, 25 bp, S. pombe
aatatatatcctcacattaccaccg

SEQ ID NO: 80720 - DNA, 25 bp, S. pombe
aattgcgatactttcctactacgtc

SEQ ID NO: 80721 - DNA, 25 bp, S. pombe
aattattactgctttgcccaaatgg

SEQ ID NO: 80722 - DNA, 25 bp, S. pombe
aatatgcttgcgagactgcagctga

SEQ ID NO: 80723 - DNA, 25 bp, S. pombe
aatatcatttgcatcctgatcgaaa

SEQ ID NO: 80724 - DNA, 25 bp, S. pombe
aatttgcttgtgtaggtctcaatca

SEQ ID NO: 80725 - DNA, 25 bp, S. pombe
aatttgttggtgtgctcagacctga

SEQ ID NO: 80726 - DNA, 25 bp, S. pombe
aatattccgctatgcgtgaacaata

SEQ ID NO: 80727 - DNA, 25 bp, S. pombe
aatatcttcgcttatggtcaactca

SEQ ID NO: 80728 - DNA, 25 bp, S. pombe
aatatccacgattatgctgccaacg

SEQ ID NO: 80729 - DNA, 25 bp, S. pombe
caatacgacgagttggccaagccaa

SEQ ID NO: 80730 - DNA, 25 bp, S. pombe
aatttgcctgctttacacaagccac

SEQ ID NO: 80731 - DNA, 25 bp, S. pombe
aatttgcttcgattactcaacccgt

SEQ ID NO: 80732 - DNA, 25 bp, S. pombe
aattcttccggtgctgatcgatctt

SEQ ID NO: 80733 - DNA, 25 bp, S. pombe
aatttgtacttccatcttctgctta

SEQ ID NO: 80734 - DNA, 25 bp, S. pombe
aatttgtttggcctttgtgttgatg

SEQ ID NO: 80735 - DNA, 25 bp, S. pombe
aatattttagttccctcagttgatg

SEQ ID NO: 80736 - DNA, 25 bp, S. pombe
aatttttggtctcattagctggctg

SEQ ID NO: 80737 - DNA, 25 bp, S. pombe
aatatcacatcttcgactgttgagg

SEQ ID NO: 80738 - DNA, 25 bp, S. pombe
aatatgccacttttctgttgaacaa

SEQ ID NO: 80739 - DNA, 25 bp, S. pombe
aatatccccttctattctgaatcaa

SEQ ID NO: 80740 - DNA, 25 bp, S. pombe
aatatacaattgttcctccttccgt

SEQ ID NO: 80741 - DNA, 25 bp, S. pombe
aatatcttcttcttcttcgattcct

SEQ ID NO: 80742 - DNA, 25 bp, S. pombe
aatatcgtgttgctcttggtatctc

SEQ ID NO: 80743 - DNA, 25 bp, S. pombe
aatatcgtgcttggcttgcttctaa

SEQ ID NO: 80744 - DNA, 25 bp, S. pombe
aattcggccctgatgtttcaaaacg

SEQ ID NO: 80745 - DNA, 25 bp, S. pombe
aatttactccctttctgactatcga

SEQ ID NO: 80746 - DNA, 25 bp, S. pombe
aatttagtactgcacctgacttggt

SEQ ID NO: 80747 - DNA, 25 bp, S. pombe
aatttcttgactatcctgacattga

SEQ ID NO: 80748 - DNA, 25 bp, S. pombe
aatatgcttctatttgttcccaaac

SEQ ID NO: 80749 - DNA, 25 bp, S. pombe
aatatgatcgtgatggttgccctcg

SEQ ID NO: 80750 - DNA, 25 bp, S. pombe
aatattcctgttgttgtcgccatca

SEQ ID NO: 80751 - DNA, 25 bp, S. pombe
aatatttttatctctcctcccaatt

SEQ ID NO: 80752 - DNA, 25 bp, S. pombe
aatttttgctacactcacgtcctat

SEQ ID NO: 80753 - DNA, 25 bp, S. pombe
aattattcggaagcaccgtcttcaa

SEQ ID NO: 80754 - DNA, 25 bp, S. pombe
aatttggctcaatggacctgctcga

SEQ ID NO: 80755 - DNA, 25 bp, S. pombe
aattgggctcctatgaacttcgggt

SEQ ID NO: 80756 - DNA, 25 bp, S. pombe
aatttgccgaccgtggattttatgg

SEQ ID NO: 80757 - DNA, 25 bp, S. pombe
aattcctcaccgtgttgtcagtgct

SEQ ID NO: 80758 - DNA, 25 bp, S. pombe
aatttctctctcaatgggtttggat

SEQ ID NO: 80759 - DNA, 25 bp, S. pombe
aattcaccaatttacctctacttgc

SEQ ID NO: 80760 - DNA, 25 bp, S. pombe
aatttaaatgtttcctctccactgg

SEQ ID NO: 80761 - DNA, 25 bp, S. pombe
aattatcaaaacaatccctcgcgcg

SEQ ID NO: 80762 - DNA, 25 bp, S. pombe
aatttaagatacatttttggcgaca

SEQ ID NO: 80763 - DNA, 25 bp, S. pombe
aatttcaagacacttttttggcaag

SEQ ID NO: 80764 - DNA, 25 bp, S. pombe
aatttccttcaatcattagtggcat

SEQ ID NO: 80765 - DNA, 25 bp, S. pombe
aatttccttttcctccaagatgcaa

SEQ ID NO: 80766 - DNA, 25 bp, S. pombe
aattttcggttgctccaattgcaca

SEQ ID NO: 80767 - DNA, 25 bp, S. pombe
aatatttacagtaggtccggcgact

SEQ ID NO: 80768 - DNA, 25 bp, S. pombe
aattcttaaaaggtgatctccataa

SEQ ID NO: 80769 - DNA, 25 bp, S. pombe
aatatgatcttgctattgccgctcc

SEQ ID NO: 80770 - DNA, 25 bp, S. pombe
aatatgacgctgcttaccggaccaa

SEQ ID NO: 80771 - DNA, 25 bp, S. pombe
aattagcctctgatcttgcggagtt

SEQ ID NO: 80772 - DNA, 25 bp, S. pombe
gaatgtaggacgagtgggattttta

SEQ ID NO: 80773 - DNA, 25 bp, S. pombe
caattaggagctaagggcgtccctt

SEQ ID NO: 80774 - DNA, 25 bp, S. pombe
aattaccgactactgccttaggcac

SEQ ID NO: 80775 - DNA, 25 bp, S. pombe
aattatcctacatcggttgggcaat

SEQ ID NO: 80776 - DNA, 25 bp, S. pombe
aattttagaaaatcgctccctgctc

SEQ ID NO: 80777 - DNA, 25 bp, S. pombe
aattttttgcaaaagtgcgctctgc

SEQ ID NO: 80778 - DNA, 25 bp, S. pombe
aatagtgatccttcttcgacttggg

SEQ ID NO: 80779 - DNA, 25 bp, S. pombe
aatagtcatgcctagttcggttcgt

SEQ ID NO: 80780 - DNA, 25 bp, S. pombe
aatatacacctactgatcgccttac

SEQ ID NO: 80781 - DNA, 25 bp, S. pombe
aattcccttgaactagcagtctcac

SEQ ID NO: 80782 - DNA, 25 bp, S. pombe
aatttccttgtaaagcttctgccca

SEQ ID NO: 80783 - DNA, 25 bp, S. pombe
aatatgtcggtgaaggtgctcgtat

SEQ ID NO: 80784 - DNA, 25 bp, S. pombe
aatattggccgtcgctatgctcgta

SEQ ID NO: 80785 - DNA, 25 bp, S. pombe
caatgttggacctgcggagcttgta

SEQ ID NO: 80786 - DNA, 25 bp, S. pombe
aatttgtatctctgcggatctgcgt

SEQ ID NO: 80787 - DNA, 25 bp, S. pombe
aatttgttgattaccgcagctcgtg

SEQ ID NO: 80788 - DNA, 25 bp, S. pombe
aattatcctgtatccgaaacttccg

SEQ ID NO: 80789 - DNA, 25 bp, S. pombe
aatttgcatttacccgagagcctct

SEQ ID NO: 80790 - DNA, 25 bp, S. pombe
aatttattccatgcgcaaggtgcta

SEQ ID NO: 80791 - DNA, 25 bp, S. pombe
aatttggcttgtgcagtaactgctc

SEQ ID NO: 80792 - DNA, 25 bp, S. pombe
aatatctgtctgaacgcaagtccgc

SEQ ID NO: 80793 - DNA, 25 bp, S. pombe
aatatccatctgaagcttatcctcc

SEQ ID NO: 80794 - DNA, 25 bp, S. pombe
aatatccagtatacgtgcttctctc

SEQ ID NO: 80795 - DNA, 25 bp, S. pombe
aatattcagtgaacgagctcctcca

SEQ ID NO: 80796 - DNA, 25 bp, S. pombe
aatatttggcaacggtatcactcaa

SEQ ID NO: 80797 - DNA, 25 bp, S. pombe
aatatctgtgcatgttgtttctcaa

SEQ ID NO: 80798 - DNA, 25 bp, S. pombe
aattcaggcagacgcagatgcattt

SEQ ID NO: 80799 - DNA, 25 bp, S. pombe
aattgcggaagacgtcctttgcgac

SEQ ID NO: 80800 - DNA, 25 bp, S. pombe
aattactacgccttacactactgat

SEQ ID NO: 80801 - DNA, 25 bp, S. pombe
aattatttcgctgtacagccagcat

SEQ ID NO: 80802 - DNA, 25 bp, S. pombe
aatatctttctatgctttcggctca

SEQ ID NO: 80803 - DNA, 25 bp, S. pombe
aattcgtttacagcgctatggccat

SEQ ID NO: 80804 - DNA, 25 bp, S. pombe
aattcgaagtcctcttattgctaaa

SEQ ID NO: 80805 - DNA, 25 bp, S. pombe
aattcgacgtaccttttgctgtaat

SEQ ID NO: 80806 - DNA, 25 bp, S. pombe
aattcgacttagcttttgcaagagg

SEQ ID NO: 80807 - DNA, 25 bp, S. pombe
aatatttccgatttgtctggtgcac

SEQ ID NO: 80808 - DNA, 25 bp, S. pombe
aatttccccgtagttttatgcatag

SEQ ID NO: 80809 - DNA, 25 bp, S. pombe
aattaccccgtattcaactagctga

SEQ ID NO: 80810 - DNA, 25 bp, S. pombe
aatattgtatccctaccaactggcc

SEQ ID NO: 80811 - DNA, 25 bp, S. pombe
aatatgtccggttcctaactgtgat

SEQ ID NO: 80812 - DNA, 25 bp, S. pombe
aatttgtcgagctcaccaagtcgtc

SEQ ID NO: 80813 - DNA, 25 bp, S. pombe
aattttatagctgcctttgctcgct

SEQ ID NO: 80814 - DNA, 25 bp, S. pombe
aatttagatcctttcgacgagcttg

SEQ ID NO: 80815 - DNA, 25 bp, S. pombe
aatatgtgagtcctgctttgaaagc

SEQ ID NO: 80816 - DNA, 25 bp, S. pombe
aatttctctctgtttggcaatgacc

SEQ ID NO: 80817 - DNA, 25 bp, S. pombe
aatttcctcagactttcaaatccct

SEQ ID NO: 80818 - DNA, 25 bp, S. pombe
aatttccgaggcttcacacaactca

SEQ ID NO: 80819 - DNA, 25 bp, S. pombe
aatttctacgcttcattcgcatggg

SEQ ID NO: 80820 - DNA, 25 bp, S. pombe
aatatttcgtctcaagggttccagc

SEQ ID NO: 80821 - DNA, 25 bp, S. pombe
aatttctcgtctcttggcggtcttg

SEQ ID NO: 80822 - DNA, 25 bp, S. pombe
aattatcggtctttcttcggtcctg

SEQ ID NO: 80823 - DNA, 25 bp, S. pombe
aattacatcgttggtcttcggcttt

SEQ ID NO: 80824 - DNA, 25 bp, S. pombe
aattataccctcatttcgactgttc

SEQ ID NO: 80825 - DNA, 25 bp, S. pombe
aattcttcagagtcccttgatccta

SEQ ID NO: 80826 - DNA, 25 bp, S. pombe
aatttctcaattgggcggtcgtatc

SEQ ID NO: 80827 - DNA, 25 bp, S. pombe
aatttaaccaccagcattcgggcaa

SEQ ID NO: 80828 - DNA, 25 bp, S. pombe
aattttatttccacatccgagctaa

SEQ ID NO: 80829 - DNA, 25 bp, S. pombe
aattattacttccacctagagccga

SEQ ID NO: 80830 - DNA, 25 bp, S. pombe
aattgaatttccttcctaccgcgat

SEQ ID NO: 80831 - DNA, 25 bp, S. pombe
aattaatctttatcgttttcatgat

SEQ ID NO: 80832 - DNA, 25 bp, S. pombe
aatatttcctatctcgctttttgtc

SEQ ID NO: 80833 - DNA, 25 bp, S. pombe
aattttgtcgatcctctttacgaag

SEQ ID NO: 80834 - DNA, 25 bp, S. pombe
aatatttgtagacccattcgaagag

SEQ ID NO: 80835 - DNA, 25 bp, S. pombe
aatatagcaagccatctcgtccaac

SEQ ID NO: 80836 - DNA, 25 bp, S. pombe
aattgcgaaaaacagcccgcttctc

SEQ ID NO: 80837 - DNA, 25 bp, S. pombe
aatatgctcgattctacctatacaa

SEQ ID NO: 80838 - DNA, 25 bp, S. pombe
caattccaaatctccttactacgtt

SEQ ID NO: 80839 - DNA, 25 bp, S. pombe
aattcaaacttctctttcttctgcc

SEQ ID NO: 80840 - DNA, 25 bp, S. pombe
aattcttacttcttattgccaactg

SEQ ID NO: 80841 - DNA, 25 bp, S. pombe
aattacccggagttcgcaaggcatc

SEQ ID NO: 80842 - DNA, 25 bp, S. pombe
aatttccgcacctagtgaattgccc

SEQ ID NO: 80843 - DNA, 25 bp, S. pombe
aatttgccgcgccatcagttttgat

SEQ ID NO: 80844 - DNA, 25 bp, S. pombe
aatttgcgcgaaatgctatcggaac

SEQ ID NO: 80845 - DNA, 25 bp, S. pombe
aatttagtaatttctgacgccatga

SEQ ID NO: 80846 - DNA, 25 bp, S. pombe
aattcattggcgatcgatgcgagct

SEQ ID NO: 80847 - DNA, 25 bp, S. pombe
aatttgtcatccttcattctagcac

SEQ ID NO: 80848 - DNA, 25 bp, S. pombe
aatatcattggcttcttgcgtcagg

SEQ ID NO: 80849 - DNA, 25 bp, S. pombe
aatatcacgcgatgattgccctgcg

SEQ ID NO: 80850 - DNA, 25 bp, S. pombe
aattaatcgtattcgcgaccctgaa

SEQ ID NO: 80851 - DNA, 25 bp, S. pombe
aatttgattgctgtcactccaccta

SEQ ID NO: 80852 - DNA, 25 bp, S. pombe
aatttgatgctgttgtatgctccat

SEQ ID NO: 80853 - DNA, 25 bp, S. pombe
aatttgttgtagatgctccttggcc

SEQ ID NO: 80854 - DNA, 25 bp, S. pombe
aatttgccttcatagctactctggt

SEQ ID NO: 80855 - DNA, 25 bp, S. pombe
aatattggcttgtacctaccgtggg

SEQ ID NO: 80856 - DNA, 25 bp, S. pombe
aatttgatctcacacctacactata

SEQ ID NO: 80857 - DNA, 25 bp, S. pombe
aattatgacatacgccctcaacgtg

SEQ ID NO: 80858 - DNA, 25 bp, S. pombe
aattcaatgttactgcctcaatggg

SEQ ID NO: 80859 - DNA, 25 bp, S. pombe
aattcaatgttcctgctctagctag

SEQ ID NO: 80860 - DNA, 25 bp, S. pombe
aattcgttgacttggctagttgcac

SEQ ID NO: 80861 - DNA, 25 bp, S. pombe
aatttgcttgataatgtctattgga

SEQ ID NO: 80862 - DNA, 25 bp, S. pombe
aatttctcgatgacgccaaatgcga

SEQ ID NO: 80863 - DNA, 25 bp, S. pombe
aattaccgagacgactataggcatc

SEQ ID NO: 80864 - DNA, 25 bp, S. pombe
aattcaccagaaggcgatcttcctc

SEQ ID NO: 80865 - DNA, 25 bp, S. pombe
aattgcatgccgcatccgggcaaaa

SEQ ID NO: 80866 - DNA, 25 bp, S. pombe
aattatcgcggtggctatggttaaa

SEQ ID NO: 80867 - DNA, 25 bp, S. pombe
aatttctgcgtttcttggttgacac

SEQ ID NO: 80868 - DNA, 25 bp, S. pombe
aattttcctatctttgcgactgcta

SEQ ID NO: 80869 - DNA, 25 bp, S. pombe
aatttatccaacttgcctgcacatg

SEQ ID NO: 80870 - DNA, 25 bp, S. pombe
aattatttcgatcaggcattggcgg

SEQ ID NO: 80871 - DNA, 25 bp, S. pombe
aatttcatattgtgccgttgcgcgg

SEQ ID NO: 80872 - DNA, 25 bp, S. pombe
aatttgcagacttgcgtcagcttcc

SEQ ID NO: 80873 - DNA, 25 bp, S. pombe
aatttcaagctagtgtcgttcctcg

SEQ ID NO: 80874 - DNA, 25 bp, S. pombe
aatttcgatcgagtttctgtcctct

SEQ ID NO: 80875 - DNA, 25 bp, S. pombe
aattatgcccgggttggtcgtcatg

SEQ ID NO: 80876 - DNA, 25 bp, S. pombe
aattattcggtggtatggctcctgc

SEQ ID NO: 80877 - DNA, 25 bp, S. pombe
aatttggtcctcaattttctcaccg

SEQ ID NO: 80878 - DNA, 25 bp, S. pombe
aatttggctccaagtttgtctacaa

SEQ ID NO: 80879 - DNA, 25 bp, S. pombe
aatttcgtcctcctattggcaagtt

SEQ ID NO: 80880 - DNA, 25 bp, S. pombe
aatttctgatccttcttcgtgcaac

SEQ ID NO: 80881 - DNA, 25 bp, S. pombe
aatttgtatcgcttttcggattcag

SEQ ID NO: 80882 - DNA, 25 bp, S. pombe
aatttgcctcgaattactcgtatcg

SEQ ID NO: 80883 - DNA, 25 bp, S. pombe
aatttgcctcaagatattcgccaag

SEQ ID NO: 80884 - DNA, 25 bp, S. pombe
aattcatatccctggtcagcctatg

SEQ ID NO: 80885 - DNA, 25 bp, S. pombe
aatttacccaacgatgcccaggatg

SEQ ID NO: 80886 - DNA, 25 bp, S. pombe
aattatgaacaacccctacttgctc

SEQ ID NO: 80887 - DNA, 25 bp, S. pombe
aatttaacaatacccgatctccatc

SEQ ID NO: 80888 - DNA, 25 bp, S. pombe
aattttccagtccatgcatcttcaa

SEQ ID NO: 80889 - DNA, 25 bp, S. pombe
aattccgctaagtttgaagccttgg

SEQ ID NO: 80890 - DNA, 25 bp, S. pombe
aattcttctccgttcaaaccattag

SEQ ID NO: 80891 - DNA, 25 bp, S. pombe
aatttggcccagtatcgacaggact

SEQ ID NO: 80892 - DNA, 25 bp, S. pombe
aatttcaacgtgtcaattctctcgt

SEQ ID NO: 80893 - DNA, 25 bp, S. pombe
aatttgcaatcgaccacatccttgg

SEQ ID NO: 80894 - DNA, 25 bp, S. pombe
aatttcttcgacgagcagcagtgca

SEQ ID NO: 80895 - DNA, 25 bp, S. pombe
aattacagagaacccatccgtgcta

SEQ ID NO: 80896 - DNA, 25 bp, S. pombe
aatttgcagggctcctgttgatcca

SEQ ID NO: 80897 - DNA, 25 bp, S. pombe
aatttctcctttcccagttatgact

SEQ ID NO: 80898 - DNA, 25 bp, S. pombe
aatttcttagtcatgagggtcacgc

SEQ ID NO: 80899 - DNA, 25 bp, S. pombe
aatttctctgcaacttgacggctgc

SEQ ID NO: 80900 - DNA, 25 bp, S. pombe
aatttgttgtcgcagacggctggac

SEQ ID NO: 80901 - DNA, 25 bp, S. pombe
aatttttcttttcggacagacacat

SEQ ID NO: 80902 - DNA, 25 bp, S. pombe
aattatatttttcgtgcttccaagt

SEQ ID NO: 80903 - DNA, 25 bp, S. pombe
aatttgtatctcacgtcttgctcca

SEQ ID NO: 80904 - DNA, 25 bp, S. pombe
aatttggtatcagtgcagtccccac

SEQ ID NO: 80905 - DNA, 25 bp, S. pombe
aatttgggacactgctggccaggaa

SEQ ID NO: 80906 - DNA, 25 bp, S. pombe
aatttgctttgcgtgatgatcctaa

SEQ ID NO: 80907 - DNA, 25 bp, S. pombe
aatttcccggtgaacctgacaatga

SEQ ID NO: 80908 - DNA, 25 bp, S. pombe
aattggccgaggatagctaccttaa

SEQ ID NO: 80909 - DNA, 25 bp, S. pombe
aatttacgcttgtagagctgcggat

SEQ ID NO: 80910 - DNA, 25 bp, S. pombe
aattatccgttgtagagctcgctct

SEQ ID NO: 80911 - DNA, 25 bp, S. pombe
aatttgcaacgcttggctttgctca

SEQ ID NO: 80912 - DNA, 25 bp, S. pombe
aatttgagccaattgggttctcgtc

SEQ ID NO: 80913 - DNA, 25 bp, S. pombe
aatttgcagcaatttgacgccatat

SEQ ID NO: 80914 - DNA, 25 bp, S. pombe
aatattgcactattggtcgcctttc

SEQ ID NO: 80915 - DNA, 25 bp, S. pombe
aatttactacacgtcagcctttggt

SEQ ID NO: 80916 - DNA, 25 bp, S. pombe
aattcagttaccacgcctagagagc

SEQ ID NO: 80917 - DNA, 25 bp, S. pombe
aattacttccctagtttcgagagct

SEQ ID NO: 80918 - DNA, 25 bp, S. pombe
aattcccctcttggttatcggagca

SEQ ID NO: 80919 - DNA, 25 bp, S. pombe
aattagtcctgctgcgaacatcggg

SEQ ID NO: 80920 - DNA, 25 bp, S. pombe
aatttgtcgctcttggaccattgaa

SEQ ID NO: 80921 - DNA, 25 bp, S. pombe
aattttagtctctcatgctgcatta

SEQ ID NO: 80922 - DNA, 25 bp, S. pombe
aattttatcccattcctgagtcagt

SEQ ID NO: 80923 - DNA, 25 bp, S. pombe
aatttttccaacttcagcgatcgct

SEQ ID NO: 80924 - DNA, 25 bp, S. pombe
aattctattgccgagttacctgtac

SEQ ID NO: 80925 - DNA, 25 bp, S. pombe
aattctcccgttcgtgtgaatggta

SEQ ID NO: 80926 - DNA, 25 bp, S. pombe
aattaccttcgctttgcattttgca

SEQ ID NO: 80927 - DNA, 25 bp, S. pombe
aattcaccttcagctgtttattgcc

SEQ ID NO: 80928 - DNA, 25 bp, S. pombe
aattttcttcatgcttttcttcctc

SEQ ID NO: 80929 - DNA, 25 bp, S. pombe
aattcacttgatcctccattttatg

SEQ ID NO: 80930 - DNA, 25 bp, S. pombe
aatttccgatgacacttctattttg

SEQ ID NO: 80931 - DNA, 25 bp, S. pombe
aattttggtgcgaatgggccttgtc

SEQ ID NO: 80932 - DNA, 25 bp, S. pombe
aatttatgccaattccatgacccca

SEQ ID NO: 80933 - DNA, 25 bp, S. pombe
aatttgatgcactctcgtttccgta

SEQ ID NO: 80934 - DNA, 25 bp, S. pombe
aattctgaagcatttccttcccgaa

SEQ ID NO: 80935 - DNA, 25 bp, S. pombe
aattctgcgagatatccttccttca

SEQ ID NO: 80936 - DNA, 25 bp, S. pombe
aattactgcaagctcggatggttca

SEQ ID NO: 80937 - DNA, 25 bp, S. pombe
aattactgaaccgtggtgggctata

SEQ ID NO: 80938 - DNA, 25 bp, S. pombe
aattattacacccactacagctcat

SEQ ID NO: 80939 - DNA, 25 bp, S. pombe
aattattaccattgcctacagctcc

SEQ ID NO: 80940 - DNA, 25 bp, S. pombe
aatttgcttgccaatttctcggaaa

SEQ ID NO: 80941 - DNA, 25 bp, S. pombe
aattataggaggtcttgctggaaat

SEQ ID NO: 80942 - DNA, 25 bp, S. pombe
aatttcggtggttgcgtttgctatc

SEQ ID NO: 80943 - DNA, 25 bp, S. pombe
aattatcgtctttcactgtttgctc

SEQ ID NO: 80944 - DNA, 25 bp, S. pombe
aatttctccatacgttgctgctttt

SEQ ID NO: 80945 - DNA, 25 bp, S. pombe
aattattccgatctgtggttgttca

SEQ ID NO: 80946 - DNA, 25 bp, S. pombe
aattatccaaatctcgttcttccag

SEQ ID NO: 80947 - DNA, 25 bp, S. pombe
aattattttctttcttggcacatca

SEQ ID NO: 80948 - DNA, 25 bp, S. pombe
aattcgtttctgtgagttccaccag

SEQ ID NO: 80949 - DNA, 25 bp, S. pombe
aattcgattttgtcggtgttcctgc

SEQ ID NO: 80950 - DNA, 25 bp, S. pombe
aatttatttctcttggttatgcctc

SEQ ID NO: 80951 - DNA, 25 bp, S. pombe
aattcacttccaccggatcttcgag

SEQ ID NO: 80952 - DNA, 25 bp, S. pombe
aattatttctagtgcctcttctgac

SEQ ID NO: 80953 - DNA, 25 bp, S. pombe
aatttttgttgttgactctgccgac

SEQ ID NO: 80954 - DNA, 25 bp, S. pombe
aatttttggccgtagtctcacacct

SEQ ID NO: 80955 - DNA, 25 bp, S. pombe
aatttttaccattcacacttccaag

SEQ ID NO: 80956 - DNA, 25 bp, S. pombe
aatttttcccattcggtgatccgag

SEQ ID NO: 80957 - DNA, 25 bp, S. pombe
aattaccttgcacaattgacctcaa

SEQ ID NO: 80958 - DNA, 25 bp, S. pombe
aattcaccttcccattcatatgagc

SEQ ID NO: 80959 - DNA, 25 bp, S. pombe
aattccgttatgtcgatactggcgc

SEQ ID NO: 80960 - DNA, 25 bp, S. pombe
aattgcaacgtctgcaggccgttct

SEQ ID NO: 80961 - DNA, 25 bp, S. pombe
caattggacgtcttatgtacccctt

SEQ ID NO: 80962 - DNA, 25 bp, S. pombe
aattgacagagcatttggacccttt

SEQ ID NO: 80963 - DNA, 25 bp, S. pombe
aatttcagactcatctcgacctata

SEQ ID NO: 80964 - DNA, 25 bp, S. pombe
aatttagcagctcattctcacactc

SEQ ID NO: 80965 - DNA, 25 bp, S. pombe
aatttatggctattctccgcaatcc

SEQ ID NO: 80966 - DNA, 25 bp, S. pombe
aatttatatgcttctcctgctgaac

SEQ ID NO: 80967 - DNA, 25 bp, S. pombe
aatttcatggcttctgggtcaccaa

SEQ ID NO: 80968 - DNA, 25 bp, S. pombe
aattcatgtcctatacgaccagcaa

SEQ ID NO: 80969 - DNA, 25 bp, S. pombe
aatttctgcttggaactcactagag

SEQ ID NO: 80970 - DNA, 25 bp, S. pombe
aattctgcgtgtcgtgctagtaaga

SEQ ID NO: 80971 - DNA, 25 bp, S. pombe
caattgtcgggcgtgttcaaccaaa

SEQ ID NO: 80972 - DNA, 25 bp, S. pombe
aattccggatgctgttgacccaaaa

SEQ ID NO: 80973 - DNA, 25 bp, S. pombe
caatactccgagtgtctcttctaaa

SEQ ID NO: 80974 - DNA, 25 bp, S. pombe
caataatcgtgcttacttcttccaa

SEQ ID NO: 80975 - DNA, 25 bp, S. pombe
aatttctgtcttcgagtttttctca

SEQ ID NO: 80976 - DNA, 25 bp, S. pombe
aattactgcttgaggcttatgttaa

SEQ ID NO: 80977 - DNA, 25 bp, S. pombe
aattgggccgtttattcatcgttgc

SEQ ID NO: 80978 - DNA, 25 bp, S. pombe
aattcggtccttttatgtctgttgt

SEQ ID NO: 80979 - DNA, 25 bp, S. pombe
aattctcctgtaaatggtggtcttg

SEQ ID NO: 80980 - DNA, 25 bp, S. pombe
aattccttgctatatatggcgtcct

SEQ ID NO: 80981 - DNA, 25 bp, S. pombe
aattatgctgattattctccggata

SEQ ID NO: 80982 - DNA, 25 bp, S. pombe
aattcgttttgtttgtatctgccta

SEQ ID NO: 80983 - DNA, 25 bp, S. pombe
aattttgcttgcttattttctcctg

SEQ ID NO: 80984 - DNA, 25 bp, S. pombe
aattttcctgatgagcttgttccta

SEQ ID NO: 80985 - DNA, 25 bp, S. pombe
aattcttacctattgcaacccgtat

SEQ ID NO: 80986 - DNA, 25 bp, S. pombe
aattctaatatctcgacacccgtag

SEQ ID NO: 80987 - DNA, 25 bp, S. pombe
aattcttctatccttaacccaatca

SEQ ID NO: 80988 - DNA, 25 bp, S. pombe
aattatacgtcgctatacctttccg

SEQ ID NO: 80989 - DNA, 25 bp, S. pombe
aatttattcattcatcttctgcttc

SEQ ID NO: 80990 - DNA, 25 bp, S. pombe
aattctttgcttatttcgcttctgg

SEQ ID NO: 80991 - DNA, 25 bp, S. pombe
aatttttgactccttgcttggttgc

SEQ ID NO: 80992 - DNA, 25 bp, S. pombe
aatttttgagcctattcttggtgaa

SEQ ID NO: 80993 - DNA, 25 bp, S. pombe
aattcggcgcgggtatcgatttcat

SEQ ID NO: 80994 - DNA, 25 bp, S. pombe
aattcgtaggcgctgaccttgtcga

SEQ ID NO: 80995 - DNA, 25 bp, S. pombe
aattctgtgtcttttgttttggtat

SEQ ID NO: 80996 - DNA, 25 bp, S. pombe
aattcctgtctacgatttcccttat

SEQ ID NO: 80997 - DNA, 25 bp, S. pombe
aattcatcttcttctgttattcctg

SEQ ID NO: 80998 - DNA, 25 bp, S. pombe
aattcacttggacggtttcgtgcgg

SEQ ID NO: 80999 - DNA, 25 bp, S. pombe
aattttctataacgcatttcggagt

SEQ ID NO: 81000 - DNA, 25 bp, S. pombe
cacttgttaaggtgttacaggacat

SEQ ID NO: 81001 - DNA, 25 bp, S. pombe
aattattaaagctggtcgcggtcgc

SEQ ID NO: 81002 - DNA, 25 bp, S. pombe
aattccaatcaagggtccacgtcca

SEQ ID NO: 81003 - DNA, 25 bp, S. pombe
aattcaattgcctttccagagctct

SEQ ID NO: 81004 - DNA, 25 bp, S. pombe
aattgcaccataccttcgcaatcta

SEQ ID NO: 81005 - DNA, 25 bp, S. pombe
aattaggcgcaattgccgtaaacgt

SEQ ID NO: 81006 - DNA, 25 bp, S. pombe
aattcggatcaatcaccgttgacta

SEQ ID NO: 81007 - DNA, 25 bp, S. pombe
aattttgcaacttcaggcagcccga

SEQ ID NO: 81008 - DNA, 25 bp, S. pombe
aattagtgcgtttccagattctgat

SEQ ID NO: 81009 - DNA, 25 bp, S. pombe
aattatggctgaactacgtggtgat

SEQ ID NO: 81010 - DNA, 25 bp, S. pombe
aattgcctcgcaactatacttgtcc

SEQ ID NO: 81011 - DNA, 25 bp, S. pombe
aattgcgcgagcgtgcagtggaatt

SEQ ID NO: 81012 - DNA, 25 bp, S. pombe
aattctgagcttcgtcagcggttca

SEQ ID NO: 81013 - DNA, 25 bp, S. pombe
aattcttggtgatggtgctgctggt

SEQ ID NO: 81014 - DNA, 25 bp, S. pombe
aattttgttgtacctggtgctgtcc

SEQ ID NO: 81015 - DNA, 25 bp, S. pombe
aattttttatctccatgggcagacc

SEQ ID NO: 81016 - DNA, 25 bp, S. pombe
aattgtttctatctcagcggaccca

SEQ ID NO: 81017 - DNA, 25 bp, S. pombe
aattccaccaatttctgcacgttta

SEQ ID NO: 81018 - DNA, 25 bp, S. pombe
aattacattctctgaacctcatcct

SEQ ID NO: 81019 - DNA, 25 bp, S. pombe
aattatgttgcctgagcccaagacc

SEQ ID NO: 81020 - DNA, 25 bp, S. pombe
aattagttgctcaggctgccaggca

SEQ ID NO: 81021 - DNA, 25 bp, S. pombe
aattacggacgtgatgctgctgatc

SEQ ID NO: 81022 - DNA, 25 bp, S. pombe
aattagccgaacgtctggctgctcg

SEQ ID NO: 81023 - DNA, 25 bp, S. pombe
aattcgcgaaagttttgctcatgca

SEQ ID NO: 81024 - DNA, 25 bp, S. pombe
caattagtcgggttttatggcacat

SEQ ID NO: 81025 - DNA, 25 bp, S. pombe
aattatgcgcgagagtccaaggcct

SEQ ID NO: 81026 - DNA, 25 bp, S. pombe
aattcttctggtcaacgacagccgt

SEQ ID NO: 81027 - DNA, 25 bp, S. pombe
aattcctaaaactctggctgcaaat

SEQ ID NO: 81028 - DNA, 25 bp, S. pombe
aattcctaataaacctcatcctcaa

SEQ ID NO: 81029 - DNA, 25 bp, S. pombe
aattctaatgtttctccttctacca

SEQ ID NO: 81030 - DNA, 25 bp, S. pombe
aattcattggtttttcttgctatca

SEQ ID NO: 81031 - DNA, 25 bp, S. pombe
aattgctttcgttttcggtcaaatg

SEQ ID NO: 81032 - DNA, 25 bp, S. pombe
gccctcccggatgctaaattttttg

SEQ ID NO: 81033 - DNA, 25 bp, S. pombe
gcccgatggaccgtcaaacttttgt

SEQ ID NO: 81034 - DNA, 25 bp, S. pombe
ctcaatttcgagcatcacctaggaa

SEQ ID NO: 81035 - DNA, 25 bp, S. pombe
aattcagactagtgctgctgctgct

SEQ ID NO: 81036 - DNA, 25 bp, S. pombe
aattcgccattattcatgctgctgc

SEQ ID NO: 81037 - DNA, 25 bp, S. pombe
aattcccattggtatccatgcggac

SEQ ID NO: 81038 - DNA, 25 bp, S. pombe
aattcttgtgcggttgttggagcga

SEQ ID NO: 81039 - DNA, 25 bp, S. pombe
aattgcggtcggtttgtataactca

SEQ ID NO: 81040 - DNA, 25 bp, S. pombe
aattggtagcgacatgcgcctacac

SEQ ID NO: 81041 - DNA, 25 bp, S. pombe
aattgtcggtcaggtttctggcagt

SEQ ID NO: 81042 - DNA, 25 bp, S. pombe
aattgtagaccgttggcctttgcaa

SEQ ID NO: 81043 - DNA, 25 bp, S. pombe
aattgttgggaacgccgcctatgga

SEQ ID NO: 81044 - DNA, 25 bp, S. pombe
aattgattcgactaagcctgaagct

SEQ ID NO: 81045 - DNA, 25 bp, S. pombe
aattcagccattgcatcaggaaagt

SEQ ID NO: 81046 - DNA, 25 bp, S. pombe
aattcagccataacttacggagggt

SEQ ID NO: 81047 - DNA, 25 bp, S. pombe
aattcatccagactcttgacggcgg

SEQ ID NO: 81048 - DNA, 25 bp, S. pombe
aattcctagctcattatctttgggc

SEQ ID NO: 81049 - DNA, 25 bp, S. pombe
aattcattactcttttcatctttac

SEQ ID NO: 81050 - DNA, 25 bp, S. pombe
aattcattcactctcttcatcaaag

SEQ ID NO: 81051 - DNA, 25 bp, S. pombe
aattcactcccatttctgttattct

SEQ ID NO: 81052 - DNA, 25 bp, S. pombe
aattgttcctttagagcgtgagcct

SEQ ID NO: 81053 - DNA, 25 bp, S. pombe
aattactttgctaccttagatgcgt

SEQ ID NO: 81054 - DNA, 25 bp, S. pombe
aattatttgcgatccttcacttgaa

SEQ ID NO: 81055 - DNA, 25 bp, S. pombe
aattgagcaagatcctccacttcct

SEQ ID NO: 81056 - DNA, 25 bp, S. pombe
aattccttacttggcaacatcaaag

SEQ ID NO: 81057 - DNA, 25 bp, S. pombe
aattgctttttcattccatactccg

SEQ ID NO: 81058 - DNA, 25 bp, S. pombe
aattcttattctactcctaactctg

SEQ ID NO: 81059 - DNA, 25 bp, S. pombe
aattctaatgctctcggtcaacctg

SEQ ID NO: 81060 - DNA, 25 bp, S. pombe
aattctaatatgcaggtccctcctg

SEQ ID NO: 81061 - DNA, 25 bp, S. pombe
aattgattcttctaccgagcttcgt

SEQ ID NO: 81062 - DNA, 25 bp, S. pombe
aattctgtcttctactaatgtgtca

SEQ ID NO: 81063 - DNA, 25 bp, S. pombe
aattcttcgatttctcaagctgcca

SEQ ID NO: 81064 - DNA, 25 bp, S. pombe
aattgcgcgtaaagccgaccacatt

SEQ ID NO: 81065 - DNA, 25 bp, S. pombe
aattaaataccttacgcagtgccag

SEQ ID NO: 81066 - DNA, 25 bp, S. pombe
aattccaaatcttaacgctgctgcc

SEQ ID NO: 81067 - DNA, 25 bp, S. pombe
aattgtgaaaccctgcaatcctgca

SEQ ID NO: 81068 - DNA, 25 bp, S. pombe
aattgcatggaacactacccaagga

SEQ ID NO: 81069 - DNA, 25 bp, S. pombe
aattcatcgaggctcttcaccaaag

SEQ ID NO: 81070 - DNA, 25 bp, S. pombe
aattcaagtgccaattgtgcgcgca

SEQ ID NO: 81071 - DNA, 25 bp, S. pombe
aattgaacgccatcgctgacaaggt

SEQ ID NO: 81072 - DNA, 25 bp, S. pombe
aattgaacgctatcgctcgtcgtaa

SEQ ID NO: 81073 - DNA, 25 bp, S. pombe
aattctgatcctcagtcggcaatga

SEQ ID NO: 81074 - DNA, 25 bp, S. pombe
aattctctactttgatgcgcgctaa

SEQ ID NO: 81075 - DNA, 25 bp, S. pombe
aattctatagcatttcatccccaat

SEQ ID NO: 81076 - DNA, 25 bp, S. pombe
aattaccgatgttttgcagctagac

SEQ ID NO: 81077 - DNA, 25 bp, S. pombe
aattccacatgaactgccggatcct

SEQ ID NO: 81078 - DNA, 25 bp, S. pombe
aattaaaagactccatgcctcctaa

SEQ ID NO: 81079 - DNA, 25 bp, S. pombe
aattcagagatcttccaggtgccca

SEQ ID NO: 81080 - DNA, 25 bp, S. pombe
aattacatgcttacaccttgtcacc

SEQ ID NO: 81081 - DNA, 25 bp, S. pombe
aattacgcctgaaatatctgccatc

SEQ ID NO: 81082 - DNA, 25 bp, S. pombe
aattgtcccagaaatcgctgcttac

SEQ ID NO: 81083 - DNA, 25 bp, S. pombe
aattcccattgacagcgtctacgtt

SEQ ID NO: 81084 - DNA, 25 bp, S. pombe
aattcgcgatcgtccattttactat

SEQ ID NO: 81085 - DNA, 25 bp, S. pombe
aattgctcaattgcctccgaatcgt

SEQ ID NO: 81086 - DNA, 25 bp, S. pombe
aattcactcttcatgctcgtgttaa

SEQ ID NO: 81087 - DNA, 25 bp, S. pombe
aattcacttccgctttgcgtaagga

SEQ ID NO: 81088 - DNA, 25 bp, S. pombe
aattgctaagcctttagctcctaaa

SEQ ID NO: 81089 - DNA, 25 bp, S. pombe
aattcactgttttgcgatgctcctg

SEQ ID NO: 81090 - DNA, 25 bp, S. pombe
aattaactattactcattgcctgga

SEQ ID NO: 81091 - DNA, 25 bp, S. pombe
aattgcaaaaaagctccggaatggc

SEQ ID NO: 81092 - DNA, 25 bp, S. pombe
aattgtcgacaatgcctccatgcag

SEQ ID NO: 81093 - DNA, 25 bp, S. pombe
aattcacgctcgtttgctctagata

SEQ ID NO: 81094 - DNA, 25 bp, S. pombe
aattacgccggcttcagctagaatt

SEQ ID NO: 81095 - DNA, 25 bp, S. pombe
aattcctccaggttcggatccaata

SEQ ID NO: 81096 - DNA, 25 bp, S. pombe
caattgattttgaacatggacgaac

SEQ ID NO: 81097 - DNA, 25 bp, S. pombe
aattctgactgctagctcatcttca

SEQ ID NO: 81098 - DNA, 25 bp, S. pombe
aattctagtgcaagctactccgcga

SEQ ID NO: 81099 - DNA, 25 bp, S. pombe
aattacgatcattctagctctccag

SEQ ID NO: 81100 - DNA, 25 bp, S. pombe
aattacgaatagcttcaccactgcg

SEQ ID NO: 81101 - DNA, 25 bp, S. pombe
aattacaatccaagccttcttctgt

SEQ ID NO: 81102 - DNA, 25 bp, S. pombe
aattcacattcacagctatttccct

SEQ ID NO: 81103 - DNA, 25 bp, S. pombe
aattcctatcgatgatctacctcct

SEQ ID NO: 81104 - DNA, 25 bp, S. pombe
aattccaaggcatactccactattt

SEQ ID NO: 81105 - DNA, 25 bp, S. pombe
aattcatttgcttgccgtacttgac

SEQ ID NO: 81106 - DNA, 25 bp, S. pombe
aattacttgcttgtgctgattgtga

SEQ ID NO: 81107 - DNA, 25 bp, S. pombe
aattacttgcttggttcaggaggaa

SEQ ID NO: 81108 - DNA, 25 bp, S. pombe
aattcagtcttgtctagtaggtgga

SEQ ID NO: 81109 - DNA, 25 bp, S. pombe
taattcgtccggtgtaagctcgcca

SEQ ID NO: 81110 - DNA, 25 bp, S. pombe
aattcctcgacctgataactaccag

SEQ ID NO: 81111 - DNA, 25 bp, S. pombe
aattccccttcaagcgtttgactca

SEQ ID NO: 81112 - DNA, 25 bp, S. pombe
aattgtatcaccagagttctccggg

SEQ ID NO: 81113 - DNA, 25 bp, S. pombe
aattgtataacctctatctcgtgga

SEQ ID NO: 81114 - DNA, 25 bp, S. pombe
aattgcctgcaacatatcgtagtgg

SEQ ID NO: 81115 - DNA, 25 bp, S. pombe
aattcattgattcctactgttcgag

SEQ ID NO: 81116 - DNA, 25 bp, S. pombe
aattcatcgatttctactggccgga

SEQ ID NO: 81117 - DNA, 25 bp, S. pombe
aattgctgctgcactgtcaacacat

SEQ ID NO: 81118 - DNA, 25 bp, S. pombe
aattgctgtatgctgctcgaactaa

SEQ ID NO: 81119 - DNA, 25 bp, S. pombe
aattcgtatgggaggattcaccgtt

SEQ ID NO: 81120 - DNA, 25 bp, S. pombe
aattggttgggctggttctctggtc

SEQ ID NO: 81121 - DNA, 25 bp, S. pombe
aattcgttgaggttcgttcgtgtat

SEQ ID NO: 81122 - DNA, 25 bp, S. pombe
aattcttctaggtctgtttctcttt

SEQ ID NO: 81123 - DNA, 25 bp, S. pombe
aattctctgaagcttttctccttga

SEQ ID NO: 81124 - DNA, 25 bp, S. pombe
cagtgtggagaatgagacccgcgtc

SEQ ID NO: 81125 - DNA, 25 bp, S. pombe
caattggacttggagcccgcgatac

SEQ ID NO: 81126 - DNA, 25 bp, S. pombe
aattcgagactctcttctgggagac

SEQ ID NO: 81127 - DNA, 25 bp, S. pombe
aattctacttcttgttgctacttat

SEQ ID NO: 81128 - DNA, 25 bp, S. pombe
aattctttgcgcatcttcgagatcc

SEQ ID NO: 81129 - DNA, 25 bp, S. pombe
aattcgtgatctccgtattcgtaag

SEQ ID NO: 81130 - DNA, 25 bp, S. pombe
aattcggtgggcctaatccatggag

SEQ ID NO: 81131 - DNA, 25 bp, S. pombe
aattgcgtgtgtcggtaaggcacca

SEQ ID NO: 81132 - DNA, 25 bp, S. pombe
aattggcagccgtgctggaccagga

SEQ ID NO: 81133 - DNA, 25 bp, S. pombe
aattcattaccacctattgtttcta

SEQ ID NO: 81134 - DNA, 25 bp, S. pombe
caattagtaccattctattttatta

SEQ ID NO: 81135 - DNA, 25 bp, S. pombe
caactcgttcagaccaaggttattt

SEQ ID NO: 81136 - DNA, 25 bp, S. pombe
aattcctcgtcccacatacatttaa

SEQ ID NO: 81137 - DNA, 25 bp, S. pombe
aattctcttgtgtcaaccaatttga

SEQ ID NO: 81138 - DNA, 25 bp, S. pombe
aattccgtggtttcaaatgctgctg

SEQ ID NO: 81139 - DNA, 25 bp, S. pombe
aattctcctctggtttgagccttta

SEQ ID NO: 81140 - DNA, 25 bp, S. pombe
aattgcctagtgatatcgtcgtaaa

SEQ ID NO: 81141 - DNA, 25 bp, S. pombe
aattccttgcatcattcgatcgcac

SEQ ID NO: 81142 - DNA, 25 bp, S. pombe
aattctctcctgaatttacagccgc

SEQ ID NO: 81143 - DNA, 25 bp, S. pombe
caatattttcggtttacaactcaat

SEQ ID NO: 81144 - DNA, 25 bp, S. pombe
caattgttacgtctcattacccttt

SEQ ID NO: 81145 - DNA, 25 bp, S. pombe
aattcatgaaattgcagccgtcgga

SEQ ID NO: 81146 - DNA, 25 bp, S. pombe
aattgacattacttcgccagggcat

SEQ ID NO: 81147 - DNA, 25 bp, S. pombe
aattcatatcctccaggtgcttgtg

SEQ ID NO: 81148 - DNA, 25 bp, S. pombe
aattggatgcgcttgtattctggct

SEQ ID NO: 81149 - DNA, 25 bp, S. pombe
aattgcgcatgcttctgctttaagt

SEQ ID NO: 81150 - DNA, 25 bp, S. pombe
aattcttctactactgctacgggtg

SEQ ID NO: 81151 - DNA, 25 bp, S. pombe
aattccattaccgtgttcagattca

SEQ ID NO: 81152 - DNA, 25 bp, S. pombe
aattctcttgaggactttcgcaaat

SEQ ID NO: 81153 - DNA, 25 bp, S. pombe
aattgcattgcagatcgctcacaaa

SEQ ID NO: 81154 - DNA, 25 bp, S. pombe
aattcgtgcggtagcatctcaacaa

SEQ ID NO: 81155 - DNA, 25 bp, S. pombe
aattcactggaatcagccgtctcat

SEQ ID NO: 81156 - DNA, 25 bp, S. pombe
aattctgtggattatactcgtcttg

SEQ ID NO: 81157 - DNA, 25 bp, S. pombe
aattgttactactcatggttttgca

SEQ ID NO: 81158 - DNA, 25 bp, S. pombe
aattgtccaagcgtacttcttttgt

SEQ ID NO: 81159 - DNA, 25 bp, S. pombe
caatcagcccaacaatctttctttt

SEQ ID NO: 81160 - DNA, 25 bp, S. pombe
aattctatttgtagccactatcagt

SEQ ID NO: 81161 - DNA, 25 bp, S. pombe
aattctccctttacgcacaagattt

SEQ ID NO: 81162 - DNA, 25 bp, S. pombe
aattctctcgacatacccaattgtt

SEQ ID NO: 81163 - DNA, 25 bp, S. pombe
aattctcataacatacccgatccta

SEQ ID NO: 81164 - DNA, 25 bp, S. pombe
aattgctcagaaacgaccccattta

SEQ ID NO: 81165 - DNA, 25 bp, S. pombe
aattctaatatcactgcgactttta

SEQ ID NO: 81166 - DNA, 25 bp, S. pombe
aattcatcttactcgcgtcttatta

SEQ ID NO: 81167 - DNA, 25 bp, S. pombe
aattcatctttagacgctttcctca

SEQ ID NO: 81168 - DNA, 25 bp, S. pombe
aattcgtctattcgcaatgtcttcc

SEQ ID NO: 81169 - DNA, 25 bp, S. pombe
aattctggtctattctcagttctcc

SEQ ID NO: 81170 - DNA, 25 bp, S. pombe
aattgaaatcgcacgtggagcttta

SEQ ID NO: 81171 - DNA, 25 bp, S. pombe
aattggaaatgcaccttggcctatt

SEQ ID NO: 81172 - DNA, 25 bp, S. pombe
aattggacagaatcgtcggcgctga

SEQ ID NO: 81173 - DNA, 25 bp, S. pombe
aattggctcgtcgtcttcgcggtga

SEQ ID NO: 81174 - DNA, 25 bp, S. pombe
aattgggttacattgagtctagctc

SEQ ID NO: 81175 - DNA, 25 bp, S. pombe
aattggaattgtacccattgccgct

SEQ ID NO: 81176 - DNA, 25 bp, S. pombe
aattgctaatcctgctttaccatac

SEQ ID NO: 81177 - DNA, 25 bp, S. pombe
aattctataccccttgcagaacaac

SEQ ID NO: 81178 - DNA, 25 bp, S. pombe
aattgtatcatctgtttgtattcca

SEQ ID NO: 81179 - DNA, 25 bp, S. pombe
aattcttccaatgttgtgttccaaa

SEQ ID NO: 81180 - DNA, 25 bp, S. pombe
aattcttcttctgatttagctccaa

SEQ ID NO: 81181 - DNA, 25 bp, S. pombe
aattggtcacattacagctttggga

SEQ ID NO: 81182 - DNA, 25 bp, S. pombe
aattctgtcattgccactttgagtg

SEQ ID NO: 81183 - DNA, 25 bp, S. pombe
aattcctggtggtcgttattacagc

SEQ ID NO: 81184 - DNA, 25 bp, S. pombe
aattctgctcctcgtagttggtata

SEQ ID NO: 81185 - DNA, 25 bp, S. pombe
aattgctttgctgggaggtcttgac

SEQ ID NO: 81186 - DNA, 25 bp, S. pombe
caattgctttacttaggtccttctt

SEQ ID NO: 81187 - DNA, 25 bp, S. pombe
aattgctagtaccttggttctcctc

SEQ ID NO: 81188 - DNA, 25 bp, S. pombe
aattgggctacgttgttttggctcg

SEQ ID NO: 81189 - DNA, 25 bp, S. pombe
aattccgcccatgatcttttggcta

SEQ ID NO: 81190 - DNA, 25 bp, S. pombe
aattcggctgtaacttgctctgagt

SEQ ID NO: 81191 - DNA, 25 bp, S. pombe
aattcgttgatgctattgctgggtc

SEQ ID NO: 81192 - DNA, 25 bp, S. pombe
aattgggctatttttgcgaggatca

SEQ ID NO: 81193 - DNA, 25 bp, S. pombe
cacttgggcttttgcgtaattggaa

SEQ ID NO: 81194 - DNA, 25 bp, S. pombe
aattgggcatttggcttcaacggta

SEQ ID NO: 81195 - DNA, 25 bp, S. pombe
aattggcaatctactctcttacggt

SEQ ID NO: 81196 - DNA, 25 bp, S. pombe
aattccgactaatttctgttcagga

SEQ ID NO: 81197 - DNA, 25 bp, S. pombe
aattcgacaatcgttggtctccgac

SEQ ID NO: 81198 - DNA, 25 bp, S. pombe
aattgaacaactgctggtcccatac

SEQ ID NO: 81199 - DNA, 25 bp, S. pombe
aattgaacgacaacccatgccttat

SEQ ID NO: 81200 - DNA, 25 bp, S. pombe
aattgaacgacttcgaccgctttgc

SEQ ID NO: 81201 - DNA, 25 bp, S. pombe
aattgttgctgagattccggttcct

SEQ ID NO: 81202 - DNA, 25 bp, S. pombe
aattgtatcgcatagctcacggtct

SEQ ID NO: 81203 - DNA, 25 bp, S. pombe
aattctattgcaccactacttcatt

SEQ ID NO: 81204 - DNA, 25 bp, S. pombe
aattctctgatattgacgcgtggat

SEQ ID NO: 81205 - DNA, 25 bp, S. pombe
aattctctgatttgattcttgctat

SEQ ID NO: 81206 - DNA, 25 bp, S. pombe
aattccattatgtagatcttgtcac

SEQ ID NO: 81207 - DNA, 25 bp, S. pombe
aattccttgtctacatctcttacat

SEQ ID NO: 81208 - DNA, 25 bp, S. pombe
aattgtttgcgatctgtctactctc

SEQ ID NO: 81209 - DNA, 25 bp, S. pombe
aattgcaaccgttcttcaacattac

SEQ ID NO: 81210 - DNA, 25 bp, S. pombe
aattcctctcgtttctcgtataatc

SEQ ID NO: 81211 - DNA, 25 bp, S. pombe
aattccgatggtttgttgccttatc

SEQ ID NO: 81212 - DNA, 25 bp, S. pombe
aattgcatcgactcttttcttgaca

SEQ ID NO: 81213 - DNA, 25 bp, S. pombe
aattgccgacgatctttcttcaaga

SEQ ID NO: 81214 - DNA, 25 bp, S. pombe
aattccgccagattttttcagcaag

SEQ ID NO: 81215 - DNA, 25 bp, S. pombe
aattcgacacgacattttgcccaga

SEQ ID NO: 81216 - DNA, 25 bp, S. pombe
aattcgacaggactttcttctcaac

SEQ ID NO: 81217 - DNA, 25 bp, S. pombe
aattctctcgtgtcatttcttccaa

SEQ ID NO: 81218 - DNA, 25 bp, S. pombe
aattctcttttattgcgcgacaccg

SEQ ID NO: 81219 - DNA, 25 bp, S. pombe
aattgcacacggacagccacttaag

SEQ ID NO: 81220 - DNA, 25 bp, S. pombe
aattgatgcacgcttgaacgagatt

SEQ ID NO: 81221 - DNA, 25 bp, S. pombe
aattgagcagggtcgcaagcagtta

SEQ ID NO: 81222 - DNA, 25 bp, S. pombe
aattgccctttgttgtcatcatcat

SEQ ID NO: 81223 - DNA, 25 bp, S. pombe
aattctgactccctagctttaatga

SEQ ID NO: 81224 - DNA, 25 bp, S. pombe
aattgggctccaacggtattgagat

SEQ ID NO: 81225 - DNA, 25 bp, S. pombe
aattgttggcctgccgttcatagaa

SEQ ID NO: 81226 - DNA, 25 bp, S. pombe
caattttgtctagccactttggagt

SEQ ID NO: 81227 - DNA, 25 bp, S. pombe
aattgttctacagcccatgattgga

SEQ ID NO: 81228 - DNA, 25 bp, S. pombe
aattccattaatgccctcactgatg

SEQ ID NO: 81229 - DNA, 25 bp, S. pombe
aattccttcattgctaccatcatgg

SEQ ID NO: 81230 - DNA, 25 bp, S. pombe
aattctgctgatctgaaagctcaat

SEQ ID NO: 81231 - DNA, 25 bp, S. pombe
caagctgctgactgtcaacgggaat

SEQ ID NO: 81232 - DNA, 25 bp, S. pombe
aattgcatgaagacaacgcatcgta

SEQ ID NO: 81233 - DNA, 25 bp, S. pombe
aattgcatgccattcgcgattgttg

SEQ ID NO: 81234 - DNA, 25 bp, S. pombe
aattgctggtatggctgatcgtatt

SEQ ID NO: 81235 - DNA, 25 bp, S. pombe
aattgtgctgaagctctggcagctt

SEQ ID NO: 81236 - DNA, 25 bp, S. pombe
aattgcgacttttagatcgttactg

SEQ ID NO: 81237 - DNA, 25 bp, S. pombe
aattcctattatcatgctgcgcgct

SEQ ID NO: 81238 - DNA, 25 bp, S. pombe
aattcgcctacatagtgccttgcgg

SEQ ID NO: 81239 - DNA, 25 bp, S. pombe
aattgctgctgcactcagttgcttt

SEQ ID NO: 81240 - DNA, 25 bp, S. pombe
aattgctgttccatttgctttaccc

SEQ ID NO: 81241 - DNA, 25 bp, S. pombe
aattcgtgttcattgtggtttagct

SEQ ID NO: 81242 - DNA, 25 bp, S. pombe
aattggtggagttttccgcatcgct

SEQ ID NO: 81243 - DNA, 25 bp, S. pombe
ctacgattttgagagctgccacacc

SEQ ID NO: 81244 - DNA, 25 bp, S. pombe
caatgtctccacttaaccttcttga

SEQ ID NO: 81245 - DNA, 25 bp, S. pombe
aattccctttcactttctttgcaag

SEQ ID NO: 81246 - DNA, 25 bp, S. pombe
aattcctcttattttggcttatgcg

SEQ ID NO: 81247 - DNA, 25 bp, S. pombe
aattccttctcttttaatgctctca

SEQ ID NO: 81248 - DNA, 25 bp, S. pombe
caacccttggccttgaaatgtttga

SEQ ID NO: 81249 - DNA, 25 bp, S. pombe
caacctacagatatactcaccgacg

SEQ ID NO: 81250 - DNA, 25 bp, S. pombe
caactttaaagtctgatcggtcgga

SEQ ID NO: 81251 - DNA, 25 bp, S. pombe
aattggtgatattgcgctccgcgtg

SEQ ID NO: 81252 - DNA, 25 bp, S. pombe
aattgcctcatcagcttttgtgtat

SEQ ID NO: 81253 - DNA, 25 bp, S. pombe
aattcctgctcctatgtgtactgaa

SEQ ID NO: 81254 - DNA, 25 bp, S. pombe
caatgtttgggctacagtccatgga

SEQ ID NO: 81255 - DNA, 25 bp, S. pombe
caattcttgggattcgtgcttctta

SEQ ID NO: 81256 - DNA, 25 bp, S. pombe
caatcctgtggttgattctttgcag

SEQ ID NO: 81257 - DNA, 25 bp, S. pombe
aattgcattgctttgaactttctga

SEQ ID NO: 81258 - DNA, 25 bp, S. pombe
aattgctcagcgtggtattcttcat

SEQ ID NO: 81259 - DNA, 25 bp, S. pombe
aattgctcatcgtttgtcttctatc

SEQ ID NO: 81260 - DNA, 25 bp, S. pombe
aattgtatcgtttgtcattagacca

SEQ ID NO: 81261 - DNA, 25 bp, S. pombe
aattgtacctgaagagtcggctcaa

SEQ ID NO: 81262 - DNA, 25 bp, S. pombe
caatcattcaacaactttctcctag

SEQ ID NO: 81263 - DNA, 25 bp, S. pombe
caattgcccgagcatgcttatcagg

SEQ ID NO: 81264 - DNA, 25 bp, S. pombe
aattgccaactcttctggaatcctg

SEQ ID NO: 81265 - DNA, 25 bp, S. pombe
aattgacgccatttctttgctagtg

SEQ ID NO: 81266 - DNA, 25 bp, S. pombe
aattgtccctgaatcagcaggctac

SEQ ID NO: 81267 - DNA, 25 bp, S. pombe
aattgaagccttaccagcgtcacaa

SEQ ID NO: 81268 - DNA, 25 bp, S. pombe
aattgatactgctggccggagacat

SEQ ID NO: 81269 - DNA, 25 bp, S. pombe
caattcatcgttttctccgtattac

SEQ ID NO: 81270 - DNA, 25 bp, S. pombe
aattgcgttggaattactgccatgt

SEQ ID NO: 81271 - DNA, 25 bp, S. pombe
aattgctttcgaattcttgaatggg

SEQ ID NO: 81272 - DNA, 25 bp, S. pombe
aattgttgtcaaactcttggctgag

SEQ ID NO: 81273 - DNA, 25 bp, S. pombe
caatggtccgtgttaaggatcccga

SEQ ID NO: 81274 - DNA, 25 bp, S. pombe
aattgtttgtgaacgattcctcgga

SEQ ID NO: 81275 - DNA, 25 bp, S. pombe
aattgtggccatggagctcacgcat

SEQ ID NO: 81276 - DNA, 25 bp, S. pombe
aattgctatctaaagtgctcgagaa

SEQ ID NO: 81277 - DNA, 25 bp, S. pombe
aattgctagaacagtgcacttgcat

SEQ ID NO: 81278 - DNA, 25 bp, S. pombe
aattgaccaacatggactgatgcta

SEQ ID NO: 81279 - DNA, 25 bp, S. pombe
caacttttgaccatcctgaacttgt

SEQ ID NO: 81280 - DNA, 25 bp, S. pombe
caatttgtctttggccattaacttt

SEQ ID NO: 81281 - DNA, 25 bp, S. pombe
caatcttttgtgctgggttacttcc

SEQ ID NO: 81282 - DNA, 25 bp, S. pombe
caatttagcttggtggtctggacgt

SEQ ID NO: 81283 - DNA, 25 bp, S. pombe
caatgtctacgtctgactcaggtgc

SEQ ID NO: 81284 - DNA, 25 bp, S. pombe
cacgcttacgtgctatacatttggg

SEQ ID NO: 81285 - DNA, 25 bp, S. pombe
cacggtgacgatgctccaaattggt

SEQ ID NO: 81286 - DNA, 25 bp, S. pombe
cgggagcacgaagcactacatggat

SEQ ID NO: 81287 - DNA, 25 bp, S. pombe
caatggagcctaaaactactgagta

SEQ ID NO: 81288 - DNA, 25 bp, S. pombe
cacgtacccaagtcgatgattttcc

SEQ ID NO: 81289 - DNA, 25 bp, S. pombe
cctaagtcagactccgatgatgaag

SEQ ID NO: 81290 - DNA, 25 bp, S. pombe
ctccgggaactagcgatgaacattt

SEQ ID NO: 81291 - DNA, 25 bp, S. pombe
tccggcggaactcttgaaacagctt

SEQ ID NO: 81292 - DNA, 25 bp, S. pombe
catcccggaatggttcgaaccgatt

SEQ ID NO: 81293 - DNA, 25 bp, S. pombe
cacagtgggatttgcttaaagacga

SEQ ID NO: 81294 - DNA, 25 bp, S. pombe
aattccatgagacaatacctagcaa

SEQ ID NO: 81295 - DNA, 25 bp, S. pombe
aattgacgagatacctccgcaagag

SEQ ID NO: 81296 - DNA, 25 bp, S. pombe
aattgaaggttttccagcaagctta

SEQ ID NO: 81297 - DNA, 25 bp, S. pombe
aattgagggcttctgctccaaatta

SEQ ID NO: 81298 - DNA, 25 bp, S. pombe
aattgaagccttctgccaatcgtct

SEQ ID NO: 81299 - DNA, 25 bp, S. pombe
aattgatatcatagaaaagctttta

SEQ ID NO: 81300 - DNA, 25 bp, S. pombe
aattgcattcatctttcacgtttag

SEQ ID NO: 81301 - DNA, 25 bp, S. pombe
aattgcttttgggtcatggttatac

SEQ ID NO: 81302 - DNA, 25 bp, S. pombe
aattgcttcaagctgctcatggaat

SEQ ID NO: 81303 - DNA, 25 bp, S. pombe
aattgcctgatgttctttctagcga

SEQ ID NO: 81304 - DNA, 25 bp, S. pombe
aattgcgctatgtgcgttttcagca

SEQ ID NO: 81305 - DNA, 25 bp, S. pombe
aattggttgaggctctttgcgctga

SEQ ID NO: 81306 - DNA, 25 bp, S. pombe
aattggtttttcctatgctgcggtt

SEQ ID NO: 81307 - DNA, 25 bp, S. pombe
aattgttcacattccttgacgggtt

SEQ ID NO: 81308 - DNA, 25 bp, S. pombe
caattgttgaattcatttggacttt

SEQ ID NO: 81309 - DNA, 25 bp, S. pombe
aattgagcttcatccgtttctttcc

SEQ ID NO: 81310 - DNA, 25 bp, S. pombe
caattagtcaatgccgttcgcgaat

SEQ ID NO: 81311 - DNA, 25 bp, S. pombe
caattcaagaattccgtaagcgtta

SEQ ID NO: 81312 - DNA, 25 bp, S. pombe
caaacacgaccttgattttagcatc

SEQ ID NO: 81313 - DNA, 25 bp, S. pombe
caataccaacttttgtctgccgatc

SEQ ID NO: 81314 - DNA, 25 bp, S. pombe
caatatcccacgagattggccgatt

SEQ ID NO: 81315 - DNA, 25 bp, S. pombe
aattgcgctcatggtttttctctca

SEQ ID NO: 81316 - DNA, 25 bp, S. pombe
aattgctcctatttgtttcgtacag

SEQ ID NO: 81317 - DNA, 25 bp, S. pombe
aattgctggcgttatgtcgggtacc

SEQ ID NO: 81318 - DNA, 25 bp, S. pombe
caattgctgtttttgtcggtggaca

SEQ ID NO: 81319 - DNA, 25 bp, S. pombe
caattggtgctatggctcatggtcc

SEQ ID NO: 81320 - DNA, 25 bp, S. pombe
caaggacatcgacgagctcattgct

SEQ ID NO: 81321 - DNA, 25 bp, S. pombe
caattagatcacctccttacaaagt

SEQ ID NO: 81322 - DNA, 25 bp, S. pombe
caatccaaccccttaggcatgaagt

SEQ ID NO: 81323 - DNA, 25 bp, S. pombe
caatccattgcctgtttggccaagg

SEQ ID NO: 81324 - DNA, 25 bp, S. pombe
aattgatgatcgttcttgcaagtcg

SEQ ID NO: 81325 - DNA, 25 bp, S. pombe
aattgcatgtgccttctacagaagc

SEQ ID NO: 81326 - DNA, 25 bp, S. pombe
aattggatgcgccttatcataagaa

SEQ ID NO: 81327 - DNA, 25 bp, S. pombe
aattggtacagctcggcattggcat

SEQ ID NO: 81328 - DNA, 25 bp, S. pombe
aattgtgcgtgctgacttgcaggaa

SEQ ID NO: 81329 - DNA, 25 bp, S. pombe
caattcatcgcttgacttcttgcaa

SEQ ID NO: 81330 - DNA, 25 bp, S. pombe
caatatccctgatctctctgaagaa

SEQ ID NO: 81331 - DNA, 25 bp, S. pombe
caatatgctcctttgcttgatgaca

SEQ ID NO: 81332 - DNA, 25 bp, S. pombe
aattgtcacaattgctccatatcaa

SEQ ID NO: 81333 - DNA, 25 bp, S. pombe
aattgaccatacgattgattcccca

SEQ ID NO: 81334 - DNA, 25 bp, S. pombe
tagtagagccatcggacgtacttga

SEQ ID NO: 81335 - DNA, 25 bp, S. pombe
cagtggcaggcaatggatcgaattc

SEQ ID NO: 81336 - DNA, 25 bp, S. pombe
caatggtgtcgtgagaccccttagt

SEQ ID NO: 81337 - DNA, 25 bp, S. pombe
caatggttttgactgacccaggttt

SEQ ID NO: 81338 - DNA, 25 bp, S. pombe
caagttatttccaatcttccggttg

SEQ ID NO: 81339 - DNA, 25 bp, S. pombe
caactttcttcggttgcgacggtag

SEQ ID NO: 81340 - DNA, 25 bp, S. pombe
caacgcgtccgtggaaactcaagta

SEQ ID NO: 81341 - DNA, 25 bp, S. pombe
aattgcaccctttagccctaagtga

SEQ ID NO: 81342 - DNA, 25 bp, S. pombe
aattggcccttttcttctcattgta

SEQ ID NO: 81343 - DNA, 25 bp, S. pombe
aattggtaaccttttgctctctgaa

SEQ ID NO: 81344 - DNA, 25 bp, S. pombe
aattggatattctcgttgctcttaa

SEQ ID NO: 81345 - DNA, 25 bp, S. pombe
caattggtgctacacgtgttgccgt

SEQ ID NO: 81346 - DNA, 25 bp, S. pombe
aattgcttctcagattgtgttcaag

SEQ ID NO: 81347 - DNA, 25 bp, S. pombe
aattgattcacacattggttgcgca

SEQ ID NO: 81348 - DNA, 25 bp, S. pombe
aattgattcatccttacctcgggta

SEQ ID NO: 81349 - DNA, 25 bp, S. pombe
aattggtgctagatatcctcctggt

SEQ ID NO: 81350 - DNA, 25 bp, S. pombe
aattgatgctttgtccatcccagac

SEQ ID NO: 81351 - DNA, 25 bp, S. pombe
caatgcttatggtgctcgcgacttc

SEQ ID NO: 81352 - DNA, 25 bp, S. pombe
caatatggacctgtacacggtgtaa

SEQ ID NO: 81353 - DNA, 25 bp, S. pombe
aattgtgaacactttacggcaggaa

SEQ ID NO: 81354 - DNA, 25 bp, S. pombe
aattgatgccttctctggatgtggt

SEQ ID NO: 81355 - DNA, 25 bp, S. pombe
caacacgccgctttactaaacaggg

SEQ ID NO: 81356 - DNA, 25 bp, S. pombe
caagccgattgtggtcctaaacata

SEQ ID NO: 81357 - DNA, 25 bp, S. pombe
taagctccgacctgttaaaaactag

SEQ ID NO: 81358 - DNA, 25 bp, S. pombe
caattcttccaacgtttgatccatc

SEQ ID NO: 81359 - DNA, 25 bp, S. pombe
caattcggtgaacgtctatgctaaa

SEQ ID NO: 81360 - DNA, 25 bp, S. pombe
aattgttttgtgctttctcacgcga

SEQ ID NO: 81361 - DNA, 25 bp, S. pombe
caacgtgtctaatgtttctacggaa

SEQ ID NO: 81362 - DNA, 25 bp, S. pombe
caatcgttattaccttgccttagag

SEQ ID NO: 81363 - DNA, 25 bp, S. pombe
caatcgctattcgtgtcttctttac

SEQ ID NO: 81364 - DNA, 25 bp, S. pombe
caatccggtcccaatttttattgat

SEQ ID NO: 81365 - DNA, 25 bp, S. pombe
caatccgtggttttgggcttttgat

SEQ ID NO: 81366 - DNA, 25 bp, S. pombe
caacattcgtgatcccgttttaact

SEQ ID NO: 81367 - DNA, 25 bp, S. pombe
caatttggatgttgcggcgtgtatt

SEQ ID NO: 81368 - DNA, 25 bp, S. pombe
caatcatccttctgatatccaacgg

SEQ ID NO: 81369 - DNA, 25 bp, S. pombe
caatcaacatttcctaccattcgta

SEQ ID NO: 81370 - DNA, 25 bp, S. pombe
ccgcttttcgattcttccaaaactg

SEQ ID NO: 81371 - DNA, 25 bp, S. pombe
caagctttatcgtctttacagcagt

SEQ ID NO: 81372 - DNA, 25 bp, S. pombe
caatatttcatatccgctcctgatg

SEQ ID NO: 81373 - DNA, 25 bp, S. pombe
caattatcatattcgctcgtacagt

SEQ ID NO: 81374 - DNA, 25 bp, S. pombe
aattgaattctttggctgcacgtgt

SEQ ID NO: 81375 - DNA, 25 bp, S. pombe
aattgaattttctgctctctctgct

SEQ ID NO: 81376 - DNA, 25 bp, S. pombe
aattgattccttgttctcatgtgga

SEQ ID NO: 81377 - DNA, 25 bp, S. pombe
caatttggcatcacttggcacgaaa

SEQ ID NO: 81378 - DNA, 25 bp, S. pombe
caattcggtgtatttgggcgtcaga

SEQ ID NO: 81379 - DNA, 25 bp, S. pombe
caatttcgtcggtctcttcgtagaa

SEQ ID NO: 81380 - DNA, 25 bp, S. pombe
caattcgtgggtacacagtccaatt

SEQ ID NO: 81381 - DNA, 25 bp, S. pombe
cacaggtgcgaagcagccatttctt

SEQ ID NO: 81382 - DNA, 25 bp, S. pombe
cacgtttccgtgtccaatttagttg

SEQ ID NO: 81383 - DNA, 25 bp, S. pombe
caattttacgttggcgattctggtt

SEQ ID NO: 81384 - DNA, 25 bp, S. pombe
caagtctacagcacccttaatggga

SEQ ID NO: 81385 - DNA, 25 bp, S. pombe
caagcgcaacgatatcccaggatag

SEQ ID NO: 81386 - DNA, 25 bp, S. pombe
caagaaaggagctatccgcactctc

SEQ ID NO: 81387 - DNA, 25 bp, S. pombe
caatggaagtgaatacagctcgcgt

SEQ ID NO: 81388 - DNA, 25 bp, S. pombe
caagtcggtatttagccacgttcct

SEQ ID NO: 81389 - DNA, 25 bp, S. pombe
aattgggtgttttatgccttcagca

SEQ ID NO: 81390 - DNA, 25 bp, S. pombe
caacggtcagaattcagggcttcaa

SEQ ID NO: 81391 - DNA, 25 bp, S. pombe
aattgtgatcaatcgacgtgttcaa

SEQ ID NO: 81392 - DNA, 25 bp, S. pombe
aattggtatacctcgatgcttgaaa

SEQ ID NO: 81393 - DNA, 25 bp, S. pombe
aattggttcccgctacagaactaga

SEQ ID NO: 81394 - DNA, 25 bp, S. pombe
aattggtttccggattgcaagcaaa

SEQ ID NO: 81395 - DNA, 25 bp, S. pombe
aattggttttgcgtgttctcacaat

SEQ ID NO: 81396 - DNA, 25 bp, S. pombe
aattggatcttcgaggtacttgcaa

SEQ ID NO: 81397 - DNA, 25 bp, S. pombe
aattgggctatagtggtccttggat

SEQ ID NO: 81398 - DNA, 25 bp, S. pombe
caattgttctaggaggcgctggttt

SEQ ID NO: 81399 - DNA, 25 bp, S. pombe
aattgtctatcgatggcctcaactg

SEQ ID NO: 81400 - DNA, 25 bp, S. pombe
aattgtttctaatgcacccacttta

SEQ ID NO: 81401 - DNA, 25 bp, S. pombe
caatatattctcttgtttccggata

SEQ ID NO: 81402 - DNA, 25 bp, S. pombe
caattacgtttgctgtcccttatgc

SEQ ID NO: 81403 - DNA, 25 bp, S. pombe
caaatgggtttgagcctattcggtt

SEQ ID NO: 81404 - DNA, 25 bp, S. pombe
caattgggttttgcgttatcctgat

SEQ ID NO: 81405 - DNA, 25 bp, S. pombe
caaggttaccgccaaggacgataat

SEQ ID NO: 81406 - DNA, 25 bp, S. pombe
caaggagaaccgcaaggccattcat

SEQ ID NO: 81407 - DNA, 25 bp, S. pombe
caatgtgcaactttccttcttttca

SEQ ID NO: 81408 - DNA, 25 bp, S. pombe
caatctcagtgtttctcgttttaca

SEQ ID NO: 81409 - DNA, 25 bp, S. pombe
caatctctcgcatacacttcatgat

SEQ ID NO: 81410 - DNA, 25 bp, S. pombe
caactatcagttttctatcgacgga

SEQ ID NO: 81411 - DNA, 25 bp, S. pombe
caaggtcgtacttttggcatctgga

SEQ ID NO: 81412 - DNA, 25 bp, S. pombe
caaggttcgacgtcgtggttggatt

SEQ ID NO: 81413 - DNA, 25 bp, S. pombe
caaggtttgcctccgtttgatgtgg

SEQ ID NO: 81414 - DNA, 25 bp, S. pombe
caagcaaattcctcgtctgttgggt

SEQ ID NO: 81415 - DNA, 25 bp, S. pombe
caagcctacaactcgtctgtattac

SEQ ID NO: 81416 - DNA, 25 bp, S. pombe
caatgtcttatatgtttctgcttta

SEQ ID NO: 81417 - DNA, 25 bp, S. pombe
caatctttcacttggtttggcttac

SEQ ID NO: 81418 - DNA, 25 bp, S. pombe
caattttccttggttggctgatcga

SEQ ID NO: 81419 - DNA, 25 bp, S. pombe
aattgttactcttctttgcgatcct

SEQ ID NO: 81420 - DNA, 25 bp, S. pombe
caagtggtaccttctttattccctg

SEQ ID NO: 81421 - DNA, 25 bp, S. pombe
caagtggtccactcatttgattttt

SEQ ID NO: 81422 - DNA, 25 bp, S. pombe
caagggcggttgcagtctattataa

SEQ ID NO: 81423 - DNA, 25 bp, S. pombe
caatggagttttctggcgtcgtaga

SEQ ID NO: 81424 - DNA, 25 bp, S. pombe
caagggttttggtccatcgggatca

SEQ ID NO: 81425 - DNA, 25 bp, S. pombe
caagggttcttgttcaccgtggtct

SEQ ID NO: 81426 - DNA, 25 bp, S. pombe
caaaatggtgttatccctgcggttt

SEQ ID NO: 81427 - DNA, 25 bp, S. pombe
caataatccttcagttttccgcttc

SEQ ID NO: 81428 - DNA, 25 bp, S. pombe
caaaaagctgctacggtttctcctt

SEQ ID NO: 81429 - DNA, 25 bp, S. pombe
caagaattatcagcgggttccccta

SEQ ID NO: 81430 - DNA, 25 bp, S. pombe
caagaaaagcccaagcaaccaaagg

SEQ ID NO: 81431 - DNA, 25 bp, S. pombe
caagaaaagcccaagcaaccaaagg

SEQ ID NO: 81432 - DNA, 25 bp, S. pombe
caaccattcgacctaattctcatta

SEQ ID NO: 81433 - DNA, 25 bp, S. pombe
caatctttggacactatttctgcta

SEQ ID NO: 81434 - DNA, 25 bp, S. pombe
caatattttggctcttcgtacgatt

SEQ ID NO: 81435 - DNA, 25 bp, S. pombe
caatatgtcttgtctggtcctgctt

SEQ ID NO: 81436 - DNA, 25 bp, S. pombe
caatctcatttgtggtgtctgcgtc

SEQ ID NO: 81437 - DNA, 25 bp, S. pombe
caacttcgtggtcatgctgcatgga

SEQ ID NO: 81438 - DNA, 25 bp, S. pombe
caattactgtgtgccattgtggctt

SEQ ID NO: 81439 - DNA, 25 bp, S. pombe
caattactcgcggtatctctcaatt

SEQ ID NO: 81440 - DNA, 25 bp, S. pombe
caatgtatccgttcaatgcccaatt

SEQ ID NO: 81441 - DNA, 25 bp, S. pombe
cactaatcgcgttattaccctttgg

SEQ ID NO: 81442 - DNA, 25 bp, S. pombe
caatatgtcggcgtttatgtttttt

SEQ ID NO: 81443 - DNA, 25 bp, S. pombe
caatggattggagtcttcccttttt

SEQ ID NO: 81444 - DNA, 25 bp, S. pombe
caaggcactcggtttcggtcataaa

SEQ ID NO: 81445 - DNA, 25 bp, S. pombe
caatttgtgaggaccgccttcgtta

SEQ ID NO: 81446 - DNA, 25 bp, S. pombe
caatcttattttcaggtaccgtacg

SEQ ID NO: 81447 - DNA, 25 bp, S. pombe
caatttcctttctgagctactctat

SEQ ID NO: 81448 - DNA, 25 bp, S. pombe
aattggcatcttctgtgcaggagca

SEQ ID NO: 81449 - DNA, 25 bp, S. pombe
aattggcacagcacgcaaagtcaca

SEQ ID NO: 81450 - DNA, 25 bp, S. pombe
caagctaggcttgcagaggctgctg

SEQ ID NO: 81451 - DNA, 25 bp, S. pombe
caagcttcgtgttgaggacatccaa

SEQ ID NO: 81452 - DNA, 25 bp, S. pombe
caatgtggactgtgttgatcccaat

SEQ ID NO: 81453 - DNA, 25 bp, S. pombe
caattctactccctctttggaaagg

SEQ ID NO: 81454 - DNA, 25 bp, S. pombe
caaacgacttctcctttagacttgg

SEQ ID NO: 81455 - DNA, 25 bp, S. pombe
caaggttggcctcgctgacaaatat

SEQ ID NO: 81456 - DNA, 25 bp, S. pombe
caagtggtcgaattacccgaatgga

SEQ ID NO: 81457 - DNA, 25 bp, S. pombe
caagtgttaaatcgtcccaatgggt

SEQ ID NO: 81458 - DNA, 25 bp, S. pombe
catatatggcaacggcgctcggcga

SEQ ID NO: 81459 - DNA, 25 bp, S. pombe
caatggtgtacttgctgccgtctgc

SEQ ID NO: 81460 - DNA, 25 bp, S. pombe
caatgtttgctgactatcgcgttcc

SEQ ID NO: 81461 - DNA, 25 bp, S. pombe
caattctgcttcttcctgtggaaaa

SEQ ID NO: 81462 - DNA, 25 bp, S. pombe
aattggcgtcttccctgcaagagaa

SEQ ID NO: 81463 - DNA, 25 bp, S. pombe
aattggatatcacggacgccatcaa

SEQ ID NO: 81464 - DNA, 25 bp, S. pombe
aattggcaatccttgaggctcctac

SEQ ID NO: 81465 - DNA, 25 bp, S. pombe
aattggctaccttgaacattcgatc

SEQ ID NO: 81466 - DNA, 25 bp, S. pombe
caatatccttacaaagtcctgtggt

SEQ ID NO: 81467 - DNA, 25 bp, S. pombe
caagatctattataagttctttata

SEQ ID NO: 81468 - DNA, 25 bp, S. pombe
caaggagctacttcgagtgcaggaa

SEQ ID NO: 81469 - DNA, 25 bp, S. pombe
caagttgtactatgcgatgatggac

SEQ ID NO: 81470 - DNA, 25 bp, S. pombe
caatgtgtagctggaggccttcttc

SEQ ID NO: 81471 - DNA, 25 bp, S. pombe
caatgctgaagctgtcgtttcgtca

SEQ ID NO: 81472 - DNA, 25 bp, S. pombe
caaggtccttgttggaggtgcttga

SEQ ID NO: 81473 - DNA, 25 bp, S. pombe
caagcccttgccaattggtaggtgt

SEQ ID NO: 81474 - DNA, 25 bp, S. pombe
caagccctgggaatctggtaacttt

SEQ ID NO: 81475 - DNA, 25 bp, S. pombe
caacaaatgggagtcgcagctgcga

SEQ ID NO: 81476 - DNA, 25 bp, S. pombe
caagctatcacttactcacagtcga

SEQ ID NO: 81477 - DNA, 25 bp, S. pombe
caagcttatggatccttaggcctaa

SEQ ID NO: 81478 - DNA, 25 bp, S. pombe
caaggtgtgaattccttcgaagtaa

SEQ ID NO: 81479 - DNA, 25 bp, S. pombe
caatggtgctatttcgatccgtggt

SEQ ID NO: 81480 - DNA, 25 bp, S. pombe
caaggcctctataacatccggtgtt

SEQ ID NO: 81481 - DNA, 25 bp, S. pombe
caatccttcaaccaggtatatcgat

SEQ ID NO: 81482 - DNA, 25 bp, S. pombe
caatccttcaacgagtatattgatt

SEQ ID NO: 81483 - DNA, 25 bp, S. pombe
caatccttcaacgagtatattgatt

SEQ ID NO: 81484 - DNA, 25 bp, S. pombe
caatccatctactaagccttcgaat

SEQ ID NO: 81485 - DNA, 25 bp, S. pombe
caagtcctactgagtctgtcgagat

SEQ ID NO: 81486 - DNA, 25 bp, S. pombe
caaggccgacctggacagacagcaa

SEQ ID NO: 81487 - DNA, 25 bp, S. pombe
caagggcgacagcaacgacagcaat

SEQ ID NO: 81488 - DNA, 25 bp, S. pombe
caagcttgacccaaacatctcgttt

SEQ ID NO: 81489 - DNA, 25 bp, S. pombe
caagcgtcaccgtaagatccttcgt

SEQ ID NO: 81490 - DNA, 25 bp, S. pombe
caagcgtcaccgtaagatccttcgt

SEQ ID NO: 81491 - DNA, 25 bp, S. pombe
caagagcgactggaccccgaagtaa

SEQ ID NO: 81492 - DNA, 25 bp, S. pombe
caagatttgcatacacgccttagtg

SEQ ID NO: 81493 - DNA, 25 bp, S. pombe
caatgtcttcactcagctgagcgaa

SEQ ID NO: 81494 - DNA, 25 bp, S. pombe
caagtggcttgctcaatacgtctaa

SEQ ID NO: 81495 - DNA, 25 bp, S. pombe
caagttgcttgttcttgcaagtcga

SEQ ID NO: 81496 - DNA, 25 bp, S. pombe
caagaccactagaacgaacgccaag

SEQ ID NO: 81497 - DNA, 25 bp, S. pombe
gaagaaacgtggaccggctccggat

SEQ ID NO: 81498 - DNA, 25 bp, S. pombe
caaaaagcttatcctcggttctcga

SEQ ID NO: 81499 - DNA, 25 bp, S. pombe
caaatgggcttattccacaggctcc

SEQ ID NO: 81500 - DNA, 25 bp, S. pombe
caatcgtttattgcagttcccaaga

SEQ ID NO: 81501 - DNA, 25 bp, S. pombe
caagattgattttgtcgcccacgac

SEQ ID NO: 81502 - DNA, 25 bp, S. pombe
caatgttttattgcagccgactact

SEQ ID NO: 81503 - DNA, 25 bp, S. pombe
caatggcttccaaattaccgcgaga

SEQ ID NO: 81504 - DNA, 25 bp, S. pombe
caagaatattggcttcagtactggt

SEQ ID NO: 81505 - DNA, 25 bp, S. pombe
caatctttgtttatgtgtttctcgg

SEQ ID NO: 81506 - DNA, 25 bp, S. pombe
caattagtgcttgtcctggtggaga

SEQ ID NO: 81507 - DNA, 25 bp, S. pombe
caagtaggcttgttcatttccggga

SEQ ID NO: 81508 - DNA, 25 bp, S. pombe
caaggtggaatttctttcatcggaa

SEQ ID NO: 81509 - DNA, 25 bp, S. pombe
caaggatggttcactttccgaccaa

SEQ ID NO: 81510 - DNA, 25 bp, S. pombe
caagtaactcttgccttggcattcc

SEQ ID NO: 81511 - DNA, 25 bp, S. pombe
gactgtaacaaacggctgggtagca

SEQ ID NO: 81512 - DNA, 25 bp, S. pombe
cacatcgggaaactggctgggtaat

SEQ ID NO: 81513 - DNA, 25 bp, S. pombe
caacctgtaccatttgccaaagctt

SEQ ID NO: 81514 - DNA, 25 bp, S. pombe
caagcccgagcaaatgtccacaaat

SEQ ID NO: 81515 - DNA, 25 bp, S. pombe
caactggcctacgaacttatgaaaa

SEQ ID NO: 81516 - DNA, 25 bp, S. pombe
caacgctggcaacaagcctgctgaa

SEQ ID NO: 81517 - DNA, 25 bp, S. pombe
caacgctggcaacaagcctgctgaa

SEQ ID NO: 81518 - DNA, 25 bp, S. pombe
caagctaccttttacgataccattc

SEQ ID NO: 81519 - DNA, 25 bp, S. pombe
caactatacttttacgatcctctta

SEQ ID NO: 81520 - DNA, 25 bp, S. pombe
caacctgtattggaaccctcttata

SEQ ID NO: 81521 - DNA, 25 bp, S. pombe
caatcttcatttttggctcctcaaa

SEQ ID NO: 81522 - DNA, 25 bp, S. pombe
caatgcttgtgattccgatgcttta

SEQ ID NO: 81523 - DNA, 25 bp, S. pombe
caactgagcatgaacctgtgcctaa

SEQ ID NO: 81524 - DNA, 25 bp, S. pombe
caatcccacacatgttttaaccaac

SEQ ID NO: 81525 - DNA, 25 bp, S. pombe
caagatccggttgctgctttagtag

SEQ ID NO: 81526 - DNA, 25 bp, S. pombe
caagatggtctgttgcgtttctggt

SEQ ID NO: 81527 - DNA, 25 bp, S. pombe
caatgcggtctatgctttacatggc

SEQ ID NO: 81528 - DNA, 25 bp, S. pombe
caagctagctttgccggacgttggt

SEQ ID NO: 81529 - DNA, 25 bp, S. pombe
cttgacgactacttgggttggcctg

SEQ ID NO: 81530 - DNA, 25 bp, S. pombe
caacaacgttactgggtcctgctac

SEQ ID NO: 81531 - DNA, 25 bp, S. pombe
caaatacttgggtggtggccttcct

SEQ ID NO: 81532 - DNA, 25 bp, S. pombe
caaattcttcgtctggtacgtctac

SEQ ID NO: 81533 - DNA, 25 bp, S. pombe
caaaccgactcctttatacgttatg

SEQ ID NO: 81534 - DNA, 25 bp, S. pombe
caatacccgtcgatttcactgttaa

SEQ ID NO: 81535 - DNA, 25 bp, S. pombe
caaactgggcagcttttccttataa

SEQ ID NO: 81536 - DNA, 25 bp, S. pombe
caaccggtagcgttttatggcacaa

SEQ ID NO: 81537 - DNA, 25 bp, S. pombe
caatgttttccatggtgttcgtcaa

SEQ ID NO: 81538 - DNA, 25 bp, S. pombe
caaggactctgttttgtttcgccaa

SEQ ID NO: 81539 - DNA, 25 bp, S. pombe
caagatgtaccgttgctggctacaa

SEQ ID NO: 81540 - DNA, 25 bp, S. pombe
caaagtatcgactgcaatgcccaag

SEQ ID NO: 81541 - DNA, 25 bp, S. pombe
caaggagcttgatggcaaggacatc

SEQ ID NO: 81542 - DNA, 25 bp, S. pombe
caacgatttgactctatggagcagc

SEQ ID NO: 81543 - DNA, 25 bp, S. pombe
caacgtttgcgctgttgacgctgaa

SEQ ID NO: 81544 - DNA, 25 bp, S. pombe
caatcgtttcgctactggaactgaa

SEQ ID NO: 81545 - DNA, 25 bp, S. pombe
caagccctacgttggtttcagaaat

SEQ ID NO: 81546 - DNA, 25 bp, S. pombe
caaggtcgacgttcagctagcaaaa

SEQ ID NO: 81547 - DNA, 25 bp, S. pombe
caatgagtcagctagtgtcgatgaa

SEQ ID NO: 81548 - DNA, 25 bp, S. pombe
caagttgctctcgatgccattgaaa

SEQ ID NO: 81549 - DNA, 25 bp, S. pombe
caagtccctcggtgatgcacagaat

SEQ ID NO: 81550 - DNA, 25 bp, S. pombe
caaggcgtttggtccatcatcaaat

SEQ ID NO: 81551 - DNA, 25 bp, S. pombe
cataacatccacgaaggcttctgcg

SEQ ID NO: 81552 - DNA, 25 bp, S. pombe
caagtggccctgttgtttggagtta

SEQ ID NO: 81553 - DNA, 25 bp, S. pombe
caaaggcctctggatttttcgtgga

SEQ ID NO: 81554 - DNA, 25 bp, S. pombe
caatgggattcgctcttgtcaagaa

SEQ ID NO: 81555 - DNA, 25 bp, S. pombe
caagagttctctccgcgaagacgtt

SEQ ID NO: 81556 - DNA, 25 bp, S. pombe
caaccgcttccttccaaaagagatg

SEQ ID NO: 81557 - DNA, 25 bp, S. pombe
caacctttcccattacttatgcaag

SEQ ID NO: 81558 - DNA, 25 bp, S. pombe
gcaaagtaattacactcctccggag

SEQ ID NO: 81559 - DNA, 25 bp, S. pombe
caaacttattgaaccccttcgtgag

SEQ ID NO: 81560 - DNA, 25 bp, S. pombe
caatggtgtttgatccttctggaaa

SEQ ID NO: 81561 - DNA, 25 bp, S. pombe
caagcgctagggattcgcaatcgaa

SEQ ID NO: 81562 - DNA, 25 bp, S. pombe
caaggtcgtcaaggtcgctggtgtc

SEQ ID NO: 81563 - DNA, 25 bp, S. pombe
caaggtcgtcaaggttgccggtgtt

SEQ ID NO: 81564 - DNA, 25 bp, S. pombe
caaagtagtgacctatctccgggta

SEQ ID NO: 81565 - DNA, 25 bp, S. pombe
caaaacccttgaaacagctgtggaa

SEQ ID NO: 81566 - DNA, 25 bp, S. pombe
caaatccctttacccgctgaatatg

SEQ ID NO: 81567 - DNA, 25 bp, S. pombe
caatcccctttttcaatgctatcaa

SEQ ID NO: 81568 - DNA, 25 bp, S. pombe
cacttccccttttcattcaaatgta

SEQ ID NO: 81569 - DNA, 25 bp, S. pombe
caaccaccgtacattccaagtttga

SEQ ID NO: 81570 - DNA, 25 bp, S. pombe
caacccaaaaacaccaatctcatta

SEQ ID NO: 81571 - DNA, 25 bp, S. pombe
caactccaaatttccagacaaccat

SEQ ID NO: 81572 - DNA, 25 bp, S. pombe
caagcaatcctctctgtatggcaag

SEQ ID NO: 81573 - DNA, 25 bp, S. pombe
caaactcgccgactttggattggca

SEQ ID NO: 81574 - DNA, 25 bp, S. pombe
caagcccgcttattttggatccagc

SEQ ID NO: 81575 - DNA, 25 bp, S. pombe
caaggctcttctttttggatggctc

SEQ ID NO: 81576 - DNA, 25 bp, S. pombe
caaggtcttgcgtcttttcatttgt

SEQ ID NO: 81577 - DNA, 25 bp, S. pombe
caacccagatgaccctttagacaat

SEQ ID NO: 81578 - DNA, 25 bp, S. pombe
caagcgcaagtctcctttgaacata

SEQ ID NO: 81579 - DNA, 25 bp, S. pombe
caaggcaatgctttactttaccaaa

SEQ ID NO: 81580 - DNA, 25 bp, S. pombe
caatgatgcttggtttgcttcctgc

SEQ ID NO: 81581 - DNA, 25 bp, S. pombe
caatgctgctggtctttcttattta

SEQ ID NO: 81582 - DNA, 25 bp, S. pombe
caatggcggcactatggtttctttt

SEQ ID NO: 81583 - DNA, 25 bp, S. pombe
caagctcctgccacgggtttatgta

SEQ ID NO: 81584 - DNA, 25 bp, S. pombe
caactagccttcgtggtttttcaga

SEQ ID NO: 81585 - DNA, 25 bp, S. pombe
caaggttcttgttggtacatccgga

SEQ ID NO: 81586 - DNA, 25 bp, S. pombe
caaggtcttttactcttaccaggtg

SEQ ID NO: 81587 - DNA, 25 bp, S. pombe
caatgagtcttcctttctacactat

SEQ ID NO: 81588 - DNA, 25 bp, S. pombe
caagatctttcttttaagccaacaa

SEQ ID NO: 81589 - DNA, 25 bp, S. pombe
caatgcttcctatgctcgacaatat

SEQ ID NO: 81590 - DNA, 25 bp, S. pombe
caagaaatcatgtccggtgctcaac

SEQ ID NO: 81591 - DNA, 25 bp, S. pombe
caaaaaggttctcatgccatggcaa

SEQ ID NO: 81592 - DNA, 25 bp, S. pombe
caaactagagttggttccggacgat

SEQ ID NO: 81593 - DNA, 25 bp, S. pombe
caaacatcctggtgttacgggtgat

SEQ ID NO: 81594 - DNA, 25 bp, S. pombe
caagttcctctgtttcctacgaata

SEQ ID NO: 81595 - DNA, 25 bp, S. pombe
caagattccacttttcctacaaacg

SEQ ID NO: 81596 - DNA, 25 bp, S. pombe
caagtgcgccattaatgccttctaa

SEQ ID NO: 81597 - DNA, 25 bp, S. pombe
caagcagtgctttcaatccctgaag

SEQ ID NO: 81598 - DNA, 25 bp, S. pombe
caagcagtttcactagtctctctag

SEQ ID NO: 81599 - DNA, 25 bp, S. pombe
caagcagcacttcttacacttctag

SEQ ID NO: 81600 - DNA, 25 bp, S. pombe
caaacaatccggttactgtctttag

SEQ ID NO: 81601 - DNA, 25 bp, S. pombe
caagagcaacctctttccttttacg

SEQ ID NO: 81602 - DNA, 25 bp, S. pombe
caaagcgaatctctttcaccatggc

SEQ ID NO: 81603 - DNA, 25 bp, S. pombe
caagggtgttggtcgccgttatgcc

SEQ ID NO: 81604 - DNA, 25 bp, S. pombe
caagggtgttggtcgtcgttacgct

SEQ ID NO: 81605 - DNA, 25 bp, S. pombe
caatgggtcttgttggtgctggtac

SEQ ID NO: 81606 - DNA, 25 bp, S. pombe
caacggcagttggatatcgggcaaa

SEQ ID NO: 81607 - DNA, 25 bp, S. pombe
caaagttcttatttgtggccctact

SEQ ID NO: 81608 - DNA, 25 bp, S. pombe
caagtttttcttggtcccacatact

SEQ ID NO: 81609 - DNA, 25 bp, S. pombe
caagtagctttttcagctccccaga

SEQ ID NO: 81610 - DNA, 25 bp, S. pombe
caaatacgtgtctggatggcactta

SEQ ID NO: 81611 - DNA, 25 bp, S. pombe
cagggatgtatcgagccaagttcag

SEQ ID NO: 81612 - DNA, 25 bp, S. pombe
caatggtatcattgcgcgcgcaggt

SEQ ID NO: 81613 - DNA, 25 bp, S. pombe
caaggtattctcgtggtggctactc

SEQ ID NO: 81614 - DNA, 25 bp, S. pombe
caagatactatcaaaagccgaattt

SEQ ID NO: 81615 - DNA, 25 bp, S. pombe
caagcaatttgaatagccctgattt

SEQ ID NO: 81616 - DNA, 25 bp, S. pombe
caagacattggctggattcggcatc

SEQ ID NO: 81617 - DNA, 25 bp, S. pombe
catttttcacgcgttgggctatgtg

SEQ ID NO: 81618 - DNA, 25 bp, S. pombe
caacttatccgggtgttctgtgtgt

SEQ ID NO: 81619 - DNA, 25 bp, S. pombe
caaggtaccgttcgtatgctgtttt

SEQ ID NO: 81620 - DNA, 25 bp, S. pombe
caaacttcccatactttgcttcttt

SEQ ID NO: 81621 - DNA, 25 bp, S. pombe
caaagcttctacaccgttttgttcg

SEQ ID NO: 81622 - DNA, 25 bp, S. pombe
caaactccgaaattctgttggccgg

SEQ ID NO: 81623 - DNA, 25 bp, S. pombe
caagcccggcaagtattttaaccag

SEQ ID NO: 81624 - DNA, 25 bp, S. pombe
caacgctcgaggttctacttaacac

SEQ ID NO: 81625 - DNA, 25 bp, S. pombe
caagcgtggaggctctgtctcaaaa

SEQ ID NO: 81626 - DNA, 25 bp, S. pombe
caaggctgagcggttttctgaaaac

SEQ ID NO: 81627 - DNA, 25 bp, S. pombe
caagggattccgtttctatattaca

SEQ ID NO: 81628 - DNA, 25 bp, S. pombe
caagtgcttttccttctgctttaaa

SEQ ID NO: 81629 - DNA, 25 bp, S. pombe
caagaattcgctcattcccaaggga

SEQ ID NO: 81630 - DNA, 25 bp, S. pombe
caaaattctcggtactcctagtcga

SEQ ID NO: 81631 - DNA, 25 bp, S. pombe
caaactctaccgaagctttttcaga

SEQ ID NO: 81632 - DNA, 25 bp, S. pombe
ctaaaccaaatcctgctacgtactg

SEQ ID NO: 81633 - DNA, 25 bp, S. pombe
caagctgttgaatacgtgcgtcgta

SEQ ID NO: 81634 - DNA, 25 bp, S. pombe
caagcgtgcttctaagattcgtcgt

SEQ ID NO: 81635 - DNA, 25 bp, S. pombe
caagcttgcttcctggtattttgaa

SEQ ID NO: 81636 - DNA, 25 bp, S. pombe
caggccacatctgaagtcttgggta

SEQ ID NO: 81637 - DNA, 25 bp, S. pombe
caacccctgtaaatgctagcggaac

SEQ ID NO: 81638 - DNA, 25 bp, S. pombe
caagtaccttgcctatttgcgtaag

SEQ ID NO: 81639 - DNA, 25 bp, S. pombe
caaggatccttagactatcgtaaag

SEQ ID NO: 81640 - DNA, 25 bp, S. pombe
caccaaccagcattaattcccatta

SEQ ID NO: 81641 - DNA, 25 bp, S. pombe
caagcaatcgccctaattcaacatt

SEQ ID NO: 81642 - DNA, 25 bp, S. pombe
caaggtgctaccattgtacaatcga

SEQ ID NO: 81643 - DNA, 25 bp, S. pombe
caagtttatttctcgcggtgccaat

SEQ ID NO: 81644 - DNA, 25 bp, S. pombe
caagttggtgttggccgtctttgca

SEQ ID NO: 81645 - DNA, 25 bp, S. pombe
caagcttggtgtctggatgttattc

SEQ ID NO: 81646 - DNA, 25 bp, S. pombe
caaactgggttatggcacttcctaa

SEQ ID NO: 81647 - DNA, 25 bp, S. pombe
cagacgtttgtttgggattcgcgta

SEQ ID NO: 81648 - DNA, 25 bp, S. pombe
cattcgatcctctccaaagtcaaag

SEQ ID NO: 81649 - DNA, 25 bp, S. pombe
gaccttacgcctaaaagtcgacgat

SEQ ID NO: 81650 - DNA, 25 bp, S. pombe
gccacttgaccctcaaattggaagc

SEQ ID NO: 81651 - DNA, 25 bp, S. pombe
ttcaccgactcctgcaaggttggga

SEQ ID NO: 81652 - DNA, 25 bp, S. pombe
taccccgtcggccaaggtaagagag

SEQ ID NO: 81653 - DNA, 25 bp, S. pombe
caaagtgcctatctaccccaaagga

SEQ ID NO: 81654 - DNA, 25 bp, S. pombe
caagagttcttctaacaaccctcaa

SEQ ID NO: 81655 - DNA, 25 bp, S. pombe
caagcgtcttttggctaaccctaag

SEQ ID NO: 81656 - DNA, 25 bp, S. pombe
cacagcccttgttagtaccgttaca

SEQ ID NO: 81657 - DNA, 25 bp, S. pombe
caagctgctcaagtggcccgaaaag

SEQ ID NO: 81658 - DNA, 25 bp, S. pombe
caaactagattggtccgtactacgg

SEQ ID NO: 81659 - DNA, 25 bp, S. pombe
caaatcgacttggtcctggactcgt

SEQ ID NO: 81660 - DNA, 25 bp, S. pombe
caagaagcgcttgttgggcactgct

SEQ ID NO: 81661 - DNA, 25 bp, S. pombe
caaagaccagtctacgccgagttat

SEQ ID NO: 81662 - DNA, 25 bp, S. pombe
caagaaatctcttttgccaaacatt

SEQ ID NO: 81663 - DNA, 25 bp, S. pombe
caagtattcttcttctgctcagtaa

SEQ ID NO: 81664 - DNA, 25 bp, S. pombe
cacagtgatcgcatttttggaacag

SEQ ID NO: 81665 - DNA, 25 bp, S. pombe
caagtgggctcttcgttggattaat

SEQ ID NO: 81666 - DNA, 25 bp, S. pombe
caagggatcttcaccgttgacgaaa

SEQ ID NO: 81667 - DNA, 25 bp, S. pombe
caacatccagttgctcgagttctaa

SEQ ID NO: 81668 - DNA, 25 bp, S. pombe
caaaaattcatatcgctgctctctc

SEQ ID NO: 81669 - DNA, 25 bp, S. pombe
caaaaagtcaatgcggctcctgctg

SEQ ID NO: 81670 - DNA, 25 bp, S. pombe
caaaacagagtgtagcttccaagct

SEQ ID NO: 81671 - DNA, 25 bp, S. pombe
caaactccgcttatgtgctaactgg

SEQ ID NO: 81672 - DNA, 25 bp, S. pombe
caaccccatggattcgattctgatg

SEQ ID NO: 81673 - DNA, 25 bp, S. pombe
caagcccttggctatgctagttatt

SEQ ID NO: 81674 - DNA, 25 bp, S. pombe
caagatcttcttggatgctgctgaa

SEQ ID NO: 81675 - DNA, 25 bp, S. pombe
caagctccctactagcagcaagagt

SEQ ID NO: 81676 - DNA, 25 bp, S. pombe
caaccttgcttgtatcttaacttta

SEQ ID NO: 81677 - DNA, 25 bp, S. pombe
caacgtgccctttattacttcaatg

SEQ ID NO: 81678 - DNA, 25 bp, S. pombe
caacaacttgcggtaaagatgataa

SEQ ID NO: 81679 - DNA, 25 bp, S. pombe
caagatcgtttgacccaagcagaaa

SEQ ID NO: 81680 - DNA, 25 bp, S. pombe
caagaagattcaaactcaccgtggt

SEQ ID NO: 81681 - DNA, 25 bp, S. pombe
caaaaacatccattctagccctaat

SEQ ID NO: 81682 - DNA, 25 bp, S. pombe
caaagagtccaatgcccgaaaaaca

SEQ ID NO: 81683 - DNA, 25 bp, S. pombe
caaatggtcgtctcttgtcaaaaaa

SEQ ID NO: 81684 - DNA, 25 bp, S. pombe
caaagggctgccaccgaaagtaaat

SEQ ID NO: 81685 - DNA, 25 bp, S. pombe
caaagatttcctattaaatcgagat

SEQ ID NO: 81686 - DNA, 25 bp, S. pombe
caacctattatgtactgggcaaatg

SEQ ID NO: 81687 - DNA, 25 bp, S. pombe
caaaccgacatttctgtgcgcaaat

SEQ ID NO: 81688 - DNA, 25 bp, S. pombe
caagcatctttaatcttctcttcca

SEQ ID NO: 81689 - DNA, 25 bp, S. pombe
caagcatctcttgtctttttggaaa

SEQ ID NO: 81690 - DNA, 25 bp, S. pombe
caagacgcttctcttttcgtaaaag

SEQ ID NO: 81691 - DNA, 25 bp, S. pombe
caagttgctcctcttttggcagaaa

SEQ ID NO: 81692 - DNA, 25 bp, S. pombe
caagattttcgcttaatatgggcta

SEQ ID NO: 81693 - DNA, 25 bp, S. pombe
caaatggctttacttgtcccaacgg

SEQ ID NO: 81694 - DNA, 25 bp, S. pombe
caaatggtttggtttcgctacggct

SEQ ID NO: 81695 - DNA, 25 bp, S. pombe
caagcagagttttggtgtctcccac

SEQ ID NO: 81696 - DNA, 25 bp, S. pombe
caagcagttgttctttctagcgaag

SEQ ID NO: 81697 - DNA, 25 bp, S. pombe
caacttttattctccgttactcctg

SEQ ID NO: 81698 - DNA, 25 bp, S. pombe
caacctattttctcccgtattatct

SEQ ID NO: 81699 - DNA, 25 bp, S. pombe
caacgtttctttgcccgaagatgtc

SEQ ID NO: 81700 - DNA, 25 bp, S. pombe
caagcgctttgtattccggatggaa

SEQ ID NO: 81701 - DNA, 25 bp, S. pombe
caaatttttgattcctgggctggtg

SEQ ID NO: 81702 - DNA, 25 bp, S. pombe
caactatatttgtgtctgctttttt

SEQ ID NO: 81703 - DNA, 25 bp, S. pombe
caacatttctttgccggttcatgga

SEQ ID NO: 81704 - DNA, 25 bp, S. pombe
cacaatttattagccgtttcgttag

SEQ ID NO: 81705 - DNA, 25 bp, S. pombe
caagccgttgctggtgttacacatg

SEQ ID NO: 81706 - DNA, 25 bp, S. pombe
caacaggttcgactaatccaatgga

SEQ ID NO: 81707 - DNA, 25 bp, S. pombe
caaccttgggcatacttggcaaaat

SEQ ID NO: 81708 - DNA, 25 bp, S. pombe
caacttcttggttctcgttgacgaa

SEQ ID NO: 81709 - DNA, 25 bp, S. pombe
caaactatcgttcccgtaggcaaat

SEQ ID NO: 81710 - DNA, 25 bp, S. pombe
caaccagcggttgctatcaagtttt

SEQ ID NO: 81711 - DNA, 25 bp, S. pombe
caacgaatcctaatctaccagcttt

SEQ ID NO: 81712 - DNA, 25 bp, S. pombe
caacgcctgaatcctgtttaccgga

SEQ ID NO: 81713 - DNA, 25 bp, S. pombe
caactcgccaattcgttactacaaa

SEQ ID NO: 81714 - DNA, 25 bp, S. pombe
caaccccacattcttttacttgatg

SEQ ID NO: 81715 - DNA, 25 bp, S. pombe
caacgccgtgttctttctggtgaat

SEQ ID NO: 81716 - DNA, 25 bp, S. pombe
caacctgttggtatttctgctgtga

SEQ ID NO: 81717 - DNA, 25 bp, S. pombe
caactgacattgcaggtcgtggtat

SEQ ID NO: 81718 - DNA, 25 bp, S. pombe
gcttaatttaccaccagaaccggct

SEQ ID NO: 81719 - DNA, 25 bp, S. pombe
caaacctccggtcagaatttcatac

SEQ ID NO: 81720 - DNA, 25 bp, S. pombe
caaaccttcgttctatatttctccg

SEQ ID NO: 81721 - DNA, 25 bp, S. pombe
caaccgcaaaggcttcttcttgtaa

SEQ ID NO: 81722 - DNA, 25 bp, S. pombe
caacggatgaacctactttacctgt

SEQ ID NO: 81723 - DNA, 25 bp, S. pombe
caaagcaataactcctatcttccgc

SEQ ID NO: 81724 - DNA, 25 bp, S. pombe
caacgtgtatatgtcgtgtacctaa

SEQ ID NO: 81725 - DNA, 25 bp, S. pombe
caagcgatatttgtatggtccggaa

SEQ ID NO: 81726 - DNA, 25 bp, S. pombe
cagagtgaattttttggaccgtata

SEQ ID NO: 81727 - DNA, 25 bp, S. pombe
caactacattgacttctggatccag

SEQ ID NO: 81728 - DNA, 25 bp, S. pombe
cacagcctttttcgcgtgacaagta

SEQ ID NO: 81729 - DNA, 25 bp, S. pombe
caacgatactttcgttcacatcact

SEQ ID NO: 81730 - DNA, 25 bp, S. pombe
caaacagaatctatggcacgacgcc

SEQ ID NO: 81731 - DNA, 25 bp, S. pombe
caacacgttcgaatggctcagcaaa

SEQ ID NO: 81732 - DNA, 25 bp, S. pombe
catcccgatgctggcagggctgaaa

SEQ ID NO: 81733 - DNA, 25 bp, S. pombe
caagcatattgtgattatgaggcca

SEQ ID NO: 81734 - DNA, 25 bp, S. pombe
caagcatattgtgattatgaggcca

SEQ ID NO: 81735 - DNA, 25 bp, S. pombe
catccccaacttacgtattgcattg

SEQ ID NO: 81736 - DNA, 25 bp, S. pombe
caagctttcgttgtatctgacacat

SEQ ID NO: 81737 - DNA, 25 bp, S. pombe
caaagtcctgtggtgtgctcaagtt

SEQ ID NO: 81738 - DNA, 25 bp, S. pombe
cacaagcaccggttgttccaaacgt

SEQ ID NO: 81739 - DNA, 25 bp, S. pombe
caaccgcgcttcagatttgatgagt

SEQ ID NO: 81740 - DNA, 25 bp, S. pombe
caacgcgcgttctgttattgacaag

SEQ ID NO: 81741 - DNA, 25 bp, S. pombe
gaactaatactatcttatctaccgg

SEQ ID NO: 81742 - DNA, 25 bp, S. pombe
gaacgaaggtaacactccctctgga

SEQ ID NO: 81743 - DNA, 25 bp, S. pombe
gaaggaattgttatactcttttaat

SEQ ID NO: 81744 - DNA, 25 bp, S. pombe
caacgacggattttctctcttcggt

SEQ ID NO: 81745 - DNA, 25 bp, S. pombe
caacgctgggatctggctctttgat

SEQ ID NO: 81746 - DNA, 25 bp, S. pombe
caagcgcctgttgattctgatgaag

SEQ ID NO: 81747 - DNA, 25 bp, S. pombe
caaccaatgtcgcttgctgctgtag

SEQ ID NO: 81748 - DNA, 25 bp, S. pombe
caacgtgttgccatttgcttagctt

SEQ ID NO: 81749 - DNA, 25 bp, S. pombe
caaagtggtatcgtgttggtactaa

SEQ ID NO: 81750 - DNA, 25 bp, S. pombe
caaagggttttggtttcatgcaatt

SEQ ID NO: 81751 - DNA, 25 bp, S. pombe
caagcgtatgttgccttatctcgtg

SEQ ID NO: 81752 - DNA, 25 bp, S. pombe
caacgtgatgatgcctcctgatgca

SEQ ID NO: 81753 - DNA, 25 bp, S. pombe
cagactttgaagacctcgatcaccg

SEQ ID NO: 81754 - DNA, 25 bp, S. pombe
caaatgtctcaatctccaataccga

SEQ ID NO: 81755 - DNA, 25 bp, S. pombe
caaattcatgtatctgcctactctc

SEQ ID NO: 81756 - DNA, 25 bp, S. pombe
caaagttgcatttgcctggcctatc

SEQ ID NO: 81757 - DNA, 25 bp, S. pombe
caacagtatgtttgcgtggacgcga

SEQ ID NO: 81758 - DNA, 25 bp, S. pombe
caaagctttgcttcgcgaattgcgt

SEQ ID NO: 81759 - DNA, 25 bp, S. pombe
caaatatgattgttccagtgccgac

SEQ ID NO: 81760 - DNA, 25 bp, S. pombe
caacttcatttcaaacgcgcaggtc

SEQ ID NO: 81761 - DNA, 25 bp, S. pombe
cactggtaataattcctgcccgtta

SEQ ID NO: 81762 - DNA, 25 bp, S. pombe
cacgtgaactggatcagcgtctcat

SEQ ID NO: 81763 - DNA, 25 bp, S. pombe
cacttagtcaaaaatggatcgcatt

SEQ ID NO: 81764 - DNA, 25 bp, S. pombe
cacagggctgctaactcggaagagg

SEQ ID NO: 81765 - DNA, 25 bp, S. pombe
caacgccagctgatgtgcttgacaa

SEQ ID NO: 81766 - DNA, 25 bp, S. pombe
caaacagttttgtgcgttggctttt

SEQ ID NO: 81767 - DNA, 25 bp, S. pombe
caaacatttttacggcctgcttctt

SEQ ID NO: 81768 - DNA, 25 bp, S. pombe
cacgttttacttccaccaatactga

SEQ ID NO: 81769 - DNA, 25 bp, S. pombe
caacttgaccccatttctaacgaga

SEQ ID NO: 81770 - DNA, 25 bp, S. pombe
caactcgcaactcctaattttatct

SEQ ID NO: 81771 - DNA, 25 bp, S. pombe
cacagctcgactacctagtggaaga

SEQ ID NO: 81772 - DNA, 25 bp, S. pombe
caacgtgacctagatgctgctgaag

SEQ ID NO: 81773 - DNA, 25 bp, S. pombe
caagcctacgcttaatgctggtgat

SEQ ID NO: 81774 - DNA, 25 bp, S. pombe
caagcccgcctaataatgaatgttt

SEQ ID NO: 81775 - DNA, 25 bp, S. pombe
caacgccgtcagactcttgaatttt

SEQ ID NO: 81776 - DNA, 25 bp, S. pombe
cacacctaagcttactcctgaagaa

SEQ ID NO: 81777 - DNA, 25 bp, S. pombe
caacctagcgtcttccaatgtaaaa

SEQ ID NO: 81778 - DNA, 25 bp, S. pombe
cacccgatgaatttcttgtttccaa

SEQ ID NO: 81779 - DNA, 25 bp, S. pombe
cactcctagaatttcggttgctcaa

SEQ ID NO: 81780 - DNA, 25 bp, S. pombe
caacctcgtcgatttatactgtaac

SEQ ID NO: 81781 - DNA, 25 bp, S. pombe
caacacttcctcacagtcattattt

SEQ ID NO: 81782 - DNA, 25 bp, S. pombe
caaacgtctttttcgaatcctgctt

SEQ ID NO: 81783 - DNA, 25 bp, S. pombe
caaacggctcttttagattcggatt

SEQ ID NO: 81784 - DNA, 25 bp, S. pombe
caaagaagcgtattgcacctacccc

SEQ ID NO: 81785 - DNA, 25 bp, S. pombe
caaagtcttttggttcgtgccgttg

SEQ ID NO: 81786 - DNA, 25 bp, S. pombe
cactggatttttctacgttcgttca

SEQ ID NO: 81787 - DNA, 25 bp, S. pombe
cagtagatttttcaccgacaggtca

SEQ ID NO: 81788 - DNA, 25 bp, S. pombe
caaaattctggtttccggaggtgca

SEQ ID NO: 81789 - DNA, 25 bp, S. pombe
caaatgttcgcgaccttactacagg

SEQ ID NO: 81790 - DNA, 25 bp, S. pombe
caacattacgcaactttacacatcc

SEQ ID NO: 81791 - DNA, 25 bp, S. pombe
caaattaatgatcctgcactccagc

SEQ ID NO: 81792 - DNA, 25 bp, S. pombe
caacatatcggctacttcttgggta

SEQ ID NO: 81793 - DNA, 25 bp, S. pombe
caacacactacatcgtcttcaggat

SEQ ID NO: 81794 - DNA, 25 bp, S. pombe
caaaaaggcctttactctcagggat

SEQ ID NO: 81795 - DNA, 25 bp, S. pombe
cactcctcgtcgtaacaaatccaat

SEQ ID NO: 81796 - DNA, 25 bp, S. pombe
cagcgacattcgttttaccaacctt

SEQ ID NO: 81797 - DNA, 25 bp, S. pombe
caaaagcgacccatgacagttcaga

SEQ ID NO: 81798 - DNA, 25 bp, S. pombe
caaacagcgtccgttgtcaacagtt

SEQ ID NO: 81799 - DNA, 25 bp, S. pombe
caaaagcgtctctttgaactccctt

SEQ ID NO: 81800 - DNA, 25 bp, S. pombe
caaacattgttctttttgctcccgt

SEQ ID NO: 81801 - DNA, 25 bp, S. pombe
caaactcgttctgattctttacctt

SEQ ID NO: 81802 - DNA, 25 bp, S. pombe
caacgttttccgttacattcaccat

SEQ ID NO: 81803 - DNA, 25 bp, S. pombe
caacgtctttctggtatggcttata

SEQ ID NO: 81804 - DNA, 25 bp, S. pombe
cttcgttttgcgcttcagttaactt

SEQ ID NO: 81805 - DNA, 25 bp, S. pombe
caactgttttggttgctcacgacaa

SEQ ID NO: 81806 - DNA, 25 bp, S. pombe
cacatttgtgttcagggcgttttca

SEQ ID NO: 81807 - DNA, 25 bp, S. pombe
cactagtttagcgtctggttctcag

SEQ ID NO: 81808 - DNA, 25 bp, S. pombe
cactgcaactaatcctggtgttcga

SEQ ID NO: 81809 - DNA, 25 bp, S. pombe
cacgcttatcaatctttgtgcccaa

SEQ ID NO: 81810 - DNA, 25 bp, S. pombe
caccttactactttggaaccgattg

SEQ ID NO: 81811 - DNA, 25 bp, S. pombe
cacgtatatccagcaaccattcaga

SEQ ID NO: 81812 - DNA, 25 bp, S. pombe
cacgatttatcagaccgttcgcaat

SEQ ID NO: 81813 - DNA, 25 bp, S. pombe
caaattcatactggcactcggttga

SEQ ID NO: 81814 - DNA, 25 bp, S. pombe
caactttactcccttgacatttaca

SEQ ID NO: 81815 - DNA, 25 bp, S. pombe
cacactcattacttccttggaatcg

SEQ ID NO: 81816 - DNA, 25 bp, S. pombe
caactatattcttctttgcccagag

SEQ ID NO: 81817 - DNA, 25 bp, S. pombe
caactcagttcatcttcccaaaagg

SEQ ID NO: 81818 - DNA, 25 bp, S. pombe
caacagagtctcttcttttcaaaat

SEQ ID NO: 81819 - DNA, 25 bp, S. pombe
caaaggttttctaatgctcccctat

SEQ ID NO: 81820 - DNA, 25 bp, S. pombe
caaagacggtttgattcctacgagt

SEQ ID NO: 81821 - DNA, 25 bp, S. pombe
caaaccgctttggagtaccttatgg

SEQ ID NO: 81822 - DNA, 25 bp, S. pombe
catcgaaattctcaaagcccgcatt

SEQ ID NO: 81823 - DNA, 25 bp, S. pombe
caacaagatgcgactcctgatgagt

SEQ ID NO: 81824 - DNA, 25 bp, S. pombe
caaaatgagcttgccgagcgctgta

SEQ ID NO: 81825 - DNA, 25 bp, S. pombe
caaactgatgttgccgctgttcttc

SEQ ID NO: 81826 - DNA, 25 bp, S. pombe
caaacttttgttcgcatttctgtcg

SEQ ID NO: 81827 - DNA, 25 bp, S. pombe
caaagcgcatagcaaccgtttcgtt

SEQ ID NO: 81828 - DNA, 25 bp, S. pombe
caaagctgaagaacctggtcttggt

SEQ ID NO: 81829 - DNA, 25 bp, S. pombe
caaagagctttctgcctggattaag

SEQ ID NO: 81830 - DNA, 25 bp, S. pombe
ctaccaatttcttccttactaacat

SEQ ID NO: 81831 - DNA, 25 bp, S. pombe
caactcttgcttctgtataccataa

SEQ ID NO: 81832 - DNA, 25 bp, S. pombe
caaagactcgatgttcactgttaaa

SEQ ID NO: 81833 - DNA, 25 bp, S. pombe
caaatgcgccgagttatggactaaa

SEQ ID NO: 81834 - DNA, 25 bp, S. pombe
caacagcaacagttattggccgaaa

SEQ ID NO: 81835 - DNA, 25 bp, S. pombe
cagccaagcacctcacgaatagata

SEQ ID NO: 81836 - DNA, 25 bp, S. pombe
ctgagtaccgcaaggccgaacgtga

SEQ ID NO: 81837 - DNA, 25 bp, S. pombe
caaagacctcccttctatttcaaag

SEQ ID NO: 81838 - DNA, 25 bp, S. pombe
caactactatcacctctcaatttaa

SEQ ID NO: 81839 - DNA, 25 bp, S. pombe
caacttccaataccatgcttttcat

SEQ ID NO: 81840 - DNA, 25 bp, S. pombe
caaattgtccccattctttttagat

SEQ ID NO: 81841 - DNA, 25 bp, S. pombe
caaaatccatctctttcgataccaa

SEQ ID NO: 81842 - DNA, 25 bp, S. pombe
caaaaccttattatcctcctcaaat

SEQ ID NO: 81843 - DNA, 25 bp, S. pombe
cagtaccttttgagttttccataga

SEQ ID NO: 81844 - DNA, 25 bp, S. pombe
caaagcctttccaaaatgtctccaa

SEQ ID NO: 81845 - DNA, 25 bp, S. pombe
caaacagagccccttgaattttcaa

SEQ ID NO: 81846 - DNA, 25 bp, S. pombe
taagacgattacccttgaggtggag

SEQ ID NO: 81847 - DNA, 25 bp, S. pombe
tactacgttgctgccttaggattgt

SEQ ID NO: 81848 - DNA, 25 bp, S. pombe
caactgcgggctggccgaagaactt

SEQ ID NO: 81849 - DNA, 25 bp, S. pombe
catccttgcgcgtgtcgagggaagt

SEQ ID NO: 81850 - DNA, 25 bp, S. pombe
cacctctggcagcttgggttacaat

SEQ ID NO: 81851 - DNA, 25 bp, S. pombe
caaacttactggtgctggctcaatt

SEQ ID NO: 81852 - DNA, 25 bp, S. pombe
caaattcccggtatgcttcatgcat

SEQ ID NO: 81853 - DNA, 25 bp, S. pombe
cttattccccttatcgtgattctta

SEQ ID NO: 81854 - DNA, 25 bp, S. pombe
caacaccagtcccatcagatgaaaa

SEQ ID NO: 81855 - DNA, 25 bp, S. pombe
caaaactgacgactcttcggttgaa

SEQ ID NO: 81856 - DNA, 25 bp, S. pombe
caaaattatcagctcgtccgattga

SEQ ID NO: 81857 - DNA, 25 bp, S. pombe
caaagttataccctgatcgcgatat

SEQ ID NO: 81858 - DNA, 25 bp, S. pombe
cacaatgttttctgcttccgctgat

SEQ ID NO: 81859 - DNA, 25 bp, S. pombe
cacaattttgtacgcttccccataa

SEQ ID NO: 81860 - DNA, 25 bp, S. pombe
cactacctacactgttcaactggaa

SEQ ID NO: 81861 - DNA, 25 bp, S. pombe
caccgcgtccacaagtttcgtaaga

SEQ ID NO: 81862 - DNA, 25 bp, S. pombe
caacactgtcttccattgcgaaagc

SEQ ID NO: 81863 - DNA, 25 bp, S. pombe
ctgaacagcctccaaagacgaacga

SEQ ID NO: 81864 - DNA, 25 bp, S. pombe
caacagctcgtatttgcatgccaaa

SEQ ID NO: 81865 - DNA, 25 bp, S. pombe
caaattgcttatttgcacgcgcaaa

SEQ ID NO: 81866 - DNA, 25 bp, S. pombe
caaagtagttcttccttgcaaggtt

SEQ ID NO: 81867 - DNA, 25 bp, S. pombe
caaatctacttactgtcgctgttca

SEQ ID NO: 81868 - DNA, 25 bp, S. pombe
caacagtttcggcacaaatcttcct

SEQ ID NO: 81869 - DNA, 25 bp, S. pombe
cacaagggcgtggtgtacttttaca

SEQ ID NO: 81870 - DNA, 25 bp, S. pombe
caaagcgtggctcgttacagacaat

SEQ ID NO: 81871 - DNA, 25 bp, S. pombe
caaatgctggatatgactaaacgat

SEQ ID NO: 81872 - DNA, 25 bp, S. pombe
caaagcggatacgactcaaggtgta

SEQ ID NO: 81873 - DNA, 25 bp, S. pombe
caaaggctgtccgaacgatggtgta

SEQ ID NO: 81874 - DNA, 25 bp, S. pombe
caaaagcttctaaacgtgttgcgaa

SEQ ID NO: 81875 - DNA, 25 bp, S. pombe
caaaatggtctattcgtggttacaa

SEQ ID NO: 81876 - DNA, 25 bp, S. pombe
cacacctgcgtggaattctggttca

SEQ ID NO: 81877 - DNA, 25 bp, S. pombe
caaaatcttggtttctggcttgcaa

SEQ ID NO: 81878 - DNA, 25 bp, S. pombe
caaaatcttgatatccgcatgcgga

SEQ ID NO: 81879 - DNA, 25 bp, S. pombe
cataaatggcaaggccctgggcttc

SEQ ID NO: 81880 - DNA, 25 bp, S. pombe
caaatgacaaagttctccgagagat

SEQ ID NO: 81881 - DNA, 25 bp, S. pombe
cacttctccgagtcgacaattctaa

SEQ ID NO: 81882 - DNA, 25 bp, S. pombe
cacggatccggatgaatttgcttca

SEQ ID NO: 81883 - DNA, 25 bp, S. pombe
cacatcgcgcttgtattacttcagt

SEQ ID NO: 81884 - DNA, 25 bp, S. pombe
caaaggcttcttttcatgcattatt

SEQ ID NO: 81885 - DNA, 25 bp, S. pombe
caaatcttgactgctggactgaata

SEQ ID NO: 81886 - DNA, 25 bp, S. pombe
caaacctatctcttgtactcataca

SEQ ID NO: 81887 - DNA, 25 bp, S. pombe
caaacgtttggcctttagcatcaca

SEQ ID NO: 81888 - DNA, 25 bp, S. pombe
caaaaatgttccctgcagctagcaa

SEQ ID NO: 81889 - DNA, 25 bp, S. pombe
cacaacttcttcagtcgtcgaaact

SEQ ID NO: 81890 - DNA, 25 bp, S. pombe
caaaaatctcaagtcagtgtggtag

SEQ ID NO: 81891 - DNA, 25 bp, S. pombe
cagaccggtcacaaggctagcgaat

SEQ ID NO: 81892 - DNA, 25 bp, S. pombe
cagaccgctgcatattttgacgaag

SEQ ID NO: 81893 - DNA, 25 bp, S. pombe
cacatcaggcgttttttactacaga

SEQ ID NO: 81894 - DNA, 25 bp, S. pombe
caaaggcgtgcgaacttactcaaca

SEQ ID NO: 81895 - DNA, 25 bp, S. pombe
caaaggcttccttttgagctcaaac

SEQ ID NO: 81896 - DNA, 25 bp, S. pombe
caaaggattcttttcgacactgata

SEQ ID NO: 81897 - DNA, 25 bp, S. pombe
caaaccgttgttactgatgctgaca

SEQ ID NO: 81898 - DNA, 25 bp, S. pombe
caaaccgcctctagtcaatcagata

SEQ ID NO: 81899 - DNA, 25 bp, S. pombe
caaatgccgcctatgatgatgaatg

SEQ ID NO: 81900 - DNA, 25 bp, S. pombe
caaagccacgcttttgcgaatgtat

SEQ ID NO: 81901 - DNA, 25 bp, S. pombe
caaacgtgccgttgctcaggagcaa

SEQ ID NO: 81902 - DNA, 25 bp, S. pombe
gcaaatccaggtgtcgttcgaactc

SEQ ID NO: 81903 - DNA, 25 bp, S. pombe
caaaatccatcaactctttcgaaag

SEQ ID NO: 81904 - DNA, 25 bp, S. pombe
caaaccttcagcttcattcaaaaaa

SEQ ID NO: 81905 - DNA, 25 bp, S. pombe
caaactattatcctcctcaacaaaa

SEQ ID NO: 81906 - DNA, 25 bp, S. pombe
caaataggcttgtttcctccaactg

SEQ ID NO: 81907 - DNA, 25 bp, S. pombe
caaagattctgtccgttatgcccat

SEQ ID NO: 81908 - DNA, 25 bp, S. pombe
caccgttcggcgtcttcaaaattag

SEQ ID NO: 81909 - DNA, 25 bp, S. pombe
cacagcctcttacttccttaaatat

SEQ ID NO: 81910 - DNA, 25 bp, S. pombe
cacggttgtccttatcgtacatatt

SEQ ID NO: 81911 - DNA, 25 bp, S. pombe
cagccgtcgagcgtcaaagttctac

SEQ ID NO: 81912 - DNA, 25 bp, S. pombe
cagcttttatttgtggcaggtgggc

SEQ ID NO: 81913 - DNA, 25 bp, S. pombe
gagcttttttgtgttggagttaccg

SEQ ID NO: 81914 - DNA, 25 bp, S. pombe
cactggtatcattttagccggtcaa

SEQ ID NO: 81915 - DNA, 25 bp, S. pombe
cactccaatttcctgagcctgaata

SEQ ID NO: 81916 - DNA, 25 bp, S. pombe
cactcatttggtggatgctccttta

SEQ ID NO: 81917 - DNA, 25 bp, S. pombe
cacgattcgttggtgctggtagctc

SEQ ID NO: 81918 - DNA, 25 bp, S. pombe
cactctacggtgttggtttcgaact

SEQ ID NO: 81919 - DNA, 25 bp, S. pombe
tcctcgaggtgctgggtatacgttt

SEQ ID NO: 81920 - DNA, 25 bp, S. pombe
cacctgctcttacactcaatggaaa

SEQ ID NO: 81921 - DNA, 25 bp, S. pombe
cagaactcctcgtgcaggcgaaaaa

SEQ ID NO: 81922 - DNA, 25 bp, S. pombe
gcttaaactaagtgaggaggatata

SEQ ID NO: 81923 - DNA, 25 bp, S. pombe
cttctagccgttttatgtggtccta

SEQ ID NO: 81924 - DNA, 25 bp, S. pombe
gccgttcacgttctaggagtcttag

SEQ ID NO: 81925 - DNA, 25 bp, S. pombe
catcggtaggttcgttgcaagtctt

SEQ ID NO: 81926 - DNA, 25 bp, S. pombe
catcccttacatccctaaaacggag

SEQ ID NO: 81927 - DNA, 25 bp, S. pombe
cacccactttggatttagcttctga

SEQ ID NO: 81928 - DNA, 25 bp, S. pombe
cagcccgtttacatcttggcaaaca

SEQ ID NO: 81929 - DNA, 25 bp, S. pombe
cagcgccgtcggtcaaaatggaaat

SEQ ID NO: 81930 - DNA, 25 bp, S. pombe
caaagtctgggttgcaattgcgaat

SEQ ID NO: 81931 - DNA, 25 bp, S. pombe
cacatgatggatttcgcgcggacgc

SEQ ID NO: 81932 - DNA, 25 bp, S. pombe
cacgtcgtcgagttggtttcatcgt

SEQ ID NO: 81933 - DNA, 25 bp, S. pombe
cacggatttatgtggttcctcgaaa

SEQ ID NO: 81934 - DNA, 25 bp, S. pombe
cactatcagttttttggcggacatt

SEQ ID NO: 81935 - DNA, 25 bp, S. pombe
caaagatgctttgcctggtaattga

SEQ ID NO: 81936 - DNA, 25 bp, S. pombe
caaagctgcaagtctgcgtgcgaga

SEQ ID NO: 81937 - DNA, 25 bp, S. pombe
cacgtctttggtgaagctggaaaca

SEQ ID NO: 81938 - DNA, 25 bp, S. pombe
cacaccgtcttgtggatgcaatcca

SEQ ID NO: 81939 - DNA, 25 bp, S. pombe
cacttggcaactgctcatgggtgca

SEQ ID NO: 81940 - DNA, 25 bp, S. pombe
cacttttatgcagagcgcggctggt

SEQ ID NO: 81941 - DNA, 25 bp, S. pombe
caaagtctggtgatttcgagcattt

SEQ ID NO: 81942 - DNA, 25 bp, S. pombe
caaagttgctggaatggtcctcata

SEQ ID NO: 81943 - DNA, 25 bp, S. pombe
caaagcaattggatggagccctcat

SEQ ID NO: 81944 - DNA, 25 bp, S. pombe
caaagaatcttcatggctgcccatt

SEQ ID NO: 81945 - DNA, 25 bp, S. pombe
caaatgatagccgttctcttattaa

SEQ ID NO: 81946 - DNA, 25 bp, S. pombe
cacagtttgtttcttttcttgagct

SEQ ID NO: 81947 - DNA, 25 bp, S. pombe
catcgtaacgttcttgtttgctcac

SEQ ID NO: 81948 - DNA, 25 bp, S. pombe
cacggaacgattacttctgttgata

SEQ ID NO: 81949 - DNA, 25 bp, S. pombe
cagccgatgccgagtttgtatttga

SEQ ID NO: 81950 - DNA, 25 bp, S. pombe
cactagcggtgctcttcctcaataa

SEQ ID NO: 81951 - DNA, 25 bp, S. pombe
cactcgtgcggctgcttcagcttaa

SEQ ID NO: 81952 - DNA, 25 bp, S. pombe
cactcgttggagacaatcgcatatg

SEQ ID NO: 81953 - DNA, 25 bp, S. pombe
cacaactgtatcctcttcttcttag

SEQ ID NO: 81954 - DNA, 25 bp, S. pombe
cacaacttgactccttccaatgtta

SEQ ID NO: 81955 - DNA, 25 bp, S. pombe
caaagacgcgataagctggcttgct

SEQ ID NO: 81956 - DNA, 25 bp, S. pombe
caaaggtctatgacgctgtttgcga

SEQ ID NO: 81957 - DNA, 25 bp, S. pombe
cactacgtgctattcgtgaacgcgt

SEQ ID NO: 81958 - DNA, 25 bp, S. pombe
cactttgctcttccgcttattaaaa

SEQ ID NO: 81959 - DNA, 25 bp, S. pombe
caccgttaatcgaactcctattcct

SEQ ID NO: 81960 - DNA, 25 bp, S. pombe
cacggatttttatctcgaattcgtt

SEQ ID NO: 81961 - DNA, 25 bp, S. pombe
cagttcgttgtaaatacccgtgccg

SEQ ID NO: 81962 - DNA, 25 bp, S. pombe
cagcgggaggatttgattcaccagt

SEQ ID NO: 81963 - DNA, 25 bp, S. pombe
cactcaacgctcagctgctagaaag

SEQ ID NO: 81964 - DNA, 25 bp, S. pombe
cacattcagcactcttcagggatta

SEQ ID NO: 81965 - DNA, 25 bp, S. pombe
cacaatagcgcgtcttcagcatgaa

SEQ ID NO: 81966 - DNA, 25 bp, S. pombe
caaattccagcaactcgacatcatt

SEQ ID NO: 81967 - DNA, 25 bp, S. pombe
cacattccaactgagtgttttaaat

SEQ ID NO: 81968 - DNA, 25 bp, S. pombe
cacattccaactgagtgttttaaat

SEQ ID NO: 81969 - DNA, 25 bp, S. pombe
caccaactcggccaactttgtataa

SEQ ID NO: 81970 - DNA, 25 bp, S. pombe
cactccattcttttgtttaccgaat

SEQ ID NO: 81971 - DNA, 25 bp, S. pombe
cacaccagttatttgctatttgcgg

SEQ ID NO: 81972 - DNA, 25 bp, S. pombe
cacttcttttcaactttttgactag

SEQ ID NO: 81973 - DNA, 25 bp, S. pombe
cagttctttttcatccggtagcaat

SEQ ID NO: 81974 - DNA, 25 bp, S. pombe
caggcttcctttatccgggttcaag

SEQ ID NO: 81975 - DNA, 25 bp, S. pombe
cacagatttgtatgctcgtcagaaa

SEQ ID NO: 81976 - DNA, 25 bp, S. pombe
cagcaacgttctttattcccatttg

SEQ ID NO: 81977 - DNA, 25 bp, S. pombe
caccatgtgggttttgttttgttga

SEQ ID NO: 81978 - DNA, 25 bp, S. pombe
cacaatctggtggtgttcgtccgtt

SEQ ID NO: 81979 - DNA, 25 bp, S. pombe
caaatttggtgggatcgcctttcta

SEQ ID NO: 81980 - DNA, 25 bp, S. pombe
caccgattcacgtacactggttgaa

SEQ ID NO: 81981 - DNA, 25 bp, S. pombe
cacatactgttaaatatggttcaat

SEQ ID NO: 81982 - DNA, 25 bp, S. pombe
cacatctttgcttctttcaacgata

SEQ ID NO: 81983 - DNA, 25 bp, S. pombe
cacatcttacgagctcatcaactat

SEQ ID NO: 81984 - DNA, 25 bp, S. pombe
cagccgactttcttaccatttcaaa

SEQ ID NO: 81985 - DNA, 25 bp, S. pombe
caccttgtttgatcgtctttgcagt

SEQ ID NO: 81986 - DNA, 25 bp, S. pombe
cacgattgttggtcagttcttctca

SEQ ID NO: 81987 - DNA, 25 bp, S. pombe
cacgtagtggtgtacttggtcgcat

SEQ ID NO: 81988 - DNA, 25 bp, S. pombe
cacacgttttccttgatgcttttac

SEQ ID NO: 81989 - DNA, 25 bp, S. pombe
cacaagttgcttctgggttttcaca

SEQ ID NO: 81990 - DNA, 25 bp, S. pombe
cacaagttatgggtgtcctctttaa

SEQ ID NO: 81991 - DNA, 25 bp, S. pombe
cagacagtacgcgagcagcaatact

SEQ ID NO: 81992 - DNA, 25 bp, S. pombe
caggattcccagctgaacgagtcat

SEQ ID NO: 81993 - DNA, 25 bp, S. pombe
cagcttggtacttcgtggaattgat

SEQ ID NO: 81994 - DNA, 25 bp, S. pombe
caccgtctcatcgatcggaggattt

SEQ ID NO: 81995 - DNA, 25 bp, S. pombe
cacacattactcctttgccagaaaa

SEQ ID NO: 81996 - DNA, 25 bp, S. pombe
caaattcggtttgtctggtcttcac

SEQ ID NO: 81997 - DNA, 25 bp, S. pombe
caaattttctgtacatacccctcac

SEQ ID NO: 81998 - DNA, 25 bp, S. pombe
cactgtccttctttcaagctgtaaa

SEQ ID NO: 81999 - DNA, 25 bp, S. pombe
cagtatttcggctgctttatttttc

SEQ ID NO: 82000 - DNA, 25 bp, S. pombe
cactagcggcgacggtctttatgaa

SEQ ID NO: 82001 - DNA, 25 bp, S. pombe
cactgttatgcgtggtgcctttaag

SEQ ID NO: 82002 - DNA, 25 bp, S. pombe
cacggtatcgttcctgacattctaa

SEQ ID NO: 82003 - DNA, 25 bp, S. pombe
cacgcgaatctgttctttcacatgt

SEQ ID NO: 82004 - DNA, 25 bp, S. pombe
cactggtgtcttgagttcatctgat

SEQ ID NO: 82005 - DNA, 25 bp, S. pombe
cagccatcgggctctcgagtaaggt

SEQ ID NO: 82006 - DNA, 25 bp, S. pombe
cagggaaattgtgaaggcttgacta

SEQ ID NO: 82007 - DNA, 25 bp, S. pombe
cacttgattggacttttaacggact

SEQ ID NO: 82008 - DNA, 25 bp, S. pombe
caccttctccagcacttttgaaaaa

SEQ ID NO: 82009 - DNA, 25 bp, S. pombe
cactttctccatcttgcgtactaaa

SEQ ID NO: 82010 - DNA, 25 bp, S. pombe
cacatttcctctttggctgtaccat

SEQ ID NO: 82011 - DNA, 25 bp, S. pombe
cacatattccctctgatgctttgaa

SEQ ID NO: 82012 - DNA, 25 bp, S. pombe
cacgatcccaattttgcaactgcag

SEQ ID NO: 82013 - DNA, 25 bp, S. pombe
caccacgatcttaagcgtcatctga

SEQ ID NO: 82014 - DNA, 25 bp, S. pombe
cacgaccattcaccagcgatatatg

SEQ ID NO: 82015 - DNA, 25 bp, S. pombe
cactgctacccaatgtcactaatta

SEQ ID NO: 82016 - DNA, 25 bp, S. pombe
cactttgcccaaatgttccgtttat

SEQ ID NO: 82017 - DNA, 25 bp, S. pombe
cacttagcgtacatttcctactcaa

SEQ ID NO: 82018 - DNA, 25 bp, S. pombe
cactttcgcatttatttccttccaa

SEQ ID NO: 82019 - DNA, 25 bp, S. pombe
cacattgtggtttttcttttgccaa

SEQ ID NO: 82020 - DNA, 25 bp, S. pombe
cagcgggcgttacttttttgccaag

SEQ ID NO: 82021 - DNA, 25 bp, S. pombe
caccgcgatccttaatcatcattga

SEQ ID NO: 82022 - DNA, 25 bp, S. pombe
cagctactttcctctattgcagaag

SEQ ID NO: 82023 - DNA, 25 bp, S. pombe
caggtcttccactctttcaaatttt

SEQ ID NO: 82024 - DNA, 25 bp, S. pombe
cagagtttactcctaccacgaattt

SEQ ID NO: 82025 - DNA, 25 bp, S. pombe
cacgttttgcggtactcctgaattt

SEQ ID NO: 82026 - DNA, 25 bp, S. pombe
cagcagtacattcaggttcctcaat

SEQ ID NO: 82027 - DNA, 25 bp, S. pombe
cactacatctcatagcagtacacca

SEQ ID NO: 82028 - DNA, 25 bp, S. pombe
cactttttcggttatcactcttctc

SEQ ID NO: 82029 - DNA, 25 bp, S. pombe
cactctttggtggtaacgcttttgc

SEQ ID NO: 82030 - DNA, 25 bp, S. pombe
cacactcttcctcataatcgtttta

SEQ ID NO: 82031 - DNA, 25 bp, S. pombe
cacaccgacattcattcacttttaa

SEQ ID NO: 82032 - DNA, 25 bp, S. pombe
cagcccataaaaattccacgacttc

SEQ ID NO: 82033 - DNA, 25 bp, S. pombe
cactgtctgtgatgtatggtcgcaa

SEQ ID NO: 82034 - DNA, 25 bp, S. pombe
caccgcgtacctattcatgatgttg

SEQ ID NO: 82035 - DNA, 25 bp, S. pombe
caccgtgaacacaatcttctgcttt

SEQ ID NO: 82036 - DNA, 25 bp, S. pombe
cactgcacgaactcatgggatattt

SEQ ID NO: 82037 - DNA, 25 bp, S. pombe
cagtagcgaccaatcatgtgcggat

SEQ ID NO: 82038 - DNA, 25 bp, S. pombe
cactactgccacttcgatggatgaa

SEQ ID NO: 82039 - DNA, 25 bp, S. pombe
cactgagtcccaattgcatcgagaa

SEQ ID NO: 82040 - DNA, 25 bp, S. pombe
cacttgcttccatttcatccagaaa

SEQ ID NO: 82041 - DNA, 25 bp, S. pombe
cacttctggtctgtcacgagatgaa

SEQ ID NO: 82042 - DNA, 25 bp, S. pombe
cagcttcttttgttaatgaggatga

SEQ ID NO: 82043 - DNA, 25 bp, S. pombe
cacaggtgacacttcgcaacaagat

SEQ ID NO: 82044 - DNA, 25 bp, S. pombe
cagtggtgacactcgacccaatgaa

SEQ ID NO: 82045 - DNA, 25 bp, S. pombe
cactgctttggctgttgcattgaag

SEQ ID NO: 82046 - DNA, 25 bp, S. pombe
cacgctttgcgaactttaatacctt

SEQ ID NO: 82047 - DNA, 25 bp, S. pombe
cagccttccttattttatcgaccgt

SEQ ID NO: 82048 - DNA, 25 bp, S. pombe
cacattctcattcaacttaactctc

SEQ ID NO: 82049 - DNA, 25 bp, S. pombe
cactttgttggcgttacttgttgaa

SEQ ID NO: 82050 - DNA, 25 bp, S. pombe
cagaaatcttcttgactttggtcga

SEQ ID NO: 82051 - DNA, 25 bp, S. pombe
cacatacattccttgcattgctttt

SEQ ID NO: 82052 - DNA, 25 bp, S. pombe
caccttcatatcttatccttttcaa

SEQ ID NO: 82053 - DNA, 25 bp, S. pombe
cactgtatcgttatgcatcctttgc

SEQ ID NO: 82054 - DNA, 25 bp, S. pombe
cactgactagtgaccttttgaaatt

SEQ ID NO: 82055 - DNA, 25 bp, S. pombe
cactgttcccagatctttatttgct

SEQ ID NO: 82056 - DNA, 25 bp, S. pombe
caccttactgctgtcgttatttcta

SEQ ID NO: 82057 - DNA, 25 bp, S. pombe
cacttctttgctgtcaatttcctag

SEQ ID NO: 82058 - DNA, 25 bp, S. pombe
cactccagatcggtttttcctagga

SEQ ID NO: 82059 - DNA, 25 bp, S. pombe
cagcccgacgtttttatctatcagg

SEQ ID NO: 82060 - DNA, 25 bp, S. pombe
cacctgctcagtcacgattatcggg

SEQ ID NO: 82061 - DNA, 25 bp, S. pombe
caggtcgcggttgtgaaatctctca

SEQ ID NO: 82062 - DNA, 25 bp, S. pombe
cacgctcgctcgtttctaaaggtga

SEQ ID NO: 82063 - DNA, 25 bp, S. pombe
cacgtcgtcgtgctaaccaagttaa

SEQ ID NO: 82064 - DNA, 25 bp, S. pombe
cgagcctgctttgaaaccggttgaa

SEQ ID NO: 82065 - DNA, 25 bp, S. pombe
cctcctctacgtaaatccgagttgg

SEQ ID NO: 82066 - DNA, 25 bp, S. pombe
cagcaagtgagtaccgttttccaat

SEQ ID NO: 82067 - DNA, 25 bp, S. pombe
cacatagtgatgtcttcgtttctca

SEQ ID NO: 82068 - DNA, 25 bp, S. pombe
cagctcctggcttcgtgttagtgaa

SEQ ID NO: 82069 - DNA, 25 bp, S. pombe
cactgcttgcttccttagatactat

SEQ ID NO: 82070 - DNA, 25 bp, S. pombe
cacgcgcgcttgcttgaatgacaat

SEQ ID NO: 82071 - DNA, 25 bp, S. pombe
caccctagctggttgcctaatgata

SEQ ID NO: 82072 - DNA, 25 bp, S. pombe
cacttgatacccttttaattgatga

SEQ ID NO: 82073 - DNA, 25 bp, S. pombe
cagcgtatacccgttgaaactcaac

SEQ ID NO: 82074 - DNA, 25 bp, S. pombe
cagccctactttttgtaagccaaca

SEQ ID NO: 82075 - DNA, 25 bp, S. pombe
caccctcttcttctgacaaggataa

SEQ ID NO: 82076 - DNA, 25 bp, S. pombe
caccctcttcgtttgtcgatcggaa

SEQ ID NO: 82077 - DNA, 25 bp, S. pombe
cacctcgttctcttattagtcgtaa

SEQ ID NO: 82078 - DNA, 25 bp, S. pombe
caccgcggtttcttatgaaatgatg

SEQ ID NO: 82079 - DNA, 25 bp, S. pombe
cactctctctcttcagaatcgttta

SEQ ID NO: 82080 - DNA, 25 bp, S. pombe
cacctctgatctttactctgtacaa

SEQ ID NO: 82081 - DNA, 25 bp, S. pombe
cacgtctattgtggctcttgtgcaa

SEQ ID NO: 82082 - DNA, 25 bp, S. pombe
cactgcttgccttacattgttcaat

SEQ ID NO: 82083 - DNA, 25 bp, S. pombe
cactcattcttcatccattgtcaat

SEQ ID NO: 82084 - DNA, 25 bp, S. pombe
cacgttcgtgacattgcgcaagcaa

SEQ ID NO: 82085 - DNA, 25 bp, S. pombe
cactttgttgacatgctccgtgaag

SEQ ID NO: 82086 - DNA, 25 bp, S. pombe
caccttcatctgcttttgcttatag

SEQ ID NO: 82087 - DNA, 25 bp, S. pombe
cacttttgaatgtcgtctttgcctc

SEQ ID NO: 82088 - DNA, 25 bp, S. pombe
cactttctagtgctgattcttgtct

SEQ ID NO: 82089 - DNA, 25 bp, S. pombe
cacggctggtggtttcctttatata

SEQ ID NO: 82090 - DNA, 25 bp, S. pombe
cagcgggttatgttacgtcggcagc

SEQ ID NO: 82091 - DNA, 25 bp, S. pombe
cagccgagtttgttgaatttaccga

SEQ ID NO: 82092 - DNA, 25 bp, S. pombe
cacgtctttcttcaattctaccaga

SEQ ID NO: 82093 - DNA, 25 bp, S. pombe
cactgcttttgtagatttcccgatc

SEQ ID NO: 82094 - DNA, 25 bp, S. pombe
cacgtcttttgaatggactcccatt

SEQ ID NO: 82095 - DNA, 25 bp, S. pombe
cacgctcgcgattcatttgttgcta

SEQ ID NO: 82096 - DNA, 25 bp, S. pombe
cactgtatcgaactgctgacttatc

SEQ ID NO: 82097 - DNA, 25 bp, S. pombe
cagtatcatgggtagtagctttcac

SEQ ID NO: 82098 - DNA, 25 bp, S. pombe
cagcttcaagctatgggatttcctt

SEQ ID NO: 82099 - DNA, 25 bp, S. pombe
cagctatggcggattgtgacttctt

SEQ ID NO: 82100 - DNA, 25 bp, S. pombe
cactcgtgccgaacttattttattt

SEQ ID NO: 82101 - DNA, 25 bp, S. pombe
cactcctcccattcttatgttttaa

SEQ ID NO: 82102 - DNA, 25 bp, S. pombe
cagccgatgggcaaacttcagatta

SEQ ID NO: 82103 - DNA, 25 bp, S. pombe
cactgttctgaatactcctgatgat

SEQ ID NO: 82104 - DNA, 25 bp, S. pombe
cagatagttggtgccgttgctacaa

SEQ ID NO: 82105 - DNA, 25 bp, S. pombe
cagacggtgctatccctattcaaga

SEQ ID NO: 82106 - DNA, 25 bp, S. pombe
ctttacgggcgccttggtgagaatt

SEQ ID NO: 82107 - DNA, 25 bp, S. pombe
ccacaaatggttctggcctacgttt

SEQ ID NO: 82108 - DNA, 25 bp, S. pombe
cagaaaagtggtgagtgcccgcctt

SEQ ID NO: 82109 - DNA, 25 bp, S. pombe
cactggcagcatcgctatttctgaa

SEQ ID NO: 82110 - DNA, 25 bp, S. pombe
cactgaacacgccaagcgtaagact

SEQ ID NO: 82111 - DNA, 25 bp, S. pombe
cagctgaacagctcacggatcaaaa

SEQ ID NO: 82112 - DNA, 25 bp, S. pombe
cagcgtctcacttcccgaaaagtta

SEQ ID NO: 82113 - DNA, 25 bp, S. pombe
cattcccctccgtcattagaaagaa

SEQ ID NO: 82114 - DNA, 25 bp, S. pombe
cagcaagctgcggttttcgggaaac

SEQ ID NO: 82115 - DNA, 25 bp, S. pombe
cagaagctgcggtgaatattggaca

SEQ ID NO: 82116 - DNA, 25 bp, S. pombe
cagacagtcgtgtatcaagccggta

SEQ ID NO: 82117 - DNA, 25 bp, S. pombe
cagcggaagccaacggtggctcaaa

SEQ ID NO: 82118 - DNA, 25 bp, S. pombe
cagcgtaagctctctgaggtacaaa

SEQ ID NO: 82119 - DNA, 25 bp, S. pombe
cagcgagcgatatcgatcctcttaa

SEQ ID NO: 82120 - DNA, 25 bp, S. pombe
caggtgcaataatgtcctttgggtt

SEQ ID NO: 82121 - DNA, 25 bp, S. pombe
cagggcgttaagtgcttattcgtta

SEQ ID NO: 82122 - DNA, 25 bp, S. pombe
cagttggaataacccctagtcttat

SEQ ID NO: 82123 - DNA, 25 bp, S. pombe
cagcgccgaaaaccttcttacttga

SEQ ID NO: 82124 - DNA, 25 bp, S. pombe
cagccgaaaacaacttcttctcttt

SEQ ID NO: 82125 - DNA, 25 bp, S. pombe
cagcgggaaccattctttgtgtttt

SEQ ID NO: 82126 - DNA, 25 bp, S. pombe
cagcctgcgtttgttcagttttttc

SEQ ID NO: 82127 - DNA, 25 bp, S. pombe
catggtgatatgtcccagggagccc

SEQ ID NO: 82128 - DNA, 25 bp, S. pombe
cactgtgcatattgcccatgcgata

SEQ ID NO: 82129 - DNA, 25 bp, S. pombe
cagcaattttggacggcctcaagta

SEQ ID NO: 82130 - DNA, 25 bp, S. pombe
cagaattcctgggtgtgggcggttg

SEQ ID NO: 82131 - DNA, 25 bp, S. pombe
tagaaatccttgacgaccggtttga

SEQ ID NO: 82132 - DNA, 25 bp, S. pombe
cagcgacgatttggtgacacacatt

SEQ ID NO: 82133 - DNA, 25 bp, S. pombe
cagaatacatgcttgcgacagggaa

SEQ ID NO: 82134 - DNA, 25 bp, S. pombe
cactgctaatgctatcaccttggag

SEQ ID NO: 82135 - DNA, 25 bp, S. pombe
cagcatatattgctccacttggcaa

SEQ ID NO: 82136 - DNA, 25 bp, S. pombe
cactgaggctggaatgtttgcgatt

SEQ ID NO: 82137 - DNA, 25 bp, S. pombe
cacggcgccttattgattgagtcta

SEQ ID NO: 82138 - DNA, 25 bp, S. pombe
cagcggctgcctttattaaatgctt

SEQ ID NO: 82139 - DNA, 25 bp, S. pombe
catgcgacctcctgttaaagatttt

SEQ ID NO: 82140 - DNA, 25 bp, S. pombe
cagaaaccctcttttaagtcatgtt

SEQ ID NO: 82141 - DNA, 25 bp, S. pombe
cagaaacccttctttgtatgccaaa

SEQ ID NO: 82142 - DNA, 25 bp, S. pombe
cagaagttccttccttgttggagaa

SEQ ID NO: 82143 - DNA, 25 bp, S. pombe
cagcgacgtccttctagttttaagt

SEQ ID NO: 82144 - DNA, 25 bp, S. pombe
cacgatgtctttgcttctgcattag

SEQ ID NO: 82145 - DNA, 25 bp, S. pombe
cagtttggatttcgcactattcggc

SEQ ID NO: 82146 - DNA, 25 bp, S. pombe
cataatcgggttcaagcagtgcaag

SEQ ID NO: 82147 - DNA, 25 bp, S. pombe
caccaagggttcaatctgctacaat

SEQ ID NO: 82148 - DNA, 25 bp, S. pombe
cagtcaagcttttcggatagcccta

SEQ ID NO: 82149 - DNA, 25 bp, S. pombe
cagtcgatctttgcgaaatcctcaa

SEQ ID NO: 82150 - DNA, 25 bp, S. pombe
cagcccattttcctctagcgaataa

SEQ ID NO: 82151 - DNA, 25 bp, S. pombe
cacccatgtgtgattctcgcgaaga

SEQ ID NO: 82152 - DNA, 25 bp, S. pombe
cagccatttctgagtctgccgaaaa

SEQ ID NO: 82153 - DNA, 25 bp, S. pombe
cagctaagtctgatggccctacaat

SEQ ID NO: 82154 - DNA, 25 bp, S. pombe
cagaaaatcgttgcatactcccatc

SEQ ID NO: 82155 - DNA, 25 bp, S. pombe
cagtaatatcggttgctgttagccc

SEQ ID NO: 82156 - DNA, 25 bp, S. pombe
caccatggtcggttgttatgcagca

SEQ ID NO: 82157 - DNA, 25 bp, S. pombe
cagctgccatccctaggttaataat

SEQ ID NO: 82158 - DNA, 25 bp, S. pombe
cagcaacgctgggtgcatgtcgata

SEQ ID NO: 82159 - DNA, 25 bp, S. pombe
cagctcgaagtgtgcatgcccatag

SEQ ID NO: 82160 - DNA, 25 bp, S. pombe
cagatcccgagaatggtgctttcca

SEQ ID NO: 82161 - DNA, 25 bp, S. pombe
cagtctcctggtatcgttatcgaag

SEQ ID NO: 82162 - DNA, 25 bp, S. pombe
caggacggcgttgcatgtgacatta

SEQ ID NO: 82163 - DNA, 25 bp, S. pombe
cagctgttgagatccctgaatctga

SEQ ID NO: 82164 - DNA, 25 bp, S. pombe
cagcgacttgactcaatggatcaga

SEQ ID NO: 82165 - DNA, 25 bp, S. pombe
cagcgagaattcttcatcggattaa

SEQ ID NO: 82166 - DNA, 25 bp, S. pombe
caccttcgactgaatgattgctatt

SEQ ID NO: 82167 - DNA, 25 bp, S. pombe
cagcagctggcgtacaagtggcatt

SEQ ID NO: 82168 - DNA, 25 bp, S. pombe
cacgaacgcgtttgtccattgagac

SEQ ID NO: 82169 - DNA, 25 bp, S. pombe
cagccgaagctgacttgctcagatt

SEQ ID NO: 82170 - DNA, 25 bp, S. pombe
caccagcctcttatgattcgttgaa

SEQ ID NO: 82171 - DNA, 25 bp, S. pombe
cacgcaactcttgaattctttctca

SEQ ID NO: 82172 - DNA, 25 bp, S. pombe
cacgttcatcttcaattcttctatc

SEQ ID NO: 82173 - DNA, 25 bp, S. pombe
cacgtttcttgatttctctgcttac

SEQ ID NO: 82174 - DNA, 25 bp, S. pombe
cacgttccttcaaccacttagtcaa

SEQ ID NO: 82175 - DNA, 25 bp, S. pombe
caccgttttcatatcctgtagctta

SEQ ID NO: 82176 - DNA, 25 bp, S. pombe
catctcttggtctcgtttggactaa

SEQ ID NO: 82177 - DNA, 25 bp, S. pombe
caggatatactgcacctgaagatat

SEQ ID NO: 82178 - DNA, 25 bp, S. pombe
cagaatctatcatcccaacatcaat

SEQ ID NO: 82179 - DNA, 25 bp, S. pombe
cagcaacccatgcaaattcctttgt

SEQ ID NO: 82180 - DNA, 25 bp, S. pombe
cagcaagccgctgaagtacttttta

SEQ ID NO: 82181 - DNA, 25 bp, S. pombe
cagcaagcttgtataccgtcggtat

SEQ ID NO: 82182 - DNA, 25 bp, S. pombe
catcacctgatatggatactgccgt

SEQ ID NO: 82183 - DNA, 25 bp, S. pombe
caggtcaagttccttcggttcgtat

SEQ ID NO: 82184 - DNA, 25 bp, S. pombe
tcggtaacgtccacggtgtctacaa

SEQ ID NO: 82185 - DNA, 25 bp, S. pombe
tcctgggtacaatcccgagacgggt

SEQ ID NO: 82186 - DNA, 25 bp, S. pombe
cagcaggtgcttttccatgggagtc

SEQ ID NO: 82187 - DNA, 25 bp, S. pombe
cagcagtacttgtcggcgctgtagt

SEQ ID NO: 82188 - DNA, 25 bp, S. pombe
cagcgctacgcctttaggcagagtt

SEQ ID NO: 82189 - DNA, 25 bp, S. pombe
cagcatcaagcatggccgggacata

SEQ ID NO: 82190 - DNA, 25 bp, S. pombe
caccgctttacaacactgtttctga

SEQ ID NO: 82191 - DNA, 25 bp, S. pombe
cacctcttcttatttgctgctttta

SEQ ID NO: 82192 - DNA, 25 bp, S. pombe
cagttcttggttttcttctttctca

SEQ ID NO: 82193 - DNA, 25 bp, S. pombe
cagcggttgtttttctgtttggcaa

SEQ ID NO: 82194 - DNA, 25 bp, S. pombe
cagtcgggtttcatttgtcgtacca

SEQ ID NO: 82195 - DNA, 25 bp, S. pombe
catggcggttttgttgttcttgaca

SEQ ID NO: 82196 - DNA, 25 bp, S. pombe
gcgacgaggtttggacgtttatcat

SEQ ID NO: 82197 - DNA, 25 bp, S. pombe
cagacgtcgttttccagttggttga

SEQ ID NO: 82198 - DNA, 25 bp, S. pombe
cagaggtaatgcacccgttcgtata

SEQ ID NO: 82199 - DNA, 25 bp, S. pombe
cagctcttcagcacgaattctttaa

SEQ ID NO: 82200 - DNA, 25 bp, S. pombe
cagaatcggccgtcgttggatagta

SEQ ID NO: 82201 - DNA, 25 bp, S. pombe
cagatagcggtcttttcggtatgtt

SEQ ID NO: 82202 - DNA, 25 bp, S. pombe
cagagtcgacgttgcttttgtacaa

SEQ ID NO: 82203 - DNA, 25 bp, S. pombe
cagagtccctctatttataccaaga

SEQ ID NO: 82204 - DNA, 25 bp, S. pombe
cgaagtcttctactttgaccgtggg

SEQ ID NO: 82205 - DNA, 25 bp, S. pombe
cgctggaagacttttcgtccgtggg

SEQ ID NO: 82206 - DNA, 25 bp, S. pombe
catgcttaacgctaaactttcagga

SEQ ID NO: 82207 - DNA, 25 bp, S. pombe
cagattcgccaatggactggtcaaa

SEQ ID NO: 82208 - DNA, 25 bp, S. pombe
cagggaggctcttcagtctaagact

SEQ ID NO: 82209 - DNA, 25 bp, S. pombe
caggagggtgtcgatcttagtacta

SEQ ID NO: 82210 - DNA, 25 bp, S. pombe
cagggatccttgtccttatgtgatt

SEQ ID NO: 82211 - DNA, 25 bp, S. pombe
gaatgcttaagtatcggaaacctcg

SEQ ID NO: 82212 - DNA, 25 bp, S. pombe
cgaaaatcccaacctgcattacgtt

SEQ ID NO: 82213 - DNA, 25 bp, S. pombe
cagccaactcccatttatcaaggtg

SEQ ID NO: 82214 - DNA, 25 bp, S. pombe
cataccttggaatacttcatctcga

SEQ ID NO: 82215 - DNA, 25 bp, S. pombe
caggtccttctttcaattatgccgt

SEQ ID NO: 82216 - DNA, 25 bp, S. pombe
cagctaactttgatggcgtccacac

SEQ ID NO: 82217 - DNA, 25 bp, S. pombe
catggttcctgtacttgctaaagcc

SEQ ID NO: 82218 - DNA, 25 bp, S. pombe
cagattgcgcagttagccttaaagc

SEQ ID NO: 82219 - DNA, 25 bp, S. pombe
cagagtcgcaggtagcagccttgaa

SEQ ID NO: 82220 - DNA, 25 bp, S. pombe
cagctcttcaagttgcgacatctaa

SEQ ID NO: 82221 - DNA, 25 bp, S. pombe
cagctctgtctagtcgatctcaaag

SEQ ID NO: 82222 - DNA, 25 bp, S. pombe
catacgagagtcatggtttcaccat

SEQ ID NO: 82223 - DNA, 25 bp, S. pombe
cagtccatttgatccattgtgccaa

SEQ ID NO: 82224 - DNA, 25 bp, S. pombe
cagcattaattgttggcagcccgta

SEQ ID NO: 82225 - DNA, 25 bp, S. pombe
cagcttctaatgatgtgcggcctta

SEQ ID NO: 82226 - DNA, 25 bp, S. pombe
cacctaaatatgttcctgcgcttgg

SEQ ID NO: 82227 - DNA, 25 bp, S. pombe
catgcctaaaattggacccggctag

SEQ ID NO: 82228 - DNA, 25 bp, S. pombe
cagccttaaaagtactcctctcagt

SEQ ID NO: 82229 - DNA, 25 bp, S. pombe
caccttgtaatttcctcctttgata

SEQ ID NO: 82230 - DNA, 25 bp, S. pombe
caccttttatacatcctgctgcaat

SEQ ID NO: 82231 - DNA, 25 bp, S. pombe
caccttttggtctttctgctgaata

SEQ ID NO: 82232 - DNA, 25 bp, S. pombe
cagcacgtgaatgaagacgccacta

SEQ ID NO: 82233 - DNA, 25 bp, S. pombe
cagattgggacttacacggcacata

SEQ ID NO: 82234 - DNA, 25 bp, S. pombe
cagcttcatgcggtttgacttcaga

SEQ ID NO: 82235 - DNA, 25 bp, S. pombe
cagccgatgcacactttgaggactc

SEQ ID NO: 82236 - DNA, 25 bp, S. pombe
cagccctgataccttatggtgctat

SEQ ID NO: 82237 - DNA, 25 bp, S. pombe
cagatagcgcataccttcgtgatat

SEQ ID NO: 82238 - DNA, 25 bp, S. pombe
cagacacgctgtccgatttgttaaa

SEQ ID NO: 82239 - DNA, 25 bp, S. pombe
caggaatgccctgaccttattatgt

SEQ ID NO: 82240 - DNA, 25 bp, S. pombe
caggacttctcaccaatgccagaga

SEQ ID NO: 82241 - DNA, 25 bp, S. pombe
cagtattagatatcgctttccatga

SEQ ID NO: 82242 - DNA, 25 bp, S. pombe
cagctattggtatggctcttggata

SEQ ID NO: 82243 - DNA, 25 bp, S. pombe
cagctcttccgatgactttgatgat

SEQ ID NO: 82244 - DNA, 25 bp, S. pombe
cagcgctatagccaagtttttcacc

SEQ ID NO: 82245 - DNA, 25 bp, S. pombe
cagctgtaccgatgttaagtcctaa

SEQ ID NO: 82246 - DNA, 25 bp, S. pombe
caggtaccgtttgcaggtgcggcaa

SEQ ID NO: 82247 - DNA, 25 bp, S. pombe
cagtttctcgttttcgcgaagtaat

SEQ ID NO: 82248 - DNA, 25 bp, S. pombe
gaattgtctcgtttacgtgggtact

SEQ ID NO: 82249 - DNA, 25 bp, S. pombe
caggcttgttcagaaattcgtgcta

SEQ ID NO: 82250 - DNA, 25 bp, S. pombe
cagctcttcttttgaattgccttca

SEQ ID NO: 82251 - DNA, 25 bp, S. pombe
cagcaattcttctgaatccgctttg

SEQ ID NO: 82252 - DNA, 25 bp, S. pombe
cagctcagtgagtttgtgcgccctt

SEQ ID NO: 82253 - DNA, 25 bp, S. pombe
ggacggaacgttatggctaccctgt

SEQ ID NO: 82254 - DNA, 25 bp, S. pombe
ctgaaaacacttattcctaccgctt

SEQ ID NO: 82255 - DNA, 25 bp, S. pombe
cagaaaacttcttcattcgttccct

SEQ ID NO: 82256 - DNA, 25 bp, S. pombe
cagaaacaattccttctctttggcc

SEQ ID NO: 82257 - DNA, 25 bp, S. pombe
catgaaaagtcggttcttcttcctt

SEQ ID NO: 82258 - DNA, 25 bp, S. pombe
cagaaaccgcactttcttttcttga

SEQ ID NO: 82259 - DNA, 25 bp, S. pombe
cagctaacaaacctgttccttctta

SEQ ID NO: 82260 - DNA, 25 bp, S. pombe
cagtacatacttctgttccttcgta

SEQ ID NO: 82261 - DNA, 25 bp, S. pombe
cagtacttcttcctgttttcgtaat

SEQ ID NO: 82262 - DNA, 25 bp, S. pombe
cagcgttttgcattctttgaggtta

SEQ ID NO: 82263 - DNA, 25 bp, S. pombe
cagcgctcttggctttttagatgga

SEQ ID NO: 82264 - DNA, 25 bp, S. pombe
cagccgctttgaatttaccgagaga

SEQ ID NO: 82265 - DNA, 25 bp, S. pombe
cagaggcgatatcatttaccgagaa

SEQ ID NO: 82266 - DNA, 25 bp, S. pombe
cagagggtgtttctacatccgatct

SEQ ID NO: 82267 - DNA, 25 bp, S. pombe
cagaccttgaagttttgtgtgcgtt

SEQ ID NO: 82268 - DNA, 25 bp, S. pombe
catgattgttcgtaggcggtttccg

SEQ ID NO: 82269 - DNA, 25 bp, S. pombe
cagacggtgctaacgattccaataa

SEQ ID NO: 82270 - DNA, 25 bp, S. pombe
catgacggttttgatatcccctttt

SEQ ID NO: 82271 - DNA, 25 bp, S. pombe
cagttggttgacttgttccatgctc

SEQ ID NO: 82272 - DNA, 25 bp, S. pombe
cagttggtgctatctttggcggtgc

SEQ ID NO: 82273 - DNA, 25 bp, S. pombe
cagcgctagcgctaaattattacta

SEQ ID NO: 82274 - DNA, 25 bp, S. pombe
cagccgcacgagcaatttatagtac

SEQ ID NO: 82275 - DNA, 25 bp, S. pombe
cagcggccctgaaagattttatgag

SEQ ID NO: 82276 - DNA, 25 bp, S. pombe
cagcgtcctctgtcaaatttaatga

SEQ ID NO: 82277 - DNA, 25 bp, S. pombe
cagcgctactcccaatattatcaat

SEQ ID NO: 82278 - DNA, 25 bp, S. pombe
cagctcgcacacagtatccagaaag

SEQ ID NO: 82279 - DNA, 25 bp, S. pombe
cagcccagtgctttctacataaatt

SEQ ID NO: 82280 - DNA, 25 bp, S. pombe
cagtgtgccgatttaatcagggctt

SEQ ID NO: 82281 - DNA, 25 bp, S. pombe
cagcgtgcctgaattacttgacctt

SEQ ID NO: 82282 - DNA, 25 bp, S. pombe
catgcgaccgacaccttggaaaata

SEQ ID NO: 82283 - DNA, 25 bp, S. pombe
cagtccatactttctgtgctgaact

SEQ ID NO: 82284 - DNA, 25 bp, S. pombe
cagacttgttgtgtgtccatgccaa

SEQ ID NO: 82285 - DNA, 25 bp, S. pombe
cagttctgttgattcttcaccacaa

SEQ ID NO: 82286 - DNA, 25 bp, S. pombe
cagatgtttcgttctttccaactga

SEQ ID NO: 82287 - DNA, 25 bp, S. pombe
cagctttctcaggtttggccttaat

SEQ ID NO: 82288 - DNA, 25 bp, S. pombe
cagcttgtatttttgttgccggaat

SEQ ID NO: 82289 - DNA, 25 bp, S. pombe
gctgctttgaggcaagttcccgaag

SEQ ID NO: 82290 - DNA, 25 bp, S. pombe
cagctattaggcttggttctcccaa

SEQ ID NO: 82291 - DNA, 25 bp, S. pombe
cattcgtactcgttatgtgctagtt

SEQ ID NO: 82292 - DNA, 25 bp, S. pombe
catcggctagtaagttggctgcaaa

SEQ ID NO: 82293 - DNA, 25 bp, S. pombe
catcgggaggtggtgtccttacttc

SEQ ID NO: 82294 - DNA, 25 bp, S. pombe
caggccgagaacgtattttatctta

SEQ ID NO: 82295 - DNA, 25 bp, S. pombe
caggtgtgatcattgtcgtatccaa

SEQ ID NO: 82296 - DNA, 25 bp, S. pombe
caggctgtggcttattttacatcga

SEQ ID NO: 82297 - DNA, 25 bp, S. pombe
cagcggtattgttagcagttgccaa

SEQ ID NO: 82298 - DNA, 25 bp, S. pombe
cagcgtctttttgatgttcattcta

SEQ ID NO: 82299 - DNA, 25 bp, S. pombe
cagcaggtgctgttttagtctatga

SEQ ID NO: 82300 - DNA, 25 bp, S. pombe
cagctggccatggtcgtattggtaa

SEQ ID NO: 82301 - DNA, 25 bp, S. pombe
catgacaggtgcacttattctctat

SEQ ID NO: 82302 - DNA, 25 bp, S. pombe
cagtcattgtctgatccctttaatc

SEQ ID NO: 82303 - DNA, 25 bp, S. pombe
cagctcacattttttgcgttggaat

SEQ ID NO: 82304 - DNA, 25 bp, S. pombe
cagcaactctctttatggacttaat

SEQ ID NO: 82305 - DNA, 25 bp, S. pombe
cagctttgcaggctcttgggtgaaa

SEQ ID NO: 82306 - DNA, 25 bp, S. pombe
cagacttgcaacaacttgcggtaaa

SEQ ID NO: 82307 - DNA, 25 bp, S. pombe
cagacactatactgcttgttccaaa

SEQ ID NO: 82308 - DNA, 25 bp, S. pombe
caggtgaatgggtttcttcttgaca

SEQ ID NO: 82309 - DNA, 25 bp, S. pombe
caggatcaagcggaattcaactatt

SEQ ID NO: 82310 - DNA, 25 bp, S. pombe
catgaggaagcaaagaccaacgtta

SEQ ID NO: 82311 - DNA, 25 bp, S. pombe
cagaagagtttgcagcttacgggct

SEQ ID NO: 82312 - DNA, 25 bp, S. pombe
cagataaccttgctgttagcgcgca

SEQ ID NO: 82313 - DNA, 25 bp, S. pombe
cagacattatttcagactcccggtt

SEQ ID NO: 82314 - DNA, 25 bp, S. pombe
caggaaagtttgacgctgctcacgt

SEQ ID NO: 82315 - DNA, 25 bp, S. pombe
cagctgccaagtagtgtcaaccacg

SEQ ID NO: 82316 - DNA, 25 bp, S. pombe
cagcacccgttgatgttcatgattc

SEQ ID NO: 82317 - DNA, 25 bp, S. pombe
cataccatccagttggtccgaagaa

SEQ ID NO: 82318 - DNA, 25 bp, S. pombe
catcacccagacacgatttgctaag

SEQ ID NO: 82319 - DNA, 25 bp, S. pombe
ctccggaacccgatgctgatgaaag

SEQ ID NO: 82320 - DNA, 25 bp, S. pombe
cagaggtcccaagtgctaagcaaaa

SEQ ID NO: 82321 - DNA, 25 bp, S. pombe
cagggatcctttaaatgctattcag

SEQ ID NO: 82322 - DNA, 25 bp, S. pombe
caggagttcccttagagggttctca

SEQ ID NO: 82323 - DNA, 25 bp, S. pombe
cagggaatccacataggcctttttt

SEQ ID NO: 82324 - DNA, 25 bp, S. pombe
caggcgagactgctctagggtttta

SEQ ID NO: 82325 - DNA, 25 bp, S. pombe
cagcaatcttagttctccgtcaata

SEQ ID NO: 82326 - DNA, 25 bp, S. pombe
cagcatgcttttcatcgcagttgta

SEQ ID NO: 82327 - DNA, 25 bp, S. pombe
cagcttatttggtctcgtctgcaag

SEQ ID NO: 82328 - DNA, 25 bp, S. pombe
cagcttattcgcctaatggatcggt

SEQ ID NO: 82329 - DNA, 25 bp, S. pombe
cagcatattctttcgcaaccaattc

SEQ ID NO: 82330 - DNA, 25 bp, S. pombe
cagaggcttctgctccaaagattaa

SEQ ID NO: 82331 - DNA, 25 bp, S. pombe
caggcctcttgctgctaacatttag

SEQ ID NO: 82332 - DNA, 25 bp, S. pombe
cagggtctggctgcatatcaagctt

SEQ ID NO: 82333 - DNA, 25 bp, S. pombe
cagactgtcggtgatcattggtgat

SEQ ID NO: 82334 - DNA, 25 bp, S. pombe
cagagctggctgcatttcgtttatt

SEQ ID NO: 82335 - DNA, 25 bp, S. pombe
cagcagctgattgagttctttgaga

SEQ ID NO: 82336 - DNA, 25 bp, S. pombe
cagattgctgtgtcctcgtttatga

SEQ ID NO: 82337 - DNA, 25 bp, S. pombe
cgtctacgttttctgagttatttca

SEQ ID NO: 82338 - DNA, 25 bp, S. pombe
catttcccttttcttctacatattt

SEQ ID NO: 82339 - DNA, 25 bp, S. pombe
cggtacttcgttctttatcattatg

SEQ ID NO: 82340 - DNA, 25 bp, S. pombe
cagagttcctatttaattctcaaat

SEQ ID NO: 82341 - DNA, 25 bp, S. pombe
cagtggattgccatctagtttaata

SEQ ID NO: 82342 - DNA, 25 bp, S. pombe
cagataaacctcttagcttgcttaa

SEQ ID NO: 82343 - DNA, 25 bp, S. pombe
cagatggagttcttcgtgtttacga

SEQ ID NO: 82344 - DNA, 25 bp, S. pombe
cagaggagttagtcgatggtgtaaa

SEQ ID NO: 82345 - DNA, 25 bp, S. pombe
cagagcgtttggactgggtgtcaaa

SEQ ID NO: 82346 - DNA, 25 bp, S. pombe
cagactggttgcgtgctggtatcat

SEQ ID NO: 82347 - DNA, 25 bp, S. pombe
cagacgctggtatggatgtttccaa

SEQ ID NO: 82348 - DNA, 25 bp, S. pombe
cagacgctgatattagggctattcc

SEQ ID NO: 82349 - DNA, 25 bp, S. pombe
cagcaatcgtagtcgggctcatgat

SEQ ID NO: 82350 - DNA, 25 bp, S. pombe
cagatggacgtcttatgggctcctt

SEQ ID NO: 82351 - DNA, 25 bp, S. pombe
catgccaaaacaccactgactttat

SEQ ID NO: 82352 - DNA, 25 bp, S. pombe
cagtagccttcatgagtggtcttaa

SEQ ID NO: 82353 - DNA, 25 bp, S. pombe
cagcagactcttgcgaacagttcgg

SEQ ID NO: 82354 - DNA, 25 bp, S. pombe
cagcaatctcttcctcagacaaatg

SEQ ID NO: 82355 - DNA, 25 bp, S. pombe
cagatagttctttgcctggcgatag

SEQ ID NO: 82356 - DNA, 25 bp, S. pombe
cagggagtcaattcatcagtgccga

SEQ ID NO: 82357 - DNA, 25 bp, S. pombe
cagggattcacattggcagctcttg

SEQ ID NO: 82358 - DNA, 25 bp, S. pombe
caggctattctattcgagatattga

SEQ ID NO: 82359 - DNA, 25 bp, S. pombe
cagatgcattgcttcccatggagta

SEQ ID NO: 82360 - DNA, 25 bp, S. pombe
cagtcagttgtttgtgccagtcaga

SEQ ID NO: 82361 - DNA, 25 bp, S. pombe
cagtcaatatgcgtggtcctaggaa

SEQ ID NO: 82362 - DNA, 25 bp, S. pombe
cagaattcagaacgctcgcattgga

SEQ ID NO: 82363 - DNA, 25 bp, S. pombe
cagttcaagctgtttctcgtgctaa

SEQ ID NO: 82364 - DNA, 25 bp, S. pombe
catggaaggtcctttgctcatgcag

SEQ ID NO: 82365 - DNA, 25 bp, S. pombe
cagagagcttctgcttatgagcccc

SEQ ID NO: 82366 - DNA, 25 bp, S. pombe
catggcagcttcgtttaactactcg

SEQ ID NO: 82367 - DNA, 25 bp, S. pombe
caggcctatgcctcatattctttaa

SEQ ID NO: 82368 - DNA, 25 bp, S. pombe
cagactcttgccaattttgcttata

SEQ ID NO: 82369 - DNA, 25 bp, S. pombe
cagatgttgcgaacgatgtgtttaa

SEQ ID NO: 82370 - DNA, 25 bp, S. pombe
cagagtacgctcttgatggaaataa

SEQ ID NO: 82371 - DNA, 25 bp, S. pombe
caggagcgattagctctacctaata

SEQ ID NO: 82372 - DNA, 25 bp, S. pombe
gatggttttaatcggtcgtccctat

SEQ ID NO: 82373 - DNA, 25 bp, S. pombe
cagagctctctgatatcgatttgac

SEQ ID NO: 82374 - DNA, 25 bp, S. pombe
cagagtttgacgtccatgatgtatt

SEQ ID NO: 82375 - DNA, 25 bp, S. pombe
caggcgattgacgatccgaatgtat

SEQ ID NO: 82376 - DNA, 25 bp, S. pombe
catggacccgtatttaccgtattca

SEQ ID NO: 82377 - DNA, 25 bp, S. pombe
ctccgaaaccggttgttgcgaacat

SEQ ID NO: 82378 - DNA, 25 bp, S. pombe
gttactgaaacccttaagggcgatg

SEQ ID NO: 82379 - DNA, 25 bp, S. pombe
cgtagtactccctctggtatggaaa

SEQ ID NO: 82380 - DNA, 25 bp, S. pombe
catgagaagtttttgtgccacggaa

SEQ ID NO: 82381 - DNA, 25 bp, S. pombe
catgacttggataatccttaagtag

SEQ ID NO: 82382 - DNA, 25 bp, S. pombe
cagttcagcctgacgcggacgaaga

SEQ ID NO: 82383 - DNA, 25 bp, S. pombe
cattctataccaccgaggagcaaat

SEQ ID NO: 82384 - DNA, 25 bp, S. pombe
cagtcgtatttttgccttggctatg

SEQ ID NO: 82385 - DNA, 25 bp, S. pombe
cagttctccttattcatttgcctat

SEQ ID NO: 82386 - DNA, 25 bp, S. pombe
caggttatggtgtcgattcctccca

SEQ ID NO: 82387 - DNA, 25 bp, S. pombe
catgttttttcttttagctcaccgg

SEQ ID NO: 82388 - DNA, 25 bp, S. pombe
cagagcttcattacctggacttaat

SEQ ID NO: 82389 - DNA, 25 bp, S. pombe
catggcttgtgttactggagtttac

SEQ ID NO: 82390 - DNA, 25 bp, S. pombe
cagttttcaactagcatggttccaa

SEQ ID NO: 82391 - DNA, 25 bp, S. pombe
cagtttatgcaaccggttcctcaaa

SEQ ID NO: 82392 - DNA, 25 bp, S. pombe
cagtcctagaagtcttttgttccaa

SEQ ID NO: 82393 - DNA, 25 bp, S. pombe
cagatcttgaaaggccttcgacacc

SEQ ID NO: 82394 - DNA, 25 bp, S. pombe
gcggttcagactctcctaaggaagt

SEQ ID NO: 82395 - DNA, 25 bp, S. pombe
caggattcatcagttgtgtgggaca

SEQ ID NO: 82396 - DNA, 25 bp, S. pombe
cggtttatcgttggaggccctgaag

SEQ ID NO: 82397 - DNA, 25 bp, S. pombe
cggtataacgtttagtcctgctgag

SEQ ID NO: 82398 - DNA, 25 bp, S. pombe
cagttgtcaagcgttttgtttctga

SEQ ID NO: 82399 - DNA, 25 bp, S. pombe
cagtttgaatgacccctttgttaca

SEQ ID NO: 82400 - DNA, 25 bp, S. pombe
cagattattgatcgcaccctttgtg

SEQ ID NO: 82401 - DNA, 25 bp, S. pombe
cagtgatatacaagccccttttgga

SEQ ID NO: 82402 - DNA, 25 bp, S. pombe
catgaataacaagcggcatttccgg

SEQ ID NO: 82403 - DNA, 25 bp, S. pombe
cagggacacccagcaatcttgaaaa

SEQ ID NO: 82404 - DNA, 25 bp, S. pombe
catggttaaacacttatcctttggt

SEQ ID NO: 82405 - DNA, 25 bp, S. pombe
cagttacaagaagctaccgcctttc

SEQ ID NO: 82406 - DNA, 25 bp, S. pombe
cattaacaagaaaccacttcctact

SEQ ID NO: 82407 - DNA, 25 bp, S. pombe
catggctgccagtgataacgttatc

SEQ ID NO: 82408 - DNA, 25 bp, S. pombe
catggtccagatcagcaagagttgt

SEQ ID NO: 82409 - DNA, 25 bp, S. pombe
catggatccttctatgcgtggtagt

SEQ ID NO: 82410 - DNA, 25 bp, S. pombe
cagtatagttatagcagcggtcgta

SEQ ID NO: 82411 - DNA, 25 bp, S. pombe
caggatgtgcttttatgttgtcgaa

SEQ ID NO: 82412 - DNA, 25 bp, S. pombe
cagatgatgatcctttgctttataa

SEQ ID NO: 82413 - DNA, 25 bp, S. pombe
cagaggcacctgatcttctagaaga

SEQ ID NO: 82414 - DNA, 25 bp, S. pombe
catcacgctcgtttcttcattaaga

SEQ ID NO: 82415 - DNA, 25 bp, S. pombe
catttccttccctggctaagttgaa

SEQ ID NO: 82416 - DNA, 25 bp, S. pombe
cagatttcctcctcgtgtagtttag

SEQ ID NO: 82417 - DNA, 25 bp, S. pombe
cagatgaaattccaccgggctggtt

SEQ ID NO: 82418 - DNA, 25 bp, S. pombe
cgggcgtattgctgtctgggacaat

SEQ ID NO: 82419 - DNA, 25 bp, S. pombe
catgggttctacaacggacaatatt

SEQ ID NO: 82420 - DNA, 25 bp, S. pombe
caggttttgttgtcaagcgcttttt

SEQ ID NO: 82421 - DNA, 25 bp, S. pombe
catggacaattgtttaatcggcttt

SEQ ID NO: 82422 - DNA, 25 bp, S. pombe
cttagagacttaccgggctgcttgc

SEQ ID NO: 82423 - DNA, 25 bp, S. pombe
catccacgctttcttttctaaacgg

SEQ ID NO: 82424 - DNA, 25 bp, S. pombe
catcctcctctttactttacaattg

SEQ ID NO: 82425 - DNA, 25 bp, S. pombe
cagatgccctttaactttacaacca

SEQ ID NO: 82426 - DNA, 25 bp, S. pombe
cagatgcctgttgatagcttcctaa

SEQ ID NO: 82427 - DNA, 25 bp, S. pombe
cagatgctcttgtacgtcttcgtaa

SEQ ID NO: 82428 - DNA, 25 bp, S. pombe
cagttgatactgcttatgtcggaaa

SEQ ID NO: 82429 - DNA, 25 bp, S. pombe
cagttgctactgctatgttgatgga

SEQ ID NO: 82430 - DNA, 25 bp, S. pombe
cagtgcctacatccttctttataag

SEQ ID NO: 82431 - DNA, 25 bp, S. pombe
caggcaccctccttctttaaatata

SEQ ID NO: 82432 - DNA, 25 bp, S. pombe
caggacacgcctctatttaatgata

SEQ ID NO: 82433 - DNA, 25 bp, S. pombe
caggtcgtactgttattcccagatc

SEQ ID NO: 82434 - DNA, 25 bp, S. pombe
caggtctacctctttcagtgatgta

SEQ ID NO: 82435 - DNA, 25 bp, S. pombe
cagtgtttccactacatcgactaaa

SEQ ID NO: 82436 - DNA, 25 bp, S. pombe
cagtatgcgtttgatctcctagatt

SEQ ID NO: 82437 - DNA, 25 bp, S. pombe
cagtctgtaaatgcatgtccggttt

SEQ ID NO: 82438 - DNA, 25 bp, S. pombe
tactttaatgcacatggcctgggcc

SEQ ID NO: 82439 - DNA, 25 bp, S. pombe
catctgttaatgctgtctcctgggc

SEQ ID NO: 82440 - DNA, 25 bp, S. pombe
cagtgttacgctttctaccggcgaa

SEQ ID NO: 82441 - DNA, 25 bp, S. pombe
cagtttatcgcctgttccagaagaa

SEQ ID NO: 82442 - DNA, 25 bp, S. pombe
cttcgtctaccagttttgctagcga

SEQ ID NO: 82443 - DNA, 25 bp, S. pombe
caggtgttactactattggctcggt

SEQ ID NO: 82444 - DNA, 25 bp, S. pombe
cagtctttacttcgatatggcttat

SEQ ID NO: 82445 - DNA, 25 bp, S. pombe
caggctgacttgttagatactcttg

SEQ ID NO: 82446 - DNA, 25 bp, S. pombe
cagtggatcttttcgtactcatgac

SEQ ID NO: 82447 - DNA, 25 bp, S. pombe
cagtagatgctttgtctgctcatcc

SEQ ID NO: 82448 - DNA, 25 bp, S. pombe
cagtcagtggtttatgcattcttct

SEQ ID NO: 82449 - DNA, 25 bp, S. pombe
caggaggcatttgatcaattgatct

SEQ ID NO: 82450 - DNA, 25 bp, S. pombe
cagtggttcctggttttgtatcatc

SEQ ID NO: 82451 - DNA, 25 bp, S. pombe
cagtggttccatgtttgtgtgatca

SEQ ID NO: 82452 - DNA, 25 bp, S. pombe
cagtttcctctgttctttttcgtgt

SEQ ID NO: 82453 - DNA, 25 bp, S. pombe
cagtggtgtgctcaagtctttggcc

SEQ ID NO: 82454 - DNA, 25 bp, S. pombe
cagtcaattacttcgcgattccaaa

SEQ ID NO: 82455 - DNA, 25 bp, S. pombe
cagtcgattatctcctgtagcgaat

SEQ ID NO: 82456 - DNA, 25 bp, S. pombe
cagtctcgtttgttgctttgatgat

SEQ ID NO: 82457 - DNA, 25 bp, S. pombe
cagttgcgatgtgttggagctttca

SEQ ID NO: 82458 - DNA, 25 bp, S. pombe
cagggtgttgcggtggacattccaa

SEQ ID NO: 82459 - DNA, 25 bp, S. pombe
cagtgccggtgctgtgggattccaa

SEQ ID NO: 82460 - DNA, 25 bp, S. pombe
cagtgcttcggtttgggatctggca

SEQ ID NO: 82461 - DNA, 25 bp, S. pombe
catacgtgcccttggtaagtcgttt

SEQ ID NO: 82462 - DNA, 25 bp, S. pombe
catccgtcgttttggtattcgtcgt

SEQ ID NO: 82463 - DNA, 25 bp, S. pombe
catcccttgtttcgacgattcacaa

SEQ ID NO: 82464 - DNA, 25 bp, S. pombe
catattggtggaacggacccgtcgt

SEQ ID NO: 82465 - DNA, 25 bp, S. pombe
catttgtttgatgcgttcacggctc

SEQ ID NO: 82466 - DNA, 25 bp, S. pombe
cagttattttactctcttgtgcata

SEQ ID NO: 82467 - DNA, 25 bp, S. pombe
cagtggctggttgcattctttatta

SEQ ID NO: 82468 - DNA, 25 bp, S. pombe
caggtgctggtacctcttttgttaa

SEQ ID NO: 82469 - DNA, 25 bp, S. pombe
cagtttggcggacttttcttgtgaa

SEQ ID NO: 82470 - DNA, 25 bp, S. pombe
caggatgctggtgctgatcttgatg

SEQ ID NO: 82471 - DNA, 25 bp, S. pombe
caggcaacatccattctcatcagat

SEQ ID NO: 82472 - DNA, 25 bp, S. pombe
cagtccttgccgttgacaatatgac

SEQ ID NO: 82473 - DNA, 25 bp, S. pombe
catggacctcggatcgttgggttaa

SEQ ID NO: 82474 - DNA, 25 bp, S. pombe
caggtcgcttggatcgcttgcttta

SEQ ID NO: 82475 - DNA, 25 bp, S. pombe
cattcacaacttctgggtcacttgt

SEQ ID NO: 82476 - DNA, 25 bp, S. pombe
catcaacaatttctggctccattac

SEQ ID NO: 82477 - DNA, 25 bp, S. pombe
catcctctccttaattgacactgaa

SEQ ID NO: 82478 - DNA, 25 bp, S. pombe
catgccggccttacttgaacaaagt

SEQ ID NO: 82479 - DNA, 25 bp, S. pombe
cagtcgcggctgatttgaatagaaa

SEQ ID NO: 82480 - DNA, 25 bp, S. pombe
cagtctctgcggctatggatgctaa

SEQ ID NO: 82481 - DNA, 25 bp, S. pombe
cagtcttgcacctttgcatgaggaa

SEQ ID NO: 82482 - DNA, 25 bp, S. pombe
cagtgcttccgaaagttgctgtcga

SEQ ID NO: 82483 - DNA, 25 bp, S. pombe
caggttgatgcattccttgtttcct

SEQ ID NO: 82484 - DNA, 25 bp, S. pombe
cagtgggaagtccttgtttctcaag

SEQ ID NO: 82485 - DNA, 25 bp, S. pombe
cttgggaccgactgttcctattata

SEQ ID NO: 82486 - DNA, 25 bp, S. pombe
cttggaagccgacacctggtttgat

SEQ ID NO: 82487 - DNA, 25 bp, S. pombe
catcggcaatgcttactacagtgga

SEQ ID NO: 82488 - DNA, 25 bp, S. pombe
catgggcgacttgtatctgttgcac

SEQ ID NO: 82489 - DNA, 25 bp, S. pombe
catgacttctcagtctgctcaaagt

SEQ ID NO: 82490 - DNA, 25 bp, S. pombe
catgttctgccgatgctacagtgaa

SEQ ID NO: 82491 - DNA, 25 bp, S. pombe
cagtcaccatcgaatctcatcttaa

SEQ ID NO: 82492 - DNA, 25 bp, S. pombe
cagtgcaatctatttcttcttcttt

SEQ ID NO: 82493 - DNA, 25 bp, S. pombe
catcgaactctcgtgattcctttat

SEQ ID NO: 82494 - DNA, 25 bp, S. pombe
cagggtctatattcttccgatcaaa

SEQ ID NO: 82495 - DNA, 25 bp, S. pombe
cagtcgttcatcatgatccttctta

SEQ ID NO: 82496 - DNA, 25 bp, S. pombe
caggccaaaagttctccacgtaaat

SEQ ID NO: 82497 - DNA, 25 bp, S. pombe
cagtggaccctattcccaagaagaa

SEQ ID NO: 82498 - DNA, 25 bp, S. pombe
cagtggacctatttccgccaaagaa

SEQ ID NO: 82499 - DNA, 25 bp, S. pombe
catggaactggtcgcatccccaaaa

SEQ ID NO: 82500 - DNA, 25 bp, S. pombe
caggaactgctttgcttggaaccaa

SEQ ID NO: 82501 - DNA, 25 bp, S. pombe
caggagacatttcccgtggactcaa

SEQ ID NO: 82502 - DNA, 25 bp, S. pombe
caggatccaattcttctggcagtaa

SEQ ID NO: 82503 - DNA, 25 bp, S. pombe
caggtattaaatcttgtcgccgcat

SEQ ID NO: 82504 - DNA, 25 bp, S. pombe
caggtttaactgactctacccgtat

SEQ ID NO: 82505 - DNA, 25 bp, S. pombe
catggagtttttgtctaccgagaat

SEQ ID NO: 82506 - DNA, 25 bp, S. pombe
cagggctatttgtcttattcggaac

SEQ ID NO: 82507 - DNA, 25 bp, S. pombe
cagggcaagtttggcgcagacgcaa

SEQ ID NO: 82508 - DNA, 25 bp, S. pombe
caggctcaggaattggctgcccaaa

SEQ ID NO: 82509 - DNA, 25 bp, S. pombe
catgactatggctacgagtgggatt

SEQ ID NO: 82510 - DNA, 25 bp, S. pombe
catccatatgcgcagagagtctttt

SEQ ID NO: 82511 - DNA, 25 bp, S. pombe
catcatgagaagtactggccccagt

SEQ ID NO: 82512 - DNA, 25 bp, S. pombe
gctaggtacagcatggccagccatt

SEQ ID NO: 82513 - DNA, 25 bp, S. pombe
ctatcgctatcaagtgactgctgga

SEQ ID NO: 82514 - DNA, 25 bp, S. pombe
cagggagcccgattacaagcattaa

SEQ ID NO: 82515 - DNA, 25 bp, S. pombe
caggccagcctgcatatatgaactt

SEQ ID NO: 82516 - DNA, 25 bp, S. pombe
cagtcctcctgcatatgagcaagtt

SEQ ID NO: 82517 - DNA, 25 bp, S. pombe
caggatggctgcttttgacaaatat

SEQ ID NO: 82518 - DNA, 25 bp, S. pombe
catccaggattttgcaacagaatac

SEQ ID NO: 82519 - DNA, 25 bp, S. pombe
catccagtctggtatgcgtcatatt

SEQ ID NO: 82520 - DNA, 25 bp, S. pombe
cagtgttattcctgatgttatagac

SEQ ID NO: 82521 - DNA, 25 bp, S. pombe
cagtgctctttctttctggtgaaaa

SEQ ID NO: 82522 - DNA, 25 bp, S. pombe
catgatagttgttatcctgatggta

SEQ ID NO: 82523 - DNA, 25 bp, S. pombe
cagtggattctctttctgtgagtaa

SEQ ID NO: 82524 - DNA, 25 bp, S. pombe
caggacttttcactattgttgctat

SEQ ID NO: 82525 - DNA, 25 bp, S. pombe
cagggttctatccatctttctgata

SEQ ID NO: 82526 - DNA, 25 bp, S. pombe
cagtggtgtcagttgcagctcttgt

SEQ ID NO: 82527 - DNA, 25 bp, S. pombe
catgcctattgcctccaagtataaa

SEQ ID NO: 82528 - DNA, 25 bp, S. pombe
catgcttcaaggtcgtatgtcaaga

SEQ ID NO: 82529 - DNA, 25 bp, S. pombe
catgcatgaattccgtgctcaagaa

SEQ ID NO: 82530 - DNA, 25 bp, S. pombe
catctgcaagtgtcgctgctggaaa

SEQ ID NO: 82531 - DNA, 25 bp, S. pombe
catccagacctgtttctcgaatgag

SEQ ID NO: 82532 - DNA, 25 bp, S. pombe
catgagctgaactatttccgtgtat

SEQ ID NO: 82533 - DNA, 25 bp, S. pombe
catggtgatgcagagttcctttata

SEQ ID NO: 82534 - DNA, 25 bp, S. pombe
caggtaattcaccatcatttgcaga

SEQ ID NO: 82535 - DNA, 25 bp, S. pombe
catgcgtcttcgtatggttcaaaaa

SEQ ID NO: 82536 - DNA, 25 bp, S. pombe
catggttgcatgtatcgaggccaaa

SEQ ID NO: 82537 - DNA, 25 bp, S. pombe
cttgtacagctcttggtccatcgga

SEQ ID NO: 82538 - DNA, 25 bp, S. pombe
cttacttcttccaacttcaaattcg

SEQ ID NO: 82539 - DNA, 25 bp, S. pombe
cttataatcttcctggttatccacc

SEQ ID NO: 82540 - DNA, 25 bp, S. pombe
caggacagatttcgtggtttcactt

SEQ ID NO: 82541 - DNA, 25 bp, S. pombe
catggcactatttcgggttgactat

SEQ ID NO: 82542 - DNA, 25 bp, S. pombe
catccctggtctgtaattcctgaag

SEQ ID NO: 82543 - DNA, 25 bp, S. pombe
catccttacttgtttggtcgcgaag

SEQ ID NO: 82544 - DNA, 25 bp, S. pombe
catccttcttgggtagttcctaagg

SEQ ID NO: 82545 - DNA, 25 bp, S. pombe
catgcactatttcggctgttttact

SEQ ID NO: 82546 - DNA, 25 bp, S. pombe
catacttaatgttctgctgtttctt

SEQ ID NO: 82547 - DNA, 25 bp, S. pombe
cattattcaaatgcgccgtttcctt

SEQ ID NO: 82548 - DNA, 25 bp, S. pombe
cataattcggatgccacttcttcag

SEQ ID NO: 82549 - DNA, 25 bp, S. pombe
catacaatttgtcggctatacgtca

SEQ ID NO: 82550 - DNA, 25 bp, S. pombe
catcgcagtattcccaggttttgat

SEQ ID NO: 82551 - DNA, 25 bp, S. pombe
catgccgcccacgaatggagtgata

SEQ ID NO: 82552 - DNA, 25 bp, S. pombe
catcggtgcctccattgagagtgat

SEQ ID NO: 82553 - DNA, 25 bp, S. pombe
catcatcccaaaaatcaaccttctt

SEQ ID NO: 82554 - DNA, 25 bp, S. pombe
cttcactaactatacacctggcttt

SEQ ID NO: 82555 - DNA, 25 bp, S. pombe
cttcctatttttaagcgccagcttg

SEQ ID NO: 82556 - DNA, 25 bp, S. pombe
cattcgtgatttggccgagcgtggt

SEQ ID NO: 82557 - DNA, 25 bp, S. pombe
ctttgtattttgtcggaatccagcg

SEQ ID NO: 82558 - DNA, 25 bp, S. pombe
catgtggttttagtcgtaagctcgt

SEQ ID NO: 82559 - DNA, 25 bp, S. pombe
catcaatgcattccttctcgtgaaa

SEQ ID NO: 82560 - DNA, 25 bp, S. pombe
catcaagttccatcgcttgcaagac

SEQ ID NO: 82561 - DNA, 25 bp, S. pombe
catggttggcattcttcctcaaaga

SEQ ID NO: 82562 - DNA, 25 bp, S. pombe
catccttatgcaacgcctcatcaag

SEQ ID NO: 82563 - DNA, 25 bp, S. pombe
catgctctattgaatctcccatttc

SEQ ID NO: 82564 - DNA, 25 bp, S. pombe
catcgcctggcaatcatgacgagtt

SEQ ID NO: 82565 - DNA, 25 bp, S. pombe
catccaaacgattgagcgcttccaa

SEQ ID NO: 82566 - DNA, 25 bp, S. pombe
catgttagaggcagagcgttcgcaa

SEQ ID NO: 82567 - DNA, 25 bp, S. pombe
catgttatcgtgtggcataccgcaa

SEQ ID NO: 82568 - DNA, 25 bp, S. pombe
catcgagaacttgcttcagggcttt

SEQ ID NO: 82569 - DNA, 25 bp, S. pombe
catgtgtccctttcttaggtgttta

SEQ ID NO: 82570 - DNA, 25 bp, S. pombe
caggctatcgttctttgtctttatg

SEQ ID NO: 82571 - DNA, 25 bp, S. pombe
caggctatggttcggcttctcataa

SEQ ID NO: 82572 - DNA, 25 bp, S. pombe
catgcatgttggttcggttctacga

SEQ ID NO: 82573 - DNA, 25 bp, S. pombe
ctaccataccgttacagccaaatat

SEQ ID NO: 82574 - DNA, 25 bp, S. pombe
ctagaaaccgttgcagactctgagt

SEQ ID NO: 82575 - DNA, 25 bp, S. pombe
ctacaaactagcttcggatccaact

SEQ ID NO: 82576 - DNA, 25 bp, S. pombe
catccctatcggaagaatattaatt

SEQ ID NO: 82577 - DNA, 25 bp, S. pombe
cgcccagacgtcgacttagtaattc

SEQ ID NO: 82578 - DNA, 25 bp, S. pombe
cggtcaacttgggtatcgcatgttt

SEQ ID NO: 82579 - DNA, 25 bp, S. pombe
cggactttgaggctatactttctaa

SEQ ID NO: 82580 - DNA, 25 bp, S. pombe
caggagcgtcgggttcaatttgtaa

SEQ ID NO: 82581 - DNA, 25 bp, S. pombe
caggagctggccatttcttttgaaa

SEQ ID NO: 82582 - DNA, 25 bp, S. pombe
caggcattttctctttgctttcaaa

SEQ ID NO: 82583 - DNA, 25 bp, S. pombe
ctggacttggcatcgggtttttatt

SEQ ID NO: 82584 - DNA, 25 bp, S. pombe
caggtttttaccgacatatttgatt

SEQ ID NO: 82585 - DNA, 25 bp, S. pombe
caggtttactttgatccacttatta

SEQ ID NO: 82586 - DNA, 25 bp, S. pombe
caggtttatcttcttcaacttgtaa

SEQ ID NO: 82587 - DNA, 25 bp, S. pombe
caggtttcgggcttgtattatcaaa

SEQ ID NO: 82588 - DNA, 25 bp, S. pombe
catggttcaaggctgggatttcaaa

SEQ ID NO: 82589 - DNA, 25 bp, S. pombe
catggttctgatcgtttggctttaa

SEQ ID NO: 82590 - DNA, 25 bp, S. pombe
ctttgcaagtactgagacggcggct

SEQ ID NO: 82591 - DNA, 25 bp, S. pombe
gcagtaatttttctggccgattcca

SEQ ID NO: 82592 - DNA, 25 bp, S. pombe
caggatttttctgttccaattccac

SEQ ID NO: 82593 - DNA, 25 bp, S. pombe
caggaatttttggacgcgacgccca

SEQ ID NO: 82594 - DNA, 25 bp, S. pombe
gtaaaaattggctcggtcgccattc

SEQ ID NO: 82595 - DNA, 25 bp, S. pombe
ggaaaaaacgcgtgcgtcgtctcaa

SEQ ID NO: 82596 - DNA, 25 bp, S. pombe
cgtaccattaccactgcttattatc

SEQ ID NO: 82597 - DNA, 25 bp, S. pombe
catacaactttattgcccctggtaa

SEQ ID NO: 82598 - DNA, 25 bp, S. pombe
catcaaagctttttccatacaccta

SEQ ID NO: 82599 - DNA, 25 bp, S. pombe
ctacgatatttattcccgtgccaat

SEQ ID NO: 82600 - DNA, 25 bp, S. pombe
cataaataattcacggcttgccgat

SEQ ID NO: 82601 - DNA, 25 bp, S. pombe
cataatgctcggtggattggcgctc

SEQ ID NO: 82602 - DNA, 25 bp, S. pombe
catatgttgactaagtttgatagat

SEQ ID NO: 82603 - DNA, 25 bp, S. pombe
catatgttgagatggccgtacgcat

SEQ ID NO: 82604 - DNA, 25 bp, S. pombe
ctttagagaacttcacgcgggttgt

SEQ ID NO: 82605 - DNA, 25 bp, S. pombe
ctatagaagagactagccgggcttt

SEQ ID NO: 82606 - DNA, 25 bp, S. pombe
ctttgaaatcttccattcgatcctc

SEQ ID NO: 82607 - DNA, 25 bp, S. pombe
catgttctttcgtttgttagaccaa

SEQ ID NO: 82608 - DNA, 25 bp, S. pombe
catttattttttctgcgtactggca

SEQ ID NO: 82609 - DNA, 25 bp, S. pombe
catgtaacatattttcttcctttcg

SEQ ID NO: 82610 - DNA, 25 bp, S. pombe
cattaccagcatttttacttcctaa

SEQ ID NO: 82611 - DNA, 25 bp, S. pombe
catgttcagttgtttgcggactcta

SEQ ID NO: 82612 - DNA, 25 bp, S. pombe
catgttcccatgattcagtgtctta

SEQ ID NO: 82613 - DNA, 25 bp, S. pombe
catggtatccggtacaagtgcgaaa

SEQ ID NO: 82614 - DNA, 25 bp, S. pombe
cattgggctcaaattacgcgtcgca

SEQ ID NO: 82615 - DNA, 25 bp, S. pombe
cttccggcagtcaaacgcgtagttg

SEQ ID NO: 82616 - DNA, 25 bp, S. pombe
catgatcgcttttctttccgtagaa

SEQ ID NO: 82617 - DNA, 25 bp, S. pombe
caggcatggctgttgtattttgcaa

SEQ ID NO: 82618 - DNA, 25 bp, S. pombe
caggcagcctttcgttattggaata

SEQ ID NO: 82619 - DNA, 25 bp, S. pombe
caggcattccctgctgtattggaaa

SEQ ID NO: 82620 - DNA, 25 bp, S. pombe
caggctacacctgttcttgaagaag

SEQ ID NO: 82621 - DNA, 25 bp, S. pombe
catggatatcgcattcattgagtat

SEQ ID NO: 82622 - DNA, 25 bp, S. pombe
catggttgtggttctcttatttggc

SEQ ID NO: 82623 - DNA, 25 bp, S. pombe
cttatcacaagaggccgttttgcgg

SEQ ID NO: 82624 - DNA, 25 bp, S. pombe
ctagatgaagacaccttgctttggg

SEQ ID NO: 82625 - DNA, 25 bp, S. pombe
catagctacgacttgcttgctgtat

SEQ ID NO: 82626 - DNA, 25 bp, S. pombe
catagtgccaggaacgcttcgtgaa

SEQ ID NO: 82627 - DNA, 25 bp, S. pombe
catactgttggaatcgatttcgcaa

SEQ ID NO: 82628 - DNA, 25 bp, S. pombe
ctttgagtaagaccgtccgcttcaa

SEQ ID NO: 82629 - DNA, 25 bp, S. pombe
ctcttgcggagagacgtctacctaa

SEQ ID NO: 82630 - DNA, 25 bp, S. pombe
cattatgctgagtacgacaatctga

SEQ ID NO: 82631 - DNA, 25 bp, S. pombe
catgctattaatgcggaatctctac

SEQ ID NO: 82632 - DNA, 25 bp, S. pombe
catgctgttgtttcatggaaccaaa

SEQ ID NO: 82633 - DNA, 25 bp, S. pombe
caggcttatttctgggcgcatgaca

SEQ ID NO: 82634 - DNA, 25 bp, S. pombe
catcatgtcattggtacggccacat

SEQ ID NO: 82635 - DNA, 25 bp, S. pombe
catctggtatttcttttgaggtcga

SEQ ID NO: 82636 - DNA, 25 bp, S. pombe
catcaggttcctttttgttgttcca

SEQ ID NO: 82637 - DNA, 25 bp, S. pombe
catagtcttcgtttgcattgggttg

SEQ ID NO: 82638 - DNA, 25 bp, S. pombe
catttcttcgttatcgggttcttca

SEQ ID NO: 82639 - DNA, 25 bp, S. pombe
ctaagctttttgattccgttcgtca

SEQ ID NO: 82640 - DNA, 25 bp, S. pombe
catttggactttaattccagcttta

SEQ ID NO: 82641 - DNA, 25 bp, S. pombe
catgctactgtgttgctttctacaa

SEQ ID NO: 82642 - DNA, 25 bp, S. pombe
catttcgattcatttcctcatcaac

SEQ ID NO: 82643 - DNA, 25 bp, S. pombe
catccacgatatcttgtctcgatac

SEQ ID NO: 82644 - DNA, 25 bp, S. pombe
catcaccgatgcttgtgctgtcaaa

SEQ ID NO: 82645 - DNA, 25 bp, S. pombe
catcagaggctcgtatgttcaccat

SEQ ID NO: 82646 - DNA, 25 bp, S. pombe
catatggatctcacgggttgcaaaa

SEQ ID NO: 82647 - DNA, 25 bp, S. pombe
catcttcatcttcaccatatggttc

SEQ ID NO: 82648 - DNA, 25 bp, S. pombe
catgctcaacatgctttgggcggat

SEQ ID NO: 82649 - DNA, 25 bp, S. pombe
catgatgcccagtcttttgtggaga

SEQ ID NO: 82650 - DNA, 25 bp, S. pombe
catgatggctctgtttttggactta

SEQ ID NO: 82651 - DNA, 25 bp, S. pombe
catcgtgatctttcgttgaggactc

SEQ ID NO: 82652 - DNA, 25 bp, S. pombe
catgggtctcatttttgggttcggc

SEQ ID NO: 82653 - DNA, 25 bp, S. pombe
catgggttatgctcttggtatttac

SEQ ID NO: 82654 - DNA, 25 bp, S. pombe
catgggtggcaatcctagtttattt

SEQ ID NO: 82655 - DNA, 25 bp, S. pombe
ctcttcgtttacatcaaatccggcg

SEQ ID NO: 82656 - DNA, 25 bp, S. pombe
catgtgtttgtctttggattgccag

SEQ ID NO: 82657 - DNA, 25 bp, S. pombe
catagggttcagaggactcctgcta

SEQ ID NO: 82658 - DNA, 25 bp, S. pombe
catacttgtcatctatggactacga

SEQ ID NO: 82659 - DNA, 25 bp, S. pombe
catactgctgctgtcgaagatctac

SEQ ID NO: 82660 - DNA, 25 bp, S. pombe
catcgtcaagactggtactcacaaa

SEQ ID NO: 82661 - DNA, 25 bp, S. pombe
catcggtctgccctactttagaaaa

SEQ ID NO: 82662 - DNA, 25 bp, S. pombe
catgaggctgctaactactggagaa

SEQ ID NO: 82663 - DNA, 25 bp, S. pombe
catggcattggtttcttaagagact

SEQ ID NO: 82664 - DNA, 25 bp, S. pombe
catgacaatgggacctttgggacta

SEQ ID NO: 82665 - DNA, 25 bp, S. pombe
catctttgctaaggctttggagggc

SEQ ID NO: 82666 - DNA, 25 bp, S. pombe
catcttgtgttagctcttcgtggag

SEQ ID NO: 82667 - DNA, 25 bp, S. pombe
catcctttatccgtcgtctgggtaa

SEQ ID NO: 82668 - DNA, 25 bp, S. pombe
catccccaactgctaatctgtttaa

SEQ ID NO: 82669 - DNA, 25 bp, S. pombe
catccgaatcttctgaatcctctat

SEQ ID NO: 82670 - DNA, 25 bp, S. pombe
catggtggatttactccgcaatcaa

SEQ ID NO: 82671 - DNA, 25 bp, S. pombe
catagggcattgttctccagagata

SEQ ID NO: 82672 - DNA, 25 bp, S. pombe
catacggttgtttccaattatccaa

SEQ ID NO: 82673 - DNA, 25 bp, S. pombe
catatggagtccatcacccttgaag

SEQ ID NO: 82674 - DNA, 25 bp, S. pombe
catttggagcacttgattgacgatc

SEQ ID NO: 82675 - DNA, 25 bp, S. pombe
catcctttgcctcgtaatcgtgaaa

SEQ ID NO: 82676 - DNA, 25 bp, S. pombe
cattttccagctctcaatctacaaa

SEQ ID NO: 82677 - DNA, 25 bp, S. pombe
cgcctgtaccgcttactggtaagga

SEQ ID NO: 82678 - DNA, 25 bp, S. pombe
catgctttatccctccaatgtttaa

SEQ ID NO: 82679 - DNA, 25 bp, S. pombe
catccctcaaactcctggtatgaaa

SEQ ID NO: 82680 - DNA, 25 bp, S. pombe
catccctaatgattttacgcctgag

SEQ ID NO: 82681 - DNA, 25 bp, S. pombe
catgcggctgttgagttacttgctg

SEQ ID NO: 82682 - DNA, 25 bp, S. pombe
catgctgcgatgtttgacttaccca

SEQ ID NO: 82683 - DNA, 25 bp, S. pombe
cttcggattcatatggcttcacacc

SEQ ID NO: 82684 - DNA, 25 bp, S. pombe
catgtcggtgattgttctggttctc

SEQ ID NO: 82685 - DNA, 25 bp, S. pombe
cttggtcgagttcctgttttactga

SEQ ID NO: 82686 - DNA, 25 bp, S. pombe
cataaaggttgtcttttctgccgtt

SEQ ID NO: 82687 - DNA, 25 bp, S. pombe
ctatactactctgatttttcgccgt

SEQ ID NO: 82688 - DNA, 25 bp, S. pombe
cttcctccttatattattcgccgta

SEQ ID NO: 82689 - DNA, 25 bp, S. pombe
cattacccttgaggttgaatcctct

SEQ ID NO: 82690 - DNA, 25 bp, S. pombe
catttctccagtcccgtttattgat

SEQ ID NO: 82691 - DNA, 25 bp, S. pombe
cttcgaacagtgtccgatcgtttac

SEQ ID NO: 82692 - DNA, 25 bp, S. pombe
catcatgtctgctcgtggtttgtta

SEQ ID NO: 82693 - DNA, 25 bp, S. pombe
catgtccacgtgcttctaatttcaa

SEQ ID NO: 82694 - DNA, 25 bp, S. pombe
cttaccgtggtgttgagcttgagca

SEQ ID NO: 82695 - DNA, 25 bp, S. pombe
catctatttatgttgcggcagctca

SEQ ID NO: 82696 - DNA, 25 bp, S. pombe
cattgatgggactcgatgtcgcggc

SEQ ID NO: 82697 - DNA, 25 bp, S. pombe
catgcacatcccttgtttatcgaga

SEQ ID NO: 82698 - DNA, 25 bp, S. pombe
cattgctcagcggattggtacgaca

SEQ ID NO: 82699 - DNA, 25 bp, S. pombe
catctgccattgctttgtgaggaca

SEQ ID NO: 82700 - DNA, 25 bp, S. pombe
catgccgattttttgctggaaacta

SEQ ID NO: 82701 - DNA, 25 bp, S. pombe
cttccaattgcttgccaacaacgtt

SEQ ID NO: 82702 - DNA, 25 bp, S. pombe
catttgttccgttgatccgtggtat

SEQ ID NO: 82703 - DNA, 25 bp, S. pombe
catccacatcgagcctggtgttgag

SEQ ID NO: 82704 - DNA, 25 bp, S. pombe
catgcttgccgaggatgccattaaa

SEQ ID NO: 82705 - DNA, 25 bp, S. pombe
catctatgccgaggcttatgccaaa

SEQ ID NO: 82706 - DNA, 25 bp, S. pombe
catcttggatatgccatgctgcgaa

SEQ ID NO: 82707 - DNA, 25 bp, S. pombe
catctatgctgaggcctatgccaag

SEQ ID NO: 82708 - DNA, 25 bp, S. pombe
catatgcatgggtttgtcgaattga

SEQ ID NO: 82709 - DNA, 25 bp, S. pombe
cattttggttttggactggcgtcta

SEQ ID NO: 82710 - DNA, 25 bp, S. pombe
cattggttgatgctttacgccgtca

SEQ ID NO: 82711 - DNA, 25 bp, S. pombe
catcagtatatgtattaccaagata

SEQ ID NO: 82712 - DNA, 25 bp, S. pombe
catcttttatctatcgtttgcgcaa

SEQ ID NO: 82713 - DNA, 25 bp, S. pombe
ctttcgatcccaacgtttatgcatt

SEQ ID NO: 82714 - DNA, 25 bp, S. pombe
cattccgtgcctttttgcaattcaa

SEQ ID NO: 82715 - DNA, 25 bp, S. pombe
catactcggcttacgggcaatctaa

SEQ ID NO: 82716 - DNA, 25 bp, S. pombe
catcttcgggtttgctgtggacgga

SEQ ID NO: 82717 - DNA, 25 bp, S. pombe
catgcttgcggccattactgtaata

SEQ ID NO: 82718 - DNA, 25 bp, S. pombe
cattctctggtattgcattctctgc

SEQ ID NO: 82719 - DNA, 25 bp, S. pombe
cattcgtcatggtctttttagcgga

SEQ ID NO: 82720 - DNA, 25 bp, S. pombe
cattcggaagaggtttttcggtcag

SEQ ID NO: 82721 - DNA, 25 bp, S. pombe
cattggcaagactgtgacacattat

SEQ ID NO: 82722 - DNA, 25 bp, S. pombe
cattgcatgtatgtctgcgtctcat

SEQ ID NO: 82723 - DNA, 25 bp, S. pombe
catcttgtgctgttactgacgttct

SEQ ID NO: 82724 - DNA, 25 bp, S. pombe
catgcttccttttctgagtacttga

SEQ ID NO: 82725 - DNA, 25 bp, S. pombe
catgctatttgcagtcccgaatttg

SEQ ID NO: 82726 - DNA, 25 bp, S. pombe
catcttggcttctctgttgtttaac

SEQ ID NO: 82727 - DNA, 25 bp, S. pombe
catgctttactttcgttgatgccaa

SEQ ID NO: 82728 - DNA, 25 bp, S. pombe
ctttatctcaagaagcccgtttggc

SEQ ID NO: 82729 - DNA, 25 bp, S. pombe
gtttttcctggacatcaaggcggcc

SEQ ID NO: 82730 - DNA, 25 bp, S. pombe
gtttctttgttagaaggtcgcccat

SEQ ID NO: 82731 - DNA, 25 bp, S. pombe
ctttcctttctagatcggttgactg

SEQ ID NO: 82732 - DNA, 25 bp, S. pombe
cattgctcctggacacagcagggat

SEQ ID NO: 82733 - DNA, 25 bp, S. pombe
catatgctctttacagtggctggcc

SEQ ID NO: 82734 - DNA, 25 bp, S. pombe
cattgtttacagttggcatatccaa

SEQ ID NO: 82735 - DNA, 25 bp, S. pombe
cattcccataattcacctatcggta

SEQ ID NO: 82736 - DNA, 25 bp, S. pombe
catctccggatttcaggactcgaaa

SEQ ID NO: 82737 - DNA, 25 bp, S. pombe
catactcgcgatttggatgccggaa

SEQ ID NO: 82738 - DNA, 25 bp, S. pombe
catcctcatggttctggcagtagta

SEQ ID NO: 82739 - DNA, 25 bp, S. pombe
catcctctggtaatgtcgatattat

SEQ ID NO: 82740 - DNA, 25 bp, S. pombe
catcctcttgttatgtggctatctt

SEQ ID NO: 82741 - DNA, 25 bp, S. pombe
catcggtcgcgaattgggctcttac

SEQ ID NO: 82742 - DNA, 25 bp, S. pombe
cttgaagatgagttgcgcgccgcat

SEQ ID NO: 82743 - DNA, 25 bp, S. pombe
cttatggatcgcgatgccgtgcatc

SEQ ID NO: 82744 - DNA, 25 bp, S. pombe
catatccaacacttgatcagaaaga

SEQ ID NO: 82745 - DNA, 25 bp, S. pombe
catccgcacgctctacgagaaaaga

SEQ ID NO: 82746 - DNA, 25 bp, S. pombe
ctatcccagggatgtcaacttcaca

SEQ ID NO: 82747 - DNA, 25 bp, S. pombe
ctctgctccagttgctaataacgtc

SEQ ID NO: 82748 - DNA, 25 bp, S. pombe
cattgagccaacatgtaaaggaaca

SEQ ID NO: 82749 - DNA, 25 bp, S. pombe
catcgcgtctcgttgaccaatgcaa

SEQ ID NO: 82750 - DNA, 25 bp, S. pombe
catcatgtgctctacaagaactagg

SEQ ID NO: 82751 - DNA, 25 bp, S. pombe
catctgtttgtattccattttggac

SEQ ID NO: 82752 - DNA, 25 bp, S. pombe
catttcactgaatctggtcgcgtaa

SEQ ID NO: 82753 - DNA, 25 bp, S. pombe
cattggaattgctgggtccactgca

SEQ ID NO: 82754 - DNA, 25 bp, S. pombe
catctcagtcttgggcgtatcgtgg

SEQ ID NO: 82755 - DNA, 25 bp, S. pombe
catactatcgtttgggttgtgctca

SEQ ID NO: 82756 - DNA, 25 bp, S. pombe
catcatctacttacggtttctgcac

SEQ ID NO: 82757 - DNA, 25 bp, S. pombe
cattctcctaatgggttcacgcatg

SEQ ID NO: 82758 - DNA, 25 bp, S. pombe
cttgggacttccttcctagtgaaga

SEQ ID NO: 82759 - DNA, 25 bp, S. pombe
cttgagtgacttggttcgtaggatc

SEQ ID NO: 82760 - DNA, 25 bp, S. pombe
catcaaatcgcatcttgtcctgagt

SEQ ID NO: 82761 - DNA, 25 bp, S. pombe
ctcgtaagcaacttgcctctaaggc

SEQ ID NO: 82762 - DNA, 25 bp, S. pombe
cattcggtgccattctatctatttg

SEQ ID NO: 82763 - DNA, 25 bp, S. pombe
cattccgtgctgttcaatctagata

SEQ ID NO: 82764 - DNA, 25 bp, S. pombe
catattgtgattatgaggccagaca

SEQ ID NO: 82765 - DNA, 25 bp, S. pombe
catattgtgattatgaggccagaca

SEQ ID NO: 82766 - DNA, 25 bp, S. pombe
catcgaagagattttggacgccaaa

SEQ ID NO: 82767 - DNA, 25 bp, S. pombe
catagttcagattttcgactccgaa

SEQ ID NO: 82768 - DNA, 25 bp, S. pombe
catacttaacattggcacctgccga

SEQ ID NO: 82769 - DNA, 25 bp, S. pombe
tattttaaatgggactgtacgtccg

SEQ ID NO: 82770 - DNA, 25 bp, S. pombe
gttttctaaggctcgatacgttcgc

SEQ ID NO: 82771 - DNA, 25 bp, S. pombe
catctattctttcttcttccattga

SEQ ID NO: 82772 - DNA, 25 bp, S. pombe
catctgacattacttctggttctcc

SEQ ID NO: 82773 - DNA, 25 bp, S. pombe
catttccattatactgtttcggcag

SEQ ID NO: 82774 - DNA, 25 bp, S. pombe
catctgttatttgcttgtgtcgaca

SEQ ID NO: 82775 - DNA, 25 bp, S. pombe
catattcttttgtcgctggtctaag

SEQ ID NO: 82776 - DNA, 25 bp, S. pombe
cattttttggctagcatggtccggt

SEQ ID NO: 82777 - DNA, 25 bp, S. pombe
catatgttcctaccgagttcgaaga

SEQ ID NO: 82778 - DNA, 25 bp, S. pombe
catatttggttctcgtccgacagaa

SEQ ID NO: 82779 - DNA, 25 bp, S. pombe
catcgattttggaagccttggctga

SEQ ID NO: 82780 - DNA, 25 bp, S. pombe
catcgtgtttggtgttatctctatc

SEQ ID NO: 82781 - DNA, 25 bp, S. pombe
catcgcttttggtttttgcttcatt

SEQ ID NO: 82782 - DNA, 25 bp, S. pombe
catcgcgtttgtgtttctttatcta

SEQ ID NO: 82783 - DNA, 25 bp, S. pombe
catcggtcttttggttggtgttatt

SEQ ID NO: 82784 - DNA, 25 bp, S. pombe
catctgggttgttgagtgctggttt

SEQ ID NO: 82785 - DNA, 25 bp, S. pombe
cattatcgtcttgtccgtgttggac

SEQ ID NO: 82786 - DNA, 25 bp, S. pombe
cttcagatcctatttgctttccatg

SEQ ID NO: 82787 - DNA, 25 bp, S. pombe
catcaagcccttttttcacaaggtg

SEQ ID NO: 82788 - DNA, 25 bp, S. pombe
catcaagctgccgatttttcacaag

SEQ ID NO: 82789 - DNA, 25 bp, S. pombe
catctcacccggacgtttatgataa

SEQ ID NO: 82790 - DNA, 25 bp, S. pombe
catacaccgcggtttcttatgaaat

SEQ ID NO: 82791 - DNA, 25 bp, S. pombe
ctactcgtagagctttggaacactt

SEQ ID NO: 82792 - DNA, 25 bp, S. pombe
catcgtcgatagctccttggaaagt

SEQ ID NO: 82793 - DNA, 25 bp, S. pombe
catttactgctcctcattgggatga

SEQ ID NO: 82794 - DNA, 25 bp, S. pombe
catctaccgctacatctgaatctaa

SEQ ID NO: 82795 - DNA, 25 bp, S. pombe
catctgatcccttctttgattctta

SEQ ID NO: 82796 - DNA, 25 bp, S. pombe
cattgaggcttttgcagagtacgct

SEQ ID NO: 82797 - DNA, 25 bp, S. pombe
cattcaggttgttaagcgacgtcaa

SEQ ID NO: 82798 - DNA, 25 bp, S. pombe
cttggaattttgctgacacccgtat

SEQ ID NO: 82799 - DNA, 25 bp, S. pombe
cttatgttcgttctgagggccgtaa

SEQ ID NO: 82800 - DNA, 25 bp, S. pombe
catctttggttattgctccttttgt

SEQ ID NO: 82801 - DNA, 25 bp, S. pombe
catctttggatgttgtctactcttt

SEQ ID NO: 82802 - DNA, 25 bp, S. pombe
catctttggatgttgtctactcttt

SEQ ID NO: 82803 - DNA, 25 bp, S. pombe
catctggtgggctttctaatctctc

SEQ ID NO: 82804 - DNA, 25 bp, S. pombe
cttggcggatcgtttagaccttgat

SEQ ID NO: 82805 - DNA, 25 bp, S. pombe
catttcttctccttctaacgttata

SEQ ID NO: 82806 - DNA, 25 bp, S. pombe
cttcacatttcgctcctaaggttaa

SEQ ID NO: 82807 - DNA, 25 bp, S. pombe
ctaaacttcctccaaatgttgccga

SEQ ID NO: 82808 - DNA, 25 bp, S. pombe
cttggaattactcaaagtctgggat

SEQ ID NO: 82809 - DNA, 25 bp, S. pombe
cttcgtttacatcaaatccggcgat

SEQ ID NO: 82810 - DNA, 25 bp, S. pombe
ctacctaacggtgctgatgttttga

SEQ ID NO: 82811 - DNA, 25 bp, S. pombe
catttttagcggtcctgtggtttca

SEQ ID NO: 82812 - DNA, 25 bp, S. pombe
cattgttatgactgcctttactttt

SEQ ID NO: 82813 - DNA, 25 bp, S. pombe
catatcttagtcgtgccttgtggct

SEQ ID NO: 82814 - DNA, 25 bp, S. pombe
gccagcttagcttcggctattgagt

SEQ ID NO: 82815 - DNA, 25 bp, S. pombe
tccacttgagtgtagggccggtttt

SEQ ID NO: 82816 - DNA, 25 bp, S. pombe
catacttatccaatcccaatctttt

SEQ ID NO: 82817 - DNA, 25 bp, S. pombe
catacattccaaactccgactaaga

SEQ ID NO: 82818 - DNA, 25 bp, S. pombe
cattattccatgactttgcctattg

SEQ ID NO: 82819 - DNA, 25 bp, S. pombe
gctagcgtttttgacctgttttcat

SEQ ID NO: 82820 - DNA, 25 bp, S. pombe
gctaaaccttcctcctgaagtaatc

SEQ ID NO: 82821 - DNA, 25 bp, S. pombe
cggaaattaccatcacgtttattat

SEQ ID NO: 82822 - DNA, 25 bp, S. pombe
cattaggatttgacagctggctggt

SEQ ID NO: 82823 - DNA, 25 bp, S. pombe
cattgggttttgacaggctggctgc

SEQ ID NO: 82824 - DNA, 25 bp, S. pombe
catattgcgatgaaaggcgtaccag

SEQ ID NO: 82825 - DNA, 25 bp, S. pombe
catattcagaacttggatgtgatca

SEQ ID NO: 82826 - DNA, 25 bp, S. pombe
gaatgacgaaatcaactctgcgagt

SEQ ID NO: 82827 - DNA, 25 bp, S. pombe
cattacttgggctagcactcttggg

SEQ ID NO: 82828 - DNA, 25 bp, S. pombe
cattgccttctgtaaatctccagca

SEQ ID NO: 82829 - DNA, 25 bp, S. pombe
cgtttattcaagtcgacccttcaga

SEQ ID NO: 82830 - DNA, 25 bp, S. pombe
catacgactaatgcatctccggttg

SEQ ID NO: 82831 - DNA, 25 bp, S. pombe
cttatgggactttgctgactttggg

SEQ ID NO: 82832 - DNA, 25 bp, S. pombe
catttggtaaattcttcttctggac

SEQ ID NO: 82833 - DNA, 25 bp, S. pombe
cattgattctaattccaccgaagga

SEQ ID NO: 82834 - DNA, 25 bp, S. pombe
cattgattcttttgcaacgccatcg

SEQ ID NO: 82835 - DNA, 25 bp, S. pombe
cattgataatcacctcgcatcgaac

SEQ ID NO: 82836 - DNA, 25 bp, S. pombe
catagttcatcatgccagtcagagg

SEQ ID NO: 82837 - DNA, 25 bp, S. pombe
cttgctgctcgtttagaccgtctaa

SEQ ID NO: 82838 - DNA, 25 bp, S. pombe
cttgcctcgataatatctccagctg

SEQ ID NO: 82839 - DNA, 25 bp, S. pombe
cttcactgccatctgtacttcaaaa

SEQ ID NO: 82840 - DNA, 25 bp, S. pombe
cattccaactgagtgttttaaataa

SEQ ID NO: 82841 - DNA, 25 bp, S. pombe
cattccaactgagtgttttaaataa

SEQ ID NO: 82842 - DNA, 25 bp, S. pombe
cattaaacgcttctttgccttacaa

SEQ ID NO: 82843 - DNA, 25 bp, S. pombe
ctaaaaaaccaattctctgcaatga

SEQ ID NO: 82844 - DNA, 25 bp, S. pombe
ctagctagtacaccgagttctgaat

SEQ ID NO: 82845 - DNA, 25 bp, S. pombe
cattctcacttacccagtcgatgaa

SEQ ID NO: 82846 - DNA, 25 bp, S. pombe
cttgctcagttatcggtcgtcaaat

SEQ ID NO: 82847 - DNA, 25 bp, S. pombe
cttctcatcaatctcgttcttcaga

SEQ ID NO: 82848 - DNA, 25 bp, S. pombe
catttgacagacacgattggcttgt

SEQ ID NO: 82849 - DNA, 25 bp, S. pombe
cttgcatacacctctaatggctgtt

SEQ ID NO: 82850 - DNA, 25 bp, S. pombe
cttttggaaggtatctcgacgctct

SEQ ID NO: 82851 - DNA, 25 bp, S. pombe
cattttgcgaagcttcttgaacccg

SEQ ID NO: 82852 - DNA, 25 bp, S. pombe
cattacggatgagcccttataccct

SEQ ID NO: 82853 - DNA, 25 bp, S. pombe
cttggcaagacattcagttagctga

SEQ ID NO: 82854 - DNA, 25 bp, S. pombe
cattatgctcttcgcgagcttcaaa

SEQ ID NO: 82855 - DNA, 25 bp, S. pombe
catatgttcttcttggcttcagctt

SEQ ID NO: 82856 - DNA, 25 bp, S. pombe
cattgctgttcaagcttctgtacct

SEQ ID NO: 82857 - DNA, 25 bp, S. pombe
cataagcccttacttttccttgtag

SEQ ID NO: 82858 - DNA, 25 bp, S. pombe
cattctccctttgatttccttgttt

SEQ ID NO: 82859 - DNA, 25 bp, S. pombe
cattcgccctctattgtttttattg

SEQ ID NO: 82860 - DNA, 25 bp, S. pombe
cattagcccgtcatctattaattcc

SEQ ID NO: 82861 - DNA, 25 bp, S. pombe
cattgagcaccgtatttcctagttt

SEQ ID NO: 82862 - DNA, 25 bp, S. pombe
cattcttcatccattgtcaatgcct

SEQ ID NO: 82863 - DNA, 25 bp, S. pombe
cttgcctctcttcgcgtacaaaaga

SEQ ID NO: 82864 - DNA, 25 bp, S. pombe
cattcaccttcgatcaagctgattc

SEQ ID NO: 82865 - DNA, 25 bp, S. pombe
ctgattcccctgaagaagttcctgg

SEQ ID NO: 82866 - DNA, 25 bp, S. pombe
ctattcccaatcagcaagttctttc

SEQ ID NO: 82867 - DNA, 25 bp, S. pombe
cttgaccctcaaattggaagcttaa

SEQ ID NO: 82868 - DNA, 25 bp, S. pombe
cttgatccccatttcccaagtcaaa

SEQ ID NO: 82869 - DNA, 25 bp, S. pombe
cattggtgccacaatcggctgtata

SEQ ID NO: 82870 - DNA, 25 bp, S. pombe
cattttcttccatggctttgcgaag

SEQ ID NO: 82871 - DNA, 25 bp, S. pombe
catttcgtttccttgcttttgatag

SEQ ID NO: 82872 - DNA, 25 bp, S. pombe
cattgaagcccttcgccgttgtcaa

SEQ ID NO: 82873 - DNA, 25 bp, S. pombe
cattcactggttcggagctatcact

SEQ ID NO: 82874 - DNA, 25 bp, S. pombe
cattacttttgtcgacgtccctaag

SEQ ID NO: 82875 - DNA, 25 bp, S. pombe
cattgtcttcttctagtatacggga

SEQ ID NO: 82876 - DNA, 25 bp, S. pombe
cattctctaaatgcgtctgttggaa

SEQ ID NO: 82877 - DNA, 25 bp, S. pombe
cttgcgcttgaagccttctcgaaaa

SEQ ID NO: 82878 - DNA, 25 bp, S. pombe
cttccctgagacgttgtttgcaagc

SEQ ID NO: 82879 - DNA, 25 bp, S. pombe
cttagccatggaagttgaaccccta

SEQ ID NO: 82880 - DNA, 25 bp, S. pombe
cttacagatgctacgggaaacccaa

SEQ ID NO: 82881 - DNA, 25 bp, S. pombe
cttccagtggacttgacttttacga

SEQ ID NO: 82882 - DNA, 25 bp, S. pombe
ctatgtttatacctccttgttggga

SEQ ID NO: 82883 - DNA, 25 bp, S. pombe
cttcctaatcaattacacttgcgat

SEQ ID NO: 82884 - DNA, 25 bp, S. pombe
cattggatggtccttacatgtctaa

SEQ ID NO: 82885 - DNA, 25 bp, S. pombe
catttggcgttgctggctctggaaa

SEQ ID NO: 82886 - DNA, 25 bp, S. pombe
cattagggctttttgccatggaaaa

SEQ ID NO: 82887 - DNA, 25 bp, S. pombe
cattatgggctcttagtgatctgga

SEQ ID NO: 82888 - DNA, 25 bp, S. pombe
cattggagcttggacttacgatcta

SEQ ID NO: 82889 - DNA, 25 bp, S. pombe
cattctagtgggtatgtctgcgtac

SEQ ID NO: 82890 - DNA, 25 bp, S. pombe
catatttcgatgtgtaccggatgac

SEQ ID NO: 82891 - DNA, 25 bp, S. pombe
cttttgagcaaaatgactgggtagc

SEQ ID NO: 82892 - DNA, 25 bp, S. pombe
cgtcgtgagcccaataccggtaaga

SEQ ID NO: 82893 - DNA, 25 bp, S. pombe
cttattgatgcctctaccgttaaac

SEQ ID NO: 82894 - DNA, 25 bp, S. pombe
cttatttgcgcaaggcatgccgtta

SEQ ID NO: 82895 - DNA, 25 bp, S. pombe
cattccaggttgcatctttgttcat

SEQ ID NO: 82896 - DNA, 25 bp, S. pombe
catatcgctgcaatacgtggtttta

SEQ ID NO: 82897 - DNA, 25 bp, S. pombe
cattgggcttatcgagcgtttctac

SEQ ID NO: 82898 - DNA, 25 bp, S. pombe
cattggctgctcacggttatatcta

SEQ ID NO: 82899 - DNA, 25 bp, S. pombe
cattgagctgtccaagattctttta

SEQ ID NO: 82900 - DNA, 25 bp, S. pombe
ctctgacttgagcaactatccttac

SEQ ID NO: 82901 - DNA, 25 bp, S. pombe
tttacccggtgaattcgttgaatct

SEQ ID NO: 82902 - DNA, 25 bp, S. pombe
cattggcccggttagtttggaagct

SEQ ID NO: 82903 - DNA, 25 bp, S. pombe
catttttggaatatttgcgctctaa

SEQ ID NO: 82904 - DNA, 25 bp, S. pombe
catttgtattcggtgctggtgcaac

SEQ ID NO: 82905 - DNA, 25 bp, S. pombe
catttgtcttctcgtcttagtacta

SEQ ID NO: 82906 - DNA, 25 bp, S. pombe
cttcgacttggtgttgtctcactaa

SEQ ID NO: 82907 - DNA, 25 bp, S. pombe
cttcgacgtgttaatcttgctactt

SEQ ID NO: 82908 - DNA, 25 bp, S. pombe
cattcttcggtttctctgtgaacat

SEQ ID NO: 82909 - DNA, 25 bp, S. pombe
catttcgcccagtcttgtgtgaaga

SEQ ID NO: 82910 - DNA, 25 bp, S. pombe
catttagcttgttggatcatcgata

SEQ ID NO: 82911 - DNA, 25 bp, S. pombe
cttctccgttacttcaaatgcttga

SEQ ID NO: 82912 - DNA, 25 bp, S. pombe
cattctcttcggtcaaaaagcttaa

SEQ ID NO: 82913 - DNA, 25 bp, S. pombe
ctagccgctcggttgaagaagttca

SEQ ID NO: 82914 - DNA, 25 bp, S. pombe
cggccagctcgtataagtgacctta

SEQ ID NO: 82915 - DNA, 25 bp, S. pombe
ctactcacttccacaaaacatctga

SEQ ID NO: 82916 - DNA, 25 bp, S. pombe
cttccagtcactcgccagaaaatta

SEQ ID NO: 82917 - DNA, 25 bp, S. pombe
cattgtttcccctctgtttgaaggg

SEQ ID NO: 82918 - DNA, 25 bp, S. pombe
cattgtttgcccgagctatgtttaa

SEQ ID NO: 82919 - DNA, 25 bp, S. pombe
cattcatctgttctgtggtatctgc

SEQ ID NO: 82920 - DNA, 25 bp, S. pombe
cattgtgtctggctgaagtttcgaa

SEQ ID NO: 82921 - DNA, 25 bp, S. pombe
catttgccacacattttgcttctga

SEQ ID NO: 82922 - DNA, 25 bp, S. pombe
cttcagctgcctctataggtttgga

SEQ ID NO: 82923 - DNA, 25 bp, S. pombe
cattcagtggtgttcctggtgtgaa

SEQ ID NO: 82924 - DNA, 25 bp, S. pombe
cattgcattgcggaattatcgacat

SEQ ID NO: 82925 - DNA, 25 bp, S. pombe
cttgctaggatgctgaacgagctat

SEQ ID NO: 82926 - DNA, 25 bp, S. pombe
cttgattatgtgttggctctccgta

SEQ ID NO: 82927 - DNA, 25 bp, S. pombe
cttggttaggcatctccgtgtgaaa

SEQ ID NO: 82928 - DNA, 25 bp, S. pombe
cttccttcaagctcatccaagtggg

SEQ ID NO: 82929 - DNA, 25 bp, S. pombe
cttctgacagtcttcctacacataa

SEQ ID NO: 82930 - DNA, 25 bp, S. pombe
cttgcctcggtcatcttgaacagaa

SEQ ID NO: 82931 - DNA, 25 bp, S. pombe
cttcctggcgacattgctgattaca

SEQ ID NO: 82932 - DNA, 25 bp, S. pombe
cttgtgctggttttgtgagtcctca

SEQ ID NO: 82933 - DNA, 25 bp, S. pombe
cattgtccattaagcattgtgccat

SEQ ID NO: 82934 - DNA, 25 bp, S. pombe
cttgcccaggcagctttattatttg

SEQ ID NO: 82935 - DNA, 25 bp, S. pombe
cttcctccagagaccttattttatg

SEQ ID NO: 82936 - DNA, 25 bp, S. pombe
ctccttcgcaggtgggatttttgaa

SEQ ID NO: 82937 - DNA, 25 bp, S. pombe
cttttctcgtaaccaatttcactct

SEQ ID NO: 82938 - DNA, 25 bp, S. pombe
catttttcttttccttttcactgca

SEQ ID NO: 82939 - DNA, 25 bp, S. pombe
cattttattgcttgtttgtattcca

SEQ ID NO: 82940 - DNA, 25 bp, S. pombe
cattttctatgcgtgtgtctggata

SEQ ID NO: 82941 - DNA, 25 bp, S. pombe
cattgtcccagccatggttggagat

SEQ ID NO: 82942 - DNA, 25 bp, S. pombe
cttctgtgtcgcttcgtcaaatgat

SEQ ID NO: 82943 - DNA, 25 bp, S. pombe
cattcctcacaagctggcaattcat

SEQ ID NO: 82944 - DNA, 25 bp, S. pombe
cattcctcgtctttgtcaagtcata

SEQ ID NO: 82945 - DNA, 25 bp, S. pombe
cattggcttctgatcctcgtattaa

SEQ ID NO: 82946 - DNA, 25 bp, S. pombe
cattgttgtctgcatttgttttcga

SEQ ID NO: 82947 - DNA, 25 bp, S. pombe
cattgttgcctttttgcatggtcgt

SEQ ID NO: 82948 - DNA, 25 bp, S. pombe
cattgttctctcaggtggtagcagt

SEQ ID NO: 82949 - DNA, 25 bp, S. pombe
ctttatgaagttatgcccgggtgtt

SEQ ID NO: 82950 - DNA, 25 bp, S. pombe
cttgttccagtgtgcatatacccag

SEQ ID NO: 82951 - DNA, 25 bp, S. pombe
cttgttctcactcttatcactataa

SEQ ID NO: 82952 - DNA, 25 bp, S. pombe
cattgtccaaatacacctgtgtcct

SEQ ID NO: 82953 - DNA, 25 bp, S. pombe
cttcaagatgaataccggcggcgtc

SEQ ID NO: 82954 - DNA, 25 bp, S. pombe
cttcgtgtgatttagccaactgcgg

SEQ ID NO: 82955 - DNA, 25 bp, S. pombe
ctttggttgcatcaaattcggtaac

SEQ ID NO: 82956 - DNA, 25 bp, S. pombe
ctttaggtgtgcttacagtcggttt

SEQ ID NO: 82957 - DNA, 25 bp, S. pombe
cttgacgagattttgctggctttaa

SEQ ID NO: 82958 - DNA, 25 bp, S. pombe
cattaccatggatttgcacgcttct

SEQ ID NO: 82959 - DNA, 25 bp, S. pombe
cattacgccagcatgagcaacaaat

SEQ ID NO: 82960 - DNA, 25 bp, S. pombe
cttccattgaagatcgtactgctga

SEQ ID NO: 82961 - DNA, 25 bp, S. pombe
cttgcctaaggagcgtacatcagat

SEQ ID NO: 82962 - DNA, 25 bp, S. pombe
ctttgcctcaagtgacaagccaaat

SEQ ID NO: 82963 - DNA, 25 bp, S. pombe
cattgccatgcctatcaaccaaaag

SEQ ID NO: 82964 - DNA, 25 bp, S. pombe
cttgcctcatctagagcatctcaaa

SEQ ID NO: 82965 - DNA, 25 bp, S. pombe
ctatgactactaatgctcctaacct

SEQ ID NO: 82966 - DNA, 25 bp, S. pombe
cttgcaaggtattcctgctttgcgt

SEQ ID NO: 82967 - DNA, 25 bp, S. pombe
cattccagctgtacaccgtgttgaa

SEQ ID NO: 82968 - DNA, 25 bp, S. pombe
cattcccactaaggctgctggagaa

SEQ ID NO: 82969 - DNA, 25 bp, S. pombe
cattgctttaggatggaccactgct

SEQ ID NO: 82970 - DNA, 25 bp, S. pombe
cattcctttatgttgggccttttgg

SEQ ID NO: 82971 - DNA, 25 bp, S. pombe
cattcatccttctgcattggcttat

SEQ ID NO: 82972 - DNA, 25 bp, S. pombe
cttgcacccgctttattttacgatt

SEQ ID NO: 82973 - DNA, 25 bp, S. pombe
cttgcaccctgctgaattacatttg

SEQ ID NO: 82974 - DNA, 25 bp, S. pombe
cttgctgttggcctcactataaaaa

SEQ ID NO: 82975 - DNA, 25 bp, S. pombe
ctttggagcggcgactcgaacgaaa

SEQ ID NO: 82976 - DNA, 25 bp, S. pombe
ctatggtaaacttgtcttcgcctct

SEQ ID NO: 82977 - DNA, 25 bp, S. pombe
cttattgaatacactccagcgctac

SEQ ID NO: 82978 - DNA, 25 bp, S. pombe
gttcctgaatccacccaaattaaca

SEQ ID NO: 82979 - DNA, 25 bp, S. pombe
ctataccaaggctcccaagattcaa

SEQ ID NO: 82980 - DNA, 25 bp, S. pombe
gcgtcgtcttttgaccttacaaatt

SEQ ID NO: 82981 - DNA, 25 bp, S. pombe
cttcattttatctacctagccacag

SEQ ID NO: 82982 - DNA, 25 bp, S. pombe
cttcttatcaacaacaacaccgcat

SEQ ID NO: 82983 - DNA, 25 bp, S. pombe
gccttaaagaacatagaccgtccgg

SEQ ID NO: 82984 - DNA, 25 bp, S. pombe
tcttttacgaaatggaacgtccagg

SEQ ID NO: 82985 - DNA, 25 bp, S. pombe
ctgtagtcgattctcctgcaaacta

SEQ ID NO: 82986 - DNA, 25 bp, S. pombe
cttaatcggtgcattgttcaactga

SEQ ID NO: 82987 - DNA, 25 bp, S. pombe
cattgtcccgtgtgcaaggttcaaa

SEQ ID NO: 82988 - DNA, 25 bp, S. pombe
ctatgaagccgatttaacgaaagga

SEQ ID NO: 82989 - DNA, 25 bp, S. pombe
cattgcatggtcttgattttctgga

SEQ ID NO: 82990 - DNA, 25 bp, S. pombe
cttggccgttttagacgaggaccat

SEQ ID NO: 82991 - DNA, 25 bp, S. pombe
cattggccctttttgtcagttgaaa

SEQ ID NO: 82992 - DNA, 25 bp, S. pombe
cattgcgtccgttgtagccggtaaa

SEQ ID NO: 82993 - DNA, 25 bp, S. pombe
cttgcggtcttttcatggttacatc

SEQ ID NO: 82994 - DNA, 25 bp, S. pombe
cttggcggcattgacatctgttaaa

SEQ ID NO: 82995 - DNA, 25 bp, S. pombe
cttgggctattccacctggtagata

SEQ ID NO: 82996 - DNA, 25 bp, S. pombe
cattggcctcattgggcttggttta

SEQ ID NO: 82997 - DNA, 25 bp, S. pombe
cttcttccttttcgtcaaagcgtga

SEQ ID NO: 82998 - DNA, 25 bp, S. pombe
cttcttcctctgttcctataaatgt

SEQ ID NO: 82999 - DNA, 25 bp, S. pombe
cttcccaaatttactccacataatc

SEQ ID NO: 83000 - DNA, 25 bp, S. pombe
cttccccgattacctactatgatat

SEQ ID NO: 83001 - DNA, 25 bp, S. pombe
cttccaccgttacttcgaatagtca

SEQ ID NO: 83002 - DNA, 25 bp, S. pombe
ctttgaccgttactgtggccaagaa

SEQ ID NO: 83003 - DNA, 25 bp, S. pombe
ctttgagtgacttacgtggcgacga

SEQ ID NO: 83004 - DNA, 25 bp, S. pombe
cttggttcattgttcgaggctggcc

SEQ ID NO: 83005 - DNA, 25 bp, S. pombe
cttaatgtttccagtgatgcttcaa

SEQ ID NO: 83006 - DNA, 25 bp, S. pombe
cttgcagctgtttcggtgtttccta

SEQ ID NO: 83007 - DNA, 25 bp, S. pombe
ctgtgatgttgtttggttattcctt

SEQ ID NO: 83008 - DNA, 25 bp, S. pombe
cattgctttgtgtttttatcccttt

SEQ ID NO: 83009 - DNA, 25 bp, S. pombe
cttggatctgtgttttggtagccta

SEQ ID NO: 83010 - DNA, 25 bp, S. pombe
ctatgaatttctacttgcctatccg

SEQ ID NO: 83011 - DNA, 25 bp, S. pombe
cttgacttctcaacttgccaattac

SEQ ID NO: 83012 - DNA, 25 bp, S. pombe
cttcgctcatccaattactcaatat

SEQ ID NO: 83013 - DNA, 25 bp, S. pombe
cttgccctcagctattaatatcttg

SEQ ID NO: 83014 - DNA, 25 bp, S. pombe
cttgggccacatatgcattcagtaa

SEQ ID NO: 83015 - DNA, 25 bp, S. pombe
ctttccccagcttataggattcgtt

SEQ ID NO: 83016 - DNA, 25 bp, S. pombe
cttcctccgtcgttaacactggcaa

SEQ ID NO: 83017 - DNA, 25 bp, S. pombe
cttcctccgtcgttaacactggcaa

SEQ ID NO: 83018 - DNA, 25 bp, S. pombe
cttggtctaccgttcgtcaatggaa

SEQ ID NO: 83019 - DNA, 25 bp, S. pombe
cttggtgtccggttcgatatcatgt

SEQ ID NO: 83020 - DNA, 25 bp, S. pombe
cttggttcctctactcaatatgatt

SEQ ID NO: 83021 - DNA, 25 bp, S. pombe
ctttcttccccagtcaaattgattg

SEQ ID NO: 83022 - DNA, 25 bp, S. pombe
cttccttccccttcagaagagagat

SEQ ID NO: 83023 - DNA, 25 bp, S. pombe
ctttgactcctggtcgtgaggacat

SEQ ID NO: 83024 - DNA, 25 bp, S. pombe
cttcttcttcccataccaatgtttt

SEQ ID NO: 83025 - DNA, 25 bp, S. pombe
cttcctattcaccttgcatgcaaga

SEQ ID NO: 83026 - DNA, 25 bp, S. pombe
ctactgctggtagggctaaccttaa

SEQ ID NO: 83027 - DNA, 25 bp, S. pombe
cttgtcgagcgaacatgggcattca

SEQ ID NO: 83028 - DNA, 25 bp, S. pombe
ctaggcttttctcattcgccaaaaa

SEQ ID NO: 83029 - DNA, 25 bp, S. pombe
ctaacactggttgagccggctgaaa

SEQ ID NO: 83030 - DNA, 25 bp, S. pombe
ctagaactgtttggcgcggtcacga

SEQ ID NO: 83031 - DNA, 25 bp, S. pombe
ctttcaactcatcaattcacctatt

SEQ ID NO: 83032 - DNA, 25 bp, S. pombe
ctttggcagcttcagatttcatctt

SEQ ID NO: 83033 - DNA, 25 bp, S. pombe
cttgctcgtgttccagatgttagta

SEQ ID NO: 83034 - DNA, 25 bp, S. pombe
cttgctgcgctttttgagtcatgta

SEQ ID NO: 83035 - DNA, 25 bp, S. pombe
cttatgcctttggtggtgctttaat

SEQ ID NO: 83036 - DNA, 25 bp, S. pombe
cgttgtacctgaggttccttcagtt

SEQ ID NO: 83037 - DNA, 25 bp, S. pombe
ctttcaaattatgcttgcccggatt

SEQ ID NO: 83038 - DNA, 25 bp, S. pombe
cttgtcaaaattcagctccgctttt

SEQ ID NO: 83039 - DNA, 25 bp, S. pombe
cttgggaatcacgaagcctgcttta

SEQ ID NO: 83040 - DNA, 25 bp, S. pombe
cttggtaatctgcagcatgccgtta

SEQ ID NO: 83041 - DNA, 25 bp, S. pombe
cttggtagttcttgagcatgcgtta

SEQ ID NO: 83042 - DNA, 25 bp, S. pombe
cttggctttgacagcagtcggaact

SEQ ID NO: 83043 - DNA, 25 bp, S. pombe
cttggctttgacagctgttggaatt

SEQ ID NO: 83044 - DNA, 25 bp, S. pombe
cttttattacattcatactcccctg

SEQ ID NO: 83045 - DNA, 25 bp, S. pombe
ctgtttttacgatcgggttctcgag

SEQ ID NO: 83046 - DNA, 25 bp, S. pombe
ctttcgctacattgctactttctat

SEQ ID NO: 83047 - DNA, 25 bp, S. pombe
cttccctcactgtcaacatttttag

SEQ ID NO: 83048 - DNA, 25 bp, S. pombe
ctttccccgagcattgattcattag

SEQ ID NO: 83049 - DNA, 25 bp, S. pombe
ctatatatttaatgacgccagggaa

SEQ ID NO: 83050 - DNA, 25 bp, S. pombe
cttcctctttagctaacgttcgatg

SEQ ID NO: 83051 - DNA, 25 bp, S. pombe
cttgagcctattccagcacaaacat

SEQ ID NO: 83052 - DNA, 25 bp, S. pombe
cttcagactttccttgtcaagcggt

SEQ ID NO: 83053 - DNA, 25 bp, S. pombe
cttccgcttcgtctttattgacaat

SEQ ID NO: 83054 - DNA, 25 bp, S. pombe
cttccttcttttttacgctctgata

SEQ ID NO: 83055 - DNA, 25 bp, S. pombe
cttgcactgcatactctcgatatat

SEQ ID NO: 83056 - DNA, 25 bp, S. pombe
cttccagcagaagttctattccaga

SEQ ID NO: 83057 - DNA, 25 bp, S. pombe
cttctaaacacttctttctctttca

SEQ ID NO: 83058 - DNA, 25 bp, S. pombe
cttcttcaagcccaatagttcgtaa

SEQ ID NO: 83059 - DNA, 25 bp, S. pombe
cttccatcaatgctaacgttcctta

SEQ ID NO: 83060 - DNA, 25 bp, S. pombe
ctgtaccctggagcaattcaacttt

SEQ ID NO: 83061 - DNA, 25 bp, S. pombe
cttacatccggatacagtccacttt

SEQ ID NO: 83062 - DNA, 25 bp, S. pombe
cttatactccctacttgttcatttt

SEQ ID NO: 83063 - DNA, 25 bp, S. pombe
cttccacaccctatgttaattccat

SEQ ID NO: 83064 - DNA, 25 bp, S. pombe
cttcgacaccatgttgtacttcatc

SEQ ID NO: 83065 - DNA, 25 bp, S. pombe
cttcgtcctatgcttgtattccaaa

SEQ ID NO: 83066 - DNA, 25 bp, S. pombe
cttcttcgcgtgtgagtgtcagcaa

SEQ ID NO: 83067 - DNA, 25 bp, S. pombe
ctataacacctttggactctgctat

SEQ ID NO: 83068 - DNA, 25 bp, S. pombe
cttacctctatctttgaccattcta

SEQ ID NO: 83069 - DNA, 25 bp, S. pombe
ctttgccgttgctgctggtaatgat

SEQ ID NO: 83070 - DNA, 25 bp, S. pombe
ctattaaatcgagatatgttcctta

SEQ ID NO: 83071 - DNA, 25 bp, S. pombe
cttcaaaccaagctattcgccgtag

SEQ ID NO: 83072 - DNA, 25 bp, S. pombe
ctatccagagattccgtttcacggt

SEQ ID NO: 83073 - DNA, 25 bp, S. pombe
cttcgcaattccagtacatacgtct

SEQ ID NO: 83074 - DNA, 25 bp, S. pombe
cttagcacttccatttaccaatcat

SEQ ID NO: 83075 - DNA, 25 bp, S. pombe
ctgtggatgtacttacttacgctac

SEQ ID NO: 83076 - DNA, 25 bp, S. pombe
ctgggttgacttccattagcttaac

SEQ ID NO: 83077 - DNA, 25 bp, S. pombe
cttggtgtgatttttgctcagtcta

SEQ ID NO: 83078 - DNA, 25 bp, S. pombe
cttgcgtaccgtttttgggtgtcat

SEQ ID NO: 83079 - DNA, 25 bp, S. pombe
gcaacgtaggttgtagcgtcccacg

SEQ ID NO: 83080 - DNA, 25 bp, S. pombe
cttgggcgattgtttatggaccttc

SEQ ID NO: 83081 - DNA, 25 bp, S. pombe
gcttactggaagttcgacgactcct

SEQ ID NO: 83082 - DNA, 25 bp, S. pombe
tcctttcgaagagcaactggtccgt

SEQ ID NO: 83083 - DNA, 25 bp, S. pombe
cttgatcccgttgcgatgcgattaa

SEQ ID NO: 83084 - DNA, 25 bp, S. pombe
cttacaccgggttatcacaagcata

SEQ ID NO: 83085 - DNA, 25 bp, S. pombe
cttgctgtacagctttggcagttat

SEQ ID NO: 83086 - DNA, 25 bp, S. pombe
cttttgacccctactatgatacttt

SEQ ID NO: 83087 - DNA, 25 bp, S. pombe
ctttggcctcccatattgtcaaata

SEQ ID NO: 83088 - DNA, 25 bp, S. pombe
cttcttcttcccaaatattccatta

SEQ ID NO: 83089 - DNA, 25 bp, S. pombe
ctttctgtttccatgaatctcgctt

SEQ ID NO: 83090 - DNA, 25 bp, S. pombe
cttgactgccaagccttttgagatt

SEQ ID NO: 83091 - DNA, 25 bp, S. pombe
cttgccttgcaagcagttttctgac

SEQ ID NO: 83092 - DNA, 25 bp, S. pombe
cttgctctgtctacgatttttcatc

SEQ ID NO: 83093 - DNA, 25 bp, S. pombe
cttccatcttcagtgtcttcaacta

SEQ ID NO: 83094 - DNA, 25 bp, S. pombe
cttacatgtcatttggttcctctat

SEQ ID NO: 83095 - DNA, 25 bp, S. pombe
cttctcgttcagattcatccaggga

SEQ ID NO: 83096 - DNA, 25 bp, S. pombe
tcttgttaacggctcttgggaaaat

SEQ ID NO: 83097 - DNA, 25 bp, S. pombe
cgggtcaacgacaatctggtggaga

SEQ ID NO: 83098 - DNA, 25 bp, S. pombe
cgggcctaggaagctctgggaaatc

SEQ ID NO: 83099 - DNA, 25 bp, S. pombe
ctttcctaggaaatgcatttggagg

SEQ ID NO: 83100 - DNA, 25 bp, S. pombe
cttactgttgtttattctcgggctc

SEQ ID NO: 83101 - DNA, 25 bp, S. pombe
cttccagtattctctccataacgaa

SEQ ID NO: 83102 - DNA, 25 bp, S. pombe
cttctttcagaaaccgctatggcaa

SEQ ID NO: 83103 - DNA, 25 bp, S. pombe
cttctattaatcttcctggtggcat

SEQ ID NO: 83104 - DNA, 25 bp, S. pombe
cttcattctcaaagtcactggtgga

SEQ ID NO: 83105 - DNA, 25 bp, S. pombe
cttttagccgatgcgcttatggatc

SEQ ID NO: 83106 - DNA, 25 bp, S. pombe
ctatgtctgcatgttggagtccgga

SEQ ID NO: 83107 - DNA, 25 bp, S. pombe
cttgcttaattttgcgacctgagtt

SEQ ID NO: 83108 - DNA, 25 bp, S. pombe
ctagtttattttctgcatcggcatt

SEQ ID NO: 83109 - DNA, 25 bp, S. pombe
ctttaggcgctaacattcgatacaa

SEQ ID NO: 83110 - DNA, 25 bp, S. pombe
ctatctgggcaaccatctttgctaa

SEQ ID NO: 83111 - DNA, 25 bp, S. pombe
ctactgggtcatatagctgcgcgat

SEQ ID NO: 83112 - DNA, 25 bp, S. pombe
cttctgcctccttgactcaaaagaa

SEQ ID NO: 83113 - DNA, 25 bp, S. pombe
ctaccggaggatgctgttgtcgaat

SEQ ID NO: 83114 - DNA, 25 bp, S. pombe
cttgcccgggcagatttgttaaatt

SEQ ID NO: 83115 - DNA, 25 bp, S. pombe
cgtcccaatcgtttttcatctaatg

SEQ ID NO: 83116 - DNA, 25 bp, S. pombe
cttctcttcttgtctatctgtcaat

SEQ ID NO: 83117 - DNA, 25 bp, S. pombe
ctttccgtggtactgctagagcaat

SEQ ID NO: 83118 - DNA, 25 bp, S. pombe
ctttcggtggatcgtctcatgctaa

SEQ ID NO: 83119 - DNA, 25 bp, S. pombe
ctttcatttggatctctggcatcag

SEQ ID NO: 83120 - DNA, 25 bp, S. pombe
ctttctgggacatcgctggatttgc

SEQ ID NO: 83121 - DNA, 25 bp, S. pombe
cttcttcgtttactttggctgtcaa

SEQ ID NO: 83122 - DNA, 25 bp, S. pombe
tccgtttatttacgttggattgccg

SEQ ID NO: 83123 - DNA, 25 bp, S. pombe
tctcggtttccgtgaattgattccc

SEQ ID NO: 83124 - DNA, 25 bp, S. pombe
cttttttgccgctggtgatgttcaa

SEQ ID NO: 83125 - DNA, 25 bp, S. pombe
ctttcagttcttttaccgttcacag

SEQ ID NO: 83126 - DNA, 25 bp, S. pombe
cttccgagtcttctgattgctttaa

SEQ ID NO: 83127 - DNA, 25 bp, S. pombe
cttgccgagcttcagagtgtgttta

SEQ ID NO: 83128 - DNA, 25 bp, S. pombe
cttcatcggccatagatttccttga

SEQ ID NO: 83129 - DNA, 25 bp, S. pombe
ctttcgtgccaagccttttgtagag

SEQ ID NO: 83130 - DNA, 25 bp, S. pombe
ctgttcgtcgaaacgcattccttaa

SEQ ID NO: 83131 - DNA, 25 bp, S. pombe
ctatccctttattgttcctaatgcc

SEQ ID NO: 83132 - DNA, 25 bp, S. pombe
cttcctttcgaaatgttgctcaaca

SEQ ID NO: 83133 - DNA, 25 bp, S. pombe
cttccactgtcgatctttatcaaca

SEQ ID NO: 83134 - DNA, 25 bp, S. pombe
cttcctgctttaatgccaattgcta

SEQ ID NO: 83135 - DNA, 25 bp, S. pombe
ctttatgcaggtcgttgggctcaaa

SEQ ID NO: 83136 - DNA, 25 bp, S. pombe
cttacttcatctcaatagctcttct

SEQ ID NO: 83137 - DNA, 25 bp, S. pombe
cttttcctgcatcacatacttacat

SEQ ID NO: 83138 - DNA, 25 bp, S. pombe
ctttgtcgccaaatgcagaattatc

SEQ ID NO: 83139 - DNA, 25 bp, S. pombe
ctttgaagggtgaagtaactgccat

SEQ ID NO: 83140 - DNA, 25 bp, S. pombe
ctattgaggcccttcgtcgttgtca

SEQ ID NO: 83141 - DNA, 25 bp, S. pombe
cttagtggccgctgattgtggtgca

SEQ ID NO: 83142 - DNA, 25 bp, S. pombe
cgactgatgggcttccggtatggat

SEQ ID NO: 83143 - DNA, 25 bp, S. pombe
ctatcttcgtgctgctcatggtaaa

SEQ ID NO: 83144 - DNA, 25 bp, S. pombe
ctattccgtagccattcgtagtgga

SEQ ID NO: 83145 - DNA, 25 bp, S. pombe
ctactgctattgaggcccttcgtcg

SEQ ID NO: 83146 - DNA, 25 bp, S. pombe
ctactgccattgaagcccttcgccg

SEQ ID NO: 83147 - DNA, 25 bp, S. pombe
cttagatccaattgctgcgtccgag

SEQ ID NO: 83148 - DNA, 25 bp, S. pombe
ctttttccatcatgagccagtggta

SEQ ID NO: 83149 - DNA, 25 bp, S. pombe
ctgtaccgcctataccaaaactttg

SEQ ID NO: 83150 - DNA, 25 bp, S. pombe
cttcgcatgcgtctcagcaggaaaa

SEQ ID NO: 83151 - DNA, 25 bp, S. pombe
ctgggccgttcatcactggaaacaa

SEQ ID NO: 83152 - DNA, 25 bp, S. pombe
ctttctttccgttcgtctcaattat

SEQ ID NO: 83153 - DNA, 25 bp, S. pombe
ctttcccttggctttgcttgataaa

SEQ ID NO: 83154 - DNA, 25 bp, S. pombe
cttttctgcggccaaatgctttaaa

SEQ ID NO: 83155 - DNA, 25 bp, S. pombe
cttcccaatccatctctatttgaat

SEQ ID NO: 83156 - DNA, 25 bp, S. pombe
cttcccatctattcctcttataaat

SEQ ID NO: 83157 - DNA, 25 bp, S. pombe
cttcagtcccttgcttgtgcaaaat

SEQ ID NO: 83158 - DNA, 25 bp, S. pombe
gctacagctcatcagagtgccatga

SEQ ID NO: 83159 - DNA, 25 bp, S. pombe
ctttgcattcattcaaggctcttca

SEQ ID NO: 83160 - DNA, 25 bp, S. pombe
ctattttatcctttgatcctctacc

SEQ ID NO: 83161 - DNA, 25 bp, S. pombe
cttctcattatggttctaggcgtca

SEQ ID NO: 83162 - DNA, 25 bp, S. pombe
cttctcgttcgtggtttggatcaga

SEQ ID NO: 83163 - DNA, 25 bp, S. pombe
ctatccgagctggtggtttagccaa

SEQ ID NO: 83164 - DNA, 25 bp, S. pombe
cttctctgcaatctctggatactga

SEQ ID NO: 83165 - DNA, 25 bp, S. pombe
cttcttacgcttccatcaatgttga

SEQ ID NO: 83166 - DNA, 25 bp, S. pombe
ctcgctctagcgacggcataatttt

SEQ ID NO: 83167 - DNA, 25 bp, S. pombe
cttcaccgccagtacatatctatat

SEQ ID NO: 83168 - DNA, 25 bp, S. pombe
cttcgctacgcattacttcttatat

SEQ ID NO: 83169 - DNA, 25 bp, S. pombe
cttctgtattgtttgctgctcttaa

SEQ ID NO: 83170 - DNA, 25 bp, S. pombe
cttctgcttttatcctcttttacaa

SEQ ID NO: 83171 - DNA, 25 bp, S. pombe
ctttggtttaccgatctcacattac

SEQ ID NO: 83172 - DNA, 25 bp, S. pombe
ctatatttttagaccttccagctcc

SEQ ID NO: 83173 - DNA, 25 bp, S. pombe
ctatttacaatattttcttccgaag

SEQ ID NO: 83174 - DNA, 25 bp, S. pombe
ctagtgatccagttctttgcaagtc

SEQ ID NO: 83175 - DNA, 25 bp, S. pombe
ctattaactgtgactctccaggacc

SEQ ID NO: 83176 - DNA, 25 bp, S. pombe
ctcatttacaggagcaccgtcaatc

SEQ ID NO: 83177 - DNA, 25 bp, S. pombe
cttaatcagcctaaaccatccagtt

SEQ ID NO: 83178 - DNA, 25 bp, S. pombe
ctttgattcctaatacgcctacttt

SEQ ID NO: 83179 - DNA, 25 bp, S. pombe
ctttttgcagctatgggaacctttt

SEQ ID NO: 83180 - DNA, 25 bp, S. pombe
ctttttagcatcatcatgcgagatc

SEQ ID NO: 83181 - DNA, 25 bp, S. pombe
ctttcgaagcatatctcggtgcatt

SEQ ID NO: 83182 - DNA, 25 bp, S. pombe
cttcttgaatcagagcgtgaggcca

SEQ ID NO: 83183 - DNA, 25 bp, S. pombe
ctttaggattagtcgatagcggctc

SEQ ID NO: 83184 - DNA, 25 bp, S. pombe
ctttggagtcctacgattgctggta

SEQ ID NO: 83185 - DNA, 25 bp, S. pombe
gtaacgtttccgtgtctagcgatac

SEQ ID NO: 83186 - DNA, 25 bp, S. pombe
gctaagggtttaccggtcgcgcata

SEQ ID NO: 83187 - DNA, 25 bp, S. pombe
ctcaaaaattgtttctggatcgcga

SEQ ID NO: 83188 - DNA, 25 bp, S. pombe
ctacaaaatttcttgacttcaggtt

SEQ ID NO: 83189 - DNA, 25 bp, S. pombe
gcgaaatcaattgccggtttggtac

SEQ ID NO: 83190 - DNA, 25 bp, S. pombe
gctcaacgttgagattcgacgaggt

SEQ ID NO: 83191 - DNA, 25 bp, S. pombe
ctatagggcctattaagcgttctgt

SEQ ID NO: 83192 - DNA, 25 bp, S. pombe
ctgaaggttaacatcgaggctccac

SEQ ID NO: 83193 - DNA, 25 bp, S. pombe
ctaccagtttcctcttaatgcatgt

SEQ ID NO: 83194 - DNA, 25 bp, S. pombe
ctacggttagcggatcctgcaaatt

SEQ ID NO: 83195 - DNA, 25 bp, S. pombe
ctaaggctgaactcaagaaggctct

SEQ ID NO: 83196 - DNA, 25 bp, S. pombe
tccaaacgctaaccgaagaggcttt

SEQ ID NO: 83197 - DNA, 25 bp, S. pombe
ctacagaactgatgttgaaaccttt

SEQ ID NO: 83198 - DNA, 25 bp, S. pombe
ctagcgacagttcttttaccttttg

SEQ ID NO: 83199 - DNA, 25 bp, S. pombe
ctacgccagtgtctggtaaaactta

SEQ ID NO: 83200 - DNA, 25 bp, S. pombe
cttcagcccttgatcgtcgaaattg

SEQ ID NO: 83201 - DNA, 25 bp, S. pombe
cttctctccatagtatcttgcgatt

SEQ ID NO: 83202 - DNA, 25 bp, S. pombe
cttatttgcacgtttggtttctcac

SEQ ID NO: 83203 - DNA, 25 bp, S. pombe
cttcttctctgaatccggacttgaa

SEQ ID NO: 83204 - DNA, 25 bp, S. pombe
cttctatttcttccggagctgaaca

SEQ ID NO: 83205 - DNA, 25 bp, S. pombe
cttatgattctgatgacgccgatga

SEQ ID NO: 83206 - DNA, 25 bp, S. pombe
cggcacctacaagaatccacggaga

SEQ ID NO: 83207 - DNA, 25 bp, S. pombe
ctgccaacgcagtcggttacgggaa

SEQ ID NO: 83208 - DNA, 25 bp, S. pombe
ctgcgcagacggtggtgctaaccaa

SEQ ID NO: 83209 - DNA, 25 bp, S. pombe
ctcctgtgaaaaaattaatctttat

SEQ ID NO: 83210 - DNA, 25 bp, S. pombe
ctccgtctagttctccaaacagtga

SEQ ID NO: 83211 - DNA, 25 bp, S. pombe
ctctttggttgcatcaaattcggta

SEQ ID NO: 83212 - DNA, 25 bp, S. pombe
ctttttactgctcaacctgcggaaa

SEQ ID NO: 83213 - DNA, 25 bp, S. pombe
ctcttttactcacccagacgtatga

SEQ ID NO: 83214 - DNA, 25 bp, S. pombe
ctattttgacacctaatgacttgaa

SEQ ID NO: 83215 - DNA, 25 bp, S. pombe
cttttgatgatctactacgcaggga

SEQ ID NO: 83216 - DNA, 25 bp, S. pombe
ctcttgttgtcgctagtggtggatt

SEQ ID NO: 83217 - DNA, 25 bp, S. pombe
cttttgaacggaaatgggatgtgca

SEQ ID NO: 83218 - DNA, 25 bp, S. pombe
cttttggtcgttgtgatcgtgctca

SEQ ID NO: 83219 - DNA, 25 bp, S. pombe
ctttatgtatggtcttgtctcgcac

SEQ ID NO: 83220 - DNA, 25 bp, S. pombe
tctctactttggctaaccgacttga

SEQ ID NO: 83221 - DNA, 25 bp, S. pombe
ctttcactccgcacataatgggtat

SEQ ID NO: 83222 - DNA, 25 bp, S. pombe
ctttccgtcgtttcaatggtggtgt

SEQ ID NO: 83223 - DNA, 25 bp, S. pombe
ctatacccattgttcaccgagtggt

SEQ ID NO: 83224 - DNA, 25 bp, S. pombe
cttagccatcgtgtaatttccaacc

SEQ ID NO: 83225 - DNA, 25 bp, S. pombe
ctcattgcccggtatcaaattccaa

SEQ ID NO: 83226 - DNA, 25 bp, S. pombe
ctattacccttgtcgtcactaagaa

SEQ ID NO: 83227 - DNA, 25 bp, S. pombe
ctattccccatttttcgcaaataca

SEQ ID NO: 83228 - DNA, 25 bp, S. pombe
ctagtaatgcgcgtttggctcaatt

SEQ ID NO: 83229 - DNA, 25 bp, S. pombe
ctcccaagttggtctcatagtgaat

SEQ ID NO: 83230 - DNA, 25 bp, S. pombe
ctccgtcgttaacactggcaacaag

SEQ ID NO: 83231 - DNA, 25 bp, S. pombe
ctccgtcgttaacactggcaacaag

SEQ ID NO: 83232 - DNA, 25 bp, S. pombe
ctactgtcggtattgaagctgaatc

SEQ ID NO: 83233 - DNA, 25 bp, S. pombe
ctacaactgcaatactgacctctga

SEQ ID NO: 83234 - DNA, 25 bp, S. pombe
ctactgacgttaccgaggctcaagt

SEQ ID NO: 83235 - DNA, 25 bp, S. pombe
ctttatcgttttcatgatcatatag

SEQ ID NO: 83236 - DNA, 25 bp, S. pombe
ctttccgttcctaatgcatctaaca

SEQ ID NO: 83237 - DNA, 25 bp, S. pombe
cttttactcagttgtgcacctattc

SEQ ID NO: 83238 - DNA, 25 bp, S. pombe
cttactattcgttgtgtcccttata

SEQ ID NO: 83239 - DNA, 25 bp, S. pombe
cttagctatgtctttggtgccaata

SEQ ID NO: 83240 - DNA, 25 bp, S. pombe
ctagcatgcaatcttgtaggccgtt

SEQ ID NO: 83241 - DNA, 25 bp, S. pombe
ctagtgaatgactgtggccgttatt

SEQ ID NO: 83242 - DNA, 25 bp, S. pombe
ctcgggatagtattcgtcgtgcttt

SEQ ID NO: 83243 - DNA, 25 bp, S. pombe
ctatgggtttcatgctcgtgtgatt

SEQ ID NO: 83244 - DNA, 25 bp, S. pombe
ctgcattgcatgagtattccggaat

SEQ ID NO: 83245 - DNA, 25 bp, S. pombe
cttactactaagtcgtttgtctact

SEQ ID NO: 83246 - DNA, 25 bp, S. pombe
ctgtcctacttgttcttttgtactt

SEQ ID NO: 83247 - DNA, 25 bp, S. pombe
cttacttgtcaaatgcccttgatga

SEQ ID NO: 83248 - DNA, 25 bp, S. pombe
ctttcctgtagattcgccattcata

SEQ ID NO: 83249 - DNA, 25 bp, S. pombe
ctttgctggatatcgacctttgtca

SEQ ID NO: 83250 - DNA, 25 bp, S. pombe
ctttagcctcaaacggtatgcctta

SEQ ID NO: 83251 - DNA, 25 bp, S. pombe
cttattccctggaggttctcttgaa

SEQ ID NO: 83252 - DNA, 25 bp, S. pombe
cttattccctttaaatctcttctca

SEQ ID NO: 83253 - DNA, 25 bp, S. pombe
cttaccggcttacgaagtcttctat

SEQ ID NO: 83254 - DNA, 25 bp, S. pombe
cttatcccagccagtacaacttaat

SEQ ID NO: 83255 - DNA, 25 bp, S. pombe
ctttctccgacctttcaagcgaaat

SEQ ID NO: 83256 - DNA, 25 bp, S. pombe
ctttgcatgcttacctggaagccaa

SEQ ID NO: 83257 - DNA, 25 bp, S. pombe
ctttggtcttcgaagctatgctcaa

SEQ ID NO: 83258 - DNA, 25 bp, S. pombe
ctaattctcgagctaatcccagtaa

SEQ ID NO: 83259 - DNA, 25 bp, S. pombe
cttatcttcaagcattcatcccaat

SEQ ID NO: 83260 - DNA, 25 bp, S. pombe
cttatatctctacattctcagctca

SEQ ID NO: 83261 - DNA, 25 bp, S. pombe
ctatgctatctgtaaagctgttata

SEQ ID NO: 83262 - DNA, 25 bp, S. pombe
cttttgaacgatcattccgctggac

SEQ ID NO: 83263 - DNA, 25 bp, S. pombe
cttttggtcagatagctcgcatgct

SEQ ID NO: 83264 - DNA, 25 bp, S. pombe
cttttgggctgctacgatccagata

SEQ ID NO: 83265 - DNA, 25 bp, S. pombe
ctctcggtcctcttttgacgaaatt

SEQ ID NO: 83266 - DNA, 25 bp, S. pombe
ctatcggtcgttatttctggcagtt

SEQ ID NO: 83267 - DNA, 25 bp, S. pombe
ctatgtttctttggtttcttcggtg

SEQ ID NO: 83268 - DNA, 25 bp, S. pombe
ctaatagttccttaagcggcatcat

SEQ ID NO: 83269 - DNA, 25 bp, S. pombe
ctattcaaggtcatgttgccgggat

SEQ ID NO: 83270 - DNA, 25 bp, S. pombe
ctttacaaaactcatgcacgccgat

SEQ ID NO: 83271 - DNA, 25 bp, S. pombe
ctcacatcaagctagtctcgtctga

SEQ ID NO: 83272 - DNA, 25 bp, S. pombe
ctatttataataccctccgaacgag

SEQ ID NO: 83273 - DNA, 25 bp, S. pombe
ctattttgaattcccagaccagcct

SEQ ID NO: 83274 - DNA, 25 bp, S. pombe
cttttacatcaaacatcctcttctg

SEQ ID NO: 83275 - DNA, 25 bp, S. pombe
ctttttatcacaacagcacctctag

SEQ ID NO: 83276 - DNA, 25 bp, S. pombe
ctatgttttggttcgcttggacttg

SEQ ID NO: 83277 - DNA, 25 bp, S. pombe
ctttccttatggttggctctcttta

SEQ ID NO: 83278 - DNA, 25 bp, S. pombe
ctactacgttgggtgcttgttacta

SEQ ID NO: 83279 - DNA, 25 bp, S. pombe
ctcaggattgtcaagcttttttact

SEQ ID NO: 83280 - DNA, 25 bp, S. pombe
gtcaactttccgatttgcttacgtc

SEQ ID NO: 83281 - DNA, 25 bp, S. pombe
ctacgccttcacaacaattcatagc

SEQ ID NO: 83282 - DNA, 25 bp, S. pombe
ctttctcctgagaaggccatcttta

SEQ ID NO: 83283 - DNA, 25 bp, S. pombe
ctttccgtggtcttttcttgatcga

SEQ ID NO: 83284 - DNA, 25 bp, S. pombe
ctttgccgactattgttctgtcaga

SEQ ID NO: 83285 - DNA, 25 bp, S. pombe
ctttggctgtgcgttcaggacctaa

SEQ ID NO: 83286 - DNA, 25 bp, S. pombe
ctagcatgtttccttattgtcgcga

SEQ ID NO: 83287 - DNA, 25 bp, S. pombe
ctaccgttctttttatcagcagcac

SEQ ID NO: 83288 - DNA, 25 bp, S. pombe
gaacccacccttattgaattccaag

SEQ ID NO: 83289 - DNA, 25 bp, S. pombe
gctaccgactttatcactacgttta

SEQ ID NO: 83290 - DNA, 25 bp, S. pombe
ctacgacgcttatttcttttgaaca

SEQ ID NO: 83291 - DNA, 25 bp, S. pombe
ctacgtcctcgtcttttgatagaac

SEQ ID NO: 83292 - DNA, 25 bp, S. pombe
ctttgacaccctccttattgaagat

SEQ ID NO: 83293 - DNA, 25 bp, S. pombe
ctttccacgactacttggctgagga

SEQ ID NO: 83294 - DNA, 25 bp, S. pombe
ctattcgctgcttttcttgtggaaa

SEQ ID NO: 83295 - DNA, 25 bp, S. pombe
ctttatctcgtgatgttgctgcgga

SEQ ID NO: 83296 - DNA, 25 bp, S. pombe
ctttatatcgtgtctgtcttcggca

SEQ ID NO: 83297 - DNA, 25 bp, S. pombe
ctaaatgttgatccgcgtattgccg

SEQ ID NO: 83298 - DNA, 25 bp, S. pombe
gtagacgatttgtccgtcgtaccta

SEQ ID NO: 83299 - DNA, 25 bp, S. pombe
ctataatcaattacgtgcacgctat

SEQ ID NO: 83300 - DNA, 25 bp, S. pombe
ctattccagaatacaggcaagctat

SEQ ID NO: 83301 - DNA, 25 bp, S. pombe
ctcattcgacactacatggcggtta

SEQ ID NO: 83302 - DNA, 25 bp, S. pombe
ctatggtgtccttcgttatgttatg

SEQ ID NO: 83303 - DNA, 25 bp, S. pombe
ctaggtatttgatgctttgcttaca

SEQ ID NO: 83304 - DNA, 25 bp, S. pombe
ctataatggttgtcgctctttctgc

SEQ ID NO: 83305 - DNA, 25 bp, S. pombe
ctagaaatttccctcatcttcgttt

SEQ ID NO: 83306 - DNA, 25 bp, S. pombe
ctaaactcttccttcgttcattgat

SEQ ID NO: 83307 - DNA, 25 bp, S. pombe
ctatcgagtcctttgtcgtttgtga

SEQ ID NO: 83308 - DNA, 25 bp, S. pombe
ctacgggcagttgatcggatttacc

SEQ ID NO: 83309 - DNA, 25 bp, S. pombe
ctaacttcaaatacattcctctcac

SEQ ID NO: 83310 - DNA, 25 bp, S. pombe
ctagctggcctttgcggtgaatatt

SEQ ID NO: 83311 - DNA, 25 bp, S. pombe
ctatgcgtgctgtgtcgggaaatat

SEQ ID NO: 83312 - DNA, 25 bp, S. pombe
cgatcgtcggtttttcagtcattta

SEQ ID NO: 83313 - DNA, 25 bp, S. pombe
gcgtaggtggtatcttcgttttaag

SEQ ID NO: 83314 - DNA, 25 bp, S. pombe
cgtttgggtgaatgccgttcgtcaa

SEQ ID NO: 83315 - DNA, 25 bp, S. pombe
cggttaaatggatgccgggctctaa

SEQ ID NO: 83316 - DNA, 25 bp, S. pombe
cgtgttaatacgataggcggcctaa

SEQ ID NO: 83317 - DNA, 25 bp, S. pombe
ctcaatactaaaaacactcctccta

SEQ ID NO: 83318 - DNA, 25 bp, S. pombe
gctctgaatcaaaaccaacgccgtc

SEQ ID NO: 83319 - DNA, 25 bp, S. pombe
ctctttattggagatcgcctgttaa

SEQ ID NO: 83320 - DNA, 25 bp, S. pombe
ctttgccattagatatcgacgctcc

SEQ ID NO: 83321 - DNA, 25 bp, S. pombe
ctttgttctatagtgcatcgctcgc

SEQ ID NO: 83322 - DNA, 25 bp, S. pombe
ctttgtctgagattttgcctggcat

SEQ ID NO: 83323 - DNA, 25 bp, S. pombe
ctttgtcttatgtatcgcctgatgc

SEQ ID NO: 83324 - DNA, 25 bp, S. pombe
ctttcgacctctatatgtatcccaa

SEQ ID NO: 83325 - DNA, 25 bp, S. pombe
ctttctttactcctttcatcacaaa

SEQ ID NO: 83326 - DNA, 25 bp, S. pombe
ctttctccatcgactaggtatcatc

SEQ ID NO: 83327 - DNA, 25 bp, S. pombe
ctacttgttcattttggctttcggc

SEQ ID NO: 83328 - DNA, 25 bp, S. pombe
ctggtggtaaggctcctcgtaagca

SEQ ID NO: 83329 - DNA, 25 bp, S. pombe
ctactttggtggctcccattggaga

SEQ ID NO: 83330 - DNA, 25 bp, S. pombe
ctaccttgttagctccattgggata

SEQ ID NO: 83331 - DNA, 25 bp, S. pombe
cgagacttcttaattccggtcgaat

SEQ ID NO: 83332 - DNA, 25 bp, S. pombe
ctatttcgtctattcctggtttatc

SEQ ID NO: 83333 - DNA, 25 bp, S. pombe
ctatttctttgattcgctcgttgtt

SEQ ID NO: 83334 - DNA, 25 bp, S. pombe
ctatttctttgttccattgctgtgt

SEQ ID NO: 83335 - DNA, 25 bp, S. pombe
ctcaatttccaaccgattatcctgt

SEQ ID NO: 83336 - DNA, 25 bp, S. pombe
ctcacttctcctactgcaaaacgga

SEQ ID NO: 83337 - DNA, 25 bp, S. pombe
ctatcttccgctcacaacataatgg

SEQ ID NO: 83338 - DNA, 25 bp, S. pombe
ctcagagtccagttggcgtgccaaa

SEQ ID NO: 83339 - DNA, 25 bp, S. pombe
ctagtcccctagattacacagcgaa

SEQ ID NO: 83340 - DNA, 25 bp, S. pombe
ctaacgctgcattattttaccggcc

SEQ ID NO: 83341 - DNA, 25 bp, S. pombe
ctcagaagaccgttgcacttggcaa

SEQ ID NO: 83342 - DNA, 25 bp, S. pombe
ctcaaagacgctttagctgctgttg

SEQ ID NO: 83343 - DNA, 25 bp, S. pombe
ctatcgctttccgaagttggtcaaa

SEQ ID NO: 83344 - DNA, 25 bp, S. pombe
ctatgctcctctctcaagttttaaa

SEQ ID NO: 83345 - DNA, 25 bp, S. pombe
ctttgtccttcgcacacttgataaa

SEQ ID NO: 83346 - DNA, 25 bp, S. pombe
ctattcctctactttgacgctataa

SEQ ID NO: 83347 - DNA, 25 bp, S. pombe
ctaatgcttgggttgctgtcggtat

SEQ ID NO: 83348 - DNA, 25 bp, S. pombe
cgaactcatggtgggctttggctac

SEQ ID NO: 83349 - DNA, 25 bp, S. pombe
ctatacttggtcgatgcttggcagc

SEQ ID NO: 83350 - DNA, 25 bp, S. pombe
ctaattgccggaattgcgtctcaac

SEQ ID NO: 83351 - DNA, 25 bp, S. pombe
ctccttgccgttattatcgaaccat

SEQ ID NO: 83352 - DNA, 25 bp, S. pombe
ctccttgactacttacttcgaagcg

SEQ ID NO: 83353 - DNA, 25 bp, S. pombe
ctttgttccagctagtaatgccaga

SEQ ID NO: 83354 - DNA, 25 bp, S. pombe
ctcttcttcctcttgtatatcggat

SEQ ID NO: 83355 - DNA, 25 bp, S. pombe
ctttgctttgctggtggtattggta

SEQ ID NO: 83356 - DNA, 25 bp, S. pombe
ctcgagttatgtgctgttttgtatc

SEQ ID NO: 83357 - DNA, 25 bp, S. pombe
ctcagctattcaaccattacgcgta

SEQ ID NO: 83358 - DNA, 25 bp, S. pombe
ctacactccatacacatacatcgtt

SEQ ID NO: 83359 - DNA, 25 bp, S. pombe
ctaccttgctatggcctcaatttaa

SEQ ID NO: 83360 - DNA, 25 bp, S. pombe
ctaccgcttattgcctactatacat

SEQ ID NO: 83361 - DNA, 25 bp, S. pombe
ctatcacgctcttctacttttaaaa

SEQ ID NO: 83362 - DNA, 25 bp, S. pombe
ctactacctcttattcttacacgaa

SEQ ID NO: 83363 - DNA, 25 bp, S. pombe
gcctaatagttctgttaatccccgc

SEQ ID NO: 83364 - DNA, 25 bp, S. pombe
gcttaaagatcctgtccaaacctac

SEQ ID NO: 83365 - DNA, 25 bp, S. pombe
ctatgcgttgtgtggctgcagtgca

SEQ ID NO: 83366 - DNA, 25 bp, S. pombe
ctagtgctctgcttttgtcattgat

SEQ ID NO: 83367 - DNA, 25 bp, S. pombe
ctagttcgctattctgccagtggag

SEQ ID NO: 83368 - DNA, 25 bp, S. pombe
ctctgtttcgcttcgcaagtggaat

SEQ ID NO: 83369 - DNA, 25 bp, S. pombe
ctgcctgtccgttcgaagatacttg

SEQ ID NO: 83370 - DNA, 25 bp, S. pombe
ctatcgaaaccatcggcacttttga

SEQ ID NO: 83371 - DNA, 25 bp, S. pombe
ctatcacaggtgttgtttgctgggt

SEQ ID NO: 83372 - DNA, 25 bp, S. pombe
ctactgctggtactttcacaactac

SEQ ID NO: 83373 - DNA, 25 bp, S. pombe
ctatccgcgctactttcaagttgat

SEQ ID NO: 83374 - DNA, 25 bp, S. pombe
ctatgcgggctactatacaggttta

SEQ ID NO: 83375 - DNA, 25 bp, S. pombe
ctagcagttgccttcttgggcgaaa

SEQ ID NO: 83376 - DNA, 25 bp, S. pombe
cgatcactggactcattctctaaga

SEQ ID NO: 83377 - DNA, 25 bp, S. pombe
ctaactgctggtacactgggtggaa

SEQ ID NO: 83378 - DNA, 25 bp, S. pombe
ctatttgcttctattgcggtggaca

SEQ ID NO: 83379 - DNA, 25 bp, S. pombe
ctattgatttggcttcttctaacga

SEQ ID NO: 83380 - DNA, 25 bp, S. pombe
ctatatgcttttcactctcttctaa

SEQ ID NO: 83381 - DNA, 25 bp, S. pombe
ctatctcacactccttcaagaggat

SEQ ID NO: 83382 - DNA, 25 bp, S. pombe
ctaccacatcttactcggacgagaa

SEQ ID NO: 83383 - DNA, 25 bp, S. pombe
ctacccactcttacgttgcgaaaat

SEQ ID NO: 83384 - DNA, 25 bp, S. pombe
ctgttgttacagcttgttggtacct

SEQ ID NO: 83385 - DNA, 25 bp, S. pombe
ctgtttttcgtcatttggctatctt

SEQ ID NO: 83386 - DNA, 25 bp, S. pombe
ctcattatggtcagttacgctttta

SEQ ID NO: 83387 - DNA, 25 bp, S. pombe
ctcatttgggtcgttatggtgctca

SEQ ID NO: 83388 - DNA, 25 bp, S. pombe
ctatgctgctcgttggattgccaaa

SEQ ID NO: 83389 - DNA, 25 bp, S. pombe
ctactgtcaacgacttgttctctga

SEQ ID NO: 83390 - DNA, 25 bp, S. pombe
ctagcactgctacgaaggtttctga

SEQ ID NO: 83391 - DNA, 25 bp, S. pombe
ctagccttagctacagtggtaccat

SEQ ID NO: 83392 - DNA, 25 bp, S. pombe
ctagctcttcgcttagtagcatacc

SEQ ID NO: 83393 - DNA, 25 bp, S. pombe
ctagtgctttccctgatgacatgaa

SEQ ID NO: 83394 - DNA, 25 bp, S. pombe
ctagtcgtactcctgcattcgaaaa

SEQ ID NO: 83395 - DNA, 25 bp, S. pombe
ctcctcgtattcgtgcagttacaat

SEQ ID NO: 83396 - DNA, 25 bp, S. pombe
ctcatttgtattgtgcgtgccgaca

SEQ ID NO: 83397 - DNA, 25 bp, S. pombe
ctacttcagctgttcaccaattttg

SEQ ID NO: 83398 - DNA, 25 bp, S. pombe
ctgattatgggtcggtcaagcgtaa

SEQ ID NO: 83399 - DNA, 25 bp, S. pombe
ctgaatacggcctccaagctgaaaa

SEQ ID NO: 83400 - DNA, 25 bp, S. pombe
ctgccatgactactcgtggattcaa

SEQ ID NO: 83401 - DNA, 25 bp, S. pombe
ctaagcctggaagcggttctatcga

SEQ ID NO: 83402 - DNA, 25 bp, S. pombe
ctcaaggctctttcgatccaaattc

SEQ ID NO: 83403 - DNA, 25 bp, S. pombe
ctagcgccaattccgcactaatgga

SEQ ID NO: 83404 - DNA, 25 bp, S. pombe
ctatatcgctcttccgttcaagaaa

SEQ ID NO: 83405 - DNA, 25 bp, S. pombe
ctaaacatgtagctaaaacgattgc

SEQ ID NO: 83406 - DNA, 25 bp, S. pombe
ctactcgttatgctcttgaactcga

SEQ ID NO: 83407 - DNA, 25 bp, S. pombe
ctactcgtccacctactgaaataat

SEQ ID NO: 83408 - DNA, 25 bp, S. pombe
ctcgtggtcgcccaaagcgtaatat

SEQ ID NO: 83409 - DNA, 25 bp, S. pombe
ctatgggtgctaagcgcattgccaa

SEQ ID NO: 83410 - DNA, 25 bp, S. pombe
ctatggagcagcgacttgactcaat

SEQ ID NO: 83411 - DNA, 25 bp, S. pombe
ctaggactatccaaactgctcgaca

SEQ ID NO: 83412 - DNA, 25 bp, S. pombe
ctcgaacgctcctaaatctctggaa

SEQ ID NO: 83413 - DNA, 25 bp, S. pombe
ctaggccagttcttgttagacgcaa

SEQ ID NO: 83414 - DNA, 25 bp, S. pombe
ctagccccattcttgtttacaggtg

SEQ ID NO: 83415 - DNA, 25 bp, S. pombe
ctactcccatgtctgtttacagtac

SEQ ID NO: 83416 - DNA, 25 bp, S. pombe
ctatcttatcggctcattctttaca

SEQ ID NO: 83417 - DNA, 25 bp, S. pombe
ctactattcacgctttttaccaaca

SEQ ID NO: 83418 - DNA, 25 bp, S. pombe
ctacaattctcccttttatcagcaa

SEQ ID NO: 83419 - DNA, 25 bp, S. pombe
ctaagtttacccaatccagagagaa

SEQ ID NO: 83420 - DNA, 25 bp, S. pombe
ctacgttttcccaccatgagtatta

SEQ ID NO: 83421 - DNA, 25 bp, S. pombe
ctacgtttctcgcagagctgaggaa

SEQ ID NO: 83422 - DNA, 25 bp, S. pombe
ctactgatgtctttggcgctctaaa

SEQ ID NO: 83423 - DNA, 25 bp, S. pombe
ctactgcacttaccggactaggatt

SEQ ID NO: 83424 - DNA, 25 bp, S. pombe
ctacgtaccaagaccagcgcatatt

SEQ ID NO: 83425 - DNA, 25 bp, S. pombe
ctgacgaagcatttacctccttata

SEQ ID NO: 83426 - DNA, 25 bp, S. pombe
ctgcaaaacatagtccccaggttgt

SEQ ID NO: 83427 - DNA, 25 bp, S. pombe
ctgtaccgaatgttcctctagtggg

SEQ ID NO: 83428 - DNA, 25 bp, S. pombe
ctcttcctcaatcaatcgttttttc

SEQ ID NO: 83429 - DNA, 25 bp, S. pombe
ctctacgcatttactgaccagactt

SEQ ID NO: 83430 - DNA, 25 bp, S. pombe
ctaccagcttcttctactcaaaaaa

SEQ ID NO: 83431 - DNA, 25 bp, S. pombe
cggcgttttcgaagaagacatgctt

SEQ ID NO: 83432 - DNA, 25 bp, S. pombe
ctggcgttagtaccgatagcttctt

SEQ ID NO: 83433 - DNA, 25 bp, S. pombe
ctccttaatcgatctcaagtccatt

SEQ ID NO: 83434 - DNA, 25 bp, S. pombe
ctcttttactgatttggagcccaaa

SEQ ID NO: 83435 - DNA, 25 bp, S. pombe
ctacttatgtgggtcttggctttat

SEQ ID NO: 83436 - DNA, 25 bp, S. pombe
ctcatttggaggacaggcttgcaga

SEQ ID NO: 83437 - DNA, 25 bp, S. pombe
ctctcttggctgcatgctacattag

SEQ ID NO: 83438 - DNA, 25 bp, S. pombe
ctctctcagtgcttttaccaaggac

SEQ ID NO: 83439 - DNA, 25 bp, S. pombe
ctacccaccatgacagttgatgagt

SEQ ID NO: 83440 - DNA, 25 bp, S. pombe
ctcattcgacctccaatctagaagt

SEQ ID NO: 83441 - DNA, 25 bp, S. pombe
ctcattcccttcaccatgataagtt

SEQ ID NO: 83442 - DNA, 25 bp, S. pombe
ctagcgctcgttttcgcatcaagaa

SEQ ID NO: 83443 - DNA, 25 bp, S. pombe
ctcatggcttgagtggtccgacaaa

SEQ ID NO: 83444 - DNA, 25 bp, S. pombe
ctctggtggtctggtctacgaatat

SEQ ID NO: 83445 - DNA, 25 bp, S. pombe
ctgctcgagcgaaaaatccggattt

SEQ ID NO: 83446 - DNA, 25 bp, S. pombe
ctctcgccgctattacagcagatga

SEQ ID NO: 83447 - DNA, 25 bp, S. pombe
ctaatcaaatattctgccgcagctc

SEQ ID NO: 83448 - DNA, 25 bp, S. pombe
ctaccttgattgttatgacctcgaa

SEQ ID NO: 83449 - DNA, 25 bp, S. pombe
ctactccgtttgctgagtgtccaaa

SEQ ID NO: 83450 - DNA, 25 bp, S. pombe
ctaccttgtgtttgtggttgaccga

SEQ ID NO: 83451 - DNA, 25 bp, S. pombe
ctctcgctggatactctttggatac

SEQ ID NO: 83452 - DNA, 25 bp, S. pombe
ccgactatctttcattggcaagccg

SEQ ID NO: 83453 - DNA, 25 bp, S. pombe
ctcgggatgcctttgacgttttata

SEQ ID NO: 83454 - DNA, 25 bp, S. pombe
ctccggatttttcactttctcaagt

SEQ ID NO: 83455 - DNA, 25 bp, S. pombe
ctagcaggtttgtttggtatttcca

SEQ ID NO: 83456 - DNA, 25 bp, S. pombe
ctccggcaatccactaatatttcac

SEQ ID NO: 83457 - DNA, 25 bp, S. pombe
ctcgggtggctacctggtcaaagca

SEQ ID NO: 83458 - DNA, 25 bp, S. pombe
gccgaccgaccagttcgttgagaga

SEQ ID NO: 83459 - DNA, 25 bp, S. pombe
gtccgggaccacatttgcgtaaaat

SEQ ID NO: 83460 - DNA, 25 bp, S. pombe
ctctgatgccccttcaagaattgga

SEQ ID NO: 83461 - DNA, 25 bp, S. pombe
ctcctggtgatcctgatgcatttga

SEQ ID NO: 83462 - DNA, 25 bp, S. pombe
ctacggactgcacctcatgttaaag

SEQ ID NO: 83463 - DNA, 25 bp, S. pombe
ctaagcctttgacggttgacagact

SEQ ID NO: 83464 - DNA, 25 bp, S. pombe
ctaagactttagagccatcacctgt

SEQ ID NO: 83465 - DNA, 25 bp, S. pombe
ctcatagaaggtttcacttcccctt

SEQ ID NO: 83466 - DNA, 25 bp, S. pombe
gttaacggatttgttcgtcctggca

SEQ ID NO: 83467 - DNA, 25 bp, S. pombe
ctctcctcaattgggtccgtcaaaa

SEQ ID NO: 83468 - DNA, 25 bp, S. pombe
ctcgttataccccttcaagaagcta

SEQ ID NO: 83469 - DNA, 25 bp, S. pombe
ctgcgttcataccagccaggaaaat

SEQ ID NO: 83470 - DNA, 25 bp, S. pombe
ctctgtggcctctttggatagatac

SEQ ID NO: 83471 - DNA, 25 bp, S. pombe
ctctgttcagcttcctatctataat

SEQ ID NO: 83472 - DNA, 25 bp, S. pombe
ctctttactccctctgaatttttga

SEQ ID NO: 83473 - DNA, 25 bp, S. pombe
ctactatcccgcaactatcaattat

SEQ ID NO: 83474 - DNA, 25 bp, S. pombe
ctcactactccttcagctttattat

SEQ ID NO: 83475 - DNA, 25 bp, S. pombe
ctctatactcctccatgaattgcaa

SEQ ID NO: 83476 - DNA, 25 bp, S. pombe
ctctgccgaatccaaggttttctac

SEQ ID NO: 83477 - DNA, 25 bp, S. pombe
cgcccgacatcgacttgtttatgga

SEQ ID NO: 83478 - DNA, 25 bp, S. pombe
ctgctcgcggcaagaacgttttgga

SEQ ID NO: 83479 - DNA, 25 bp, S. pombe
ctgctcctgggattgacgtgtattc

SEQ ID NO: 83480 - DNA, 25 bp, S. pombe
ctgctcactgggtttattcggacga

SEQ ID NO: 83481 - DNA, 25 bp, S. pombe
ctcgtagccgtggtgtttctttaag

SEQ ID NO: 83482 - DNA, 25 bp, S. pombe
ctcgtatcggtgtggttggtcccaa

SEQ ID NO: 83483 - DNA, 25 bp, S. pombe
ctctatagccttttagtcggtctac

SEQ ID NO: 83484 - DNA, 25 bp, S. pombe
ctccccaaggagatactgctggatt

SEQ ID NO: 83485 - DNA, 25 bp, S. pombe
ctagcgatggttgagtttgcggaat

SEQ ID NO: 83486 - DNA, 25 bp, S. pombe
ctcatggcaatgacggtggtaccct

SEQ ID NO: 83487 - DNA, 25 bp, S. pombe
ctgatcgttccggtttagcaactaa

SEQ ID NO: 83488 - DNA, 25 bp, S. pombe
ctgccttgtccgagactggtattaa

SEQ ID NO: 83489 - DNA, 25 bp, S. pombe
ctacttactgccctgacgaggttaa

SEQ ID NO: 83490 - DNA, 25 bp, S. pombe
ctgatgcggcactcgtaaacctaga

SEQ ID NO: 83491 - DNA, 25 bp, S. pombe
ctagccagccgttgtctaacttaga

SEQ ID NO: 83492 - DNA, 25 bp, S. pombe
gctcctaagccagtcacagaacggg

SEQ ID NO: 83493 - DNA, 25 bp, S. pombe
ctacgcagtatattccagcttgtga

SEQ ID NO: 83494 - DNA, 25 bp, S. pombe
ctacacagattatcccattcacaac

SEQ ID NO: 83495 - DNA, 25 bp, S. pombe
ctgcaggagattttcgccaagctaa

SEQ ID NO: 83496 - DNA, 25 bp, S. pombe
ctctccataatgaacggtcgccaat

SEQ ID NO: 83497 - DNA, 25 bp, S. pombe
ctgaatattttgatgctcttacccc

SEQ ID NO: 83498 - DNA, 25 bp, S. pombe
tctgccaccggtaactttggttttg

SEQ ID NO: 83499 - DNA, 25 bp, S. pombe
ctacagtgtctcctttgttgcctaa

SEQ ID NO: 83500 - DNA, 25 bp, S. pombe
ctacgatcctttacacctacagaaa

SEQ ID NO: 83501 - DNA, 25 bp, S. pombe
ctacctccggtgaagcagttacaaa

SEQ ID NO: 83502 - DNA, 25 bp, S. pombe
ctcaacccctcttgacattgttaaa

SEQ ID NO: 83503 - DNA, 25 bp, S. pombe
ctcactgcaatcctctaactattta

SEQ ID NO: 83504 - DNA, 25 bp, S. pombe
ctgaggctagcttgtcgtaattgtg

SEQ ID NO: 83505 - DNA, 25 bp, S. pombe
ctcattgccgagattcttgtcgaac

SEQ ID NO: 83506 - DNA, 25 bp, S. pombe
ctcatttgtggaattgttttgcctc

SEQ ID NO: 83507 - DNA, 25 bp, S. pombe
ctaatgttggtcatgcttgctgtac

SEQ ID NO: 83508 - DNA, 25 bp, S. pombe
ctactgattttacgttctgaagcat

SEQ ID NO: 83509 - DNA, 25 bp, S. pombe
ctacgatattgtaagttctgtctat

SEQ ID NO: 83510 - DNA, 25 bp, S. pombe
ctctcgacttgtacacgttgatcat

SEQ ID NO: 83511 - DNA, 25 bp, S. pombe
ctccgtaagtatatctatggtggtc

SEQ ID NO: 83512 - DNA, 25 bp, S. pombe
ctctcctaagttgcttggtgtttca

SEQ ID NO: 83513 - DNA, 25 bp, S. pombe
ctcccggtttttgcaattctgatga

SEQ ID NO: 83514 - DNA, 25 bp, S. pombe
ctccctcttatgctagctactttaa

SEQ ID NO: 83515 - DNA, 25 bp, S. pombe
ctcgcgccttgggtgactacaaaga

SEQ ID NO: 83516 - DNA, 25 bp, S. pombe
ctcaggctcatttccacacttaaaa

SEQ ID NO: 83517 - DNA, 25 bp, S. pombe
ctgaccctaacgtctcttatagaga

SEQ ID NO: 83518 - DNA, 25 bp, S. pombe
ctcacctccaaacacattgcataaa

SEQ ID NO: 83519 - DNA, 25 bp, S. pombe
ctgctcctaaacctacttgtgtgaa

SEQ ID NO: 83520 - DNA, 25 bp, S. pombe
ctctctttgagggttctgatgctgg

SEQ ID NO: 83521 - DNA, 25 bp, S. pombe
ctccaggttgaagcccgtaattaag

SEQ ID NO: 83522 - DNA, 25 bp, S. pombe
cccagaattatctcccctatttgaa

SEQ ID NO: 83523 - DNA, 25 bp, S. pombe
cccaagatttcctcacatcgtattg

SEQ ID NO: 83524 - DNA, 25 bp, S. pombe
ctctcacagttttaccaacctttgg

SEQ ID NO: 83525 - DNA, 25 bp, S. pombe
ctctccgtctgcttcaaaagtttgt

SEQ ID NO: 83526 - DNA, 25 bp, S. pombe
ctctacgagtgcagccaatggttct

SEQ ID NO: 83527 - DNA, 25 bp, S. pombe
ctctaatttgctccctacttattta

SEQ ID NO: 83528 - DNA, 25 bp, S. pombe
ctcaacttttccgtcttctattatg

SEQ ID NO: 83529 - DNA, 25 bp, S. pombe
gttccttttactgctttcaatggtg

SEQ ID NO: 83530 - DNA, 25 bp, S. pombe
ctccacgtagtgttacagttaccgg

SEQ ID NO: 83531 - DNA, 25 bp, S. pombe
ctgaggtccaatctgtttttacaca

SEQ ID NO: 83532 - DNA, 25 bp, S. pombe
ctcactgtccgtttgtatttttgca

SEQ ID NO: 83533 - DNA, 25 bp, S. pombe
ctacggctcatttcgtttctactga

SEQ ID NO: 83534 - DNA, 25 bp, S. pombe
ctactcatctttccgttatcgacaa

SEQ ID NO: 83535 - DNA, 25 bp, S. pombe
ctaatccttgctctcctgatgaaaa

SEQ ID NO: 83536 - DNA, 25 bp, S. pombe
ctcacagctgttgactatcggcaaa

SEQ ID NO: 83537 - DNA, 25 bp, S. pombe
ctactgtatttcttctcttcttcaa

SEQ ID NO: 83538 - DNA, 25 bp, S. pombe
ctacttttcatgtttctcacctaga

SEQ ID NO: 83539 - DNA, 25 bp, S. pombe
ctactacattgctttgtcccattac

SEQ ID NO: 83540 - DNA, 25 bp, S. pombe
cgttgttttcgtctcaggatggtga

SEQ ID NO: 83541 - DNA, 25 bp, S. pombe
ctgccactttattgaacgtcgttcc

SEQ ID NO: 83542 - DNA, 25 bp, S. pombe
ctgcaccattagtaacaccatcgtt

SEQ ID NO: 83543 - DNA, 25 bp, S. pombe
ctgctgccaacaccattcaaaattt

SEQ ID NO: 83544 - DNA, 25 bp, S. pombe
ctcttccacctgaaagtcgctataa

SEQ ID NO: 83545 - DNA, 25 bp, S. pombe
ctcttcctatttcaactccttatgg

SEQ ID NO: 83546 - DNA, 25 bp, S. pombe
ctgctcacgtatctcattcgattga

SEQ ID NO: 83547 - DNA, 25 bp, S. pombe
ctctactgttcctagtccaagatca

SEQ ID NO: 83548 - DNA, 25 bp, S. pombe
ctccctcttccatgtcttgaaaaaa

SEQ ID NO: 83549 - DNA, 25 bp, S. pombe
ctcccgtcctctttgcatggaaaaa

SEQ ID NO: 83550 - DNA, 25 bp, S. pombe
ctctcgctcgactttatactaggta

SEQ ID NO: 83551 - DNA, 25 bp, S. pombe
ctcgttctagagcttcatcagtatc

SEQ ID NO: 83552 - DNA, 25 bp, S. pombe
ctcccttgaggcgtacgttgcaaac

SEQ ID NO: 83553 - DNA, 25 bp, S. pombe
ctcctcctgagtctactgttgaaat

SEQ ID NO: 83554 - DNA, 25 bp, S. pombe
ctcgattacccgtcggtagaggcaa

SEQ ID NO: 83555 - DNA, 25 bp, S. pombe
ctcgttactcgtttgggtggtgaat

SEQ ID NO: 83556 - DNA, 25 bp, S. pombe
ctcgctatggctgtttgtttgttgt

SEQ ID NO: 83557 - DNA, 25 bp, S. pombe
ctgttcctcctatcaattctaatgc

SEQ ID NO: 83558 - DNA, 25 bp, S. pombe
ctgtttctccagtatcgtccaagaa

SEQ ID NO: 83559 - DNA, 25 bp, S. pombe
ctgctcattgaagctggcgtcgaat

SEQ ID NO: 83560 - DNA, 25 bp, S. pombe
ctgagttcattgttgccgatgtcga

SEQ ID NO: 83561 - DNA, 25 bp, S. pombe
cgaatcgtaatttagcaaccgctca

SEQ ID NO: 83562 - DNA, 25 bp, S. pombe
ctacatctgcttattacaatccacc

SEQ ID NO: 83563 - DNA, 25 bp, S. pombe
ctcactcttccctatctaattttaa

SEQ ID NO: 83564 - DNA, 25 bp, S. pombe
ctcacgatttccgtctaattggtca

SEQ ID NO: 83565 - DNA, 25 bp, S. pombe
ccacaatgcttcctactgaacggga

SEQ ID NO: 83566 - DNA, 25 bp, S. pombe
ctgctcaacctcctagtaaacttga

SEQ ID NO: 83567 - DNA, 25 bp, S. pombe
ctaacaactctgtactcatcacttg

SEQ ID NO: 83568 - DNA, 25 bp, S. pombe
ctcaccaactctggccatgaatatt

SEQ ID NO: 83569 - DNA, 25 bp, S. pombe
ctcttcttgatcctgtagacgctaa

SEQ ID NO: 83570 - DNA, 25 bp, S. pombe
ctgctgggcttatggtggctcaaaa

SEQ ID NO: 83571 - DNA, 25 bp, S. pombe
ctcattactctattgcctgcttaaa

SEQ ID NO: 83572 - DNA, 25 bp, S. pombe
ctgagtcatctttgagctcgtcaac

SEQ ID NO: 83573 - DNA, 25 bp, S. pombe
ctctggatgcgagcttctagtgcaa

SEQ ID NO: 83574 - DNA, 25 bp, S. pombe
ctcgtcattaccttctgctgagaat

SEQ ID NO: 83575 - DNA, 25 bp, S. pombe
ctcgctttcatcacataggcaatat

SEQ ID NO: 83576 - DNA, 25 bp, S. pombe
ctgacatttactctactgccatttt

SEQ ID NO: 83577 - DNA, 25 bp, S. pombe
ctaatctccactatatctgctactt

SEQ ID NO: 83578 - DNA, 25 bp, S. pombe
ctcacattggtacgcttttcgaatc

SEQ ID NO: 83579 - DNA, 25 bp, S. pombe
ctccttcctacctttatcgtattat

SEQ ID NO: 83580 - DNA, 25 bp, S. pombe
ctcgacttcttgactctctattgat

SEQ ID NO: 83581 - DNA, 25 bp, S. pombe
ctcgattttctagcgcatttcatac

SEQ ID NO: 83582 - DNA, 25 bp, S. pombe
ctccattcactgcaccgttattaga

SEQ ID NO: 83583 - DNA, 25 bp, S. pombe
ctctttatggcgacgtgtttggtaa

SEQ ID NO: 83584 - DNA, 25 bp, S. pombe
ctctttgttcgtggtgattcggtta

SEQ ID NO: 83585 - DNA, 25 bp, S. pombe
ctctcattatctgtgggttcgtcat

SEQ ID NO: 83586 - DNA, 25 bp, S. pombe
ctcacattacactttgttctcctga

SEQ ID NO: 83587 - DNA, 25 bp, S. pombe
ctcatcttcagctgttgtaccgata

SEQ ID NO: 83588 - DNA, 25 bp, S. pombe
ctcccatctttggtggacacagcaa

SEQ ID NO: 83589 - DNA, 25 bp, S. pombe
ctcttctctctatggcaaacgctaa

SEQ ID NO: 83590 - DNA, 25 bp, S. pombe
ctgttctcgtgatggactgggcatt

SEQ ID NO: 83591 - DNA, 25 bp, S. pombe
ctgtcccctataccgcaagttatgt

SEQ ID NO: 83592 - DNA, 25 bp, S. pombe
ctcaagcctcaatcaccaattttta

SEQ ID NO: 83593 - DNA, 25 bp, S. pombe
ctcaacctcataccatccatattaa

SEQ ID NO: 83594 - DNA, 25 bp, S. pombe
ctcgatgccgctactattctatata

SEQ ID NO: 83595 - DNA, 25 bp, S. pombe
ctcgccgtgctatcaatgtgcttaa

SEQ ID NO: 83596 - DNA, 25 bp, S. pombe
gttgggtaccactgaattagcctct

SEQ ID NO: 83597 - DNA, 25 bp, S. pombe
ctgttacggttggtgggatctctca

SEQ ID NO: 83598 - DNA, 25 bp, S. pombe
ctcttccgcgtctggtgatgagtag

SEQ ID NO: 83599 - DNA, 25 bp, S. pombe
ctcctactagatttgcatgggtgaa

SEQ ID NO: 83600 - DNA, 25 bp, S. pombe
ctcgtactactgttgctgctggtaa

SEQ ID NO: 83601 - DNA, 25 bp, S. pombe
ctgctattgaggcccttcgtcgttg

SEQ ID NO: 83602 - DNA, 25 bp, S. pombe
ctgccattgaagcccttcgccgttg

SEQ ID NO: 83603 - DNA, 25 bp, S. pombe
ctcaaattatcgatccacactggtt

SEQ ID NO: 83604 - DNA, 25 bp, S. pombe
ctcttgtaatagctccacttgtgtt

SEQ ID NO: 83605 - DNA, 25 bp, S. pombe
ctcatgttcctcttagtaaacgatt

SEQ ID NO: 83606 - DNA, 25 bp, S. pombe
ctcatgcctccgctattgataaaat

SEQ ID NO: 83607 - DNA, 25 bp, S. pombe
ctccgcaattggtgctcttcaagaa

SEQ ID NO: 83608 - DNA, 25 bp, S. pombe
ctccaggacctgctatttttgaagt

SEQ ID NO: 83609 - DNA, 25 bp, S. pombe
ctcgcacgccctattattcaagaat

SEQ ID NO: 83610 - DNA, 25 bp, S. pombe
ctctgctatttcatctggactgcta

SEQ ID NO: 83611 - DNA, 25 bp, S. pombe
ctctgtaaatctttgggtgccactc

SEQ ID NO: 83612 - DNA, 25 bp, S. pombe
ctcttagaatgcttgggtgtatccc

SEQ ID NO: 83613 - DNA, 25 bp, S. pombe
ctcttatttggcttctttgcataca

SEQ ID NO: 83614 - DNA, 25 bp, S. pombe
ctctctatttattttcgcgatccag

SEQ ID NO: 83615 - DNA, 25 bp, S. pombe
ctcttttatattaccgctaccaact

SEQ ID NO: 83616 - DNA, 25 bp, S. pombe
ctccccgttttcatgtcgatgtgaa

SEQ ID NO: 83617 - DNA, 25 bp, S. pombe
ctcccggcgatgactttgacaatta

SEQ ID NO: 83618 - DNA, 25 bp, S. pombe
ctccgatcattccttttccaaaaga

SEQ ID NO: 83619 - DNA, 25 bp, S. pombe
ctccgatcctcgagtatggcaaatc

SEQ ID NO: 83620 - DNA, 25 bp, S. pombe
ctggactattttttgggatcgtttg

SEQ ID NO: 83621 - DNA, 25 bp, S. pombe
ctcgtcgtttgtcttggactgtttt

SEQ ID NO: 83622 - DNA, 25 bp, S. pombe
ctcatgttggtggtcttggtcttaa

SEQ ID NO: 83623 - DNA, 25 bp, S. pombe
ctgatatcgagtctgttttgtctac

SEQ ID NO: 83624 - DNA, 25 bp, S. pombe
ctgtatgcggctgattgtattgact

SEQ ID NO: 83625 - DNA, 25 bp, S. pombe
ctcgtgcagggcgtattgatcatga

SEQ ID NO: 83626 - DNA, 25 bp, S. pombe
ctcatgctaagggtatcgttgtcga

SEQ ID NO: 83627 - DNA, 25 bp, S. pombe
ctctatgaagggttgtgggctgcta

SEQ ID NO: 83628 - DNA, 25 bp, S. pombe
ctcttgaagggcatcgtggcgatac

SEQ ID NO: 83629 - DNA, 25 bp, S. pombe
ctcctcatttgcgtctagactttga

SEQ ID NO: 83630 - DNA, 25 bp, S. pombe
ctcctcatgttcctcttagtaaacg

SEQ ID NO: 83631 - DNA, 25 bp, S. pombe
ctcttcgtcgaactcatggtatatt

SEQ ID NO: 83632 - DNA, 25 bp, S. pombe
ctgcttcgtcgacgccgaatatgaa

SEQ ID NO: 83633 - DNA, 25 bp, S. pombe
ctctgtcgtcaacgctggcaacaag

SEQ ID NO: 83634 - DNA, 25 bp, S. pombe
ctctgtcgtcaacgctggcaacaag

SEQ ID NO: 83635 - DNA, 25 bp, S. pombe
ctggttcgatatccttagctgcata

SEQ ID NO: 83636 - DNA, 25 bp, S. pombe
ctcggtgagcagtcagttggcaaaa

SEQ ID NO: 83637 - DNA, 25 bp, S. pombe
ctgtgcgttcactaaggtcgagatt

SEQ ID NO: 83638 - DNA, 25 bp, S. pombe
ctccttactatacggctgctgatat

SEQ ID NO: 83639 - DNA, 25 bp, S. pombe
ctcttcatccgttgttgatcttcat

SEQ ID NO: 83640 - DNA, 25 bp, S. pombe
cgtaaaccccactaactatgcatat

SEQ ID NO: 83641 - DNA, 25 bp, S. pombe
ctccaagacgctttagcttctgtta

SEQ ID NO: 83642 - DNA, 25 bp, S. pombe
ctcgtaaggccattacttctgctta

SEQ ID NO: 83643 - DNA, 25 bp, S. pombe
ctcttcagccaagcgaagcgcattt

SEQ ID NO: 83644 - DNA, 25 bp, S. pombe
ctcccactatgcgtgagtctttatt

SEQ ID NO: 83645 - DNA, 25 bp, S. pombe
ctgctcaattgtaccattcctgaat

SEQ ID NO: 83646 - DNA, 25 bp, S. pombe
ctctcaaccaaccttgtctgatgat

SEQ ID NO: 83647 - DNA, 25 bp, S. pombe
ctgcctctcctacattgacagatga

SEQ ID NO: 83648 - DNA, 25 bp, S. pombe
ctcgtgctcgcattgtcattgacaa

SEQ ID NO: 83649 - DNA, 25 bp, S. pombe
ccggcttctacggtacagattctag

SEQ ID NO: 83650 - DNA, 25 bp, S. pombe
gcattggatactccggtaccagcga

SEQ ID NO: 83651 - DNA, 25 bp, S. pombe
ctgggagaccccatactacgaatat

SEQ ID NO: 83652 - DNA, 25 bp, S. pombe
ctgccggagcatcgtctgacaaaag

SEQ ID NO: 83653 - DNA, 25 bp, S. pombe
ctgccgcaagcaaatgtgtccaaat

SEQ ID NO: 83654 - DNA, 25 bp, S. pombe
ctgccgctaccttgatgttgagtga

SEQ ID NO: 83655 - DNA, 25 bp, S. pombe
ctccactttctaccaatcaaggatc

SEQ ID NO: 83656 - DNA, 25 bp, S. pombe
ctcttgctctccattctattgaata

SEQ ID NO: 83657 - DNA, 25 bp, S. pombe
ctcatctctctctgtcaaactaaat

SEQ ID NO: 83658 - DNA, 25 bp, S. pombe
ctcctgcagccgcttttgaagaagt

SEQ ID NO: 83659 - DNA, 25 bp, S. pombe
tcatgacgacaacacttttaccctt

SEQ ID NO: 83660 - DNA, 25 bp, S. pombe
cgatcagaaaccttaccaaccaatt

SEQ ID NO: 83661 - DNA, 25 bp, S. pombe
ctcctcaccacaaaattccgtttat

SEQ ID NO: 83662 - DNA, 25 bp, S. pombe
ctcttcagcttcaaaattctccttt

SEQ ID NO: 83663 - DNA, 25 bp, S. pombe
ctctctcctatctaattatctcttt

SEQ ID NO: 83664 - DNA, 25 bp, S. pombe
ctctctcaatgtttctaatcgcttt

SEQ ID NO: 83665 - DNA, 25 bp, S. pombe
ctgtccgttgtgtcgtgccaaagaa

SEQ ID NO: 83666 - DNA, 25 bp, S. pombe
ctctgcccttcgtcgtgaaacagaa

SEQ ID NO: 83667 - DNA, 25 bp, S. pombe
ctcgtccatgggttgctgaaattgc

SEQ ID NO: 83668 - DNA, 25 bp, S. pombe
ctctccctatggtgatcgtattgaa

SEQ ID NO: 83669 - DNA, 25 bp, S. pombe
ctccccgagaatcgcacgtttatga

SEQ ID NO: 83670 - DNA, 25 bp, S. pombe
ctgacttgatggtactttcgagctt

SEQ ID NO: 83671 - DNA, 25 bp, S. pombe
ctgcgttcggtatcatctaaggtaa

SEQ ID NO: 83672 - DNA, 25 bp, S. pombe
ctgctccggagctactaagaggtga

SEQ ID NO: 83673 - DNA, 25 bp, S. pombe
cccgcctccttctaaagatgtgttg

SEQ ID NO: 83674 - DNA, 25 bp, S. pombe
ctccacccgtgaatatcagttgctt

SEQ ID NO: 83675 - DNA, 25 bp, S. pombe
ctcttcccggatacattgctattta

SEQ ID NO: 83676 - DNA, 25 bp, S. pombe
ctctgtaccgtattcttccaattga

SEQ ID NO: 83677 - DNA, 25 bp, S. pombe
ctctttcctctactttcgagtgtat

SEQ ID NO: 83678 - DNA, 25 bp, S. pombe
ctctacctctgttgaagccgaaaaa

SEQ ID NO: 83679 - DNA, 25 bp, S. pombe
ctgatgcgatcgtttgtcccaaata

SEQ ID NO: 83680 - DNA, 25 bp, S. pombe
ctcggctcagatcagtccatggaaa

SEQ ID NO: 83681 - DNA, 25 bp, S. pombe
ctctgcctcgcaaaaccagtatgga

SEQ ID NO: 83682 - DNA, 25 bp, S. pombe
ctctctgggctaaatcgtttctgat

SEQ ID NO: 83683 - DNA, 25 bp, S. pombe
ctctctcggttacttacttcggaag

SEQ ID NO: 83684 - DNA, 25 bp, S. pombe
ctgaatcctatatctctactatcgg

SEQ ID NO: 83685 - DNA, 25 bp, S. pombe
ctccagccaattcttactacagtgt

SEQ ID NO: 83686 - DNA, 25 bp, S. pombe
ctcccgatgcttcctataatagcgt

SEQ ID NO: 83687 - DNA, 25 bp, S. pombe
ctgcagccgcgttattacgtttaac

SEQ ID NO: 83688 - DNA, 25 bp, S. pombe
ctcgtcgcatgttttatcaccttaa

SEQ ID NO: 83689 - DNA, 25 bp, S. pombe
ctcgtcttgatcctgttactggtaa

SEQ ID NO: 83690 - DNA, 25 bp, S. pombe
ctgcaccttttgatttggctaactt

SEQ ID NO: 83691 - DNA, 25 bp, S. pombe
ctctcatttttctttgtacaacgcc

SEQ ID NO: 83692 - DNA, 25 bp, S. pombe
cctggtgtttcagtggtaaccgact

SEQ ID NO: 83693 - DNA, 25 bp, S. pombe
gcttcggtccagaggtgctagttaa

SEQ ID NO: 83694 - DNA, 25 bp, S. pombe
ctcgtttccctgctgatcaagttaa

SEQ ID NO: 83695 - DNA, 25 bp, S. pombe
ctccctgttccgcttaatgattatg

SEQ ID NO: 83696 - DNA, 25 bp, S. pombe
ctcgtctttccaacgtttttgtcat

SEQ ID NO: 83697 - DNA, 25 bp, S. pombe
cgtctgggtcgtcctttaatagcaa

SEQ ID NO: 83698 - DNA, 25 bp, S. pombe
ctgtgacggtcgatttaattccaaa

SEQ ID NO: 83699 - DNA, 25 bp, S. pombe
ctctcgggtgccaatattatgattc

SEQ ID NO: 83700 - DNA, 25 bp, S. pombe
ctccaactcttccactttataatgt

SEQ ID NO: 83701 - DNA, 25 bp, S. pombe
ctccacatctgtttctcgtacaaag

SEQ ID NO: 83702 - DNA, 25 bp, S. pombe
ctcctatcatactatctccgaattt

SEQ ID NO: 83703 - DNA, 25 bp, S. pombe
cgctgatgcagccaatgttcattgt

SEQ ID NO: 83704 - DNA, 25 bp, S. pombe
ctgctcgttcttcggctttattgaa

SEQ ID NO: 83705 - DNA, 25 bp, S. pombe
ctctgggtttggactttgctttaat

SEQ ID NO: 83706 - DNA, 25 bp, S. pombe
tctggagggtctttagtttctggct

SEQ ID NO: 83707 - DNA, 25 bp, S. pombe
ctgactaacttactatttcccggat

SEQ ID NO: 83708 - DNA, 25 bp, S. pombe
ctgctcaaagttatatccctccaag

SEQ ID NO: 83709 - DNA, 25 bp, S. pombe
ctccaaaacttttccactctaatgt

SEQ ID NO: 83710 - DNA, 25 bp, S. pombe
ctcgaaagaccgaaccatccaattt

SEQ ID NO: 83711 - DNA, 25 bp, S. pombe
ctcgtcgctcttttcgtaattcaat

SEQ ID NO: 83712 - DNA, 25 bp, S. pombe
ctcgttatctcttttagttcgccaa

SEQ ID NO: 83713 - DNA, 25 bp, S. pombe
ctcgttcttattctatctgttgcca

SEQ ID NO: 83714 - DNA, 25 bp, S. pombe
ctccttcgccttctatcgatatgaa

SEQ ID NO: 83715 - DNA, 25 bp, S. pombe
ctccattgcctctattaatcgcatt

SEQ ID NO: 83716 - DNA, 25 bp, S. pombe
ctgaccaacatggaatggtgctatt

SEQ ID NO: 83717 - DNA, 25 bp, S. pombe
ctgaccaacatggaatggtgctatt

SEQ ID NO: 83718 - DNA, 25 bp, S. pombe
ctggtgtagcgggacgtgtcacatc

SEQ ID NO: 83719 - DNA, 25 bp, S. pombe
ctcgccgtcgttatcgtgatgatta

SEQ ID NO: 83720 - DNA, 25 bp, S. pombe
ctctgattttgtacatgccttggaa

SEQ ID NO: 83721 - DNA, 25 bp, S. pombe
ctctgcaacgctttttcttcgaaga

SEQ ID NO: 83722 - DNA, 25 bp, S. pombe
ctgccattggtgactttgctgacga

SEQ ID NO: 83723 - DNA, 25 bp, S. pombe
ctctgcttaccggtgttaccaaaga

SEQ ID NO: 83724 - DNA, 25 bp, S. pombe
ctctgcctgacgaacttttccaaaa

SEQ ID NO: 83725 - DNA, 25 bp, S. pombe
ctcgacaacgttatactctgaaaaa

SEQ ID NO: 83726 - DNA, 25 bp, S. pombe
ctgccgaagcggatgaattgattaa

SEQ ID NO: 83727 - DNA, 25 bp, S. pombe
ctcgagcttgtttatgttgtctgaa

SEQ ID NO: 83728 - DNA, 25 bp, S. pombe
ctgcacgtaaatcaactggtggtaa

SEQ ID NO: 83729 - DNA, 25 bp, S. pombe
ctcgcgcgcaaaatactgaccaagt

SEQ ID NO: 83730 - DNA, 25 bp, S. pombe
ctcctgcatcaacaaaacgacgctg

SEQ ID NO: 83731 - DNA, 25 bp, S. pombe
ctgaacttaattcggcttccactaa

SEQ ID NO: 83732 - DNA, 25 bp, S. pombe
ctgacgatcttttccaaatcccaaa

SEQ ID NO: 83733 - DNA, 25 bp, S. pombe
cgcaccctttgttagtcggtgtgtt

SEQ ID NO: 83734 - DNA, 25 bp, S. pombe
ctgaaacttttaatgccgggctgat

SEQ ID NO: 83735 - DNA, 25 bp, S. pombe
ctgaagagttcttttgaggctgcaa

SEQ ID NO: 83736 - DNA, 25 bp, S. pombe
ctcccatcctatttacattttgcta

SEQ ID NO: 83737 - DNA, 25 bp, S. pombe
ctgaccttcattcaagccctaaaag

SEQ ID NO: 83738 - DNA, 25 bp, S. pombe
ctggttccacattcgatcccaatga

SEQ ID NO: 83739 - DNA, 25 bp, S. pombe
ctcgtgtcagcggttcattcttaac

SEQ ID NO: 83740 - DNA, 25 bp, S. pombe
ctgcctaacgttttatgctgctcaa

SEQ ID NO: 83741 - DNA, 25 bp, S. pombe
ctccgatcaccttttattcacaaat

SEQ ID NO: 83742 - DNA, 25 bp, S. pombe
ctgctcgacaccttaattgccaaaa

SEQ ID NO: 83743 - DNA, 25 bp, S. pombe
ctgctcgactcgctgaagttgcaaa

SEQ ID NO: 83744 - DNA, 25 bp, S. pombe
ctccggctcgctagatgattacaaa

SEQ ID NO: 83745 - DNA, 25 bp, S. pombe
cccaccggcctttatgatttagtcg

SEQ ID NO: 83746 - DNA, 25 bp, S. pombe
ctcccatgggccctatatgtttatg

SEQ ID NO: 83747 - DNA, 25 bp, S. pombe
ctgcgccggaggcatttattggcat

SEQ ID NO: 83748 - DNA, 25 bp, S. pombe
ctccctgtgggcatatattttgcaa

SEQ ID NO: 83749 - DNA, 25 bp, S. pombe
ctgccctgtggtctatggtttcaaa

SEQ ID NO: 83750 - DNA, 25 bp, S. pombe
ctccgttgtgcgcattgttcttaaa

SEQ ID NO: 83751 - DNA, 25 bp, S. pombe
ctccttgttgggacactatctctaa

SEQ ID NO: 83752 - DNA, 25 bp, S. pombe
ctgctgctagctctgaacaacattt

SEQ ID NO: 83753 - DNA, 25 bp, S. pombe
ctgcctcatctcaattaaactcttc

SEQ ID NO: 83754 - DNA, 25 bp, S. pombe
ctcctcagctaataatgtctctacc

SEQ ID NO: 83755 - DNA, 25 bp, S. pombe
ctccacattcaaaacttcactatcg

SEQ ID NO: 83756 - DNA, 25 bp, S. pombe
ctccctcatcaagcatttatttcgt

SEQ ID NO: 83757 - DNA, 25 bp, S. pombe
ctcctctctcaagtggtaacatcga

SEQ ID NO: 83758 - DNA, 25 bp, S. pombe
ctcgcatactaactcgtgaaagctt

SEQ ID NO: 83759 - DNA, 25 bp, S. pombe
ctcgcaggtcgcttacaagacattt

SEQ ID NO: 83760 - DNA, 25 bp, S. pombe
ctgcgatgcgtgctttagggtttaa

SEQ ID NO: 83761 - DNA, 25 bp, S. pombe
ctgatggcgctgtttgtaccgttta

SEQ ID NO: 83762 - DNA, 25 bp, S. pombe
ctgctgctccttcgattacgggaaa

SEQ ID NO: 83763 - DNA, 25 bp, S. pombe
ctgcgcctgttctcaaattttttga

SEQ ID NO: 83764 - DNA, 25 bp, S. pombe
ctcgctcacgttctttttactgatt

SEQ ID NO: 83765 - DNA, 25 bp, S. pombe
gcgccgacgttccttttaaacgcat

SEQ ID NO: 83766 - DNA, 25 bp, S. pombe
cgagggcagctttttacttacgttg

SEQ ID NO: 83767 - DNA, 25 bp, S. pombe
ctgaaccagagttttacgcttcctt

SEQ ID NO: 83768 - DNA, 25 bp, S. pombe
ctggaccgagtctgatatcctttca

SEQ ID NO: 83769 - DNA, 25 bp, S. pombe
ctgtacgctaagaccattccttgta

SEQ ID NO: 83770 - DNA, 25 bp, S. pombe
ctggtgaccaacatgttcatccttg

SEQ ID NO: 83771 - DNA, 25 bp, S. pombe
ctgatactggcaagcttggtacctt

SEQ ID NO: 83772 - DNA, 25 bp, S. pombe
ctgagcacttggtcttgcacttaaa

SEQ ID NO: 83773 - DNA, 25 bp, S. pombe
ctgcccttgccattcatggtgataa

SEQ ID NO: 83774 - DNA, 25 bp, S. pombe
cgaggattacgatacacccacatgg

SEQ ID NO: 83775 - DNA, 25 bp, S. pombe
cgaccaaattcgctaccttgtagag

SEQ ID NO: 83776 - DNA, 25 bp, S. pombe
cggtaaattccttgcaactttgcgt

SEQ ID NO: 83777 - DNA, 25 bp, S. pombe
cgatgatagtccagttgtcccgttg

SEQ ID NO: 83778 - DNA, 25 bp, S. pombe
ctgttggatcgttgtttcaccgtta

SEQ ID NO: 83779 - DNA, 25 bp, S. pombe
ctgctgatgctttggctcataacta

SEQ ID NO: 83780 - DNA, 25 bp, S. pombe
cgagcagcagtaagcgacccagttg

SEQ ID NO: 83781 - DNA, 25 bp, S. pombe
cgggcaatagccgacgcaagtcatt

SEQ ID NO: 83782 - DNA, 25 bp, S. pombe
ctgcccaaagcagactcaagtgttt

SEQ ID NO: 83783 - DNA, 25 bp, S. pombe
ctgttccattgcgtgagatgaactc

SEQ ID NO: 83784 - DNA, 25 bp, S. pombe
ctgtcccctttattgagcctaaatg

SEQ ID NO: 83785 - DNA, 25 bp, S. pombe
ctgcatacccactttgtagccaaaa

SEQ ID NO: 83786 - DNA, 25 bp, S. pombe
ctgtctcttttaatcttccttatcg

SEQ ID NO: 83787 - DNA, 25 bp, S. pombe
ctgcctgcattgctttagctttttt

SEQ ID NO: 83788 - DNA, 25 bp, S. pombe
ctgctccagtatcttcagcttttta

SEQ ID NO: 83789 - DNA, 25 bp, S. pombe
ctgctgtcagtgttattgtgcctat

SEQ ID NO: 83790 - DNA, 25 bp, S. pombe
ctgtcatgttggctcttcctaaaat

SEQ ID NO: 83791 - DNA, 25 bp, S. pombe
ctccttcacagcagcgtctgatcta

SEQ ID NO: 83792 - DNA, 25 bp, S. pombe
ctgccggcgttcctattattcaaaa

SEQ ID NO: 83793 - DNA, 25 bp, S. pombe
cggccgtattccaactttcgatgaa

SEQ ID NO: 83794 - DNA, 25 bp, S. pombe
ctgcaattcctagaacacgccgtaa

SEQ ID NO: 83795 - DNA, 25 bp, S. pombe
ctgccattctctcaaataccacaga

SEQ ID NO: 83796 - DNA, 25 bp, S. pombe
ctgtttcatgcgttgaacctgtcaa

SEQ ID NO: 83797 - DNA, 25 bp, S. pombe
ctgatgttgttgttggacttcctga

SEQ ID NO: 83798 - DNA, 25 bp, S. pombe
ctgcatttgttctagttattcatta

SEQ ID NO: 83799 - DNA, 25 bp, S. pombe
ctgcttctgtccaagctgtttttga

SEQ ID NO: 83800 - DNA, 25 bp, S. pombe
ctgtattgtgccaagcctatctcaa

SEQ ID NO: 83801 - DNA, 25 bp, S. pombe
ctgaatgttctttctggccttcgat

SEQ ID NO: 83802 - DNA, 25 bp, S. pombe
cgtcaatgatctttgctatcctggc

SEQ ID NO: 83803 - DNA, 25 bp, S. pombe
ctggctaatgtctgtctcgggtgga

SEQ ID NO: 83804 - DNA, 25 bp, S. pombe
gcgtaaaaccgcaaggattcgaaga

SEQ ID NO: 83805 - DNA, 25 bp, S. pombe
cgtaagaacggccacgtcgtgatta

SEQ ID NO: 83806 - DNA, 25 bp, S. pombe
cgtcaatggacctaagcgttcttta

SEQ ID NO: 83807 - DNA, 25 bp, S. pombe
cgtccagcttccaagggtacttata

SEQ ID NO: 83808 - DNA, 25 bp, S. pombe
ctgttttgcttatggaggacgtcta

SEQ ID NO: 83809 - DNA, 25 bp, S. pombe
ctgcttcttctccacaaaagactgg

SEQ ID NO: 83810 - DNA, 25 bp, S. pombe
ctgttccctctgtcaataatgctgg

SEQ ID NO: 83811 - DNA, 25 bp, S. pombe
ctggtgcctttgtcattgccatgat

SEQ ID NO: 83812 - DNA, 25 bp, S. pombe
ctgtcacctatactgagcatgccaa

SEQ ID NO: 83813 - DNA, 25 bp, S. pombe
ctgttgatcaaactgctgctgccaa

SEQ ID NO: 83814 - DNA, 25 bp, S. pombe
cgtgctctctactacagtcaaagct

SEQ ID NO: 83815 - DNA, 25 bp, S. pombe
ctgccttgttcatcgctagcaagta

SEQ ID NO: 83816 - DNA, 25 bp, S. pombe
ctccttgcattatgactcctactta

SEQ ID NO: 83817 - DNA, 25 bp, S. pombe
ctcctgctctcctagaatgtttctt

SEQ ID NO: 83818 - DNA, 25 bp, S. pombe
ctccttctcatatggttcctggtat

SEQ ID NO: 83819 - DNA, 25 bp, S. pombe
gcttactaagtctcgattgggttta

SEQ ID NO: 83820 - DNA, 25 bp, S. pombe
ctggagacactctggtcggattgtt

SEQ ID NO: 83821 - DNA, 25 bp, S. pombe
ctgcgcgacacattgttgttcacga

SEQ ID NO: 83822 - DNA, 25 bp, S. pombe
ctgccattacggagcttgagccata

SEQ ID NO: 83823 - DNA, 25 bp, S. pombe
ctgtaatgcacgtggcttggccaaa

SEQ ID NO: 83824 - DNA, 25 bp, S. pombe
ctgattcatcggctggtgtcgacaa

SEQ ID NO: 83825 - DNA, 25 bp, S. pombe
ctgaacgtgcgcatagtactgaaaa

SEQ ID NO: 83826 - DNA, 25 bp, S. pombe
ctgaacccttccatatctctaaaag

SEQ ID NO: 83827 - DNA, 25 bp, S. pombe
ctgaagcttccgattctatgtcaaa

SEQ ID NO: 83828 - DNA, 25 bp, S. pombe
cgtcgctaccgagggtatgtacact

SEQ ID NO: 83829 - DNA, 25 bp, S. pombe
ctgacgcggccggtataatacattc

SEQ ID NO: 83830 - DNA, 25 bp, S. pombe
ctgatggcgaagctcctgctgaaga

SEQ ID NO: 83831 - DNA, 25 bp, S. pombe
ctgctgaggctttcaacgagactgt

SEQ ID NO: 83832 - DNA, 25 bp, S. pombe
ctgctgaagttgtgcctgctactca

SEQ ID NO: 83833 - DNA, 25 bp, S. pombe
ctgacttgaagttagcgcgtgcccg

SEQ ID NO: 83834 - DNA, 25 bp, S. pombe
ctgtcgataatttggagcgtgctct

SEQ ID NO: 83835 - DNA, 25 bp, S. pombe
ctgcttgttagcaggaacatttgta

SEQ ID NO: 83836 - DNA, 25 bp, S. pombe
ctgctttttgctctgattattctaa

SEQ ID NO: 83837 - DNA, 25 bp, S. pombe
ctgctgcttccgctgttgaaattga

SEQ ID NO: 83838 - DNA, 25 bp, S. pombe
ctggctggcccaaggtatagctgga

SEQ ID NO: 83839 - DNA, 25 bp, S. pombe
ctgctggtgctcttagttgttggaa

SEQ ID NO: 83840 - DNA, 25 bp, S. pombe
ctgctgttgactacgattcttctga

SEQ ID NO: 83841 - DNA, 25 bp, S. pombe
ctgcgtggagcgatttctttggtat

SEQ ID NO: 83842 - DNA, 25 bp, S. pombe
ctgccgcctgtatggttttgattag

SEQ ID NO: 83843 - DNA, 25 bp, S. pombe
ccctcaaatgtctcgtgtagtccat

SEQ ID NO: 83844 - DNA, 25 bp, S. pombe
cgttcaaagtgagcgtgccttccag

SEQ ID NO: 83845 - DNA, 25 bp, S. pombe
cgttgaaattgttactgccgaggca

SEQ ID NO: 83846 - DNA, 25 bp, S. pombe
cgttgagaaggttgcccctggtgcc

SEQ ID NO: 83847 - DNA, 25 bp, S. pombe
cggtgctaaggttcgctctcaggag

SEQ ID NO: 83848 - DNA, 25 bp, S. pombe
cggtttcggccctgtgatgaggaat

SEQ ID NO: 83849 - DNA, 25 bp, S. pombe
ctgtgctttcttccaacggtaagtt

SEQ ID NO: 83850 - DNA, 25 bp, S. pombe
ctgatatttataacgccatcgccgc

SEQ ID NO: 83851 - DNA, 25 bp, S. pombe
ctgttatacataaagcctgcccgga

SEQ ID NO: 83852 - DNA, 25 bp, S. pombe
ctgtcagtgttcgtcttgcggaaaa

SEQ ID NO: 83853 - DNA, 25 bp, S. pombe
ctgctcttcatatttctcgggataa

SEQ ID NO: 83854 - DNA, 25 bp, S. pombe
ctgcagcaaatctctccttggatga

SEQ ID NO: 83855 - DNA, 25 bp, S. pombe
ctgtggccttttttcggaggagcta

SEQ ID NO: 83856 - DNA, 25 bp, S. pombe
cgggcctcatttgctgggcgaagaa

SEQ ID NO: 83857 - DNA, 25 bp, S. pombe
ctgctctgggtaatctttcttctaa

SEQ ID NO: 83858 - DNA, 25 bp, S. pombe
ctgcctggtgtgatcgtatctgtta

SEQ ID NO: 83859 - DNA, 25 bp, S. pombe
ctgtgtggcgtgtaatgcgtcgatc

SEQ ID NO: 83860 - DNA, 25 bp, S. pombe
ctgtaaatggtgctccatctgctga

SEQ ID NO: 83861 - DNA, 25 bp, S. pombe
cggattgcattatcacttctagtga

SEQ ID NO: 83862 - DNA, 25 bp, S. pombe
ctgcgctgcgcttaaagtgtctagt

SEQ ID NO: 83863 - DNA, 25 bp, S. pombe
ctgcattcatcttcagtcatctgag

SEQ ID NO: 83864 - DNA, 25 bp, S. pombe
ctgctgtttgtgttgctcttaatga

SEQ ID NO: 83865 - DNA, 25 bp, S. pombe
ctgcttatgagcttcctggacttac

SEQ ID NO: 83866 - DNA, 25 bp, S. pombe
ctggcttaaccattttgcgtactgc

SEQ ID NO: 83867 - DNA, 25 bp, S. pombe
ctggttactagcaatctcaggattg

SEQ ID NO: 83868 - DNA, 25 bp, S. pombe
ctgcgagttcggattttattgcctt

SEQ ID NO: 83869 - DNA, 25 bp, S. pombe
ctgggccgtaataggactcgcattc

SEQ ID NO: 83870 - DNA, 25 bp, S. pombe
ctggaagctcaatcaatcgacgttt

SEQ ID NO: 83871 - DNA, 25 bp, S. pombe
gctggacgccgacaacacgatggaa

SEQ ID NO: 83872 - DNA, 25 bp, S. pombe
ctgtcggccatgtcgagatgtctga

SEQ ID NO: 83873 - DNA, 25 bp, S. pombe
ctgtcgctgccggtattattgatgg

SEQ ID NO: 83874 - DNA, 25 bp, S. pombe
ctgcttctgcttgggaatatcgtga

SEQ ID NO: 83875 - DNA, 25 bp, S. pombe
ctgcttcgcttgttagtactgtggt

SEQ ID NO: 83876 - DNA, 25 bp, S. pombe
ctggtcgtggttttactcttgagga

SEQ ID NO: 83877 - DNA, 25 bp, S. pombe
ctggagctgtggatgctgtaccttc

SEQ ID NO: 83878 - DNA, 25 bp, S. pombe
ctgagtggtgtaacatgccctctgt

SEQ ID NO: 83879 - DNA, 25 bp, S. pombe
ctgagtccacctgctttacagagaa

SEQ ID NO: 83880 - DNA, 25 bp, S. pombe
ctgcagtcgccttttgtttcaatta

SEQ ID NO: 83881 - DNA, 25 bp, S. pombe
ctgctagcgctatgtttgttggtat

SEQ ID NO: 83882 - DNA, 25 bp, S. pombe
ccgagcgctgtagatgtttggtctt

SEQ ID NO: 83883 - DNA, 25 bp, S. pombe
cggtggtcccaatgtcgttgataga

SEQ ID NO: 83884 - DNA, 25 bp, S. pombe
ctgagttacgtgcaatttctgggaa

SEQ ID NO: 83885 - DNA, 25 bp, S. pombe
ctggcggcagcatcttcgataatgg

SEQ ID NO: 83886 - DNA, 25 bp, S. pombe
ctgtgcgcagcacgaaagtgtttga

SEQ ID NO: 83887 - DNA, 25 bp, S. pombe
ctgtcctctgttttcgattctatga

SEQ ID NO: 83888 - DNA, 25 bp, S. pombe
ctgttgctccttttactcatgttat

SEQ ID NO: 83889 - DNA, 25 bp, S. pombe
ctgactctgatgatgcttctgagaa

SEQ ID NO: 83890 - DNA, 25 bp, S. pombe
ctgagcagctcgatcattttgacat

SEQ ID NO: 83891 - DNA, 25 bp, S. pombe
ctgagagcaatgacccttctatatt

SEQ ID NO: 83892 - DNA, 25 bp, S. pombe
ctgctgccgatactttacgatctta

SEQ ID NO: 83893 - DNA, 25 bp, S. pombe
ctgagcgtgttgaagctttgatcaa

SEQ ID NO: 83894 - DNA, 25 bp, S. pombe
cgtgcagtttcatcttttcggcgac

SEQ ID NO: 83895 - DNA, 25 bp, S. pombe
ctggtctccagaagcacgtttacaa

SEQ ID NO: 83896 - DNA, 25 bp, S. pombe
ctgtgtccacagaaacggcgttaaa

SEQ ID NO: 83897 - DNA, 25 bp, S. pombe
ctggctctgaagctctagacgcaat

SEQ ID NO: 83898 - DNA, 25 bp, S. pombe
ctgtttctgctgttggttccattga

SEQ ID NO: 83899 - DNA, 25 bp, S. pombe
ctgagccatcacattttgcttgggc

SEQ ID NO: 83900 - DNA, 25 bp, S. pombe
cgtcaagcgtaactgctggcctcgt

SEQ ID NO: 83901 - DNA, 25 bp, S. pombe
cgatctcggtaacgcgtgctggaca

SEQ ID NO: 83902 - DNA, 25 bp, S. pombe
ctgtccccaacgttgctattgatta

SEQ ID NO: 83903 - DNA, 25 bp, S. pombe
ctgtcgccactgttgctatcaataa

SEQ ID NO: 83904 - DNA, 25 bp, S. pombe
ctgtcccgtggttccaggtgagaaa

SEQ ID NO: 83905 - DNA, 25 bp, S. pombe
ctgacctcgtttgccttgtagaaaa

SEQ ID NO: 83906 - DNA, 25 bp, S. pombe
cggaccgcttatttgcaaactcaga

SEQ ID NO: 83907 - DNA, 25 bp, S. pombe
ctggatcgcggaagtctctgctaaa

SEQ ID NO: 83908 - DNA, 25 bp, S. pombe
ctgtgtggtggatgtattgcggaat

SEQ ID NO: 83909 - DNA, 25 bp, S. pombe
ctgtgggtcagctagttggtgttat

SEQ ID NO: 83910 - DNA, 25 bp, S. pombe
ctgttgctggcgtatttggtcttaa

SEQ ID NO: 83911 - DNA, 25 bp, S. pombe
cggtcttccttcacgtcttgaaaag

SEQ ID NO: 83912 - DNA, 25 bp, S. pombe
ctggcattgttgtttatgaacctat

SEQ ID NO: 83913 - DNA, 25 bp, S. pombe
ctgagtgttttaaataaccattggc

SEQ ID NO: 83914 - DNA, 25 bp, S. pombe
cgtggtcttcttcttggtttgcaat

SEQ ID NO: 83915 - DNA, 25 bp, S. pombe
ctgggtcttttttctggtttgacat

SEQ ID NO: 83916 - DNA, 25 bp, S. pombe
ctgttccttccatgagttttgctaa

SEQ ID NO: 83917 - DNA, 25 bp, S. pombe
ctggttatggccttgagttttctta

SEQ ID NO: 83918 - DNA, 25 bp, S. pombe
cgtatttcccttcgtgatgtttgta

SEQ ID NO: 83919 - DNA, 25 bp, S. pombe
cgttttccctctctatttttgatga

SEQ ID NO: 83920 - DNA, 25 bp, S. pombe
cgagtttcccgcattttcatttgaa

SEQ ID NO: 83921 - DNA, 25 bp, S. pombe
ctgttcctccttgttgtattcacaa

SEQ ID NO: 83922 - DNA, 25 bp, S. pombe
ctgacgttctttatctttccatcaa

SEQ ID NO: 83923 - DNA, 25 bp, S. pombe
ctgaaactctcagcccttatgttga

SEQ ID NO: 83924 - DNA, 25 bp, S. pombe
ctgcaaaatacattggtgctggttt

SEQ ID NO: 83925 - DNA, 25 bp, S. pombe
ctgtaaatatacttgctgtggctat

SEQ ID NO: 83926 - DNA, 25 bp, S. pombe
ctgttcttacacttattggcgtcta

SEQ ID NO: 83927 - DNA, 25 bp, S. pombe
ctgtctatgttccagctgacgattt

SEQ ID NO: 83928 - DNA, 25 bp, S. pombe
ctgtctgatattcgagctatggctc

SEQ ID NO: 83929 - DNA, 25 bp, S. pombe
ctggttcccggttatctgtggatag

SEQ ID NO: 83930 - DNA, 25 bp, S. pombe
ctgaggttccatctactgttcgtag

SEQ ID NO: 83931 - DNA, 25 bp, S. pombe
cggaattcccgttctttcgaatgat

SEQ ID NO: 83932 - DNA, 25 bp, S. pombe
cggagataccagcttttcttactag

SEQ ID NO: 83933 - DNA, 25 bp, S. pombe
gaagattatccgcaggttatggcct

SEQ ID NO: 83934 - DNA, 25 bp, S. pombe
gaatcaattcctcagttcggtctgt

SEQ ID NO: 83935 - DNA, 25 bp, S. pombe
ctggctcaaacacagtttacgggat

SEQ ID NO: 83936 - DNA, 25 bp, S. pombe
ctggtagtccttctggttcacataa

SEQ ID NO: 83937 - DNA, 25 bp, S. pombe
ctgtattcgctactttcagccttaa

SEQ ID NO: 83938 - DNA, 25 bp, S. pombe
ctgtgttccttctattcgtctataa

SEQ ID NO: 83939 - DNA, 25 bp, S. pombe
ctgtctaccatcgagttcactttga

SEQ ID NO: 83940 - DNA, 25 bp, S. pombe
ctgagcacccagaagagtttttgaa

SEQ ID NO: 83941 - DNA, 25 bp, S. pombe
cggcgtctgccgagaatgaatctat

SEQ ID NO: 83942 - DNA, 25 bp, S. pombe
ctgggattccagaggcggtcatgca

SEQ ID NO: 83943 - DNA, 25 bp, S. pombe
ctgaggctgattgcttagggttacc

SEQ ID NO: 83944 - DNA, 25 bp, S. pombe
ctggcaggaagaattggccccactg

SEQ ID NO: 83945 - DNA, 25 bp, S. pombe
ctggactagatttgtggcacctgga

SEQ ID NO: 83946 - DNA, 25 bp, S. pombe
ctggacttgctctaggtaccgataa

SEQ ID NO: 83947 - DNA, 25 bp, S. pombe
cgtacaccaggttctacaggtcaaa

SEQ ID NO: 83948 - DNA, 25 bp, S. pombe
cgttgtcgtcgatgaggcctatatt

SEQ ID NO: 83949 - DNA, 25 bp, S. pombe
cgatcatccattttcacagcaactt

SEQ ID NO: 83950 - DNA, 25 bp, S. pombe
cgatatacttggacattcagagcta

SEQ ID NO: 83951 - DNA, 25 bp, S. pombe
cggcgacatcaacgcattcatggtt

SEQ ID NO: 83952 - DNA, 25 bp, S. pombe
gctgttcgaaaatacggccacgttt

SEQ ID NO: 83953 - DNA, 25 bp, S. pombe
ctgtggctatttacgactcatggca

SEQ ID NO: 83954 - DNA, 25 bp, S. pombe
ctgagcattttgaacgtcgcgtcca

SEQ ID NO: 83955 - DNA, 25 bp, S. pombe
ctgagcatttataccgttatccacc

SEQ ID NO: 83956 - DNA, 25 bp, S. pombe
ctggcaacattattcgtggattcga

SEQ ID NO: 83957 - DNA, 25 bp, S. pombe
cgtacccctatagcgcttcaaagaa

SEQ ID NO: 83958 - DNA, 25 bp, S. pombe
ctggaccctcgattcctttaaatat

SEQ ID NO: 83959 - DNA, 25 bp, S. pombe
ctggtccctcagaagttttggtaat

SEQ ID NO: 83960 - DNA, 25 bp, S. pombe
cgatttgcttggtgccttaggatca

SEQ ID NO: 83961 - DNA, 25 bp, S. pombe
cggtgtcattgttttgaccacctct

SEQ ID NO: 83962 - DNA, 25 bp, S. pombe
cggcttgtcggatattgcccataca

SEQ ID NO: 83963 - DNA, 25 bp, S. pombe
ctggtgttcgcgatggccgtaagaa

SEQ ID NO: 83964 - DNA, 25 bp, S. pombe
cggtttcgatatgacctctgacaaa

SEQ ID NO: 83965 - DNA, 25 bp, S. pombe
ctggtgcttatgttcaacttcgaca

SEQ ID NO: 83966 - DNA, 25 bp, S. pombe
ctggtgcttccaacaacttacaaaa

SEQ ID NO: 83967 - DNA, 25 bp, S. pombe
ctggtcagtccaaaagttatcgaac

SEQ ID NO: 83968 - DNA, 25 bp, S. pombe
ctgattacccttttgttatcgaaca

SEQ ID NO: 83969 - DNA, 25 bp, S. pombe
ctgttggccctttgatttctcaaga

SEQ ID NO: 83970 - DNA, 25 bp, S. pombe
ctgtcgtttgtttgatagtctccat

SEQ ID NO: 83971 - DNA, 25 bp, S. pombe
ctggagtttctcttttgtatgctaa

SEQ ID NO: 83972 - DNA, 25 bp, S. pombe
cgggcgaacgcttacgagacgaaat

SEQ ID NO: 83973 - DNA, 25 bp, S. pombe
cggcccaagcgatacgtactatgaa

SEQ ID NO: 83974 - DNA, 25 bp, S. pombe
cggcttcaggcgttacagtacaaaa

SEQ ID NO: 83975 - DNA, 25 bp, S. pombe
ctggttcggctcttgatcctaaaaa

SEQ ID NO: 83976 - DNA, 25 bp, S. pombe
ctgggcattgctatgtggttcttta

SEQ ID NO: 83977 - DNA, 25 bp, S. pombe
ctgtttctgcttttcgattctttga

SEQ ID NO: 83978 - DNA, 25 bp, S. pombe
cggcatacgctttattacatcttcc

SEQ ID NO: 83979 - DNA, 25 bp, S. pombe
cggtatagctacgatttcacctagt

SEQ ID NO: 83980 - DNA, 25 bp, S. pombe
cggctaaaaccactgatgcttcttt

SEQ ID NO: 83981 - DNA, 25 bp, S. pombe
ctggctgaaaacgtcgagtctattt

SEQ ID NO: 83982 - DNA, 25 bp, S. pombe
cgtggcgtcgagcttgaacaacttt

SEQ ID NO: 83983 - DNA, 25 bp, S. pombe
ctggtcctcgacctagtaagacttt

SEQ ID NO: 83984 - DNA, 25 bp, S. pombe
ctggctccgtgaccgagaaactttt

SEQ ID NO: 83985 - DNA, 25 bp, S. pombe
ctggtaggtcatttgttcgtgctta

SEQ ID NO: 83986 - DNA, 25 bp, S. pombe
ctgttggctgtctttgttctattta

SEQ ID NO: 83987 - DNA, 25 bp, S. pombe
ctgtctggctctgttgttggtcaat

SEQ ID NO: 83988 - DNA, 25 bp, S. pombe
ctgtcgttttccacaatcctgaaga

SEQ ID NO: 83989 - DNA, 25 bp, S. pombe
ctgtcggtttccactagtcatttga

SEQ ID NO: 83990 - DNA, 25 bp, S. pombe
cggcggtttgtacctcaacaatcaa

SEQ ID NO: 83991 - DNA, 25 bp, S. pombe
gaatattcctttcctcgaaacgtct

SEQ ID NO: 83992 - DNA, 25 bp, S. pombe
gagtttccgtaccaagcaaaagctt

SEQ ID NO: 83993 - DNA, 25 bp, S. pombe
ctgttgaccctaccatgactattat

SEQ ID NO: 83994 - DNA, 25 bp, S. pombe
ctgtgtttcagtttgcattcgatta

SEQ ID NO: 83995 - DNA, 25 bp, S. pombe
ctgggcttcagtttgattacattgt

SEQ ID NO: 83996 - DNA, 25 bp, S. pombe
cgaggtttggcatcgtaaatacttt

SEQ ID NO: 83997 - DNA, 25 bp, S. pombe
cgtcgttaacactggcaacaagcct

SEQ ID NO: 83998 - DNA, 25 bp, S. pombe
cgtcgttaacactggcaacaagcct

SEQ ID NO: 83999 - DNA, 25 bp, S. pombe
ccgattatccctttgcaaaccagga

SEQ ID NO: 84000 - DNA, 25 bp, S. pombe
cggattactcctttgctaactggta

SEQ ID NO: 84001 - DNA, 25 bp, S. pombe
cggtaactctcttgtccaaacttat

SEQ ID NO: 84002 - DNA, 25 bp, S. pombe
cgtggcaaaccttttccagacattt

SEQ ID NO: 84003 - DNA, 25 bp, S. pombe
cgtggcgtttcttttcatcgaatta

SEQ ID NO: 84004 - DNA, 25 bp, S. pombe
ccttggctttggctactattgaaca

SEQ ID NO: 84005 - DNA, 25 bp, S. pombe
cggtcgtgctggtaacactggtcaa

SEQ ID NO: 84006 - DNA, 25 bp, S. pombe
cggctcggatggtatacccgttgat

SEQ ID NO: 84007 - DNA, 25 bp, S. pombe
cggctatgagctgtaacgaccaaga

SEQ ID NO: 84008 - DNA, 25 bp, S. pombe
cggccgatgttcgtaccatggtgga

SEQ ID NO: 84009 - DNA, 25 bp, S. pombe
cgttccaacttgttactggtcgagt

SEQ ID NO: 84010 - DNA, 25 bp, S. pombe
cgtaccattcatttcgccgagtata

SEQ ID NO: 84011 - DNA, 25 bp, S. pombe
ctgtatgcttacactcctgaggtat

SEQ ID NO: 84012 - DNA, 25 bp, S. pombe
ctgtttcatgtcaaagccggttcta

SEQ ID NO: 84013 - DNA, 25 bp, S. pombe
ctgttttatcttctcatcttcctaa

SEQ ID NO: 84014 - DNA, 25 bp, S. pombe
ctggctttatttcttcatctggtac

SEQ ID NO: 84015 - DNA, 25 bp, S. pombe
ctgtctctggtattgctattatctc

SEQ ID NO: 84016 - DNA, 25 bp, S. pombe
ctggcatgcgtgttggtttatctca

SEQ ID NO: 84017 - DNA, 25 bp, S. pombe
ctggacatatcaaattgttcaacaa

SEQ ID NO: 84018 - DNA, 25 bp, S. pombe
cggctattgcacctgagtctgcaaa

SEQ ID NO: 84019 - DNA, 25 bp, S. pombe
cgggtcgttttattgttcgtcatat

SEQ ID NO: 84020 - DNA, 25 bp, S. pombe
cggttcttctaccaagtccttatat

SEQ ID NO: 84021 - DNA, 25 bp, S. pombe
cggcttttctacgaatgctcctaaa

SEQ ID NO: 84022 - DNA, 25 bp, S. pombe
ctgtcgatctgtatacactgcgtta

SEQ ID NO: 84023 - DNA, 25 bp, S. pombe
ctgtcctcgtgtaaattgctgctat

SEQ ID NO: 84024 - DNA, 25 bp, S. pombe
ctgtctccagttcagcaatctgtat

SEQ ID NO: 84025 - DNA, 25 bp, S. pombe
ctggaggatcagagagcaacggcat

SEQ ID NO: 84026 - DNA, 25 bp, S. pombe
cgcatttaattcacccgggattcta

SEQ ID NO: 84027 - DNA, 25 bp, S. pombe
cgttatttattacccgagcagattc

SEQ ID NO: 84028 - DNA, 25 bp, S. pombe
cggatagttacattcagcgcattat

SEQ ID NO: 84029 - DNA, 25 bp, S. pombe
ctggtggatttattgctgctctttc

SEQ ID NO: 84030 - DNA, 25 bp, S. pombe
ctggatatggatccctatcgcctaa

SEQ ID NO: 84031 - DNA, 25 bp, S. pombe
ctggatcagctacaggtgcacctaa

SEQ ID NO: 84032 - DNA, 25 bp, S. pombe
cgagacattacctggccggatgatt

SEQ ID NO: 84033 - DNA, 25 bp, S. pombe
cgaggattactctaccagcggaggt

SEQ ID NO: 84034 - DNA, 25 bp, S. pombe
cgttcttaattatctacgctgctta

SEQ ID NO: 84035 - DNA, 25 bp, S. pombe
cgtccaaatattttagtcgcgttga

SEQ ID NO: 84036 - DNA, 25 bp, S. pombe
cgttataaatcgttgccagcaccta

SEQ ID NO: 84037 - DNA, 25 bp, S. pombe
cgttacaagtcctcaatgcatcgtg

SEQ ID NO: 84038 - DNA, 25 bp, S. pombe
cgttacaagctaggccgccacggtt

SEQ ID NO: 84039 - DNA, 25 bp, S. pombe
cggactcacagcttctatcaatttg

SEQ ID NO: 84040 - DNA, 25 bp, S. pombe
cggttccaccagtcagtcaatttaa

SEQ ID NO: 84041 - DNA, 25 bp, S. pombe
cgtttcgccaacttccaagtgatta

SEQ ID NO: 84042 - DNA, 25 bp, S. pombe
cggtttctaactttcgtgctgatta

SEQ ID NO: 84043 - DNA, 25 bp, S. pombe
ctggatctccacctgtaggatggga

SEQ ID NO: 84044 - DNA, 25 bp, S. pombe
ctggtatcattcgacctggtcaatg

SEQ ID NO: 84045 - DNA, 25 bp, S. pombe
cgagataatccttggtggcgaaatt

SEQ ID NO: 84046 - DNA, 25 bp, S. pombe
cgaaactcaggtctcacaatacact

SEQ ID NO: 84047 - DNA, 25 bp, S. pombe
cggaacttcttctgacgatgtcgct

SEQ ID NO: 84048 - DNA, 25 bp, S. pombe
cggaacttctggtgttcatactcat

SEQ ID NO: 84049 - DNA, 25 bp, S. pombe
ctggcgtcaggaggagttgtcaaat

SEQ ID NO: 84050 - DNA, 25 bp, S. pombe
ctggccagatggttggtcgtagaaa

SEQ ID NO: 84051 - DNA, 25 bp, S. pombe
ctggcgccatcgtcggtacggagaa

SEQ ID NO: 84052 - DNA, 25 bp, S. pombe
ctggagcttccttctgttcgaagaa

SEQ ID NO: 84053 - DNA, 25 bp, S. pombe
cggctagtccagttgcttcgaaaaa

SEQ ID NO: 84054 - DNA, 25 bp, S. pombe
cggctcgacatcaacgttcaacaaa

SEQ ID NO: 84055 - DNA, 25 bp, S. pombe
cggcttctcactcacaaatacagga

SEQ ID NO: 84056 - DNA, 25 bp, S. pombe
ctgggagttctcattgcagatcaac

SEQ ID NO: 84057 - DNA, 25 bp, S. pombe
ctggtctactggatgcgtgatggct

SEQ ID NO: 84058 - DNA, 25 bp, S. pombe
ctggtgctttgtatgaatgtggctc

SEQ ID NO: 84059 - DNA, 25 bp, S. pombe
cgtggacatttgattgcgactgcat

SEQ ID NO: 84060 - DNA, 25 bp, S. pombe
cgtgctagattttgccttgaacttc

SEQ ID NO: 84061 - DNA, 25 bp, S. pombe
cgatgatggtgttatcctggagact

SEQ ID NO: 84062 - DNA, 25 bp, S. pombe
cgtatggtttacacggccgacaata

SEQ ID NO: 84063 - DNA, 25 bp, S. pombe
ctggtgctcccatgttttatgaaga

SEQ ID NO: 84064 - DNA, 25 bp, S. pombe
ctggctgtgcatcctcatttttaaa

SEQ ID NO: 84065 - DNA, 25 bp, S. pombe
cggctaccttacttattcgagacat

SEQ ID NO: 84066 - DNA, 25 bp, S. pombe
cggctacacaatccatctttcgaaa

SEQ ID NO: 84067 - DNA, 25 bp, S. pombe
cgtggattccggttttatattcaat

SEQ ID NO: 84068 - DNA, 25 bp, S. pombe
cgtccttacttcgagtcttctaaag

SEQ ID NO: 84069 - DNA, 25 bp, S. pombe
cggagttcacgttccacagtggtaa

SEQ ID NO: 84070 - DNA, 25 bp, S. pombe
cgttataattgttctcgttggtaat

SEQ ID NO: 84071 - DNA, 25 bp, S. pombe
cgttttattaactctctttggatcg

SEQ ID NO: 84072 - DNA, 25 bp, S. pombe
cgacaatttccaacacattctccgt

SEQ ID NO: 84073 - DNA, 25 bp, S. pombe
cgtcgatgttgaacccatttgggct

SEQ ID NO: 84074 - DNA, 25 bp, S. pombe
cggagtttatacctgcattgcttga

SEQ ID NO: 84075 - DNA, 25 bp, S. pombe
cggctcttcacgatctgattctagt

SEQ ID NO: 84076 - DNA, 25 bp, S. pombe
cgtcctatttctgctacagtcgagg

SEQ ID NO: 84077 - DNA, 25 bp, S. pombe
ctggcacccttatagttcttgatga

SEQ ID NO: 84078 - DNA, 25 bp, S. pombe
cggaccctgcttacgatttagatag

SEQ ID NO: 84079 - DNA, 25 bp, S. pombe
cggacaatcttctgctcttattata

SEQ ID NO: 84080 - DNA, 25 bp, S. pombe
cggagctagtgattttgttttatgc

SEQ ID NO: 84081 - DNA, 25 bp, S. pombe
cggatgcgcttatttcttggtttgt

SEQ ID NO: 84082 - DNA, 25 bp, S. pombe
cggtgcaatatctcatcatcctagt

SEQ ID NO: 84083 - DNA, 25 bp, S. pombe
cgttcaaaaagcattcgtcgcaata

SEQ ID NO: 84084 - DNA, 25 bp, S. pombe
cgatgccaggaatgctttagcccaa

SEQ ID NO: 84085 - DNA, 25 bp, S. pombe
cgtgccatcgacgttttgaaaccaa

SEQ ID NO: 84086 - DNA, 25 bp, S. pombe
cggactcgacgtataaccaagcaaa

SEQ ID NO: 84087 - DNA, 25 bp, S. pombe
ctggttggccttattcctcaaagaa

SEQ ID NO: 84088 - DNA, 25 bp, S. pombe
cggcttggtatttttgattcttgga

SEQ ID NO: 84089 - DNA, 25 bp, S. pombe
ctggtatactatcgatgcttgcttt

SEQ ID NO: 84090 - DNA, 25 bp, S. pombe
cggttcgtggcgctgtatatgcaat

SEQ ID NO: 84091 - DNA, 25 bp, S. pombe
cgttggcaggctacttgagattcat

SEQ ID NO: 84092 - DNA, 25 bp, S. pombe
cgttgacatggccttcttgtaccaa

SEQ ID NO: 84093 - DNA, 25 bp, S. pombe
cgagcttgcgtctcaatctattttg

SEQ ID NO: 84094 - DNA, 25 bp, S. pombe
cggtcgctacatggcaacgtgtttg

SEQ ID NO: 84095 - DNA, 25 bp, S. pombe
cggaggctacatcgcaattggaaga

SEQ ID NO: 84096 - DNA, 25 bp, S. pombe
cggctcctatgtttggcgctggaaa

SEQ ID NO: 84097 - DNA, 25 bp, S. pombe
cggattttgatcgtggtgctggtaa

SEQ ID NO: 84098 - DNA, 25 bp, S. pombe
cgtaggtatcatttgcgccattgca

SEQ ID NO: 84099 - DNA, 25 bp, S. pombe
ctggacagcttctccgaatcatgaa

SEQ ID NO: 84100 - DNA, 25 bp, S. pombe
cggtgccatcatttttgaacgtgtt

SEQ ID NO: 84101 - DNA, 25 bp, S. pombe
cggctcctcaacttgttcaaatgtt

SEQ ID NO: 84102 - DNA, 25 bp, S. pombe
cggtcctaagatcgatgtaatggtt

SEQ ID NO: 84103 - DNA, 25 bp, S. pombe
cgagctacctaccagtgtttttgag

SEQ ID NO: 84104 - DNA, 25 bp, S. pombe
cgaggtctctacttggtgatttcca

SEQ ID NO: 84105 - DNA, 25 bp, S. pombe
cgaggagcctttgaattgttgccaa

SEQ ID NO: 84106 - DNA, 25 bp, S. pombe
cggtcaccctggtatttctgtgaat

SEQ ID NO: 84107 - DNA, 25 bp, S. pombe
cggtcctcgatgctataactgtggt

SEQ ID NO: 84108 - DNA, 25 bp, S. pombe
cgcgtgcgtcgtctcaaacgtaaaa

SEQ ID NO: 84109 - DNA, 25 bp, S. pombe
cggcgatggctactggcgattacta

SEQ ID NO: 84110 - DNA, 25 bp, S. pombe
cgaggctctggtaggttgcattctt

SEQ ID NO: 84111 - DNA, 25 bp, S. pombe
ctggcgcttaatttctctttgcaaa

SEQ ID NO: 84112 - DNA, 25 bp, S. pombe
ctggctctactttatcttgttcatt

SEQ ID NO: 84113 - DNA, 25 bp, S. pombe
cggcctcgcatttggcattgagtat

SEQ ID NO: 84114 - DNA, 25 bp, S. pombe
cggaatcaattcgtacagctgttag

SEQ ID NO: 84115 - DNA, 25 bp, S. pombe
tcgaacgtagtcttacctctttggg

SEQ ID NO: 84116 - DNA, 25 bp, S. pombe
cgatacagttgtccatgcatgcagt

SEQ ID NO: 84117 - DNA, 25 bp, S. pombe
cgacgaattacctgtttcaatgcct

SEQ ID NO: 84118 - DNA, 25 bp, S. pombe
cgagggtattatccgtttgttcaat

SEQ ID NO: 84119 - DNA, 25 bp, S. pombe
cggccacagggcaacgtacttatat

SEQ ID NO: 84120 - DNA, 25 bp, S. pombe
cggcctatcggcagagtatgacaga

SEQ ID NO: 84121 - DNA, 25 bp, S. pombe
cgtgacttcagcatcgccgaaatta

SEQ ID NO: 84122 - DNA, 25 bp, S. pombe
cggatctcttgctcgtattgccatt

SEQ ID NO: 84123 - DNA, 25 bp, S. pombe
cggcattggatctcgcgaagttttt

SEQ ID NO: 84124 - DNA, 25 bp, S. pombe
cgtattgtgcaaccgtgaccttttt

SEQ ID NO: 84125 - DNA, 25 bp, S. pombe
cgtctcttggagtcggtgatattct

SEQ ID NO: 84126 - DNA, 25 bp, S. pombe
cgacatgtacgatccagtattgttt

SEQ ID NO: 84127 - DNA, 25 bp, S. pombe
ctggcgacggctttgtgtttatatt

SEQ ID NO: 84128 - DNA, 25 bp, S. pombe
cggctcatcgagatcggctgtttaa

SEQ ID NO: 84129 - DNA, 25 bp, S. pombe
cggctgtctcatatcttcgttataa

SEQ ID NO: 84130 - DNA, 25 bp, S. pombe
cggtgttcttcgtggttatgatatc

SEQ ID NO: 84131 - DNA, 25 bp, S. pombe
cgagccttttcagagttgttgtcct

SEQ ID NO: 84132 - DNA, 25 bp, S. pombe
cgggagcttccgatgattttcaaaa

SEQ ID NO: 84133 - DNA, 25 bp, S. pombe
ccgaaatacgcgctctctttaaaga

SEQ ID NO: 84134 - DNA, 25 bp, S. pombe
cgtattcactttcctttagtcactt

SEQ ID NO: 84135 - DNA, 25 bp, S. pombe
cgttttcatttcctatttccacaat

SEQ ID NO: 84136 - DNA, 25 bp, S. pombe
cgtcttctttatttgcatttctgcc

SEQ ID NO: 84137 - DNA, 25 bp, S. pombe
cgtattttccagttgcagttgcgat

SEQ ID NO: 84138 - DNA, 25 bp, S. pombe
cgttacctccacttgcagttaatga

SEQ ID NO: 84139 - DNA, 25 bp, S. pombe
cgtgatccaatactcttgcgggtat

SEQ ID NO: 84140 - DNA, 25 bp, S. pombe
gcgttcctaagagagcgggtttgct

SEQ ID NO: 84141 - DNA, 25 bp, S. pombe
cggtcttctgggtactgttggagta

SEQ ID NO: 84142 - DNA, 25 bp, S. pombe
cggtatcccggatctggtggtgaaa

SEQ ID NO: 84143 - DNA, 25 bp, S. pombe
cggcctcctcagaaaatgcgtggta

SEQ ID NO: 84144 - DNA, 25 bp, S. pombe
cggtctcccaattgatactatctac

SEQ ID NO: 84145 - DNA, 25 bp, S. pombe
cgtgaacccaagtctactgcattga

SEQ ID NO: 84146 - DNA, 25 bp, S. pombe
gtttccccaaattttgactgccgag

SEQ ID NO: 84147 - DNA, 25 bp, S. pombe
gctttacccaaagtgtccaaacgag

SEQ ID NO: 84148 - DNA, 25 bp, S. pombe
cgaggcaccacagatcttagacgat

SEQ ID NO: 84149 - DNA, 25 bp, S. pombe
cgggtgcccttttgatagagatcca

SEQ ID NO: 84150 - DNA, 25 bp, S. pombe
cggttatcctctttacatgtttcat

SEQ ID NO: 84151 - DNA, 25 bp, S. pombe
cggctgtacctttatatcgtctttt

SEQ ID NO: 84152 - DNA, 25 bp, S. pombe
cgagactgggtggtttccttcaaat

SEQ ID NO: 84153 - DNA, 25 bp, S. pombe
cgagtgggcttggtttgtcttgtaa

SEQ ID NO: 84154 - DNA, 25 bp, S. pombe
cgaatttgtctcaggtctcattacc

SEQ ID NO: 84155 - DNA, 25 bp, S. pombe
cgggtgctacagttccattgcaaca

SEQ ID NO: 84156 - DNA, 25 bp, S. pombe
cggtgtcccactagccaatgtaatg

SEQ ID NO: 84157 - DNA, 25 bp, S. pombe
cggttgctattctttcagaggatag

SEQ ID NO: 84158 - DNA, 25 bp, S. pombe
cggatcgtcatcttttagctgtcat

SEQ ID NO: 84159 - DNA, 25 bp, S. pombe
cgtcatcttcaattggctattcgca

SEQ ID NO: 84160 - DNA, 25 bp, S. pombe
cggctggcgctttgttgttgcaaaa

SEQ ID NO: 84161 - DNA, 25 bp, S. pombe
cggctgtcggcttttcatttggaac

SEQ ID NO: 84162 - DNA, 25 bp, S. pombe
cgtggtatcgattttcatggtgtaa

SEQ ID NO: 84163 - DNA, 25 bp, S. pombe
cgtacattacggctgtgctaagaaa

SEQ ID NO: 84164 - DNA, 25 bp, S. pombe
cggttgctacgccaagttcttgaat

SEQ ID NO: 84165 - DNA, 25 bp, S. pombe
cgtgcattgccagtacatcggttga

SEQ ID NO: 84166 - DNA, 25 bp, S. pombe
cgtattgccgcaactcgaggacaat

SEQ ID NO: 84167 - DNA, 25 bp, S. pombe
cgcaatccacacagtcagggcaata

SEQ ID NO: 84168 - DNA, 25 bp, S. pombe
cgagatgacatgtggctggagccct

SEQ ID NO: 84169 - DNA, 25 bp, S. pombe
cgtggcattgcatctctgagtgtat

SEQ ID NO: 84170 - DNA, 25 bp, S. pombe
cgaagcctgctcttaggtgtagatc

SEQ ID NO: 84171 - DNA, 25 bp, S. pombe
cgacacctctgctcaagttatggtt

SEQ ID NO: 84172 - DNA, 25 bp, S. pombe
cgaccggcagaagacgattcacctt

SEQ ID NO: 84173 - DNA, 25 bp, S. pombe
tcatgccgaaaaaatccgtacccgt

SEQ ID NO: 84174 - DNA, 25 bp, S. pombe
cgtctcaactttttcgataccggtg

SEQ ID NO: 84175 - DNA, 25 bp, S. pombe
cgttgtacctgttagtatgccacca

SEQ ID NO: 84176 - DNA, 25 bp, S. pombe
cgttcatagattccgatgcaagcca

SEQ ID NO: 84177 - DNA, 25 bp, S. pombe
cgtaaagttggcgtgcagtcctgac

SEQ ID NO: 84178 - DNA, 25 bp, S. pombe
cgaagacttggacgccgataccgta

SEQ ID NO: 84179 - DNA, 25 bp, S. pombe
cgggatttcaaaccccaacagcaat

SEQ ID NO: 84180 - DNA, 25 bp, S. pombe
cggtatttcgtaatcgccttagcaa

SEQ ID NO: 84181 - DNA, 25 bp, S. pombe
cggtttatcattatcgcttatggaa

SEQ ID NO: 84182 - DNA, 25 bp, S. pombe
cggtaattcataacgctcttcagga

SEQ ID NO: 84183 - DNA, 25 bp, S. pombe
cggatagctacgattctttcaggta

SEQ ID NO: 84184 - DNA, 25 bp, S. pombe
cgtggtctcttgcttttggctgaaa

SEQ ID NO: 84185 - DNA, 25 bp, S. pombe
cgtcttcaactattatcgcgagcta

SEQ ID NO: 84186 - DNA, 25 bp, S. pombe
cgtttatacctttagctgcagcatt

SEQ ID NO: 84187 - DNA, 25 bp, S. pombe
cggtgtcaagcgattaggccacatt

SEQ ID NO: 84188 - DNA, 25 bp, S. pombe
cgggtgatttacttcgcagacaata

SEQ ID NO: 84189 - DNA, 25 bp, S. pombe
cgggtgctctgttcattcattacaa

SEQ ID NO: 84190 - DNA, 25 bp, S. pombe
cggacagttgtacgagctctcaaaa

SEQ ID NO: 84191 - DNA, 25 bp, S. pombe
cgggcatttgttcgatcatctggaa

SEQ ID NO: 84192 - DNA, 25 bp, S. pombe
cggcaatttgcctgatgacatcgaa

SEQ ID NO: 84193 - DNA, 25 bp, S. pombe
cgtactttcatcaagcagcatgcgc

SEQ ID NO: 84194 - DNA, 25 bp, S. pombe
cgttcaggtgtggaggtttcagcaa

SEQ ID NO: 84195 - DNA, 25 bp, S. pombe
cgtggtttcccatatattcctgata

SEQ ID NO: 84196 - DNA, 25 bp, S. pombe
cgggattttctatttttgctcttga

SEQ ID NO: 84197 - DNA, 25 bp, S. pombe
cccgttttccaaagctagtcaatct

SEQ ID NO: 84198 - DNA, 25 bp, S. pombe
cctcgtttaaccaggcgtaatgcta

SEQ ID NO: 84199 - DNA, 25 bp, S. pombe
gcgcggttttactggttgaaagcta

SEQ ID NO: 84200 - DNA, 25 bp, S. pombe
cgaatcctagattgtccgttgaaga

SEQ ID NO: 84201 - DNA, 25 bp, S. pombe
cggttcttgttgaccgtatgaagat

SEQ ID NO: 84202 - DNA, 25 bp, S. pombe
cgggccgcgttgacgttaaagcata

SEQ ID NO: 84203 - DNA, 25 bp, S. pombe
ccccaaggttgaaaagcaagagaag

SEQ ID NO: 84204 - DNA, 25 bp, S. pombe
ccgtcaaaggtgaaatggccgaaat

SEQ ID NO: 84205 - DNA, 25 bp, S. pombe
cggtaccgttgtttccaccaagatg

SEQ ID NO: 84206 - DNA, 25 bp, S. pombe
cggttcgttcctatacaactctgaa

SEQ ID NO: 84207 - DNA, 25 bp, S. pombe
cggtccttctccagaaaccattaga

SEQ ID NO: 84208 - DNA, 25 bp, S. pombe
cgcggagcttacttgagaacccatt

SEQ ID NO: 84209 - DNA, 25 bp, S. pombe
cggtgcctccaaacgaagatcaata

SEQ ID NO: 84210 - DNA, 25 bp, S. pombe
cgatctcggcattttgacgggactt

SEQ ID NO: 84211 - DNA, 25 bp, S. pombe
cgagtcggacacatacaagtagcat

SEQ ID NO: 84212 - DNA, 25 bp, S. pombe
cgccgggagagatgctacagttata

SEQ ID NO: 84213 - DNA, 25 bp, S. pombe
cccgtacgcttatctacttgttata

SEQ ID NO: 84214 - DNA, 25 bp, S. pombe
tcgcccttaccatattaaccttagt

SEQ ID NO: 84215 - DNA, 25 bp, S. pombe
cgtcttaccattgaaaaccttgcag

SEQ ID NO: 84216 - DNA, 25 bp, S. pombe
cgtgttcgtgcctctaagaagctta

SEQ ID NO: 84217 - DNA, 25 bp, S. pombe
cgtcttcttctatcgtaacagcatt

SEQ ID NO: 84218 - DNA, 25 bp, S. pombe
cggtattctctaattttgacatgct

SEQ ID NO: 84219 - DNA, 25 bp, S. pombe
cgggtatcctattttatcagctgtt

SEQ ID NO: 84220 - DNA, 25 bp, S. pombe
cgggatgctttaatttcttcttcta

SEQ ID NO: 84221 - DNA, 25 bp, S. pombe
cgaacatttttcattccctgtcaaa

SEQ ID NO: 84222 - DNA, 25 bp, S. pombe
cgcttttttctgagctggaccggaa

SEQ ID NO: 84223 - DNA, 25 bp, S. pombe
ccccagttgctatggattccgggaa

SEQ ID NO: 84224 - DNA, 25 bp, S. pombe
ccgtgtttgttaccaacctgaggat

SEQ ID NO: 84225 - DNA, 25 bp, S. pombe
cctggtcttggtttaactccgatga

SEQ ID NO: 84226 - DNA, 25 bp, S. pombe
cgctgctaagcgtggttacaccgat

SEQ ID NO: 84227 - DNA, 25 bp, S. pombe
cgctgtaactggcatttcctatcta

SEQ ID NO: 84228 - DNA, 25 bp, S. pombe
cggtgcgatccgtatttttattaat

SEQ ID NO: 84229 - DNA, 25 bp, S. pombe
cgggcgaggcgagttaattctgtta

SEQ ID NO: 84230 - DNA, 25 bp, S. pombe
gcgccggagaggattaccacgtcta

SEQ ID NO: 84231 - DNA, 25 bp, S. pombe
cgtccagcagcataacaatccgttg

SEQ ID NO: 84232 - DNA, 25 bp, S. pombe
cggtggttgcacctcaagttgatgt

SEQ ID NO: 84233 - DNA, 25 bp, S. pombe
cgatgatggctttcaaactgttacc

SEQ ID NO: 84234 - DNA, 25 bp, S. pombe
cgaatgtgtatgttattcgttactt

SEQ ID NO: 84235 - DNA, 25 bp, S. pombe
cgactctagagctgaccttttgtta

SEQ ID NO: 84236 - DNA, 25 bp, S. pombe
cgtccccacaaattcggtatatcga

SEQ ID NO: 84237 - DNA, 25 bp, S. pombe
cgtgcgcctgcaagattcattttaa

SEQ ID NO: 84238 - DNA, 25 bp, S. pombe
cgtgatcctatcgactttacaaagt

SEQ ID NO: 84239 - DNA, 25 bp, S. pombe
cgtctccttcgcacattacaaatat

SEQ ID NO: 84240 - DNA, 25 bp, S. pombe
cgtccgtatgctcaattgccagaaa

SEQ ID NO: 84241 - DNA, 25 bp, S. pombe
cgtgctttcagccacattagtcaaa

SEQ ID NO: 84242 - DNA, 25 bp, S. pombe
cgtgtcttccgcgttgattatggac

SEQ ID NO: 84243 - DNA, 25 bp, S. pombe
cggtgcgtttgcgtattgttggaaa

SEQ ID NO: 84244 - DNA, 25 bp, S. pombe
cgggaactattcctactcgtggagt

SEQ ID NO: 84245 - DNA, 25 bp, S. pombe
cgttaattatttcaccgccaagcat

SEQ ID NO: 84246 - DNA, 25 bp, S. pombe
cgttcgatttggatagccttgacaa

SEQ ID NO: 84247 - DNA, 25 bp, S. pombe
cggtccactttgaaatctctgcaga

SEQ ID NO: 84248 - DNA, 25 bp, S. pombe
cgtgacactgctccgttaaaagatc

SEQ ID NO: 84249 - DNA, 25 bp, S. pombe
cgttgcgcagattttcgtgagacag

SEQ ID NO: 84250 - DNA, 25 bp, S. pombe
cgtctgccagcttcattaacgcaag

SEQ ID NO: 84251 - DNA, 25 bp, S. pombe
cgacatctcatcacattagctctaa

SEQ ID NO: 84252 - DNA, 25 bp, S. pombe
cgtatgcctcaatattctgcgtcag

SEQ ID NO: 84253 - DNA, 25 bp, S. pombe
cgtgctacgcactattgatctcaaa

SEQ ID NO: 84254 - DNA, 25 bp, S. pombe
cgtgcattggcaaagcggctcataa

SEQ ID NO: 84255 - DNA, 25 bp, S. pombe
cgagagattcacgacaatgccattg

SEQ ID NO: 84256 - DNA, 25 bp, S. pombe
cggtcgttcagtatgttcctcaaat

SEQ ID NO: 84257 - DNA, 25 bp, S. pombe
cgtgatcatgttcaggtttctccta

SEQ ID NO: 84258 - DNA, 25 bp, S. pombe
cgaagtttacgctttctgatcgtga

SEQ ID NO: 84259 - DNA, 25 bp, S. pombe
cgagcaaaagctatggcacccaaat

SEQ ID NO: 84260 - DNA, 25 bp, S. pombe
ttagagctcaacaccgaccaaaatg

SEQ ID NO: 84261 - DNA, 25 bp, S. pombe
cgagaccaagcaacctatccgtaag

SEQ ID NO: 84262 - DNA, 25 bp, S. pombe
cgtgttccacataacgctgcaagaa

SEQ ID NO: 84263 - DNA, 25 bp, S. pombe
cgattcttctgcttacggcgaggaa

SEQ ID NO: 84264 - DNA, 25 bp, S. pombe
cgatgcgacatttagacgttactct

SEQ ID NO: 84265 - DNA, 25 bp, S. pombe
cgagcagagcacagtttcattacct

SEQ ID NO: 84266 - DNA, 25 bp, S. pombe
cgtaccactcgaattcagtatctct

SEQ ID NO: 84267 - DNA, 25 bp, S. pombe
cctccatattcagaacttggatgtg

SEQ ID NO: 84268 - DNA, 25 bp, S. pombe
cgtccgtatcatcgaatccttattg

SEQ ID NO: 84269 - DNA, 25 bp, S. pombe
ccctggtacaaaactgccacacatg

SEQ ID NO: 84270 - DNA, 25 bp, S. pombe
cggtgcgtctgctaccaatgggaaa

SEQ ID NO: 84271 - DNA, 25 bp, S. pombe
cgggcggtccctagattgaaagatt

SEQ ID NO: 84272 - DNA, 25 bp, S. pombe
cgggagtgttcttggtgatctttta

SEQ ID NO: 84273 - DNA, 25 bp, S. pombe
cgggatcttatttctcgtctattac

SEQ ID NO: 84274 - DNA, 25 bp, S. pombe
cggtgtcttggttttgctgctcaaa

SEQ ID NO: 84275 - DNA, 25 bp, S. pombe
cgtcgtttgagatttgttgcccaca

SEQ ID NO: 84276 - DNA, 25 bp, S. pombe
cgttggttgatcaagcgtccgctaa

SEQ ID NO: 84277 - DNA, 25 bp, S. pombe
cgaaattttatacccattctggacg

SEQ ID NO: 84278 - DNA, 25 bp, S. pombe
cgaacatttatatggccatccgagc

SEQ ID NO: 84279 - DNA, 25 bp, S. pombe
ccggttgatggcaatgaccctgatc

SEQ ID NO: 84280 - DNA, 25 bp, S. pombe
cgaagatgacatccgtactcctgat

SEQ ID NO: 84281 - DNA, 25 bp, S. pombe
cgtcgaatgatcgttagtcctgatt

SEQ ID NO: 84282 - DNA, 25 bp, S. pombe
cgtcgttgccgacttgatcaatgaa

SEQ ID NO: 84283 - DNA, 25 bp, S. pombe
tcttgctgcgttgttcgaaagggtt

SEQ ID NO: 84284 - DNA, 25 bp, S. pombe
cgatgtcgttgagtctggaaaggtt

SEQ ID NO: 84285 - DNA, 25 bp, S. pombe
ccctcaaggatttgcatctcgtgtg

SEQ ID NO: 84286 - DNA, 25 bp, S. pombe
cgggcatttgcttcttacatttgtg

SEQ ID NO: 84287 - DNA, 25 bp, S. pombe
cgggcatttttcattctttcaacac

SEQ ID NO: 84288 - DNA, 25 bp, S. pombe
cggtggttttatcgtgtattctact

SEQ ID NO: 84289 - DNA, 25 bp, S. pombe
cgtagcgatcttttcgttcttatca

SEQ ID NO: 84290 - DNA, 25 bp, S. pombe
cgtcctggttgttgctcatgatata

SEQ ID NO: 84291 - DNA, 25 bp, S. pombe
cgatgctatagctgttgcctgttat

SEQ ID NO: 84292 - DNA, 25 bp, S. pombe
cgtctagagggcaatcgctattatg

SEQ ID NO: 84293 - DNA, 25 bp, S. pombe
cgttatggactctcgttttgggatc

SEQ ID NO: 84294 - DNA, 25 bp, S. pombe
cgttgagatcttttcgttttggact

SEQ ID NO: 84295 - DNA, 25 bp, S. pombe
cgtcaatatcttttcctttctcgtg

SEQ ID NO: 84296 - DNA, 25 bp, S. pombe
cgacgttgttttctttgctcagtaa

SEQ ID NO: 84297 - DNA, 25 bp, S. pombe
cgtcgttcgtaaacttgccactgaa

SEQ ID NO: 84298 - DNA, 25 bp, S. pombe
cgacctgatttaatcgttccctaca

SEQ ID NO: 84299 - DNA, 25 bp, S. pombe
cgtgctgatgaacgacgcattcgaa

SEQ ID NO: 84300 - DNA, 25 bp, S. pombe
ccttatcctattcgcttcgaaggga

SEQ ID NO: 84301 - DNA, 25 bp, S. pombe
cgttcacattttccgtctcaaggag

SEQ ID NO: 84302 - DNA, 25 bp, S. pombe
cgtaccttggtctgtggcatcacaa

SEQ ID NO: 84303 - DNA, 25 bp, S. pombe
cgtcacctctggatctttacataag

SEQ ID NO: 84304 - DNA, 25 bp, S. pombe
cgaaagctcttgatgtcgctatcat

SEQ ID NO: 84305 - DNA, 25 bp, S. pombe
cgtagcattcctcaatttcaacagc

SEQ ID NO: 84306 - DNA, 25 bp, S. pombe
cgtggcaccttttattctagcgagt

SEQ ID NO: 84307 - DNA, 25 bp, S. pombe
cgagacggtttaattttggcagagc

SEQ ID NO: 84308 - DNA, 25 bp, S. pombe
cgtaagactgttacatctttggatg

SEQ ID NO: 84309 - DNA, 25 bp, S. pombe
cgaaaattcttatctggtggctgca

SEQ ID NO: 84310 - DNA, 25 bp, S. pombe
cgaagttattaatcgcgcttggcgt

SEQ ID NO: 84311 - DNA, 25 bp, S. pombe
ttagacattacggttcctactctgg

SEQ ID NO: 84312 - DNA, 25 bp, S. pombe
gaaaagtagtgtcttcttccggcct

SEQ ID NO: 84313 - DNA, 25 bp, S. pombe
gaaaaggaagtctttcccgccatgg

SEQ ID NO: 84314 - DNA, 25 bp, S. pombe
gcgaacgacacttttatccgtacca

SEQ ID NO: 84315 - DNA, 25 bp, S. pombe
cgaagcgatccttggaatctccata

SEQ ID NO: 84316 - DNA, 25 bp, S. pombe
cgatgtgagacgtgcaactgtacta

SEQ ID NO: 84317 - DNA, 25 bp, S. pombe
cgtgccggctcagtcagatttgtga

SEQ ID NO: 84318 - DNA, 25 bp, S. pombe
cgaagacctctctgcattcaatgaa

SEQ ID NO: 84319 - DNA, 25 bp, S. pombe
cgttatccgctgtcttgtcaagcag

SEQ ID NO: 84320 - DNA, 25 bp, S. pombe
cgtcttcgcatgtctcgcaatagaa

SEQ ID NO: 84321 - DNA, 25 bp, S. pombe
cgttcctctttccatattgcatatg

SEQ ID NO: 84322 - DNA, 25 bp, S. pombe
cgtactctaagtttcaggcatataa

SEQ ID NO: 84323 - DNA, 25 bp, S. pombe
cgatacctcgagatgtcgtgttaga

SEQ ID NO: 84324 - DNA, 25 bp, S. pombe
cgtcgcaccatccaatttgttgatt

SEQ ID NO: 84325 - DNA, 25 bp, S. pombe
cgtggcttctgatatacgtgaatcc

SEQ ID NO: 84326 - DNA, 25 bp, S. pombe
cgaagatttgatccgcactgtgcga

SEQ ID NO: 84327 - DNA, 25 bp, S. pombe
cgaaaatatttgcacatctacgatt

SEQ ID NO: 84328 - DNA, 25 bp, S. pombe
cgataactatcctccactttatgtt

SEQ ID NO: 84329 - DNA, 25 bp, S. pombe
cgttcactctactcgttcaatgatg

SEQ ID NO: 84330 - DNA, 25 bp, S. pombe
cgagctactatctccgtacaaggta

SEQ ID NO: 84331 - DNA, 25 bp, S. pombe
ccctctctcggtattaacggacttg

SEQ ID NO: 84332 - DNA, 25 bp, S. pombe
cgagctttcgacttgtgatcatggt

SEQ ID NO: 84333 - DNA, 25 bp, S. pombe
cgatgtttccgttgttgacttgacc

SEQ ID NO: 84334 - DNA, 25 bp, S. pombe
cgttcctccagttgaaacttcatca

SEQ ID NO: 84335 - DNA, 25 bp, S. pombe
cgtgtccccgctgatgaacttaaag

SEQ ID NO: 84336 - DNA, 25 bp, S. pombe
cgagcccgtcgatataactgtggat

SEQ ID NO: 84337 - DNA, 25 bp, S. pombe
gcgaccagtgcggagatcagaatct

SEQ ID NO: 84338 - DNA, 25 bp, S. pombe
gctggcctgggaaggaattactgct

SEQ ID NO: 84339 - DNA, 25 bp, S. pombe
ccgtgcatgcactaggagaccattt

SEQ ID NO: 84340 - DNA, 25 bp, S. pombe
cgacccagttcactcaattttacta

SEQ ID NO: 84341 - DNA, 25 bp, S. pombe
cgagcaaagcttggccaggcagtat

SEQ ID NO: 84342 - DNA, 25 bp, S. pombe
cgtgctgcaggctactctgatgaaa

SEQ ID NO: 84343 - DNA, 25 bp, S. pombe
cgcctacctatttccaacatttgat

SEQ ID NO: 84344 - DNA, 25 bp, S. pombe
cgagcccggtattaccttttgatgt

SEQ ID NO: 84345 - DNA, 25 bp, S. pombe
cgatgaactgtttacgcgttttgga

SEQ ID NO: 84346 - DNA, 25 bp, S. pombe
gccaacttctttacctaatgttcgg

SEQ ID NO: 84347 - DNA, 25 bp, S. pombe
cgtctcaattcctccaatgcgaaaa

SEQ ID NO: 84348 - DNA, 25 bp, S. pombe
cgctgtttcttatggtggtatcttt

SEQ ID NO: 84349 - DNA, 25 bp, S. pombe
cgatttttatgctcatgccgttagt

SEQ ID NO: 84350 - DNA, 25 bp, S. pombe
cgtccgctggactattgttcaaatt

SEQ ID NO: 84351 - DNA, 25 bp, S. pombe
cgtccgcttgtcttaggttcaaatg

SEQ ID NO: 84352 - DNA, 25 bp, S. pombe
cgtcgcgtcatgactgaaggtctat

SEQ ID NO: 84353 - DNA, 25 bp, S. pombe
cgtctggtgcggcaaagctcttaaa

SEQ ID NO: 84354 - DNA, 25 bp, S. pombe
gccctggcggtgcaaactattttaa

SEQ ID NO: 84355 - DNA, 25 bp, S. pombe
gggccttactgctgcggaagagtcc

SEQ ID NO: 84356 - DNA, 25 bp, S. pombe
gactattcccaaagcctcaaatgag

SEQ ID NO: 84357 - DNA, 25 bp, S. pombe
cgaatttgcaaaagagccctccgtt

SEQ ID NO: 84358 - DNA, 25 bp, S. pombe
cgattttgaggaagagccaccgctt

SEQ ID NO: 84359 - DNA, 25 bp, S. pombe
cgttgtattgattgagacccctctt

SEQ ID NO: 84360 - DNA, 25 bp, S. pombe
cgattatattttacggcgcctctat

SEQ ID NO: 84361 - DNA, 25 bp, S. pombe
cgtataatcggttctggtggctcta

SEQ ID NO: 84362 - DNA, 25 bp, S. pombe
cgacgaatctgccaatcctaatgag

SEQ ID NO: 84363 - DNA, 25 bp, S. pombe
cgactgattcctttttactgggtca

SEQ ID NO: 84364 - DNA, 25 bp, S. pombe
cgagttatgctttctactactgaag

SEQ ID NO: 84365 - DNA, 25 bp, S. pombe
cgagctgatggtttgtttccgagag

SEQ ID NO: 84366 - DNA, 25 bp, S. pombe
cgttccattttcatctaccaaagct

SEQ ID NO: 84367 - DNA, 25 bp, S. pombe
cgttcgcatgcctaggtctacaaaa

SEQ ID NO: 84368 - DNA, 25 bp, S. pombe
cgacttcaccatccgttcaaaataa

SEQ ID NO: 84369 - DNA, 25 bp, S. pombe
cgagtgtcacatatcgtttacgata

SEQ ID NO: 84370 - DNA, 25 bp, S. pombe
cgtctacaatcaatcgtttccgcaa

SEQ ID NO: 84371 - DNA, 25 bp, S. pombe
cgactaatgcctactttgccattga

SEQ ID NO: 84372 - DNA, 25 bp, S. pombe
cgatcctgatcgcatgttggttaaa

SEQ ID NO: 84373 - DNA, 25 bp, S. pombe
cgtttagatctccttgttcatttgc

SEQ ID NO: 84374 - DNA, 25 bp, S. pombe
cgtttacttccccttgatattgatc

SEQ ID NO: 84375 - DNA, 25 bp, S. pombe
cgttcttcttcacgtcgagatttga

SEQ ID NO: 84376 - DNA, 25 bp, S. pombe
cgtacttttctcctgctagtattga

SEQ ID NO: 84377 - DNA, 25 bp, S. pombe
cgattcttttcctttattcttcaca

SEQ ID NO: 84378 - DNA, 25 bp, S. pombe
cgttcttcttctgtctatttgttaa

SEQ ID NO: 84379 - DNA, 25 bp, S. pombe
cgttccatctgaccttacagttggt

SEQ ID NO: 84380 - DNA, 25 bp, S. pombe
gccattgaagcccttcgccgttgtc

SEQ ID NO: 84381 - DNA, 25 bp, S. pombe
ccattgaagcccttcgccgttgtca

SEQ ID NO: 84382 - DNA, 25 bp, S. pombe
cgatagttcctctcctttatgtaat

SEQ ID NO: 84383 - DNA, 25 bp, S. pombe
cgccatcataacactactcgtatta

SEQ ID NO: 84384 - DNA, 25 bp, S. pombe
cgcttttaaatctctggctgttgcc

SEQ ID NO: 84385 - DNA, 25 bp, S. pombe
cgattctctgaacaccattgctagt

SEQ ID NO: 84386 - DNA, 25 bp, S. pombe
cgatcgtcgtaccattcttgtagta

SEQ ID NO: 84387 - DNA, 25 bp, S. pombe
cgatcttccatacgttttgtctttc

SEQ ID NO: 84388 - DNA, 25 bp, S. pombe
cgaccgctgcgtttttatactatac

SEQ ID NO: 84389 - DNA, 25 bp, S. pombe
cgtacaggctgatgtgtggtctcta

SEQ ID NO: 84390 - DNA, 25 bp, S. pombe
cgctcatcggatgttgttctgaagt

SEQ ID NO: 84391 - DNA, 25 bp, S. pombe
cgtacagccctatccttatgataaa

SEQ ID NO: 84392 - DNA, 25 bp, S. pombe
cgtatcccctttatcttgcatggaa

SEQ ID NO: 84393 - DNA, 25 bp, S. pombe
cgttccctctgatatctcatttgaa

SEQ ID NO: 84394 - DNA, 25 bp, S. pombe
cgcatggcgatcatcatcatcttta

SEQ ID NO: 84395 - DNA, 25 bp, S. pombe
cgatgataccactactcgatctaac

SEQ ID NO: 84396 - DNA, 25 bp, S. pombe
cgatgttcgccaattcgttattcgt

SEQ ID NO: 84397 - DNA, 25 bp, S. pombe
cgagttctggtcatcaagtgttcaa

SEQ ID NO: 84398 - DNA, 25 bp, S. pombe
cgagtccatggttagcaagctgtct

SEQ ID NO: 84399 - DNA, 25 bp, S. pombe
cgagctcctctcatacaagtatttc

SEQ ID NO: 84400 - DNA, 25 bp, S. pombe
gcgattccgatcagactaccattgc

SEQ ID NO: 84401 - DNA, 25 bp, S. pombe
ccatcaccatgagctttactacttt

SEQ ID NO: 84402 - DNA, 25 bp, S. pombe
cgcaaactgtggctgatcttctaaa

SEQ ID NO: 84403 - DNA, 25 bp, S. pombe
cgagcaaccagcgttttgtgtaaat

SEQ ID NO: 84404 - DNA, 25 bp, S. pombe
cgatgccacggtttcatatctgata

SEQ ID NO: 84405 - DNA, 25 bp, S. pombe
ccatcgttctcgtcgggctaaaagc

SEQ ID NO: 84406 - DNA, 25 bp, S. pombe
gccgagctagatatgcgaggccgct

SEQ ID NO: 84407 - DNA, 25 bp, S. pombe
ccctgctgccagttgtggtgatatg

SEQ ID NO: 84408 - DNA, 25 bp, S. pombe
gcctatgtacgataccatttccgag

SEQ ID NO: 84409 - DNA, 25 bp, S. pombe
cgctcagttgcacccgaagaatttc

SEQ ID NO: 84410 - DNA, 25 bp, S. pombe
cgttcttctcatccagcaataactt

SEQ ID NO: 84411 - DNA, 25 bp, S. pombe
cgctgaccagcctcaatataactat

SEQ ID NO: 84412 - DNA, 25 bp, S. pombe
gcgcgaagaggctaatcaagacact

SEQ ID NO: 84413 - DNA, 25 bp, S. pombe
ccgaaacttctggacgtagcaacaa

SEQ ID NO: 84414 - DNA, 25 bp, S. pombe
cgacaaactttgacggctgcagaac

SEQ ID NO: 84415 - DNA, 25 bp, S. pombe
cgagatcctagttctttacctaaag

SEQ ID NO: 84416 - DNA, 25 bp, S. pombe
cgatattcctgtgcgtgtacgtaat

SEQ ID NO: 84417 - DNA, 25 bp, S. pombe
cgaagggctcgagctgctggtataa

SEQ ID NO: 84418 - DNA, 25 bp, S. pombe
cgaactggctgctattatgggtata

SEQ ID NO: 84419 - DNA, 25 bp, S. pombe
cgattccgacattcttgctgcttag

SEQ ID NO: 84420 - DNA, 25 bp, S. pombe
cgagcttaaagcaccgcctaaagaa

SEQ ID NO: 84421 - DNA, 25 bp, S. pombe
cgctcgttattgtgcccctagaaga

SEQ ID NO: 84422 - DNA, 25 bp, S. pombe
cccctcttggtaatgcatcacgaac

SEQ ID NO: 84423 - DNA, 25 bp, S. pombe
ccttcgttctggtaaagctaaattg

SEQ ID NO: 84424 - DNA, 25 bp, S. pombe
cgttccttctcgtcaagatgtcgaa

SEQ ID NO: 84425 - DNA, 25 bp, S. pombe
cgttccttgtcgtgttgattctatt

SEQ ID NO: 84426 - DNA, 25 bp, S. pombe
cgttgctcttcttattttgttcttg

SEQ ID NO: 84427 - DNA, 25 bp, S. pombe
cgttgacttccgattttgctatgaa

SEQ ID NO: 84428 - DNA, 25 bp, S. pombe
cgagcctttactgttggcggaaata

SEQ ID NO: 84429 - DNA, 25 bp, S. pombe
cgccctttactttctgggagaatat

SEQ ID NO: 84430 - DNA, 25 bp, S. pombe
cgcaccccttaatctggtcaaatag

SEQ ID NO: 84431 - DNA, 25 bp, S. pombe
cgattcactttcattctcttcaaat

SEQ ID NO: 84432 - DNA, 25 bp, S. pombe
cgccgagttatctcctgtaactgat

SEQ ID NO: 84433 - DNA, 25 bp, S. pombe
cgcaggaccttcttcgtaaaacatt

SEQ ID NO: 84434 - DNA, 25 bp, S. pombe
ccgtactctttctgactacaacatt

SEQ ID NO: 84435 - DNA, 25 bp, S. pombe
ccgtcaactttgtcaagcctcaaat

SEQ ID NO: 84436 - DNA, 25 bp, S. pombe
gccttccttgaagaattcggctcac

SEQ ID NO: 84437 - DNA, 25 bp, S. pombe
cgctctttttctgcgaagggacaac

SEQ ID NO: 84438 - DNA, 25 bp, S. pombe
ccgtcatcgacttcctaaactaaat

SEQ ID NO: 84439 - DNA, 25 bp, S. pombe
ccgctaagctccgtaaagaccattg

SEQ ID NO: 84440 - DNA, 25 bp, S. pombe
gctcgaaagtttcaaatggcaattt

SEQ ID NO: 84441 - DNA, 25 bp, S. pombe
ccgggaggttccacaggcatattga

SEQ ID NO: 84442 - DNA, 25 bp, S. pombe
ccgtaaggtcccaactgagcatgaa

SEQ ID NO: 84443 - DNA, 25 bp, S. pombe
ccgctagcttccttaactactgata

SEQ ID NO: 84444 - DNA, 25 bp, S. pombe
cgccgaaggatttcaacgcgtctta

SEQ ID NO: 84445 - DNA, 25 bp, S. pombe
tgccgccgagggtttcaaattggac

SEQ ID NO: 84446 - DNA, 25 bp, S. pombe
tcgacctagggatttcaagctttgt

SEQ ID NO: 84447 - DNA, 25 bp, S. pombe
cgcccttggttcttcatacaattgt

SEQ ID NO: 84448 - DNA, 25 bp, S. pombe
cgcatacttcgtcttaagccatttg

SEQ ID NO: 84449 - DNA, 25 bp, S. pombe
cgacgattaccttctgttcaacata

SEQ ID NO: 84450 - DNA, 25 bp, S. pombe
gccttagttaagagtccggcgaaca

SEQ ID NO: 84451 - DNA, 25 bp, S. pombe
ccgtggtatggaattcgtcggccaa

SEQ ID NO: 84452 - DNA, 25 bp, S. pombe
cgcttccagctccattgattgataa

SEQ ID NO: 84453 - DNA, 25 bp, S. pombe
cgccatgaagcgcaattgctatcta

SEQ ID NO: 84454 - DNA, 25 bp, S. pombe
cgcgcattgtcggatattcttgaaa

SEQ ID NO: 84455 - DNA, 25 bp, S. pombe
ccaccattgggatttctacgaccta

SEQ ID NO: 84456 - DNA, 25 bp, S. pombe
ccccttgcaatatttttagaccatt

SEQ ID NO: 84457 - DNA, 25 bp, S. pombe
cgccgtcgcaaaattatccgttatt

SEQ ID NO: 84458 - DNA, 25 bp, S. pombe
ggctccaaggagacgaataagtttt

SEQ ID NO: 84459 - DNA, 25 bp, S. pombe
cccgagatccggcttcatataatgc

SEQ ID NO: 84460 - DNA, 25 bp, S. pombe
gcctgttttgggtaagaagcttcgc

SEQ ID NO: 84461 - DNA, 25 bp, S. pombe
gcgaaggtattgatccagctcccta

SEQ ID NO: 84462 - DNA, 25 bp, S. pombe
cgaaggatttcaattgcagcatgct

SEQ ID NO: 84463 - DNA, 25 bp, S. pombe
cgactcttcatctactaactcattt

SEQ ID NO: 84464 - DNA, 25 bp, S. pombe
cgactccatcacagaacctgtttta

SEQ ID NO: 84465 - DNA, 25 bp, S. pombe
cgcaccacagtctgcttttgatgga

SEQ ID NO: 84466 - DNA, 25 bp, S. pombe
cgacctcttgcagctttgttagcaa

SEQ ID NO: 84467 - DNA, 25 bp, S. pombe
cgacctcatgactattttgcggaaa

SEQ ID NO: 84468 - DNA, 25 bp, S. pombe
cgagctctgatacttcttttggaaa

SEQ ID NO: 84469 - DNA, 25 bp, S. pombe
cgagctgttcgttctttcgatgaag

SEQ ID NO: 84470 - DNA, 25 bp, S. pombe
cgctagcattcatttccataccaga

SEQ ID NO: 84471 - DNA, 25 bp, S. pombe
cgaagttctccgtctattagatgaa

SEQ ID NO: 84472 - DNA, 25 bp, S. pombe
cgaaccactactccttatatgacaa

SEQ ID NO: 84473 - DNA, 25 bp, S. pombe
cgctactccatctctctgaaaaatg

SEQ ID NO: 84474 - DNA, 25 bp, S. pombe
cgctcactctgctttccaaaaaatt

SEQ ID NO: 84475 - DNA, 25 bp, S. pombe
cgcgcaatcatctcgtccaaaagag

SEQ ID NO: 84476 - DNA, 25 bp, S. pombe
cgagactatatctgtcgctgagaat

SEQ ID NO: 84477 - DNA, 25 bp, S. pombe
cgaggattcaacgtctggcaaaaag

SEQ ID NO: 84478 - DNA, 25 bp, S. pombe
cgagtagctatcaagttgtctgcaa

SEQ ID NO: 84479 - DNA, 25 bp, S. pombe
cgatgctactattactatgcctgct

SEQ ID NO: 84480 - DNA, 25 bp, S. pombe
cgactactcatgtacagcatcctaa

SEQ ID NO: 84481 - DNA, 25 bp, S. pombe
cgcactggtttatatctcgactatt

SEQ ID NO: 84482 - DNA, 25 bp, S. pombe
cgaggagtatttgctcttgagccta

SEQ ID NO: 84483 - DNA, 25 bp, S. pombe
cgacagtttactgcttcgcatcaat

SEQ ID NO: 84484 - DNA, 25 bp, S. pombe
cgagagtatgtttcctatcgataaa

SEQ ID NO: 84485 - DNA, 25 bp, S. pombe
cgaagtggctgatcctacgttcaaa

SEQ ID NO: 84486 - DNA, 25 bp, S. pombe
cgagtggtgtaatccctgcttacaa

SEQ ID NO: 84487 - DNA, 25 bp, S. pombe
cgcaaacctcatatgtctcgtgaaa

SEQ ID NO: 84488 - DNA, 25 bp, S. pombe
cgaatgtcctcgatgtgcttataaa

SEQ ID NO: 84489 - DNA, 25 bp, S. pombe
cgactacttcgggtgataggtacac

SEQ ID NO: 84490 - DNA, 25 bp, S. pombe
cgatgtcctcatttcgttttatcaa

SEQ ID NO: 84491 - DNA, 25 bp, S. pombe
cgagacttgcattccgactgattta

SEQ ID NO: 84492 - DNA, 25 bp, S. pombe
cgatgagctattaacgcggtaccgt

SEQ ID NO: 84493 - DNA, 25 bp, S. pombe
gcctacgatttattcgtggacgcgt

SEQ ID NO: 84494 - DNA, 25 bp, S. pombe
gcgtacttactttctgatggatccc

SEQ ID NO: 84495 - DNA, 25 bp, S. pombe
cgctactttatttggagtgtcccta

SEQ ID NO: 84496 - DNA, 25 bp, S. pombe
ccaccattcttttgggatgttccgg

SEQ ID NO: 84497 - DNA, 25 bp, S. pombe
cgcgcgcgttgaagacattagtcca

SEQ ID NO: 84498 - DNA, 25 bp, S. pombe
cgccgacttatacgcactacaatca

SEQ ID NO: 84499 - DNA, 25 bp, S. pombe
cgcccagctgtagtcgatgtatcga

SEQ ID NO: 84500 - DNA, 25 bp, S. pombe
ccacttggccaactaaacgatcttt

SEQ ID NO: 84501 - DNA, 25 bp, S. pombe
cgatgcgtttcgtaagttcttttga

SEQ ID NO: 84502 - DNA, 25 bp, S. pombe
cgacgctgatgatgccggagagtta

SEQ ID NO: 84503 - DNA, 25 bp, S. pombe
cgatgttctctcgtggtaattcgat

SEQ ID NO: 84504 - DNA, 25 bp, S. pombe
cgatgatgtttcttggtcagttcaa

SEQ ID NO: 84505 - DNA, 25 bp, S. pombe
cgaagtattctgcagggctatcata

SEQ ID NO: 84506 - DNA, 25 bp, S. pombe
cgaagtagtcgttgcgcgtcattgt

SEQ ID NO: 84507 - DNA, 25 bp, S. pombe
cgaaatttgtttactacttagctat

SEQ ID NO: 84508 - DNA, 25 bp, S. pombe
cgaaaatcctttacgtgctctatat

SEQ ID NO: 84509 - DNA, 25 bp, S. pombe
cgccccatacgtagtgcagtcaaat

SEQ ID NO: 84510 - DNA, 25 bp, S. pombe
cgccctccgattcatatcaatacaa

SEQ ID NO: 84511 - DNA, 25 bp, S. pombe
cgcaccagctttttcatcatgttaa

SEQ ID NO: 84512 - DNA, 25 bp, S. pombe
cgacgaatccgtcattgctgaagat

SEQ ID NO: 84513 - DNA, 25 bp, S. pombe
ccgaggctactttgcttaacatgtt

SEQ ID NO: 84514 - DNA, 25 bp, S. pombe
cccagtctgctcgtacttacataga

SEQ ID NO: 84515 - DNA, 25 bp, S. pombe
cgagcgtcaagctttcgcgagagca

SEQ ID NO: 84516 - DNA, 25 bp, S. pombe
ccccttactgattgcggttatggtc

SEQ ID NO: 84517 - DNA, 25 bp, S. pombe
cgactatttcgtgcatttggttgaa

SEQ ID NO: 84518 - DNA, 25 bp, S. pombe
cgccgatttcttgattcccattgaa

SEQ ID NO: 84519 - DNA, 25 bp, S. pombe
cccgctagagccgtcgagttaatta

SEQ ID NO: 84520 - DNA, 25 bp, S. pombe
cccatccatggccttttcaaaaaga

SEQ ID NO: 84521 - DNA, 25 bp, S. pombe
cgccggtggccgtatgtcaaaaaag

SEQ ID NO: 84522 - DNA, 25 bp, S. pombe
cccattgctgcagtcgaagtcgaat

SEQ ID NO: 84523 - DNA, 25 bp, S. pombe
ccgcctccaagtttgctgaacgtaa

SEQ ID NO: 84524 - DNA, 25 bp, S. pombe
cgcatcgcccattgtttcaacaagt

SEQ ID NO: 84525 - DNA, 25 bp, S. pombe
ccgtgcctcctgatttagcaaaggt

SEQ ID NO: 84526 - DNA, 25 bp, S. pombe
tcgtagaaccggtcttttgcgtggt

SEQ ID NO: 84527 - DNA, 25 bp, S. pombe
cgaaaaccgcttgggtggtggctct

SEQ ID NO: 84528 - DNA, 25 bp, S. pombe
cctaatcctggaaacgttatcggtg

SEQ ID NO: 84529 - DNA, 25 bp, S. pombe
cctaatgctcttgtaattgcccttt

SEQ ID NO: 84530 - DNA, 25 bp, S. pombe
gccgaatggcttgttttaactcaac

SEQ ID NO: 84531 - DNA, 25 bp, S. pombe
tccgaaggtcgtgttatttccgtcg

SEQ ID NO: 84532 - DNA, 25 bp, S. pombe
tggaacggtcagtgggtctcccaaa

SEQ ID NO: 84533 - DNA, 25 bp, S. pombe
gctaactggacgtgggataccccaa

SEQ ID NO: 84534 - DNA, 25 bp, S. pombe
gccaaggaacctgaggaacctccaa

SEQ ID NO: 84535 - DNA, 25 bp, S. pombe
ccggcttactctggaactacgttga

SEQ ID NO: 84536 - DNA, 25 bp, S. pombe
cccgttgcctatgatactaccattt

SEQ ID NO: 84537 - DNA, 25 bp, S. pombe
ccactgcacgcttacactaaaaact

SEQ ID NO: 84538 - DNA, 25 bp, S. pombe
cgcctcactcagtacctattgaagg

SEQ ID NO: 84539 - DNA, 25 bp, S. pombe
cgctgccttagccagtggtaattat

SEQ ID NO: 84540 - DNA, 25 bp, S. pombe
ccctttagcgggtttgatgatcttg

SEQ ID NO: 84541 - DNA, 25 bp, S. pombe
cccattccgcggttttgtgatggaa

SEQ ID NO: 84542 - DNA, 25 bp, S. pombe
cgctttccctcttttcattgattat

SEQ ID NO: 84543 - DNA, 25 bp, S. pombe
cgctaccatcctcatgttgattgta

SEQ ID NO: 84544 - DNA, 25 bp, S. pombe
cgctgccatcatgtgctttttgtaa

SEQ ID NO: 84545 - DNA, 25 bp, S. pombe
cgaattttcaatcgcatctgaggaa

SEQ ID NO: 84546 - DNA, 25 bp, S. pombe
cgagcctttgaacccatgcattatg

SEQ ID NO: 84547 - DNA, 25 bp, S. pombe
cgagctgttatagccctgaatcttt

SEQ ID NO: 84548 - DNA, 25 bp, S. pombe
cccagtccagacaccatgttttatg

SEQ ID NO: 84549 - DNA, 25 bp, S. pombe
cccagaccagccactatgatttatt

SEQ ID NO: 84550 - DNA, 25 bp, S. pombe
cgcccatcatgggattcgtacttta

SEQ ID NO: 84551 - DNA, 25 bp, S. pombe
cgcagcgctcatctttagaatcttt

SEQ ID NO: 84552 - DNA, 25 bp, S. pombe
cgccgtttcgattgcctggttggaa

SEQ ID NO: 84553 - DNA, 25 bp, S. pombe
ccacctttggaacgctttttgactg

SEQ ID NO: 84554 - DNA, 25 bp, S. pombe
cgcactctttggttggttgttatca

SEQ ID NO: 84555 - DNA, 25 bp, S. pombe
cgctctttgccgtttcattatttac

SEQ ID NO: 84556 - DNA, 25 bp, S. pombe
cgcctcttgtcttgcattgatgatt

SEQ ID NO: 84557 - DNA, 25 bp, S. pombe
cgcgctctatgtcatcttgaaggta

SEQ ID NO: 84558 - DNA, 25 bp, S. pombe
cgctgatctcgtcaattccattttt

SEQ ID NO: 84559 - DNA, 25 bp, S. pombe
cgctaccagtgggatctaaatattt

SEQ ID NO: 84560 - DNA, 25 bp, S. pombe
ccaacctttcgggagatgttcatgg

SEQ ID NO: 84561 - DNA, 25 bp, S. pombe
ccccgacttcgtcatggtaatgatg

SEQ ID NO: 84562 - DNA, 25 bp, S. pombe
ccccaacctttcaatatgctagacg

SEQ ID NO: 84563 - DNA, 25 bp, S. pombe
ccccagccgtactttatcataataa

SEQ ID NO: 84564 - DNA, 25 bp, S. pombe
cccaaccttggcatttttactcata

SEQ ID NO: 84565 - DNA, 25 bp, S. pombe
ccgcaaactttaccctgattactat

SEQ ID NO: 84566 - DNA, 25 bp, S. pombe
cccaacaccttgagcactttagtaa

SEQ ID NO: 84567 - DNA, 25 bp, S. pombe
gcgcgaatggcgaccagaccaggaa

SEQ ID NO: 84568 - DNA, 25 bp, S. pombe
cgctgtattcaaaccgctgagtcaa

SEQ ID NO: 84569 - DNA, 25 bp, S. pombe
ccggtgatctgctaactccaattaa

SEQ ID NO: 84570 - DNA, 25 bp, S. pombe
cgcaggcgccgttctcataaaaaag

SEQ ID NO: 84571 - DNA, 25 bp, S. pombe
cgcggcccgtttaagtacaaatgat

SEQ ID NO: 84572 - DNA, 25 bp, S. pombe
cctgggacatgttttgggacttgga

SEQ ID NO: 84573 - DNA, 25 bp, S. pombe
cgctagaggatttacgagggttgtt

SEQ ID NO: 84574 - DNA, 25 bp, S. pombe
cgaagctgtctttactggtgatgtt

SEQ ID NO: 84575 - DNA, 25 bp, S. pombe
cgaacgatttgacctctctgagttt

SEQ ID NO: 84576 - DNA, 25 bp, S. pombe
cgaacactttgagctttggtacatt

SEQ ID NO: 84577 - DNA, 25 bp, S. pombe
cgaaatctttcggtctagcaggaat

SEQ ID NO: 84578 - DNA, 25 bp, S. pombe
cgcaggcttttaccgtctagtagat

SEQ ID NO: 84579 - DNA, 25 bp, S. pombe
cgaagcttttgatcgtcctgaagaa

SEQ ID NO: 84580 - DNA, 25 bp, S. pombe
cgcaatgtatttgagccgccgatta

SEQ ID NO: 84581 - DNA, 25 bp, S. pombe
cgcactttcggcagcttttggaata

SEQ ID NO: 84582 - DNA, 25 bp, S. pombe
ccaattccccgaagctttagcagat

SEQ ID NO: 84583 - DNA, 25 bp, S. pombe
ccgacccagacgtgctttatgagta

SEQ ID NO: 84584 - DNA, 25 bp, S. pombe
ccggccaagtcggaggttgtgcaat

SEQ ID NO: 84585 - DNA, 25 bp, S. pombe
cccaaagggcgctggtatgcttaaa

SEQ ID NO: 84586 - DNA, 25 bp, S. pombe
cgccatggatgctgtgtcgttcaaa

SEQ ID NO: 84587 - DNA, 25 bp, S. pombe
cccatcgtcacgttcgtatctagaa

SEQ ID NO: 84588 - DNA, 25 bp, S. pombe
gcgtacgtaagattttctcccttca

SEQ ID NO: 84589 - DNA, 25 bp, S. pombe
gccagacttcaaaagatgccacctc

SEQ ID NO: 84590 - DNA, 25 bp, S. pombe
gctgcattggtacaaagccacccag

SEQ ID NO: 84591 - DNA, 25 bp, S. pombe
cgcttcctagctgtatgggtctaat

SEQ ID NO: 84592 - DNA, 25 bp, S. pombe
cgctttctaattatggcttccgatg

SEQ ID NO: 84593 - DNA, 25 bp, S. pombe
cgcttgtgctcattagttcatccta

SEQ ID NO: 84594 - DNA, 25 bp, S. pombe
cgcattgatgcgttacttagggaaa

SEQ ID NO: 84595 - DNA, 25 bp, S. pombe
ccatgctgacgacctttacggtaaa

SEQ ID NO: 84596 - DNA, 25 bp, S. pombe
cgcgtacgacgtttcatctatcaaa

SEQ ID NO: 84597 - DNA, 25 bp, S. pombe
gcgagttgcgggtttgcgtcaaata

SEQ ID NO: 84598 - DNA, 25 bp, S. pombe
cgctttgccttgttttgtcgattca

SEQ ID NO: 84599 - DNA, 25 bp, S. pombe
cccatgtcgtttttgcgtcgtataa

SEQ ID NO: 84600 - DNA, 25 bp, S. pombe
cccaatcgtttgtgtatctcctaaa

SEQ ID NO: 84601 - DNA, 25 bp, S. pombe
cgcgcaatagttagacgttccaaaa

SEQ ID NO: 84602 - DNA, 25 bp, S. pombe
cgctttgctgttatgcgccttaaga

SEQ ID NO: 84603 - DNA, 25 bp, S. pombe
cgctacatctttttcgtcttataca

SEQ ID NO: 84604 - DNA, 25 bp, S. pombe
cgctactctctacttcgtttttgta

SEQ ID NO: 84605 - DNA, 25 bp, S. pombe
cgctattctctttccttttgtagga

SEQ ID NO: 84606 - DNA, 25 bp, S. pombe
cgaagcttctttcattttttgcgaa

SEQ ID NO: 84607 - DNA, 25 bp, S. pombe
cgaagcctattctgtgttttgtaaa

SEQ ID NO: 84608 - DNA, 25 bp, S. pombe
cgcgacccgtctgctgttaagaaaa

SEQ ID NO: 84609 - DNA, 25 bp, S. pombe
cgctgtcccggagctttatcaaaag

SEQ ID NO: 84610 - DNA, 25 bp, S. pombe
cctaaacctacgcttctcatgaata

SEQ ID NO: 84611 - DNA, 25 bp, S. pombe
cgcctctaagcgtcttcgtaataaa

SEQ ID NO: 84612 - DNA, 25 bp, S. pombe
ccttctgagcttttagaccctttga

SEQ ID NO: 84613 - DNA, 25 bp, S. pombe
cgcctggaggatattgtgccgaatt

SEQ ID NO: 84614 - DNA, 25 bp, S. pombe
cgctgctgggtattgtttcgagaat

SEQ ID NO: 84615 - DNA, 25 bp, S. pombe
cgaatcataaagctcttcatcctga

SEQ ID NO: 84616 - DNA, 25 bp, S. pombe
cgcttctccagataagtcagcagtt

SEQ ID NO: 84617 - DNA, 25 bp, S. pombe
cgcacttcatccatggaccaaagtt

SEQ ID NO: 84618 - DNA, 25 bp, S. pombe
cctgcctccgagaatgtgtacttga

SEQ ID NO: 84619 - DNA, 25 bp, S. pombe
cgctgacgccgatgattattcttca

SEQ ID NO: 84620 - DNA, 25 bp, S. pombe
ccgttggctcatggtttgctaacag

SEQ ID NO: 84621 - DNA, 25 bp, S. pombe
cgcagacgtggctttgttgttgaca

SEQ ID NO: 84622 - DNA, 25 bp, S. pombe
ccacctggttcatccgatatgttta

SEQ ID NO: 84623 - DNA, 25 bp, S. pombe
ccgctccattgttgacaccatatga

SEQ ID NO: 84624 - DNA, 25 bp, S. pombe
cgctcctctataacatgccgtagaa

SEQ ID NO: 84625 - DNA, 25 bp, S. pombe
ccgcactctctaaatcacaggatga

SEQ ID NO: 84626 - DNA, 25 bp, S. pombe
ccgccctctacgtctaagtgatata

SEQ ID NO: 84627 - DNA, 25 bp, S. pombe
cccatccatacggttgtcgagttat

SEQ ID NO: 84628 - DNA, 25 bp, S. pombe
cgcttccaaaatcgcatgttcagtt

SEQ ID NO: 84629 - DNA, 25 bp, S. pombe
cgctgatgcttcaaatctcgtctag

SEQ ID NO: 84630 - DNA, 25 bp, S. pombe
cgctggtaccgatcgtctagataaa

SEQ ID NO: 84631 - DNA, 25 bp, S. pombe
ccattttggttcattatcctccgaa

SEQ ID NO: 84632 - DNA, 25 bp, S. pombe
ccattcttgaaaagcttccttccga

SEQ ID NO: 84633 - DNA, 25 bp, S. pombe
ccccagttcctgctatatctaaaaa

SEQ ID NO: 84634 - DNA, 25 bp, S. pombe
cgctcgccatctatctgaggtgaaa

SEQ ID NO: 84635 - DNA, 25 bp, S. pombe
cgccgcttccacaagatttactaga

SEQ ID NO: 84636 - DNA, 25 bp, S. pombe
cgcccagtccttagacctaatgaaa

SEQ ID NO: 84637 - DNA, 25 bp, S. pombe
ccccaacccttgaccaattgaatat

SEQ ID NO: 84638 - DNA, 25 bp, S. pombe
ccccgatgcccttgagaaactgata

SEQ ID NO: 84639 - DNA, 25 bp, S. pombe
ccttatatgactttgcgggacgcag

SEQ ID NO: 84640 - DNA, 25 bp, S. pombe
ccgcaaatatatctatggtggccat

SEQ ID NO: 84641 - DNA, 25 bp, S. pombe
cccaggctgctggtgtaattcacac

SEQ ID NO: 84642 - DNA, 25 bp, S. pombe
cctggagcgcggcacttgtaaaaaa

SEQ ID NO: 84643 - DNA, 25 bp, S. pombe
gctacgtttaaagagtttgcatgtt

SEQ ID NO: 84644 - DNA, 25 bp, S. pombe
gcggagtttaaatctcttcctattg

SEQ ID NO: 84645 - DNA, 25 bp, S. pombe
ccgaaattacactcacattccttag

SEQ ID NO: 84646 - DNA, 25 bp, S. pombe
cctgatactcggtggatgctgtgaa

SEQ ID NO: 84647 - DNA, 25 bp, S. pombe
cgctgaaccccttattgatatggct

SEQ ID NO: 84648 - DNA, 25 bp, S. pombe
ccattgacctttgcctgcaaggaga

SEQ ID NO: 84649 - DNA, 25 bp, S. pombe
cgcgaagctgagattgcctaccaaa

SEQ ID NO: 84650 - DNA, 25 bp, S. pombe
ccgatttggcaattgctgttcctga

SEQ ID NO: 84651 - DNA, 25 bp, S. pombe
cccaccatcaaattctttcctaaag

SEQ ID NO: 84652 - DNA, 25 bp, S. pombe
cgcttgacgcgtgatgtttctggta

SEQ ID NO: 84653 - DNA, 25 bp, S. pombe
cgctgtatgcgtgtcttttttgtaa

SEQ ID NO: 84654 - DNA, 25 bp, S. pombe
ccgtctggttccgaggttgttcaat

SEQ ID NO: 84655 - DNA, 25 bp, S. pombe
ccgatgcggcgatttaggaggatat

SEQ ID NO: 84656 - DNA, 25 bp, S. pombe
cgcttgtcttgctttttgctttttt

SEQ ID NO: 84657 - DNA, 25 bp, S. pombe
cgcttgctctgtcatgtctctctaa

SEQ ID NO: 84658 - DNA, 25 bp, S. pombe
cgcgcgcaagttagccgggctcgaa

SEQ ID NO: 84659 - DNA, 25 bp, S. pombe
cgcgctgacactaaacgtttcgaaa

SEQ ID NO: 84660 - DNA, 25 bp, S. pombe
cccgatagtgatgaggaattgcgaa

SEQ ID NO: 84661 - DNA, 25 bp, S. pombe
ccgtcgattggtggtctatgggtat

SEQ ID NO: 84662 - DNA, 25 bp, S. pombe
ccctcttgctccttactttaaagat

SEQ ID NO: 84663 - DNA, 25 bp, S. pombe
ccccaggtttcaagctttacataga

SEQ ID NO: 84664 - DNA, 25 bp, S. pombe
cgcgcttttggtgttgctgatgata

SEQ ID NO: 84665 - DNA, 25 bp, S. pombe
cgctgttcctgttgtaccagaagct

SEQ ID NO: 84666 - DNA, 25 bp, S. pombe
cccaattccgaatgtcagcactata

SEQ ID NO: 84667 - DNA, 25 bp, S. pombe
ccgcatattccgctattaacgctga

SEQ ID NO: 84668 - DNA, 25 bp, S. pombe
ccgatgcattcttcttttaccgtaa

SEQ ID NO: 84669 - DNA, 25 bp, S. pombe
cgcgaggtcattgcttttccgaaaa

SEQ ID NO: 84670 - DNA, 25 bp, S. pombe
cctaggaaatgcatttggagggata

SEQ ID NO: 84671 - DNA, 25 bp, S. pombe
gccaaaggtcttatctcggtagtat

SEQ ID NO: 84672 - DNA, 25 bp, S. pombe
ccacaaatcgtacgccagggtttag

SEQ ID NO: 84673 - DNA, 25 bp, S. pombe
ccggatcatctacggacggcagtga

SEQ ID NO: 84674 - DNA, 25 bp, S. pombe
gccaagtattcactgaacttcgtcg

SEQ ID NO: 84675 - DNA, 25 bp, S. pombe
tccaagtcgtccaaaacctactaat

SEQ ID NO: 84676 - DNA, 25 bp, S. pombe
cccgttcctgaactacgaattgatt

SEQ ID NO: 84677 - DNA, 25 bp, S. pombe
ccccatgttcgggtactggtgttat

SEQ ID NO: 84678 - DNA, 25 bp, S. pombe
cctgcaattcgcatgattactccaa

SEQ ID NO: 84679 - DNA, 25 bp, S. pombe
gccctggtcaatctggtcgttgcga

SEQ ID NO: 84680 - DNA, 25 bp, S. pombe
cctctactcataacatggacgttcc

SEQ ID NO: 84681 - DNA, 25 bp, S. pombe
cctattaaatcgagatatgttcctt

SEQ ID NO: 84682 - DNA, 25 bp, S. pombe
gcctttgcaaatcatcacttttctc

SEQ ID NO: 84683 - DNA, 25 bp, S. pombe
ccgtcgcctatgatactactatcta

SEQ ID NO: 84684 - DNA, 25 bp, S. pombe
ccatgttatcaatgccgttcgggaa

SEQ ID NO: 84685 - DNA, 25 bp, S. pombe
ccagtggccaaaatttatcgggagt

SEQ ID NO: 84686 - DNA, 25 bp, S. pombe
cccctagtgtgcagattgattcaga

SEQ ID NO: 84687 - DNA, 25 bp, S. pombe
ccgcgagcggtgtaatccttagtat

SEQ ID NO: 84688 - DNA, 25 bp, S. pombe
ccctctgattattgtctatgcctgt

SEQ ID NO: 84689 - DNA, 25 bp, S. pombe
ccccgttcagtaggatccatttttg

SEQ ID NO: 84690 - DNA, 25 bp, S. pombe
cgccctgattggaacgactactatg

SEQ ID NO: 84691 - DNA, 25 bp, S. pombe
ccttgcgacaagaaacatcatacct

SEQ ID NO: 84692 - DNA, 25 bp, S. pombe
cctcgtcttacattggacttccaaa

SEQ ID NO: 84693 - DNA, 25 bp, S. pombe
cgcgattgaaagtgcttgcctctta

SEQ ID NO: 84694 - DNA, 25 bp, S. pombe
cgctttgtgcaatcgcttatcattt

SEQ ID NO: 84695 - DNA, 25 bp, S. pombe
cccttcgactccattatctgataat

SEQ ID NO: 84696 - DNA, 25 bp, S. pombe
cccatccaatgctcgttatcttaaa

SEQ ID NO: 84697 - DNA, 25 bp, S. pombe
ccctccgtggtgatgttgatgactt

SEQ ID NO: 84698 - DNA, 25 bp, S. pombe
cgcggtgcctacgattttggtatat

SEQ ID NO: 84699 - DNA, 25 bp, S. pombe
tcgtgtggttaaaagtatcgtatac

SEQ ID NO: 84700 - DNA, 25 bp, S. pombe
gcgcggttgtagtgctgaaagccaa

SEQ ID NO: 84701 - DNA, 25 bp, S. pombe
cgcgtttcatcgtctgctaaagcaa

SEQ ID NO: 84702 - DNA, 25 bp, S. pombe
ccgtgatgttcgtgctccagagcat

SEQ ID NO: 84703 - DNA, 25 bp, S. pombe
tccggtaaaatgaccactcctcagt

SEQ ID NO: 84704 - DNA, 25 bp, S. pombe
gccggtataaatcaagccatcgcat

SEQ ID NO: 84705 - DNA, 25 bp, S. pombe
ccgagtcaacaacagaagaagcatt

SEQ ID NO: 84706 - DNA, 25 bp, S. pombe
cctgtctccccgatgttggaagata

SEQ ID NO: 84707 - DNA, 25 bp, S. pombe
cgctggcaccagctaattgggaagt

SEQ ID NO: 84708 - DNA, 25 bp, S. pombe
cgcgctgccctgtctaatgaagaaa

SEQ ID NO: 84709 - DNA, 25 bp, S. pombe
cccaccggtcactatgctgaaataa

SEQ ID NO: 84710 - DNA, 25 bp, S. pombe
cctttggaatggacggtgctgttat

SEQ ID NO: 84711 - DNA, 25 bp, S. pombe
cctgtcgtatttatgggcgtcttag

SEQ ID NO: 84712 - DNA, 25 bp, S. pombe
ccctggtacttttgatggcgttatt

SEQ ID NO: 84713 - DNA, 25 bp, S. pombe
ccttctattgtttctccgtatggtg

SEQ ID NO: 84714 - DNA, 25 bp, S. pombe
ccttttcttactctaccagcaatta

SEQ ID NO: 84715 - DNA, 25 bp, S. pombe
ccttattctatattcgttggccaac

SEQ ID NO: 84716 - DNA, 25 bp, S. pombe
ccgctatgtcttttgtagtgcccaa

SEQ ID NO: 84717 - DNA, 25 bp, S. pombe
ccgatgtcgatttattaggcccaac

SEQ ID NO: 84718 - DNA, 25 bp, S. pombe
cctgacatgagtgggttaccgacaa

SEQ ID NO: 84719 - DNA, 25 bp, S. pombe
tccgtgcccgtgcaggacaattaga

SEQ ID NO: 84720 - DNA, 25 bp, S. pombe
ccgtgccttgatcatggacttggag

SEQ ID NO: 84721 - DNA, 25 bp, S. pombe
cccacctttgtgttctatgcgagag

SEQ ID NO: 84722 - DNA, 25 bp, S. pombe
cgctggccttgtcttctgttgagaa

SEQ ID NO: 84723 - DNA, 25 bp, S. pombe
ccatcgtttgcgctttgggactaaa

SEQ ID NO: 84724 - DNA, 25 bp, S. pombe
cgctgcttcattgtcgaacgtttga

SEQ ID NO: 84725 - DNA, 25 bp, S. pombe
cgcgctacagctgccgaattattaa

SEQ ID NO: 84726 - DNA, 25 bp, S. pombe
cgcgctatagctactcgtctattga

SEQ ID NO: 84727 - DNA, 25 bp, S. pombe
cctttgcgattttatagcgttgctc

SEQ ID NO: 84728 - DNA, 25 bp, S. pombe
ccatttgatggtacgcaggctgttc

SEQ ID NO: 84729 - DNA, 25 bp, S. pombe
ccatacgcagtcaggcaggcgttaa

SEQ ID NO: 84730 - DNA, 25 bp, S. pombe
cccacggtcttgcttggactgaaaa

SEQ ID NO: 84731 - DNA, 25 bp, S. pombe
cccctggtttgctgattactggata

SEQ ID NO: 84732 - DNA, 25 bp, S. pombe
gcctacgcattagcggaattctcct

SEQ ID NO: 84733 - DNA, 25 bp, S. pombe
ccgctctttctacagttctacagta

SEQ ID NO: 84734 - DNA, 25 bp, S. pombe
cccatctctgcattagcggaattat

SEQ ID NO: 84735 - DNA, 25 bp, S. pombe
gccgcatctgaattctgcaagcgat

SEQ ID NO: 84736 - DNA, 25 bp, S. pombe
cgcgtaaaacattcgcatcagctta

SEQ ID NO: 84737 - DNA, 25 bp, S. pombe
gcttggttgagatgtcgcattccct

SEQ ID NO: 84738 - DNA, 25 bp, S. pombe
gttggttaatgaccctattcctaat

SEQ ID NO: 84739 - DNA, 25 bp, S. pombe
gcgcttttacgcacctagtagtggg

SEQ ID NO: 84740 - DNA, 25 bp, S. pombe
cgcgatttcgcggacgtggtcaacg

SEQ ID NO: 84741 - DNA, 25 bp, S. pombe
cccggtaactgattggcgtctttat

SEQ ID NO: 84742 - DNA, 25 bp, S. pombe
ccggtattgaccctatgtccttaat

SEQ ID NO: 84743 - DNA, 25 bp, S. pombe
ccggtattattcacgctctctatat

SEQ ID NO: 84744 - DNA, 25 bp, S. pombe
ccggtggtggtattgtgtttgattc

SEQ ID NO: 84745 - DNA, 25 bp, S. pombe
cccgggtgttttatgctagatgtga

SEQ ID NO: 84746 - DNA, 25 bp, S. pombe
cccgtggttcatattgtgttcgtat

SEQ ID NO: 84747 - DNA, 25 bp, S. pombe
ccgccgtgctggattcgatgatttg

SEQ ID NO: 84748 - DNA, 25 bp, S. pombe
cccgattccgagtttgcatccaaaa

SEQ ID NO: 84749 - DNA, 25 bp, S. pombe
gcccgataacgatcttgttcaagtc

SEQ ID NO: 84750 - DNA, 25 bp, S. pombe
gcaagaagactgtgccttgtccggt

SEQ ID NO: 84751 - DNA, 25 bp, S. pombe
gcgagatacaatgtcctttcaaggg

SEQ ID NO: 84752 - DNA, 25 bp, S. pombe
cccatcatcattgagtccttctaag

SEQ ID NO: 84753 - DNA, 25 bp, S. pombe
cgccaactgctattcttcttcaaga

SEQ ID NO: 84754 - DNA, 25 bp, S. pombe
cccagcagacactccatttgaagat

SEQ ID NO: 84755 - DNA, 25 bp, S. pombe
cccgtcacacttttcctatatttat

SEQ ID NO: 84756 - DNA, 25 bp, S. pombe
cccgtgccaatgactatactcgaat

SEQ ID NO: 84757 - DNA, 25 bp, S. pombe
cccgtgccagtatatcaggtgctat

SEQ ID NO: 84758 - DNA, 25 bp, S. pombe
cccttgctacttctttgaatgctca

SEQ ID NO: 84759 - DNA, 25 bp, S. pombe
cctcgtttttgtctgcctttagaag

SEQ ID NO: 84760 - DNA, 25 bp, S. pombe
ccctggcactattcgcggtgattat

SEQ ID NO: 84761 - DNA, 25 bp, S. pombe
ccctgtctctgatcctgaatatttt

SEQ ID NO: 84762 - DNA, 25 bp, S. pombe
ccgcgttcatgccttcgagaagatt

SEQ ID NO: 84763 - DNA, 25 bp, S. pombe
cccatgttcccagttgttcaatttg

SEQ ID NO: 84764 - DNA, 25 bp, S. pombe
ccgttgccacggatgctatacagta

SEQ ID NO: 84765 - DNA, 25 bp, S. pombe
cccgccttggctatattactggaaa

SEQ ID NO: 84766 - DNA, 25 bp, S. pombe
ccgggctttgctcatttactggaag

SEQ ID NO: 84767 - DNA, 25 bp, S. pombe
cctactggctaggtttttgcggtat

SEQ ID NO: 84768 - DNA, 25 bp, S. pombe
tcaggaaaggtgtttcgtccggttg

SEQ ID NO: 84769 - DNA, 25 bp, S. pombe
tcgctcaaagggttacggctacgtt

SEQ ID NO: 84770 - DNA, 25 bp, S. pombe
cccgacgtcgtctttttgatatgag

SEQ ID NO: 84771 - DNA, 25 bp, S. pombe
cccgtcgtgcttcttctatgaaaaa

SEQ ID NO: 84772 - DNA, 25 bp, S. pombe
cgccgtgaggcttccttttgaagaa

SEQ ID NO: 84773 - DNA, 25 bp, S. pombe
cccgctggagcttcggtaggccgaa

SEQ ID NO: 84774 - DNA, 25 bp, S. pombe
cccgcgtgccaatgataaccttgat

SEQ ID NO: 84775 - DNA, 25 bp, S. pombe
cccttctgcggacgtaacactgtaa

SEQ ID NO: 84776 - DNA, 25 bp, S. pombe
cgcctggttcgctggtcaagagaat

SEQ ID NO: 84777 - DNA, 25 bp, S. pombe
cccatgtttcgtggagtacagcaaa

SEQ ID NO: 84778 - DNA, 25 bp, S. pombe
cccggatccaacctctgataatttt

SEQ ID NO: 84779 - DNA, 25 bp, S. pombe
cctactgttgccagcggttttggaa

SEQ ID NO: 84780 - DNA, 25 bp, S. pombe
ccctctggaggatggttcttctgaa

SEQ ID NO: 84781 - DNA, 25 bp, S. pombe
ccgcttgtggttttgtttgtgttga

SEQ ID NO: 84782 - DNA, 25 bp, S. pombe
ccggttcccggaatcgatgatgtga

SEQ ID NO: 84783 - DNA, 25 bp, S. pombe
gcggaatttagcgtccagcggacac

SEQ ID NO: 84784 - DNA, 25 bp, S. pombe
gccataattcattcgcacggtctga

SEQ ID NO: 84785 - DNA, 25 bp, S. pombe
gcctctactgcatactacggtttag

SEQ ID NO: 84786 - DNA, 25 bp, S. pombe
ccgcttctcagcactaattggttag

SEQ ID NO: 84787 - DNA, 25 bp, S. pombe
ccgtgtgtccatcctcaatttatta

SEQ ID NO: 84788 - DNA, 25 bp, S. pombe
cgccatgtatcttgttcctatttta

SEQ ID NO: 84789 - DNA, 25 bp, S. pombe
ccgctgttattcttacttgttactt

SEQ ID NO: 84790 - DNA, 25 bp, S. pombe
ccccatggcattcgtttaattgatt

SEQ ID NO: 84791 - DNA, 25 bp, S. pombe
cccctccttacaatactgttgattg

SEQ ID NO: 84792 - DNA, 25 bp, S. pombe
cctcccagtgttgaacgacttggtt

SEQ ID NO: 84793 - DNA, 25 bp, S. pombe
cccagcaccttttgtctgagtttga

SEQ ID NO: 84794 - DNA, 25 bp, S. pombe
cccagagctgggtttgtcgagattg

SEQ ID NO: 84795 - DNA, 25 bp, S. pombe
ccgcaattggctttgtggcaggaat

SEQ ID NO: 84796 - DNA, 25 bp, S. pombe
ccggtatcgacaggcacagacaaat

SEQ ID NO: 84797 - DNA, 25 bp, S. pombe
cctggctgcccgttttataaaatat

SEQ ID NO: 84798 - DNA, 25 bp, S. pombe
cctggactcgtctttttagatttga

SEQ ID NO: 84799 - DNA, 25 bp, S. pombe
cctatgccgactgacgctaagttat

SEQ ID NO: 84800 - DNA, 25 bp, S. pombe
gcattagctgctgtgaccgtaagta

SEQ ID NO: 84801 - DNA, 25 bp, S. pombe
ccgcagctgctgatacgagtacaat

SEQ ID NO: 84802 - DNA, 25 bp, S. pombe
cccagtgaaacatctgttcctgcta

SEQ ID NO: 84803 - DNA, 25 bp, S. pombe
ccgttgagaaggttgcccctggtgc

SEQ ID NO: 84804 - DNA, 25 bp, S. pombe
ccgtgtagaacgtatccctgcatga

SEQ ID NO: 84805 - DNA, 25 bp, S. pombe
ccctggaagagcacgattgccgata

SEQ ID NO: 84806 - DNA, 25 bp, S. pombe
ccatcctgtaagtttccttggacat

SEQ ID NO: 84807 - DNA, 25 bp, S. pombe
ccgctcccgagatgcacttaataaa

SEQ ID NO: 84808 - DNA, 25 bp, S. pombe
ccttcccagttcaagattccttctt

SEQ ID NO: 84809 - DNA, 25 bp, S. pombe
ccttcttcggtgtcatgggatgtac

SEQ ID NO: 84810 - DNA, 25 bp, S. pombe
ccctttttctatggtcgtggactat

SEQ ID NO: 84811 - DNA, 25 bp, S. pombe
ccctttggtccttatattgctactg

SEQ ID NO: 84812 - DNA, 25 bp, S. pombe
cccgacttgtttccatcatgtgata

SEQ ID NO: 84813 - DNA, 25 bp, S. pombe
ccgctattctatttcccttgatgat

SEQ ID NO: 84814 - DNA, 25 bp, S. pombe
cccctgcacaaagtctcggagtaga

SEQ ID NO: 84815 - DNA, 25 bp, S. pombe
cccgagtcagagtcgttgcgtgaaa

SEQ ID NO: 84816 - DNA, 25 bp, S. pombe
cccgcagatgactcttcagcttaaa

SEQ ID NO: 84817 - DNA, 25 bp, S. pombe
ccctgcaatggaacttcgtggcgaa

SEQ ID NO: 84818 - DNA, 25 bp, S. pombe
ccgctatagcgacggtagtggcaaa

SEQ ID NO: 84819 - DNA, 25 bp, S. pombe
ccgtagcgctggtttgggtcaaaat

SEQ ID NO: 84820 - DNA, 25 bp, S. pombe
cccctgcttggaatagtggtgctaa

SEQ ID NO: 84821 - DNA, 25 bp, S. pombe
cccgccatgttgtctcagtggtaga

SEQ ID NO: 84822 - DNA, 25 bp, S. pombe
ccttctgcttctccatttatagatc

SEQ ID NO: 84823 - DNA, 25 bp, S. pombe
cctactgctttactgttatcttctg

SEQ ID NO: 84824 - DNA, 25 bp, S. pombe
cccattgcttctttgtatctttcta

SEQ ID NO: 84825 - DNA, 25 bp, S. pombe
cctttgttgctcttatgattcccat

SEQ ID NO: 84826 - DNA, 25 bp, S. pombe
ccgatgtccctatatctcattcaaa

SEQ ID NO: 84827 - DNA, 25 bp, S. pombe
ccgcgtatcctctactttcaaaatt

SEQ ID NO: 84828 - DNA, 25 bp, S. pombe
ccttctacttcaaataccaacgcat

SEQ ID NO: 84829 - DNA, 25 bp, S. pombe
ccggatactgtattattcgcaacgt

SEQ ID NO: 84830 - DNA, 25 bp, S. pombe
ccggtggtgtttatcagcaggcttt

SEQ ID NO: 84831 - DNA, 25 bp, S. pombe
ccatggcaaaggtcttgtcggtctt

SEQ ID NO: 84832 - DNA, 25 bp, S. pombe
cctgcgcgcaggatttgtagagttc

SEQ ID NO: 84833 - DNA, 25 bp, S. pombe
ccttctcaggtcatttacgatcatc

SEQ ID NO: 84834 - DNA, 25 bp, S. pombe
gccgatcaatacgaccttggtgctg

SEQ ID NO: 84835 - DNA, 25 bp, S. pombe
ccgaattacgcagcatcgagtctaa

SEQ ID NO: 84836 - DNA, 25 bp, S. pombe
ccggtttccacatttgatgtctcta

SEQ ID NO: 84837 - DNA, 25 bp, S. pombe
cccgctactcctagtattgtgacaa

SEQ ID NO: 84838 - DNA, 25 bp, S. pombe
ccgttttcgctaccattgcttatat

SEQ ID NO: 84839 - DNA, 25 bp, S. pombe
ccgtttctcctaagtattctagctc

SEQ ID NO: 84840 - DNA, 25 bp, S. pombe
cctgatggctcttctattgttacta

SEQ ID NO: 84841 - DNA, 25 bp, S. pombe
ccgctgctgtatttaagtctcctga

SEQ ID NO: 84842 - DNA, 25 bp, S. pombe
ccctcgtctttacgtcgatgtagta

SEQ ID NO: 84843 - DNA, 25 bp, S. pombe
cctcctgatttttcctcggtaatat

SEQ ID NO: 84844 - DNA, 25 bp, S. pombe
ccattcttttggtcctgtcgtaaat

SEQ ID NO: 84845 - DNA, 25 bp, S. pombe
ccagcgtaattgtatgcggtagtct

SEQ ID NO: 84846 - DNA, 25 bp, S. pombe
gaatttaagatacatttttggcgac

SEQ ID NO: 84847 - DNA, 25 bp, S. pombe
cccgtttgggcgttatcatcagcaa

SEQ ID NO: 84848 - DNA, 25 bp, S. pombe
tcccgaaagggctcaactcaacaag

SEQ ID NO: 84849 - DNA, 25 bp, S. pombe
cctccaatttggaaggcttgcagga

SEQ ID NO: 84850 - DNA, 25 bp, S. pombe
cctcgcagtttcttcatggatgtca

SEQ ID NO: 84851 - DNA, 25 bp, S. pombe
ccgacgctgctcctagtcagaaaaa

SEQ ID NO: 84852 - DNA, 25 bp, S. pombe
ccgccgctcctgtagaagatgacaa

SEQ ID NO: 84853 - DNA, 25 bp, S. pombe
ccggcgctaaagttcgttctcaaga

SEQ ID NO: 84854 - DNA, 25 bp, S. pombe
ccgtgactctcatggaattcctcaa

SEQ ID NO: 84855 - DNA, 25 bp, S. pombe
ccttgggtgcatgaggctgtcaaac

SEQ ID NO: 84856 - DNA, 25 bp, S. pombe
ttcaagggcgagttcgtttcgtcgt

SEQ ID NO: 84857 - DNA, 25 bp, S. pombe
gcctaccatggtattgtttcgtaag

SEQ ID NO: 84858 - DNA, 25 bp, S. pombe
cctaccaattgcaaatgtcgcgcgt

SEQ ID NO: 84859 - DNA, 25 bp, S. pombe
cctggatcatggtcgcaagtagcaa

SEQ ID NO: 84860 - DNA, 25 bp, S. pombe
cctctagtggacctcgtttctataa

SEQ ID NO: 84861 - DNA, 25 bp, S. pombe
gccttgaggtacatctttgccctaa

SEQ ID NO: 84862 - DNA, 25 bp, S. pombe
cctcattcttccagcacttgtaaaa

SEQ ID NO: 84863 - DNA, 25 bp, S. pombe
cctgctcagcttccatatatttcat

SEQ ID NO: 84864 - DNA, 25 bp, S. pombe
ccttgcagtctgtagatagttatat

SEQ ID NO: 84865 - DNA, 25 bp, S. pombe
tcctcatgactggtggatcaaagtt

SEQ ID NO: 84866 - DNA, 25 bp, S. pombe
gccaaggctaggttgcaaggttttt

SEQ ID NO: 84867 - DNA, 25 bp, S. pombe
ccatcggtggtttgactgcttacat

SEQ ID NO: 84868 - DNA, 25 bp, S. pombe
gcccggtaaacccagccaattgagg

SEQ ID NO: 84869 - DNA, 25 bp, S. pombe
gcccgaatgccttcctaaagttgag

SEQ ID NO: 84870 - DNA, 25 bp, S. pombe
ccgctgacagtcttcctattattta

SEQ ID NO: 84871 - DNA, 25 bp, S. pombe
ccgctatactgcatgggtttcctga

SEQ ID NO: 84872 - DNA, 25 bp, S. pombe
ccgctgtacagccttctaatttagt

SEQ ID NO: 84873 - DNA, 25 bp, S. pombe
ccgcatcggcagctgttgtatttaa

SEQ ID NO: 84874 - DNA, 25 bp, S. pombe
ccgacgtgctgctaattttgcttat

SEQ ID NO: 84875 - DNA, 25 bp, S. pombe
ccgacgcttatcgtttcttgtataa

SEQ ID NO: 84876 - DNA, 25 bp, S. pombe
ccgaccacatatccgggtttagcaa

SEQ ID NO: 84877 - DNA, 25 bp, S. pombe
ccgtacccaatatctttattcacca

SEQ ID NO: 84878 - DNA, 25 bp, S. pombe
ccgtaactcttattctgatctttcc

SEQ ID NO: 84879 - DNA, 25 bp, S. pombe
ccgatccttcaccaagtttgttgta

SEQ ID NO: 84880 - DNA, 25 bp, S. pombe
ccgttcttccatactatccgtaata

SEQ ID NO: 84881 - DNA, 25 bp, S. pombe
ccgcctctttattacacgcgataaa

SEQ ID NO: 84882 - DNA, 25 bp, S. pombe
ccgtgttttgagactcgcgctgaaa

SEQ ID NO: 84883 - DNA, 25 bp, S. pombe
ccgacattttatcttcagctggaaa

SEQ ID NO: 84884 - DNA, 25 bp, S. pombe
ccggcttctttatctactggaacta

SEQ ID NO: 84885 - DNA, 25 bp, S. pombe
ccccttgttcatgattacggtgctt

SEQ ID NO: 84886 - DNA, 25 bp, S. pombe
cctcagtattatgtttccggtgcta

SEQ ID NO: 84887 - DNA, 25 bp, S. pombe
ccaataattttttccgtggtcatat

SEQ ID NO: 84888 - DNA, 25 bp, S. pombe
gccgaattcctgtcaacgggttcaa

SEQ ID NO: 84889 - DNA, 25 bp, S. pombe
ccgagggtctgctaagatgggttca

SEQ ID NO: 84890 - DNA, 25 bp, S. pombe
gccaagggcttcaaaacgcgttagt

SEQ ID NO: 84891 - DNA, 25 bp, S. pombe
gccaaggatgcaaaagataccgact

SEQ ID NO: 84892 - DNA, 25 bp, S. pombe
gccaaggatgcagggtatacgagtc

SEQ ID NO: 84893 - DNA, 25 bp, S. pombe
ccgtcaggtttcttctggtagttct

SEQ ID NO: 84894 - DNA, 25 bp, S. pombe
ccgtcaacgtgttttgcgtcgtctt

SEQ ID NO: 84895 - DNA, 25 bp, S. pombe
ccgatcgactggttttggttcttat

SEQ ID NO: 84896 - DNA, 25 bp, S. pombe
ccggatctccttgtatttcacatta

SEQ ID NO: 84897 - DNA, 25 bp, S. pombe
ccgaatccttgcatgttttccatta

SEQ ID NO: 84898 - DNA, 25 bp, S. pombe
ccgtcctcttatagtcatctttcag

SEQ ID NO: 84899 - DNA, 25 bp, S. pombe
ccttcaattccaagcattcgttcag

SEQ ID NO: 84900 - DNA, 25 bp, S. pombe
ccgtttctggcttgcatctgattat

SEQ ID NO: 84901 - DNA, 25 bp, S. pombe
ccgtgtctctggtggtggtcatgtt

SEQ ID NO: 84902 - DNA, 25 bp, S. pombe
ccgttgaccgtcatgaatctgtgga

SEQ ID NO: 84903 - DNA, 25 bp, S. pombe
ccgtccaggccgaataatttgtcaa

SEQ ID NO: 84904 - DNA, 25 bp, S. pombe
ccgctgcctggctttcagaaattta

SEQ ID NO: 84905 - DNA, 25 bp, S. pombe
ccggccgtggatgatagcaagcaat

SEQ ID NO: 84906 - DNA, 25 bp, S. pombe
ccgacagcagcattcttcttagtgg

SEQ ID NO: 84907 - DNA, 25 bp, S. pombe
gccaaatcctaatcacgtcctttta

SEQ ID NO: 84908 - DNA, 25 bp, S. pombe
cctgaagactatttggatgctcccg

SEQ ID NO: 84909 - DNA, 25 bp, S. pombe
cctgagtgtcatagtggttccaaaa

SEQ ID NO: 84910 - DNA, 25 bp, S. pombe
ccgcatcctcagctagattctatga

SEQ ID NO: 84911 - DNA, 25 bp, S. pombe
ccttgcctcaagacgtgttagaaat

SEQ ID NO: 84912 - DNA, 25 bp, S. pombe
ccgctgccaagactcgtagttacaa

SEQ ID NO: 84913 - DNA, 25 bp, S. pombe
ccgtccgtagctttgcattaacaac

SEQ ID NO: 84914 - DNA, 25 bp, S. pombe
ccgctccgctcaagttgttaaatca

SEQ ID NO: 84915 - DNA, 25 bp, S. pombe
cctctttctgcgattgctaaacaca

SEQ ID NO: 84916 - DNA, 25 bp, S. pombe
ccgtgctaatttaatggccagtatc

SEQ ID NO: 84917 - DNA, 25 bp, S. pombe
cctgatgtcaatattcttccctttt

SEQ ID NO: 84918 - DNA, 25 bp, S. pombe
ccgtacttactttccatggctatga

SEQ ID NO: 84919 - DNA, 25 bp, S. pombe
ccggtttgtgccgaaatgctggata

SEQ ID NO: 84920 - DNA, 25 bp, S. pombe
ccggtcgatgctctcatatttgtaa

SEQ ID NO: 84921 - DNA, 25 bp, S. pombe
cctggctcgtgtctagtgctgttga

SEQ ID NO: 84922 - DNA, 25 bp, S. pombe
ccgagcacatggactctagggtttt

SEQ ID NO: 84923 - DNA, 25 bp, S. pombe
ccaggcccttcctagatggatttta

SEQ ID NO: 84924 - DNA, 25 bp, S. pombe
ccgtgtccttcctagtttgaatgtt

SEQ ID NO: 84925 - DNA, 25 bp, S. pombe
ccgtccacgtctgagtcaagtatgt

SEQ ID NO: 84926 - DNA, 25 bp, S. pombe
ccggccgttcaaccattagcaaatg

SEQ ID NO: 84927 - DNA, 25 bp, S. pombe
cctagtgctgttcatcttgtacgta

SEQ ID NO: 84928 - DNA, 25 bp, S. pombe
cctggctatggatttactgaactga

SEQ ID NO: 84929 - DNA, 25 bp, S. pombe
ccatctcttcttagaccaggtcgat

SEQ ID NO: 84930 - DNA, 25 bp, S. pombe
gcctcctaaaattcgcaaagttctg

SEQ ID NO: 84931 - DNA, 25 bp, S. pombe
gccgccgtacgatagcattagttca

SEQ ID NO: 84932 - DNA, 25 bp, S. pombe
ccattcgtactaccacttgtgtatc

SEQ ID NO: 84933 - DNA, 25 bp, S. pombe
ccgatttctttgaccctttggatga

SEQ ID NO: 84934 - DNA, 25 bp, S. pombe
ccgtatcgttggtttggctgctgaa

SEQ ID NO: 84935 - DNA, 25 bp, S. pombe
ccagacatagttgtatccgccgata

SEQ ID NO: 84936 - DNA, 25 bp, S. pombe
ccgtcttttgggattctctcacaaa

SEQ ID NO: 84937 - DNA, 25 bp, S. pombe
ccgttttggtggcttcttctgaaag

SEQ ID NO: 84938 - DNA, 25 bp, S. pombe
cctattttggtgtgcttcttgttca

SEQ ID NO: 84939 - DNA, 25 bp, S. pombe
cctactgttattcgtcttgctgagt

SEQ ID NO: 84940 - DNA, 25 bp, S. pombe
cctatgtttatttgtctgttgcgcg

SEQ ID NO: 84941 - DNA, 25 bp, S. pombe
cctggttgtcttttgtgtggtggat

SEQ ID NO: 84942 - DNA, 25 bp, S. pombe
cctggtttgcgttttggatgtcaat

SEQ ID NO: 84943 - DNA, 25 bp, S. pombe
ccatgggtttgccttgggatgcaca

SEQ ID NO: 84944 - DNA, 25 bp, S. pombe
ccgtgttgctactctcttgtcataa

SEQ ID NO: 84945 - DNA, 25 bp, S. pombe
ccgttgatgctaacttctctgctaa

SEQ ID NO: 84946 - DNA, 25 bp, S. pombe
cctttggcttgatggctctctagag

SEQ ID NO: 84947 - DNA, 25 bp, S. pombe
ccaccgaatcttgggttgccagatg

SEQ ID NO: 84948 - DNA, 25 bp, S. pombe
ccttctggtttaatcactcctgtaa

SEQ ID NO: 84949 - DNA, 25 bp, S. pombe
cctaccctgcattgattaatccttg

SEQ ID NO: 84950 - DNA, 25 bp, S. pombe
ccaggtcctcttctagtgactagta

SEQ ID NO: 84951 - DNA, 25 bp, S. pombe
ccttctcttcgtcttgttcataaat

SEQ ID NO: 84952 - DNA, 25 bp, S. pombe
cctcctgttcgtcctaatgtaatgt

SEQ ID NO: 84953 - DNA, 25 bp, S. pombe
cctctcgacattttaatcctctcaa

SEQ ID NO: 84954 - DNA, 25 bp, S. pombe
cctcatcgacattttttactcctga

SEQ ID NO: 84955 - DNA, 25 bp, S. pombe
cctgctgaatctgcagctgctgtaa

SEQ ID NO: 84956 - DNA, 25 bp, S. pombe
gccattattaccaccgatttacgtc

SEQ ID NO: 84957 - DNA, 25 bp, S. pombe
gccccgaagcaggaaggcgtcttta

SEQ ID NO: 84958 - DNA, 25 bp, S. pombe
ccaccgtaggtctgatggtcgttat

SEQ ID NO: 84959 - DNA, 25 bp, S. pombe
ccactttcagatttaggcctcgtta

SEQ ID NO: 84960 - DNA, 25 bp, S. pombe
ccgtttaatctttggtgctggagct

SEQ ID NO: 84961 - DNA, 25 bp, S. pombe
ccggcgtgtttgtttttgctatgca

SEQ ID NO: 84962 - DNA, 25 bp, S. pombe
ccatctacttttttcgtttcttcag

SEQ ID NO: 84963 - DNA, 25 bp, S. pombe
gcgattgcatcgttggccgtgaaag

SEQ ID NO: 84964 - DNA, 25 bp, S. pombe
cctgctcacagcgttacaactagta

SEQ ID NO: 84965 - DNA, 25 bp, S. pombe
cctggacacgttttcactagcgaag

SEQ ID NO: 84966 - DNA, 25 bp, S. pombe
ccggatctggttcatcagctacaaa

SEQ ID NO: 84967 - DNA, 25 bp, S. pombe
ccggcatctatcaacgctagtacaa

SEQ ID NO: 84968 - DNA, 25 bp, S. pombe
cctctgtcgtcaacgctggcaacaa

SEQ ID NO: 84969 - DNA, 25 bp, S. pombe
cctctcatcctgtagttgccaaaag

SEQ ID NO: 84970 - DNA, 25 bp, S. pombe
cctcatcctctgcagttgaactaga

SEQ ID NO: 84971 - DNA, 25 bp, S. pombe
ccgtaaaattcttcgtgacaacatt

SEQ ID NO: 84972 - DNA, 25 bp, S. pombe
ccggcgtcagcctatagtactaata

SEQ ID NO: 84973 - DNA, 25 bp, S. pombe
ccggagctttcgctagacgatgtat

SEQ ID NO: 84974 - DNA, 25 bp, S. pombe
ccaggatttcttcgtctgacaattc

SEQ ID NO: 84975 - DNA, 25 bp, S. pombe
ccgggcgtctctcttgatgagaatg

SEQ ID NO: 84976 - DNA, 25 bp, S. pombe
ccggatcctgatttcgtgtttgacg

SEQ ID NO: 84977 - DNA, 25 bp, S. pombe
cctttaatgggatgggctgcgtgtt

SEQ ID NO: 84978 - DNA, 25 bp, S. pombe
gcctcttaaggccaaggtctttggt

SEQ ID NO: 84979 - DNA, 25 bp, S. pombe
gctcctgaaggttaccgtatcggtt

SEQ ID NO: 84980 - DNA, 25 bp, S. pombe
cctgacgacgtagctatggtggaca

SEQ ID NO: 84981 - DNA, 25 bp, S. pombe
ccttcgcaagtaccgtgagtctggt

SEQ ID NO: 84982 - DNA, 25 bp, S. pombe
cctcttcttgaagcagcacgcaaag

SEQ ID NO: 84983 - DNA, 25 bp, S. pombe
cctctgcgctattatgggaccaaag

SEQ ID NO: 84984 - DNA, 25 bp, S. pombe
cctgctgtttcttgggactcagaca

SEQ ID NO: 84985 - DNA, 25 bp, S. pombe
cctatgccattaattctactctcta

SEQ ID NO: 84986 - DNA, 25 bp, S. pombe
ccttcacctctctctatattttaag

SEQ ID NO: 84987 - DNA, 25 bp, S. pombe
ccttgacacaatctttcctactgaa

SEQ ID NO: 84988 - DNA, 25 bp, S. pombe
gcccattcaaacattccctttaaag

SEQ ID NO: 84989 - DNA, 25 bp, S. pombe
cctacctcaactattgccgttaata

SEQ ID NO: 84990 - DNA, 25 bp, S. pombe
cctggttgccgtcatgttggtttaa

SEQ ID NO: 84991 - DNA, 25 bp, S. pombe
cctgcttctccgaaagctggtttta

SEQ ID NO: 84992 - DNA, 25 bp, S. pombe
cctgttgctcgttatcttggtttaa

SEQ ID NO: 84993 - DNA, 25 bp, S. pombe
cctatgaatttcctacgtcgtatct

SEQ ID NO: 84994 - DNA, 25 bp, S. pombe
ccttgtttcaataccgcagcgatat

SEQ ID NO: 84995 - DNA, 25 bp, S. pombe
cctttatctaaaccacgtgcttcaa

SEQ ID NO: 84996 - DNA, 25 bp, S. pombe
ccttattgttcattaccttgctgga

SEQ ID NO: 84997 - DNA, 25 bp, S. pombe
cctgactctggcttgaaacctttga

SEQ ID NO: 84998 - DNA, 25 bp, S. pombe
cctacttccgtgtcaacattgttga

SEQ ID NO: 84999 - DNA, 25 bp, S. pombe
cctcctcatcttagtccatttgtta

SEQ ID NO: 85000 - DNA, 25 bp, S. pombe
cctctttctgctagctactattgtt

SEQ ID NO: 85001 - DNA, 25 bp, S. pombe
ccttttcatgcttcgttatggctac

SEQ ID NO: 85002 - DNA, 25 bp, S. pombe
gcctaggaactttttgttgcgcaat

SEQ ID NO: 85003 - DNA, 25 bp, S. pombe
ccggtgattttatttctcctgcata

SEQ ID NO: 85004 - DNA, 25 bp, S. pombe
cctgcagaccttatgcccattatat

SEQ ID NO: 85005 - DNA, 25 bp, S. pombe
cctctgctgctcttactatcaatga

SEQ ID NO: 85006 - DNA, 25 bp, S. pombe
cctatcctctctaatgcagcaatat

SEQ ID NO: 85007 - DNA, 25 bp, S. pombe
cctcacgcattcttagcgcaagatt

SEQ ID NO: 85008 - DNA, 25 bp, S. pombe
cctctctttcaatggctagttcaac

SEQ ID NO: 85009 - DNA, 25 bp, S. pombe
ccacgacttcaacggtagcttctag

SEQ ID NO: 85010 - DNA, 25 bp, S. pombe
ccaccaactctactttctggttgaa

SEQ ID NO: 85011 - DNA, 25 bp, S. pombe
ccatactggacggaccttcttgaaa

SEQ ID NO: 85012 - DNA, 25 bp, S. pombe
ccaactccgtcctaagaagaagctt

SEQ ID NO: 85013 - DNA, 25 bp, S. pombe
cctagctgccctcgataatgtaaag

SEQ ID NO: 85014 - DNA, 25 bp, S. pombe
cctcataccgctttttctaatcata

SEQ ID NO: 85015 - DNA, 25 bp, S. pombe
cctgtccttgttcgtcttaaatggg

SEQ ID NO: 85016 - DNA, 25 bp, S. pombe
ccttcctcatttcgcttacattata

SEQ ID NO: 85017 - DNA, 25 bp, S. pombe
ccaacctcattctcgtacaattgtt

SEQ ID NO: 85018 - DNA, 25 bp, S. pombe
ccacacctgtttcaatcgacttgat

SEQ ID NO: 85019 - DNA, 25 bp, S. pombe
ccaacacgtcgtcatatccatttag

SEQ ID NO: 85020 - DNA, 25 bp, S. pombe
ccaacatccctactatttcggtaat

SEQ ID NO: 85021 - DNA, 25 bp, S. pombe
ccattatgtctaccccaaagctgaa

SEQ ID NO: 85022 - DNA, 25 bp, S. pombe
ccattgcgtgagatgaactccgaaa

SEQ ID NO: 85023 - DNA, 25 bp, S. pombe
ccagcgattactttccattgaggag

SEQ ID NO: 85024 - DNA, 25 bp, S. pombe
cctcagcatttagactccttggaaa

SEQ ID NO: 85025 - DNA, 25 bp, S. pombe
cctcacagttcgtctcatttttgga

SEQ ID NO: 85026 - DNA, 25 bp, S. pombe
ccttcccgactcattttctatgata

SEQ ID NO: 85027 - DNA, 25 bp, S. pombe
ccttggctaactggtcttttactga

SEQ ID NO: 85028 - DNA, 25 bp, S. pombe
cctctggcatagacacgttctctaa

SEQ ID NO: 85029 - DNA, 25 bp, S. pombe
cctggtcaatgactccttctggaga

SEQ ID NO: 85030 - DNA, 25 bp, S. pombe
ccacagccgaattccgactatttaa

SEQ ID NO: 85031 - DNA, 25 bp, S. pombe
ccatacgctgtttccagttctttaa

SEQ ID NO: 85032 - DNA, 25 bp, S. pombe
ccaattcggtcccatgatttttcaa

SEQ ID NO: 85033 - DNA, 25 bp, S. pombe
ccaatgcaattgtaccgcttttatg

SEQ ID NO: 85034 - DNA, 25 bp, S. pombe
gccagctatgatcaacctgcttttg

SEQ ID NO: 85035 - DNA, 25 bp, S. pombe
gccgctatgcagcttactcagagta

SEQ ID NO: 85036 - DNA, 25 bp, S. pombe
gccgctgctttgaaggctcaggcga

SEQ ID NO: 85037 - DNA, 25 bp, S. pombe
gccgatgcttaccaggcacaggata

SEQ ID NO: 85038 - DNA, 25 bp, S. pombe
cctgctattggtggtttggctatca

SEQ ID NO: 85039 - DNA, 25 bp, S. pombe
ccagttgggtggtctcatggtacaa

SEQ ID NO: 85040 - DNA, 25 bp, S. pombe
ccagccataggagatcgcgttgcat

SEQ ID NO: 85041 - DNA, 25 bp, S. pombe
ccaccaaagttgtcgtatcctgcaa

SEQ ID NO: 85042 - DNA, 25 bp, S. pombe
ccttccttcattatcttccaacaaa

SEQ ID NO: 85043 - DNA, 25 bp, S. pombe
cctgattatgttcatctcttccaac

SEQ ID NO: 85044 - DNA, 25 bp, S. pombe
cctacttattcagctttccaacaga

SEQ ID NO: 85045 - DNA, 25 bp, S. pombe
cctatctccttgctattgctacaat

SEQ ID NO: 85046 - DNA, 25 bp, S. pombe
cctcctcctcatcttctaaagaatg

SEQ ID NO: 85047 - DNA, 25 bp, S. pombe
ccttctgcagctgttcgtagtggaa

SEQ ID NO: 85048 - DNA, 25 bp, S. pombe
ccttctgagttgttgcaatttgcca

SEQ ID NO: 85049 - DNA, 25 bp, S. pombe
ccttcgagcactttcatcatttcaa

SEQ ID NO: 85050 - DNA, 25 bp, S. pombe
gtcaacgaggtcgactttaccgtat

SEQ ID NO: 85051 - DNA, 25 bp, S. pombe
gttggtattgtacataccccgtcgg

SEQ ID NO: 85052 - DNA, 25 bp, S. pombe
gtcaggttcgtataccaaccgttgg

SEQ ID NO: 85053 - DNA, 25 bp, S. pombe
gccaagaagaggctcggtaccctta

SEQ ID NO: 85054 - DNA, 25 bp, S. pombe
ccaagcaggctctcggagatggcaa

SEQ ID NO: 85055 - DNA, 25 bp, S. pombe
ccaggcttcttgacactagatttca

SEQ ID NO: 85056 - DNA, 25 bp, S. pombe
gccggctttggcaatcgtattacag

SEQ ID NO: 85057 - DNA, 25 bp, S. pombe
cctcgacgataaccctttagctgaa

SEQ ID NO: 85058 - DNA, 25 bp, S. pombe
cctcccttgcaattcttttacatta

SEQ ID NO: 85059 - DNA, 25 bp, S. pombe
cctcaccaacgcttcttttgaaagt

SEQ ID NO: 85060 - DNA, 25 bp, S. pombe
ccatttgaatgtcgcgtggctccaa

SEQ ID NO: 85061 - DNA, 25 bp, S. pombe
ccatttgcctgtccggctggaaaaa

SEQ ID NO: 85062 - DNA, 25 bp, S. pombe
ccaacatcctctgtagaccttaatg

SEQ ID NO: 85063 - DNA, 25 bp, S. pombe
ccagagctccagattggcccattaa

SEQ ID NO: 85064 - DNA, 25 bp, S. pombe
ccatgtaccgccaagacctagtaaa

SEQ ID NO: 85065 - DNA, 25 bp, S. pombe
ccaactcatacaccgcggtttctta

SEQ ID NO: 85066 - DNA, 25 bp, S. pombe
tctgctttaaatcgcgttacttggg

SEQ ID NO: 85067 - DNA, 25 bp, S. pombe
tccctaaagaagtttccttggatga

SEQ ID NO: 85068 - DNA, 25 bp, S. pombe
cctttaaatgattctctttctggag

SEQ ID NO: 85069 - DNA, 25 bp, S. pombe
cctccttcgtattcattttctctta

SEQ ID NO: 85070 - DNA, 25 bp, S. pombe
ccatcgttcggtttttctgtaatag

SEQ ID NO: 85071 - DNA, 25 bp, S. pombe
ccaggaaaggttgctcttatcacaa

SEQ ID NO: 85072 - DNA, 25 bp, S. pombe
gccaattcattgcagcctggatgga

SEQ ID NO: 85073 - DNA, 25 bp, S. pombe
ccaagcagccggagatttatctttt

SEQ ID NO: 85074 - DNA, 25 bp, S. pombe
ccagcccgcgctaatttattcaatt

SEQ ID NO: 85075 - DNA, 25 bp, S. pombe
ccatccctcatatgccgagattgta

SEQ ID NO: 85076 - DNA, 25 bp, S. pombe
gaatgagcgatacacgtcgttttaa

SEQ ID NO: 85077 - DNA, 25 bp, S. pombe
gacaggactgctcagcgtaggttta

SEQ ID NO: 85078 - DNA, 25 bp, S. pombe
ccttcttgaaggtctatcggctgtt

SEQ ID NO: 85079 - DNA, 25 bp, S. pombe
ccaacgctgttggatggtcatcatc

SEQ ID NO: 85080 - DNA, 25 bp, S. pombe
gccaagggtgactcgattcaacatt

SEQ ID NO: 85081 - DNA, 25 bp, S. pombe
gccaaatcggactactcttactttt

SEQ ID NO: 85082 - DNA, 25 bp, S. pombe
gccaagaagatacagccacccttta

SEQ ID NO: 85083 - DNA, 25 bp, S. pombe
cctctcctgagggtggcgaaattgt

SEQ ID NO: 85084 - DNA, 25 bp, S. pombe
ccatggtttacctacgaagagctat

SEQ ID NO: 85085 - DNA, 25 bp, S. pombe
ccttttccacttatctctcattaaa

SEQ ID NO: 85086 - DNA, 25 bp, S. pombe
gcctttactcaggttcgtactctaa

SEQ ID NO: 85087 - DNA, 25 bp, S. pombe
ccatttactcactgtagaccctaga

SEQ ID NO: 85088 - DNA, 25 bp, S. pombe
ccattttgcttgctgttccaaagaa

SEQ ID NO: 85089 - DNA, 25 bp, S. pombe
ccatctttctttggccctgcaaaaa

SEQ ID NO: 85090 - DNA, 25 bp, S. pombe
ccttcgtcgtatggctcctaagaaa

SEQ ID NO: 85091 - DNA, 25 bp, S. pombe
ccagcagttctggttcactaggtac

SEQ ID NO: 85092 - DNA, 25 bp, S. pombe
gccgtcaaaacgtccgtaagttgat

SEQ ID NO: 85093 - DNA, 25 bp, S. pombe
gcctcctaaaggtccgtttgatatt

SEQ ID NO: 85094 - DNA, 25 bp, S. pombe
gccagggaaaggtgcgtttagctaa

SEQ ID NO: 85095 - DNA, 25 bp, S. pombe
gccaaagtatacactggttttacca

SEQ ID NO: 85096 - DNA, 25 bp, S. pombe
ccttgcccaattccatgagttttga

SEQ ID NO: 85097 - DNA, 25 bp, S. pombe
ccattaacgttgagtccttcttcga

SEQ ID NO: 85098 - DNA, 25 bp, S. pombe
gcctttttatcgagaactttgtcag

SEQ ID NO: 85099 - DNA, 25 bp, S. pombe
ccttggcttatctttcaaaacctga

SEQ ID NO: 85100 - DNA, 25 bp, S. pombe
gttatgtcgtctgtggaacaaccgt

SEQ ID NO: 85101 - DNA, 25 bp, S. pombe
gctaagccttctacggaaagaccgg

SEQ ID NO: 85102 - DNA, 25 bp, S. pombe
gcgaaacttctacaggacaggcgga

SEQ ID NO: 85103 - DNA, 25 bp, S. pombe
ccaagagttctactcccaggaggat

SEQ ID NO: 85104 - DNA, 25 bp, S. pombe
ccaggatttcatagcccatcgtaaa

SEQ ID NO: 85105 - DNA, 25 bp, S. pombe
ccatggtttttccaacgtgggacat

SEQ ID NO: 85106 - DNA, 25 bp, S. pombe
ccagaatttgttttgcgtgctccta

SEQ ID NO: 85107 - DNA, 25 bp, S. pombe
ccaggtctgcgtaggagctgttaga

SEQ ID NO: 85108 - DNA, 25 bp, S. pombe
ccaggtcatcctccgaaattgtaaa

SEQ ID NO: 85109 - DNA, 25 bp, S. pombe
ccttggatgttgttcggagcgctag

SEQ ID NO: 85110 - DNA, 25 bp, S. pombe
cctaggaggtatagcaaatgcgatt

SEQ ID NO: 85111 - DNA, 25 bp, S. pombe
ccttctggctctcttgttttaaata

SEQ ID NO: 85112 - DNA, 25 bp, S. pombe
ccttctcaagttggatttgtcgcaa

SEQ ID NO: 85113 - DNA, 25 bp, S. pombe
ccttctcttttccagttgattgtga

SEQ ID NO: 85114 - DNA, 25 bp, S. pombe
ccttcactcaggaggcttatctgta

SEQ ID NO: 85115 - DNA, 25 bp, S. pombe
ccttcaccgaagagctttggtcgtt

SEQ ID NO: 85116 - DNA, 25 bp, S. pombe
gcctaacgggaaacttgctcttatt

SEQ ID NO: 85117 - DNA, 25 bp, S. pombe
gctgctattcgtgaagacgtctccg

SEQ ID NO: 85118 - DNA, 25 bp, S. pombe
gcccctactggtgaaattggtcttt

SEQ ID NO: 85119 - DNA, 25 bp, S. pombe
ccatcgttctggtaaaatcgttatt

SEQ ID NO: 85120 - DNA, 25 bp, S. pombe
ccatcgccgctactaataatctttt

SEQ ID NO: 85121 - DNA, 25 bp, S. pombe
gccagactcaagtagcagtacgctg

SEQ ID NO: 85122 - DNA, 25 bp, S. pombe
gccaaaaagccgttacctgtttctg

SEQ ID NO: 85123 - DNA, 25 bp, S. pombe
gccaagactcgtagttacaactggg

SEQ ID NO: 85124 - DNA, 25 bp, S. pombe
gccagaacctgagactaccgtgagt

SEQ ID NO: 85125 - DNA, 25 bp, S. pombe
gcgaaacactagcacaaccgggtca

SEQ ID NO: 85126 - DNA, 25 bp, S. pombe
gccaaggcccttgcattaggagcta

SEQ ID NO: 85127 - DNA, 25 bp, S. pombe
gccaaaccggtggtgtatctggtaa

SEQ ID NO: 85128 - DNA, 25 bp, S. pombe
gccaaaacgggccagatatctcata

SEQ ID NO: 85129 - DNA, 25 bp, S. pombe
ccaagggcgagtccgatgactgcat

SEQ ID NO: 85130 - DNA, 25 bp, S. pombe
gcgcagctggcattgaccgaacgaa

SEQ ID NO: 85131 - DNA, 25 bp, S. pombe
ccatcgctggtcttggtgatacaaa

SEQ ID NO: 85132 - DNA, 25 bp, S. pombe
ccatctgcttccattgcgaaatcaa

SEQ ID NO: 85133 - DNA, 25 bp, S. pombe
ccatcattattttccttgctagcta

SEQ ID NO: 85134 - DNA, 25 bp, S. pombe
ccatttcattgtttgcttcggctat

SEQ ID NO: 85135 - DNA, 25 bp, S. pombe
ccagttcaagattccttcttggttc

SEQ ID NO: 85136 - DNA, 25 bp, S. pombe
ccatttcttgaacatcttgctcgtg

SEQ ID NO: 85137 - DNA, 25 bp, S. pombe
ccttgcctattactattgctcttat

SEQ ID NO: 85138 - DNA, 25 bp, S. pombe
gcctggaattatttagcgtcttgcg

SEQ ID NO: 85139 - DNA, 25 bp, S. pombe
gccacaattagtaccattctatttt

SEQ ID NO: 85140 - DNA, 25 bp, S. pombe
ccaaggtttctttatgtgcaggttc

SEQ ID NO: 85141 - DNA, 25 bp, S. pombe
ccaacgtggtcgatttcggtgtcaa

SEQ ID NO: 85142 - DNA, 25 bp, S. pombe
gcccagcgaggctcttaagacggta

SEQ ID NO: 85143 - DNA, 25 bp, S. pombe
ccacggctaacgttgtaggctttga

SEQ ID NO: 85144 - DNA, 25 bp, S. pombe
gcccgttggactgtcgaagctttat

SEQ ID NO: 85145 - DNA, 25 bp, S. pombe
ccattatttaatcagcgctagcgct

SEQ ID NO: 85146 - DNA, 25 bp, S. pombe
gccaattgcctatttgacgtttgtc

SEQ ID NO: 85147 - DNA, 25 bp, S. pombe
ccaatctacagttcttatcctttcg

SEQ ID NO: 85148 - DNA, 25 bp, S. pombe
ccattgtggatgcttttctcttttg

SEQ ID NO: 85149 - DNA, 25 bp, S. pombe
ccaatctgatgtgcgtgagcctcaa

SEQ ID NO: 85150 - DNA, 25 bp, S. pombe
ccatgttccatgttttcagccttat

SEQ ID NO: 85151 - DNA, 25 bp, S. pombe
ccattttgcacgaggatgcctttga

SEQ ID NO: 85152 - DNA, 25 bp, S. pombe
ccagccgtcacgagaacttatttgc

SEQ ID NO: 85153 - DNA, 25 bp, S. pombe
ccacatttccaccaggctttattaa

SEQ ID NO: 85154 - DNA, 25 bp, S. pombe
ccagcggtcgctgatcttttaggat

SEQ ID NO: 85155 - DNA, 25 bp, S. pombe
ccaagctacttgaacctctacatga

SEQ ID NO: 85156 - DNA, 25 bp, S. pombe
gccaagctggttcattctatgcaaa

SEQ ID NO: 85157 - DNA, 25 bp, S. pombe
ccaactggtggaactcggtgctatt

SEQ ID NO: 85158 - DNA, 25 bp, S. pombe
gccaaccgcgttatgcaagttcgta

SEQ ID NO: 85159 - DNA, 25 bp, S. pombe
gccgatcagcgccttttaagtggag

SEQ ID NO: 85160 - DNA, 25 bp, S. pombe
gccagctaggatctttgttgggcaa

SEQ ID NO: 85161 - DNA, 25 bp, S. pombe
ccagcttgttgcttttgcgtgtgaa

SEQ ID NO: 85162 - DNA, 25 bp, S. pombe
ccaccgcttgcaagcttcgaagaca

SEQ ID NO: 85163 - DNA, 25 bp, S. pombe
ccatctcgcttactgaatctttcaa

SEQ ID NO: 85164 - DNA, 25 bp, S. pombe
ccattggcgatcttcatttttctca

SEQ ID NO: 85165 - DNA, 25 bp, S. pombe
ccacagtggatctctcattttcgaa

SEQ ID NO: 85166 - DNA, 25 bp, S. pombe
gccggaagctgaacctgactatcga

SEQ ID NO: 85167 - DNA, 25 bp, S. pombe
ccatcgaggctgttcatctgttgat

SEQ ID NO: 85168 - DNA, 25 bp, S. pombe
ccatcttctgatgcctcgagtgata

SEQ ID NO: 85169 - DNA, 25 bp, S. pombe
ccatgtgattgtggcttcaggctat

SEQ ID NO: 85170 - DNA, 25 bp, S. pombe
gcgagcgatgctaacttgcgtcaag

SEQ ID NO: 85171 - DNA, 25 bp, S. pombe
gctacgtacgaatggtcttcacttt

SEQ ID NO: 85172 - DNA, 25 bp, S. pombe
gacccttcgaaacgtttaactgctg

SEQ ID NO: 85173 - DNA, 25 bp, S. pombe
ccagtttctgctacaagacctcaaa

SEQ ID NO: 85174 - DNA, 25 bp, S. pombe
ccttggcattgctcatcgtgatata

SEQ ID NO: 85175 - DNA, 25 bp, S. pombe
ccattactccacttttggcacagga

SEQ ID NO: 85176 - DNA, 25 bp, S. pombe
gccaattggcacaacaggtcgctga

SEQ ID NO: 85177 - DNA, 25 bp, S. pombe
gccattgaccaatgctgctactcag

SEQ ID NO: 85178 - DNA, 25 bp, S. pombe
ccatcagcctataatctctttcaga

SEQ ID NO: 85179 - DNA, 25 bp, S. pombe
gccaacgctcattacgcagttcaaa

SEQ ID NO: 85180 - DNA, 25 bp, S. pombe
ccagcctgctacttctgcaagaaga

SEQ ID NO: 85181 - DNA, 25 bp, S. pombe
ccaaagctctcgtttggctcactaa

SEQ ID NO: 85182 - DNA, 25 bp, S. pombe
ccacgatcctagcttatttgcatgc

SEQ ID NO: 85183 - DNA, 25 bp, S. pombe
ccagcagctttcgaagaggttacta

SEQ ID NO: 85184 - DNA, 25 bp, S. pombe
ccaagcttgctgacaatagtaacgt

SEQ ID NO: 85185 - DNA, 25 bp, S. pombe
ccaagtatcaaagctgggcgttaca

SEQ ID NO: 85186 - DNA, 25 bp, S. pombe
ccagctttaaaggttggcgatgcct

SEQ ID NO: 85187 - DNA, 25 bp, S. pombe
ccagttccaacgactctgatgcaga

SEQ ID NO: 85188 - DNA, 25 bp, S. pombe
ccagatatgccatcaatgcctcatg

SEQ ID NO: 85189 - DNA, 25 bp, S. pombe
gccaaatccgatgttgcacttttca

SEQ ID NO: 85190 - DNA, 25 bp, S. pombe
ccaactcctgagttttcttcattac

SEQ ID NO: 85191 - DNA, 25 bp, S. pombe
gccaaatcgcgagcctgtttcagaa

SEQ ID NO: 85192 - DNA, 25 bp, S. pombe
gcgcggctactagtcttactggaag

SEQ ID NO: 85193 - DNA, 25 bp, S. pombe
gccgtgtgaccggttgcacttggaa

SEQ ID NO: 85194 - DNA, 25 bp, S. pombe
ccagttactcggaaccattgtgcaa

SEQ ID NO: 85195 - DNA, 25 bp, S. pombe
gccccgggtgcagctgaagtcgtat

SEQ ID NO: 85196 - DNA, 25 bp, S. pombe
gcgccaaatggctcaactacatcaa

SEQ ID NO: 85197 - DNA, 25 bp, S. pombe
gccaagcttgctcatgccatgatga

SEQ ID NO: 85198 - DNA, 25 bp, S. pombe
ccagcccatgatcgcatacttgaaa

SEQ ID NO: 85199 - DNA, 25 bp, S. pombe
ccatgctcaaatccttctcaagaag

SEQ ID NO: 85200 - DNA, 25 bp, S. pombe
gccatgcgcgcgagattgctaatga

SEQ ID NO: 85201 - DNA, 25 bp, S. pombe
gcctcgtaccgaatttgactttcaa

SEQ ID NO: 85202 - DNA, 25 bp, S. pombe
gccgcactacctcatttacgtaata

SEQ ID NO: 85203 - DNA, 25 bp, S. pombe
ccaagtggttggtatcatcaggttt

SEQ ID NO: 85204 - DNA, 25 bp, S. pombe
ccaaatctttggttgctgctggttt

SEQ ID NO: 85205 - DNA, 25 bp, S. pombe
gccaaccattcaagttcccaattta

SEQ ID NO: 85206 - DNA, 25 bp, S. pombe
ccatcgatcaccttaggcctttaaa

SEQ ID NO: 85207 - DNA, 25 bp, S. pombe
gccatttgactcttaagttggaaaa

SEQ ID NO: 85208 - DNA, 25 bp, S. pombe
gccaattccctttcgttagagcaag

SEQ ID NO: 85209 - DNA, 25 bp, S. pombe
ccactctgttcttacttttgactac

SEQ ID NO: 85210 - DNA, 25 bp, S. pombe
ccacttctattctcttatgtcacgg

SEQ ID NO: 85211 - DNA, 25 bp, S. pombe
ccactcttctttatcttgcacaata

SEQ ID NO: 85212 - DNA, 25 bp, S. pombe
ccagctgccttttttattccaattt

SEQ ID NO: 85213 - DNA, 25 bp, S. pombe
ccaaccatttgtattccggaagcta

SEQ ID NO: 85214 - DNA, 25 bp, S. pombe
ccagaccatttcctcattctaagat

SEQ ID NO: 85215 - DNA, 25 bp, S. pombe
ccatgccgctcactcgaatttagag

SEQ ID NO: 85216 - DNA, 25 bp, S. pombe
gcctacgatcttgcaactgattttt

SEQ ID NO: 85217 - DNA, 25 bp, S. pombe
ccaatccttcttcaccttattatta

SEQ ID NO: 85218 - DNA, 25 bp, S. pombe
ccaccaattcggtacctggataatg

SEQ ID NO: 85219 - DNA, 25 bp, S. pombe
gcacccaaaccgttagctggtcaag

SEQ ID NO: 85220 - DNA, 25 bp, S. pombe
gcccgaaagtcggtttgttcagaat

SEQ ID NO: 85221 - DNA, 25 bp, S. pombe
gccacggaattgcactttctttaat

SEQ ID NO: 85222 - DNA, 25 bp, S. pombe
gccaaggccgttactgctttgaagg

SEQ ID NO: 85223 - DNA, 25 bp, S. pombe
ccaagcacccctactttgaagaggt

SEQ ID NO: 85224 - DNA, 25 bp, S. pombe
gccaagcgcccctactattaaaagt

SEQ ID NO: 85225 - DNA, 25 bp, S. pombe
ccaaggccgctatttcgcatatgaa

SEQ ID NO: 85226 - DNA, 25 bp, S. pombe
ccacctgctcatgctattttaactg

SEQ ID NO: 85227 - DNA, 25 bp, S. pombe
gccaatctgctagtgctcgtttaaa

SEQ ID NO: 85228 - DNA, 25 bp, S. pombe
ccaatgttgcattacctgtcgaata

SEQ ID NO: 85229 - DNA, 25 bp, S. pombe
ccatggattctctttctcatcaaat

SEQ ID NO: 85230 - DNA, 25 bp, S. pombe
gccagccttggaatgcgattgcata

SEQ ID NO: 85231 - DNA, 25 bp, S. pombe
gccagtatcagagccagcggtggta

SEQ ID NO: 85232 - DNA, 25 bp, S. pombe
gccttcaatacttctgcggcaggta

SEQ ID NO: 85233 - DNA, 25 bp, S. pombe
gcctgggaaagcttgatgccggtat

SEQ ID NO: 85234 - DNA, 25 bp, S. pombe
ccaggaaagcgcgttttgcacaata

SEQ ID NO: 85235 - DNA, 25 bp, S. pombe
ccaagacgctttagcttctgttaca

SEQ ID NO: 85236 - DNA, 25 bp, S. pombe
ccacattcgctttggattcggtgaa

SEQ ID NO: 85237 - DNA, 25 bp, S. pombe
ccactttttgcctattcttgatgaa

SEQ ID NO: 85238 - DNA, 25 bp, S. pombe
ccacctctgttgacatcttggttaa

SEQ ID NO: 85239 - DNA, 25 bp, S. pombe
ccagccttgcagattattgtttgaa

SEQ ID NO: 85240 - DNA, 25 bp, S. pombe
gccacccttggtagcttaattgttg

SEQ ID NO: 85241 - DNA, 25 bp, S. pombe
gccagccgcttggaatgttttttct

SEQ ID NO: 85242 - DNA, 25 bp, S. pombe
gccaacgttggcatcttttcaatgt

SEQ ID NO: 85243 - DNA, 25 bp, S. pombe
gccaatccaaggctgctttaaattt

SEQ ID NO: 85244 - DNA, 25 bp, S. pombe
gccagttctaaaagcttcaccatga

SEQ ID NO: 85245 - DNA, 25 bp, S. pombe
gccatgtttaattccagcagacctg

SEQ ID NO: 85246 - DNA, 25 bp, S. pombe
gccagattatagtgccagacctcga

SEQ ID NO: 85247 - DNA, 25 bp, S. pombe
gcctgcttccgaggaaacttttcat

SEQ ID NO: 85248 - DNA, 25 bp, S. pombe
gcctgcctccaaagaacaaaccgat

SEQ ID NO: 85249 - DNA, 25 bp, S. pombe
gccaatcctcctgagtcagcaaatg

SEQ ID NO: 85250 - DNA, 25 bp, S. pombe
gccagttcttctagtagcggtgcta

SEQ ID NO: 85251 - DNA, 25 bp, S. pombe
gccagtccttctggtgactattttg

SEQ ID NO: 85252 - DNA, 25 bp, S. pombe
gccagggtgcggctgcaatttattt

SEQ ID NO: 85253 - DNA, 25 bp, S. pombe
ccacgccagatgttgagacctctaa

SEQ ID NO: 85254 - DNA, 25 bp, S. pombe
gccaatgtttttagcttaccgtcca

SEQ ID NO: 85255 - DNA, 25 bp, S. pombe
gcctacctttggctttcaaattcga

SEQ ID NO: 85256 - DNA, 25 bp, S. pombe
gcctcccttccagattggcaaatat

SEQ ID NO: 85257 - DNA, 25 bp, S. pombe
gccttaaactccctaatgtcacaag

SEQ ID NO: 85258 - DNA, 25 bp, S. pombe
gccaccggagctgactggatgcaaa

SEQ ID NO: 85259 - DNA, 25 bp, S. pombe
gccactgaggctgtttctaaaacgc

SEQ ID NO: 85260 - DNA, 25 bp, S. pombe
gccaagcttgcacttaccatgaaga

SEQ ID NO: 85261 - DNA, 25 bp, S. pombe
gccgggtactattttgaagacgcct

SEQ ID NO: 85262 - DNA, 25 bp, S. pombe
gccgggagaccgtattgccaatcag

SEQ ID NO: 85263 - DNA, 25 bp, S. pombe
gccgtagatactcttaccaatcggt

SEQ ID NO: 85264 - DNA, 25 bp, S. pombe
gccagaaatagagcagcccgcgata

SEQ ID NO: 85265 - DNA, 25 bp, S. pombe
gccacaatgttgatcagccacgcaa

SEQ ID NO: 85266 - DNA, 25 bp, S. pombe
gccaatgattgtagaagccaacgat

SEQ ID NO: 85267 - DNA, 25 bp, S. pombe
gccacagttattttgcaccttcgtg

SEQ ID NO: 85268 - DNA, 25 bp, S. pombe
gccactgttaagacccatttgcgta

SEQ ID NO: 85269 - DNA, 25 bp, S. pombe
gcctttatactcttcgcctaatgat

SEQ ID NO: 85270 - DNA, 25 bp, S. pombe
gccgttgagaaggttgcccctggtg

SEQ ID NO: 85271 - DNA, 25 bp, S. pombe
gccaattggcttctttacctgatca

SEQ ID NO: 85272 - DNA, 25 bp, S. pombe
gcctcaggctatcgcatgtacgaat

SEQ ID NO: 85273 - DNA, 25 bp, S. pombe
gccagatgggtcgttagttagctca

SEQ ID NO: 85274 - DNA, 25 bp, S. pombe
gccatgccgagtttgctattttgct

SEQ ID NO: 85275 - DNA, 25 bp, S. pombe
gcccgcgataccttacgtttagaag

SEQ ID NO: 85276 - DNA, 25 bp, S. pombe
gccactgaaggcaagggtttctctt

SEQ ID NO: 85277 - DNA, 25 bp, S. pombe
gccattggttggcatgctgttactc

SEQ ID NO: 85278 - DNA, 25 bp, S. pombe
ccactgcgtctacttccattatgaa

SEQ ID NO: 85279 - DNA, 25 bp, S. pombe
gccatcgatatttgtgcagcttgaa

SEQ ID NO: 85280 - DNA, 25 bp, S. pombe
gccttgatgatttggctatgcgcat

SEQ ID NO: 85281 - DNA, 25 bp, S. pombe
gcctgctaatgttgctgtcggtaga

SEQ ID NO: 85282 - DNA, 25 bp, S. pombe
gcctcgcatcgacaacagttacaaa

SEQ ID NO: 85283 - DNA, 25 bp, S. pombe
tccggccgaggttacttcagaggta

SEQ ID NO: 85284 - DNA, 25 bp, S. pombe
tccgggcggtgctgacaatggacct

SEQ ID NO: 85285 - DNA, 25 bp, S. pombe
tccgagtccgacttaactttgggat

SEQ ID NO: 85286 - DNA, 25 bp, S. pombe
gaccccttaacgtgagcctggagga

SEQ ID NO: 85287 - DNA, 25 bp, S. pombe
gccactctggcgctattttggagac

SEQ ID NO: 85288 - DNA, 25 bp, S. pombe
gccaactggcacaagggttccgata

SEQ ID NO: 85289 - DNA, 25 bp, S. pombe
gccgaatgcaaatccctttttactt

SEQ ID NO: 85290 - DNA, 25 bp, S. pombe
gccggacccactaacgtagttattg

SEQ ID NO: 85291 - DNA, 25 bp, S. pombe
gccggtcgtctagagcctatggaag

SEQ ID NO: 85292 - DNA, 25 bp, S. pombe
gccagccatagcagtaattgtgttt

SEQ ID NO: 85293 - DNA, 25 bp, S. pombe
gccggtttacgaactcgcctaagtg

SEQ ID NO: 85294 - DNA, 25 bp, S. pombe
gccaatttaaggaatcgccgtgcta

SEQ ID NO: 85295 - DNA, 25 bp, S. pombe
ccaatgtctaatctttctcctcaaa

SEQ ID NO: 85296 - DNA, 25 bp, S. pombe
gccaatgttacatcttctaccgaaa

SEQ ID NO: 85297 - DNA, 25 bp, S. pombe
gccaatgcctatctggtgttgcgga

SEQ ID NO: 85298 - DNA, 25 bp, S. pombe
ccaatccttcctgtttctatgagaa

SEQ ID NO: 85299 - DNA, 25 bp, S. pombe
gccaatttttctaagcactgcacct

SEQ ID NO: 85300 - DNA, 25 bp, S. pombe
gccacagaccttaccttgaattgct

SEQ ID NO: 85301 - DNA, 25 bp, S. pombe
gccactaccactaccaatgcagatg

SEQ ID NO: 85302 - DNA, 25 bp, S. pombe
gcccgtgaatctcgcctgaaggttg

SEQ ID NO: 85303 - DNA, 25 bp, S. pombe
gccattgctcagttccagaagactt

SEQ ID NO: 85304 - DNA, 25 bp, S. pombe
gccttacagaaactcattgaatcgc

SEQ ID NO: 85305 - DNA, 25 bp, S. pombe
gcctctgaagattatgcaattgaac

SEQ ID NO: 85306 - DNA, 25 bp, S. pombe
gccgtcaatggtcgtggtatgccta

SEQ ID NO: 85307 - DNA, 25 bp, S. pombe
gccttgttggctcgtatgtatgtca

SEQ ID NO: 85308 - DNA, 25 bp, S. pombe
gccttggtgctgtggttatctatgc

SEQ ID NO: 85309 - DNA, 25 bp, S. pombe
ccaatgatggtatcggttgctccgc

SEQ ID NO: 85310 - DNA, 25 bp, S. pombe
gccttacctatatgtgcgtgtgcta

SEQ ID NO: 85311 - DNA, 25 bp, S. pombe
gactccggttatgtccgttgttggc

SEQ ID NO: 85312 - DNA, 25 bp, S. pombe
gcctttggtcaaatctccgttttag

SEQ ID NO: 85313 - DNA, 25 bp, S. pombe
gcctttcttctgaggtcggatggaa

SEQ ID NO: 85314 - DNA, 25 bp, S. pombe
gccttttagtcctcttgctggagaa

SEQ ID NO: 85315 - DNA, 25 bp, S. pombe
gcctttaatgcagtctcctttggta

SEQ ID NO: 85316 - DNA, 25 bp, S. pombe
gcctattcctgagtcacctagggta

SEQ ID NO: 85317 - DNA, 25 bp, S. pombe
gcgttaccggtaaatatggcgttcg

SEQ ID NO: 85318 - DNA, 25 bp, S. pombe
gccttcgttggcttaactcttggaa

SEQ ID NO: 85319 - DNA, 25 bp, S. pombe
gcctacgattcctcaactttatatt

SEQ ID NO: 85320 - DNA, 25 bp, S. pombe
gcctacttccgctgctactgcttag

SEQ ID NO: 85321 - DNA, 25 bp, S. pombe
ccaagttccagcttcaactgctaaa

SEQ ID NO: 85322 - DNA, 25 bp, S. pombe
gcccgcattgctttgaaaaaggctt

SEQ ID NO: 85323 - DNA, 25 bp, S. pombe
gccaaccgctaatattgtgccttta

SEQ ID NO: 85324 - DNA, 25 bp, S. pombe
ccaaggctcattttgtttccactga

SEQ ID NO: 85325 - DNA, 25 bp, S. pombe
ccaaggatcgcttttgttctcttaa

SEQ ID NO: 85326 - DNA, 25 bp, S. pombe
gcccaagacaacgatacccaattag

SEQ ID NO: 85327 - DNA, 25 bp, S. pombe
gcctggcaagaacctcaactaatta

SEQ ID NO: 85328 - DNA, 25 bp, S. pombe
gccagcccaaacagcatgattcaat

SEQ ID NO: 85329 - DNA, 25 bp, S. pombe
gccagtcctcaagttgcagacacta

SEQ ID NO: 85330 - DNA, 25 bp, S. pombe
gccatctccctgtatatcaacgaat

SEQ ID NO: 85331 - DNA, 25 bp, S. pombe
gcctaggctctccatatgtgacaag

SEQ ID NO: 85332 - DNA, 25 bp, S. pombe
gccatgaggttctatttgcaacgtc

SEQ ID NO: 85333 - DNA, 25 bp, S. pombe
gccagtgtgttcttgttgcatatcg

SEQ ID NO: 85334 - DNA, 25 bp, S. pombe
gccacctatggcttttgattacgga

SEQ ID NO: 85335 - DNA, 25 bp, S. pombe
gccagctatcggtcctttgtataat

SEQ ID NO: 85336 - DNA, 25 bp, S. pombe
gcctgtttggcgtttaattgtcttt

SEQ ID NO: 85337 - DNA, 25 bp, S. pombe
gcctttttcattactcatctcgtta

SEQ ID NO: 85338 - DNA, 25 bp, S. pombe
gccaactcttttgatatacggtcat

SEQ ID NO: 85339 - DNA, 25 bp, S. pombe
gccggtgctcccttagtaaagttca

SEQ ID NO: 85340 - DNA, 25 bp, S. pombe
gccgtggttctcgtactataggtaa

SEQ ID NO: 85341 - DNA, 25 bp, S. pombe
gccggtgtacgaaacgcttatgctt

SEQ ID NO: 85342 - DNA, 25 bp, S. pombe
gccctgtgctaagaatgccgtttat

SEQ ID NO: 85343 - DNA, 25 bp, S. pombe
gctttcacatctgtagacgggcgta

SEQ ID NO: 85344 - DNA, 25 bp, S. pombe
gcctgagctaaattatgccggttta

SEQ ID NO: 85345 - DNA, 25 bp, S. pombe
gccagagagtactttcaccgttatt

SEQ ID NO: 85346 - DNA, 25 bp, S. pombe
gccaaagctaatgtccctgtgtatt

SEQ ID NO: 85347 - DNA, 25 bp, S. pombe
gccaatatctagtttccactgcgta

SEQ ID NO: 85348 - DNA, 25 bp, S. pombe
gccatgcaatcatcgaaactgctag

SEQ ID NO: 85349 - DNA, 25 bp, S. pombe
gccttaacggatacattctctactg

SEQ ID NO: 85350 - DNA, 25 bp, S. pombe
gccattggagtcgaacacagtctat

SEQ ID NO: 85351 - DNA, 25 bp, S. pombe
gccatgaaagtcgtgatacctccta

SEQ ID NO: 85352 - DNA, 25 bp, S. pombe
gccagaaatgtgttcttccatccta

SEQ ID NO: 85353 - DNA, 25 bp, S. pombe
gccagtaatgcttcttcctttgtta

SEQ ID NO: 85354 - DNA, 25 bp, S. pombe
gccaaggctctgcttaacactatta

SEQ ID NO: 85355 - DNA, 25 bp, S. pombe
gccaaggccgcgatgaatacattta

SEQ ID NO: 85356 - DNA, 25 bp, S. pombe
gccaacgatggccttgatgtaattt

SEQ ID NO: 85357 - DNA, 25 bp, S. pombe
gccaccgccgatattgtaaccaata

SEQ ID NO: 85358 - DNA, 25 bp, S. pombe
gcctctcgcgaagtcgttctttaag

SEQ ID NO: 85359 - DNA, 25 bp, S. pombe
gccatttgcccagcgtcatatttga

SEQ ID NO: 85360 - DNA, 25 bp, S. pombe
gccatgttgctcgtcaagtacgttt

SEQ ID NO: 85361 - DNA, 25 bp, S. pombe
gccacgagttattcagcaatcttct

SEQ ID NO: 85362 - DNA, 25 bp, S. pombe
gcctatgtgcatttgtcaggatacc

SEQ ID NO: 85363 - DNA, 25 bp, S. pombe
gccagtgctggcttgttggatgaat

SEQ ID NO: 85364 - DNA, 25 bp, S. pombe
tgcccttcatcgttaattttaccca

SEQ ID NO: 85365 - DNA, 25 bp, S. pombe
gcgcgacggagccatgagcaaactt

SEQ ID NO: 85366 - DNA, 25 bp, S. pombe
gccttctcaatcctcaatttcatga

SEQ ID NO: 85367 - DNA, 25 bp, S. pombe
gcctctgctgtttggaatggcgcat

SEQ ID NO: 85368 - DNA, 25 bp, S. pombe
gccgtactggtacatctgcgatgac

SEQ ID NO: 85369 - DNA, 25 bp, S. pombe
gccagctatggatgacgaatttgat

SEQ ID NO: 85370 - DNA, 25 bp, S. pombe
gccatgcgctggtgaaaatcctcta

SEQ ID NO: 85371 - DNA, 25 bp, S. pombe
gcccaccgtcgatgcaacaattata

SEQ ID NO: 85372 - DNA, 25 bp, S. pombe
gctcacctcgaaaaaactgactcct

SEQ ID NO: 85373 - DNA, 25 bp, S. pombe
gccaactgggtttcatttttcgatc

SEQ ID NO: 85374 - DNA, 25 bp, S. pombe
gccattcttggttacgttttctacg

SEQ ID NO: 85375 - DNA, 25 bp, S. pombe
gccaaacttgctgtggaccatggat

SEQ ID NO: 85376 - DNA, 25 bp, S. pombe
gcctacacccaattgcgtgaatcta

SEQ ID NO: 85377 - DNA, 25 bp, S. pombe
gcctacaacaacaatcctaccgatg

SEQ ID NO: 85378 - DNA, 25 bp, S. pombe
gccaggttggtgtgtgattgtccca

SEQ ID NO: 85379 - DNA, 25 bp, S. pombe
gccactgtttacttgattgattcta

SEQ ID NO: 85380 - DNA, 25 bp, S. pombe
gcccgtgtcaacatgttacgttctc

SEQ ID NO: 85381 - DNA, 25 bp, S. pombe
gccgatgctgctagtgctgtggata

SEQ ID NO: 85382 - DNA, 25 bp, S. pombe
gccgctcgtagtcgcatgaatgtca

SEQ ID NO: 85383 - DNA, 25 bp, S. pombe
gccacttttggctttttcatgtcca

SEQ ID NO: 85384 - DNA, 25 bp, S. pombe
gcctttgttggcattttacctacgg

SEQ ID NO: 85385 - DNA, 25 bp, S. pombe
gccttcgacgctctcattgttaaga

SEQ ID NO: 85386 - DNA, 25 bp, S. pombe
gccatcgctgcaaacacttttacaa

SEQ ID NO: 85387 - DNA, 25 bp, S. pombe
gccagcaggtgcacattgtttctta

SEQ ID NO: 85388 - DNA, 25 bp, S. pombe
gccagcgtgtgcctcaatttttgaa

SEQ ID NO: 85389 - DNA, 25 bp, S. pombe
gccctttctctacttcaattaacta

SEQ ID NO: 85390 - DNA, 25 bp, S. pombe
gcctcgtatcgaagcttcaatcaga

SEQ ID NO: 85391 - DNA, 25 bp, S. pombe
gcctctgtcttcaagttcgacgaca

SEQ ID NO: 85392 - DNA, 25 bp, S. pombe
gccatctatttctacgaggagccga

SEQ ID NO: 85393 - DNA, 25 bp, S. pombe
gccagctatttcttcgagcagcgaa

SEQ ID NO: 85394 - DNA, 25 bp, S. pombe
gccactattctgttgcgtgaaatga

SEQ ID NO: 85395 - DNA, 25 bp, S. pombe
gcctgcagcacctactgttgaagct

SEQ ID NO: 85396 - DNA, 25 bp, S. pombe
gccatccgatgcctcaagatacgaa

SEQ ID NO: 85397 - DNA, 25 bp, S. pombe
gccagcacggcatttttccaaaaaa

SEQ ID NO: 85398 - DNA, 25 bp, S. pombe
gccgtgctaagcctgagtctaacta

SEQ ID NO: 85399 - DNA, 25 bp, S. pombe
gcgccctcctgacggatttgatgaa

SEQ ID NO: 85400 - DNA, 25 bp, S. pombe
gccaccatgcctcaagatgttttgg

SEQ ID NO: 85401 - DNA, 25 bp, S. pombe
gcctcctccattaaatttttccaga

SEQ ID NO: 85402 - DNA, 25 bp, S. pombe
gcccatgccgtcgaattgagttttc

SEQ ID NO: 85403 - DNA, 25 bp, S. pombe
gccgatgcctctgatttacgaattc

SEQ ID NO: 85404 - DNA, 25 bp, S. pombe
gccgcagtaattgtctccgttgcaa

SEQ ID NO: 85405 - DNA, 25 bp, S. pombe
gcgccgagagttgcataccatttta

SEQ ID NO: 85406 - DNA, 25 bp, S. pombe
gcctcgacaggcactaacatttcaa

SEQ ID NO: 85407 - DNA, 25 bp, S. pombe
gccatttcctatttctgttttacaa

SEQ ID NO: 85408 - DNA, 25 bp, S. pombe
gccattatctttgacttttcagccg

SEQ ID NO: 85409 - DNA, 25 bp, S. pombe
gccctatctttctaagtcattccgg

SEQ ID NO: 85410 - DNA, 25 bp, S. pombe
gcgcctgatcttaaaaagtacctag

SEQ ID NO: 85411 - DNA, 25 bp, S. pombe
gccgtcctttaatagccatggttgt

SEQ ID NO: 85412 - DNA, 25 bp, S. pombe
gcctaccgtttatacacttatcgat

SEQ ID NO: 85413 - DNA, 25 bp, S. pombe
gcctgacaaggttactgagctaatc

SEQ ID NO: 85414 - DNA, 25 bp, S. pombe
gccatgctgcctacgatcatattga

SEQ ID NO: 85415 - DNA, 25 bp, S. pombe
gccccaagttggctctctaattgat

SEQ ID NO: 85416 - DNA, 25 bp, S. pombe
gccggaatttggctctgtattaaca

SEQ ID NO: 85417 - DNA, 25 bp, S. pombe
gccgtgcttataagcgtcttttata

SEQ ID NO: 85418 - DNA, 25 bp, S. pombe
gcccagcgcccaaatcggaatagaa

SEQ ID NO: 85419 - DNA, 25 bp, S. pombe
gcctactcaccttttggcaatcaaa

SEQ ID NO: 85420 - DNA, 25 bp, S. pombe
gccatccttcttccttctgaaaaaa

SEQ ID NO: 85421 - DNA, 25 bp, S. pombe
gccttttatcctcttgtgaagaaag

SEQ ID NO: 85422 - DNA, 25 bp, S. pombe
gccttgctttcgtgctggtgaaaac

SEQ ID NO: 85423 - DNA, 25 bp, S. pombe
gccattgcataacattcgctcagga

SEQ ID NO: 85424 - DNA, 25 bp, S. pombe
gccataaacgccatcactcatgaga

SEQ ID NO: 85425 - DNA, 25 bp, S. pombe
gccattatgcatgctactgctggaa

SEQ ID NO: 85426 - DNA, 25 bp, S. pombe
gcctttgctcacaactgggtactaa

SEQ ID NO: 85427 - DNA, 25 bp, S. pombe
gcctttggatgttttggcttctaaa

SEQ ID NO: 85428 - DNA, 25 bp, S. pombe
gccatttgaagttgtatgcctccta

SEQ ID NO: 85429 - DNA, 25 bp, S. pombe
gccatcaatgagatttccgagccta

SEQ ID NO: 85430 - DNA, 25 bp, S. pombe
gccgtaaaggccacactgaaccaaa

SEQ ID NO: 85431 - DNA, 25 bp, S. pombe
gccgtccatggatacttgtgttgaa

SEQ ID NO: 85432 - DNA, 25 bp, S. pombe
gccgtcttcgtcagttttttgagaa

SEQ ID NO: 85433 - DNA, 25 bp, S. pombe
gccttctccgtcaagttcaattgta

SEQ ID NO: 85434 - DNA, 25 bp, S. pombe
gcctgttgttgattcgcctttattt

SEQ ID NO: 85435 - DNA, 25 bp, S. pombe
gccagtatgttacgtgttcttcgaa

SEQ ID NO: 85436 - DNA, 25 bp, S. pombe
gccttcgttgatcttgtcacggaac

SEQ ID NO: 85437 - DNA, 25 bp, S. pombe
gcctctagaatcaaattccgctctg

SEQ ID NO: 85438 - DNA, 25 bp, S. pombe
gccgatgccctagctttagttaaga

SEQ ID NO: 85439 - DNA, 25 bp, S. pombe
gccgtcccaatcgttaattctgaag

SEQ ID NO: 85440 - DNA, 25 bp, S. pombe
gccgtcctctatatcacctaataag

SEQ ID NO: 85441 - DNA, 25 bp, S. pombe
gccttccatctcttaaatctactat

SEQ ID NO: 85442 - DNA, 25 bp, S. pombe
gccatttcttccgtaacaagctcaa

SEQ ID NO: 85443 - DNA, 25 bp, S. pombe
gccgtatttcccaacaaggtcaacg

SEQ ID NO: 85444 - DNA, 25 bp, S. pombe
gccgtatcttccgagcctaatgtag

SEQ ID NO: 85445 - DNA, 25 bp, S. pombe
gccatgatcgttgttctgttatttg

SEQ ID NO: 85446 - DNA, 25 bp, S. pombe
gccgtcgtttacctgttatcatgtg

SEQ ID NO: 85447 - DNA, 25 bp, S. pombe
gccatgccgatattacagcgtcttt

SEQ ID NO: 85448 - DNA, 25 bp, S. pombe
gccgccaagattactgaggctttag

SEQ ID NO: 85449 - DNA, 25 bp, S. pombe
gcctgacatgaattgttctactcaa

SEQ ID NO: 85450 - DNA, 25 bp, S. pombe
gcctcttgagttatgttttttcgcg

SEQ ID NO: 85451 - DNA, 25 bp, S. pombe
gcctgttggcttacttttcgatttg

SEQ ID NO: 85452 - DNA, 25 bp, S. pombe
gcctttgcgttttcactggactaga

SEQ ID NO: 85453 - DNA, 25 bp, S. pombe
gccattatgggttcagctgctggac

SEQ ID NO: 85454 - DNA, 25 bp, S. pombe
gcctgctttaacgattggtatgcga

SEQ ID NO: 85455 - DNA, 25 bp, S. pombe
gctcttgagtcacacattcgaacgg

SEQ ID NO: 85456 - DNA, 25 bp, S. pombe
gcccggtctgccattcaaacaggaa

SEQ ID NO: 85457 - DNA, 25 bp, S. pombe
gcgccgggccctagaaacaatgaaa

SEQ ID NO: 85458 - DNA, 25 bp, S. pombe
gccgtggcaccatttctaaaagaga

SEQ ID NO: 85459 - DNA, 25 bp, S. pombe
gccaggcttggtaatctacgaggaa

SEQ ID NO: 85460 - DNA, 25 bp, S. pombe
gccagtgttgacatatatcgcgcaa

SEQ ID NO: 85461 - DNA, 25 bp, S. pombe
gcacgtactacagatgttgccatac

SEQ ID NO: 85462 - DNA, 25 bp, S. pombe
gccttagcgacgaaaagcctgaaac

SEQ ID NO: 85463 - DNA, 25 bp, S. pombe
gccttcggttggtgcagccatcaaa

SEQ ID NO: 85464 - DNA, 25 bp, S. pombe
gccatgattggttcgatccatccga

SEQ ID NO: 85465 - DNA, 25 bp, S. pombe
gccatgaatggtttgctcgaccagt

SEQ ID NO: 85466 - DNA, 25 bp, S. pombe
gccattcagagtttgtgcgcacagc

SEQ ID NO: 85467 - DNA, 25 bp, S. pombe
gccatacgatgttttgcttgcagct

SEQ ID NO: 85468 - DNA, 25 bp, S. pombe
gcctcgtgattctttcattgactgt

SEQ ID NO: 85469 - DNA, 25 bp, S. pombe
gccccagaatctgcgcattttggta

SEQ ID NO: 85470 - DNA, 25 bp, S. pombe
gccctcgccgatgtggaattgatta

SEQ ID NO: 85471 - DNA, 25 bp, S. pombe
gcacctaccgatgacgagccttata

SEQ ID NO: 85472 - DNA, 25 bp, S. pombe
gccgctaccggctcatatgtaaatt

SEQ ID NO: 85473 - DNA, 25 bp, S. pombe
gccatttctcggctcttgtgaagat

SEQ ID NO: 85474 - DNA, 25 bp, S. pombe
gccattttagcatctttggacgcat

SEQ ID NO: 85475 - DNA, 25 bp, S. pombe
gccattcttgtcaacgttgcgaggt

SEQ ID NO: 85476 - DNA, 25 bp, S. pombe
gccattttgctccaaactgcgaagt

SEQ ID NO: 85477 - DNA, 25 bp, S. pombe
gccattgatctagcgaaatccctgt

SEQ ID NO: 85478 - DNA, 25 bp, S. pombe
gcctgttaatgttagcagaccgatt

SEQ ID NO: 85479 - DNA, 25 bp, S. pombe
gccgaattctggagcgcaatcgcat

SEQ ID NO: 85480 - DNA, 25 bp, S. pombe
gcctagtattagaacagcacgccat

SEQ ID NO: 85481 - DNA, 25 bp, S. pombe
gcctttattgagattgagcgccata

SEQ ID NO: 85482 - DNA, 25 bp, S. pombe
gccgttactctcatgcgaatggtgt

SEQ ID NO: 85483 - DNA, 25 bp, S. pombe
gccgtgatttctggtgcaatttctt

SEQ ID NO: 85484 - DNA, 25 bp, S. pombe
gcctaatgccattgagctgtttgat

SEQ ID NO: 85485 - DNA, 25 bp, S. pombe
gcgcatagtgtcttgttgtggagtc

SEQ ID NO: 85486 - DNA, 25 bp, S. pombe
gccattttcattctaggagcttcaa

SEQ ID NO: 85487 - DNA, 25 bp, S. pombe
gccatatctggcgaaattattcctg

SEQ ID NO: 85488 - DNA, 25 bp, S. pombe
gccattgctctacctattctgttaa

SEQ ID NO: 85489 - DNA, 25 bp, S. pombe
gccttgcgtgagcttatcggtgata

SEQ ID NO: 85490 - DNA, 25 bp, S. pombe
gccctcgtacctgatcaaatgcata

SEQ ID NO: 85491 - DNA, 25 bp, S. pombe
gccgggctatactccttacatgaga

SEQ ID NO: 85492 - DNA, 25 bp, S. pombe
gcgcgggaaaattcgcttcacttgg

SEQ ID NO: 85493 - DNA, 25 bp, S. pombe
gcgcgggcgggatacttcaaatgca

SEQ ID NO: 85494 - DNA, 25 bp, S. pombe
gcaccaacggcacattgtacggttt

SEQ ID NO: 85495 - DNA, 25 bp, S. pombe
gccctgactgtctaattgttgctgg

SEQ ID NO: 85496 - DNA, 25 bp, S. pombe
gccatcaccattgttttctgcagag

SEQ ID NO: 85497 - DNA, 25 bp, S. pombe
gccatcggttcaagctcatttcaag

SEQ ID NO: 85498 - DNA, 25 bp, S. pombe
gccatttatcgtctctctcatataa

SEQ ID NO: 85499 - DNA, 25 bp, S. pombe
gccattgctgctttgtttgttatta

SEQ ID NO: 85500 - DNA, 25 bp, S. pombe
gccatctctgcatatctcttgaaaa

SEQ ID NO: 85501 - DNA, 25 bp, S. pombe
gccttcaacaacttctcgatcataa

SEQ ID NO: 85502 - DNA, 25 bp, S. pombe
gttgtcctcaactcactaatttgtc

SEQ ID NO: 85503 - DNA, 25 bp, S. pombe
gccttgtccggtgcaacattgtaga

SEQ ID NO: 85504 - DNA, 25 bp, S. pombe
gccttcacctttgcaagtgctttga

SEQ ID NO: 85505 - DNA, 25 bp, S. pombe
gccgtcctttcaaacagtggcttga

SEQ ID NO: 85506 - DNA, 25 bp, S. pombe
gccgtcctttccgtgaagctttaag

SEQ ID NO: 85507 - DNA, 25 bp, S. pombe
gcctcgcacgtttgctttttgagaa

SEQ ID NO: 85508 - DNA, 25 bp, S. pombe
gcctggttttgtcgtttctgaagcc

SEQ ID NO: 85509 - DNA, 25 bp, S. pombe
gcctcatacggcactgatgtatttg

SEQ ID NO: 85510 - DNA, 25 bp, S. pombe
gccgacgtcgtagttttagtatcca

SEQ ID NO: 85511 - DNA, 25 bp, S. pombe
gcgcgcctagggtttttatggtcaa

SEQ ID NO: 85512 - DNA, 25 bp, S. pombe
gctcaactagcccttgactttagtt

SEQ ID NO: 85513 - DNA, 25 bp, S. pombe
gccggtcaatgcactgttcaatatt

SEQ ID NO: 85514 - DNA, 25 bp, S. pombe
gccgactactgattgcctagttcaa

SEQ ID NO: 85515 - DNA, 25 bp, S. pombe
gcctattctctattgctattggtca

SEQ ID NO: 85516 - DNA, 25 bp, S. pombe
gcctgtgattgctaccgtatcgaaa

SEQ ID NO: 85517 - DNA, 25 bp, S. pombe
gctatgcctggtatacctggtgcaa

SEQ ID NO: 85518 - DNA, 25 bp, S. pombe
gccggtgagtcagtggtttcgaaaa

SEQ ID NO: 85519 - DNA, 25 bp, S. pombe
gccgtgatcaccgtgttttcgaaat

SEQ ID NO: 85520 - DNA, 25 bp, S. pombe
gccgtggttcagttttgtcgtgcaa

SEQ ID NO: 85521 - DNA, 25 bp, S. pombe
gcctgttaactaattccgacgctat

SEQ ID NO: 85522 - DNA, 25 bp, S. pombe
gcctgttgggctatttctaatgcta

SEQ ID NO: 85523 - DNA, 25 bp, S. pombe
gccttgttggtctttttgatctcat

SEQ ID NO: 85524 - DNA, 25 bp, S. pombe
gcgcctgcttttcgcaaaggtataa

SEQ ID NO: 85525 - DNA, 25 bp, S. pombe
gcgactgctattacagggaggcctt

SEQ ID NO: 85526 - DNA, 25 bp, S. pombe
gcgccggccaacatcattagattat

SEQ ID NO: 85527 - DNA, 25 bp, S. pombe
gccattgcccaagttgccgaatttg

SEQ ID NO: 85528 - DNA, 25 bp, S. pombe
gccttgtcagcctatagtgcatatt

SEQ ID NO: 85529 - DNA, 25 bp, S. pombe
gcctcatcttgccaatcctaatgat

SEQ ID NO: 85530 - DNA, 25 bp, S. pombe
gccgctgcgaaatgactgactctat

SEQ ID NO: 85531 - DNA, 25 bp, S. pombe
gccattgctaaatcacattcctcat

SEQ ID NO: 85532 - DNA, 25 bp, S. pombe
gcctatgccgagactattatcgcta

SEQ ID NO: 85533 - DNA, 25 bp, S. pombe
gccttcgctactgtttcatctatat

SEQ ID NO: 85534 - DNA, 25 bp, S. pombe
gccgtctcgtcattttcgttagtga

SEQ ID NO: 85535 - DNA, 25 bp, S. pombe
gccctgtggtatttgtcgtcaagta

SEQ ID NO: 85536 - DNA, 25 bp, S. pombe
gccgtatggaaattgactgctgcta

SEQ ID NO: 85537 - DNA, 25 bp, S. pombe
gccttcatgggattaatcgctgttg

SEQ ID NO: 85538 - DNA, 25 bp, S. pombe
gcctttagtgttgttgctgttgcca

SEQ ID NO: 85539 - DNA, 25 bp, S. pombe
gccccggttagagcatttcgtgtaa

SEQ ID NO: 85540 - DNA, 25 bp, S. pombe
gcctctaaccttgcctttgaaatat

SEQ ID NO: 85541 - DNA, 25 bp, S. pombe
gccgtttggcacgtcaactatggta

SEQ ID NO: 85542 - DNA, 25 bp, S. pombe
gccgtattcgcaaacaacgtgaaga

SEQ ID NO: 85543 - DNA, 25 bp, S. pombe
gcctcttccaatgccaaatctagtg

SEQ ID NO: 85544 - DNA, 25 bp, S. pombe
gccttttacactgcttcattactga

SEQ ID NO: 85545 - DNA, 25 bp, S. pombe
gccttttccgcgtatattgtagcat

SEQ ID NO: 85546 - DNA, 25 bp, S. pombe
gcccttgtcagctagagttttcgat

SEQ ID NO: 85547 - DNA, 25 bp, S. pombe
gcccgtccaacgttttcttgtatga

SEQ ID NO: 85548 - DNA, 25 bp, S. pombe
gccgttctcaagcttttcttggaaa

SEQ ID NO: 85549 - DNA, 25 bp, S. pombe
gccgtttaagctctaccttcaaagc

SEQ ID NO: 85550 - DNA, 25 bp, S. pombe
gccttgctgtcattttctatgtgtt

SEQ ID NO: 85551 - DNA, 25 bp, S. pombe
gcctcgttcagtattattcgccggt

SEQ ID NO: 85552 - DNA, 25 bp, S. pombe
gcttcaacacttattggtcccggta

SEQ ID NO: 85553 - DNA, 25 bp, S. pombe
gcctaagacgtccagtatacatgct

SEQ ID NO: 85554 - DNA, 25 bp, S. pombe
gcgcttttcaataccgttcaatcgt

SEQ ID NO: 85555 - DNA, 25 bp, S. pombe
gccttcttaggttcttcaacatggt

SEQ ID NO: 85556 - DNA, 25 bp, S. pombe
gcctcctttgcggacgatcgaagat

SEQ ID NO: 85557 - DNA, 25 bp, S. pombe
gcctttcactgcgtctgatcaggaa

SEQ ID NO: 85558 - DNA, 25 bp, S. pombe
gcctcattctcggttctcagaaaag

SEQ ID NO: 85559 - DNA, 25 bp, S. pombe
gcccgagcatcgtattctcagggta

SEQ ID NO: 85560 - DNA, 25 bp, S. pombe
gcctccgacgattttatgggtgaat

SEQ ID NO: 85561 - DNA, 25 bp, S. pombe
gccccagacgattttgttgccgaaa

SEQ ID NO: 85562 - DNA, 25 bp, S. pombe
gcctaattgtacttttattctcgtt

SEQ ID NO: 85563 - DNA, 25 bp, S. pombe
gccttttggactttttctgtgcgta

SEQ ID NO: 85564 - DNA, 25 bp, S. pombe
gcctttttagcttacttcgttggag

SEQ ID NO: 85565 - DNA, 25 bp, S. pombe
gcctatctcaaatctttacgcgaaa

SEQ ID NO: 85566 - DNA, 25 bp, S. pombe
gcgcgatcgatctcctattacgaaa

SEQ ID NO: 85567 - DNA, 25 bp, S. pombe
gcgcgtcttcctcgaagtacggaaa

SEQ ID NO: 85568 - DNA, 25 bp, S. pombe
gccctggatgcctaggcccgagaat

SEQ ID NO: 85569 - DNA, 25 bp, S. pombe
gccctggatgcctagacctaagaac

SEQ ID NO: 85570 - DNA, 25 bp, S. pombe
gcctggtatgccgaacctgaatatg

SEQ ID NO: 85571 - DNA, 25 bp, S. pombe
gcctctatatctccttcagtaattg

SEQ ID NO: 85572 - DNA, 25 bp, S. pombe
gcctcttatcccgatcatgatttta

SEQ ID NO: 85573 - DNA, 25 bp, S. pombe
gcctctcctcctgaagattttgaat

SEQ ID NO: 85574 - DNA, 25 bp, S. pombe
gcccaccttgctgagagcagtgatt

SEQ ID NO: 85575 - DNA, 25 bp, S. pombe
gcgctgaatttgtgattcctgctca

SEQ ID NO: 85576 - DNA, 25 bp, S. pombe
gcgaaactaacgcatccgtagcatt

SEQ ID NO: 85577 - DNA, 25 bp, S. pombe
gcctgaacgactaaagcctacgatt

SEQ ID NO: 85578 - DNA, 25 bp, S. pombe
gccgattcctctaaagcggatagtt

SEQ ID NO: 85579 - DNA, 25 bp, S. pombe
gcccgcattgcaacattcgaagaca

SEQ ID NO: 85580 - DNA, 25 bp, S. pombe
gccgtgccatgcaacttagcattga

SEQ ID NO: 85581 - DNA, 25 bp, S. pombe
gcctgaccctcgtgatgacttgaat

SEQ ID NO: 85582 - DNA, 25 bp, S. pombe
gcctacccttattgacagcttttaa

SEQ ID NO: 85583 - DNA, 25 bp, S. pombe
gcctatctccgtaaagcacttttag

SEQ ID NO: 85584 - DNA, 25 bp, S. pombe
gcgctactcggaagcatgatccttt

SEQ ID NO: 85585 - DNA, 25 bp, S. pombe
gcgcagaagttttactagctctcgt

SEQ ID NO: 85586 - DNA, 25 bp, S. pombe
gcagtcgactggtggacccttggta

SEQ ID NO: 85587 - DNA, 25 bp, S. pombe
gacaaggaaccttcgctgcaggagt

SEQ ID NO: 85588 - DNA, 25 bp, S. pombe
gtcgtaaagttctcaatattccgtt

SEQ ID NO: 85589 - DNA, 25 bp, S. pombe
gcagtgtgaaacacctttttcggtt

SEQ ID NO: 85590 - DNA, 25 bp, S. pombe
gcgattcaaatgttggttcggtaat

SEQ ID NO: 85591 - DNA, 25 bp, S. pombe
gccgcgacgatcactgctgatatta

SEQ ID NO: 85592 - DNA, 25 bp, S. pombe
gcctctggaggaacctgtggttttc

SEQ ID NO: 85593 - DNA, 25 bp, S. pombe
gcctcttctcttaacgtctattata

SEQ ID NO: 85594 - DNA, 25 bp, S. pombe
gccggcaacagggacacattgtaca

SEQ ID NO: 85595 - DNA, 25 bp, S. pombe
gcgctagcagtatggccaggtacaa

SEQ ID NO: 85596 - DNA, 25 bp, S. pombe
gcctggccgagatgcatttacatgt

SEQ ID NO: 85597 - DNA, 25 bp, S. pombe
gccgccaggaatgccttatcgtgag

SEQ ID NO: 85598 - DNA, 25 bp, S. pombe
gcccttaaatccgtcatttctgagg

SEQ ID NO: 85599 - DNA, 25 bp, S. pombe
gcctcttgagaaacgtccttggatt

SEQ ID NO: 85600 - DNA, 25 bp, S. pombe
gcgaccttgaagctgaacgtgtagt

SEQ ID NO: 85601 - DNA, 25 bp, S. pombe
gccgttagtttatacattgctcagc

SEQ ID NO: 85602 - DNA, 25 bp, S. pombe
gccgaacctcccaaaatagctgata

SEQ ID NO: 85603 - DNA, 25 bp, S. pombe
gccgcaatgagcgattcaattaaca

SEQ ID NO: 85604 - DNA, 25 bp, S. pombe
gcctcttttatcattctggtgcatc

SEQ ID NO: 85605 - DNA, 25 bp, S. pombe
gccgtttatgatgatgcctgtgtct

SEQ ID NO: 85606 - DNA, 25 bp, S. pombe
gcccgttatgggatttggttcagga

SEQ ID NO: 85607 - DNA, 25 bp, S. pombe
gcccgtccaggatctttggtatcaa

SEQ ID NO: 85608 - DNA, 25 bp, S. pombe
gcgccctccatttttgtgggttata

SEQ ID NO: 85609 - DNA, 25 bp, S. pombe
gcctgtttgcttttagcactccaaa

SEQ ID NO: 85610 - DNA, 25 bp, S. pombe
gcctgctgttggtaaaggagcatcc

SEQ ID NO: 85611 - DNA, 25 bp, S. pombe
gccgtcaaatcctcaagatgctcag

SEQ ID NO: 85612 - DNA, 25 bp, S. pombe
gccgcaaacctgttcagggctatga

SEQ ID NO: 85613 - DNA, 25 bp, S. pombe
gccgcgtacgcgatcattatttgtt

SEQ ID NO: 85614 - DNA, 25 bp, S. pombe
gcccttacggaccatgatactaaca

SEQ ID NO: 85615 - DNA, 25 bp, S. pombe
gccctacacctcgagttacgaaaga

SEQ ID NO: 85616 - DNA, 25 bp, S. pombe
gccctactttccaattgaccgaaat

SEQ ID NO: 85617 - DNA, 25 bp, S. pombe
gccgctacattctatcgttggacaa

SEQ ID NO: 85618 - DNA, 25 bp, S. pombe
gcgcaggacgtgtctcgattacaaa

SEQ ID NO: 85619 - DNA, 25 bp, S. pombe
gcctctttctcctttgtctatgata

SEQ ID NO: 85620 - DNA, 25 bp, S. pombe
gcctctttcgtcttctgatgatgaa

SEQ ID NO: 85621 - DNA, 25 bp, S. pombe
gcctcgtcatgcctcatttgaaaaa

SEQ ID NO: 85622 - DNA, 25 bp, S. pombe
gcccgcgatagctgtggatgaaatt

SEQ ID NO: 85623 - DNA, 25 bp, S. pombe
gccgtcgacgcatgttgcagcaaat

SEQ ID NO: 85624 - DNA, 25 bp, S. pombe
gccctcggtgtcattttcaacttga

SEQ ID NO: 85625 - DNA, 25 bp, S. pombe
gcctggagcaatacgcttccgaata

SEQ ID NO: 85626 - DNA, 25 bp, S. pombe
gccgatgatattacattgtccgact

SEQ ID NO: 85627 - DNA, 25 bp, S. pombe
gccggatcattttttgtggtgccat

SEQ ID NO: 85628 - DNA, 25 bp, S. pombe
gcccatgtcgtttggacttttcaac

SEQ ID NO: 85629 - DNA, 25 bp, S. pombe
gcctcgtgctctacaattttcatta

SEQ ID NO: 85630 - DNA, 25 bp, S. pombe
gcctgcgctactactgatttttcga

SEQ ID NO: 85631 - DNA, 25 bp, S. pombe
gccggcggatcgactacaagttcat

SEQ ID NO: 85632 - DNA, 25 bp, S. pombe
gaagattccccagaaggttttgttg

SEQ ID NO: 85633 - DNA, 25 bp, S. pombe
gaatatacccttgagggtcctcgta

SEQ ID NO: 85634 - DNA, 25 bp, S. pombe
gctttcccacttaaaccctttgatg

SEQ ID NO: 85635 - DNA, 25 bp, S. pombe
gcgctaacctttacaatccgttgga

SEQ ID NO: 85636 - DNA, 25 bp, S. pombe
gctctagcttttaatatcccgtgtg

SEQ ID NO: 85637 - DNA, 25 bp, S. pombe
gccgcagctggtaaaacccttgatt

SEQ ID NO: 85638 - DNA, 25 bp, S. pombe
gccgacttgctaatacgccttatgt

SEQ ID NO: 85639 - DNA, 25 bp, S. pombe
gcgcgcactttaacacttttaacct

SEQ ID NO: 85640 - DNA, 25 bp, S. pombe
gccgcagcagctttacatttgttta

SEQ ID NO: 85641 - DNA, 25 bp, S. pombe
gccgatgcagctttgtcatttttac

SEQ ID NO: 85642 - DNA, 25 bp, S. pombe
gccgcagcagcgatgtttccgaata

SEQ ID NO: 85643 - DNA, 25 bp, S. pombe
gccgcaaatgcggtttccgtataga

SEQ ID NO: 85644 - DNA, 25 bp, S. pombe
gcgacagttccctccgaaaaacgat

SEQ ID NO: 85645 - DNA, 25 bp, S. pombe
gcgcgatttacagcgtcgtcaacaa

SEQ ID NO: 85646 - DNA, 25 bp, S. pombe
gcctgatttgactacgctgggcaaa

SEQ ID NO: 85647 - DNA, 25 bp, S. pombe
gcgcgatcttgagctagctgttgaa

SEQ ID NO: 85648 - DNA, 25 bp, S. pombe
gccgacctgagcttactgttgtggg

SEQ ID NO: 85649 - DNA, 25 bp, S. pombe
gccgaacgtgccttatgtctgtgga

SEQ ID NO: 85650 - DNA, 25 bp, S. pombe
gcgaccggagccagtgtcactaaaa

SEQ ID NO: 85651 - DNA, 25 bp, S. pombe
gcgaaacattgcttcagacttttta

SEQ ID NO: 85652 - DNA, 25 bp, S. pombe
gcgtttgaaaatcgccagcttcgac

SEQ ID NO: 85653 - DNA, 25 bp, S. pombe
gcgtcgtaaacaataccttggtcct

SEQ ID NO: 85654 - DNA, 25 bp, S. pombe
gcgtttgattccatacctgatactc

SEQ ID NO: 85655 - DNA, 25 bp, S. pombe
gcgtatacttatttggccgaatcca

SEQ ID NO: 85656 - DNA, 25 bp, S. pombe
gcgactaaatatctagccggccaca

SEQ ID NO: 85657 - DNA, 25 bp, S. pombe
gcgaataccattcggagcgccggaa

SEQ ID NO: 85658 - DNA, 25 bp, S. pombe
gccgctcccgctaccggaggtgtta

SEQ ID NO: 85659 - DNA, 25 bp, S. pombe
gccgctcccgctaccggaggtgtta

SEQ ID NO: 85660 - DNA, 25 bp, S. pombe
gcgtcccggtcgtatagatcgtaaa

SEQ ID NO: 85661 - DNA, 25 bp, S. pombe
gcaagggccgaatagtgaagacatt

SEQ ID NO: 85662 - DNA, 25 bp, S. pombe
gaggcggtaggatcacaggaacaat

SEQ ID NO: 85663 - DNA, 25 bp, S. pombe
gcggcggctcatcgtaaccgagaaa

SEQ ID NO: 85664 - DNA, 25 bp, S. pombe
gccgggattggcttgattcgataaa

SEQ ID NO: 85665 - DNA, 25 bp, S. pombe
gctcgggttggcaatttcctaacac

SEQ ID NO: 85666 - DNA, 25 bp, S. pombe
gctacttgtttgctttaccagtcac

SEQ ID NO: 85667 - DNA, 25 bp, S. pombe
gctccctttattcttacttgtacat

SEQ ID NO: 85668 - DNA, 25 bp, S. pombe
gtccgacgtttgtttactactacat

SEQ ID NO: 85669 - DNA, 25 bp, S. pombe
gcgacgaccgatatcgtgttcgtga

SEQ ID NO: 85670 - DNA, 25 bp, S. pombe
gccctcctatctctatttctaagat

SEQ ID NO: 85671 - DNA, 25 bp, S. pombe
gccgcttctttaacttgtccaagga

SEQ ID NO: 85672 - DNA, 25 bp, S. pombe
gcgcacatgatgactgctaaccttc

SEQ ID NO: 85673 - DNA, 25 bp, S. pombe
gcgaattgttgttaaaaccccaatg

SEQ ID NO: 85674 - DNA, 25 bp, S. pombe
gccgcgtcttttctaatgtgtttat

SEQ ID NO: 85675 - DNA, 25 bp, S. pombe
gccccgtactgtctgtttatgtata

SEQ ID NO: 85676 - DNA, 25 bp, S. pombe
gcgaccgtaggtcgtgtatcttttt

SEQ ID NO: 85677 - DNA, 25 bp, S. pombe
gcccgctatgggtgcttatatttta

SEQ ID NO: 85678 - DNA, 25 bp, S. pombe
gccccatcggtgcttctaataaaat

SEQ ID NO: 85679 - DNA, 25 bp, S. pombe
gccctaatgcatctagagctccaga

SEQ ID NO: 85680 - DNA, 25 bp, S. pombe
gccggatttatcactctacaaacag

SEQ ID NO: 85681 - DNA, 25 bp, S. pombe
gccggtgtcattcaactcatcaaga

SEQ ID NO: 85682 - DNA, 25 bp, S. pombe
gccggcatgccagaagcttcataaa

SEQ ID NO: 85683 - DNA, 25 bp, S. pombe
gccgttatgccaacattgtttgcaa

SEQ ID NO: 85684 - DNA, 25 bp, S. pombe
gcccgttactattcctgtccaaatt

SEQ ID NO: 85685 - DNA, 25 bp, S. pombe
gcgcccttacttcaaaccaaatgat

SEQ ID NO: 85686 - DNA, 25 bp, S. pombe
gcggcgtttcttcagtcaaaatctt

SEQ ID NO: 85687 - DNA, 25 bp, S. pombe
gcgccaatttgcattcattccagga

SEQ ID NO: 85688 - DNA, 25 bp, S. pombe
gccctgatattattttgcccatgga

SEQ ID NO: 85689 - DNA, 25 bp, S. pombe
gccgcgaatattcttgcagctgaag

SEQ ID NO: 85690 - DNA, 25 bp, S. pombe
gccgtgaaaactggtcgcttaatgt

SEQ ID NO: 85691 - DNA, 25 bp, S. pombe
gacttgtaccggctgactataatca

SEQ ID NO: 85692 - DNA, 25 bp, S. pombe
gcccctttccgtctatgtatatata

SEQ ID NO: 85693 - DNA, 25 bp, S. pombe
gccgtgctcttgttagtggattttt

SEQ ID NO: 85694 - DNA, 25 bp, S. pombe
gcgcgtgcccgttgggaaatcgtta

SEQ ID NO: 85695 - DNA, 25 bp, S. pombe
gcccgtgctcgtgaacataactata

SEQ ID NO: 85696 - DNA, 25 bp, S. pombe
gccggtgctcctttaattgaccata

SEQ ID NO: 85697 - DNA, 25 bp, S. pombe
gccgtagaactcctaatcgtcctaa

SEQ ID NO: 85698 - DNA, 25 bp, S. pombe
gcgtcaaggatggtagactaaactt

SEQ ID NO: 85699 - DNA, 25 bp, S. pombe
gcgagagctaaccagtattatgcct

SEQ ID NO: 85700 - DNA, 25 bp, S. pombe
gccgcagctcatactcgtatttgtt

SEQ ID NO: 85701 - DNA, 25 bp, S. pombe
gccgtgtctacttctgatttcaatt

SEQ ID NO: 85702 - DNA, 25 bp, S. pombe
gctcgagtcacaaacggttcgtttt

SEQ ID NO: 85703 - DNA, 25 bp, S. pombe
gcgacgaacgacttggaatccattt

SEQ ID NO: 85704 - DNA, 25 bp, S. pombe
gccgcatccaacgtttacagtatct

SEQ ID NO: 85705 - DNA, 25 bp, S. pombe
gccgatggattctgtttctgacttt

SEQ ID NO: 85706 - DNA, 25 bp, S. pombe
gccgaagctatcaatgccgttactt

SEQ ID NO: 85707 - DNA, 25 bp, S. pombe
gccctgttttgcttgccaatgtaaa

SEQ ID NO: 85708 - DNA, 25 bp, S. pombe
gccgcttttttcctcgattagatgg

SEQ ID NO: 85709 - DNA, 25 bp, S. pombe
gccgctcttcaaactgttgttcagt

SEQ ID NO: 85710 - DNA, 25 bp, S. pombe
gccgccagagaggtcttcatttaga

SEQ ID NO: 85711 - DNA, 25 bp, S. pombe
gccgccagtagatgcttagagtcga

SEQ ID NO: 85712 - DNA, 25 bp, S. pombe
gcgaccgtcaaacttgagcagttaa

SEQ ID NO: 85713 - DNA, 25 bp, S. pombe
gcgtcttaaatctcgcgctaatgaa

SEQ ID NO: 85714 - DNA, 25 bp, S. pombe
gcattcaactgctggtttaggctta

SEQ ID NO: 85715 - DNA, 25 bp, S. pombe
gccctctttcttcctttacaagaat

SEQ ID NO: 85716 - DNA, 25 bp, S. pombe
gcccgttctttcaattcatcatata

SEQ ID NO: 85717 - DNA, 25 bp, S. pombe
gccgattttgtaattcttgcatgga

SEQ ID NO: 85718 - DNA, 25 bp, S. pombe
gccctccgttgacttctttgtatag

SEQ ID NO: 85719 - DNA, 25 bp, S. pombe
gcccttactgccatgctactgaaaa

SEQ ID NO: 85720 - DNA, 25 bp, S. pombe
gccgctctcaatatctatcacaaaa

SEQ ID NO: 85721 - DNA, 25 bp, S. pombe
gccgcttcaccagtattccagaaaa

SEQ ID NO: 85722 - DNA, 25 bp, S. pombe
gcagaaccctgttaaactatgccgg

SEQ ID NO: 85723 - DNA, 25 bp, S. pombe
gctgtcggtcgatttataattgttg

SEQ ID NO: 85724 - DNA, 25 bp, S. pombe
gcgctccatttaagcttacggcgga

SEQ ID NO: 85725 - DNA, 25 bp, S. pombe
gccctcgattatgcttacggaaaag

SEQ ID NO: 85726 - DNA, 25 bp, S. pombe
gccgccgcctgtgatgttactagaa

SEQ ID NO: 85727 - DNA, 25 bp, S. pombe
gcccaagctggctcttttagctaaa

SEQ ID NO: 85728 - DNA, 25 bp, S. pombe
gcccaccgagtttatctgtttgtta

SEQ ID NO: 85729 - DNA, 25 bp, S. pombe
gccccagcaaggatacatgtctcag

SEQ ID NO: 85730 - DNA, 25 bp, S. pombe
gcccagctcaagtcatttcattcaa

SEQ ID NO: 85731 - DNA, 25 bp, S. pombe
gccgccttggttagctatatcaatt

SEQ ID NO: 85732 - DNA, 25 bp, S. pombe
gccgcttatgctggtctttgaaacg

SEQ ID NO: 85733 - DNA, 25 bp, S. pombe
gccctcttcaaaacacttgctgtaa

SEQ ID NO: 85734 - DNA, 25 bp, S. pombe
gccgatgctcttttgataattccta

SEQ ID NO: 85735 - DNA, 25 bp, S. pombe
gccgctccattactttttcctagaa

SEQ ID NO: 85736 - DNA, 25 bp, S. pombe
gcccttatagtgcttttgccggtca

SEQ ID NO: 85737 - DNA, 25 bp, S. pombe
gcgccttatacgattttggtgtgat

SEQ ID NO: 85738 - DNA, 25 bp, S. pombe
gcccatttaggtgtttcagctgagg

SEQ ID NO: 85739 - DNA, 25 bp, S. pombe
gcgtactttttgcttttcttggaat

SEQ ID NO: 85740 - DNA, 25 bp, S. pombe
gcggtcgagcatctaaaggtttcca

SEQ ID NO: 85741 - DNA, 25 bp, S. pombe
gcgctggttgctctgaagtttttaa

SEQ ID NO: 85742 - DNA, 25 bp, S. pombe
gcccctctccattgaaatctttcta

SEQ ID NO: 85743 - DNA, 25 bp, S. pombe
gcccctccgcattcaagagatatta

SEQ ID NO: 85744 - DNA, 25 bp, S. pombe
gcccactccgtacttagatattcat

SEQ ID NO: 85745 - DNA, 25 bp, S. pombe
gcgctactgagaatagtgcaccgaa

SEQ ID NO: 85746 - DNA, 25 bp, S. pombe
gcgaatccgtattatatgcagcatg

SEQ ID NO: 85747 - DNA, 25 bp, S. pombe
gccctactagcttttcctgaattta

SEQ ID NO: 85748 - DNA, 25 bp, S. pombe
gctcctcctgaacttccggaattaa

SEQ ID NO: 85749 - DNA, 25 bp, S. pombe
gcccaccactgcttctaagaggatt

SEQ ID NO: 85750 - DNA, 25 bp, S. pombe
gcgactttctcttctaagctggtta

SEQ ID NO: 85751 - DNA, 25 bp, S. pombe
gcgttgatgtagaactccctggtgt

SEQ ID NO: 85752 - DNA, 25 bp, S. pombe
gcgaatgcttgagacatcccgaatt

SEQ ID NO: 85753 - DNA, 25 bp, S. pombe
gcccacttttcgatgatgccgttga

SEQ ID NO: 85754 - DNA, 25 bp, S. pombe
gccctcttatgtgtcgatttgtgta

SEQ ID NO: 85755 - DNA, 25 bp, S. pombe
gcgcctttctgtcatggacttttaa

SEQ ID NO: 85756 - DNA, 25 bp, S. pombe
gcgccatttttgcaggtttgaactc

SEQ ID NO: 85757 - DNA, 25 bp, S. pombe
gccgctgaggctaatcttttattct

SEQ ID NO: 85758 - DNA, 25 bp, S. pombe
gccgctgatgttttgctttatgatt

SEQ ID NO: 85759 - DNA, 25 bp, S. pombe
gccgccgttcgcaaagatcttgaga

SEQ ID NO: 85760 - DNA, 25 bp, S. pombe
gccgccgaccgagaacttgatgcaa

SEQ ID NO: 85761 - DNA, 25 bp, S. pombe
gcggctcgtcgcgttaacttggaag

SEQ ID NO: 85762 - DNA, 25 bp, S. pombe
gcgttaccgaaaaacactctgaaat

SEQ ID NO: 85763 - DNA, 25 bp, S. pombe
gcgttggtacgtctatgtctgataa

SEQ ID NO: 85764 - DNA, 25 bp, S. pombe
gcgaatggtatcgtcttcatacgtt

SEQ ID NO: 85765 - DNA, 25 bp, S. pombe
gcgaatcaattcgtcctacaacttc

SEQ ID NO: 85766 - DNA, 25 bp, S. pombe
gctaagacccgtagctacaactggg

SEQ ID NO: 85767 - DNA, 25 bp, S. pombe
gctaagacccgtagctacaactggg

SEQ ID NO: 85768 - DNA, 25 bp, S. pombe
gcgacctgtttcaagcactacgtta

SEQ ID NO: 85769 - DNA, 25 bp, S. pombe
gcgcaagcttttcaactacatctta

SEQ ID NO: 85770 - DNA, 25 bp, S. pombe
gcgactttgtatccaacaacttctt

SEQ ID NO: 85771 - DNA, 25 bp, S. pombe
gccgctttacctccaagagacaatt

SEQ ID NO: 85772 - DNA, 25 bp, S. pombe
gccgctatgtaccttgccagggaaa

SEQ ID NO: 85773 - DNA, 25 bp, S. pombe
gccgctcttattttggccgatgagg

SEQ ID NO: 85774 - DNA, 25 bp, S. pombe
gcccgtgagcttttgacacttgatg

SEQ ID NO: 85775 - DNA, 25 bp, S. pombe
gcccgtactctcatggaattcaggt

SEQ ID NO: 85776 - DNA, 25 bp, S. pombe
gcgccgatacttacttgcatttcga

SEQ ID NO: 85777 - DNA, 25 bp, S. pombe
gcccggatctcattagtgcatttct

SEQ ID NO: 85778 - DNA, 25 bp, S. pombe
gcgcttgccaatgaatttaaccgat

SEQ ID NO: 85779 - DNA, 25 bp, S. pombe
gcgctctccaaaccggatttcgatt

SEQ ID NO: 85780 - DNA, 25 bp, S. pombe
gcgccattaccttaggtgaccgaaa

SEQ ID NO: 85781 - DNA, 25 bp, S. pombe
gcgcgttagcgttaatggcaccgta

SEQ ID NO: 85782 - DNA, 25 bp, S. pombe
gcgtgttaactcagctacagaccaa

SEQ ID NO: 85783 - DNA, 25 bp, S. pombe
gcgtattacgatgtcatagaaccat

SEQ ID NO: 85784 - DNA, 25 bp, S. pombe
gcgataccaactctcaggaatccag

SEQ ID NO: 85785 - DNA, 25 bp, S. pombe
gcgaaccaatgtctcagaagcatct

SEQ ID NO: 85786 - DNA, 25 bp, S. pombe
gcggtgatgttgtcaaagctaccat

SEQ ID NO: 85787 - DNA, 25 bp, S. pombe
gcgcgatattcgtcaacagctggtc

SEQ ID NO: 85788 - DNA, 25 bp, S. pombe
gcgaagaatctcctgaagccggtaa

SEQ ID NO: 85789 - DNA, 25 bp, S. pombe
gcgagcagcaatactgctattccgt

SEQ ID NO: 85790 - DNA, 25 bp, S. pombe
gcgctagctcgcatgataccagata

SEQ ID NO: 85791 - DNA, 25 bp, S. pombe
gcgcagctgctcgtcttagaatgta

SEQ ID NO: 85792 - DNA, 25 bp, S. pombe
gcgtccgccggtgatgataatacag

SEQ ID NO: 85793 - DNA, 25 bp, S. pombe
gcgatcagatcgtttcaatgcaatt

SEQ ID NO: 85794 - DNA, 25 bp, S. pombe
gcgccaatgctgtcaaggatcgaat

SEQ ID NO: 85795 - DNA, 25 bp, S. pombe
gcgtatgactgcagatggacacact

SEQ ID NO: 85796 - DNA, 25 bp, S. pombe
gcgtgcgattgctcaggctcatgaa

SEQ ID NO: 85797 - DNA, 25 bp, S. pombe
gcgctggataatttgctggtcattt

SEQ ID NO: 85798 - DNA, 25 bp, S. pombe
gcgccagacatgtagcgttatcttt

SEQ ID NO: 85799 - DNA, 25 bp, S. pombe
gcgacatagtcatctcaattacctg

SEQ ID NO: 85800 - DNA, 25 bp, S. pombe
gattacgaaactgccgaattactag

SEQ ID NO: 85801 - DNA, 25 bp, S. pombe
gcgccatcaaggttgctcttcaaaa

SEQ ID NO: 85802 - DNA, 25 bp, S. pombe
gcccttggagtctttcacagcaaaa

SEQ ID NO: 85803 - DNA, 25 bp, S. pombe
gcggttccaacgttactagtagcat

SEQ ID NO: 85804 - DNA, 25 bp, S. pombe
gcccttcaagcagtcttagtttatc

SEQ ID NO: 85805 - DNA, 25 bp, S. pombe
gcccggatattcctgcttatgataa

SEQ ID NO: 85806 - DNA, 25 bp, S. pombe
gccctggactttctgtgctgaagaa

SEQ ID NO: 85807 - DNA, 25 bp, S. pombe
gcccgtgacaaattctgtgctgaca

SEQ ID NO: 85808 - DNA, 25 bp, S. pombe
gcgcatcgtgaagcttctcgtgaaa

SEQ ID NO: 85809 - DNA, 25 bp, S. pombe
gcccattatctgcatctactgacaa

SEQ ID NO: 85810 - DNA, 25 bp, S. pombe
gcgcagcagcagcaatcaccgaaag

SEQ ID NO: 85811 - DNA, 25 bp, S. pombe
gcgcttttaagttcttacttgattg

SEQ ID NO: 85812 - DNA, 25 bp, S. pombe
gcgcttaatgatatggttccttgtt

SEQ ID NO: 85813 - DNA, 25 bp, S. pombe
gcgctatacgaaaaggcacctgctt

SEQ ID NO: 85814 - DNA, 25 bp, S. pombe
gcgcgaaggtctactctgttgatat

SEQ ID NO: 85815 - DNA, 25 bp, S. pombe
gcgcgactggtctaggtttaattct

SEQ ID NO: 85816 - DNA, 25 bp, S. pombe
gcgagggacgtcgtattcgtacacc

SEQ ID NO: 85817 - DNA, 25 bp, S. pombe
gctgctgtaacgaccattaaggcca

SEQ ID NO: 85818 - DNA, 25 bp, S. pombe
gcgctgaaagctattttggactctc

SEQ ID NO: 85819 - DNA, 25 bp, S. pombe
gcgcgaagcttttcttaggacctga

SEQ ID NO: 85820 - DNA, 25 bp, S. pombe
gcgccaggtgtttttgttatccata

SEQ ID NO: 85821 - DNA, 25 bp, S. pombe
gcgctcaaagagattgtgcctgtca

SEQ ID NO: 85822 - DNA, 25 bp, S. pombe
gcgctaaatgcgactgtgatcctta

SEQ ID NO: 85823 - DNA, 25 bp, S. pombe
gcgatcaaattgaggctgtcttaga

SEQ ID NO: 85824 - DNA, 25 bp, S. pombe
gcgattacatcgtggaccttacaac

SEQ ID NO: 85825 - DNA, 25 bp, S. pombe
gcgttaatattttcgttggcccaag

SEQ ID NO: 85826 - DNA, 25 bp, S. pombe
gctttaaatcttccctttgtccaag

SEQ ID NO: 85827 - DNA, 25 bp, S. pombe
gcgctaatcgtcttattctgtttga

SEQ ID NO: 85828 - DNA, 25 bp, S. pombe
gcgacaatttcgatgcctatggtgc

SEQ ID NO: 85829 - DNA, 25 bp, S. pombe
gcagtattagcattcagtgagcatc

SEQ ID NO: 85830 - DNA, 25 bp, S. pombe
gatgcattggagaacccgggtaaat

SEQ ID NO: 85831 - DNA, 25 bp, S. pombe
gcgcttggatggacaccggatgcat

SEQ ID NO: 85832 - DNA, 25 bp, S. pombe
gcgatttggattagccggactttaa

SEQ ID NO: 85833 - DNA, 25 bp, S. pombe
gcgacataaatttctcggactattc

SEQ ID NO: 85834 - DNA, 25 bp, S. pombe
gcgacaacaatttactcatcctgat

SEQ ID NO: 85835 - DNA, 25 bp, S. pombe
gcgactaaacgctttgaaatcataa

SEQ ID NO: 85836 - DNA, 25 bp, S. pombe
gcggtacttgctttacgggtgaccg

SEQ ID NO: 85837 - DNA, 25 bp, S. pombe
gcggtacttgctttattggacgcag

SEQ ID NO: 85838 - DNA, 25 bp, S. pombe
tggtaccttagcctctggaacggga

SEQ ID NO: 85839 - DNA, 25 bp, S. pombe
gcaggacctaaagacgaacagttat

SEQ ID NO: 85840 - DNA, 25 bp, S. pombe
gcgagaccggcaaattccacatcag

SEQ ID NO: 85841 - DNA, 25 bp, S. pombe
gcgacttcacctattcaaccaaatt

SEQ ID NO: 85842 - DNA, 25 bp, S. pombe
gcagatacgtttctttatgtccgct

SEQ ID NO: 85843 - DNA, 25 bp, S. pombe
gcgaaggtatttttccagctaacta

SEQ ID NO: 85844 - DNA, 25 bp, S. pombe
gcgaatgtgtatgttattcgttact

SEQ ID NO: 85845 - DNA, 25 bp, S. pombe
gcgcggtcaagcatttgtagtattc

SEQ ID NO: 85846 - DNA, 25 bp, S. pombe
gcgcgttcatagtgtttcgttgttt

SEQ ID NO: 85847 - DNA, 25 bp, S. pombe
gacttcaagggtactgccgttgtta

SEQ ID NO: 85848 - DNA, 25 bp, S. pombe
gcgttggcctttatgcttatttcca

SEQ ID NO: 85849 - DNA, 25 bp, S. pombe
gcgtatggcgctagacctttgaatc

SEQ ID NO: 85850 - DNA, 25 bp, S. pombe
gctctccttcaccttttttacgttg

SEQ ID NO: 85851 - DNA, 25 bp, S. pombe
gcgtcctttaccgaatttgccaatg

SEQ ID NO: 85852 - DNA, 25 bp, S. pombe
gcccatctgcattcttttgacataa

SEQ ID NO: 85853 - DNA, 25 bp, S. pombe
gcccttctgcatcgcgttttagata

SEQ ID NO: 85854 - DNA, 25 bp, S. pombe
gcgctttgcatcatcgttggcttta

SEQ ID NO: 85855 - DNA, 25 bp, S. pombe
gcgctttacgtcgtattgctcgaat

SEQ ID NO: 85856 - DNA, 25 bp, S. pombe
gcgtcttacctgctttactttatgg

SEQ ID NO: 85857 - DNA, 25 bp, S. pombe
gcgcccttcctcatatttctttgag

SEQ ID NO: 85858 - DNA, 25 bp, S. pombe
gcgcacactctattagctaccataa

SEQ ID NO: 85859 - DNA, 25 bp, S. pombe
gcgtgttgaagctcctgaccgaaag

SEQ ID NO: 85860 - DNA, 25 bp, S. pombe
gcgctggtcaggcatattcattgga

SEQ ID NO: 85861 - DNA, 25 bp, S. pombe
gcgaaatccttttctagctgacaga

SEQ ID NO: 85862 - DNA, 25 bp, S. pombe
gcgaagtttcacatatgctggctaa

SEQ ID NO: 85863 - DNA, 25 bp, S. pombe
gcgccagttggagcttatcctgaga

SEQ ID NO: 85864 - DNA, 25 bp, S. pombe
gcgagagatcatgttgctttcacgt

SEQ ID NO: 85865 - DNA, 25 bp, S. pombe
gcgaaacctggttttccgatgattc

SEQ ID NO: 85866 - DNA, 25 bp, S. pombe
gctggccacttccaatataccgaat

SEQ ID NO: 85867 - DNA, 25 bp, S. pombe
gcgaccgagtgcagggcttttagca

SEQ ID NO: 85868 - DNA, 25 bp, S. pombe
gcgacgccaatctcaggtttttgaa

SEQ ID NO: 85869 - DNA, 25 bp, S. pombe
gcgcgctctcttatatgctaattgg

SEQ ID NO: 85870 - DNA, 25 bp, S. pombe
gcggatctgtttttcgttacggact

SEQ ID NO: 85871 - DNA, 25 bp, S. pombe
gcgaatttagttgcagccctcgaaa

SEQ ID NO: 85872 - DNA, 25 bp, S. pombe
gcgaatttctgtttacgaccgcaaa

SEQ ID NO: 85873 - DNA, 25 bp, S. pombe
gcgcctgttgcttcgatagctgaat

SEQ ID NO: 85874 - DNA, 25 bp, S. pombe
gcgttcatcaggttgcgaggttcca

SEQ ID NO: 85875 - DNA, 25 bp, S. pombe
ggctaccgttggtggttcgattata

SEQ ID NO: 85876 - DNA, 25 bp, S. pombe
gcgatgccattgatcaaacttacga

SEQ ID NO: 85877 - DNA, 25 bp, S. pombe
gctgctctttctcaaggccaaggaa

SEQ ID NO: 85878 - DNA, 25 bp, S. pombe
gcgaaagtcgttcatgctgtcatct

SEQ ID NO: 85879 - DNA, 25 bp, S. pombe
gcgacgaatcgtttgatgtttctga

SEQ ID NO: 85880 - DNA, 25 bp, S. pombe
gcgctgtttgcatttgcttttctag

SEQ ID NO: 85881 - DNA, 25 bp, S. pombe
gcgctgctttttcttggatgctaga

SEQ ID NO: 85882 - DNA, 25 bp, S. pombe
gcgcgaattccttctcttgtaaaat

SEQ ID NO: 85883 - DNA, 25 bp, S. pombe
gcgaaatatcgcctcttttaactaa

SEQ ID NO: 85884 - DNA, 25 bp, S. pombe
ggaaggtccctctgaacgacgagca

SEQ ID NO: 85885 - DNA, 25 bp, S. pombe
gcgtcaggtctcctttgaacaggga

SEQ ID NO: 85886 - DNA, 25 bp, S. pombe
gcgataaatctttcttacctttcgg

SEQ ID NO: 85887 - DNA, 25 bp, S. pombe
gcgccaattgtttcttccgcaattt

SEQ ID NO: 85888 - DNA, 25 bp, S. pombe
gcgatccttgagttgccttcaattt

SEQ ID NO: 85889 - DNA, 25 bp, S. pombe
gcgatcgtgtggcatacttactgtt

SEQ ID NO: 85890 - DNA, 25 bp, S. pombe
gcgacattggtttttgtacactgac

SEQ ID NO: 85891 - DNA, 25 bp, S. pombe
gcgactcatgagttcgactgataaa

SEQ ID NO: 85892 - DNA, 25 bp, S. pombe
gcgatataccacttcaacgatctat

SEQ ID NO: 85893 - DNA, 25 bp, S. pombe
gcgcagcacaccgactgaattgtta

SEQ ID NO: 85894 - DNA, 25 bp, S. pombe
gcgcgccattgcagaagatttagac

SEQ ID NO: 85895 - DNA, 25 bp, S. pombe
gcgcttccccagacttttgaaataa

SEQ ID NO: 85896 - DNA, 25 bp, S. pombe
gcgcttatcctcgttttggtaagat

SEQ ID NO: 85897 - DNA, 25 bp, S. pombe
gcgcaatcttccactgcagatggta

SEQ ID NO: 85898 - DNA, 25 bp, S. pombe
gcgaagtctcctgacatgttttcat

SEQ ID NO: 85899 - DNA, 25 bp, S. pombe
gcgccggtgtgattgatgcagatta

SEQ ID NO: 85900 - DNA, 25 bp, S. pombe
gcgcttggattatgcatctcttaaa

SEQ ID NO: 85901 - DNA, 25 bp, S. pombe
gcgcttctagacttatgccttacaa

SEQ ID NO: 85902 - DNA, 25 bp, S. pombe
gcgagcctaacgttcagatctctga

SEQ ID NO: 85903 - DNA, 25 bp, S. pombe
gcgcgcgtactcattcgaatgctaa

SEQ ID NO: 85904 - DNA, 25 bp, S. pombe
gcgatgggcatttctgattctgtgt

SEQ ID NO: 85905 - DNA, 25 bp, S. pombe
gcgatgacactgtgccttggattga

SEQ ID NO: 85906 - DNA, 25 bp, S. pombe
gcgaatcctacagctttgaatgctt

SEQ ID NO: 85907 - DNA, 25 bp, S. pombe
gcgaattcccattgtttacagctgt

SEQ ID NO: 85908 - DNA, 25 bp, S. pombe
gcgtaccaccatatcgattctataa

SEQ ID NO: 85909 - DNA, 25 bp, S. pombe
gcgatcgtcatccttccaatttgat

SEQ ID NO: 85910 - DNA, 25 bp, S. pombe
gcgacggacgctttcaatactacta

SEQ ID NO: 85911 - DNA, 25 bp, S. pombe
gcggcggaaaacaaacccactgatt

SEQ ID NO: 85912 - DNA, 25 bp, S. pombe
gcgaatgcggtctctggaaacacaa

SEQ ID NO: 85913 - DNA, 25 bp, S. pombe
gcgaggtcgctctcaatgtaaccaa

SEQ ID NO: 85914 - DNA, 25 bp, S. pombe
gcgaggtcagtattccaacagtaat

SEQ ID NO: 85915 - DNA, 25 bp, S. pombe
gcgagggcgacaactctactttgga

SEQ ID NO: 85916 - DNA, 25 bp, S. pombe
gcgcgtggtattgacgttgctaata

SEQ ID NO: 85917 - DNA, 25 bp, S. pombe
gcggcgattttgacgaggactttcc

SEQ ID NO: 85918 - DNA, 25 bp, S. pombe
gcgatctacgtttgagcccattgaa

SEQ ID NO: 85919 - DNA, 25 bp, S. pombe
gcgcaccatctcaaaacgcttatga

SEQ ID NO: 85920 - DNA, 25 bp, S. pombe
gcgctcctcaagatgatcctatgtt

SEQ ID NO: 85921 - DNA, 25 bp, S. pombe
gcgattttggtcattcaaggctcat

SEQ ID NO: 85922 - DNA, 25 bp, S. pombe
gcgtttgttgttgtagcagtcctag

SEQ ID NO: 85923 - DNA, 25 bp, S. pombe
gcgcttattgggaaccgcttacaag

SEQ ID NO: 85924 - DNA, 25 bp, S. pombe
gcgttacgacgctcatatggacagt

SEQ ID NO: 85925 - DNA, 25 bp, S. pombe
gcgtaacgtcgcacatttacagaat

SEQ ID NO: 85926 - DNA, 25 bp, S. pombe
gcggaaggcccaactacaatcaatg

SEQ ID NO: 85927 - DNA, 25 bp, S. pombe
gcgtcaactctctatctccaaaaag

SEQ ID NO: 85928 - DNA, 25 bp, S. pombe
gcgttaccactcgtctcaaaagaag

SEQ ID NO: 85929 - DNA, 25 bp, S. pombe
gcgaacccgctgaatcattggacaa

SEQ ID NO: 85930 - DNA, 25 bp, S. pombe
gcgaattgcccgaaacagccaagat

SEQ ID NO: 85931 - DNA, 25 bp, S. pombe
gcgagattgcttgttacatccataa

SEQ ID NO: 85932 - DNA, 25 bp, S. pombe
gcgaaacttcgagtgcatcttcata

SEQ ID NO: 85933 - DNA, 25 bp, S. pombe
gcgctattattgctacttttgccat

SEQ ID NO: 85934 - DNA, 25 bp, S. pombe
gcgtatgcggtgtttcatttcttat

SEQ ID NO: 85935 - DNA, 25 bp, S. pombe
gcgttgctgagacaaagttcttcat

SEQ ID NO: 85936 - DNA, 25 bp, S. pombe
gcgttccgacaattcagcatgacaa

SEQ ID NO: 85937 - DNA, 25 bp, S. pombe
gcgttccttggaatacaactctgct

SEQ ID NO: 85938 - DNA, 25 bp, S. pombe
gcagtctccattgttggacgttcac

SEQ ID NO: 85939 - DNA, 25 bp, S. pombe
gcgtctactgctaagggaggcccaa

SEQ ID NO: 85940 - DNA, 25 bp, S. pombe
gcgctgccatccgtgaaggtgatat

SEQ ID NO: 85941 - DNA, 25 bp, S. pombe
gcgtgatttgagcagtcctttctac

SEQ ID NO: 85942 - DNA, 25 bp, S. pombe
gcgtctttgcattatcattggtatc

SEQ ID NO: 85943 - DNA, 25 bp, S. pombe
gcgctttatcaaatcaatcggcatt

SEQ ID NO: 85944 - DNA, 25 bp, S. pombe
gcgtctggtaataagtccgccatta

SEQ ID NO: 85945 - DNA, 25 bp, S. pombe
gcgctcatggattttggcttctcaa

SEQ ID NO: 85946 - DNA, 25 bp, S. pombe
gcgctttttacccatcatatctaat

SEQ ID NO: 85947 - DNA, 25 bp, S. pombe
gcgctattattagggctctcgaaga

SEQ ID NO: 85948 - DNA, 25 bp, S. pombe
gcgcagacaattattagagccagaa

SEQ ID NO: 85949 - DNA, 25 bp, S. pombe
gcgagtttggtctggtcgcctcaaa

SEQ ID NO: 85950 - DNA, 25 bp, S. pombe
gcatttgtaactcaaaaacctcaat

SEQ ID NO: 85951 - DNA, 25 bp, S. pombe
gcgtagttaccgtgatatccttcgt

SEQ ID NO: 85952 - DNA, 25 bp, S. pombe
gcggtttatcaattcgattcccacg

SEQ ID NO: 85953 - DNA, 25 bp, S. pombe
gcggcttgtatagttcgagtcccta

SEQ ID NO: 85954 - DNA, 25 bp, S. pombe
gcggatttcaagtacgagcccattc

SEQ ID NO: 85955 - DNA, 25 bp, S. pombe
gcgttttcaacatcagactacattt

SEQ ID NO: 85956 - DNA, 25 bp, S. pombe
gcgattttcctctgttcaattttct

SEQ ID NO: 85957 - DNA, 25 bp, S. pombe
gcgcttttccttctattttctgatt

SEQ ID NO: 85958 - DNA, 25 bp, S. pombe
gcgttctaacttgagaggcgtctta

SEQ ID NO: 85959 - DNA, 25 bp, S. pombe
gcgttacgacattcacagggtcttt

SEQ ID NO: 85960 - DNA, 25 bp, S. pombe
gcgtaccgttcaaaaggcctttgca

SEQ ID NO: 85961 - DNA, 25 bp, S. pombe
gcgtttgccgcaatttggtttgttc

SEQ ID NO: 85962 - DNA, 25 bp, S. pombe
gcgaatctcctgtttgggctttgaa

SEQ ID NO: 85963 - DNA, 25 bp, S. pombe
gcgcagttactgtattcggtaccat

SEQ ID NO: 85964 - DNA, 25 bp, S. pombe
gcgagaatcacattcctttatacat

SEQ ID NO: 85965 - DNA, 25 bp, S. pombe
gcgagcgcaattccctttataaaat

SEQ ID NO: 85966 - DNA, 25 bp, S. pombe
gcgagcttccttgacctcataaaat

SEQ ID NO: 85967 - DNA, 25 bp, S. pombe
gcgcaagcctctagttccaaagttt

SEQ ID NO: 85968 - DNA, 25 bp, S. pombe
gcgaagcctccaatatccttagatt

SEQ ID NO: 85969 - DNA, 25 bp, S. pombe
gcgtcttccaaaaagccgggttatg

SEQ ID NO: 85970 - DNA, 25 bp, S. pombe
gcgttcttcttcaaaatcggctggg

SEQ ID NO: 85971 - DNA, 25 bp, S. pombe
gcgttcttcaatcaagcctgtgtgt

SEQ ID NO: 85972 - DNA, 25 bp, S. pombe
gcgattttcaacctacctttcaaag

SEQ ID NO: 85973 - DNA, 25 bp, S. pombe
gcggccgtgggcatgaacgaattct

SEQ ID NO: 85974 - DNA, 25 bp, S. pombe
gcggttgcggtgacattcaatccat

SEQ ID NO: 85975 - DNA, 25 bp, S. pombe
gcgagatcggtttcagacgaggcat

SEQ ID NO: 85976 - DNA, 25 bp, S. pombe
gcggtcaagctgtttccgaggatga

SEQ ID NO: 85977 - DNA, 25 bp, S. pombe
gcggattgaggctttaccgactaat

SEQ ID NO: 85978 - DNA, 25 bp, S. pombe
gcgagctgaactcaatcaccgttat

SEQ ID NO: 85979 - DNA, 25 bp, S. pombe
gcggctcaactttacactcgtttga

SEQ ID NO: 85980 - DNA, 25 bp, S. pombe
gcgggtcagcttgcacttcgtaaag

SEQ ID NO: 85981 - DNA, 25 bp, S. pombe
gcgtgagacgccttaaacgtaaaag

SEQ ID NO: 85982 - DNA, 25 bp, S. pombe
gcgtgcgtcgtctcaaacgtaaaag

SEQ ID NO: 85983 - DNA, 25 bp, S. pombe
gcgtcttcgtaaattggcgctagaa

SEQ ID NO: 85984 - DNA, 25 bp, S. pombe
gcgtttgctgtaaatcgtccggaat

SEQ ID NO: 85985 - DNA, 25 bp, S. pombe
gcgtttggaaactctgtctgggcag

SEQ ID NO: 85986 - DNA, 25 bp, S. pombe
gcgttaagcaaagttctatcgggat

SEQ ID NO: 85987 - DNA, 25 bp, S. pombe
gcgacgaaaacagcttcaactttaa

SEQ ID NO: 85988 - DNA, 25 bp, S. pombe
gcgacgagaattaccgtcttcttta

SEQ ID NO: 85989 - DNA, 25 bp, S. pombe
gcgtccgagttgtccgattctttta

SEQ ID NO: 85990 - DNA, 25 bp, S. pombe
gcgtcgttcttgtccgattatttat

SEQ ID NO: 85991 - DNA, 25 bp, S. pombe
gcgatcttcctcaaccaaatattta

SEQ ID NO: 85992 - DNA, 25 bp, S. pombe
gcgattccctgatgctaaaacgttt

SEQ ID NO: 85993 - DNA, 25 bp, S. pombe
gcgattccttatttacgttttcatt

SEQ ID NO: 85994 - DNA, 25 bp, S. pombe
gcgtatcgtactgaacggttgctta

SEQ ID NO: 85995 - DNA, 25 bp, S. pombe
gcgtgctcctactgagttttcagag

SEQ ID NO: 85996 - DNA, 25 bp, S. pombe
gcgtcacgctgattatgcagctctt

SEQ ID NO: 85997 - DNA, 25 bp, S. pombe
gcgtcacctgcttttgctgtgataa

SEQ ID NO: 85998 - DNA, 25 bp, S. pombe
gcgatcaacgccatttcagtagaca

SEQ ID NO: 85999 - DNA, 25 bp, S. pombe
gcgtcgacccttctttgaacaagga

SEQ ID NO: 86000 - DNA, 25 bp, S. pombe
gctggaaaccggcaattacaattaa

SEQ ID NO: 86001 - DNA, 25 bp, S. pombe
gcgggagacccttgcaattatcata

SEQ ID NO: 86002 - DNA, 25 bp, S. pombe
gcgttaactctcaatctggcaaggg

SEQ ID NO: 86003 - DNA, 25 bp, S. pombe
gcgagatctactcttgttgcaactg

SEQ ID NO: 86004 - DNA, 25 bp, S. pombe
gcgaactaatgtctccgattctaca

SEQ ID NO: 86005 - DNA, 25 bp, S. pombe
gcgaaatatctgcttcacctttaca

SEQ ID NO: 86006 - DNA, 25 bp, S. pombe
gcggcgtttctgatacgtctcctaa

SEQ ID NO: 86007 - DNA, 25 bp, S. pombe
gcgggtattccgaagcgattttcag

SEQ ID NO: 86008 - DNA, 25 bp, S. pombe
gcgaggtaccaacacatttttccgt

SEQ ID NO: 86009 - DNA, 25 bp, S. pombe
gctggtatcaacatttccggtatca

SEQ ID NO: 86010 - DNA, 25 bp, S. pombe
gcgtcgtaacctttgcttagcaata

SEQ ID NO: 86011 - DNA, 25 bp, S. pombe
gctgatcaaaccgaagtgttacaat

SEQ ID NO: 86012 - DNA, 25 bp, S. pombe
gcgtcaggatccgtagtaattcttc

SEQ ID NO: 86013 - DNA, 25 bp, S. pombe
gcgtcgtatgcctaaagtattctcc

SEQ ID NO: 86014 - DNA, 25 bp, S. pombe
gcgtcgttgggctacagaacttgca

SEQ ID NO: 86015 - DNA, 25 bp, S. pombe
gggccatctaggtggacctaaacaa

SEQ ID NO: 86016 - DNA, 25 bp, S. pombe
gcgacccagttttcatcacaatcaa

SEQ ID NO: 86017 - DNA, 25 bp, S. pombe
gcggctctcatttgcgaaggaatta

SEQ ID NO: 86018 - DNA, 25 bp, S. pombe
gcggcccatggacgccaaagttagt

SEQ ID NO: 86019 - DNA, 25 bp, S. pombe
gatcccaaaattcacaaaagagtac

SEQ ID NO: 86020 - DNA, 25 bp, S. pombe
tttttggaccagctggacgtcttta

SEQ ID NO: 86021 - DNA, 25 bp, S. pombe
gcgattgcagcattgttttacgaga

SEQ ID NO: 86022 - DNA, 25 bp, S. pombe
gcgacactactgatttacaagacga

SEQ ID NO: 86023 - DNA, 25 bp, S. pombe
gcgaaagtcgtttctccattctaat

SEQ ID NO: 86024 - DNA, 25 bp, S. pombe
gcggcccaaaatgcttctggtattt

SEQ ID NO: 86025 - DNA, 25 bp, S. pombe
gctggcgtaaattcacttttttctt

SEQ ID NO: 86026 - DNA, 25 bp, S. pombe
gcgtgaggccagaagattgcgttaa

SEQ ID NO: 86027 - DNA, 25 bp, S. pombe
gcgattgctttaggcttttgtataa

SEQ ID NO: 86028 - DNA, 25 bp, S. pombe
gcggaagaatcccagttaacacttt

SEQ ID NO: 86029 - DNA, 25 bp, S. pombe
gctgataaacttcccggcaactttt

SEQ ID NO: 86030 - DNA, 25 bp, S. pombe
gcgttcaactatccctactaaattt

SEQ ID NO: 86031 - DNA, 25 bp, S. pombe
gcggtatactatgctttccaaaact

SEQ ID NO: 86032 - DNA, 25 bp, S. pombe
gctggttgcttatctttacctcaat

SEQ ID NO: 86033 - DNA, 25 bp, S. pombe
gcggtaaattccctgattctgttaa

SEQ ID NO: 86034 - DNA, 25 bp, S. pombe
gcgttggcttttggtgatttttcga

SEQ ID NO: 86035 - DNA, 25 bp, S. pombe
gcgtacaaggcatcgtcctaatcat

SEQ ID NO: 86036 - DNA, 25 bp, S. pombe
gcgtagctgaacaacttcctatttt

SEQ ID NO: 86037 - DNA, 25 bp, S. pombe
gcgatgcacgattttcttctttttt

SEQ ID NO: 86038 - DNA, 25 bp, S. pombe
gcgagacgacgaatttgcttttatt

SEQ ID NO: 86039 - DNA, 25 bp, S. pombe
gcgactcttccattgttggtgttat

SEQ ID NO: 86040 - DNA, 25 bp, S. pombe
gcgattaccgcccatattggttcag

SEQ ID NO: 86041 - DNA, 25 bp, S. pombe
gcgactttagtacgttggcttccaa

SEQ ID NO: 86042 - DNA, 25 bp, S. pombe
gcgttgttattacttgtggcttcca

SEQ ID NO: 86043 - DNA, 25 bp, S. pombe
gcggtggacatttcttggtttcgta

SEQ ID NO: 86044 - DNA, 25 bp, S. pombe
gcggtagtgatatcttggcgtccat

SEQ ID NO: 86045 - DNA, 25 bp, S. pombe
gcgatttggcgtcatttatcccaga

SEQ ID NO: 86046 - DNA, 25 bp, S. pombe
gctggttatttttctaatgctgcac

SEQ ID NO: 86047 - DNA, 25 bp, S. pombe
gcgtatcttgcgtgctttgaaaaaa

SEQ ID NO: 86048 - DNA, 25 bp, S. pombe
gcgagacgtcttagctcatctgtag

SEQ ID NO: 86049 - DNA, 25 bp, S. pombe
gcgagtacatcttctcctgagcaaa

SEQ ID NO: 86050 - DNA, 25 bp, S. pombe
gcgattctcttgttgcactcaaaac

SEQ ID NO: 86051 - DNA, 25 bp, S. pombe
gcgtcctcaagtagcactgcagaat

SEQ ID NO: 86052 - DNA, 25 bp, S. pombe
gcgagcagccaaagcaacctatatt

SEQ ID NO: 86053 - DNA, 25 bp, S. pombe
gcgatggcatatttactcctgttga

SEQ ID NO: 86054 - DNA, 25 bp, S. pombe
gcgatagtcttcaatatgcctttat

SEQ ID NO: 86055 - DNA, 25 bp, S. pombe
gcgtggatttgcatactcattgttc

SEQ ID NO: 86056 - DNA, 25 bp, S. pombe
gcgggatattctgcacttaatttga

SEQ ID NO: 86057 - DNA, 25 bp, S. pombe
gcggttttaccctatgccattgaaa

SEQ ID NO: 86058 - DNA, 25 bp, S. pombe
gcgaggccccaatgaatactcttta

SEQ ID NO: 86059 - DNA, 25 bp, S. pombe
gcataagagtacctccaaaacccga

SEQ ID NO: 86060 - DNA, 25 bp, S. pombe
gcaaaagcatcctctagaaacccta

SEQ ID NO: 86061 - DNA, 25 bp, S. pombe
gcacgacgtgtctctaaacccgaaa

SEQ ID NO: 86062 - DNA, 25 bp, S. pombe
gcagcgaacttctcaaatacccgaa

SEQ ID NO: 86063 - DNA, 25 bp, S. pombe
gcgattgccccagatggtcatacta

SEQ ID NO: 86064 - DNA, 25 bp, S. pombe
gcgttcagtgctcaatacgacttta

SEQ ID NO: 86065 - DNA, 25 bp, S. pombe
gcgatgttactggattactggctat

SEQ ID NO: 86066 - DNA, 25 bp, S. pombe
gcgagattcacgacattattgcttt

SEQ ID NO: 86067 - DNA, 25 bp, S. pombe
gcgttcatcgcgaacatgatccttt

SEQ ID NO: 86068 - DNA, 25 bp, S. pombe
gcgttcaagcagattggcctgtttt

SEQ ID NO: 86069 - DNA, 25 bp, S. pombe
gcgttcagacgtatgctcttttgta

SEQ ID NO: 86070 - DNA, 25 bp, S. pombe
gcgttacacttgcttcgtttgttga

SEQ ID NO: 86071 - DNA, 25 bp, S. pombe
gaattagctcctcagtttttccttc

SEQ ID NO: 86072 - DNA, 25 bp, S. pombe
gctactactcccgaattaactactt

SEQ ID NO: 86073 - DNA, 25 bp, S. pombe
gcgtttttattcgaacttccatgca

SEQ ID NO: 86074 - DNA, 25 bp, S. pombe
gcgtcgggtgacttaactgccaata

SEQ ID NO: 86075 - DNA, 25 bp, S. pombe
gcgtcgcagaggcattaactatcgt

SEQ ID NO: 86076 - DNA, 25 bp, S. pombe
gcggaatatattctccagcttcaag

SEQ ID NO: 86077 - DNA, 25 bp, S. pombe
gcgtggtggttgtattatccgttcc

SEQ ID NO: 86078 - DNA, 25 bp, S. pombe
gcggatgggattctattcacgtgtt

SEQ ID NO: 86079 - DNA, 25 bp, S. pombe
gcgatctctctcttgtttatttcta

SEQ ID NO: 86080 - DNA, 25 bp, S. pombe
gcgatcctccatttcattttttact

SEQ ID NO: 86081 - DNA, 25 bp, S. pombe
gcgtactctctccttttggatgaac

SEQ ID NO: 86082 - DNA, 25 bp, S. pombe
gctcaacctcgttccgaaatttcag

SEQ ID NO: 86083 - DNA, 25 bp, S. pombe
gcgtccatccattaacaactcttat

SEQ ID NO: 86084 - DNA, 25 bp, S. pombe
gcgattccttaattcacctcaatat

SEQ ID NO: 86085 - DNA, 25 bp, S. pombe
gcgtatggttcctacgggctctaaa

SEQ ID NO: 86086 - DNA, 25 bp, S. pombe
gcgagtactggctattgatttctta

SEQ ID NO: 86087 - DNA, 25 bp, S. pombe
gcgttcactccatttattcatcagt

SEQ ID NO: 86088 - DNA, 25 bp, S. pombe
gcgtgtttacatttactccagtggg

SEQ ID NO: 86089 - DNA, 25 bp, S. pombe
gcgatgctcccattgatatgacaca

SEQ ID NO: 86090 - DNA, 25 bp, S. pombe
gcgagtgccaggaatgctgctagaa

SEQ ID NO: 86091 - DNA, 25 bp, S. pombe
gcggtggtgtattgcctcatatcaa

SEQ ID NO: 86092 - DNA, 25 bp, S. pombe
gctcgtgggcaatcagtgtctggtc

SEQ ID NO: 86093 - DNA, 25 bp, S. pombe
gctactctggatacggtggctttga

SEQ ID NO: 86094 - DNA, 25 bp, S. pombe
gctactcttctacggcggcatttat

SEQ ID NO: 86095 - DNA, 25 bp, S. pombe
gctgacccttaccttggtgttgaaa

SEQ ID NO: 86096 - DNA, 25 bp, S. pombe
gcgtcttctgttgccaacactattg

SEQ ID NO: 86097 - DNA, 25 bp, S. pombe
gcgtttgctgttaccaacaactaac

SEQ ID NO: 86098 - DNA, 25 bp, S. pombe
gcggtattttcctagactactcaag

SEQ ID NO: 86099 - DNA, 25 bp, S. pombe
gcgggatcatttacgagtttgctca

SEQ ID NO: 86100 - DNA, 25 bp, S. pombe
gcgttccgtcccagctggaaatgaa

SEQ ID NO: 86101 - DNA, 25 bp, S. pombe
gcgatcccgtttttcacagacaaat

SEQ ID NO: 86102 - DNA, 25 bp, S. pombe
gcgtcctttttagccaaacaattca

SEQ ID NO: 86103 - DNA, 25 bp, S. pombe
gcggttcttatgttactgctcatgc

SEQ ID NO: 86104 - DNA, 25 bp, S. pombe
gcggatgtcgatccagtatggccat

SEQ ID NO: 86105 - DNA, 25 bp, S. pombe
gcgtgtgcaacgcattttcagtaat

SEQ ID NO: 86106 - DNA, 25 bp, S. pombe
gcggcaccactgcagttctgaaaga

SEQ ID NO: 86107 - DNA, 25 bp, S. pombe
gcggtcctggctgttgtgaaatgaa

SEQ ID NO: 86108 - DNA, 25 bp, S. pombe
gcggtttcacccgtttatgattcaa

SEQ ID NO: 86109 - DNA, 25 bp, S. pombe
gcgtaaagcttcatccacggcaata

SEQ ID NO: 86110 - DNA, 25 bp, S. pombe
gcgtgatgatttgcgttttcttgtt

SEQ ID NO: 86111 - DNA, 25 bp, S. pombe
gcggctcaccacagaggattcatga

SEQ ID NO: 86112 - DNA, 25 bp, S. pombe
gcggaagcagctgtttcgtctaata

SEQ ID NO: 86113 - DNA, 25 bp, S. pombe
gcgatctttgctgtggtctattgac

SEQ ID NO: 86114 - DNA, 25 bp, S. pombe
gcgattttgtcgatgcctatatact

SEQ ID NO: 86115 - DNA, 25 bp, S. pombe
gcgggattgcaagttgcgcgctctc

SEQ ID NO: 86116 - DNA, 25 bp, S. pombe
gcgttcccgacgataagctattggc

SEQ ID NO: 86117 - DNA, 25 bp, S. pombe
gcgttcgtcgacgttacagcgaatt

SEQ ID NO: 86118 - DNA, 25 bp, S. pombe
gcgtttctcgtcttgctaacgaatt

SEQ ID NO: 86119 - DNA, 25 bp, S. pombe
gcgtttctcttcctgagaatgcagt

SEQ ID NO: 86120 - DNA, 25 bp, S. pombe
gcgtctttcttctgcgatatcatgg

SEQ ID NO: 86121 - DNA, 25 bp, S. pombe
gcgatttcatctttcattctttgta

SEQ ID NO: 86122 - DNA, 25 bp, S. pombe
gcgtgttactgttattgtttctcgg

SEQ ID NO: 86123 - DNA, 25 bp, S. pombe
gcgtatctacttggaattgtcacat

SEQ ID NO: 86124 - DNA, 25 bp, S. pombe
gcgggtatctgagcatgacttgaat

SEQ ID NO: 86125 - DNA, 25 bp, S. pombe
gcggagtatcgcaatgatcctagaa

SEQ ID NO: 86126 - DNA, 25 bp, S. pombe
gcgtatgttcgcaaagctcaagctc

SEQ ID NO: 86127 - DNA, 25 bp, S. pombe
gcgttcaaatgcagtacaatcagat

SEQ ID NO: 86128 - DNA, 25 bp, S. pombe
gcggcaccttcatcaacgttatata

SEQ ID NO: 86129 - DNA, 25 bp, S. pombe
gcaggtccttggtgagcttctttac

SEQ ID NO: 86130 - DNA, 25 bp, S. pombe
gctggtccattaagtgttttacaac

SEQ ID NO: 86131 - DNA, 25 bp, S. pombe
gcgtatccatgaggttcgtgttcgt

SEQ ID NO: 86132 - DNA, 25 bp, S. pombe
gcgtgacaaccttaccttatggact

SEQ ID NO: 86133 - DNA, 25 bp, S. pombe
gcgtccccaaactgcttgaagatgc

SEQ ID NO: 86134 - DNA, 25 bp, S. pombe
gcgtcccaattattttctgaacagc

SEQ ID NO: 86135 - DNA, 25 bp, S. pombe
gcgttgctcaatcatttttgtccca

SEQ ID NO: 86136 - DNA, 25 bp, S. pombe
gcgttcgatatggattttccgacga

SEQ ID NO: 86137 - DNA, 25 bp, S. pombe
gcgtctggtcgcgttatgtccgaag

SEQ ID NO: 86138 - DNA, 25 bp, S. pombe
gcgtatcttgaactctttcgtcaac

SEQ ID NO: 86139 - DNA, 25 bp, S. pombe
gcgtatgcgcgctgattcgaagaga

SEQ ID NO: 86140 - DNA, 25 bp, S. pombe
gcggcagcagctgtccataacaatg

SEQ ID NO: 86141 - DNA, 25 bp, S. pombe
gcgtgagatgaactccgaaagtgaa

SEQ ID NO: 86142 - DNA, 25 bp, S. pombe
gcgtgcgagaattcatcccagagtt

SEQ ID NO: 86143 - DNA, 25 bp, S. pombe
gctgggagcgtatcctgaagcttat

SEQ ID NO: 86144 - DNA, 25 bp, S. pombe
gcgtcgtgatgttcgtaagatcgag

SEQ ID NO: 86145 - DNA, 25 bp, S. pombe
gcgtcatcacaatctattccaacta

SEQ ID NO: 86146 - DNA, 25 bp, S. pombe
gcgtaccaaaattgctgtctttctt

SEQ ID NO: 86147 - DNA, 25 bp, S. pombe
gcggaaaagagctgtgccaccattt

SEQ ID NO: 86148 - DNA, 25 bp, S. pombe
gctgggaaaaccttgacgaccttga

SEQ ID NO: 86149 - DNA, 25 bp, S. pombe
gctggtaataaaactccgtcctgga

SEQ ID NO: 86150 - DNA, 25 bp, S. pombe
gcggtagtctttatcttctaggaga

SEQ ID NO: 86151 - DNA, 25 bp, S. pombe
gcggccgttctaccaaagctggatc

SEQ ID NO: 86152 - DNA, 25 bp, S. pombe
gcgtcggtgacaatactagtcctca

SEQ ID NO: 86153 - DNA, 25 bp, S. pombe
gcgtctcggaaaacaattgcttgaa

SEQ ID NO: 86154 - DNA, 25 bp, S. pombe
gcgtcgtgtggatatccgcaatatt

SEQ ID NO: 86155 - DNA, 25 bp, S. pombe
gctgtcatgtcccttgcaaaaataa

SEQ ID NO: 86156 - DNA, 25 bp, S. pombe
gctgtcgacctctgcctaatgaaaa

SEQ ID NO: 86157 - DNA, 25 bp, S. pombe
gcgttatgccgctgttgtcgagaat

SEQ ID NO: 86158 - DNA, 25 bp, S. pombe
gcgtttgccgctttatatctgaaaa

SEQ ID NO: 86159 - DNA, 25 bp, S. pombe
gcgtgctttacgtgctatatttgaa

SEQ ID NO: 86160 - DNA, 25 bp, S. pombe
gcgtaattactactgtttctgctac

SEQ ID NO: 86161 - DNA, 25 bp, S. pombe
gcgggtcttttaaattggcacatca

SEQ ID NO: 86162 - DNA, 25 bp, S. pombe
gcgtgctggcgctaacatagttttg

SEQ ID NO: 86163 - DNA, 25 bp, S. pombe
gcgtgccacgtatgctgaacagctt

SEQ ID NO: 86164 - DNA, 25 bp, S. pombe
gcgggactgaatgctgcaactgatt

SEQ ID NO: 86165 - DNA, 25 bp, S. pombe
gctggtgactagtgaaatgcctcaa

SEQ ID NO: 86166 - DNA, 25 bp, S. pombe
gctggatgcttcgaaaaacctgtca

SEQ ID NO: 86167 - DNA, 25 bp, S. pombe
gcggatttacagtgatacatcgata

SEQ ID NO: 86168 - DNA, 25 bp, S. pombe
gcgtgttattcgttatgcattccaa

SEQ ID NO: 86169 - DNA, 25 bp, S. pombe
gcggttatgttccaatcgcttgtaa

SEQ ID NO: 86170 - DNA, 25 bp, S. pombe
gcggatcatcctgagcgtttttata

SEQ ID NO: 86171 - DNA, 25 bp, S. pombe
gctgatgatcatcctggaggcttag

SEQ ID NO: 86172 - DNA, 25 bp, S. pombe
gcggtatccgtgaagcttccaaagc

SEQ ID NO: 86173 - DNA, 25 bp, S. pombe
gcgtctatcatcaggagctagtcat

SEQ ID NO: 86174 - DNA, 25 bp, S. pombe
gctggcactaatggtaaagtatcgc

SEQ ID NO: 86175 - DNA, 25 bp, S. pombe
gctggcacattcactggaacttcgt

SEQ ID NO: 86176 - DNA, 25 bp, S. pombe
gcgttattaagccactttgcgatat

SEQ ID NO: 86177 - DNA, 25 bp, S. pombe
gctggcgaggaaatacttacgacat

SEQ ID NO: 86178 - DNA, 25 bp, S. pombe
gcgtcgtggcagtttggtgcacaaa

SEQ ID NO: 86179 - DNA, 25 bp, S. pombe
gcgtctggtgattttgtgctagcta

SEQ ID NO: 86180 - DNA, 25 bp, S. pombe
gcgttttctagctcttcagttatgt

SEQ ID NO: 86181 - DNA, 25 bp, S. pombe
gcagtacctaatcttactttaaaat

SEQ ID NO: 86182 - DNA, 25 bp, S. pombe
gcggacggccatcggaactttgaaa

SEQ ID NO: 86183 - DNA, 25 bp, S. pombe
gcgtaccgcctgaagtagctttgaa

SEQ ID NO: 86184 - DNA, 25 bp, S. pombe
gcgtcacctttcttatcaggcaaga

SEQ ID NO: 86185 - DNA, 25 bp, S. pombe
gctgccgaagctcaagaacgtttat

SEQ ID NO: 86186 - DNA, 25 bp, S. pombe
gctgccttaggcctaaacggtcgaa

SEQ ID NO: 86187 - DNA, 25 bp, S. pombe
gctccggaatggcacaaaagtttgg

SEQ ID NO: 86188 - DNA, 25 bp, S. pombe
gcggcggttcagcataacataggtt

SEQ ID NO: 86189 - DNA, 25 bp, S. pombe
gcggtatttacaattgctttctttc

SEQ ID NO: 86190 - DNA, 25 bp, S. pombe
gcggttatgcacatctttactcttt

SEQ ID NO: 86191 - DNA, 25 bp, S. pombe
gcggaggactcaacattcatacttt

SEQ ID NO: 86192 - DNA, 25 bp, S. pombe
gcgtgggtgccaaaaacagctgtta

SEQ ID NO: 86193 - DNA, 25 bp, S. pombe
gcggaggctgccataaaagtttcac

SEQ ID NO: 86194 - DNA, 25 bp, S. pombe
gcggaacgcgttgaaagcttaatca

SEQ ID NO: 86195 - DNA, 25 bp, S. pombe
gctgggagcccttctaattttgaaa

SEQ ID NO: 86196 - DNA, 25 bp, S. pombe
gctggcctccttttaactttggaag

SEQ ID NO: 86197 - DNA, 25 bp, S. pombe
gctggcctttatttttgtttttgtg

SEQ ID NO: 86198 - DNA, 25 bp, S. pombe
gctggcccgtcaagtctgttaaatt

SEQ ID NO: 86199 - DNA, 25 bp, S. pombe
gctgggacaagatccttactcggaa

SEQ ID NO: 86200 - DNA, 25 bp, S. pombe
gcggcgaagagttgcctctatgcta

SEQ ID NO: 86201 - DNA, 25 bp, S. pombe
gcgtgacacttgttcgtttctacag

SEQ ID NO: 86202 - DNA, 25 bp, S. pombe
gcgtggattcaggtcgcttgtccaa

SEQ ID NO: 86203 - DNA, 25 bp, S. pombe
gcggtgttgttgagctcattgcata

SEQ ID NO: 86204 - DNA, 25 bp, S. pombe
gcggtgcgtgagactatgccattaa

SEQ ID NO: 86205 - DNA, 25 bp, S. pombe
gcgggcctcactttgcagtgtaatt

SEQ ID NO: 86206 - DNA, 25 bp, S. pombe
gcggatcctgttttgcaagtacgta

SEQ ID NO: 86207 - DNA, 25 bp, S. pombe
gctaacatcatcatcgaaccagagg

SEQ ID NO: 86208 - DNA, 25 bp, S. pombe
gctgcttacccaaattcaattcgtc

SEQ ID NO: 86209 - DNA, 25 bp, S. pombe
gctggaacccatgatgtcacatttt

SEQ ID NO: 86210 - DNA, 25 bp, S. pombe
gcggtccttgctgttacttatttaa

SEQ ID NO: 86211 - DNA, 25 bp, S. pombe
gcggtcggtgctgatatttctattt

SEQ ID NO: 86212 - DNA, 25 bp, S. pombe
gctaggcgcggtttggaacacattc

SEQ ID NO: 86213 - DNA, 25 bp, S. pombe
gcggttactcaatacttgctgcatt

SEQ ID NO: 86214 - DNA, 25 bp, S. pombe
gcgtgtgaaacaattactctctgat

SEQ ID NO: 86215 - DNA, 25 bp, S. pombe
gcgtggaattctaatgatccttatt

SEQ ID NO: 86216 - DNA, 25 bp, S. pombe
gcgtgagcgatttgagcacttgctt

SEQ ID NO: 86217 - DNA, 25 bp, S. pombe
gcgtgcagcttactgagccattgaa

SEQ ID NO: 86218 - DNA, 25 bp, S. pombe
gctgtcactttttactaacctcata

SEQ ID NO: 86219 - DNA, 25 bp, S. pombe
gctgggtttgactcttactggaaca

SEQ ID NO: 86220 - DNA, 25 bp, S. pombe
gcgtgcttgcaagaactgtacctgt

SEQ ID NO: 86221 - DNA, 25 bp, S. pombe
gcgtcattgtggtattcgtgttctt

SEQ ID NO: 86222 - DNA, 25 bp, S. pombe
gcgtgcaaatgggtctgccttttta

SEQ ID NO: 86223 - DNA, 25 bp, S. pombe
gcgtcaattggagcgcgctattcaa

SEQ ID NO: 86224 - DNA, 25 bp, S. pombe
gcgtcaattctcacgctgttgtgaa

SEQ ID NO: 86225 - DNA, 25 bp, S. pombe
gcgtctactcgaggcttatttcaga

SEQ ID NO: 86226 - DNA, 25 bp, S. pombe
gcgtcttagctactgtcttggtgaa

SEQ ID NO: 86227 - DNA, 25 bp, S. pombe
gcgtctttatgcgttatgcctggat

SEQ ID NO: 86228 - DNA, 25 bp, S. pombe
gcgtcttctacggatcattctctaa

SEQ ID NO: 86229 - DNA, 25 bp, S. pombe
gcgtcttcttctttgctatttgaat

SEQ ID NO: 86230 - DNA, 25 bp, S. pombe
gctattaaccctgttgctggaaaaa

SEQ ID NO: 86231 - DNA, 25 bp, S. pombe
gcgtgaaacccttcttgtccaaaag

SEQ ID NO: 86232 - DNA, 25 bp, S. pombe
gcggtacatccttgcatgatccaac

SEQ ID NO: 86233 - DNA, 25 bp, S. pombe
gcggaggatgcttcttttggactta

SEQ ID NO: 86234 - DNA, 25 bp, S. pombe
gcggtgctacatactcatgctataa

SEQ ID NO: 86235 - DNA, 25 bp, S. pombe
gctgaggaagcattggatcacgatt

SEQ ID NO: 86236 - DNA, 25 bp, S. pombe
gcagtctttccacaaggtttaccga

SEQ ID NO: 86237 - DNA, 25 bp, S. pombe
gctcgcttcttcacggtgttttaaa

SEQ ID NO: 86238 - DNA, 25 bp, S. pombe
gctccttttcaagttcgtgacattc

SEQ ID NO: 86239 - DNA, 25 bp, S. pombe
gctgcccgtacatttgatcttactt

SEQ ID NO: 86240 - DNA, 25 bp, S. pombe
gctggcactggatttttctacgttc

SEQ ID NO: 86241 - DNA, 25 bp, S. pombe
gctggtgcagtcgtttggcgtttaa

SEQ ID NO: 86242 - DNA, 25 bp, S. pombe
gcgtgaccttcagtttcttcaataa

SEQ ID NO: 86243 - DNA, 25 bp, S. pombe
gcggagcaagtagctgtttccagaa

SEQ ID NO: 86244 - DNA, 25 bp, S. pombe
gctgggataccaacgtctttgcata

SEQ ID NO: 86245 - DNA, 25 bp, S. pombe
gcgtcgttctcaggagtcaattagt

SEQ ID NO: 86246 - DNA, 25 bp, S. pombe
gcgtcgtatcccagtacagaaatat

SEQ ID NO: 86247 - DNA, 25 bp, S. pombe
gcgtcgtctcaaacgtaaaagaaga

SEQ ID NO: 86248 - DNA, 25 bp, S. pombe
gcggcactagtttcgctacatgaaa

SEQ ID NO: 86249 - DNA, 25 bp, S. pombe
gcggatgtaggttctcaagctcaaa

SEQ ID NO: 86250 - DNA, 25 bp, S. pombe
gcggagtccttactaatgctgcaca

SEQ ID NO: 86251 - DNA, 25 bp, S. pombe
gcgtgatgattcgtactatcgtcaa

SEQ ID NO: 86252 - DNA, 25 bp, S. pombe
gcgtccatttgcttgaacagcagaa

SEQ ID NO: 86253 - DNA, 25 bp, S. pombe
gcgtccgctatgaaattgctgcaga

SEQ ID NO: 86254 - DNA, 25 bp, S. pombe
gctttgggtaatcctgagtcgaaca

SEQ ID NO: 86255 - DNA, 25 bp, S. pombe
gctaagcatcccgttactggtgaag

SEQ ID NO: 86256 - DNA, 25 bp, S. pombe
gctaaggcagccattcgtagtcgaa

SEQ ID NO: 86257 - DNA, 25 bp, S. pombe
gcggagagcggttcttgcttacaaa

SEQ ID NO: 86258 - DNA, 25 bp, S. pombe
gcgggtgcggaattcattgtcaaat

SEQ ID NO: 86259 - DNA, 25 bp, S. pombe
gctgagctagagattgccttttcct

SEQ ID NO: 86260 - DNA, 25 bp, S. pombe
gctgatgctgagtcgtatgctcatt

SEQ ID NO: 86261 - DNA, 25 bp, S. pombe
gctggctcaattgacgatctttcta

SEQ ID NO: 86262 - DNA, 25 bp, S. pombe
tcctgaaccccgtgttgaatctatt

SEQ ID NO: 86263 - DNA, 25 bp, S. pombe
gctggaaacactatctggccaattt

SEQ ID NO: 86264 - DNA, 25 bp, S. pombe
gctgcgtagaccaactcgggaatct

SEQ ID NO: 86265 - DNA, 25 bp, S. pombe
gcatcaaggttagcggcactactct

SEQ ID NO: 86266 - DNA, 25 bp, S. pombe
gctaaggataaactggccgctgctt

SEQ ID NO: 86267 - DNA, 25 bp, S. pombe
gctggagctaaagatgccgcacttc

SEQ ID NO: 86268 - DNA, 25 bp, S. pombe
gctatggcactgtgggcctaagctt

SEQ ID NO: 86269 - DNA, 25 bp, S. pombe
gctcctgcgatattcggttgtgtta

SEQ ID NO: 86270 - DNA, 25 bp, S. pombe
gctcaaggtggtgttgttcccaaca

SEQ ID NO: 86271 - DNA, 25 bp, S. pombe
gctttggtccgtctacaatatctca

SEQ ID NO: 86272 - DNA, 25 bp, S. pombe
gctgttttacagtcctccaagatta

SEQ ID NO: 86273 - DNA, 25 bp, S. pombe
gctgttttagctgtcactgaggtcc

SEQ ID NO: 86274 - DNA, 25 bp, S. pombe
gctgttttcagcttatggccgttac

SEQ ID NO: 86275 - DNA, 25 bp, S. pombe
gcggttgtcaaacctgatcgaacaa

SEQ ID NO: 86276 - DNA, 25 bp, S. pombe
gcgtgtccctgatctttctgataag

SEQ ID NO: 86277 - DNA, 25 bp, S. pombe
gctgtgacacactctgctaaggttg

SEQ ID NO: 86278 - DNA, 25 bp, S. pombe
gctgtcgatacaccccaagaagatg

SEQ ID NO: 86279 - DNA, 25 bp, S. pombe
gctgctggccagaacaaaactatta

SEQ ID NO: 86280 - DNA, 25 bp, S. pombe
gctgtggcatcttccaatcaatcta

SEQ ID NO: 86281 - DNA, 25 bp, S. pombe
gcgggcattgcaggaccatatctta

SEQ ID NO: 86282 - DNA, 25 bp, S. pombe
gcgtggtgggcaaactacatttcat

SEQ ID NO: 86283 - DNA, 25 bp, S. pombe
gcggctcttcttgcttaaatgtggt

SEQ ID NO: 86284 - DNA, 25 bp, S. pombe
gctggtctttcagctgcaacaagat

SEQ ID NO: 86285 - DNA, 25 bp, S. pombe
gctggttccaaaaatatcgatgttt

SEQ ID NO: 86286 - DNA, 25 bp, S. pombe
gctcgtactaaacaaacagctcgta

SEQ ID NO: 86287 - DNA, 25 bp, S. pombe
gctcgtactaaacaaacagctcgta

SEQ ID NO: 86288 - DNA, 25 bp, S. pombe
gcttcaagccaagaaaagtccgttt

SEQ ID NO: 86289 - DNA, 25 bp, S. pombe
gcaaaaggtccctcacttggtacaa

SEQ ID NO: 86290 - DNA, 25 bp, S. pombe
gcaaaaaatcccactcttcctataa

SEQ ID NO: 86291 - DNA, 25 bp, S. pombe
gcggtaaaccagatgccagtgcatt

SEQ ID NO: 86292 - DNA, 25 bp, S. pombe
gctgagatatatcgtattacctggg

SEQ ID NO: 86293 - DNA, 25 bp, S. pombe
gctgcttaacagtgctagtcgtggt

SEQ ID NO: 86294 - DNA, 25 bp, S. pombe
gctccaaactgaagataggttcgtt

SEQ ID NO: 86295 - DNA, 25 bp, S. pombe
gtccaattttatcaggttctaccct

SEQ ID NO: 86296 - DNA, 25 bp, S. pombe
gctagtggatttaaagttgaccccg

SEQ ID NO: 86297 - DNA, 25 bp, S. pombe
gctgaggatttatctatgtgcttta

SEQ ID NO: 86298 - DNA, 25 bp, S. pombe
gctgtcggtgtgattatggctacta

SEQ ID NO: 86299 - DNA, 25 bp, S. pombe
gctgtcgaggtcgttatggctatcg

SEQ ID NO: 86300 - DNA, 25 bp, S. pombe
gctgaaacgaaggatgcgcttgcaa

SEQ ID NO: 86301 - DNA, 25 bp, S. pombe
gctgcattgggtatgtccttggaat

SEQ ID NO: 86302 - DNA, 25 bp, S. pombe
gctgtttcggtttgttctgttattc

SEQ ID NO: 86303 - DNA, 25 bp, S. pombe
gcattggcggattttttcggtttca

SEQ ID NO: 86304 - DNA, 25 bp, S. pombe
gctgagaaggctttattccgtgctt

SEQ ID NO: 86305 - DNA, 25 bp, S. pombe
gctgatggccctatgaacttgttaa

SEQ ID NO: 86306 - DNA, 25 bp, S. pombe
gctggaatcttgctaatcgtgtgta

SEQ ID NO: 86307 - DNA, 25 bp, S. pombe
gcggactcattccatttgcagggta

SEQ ID NO: 86308 - DNA, 25 bp, S. pombe
gctggactcttcgaattcataccta

SEQ ID NO: 86309 - DNA, 25 bp, S. pombe
gctggatctttggataccgacatct

SEQ ID NO: 86310 - DNA, 25 bp, S. pombe
gcatcccggcggagagccaatttaa

SEQ ID NO: 86311 - DNA, 25 bp, S. pombe
gctgtcaaatgcatcgaactcgtta

SEQ ID NO: 86312 - DNA, 25 bp, S. pombe
gcttcacctgttcaaattggccagt

SEQ ID NO: 86313 - DNA, 25 bp, S. pombe
gctgcatggtctttcgtcataacag

SEQ ID NO: 86314 - DNA, 25 bp, S. pombe
gctggcgagctatctgtgcaattca

SEQ ID NO: 86315 - DNA, 25 bp, S. pombe
gctggccgcgaaatgtgtactgcat

SEQ ID NO: 86316 - DNA, 25 bp, S. pombe
gcggctccggaattgctagatgcta

SEQ ID NO: 86317 - DNA, 25 bp, S. pombe
gcggttcgaaaatgcttgctggtca

SEQ ID NO: 86318 - DNA, 25 bp, S. pombe
gctggtcttaaatacttgtcgtctt

SEQ ID NO: 86319 - DNA, 25 bp, S. pombe
gctgcagctctggtcaggtaacgat

SEQ ID NO: 86320 - DNA, 25 bp, S. pombe
gctgcactctgcgtatgattgaaca

SEQ ID NO: 86321 - DNA, 25 bp, S. pombe
gctggtctgcttaccgaactggaaa

SEQ ID NO: 86322 - DNA, 25 bp, S. pombe
gctgcccagtcactcaatggtagta

SEQ ID NO: 86323 - DNA, 25 bp, S. pombe
gcggccattcgttatgttgagtcat

SEQ ID NO: 86324 - DNA, 25 bp, S. pombe
gctgaggtgaatttgacttttgttg

SEQ ID NO: 86325 - DNA, 25 bp, S. pombe
gcggcaaattctactatatggtcca

SEQ ID NO: 86326 - DNA, 25 bp, S. pombe
gctgtcaacatgatacgtcgttcca

SEQ ID NO: 86327 - DNA, 25 bp, S. pombe
gcggttgtacacgaacgataggtat

SEQ ID NO: 86328 - DNA, 25 bp, S. pombe
gctactttgagctcactccggaaaa

SEQ ID NO: 86329 - DNA, 25 bp, S. pombe
gctcccaataatgcacgtcgtaaac

SEQ ID NO: 86330 - DNA, 25 bp, S. pombe
gctgatgctcaaagaactccgtatg

SEQ ID NO: 86331 - DNA, 25 bp, S. pombe
gctggctataactattctcctattc

SEQ ID NO: 86332 - DNA, 25 bp, S. pombe
gctggttcaacaagtatatcattct

SEQ ID NO: 86333 - DNA, 25 bp, S. pombe
gcggcttcagccatttatttatata

SEQ ID NO: 86334 - DNA, 25 bp, S. pombe
gcaggcctatcggatttacttcaaa

SEQ ID NO: 86335 - DNA, 25 bp, S. pombe
gctgtagcattatggcaatgggaca

SEQ ID NO: 86336 - DNA, 25 bp, S. pombe
gctgctttctacactttgggtcaaa

SEQ ID NO: 86337 - DNA, 25 bp, S. pombe
gcttcttctacgctttcatgggtac

SEQ ID NO: 86338 - DNA, 25 bp, S. pombe
gctgttacagacctttttacttgtg

SEQ ID NO: 86339 - DNA, 25 bp, S. pombe
gctgtaaccacgtctttatcaactt

SEQ ID NO: 86340 - DNA, 25 bp, S. pombe
gctggcagaatttattgatacactt

SEQ ID NO: 86341 - DNA, 25 bp, S. pombe
gctggtcattcttttggtgccgcta

SEQ ID NO: 86342 - DNA, 25 bp, S. pombe
gctggtattatcgttggtatggcat

SEQ ID NO: 86343 - DNA, 25 bp, S. pombe
gctggtaatatcactgcgcttgcta

SEQ ID NO: 86344 - DNA, 25 bp, S. pombe
gctgatatcagatcgccaggaactt

SEQ ID NO: 86345 - DNA, 25 bp, S. pombe
gctggttttcctgtaaatcctagac

SEQ ID NO: 86346 - DNA, 25 bp, S. pombe
gctgtttgctagctttactccaatg

SEQ ID NO: 86347 - DNA, 25 bp, S. pombe
gcagatttccggtttacatatcagt

SEQ ID NO: 86348 - DNA, 25 bp, S. pombe
gcagtcttgggtatgattatagcag

SEQ ID NO: 86349 - DNA, 25 bp, S. pombe
gcggccattattattcgttttgcaa

SEQ ID NO: 86350 - DNA, 25 bp, S. pombe
gctcatgctgctaacattgtcacgg

SEQ ID NO: 86351 - DNA, 25 bp, S. pombe
gctgccgctttgacgaacttagaac

SEQ ID NO: 86352 - DNA, 25 bp, S. pombe
gctggcatctaggaaaacggctttt

SEQ ID NO: 86353 - DNA, 25 bp, S. pombe
gctggatatccttgaatacgtgctt

SEQ ID NO: 86354 - DNA, 25 bp, S. pombe
gctggatctcttgggatagttctta

SEQ ID NO: 86355 - DNA, 25 bp, S. pombe
gctgttctgccttggatattggttc

SEQ ID NO: 86356 - DNA, 25 bp, S. pombe
gctgatgagcctatgacaacgtttt

SEQ ID NO: 86357 - DNA, 25 bp, S. pombe
gctgatagcaccgtagcagattata

SEQ ID NO: 86358 - DNA, 25 bp, S. pombe
gctgtcctcaagctcttcttggaaa

SEQ ID NO: 86359 - DNA, 25 bp, S. pombe
gctgttgctgagttccaacatccaa

SEQ ID NO: 86360 - DNA, 25 bp, S. pombe
gctggtgccatgatatttccggttt

SEQ ID NO: 86361 - DNA, 25 bp, S. pombe
gctgctcagccggttttgaaggctt

SEQ ID NO: 86362 - DNA, 25 bp, S. pombe
gctggagcaagaatcatcgtcaact

SEQ ID NO: 86363 - DNA, 25 bp, S. pombe
gctcagccagagatacgcataatgt

SEQ ID NO: 86364 - DNA, 25 bp, S. pombe
gctttgctgaacaaggtaagtcgtc

SEQ ID NO: 86365 - DNA, 25 bp, S. pombe
gctgttgagcttaaactaagtgagg

SEQ ID NO: 86366 - DNA, 25 bp, S. pombe
gctgaacgcatgtactaaacctgag

SEQ ID NO: 86367 - DNA, 25 bp, S. pombe
gctgaattagctccaaagtcatcta

SEQ ID NO: 86368 - DNA, 25 bp, S. pombe
gctgagttcaaatctctaccgaagg

SEQ ID NO: 86369 - DNA, 25 bp, S. pombe
gctggcagtctttttattcgtaata

SEQ ID NO: 86370 - DNA, 25 bp, S. pombe
gctgctcctgctaagaaggccgaaa

SEQ ID NO: 86371 - DNA, 25 bp, S. pombe
gcatggcaattcagacagtgtggta

SEQ ID NO: 86372 - DNA, 25 bp, S. pombe
gctgtgttttactatgatggtccta

SEQ ID NO: 86373 - DNA, 25 bp, S. pombe
gctggttggatttactggactgcta

SEQ ID NO: 86374 - DNA, 25 bp, S. pombe
gctgatggctttaaactctcttgtt

SEQ ID NO: 86375 - DNA, 25 bp, S. pombe
gctgtggctatgtaggatccctcga

SEQ ID NO: 86376 - DNA, 25 bp, S. pombe
gctgatgccggattggattctctaa

SEQ ID NO: 86377 - DNA, 25 bp, S. pombe
gctgacggagttgacatctctacat

SEQ ID NO: 86378 - DNA, 25 bp, S. pombe
gctgacgccgttgcgctttatgatt

SEQ ID NO: 86379 - DNA, 25 bp, S. pombe
gctgccttcggtgcctttgaaaaat

SEQ ID NO: 86380 - DNA, 25 bp, S. pombe
gctggttactgtatcgttcacaaca

SEQ ID NO: 86381 - DNA, 25 bp, S. pombe
gctgtgtatgccattgtaacccatg

SEQ ID NO: 86382 - DNA, 25 bp, S. pombe
gctggcaccactaatacgcttataa

SEQ ID NO: 86383 - DNA, 25 bp, S. pombe
gctggctctgtttctgatcttttaa

SEQ ID NO: 86384 - DNA, 25 bp, S. pombe
gctggcctaaactacattgcttcgg

SEQ ID NO: 86385 - DNA, 25 bp, S. pombe
gctggcgatactactaattttgctg

SEQ ID NO: 86386 - DNA, 25 bp, S. pombe
gctcgttatttacgcacttatccgt

SEQ ID NO: 86387 - DNA, 25 bp, S. pombe
gctcgtcgtgttaacgatttcccta

SEQ ID NO: 86388 - DNA, 25 bp, S. pombe
gctgctgttgagcttaaactaagtg

SEQ ID NO: 86389 - DNA, 25 bp, S. pombe
gctggcactgcattcttatataact

SEQ ID NO: 86390 - DNA, 25 bp, S. pombe
gctggactgtctggctcatatatca

SEQ ID NO: 86391 - DNA, 25 bp, S. pombe
gctggtcaccattgctatcttgata

SEQ ID NO: 86392 - DNA, 25 bp, S. pombe
gctggcatggctgttgacggtcata

SEQ ID NO: 86393 - DNA, 25 bp, S. pombe
gctgccgaatttcaacgcattactc

SEQ ID NO: 86394 - DNA, 25 bp, S. pombe
gcttacttcaatgtttttgctcggt

SEQ ID NO: 86395 - DNA, 25 bp, S. pombe
gctgcttttaatgttgttccttgga

SEQ ID NO: 86396 - DNA, 25 bp, S. pombe
gctgctttcaacaagtcgttcgtat

SEQ ID NO: 86397 - DNA, 25 bp, S. pombe
gctgattttgatcctacttcgctag

SEQ ID NO: 86398 - DNA, 25 bp, S. pombe
gctgatttatctcgttacatgccaa

SEQ ID NO: 86399 - DNA, 25 bp, S. pombe
gctgcttctactaccgatcaaggag

SEQ ID NO: 86400 - DNA, 25 bp, S. pombe
gctgttctcagaagagtgtgcctct

SEQ ID NO: 86401 - DNA, 25 bp, S. pombe
gctgtcatcgactacgtgctcacga

SEQ ID NO: 86402 - DNA, 25 bp, S. pombe
gcatgccgtttgtggaaacccatta

SEQ ID NO: 86403 - DNA, 25 bp, S. pombe
gcagtcgttctgttggaaagtccag

SEQ ID NO: 86404 - DNA, 25 bp, S. pombe
gctgccgctgacgttaaagaattaa

SEQ ID NO: 86405 - DNA, 25 bp, S. pombe
gctgttggtgctgatagccttattc

SEQ ID NO: 86406 - DNA, 25 bp, S. pombe
gctgttggtgcatacgactttgttg

SEQ ID NO: 86407 - DNA, 25 bp, S. pombe
gctggattggcatctcgattatctt

SEQ ID NO: 86408 - DNA, 25 bp, S. pombe
gctggcttagctgcttgtattctat

SEQ ID NO: 86409 - DNA, 25 bp, S. pombe
gctggctttcccttgaatgcattat

SEQ ID NO: 86410 - DNA, 25 bp, S. pombe
gctgttcgctaccttaagcagttta

SEQ ID NO: 86411 - DNA, 25 bp, S. pombe
gctgttgccctctttacaagactta

SEQ ID NO: 86412 - DNA, 25 bp, S. pombe
gctgttgcaccctatgtcagtgaga

SEQ ID NO: 86413 - DNA, 25 bp, S. pombe
gctgttgctgctgctgaattcgaga

SEQ ID NO: 86414 - DNA, 25 bp, S. pombe
gctgctcccggcaagattctagaat

SEQ ID NO: 86415 - DNA, 25 bp, S. pombe
gctgccccggaagccataagcattg

SEQ ID NO: 86416 - DNA, 25 bp, S. pombe
gctactacgcgctatcatcgaaagt

SEQ ID NO: 86417 - DNA, 25 bp, S. pombe
gctagacagcgcgaaccagttgggt

SEQ ID NO: 86418 - DNA, 25 bp, S. pombe
gctgacccgcgcaatatttcgataa

SEQ ID NO: 86419 - DNA, 25 bp, S. pombe
gctggacaacccttgcttgatcaaa

SEQ ID NO: 86420 - DNA, 25 bp, S. pombe
gctgtgagatcaatccttcgttcaa

SEQ ID NO: 86421 - DNA, 25 bp, S. pombe
gctgaggtcttccttgacttcaaga

SEQ ID NO: 86422 - DNA, 25 bp, S. pombe
gctggtgttctgattgaccgactaa

SEQ ID NO: 86423 - DNA, 25 bp, S. pombe
gctggatctcagctttgagcgatac

SEQ ID NO: 86424 - DNA, 25 bp, S. pombe
gctggacatcgcattgtacgttcaa

SEQ ID NO: 86425 - DNA, 25 bp, S. pombe
gctgtaccgcattgttgttgctcaa

SEQ ID NO: 86426 - DNA, 25 bp, S. pombe
gctgataacctagcttctgcaatcg

SEQ ID NO: 86427 - DNA, 25 bp, S. pombe
gcttctttcttttatacttccgtgg

SEQ ID NO: 86428 - DNA, 25 bp, S. pombe
gctaatttgagtaaacccgcttggg

SEQ ID NO: 86429 - DNA, 25 bp, S. pombe
gctgaattcgttgagttaccggctg

SEQ ID NO: 86430 - DNA, 25 bp, S. pombe
gctgaagtcgttgagttccctgtta

SEQ ID NO: 86431 - DNA, 25 bp, S. pombe
gctcataggcctcatcgtttgaaaa

SEQ ID NO: 86432 - DNA, 25 bp, S. pombe
gctggtggattcgatctcatcttaa

SEQ ID NO: 86433 - DNA, 25 bp, S. pombe
gctgcgagcgactacattggttgtt

SEQ ID NO: 86434 - DNA, 25 bp, S. pombe
gctggtgtagctactcctgagaact

SEQ ID NO: 86435 - DNA, 25 bp, S. pombe
gcttcagctttctaaccggaggtct

SEQ ID NO: 86436 - DNA, 25 bp, S. pombe
gctccgttgatcctaccattgggta

SEQ ID NO: 86437 - DNA, 25 bp, S. pombe
gctcacatggccctcaaggtaggag

SEQ ID NO: 86438 - DNA, 25 bp, S. pombe
gctgcctcccgtaatcgttatgata

SEQ ID NO: 86439 - DNA, 25 bp, S. pombe
gctcgcactatctttccaatttgaa

SEQ ID NO: 86440 - DNA, 25 bp, S. pombe
gctgctgctcttggtcctaatttaa

SEQ ID NO: 86441 - DNA, 25 bp, S. pombe
gctgctttatttttcattttattgc

SEQ ID NO: 86442 - DNA, 25 bp, S. pombe
gctgtttcacaatacttcttagtca

SEQ ID NO: 86443 - DNA, 25 bp, S. pombe
gctgtttcagcattacaacttgtct

SEQ ID NO: 86444 - DNA, 25 bp, S. pombe
gctgtgatattttgcaattctcgta

SEQ ID NO: 86445 - DNA, 25 bp, S. pombe
gctgtagttgtttcttttatcgtga

SEQ ID NO: 86446 - DNA, 25 bp, S. pombe
gctaattattctttctggtacgaca

SEQ ID NO: 86447 - DNA, 25 bp, S. pombe
gctgataccccttacctgaaagaag

SEQ ID NO: 86448 - DNA, 25 bp, S. pombe
gctgttgcacccgtttcaaacaaat

SEQ ID NO: 86449 - DNA, 25 bp, S. pombe
gctgtgtgacaccttctatcataaa

SEQ ID NO: 86450 - DNA, 25 bp, S. pombe
gctgcagctataccccgaagagaaa

SEQ ID NO: 86451 - DNA, 25 bp, S. pombe
gctgagcgaactttcaaaatgccat

SEQ ID NO: 86452 - DNA, 25 bp, S. pombe
gctgtgcccctgctagagatatgaa

SEQ ID NO: 86453 - DNA, 25 bp, S. pombe
gctggtgatatttctcccatggatg

SEQ ID NO: 86454 - DNA, 25 bp, S. pombe
gctgttattgtactcatcgtctatg

SEQ ID NO: 86455 - DNA, 25 bp, S. pombe
gctgttaatgctaggtcgctgctta

SEQ ID NO: 86456 - DNA, 25 bp, S. pombe
gctgtttgcgagattccatatggta

SEQ ID NO: 86457 - DNA, 25 bp, S. pombe
gctgcctttggacgttgtttccgaa

SEQ ID NO: 86458 - DNA, 25 bp, S. pombe
gctgactatgtctaatgttctttct

SEQ ID NO: 86459 - DNA, 25 bp, S. pombe
gctgagcatatctgactgtttgtcc

SEQ ID NO: 86460 - DNA, 25 bp, S. pombe
gctggtcgcttttgtttgtattttt

SEQ ID NO: 86461 - DNA, 25 bp, S. pombe
gctggtgtcttgtcggatgaacttt

SEQ ID NO: 86462 - DNA, 25 bp, S. pombe
gctgaacttcatatcgagtactctt

SEQ ID NO: 86463 - DNA, 25 bp, S. pombe
gctgaacagtcttctcgagatccta

SEQ ID NO: 86464 - DNA, 25 bp, S. pombe
gctgtcgtgccagtgggtattgcaa

SEQ ID NO: 86465 - DNA, 25 bp, S. pombe
gctgaattatgcgaagcgtgctaaa

SEQ ID NO: 86466 - DNA, 25 bp, S. pombe
gctgtcattcccgatttgtcgatag

SEQ ID NO: 86467 - DNA, 25 bp, S. pombe
gctgatattctgtgatttgcctaac

SEQ ID NO: 86468 - DNA, 25 bp, S. pombe
gctgatttcgatgctatccgcaaat

SEQ ID NO: 86469 - DNA, 25 bp, S. pombe
gctgatgatcagcacgctttcgaaa

SEQ ID NO: 86470 - DNA, 25 bp, S. pombe
gctgttgggatcttgctttttactt

SEQ ID NO: 86471 - DNA, 25 bp, S. pombe
gctgttggtggagcttatcttccaa

SEQ ID NO: 86472 - DNA, 25 bp, S. pombe
gctaaacttcttctttgtactcggt

SEQ ID NO: 86473 - DNA, 25 bp, S. pombe
gctacttcacgtcttcggactatga

SEQ ID NO: 86474 - DNA, 25 bp, S. pombe
gctttggacgctttccagtttatga

SEQ ID NO: 86475 - DNA, 25 bp, S. pombe
gctcttgtacgttttccttttcata

SEQ ID NO: 86476 - DNA, 25 bp, S. pombe
gctaatgaacgtactttcctttctt

SEQ ID NO: 86477 - DNA, 25 bp, S. pombe
gcagcaaacgcctcttggtatttat

SEQ ID NO: 86478 - DNA, 25 bp, S. pombe
gctgtctacgatgatgcttgtgtct

SEQ ID NO: 86479 - DNA, 25 bp, S. pombe
gctgttcaacgggatctctcgaaat

SEQ ID NO: 86480 - DNA, 25 bp, S. pombe
gctgcccaagggtctattgaaatct

SEQ ID NO: 86481 - DNA, 25 bp, S. pombe
gctcccatatcccagttcatgaagg

SEQ ID NO: 86482 - DNA, 25 bp, S. pombe
gctgactttccagataccaaatgcg

SEQ ID NO: 86483 - DNA, 25 bp, S. pombe
gctgcagtcgctcatgtaaccaaag

SEQ ID NO: 86484 - DNA, 25 bp, S. pombe
gctgctaaaatcctgaagtggcctt

SEQ ID NO: 86485 - DNA, 25 bp, S. pombe
gctctaaagttgatgggcgcagctt

SEQ ID NO: 86486 - DNA, 25 bp, S. pombe
gctcttcaagaagctgtcgaggctt

SEQ ID NO: 86487 - DNA, 25 bp, S. pombe
gctgttgctcaagctggcgaattga

SEQ ID NO: 86488 - DNA, 25 bp, S. pombe
gctgataactggtggcttcgtcatc

SEQ ID NO: 86489 - DNA, 25 bp, S. pombe
gctgagggctcatcagagatctctt

SEQ ID NO: 86490 - DNA, 25 bp, S. pombe
gctacggcttgtgaactgttgacta

SEQ ID NO: 86491 - DNA, 25 bp, S. pombe
gctgcgtcctggtcgtttagataaa

SEQ ID NO: 86492 - DNA, 25 bp, S. pombe
gctgccacggagtccttttttgaga

SEQ ID NO: 86493 - DNA, 25 bp, S. pombe
gctgattatttctacattgccctat

SEQ ID NO: 86494 - DNA, 25 bp, S. pombe
gctgctgttgtcatagctaaccaag

SEQ ID NO: 86495 - DNA, 25 bp, S. pombe
gctgtacttgctggcgctgtttcga

SEQ ID NO: 86496 - DNA, 25 bp, S. pombe
gctgctgacattcccgcatttgtaa

SEQ ID NO: 86497 - DNA, 25 bp, S. pombe
gctgcagacgcattcgacattttaa

SEQ ID NO: 86498 - DNA, 25 bp, S. pombe
gctatttcagtgttttacgcccaag

SEQ ID NO: 86499 - DNA, 25 bp, S. pombe
gctcttgctagccatttcaaacttg

SEQ ID NO: 86500 - DNA, 25 bp, S. pombe
gctgctttacctcctaggacaatgg

SEQ ID NO: 86501 - DNA, 25 bp, S. pombe
gctgctggtataatgccgacgaaat

SEQ ID NO: 86502 - DNA, 25 bp, S. pombe
gctccggtgagcttttaaggcatcc

SEQ ID NO: 86503 - DNA, 25 bp, S. pombe
gctcccaaagttattcaggctcatt

SEQ ID NO: 86504 - DNA, 25 bp, S. pombe
gctgcccaatgtttaggtcgcgttt

SEQ ID NO: 86505 - DNA, 25 bp, S. pombe
gctgcggtttatcaatgtgcctggt

SEQ ID NO: 86506 - DNA, 25 bp, S. pombe
gctcctggttcgcatattgtagata

SEQ ID NO: 86507 - DNA, 25 bp, S. pombe
gctcgttgggccgttactaataaca

SEQ ID NO: 86508 - DNA, 25 bp, S. pombe
gctacattaacaccttaagccgcgt

SEQ ID NO: 86509 - DNA, 25 bp, S. pombe
gctcctctatcactaatctagctta

SEQ ID NO: 86510 - DNA, 25 bp, S. pombe
gctccaattgatcattccaggcatt

SEQ ID NO: 86511 - DNA, 25 bp, S. pombe
gctcaaacaaactctgcaacaggct

SEQ ID NO: 86512 - DNA, 25 bp, S. pombe
gctaattcaaatgctccaactccag

SEQ ID NO: 86513 - DNA, 25 bp, S. pombe
gctgaatttagagcccaagcttgct

SEQ ID NO: 86514 - DNA, 25 bp, S. pombe
gctgcatatttactccttactgttg

SEQ ID NO: 86515 - DNA, 25 bp, S. pombe
gctcatgcaacttcaaccaagcttg

SEQ ID NO: 86516 - DNA, 25 bp, S. pombe
gctgctgctatttatgatcccacta

SEQ ID NO: 86517 - DNA, 25 bp, S. pombe
gctgctgctcatattttggacaagg

SEQ ID NO: 86518 - DNA, 25 bp, S. pombe
gctgaactgttttatcgcttgtcta

SEQ ID NO: 86519 - DNA, 25 bp, S. pombe
gctccaattctttacgtactcacag

SEQ ID NO: 86520 - DNA, 25 bp, S. pombe
gctcctgaacttttgcttggtgcac

SEQ ID NO: 86521 - DNA, 25 bp, S. pombe
gctcccaagtctttcacgtacatga

SEQ ID NO: 86522 - DNA, 25 bp, S. pombe
gctgaattggatgcttatttacaca

SEQ ID NO: 86523 - DNA, 25 bp, S. pombe
gctgaactggttctttcttacgatt

SEQ ID NO: 86524 - DNA, 25 bp, S. pombe
gctgaaacgtttttgtctgtggatc

SEQ ID NO: 86525 - DNA, 25 bp, S. pombe
gctgaaatctgctctagtgctttgc

SEQ ID NO: 86526 - DNA, 25 bp, S. pombe
gctgaagccatcatcatgcaagttt

SEQ ID NO: 86527 - DNA, 25 bp, S. pombe
gctgcaaatcatgcttatcaggttt

SEQ ID NO: 86528 - DNA, 25 bp, S. pombe
gctgaactcttcgtagctgtgctat

SEQ ID NO: 86529 - DNA, 25 bp, S. pombe
gctgaacttccgaactatgctcgat

SEQ ID NO: 86530 - DNA, 25 bp, S. pombe
gctgatccttctgctattgattcaa

SEQ ID NO: 86531 - DNA, 25 bp, S. pombe
gctccttacactttgaaccttacaa

SEQ ID NO: 86532 - DNA, 25 bp, S. pombe
gctgctttacccgatgataccgtaa

SEQ ID NO: 86533 - DNA, 25 bp, S. pombe
gctgctttgattgcttcacatctgg

SEQ ID NO: 86534 - DNA, 25 bp, S. pombe
gctgatattgtagacgccgctggcg

SEQ ID NO: 86535 - DNA, 25 bp, S. pombe
gctcatatggtttgacgaacgccga

SEQ ID NO: 86536 - DNA, 25 bp, S. pombe
gctgcatttgtataggcgaccacga

SEQ ID NO: 86537 - DNA, 25 bp, S. pombe
gctgactctcaaagctacgtgttga

SEQ ID NO: 86538 - DNA, 25 bp, S. pombe
gctaacttagcacatcctttcttta

SEQ ID NO: 86539 - DNA, 25 bp, S. pombe
gctcctattattatccttgccgatg

SEQ ID NO: 86540 - DNA, 25 bp, S. pombe
gctttatgatttcgcggcaaccgag

SEQ ID NO: 86541 - DNA, 25 bp, S. pombe
gctgctcgcttgattaagaccgcta

SEQ ID NO: 86542 - DNA, 25 bp, S. pombe
gctgctcctcatactataatgcttc

SEQ ID NO: 86543 - DNA, 25 bp, S. pombe
gctgctactatccatatgcttctta

SEQ ID NO: 86544 - DNA, 25 bp, S. pombe
gctgctatgcttggatggcctcaat

SEQ ID NO: 86545 - DNA, 25 bp, S. pombe
gctcgtgctctagacactgagtcag

SEQ ID NO: 86546 - DNA, 25 bp, S. pombe
gctcggccattgcagcgatggtcaa

SEQ ID NO: 86547 - DNA, 25 bp, S. pombe
gctgcaagtgctttagctgctgcta

SEQ ID NO: 86548 - DNA, 25 bp, S. pombe
gctgcggagctaatatcatcatcta

SEQ ID NO: 86549 - DNA, 25 bp, S. pombe
gctgctgctcgtggtgattcagatg

SEQ ID NO: 86550 - DNA, 25 bp, S. pombe
gctcctgtatacatgcatcctagtg

SEQ ID NO: 86551 - DNA, 25 bp, S. pombe
gctaataacatttcatcgcggtcgg

SEQ ID NO: 86552 - DNA, 25 bp, S. pombe
gctaaagcaattgcagctccgtcaa

SEQ ID NO: 86553 - DNA, 25 bp, S. pombe
gctcagaagtttgcgcctacacaag

SEQ ID NO: 86554 - DNA, 25 bp, S. pombe
gctagagcctctactaccgaaatag

SEQ ID NO: 86555 - DNA, 25 bp, S. pombe
gctcgaggcattgacccgaagcaag

SEQ ID NO: 86556 - DNA, 25 bp, S. pombe
gctcgaccattgttcccaggaaagg

SEQ ID NO: 86557 - DNA, 25 bp, S. pombe
gctgcagtaagctttcatctagtga

SEQ ID NO: 86558 - DNA, 25 bp, S. pombe
gctgctcaagagtgcacagtggcat

SEQ ID NO: 86559 - DNA, 25 bp, S. pombe
gctgacaggcatttatccgttgaaa

SEQ ID NO: 86560 - DNA, 25 bp, S. pombe
gctgaagcacttctgccgttaaatt

SEQ ID NO: 86561 - DNA, 25 bp, S. pombe
gctgagatgcgtgtttactggtctt

SEQ ID NO: 86562 - DNA, 25 bp, S. pombe
gctactgccgctttaatgggacttt

SEQ ID NO: 86563 - DNA, 25 bp, S. pombe
gctgctgtccgtcttgctaaaaagt

SEQ ID NO: 86564 - DNA, 25 bp, S. pombe
gctgctggacgctgtatctgtaaaa

SEQ ID NO: 86565 - DNA, 25 bp, S. pombe
gcatgctcatatggtctgtacgtat

SEQ ID NO: 86566 - DNA, 25 bp, S. pombe
gctgcaattgcgatgaaggccttaa

SEQ ID NO: 86567 - DNA, 25 bp, S. pombe
gctgccatggcctttgaagtcttaa

SEQ ID NO: 86568 - DNA, 25 bp, S. pombe
gctgctggtaacttgtatttctcta

SEQ ID NO: 86569 - DNA, 25 bp, S. pombe
gctccgacaacttcttcaatcagta

SEQ ID NO: 86570 - DNA, 25 bp, S. pombe
gctcccagaagcatgcgtgataatg

SEQ ID NO: 86571 - DNA, 25 bp, S. pombe
gctcgcggacattcgcttgaagatt

SEQ ID NO: 86572 - DNA, 25 bp, S. pombe
gctcgcgaaatttctcgtcacattg

SEQ ID NO: 86573 - DNA, 25 bp, S. pombe
gctgacatacagtctcttcaatcaa

SEQ ID NO: 86574 - DNA, 25 bp, S. pombe
gctgaatatgctaatcttgcatcaa

SEQ ID NO: 86575 - DNA, 25 bp, S. pombe
gctgcaattgctctttactatatca

SEQ ID NO: 86576 - DNA, 25 bp, S. pombe
gctgctcgtcttgatcggtgtaaaa

SEQ ID NO: 86577 - DNA, 25 bp, S. pombe
gctgctgtttctttttctactatca

SEQ ID NO: 86578 - DNA, 25 bp, S. pombe
gctgaatcttcttttgtcggtacaa

SEQ ID NO: 86579 - DNA, 25 bp, S. pombe
gctccttgggatgtcatgcctgatc

SEQ ID NO: 86580 - DNA, 25 bp, S. pombe
gctgctttgggcaagtactctatct

SEQ ID NO: 86581 - DNA, 25 bp, S. pombe
gctcaatggatgcatcgcgcggaat

SEQ ID NO: 86582 - DNA, 25 bp, S. pombe
gctcgcacagattcaggcacagtat

SEQ ID NO: 86583 - DNA, 25 bp, S. pombe
gctgcccaggcagtggatacgattg

SEQ ID NO: 86584 - DNA, 25 bp, S. pombe
gctcatggcccaaacgagtatgtta

SEQ ID NO: 86585 - DNA, 25 bp, S. pombe
gctcaagccttgaccgatgaagcgt

SEQ ID NO: 86586 - DNA, 25 bp, S. pombe
gctgcctgcagctgctcgaaaaaga

SEQ ID NO: 86587 - DNA, 25 bp, S. pombe
gctccttctagttctcgatacaaaa

SEQ ID NO: 86588 - DNA, 25 bp, S. pombe
gctgcacaagcgttggtgtgtgaaa

SEQ ID NO: 86589 - DNA, 25 bp, S. pombe
gctgcatccactcttcatgttgata

SEQ ID NO: 86590 - DNA, 25 bp, S. pombe
gctgcactaggtgtgctgctgaaat

SEQ ID NO: 86591 - DNA, 25 bp, S. pombe
gctcctggatatggtgtgcgacgca

SEQ ID NO: 86592 - DNA, 25 bp, S. pombe
gctcctgctgaagctgccgaagaag

SEQ ID NO: 86593 - DNA, 25 bp, S. pombe
gctccagctggtcatgcacgaataa

SEQ ID NO: 86594 - DNA, 25 bp, S. pombe
gctcggactgggaactgcttatatt

SEQ ID NO: 86595 - DNA, 25 bp, S. pombe
gctcgtgatgctaaaaaccctgatt

SEQ ID NO: 86596 - DNA, 25 bp, S. pombe
gctgctaaaactagagctcccgttt

SEQ ID NO: 86597 - DNA, 25 bp, S. pombe
gctacatgtctatcttttatccctg

SEQ ID NO: 86598 - DNA, 25 bp, S. pombe
gctgcactgattttctttttcttta

SEQ ID NO: 86599 - DNA, 25 bp, S. pombe
gctgctcacgttgcattgatggttt

SEQ ID NO: 86600 - DNA, 25 bp, S. pombe
gctgctaacattgttcttcctgata

SEQ ID NO: 86601 - DNA, 25 bp, S. pombe
gctgccaatattgtgcatttcgata

SEQ ID NO: 86602 - DNA, 25 bp, S. pombe
gctgctttttatatctgcggtgatg

SEQ ID NO: 86603 - DNA, 25 bp, S. pombe
gctgcttacttatttttgctggtga

SEQ ID NO: 86604 - DNA, 25 bp, S. pombe
gctgctaacgcaattttcaatcgct

SEQ ID NO: 86605 - DNA, 25 bp, S. pombe
tcctagccgcattttgtccaagttt

SEQ ID NO: 86606 - DNA, 25 bp, S. pombe
tccagagaactcttggtccacgata

SEQ ID NO: 86607 - DNA, 25 bp, S. pombe
tcgcggtggctatggttaaaatttt

SEQ ID NO: 86608 - DNA, 25 bp, S. pombe
gctccggattctctgcttaataata

SEQ ID NO: 86609 - DNA, 25 bp, S. pombe
gctgcccctattcctttggaaatga

SEQ ID NO: 86610 - DNA, 25 bp, S. pombe
gctactaccttgcagcaattgccaa

SEQ ID NO: 86611 - DNA, 25 bp, S. pombe
gctataacccttcgcaatatggctg

SEQ ID NO: 86612 - DNA, 25 bp, S. pombe
gctcaccgtcttcgcacaataaagg

SEQ ID NO: 86613 - DNA, 25 bp, S. pombe
gctgcatctgttattcctgttggaa

SEQ ID NO: 86614 - DNA, 25 bp, S. pombe
gctcctggtcttacttgtgggatat

SEQ ID NO: 86615 - DNA, 25 bp, S. pombe
gctgcttgtgcttttgttttgttaa

SEQ ID NO: 86616 - DNA, 25 bp, S. pombe
gctgcgattatctataccatgttgt

SEQ ID NO: 86617 - DNA, 25 bp, S. pombe
gctgctgctcttgaacagtttgctt

SEQ ID NO: 86618 - DNA, 25 bp, S. pombe
gctgctccgtcaattcagaattctt

SEQ ID NO: 86619 - DNA, 25 bp, S. pombe
gctgcctcgcgaaccaaatttgtaa

SEQ ID NO: 86620 - DNA, 25 bp, S. pombe
gctccaaagatagcttccttaccta

SEQ ID NO: 86621 - DNA, 25 bp, S. pombe
gctgcttaccaagctttgttcttta

SEQ ID NO: 86622 - DNA, 25 bp, S. pombe
gctcgtattactgcatttttctctg

SEQ ID NO: 86623 - DNA, 25 bp, S. pombe
gctcagggtgcttctttttacaatt

SEQ ID NO: 86624 - DNA, 25 bp, S. pombe
gctgctggtatttttgttgctgaca

SEQ ID NO: 86625 - DNA, 25 bp, S. pombe
gctgcttgcttttattctgctctaa

SEQ ID NO: 86626 - DNA, 25 bp, S. pombe
gctgctgttgccaaatctgctcaat

SEQ ID NO: 86627 - DNA, 25 bp, S. pombe
gctgctgcacctcagttacagatta

SEQ ID NO: 86628 - DNA, 25 bp, S. pombe
gctcgaccagtataagcagctcgaa

SEQ ID NO: 86629 - DNA, 25 bp, S. pombe
gctcaggctcgtgaaaatgctccat

SEQ ID NO: 86630 - DNA, 25 bp, S. pombe
gctcctttaggatcttctctagaac

SEQ ID NO: 86631 - DNA, 25 bp, S. pombe
gctcctctagtaccgttagctcaga

SEQ ID NO: 86632 - DNA, 25 bp, S. pombe
gctgctttagcatcacgtgttattg

SEQ ID NO: 86633 - DNA, 25 bp, S. pombe
gctcgccttgcttggaacaatgtta

SEQ ID NO: 86634 - DNA, 25 bp, S. pombe
gctcgtcgagcttgcgaaaagcttt

SEQ ID NO: 86635 - DNA, 25 bp, S. pombe
gctctggtacccacaacatgtacaa

SEQ ID NO: 86636 - DNA, 25 bp, S. pombe
gctctgaaggctctaaaactgctaa

SEQ ID NO: 86637 - DNA, 25 bp, S. pombe
gctctgaactctcgcttagtaactg

SEQ ID NO: 86638 - DNA, 25 bp, S. pombe
gctgctcatcttcgcaacaagtttg

SEQ ID NO: 86639 - DNA, 25 bp, S. pombe
gctgctactagccaagccgttatga

SEQ ID NO: 86640 - DNA, 25 bp, S. pombe
gctgccgtcgctggatagattgcat

SEQ ID NO: 86641 - DNA, 25 bp, S. pombe
gcatccgacgtggtgacaatcattt

SEQ ID NO: 86642 - DNA, 25 bp, S. pombe
gctcctcgcatcaagaccaaaaatt

SEQ ID NO: 86643 - DNA, 25 bp, S. pombe
gctcctcctgagtatgccgaaaatc

SEQ ID NO: 86644 - DNA, 25 bp, S. pombe
gctcctactgctccaaaatacgatg

SEQ ID NO: 86645 - DNA, 25 bp, S. pombe
gctacatacagctaaaaccaccggg

SEQ ID NO: 86646 - DNA, 25 bp, S. pombe
gctcctgccagtgctgaagaagcta

SEQ ID NO: 86647 - DNA, 25 bp, S. pombe
gctcaaactacaccttttcaagact

SEQ ID NO: 86648 - DNA, 25 bp, S. pombe
gcaccatgcattacccgaaggacga

SEQ ID NO: 86649 - DNA, 25 bp, S. pombe
gctatgggccacacggaaacgataa

SEQ ID NO: 86650 - DNA, 25 bp, S. pombe
gctcaatttttactgtccatgaccc

SEQ ID NO: 86651 - DNA, 25 bp, S. pombe
gcttacgatttacttctaggcgctc

SEQ ID NO: 86652 - DNA, 25 bp, S. pombe
gcattacagactacacgtttaccta

SEQ ID NO: 86653 - DNA, 25 bp, S. pombe
gcagcgatcaataaaaccaccgttt

SEQ ID NO: 86654 - DNA, 25 bp, S. pombe
gcatggacaagtttccccagactta

SEQ ID NO: 86655 - DNA, 25 bp, S. pombe
gctaagaagcgttcctccaaggtac

SEQ ID NO: 86656 - DNA, 25 bp, S. pombe
gctatgggtaactttgccggcgtta

SEQ ID NO: 86657 - DNA, 25 bp, S. pombe
gcttaccttgcgttttcggtgcaaa

SEQ ID NO: 86658 - DNA, 25 bp, S. pombe
gctaggccatccatttttggtcgta

SEQ ID NO: 86659 - DNA, 25 bp, S. pombe
gctatggctcatcaacttggtggtt

SEQ ID NO: 86660 - DNA, 25 bp, S. pombe
gctagttcattatgccggtggtttc

SEQ ID NO: 86661 - DNA, 25 bp, S. pombe
gctaaacatgtagctaaaacgattg

SEQ ID NO: 86662 - DNA, 25 bp, S. pombe
gctacaagtattatcctcgaggaga

SEQ ID NO: 86663 - DNA, 25 bp, S. pombe
tgtcaatgaggatccggcttgcggt

SEQ ID NO: 86664 - DNA, 25 bp, S. pombe
gctaatcctgtgtctcaagcttcag

SEQ ID NO: 86665 - DNA, 25 bp, S. pombe
gctcgacccgatgaagctgtcagtt

SEQ ID NO: 86666 - DNA, 25 bp, S. pombe
gcttctggacgtgcaaatttatctg

SEQ ID NO: 86667 - DNA, 25 bp, S. pombe
gctatttcccgaagacatttcctaa

SEQ ID NO: 86668 - DNA, 25 bp, S. pombe
gcttttttaatcgtcactggccaaa

SEQ ID NO: 86669 - DNA, 25 bp, S. pombe
gcttttttgaaggaacggctgctga

SEQ ID NO: 86670 - DNA, 25 bp, S. pombe
gctactttggaagactctatgcacg

SEQ ID NO: 86671 - DNA, 25 bp, S. pombe
gctccagattatgactacctacgaa

SEQ ID NO: 86672 - DNA, 25 bp, S. pombe
gctaattgtgtatcccgcaagtcaa

SEQ ID NO: 86673 - DNA, 25 bp, S. pombe
gctgccaagcttttattccaagaat

SEQ ID NO: 86674 - DNA, 25 bp, S. pombe
gcttcgacctactgtgcctgtaaag

SEQ ID NO: 86675 - DNA, 25 bp, S. pombe
gcttgtgtcctagcgcctttaaaga

SEQ ID NO: 86676 - DNA, 25 bp, S. pombe
gctatccatagtgcaccagagacga

SEQ ID NO: 86677 - DNA, 25 bp, S. pombe
gcttccaacatctccgactaaaatt

SEQ ID NO: 86678 - DNA, 25 bp, S. pombe
gactacgggttctggtacttcttgg

SEQ ID NO: 86679 - DNA, 25 bp, S. pombe
gattccaacgaatcttggtttcccg

SEQ ID NO: 86680 - DNA, 25 bp, S. pombe
gttcaatccgactacttgggtatcc

SEQ ID NO: 86681 - DNA, 25 bp, S. pombe
gttcaacttgaatggtcggttcctg

SEQ ID NO: 86682 - DNA, 25 bp, S. pombe
gctccattatcccaatctgtgtttg

SEQ ID NO: 86683 - DNA, 25 bp, S. pombe
gtcttcggaagcttttactcgttgg

SEQ ID NO: 86684 - DNA, 25 bp, S. pombe
gctcttacgatgcttatgtttcagt

SEQ ID NO: 86685 - DNA, 25 bp, S. pombe
gctcttcacgtcctttacataagtt

SEQ ID NO: 86686 - DNA, 25 bp, S. pombe
gctccgccttccattacagaagata

SEQ ID NO: 86687 - DNA, 25 bp, S. pombe
gctcccgcttacgatgttgcagaaa

SEQ ID NO: 86688 - DNA, 25 bp, S. pombe
gctcaatccgttgctttatcaatga

SEQ ID NO: 86689 - DNA, 25 bp, S. pombe
gctcactctcgtacaagatgcattc

SEQ ID NO: 86690 - DNA, 25 bp, S. pombe
gctcctcatgcattgcaacaatcgg

SEQ ID NO: 86691 - DNA, 25 bp, S. pombe
gctcctatgttcaaagttggccctg

SEQ ID NO: 86692 - DNA, 25 bp, S. pombe
gctccacattactaagggccgatac

SEQ ID NO: 86693 - DNA, 25 bp, S. pombe
gctccagatattctcgggcacgtag

SEQ ID NO: 86694 - DNA, 25 bp, S. pombe
gctcaagcatgaatcgtcggaccgt

SEQ ID NO: 86695 - DNA, 25 bp, S. pombe
gctccagagaataatcgtgatccta

SEQ ID NO: 86696 - DNA, 25 bp, S. pombe
gcattcactgacatgagcttcgaga

SEQ ID NO: 86697 - DNA, 25 bp, S. pombe
gctccatggcatatcatcatatcaa

SEQ ID NO: 86698 - DNA, 25 bp, S. pombe
gctctgttgctactatcattcacga

SEQ ID NO: 86699 - DNA, 25 bp, S. pombe
gctactgaggaacatgctgccggca

SEQ ID NO: 86700 - DNA, 25 bp, S. pombe
gctccactgtccttcaagcaaaagt

SEQ ID NO: 86701 - DNA, 25 bp, S. pombe
gctccatgttgcaacgataccgaat

SEQ ID NO: 86702 - DNA, 25 bp, S. pombe
gctcaacgcaagctgttccatgaat

SEQ ID NO: 86703 - DNA, 25 bp, S. pombe
gctccactcctttgtttcgattatg

SEQ ID NO: 86704 - DNA, 25 bp, S. pombe
gctaaatgttcttcttcgggtgtat

SEQ ID NO: 86705 - DNA, 25 bp, S. pombe
gctagacaagctcttcaagccgttg

SEQ ID NO: 86706 - DNA, 25 bp, S. pombe
gctagccttgctcttttgtttattt

SEQ ID NO: 86707 - DNA, 25 bp, S. pombe
gctcagttccgtactttttgggact

SEQ ID NO: 86708 - DNA, 25 bp, S. pombe
gcttctcccgatattgttacgaacg

SEQ ID NO: 86709 - DNA, 25 bp, S. pombe
gctaatctacgatactttccgtaca

SEQ ID NO: 86710 - DNA, 25 bp, S. pombe
gtagtaaaagcgtgtcttactgaga

SEQ ID NO: 86711 - DNA, 25 bp, S. pombe
gctacgtatacggttgtcgaatcga

SEQ ID NO: 86712 - DNA, 25 bp, S. pombe
gcttccggtcatgttgttgaacgca

SEQ ID NO: 86713 - DNA, 25 bp, S. pombe
gctcttcgggaggttcttgaactta

SEQ ID NO: 86714 - DNA, 25 bp, S. pombe
gctctctgatgtcgctagttctgaa

SEQ ID NO: 86715 - DNA, 25 bp, S. pombe
gctcctatttgcacatctccaaagg

SEQ ID NO: 86716 - DNA, 25 bp, S. pombe
gctcctactgtgttatctgcatcaa

SEQ ID NO: 86717 - DNA, 25 bp, S. pombe
gctctgcaacagtattcacctagaa

SEQ ID NO: 86718 - DNA, 25 bp, S. pombe
gctcaaacagtttctttagttggta

SEQ ID NO: 86719 - DNA, 25 bp, S. pombe
gctcaacaagtagctagcggcgtta

SEQ ID NO: 86720 - DNA, 25 bp, S. pombe
gctcctatcgttattatggcttcta

SEQ ID NO: 86721 - DNA, 25 bp, S. pombe
gctcttctggttcttattcccaaac

SEQ ID NO: 86722 - DNA, 25 bp, S. pombe
gctattacgtactcataaccggcaa

SEQ ID NO: 86723 - DNA, 25 bp, S. pombe
gctcttacagtatttttcaccggta

SEQ ID NO: 86724 - DNA, 25 bp, S. pombe
gctctaagctacaagcgaccgtcaa

SEQ ID NO: 86725 - DNA, 25 bp, S. pombe
gctacgatggacttgcgacacgtta

SEQ ID NO: 86726 - DNA, 25 bp, S. pombe
gcatacccaactctacctgtaaaag

SEQ ID NO: 86727 - DNA, 25 bp, S. pombe
gctctcaaaagctcttcaggaacag

SEQ ID NO: 86728 - DNA, 25 bp, S. pombe
gctcttgaggacttctacactgtca

SEQ ID NO: 86729 - DNA, 25 bp, S. pombe
gctcttcgtaataaatccgctgatt

SEQ ID NO: 86730 - DNA, 25 bp, S. pombe
gctctttatttagctcagcgctcta

SEQ ID NO: 86731 - DNA, 25 bp, S. pombe
gctcctaaatttgctcctgctaaaa

SEQ ID NO: 86732 - DNA, 25 bp, S. pombe
gctccttactttccagctcaaaaaa

SEQ ID NO: 86733 - DNA, 25 bp, S. pombe
gctcctgtatctttcgctaacaaaa

SEQ ID NO: 86734 - DNA, 25 bp, S. pombe
gctcgtgagaatcctgctgctttga

SEQ ID NO: 86735 - DNA, 25 bp, S. pombe
gctcatgacgaacactctattccaa

SEQ ID NO: 86736 - DNA, 25 bp, S. pombe
gctattacatttttcactccacaag

SEQ ID NO: 86737 - DNA, 25 bp, S. pombe
gctcttcacgttgtaattcctcagg

SEQ ID NO: 86738 - DNA, 25 bp, S. pombe
gctcttccggtaatatatctttctg

SEQ ID NO: 86739 - DNA, 25 bp, S. pombe
gctcgtcaagttttatatgcgtttt

SEQ ID NO: 86740 - DNA, 25 bp, S. pombe
gctcctcacacaattttctgtctta

SEQ ID NO: 86741 - DNA, 25 bp, S. pombe
gctcctgcagaagtcgttcgtcaaa

SEQ ID NO: 86742 - DNA, 25 bp, S. pombe
gctccctttgcaattgaatgacgaa

SEQ ID NO: 86743 - DNA, 25 bp, S. pombe
gctccctctatgattggtactcgta

SEQ ID NO: 86744 - DNA, 25 bp, S. pombe
gctccctctatgaatatgtttgccc

SEQ ID NO: 86745 - DNA, 25 bp, S. pombe
gctcgcgattatctatcattccaca

SEQ ID NO: 86746 - DNA, 25 bp, S. pombe
gctaaattgatcctcattgccgcaa

SEQ ID NO: 86747 - DNA, 25 bp, S. pombe
gctaaagtaccctattctcgtcaat

SEQ ID NO: 86748 - DNA, 25 bp, S. pombe
gtaccgatcgcttaatttggaccgt

SEQ ID NO: 86749 - DNA, 25 bp, S. pombe
gctaggttcggtaatgctttgacac

SEQ ID NO: 86750 - DNA, 25 bp, S. pombe
gctcggtacatgcttatgcttgcta

SEQ ID NO: 86751 - DNA, 25 bp, S. pombe
gctcgggaatctgtatgcttgacat

SEQ ID NO: 86752 - DNA, 25 bp, S. pombe
gctatgccgcgaaaatgtttcccgg

SEQ ID NO: 86753 - DNA, 25 bp, S. pombe
gctaacgatgaatgccttcctgttt

SEQ ID NO: 86754 - DNA, 25 bp, S. pombe
gctaaagcttcttctcaggagattc

SEQ ID NO: 86755 - DNA, 25 bp, S. pombe
gctacagtcagtcttccagaacgtg

SEQ ID NO: 86756 - DNA, 25 bp, S. pombe
gctcgtcttatggagggatgctctt

SEQ ID NO: 86757 - DNA, 25 bp, S. pombe
gctcgtgatttagtacaggattttt

SEQ ID NO: 86758 - DNA, 25 bp, S. pombe
gctcgtctgcttttttgcatcttta

SEQ ID NO: 86759 - DNA, 25 bp, S. pombe
gctctgttgccttgatgcttgaatt

SEQ ID NO: 86760 - DNA, 25 bp, S. pombe
gctctgcttgtttgatgatcgcgtt

SEQ ID NO: 86761 - DNA, 25 bp, S. pombe
gctctatcgtctcaacgtatcttga

SEQ ID NO: 86762 - DNA, 25 bp, S. pombe
gctctaattctaccactgattctta

SEQ ID NO: 86763 - DNA, 25 bp, S. pombe
gctcttgtacctttgcatgcatgct

SEQ ID NO: 86764 - DNA, 25 bp, S. pombe
gctcatgtttcgtttggtgatccat

SEQ ID NO: 86765 - DNA, 25 bp, S. pombe
gctcttttacttggcgttcactata

SEQ ID NO: 86766 - DNA, 25 bp, S. pombe
gctaatggagacaacactgctacta

SEQ ID NO: 86767 - DNA, 25 bp, S. pombe
gctcaatccgtcaaactttctaggt

SEQ ID NO: 86768 - DNA, 25 bp, S. pombe
gctactccgttgtcagtttatggct

SEQ ID NO: 86769 - DNA, 25 bp, S. pombe
gctaccctacaattggcatccgtag

SEQ ID NO: 86770 - DNA, 25 bp, S. pombe
gctacccgactttctaacgtctttg

SEQ ID NO: 86771 - DNA, 25 bp, S. pombe
gctactcttcttttacaacgactaa

SEQ ID NO: 86772 - DNA, 25 bp, S. pombe
gctacgaattgttttcctcgtctaa

SEQ ID NO: 86773 - DNA, 25 bp, S. pombe
gcttcttgctaatattcccgttaca

SEQ ID NO: 86774 - DNA, 25 bp, S. pombe
gcattcgttaaacagtactccggaa

SEQ ID NO: 86775 - DNA, 25 bp, S. pombe
gctctttaaagtacacccttgctga

SEQ ID NO: 86776 - DNA, 25 bp, S. pombe
gcttttaaacaatgtcttggtctct

SEQ ID NO: 86777 - DNA, 25 bp, S. pombe
gaattgtctaaaacgttttctcctg

SEQ ID NO: 86778 - DNA, 25 bp, S. pombe
gctacgccatacagaggttattcca

SEQ ID NO: 86779 - DNA, 25 bp, S. pombe
gctctctacttttatggcgaccgaa

SEQ ID NO: 86780 - DNA, 25 bp, S. pombe
gctattactgttatgggcgccgatt

SEQ ID NO: 86781 - DNA, 25 bp, S. pombe
gcttctttcctaggaaatgcatttg

SEQ ID NO: 86782 - DNA, 25 bp, S. pombe
gctcttttcctgtcatcaaatcatt

SEQ ID NO: 86783 - DNA, 25 bp, S. pombe
gctcattcttcctcataacacattt

SEQ ID NO: 86784 - DNA, 25 bp, S. pombe
gctcgtgcttccatgcttaaattta

SEQ ID NO: 86785 - DNA, 25 bp, S. pombe
gctcgtgtgcatctggtgtttgtac

SEQ ID NO: 86786 - DNA, 25 bp, S. pombe
gctcgtgctcatcaattggttatgg

SEQ ID NO: 86787 - DNA, 25 bp, S. pombe
gctcgtgctcatcaacttgttcaag

SEQ ID NO: 86788 - DNA, 25 bp, S. pombe
gctctctgctcgtcaaatgcattta

SEQ ID NO: 86789 - DNA, 25 bp, S. pombe
gctacttagccaagcaagcctttga

SEQ ID NO: 86790 - DNA, 25 bp, S. pombe
gctactttgctataatccgttgtca

SEQ ID NO: 86791 - DNA, 25 bp, S. pombe
gctaaactgttaattcacgaatcta

SEQ ID NO: 86792 - DNA, 25 bp, S. pombe
gctcgatactttcttccatattcta

SEQ ID NO: 86793 - DNA, 25 bp, S. pombe
gctcaaacttctcgttcaactattc

SEQ ID NO: 86794 - DNA, 25 bp, S. pombe
gctacccctcaacatcaaaattcat

SEQ ID NO: 86795 - DNA, 25 bp, S. pombe
gcatacgtttagcattcaatcagga

SEQ ID NO: 86796 - DNA, 25 bp, S. pombe
gcattcgtgccgagtccaaaggtat

SEQ ID NO: 86797 - DNA, 25 bp, S. pombe
gctcattccgtcagtccaaaggtaa

SEQ ID NO: 86798 - DNA, 25 bp, S. pombe
gcttacctttcaaccaaacgaatat

SEQ ID NO: 86799 - DNA, 25 bp, S. pombe
gctaaccttccttctcaaatacaaa

SEQ ID NO: 86800 - DNA, 25 bp, S. pombe
gctcatcctttctttgctagtattg

SEQ ID NO: 86801 - DNA, 25 bp, S. pombe
gctctcctgtgttctctgatgaaat

SEQ ID NO: 86802 - DNA, 25 bp, S. pombe
gctaaaacggctttgcacacatggc

SEQ ID NO: 86803 - DNA, 25 bp, S. pombe
gctatggcttgtgatggctgcaaaa

SEQ ID NO: 86804 - DNA, 25 bp, S. pombe
gctagcgttgctgcacctaaagata

SEQ ID NO: 86805 - DNA, 25 bp, S. pombe
gctaactgtttacatgctgggcaca

SEQ ID NO: 86806 - DNA, 25 bp, S. pombe
gctatatcgggtgcaatctggaaca

SEQ ID NO: 86807 - DNA, 25 bp, S. pombe
gctcaggccgccttttgatgagaaa

SEQ ID NO: 86808 - DNA, 25 bp, S. pombe
gctctttccttgctacgatgatgtc

SEQ ID NO: 86809 - DNA, 25 bp, S. pombe
gctctcaatcctggttacgttacta

SEQ ID NO: 86810 - DNA, 25 bp, S. pombe
gctctcaatcgctgtaccaaattta

SEQ ID NO: 86811 - DNA, 25 bp, S. pombe
gcttacgctactatggctttacgag

SEQ ID NO: 86812 - DNA, 25 bp, S. pombe
gctctcgccatttcggaatctgttt

SEQ ID NO: 86813 - DNA, 25 bp, S. pombe
gctctcgatgcattccaaaactggg

SEQ ID NO: 86814 - DNA, 25 bp, S. pombe
gctctcgccgatgcttctatgaaat

SEQ ID NO: 86815 - DNA, 25 bp, S. pombe
gctactggcaacattatcaggacat

SEQ ID NO: 86816 - DNA, 25 bp, S. pombe
gctactagcaactcgcctcaagtga

SEQ ID NO: 86817 - DNA, 25 bp, S. pombe
gctacctttgataacagatgccctt

SEQ ID NO: 86818 - DNA, 25 bp, S. pombe
gctattgattttactttccgtccac

SEQ ID NO: 86819 - DNA, 25 bp, S. pombe
gcttactgctgatagtgttccgttc

SEQ ID NO: 86820 - DNA, 25 bp, S. pombe
gcttttggaaagcttctctgcctaa

SEQ ID NO: 86821 - DNA, 25 bp, S. pombe
gctctttaggagttgctttggcaaa

SEQ ID NO: 86822 - DNA, 25 bp, S. pombe
gctcttttgctgtcttctcttgaaa

SEQ ID NO: 86823 - DNA, 25 bp, S. pombe
gcttatgttgaagtcacgcccaaag

SEQ ID NO: 86824 - DNA, 25 bp, S. pombe
gctctctataggtaatcacgcacgt

SEQ ID NO: 86825 - DNA, 25 bp, S. pombe
gctctgcattgctaaggtttttgga

SEQ ID NO: 86826 - DNA, 25 bp, S. pombe
gctctcgcagaatggctgttttcta

SEQ ID NO: 86827 - DNA, 25 bp, S. pombe
gctctccgagacactatgctgatag

SEQ ID NO: 86828 - DNA, 25 bp, S. pombe
gctagcaaagattacaaccgtggca

SEQ ID NO: 86829 - DNA, 25 bp, S. pombe
gctcaaagacattaagacctgcgtt

SEQ ID NO: 86830 - DNA, 25 bp, S. pombe
gctctacaactacgaattctgcatt

SEQ ID NO: 86831 - DNA, 25 bp, S. pombe
gcagcaatgccacatggaggtccat

SEQ ID NO: 86832 - DNA, 25 bp, S. pombe
gctactctctgaatggcttgctgaa

SEQ ID NO: 86833 - DNA, 25 bp, S. pombe
gctcaatgcgcaattctttggccaa

SEQ ID NO: 86834 - DNA, 25 bp, S. pombe
gctcaacacattacatctcttgctg

SEQ ID NO: 86835 - DNA, 25 bp, S. pombe
gctcttgaattcgaatcggcagcca

SEQ ID NO: 86836 - DNA, 25 bp, S. pombe
gctcttgatcaagttcacggtgcca

SEQ ID NO: 86837 - DNA, 25 bp, S. pombe
gctatcaatgagatttctgagccca

SEQ ID NO: 86838 - DNA, 25 bp, S. pombe
gctacaagcgatgcagttgtccctg

SEQ ID NO: 86839 - DNA, 25 bp, S. pombe
gctcacaaccaatgtttccttctat

SEQ ID NO: 86840 - DNA, 25 bp, S. pombe
gctcaacctcaattattcccattaa

SEQ ID NO: 86841 - DNA, 25 bp, S. pombe
gctatagcaaatgcaccgcggcaaa

SEQ ID NO: 86842 - DNA, 25 bp, S. pombe
gctactgccattgaagcccttcgcc

SEQ ID NO: 86843 - DNA, 25 bp, S. pombe
gctactgctattgaggcccttcgtc

SEQ ID NO: 86844 - DNA, 25 bp, S. pombe
gctactctaagcttgagcaccttga

SEQ ID NO: 86845 - DNA, 25 bp, S. pombe
gctcattataacgttgcttctgcta

SEQ ID NO: 86846 - DNA, 25 bp, S. pombe
gctcatcttcaactgtttctacaac

SEQ ID NO: 86847 - DNA, 25 bp, S. pombe
gctcagctgttattgtgtttccatt

SEQ ID NO: 86848 - DNA, 25 bp, S. pombe
gctcagctgagcaaccatttgttat

SEQ ID NO: 86849 - DNA, 25 bp, S. pombe
gctcatagagctacctggcgttgta

SEQ ID NO: 86850 - DNA, 25 bp, S. pombe
gctaagatgctttcttctgctgtta

SEQ ID NO: 86851 - DNA, 25 bp, S. pombe
gctacatgattctctatctgcgcaa

SEQ ID NO: 86852 - DNA, 25 bp, S. pombe
gctcaatcattctctgcatctggat

SEQ ID NO: 86853 - DNA, 25 bp, S. pombe
gctaatcataaagtgcctgctgcaa

SEQ ID NO: 86854 - DNA, 25 bp, S. pombe
gctaccagttattcagctctcattt

SEQ ID NO: 86855 - DNA, 25 bp, S. pombe
gctacagcaagcaattcaccaattt

SEQ ID NO: 86856 - DNA, 25 bp, S. pombe
gctaatgaagctctgcgtgcagttt

SEQ ID NO: 86857 - DNA, 25 bp, S. pombe
gctatttggcccgtgttttacgaca

SEQ ID NO: 86858 - DNA, 25 bp, S. pombe
gctactggacttttttgttacgaca

SEQ ID NO: 86859 - DNA, 25 bp, S. pombe
gctttagcttctgttacacttaaac

SEQ ID NO: 86860 - DNA, 25 bp, S. pombe
gtaccgctcgcgctaacgaagatgg

SEQ ID NO: 86861 - DNA, 25 bp, S. pombe
gctaaggtctcttctctggaggaga

SEQ ID NO: 86862 - DNA, 25 bp, S. pombe
gctacgtctccttctttgaaacaag

SEQ ID NO: 86863 - DNA, 25 bp, S. pombe
gctactactcgtttcattgcacaaa

SEQ ID NO: 86864 - DNA, 25 bp, S. pombe
gctatgagtccattgaagttccaga

SEQ ID NO: 86865 - DNA, 25 bp, S. pombe
gctcatcccgcttatggaattccaa

SEQ ID NO: 86866 - DNA, 25 bp, S. pombe
gctcttcctgcttcttatgaattga

SEQ ID NO: 86867 - DNA, 25 bp, S. pombe
gctaaccgtcaccttgcatatgtaa

SEQ ID NO: 86868 - DNA, 25 bp, S. pombe
gctaaacttgagcttctttctgcag

SEQ ID NO: 86869 - DNA, 25 bp, S. pombe
gctaacgttaccttgatttctcctt

SEQ ID NO: 86870 - DNA, 25 bp, S. pombe
gctaagtttgccgaggttatcacca

SEQ ID NO: 86871 - DNA, 25 bp, S. pombe
gctaacttcattcctgctgtttatg

SEQ ID NO: 86872 - DNA, 25 bp, S. pombe
gctaatgctcaattcctgatgggtt

SEQ ID NO: 86873 - DNA, 25 bp, S. pombe
gctagtcccgaatctcagaatctgt

SEQ ID NO: 86874 - DNA, 25 bp, S. pombe
gctaggtgccgatttcacggttgat

SEQ ID NO: 86875 - DNA, 25 bp, S. pombe
gctacggctggatatacttgtctaa

SEQ ID NO: 86876 - DNA, 25 bp, S. pombe
gctttcctggttttattagttcatt

SEQ ID NO: 86877 - DNA, 25 bp, S. pombe
gcttttagctggaactggtcaggta

SEQ ID NO: 86878 - DNA, 25 bp, S. pombe
gctcaattatgtcgaaccgcctggt

SEQ ID NO: 86879 - DNA, 25 bp, S. pombe
gcttgaacagccttcagaggtctat

SEQ ID NO: 86880 - DNA, 25 bp, S. pombe
gctatgcttggcgttcgaggtttat

SEQ ID NO: 86881 - DNA, 25 bp, S. pombe
gcttgcattggttgggacgacacta

SEQ ID NO: 86882 - DNA, 25 bp, S. pombe
gctagatctctgcaaatgtcgccaa

SEQ ID NO: 86883 - DNA, 25 bp, S. pombe
gctacatcttatttcttcccaaatg

SEQ ID NO: 86884 - DNA, 25 bp, S. pombe
gctagctatgcttctggaatcggaa

SEQ ID NO: 86885 - DNA, 25 bp, S. pombe
gctactatggcagagcacatcgaaa

SEQ ID NO: 86886 - DNA, 25 bp, S. pombe
gctcagacggtcagtattttttcaa

SEQ ID NO: 86887 - DNA, 25 bp, S. pombe
gctatggctgttctgtttctttaaa

SEQ ID NO: 86888 - DNA, 25 bp, S. pombe
gctaaggtccctatttctgctaatc

SEQ ID NO: 86889 - DNA, 25 bp, S. pombe
gctaaaatctccattttgcgtccac

SEQ ID NO: 86890 - DNA, 25 bp, S. pombe
gcttaggaatttcagtacgcttaca

SEQ ID NO: 86891 - DNA, 25 bp, S. pombe
gctaaggagctttctggtaccgtta

SEQ ID NO: 86892 - DNA, 25 bp, S. pombe
gctaatgctggtattgcgattcccc

SEQ ID NO: 86893 - DNA, 25 bp, S. pombe
gctattcctgaaatggctttaccac

SEQ ID NO: 86894 - DNA, 25 bp, S. pombe
gcatttccggcttgacccaaaatcg

SEQ ID NO: 86895 - DNA, 25 bp, S. pombe
gctactacgttgtatacacaccctt

SEQ ID NO: 86896 - DNA, 25 bp, S. pombe
gcatttaatttgtccacaggccctt

SEQ ID NO: 86897 - DNA, 25 bp, S. pombe
gctacagtctgcgaaacgttggata

SEQ ID NO: 86898 - DNA, 25 bp, S. pombe
gctacgccatgctaaacttgaagat

SEQ ID NO: 86899 - DNA, 25 bp, S. pombe
gctaaccacttattgatgcccgaga

SEQ ID NO: 86900 - DNA, 25 bp, S. pombe
gctttgcccgattacagcactggaa

SEQ ID NO: 86901 - DNA, 25 bp, S. pombe
gctagcgaaggcactctcaacttga

SEQ ID NO: 86902 - DNA, 25 bp, S. pombe
gcttgccaaagatcctaatttcctc

SEQ ID NO: 86903 - DNA, 25 bp, S. pombe
gcaaccgacagatccacaatttggc

SEQ ID NO: 86904 - DNA, 25 bp, S. pombe
gcagaccttcctcgaaattttggca

SEQ ID NO: 86905 - DNA, 25 bp, S. pombe
gctagtcttccttagtatggttgca

SEQ ID NO: 86906 - DNA, 25 bp, S. pombe
gcttccattgctcgtaggtaccaaa

SEQ ID NO: 86907 - DNA, 25 bp, S. pombe
gcttcctcctttatcaggaccagga

SEQ ID NO: 86908 - DNA, 25 bp, S. pombe
gcattacccttacttctcgtaacgt

SEQ ID NO: 86909 - DNA, 25 bp, S. pombe
gtctaagttttctctttttggcaat

SEQ ID NO: 86910 - DNA, 25 bp, S. pombe
gcttttcttttatcgctttttcaat

SEQ ID NO: 86911 - DNA, 25 bp, S. pombe
gcacgttattacttcgaccttttag

SEQ ID NO: 86912 - DNA, 25 bp, S. pombe
gcatttcgtttagccaccatttctg

SEQ ID NO: 86913 - DNA, 25 bp, S. pombe
gctatcacgtagtaaccccatttat

SEQ ID NO: 86914 - DNA, 25 bp, S. pombe
gctaggacagctgaacccaggtttt

SEQ ID NO: 86915 - DNA, 25 bp, S. pombe
gctaatggcactaacacctcatggg

SEQ ID NO: 86916 - DNA, 25 bp, S. pombe
gcttcaagagaagacgcctcgcctt

SEQ ID NO: 86917 - DNA, 25 bp, S. pombe
gcttcaagaagagctccgggtcgaa

SEQ ID NO: 86918 - DNA, 25 bp, S. pombe
gctttacaagtctcaggcgttcgat

SEQ ID NO: 86919 - DNA, 25 bp, S. pombe
gcttttacaagcttctcggttagat

SEQ ID NO: 86920 - DNA, 25 bp, S. pombe
gctacttactcactctcgttaatta

SEQ ID NO: 86921 - DNA, 25 bp, S. pombe
gctttgttttacatgaacactccga

SEQ ID NO: 86922 - DNA, 25 bp, S. pombe
gcttaattctgtttccgaagtcaaa

SEQ ID NO: 86923 - DNA, 25 bp, S. pombe
gcttagcttactctccggatggaaa

SEQ ID NO: 86924 - DNA, 25 bp, S. pombe
gcttagtagaatctgctcgcggagt

SEQ ID NO: 86925 - DNA, 25 bp, S. pombe
gcttatgccgaattccttggtggta

SEQ ID NO: 86926 - DNA, 25 bp, S. pombe
gcttacacaatgttcctggttgctt

SEQ ID NO: 86927 - DNA, 25 bp, S. pombe
gcttaatactattccttctgcttct

SEQ ID NO: 86928 - DNA, 25 bp, S. pombe
gctttatcgcgaaactgttctttgt

SEQ ID NO: 86929 - DNA, 25 bp, S. pombe
gcttttgcagctctaactttttgtt

SEQ ID NO: 86930 - DNA, 25 bp, S. pombe
gctagtatctttgtcaatcttggaa

SEQ ID NO: 86931 - DNA, 25 bp, S. pombe
gctttttccatacacctatagagag

SEQ ID NO: 86932 - DNA, 25 bp, S. pombe
gcttctttcctaggaggtatagcaa

SEQ ID NO: 86933 - DNA, 25 bp, S. pombe
gcttaacttacctccagattcgatt

SEQ ID NO: 86934 - DNA, 25 bp, S. pombe
gcattaagctttgtacctcgagcgt

SEQ ID NO: 86935 - DNA, 25 bp, S. pombe
gcaatactcaaaaatcgtccgggat

SEQ ID NO: 86936 - DNA, 25 bp, S. pombe
gctactgtaaagatgcttccgggaa

SEQ ID NO: 86937 - DNA, 25 bp, S. pombe
gctacgtaaattctcagctcgtgga

SEQ ID NO: 86938 - DNA, 25 bp, S. pombe
gctacgtcgttttatcgcatctagt

SEQ ID NO: 86939 - DNA, 25 bp, S. pombe
gcttgacagggagctttccaatttt

SEQ ID NO: 86940 - DNA, 25 bp, S. pombe
gcactctaaaacctagtacctcttg

SEQ ID NO: 86941 - DNA, 25 bp, S. pombe
gcttcaaaaatggtttccgttctgg

SEQ ID NO: 86942 - DNA, 25 bp, S. pombe
gcttcaaaaatggtttccgttctgg

SEQ ID NO: 86943 - DNA, 25 bp, S. pombe
gctttggatccagaagtctctctag

SEQ ID NO: 86944 - DNA, 25 bp, S. pombe
gctttcggctcatagcagttactgg

SEQ ID NO: 86945 - DNA, 25 bp, S. pombe
gctagcttatattgcggccctgaag

SEQ ID NO: 86946 - DNA, 25 bp, S. pombe
gctagggatcttcgagctcaattag

SEQ ID NO: 86947 - DNA, 25 bp, S. pombe
gctactggtcttcatggtattcata

SEQ ID NO: 86948 - DNA, 25 bp, S. pombe
gctatccatggcaagcgtgttacca

SEQ ID NO: 86949 - DNA, 25 bp, S. pombe
gctattttcttgcttttgcaccgaa

SEQ ID NO: 86950 - DNA, 25 bp, S. pombe
gcttatactattctttctgacccag

SEQ ID NO: 86951 - DNA, 25 bp, S. pombe
gctttgtcggtgagttgcaacgcat

SEQ ID NO: 86952 - DNA, 25 bp, S. pombe
gcttcttgccttttttaaagcatct

SEQ ID NO: 86953 - DNA, 25 bp, S. pombe
gcttctaggttgtcatttgcgctga

SEQ ID NO: 86954 - DNA, 25 bp, S. pombe
gctttgcagtactatcatttggcca

SEQ ID NO: 86955 - DNA, 25 bp, S. pombe
gctatatttctccaagtttcctgtt

SEQ ID NO: 86956 - DNA, 25 bp, S. pombe
gctatatttagccaatcttaccctc

SEQ ID NO: 86957 - DNA, 25 bp, S. pombe
gctactgtcagctatactgatgcgt

SEQ ID NO: 86958 - DNA, 25 bp, S. pombe
gctactatgcccgatgttacttaca

SEQ ID NO: 86959 - DNA, 25 bp, S. pombe
gctatatcagctaccacttctttag

SEQ ID NO: 86960 - DNA, 25 bp, S. pombe
gcttctcacttatcaatggctaact

SEQ ID NO: 86961 - DNA, 25 bp, S. pombe
gctttcaagatcctattcgtgtccg

SEQ ID NO: 86962 - DNA, 25 bp, S. pombe
gcatttaaaccgatcattggcaaga

SEQ ID NO: 86963 - DNA, 25 bp, S. pombe
gctacttctgctctggacacaaata

SEQ ID NO: 86964 - DNA, 25 bp, S. pombe
gctagtatgatgtctcgtacaccaa

SEQ ID NO: 86965 - DNA, 25 bp, S. pombe
gctactcgactcgttatcgcagcaa

SEQ ID NO: 86966 - DNA, 25 bp, S. pombe
gctatttgatacagctgatgtacga

SEQ ID NO: 86967 - DNA, 25 bp, S. pombe
gctacgtctgactcgattactgaaa

SEQ ID NO: 86968 - DNA, 25 bp, S. pombe
gcatttacgctctcgttcaaggata

SEQ ID NO: 86969 - DNA, 25 bp, S. pombe
gcttcaacgttcttcgtgtcgttaa

SEQ ID NO: 86970 - DNA, 25 bp, S. pombe
gctatacaacttttactgctttacg

SEQ ID NO: 86971 - DNA, 25 bp, S. pombe
gctaaacagctttgtcattgcctta

SEQ ID NO: 86972 - DNA, 25 bp, S. pombe
gctacaacagtaattcaatgtccat

SEQ ID NO: 86973 - DNA, 25 bp, S. pombe
gctaccactttgttcatgcatttat

SEQ ID NO: 86974 - DNA, 25 bp, S. pombe
gctacatcatctattggcttttcgt

SEQ ID NO: 86975 - DNA, 25 bp, S. pombe
gctacacatctcattgttccagtat

SEQ ID NO: 86976 - DNA, 25 bp, S. pombe
gctacctgcgtattgtcctattatc

SEQ ID NO: 86977 - DNA, 25 bp, S. pombe
tgtaccgggtttgctttacccatag

SEQ ID NO: 86978 - DNA, 25 bp, S. pombe
gcttctaaagtttttgcggctgtaa

SEQ ID NO: 86979 - DNA, 25 bp, S. pombe
gcttctaaggttgctgatactcgta

SEQ ID NO: 86980 - DNA, 25 bp, S. pombe
gcatggtaaggttcgctaacacagt

SEQ ID NO: 86981 - DNA, 25 bp, S. pombe
gctattcacggaaaacgtgttacga

SEQ ID NO: 86982 - DNA, 25 bp, S. pombe
gctattcacggaaaacgtgttacga

SEQ ID NO: 86983 - DNA, 25 bp, S. pombe
gctactcaggtcttcaagttgctta

SEQ ID NO: 86984 - DNA, 25 bp, S. pombe
gctacacagaacacgagctggcctt

SEQ ID NO: 86985 - DNA, 25 bp, S. pombe
gcatccccatataaagagttcgttt

SEQ ID NO: 86986 - DNA, 25 bp, S. pombe
gctttcagctttgtatggtttgtca

SEQ ID NO: 86987 - DNA, 25 bp, S. pombe
gctttttctttatttgaccgccatg

SEQ ID NO: 86988 - DNA, 25 bp, S. pombe
gctttttcactttattgcgtaccaa

SEQ ID NO: 86989 - DNA, 25 bp, S. pombe
gcttcacgtcctcaattttctgata

SEQ ID NO: 86990 - DNA, 25 bp, S. pombe
gcttcgtggtggtaatttctctgca

SEQ ID NO: 86991 - DNA, 25 bp, S. pombe
gcactcggcgcacggttaagtattt

SEQ ID NO: 86992 - DNA, 25 bp, S. pombe
gacgggcgcaacgttaactgttcga

SEQ ID NO: 86993 - DNA, 25 bp, S. pombe
gcaagggccaccgttataacaactc

SEQ ID NO: 86994 - DNA, 25 bp, S. pombe
gctaccactcatgctgatctagtta

SEQ ID NO: 86995 - DNA, 25 bp, S. pombe
gctattcacgcagctgttcaagcaa

SEQ ID NO: 86996 - DNA, 25 bp, S. pombe
gctttaccgactaatgcacatccta

SEQ ID NO: 86997 - DNA, 25 bp, S. pombe
gcttttcgtagccttcatcatgttc

SEQ ID NO: 86998 - DNA, 25 bp, S. pombe
gcttctgttacacttaaactaaatg

SEQ ID NO: 86999 - DNA, 25 bp, S. pombe
gctactgagtgagtggtctccggaa

SEQ ID NO: 87000 - DNA, 25 bp, S. pombe
gctagtggaactttcaccatctcta

SEQ ID NO: 87001 - DNA, 25 bp, S. pombe
gctagcgcagatgtttcaagactta

SEQ ID NO: 87002 - DNA, 25 bp, S. pombe
gctagtgaattggttgccgacttta

SEQ ID NO: 87003 - DNA, 25 bp, S. pombe
gctagctgttgatctttggactgtt

SEQ ID NO: 87004 - DNA, 25 bp, S. pombe
gctactgctctaacttgcgtgtatt

SEQ ID NO: 87005 - DNA, 25 bp, S. pombe
gctagatatcttactcggaggtgaa

SEQ ID NO: 87006 - DNA, 25 bp, S. pombe
gcaatggaaaatgatgcactttcaa

SEQ ID NO: 87007 - DNA, 25 bp, S. pombe
gctatggtaattgatcctcccagaa

SEQ ID NO: 87008 - DNA, 25 bp, S. pombe
gcatcaggatatttcttcgacccag

SEQ ID NO: 87009 - DNA, 25 bp, S. pombe
gcatttacgagcaaggtcacctgaa

SEQ ID NO: 87010 - DNA, 25 bp, S. pombe
gcttctagcgataacgattcctccg

SEQ ID NO: 87011 - DNA, 25 bp, S. pombe
gctttcttagtcaatgtggctccaa

SEQ ID NO: 87012 - DNA, 25 bp, S. pombe
gctttcttaacatggcttcgctata

SEQ ID NO: 87013 - DNA, 25 bp, S. pombe
gctaccttagctgagtgcattcgtg

SEQ ID NO: 87014 - DNA, 25 bp, S. pombe
gctatccatgatccttactttgagt

SEQ ID NO: 87015 - DNA, 25 bp, S. pombe
gctactgctgccaattacattatga

SEQ ID NO: 87016 - DNA, 25 bp, S. pombe
gctagcagtgggtcttctccttaat

SEQ ID NO: 87017 - DNA, 25 bp, S. pombe
gcttgtcgtagagacttggctaata

SEQ ID NO: 87018 - DNA, 25 bp, S. pombe
gctattcaggaagcccatactataa

SEQ ID NO: 87019 - DNA, 25 bp, S. pombe
gcatcttcggaagccatttctcaat

SEQ ID NO: 87020 - DNA, 25 bp, S. pombe
gcttcatctgggttccttacaaatt

SEQ ID NO: 87021 - DNA, 25 bp, S. pombe
gcttgcaatggatgaacgcgctgaa

SEQ ID NO: 87022 - DNA, 25 bp, S. pombe
gctatagtcaatcgtatgcgccggt

SEQ ID NO: 87023 - DNA, 25 bp, S. pombe
gctataggttcatttgcagtcggat

SEQ ID NO: 87024 - DNA, 25 bp, S. pombe
gcttagtagctattctgctgtcagt

SEQ ID NO: 87025 - DNA, 25 bp, S. pombe
gctttgctattactgcgggatgatc

SEQ ID NO: 87026 - DNA, 25 bp, S. pombe
gcttttcttcaacatggaatccgca

SEQ ID NO: 87027 - DNA, 25 bp, S. pombe
gctttataccggcttttctcacaaa

SEQ ID NO: 87028 - DNA, 25 bp, S. pombe
gcttttgcaccgcagattttctaat

SEQ ID NO: 87029 - DNA, 25 bp, S. pombe
gcttattacgcaacacttcgtgcaa

SEQ ID NO: 87030 - DNA, 25 bp, S. pombe
gctattgaagcactggttgtttgaa

SEQ ID NO: 87031 - DNA, 25 bp, S. pombe
gcaccttcaacaaccgctgtagatg

SEQ ID NO: 87032 - DNA, 25 bp, S. pombe
gcacgttaactagcgatcttgagaa

SEQ ID NO: 87033 - DNA, 25 bp, S. pombe
gcttttaaatgaggctgatctaagt

SEQ ID NO: 87034 - DNA, 25 bp, S. pombe
gctatgccttacaaccttcgtatat

SEQ ID NO: 87035 - DNA, 25 bp, S. pombe
gcttagttcctattcctttcatatt

SEQ ID NO: 87036 - DNA, 25 bp, S. pombe
gctattgtacagcagaccattcgca

SEQ ID NO: 87037 - DNA, 25 bp, S. pombe
gctatggctccatcaacaatatgtg

SEQ ID NO: 87038 - DNA, 25 bp, S. pombe
gctaccccacataaacgcagagttt

SEQ ID NO: 87039 - DNA, 25 bp, S. pombe
gctagcaccgatttttcaacttcat

SEQ ID NO: 87040 - DNA, 25 bp, S. pombe
gctacgcaggtattttacacttcaa

SEQ ID NO: 87041 - DNA, 25 bp, S. pombe
gctatcaagttaattccacctgctc

SEQ ID NO: 87042 - DNA, 25 bp, S. pombe
gctatcattgactacattccactac

SEQ ID NO: 87043 - DNA, 25 bp, S. pombe
gctatcgagcaaaccatcacttggg

SEQ ID NO: 87044 - DNA, 25 bp, S. pombe
gctatcaattatcagggccgtcctt

SEQ ID NO: 87045 - DNA, 25 bp, S. pombe
gctatcgttacatggtacttgccta

SEQ ID NO: 87046 - DNA, 25 bp, S. pombe
gctagcgttacgtggtttgtctaat

SEQ ID NO: 87047 - DNA, 25 bp, S. pombe
gctaccataacgctagtttgtctat

SEQ ID NO: 87048 - DNA, 25 bp, S. pombe
gcttcgaaatctctaaactcgcttt

SEQ ID NO: 87049 - DNA, 25 bp, S. pombe
gctttaaatagcatggatcgtcctt

SEQ ID NO: 87050 - DNA, 25 bp, S. pombe
gctacgttgattttgagacccctga

SEQ ID NO: 87051 - DNA, 25 bp, S. pombe
gctacgattcttttgaaaccgctga

SEQ ID NO: 87052 - DNA, 25 bp, S. pombe
gcatacgagttttttctacgccttc

SEQ ID NO: 87053 - DNA, 25 bp, S. pombe
gcatagtttcttcttctaaccttca

SEQ ID NO: 87054 - DNA, 25 bp, S. pombe
gctttttccatcgttatacacctat

SEQ ID NO: 87055 - DNA, 25 bp, S. pombe
gctttgcttatctgtcttcacaagg

SEQ ID NO: 87056 - DNA, 25 bp, S. pombe
gcttcgctcgaaaatctgttttctc

SEQ ID NO: 87057 - DNA, 25 bp, S. pombe
gcttcctcggatgattttgcattca

SEQ ID NO: 87058 - DNA, 25 bp, S. pombe
gctatggctagattaaactcgtttc

SEQ ID NO: 87059 - DNA, 25 bp, S. pombe
gcttgaggcttaccacataaattgt

SEQ ID NO: 87060 - DNA, 25 bp, S. pombe
gcttgaacccgagacatccatatat

SEQ ID NO: 87061 - DNA, 25 bp, S. pombe
gctatttctcaaaacaacctggcat

SEQ ID NO: 87062 - DNA, 25 bp, S. pombe
gctttcacgttgatgctagcgcaag

SEQ ID NO: 87063 - DNA, 25 bp, S. pombe
gcttttcgttagtcatcaggcacat

SEQ ID NO: 87064 - DNA, 25 bp, S. pombe
gctttatgcttatgaccacgaccat

SEQ ID NO: 87065 - DNA, 25 bp, S. pombe
gcttaagtctcttggctacgatcaa

SEQ ID NO: 87066 - DNA, 25 bp, S. pombe
gcttactgtcttgctgcatatcgaa

SEQ ID NO: 87067 - DNA, 25 bp, S. pombe
gctagtcgcatcttcttcggatatg

SEQ ID NO: 87068 - DNA, 25 bp, S. pombe
gcttctgcgctatgcattcatggca

SEQ ID NO: 87069 - DNA, 25 bp, S. pombe
gctttgatcatcaacatcctggata

SEQ ID NO: 87070 - DNA, 25 bp, S. pombe
gctttctctctgttccatggaaatg

SEQ ID NO: 87071 - DNA, 25 bp, S. pombe
gcttttctcactgcgatgggtagta

SEQ ID NO: 87072 - DNA, 25 bp, S. pombe
gctagcagccgcaattgattatgaa

SEQ ID NO: 87073 - DNA, 25 bp, S. pombe
gcatgccaagcacttttaccattga

SEQ ID NO: 87074 - DNA, 25 bp, S. pombe
gctagcaatgcactttttctttacg

SEQ ID NO: 87075 - DNA, 25 bp, S. pombe
gctagatatgccttgtgtttacttt

SEQ ID NO: 87076 - DNA, 25 bp, S. pombe
gctagtatcgccttttctgaatctt

SEQ ID NO: 87077 - DNA, 25 bp, S. pombe
gcttgcactagcacttgagtttacc

SEQ ID NO: 87078 - DNA, 25 bp, S. pombe
gcttgctggccttagagtttttgat

SEQ ID NO: 87079 - DNA, 25 bp, S. pombe
gcttgcatggtacggacacttttgt

SEQ ID NO: 87080 - DNA, 25 bp, S. pombe
gctatcttctattccacgtttttgt

SEQ ID NO: 87081 - DNA, 25 bp, S. pombe
gcttccctattccacgatttattgt

SEQ ID NO: 87082 - DNA, 25 bp, S. pombe
gcttctgctaagcttcgaagtgctt

SEQ ID NO: 87083 - DNA, 25 bp, S. pombe
gctatccataactttgcccaatcat

SEQ ID NO: 87084 - DNA, 25 bp, S. pombe
gctatccagaagctacatccaatat

SEQ ID NO: 87085 - DNA, 25 bp, S. pombe
gcttctagtatttccagtcaagatg

SEQ ID NO: 87086 - DNA, 25 bp, S. pombe
gcttcattttcttcgcagtattctc

SEQ ID NO: 87087 - DNA, 25 bp, S. pombe
gctttttgtcccgattttcttattg

SEQ ID NO: 87088 - DNA, 25 bp, S. pombe
gcttctattcatcagaacgtcgcca

SEQ ID NO: 87089 - DNA, 25 bp, S. pombe
gcttcggtagaaactttgcgtcaaa

SEQ ID NO: 87090 - DNA, 25 bp, S. pombe
gcttcatgggcaaaaggcgctctta

SEQ ID NO: 87091 - DNA, 25 bp, S. pombe
gcattgcagtgactcaaaccccgaa

SEQ ID NO: 87092 - DNA, 25 bp, S. pombe
gcagctaagcaacatgtcgtccaac

SEQ ID NO: 87093 - DNA, 25 bp, S. pombe
gcattcttaaggttactggtccatc

SEQ ID NO: 87094 - DNA, 25 bp, S. pombe
gttgtgtaacggctgctgaatctat

SEQ ID NO: 87095 - DNA, 25 bp, S. pombe
gcttctttactccttcatgaatcga

SEQ ID NO: 87096 - DNA, 25 bp, S. pombe
gctagtgaagctccagatgccttgg

SEQ ID NO: 87097 - DNA, 25 bp, S. pombe
gctatgtacaatgagatgactgtca

SEQ ID NO: 87098 - DNA, 25 bp, S. pombe
gcagagcccgactggatatccaaca

SEQ ID NO: 87099 - DNA, 25 bp, S. pombe
gcaggctcatccaatgggtcagcaa

SEQ ID NO: 87100 - DNA, 25 bp, S. pombe
gcttcccaaacgtcttgatcgggtt

SEQ ID NO: 87101 - DNA, 25 bp, S. pombe
gctatcaccttcttcatcattggat

SEQ ID NO: 87102 - DNA, 25 bp, S. pombe
gctttggcatgcttacaatttctat

SEQ ID NO: 87103 - DNA, 25 bp, S. pombe
gcttttagtcttgggtcctcacaaa

SEQ ID NO: 87104 - DNA, 25 bp, S. pombe
gctttgggtgctatttatcatacga

SEQ ID NO: 87105 - DNA, 25 bp, S. pombe
gcttgtggccgcatatgtacctaat

SEQ ID NO: 87106 - DNA, 25 bp, S. pombe
gtcaggacccgtttaccataatggc

SEQ ID NO: 87107 - DNA, 25 bp, S. pombe
gctattgcagacagcttggaccaaa

SEQ ID NO: 87108 - DNA, 25 bp, S. pombe
gcatttgagccaagcaagcgtccta

SEQ ID NO: 87109 - DNA, 25 bp, S. pombe
gctttatcaatctaaccctgtactt

SEQ ID NO: 87110 - DNA, 25 bp, S. pombe
gcttcttaaacaacctcagtactct

SEQ ID NO: 87111 - DNA, 25 bp, S. pombe
gctattgctgaatcttcatctacga

SEQ ID NO: 87112 - DNA, 25 bp, S. pombe
gcttgctatgttgctgagtctgacg

SEQ ID NO: 87113 - DNA, 25 bp, S. pombe
gcttcatgatgtggtgctggctgct

SEQ ID NO: 87114 - DNA, 25 bp, S. pombe
gcttcaatcgagtctgccatgtatg

SEQ ID NO: 87115 - DNA, 25 bp, S. pombe
gctatgctcgatatttgcttcctaa

SEQ ID NO: 87116 - DNA, 25 bp, S. pombe
gctatgcttgcattatgtctcgatt

SEQ ID NO: 87117 - DNA, 25 bp, S. pombe
gctatgtggctctttgtccttgtga

SEQ ID NO: 87118 - DNA, 25 bp, S. pombe
gctttcagatcgttcagttctttgc

SEQ ID NO: 87119 - DNA, 25 bp, S. pombe
gcttctctgtagctccatttttgga

SEQ ID NO: 87120 - DNA, 25 bp, S. pombe
gcttttccgctgcttgctattttaa

SEQ ID NO: 87121 - DNA, 25 bp, S. pombe
gcttattacgcctttctcgaattaa

SEQ ID NO: 87122 - DNA, 25 bp, S. pombe
gctttgaacacttttgctcctattt

SEQ ID NO: 87123 - DNA, 25 bp, S. pombe
gctattgaggcccttcgtcgttgtc

SEQ ID NO: 87124 - DNA, 25 bp, S. pombe
gctttatcccctcagtcgattgata

SEQ ID NO: 87125 - DNA, 25 bp, S. pombe
gcttttcaccttccaggcaagtatg

SEQ ID NO: 87126 - DNA, 25 bp, S. pombe
gcttatcccctatcggcagatgatt

SEQ ID NO: 87127 - DNA, 25 bp, S. pombe
gcttatcctcctaatcctgaaggga

SEQ ID NO: 87128 - DNA, 25 bp, S. pombe
gctttaatcgcttcattctccataa

SEQ ID NO: 87129 - DNA, 25 bp, S. pombe
gcttaccatcgcagcagtagtcaat

SEQ ID NO: 87130 - DNA, 25 bp, S. pombe
gctatccccatcatggtagctcaaa

SEQ ID NO: 87131 - DNA, 25 bp, S. pombe
gcttctcctatgactggtccaacaa

SEQ ID NO: 87132 - DNA, 25 bp, S. pombe
gcaggaagcgcgcattagttcgtat

SEQ ID NO: 87133 - DNA, 25 bp, S. pombe
gcagccaacgctccatttttggtag

SEQ ID NO: 87134 - DNA, 25 bp, S. pombe
gcatctaaactacatttgggtcgca

SEQ ID NO: 87135 - DNA, 25 bp, S. pombe
gcttaatcttacatttgagttgcaa

SEQ ID NO: 87136 - DNA, 25 bp, S. pombe
gcttgcattttagctgtgcgcgata

SEQ ID NO: 87137 - DNA, 25 bp, S. pombe
gctatatcggctttatctggactat

SEQ ID NO: 87138 - DNA, 25 bp, S. pombe
gcatagtcgcgtataccgattccaa

SEQ ID NO: 87139 - DNA, 25 bp, S. pombe
gctttctgagttaactggcattcca

SEQ ID NO: 87140 - DNA, 25 bp, S. pombe
gcttctactttgagttcacctttca

SEQ ID NO: 87141 - DNA, 25 bp, S. pombe
gctttctatattgggttgcctcttt

SEQ ID NO: 87142 - DNA, 25 bp, S. pombe
gctattgcttttgttctgactggtt

SEQ ID NO: 87143 - DNA, 25 bp, S. pombe
gcttcgttgttccaagtacttgtat

SEQ ID NO: 87144 - DNA, 25 bp, S. pombe
gcattttgtggtttgggcgtttact

SEQ ID NO: 87145 - DNA, 25 bp, S. pombe
gcttctgaagtgtcggcatctgtga

SEQ ID NO: 87146 - DNA, 25 bp, S. pombe
gcttgcaaatcaactcctatctgac

SEQ ID NO: 87147 - DNA, 25 bp, S. pombe
gctatttgcgacagccaagactcta

SEQ ID NO: 87148 - DNA, 25 bp, S. pombe
gctattcaagctcccttacttttaa

SEQ ID NO: 87149 - DNA, 25 bp, S. pombe
gcttgtgcaactttcttccattaaa

SEQ ID NO: 87150 - DNA, 25 bp, S. pombe
gcttctgcagacttagctttgctta

SEQ ID NO: 87151 - DNA, 25 bp, S. pombe
gctatataacccgatctcatgcatt

SEQ ID NO: 87152 - DNA, 25 bp, S. pombe
gctttaactccttctgatatgctct

SEQ ID NO: 87153 - DNA, 25 bp, S. pombe
gcttttactcacaacattactcttc

SEQ ID NO: 87154 - DNA, 25 bp, S. pombe
gcttttacttattggcgactctggt

SEQ ID NO: 87155 - DNA, 25 bp, S. pombe
gctattctcgattattcctcaactg

SEQ ID NO: 87156 - DNA, 25 bp, S. pombe
gcttttccatactagtgctacttca

SEQ ID NO: 87157 - DNA, 25 bp, S. pombe
gcttttcgcaagtatgtcctcaaat

SEQ ID NO: 87158 - DNA, 25 bp, S. pombe
gctattgccattttaccacagctac

SEQ ID NO: 87159 - DNA, 25 bp, S. pombe
gcttatgaacaagaccatgcccatg

SEQ ID NO: 87160 - DNA, 25 bp, S. pombe
gcattccatgaatccaacagcgtac

SEQ ID NO: 87161 - DNA, 25 bp, S. pombe
gcatcctcttcaacaaacggtactt

SEQ ID NO: 87162 - DNA, 25 bp, S. pombe
gcatcccagggccaaacgttggatt

SEQ ID NO: 87163 - DNA, 25 bp, S. pombe
gcatccttttctgttaccagtgcta

SEQ ID NO: 87164 - DNA, 25 bp, S. pombe
gcttctggtatctttctacctgaga

SEQ ID NO: 87165 - DNA, 25 bp, S. pombe
gcttctagtgaatctgccaacggca

SEQ ID NO: 87166 - DNA, 25 bp, S. pombe
gctttatggcaattacacaacggag

SEQ ID NO: 87167 - DNA, 25 bp, S. pombe
gcatttttctcacatagttccgcta

SEQ ID NO: 87168 - DNA, 25 bp, S. pombe
gcttagtatttgctgttgcccgaga

SEQ ID NO: 87169 - DNA, 25 bp, S. pombe
gcttttccagcgatattccttggga

SEQ ID NO: 87170 - DNA, 25 bp, S. pombe
gctttcatccgtgctttagtggtta

SEQ ID NO: 87171 - DNA, 25 bp, S. pombe
gcattatactcccttcgttttgaaa

SEQ ID NO: 87172 - DNA, 25 bp, S. pombe
gcattgacacctattcaccttttat

SEQ ID NO: 87173 - DNA, 25 bp, S. pombe
gcttcaaatgctggtaccgttgttt

SEQ ID NO: 87174 - DNA, 25 bp, S. pombe
gcttcaaatgcgcttaccatcagtt

SEQ ID NO: 87175 - DNA, 25 bp, S. pombe
gcttttattgactgtggaggcgttc

SEQ ID NO: 87176 - DNA, 25 bp, S. pombe
gcttttgaatactgggctgcacgga

SEQ ID NO: 87177 - DNA, 25 bp, S. pombe
gctttacaatactttggcccatgaa

SEQ ID NO: 87178 - DNA, 25 bp, S. pombe
gctttcacatggacttttgccttag

SEQ ID NO: 87179 - DNA, 25 bp, S. pombe
gctttccatgatacttatttcgttg

SEQ ID NO: 87180 - DNA, 25 bp, S. pombe
gcttgtccatatttcagtgtgctga

SEQ ID NO: 87181 - DNA, 25 bp, S. pombe
gcttcccctgaacgtatgcataatg

SEQ ID NO: 87182 - DNA, 25 bp, S. pombe
gctttgtctaaggactcggaaacca

SEQ ID NO: 87183 - DNA, 25 bp, S. pombe
gcttaccagggccatttggactaca

SEQ ID NO: 87184 - DNA, 25 bp, S. pombe
gcttaggcatgaaccggcttggaaa

SEQ ID NO: 87185 - DNA, 25 bp, S. pombe
gctttacatctagctggcgtcgata

SEQ ID NO: 87186 - DNA, 25 bp, S. pombe
gcttattgacttgtgcgttcgtatc

SEQ ID NO: 87187 - DNA, 25 bp, S. pombe
gcttttagttgcttcgtttattcca

SEQ ID NO: 87188 - DNA, 25 bp, S. pombe
gcttattatttggtgtattttgatt

SEQ ID NO: 87189 - DNA, 25 bp, S. pombe
gcttttatattaggtatgtgtattc

SEQ ID NO: 87190 - DNA, 25 bp, S. pombe
gctttactacttgcatatgtccgtc

SEQ ID NO: 87191 - DNA, 25 bp, S. pombe
gctttaatttcataccacttcgcaa

SEQ ID NO: 87192 - DNA, 25 bp, S. pombe
gcatttactgaatctccttgtggaa

SEQ ID NO: 87193 - DNA, 25 bp, S. pombe
gcatttacaagatccccgatggcaa

SEQ ID NO: 87194 - DNA, 25 bp, S. pombe
gcttgaggaaatggcccgctattca

SEQ ID NO: 87195 - DNA, 25 bp, S. pombe
gcattgggttatggtacgccttcat

SEQ ID NO: 87196 - DNA, 25 bp, S. pombe
gcatctggcgtttttactggtactt

SEQ ID NO: 87197 - DNA, 25 bp, S. pombe
gcttccagctcgtttactcgaaaat

SEQ ID NO: 87198 - DNA, 25 bp, S. pombe
gctttagctgctgttgagcttaaac

SEQ ID NO: 87199 - DNA, 25 bp, S. pombe
gctttccaaggcgtttctttcaata

SEQ ID NO: 87200 - DNA, 25 bp, S. pombe
gcttgtccaaggctttccatagatt

SEQ ID NO: 87201 - DNA, 25 bp, S. pombe
gcttctgttaatggtttgccgatac

SEQ ID NO: 87202 - DNA, 25 bp, S. pombe
gctttcgtcaaggattgtgcccata

SEQ ID NO: 87203 - DNA, 25 bp, S. pombe
gctttcgatgcttggtttgggtgac

SEQ ID NO: 87204 - DNA, 25 bp, S. pombe
gcattgaaactgatggatggactcc

SEQ ID NO: 87205 - DNA, 25 bp, S. pombe
gcttgggatctgttgagcttcacaa

SEQ ID NO: 87206 - DNA, 25 bp, S. pombe
gcttcatgtgatcattgagccccat

SEQ ID NO: 87207 - DNA, 25 bp, S. pombe
gcttgccatgatctgggtgcctata

SEQ ID NO: 87208 - DNA, 25 bp, S. pombe
gcttccttttggtattcaatccgca

SEQ ID NO: 87209 - DNA, 25 bp, S. pombe
gctttattcctgatggccaacacat

SEQ ID NO: 87210 - DNA, 25 bp, S. pombe
gctttactctctataatacccatct

SEQ ID NO: 87211 - DNA, 25 bp, S. pombe
gcttcttccttgataaacgctatga

SEQ ID NO: 87212 - DNA, 25 bp, S. pombe
gcttttgaagccatttatccagtat

SEQ ID NO: 87213 - DNA, 25 bp, S. pombe
gcttttgacgctcatgtttcaggta

SEQ ID NO: 87214 - DNA, 25 bp, S. pombe
gcttcttacagctcttcttatgatc

SEQ ID NO: 87215 - DNA, 25 bp, S. pombe
gcatccttcaagttttcgtacacct

SEQ ID NO: 87216 - DNA, 25 bp, S. pombe
gcattcgttaattttggcataccct

SEQ ID NO: 87217 - DNA, 25 bp, S. pombe
gcatcgccctaatgtttgattccat

SEQ ID NO: 87218 - DNA, 25 bp, S. pombe
gcttatgactgatcgtgttttgcca

SEQ ID NO: 87219 - DNA, 25 bp, S. pombe
gctttagtatgctttcttttgccaa

SEQ ID NO: 87220 - DNA, 25 bp, S. pombe
gctttttatgtgctgcttatccaaa

SEQ ID NO: 87221 - DNA, 25 bp, S. pombe
gcttcttcaactagagtatctcccg

SEQ ID NO: 87222 - DNA, 25 bp, S. pombe
gcttatgacgcagggttatctccac

SEQ ID NO: 87223 - DNA, 25 bp, S. pombe
gcttcagatgcgtagctttttccaa

SEQ ID NO: 87224 - DNA, 25 bp, S. pombe
gcttagtctgctcttatgttcatga

SEQ ID NO: 87225 - DNA, 25 bp, S. pombe
gcatgggttgctctctaactataca

SEQ ID NO: 87226 - DNA, 25 bp, S. pombe
gcatagtatgtctctgcgacacaaa

SEQ ID NO: 87227 - DNA, 25 bp, S. pombe
gcatttttatgcactttactacttt

SEQ ID NO: 87228 - DNA, 25 bp, S. pombe
gcttatcccatcatctttagcgaga

SEQ ID NO: 87229 - DNA, 25 bp, S. pombe
gcattatccgttagtcgttcgtcag

SEQ ID NO: 87230 - DNA, 25 bp, S. pombe
gcatttcctcaaattcagtacgctt

SEQ ID NO: 87231 - DNA, 25 bp, S. pombe
gcttcattatttactggtccatctt

SEQ ID NO: 87232 - DNA, 25 bp, S. pombe
gcttttcattcgtttgtactctcaa

SEQ ID NO: 87233 - DNA, 25 bp, S. pombe
gcttattgcttccattttcacgtaa

SEQ ID NO: 87234 - DNA, 25 bp, S. pombe
gcttattcttactatcgcttcgata

SEQ ID NO: 87235 - DNA, 25 bp, S. pombe
gctttttctgaccactgcatttgat

SEQ ID NO: 87236 - DNA, 25 bp, S. pombe
gcttttctttggactgctttacatg

SEQ ID NO: 87237 - DNA, 25 bp, S. pombe
gcatgttctttttacttgttccagc

SEQ ID NO: 87238 - DNA, 25 bp, S. pombe
gcttatctgtttgacgttctttcga

SEQ ID NO: 87239 - DNA, 25 bp, S. pombe
gcagctacgttctgactgttttgta

SEQ ID NO: 87240 - DNA, 25 bp, S. pombe
gcaaaccttgccaacgttagtatat

SEQ ID NO: 87241 - DNA, 25 bp, S. pombe
gcagatacccgtttgtagctaataa

SEQ ID NO: 87242 - DNA, 25 bp, S. pombe
gcttcccctgtctctgacaatgtaa

SEQ ID NO: 87243 - DNA, 25 bp, S. pombe
gcttcagcccgttgtcaaatttcaa

SEQ ID NO: 87244 - DNA, 25 bp, S. pombe
gcatgtggtaaattatttcgcgtcg

SEQ ID NO: 87245 - DNA, 25 bp, S. pombe
gcattggtagtgtatcctttcggaa

SEQ ID NO: 87246 - DNA, 25 bp, S. pombe
gcttaactttcttgaactcctaggg

SEQ ID NO: 87247 - DNA, 25 bp, S. pombe
gcatctgcgcgatctaaagaaccat

SEQ ID NO: 87248 - DNA, 25 bp, S. pombe
gcattgcgaataatttcaagacact

SEQ ID NO: 87249 - DNA, 25 bp, S. pombe
gagcgacgacgacttatggcatact

SEQ ID NO: 87250 - DNA, 25 bp, S. pombe
gcttctgctagtttgattgtctctg

SEQ ID NO: 87251 - DNA, 25 bp, S. pombe
gcttgtgtcccattaattcctggaa

SEQ ID NO: 87252 - DNA, 25 bp, S. pombe
gcttgccaatccttagattctcgtg

SEQ ID NO: 87253 - DNA, 25 bp, S. pombe
gcttctaagcgctattgattctgtc

SEQ ID NO: 87254 - DNA, 25 bp, S. pombe
gcttcgtgatgctatgatggattct

SEQ ID NO: 87255 - DNA, 25 bp, S. pombe
gcattcgtatgccaaggtccgttaa

SEQ ID NO: 87256 - DNA, 25 bp, S. pombe
gcatcggtggatgcgttccaaggaa

SEQ ID NO: 87257 - DNA, 25 bp, S. pombe
gcttcctcgatcgatcattatgcga

SEQ ID NO: 87258 - DNA, 25 bp, S. pombe
gcttgatactggagatgatacgcta

SEQ ID NO: 87259 - DNA, 25 bp, S. pombe
gcttaggttgtcttactcatccaaa

SEQ ID NO: 87260 - DNA, 25 bp, S. pombe
gcattcgtttaattcctacggagca

SEQ ID NO: 87261 - DNA, 25 bp, S. pombe
gcttggatttgcaaaccgacggaat

SEQ ID NO: 87262 - DNA, 25 bp, S. pombe
gcttttactacgacatggtgctgca

SEQ ID NO: 87263 - DNA, 25 bp, S. pombe
gcttttgcgctggttcagagctaat

SEQ ID NO: 87264 - DNA, 25 bp, S. pombe
gcttgtggcgatggaccgagcaatt

SEQ ID NO: 87265 - DNA, 25 bp, S. pombe
gcatatggttgtttcacggactttc

SEQ ID NO: 87266 - DNA, 25 bp, S. pombe
gcaggtggtgtattccctttttcgg

SEQ ID NO: 87267 - DNA, 25 bp, S. pombe
gcagcacgggtatagcgatcctaga

SEQ ID NO: 87268 - DNA, 25 bp, S. pombe
gcatctgggtcttaacgatcctatc

SEQ ID NO: 87269 - DNA, 25 bp, S. pombe
gcttgcgattattgtaactcctact

SEQ ID NO: 87270 - DNA, 25 bp, S. pombe
gcttgctgtttacaatccagacact

SEQ ID NO: 87271 - DNA, 25 bp, S. pombe
gcttgcttttataaaatatgatccc

SEQ ID NO: 87272 - DNA, 25 bp, S. pombe
gcttctttatgtacagttgatcccc

SEQ ID NO: 87273 - DNA, 25 bp, S. pombe
gcattttctagacgcagggacccga

SEQ ID NO: 87274 - DNA, 25 bp, S. pombe
gcattcgtgtagttcgcgcgggaaa

SEQ ID NO: 87275 - DNA, 25 bp, S. pombe
gcattgccaagcgttctagagtgaa

SEQ ID NO: 87276 - DNA, 25 bp, S. pombe
gcttgccaaggctgcgcgtcaaaac

SEQ ID NO: 87277 - DNA, 25 bp, S. pombe
gcatacattagctgctcgcattaca

SEQ ID NO: 87278 - DNA, 25 bp, S. pombe
gcattgcttcaatcaccttatcttg

SEQ ID NO: 87279 - DNA, 25 bp, S. pombe
gcttgcaggcgccagcaaatacaaa

SEQ ID NO: 87280 - DNA, 25 bp, S. pombe
gcttgcgtcgctcatcaagtcaaag

SEQ ID NO: 87281 - DNA, 25 bp, S. pombe
gcttacgctgtacttcatcatttgg

SEQ ID NO: 87282 - DNA, 25 bp, S. pombe
gcttatcgttggcatctgctgatga

SEQ ID NO: 87283 - DNA, 25 bp, S. pombe
gcttctggttgtacatatgctggac

SEQ ID NO: 87284 - DNA, 25 bp, S. pombe
gcttgtttcatgtactatcgggcca

SEQ ID NO: 87285 - DNA, 25 bp, S. pombe
gcttcttacatatctcgctcgagta

SEQ ID NO: 87286 - DNA, 25 bp, S. pombe
gcttgataactgtcgccagctggat

SEQ ID NO: 87287 - DNA, 25 bp, S. pombe
gcatattcaacgtgccaaggctgag

SEQ ID NO: 87288 - DNA, 25 bp, S. pombe
gcttgacattgcgacgtatcatgga

SEQ ID NO: 87289 - DNA, 25 bp, S. pombe
gcttacattccaggtatcggtcata

SEQ ID NO: 87290 - DNA, 25 bp, S. pombe
gcttgacatttcgtttgtttgcaga

SEQ ID NO: 87291 - DNA, 25 bp, S. pombe
gcttcctttaagtgcatttgaacat

SEQ ID NO: 87292 - DNA, 25 bp, S. pombe
gcagacccttatgaagctttacgca

SEQ ID NO: 87293 - DNA, 25 bp, S. pombe
gcattggcttattggcgtctaggat

SEQ ID NO: 87294 - DNA, 25 bp, S. pombe
gcttcgcttcattcacgtacaatgg

SEQ ID NO: 87295 - DNA, 25 bp, S. pombe
gcttcaatcatccagagtccagaca

SEQ ID NO: 87296 - DNA, 25 bp, S. pombe
gcttccatccattgagaccataatc

SEQ ID NO: 87297 - DNA, 25 bp, S. pombe
gcttgtgcccagcagacaaattcga

SEQ ID NO: 87298 - DNA, 25 bp, S. pombe
gcttatgccacatgcgatatccatt

SEQ ID NO: 87299 - DNA, 25 bp, S. pombe
gcttatgctcctgaatctcaatgta

SEQ ID NO: 87300 - DNA, 25 bp, S. pombe
gcttagtgcctaatgctcttttatt

SEQ ID NO: 87301 - DNA, 25 bp, S. pombe
gcttagtccactagatgctgtctat

SEQ ID NO: 87302 - DNA, 25 bp, S. pombe
gcttcagttcacgagcagtgcacta

SEQ ID NO: 87303 - DNA, 25 bp, S. pombe
gcatgggactaatccaactgctggt

SEQ ID NO: 87304 - DNA, 25 bp, S. pombe
gcatgcacgagtagtaccaacgcta

SEQ ID NO: 87305 - DNA, 25 bp, S. pombe
gcttgcagctataataccggcgact

SEQ ID NO: 87306 - DNA, 25 bp, S. pombe
gcttctttcatgagcagcgtcagac

SEQ ID NO: 87307 - DNA, 25 bp, S. pombe
gcttcactaatgacgatgcggttca

SEQ ID NO: 87308 - DNA, 25 bp, S. pombe
gcttactcatcttctggcgacagtt

SEQ ID NO: 87309 - DNA, 25 bp, S. pombe
gcattcatttgtgcctccaaacttt

SEQ ID NO: 87310 - DNA, 25 bp, S. pombe
gcttcttgggagacattactacttt

SEQ ID NO: 87311 - DNA, 25 bp, S. pombe
gcttgtatggttcttcactatctaa

SEQ ID NO: 87312 - DNA, 25 bp, S. pombe
gcttccttcatacttcttcaaaaac

SEQ ID NO: 87313 - DNA, 25 bp, S. pombe
gcttctgtaggtgatcgtgcactta

SEQ ID NO: 87314 - DNA, 25 bp, S. pombe
gcttggtagtcggttgattgcttca

SEQ ID NO: 87315 - DNA, 25 bp, S. pombe
gcttcgctaggacattgcatcgtaa

SEQ ID NO: 87316 - DNA, 25 bp, S. pombe
gcttcgcaaagatatggctcgtgtt

SEQ ID NO: 87317 - DNA, 25 bp, S. pombe
gcattacattacagatgcccgcatt

SEQ ID NO: 87318 - DNA, 25 bp, S. pombe
gcattagcctatcaagtctcagaat

SEQ ID NO: 87319 - DNA, 25 bp, S. pombe
gcaaaagcttgccaaggctgcgcgt

SEQ ID NO: 87320 - DNA, 25 bp, S. pombe
gcataacggcgcctgttgaacatca

SEQ ID NO: 87321 - DNA, 25 bp, S. pombe
gcatttttgcactatgttgaatcca

SEQ ID NO: 87322 - DNA, 25 bp, S. pombe
gcttgtttgggttctttcacatcat

SEQ ID NO: 87323 - DNA, 25 bp, S. pombe
gcattcttcgtgatcttcatggtca

SEQ ID NO: 87324 - DNA, 25 bp, S. pombe
gcatagctctcgtgattccagggaa

SEQ ID NO: 87325 - DNA, 25 bp, S. pombe
gcttgcttcagcttgggcagagaaa

SEQ ID NO: 87326 - DNA, 25 bp, S. pombe
gcatcgctatcacctaggagcagaa

SEQ ID NO: 87327 - DNA, 25 bp, S. pombe
gcaatgttgcatcctgagtcagcgg

SEQ ID NO: 87328 - DNA, 25 bp, S. pombe
gcattgtgcatgacgctgactcaaa

SEQ ID NO: 87329 - DNA, 25 bp, S. pombe
gcatctggatccgtaactcaaactc

SEQ ID NO: 87330 - DNA, 25 bp, S. pombe
gcatcgttcgactttcattgtattg

SEQ ID NO: 87331 - DNA, 25 bp, S. pombe
gcatcagatgccgaccttaataatt

SEQ ID NO: 87332 - DNA, 25 bp, S. pombe
gcataagcctgcttctttcaaaagg

SEQ ID NO: 87333 - DNA, 25 bp, S. pombe
gcattcacctcattccgtaaaattg

SEQ ID NO: 87334 - DNA, 25 bp, S. pombe
tcgtcccgaagctagatttaccagt

SEQ ID NO: 87335 - DNA, 25 bp, S. pombe
gactagtcgtgtgtgggatcaccat

SEQ ID NO: 87336 - DNA, 25 bp, S. pombe
gcagtattcggtgttggcatattac

SEQ ID NO: 87337 - DNA, 25 bp, S. pombe
gcttcccggtgtagcttatgtagtg

SEQ ID NO: 87338 - DNA, 25 bp, S. pombe
gcattccccgttactcgagaagata

SEQ ID NO: 87339 - DNA, 25 bp, S. pombe
gcttcaccaggatttgtggctcgag

SEQ ID NO: 87340 - DNA, 25 bp, S. pombe
gcattggccgctattttgaacgcaa

SEQ ID NO: 87341 - DNA, 25 bp, S. pombe
gcaggcggcagtataacaacagtat

SEQ ID NO: 87342 - DNA, 25 bp, S. pombe
gcaagttgtggtaccgacgatcgaa

SEQ ID NO: 87343 - DNA, 25 bp, S. pombe
gcatttttggcttccttcaatcgaa

SEQ ID NO: 87344 - DNA, 25 bp, S. pombe
gcattttcttctccctcaaaaatca

SEQ ID NO: 87345 - DNA, 25 bp, S. pombe
gcacctatgtttccccagaatgtag

SEQ ID NO: 87346 - DNA, 25 bp, S. pombe
gcatcaccattcctgttcgaaatgt

SEQ ID NO: 87347 - DNA, 25 bp, S. pombe
gcatttataccactacgagcacatt

SEQ ID NO: 87348 - DNA, 25 bp, S. pombe
gcttctctggtctctgcaatgacaa

SEQ ID NO: 87349 - DNA, 25 bp, S. pombe
gcttctgagttcttgtgtgctgaaa

SEQ ID NO: 87350 - DNA, 25 bp, S. pombe
gcttctaatttgcttttacttgacc

SEQ ID NO: 87351 - DNA, 25 bp, S. pombe
gcttctacatctgttcctgttttag

SEQ ID NO: 87352 - DNA, 25 bp, S. pombe
gcttctactcattttcctgtatcta

SEQ ID NO: 87353 - DNA, 25 bp, S. pombe
gcttgtgaatgctttttgtatccta

SEQ ID NO: 87354 - DNA, 25 bp, S. pombe
gcttctacattatggatagatccta

SEQ ID NO: 87355 - DNA, 25 bp, S. pombe
gcttcttgatttctctctgtctgac

SEQ ID NO: 87356 - DNA, 25 bp, S. pombe
gcatctttattctaagccgtgtgac

SEQ ID NO: 87357 - DNA, 25 bp, S. pombe
gcatcctgacaacaagggttcttca

SEQ ID NO: 87358 - DNA, 25 bp, S. pombe
gcagtcgaagtgctatttcctgttt

SEQ ID NO: 87359 - DNA, 25 bp, S. pombe
gcaacaaaccgtttctatttcttcg

SEQ ID NO: 87360 - DNA, 25 bp, S. pombe
gcaacttacacctgtctgattcatg

SEQ ID NO: 87361 - DNA, 25 bp, S. pombe
gcttgcttcaactattgctgcacaa

SEQ ID NO: 87362 - DNA, 25 bp, S. pombe
gcttgctaatacatgctttcgtggc

SEQ ID NO: 87363 - DNA, 25 bp, S. pombe
gcttggaaaccttttttgcctatat

SEQ ID NO: 87364 - DNA, 25 bp, S. pombe
gcagttacgaaagctagcacttctt

SEQ ID NO: 87365 - DNA, 25 bp, S. pombe
gcattgaccgtcctaatgacatttt

SEQ ID NO: 87366 - DNA, 25 bp, S. pombe
gcttcctcgcacctgaaatattttt

SEQ ID NO: 87367 - DNA, 25 bp, S. pombe
gcattccctctctacacttagaaga

SEQ ID NO: 87368 - DNA, 25 bp, S. pombe
gcattctcccgctactgttaatgag

SEQ ID NO: 87369 - DNA, 25 bp, S. pombe
gcttgtgcccaatctgtagtcatca

SEQ ID NO: 87370 - DNA, 25 bp, S. pombe
gcttctgcttccgttgatgatgtaa

SEQ ID NO: 87371 - DNA, 25 bp, S. pombe
gcttcgttcagctttggatccaaaa

SEQ ID NO: 87372 - DNA, 25 bp, S. pombe
gcttgctttacgttggaccaccaaa

SEQ ID NO: 87373 - DNA, 25 bp, S. pombe
gcattcttaattttagaggacgcta

SEQ ID NO: 87374 - DNA, 25 bp, S. pombe
gcatctttaccgttatgggactttt

SEQ ID NO: 87375 - DNA, 25 bp, S. pombe
gcaggcctaccataatgggaccgtt

SEQ ID NO: 87376 - DNA, 25 bp, S. pombe
gcaggctcttccaaaggtaaccgat

SEQ ID NO: 87377 - DNA, 25 bp, S. pombe
gcatattgtgattatgaggccagac

SEQ ID NO: 87378 - DNA, 25 bp, S. pombe
gcatattgtgattatgaggccagac

SEQ ID NO: 87379 - DNA, 25 bp, S. pombe
gcattttgtataatcagccacccgc

SEQ ID NO: 87380 - DNA, 25 bp, S. pombe
gcttccattcttgcaattatccatg

SEQ ID NO: 87381 - DNA, 25 bp, S. pombe
gcttcgattttacgtgcttgccata

SEQ ID NO: 87382 - DNA, 25 bp, S. pombe
gcttcgattgttggtatgcctctta

SEQ ID NO: 87383 - DNA, 25 bp, S. pombe
gcttgcagattatcagcctatcttt

SEQ ID NO: 87384 - DNA, 25 bp, S. pombe
gcattcattgcaaccgtttggccgg

SEQ ID NO: 87385 - DNA, 25 bp, S. pombe
gcatatcccaacgtgtttgtcaagg

SEQ ID NO: 87386 - DNA, 25 bp, S. pombe
gcttcctcaacttccatatttgcta

SEQ ID NO: 87387 - DNA, 25 bp, S. pombe
gcttctcgtgtttctaatttgctaa

SEQ ID NO: 87388 - DNA, 25 bp, S. pombe
gcattctttgttttaattggcttaa

SEQ ID NO: 87389 - DNA, 25 bp, S. pombe
gcacgtaattcttctaatagtctta

SEQ ID NO: 87390 - DNA, 25 bp, S. pombe
gcatttcgatacatcttgtacccga

SEQ ID NO: 87391 - DNA, 25 bp, S. pombe
gcaggttacgatcaatgccttgtag

SEQ ID NO: 87392 - DNA, 25 bp, S. pombe
gcagatggtccatgttcgttttccc

SEQ ID NO: 87393 - DNA, 25 bp, S. pombe
gcatcgttccgtaatcgtcagcaaa

SEQ ID NO: 87394 - DNA, 25 bp, S. pombe
gcttgatctcgcttttggtgcaaaa

SEQ ID NO: 87395 - DNA, 25 bp, S. pombe
gcttgatccgcaggcttcttgtaaa

SEQ ID NO: 87396 - DNA, 25 bp, S. pombe
gcttggcgtagctcatcatggtgga

SEQ ID NO: 87397 - DNA, 25 bp, S. pombe
gcttgctttgtcttcagtttgtagg

SEQ ID NO: 87398 - DNA, 25 bp, S. pombe
gcataccgtattgagttctctgcag

SEQ ID NO: 87399 - DNA, 25 bp, S. pombe
gcatcggaagcgtttgatagcctta

SEQ ID NO: 87400 - DNA, 25 bp, S. pombe
gcttgaagatgctcgtagtgactta

SEQ ID NO: 87401 - DNA, 25 bp, S. pombe
gcttggacgtccgatgattgttata

SEQ ID NO: 87402 - DNA, 25 bp, S. pombe
gcttgatggtgtacttgaggctaga

SEQ ID NO: 87403 - DNA, 25 bp, S. pombe
gcttgctgtagaatcctttgctaga

SEQ ID NO: 87404 - DNA, 25 bp, S. pombe
gcttcgctcagcttccttataagaa

SEQ ID NO: 87405 - DNA, 25 bp, S. pombe
gcagatttatgccatgccatatgga

SEQ ID NO: 87406 - DNA, 25 bp, S. pombe
gcatattgttgctcaaaggccgcca

SEQ ID NO: 87407 - DNA, 25 bp, S. pombe
gcattcgcatttagataagcctcca

SEQ ID NO: 87408 - DNA, 25 bp, S. pombe
gcttccattatcgaataccaccatt

SEQ ID NO: 87409 - DNA, 25 bp, S. pombe
gcttccttggaagttcacacagcat

SEQ ID NO: 87410 - DNA, 25 bp, S. pombe
gcttcctgtgatttgtatcccatat

SEQ ID NO: 87411 - DNA, 25 bp, S. pombe
gcatcactttgactttaccggttgt

SEQ ID NO: 87412 - DNA, 25 bp, S. pombe
gcatctccttatttacccaagtttg

SEQ ID NO: 87413 - DNA, 25 bp, S. pombe
gcatggccgtggtcataccaaattt

SEQ ID NO: 87414 - DNA, 25 bp, S. pombe
gcatgttggtggtaactcggatttc

SEQ ID NO: 87415 - DNA, 25 bp, S. pombe
gcattttgcgtaacctctggattct

SEQ ID NO: 87416 - DNA, 25 bp, S. pombe
gcatactgtgggagctcatcggaat

SEQ ID NO: 87417 - DNA, 25 bp, S. pombe
gcatcactttgacactacggcaaga

SEQ ID NO: 87418 - DNA, 25 bp, S. pombe
gcttgaattatcttcctcaccaagg

SEQ ID NO: 87419 - DNA, 25 bp, S. pombe
gcatgtgcaactcgtgattcttcag

SEQ ID NO: 87420 - DNA, 25 bp, S. pombe
gcatgcatgctttgttgatgtctat

SEQ ID NO: 87421 - DNA, 25 bp, S. pombe
gcattggctggacttgggaacctta

SEQ ID NO: 87422 - DNA, 25 bp, S. pombe
gcagatactgtgttcggcgagacgt

SEQ ID NO: 87423 - DNA, 25 bp, S. pombe
gcatactgtcatacttatgggaact

SEQ ID NO: 87424 - DNA, 25 bp, S. pombe
gcatattgctgcacgaatccttctg

SEQ ID NO: 87425 - DNA, 25 bp, S. pombe
gcatatcgttgccagaatccttaag

SEQ ID NO: 87426 - DNA, 25 bp, S. pombe
gcattatctcagtaaacctttcaag

SEQ ID NO: 87427 - DNA, 25 bp, S. pombe
gcttgttagcaggaacatttgtaga

SEQ ID NO: 87428 - DNA, 25 bp, S. pombe
gcattgcatactccttactcgagga

SEQ ID NO: 87429 - DNA, 25 bp, S. pombe
gcatttgtcaagctttctgccgatg

SEQ ID NO: 87430 - DNA, 25 bp, S. pombe
gcatattctcttcgtaattccttgg

SEQ ID NO: 87431 - DNA, 25 bp, S. pombe
gcactttttgagcaataccttggca

SEQ ID NO: 87432 - DNA, 25 bp, S. pombe
gcacagcctttttaaatggtttccg

SEQ ID NO: 87433 - DNA, 25 bp, S. pombe
gcatccattttttaagagactccat

SEQ ID NO: 87434 - DNA, 25 bp, S. pombe
gcatcctttttccaagtcattgtct

SEQ ID NO: 87435 - DNA, 25 bp, S. pombe
gcagcctcctgctcatcaaatttgg

SEQ ID NO: 87436 - DNA, 25 bp, S. pombe
gcatcttttgcccatcaacttttga

SEQ ID NO: 87437 - DNA, 25 bp, S. pombe
gcatggctttccaataccttcaaga

SEQ ID NO: 87438 - DNA, 25 bp, S. pombe
gcagttgtctcccaagccaaaaagg

SEQ ID NO: 87439 - DNA, 25 bp, S. pombe
gcacgtacctggtttcaatccgaaa

SEQ ID NO: 87440 - DNA, 25 bp, S. pombe
gcataaacctagtcttgaatccgct

SEQ ID NO: 87441 - DNA, 25 bp, S. pombe
gcatcaagacgtcatttgtaccagt

SEQ ID NO: 87442 - DNA, 25 bp, S. pombe
gcattagcagcgtgtggttcccaga

SEQ ID NO: 87443 - DNA, 25 bp, S. pombe
gacttagctgcttttttactcggga

SEQ ID NO: 87444 - DNA, 25 bp, S. pombe
gcagctttgcttctttggactttaa

SEQ ID NO: 87445 - DNA, 25 bp, S. pombe
gcattcttctatcattctgtttttg

SEQ ID NO: 87446 - DNA, 25 bp, S. pombe
gcatgtttatctcttcggttttccc

SEQ ID NO: 87447 - DNA, 25 bp, S. pombe
gcattagctactgctctagtcgatt

SEQ ID NO: 87448 - DNA, 25 bp, S. pombe
gcattacttgcttctttgtccagat

SEQ ID NO: 87449 - DNA, 25 bp, S. pombe
gcattcaagcgttttcgagcaagtt

SEQ ID NO: 87450 - DNA, 25 bp, S. pombe
gcattcaagctttaattcacggttt

SEQ ID NO: 87451 - DNA, 25 bp, S. pombe
gcaaaagtcgattccaacggttctt

SEQ ID NO: 87452 - DNA, 25 bp, S. pombe
gcagccataaatcccttggtggtgt

SEQ ID NO: 87453 - DNA, 25 bp, S. pombe
gcattgctaactccatcggtgtagt

SEQ ID NO: 87454 - DNA, 25 bp, S. pombe
gcattcgcgcagcaactggttcaaa

SEQ ID NO: 87455 - DNA, 25 bp, S. pombe
gcttgggcttagttgctcttgaaat

SEQ ID NO: 87456 - DNA, 25 bp, S. pombe
gcatttgagccggacttcattgaaa

SEQ ID NO: 87457 - DNA, 25 bp, S. pombe
gcattttaccagttttcttttgacg

SEQ ID NO: 87458 - DNA, 25 bp, S. pombe
gcaggctttgtcttgtgctagtcaa

SEQ ID NO: 87459 - DNA, 25 bp, S. pombe
gcatttatttgcagtcctccacaat

SEQ ID NO: 87460 - DNA, 25 bp, S. pombe
gcatttatatatgggctacgctcct

SEQ ID NO: 87461 - DNA, 25 bp, S. pombe
gcatgattcaatttggtgtaccgct

SEQ ID NO: 87462 - DNA, 25 bp, S. pombe
gcattcgccgatttttacaactcac

SEQ ID NO: 87463 - DNA, 25 bp, S. pombe
gcattcgttgagtttataaatccca

SEQ ID NO: 87464 - DNA, 25 bp, S. pombe
gcagaaattatgttagccgtccttt

SEQ ID NO: 87465 - DNA, 25 bp, S. pombe
gagttactaggtgggcttgacttgc

SEQ ID NO: 87466 - DNA, 25 bp, S. pombe
gcagttatcgatgtttgcttactta

SEQ ID NO: 87467 - DNA, 25 bp, S. pombe
gcagttggcgaatattgctctcctt

SEQ ID NO: 87468 - DNA, 25 bp, S. pombe
gcatttcaatgttccttcttcaaga

SEQ ID NO: 87469 - DNA, 25 bp, S. pombe
gcattgttcatcatcgttttcggtt

SEQ ID NO: 87470 - DNA, 25 bp, S. pombe
gcattcctgcatattgttttcctat

SEQ ID NO: 87471 - DNA, 25 bp, S. pombe
gcatttcatgcatttgcttctttgc

SEQ ID NO: 87472 - DNA, 25 bp, S. pombe
gcatgatttgttgcgcacttatcct

SEQ ID NO: 87473 - DNA, 25 bp, S. pombe
gcattgcaaatgtcgctgttttatt

SEQ ID NO: 87474 - DNA, 25 bp, S. pombe
gcattatcaatgtctctgcccgtga

SEQ ID NO: 87475 - DNA, 25 bp, S. pombe
gcattcacaacttgcttcgctggtt

SEQ ID NO: 87476 - DNA, 25 bp, S. pombe
gcatatatgcaagttcttcggagta

SEQ ID NO: 87477 - DNA, 25 bp, S. pombe
gcatttgcccattcatccgacaaaa

SEQ ID NO: 87478 - DNA, 25 bp, S. pombe
gcataggtcaattcattcattcaga

SEQ ID NO: 87479 - DNA, 25 bp, S. pombe
gcttggctgatctaggaccctatga

SEQ ID NO: 87480 - DNA, 25 bp, S. pombe
gcattgccataccaaaccatctatg

SEQ ID NO: 87481 - DNA, 25 bp, S. pombe
gcatctcccatcgaaactatcattt

SEQ ID NO: 87482 - DNA, 25 bp, S. pombe
gcatccgcagcaacattatcttcag

SEQ ID NO: 87483 - DNA, 25 bp, S. pombe
gcatacaatacctttgctgccagta

SEQ ID NO: 87484 - DNA, 25 bp, S. pombe
gcatatctgttgttttatcgccgaa

SEQ ID NO: 87485 - DNA, 25 bp, S. pombe
gcatatcagcggttgttgacacctg

SEQ ID NO: 87486 - DNA, 25 bp, S. pombe
gcatatccaaagtttatctcctgag

SEQ ID NO: 87487 - DNA, 25 bp, S. pombe
gcattctgcgcttgcttggaaagta

SEQ ID NO: 87488 - DNA, 25 bp, S. pombe
gcattagctgctcgcgcggaattag

SEQ ID NO: 87489 - DNA, 25 bp, S. pombe
gcattatctgattgtggcttttctg

SEQ ID NO: 87490 - DNA, 25 bp, S. pombe
gcatattcttatcatgttctcatag

SEQ ID NO: 87491 - DNA, 25 bp, S. pombe
gcattgctcgtatattggctattca

SEQ ID NO: 87492 - DNA, 25 bp, S. pombe
gcattccttggatttagcgcttcat

SEQ ID NO: 87493 - DNA, 25 bp, S. pombe
gcattggtgcctctttgtattgcaa

SEQ ID NO: 87494 - DNA, 25 bp, S. pombe
gcagtttcactgtttttatcctaaa

SEQ ID NO: 87495 - DNA, 25 bp, S. pombe
gcaggtataagatcttttccccaaa

SEQ ID NO: 87496 - DNA, 25 bp, S. pombe
gcatacagcttttctccaatgtcaa

SEQ ID NO: 87497 - DNA, 25 bp, S. pombe
gcatttgcttctgcatccattgtaa

SEQ ID NO: 87498 - DNA, 25 bp, S. pombe
gcatgcttaaagttgcgcctggaag

SEQ ID NO: 87499 - DNA, 25 bp, S. pombe
gcatatgttccaccaagcagacgta

SEQ ID NO: 87500 - DNA, 25 bp, S. pombe
gcatgatttatacccacagccggat

SEQ ID NO: 87501 - DNA, 25 bp, S. pombe
gcatgcatttatccccggtaagtat

SEQ ID NO: 87502 - DNA, 25 bp, S. pombe
gcatttgcggctttcttgagtagct

SEQ ID NO: 87503 - DNA, 25 bp, S. pombe
gcatcatcttggctcttttgaaatt

SEQ ID NO: 87504 - DNA, 25 bp, S. pombe
gcaggttctttatctgggactcaga

SEQ ID NO: 87505 - DNA, 25 bp, S. pombe
gcagtttttaccattcaaccatgaa

SEQ ID NO: 87506 - DNA, 25 bp, S. pombe
gcagtttcttacgacgttcctatga

SEQ ID NO: 87507 - DNA, 25 bp, S. pombe
gcatccattgtaataaattctaaca

SEQ ID NO: 87508 - DNA, 25 bp, S. pombe
gcatcataccgggagctacacataa

SEQ ID NO: 87509 - DNA, 25 bp, S. pombe
gcatctacaataccttcacattcat

SEQ ID NO: 87510 - DNA, 25 bp, S. pombe
gcatctgatcagtatggcaactatt

SEQ ID NO: 87511 - DNA, 25 bp, S. pombe
gcatcttcaatggtatactattcgc

SEQ ID NO: 87512 - DNA, 25 bp, S. pombe
gcatgttgaagatacggaccctggt

SEQ ID NO: 87513 - DNA, 25 bp, S. pombe
gcagcttgaaattgccaaccccagg

SEQ ID NO: 87514 - DNA, 25 bp, S. pombe
gcataggacacatagctcagcaaat

SEQ ID NO: 87515 - DNA, 25 bp, S. pombe
gcattgcgaatctatcattgccaaa

SEQ ID NO: 87516 - DNA, 25 bp, S. pombe
gcattgcatgcctacggaaatcatt

SEQ ID NO: 87517 - DNA, 25 bp, S. pombe
gcatatgctgctttttacgattctg

SEQ ID NO: 87518 - DNA, 25 bp, S. pombe
gcaccaatggatgctgattctgctt

SEQ ID NO: 87519 - DNA, 25 bp, S. pombe
gcataccaagcatctgttccaattt

SEQ ID NO: 87520 - DNA, 25 bp, S. pombe
gcatgtcttctgttgctgaatcgca

SEQ ID NO: 87521 - DNA, 25 bp, S. pombe
gcatgtctctatgtgctcatcatac

SEQ ID NO: 87522 - DNA, 25 bp, S. pombe
gcaccctgacgggatcatacgtata

SEQ ID NO: 87523 - DNA, 25 bp, S. pombe
gcattcagatgctggaaaccttcta

SEQ ID NO: 87524 - DNA, 25 bp, S. pombe
gcattcaattcatgagccacctttg

SEQ ID NO: 87525 - DNA, 25 bp, S. pombe
gcatccaactgctggtcatttctta

SEQ ID NO: 87526 - DNA, 25 bp, S. pombe
gcattccgtttgcagcatattctta

SEQ ID NO: 87527 - DNA, 25 bp, S. pombe
gcatcccaacattcaggagctttag

SEQ ID NO: 87528 - DNA, 25 bp, S. pombe
gcatctgctattcgacgacgcggaa

SEQ ID NO: 87529 - DNA, 25 bp, S. pombe
gcatcgctatgaatactcctgtgga

SEQ ID NO: 87530 - DNA, 25 bp, S. pombe
gcattcattgcagtcgtctaggagt

SEQ ID NO: 87531 - DNA, 25 bp, S. pombe
gcattcggtgtccttagcggtttaa

SEQ ID NO: 87532 - DNA, 25 bp, S. pombe
gcaggcggttctttacgttcttcta

SEQ ID NO: 87533 - DNA, 25 bp, S. pombe
gcaggctggagcttacgactttact

SEQ ID NO: 87534 - DNA, 25 bp, S. pombe
gcatcagcatttcgacaactttgga

SEQ ID NO: 87535 - DNA, 25 bp, S. pombe
gcatatttattttattctggcatta

SEQ ID NO: 87536 - DNA, 25 bp, S. pombe
gcatatgtttttcgtttggatcttg

SEQ ID NO: 87537 - DNA, 25 bp, S. pombe
gcatttttagctactgttgaagaca

SEQ ID NO: 87538 - DNA, 25 bp, S. pombe
gcatctgactggatctcttcatgga

SEQ ID NO: 87539 - DNA, 25 bp, S. pombe
gcatcgaacaagacatctccatgga

SEQ ID NO: 87540 - DNA, 25 bp, S. pombe
gcaagccaagggtactgaacaagca

SEQ ID NO: 87541 - DNA, 25 bp, S. pombe
gcatacaacggtttatggacttgca

SEQ ID NO: 87542 - DNA, 25 bp, S. pombe
gcattcagtgcagcgatttatctcg

SEQ ID NO: 87543 - DNA, 25 bp, S. pombe
gcattagtcactgatgtcgtctcaa

SEQ ID NO: 87544 - DNA, 25 bp, S. pombe
gcatagatatattcgtcaccctgag

SEQ ID NO: 87545 - DNA, 25 bp, S. pombe
gcagatgtagttgtcagcagcctca

SEQ ID NO: 87546 - DNA, 25 bp, S. pombe
gcatggttctcaaccgcacgtaaaa

SEQ ID NO: 87547 - DNA, 25 bp, S. pombe
gcatgtcaaatcttggtcttataca

SEQ ID NO: 87548 - DNA, 25 bp, S. pombe
gcatgacactactcctctagatgaa

SEQ ID NO: 87549 - DNA, 25 bp, S. pombe
gcatccatcgcccaaagatcagaat

SEQ ID NO: 87550 - DNA, 25 bp, S. pombe
gcatcgcatggctcaaatggctgga

SEQ ID NO: 87551 - DNA, 25 bp, S. pombe
gcatcgcaattggtacttcatggtt

SEQ ID NO: 87552 - DNA, 25 bp, S. pombe
gcatcgtttgtttttgcagtctcga

SEQ ID NO: 87553 - DNA, 25 bp, S. pombe
gcattatgttttttcgcatttgcaa

SEQ ID NO: 87554 - DNA, 25 bp, S. pombe
gcagagatttttcacgttacacaag

SEQ ID NO: 87555 - DNA, 25 bp, S. pombe
gcacgtcgttatgcaaaggccatga

SEQ ID NO: 87556 - DNA, 25 bp, S. pombe
gcatgccacggctttacaagaactt

SEQ ID NO: 87557 - DNA, 25 bp, S. pombe
gcaggagcctcttcaaacagtttta

SEQ ID NO: 87558 - DNA, 25 bp, S. pombe
gcagagactccagacgatattttat

SEQ ID NO: 87559 - DNA, 25 bp, S. pombe
gcatatgaacttgacggctgttttt

SEQ ID NO: 87560 - DNA, 25 bp, S. pombe
gcatatctcatatccaggttttccg

SEQ ID NO: 87561 - DNA, 25 bp, S. pombe
gcatatctgcattacgtgccatcga

SEQ ID NO: 87562 - DNA, 25 bp, S. pombe
gcagctgccaaatttgctccaggtg

SEQ ID NO: 87563 - DNA, 25 bp, S. pombe
gcaaaacatttccaagcttcccttt

SEQ ID NO: 87564 - DNA, 25 bp, S. pombe
gcaacaaaagtctgaggttcctcct

SEQ ID NO: 87565 - DNA, 25 bp, S. pombe
gcagacaaacttttgcgggttgcta

SEQ ID NO: 87566 - DNA, 25 bp, S. pombe
gcatgcagtcgtattctcctaaatt

SEQ ID NO: 87567 - DNA, 25 bp, S. pombe
gcatgcagttgcatttctcaaccaa

SEQ ID NO: 87568 - DNA, 25 bp, S. pombe
gcagctggtgtttttacccaacctt

SEQ ID NO: 87569 - DNA, 25 bp, S. pombe
gcatgggttgcttttatcctaacct

SEQ ID NO: 87570 - DNA, 25 bp, S. pombe
gcatgcgtttgtttttcttttctca

SEQ ID NO: 87571 - DNA, 25 bp, S. pombe
gcatcttccttcttttttgtgtacg

SEQ ID NO: 87572 - DNA, 25 bp, S. pombe
gcatcttgcttttctgttctactta

SEQ ID NO: 87573 - DNA, 25 bp, S. pombe
gcagcttgctttcacttccgaatag

SEQ ID NO: 87574 - DNA, 25 bp, S. pombe
gcagtagtattttccccaacattaa

SEQ ID NO: 87575 - DNA, 25 bp, S. pombe
gcaacttacttcttcccaaattcaa

SEQ ID NO: 87576 - DNA, 25 bp, S. pombe
gcaccttacttcacctcaagtataa

SEQ ID NO: 87577 - DNA, 25 bp, S. pombe
gcatactgcttgactcaaatccgtt

SEQ ID NO: 87578 - DNA, 25 bp, S. pombe
gcagcttatttactagtatcggcaa

SEQ ID NO: 87579 - DNA, 25 bp, S. pombe
gcagtgtgattctactacttcgaga

SEQ ID NO: 87580 - DNA, 25 bp, S. pombe
gcatttcccttttccattatcgtaa

SEQ ID NO: 87581 - DNA, 25 bp, S. pombe
gcatttctcgttttcacatctttat

SEQ ID NO: 87582 - DNA, 25 bp, S. pombe
gcatcatctgcttcacgaataagtc

SEQ ID NO: 87583 - DNA, 25 bp, S. pombe
gcatgctgtgcttccaaaaagtcta

SEQ ID NO: 87584 - DNA, 25 bp, S. pombe
gcatgcaacttccatctcgtaaata

SEQ ID NO: 87585 - DNA, 25 bp, S. pombe
gcacggaaagctgcagatgccataa

SEQ ID NO: 87586 - DNA, 25 bp, S. pombe
gcagctgaagctggcgttcacgcta

SEQ ID NO: 87587 - DNA, 25 bp, S. pombe
gcatgtaccattgttcacgtgacga

SEQ ID NO: 87588 - DNA, 25 bp, S. pombe
gcaacttaagtccttgggtgctact

SEQ ID NO: 87589 - DNA, 25 bp, S. pombe
gcaccttggcctattggagttacta

SEQ ID NO: 87590 - DNA, 25 bp, S. pombe
gcagcctctactcacattgggatta

SEQ ID NO: 87591 - DNA, 25 bp, S. pombe
gcatgcgccatgtttattgtttatt

SEQ ID NO: 87592 - DNA, 25 bp, S. pombe
gcatcggtgctgttgagtcagtcaa

SEQ ID NO: 87593 - DNA, 25 bp, S. pombe
gcatgggcgtcaaagtcgtacctta

SEQ ID NO: 87594 - DNA, 25 bp, S. pombe
gcagggcgtcaaacctttacttgat

SEQ ID NO: 87595 - DNA, 25 bp, S. pombe
gcatctcgactttaccttgtttggg

SEQ ID NO: 87596 - DNA, 25 bp, S. pombe
gcagcttatttttatgggaactcca

SEQ ID NO: 87597 - DNA, 25 bp, S. pombe
gcagtgtgttttttgagtgtaatcc

SEQ ID NO: 87598 - DNA, 25 bp, S. pombe
gcagaagctaccattgagggcaatc

SEQ ID NO: 87599 - DNA, 25 bp, S. pombe
gcatcaaatattctcactttccctc

SEQ ID NO: 87600 - DNA, 25 bp, S. pombe
gcatcacgagttctattggtccttc

SEQ ID NO: 87601 - DNA, 25 bp, S. pombe
gcatcagcggttttgattcctctta

SEQ ID NO: 87602 - DNA, 25 bp, S. pombe
gcacgctagtatgcggtattttaga

SEQ ID NO: 87603 - DNA, 25 bp, S. pombe
gcatggccggtgaaggttattccaa

SEQ ID NO: 87604 - DNA, 25 bp, S. pombe
gcatgacccttgaggaggcttctaa

SEQ ID NO: 87605 - DNA, 25 bp, S. pombe
gaatccgttcagatgggcatgtcaa

SEQ ID NO: 87606 - DNA, 25 bp, S. pombe
gaatcggacgtactggccgtgccaa

SEQ ID NO: 87607 - DNA, 25 bp, S. pombe
gcatatcctacagacggcggtgaca

SEQ ID NO: 87608 - DNA, 25 bp, S. pombe
gcagcgatcaatgcctagtgttctt

SEQ ID NO: 87609 - DNA, 25 bp, S. pombe
gcagcgggcattggctagtatacat

SEQ ID NO: 87610 - DNA, 25 bp, S. pombe
gcacgaggaattccgtatgcactat

SEQ ID NO: 87611 - DNA, 25 bp, S. pombe
gcaagcatggaatctcgtctacgag

SEQ ID NO: 87612 - DNA, 25 bp, S. pombe
gcaggtttcaatcatcccaaggtta

SEQ ID NO: 87613 - DNA, 25 bp, S. pombe
gcatggttacaatctcccaagggca

SEQ ID NO: 87614 - DNA, 25 bp, S. pombe
gcagtctaaacttcatcccgaggaa

SEQ ID NO: 87615 - DNA, 25 bp, S. pombe
gcagttagctccttataccgttgaa

SEQ ID NO: 87616 - DNA, 25 bp, S. pombe
gacattagctcctttagcggttttg

SEQ ID NO: 87617 - DNA, 25 bp, S. pombe
gcatcaaattcggtaacctgaactt

SEQ ID NO: 87618 - DNA, 25 bp, S. pombe
gcaagttccggtaaactgcttcgta

SEQ ID NO: 87619 - DNA, 25 bp, S. pombe
gcacgttcctgaccaaattgcttga

SEQ ID NO: 87620 - DNA, 25 bp, S. pombe
gcacttccctcccaagattattgaa

SEQ ID NO: 87621 - DNA, 25 bp, S. pombe
gcagcttccatctttgccaaattag

SEQ ID NO: 87622 - DNA, 25 bp, S. pombe
gcagtggattgcgactcagaagcta

SEQ ID NO: 87623 - DNA, 25 bp, S. pombe
gcagttgcagattgccaacgagcat

SEQ ID NO: 87624 - DNA, 25 bp, S. pombe
gcatccttcatgtggtttgtcagtg

SEQ ID NO: 87625 - DNA, 25 bp, S. pombe
gcatctcatattcaagcttcccagt

SEQ ID NO: 87626 - DNA, 25 bp, S. pombe
gcagccatatgatcatgccgtcgat

SEQ ID NO: 87627 - DNA, 25 bp, S. pombe
gcatacggattatcgttcatacagt

SEQ ID NO: 87628 - DNA, 25 bp, S. pombe
gcagccggccaatttattatttcat

SEQ ID NO: 87629 - DNA, 25 bp, S. pombe
gcagacggccctatgaatttgttaa

SEQ ID NO: 87630 - DNA, 25 bp, S. pombe
gcagtaatcctctcaacttgatgaa

SEQ ID NO: 87631 - DNA, 25 bp, S. pombe
gcagatggtcgtcgacattcttcac

SEQ ID NO: 87632 - DNA, 25 bp, S. pombe
gcaggcacctgcatttttcaagtac

SEQ ID NO: 87633 - DNA, 25 bp, S. pombe
gcagacgttttattttatcctcgta

SEQ ID NO: 87634 - DNA, 25 bp, S. pombe
gcaagcttttttgttttctcgtcgt

SEQ ID NO: 87635 - DNA, 25 bp, S. pombe
gcatgccgcttcattggtttgtgaa

SEQ ID NO: 87636 - DNA, 25 bp, S. pombe
gcatgtcgttttcggtgaggtcact

SEQ ID NO: 87637 - DNA, 25 bp, S. pombe
gcacctcaatttagatcgacgtaca

SEQ ID NO: 87638 - DNA, 25 bp, S. pombe
gcaggtcatagctcaatgccctaat

SEQ ID NO: 87639 - DNA, 25 bp, S. pombe
gcatggatggcaattcgtattctga

SEQ ID NO: 87640 - DNA, 25 bp, S. pombe
gcagtgttagttctcaacgcagctc

SEQ ID NO: 87641 - DNA, 25 bp, S. pombe
gcagtcaaccggtatcccaagaagt

SEQ ID NO: 87642 - DNA, 25 bp, S. pombe
gcagctcgaagcagaattccaaaag

SEQ ID NO: 87643 - DNA, 25 bp, S. pombe
gcatctttaatgactagccctagcg

SEQ ID NO: 87644 - DNA, 25 bp, S. pombe
gcacccatattcaggcaagccagtt

SEQ ID NO: 87645 - DNA, 25 bp, S. pombe
gcatccgtttcaatcgcatacaatt

SEQ ID NO: 87646 - DNA, 25 bp, S. pombe
gcaccatttccatgcccaagattgg

SEQ ID NO: 87647 - DNA, 25 bp, S. pombe
gcatctgcgcttcatgttgcattaa

SEQ ID NO: 87648 - DNA, 25 bp, S. pombe
gcatctgatgttcctattctattaa

SEQ ID NO: 87649 - DNA, 25 bp, S. pombe
gcactgcctcagacttatctagttt

SEQ ID NO: 87650 - DNA, 25 bp, S. pombe
gcaggccagacgacgccgattggaa

SEQ ID NO: 87651 - DNA, 25 bp, S. pombe
gcatgaatctggtcctgagacggaa

SEQ ID NO: 87652 - DNA, 25 bp, S. pombe
gcagcaagcagttcattatgactcg

SEQ ID NO: 87653 - DNA, 25 bp, S. pombe
gcagatcgttccaatgatgactcta

SEQ ID NO: 87654 - DNA, 25 bp, S. pombe
gcagagcttcaccatattcgcaatg

SEQ ID NO: 87655 - DNA, 25 bp, S. pombe
gcagagtcatcacaacacgctgagg

SEQ ID NO: 87656 - DNA, 25 bp, S. pombe
gcacatttaagatctcataccggcg

SEQ ID NO: 87657 - DNA, 25 bp, S. pombe
gcacgtgaatgaagacgccactatt

SEQ ID NO: 87658 - DNA, 25 bp, S. pombe
gcatgcctaatggtctcaaagcttt

SEQ ID NO: 87659 - DNA, 25 bp, S. pombe
gcatgccatgttgttgagaaggttt

SEQ ID NO: 87660 - DNA, 25 bp, S. pombe
gcatgcttcttactagcgaacgtac

SEQ ID NO: 87661 - DNA, 25 bp, S. pombe
gcagtatctctgtcaaggaagctta

SEQ ID NO: 87662 - DNA, 25 bp, S. pombe
gcatgcattttgttcacagccttta

SEQ ID NO: 87663 - DNA, 25 bp, S. pombe
gcatctggatattactcgctcgtta

SEQ ID NO: 87664 - DNA, 25 bp, S. pombe
gcacctataccagcttcgttgaaga

SEQ ID NO: 87665 - DNA, 25 bp, S. pombe
gcatccttagctgcatttcgtctaa

SEQ ID NO: 87666 - DNA, 25 bp, S. pombe
gcatgccttggctcagtattgaaga

SEQ ID NO: 87667 - DNA, 25 bp, S. pombe
gcagccgaattccactgatttcaat

SEQ ID NO: 87668 - DNA, 25 bp, S. pombe
gcagttaggccggtgattcccaaat

SEQ ID NO: 87669 - DNA, 25 bp, S. pombe
gcagttagagtcgttgtcttccaaa

SEQ ID NO: 87670 - DNA, 25 bp, S. pombe
gcagattacagtttttctcctgagg

SEQ ID NO: 87671 - DNA, 25 bp, S. pombe
gcagtctgaatttttctcgcctatt

SEQ ID NO: 87672 - DNA, 25 bp, S. pombe
gcatgttttttattccccatttcta

SEQ ID NO: 87673 - DNA, 25 bp, S. pombe
gcatgttttcttattcctcggatat

SEQ ID NO: 87674 - DNA, 25 bp, S. pombe
gcagtattacgcacttcctatttat

SEQ ID NO: 87675 - DNA, 25 bp, S. pombe
gcaccattacgctctttcatttaat

SEQ ID NO: 87676 - DNA, 25 bp, S. pombe
gcatccatttggctctttatctgat

SEQ ID NO: 87677 - DNA, 25 bp, S. pombe
gcatccacttggtctctaacgaata

SEQ ID NO: 87678 - DNA, 25 bp, S. pombe
gcaagtcgggactcgtggtttacaa

SEQ ID NO: 87679 - DNA, 25 bp, S. pombe
gcacttgcgggttttgttctttcga

SEQ ID NO: 87680 - DNA, 25 bp, S. pombe
gcacggcggtgttagattctttgta

SEQ ID NO: 87681 - DNA, 25 bp, S. pombe
gcatgcagagcccttaacgtatttt

SEQ ID NO: 87682 - DNA, 25 bp, S. pombe
gcatgaagctcgtttggctgaactt

SEQ ID NO: 87683 - DNA, 25 bp, S. pombe
gcatggtctgctattgtctatactt

SEQ ID NO: 87684 - DNA, 25 bp, S. pombe
gcatgttggtaatgagcttccgcaa

SEQ ID NO: 87685 - DNA, 25 bp, S. pombe
gcagtcaggctcacattggaatcaa

SEQ ID NO: 87686 - DNA, 25 bp, S. pombe
gcagtagttcatcatttgcaacaga

SEQ ID NO: 87687 - DNA, 25 bp, S. pombe
gcatggctgctaccaatctttctaa

SEQ ID NO: 87688 - DNA, 25 bp, S. pombe
gcatggcttttcaacttctctcaat

SEQ ID NO: 87689 - DNA, 25 bp, S. pombe
gcaggttttgtcatcgcagctttaa

SEQ ID NO: 87690 - DNA, 25 bp, S. pombe
gcaggcatggtgtttatcaattcaa

SEQ ID NO: 87691 - DNA, 25 bp, S. pombe
gcaggcttggcccattactatagta

SEQ ID NO: 87692 - DNA, 25 bp, S. pombe
gcagctattatgtttttactcccga

SEQ ID NO: 87693 - DNA, 25 bp, S. pombe
gcagctttctttgttacgctatcgt

SEQ ID NO: 87694 - DNA, 25 bp, S. pombe
gcatgtagttagactttatcgcaat

SEQ ID NO: 87695 - DNA, 25 bp, S. pombe
gcagtagttgcacctgttacagact

SEQ ID NO: 87696 - DNA, 25 bp, S. pombe
gcaaattctcagtctttacagtgga

SEQ ID NO: 87697 - DNA, 25 bp, S. pombe
gcagtgcaagggatttcgcaatcta

SEQ ID NO: 87698 - DNA, 25 bp, S. pombe
gcatgtaatggtgttagcgccgcaa

SEQ ID NO: 87699 - DNA, 25 bp, S. pombe
gcaggaatctgtgtcgttccagcaa

SEQ ID NO: 87700 - DNA, 25 bp, S. pombe
gcaaggaagaagacgcgtcccatta

SEQ ID NO: 87701 - DNA, 25 bp, S. pombe
gcagatcatgaagagccggttccag

SEQ ID NO: 87702 - DNA, 25 bp, S. pombe
gcagagcagcattcagtgccgtgtt

SEQ ID NO: 87703 - DNA, 25 bp, S. pombe
gcagttgctgtttctgcttttgcaa

SEQ ID NO: 87704 - DNA, 25 bp, S. pombe
gcagacttgcagaatcgtttatgta

SEQ ID NO: 87705 - DNA, 25 bp, S. pombe
gcaggctatctttgctgttttgata

SEQ ID NO: 87706 - DNA, 25 bp, S. pombe
gcaggatcgcatgttattcgtgata

SEQ ID NO: 87707 - DNA, 25 bp, S. pombe
gcaggtgcttggacttacatggaac

SEQ ID NO: 87708 - DNA, 25 bp, S. pombe
gcagaagcgacttgctgcatccgtc

SEQ ID NO: 87709 - DNA, 25 bp, S. pombe
gcagcttaaccttcatcttactgat

SEQ ID NO: 87710 - DNA, 25 bp, S. pombe
gcaccagaccaaagcgcttcagata

SEQ ID NO: 87711 - DNA, 25 bp, S. pombe
gcagcatctgacaaaacatgttcaa

SEQ ID NO: 87712 - DNA, 25 bp, S. pombe
gcatgctcgccaaatatcttcaaga

SEQ ID NO: 87713 - DNA, 25 bp, S. pombe
gcaccgcctagcattgagcaattgg

SEQ ID NO: 87714 - DNA, 25 bp, S. pombe
gcaccgctcgaggtcgacgatatag

SEQ ID NO: 87715 - DNA, 25 bp, S. pombe
gcactctacgcacttgggacataac

SEQ ID NO: 87716 - DNA, 25 bp, S. pombe
gcacgaagcctgtgggtatttctcg

SEQ ID NO: 87717 - DNA, 25 bp, S. pombe
gcagctaagctttgggtttcgtctc

SEQ ID NO: 87718 - DNA, 25 bp, S. pombe
gcagattcgttaatggtcttttcct

SEQ ID NO: 87719 - DNA, 25 bp, S. pombe
gcaaacggataaaactttctcctga

SEQ ID NO: 87720 - DNA, 25 bp, S. pombe
gcacgaccctttacgctctatgaag

SEQ ID NO: 87721 - DNA, 25 bp, S. pombe
gcaggacgccttttctttaactgac

SEQ ID NO: 87722 - DNA, 25 bp, S. pombe
gcaggattatccgtacttcttttaa

SEQ ID NO: 87723 - DNA, 25 bp, S. pombe
gcagtcgatgctggtgcaacatttt

SEQ ID NO: 87724 - DNA, 25 bp, S. pombe
gcatgtttgctattcatgtgccaaa

SEQ ID NO: 87725 - DNA, 25 bp, S. pombe
gcagatcgtgcttatcttggcacaa

SEQ ID NO: 87726 - DNA, 25 bp, S. pombe
gcagttggtattctcgctcatagta

SEQ ID NO: 87727 - DNA, 25 bp, S. pombe
gcaaatggtcatgtcgattggtcta

SEQ ID NO: 87728 - DNA, 25 bp, S. pombe
gcagtaatcgatttcctaactagca

SEQ ID NO: 87729 - DNA, 25 bp, S. pombe
gcagctgtatttttcctcggttatt

SEQ ID NO: 87730 - DNA, 25 bp, S. pombe
gcagttttatatccgccagtttttg

SEQ ID NO: 87731 - DNA, 25 bp, S. pombe
gcagttcgtttattctcattcgctt

SEQ ID NO: 87732 - DNA, 25 bp, S. pombe
gcagctagcaacgatgacggcttaa

SEQ ID NO: 87733 - DNA, 25 bp, S. pombe
gcacttgcatagctgaatccttcga

SEQ ID NO: 87734 - DNA, 25 bp, S. pombe
gaaagccctaggtgaagccacgcat

SEQ ID NO: 87735 - DNA, 25 bp, S. pombe
gaattgcctcaacaagacggccgtg

SEQ ID NO: 87736 - DNA, 25 bp, S. pombe
gcagacgtctttgctgacatcggaa

SEQ ID NO: 87737 - DNA, 25 bp, S. pombe
gcatggatgcacttaaccgacatta

SEQ ID NO: 87738 - DNA, 25 bp, S. pombe
gcatggcaccgtagtttcaatcgat

SEQ ID NO: 87739 - DNA, 25 bp, S. pombe
gcagcagctcttcggattctagtga

SEQ ID NO: 87740 - DNA, 25 bp, S. pombe
gcactctcagataccgaagacactc

SEQ ID NO: 87741 - DNA, 25 bp, S. pombe
gcagccttgtcccaacattagaatt

SEQ ID NO: 87742 - DNA, 25 bp, S. pombe
gcacttgatccaacaaatcctcatt

SEQ ID NO: 87743 - DNA, 25 bp, S. pombe
gcaatctgggcaaggactcccttca

SEQ ID NO: 87744 - DNA, 25 bp, S. pombe
gcagtcgcctcaagagattccagtt

SEQ ID NO: 87745 - DNA, 25 bp, S. pombe
gcagatccgctatggatattcctat

SEQ ID NO: 87746 - DNA, 25 bp, S. pombe
gcagccccagttacaagtacgacta

SEQ ID NO: 87747 - DNA, 25 bp, S. pombe
gcagccctccatgttacaaagacta

SEQ ID NO: 87748 - DNA, 25 bp, S. pombe
gcacctttcatacttagcgggacta

SEQ ID NO: 87749 - DNA, 25 bp, S. pombe
gcagcgcttagcaatcctagggaga

SEQ ID NO: 87750 - DNA, 25 bp, S. pombe
gcagctctgggcaatcttagtcaaa

SEQ ID NO: 87751 - DNA, 25 bp, S. pombe
gcacctgcggctttcaatgagcgaa

SEQ ID NO: 87752 - DNA, 25 bp, S. pombe
gcactgctctggttcatgcaaacga

SEQ ID NO: 87753 - DNA, 25 bp, S. pombe
gcagccagcggtcaaaattacattt

SEQ ID NO: 87754 - DNA, 25 bp, S. pombe
gcaggtggagtcgacattattctta

SEQ ID NO: 87755 - DNA, 25 bp, S. pombe
gcagagctaagtccctttctcaaaa

SEQ ID NO: 87756 - DNA, 25 bp, S. pombe
gcagtgcagcttcttgattcttgta

SEQ ID NO: 87757 - DNA, 25 bp, S. pombe
gcaggaattcgttgatgcccgtcgc

SEQ ID NO: 87758 - DNA, 25 bp, S. pombe
gcaaggaattttaccggcctattgt

SEQ ID NO: 87759 - DNA, 25 bp, S. pombe
gaaggaatccaaggtcggccctggt

SEQ ID NO: 87760 - DNA, 25 bp, S. pombe
gcagaagacctttttacaattcaaa

SEQ ID NO: 87761 - DNA, 25 bp, S. pombe
gcaagagcagcgctgttgataactg

SEQ ID NO: 87762 - DNA, 25 bp, S. pombe
gcagatggctgcagctgttgatgaa

SEQ ID NO: 87763 - DNA, 25 bp, S. pombe
gcagtcattgcaatctctcaggtta

SEQ ID NO: 87764 - DNA, 25 bp, S. pombe
gaagcatgtgcacgacatcgatgat

SEQ ID NO: 87765 - DNA, 25 bp, S. pombe
gcagcatgcaaccagcgatagtcat

SEQ ID NO: 87766 - DNA, 25 bp, S. pombe
gcagaagttgacctagcagccagaa

SEQ ID NO: 87767 - DNA, 25 bp, S. pombe
gcaagagaagcccaagcagcccaag

SEQ ID NO: 87768 - DNA, 25 bp, S. pombe
gcagcttgcaacttgtgtgccgcta

SEQ ID NO: 87769 - DNA, 25 bp, S. pombe
gcagaaatcgtcagagccgtggaaa

SEQ ID NO: 87770 - DNA, 25 bp, S. pombe
gcaggttcccttaacgattctacaa

SEQ ID NO: 87771 - DNA, 25 bp, S. pombe
gcaggagctcagtttaccgttccaa

SEQ ID NO: 87772 - DNA, 25 bp, S. pombe
gcacctccaattcatcagcgtgata

SEQ ID NO: 87773 - DNA, 25 bp, S. pombe
gcagcaaattcgtatttccggtcaa

SEQ ID NO: 87774 - DNA, 25 bp, S. pombe
gcactctggcatgttgcttatgaac

SEQ ID NO: 87775 - DNA, 25 bp, S. pombe
gcagcaaacccttcacgagtgtcag

SEQ ID NO: 87776 - DNA, 25 bp, S. pombe
gaagaggcgcgaaaccgctttctaa

SEQ ID NO: 87777 - DNA, 25 bp, S. pombe
gaagatggccaataccgtttgttaa

SEQ ID NO: 87778 - DNA, 25 bp, S. pombe
gaaatcgactaatcctgttcttttt

SEQ ID NO: 87779 - DNA, 25 bp, S. pombe
gaacctgaagcgcaattgaacccta

SEQ ID NO: 87780 - DNA, 25 bp, S. pombe
gcaacgctaccgactttgaagactt

SEQ ID NO: 87781 - DNA, 25 bp, S. pombe
gcaccctacattgctccagaagaat

SEQ ID NO: 87782 - DNA, 25 bp, S. pombe
gcagcagaaggttaagctacagcaa

SEQ ID NO: 87783 - DNA, 25 bp, S. pombe
gcagaacgcccattatttccggtta

SEQ ID NO: 87784 - DNA, 25 bp, S. pombe
gcaaacatcctaattaactacgcta

SEQ ID NO: 87785 - DNA, 25 bp, S. pombe
gcagaacttttttgccgtattcctt

SEQ ID NO: 87786 - DNA, 25 bp, S. pombe
gcagatcctatgattaacagcttct

SEQ ID NO: 87787 - DNA, 25 bp, S. pombe
gcagatgtcttaatggccacgcaaa

SEQ ID NO: 87788 - DNA, 25 bp, S. pombe
gcagttgcctgttgtgttcgatcga

SEQ ID NO: 87789 - DNA, 25 bp, S. pombe
gcagtactgctgacttttcgtcgaa

SEQ ID NO: 87790 - DNA, 25 bp, S. pombe
gcagcttctagcacgttagtcgaca

SEQ ID NO: 87791 - DNA, 25 bp, S. pombe
gcagctagtacgtttccgaaatcaa

SEQ ID NO: 87792 - DNA, 25 bp, S. pombe
gcagctcctactttatccatgaaat

SEQ ID NO: 87793 - DNA, 25 bp, S. pombe
gcaccggttgacattctttctgaag

SEQ ID NO: 87794 - DNA, 25 bp, S. pombe
gcagaggctttattcaactaacaac

SEQ ID NO: 87795 - DNA, 25 bp, S. pombe
gcagagacgtttgggctatcagcta

SEQ ID NO: 87796 - DNA, 25 bp, S. pombe
gcaccacctccaaagtacgatgata

SEQ ID NO: 87797 - DNA, 25 bp, S. pombe
gcagcggtgatctttgggcccatag

SEQ ID NO: 87798 - DNA, 25 bp, S. pombe
gcacgatgagccttacagatgactt

SEQ ID NO: 87799 - DNA, 25 bp, S. pombe
gcacttgcactttacggacacttaa

SEQ ID NO: 87800 - DNA, 25 bp, S. pombe
gcactcctcagtttgagcgtggtta

SEQ ID NO: 87801 - DNA, 25 bp, S. pombe
gcacccatcacttttggatctgtta

SEQ ID NO: 87802 - DNA, 25 bp, S. pombe
gcactgtactctatgtctcagctaa

SEQ ID NO: 87803 - DNA, 25 bp, S. pombe
gcactggtcatattcattcccttaa

SEQ ID NO: 87804 - DNA, 25 bp, S. pombe
gcagggtttgtcaaatttccccaag

SEQ ID NO: 87805 - DNA, 25 bp, S. pombe
gcagggattttgcttgcttccatgt

SEQ ID NO: 87806 - DNA, 25 bp, S. pombe
gcagttccttgtatacttctcagaa

SEQ ID NO: 87807 - DNA, 25 bp, S. pombe
gcacctcttaatctagacccagaaa

SEQ ID NO: 87808 - DNA, 25 bp, S. pombe
gcaccttctggaattatggcaccgt

SEQ ID NO: 87809 - DNA, 25 bp, S. pombe
gcacctgagttgcataatcctgtca

SEQ ID NO: 87810 - DNA, 25 bp, S. pombe
gcacttggtctcgtgtattctagca

SEQ ID NO: 87811 - DNA, 25 bp, S. pombe
gcacctggaactggtactcctgaaa

SEQ ID NO: 87812 - DNA, 25 bp, S. pombe
gcaacgttttcaactacagcttggt

SEQ ID NO: 87813 - DNA, 25 bp, S. pombe
gcaccggccaacatcgttgttttat

SEQ ID NO: 87814 - DNA, 25 bp, S. pombe
gcagcctaccatggaaactcagttt

SEQ ID NO: 87815 - DNA, 25 bp, S. pombe
gcacttactactaatgactcgggat

SEQ ID NO: 87816 - DNA, 25 bp, S. pombe
gaactttcgactttcccagattgga

SEQ ID NO: 87817 - DNA, 25 bp, S. pombe
gcaacgtaagttttcatccatgtcg

SEQ ID NO: 87818 - DNA, 25 bp, S. pombe
gcagctcggtggttatatgcggcac

SEQ ID NO: 87819 - DNA, 25 bp, S. pombe
gcagcagtggtcagcgtacttttaa

SEQ ID NO: 87820 - DNA, 25 bp, S. pombe
gcagcaatggccgtggagcagtatt

SEQ ID NO: 87821 - DNA, 25 bp, S. pombe
gaaatacaggacaggccgttacttt

SEQ ID NO: 87822 - DNA, 25 bp, S. pombe
gcaacatcgttacaccgaacaggat

SEQ ID NO: 87823 - DNA, 25 bp, S. pombe
gcaaattcaaaaagctcgtcaggtt

SEQ ID NO: 87824 - DNA, 25 bp, S. pombe
gcaacttcagcacttaacgtcgaac

SEQ ID NO: 87825 - DNA, 25 bp, S. pombe
gcagctctattaacaataccccttt

SEQ ID NO: 87826 - DNA, 25 bp, S. pombe
gcagaaaactaaagaatccgattga

SEQ ID NO: 87827 - DNA, 25 bp, S. pombe
gcacaggtagcccttatacgacagt

SEQ ID NO: 87828 - DNA, 25 bp, S. pombe
gcacgttccgttttgttgacagttt

SEQ ID NO: 87829 - DNA, 25 bp, S. pombe
gcagcgttgcgcctacttggaatga

SEQ ID NO: 87830 - DNA, 25 bp, S. pombe
gcagatttcctgttgctcgtataaa

SEQ ID NO: 87831 - DNA, 25 bp, S. pombe
gcagagttcctttatactcgatgga

SEQ ID NO: 87832 - DNA, 25 bp, S. pombe
gcagttcttctttcaaccttatgca

SEQ ID NO: 87833 - DNA, 25 bp, S. pombe
gcagaatctttcatgcacgatgctt

SEQ ID NO: 87834 - DNA, 25 bp, S. pombe
gcagctttgtttgccgctttaaaaa

SEQ ID NO: 87835 - DNA, 25 bp, S. pombe
gcagttgttatttcggttgatccta

SEQ ID NO: 87836 - DNA, 25 bp, S. pombe
gcagctcttgcttttagtgtcttat

SEQ ID NO: 87837 - DNA, 25 bp, S. pombe
gcagctcttgtaggttgggcatcaa

SEQ ID NO: 87838 - DNA, 25 bp, S. pombe
gcacgagttgcttgagcagctttac

SEQ ID NO: 87839 - DNA, 25 bp, S. pombe
gcagccaatatttcgcagtatccta

SEQ ID NO: 87840 - DNA, 25 bp, S. pombe
gcagacaatattctcgttcaccatc

SEQ ID NO: 87841 - DNA, 25 bp, S. pombe
gcacagattcaaccagcgaggaact

SEQ ID NO: 87842 - DNA, 25 bp, S. pombe
gcagaagggagcttttatttactac

SEQ ID NO: 87843 - DNA, 25 bp, S. pombe
gcagaacccattcgtcttttattac

SEQ ID NO: 87844 - DNA, 25 bp, S. pombe
gcaaacgccattcttttggaggagt

SEQ ID NO: 87845 - DNA, 25 bp, S. pombe
gcaaccttcaggctttactttgatt

SEQ ID NO: 87846 - DNA, 25 bp, S. pombe
gaatccctccaagattaccttacat

SEQ ID NO: 87847 - DNA, 25 bp, S. pombe
gcaaattcgctctgttcaaactaag

SEQ ID NO: 87848 - DNA, 25 bp, S. pombe
gcaaattcggcataatcagacctac

SEQ ID NO: 87849 - DNA, 25 bp, S. pombe
gcagcagcttcctcagctgtttacc

SEQ ID NO: 87850 - DNA, 25 bp, S. pombe
gcagcagcgacctaatcgtgttgat

SEQ ID NO: 87851 - DNA, 25 bp, S. pombe
gcacgccatggatacggatttacga

SEQ ID NO: 87852 - DNA, 25 bp, S. pombe
gcagcgcctttattacgaatctcat

SEQ ID NO: 87853 - DNA, 25 bp, S. pombe
gcaaccgttttctcttacatttcag

SEQ ID NO: 87854 - DNA, 25 bp, S. pombe
gcagaccgtcttgctatttacaatg

SEQ ID NO: 87855 - DNA, 25 bp, S. pombe
gcagagccattttgaggttcccgat

SEQ ID NO: 87856 - DNA, 25 bp, S. pombe
gcacactcagattacggttccatta

SEQ ID NO: 87857 - DNA, 25 bp, S. pombe
gcaagctgcagaacctactgtcgtt

SEQ ID NO: 87858 - DNA, 25 bp, S. pombe
gcaacgaactacgagtactgctatt

SEQ ID NO: 87859 - DNA, 25 bp, S. pombe
gcagataatgcacttcttcgtctag

SEQ ID NO: 87860 - DNA, 25 bp, S. pombe
gcagctgtagcgctttatctcgaag

SEQ ID NO: 87861 - DNA, 25 bp, S. pombe
gcagcgctgccgagattatctacaa

SEQ ID NO: 87862 - DNA, 25 bp, S. pombe
gcagagtgtcttcgtatttcacaga

SEQ ID NO: 87863 - DNA, 25 bp, S. pombe
gcacaccatcaaagttctccgaaaa

SEQ ID NO: 87864 - DNA, 25 bp, S. pombe
gcagaaaccactgttcctcaagaat

SEQ ID NO: 87865 - DNA, 25 bp, S. pombe
gcagcaacaacaattttcacccgaa

SEQ ID NO: 87866 - DNA, 25 bp, S. pombe
gcaacaagtttgctgtacctggaaa

SEQ ID NO: 87867 - DNA, 25 bp, S. pombe
gcaacacgaattgtgggcgtcggta

SEQ ID NO: 87868 - DNA, 25 bp, S. pombe
gcaccaaaccgtcgtggccgtggta

SEQ ID NO: 87869 - DNA, 25 bp, S. pombe
gcacctactccttggttagacggaa

SEQ ID NO: 87870 - DNA, 25 bp, S. pombe
gcacgttatgttggtgatcacttaa

SEQ ID NO: 87871 - DNA, 25 bp, S. pombe
gcaccttttgctagtctacttgaag

SEQ ID NO: 87872 - DNA, 25 bp, S. pombe
gcaccctttgttcgttgtatgcgaa

SEQ ID NO: 87873 - DNA, 25 bp, S. pombe
gcacccattatagtccattgttcag

SEQ ID NO: 87874 - DNA, 25 bp, S. pombe
gcagacgtgaagcttcatccttttt

SEQ ID NO: 87875 - DNA, 25 bp, S. pombe
gcagagctggaacatcgcaactttt

SEQ ID NO: 87876 - DNA, 25 bp, S. pombe
gcaccgtgctcctatatacagtatt

SEQ ID NO: 87877 - DNA, 25 bp, S. pombe
gcagcatcctggcttgcaaagatat

SEQ ID NO: 87878 - DNA, 25 bp, S. pombe
gcagatgcctgtattgttagagtga

SEQ ID NO: 87879 - DNA, 25 bp, S. pombe
gcactgcacctcacgtcgaatatga

SEQ ID NO: 87880 - DNA, 25 bp, S. pombe
gcagcaagctctaccgtatcaatat

SEQ ID NO: 87881 - DNA, 25 bp, S. pombe
gcacatgaactcgaacaggaacttt

SEQ ID NO: 87882 - DNA, 25 bp, S. pombe
gcacaaaagccagtgggacctgatt

SEQ ID NO: 87883 - DNA, 25 bp, S. pombe
gcacacaaacgcttggagtgaattt

SEQ ID NO: 87884 - DNA, 25 bp, S. pombe
gcactttcaaaaaccatcatcacta

SEQ ID NO: 87885 - DNA, 25 bp, S. pombe
gcacattgtatatcagggccctcaa

SEQ ID NO: 87886 - DNA, 25 bp, S. pombe
gcactcttagagttgtaccccaaag

SEQ ID NO: 87887 - DNA, 25 bp, S. pombe
gcagcctgttgacttggatgagccc

SEQ ID NO: 87888 - DNA, 25 bp, S. pombe
gcaccagctttattggattgccgtc

SEQ ID NO: 87889 - DNA, 25 bp, S. pombe
gcaaatttatcctgccggtgactat

SEQ ID NO: 87890 - DNA, 25 bp, S. pombe
gaactgtagtcactggccgtgtcga

SEQ ID NO: 87891 - DNA, 25 bp, S. pombe
gcacagcgtggttctcgtcggtaga

SEQ ID NO: 87892 - DNA, 25 bp, S. pombe
gcaagcttctactgctacagacgta

SEQ ID NO: 87893 - DNA, 25 bp, S. pombe
gcagagcccttcttttgggtacaaa

SEQ ID NO: 87894 - DNA, 25 bp, S. pombe
gcactcgattataatgacagcgctg

SEQ ID NO: 87895 - DNA, 25 bp, S. pombe
gcagcttgcatgtatattgtcggat

SEQ ID NO: 87896 - DNA, 25 bp, S. pombe
gcagcttgagtttgcttggagcatt

SEQ ID NO: 87897 - DNA, 25 bp, S. pombe
gcagcttctggttttggcaattcaa

SEQ ID NO: 87898 - DNA, 25 bp, S. pombe
gcacaatttctactcttccaatgat

SEQ ID NO: 87899 - DNA, 25 bp, S. pombe
gcacctttgagactgctcttggaga

SEQ ID NO: 87900 - DNA, 25 bp, S. pombe
gcagcactcactgatttgggaggaa

SEQ ID NO: 87901 - DNA, 25 bp, S. pombe
gcagcaatcctgactttccaaggta

SEQ ID NO: 87902 - DNA, 25 bp, S. pombe
gcaaatcttcatcagggtacgccaa

SEQ ID NO: 87903 - DNA, 25 bp, S. pombe
gaagtcgtcaagcaagtacccgaat

SEQ ID NO: 87904 - DNA, 25 bp, S. pombe
gcaagtcgttagcaagcgttcctaa

SEQ ID NO: 87905 - DNA, 25 bp, S. pombe
gcaaggccggcatagggttcttaat

SEQ ID NO: 87906 - DNA, 25 bp, S. pombe
gcagcattcacatttacctttcaag

SEQ ID NO: 87907 - DNA, 25 bp, S. pombe
gcagcagtcgattatggccttctct

SEQ ID NO: 87908 - DNA, 25 bp, S. pombe
gcacttcgtcaatggtttcagcaga

SEQ ID NO: 87909 - DNA, 25 bp, S. pombe
gcagctcttgaaatcttggctctgg

SEQ ID NO: 87910 - DNA, 25 bp, S. pombe
gcagcatgtgtgatttcagcctgta

SEQ ID NO: 87911 - DNA, 25 bp, S. pombe
gcagcgatatgtttgattcccgaat

SEQ ID NO: 87912 - DNA, 25 bp, S. pombe
gcagccatatctactattcctggat

SEQ ID NO: 87913 - DNA, 25 bp, S. pombe
gcagcccagctgatgtttcatttta

SEQ ID NO: 87914 - DNA, 25 bp, S. pombe
gcagcgatgagtcctgttccaataa

SEQ ID NO: 87915 - DNA, 25 bp, S. pombe
gcacgtatctggttcttacttgtta

SEQ ID NO: 87916 - DNA, 25 bp, S. pombe
gcagcttatttactcttgaccgttg

SEQ ID NO: 87917 - DNA, 25 bp, S. pombe
gcaaagcgttggtcttcggcaagta

SEQ ID NO: 87918 - DNA, 25 bp, S. pombe
gcaaagtttggtatctcccattcgc

SEQ ID NO: 87919 - DNA, 25 bp, S. pombe
gaaactttgcgtgtttggcgccggt

SEQ ID NO: 87920 - DNA, 25 bp, S. pombe
gcaaagttcgtgaaggttgtcccgg

SEQ ID NO: 87921 - DNA, 25 bp, S. pombe
gcaaacttcaaatcgcattacccag

SEQ ID NO: 87922 - DNA, 25 bp, S. pombe
gcacaagaatgctacccgttttcat

SEQ ID NO: 87923 - DNA, 25 bp, S. pombe
gcacgagatgtttctacggcttcat

SEQ ID NO: 87924 - DNA, 25 bp, S. pombe
gcagcaaacgcttatgtccaactat

SEQ ID NO: 87925 - DNA, 25 bp, S. pombe
gcactgacagagaaggcgctgccat

SEQ ID NO: 87926 - DNA, 25 bp, S. pombe
gcacgagatcactttgcttctcaga

SEQ ID NO: 87927 - DNA, 25 bp, S. pombe
gcagctggatgcctttttatcgaga

SEQ ID NO: 87928 - DNA, 25 bp, S. pombe
gcagctggagtctcatttcttggac

SEQ ID NO: 87929 - DNA, 25 bp, S. pombe
gcagctgtatatgatgctccactta

SEQ ID NO: 87930 - DNA, 25 bp, S. pombe
gcacaggttctgtcggtcaattatt

SEQ ID NO: 87931 - DNA, 25 bp, S. pombe
gcaccggttctcgtggtggagtcac

SEQ ID NO: 87932 - DNA, 25 bp, S. pombe
gcaaaggcttgtggaggtcaactca

SEQ ID NO: 87933 - DNA, 25 bp, S. pombe
gcaataagtgatatcccgttcctga

SEQ ID NO: 87934 - DNA, 25 bp, S. pombe
gcaaagtccgttccatccgaaaatg

SEQ ID NO: 87935 - DNA, 25 bp, S. pombe
gcaaatttcgtagcacatttccagt

SEQ ID NO: 87936 - DNA, 25 bp, S. pombe
gcacatcatccatgctgttcattat

SEQ ID NO: 87937 - DNA, 25 bp, S. pombe
gcacaatccaaagctatttcaaggc

SEQ ID NO: 87938 - DNA, 25 bp, S. pombe
gcaaatcgtacagctttacatcctg

SEQ ID NO: 87939 - DNA, 25 bp, S. pombe
gcaaaactatactcctacagccatg

SEQ ID NO: 87940 - DNA, 25 bp, S. pombe
gcaaaatgggtcttggtcatcgaaa

SEQ ID NO: 87941 - DNA, 25 bp, S. pombe
gcaaaggtcatctaacgcttctgaa

SEQ ID NO: 87942 - DNA, 25 bp, S. pombe
gcacacacatgtttcaatcgcttgg

SEQ ID NO: 87943 - DNA, 25 bp, S. pombe
gcacgcaattcggtacgctggtaga

SEQ ID NO: 87944 - DNA, 25 bp, S. pombe
gcagcattatcttcgtacgcgtcaa

SEQ ID NO: 87945 - DNA, 25 bp, S. pombe
gcagctatttgggaatcactttgtt

SEQ ID NO: 87946 - DNA, 25 bp, S. pombe
gcactctcaatctgtcgtaggcgaa

SEQ ID NO: 87947 - DNA, 25 bp, S. pombe
gcagcgtcttgcatcttgtgttagc

SEQ ID NO: 87948 - DNA, 25 bp, S. pombe
gcagctcaccatatctggatttgaa

SEQ ID NO: 87949 - DNA, 25 bp, S. pombe
gcagcgactgtgtttctatgttgaa

SEQ ID NO: 87950 - DNA, 25 bp, S. pombe
gcaaagctattcacctaaaggcaat

SEQ ID NO: 87951 - DNA, 25 bp, S. pombe
gcacaggtgaatctttaatggccaa

SEQ ID NO: 87952 - DNA, 25 bp, S. pombe
gcacagaagaatacgttaatggcaa

SEQ ID NO: 87953 - DNA, 25 bp, S. pombe
gcaagtacgcatcctttgagaccaa

SEQ ID NO: 87954 - DNA, 25 bp, S. pombe
gcacagagcacctcatttggcattg

SEQ ID NO: 87955 - DNA, 25 bp, S. pombe
tccagaatttccagatcagcatcag

SEQ ID NO: 87956 - DNA, 25 bp, S. pombe
tcctgttttgttgaagccatggccc

SEQ ID NO: 87957 - DNA, 25 bp, S. pombe
gaacaggttcggtatcgttggacgt

SEQ ID NO: 87958 - DNA, 25 bp, S. pombe
gcaaatgaagtctgaagcgccttaa

SEQ ID NO: 87959 - DNA, 25 bp, S. pombe
gcaaaatgagctcggtatcccttta

SEQ ID NO: 87960 - DNA, 25 bp, S. pombe
gcactatatatgctattctccactt

SEQ ID NO: 87961 - DNA, 25 bp, S. pombe
gcagctgatttctttctttgtcatt

SEQ ID NO: 87962 - DNA, 25 bp, S. pombe
gcacagttatgtgactctatggctt

SEQ ID NO: 87963 - DNA, 25 bp, S. pombe
gcacgttgtgggtctatggatgttt

SEQ ID NO: 87964 - DNA, 25 bp, S. pombe
gacgtaccaggacttggttggttct

SEQ ID NO: 87965 - DNA, 25 bp, S. pombe
gacttaccttacattcctggatcat

SEQ ID NO: 87966 - DNA, 25 bp, S. pombe
gcacctacagctaacatttccggaa

SEQ ID NO: 87967 - DNA, 25 bp, S. pombe
gattcatacattcaaacgacggacg

SEQ ID NO: 87968 - DNA, 25 bp, S. pombe
gcaccatctctttcaaacgtcagga

SEQ ID NO: 87969 - DNA, 25 bp, S. pombe
gcagccatgcgtgctcaaacattag

SEQ ID NO: 87970 - DNA, 25 bp, S. pombe
gaaggcggtttatacaaactcacaa

SEQ ID NO: 87971 - DNA, 25 bp, S. pombe
gcaactgccgttcaaaataatccta

SEQ ID NO: 87972 - DNA, 25 bp, S. pombe
gcacttgctagtggccatttagtta

SEQ ID NO: 87973 - DNA, 25 bp, S. pombe
gcactatttcggctgttttactttt

SEQ ID NO: 87974 - DNA, 25 bp, S. pombe
gcaaaacttgctctttcgttataga

SEQ ID NO: 87975 - DNA, 25 bp, S. pombe
gcaacaaatttgactttcttgaatc

SEQ ID NO: 87976 - DNA, 25 bp, S. pombe
gcaagaaggtctttgctcctcaccg

SEQ ID NO: 87977 - DNA, 25 bp, S. pombe
gcaagaaggttaaccctactgccgt

SEQ ID NO: 87978 - DNA, 25 bp, S. pombe
gcaaacgatgcttagaaaggaatta

SEQ ID NO: 87979 - DNA, 25 bp, S. pombe
gcaaactgcctctcgtgaaggtgtt

SEQ ID NO: 87980 - DNA, 25 bp, S. pombe
gcaaatccgtcagtcagttcgaaga

SEQ ID NO: 87981 - DNA, 25 bp, S. pombe
gcaacccgtattccttctaatgaag

SEQ ID NO: 87982 - DNA, 25 bp, S. pombe
gcaagccccacaatttcaatcaaaa

SEQ ID NO: 87983 - DNA, 25 bp, S. pombe
gcacagccaatctcattatcaacat

SEQ ID NO: 87984 - DNA, 25 bp, S. pombe
gcaagctaaagctgcggccgaaaat

SEQ ID NO: 87985 - DNA, 25 bp, S. pombe
gcaaccaacgttgggcctcaaattc

SEQ ID NO: 87986 - DNA, 25 bp, S. pombe
gcaaaacgctttggacgctacaatt

SEQ ID NO: 87987 - DNA, 25 bp, S. pombe
gcaaacgaggttatggctcatcctt

SEQ ID NO: 87988 - DNA, 25 bp, S. pombe
gcaaaagtctgtttcggtttccatt

SEQ ID NO: 87989 - DNA, 25 bp, S. pombe
gcaagggtgcttgaaagttctccag

SEQ ID NO: 87990 - DNA, 25 bp, S. pombe
gcacaaacgtgccttgattgaacat

SEQ ID NO: 87991 - DNA, 25 bp, S. pombe
gcactcaaggctcctctattgaaga

SEQ ID NO: 87992 - DNA, 25 bp, S. pombe
gcacatggctagtttgttatgctga

SEQ ID NO: 87993 - DNA, 25 bp, S. pombe
gcactgatgttcttactctagctga

SEQ ID NO: 87994 - DNA, 25 bp, S. pombe
gcactgattcccttcatatagcgaa

SEQ ID NO: 87995 - DNA, 25 bp, S. pombe
gcacggatactcacttggttcttgt

SEQ ID NO: 87996 - DNA, 25 bp, S. pombe
gaaggcaagcttactaggttaggtt

SEQ ID NO: 87997 - DNA, 25 bp, S. pombe
gaaatccggcttatcgactttggta

SEQ ID NO: 87998 - DNA, 25 bp, S. pombe
gaaccaaaagggaaactcatctcgt

SEQ ID NO: 87999 - DNA, 25 bp, S. pombe
gcacaacagctaaatcatcatcccg

SEQ ID NO: 88000 - DNA, 25 bp, S. pombe
gcaaaccaaggtttctcctggtcaa

SEQ ID NO: 88001 - DNA, 25 bp, S. pombe
gcaaatttgtcgctgaggccaagta

SEQ ID NO: 88002 - DNA, 25 bp, S. pombe
gcaaattttacgtcgcggatagttt

SEQ ID NO: 88003 - DNA, 25 bp, S. pombe
gcaagcaactatttactagaacttc

SEQ ID NO: 88004 - DNA, 25 bp, S. pombe
gcaaccctcaacttcatataacttt

SEQ ID NO: 88005 - DNA, 25 bp, S. pombe
gaaccttaccgacatgcaactgttt

SEQ ID NO: 88006 - DNA, 25 bp, S. pombe
taattttttcgagcagcggtccgca

SEQ ID NO: 88007 - DNA, 25 bp, S. pombe
gacttgccttttatgagcggaacta

SEQ ID NO: 88008 - DNA, 25 bp, S. pombe
gcacctcctttttctggacaaagca

SEQ ID NO: 88009 - DNA, 25 bp, S. pombe
gcaacccctggttttgaaagagact

SEQ ID NO: 88010 - DNA, 25 bp, S. pombe
gcacaagtgacgctgagtttctctc

SEQ ID NO: 88011 - DNA, 25 bp, S. pombe
gaaggccttgcagcattttaccgag

SEQ ID NO: 88012 - DNA, 25 bp, S. pombe
gcaacaccttttgattaaatcccaa

SEQ ID NO: 88013 - DNA, 25 bp, S. pombe
gcaacgcgtttattgagttcgtaaa

SEQ ID NO: 88014 - DNA, 25 bp, S. pombe
gcacaccctttaatccgactgtaaa

SEQ ID NO: 88015 - DNA, 25 bp, S. pombe
gcacccctttaccttcaatgattat

SEQ ID NO: 88016 - DNA, 25 bp, S. pombe
gcacgccgattttcattgtcaacaa

SEQ ID NO: 88017 - DNA, 25 bp, S. pombe
gcacatgctcttgcaacgggtcata

SEQ ID NO: 88018 - DNA, 25 bp, S. pombe
gcacatgcttgtcaacattgggtcg

SEQ ID NO: 88019 - DNA, 25 bp, S. pombe
gcacctgaacaagctgccatggttt

SEQ ID NO: 88020 - DNA, 25 bp, S. pombe
gcaacatctactccaaaacgtctga

SEQ ID NO: 88021 - DNA, 25 bp, S. pombe
gcaagcctgcttcggagaacgtcta

SEQ ID NO: 88022 - DNA, 25 bp, S. pombe
gcaccgtttgtctctcaatacttaa

SEQ ID NO: 88023 - DNA, 25 bp, S. pombe
gcacgcattctgaccttgtatttca

SEQ ID NO: 88024 - DNA, 25 bp, S. pombe
gcacctcttccgcagtatatataaa

SEQ ID NO: 88025 - DNA, 25 bp, S. pombe
gcacctcttctttggttagcacata

SEQ ID NO: 88026 - DNA, 25 bp, S. pombe
gcacttttcttggtgtatggcctac

SEQ ID NO: 88027 - DNA, 25 bp, S. pombe
gcactttctttgcttttgtctcaag

SEQ ID NO: 88028 - DNA, 25 bp, S. pombe
gcactttctttgcttcctcataaag

SEQ ID NO: 88029 - DNA, 25 bp, S. pombe
gcacgttttcatgcaagcagcttgc

SEQ ID NO: 88030 - DNA, 25 bp, S. pombe
gcacatgctgttagttcaacgctta

SEQ ID NO: 88031 - DNA, 25 bp, S. pombe
gcaaccggcttctacaatacaaatt

SEQ ID NO: 88032 - DNA, 25 bp, S. pombe
gcacgcttctcaaatccaaggtttt

SEQ ID NO: 88033 - DNA, 25 bp, S. pombe
gaccggtcaagctgagggtttctct

SEQ ID NO: 88034 - DNA, 25 bp, S. pombe
gcactcggtgtttatactggtcgta

SEQ ID NO: 88035 - DNA, 25 bp, S. pombe
gcacttggcgttttatatcggcgag

SEQ ID NO: 88036 - DNA, 25 bp, S. pombe
gaagcttgggactaagtcgccggaa

SEQ ID NO: 88037 - DNA, 25 bp, S. pombe
gcaagcctgtaataattcgcgtggt

SEQ ID NO: 88038 - DNA, 25 bp, S. pombe
gcacatttgttggagtcacttcttg

SEQ ID NO: 88039 - DNA, 25 bp, S. pombe
gcaaatgcgcccttaattcttcgtc

SEQ ID NO: 88040 - DNA, 25 bp, S. pombe
gcaaaatcccgtacttttcagtctt

SEQ ID NO: 88041 - DNA, 25 bp, S. pombe
gcaaaatcgccttttacttcagcag

SEQ ID NO: 88042 - DNA, 25 bp, S. pombe
gcaaaattactgttgtccccggatg

SEQ ID NO: 88043 - DNA, 25 bp, S. pombe
gcaacaattcctttaccttctttgg

SEQ ID NO: 88044 - DNA, 25 bp, S. pombe
gcaaaaatgccatcgatcgcgtttt

SEQ ID NO: 88045 - DNA, 25 bp, S. pombe
gcaattagaggatggccgtactctt

SEQ ID NO: 88046 - DNA, 25 bp, S. pombe
gaattcaaggaacccgatgttgcta

SEQ ID NO: 88047 - DNA, 25 bp, S. pombe
gcaatcagaccatttcaattcaccc

SEQ ID NO: 88048 - DNA, 25 bp, S. pombe
gcaacaacctgtacaactcttacgt

SEQ ID NO: 88049 - DNA, 25 bp, S. pombe
gcaacaacgtgaccaattctgatga

SEQ ID NO: 88050 - DNA, 25 bp, S. pombe
gcacagattacggtcgattctcaat

SEQ ID NO: 88051 - DNA, 25 bp, S. pombe
gcaactcaacgtttttagcatcagc

SEQ ID NO: 88052 - DNA, 25 bp, S. pombe
gcacacttactttcttgcttgaaca

SEQ ID NO: 88053 - DNA, 25 bp, S. pombe
gcaaagtgcttcatctatgcttaaa

SEQ ID NO: 88054 - DNA, 25 bp, S. pombe
gcacaatgtcccatctagtatgaat

SEQ ID NO: 88055 - DNA, 25 bp, S. pombe
gcacacttggatggttcctgtacta

SEQ ID NO: 88056 - DNA, 25 bp, S. pombe
gcaaccgaaggcgtcttgaacaaga

SEQ ID NO: 88057 - DNA, 25 bp, S. pombe
gcaaccgtgacgatcctaagaagca

SEQ ID NO: 88058 - DNA, 25 bp, S. pombe
gcaaaaccgtttcccagtagtgaag

SEQ ID NO: 88059 - DNA, 25 bp, S. pombe
gcaaaacggttgaccttccaagaag

SEQ ID NO: 88060 - DNA, 25 bp, S. pombe
gcaaagacatggtggcctcttgcac

SEQ ID NO: 88061 - DNA, 25 bp, S. pombe
gcaagccatatagacggttcatcaa

SEQ ID NO: 88062 - DNA, 25 bp, S. pombe
gcactcctgtcggtttgaatgctga

SEQ ID NO: 88063 - DNA, 25 bp, S. pombe
gcacttttctgaagcatctcttatg

SEQ ID NO: 88064 - DNA, 25 bp, S. pombe
gcacttttctgctatcctgatttaa

SEQ ID NO: 88065 - DNA, 25 bp, S. pombe
gcacaaatttgcttccgtagtatca

SEQ ID NO: 88066 - DNA, 25 bp, S. pombe
gcaaaatctatgctctcgtcactca

SEQ ID NO: 88067 - DNA, 25 bp, S. pombe
gcacagatacattggctgccgtaat

SEQ ID NO: 88068 - DNA, 25 bp, S. pombe
gaaccaaactcaggcttttgtggct

SEQ ID NO: 88069 - DNA, 25 bp, S. pombe
gaaggcatctactggcgtttgttta

SEQ ID NO: 88070 - DNA, 25 bp, S. pombe
gcaagctatcgacggtgttgttttt

SEQ ID NO: 88071 - DNA, 25 bp, S. pombe
gcaagccaagcgtcatcttgttgga

SEQ ID NO: 88072 - DNA, 25 bp, S. pombe
gcaaacgtttctggtggcttattaa

SEQ ID NO: 88073 - DNA, 25 bp, S. pombe
gcactcttagaagttgttcgcctga

SEQ ID NO: 88074 - DNA, 25 bp, S. pombe
gcaattgaaaccttgttcggctgtc

SEQ ID NO: 88075 - DNA, 25 bp, S. pombe
gcaaaatatacctccttctgatgtg

SEQ ID NO: 88076 - DNA, 25 bp, S. pombe
gcaagaagcagttccccattgataa

SEQ ID NO: 88077 - DNA, 25 bp, S. pombe
gcaagcaagagttttcatcatcaaa

SEQ ID NO: 88078 - DNA, 25 bp, S. pombe
gcaagtgcggctttgaatccagtac

SEQ ID NO: 88079 - DNA, 25 bp, S. pombe
gcaaaagtcctttgcttcctaaaga

SEQ ID NO: 88080 - DNA, 25 bp, S. pombe
gcaaaaaactgttgtccgcctgaaa

SEQ ID NO: 88081 - DNA, 25 bp, S. pombe
gcaagcaatgacaactcgggagcct

SEQ ID NO: 88082 - DNA, 25 bp, S. pombe
gcaagcaatcttatcgacgaccagg

SEQ ID NO: 88083 - DNA, 25 bp, S. pombe
gcactccctgtttctaagcagcgat

SEQ ID NO: 88084 - DNA, 25 bp, S. pombe
gcacttcgttattctgaagctgctc

SEQ ID NO: 88085 - DNA, 25 bp, S. pombe
gcaacggttgcatccattagtgatt

SEQ ID NO: 88086 - DNA, 25 bp, S. pombe
gcaaggccattgctcctaagtttga

SEQ ID NO: 88087 - DNA, 25 bp, S. pombe
gcaaggcctgtggtccgaacaaaat

SEQ ID NO: 88088 - DNA, 25 bp, S. pombe
gcaatgcatcgatgattcctttgat

SEQ ID NO: 88089 - DNA, 25 bp, S. pombe
gcaatgggctgctcgtaagagtcga

SEQ ID NO: 88090 - DNA, 25 bp, S. pombe
gcaacgtattcctttgtctgataac

SEQ ID NO: 88091 - DNA, 25 bp, S. pombe
gcaagcgtatgggtcttatccgaac

SEQ ID NO: 88092 - DNA, 25 bp, S. pombe
gcaaagttgctcctctgaatccgat

SEQ ID NO: 88093 - DNA, 25 bp, S. pombe
gcaaagtgttccgagctcatgaaaa

SEQ ID NO: 88094 - DNA, 25 bp, S. pombe
gcaaccataccataccgtgatcaag

SEQ ID NO: 88095 - DNA, 25 bp, S. pombe
gcaaatgtaacttctacgggccaag

SEQ ID NO: 88096 - DNA, 25 bp, S. pombe
gcaatcggtaaagcaaactgccaag

SEQ ID NO: 88097 - DNA, 25 bp, S. pombe
gaatcaattgaaaccaacggccatg

SEQ ID NO: 88098 - DNA, 25 bp, S. pombe
gcaacagtttaagcactcggccatt

SEQ ID NO: 88099 - DNA, 25 bp, S. pombe
gcaacgattttaggacctgcccata

SEQ ID NO: 88100 - DNA, 25 bp, S. pombe
gcaactgatttacaacggaccaatt

SEQ ID NO: 88101 - DNA, 25 bp, S. pombe
gcaagcgatttacactcgtgcggct

SEQ ID NO: 88102 - DNA, 25 bp, S. pombe
gcaaaatcatgaaagaccgcctcgt

SEQ ID NO: 88103 - DNA, 25 bp, S. pombe
gcaaaatatgtttcgtcgcgtcatg

SEQ ID NO: 88104 - DNA, 25 bp, S. pombe
gcaaggattgtacctccggaatgga

SEQ ID NO: 88105 - DNA, 25 bp, S. pombe
gcaaggcatggtcactcaatggcaa

SEQ ID NO: 88106 - DNA, 25 bp, S. pombe
gcaatggccctcaagctcaaggaga

SEQ ID NO: 88107 - DNA, 25 bp, S. pombe
gcaacctctgctcgcgtgaagaaga

SEQ ID NO: 88108 - DNA, 25 bp, S. pombe
gcaagacattcttcagtgggaacaa

SEQ ID NO: 88109 - DNA, 25 bp, S. pombe
gcaaaattctgtcatggctgaggca

SEQ ID NO: 88110 - DNA, 25 bp, S. pombe
gcaaatctcggattgctatgcaaaa

SEQ ID NO: 88111 - DNA, 25 bp, S. pombe
gcaaatgctcctggtgcataccaaa

SEQ ID NO: 88112 - DNA, 25 bp, S. pombe
gcaactgctagtggtgatcaacgta

SEQ ID NO: 88113 - DNA, 25 bp, S. pombe
gcacaatgcttgcaactgcttctga

SEQ ID NO: 88114 - DNA, 25 bp, S. pombe
gcaaactggtctaccttgagtctat

SEQ ID NO: 88115 - DNA, 25 bp, S. pombe
gcaaatttgctgtcgaagggctttc

SEQ ID NO: 88116 - DNA, 25 bp, S. pombe
gcaagtgccgtggaaacttcagcaa

SEQ ID NO: 88117 - DNA, 25 bp, S. pombe
gaagttcgcgaagcctttaaagtct

SEQ ID NO: 88118 - DNA, 25 bp, S. pombe
gaatctacccctgccgttgaaaaag

SEQ ID NO: 88119 - DNA, 25 bp, S. pombe
gaattcgcccgggatagcttagaaa

SEQ ID NO: 88120 - DNA, 25 bp, S. pombe
gcaacggttctgatgtcttccaaag

SEQ ID NO: 88121 - DNA, 25 bp, S. pombe
gcaacgacttcttgagctgatggtt

SEQ ID NO: 88122 - DNA, 25 bp, S. pombe
gcacacgttgacatatgccattcag

SEQ ID NO: 88123 - DNA, 25 bp, S. pombe
gcaagagcagctgcatctcgacaaa

SEQ ID NO: 88124 - DNA, 25 bp, S. pombe
gcaagcacgcattattcgtcgacaa

SEQ ID NO: 88125 - DNA, 25 bp, S. pombe
gcaaatactgtgctatctatccttt

SEQ ID NO: 88126 - DNA, 25 bp, S. pombe
gaattcaacgtgtatgctgatcctg

SEQ ID NO: 88127 - DNA, 25 bp, S. pombe
gcaatctacggctgctggtcttgga

SEQ ID NO: 88128 - DNA, 25 bp, S. pombe
gaatccacggtcctcgttagcggag

SEQ ID NO: 88129 - DNA, 25 bp, S. pombe
gcaatacacggtctttcttcggaaa

SEQ ID NO: 88130 - DNA, 25 bp, S. pombe
gcaatgaccagttttcgttgtccaa

SEQ ID NO: 88131 - DNA, 25 bp, S. pombe
gcaacgaagtgctttcagcttttaa

SEQ ID NO: 88132 - DNA, 25 bp, S. pombe
gcaacttgtttgattcggtattctc

SEQ ID NO: 88133 - DNA, 25 bp, S. pombe
gaatgtacgcccaaggtgttaccgt

SEQ ID NO: 88134 - DNA, 25 bp, S. pombe
gaatgtacgcccaaagtcttcggga

SEQ ID NO: 88135 - DNA, 25 bp, S. pombe
gaattgggcaaactcgtccgacgtt

SEQ ID NO: 88136 - DNA, 25 bp, S. pombe
gcaaagggtagctctgtggttcgtt

SEQ ID NO: 88137 - DNA, 25 bp, S. pombe
gcaatcggttcttactatttgtccc

SEQ ID NO: 88138 - DNA, 25 bp, S. pombe
gcacaagttttgaccgagctcgacg

SEQ ID NO: 88139 - DNA, 25 bp, S. pombe
gcaatacggcaattacctgaccatt

SEQ ID NO: 88140 - DNA, 25 bp, S. pombe
gcaaagtcttcatctcaaacggcgc

SEQ ID NO: 88141 - DNA, 25 bp, S. pombe
gcaagagtcttattggcctgtaact

SEQ ID NO: 88142 - DNA, 25 bp, S. pombe
gcaagagctctcaacaagtcgtgga

SEQ ID NO: 88143 - DNA, 25 bp, S. pombe
gcaagcatccgttctttgttagaga

SEQ ID NO: 88144 - DNA, 25 bp, S. pombe
gcacaatgcctcattattctttgtt

SEQ ID NO: 88145 - DNA, 25 bp, S. pombe
gcaaaggctctattggccatctttt

SEQ ID NO: 88146 - DNA, 25 bp, S. pombe
gcaaagttcctattaacagttccaa

SEQ ID NO: 88147 - DNA, 25 bp, S. pombe
gacaatttaattgttcccctcatcc

SEQ ID NO: 88148 - DNA, 25 bp, S. pombe
gcaagtacgtacattttcctatcct

SEQ ID NO: 88149 - DNA, 25 bp, S. pombe
gcaaggacgttgatgttgtcactaa

SEQ ID NO: 88150 - DNA, 25 bp, S. pombe
gcaatcgttgtttttgtgccccaac

SEQ ID NO: 88151 - DNA, 25 bp, S. pombe
gcaaatttttcagcgatgtcttcta

SEQ ID NO: 88152 - DNA, 25 bp, S. pombe
gcaacttttcacaactatggcccat

SEQ ID NO: 88153 - DNA, 25 bp, S. pombe
gcaaatttctcagttttcagcccat

SEQ ID NO: 88154 - DNA, 25 bp, S. pombe
gcaaattgtgcctctttccaagata

SEQ ID NO: 88155 - DNA, 25 bp, S. pombe
gcaacaaggctatctcgcaggtcga

SEQ ID NO: 88156 - DNA, 25 bp, S. pombe
gcaaatcgcctcgtttattcgaaat

SEQ ID NO: 88157 - DNA, 25 bp, S. pombe
gcaaattgtttgttacattctgatt

SEQ ID NO: 88158 - DNA, 25 bp, S. pombe
gcaaaattcctccttgcattcaatt

SEQ ID NO: 88159 - DNA, 25 bp, S. pombe
gcaaaatgctggtctttcttcaatt

SEQ ID NO: 88160 - DNA, 25 bp, S. pombe
gcaaagatcgtggacttctccaatt

SEQ ID NO: 88161 - DNA, 25 bp, S. pombe
gcaagaatctcgatctggtggtaga

SEQ ID NO: 88162 - DNA, 25 bp, S. pombe
gcaagaactgcacttcgagctgtta

SEQ ID NO: 88163 - DNA, 25 bp, S. pombe
gcaaatatgcgactgtccagcgttt

SEQ ID NO: 88164 - DNA, 25 bp, S. pombe
gaatatcaatgctactaggccaggt

SEQ ID NO: 88165 - DNA, 25 bp, S. pombe
gcaacatccatatctagccaaaatt

SEQ ID NO: 88166 - DNA, 25 bp, S. pombe
gcaattcccttctatgccatgaata

SEQ ID NO: 88167 - DNA, 25 bp, S. pombe
gcaaccagtgctttagacagtcata

SEQ ID NO: 88168 - DNA, 25 bp, S. pombe
gcaaagcacgtgcatctgcgttaaa

SEQ ID NO: 88169 - DNA, 25 bp, S. pombe
gcaacaagcgttttctcacatggta

SEQ ID NO: 88170 - DNA, 25 bp, S. pombe
gcaacaaccttctaaccatgggaga

SEQ ID NO: 88171 - DNA, 25 bp, S. pombe
gcaaattattcaactcgcctggaag

SEQ ID NO: 88172 - DNA, 25 bp, S. pombe
gcaaatttctaagctgacggataat

SEQ ID NO: 88173 - DNA, 25 bp, S. pombe
gcaaacttatgggatgtcaccgata

SEQ ID NO: 88174 - DNA, 25 bp, S. pombe
gcaaagctcatttccttctgtttat

SEQ ID NO: 88175 - DNA, 25 bp, S. pombe
gcaacctgcttctgctatttttatg

SEQ ID NO: 88176 - DNA, 25 bp, S. pombe
gcaaacttccaactcattgttatta

SEQ ID NO: 88177 - DNA, 25 bp, S. pombe
gcaatttgttttgacatccgcttcc

SEQ ID NO: 88178 - DNA, 25 bp, S. pombe
gcaaacatttatccagcaggtcggt

SEQ ID NO: 88179 - DNA, 25 bp, S. pombe
gcaacccaatttccatttgcatgtt

SEQ ID NO: 88180 - DNA, 25 bp, S. pombe
gcaacatatgttctcagcagccggg

SEQ ID NO: 88181 - DNA, 25 bp, S. pombe
gcaagagtgttgctcatgctcctcg

SEQ ID NO: 88182 - DNA, 25 bp, S. pombe
gcaaatgtgctgctgtagccacatc

SEQ ID NO: 88183 - DNA, 25 bp, S. pombe
gcaagattgctgttattgctcacat

SEQ ID NO: 88184 - DNA, 25 bp, S. pombe
gcaatgctgccgttgaaaaccaagt

SEQ ID NO: 88185 - DNA, 25 bp, S. pombe
gcaactgttgttacggtacctgtcg

SEQ ID NO: 88186 - DNA, 25 bp, S. pombe
gaatcgctgtacttgggaaccgtcg

SEQ ID NO: 88187 - DNA, 25 bp, S. pombe
gactgattcgtcacttttaagctta

SEQ ID NO: 88188 - DNA, 25 bp, S. pombe
gcaactttctctttccttggttgaa

SEQ ID NO: 88189 - DNA, 25 bp, S. pombe
gcaactttctgcttctacgtgttta

SEQ ID NO: 88190 - DNA, 25 bp, S. pombe
gcaaagtctggctttagcgtgttgt

SEQ ID NO: 88191 - DNA, 25 bp, S. pombe
gcaatatcttttctacttcttctcg

SEQ ID NO: 88192 - DNA, 25 bp, S. pombe
gcaatgtctctgatgtcgaactttt

SEQ ID NO: 88193 - DNA, 25 bp, S. pombe
gcaagggtggtgtcgcatatctgtt

SEQ ID NO: 88194 - DNA, 25 bp, S. pombe
gcaaggctgcattgaaaatccccaa

SEQ ID NO: 88195 - DNA, 25 bp, S. pombe
gcaaactgctcgtaaatctaccggt

SEQ ID NO: 88196 - DNA, 25 bp, S. pombe
gcaaactgcacgtaaatcaactggt

SEQ ID NO: 88197 - DNA, 25 bp, S. pombe
gcaacccatcgatactgtcaagagt

SEQ ID NO: 88198 - DNA, 25 bp, S. pombe
gcaatcagcctttatgccagcaaag

SEQ ID NO: 88199 - DNA, 25 bp, S. pombe
gcaagagctcgatatgatccatcaa

SEQ ID NO: 88200 - DNA, 25 bp, S. pombe
gcaagtcgctgtgagatctgtgaaa

SEQ ID NO: 88201 - DNA, 25 bp, S. pombe
gcaagctcggcgaactcgtacaata

SEQ ID NO: 88202 - DNA, 25 bp, S. pombe
gcaacattggtttgcttgcttccaa

SEQ ID NO: 88203 - DNA, 25 bp, S. pombe
gcaaaatcctttccaaactcctgaa

SEQ ID NO: 88204 - DNA, 25 bp, S. pombe
gcaaaccgctcttcaacaaatactg

SEQ ID NO: 88205 - DNA, 25 bp, S. pombe
gcaatgccaacagccgtcaaaacgt

SEQ ID NO: 88206 - DNA, 25 bp, S. pombe
gttgtagacaccagtggattccccg

SEQ ID NO: 88207 - DNA, 25 bp, S. pombe
gcaagcgtgttaccattcaacccaa

SEQ ID NO: 88208 - DNA, 25 bp, S. pombe
gttcctctttggttgctacttacga

SEQ ID NO: 88209 - DNA, 25 bp, S. pombe
tgcaacggtttcagtttgggttctt

SEQ ID NO: 88210 - DNA, 25 bp, S. pombe
gaaggaatacacataccaaagttta

SEQ ID NO: 88211 - DNA, 25 bp, S. pombe
gaagttatcagctcgttaatacggg

SEQ ID NO: 88212 - DNA, 25 bp, S. pombe
gaataaccagccattactttcgttg

SEQ ID NO: 88213 - DNA, 25 bp, S. pombe
gcaagaccgtgtaatgtaccagcaa

SEQ ID NO: 88214 - DNA, 25 bp, S. pombe
gcaactactcttatgggcaagcaca

SEQ ID NO: 88215 - DNA, 25 bp, S. pombe
gcaagtacggaaagggcagcagaca

SEQ ID NO: 88216 - DNA, 25 bp, S. pombe
gcaagtatcgagacaagctcccaga

SEQ ID NO: 88217 - DNA, 25 bp, S. pombe
gcaagttgagactacgccacagaat

SEQ ID NO: 88218 - DNA, 25 bp, S. pombe
gcaagccaatattctacagccacga

SEQ ID NO: 88219 - DNA, 25 bp, S. pombe
gcaacaatattctggactcgctaag

SEQ ID NO: 88220 - DNA, 25 bp, S. pombe
gcaacagtgttccagaagccgctta

SEQ ID NO: 88221 - DNA, 25 bp, S. pombe
gcaatatattgcacttcagggcgtt

SEQ ID NO: 88222 - DNA, 25 bp, S. pombe
gaattttacatttcgaagaggcatt

SEQ ID NO: 88223 - DNA, 25 bp, S. pombe
gaattatgaaaccttacagggcctt

SEQ ID NO: 88224 - DNA, 25 bp, S. pombe
gcaacttgctacttttttccgggct

SEQ ID NO: 88225 - DNA, 25 bp, S. pombe
gcaactccgccacttttacgggaag

SEQ ID NO: 88226 - DNA, 25 bp, S. pombe
gcaactctcctcctaaatgtcggaa

SEQ ID NO: 88227 - DNA, 25 bp, S. pombe
gcaagtcccggtttttccagaagag

SEQ ID NO: 88228 - DNA, 25 bp, S. pombe
gcaatcacctatgcagtattcctac

SEQ ID NO: 88229 - DNA, 25 bp, S. pombe
gcaacctgctatgctgattttggat

SEQ ID NO: 88230 - DNA, 25 bp, S. pombe
gcaacactgttcttgttcgtggtaa

SEQ ID NO: 88231 - DNA, 25 bp, S. pombe
gcaaggagtcttctttcgatgatga

SEQ ID NO: 88232 - DNA, 25 bp, S. pombe
gcaaggagcctgttcgctctttaaa

SEQ ID NO: 88233 - DNA, 25 bp, S. pombe
gcaaggctggtccaacatgatgtta

SEQ ID NO: 88234 - DNA, 25 bp, S. pombe
gcaatccaccatttagctctagtga

SEQ ID NO: 88235 - DNA, 25 bp, S. pombe
gcaacgtaggtctagcagtcattat

SEQ ID NO: 88236 - DNA, 25 bp, S. pombe
gcaactgctaataccattttccaat

SEQ ID NO: 88237 - DNA, 25 bp, S. pombe
gcaattttgggcttcggtccgtcaa

SEQ ID NO: 88238 - DNA, 25 bp, S. pombe
gaagttttggaacctgtcggagcaa

SEQ ID NO: 88239 - DNA, 25 bp, S. pombe
gattttttcgaaccttggccgatgt

SEQ ID NO: 88240 - DNA, 25 bp, S. pombe
gaattgtaccgagaactgaccgtag

SEQ ID NO: 88241 - DNA, 25 bp, S. pombe
gaattgtcccgagaagttccttaag

SEQ ID NO: 88242 - DNA, 25 bp, S. pombe
gaatggtactaagagtgcccctata

SEQ ID NO: 88243 - DNA, 25 bp, S. pombe
gaattgcgataatccaccctcctta

SEQ ID NO: 88244 - DNA, 25 bp, S. pombe
gaattggtttgacatgcctgccacc

SEQ ID NO: 88245 - DNA, 25 bp, S. pombe
gcaattggtattcatttacgccgaa

SEQ ID NO: 88246 - DNA, 25 bp, S. pombe
gcaactactattcattcttcagccg

SEQ ID NO: 88247 - DNA, 25 bp, S. pombe
gcaacttttctcattttaacgctga

SEQ ID NO: 88248 - DNA, 25 bp, S. pombe
gcaagttatctttcttcacctaatc

SEQ ID NO: 88249 - DNA, 25 bp, S. pombe
gcaactgtcttttttaattcttccg

SEQ ID NO: 88250 - DNA, 25 bp, S. pombe
gcaacttttctacttcaaccgttag

SEQ ID NO: 88251 - DNA, 25 bp, S. pombe
gaatggtcgtattaacaagtgcggt

SEQ ID NO: 88252 - DNA, 25 bp, S. pombe
gcaagcgctttgctcaaaactgcag

SEQ ID NO: 88253 - DNA, 25 bp, S. pombe
gcaactctgttgctaaaccgtcgtt

SEQ ID NO: 88254 - DNA, 25 bp, S. pombe
gcaagctttgtgtacgaaccgccgt

SEQ ID NO: 88255 - DNA, 25 bp, S. pombe
gcaactgctttttatgttacgtggc

SEQ ID NO: 88256 - DNA, 25 bp, S. pombe
gcaacggtcgatttgttccagatga

SEQ ID NO: 88257 - DNA, 25 bp, S. pombe
gcaattgagtcatacgctaccagtg

SEQ ID NO: 88258 - DNA, 25 bp, S. pombe
gcaactactagttcctcatttgaaa

SEQ ID NO: 88259 - DNA, 25 bp, S. pombe
gcaaaatttgtatctcttcggctca

SEQ ID NO: 88260 - DNA, 25 bp, S. pombe
gcaagctcatttcaattctaccggt

SEQ ID NO: 88261 - DNA, 25 bp, S. pombe
gcaagcaattgcactttccagtcaa

SEQ ID NO: 88262 - DNA, 25 bp, S. pombe
gacacgtccaccagatgcattggta

SEQ ID NO: 88263 - DNA, 25 bp, S. pombe
gagttacccgatctcagaatgcaac

SEQ ID NO: 88264 - DNA, 25 bp, S. pombe
gagcattactcgctactggaaattc

SEQ ID NO: 88265 - DNA, 25 bp, S. pombe
gaattggccagtcacatcgttgaga

SEQ ID NO: 88266 - DNA, 25 bp, S. pombe
gaattgcttaaacagtcttccagaa

SEQ ID NO: 88267 - DNA, 25 bp, S. pombe
gaattcctaacaaacgctcccaaag

SEQ ID NO: 88268 - DNA, 25 bp, S. pombe
gaataaagctcgtttgcttgtaaaa

SEQ ID NO: 88269 - DNA, 25 bp, S. pombe
gaatcaaatttcctctctgttaaaa

SEQ ID NO: 88270 - DNA, 25 bp, S. pombe
gaatattcattaccccttcctaaga

SEQ ID NO: 88271 - DNA, 25 bp, S. pombe
gcaatcaagcatgcacacggcgtta

SEQ ID NO: 88272 - DNA, 25 bp, S. pombe
gcaagacatgagcactcgcgagtat

SEQ ID NO: 88273 - DNA, 25 bp, S. pombe
gcaagcagcaaggactctcgatatt

SEQ ID NO: 88274 - DNA, 25 bp, S. pombe
gcaagttgttgtaaacaatgctggt

SEQ ID NO: 88275 - DNA, 25 bp, S. pombe
gcaagtcctatgcaaacagatgctg

SEQ ID NO: 88276 - DNA, 25 bp, S. pombe
gcaagctcctgaataccactatgta

SEQ ID NO: 88277 - DNA, 25 bp, S. pombe
gcaagcttgatgtgcctactattca

SEQ ID NO: 88278 - DNA, 25 bp, S. pombe
gcaagcctctatacttactgcattg

SEQ ID NO: 88279 - DNA, 25 bp, S. pombe
gcaagttcccacctggatcaaagtt

SEQ ID NO: 88280 - DNA, 25 bp, S. pombe
gaatgttcctagctttcgaatgtaa

SEQ ID NO: 88281 - DNA, 25 bp, S. pombe
gaagaaggtcctttgccttggtgtt

SEQ ID NO: 88282 - DNA, 25 bp, S. pombe
gaatcaaagtttctcctgtgggtta

SEQ ID NO: 88283 - DNA, 25 bp, S. pombe
gaattaactattcttcttgggcaat

SEQ ID NO: 88284 - DNA, 25 bp, S. pombe
gaaggcaattgctctttctttgggt

SEQ ID NO: 88285 - DNA, 25 bp, S. pombe
gcaacgtcgcaacagatattccttt

SEQ ID NO: 88286 - DNA, 25 bp, S. pombe
gcaacttctcttggcaaactgtgaa

SEQ ID NO: 88287 - DNA, 25 bp, S. pombe
gcaacgacatttctagagcggattt

SEQ ID NO: 88288 - DNA, 25 bp, S. pombe
gcaaggccatttcgaaatcccaatt

SEQ ID NO: 88289 - DNA, 25 bp, S. pombe
gaattgcccaattgactaacgaatg

SEQ ID NO: 88290 - DNA, 25 bp, S. pombe
gaattgtcaatccaccagtcatact

SEQ ID NO: 88291 - DNA, 25 bp, S. pombe
gcaagtatcttatccagcattttta

SEQ ID NO: 88292 - DNA, 25 bp, S. pombe
gcaactatgctttcttattcacctt

SEQ ID NO: 88293 - DNA, 25 bp, S. pombe
gcaaggttactgaggatcttctaaa

SEQ ID NO: 88294 - DNA, 25 bp, S. pombe
gcaagtttactgcattacctatcaa

SEQ ID NO: 88295 - DNA, 25 bp, S. pombe
gcaaggaaccattcactggctacat

SEQ ID NO: 88296 - DNA, 25 bp, S. pombe
gaattagctgccattgaacgaaata

SEQ ID NO: 88297 - DNA, 25 bp, S. pombe
gaattagctcaaatcgcccgatgaa

SEQ ID NO: 88298 - DNA, 25 bp, S. pombe
gaatctaatatgttgcgtcgggcca

SEQ ID NO: 88299 - DNA, 25 bp, S. pombe
gcaactgtatacttggttagcacca

SEQ ID NO: 88300 - DNA, 25 bp, S. pombe
gcaattggcaacttgattatcgctg

SEQ ID NO: 88301 - DNA, 25 bp, S. pombe
gcaatctatgcaaccttcaactgtg

SEQ ID NO: 88302 - DNA, 25 bp, S. pombe
gcaactagcatctcttcacgatatg

SEQ ID NO: 88303 - DNA, 25 bp, S. pombe
gcaagctatttctggtgctggatac

SEQ ID NO: 88304 - DNA, 25 bp, S. pombe
gcaatctatttctagggcggctacg

SEQ ID NO: 88305 - DNA, 25 bp, S. pombe
gcaattagcgcccagtatatcaacc

SEQ ID NO: 88306 - DNA, 25 bp, S. pombe
gaatcagaagcttcagtggaccaca

SEQ ID NO: 88307 - DNA, 25 bp, S. pombe
gaattgcgcattcttattgtccatg

SEQ ID NO: 88308 - DNA, 25 bp, S. pombe
gcaatactcaatctctatctaccaa

SEQ ID NO: 88309 - DNA, 25 bp, S. pombe
gaattgcttgaacccttagctttac

SEQ ID NO: 88310 - DNA, 25 bp, S. pombe
gaattgccagaactcaccgatgcta

SEQ ID NO: 88311 - DNA, 25 bp, S. pombe
gcaatattgttgtccgcgaactctg

SEQ ID NO: 88312 - DNA, 25 bp, S. pombe
gcaattgctgcatggccggaaatcg

SEQ ID NO: 88313 - DNA, 25 bp, S. pombe
gcaagcgtcgtgaccaacataattt

SEQ ID NO: 88314 - DNA, 25 bp, S. pombe
gcaagcgtcagtgccaaatccaaca

SEQ ID NO: 88315 - DNA, 25 bp, S. pombe
gaaggttgtcccaaggccaagactt

SEQ ID NO: 88316 - DNA, 25 bp, S. pombe
gaatagtattcctaagccggaagct

SEQ ID NO: 88317 - DNA, 25 bp, S. pombe
gaaggattctcaaactccgtcggaa

SEQ ID NO: 88318 - DNA, 25 bp, S. pombe
gaataattctacagctacctccgag

SEQ ID NO: 88319 - DNA, 25 bp, S. pombe
gaatcgattcggaaaagcctatgtt

SEQ ID NO: 88320 - DNA, 25 bp, S. pombe
gcaatggtgctctcaaaactttatc

SEQ ID NO: 88321 - DNA, 25 bp, S. pombe
gcaagggctttcaagttcgttcata

SEQ ID NO: 88322 - DNA, 25 bp, S. pombe
gcaagggatttggactcggtatcaa

SEQ ID NO: 88323 - DNA, 25 bp, S. pombe
gcaaccattgcttcaagagtgtcta

SEQ ID NO: 88324 - DNA, 25 bp, S. pombe
gcaatacctgcttacaaggcgacaa

SEQ ID NO: 88325 - DNA, 25 bp, S. pombe
gcaagctgttttggacgctgtcgaa

SEQ ID NO: 88326 - DNA, 25 bp, S. pombe
gcaaggtatgttggcatgccttcat

SEQ ID NO: 88327 - DNA, 25 bp, S. pombe
gaattgctatgcttgtggctcttat

SEQ ID NO: 88328 - DNA, 25 bp, S. pombe
gcaatatctgctcttgacaacgcta

SEQ ID NO: 88329 - DNA, 25 bp, S. pombe
gcaatcattgcacctatttgggcat

SEQ ID NO: 88330 - DNA, 25 bp, S. pombe
gcaatattgtgtctcttgcgctatt

SEQ ID NO: 88331 - DNA, 25 bp, S. pombe
gcaagttgttgcttctactcctgta

SEQ ID NO: 88332 - DNA, 25 bp, S. pombe
gcaagcctctttagtagattccgat

SEQ ID NO: 88333 - DNA, 25 bp, S. pombe
gcaagactcctgatgaagtttcgta

SEQ ID NO: 88334 - DNA, 25 bp, S. pombe
gaattctcactctgaagcttcggat

SEQ ID NO: 88335 - DNA, 25 bp, S. pombe
gcaatgtaccacaacgacgtcttaa

SEQ ID NO: 88336 - DNA, 25 bp, S. pombe
gaatatgcaccaccggaagtttata

SEQ ID NO: 88337 - DNA, 25 bp, S. pombe
gaataggtctcgtttagtcttacaa

SEQ ID NO: 88338 - DNA, 25 bp, S. pombe
gaattggatcctttcgtgtatataa

SEQ ID NO: 88339 - DNA, 25 bp, S. pombe
gaatgtggttttccgccttataatc

SEQ ID NO: 88340 - DNA, 25 bp, S. pombe
gaattgtgtttctgcctctagtaac

SEQ ID NO: 88341 - DNA, 25 bp, S. pombe
gcaatgatgaatgtccagctcgtga

SEQ ID NO: 88342 - DNA, 25 bp, S. pombe
gcaagatgccactatgacgctcgaa

SEQ ID NO: 88343 - DNA, 25 bp, S. pombe
gcaattacattttggccctagtcgc

SEQ ID NO: 88344 - DNA, 25 bp, S. pombe
gaattccctaaaaatcctcacgcat

SEQ ID NO: 88345 - DNA, 25 bp, S. pombe
gcaattctctcttactttcgttagt

SEQ ID NO: 88346 - DNA, 25 bp, S. pombe
gcaatctcctttcttctcttagaat

SEQ ID NO: 88347 - DNA, 25 bp, S. pombe
gaattcctattgttttctacggaca

SEQ ID NO: 88348 - DNA, 25 bp, S. pombe
gaattcctctgatttgttttctaag

SEQ ID NO: 88349 - DNA, 25 bp, S. pombe
gacttggcattgatcgtttataacc

SEQ ID NO: 88350 - DNA, 25 bp, S. pombe
gaattacttgactgactcttaccct

SEQ ID NO: 88351 - DNA, 25 bp, S. pombe
gaattttatgtctccattttccctg

SEQ ID NO: 88352 - DNA, 25 bp, S. pombe
gcaattttgtaatttctggttcccg

SEQ ID NO: 88353 - DNA, 25 bp, S. pombe
gcaatttgggatctgtcgttacgac

SEQ ID NO: 88354 - DNA, 25 bp, S. pombe
gcaatttggaagcttctttgtcgcc

SEQ ID NO: 88355 - DNA, 25 bp, S. pombe
gcaattttcgtgctattcaagggtc

SEQ ID NO: 88356 - DNA, 25 bp, S. pombe
gaattttgctgggtttgtctgggtc

SEQ ID NO: 88357 - DNA, 25 bp, S. pombe
gaattcgtcgtactttggcttggat

SEQ ID NO: 88358 - DNA, 25 bp, S. pombe
gaattgagacggcttcttcttgaag

SEQ ID NO: 88359 - DNA, 25 bp, S. pombe
gaattgtccgacaacctcgtaaaag

SEQ ID NO: 88360 - DNA, 25 bp, S. pombe
gaatataccggcaatggctcgtatc

SEQ ID NO: 88361 - DNA, 25 bp, S. pombe
gaattaaaatgtgccaacgcccttt

SEQ ID NO: 88362 - DNA, 25 bp, S. pombe
gaatactttgaagcgtacgtccgaa

SEQ ID NO: 88363 - DNA, 25 bp, S. pombe
gaatacggtggatcacttccttcgt

SEQ ID NO: 88364 - DNA, 25 bp, S. pombe
gaataagcccgttcattactttctc

SEQ ID NO: 88365 - DNA, 25 bp, S. pombe
gcaatcgcggccaatacattactta

SEQ ID NO: 88366 - DNA, 25 bp, S. pombe
gcaatggccgccaattttccaaaaa

SEQ ID NO: 88367 - DNA, 25 bp, S. pombe
gcaatgctccttccaatttatcaaa

SEQ ID NO: 88368 - DNA, 25 bp, S. pombe
gcaagtctcatcaagcgcattttcg

SEQ ID NO: 88369 - DNA, 25 bp, S. pombe
gaattgtcatgtacagtttcctgat

SEQ ID NO: 88370 - DNA, 25 bp, S. pombe
gaattgctagctacggaacctattt

SEQ ID NO: 88371 - DNA, 25 bp, S. pombe
gaattgttgcaagctaaacttcacc

SEQ ID NO: 88372 - DNA, 25 bp, S. pombe
gaatcggttggcgtacactttaatg

SEQ ID NO: 88373 - DNA, 25 bp, S. pombe
gaattggtcaccgatagcagcgtta

SEQ ID NO: 88374 - DNA, 25 bp, S. pombe
gaatttaattcctccgtctatgaaa

SEQ ID NO: 88375 - DNA, 25 bp, S. pombe
gaattctatccctcttggcgatgac

SEQ ID NO: 88376 - DNA, 25 bp, S. pombe
gaattcccaaccattggatctgcgg

SEQ ID NO: 88377 - DNA, 25 bp, S. pombe
gaattgccgcaacttttgtcttctg

SEQ ID NO: 88378 - DNA, 25 bp, S. pombe
gaattacttgagctacctcctgaga

SEQ ID NO: 88379 - DNA, 25 bp, S. pombe
gaattccaatggctctcaacctaga

SEQ ID NO: 88380 - DNA, 25 bp, S. pombe
gaattcgatgacagttcaagacata

SEQ ID NO: 88381 - DNA, 25 bp, S. pombe
gcaattgctccgtcttttgcaaatt

SEQ ID NO: 88382 - DNA, 25 bp, S. pombe
gaattagttcttcctgcagatgcag

SEQ ID NO: 88383 - DNA, 25 bp, S. pombe
gcaatcgctgagatttctcccttaa

SEQ ID NO: 88384 - DNA, 25 bp, S. pombe
gaattcatatgggtttccacttcca

SEQ ID NO: 88385 - DNA, 25 bp, S. pombe
gcaagtcgattactgtatgtccatt

SEQ ID NO: 88386 - DNA, 25 bp, S. pombe
gcaatgtcatttcacgctgcttcaa

SEQ ID NO: 88387 - DNA, 25 bp, S. pombe
gaatgtgacccaaccgttaagcaat

SEQ ID NO: 88388 - DNA, 25 bp, S. pombe
gaattttccaacatcaagtcggcag

SEQ ID NO: 88389 - DNA, 25 bp, S. pombe
gaatttcccgcagacaagttgatcc

SEQ ID NO: 88390 - DNA, 25 bp, S. pombe
gaattgtgtccgtcgaattgggaaa

SEQ ID NO: 88391 - DNA, 25 bp, S. pombe
gaatatttcatggacgaacggcgaa

SEQ ID NO: 88392 - DNA, 25 bp, S. pombe
gaacaattacggaatccctgtcgtc

SEQ ID NO: 88393 - DNA, 25 bp, S. pombe
gaaaattccggcttcgtatccgtgg

SEQ ID NO: 88394 - DNA, 25 bp, S. pombe
gaatttacctgggactctatttgcc

SEQ ID NO: 88395 - DNA, 25 bp, S. pombe
gaattgatgcatccttcggttcatt

SEQ ID NO: 88396 - DNA, 25 bp, S. pombe
gcaattgcgattctgggttatcttt

SEQ ID NO: 88397 - DNA, 25 bp, S. pombe
gaattgcgaccttggttgtcgtttc

SEQ ID NO: 88398 - DNA, 25 bp, S. pombe
gaattacgcagccttcgttgagtcc

SEQ ID NO: 88399 - DNA, 25 bp, S. pombe
gcaattgcctatgacaatgctcctt

SEQ ID NO: 88400 - DNA, 25 bp, S. pombe
gcaatgtctctagggctatgtgcca

SEQ ID NO: 88401 - DNA, 25 bp, S. pombe
gaatttagcgatggtgtagacttaa

SEQ ID NO: 88402 - DNA, 25 bp, S. pombe
gaattgtggacatgtgtaccccata

SEQ ID NO: 88403 - DNA, 25 bp, S. pombe
gaatttgctagcagttcaccaccca

SEQ ID NO: 88404 - DNA, 25 bp, S. pombe
gcaatgttagtcgtgattcctctca

SEQ ID NO: 88405 - DNA, 25 bp, S. pombe
gaatgcattgaatcatggtccctaa

SEQ ID NO: 88406 - DNA, 25 bp, S. pombe
gcaatcattataaccggctccaaag

SEQ ID NO: 88407 - DNA, 25 bp, S. pombe
gcaatctgtattaggcagtgccaca

SEQ ID NO: 88408 - DNA, 25 bp, S. pombe
gaattgatgattgcagagcctcaga

SEQ ID NO: 88409 - DNA, 25 bp, S. pombe
gcaattgctgtaggcatccttcaga

SEQ ID NO: 88410 - DNA, 25 bp, S. pombe
gaattgtcctgtgaaatgatccctc

SEQ ID NO: 88411 - DNA, 25 bp, S. pombe
gcaatttttggccaagcacgacttt

SEQ ID NO: 88412 - DNA, 25 bp, S. pombe
gacttcttgtcggtggtttggctat

SEQ ID NO: 88413 - DNA, 25 bp, S. pombe
gaatcctaactttgagcttcccgaa

SEQ ID NO: 88414 - DNA, 25 bp, S. pombe
gaatatgctgtttatcccttttccg

SEQ ID NO: 88415 - DNA, 25 bp, S. pombe
gaattcatttggactttaattccag

SEQ ID NO: 88416 - DNA, 25 bp, S. pombe
gaattccacattacttcctaaggct

SEQ ID NO: 88417 - DNA, 25 bp, S. pombe
gcaattctgaaaaatgctcctcact

SEQ ID NO: 88418 - DNA, 25 bp, S. pombe
gcaatttcaaaccagtactctcgat

SEQ ID NO: 88419 - DNA, 25 bp, S. pombe
gaattccaaatccaaatctgctgca

SEQ ID NO: 88420 - DNA, 25 bp, S. pombe
gaattacctactcctataagaaatg

SEQ ID NO: 88421 - DNA, 25 bp, S. pombe
gcaatagccgctggtactgatttgg

SEQ ID NO: 88422 - DNA, 25 bp, S. pombe
gaattggctgctgatactttgtcaa

SEQ ID NO: 88423 - DNA, 25 bp, S. pombe
gcaatctggccgcaaagtaccatgt

SEQ ID NO: 88424 - DNA, 25 bp, S. pombe
gcaattgaacttacgggcagcccta

SEQ ID NO: 88425 - DNA, 25 bp, S. pombe
gaatgctacggctggtggacctcgt

SEQ ID NO: 88426 - DNA, 25 bp, S. pombe
gaattccaagatcgtatgcgtcaaa

SEQ ID NO: 88427 - DNA, 25 bp, S. pombe
gcaattacaagagctccgtcaagag

SEQ ID NO: 88428 - DNA, 25 bp, S. pombe
gaatagttcaaccattccccaggct

SEQ ID NO: 88429 - DNA, 25 bp, S. pombe
gaatccttatcccattaacaaccaa

SEQ ID NO: 88430 - DNA, 25 bp, S. pombe
gattccgtccttctcgaaagggtgg

SEQ ID NO: 88431 - DNA, 25 bp, S. pombe
gaagagtgttttctttccgttgtct

SEQ ID NO: 88432 - DNA, 25 bp, S. pombe
gcaaggtttctgctttatctggttt

SEQ ID NO: 88433 - DNA, 25 bp, S. pombe
gaatttcttcggattagctggtttt

SEQ ID NO: 88434 - DNA, 25 bp, S. pombe
gaattcttagtattcttccttacta

SEQ ID NO: 88435 - DNA, 25 bp, S. pombe
gcaatcttacttttccccattgtat

SEQ ID NO: 88436 - DNA, 25 bp, S. pombe
gcaattcaagtttatccccactgat

SEQ ID NO: 88437 - DNA, 25 bp, S. pombe
gaattgcaagccataatcctagccc

SEQ ID NO: 88438 - DNA, 25 bp, S. pombe
gcaatagcttgcattatacccgccg

SEQ ID NO: 88439 - DNA, 25 bp, S. pombe
gaattgggatcattatccgccgccg

SEQ ID NO: 88440 - DNA, 25 bp, S. pombe
gaatttttcgcaccagattacaccc

SEQ ID NO: 88441 - DNA, 25 bp, S. pombe
gaatttttacgtgatccatacttgg

SEQ ID NO: 88442 - DNA, 25 bp, S. pombe
gaattgctcttaaggtgtctaacat

SEQ ID NO: 88443 - DNA, 25 bp, S. pombe
gaattgtcgtcttggctgtctgata

SEQ ID NO: 88444 - DNA, 25 bp, S. pombe
gaattgctgttcttggcagtcgttc

SEQ ID NO: 88445 - DNA, 25 bp, S. pombe
gcaatctgtttgtggctgtcgctaa

SEQ ID NO: 88446 - DNA, 25 bp, S. pombe
gaattctcctaaatcggcaaaatga

SEQ ID NO: 88447 - DNA, 25 bp, S. pombe
gaattccgctactgcgaataacgat

SEQ ID NO: 88448 - DNA, 25 bp, S. pombe
gaatcttaaacgagaccttgccaag

SEQ ID NO: 88449 - DNA, 25 bp, S. pombe
gaatttataagccaaactcctccgg

SEQ ID NO: 88450 - DNA, 25 bp, S. pombe
gaattttacccttatcttctcgcag

SEQ ID NO: 88451 - DNA, 25 bp, S. pombe
gaatctaggcgtcacttttcaggtg

SEQ ID NO: 88452 - DNA, 25 bp, S. pombe
gaatttgttcgttaccggaggcagt

SEQ ID NO: 88453 - DNA, 25 bp, S. pombe
gaattttttgccttcacggaggtct

SEQ ID NO: 88454 - DNA, 25 bp, S. pombe
gaattttttgccattcacgaggtaa

SEQ ID NO: 88455 - DNA, 25 bp, S. pombe
gaattggtccgccatgttccaagtg

SEQ ID NO: 88456 - DNA, 25 bp, S. pombe
gaattggctccttcagctttaagat

SEQ ID NO: 88457 - DNA, 25 bp, S. pombe
gaattgtttgcctctcttaagaaga

SEQ ID NO: 88458 - DNA, 25 bp, S. pombe
gaatttttcagttcaatttcctgga

SEQ ID NO: 88459 - DNA, 25 bp, S. pombe
gcaattactgcaactctactttata

SEQ ID NO: 88460 - DNA, 25 bp, S. pombe
gaattgcatcttgtatcacctgaac

SEQ ID NO: 88461 - DNA, 25 bp, S. pombe
gaattagcatctttacactctgccc

SEQ ID NO: 88462 - DNA, 25 bp, S. pombe
gcaatctctcaggttacactcaatt

SEQ ID NO: 88463 - DNA, 25 bp, S. pombe
gcaatgtctcatgctttggctcaat

SEQ ID NO: 88464 - DNA, 25 bp, S. pombe
gcaatcatcttcctctctgatgttt

SEQ ID NO: 88465 - DNA, 25 bp, S. pombe
gaatatcttagtttcactttgagtg

SEQ ID NO: 88466 - DNA, 25 bp, S. pombe
gaatatttattgctgtgctcattgg

SEQ ID NO: 88467 - DNA, 25 bp, S. pombe
gaattggctggaaacgctgctcgtg

SEQ ID NO: 88468 - DNA, 25 bp, S. pombe
gaattggcttattagccctcctgga

SEQ ID NO: 88469 - DNA, 25 bp, S. pombe
gaattgtttataggccgtcctctgt

SEQ ID NO: 88470 - DNA, 25 bp, S. pombe
gcaattgcgtgttaagggtcctgtt

SEQ ID NO: 88471 - DNA, 25 bp, S. pombe
gaattctcgcactaacggtgcctta

SEQ ID NO: 88472 - DNA, 25 bp, S. pombe
gaatttacgaccttaagctccctgt

SEQ ID NO: 88473 - DNA, 25 bp, S. pombe
gaattaaccaaactcaagcccactt

SEQ ID NO: 88474 - DNA, 25 bp, S. pombe
gaattacctacaattcaacccctgt

SEQ ID NO: 88475 - DNA, 25 bp, S. pombe
gaattgagtccccaataactgcatg

SEQ ID NO: 88476 - DNA, 25 bp, S. pombe
gaatatttaacccaaatcgcgattt

SEQ ID NO: 88477 - DNA, 25 bp, S. pombe
gaattgtctggatacaccttcagat

SEQ ID NO: 88478 - DNA, 25 bp, S. pombe
gaatctcaaggcgaaagctcttcac

SEQ ID NO: 88479 - DNA, 25 bp, S. pombe
gaattcagttctcgtccagttatag

SEQ ID NO: 88480 - DNA, 25 bp, S. pombe
gaattattactgctgccgagtctgt

SEQ ID NO: 88481 - DNA, 25 bp, S. pombe
gaattgtcttacagagctcgtgatt

SEQ ID NO: 88482 - DNA, 25 bp, S. pombe
gcaatcatgctttaccaaacagtgt

SEQ ID NO: 88483 - DNA, 25 bp, S. pombe
gcaattgcatctgtgccgaacgagt

SEQ ID NO: 88484 - DNA, 25 bp, S. pombe
gaattgtctccaacagatcactcga

SEQ ID NO: 88485 - DNA, 25 bp, S. pombe
gaatttctgaacttaatgaccgtga

SEQ ID NO: 88486 - DNA, 25 bp, S. pombe
gaatttttgactatgatggcccgaa

SEQ ID NO: 88487 - DNA, 25 bp, S. pombe
gcaattgtccttcagtgtggtgctg

SEQ ID NO: 88488 - DNA, 25 bp, S. pombe
gaatttgctaaatggtttcatggac

SEQ ID NO: 88489 - DNA, 25 bp, S. pombe
gaatttgtaccaagctctttaggag

SEQ ID NO: 88490 - DNA, 25 bp, S. pombe
gaattcctaatatgctgctttccga

SEQ ID NO: 88491 - DNA, 25 bp, S. pombe
gcaattactaatctctccataccag

SEQ ID NO: 88492 - DNA, 25 bp, S. pombe
gcaatttttattcttgtcaccaaac

SEQ ID NO: 88493 - DNA, 25 bp, S. pombe
gaatttcttattctaacgacttacg

SEQ ID NO: 88494 - DNA, 25 bp, S. pombe
gacttttataatctacctggttcaa

SEQ ID NO: 88495 - DNA, 25 bp, S. pombe
gaattgccttatcgtatcgttgcca

SEQ ID NO: 88496 - DNA, 25 bp, S. pombe
gaattcccagactttgatgatagcg

SEQ ID NO: 88497 - DNA, 25 bp, S. pombe
gaatttcctggtttatggtgcaata

SEQ ID NO: 88498 - DNA, 25 bp, S. pombe
gacttctagttttttcgggtgcgca

SEQ ID NO: 88499 - DNA, 25 bp, S. pombe
gaatttatgttttctacgtaagcaa

SEQ ID NO: 88500 - DNA, 25 bp, S. pombe
gaatttattcgttcctctgttcaga

SEQ ID NO: 88501 - DNA, 25 bp, S. pombe
gaattgcggccattcatactggtat

SEQ ID NO: 88502 - DNA, 25 bp, S. pombe
gaattcatccatagccagaccattg

SEQ ID NO: 88503 - DNA, 25 bp, S. pombe
gaatagacgctagtgagcgacccgt

SEQ ID NO: 88504 - DNA, 25 bp, S. pombe
gactttgactaagcgtcaacttcct

SEQ ID NO: 88505 - DNA, 25 bp, S. pombe
gaattatgtaccttgagaactgctc

SEQ ID NO: 88506 - DNA, 25 bp, S. pombe
gaatctttaggttatgtgctcgtct

SEQ ID NO: 88507 - DNA, 25 bp, S. pombe
gaatttctcctcgtggtgccggata

SEQ ID NO: 88508 - DNA, 25 bp, S. pombe
gaatttcttgatgatcggcctgaat

SEQ ID NO: 88509 - DNA, 25 bp, S. pombe
gaatttcgccgtccgcaatggtaag

SEQ ID NO: 88510 - DNA, 25 bp, S. pombe
gaattgttccttgcgaagcgttcta

SEQ ID NO: 88511 - DNA, 25 bp, S. pombe
gaattgttgcgcaatgctcctcatg

SEQ ID NO: 88512 - DNA, 25 bp, S. pombe
gaattgttctcagcattgtcgtgac

SEQ ID NO: 88513 - DNA, 25 bp, S. pombe
gaattgttcgactttatcgtgacaa

SEQ ID NO: 88514 - DNA, 25 bp, S. pombe
gaatgttaggttatcccaccaacga

SEQ ID NO: 88515 - DNA, 25 bp, S. pombe
gaatttactgcactagctgtcaatc

SEQ ID NO: 88516 - DNA, 25 bp, S. pombe
gaatttgatccacgcgcagtagatg

SEQ ID NO: 88517 - DNA, 25 bp, S. pombe
gaatcttacaagaccctgctatgca

SEQ ID NO: 88518 - DNA, 25 bp, S. pombe
gaattggattcagctcctgctaaaa

SEQ ID NO: 88519 - DNA, 25 bp, S. pombe
gaattggatttctacattgcctcaa

SEQ ID NO: 88520 - DNA, 25 bp, S. pombe
gaattacttgttgagatgcctccaa

SEQ ID NO: 88521 - DNA, 25 bp, S. pombe
gaattgctacgcgattggcatcgtt

SEQ ID NO: 88522 - DNA, 25 bp, S. pombe
gcaattgctacgcttccatggtata

SEQ ID NO: 88523 - DNA, 25 bp, S. pombe
gaattgccaactccttcgaggatga

SEQ ID NO: 88524 - DNA, 25 bp, S. pombe
gaattgcgagttccgtatctacgat

SEQ ID NO: 88525 - DNA, 25 bp, S. pombe
gaatctggaattcaccctgatcgat

SEQ ID NO: 88526 - DNA, 25 bp, S. pombe
gaattgttgcagctacctgttcatc

SEQ ID NO: 88527 - DNA, 25 bp, S. pombe
gaatcgttgcagctgaagcgtgccc

SEQ ID NO: 88528 - DNA, 25 bp, S. pombe
gaattgatatcacatcccgtgccag

SEQ ID NO: 88529 - DNA, 25 bp, S. pombe
gaatatcatccaagtgtcccgtaga

SEQ ID NO: 88530 - DNA, 25 bp, S. pombe
gaattctcaactactccttttgact

SEQ ID NO: 88531 - DNA, 25 bp, S. pombe
gaattactatgttgctccgttggaa

SEQ ID NO: 88532 - DNA, 25 bp, S. pombe
gaatcttcattaagtccgttagacc

SEQ ID NO: 88533 - DNA, 25 bp, S. pombe
gaattctattcaacaggcggtagcc

SEQ ID NO: 88534 - DNA, 25 bp, S. pombe
gaatatgaatttacagggccggatc

SEQ ID NO: 88535 - DNA, 25 bp, S. pombe
gaattgaatatttccggccatttct

SEQ ID NO: 88536 - DNA, 25 bp, S. pombe
gaatttcaaaacttcgccggcagtg

SEQ ID NO: 88537 - DNA, 25 bp, S. pombe
gaatagtaagccgatacccgttgac

SEQ ID NO: 88538 - DNA, 25 bp, S. pombe
gaatcgatacttttactcccggaat

SEQ ID NO: 88539 - DNA, 25 bp, S. pombe
gaattacctcttttacctactgata

SEQ ID NO: 88540 - DNA, 25 bp, S. pombe
gaattacctcttaccacctttatga

SEQ ID NO: 88541 - DNA, 25 bp, S. pombe
gaattaattcccgtttttgcatctg

SEQ ID NO: 88542 - DNA, 25 bp, S. pombe
gaattagtacgcgttctttgcttat

SEQ ID NO: 88543 - DNA, 25 bp, S. pombe
gaattaatatctgttccttcgaaat

SEQ ID NO: 88544 - DNA, 25 bp, S. pombe
gaatttacgtccttggcttcgaaga

SEQ ID NO: 88545 - DNA, 25 bp, S. pombe
gaattcttggacagactgcttcgat

SEQ ID NO: 88546 - DNA, 25 bp, S. pombe
gaattgctgctcgtgcatttgccaa

SEQ ID NO: 88547 - DNA, 25 bp, S. pombe
gaatattctacagggctttcatact

SEQ ID NO: 88548 - DNA, 25 bp, S. pombe
gaatctttacgaggcacttcgacac

SEQ ID NO: 88549 - DNA, 25 bp, S. pombe
gaatctctggtattaacggacccca

SEQ ID NO: 88550 - DNA, 25 bp, S. pombe
gaacttcgaaaagatccagtcctgg

SEQ ID NO: 88551 - DNA, 25 bp, S. pombe
gaattgttaaatgctcctgactact

SEQ ID NO: 88552 - DNA, 25 bp, S. pombe
gaattcctaaaaaccagcgctccct

SEQ ID NO: 88553 - DNA, 25 bp, S. pombe
gaacccctaaatgaatggctccagt

SEQ ID NO: 88554 - DNA, 25 bp, S. pombe
gaaaccctttatcaatggctaacgg

SEQ ID NO: 88555 - DNA, 25 bp, S. pombe
gaatatcctcgtagcacaaggccga

SEQ ID NO: 88556 - DNA, 25 bp, S. pombe
gaattcactccaccaatttcagttg

SEQ ID NO: 88557 - DNA, 25 bp, S. pombe
gaattcgccctttacatacctgatt

SEQ ID NO: 88558 - DNA, 25 bp, S. pombe
gaattcctccgatttattcttggta

SEQ ID NO: 88559 - DNA, 25 bp, S. pombe
gaatcacttcccattatttgttaca

SEQ ID NO: 88560 - DNA, 25 bp, S. pombe
gaatttgctctctagcccaagtaag

SEQ ID NO: 88561 - DNA, 25 bp, S. pombe
gaattgactctcgagcagctgtttt

SEQ ID NO: 88562 - DNA, 25 bp, S. pombe
gaattcgagtttcaagaccacgctt

SEQ ID NO: 88563 - DNA, 25 bp, S. pombe
gaattcgtgtatctatgtctcccca

SEQ ID NO: 88564 - DNA, 25 bp, S. pombe
gaattgccgtatggttgttatttca

SEQ ID NO: 88565 - DNA, 25 bp, S. pombe
gaatatgccgtcttcctttatttaa

SEQ ID NO: 88566 - DNA, 25 bp, S. pombe
gaatttcgttctcgacctgattcta

SEQ ID NO: 88567 - DNA, 25 bp, S. pombe
gaattttccgcttgtcataaaccta

SEQ ID NO: 88568 - DNA, 25 bp, S. pombe
gaattatactccttgcgtaaccgta

SEQ ID NO: 88569 - DNA, 25 bp, S. pombe
gaattttcggcagtcctttactatt

SEQ ID NO: 88570 - DNA, 25 bp, S. pombe
gaattttaggccttcgttcatccat

SEQ ID NO: 88571 - DNA, 25 bp, S. pombe
gaatatatctcatctactgcaccaa

SEQ ID NO: 88572 - DNA, 25 bp, S. pombe
gaattcattcattgtcctgcagcaa

SEQ ID NO: 88573 - DNA, 25 bp, S. pombe
gaattctatctcatcctgatcacga

SEQ ID NO: 88574 - DNA, 25 bp, S. pombe
gaattcgagtgcaccagtacagcaa

SEQ ID NO: 88575 - DNA, 25 bp, S. pombe
gaatagtactgcaccatctacgggt

SEQ ID NO: 88576 - DNA, 25 bp, S. pombe
gaatcaggttttgcagtacttggaa

SEQ ID NO: 88577 - DNA, 25 bp, S. pombe
gaatctttatttccagtcaccgaat

SEQ ID NO: 88578 - DNA, 25 bp, S. pombe
gaatttcattcttacgttcgcccat

SEQ ID NO: 88579 - DNA, 25 bp, S. pombe
gaattcggctttactgttgcacaag

SEQ ID NO: 88580 - DNA, 25 bp, S. pombe
gaattcgtgcttctctgtacaatgc

SEQ ID NO: 88581 - DNA, 25 bp, S. pombe
gaattcgctttactttgacagccat

SEQ ID NO: 88582 - DNA, 25 bp, S. pombe
gaattcctctatactgttacgatga

SEQ ID NO: 88583 - DNA, 25 bp, S. pombe
gaattcgcgctcgtagtaagctagc

SEQ ID NO: 88584 - DNA, 25 bp, S. pombe
gaattcgtttcttatattgctagag

SEQ ID NO: 88585 - DNA, 25 bp, S. pombe
gaattcttctttaaatcctgcaagt

SEQ ID NO: 88586 - DNA, 25 bp, S. pombe
gaattcattgctaaacatcccgaca

SEQ ID NO: 88587 - DNA, 25 bp, S. pombe
gaattttatgctcaaccgttcgtag

SEQ ID NO: 88588 - DNA, 25 bp, S. pombe
gaattcgttctgttaacggtcgtcg

SEQ ID NO: 88589 - DNA, 25 bp, S. pombe
gaattcgtcttttatacgactcctt

SEQ ID NO: 88590 - DNA, 25 bp, S. pombe
gaactcgttgtgcaaccgactttgt

SEQ ID NO: 88591 - DNA, 25 bp, S. pombe
gaaccgtttacgaccgactgaaatg

SEQ ID NO: 88592 - DNA, 25 bp, S. pombe
gaatccgtggttctggtttgaaatt

SEQ ID NO: 88593 - DNA, 25 bp, S. pombe
gaatccctcgttcgcgctttaaaat

SEQ ID NO: 88594 - DNA, 25 bp, S. pombe
gaatacttggttcccttcaattatt

SEQ ID NO: 88595 - DNA, 25 bp, S. pombe
gaattttgcctctcgtaaatgtgta

SEQ ID NO: 88596 - DNA, 25 bp, S. pombe
gaattatttctctctgtggtcatgg

SEQ ID NO: 88597 - DNA, 25 bp, S. pombe
gaattttgtcaaacttggctgagaa

SEQ ID NO: 88598 - DNA, 25 bp, S. pombe
gaatcgttggcgtaccaggcggaca

SEQ ID NO: 88599 - DNA, 25 bp, S. pombe
ggataacgggtcttagcaaccaact

SEQ ID NO: 88600 - DNA, 25 bp, S. pombe
gaatagcacggttttaccaactcct

SEQ ID NO: 88601 - DNA, 25 bp, S. pombe
gaatgacacggtcttcctaaccgat

SEQ ID NO: 88602 - DNA, 25 bp, S. pombe
gaatttcaactttggctgaagcgga

SEQ ID NO: 88603 - DNA, 25 bp, S. pombe
gaatttcacactctgtcgaagcgac

SEQ ID NO: 88604 - DNA, 25 bp, S. pombe
gaattacacatccatcgtccataga

SEQ ID NO: 88605 - DNA, 25 bp, S. pombe
gaattctcgacaatcctcgtagagt

SEQ ID NO: 88606 - DNA, 25 bp, S. pombe
gaatttaggttttcatggcgacgaa

SEQ ID NO: 88607 - DNA, 25 bp, S. pombe
gaattttgtttttcggtcacagata

SEQ ID NO: 88608 - DNA, 25 bp, S. pombe
gaattcgtagttgctgtcagatcat

SEQ ID NO: 88609 - DNA, 25 bp, S. pombe
gaattctgaggaacgcgaagcccaa

SEQ ID NO: 88610 - DNA, 25 bp, S. pombe
gaatccaggaatgccggcgcctgta

SEQ ID NO: 88611 - DNA, 25 bp, S. pombe
gaattcatcccgtactagatcctat

SEQ ID NO: 88612 - DNA, 25 bp, S. pombe
gaattagctccgtacgatcctgatt

SEQ ID NO: 88613 - DNA, 25 bp, S. pombe
gaattctcctacaacctataatgcc

SEQ ID NO: 88614 - DNA, 25 bp, S. pombe
gaatatttccgtccaaggtttgaag

SEQ ID NO: 88615 - DNA, 25 bp, S. pombe
gaatatctcttctccaaaccttaag

SEQ ID NO: 88616 - DNA, 25 bp, S. pombe
gaatatgtgacacccgtttcgtcgg

SEQ ID NO: 88617 - DNA, 25 bp, S. pombe
gaatctgatgcatacggtgtttttg

SEQ ID NO: 88618 - DNA, 25 bp, S. pombe
gaatcccaaactcgtttaacacttg

SEQ ID NO: 88619 - DNA, 25 bp, S. pombe
gaatccgaaggtcgttgttacattt

SEQ ID NO: 88620 - DNA, 25 bp, S. pombe
gaatcaacaagctccgtacgtgtgt

SEQ ID NO: 88621 - DNA, 25 bp, S. pombe
gaattatattgttcattggcaccag

SEQ ID NO: 88622 - DNA, 25 bp, S. pombe
gaattagattctcgcttggatcctg

SEQ ID NO: 88623 - DNA, 25 bp, S. pombe
gaattcgatgattctcgtcctcctg

SEQ ID NO: 88624 - DNA, 25 bp, S. pombe
gaattcacactccattgttgcactc

SEQ ID NO: 88625 - DNA, 25 bp, S. pombe
gaattatcacctctttgcagtagca

SEQ ID NO: 88626 - DNA, 25 bp, S. pombe
gaataccaagctaggcgtctactca

SEQ ID NO: 88627 - DNA, 25 bp, S. pombe
gaatactcaacctgagcgcattcat

SEQ ID NO: 88628 - DNA, 25 bp, S. pombe
gaatcttcaagccattgagcctctt

SEQ ID NO: 88629 - DNA, 25 bp, S. pombe
gaatcattcaatctcggtccgtata

SEQ ID NO: 88630 - DNA, 25 bp, S. pombe
gaatatgctaatcacctatggacag

SEQ ID NO: 88631 - DNA, 25 bp, S. pombe
gaatcttgcattttccttggacgga

SEQ ID NO: 88632 - DNA, 25 bp, S. pombe
gaatatgcttcaaacactagtgctt

SEQ ID NO: 88633 - DNA, 25 bp, S. pombe
gaattcttgaagtatctcgttctac

SEQ ID NO: 88634 - DNA, 25 bp, S. pombe
gaatattggtcatatgctgtgtaca

SEQ ID NO: 88635 - DNA, 25 bp, S. pombe
gaatatcatccggtcacttagtgaa

SEQ ID NO: 88636 - DNA, 25 bp, S. pombe
gaattctgccgcttctatgtataag

SEQ ID NO: 88637 - DNA, 25 bp, S. pombe
gaatgcctgtcgttacttttcgtaa

SEQ ID NO: 88638 - DNA, 25 bp, S. pombe
gaatatctatcgcttgttcttccaa

SEQ ID NO: 88639 - DNA, 25 bp, S. pombe
gaattttgctattgtcacagccctt

SEQ ID NO: 88640 - DNA, 25 bp, S. pombe
gaattaccatatttcacgccctgaa

SEQ ID NO: 88641 - DNA, 25 bp, S. pombe
gaatacgctcgtttactctgtaatc

SEQ ID NO: 88642 - DNA, 25 bp, S. pombe
gaatcaaggcgcgagtcaacttatt

SEQ ID NO: 88643 - DNA, 25 bp, S. pombe
gaatatgagctcgaacatcccactt

SEQ ID NO: 88644 - DNA, 25 bp, S. pombe
gaataatgatctctagcgaggccta

SEQ ID NO: 88645 - DNA, 25 bp, S. pombe
gaattcatgcgctgaacggtgccga

SEQ ID NO: 88646 - DNA, 25 bp, S. pombe
gaattagccaaacgctggtgcccgg

SEQ ID NO: 88647 - DNA, 25 bp, S. pombe
gaattacccaaactgagcccggcaa

SEQ ID NO: 88648 - DNA, 25 bp, S. pombe
gaattacccaggttgctgtacagga

SEQ ID NO: 88649 - DNA, 25 bp, S. pombe
gaattatcagactctcagcagcgaa

SEQ ID NO: 88650 - DNA, 25 bp, S. pombe
gaatctagctaccacgatcaggaag

SEQ ID NO: 88651 - DNA, 25 bp, S. pombe
gaacagggacaagcgttagccgatg

SEQ ID NO: 88652 - DNA, 25 bp, S. pombe
gaatctgtggtttccgttagcccta

SEQ ID NO: 88653 - DNA, 25 bp, S. pombe
gaatttcgttatggatctgggcaaa

SEQ ID NO: 88654 - DNA, 25 bp, S. pombe
gaatttggtctttatgctcgagaaa

SEQ ID NO: 88655 - DNA, 25 bp, S. pombe
gaatatatgctaaaggccctcaacg

SEQ ID NO: 88656 - DNA, 25 bp, S. pombe
gaataactgctatagccccagacat

SEQ ID NO: 88657 - DNA, 25 bp, S. pombe
gaatttcatgttacaaaccgccaag

SEQ ID NO: 88658 - DNA, 25 bp, S. pombe
gaatttggattcgtcacactctccg

SEQ ID NO: 88659 - DNA, 25 bp, S. pombe
gaatacggtttaccacctacagctg

SEQ ID NO: 88660 - DNA, 25 bp, S. pombe
gaattattcccgcatacaacacttt

SEQ ID NO: 88661 - DNA, 25 bp, S. pombe
gaattttcagtgttgcattctcgaa

SEQ ID NO: 88662 - DNA, 25 bp, S. pombe
gaattattcgcttggactcatccat

SEQ ID NO: 88663 - DNA, 25 bp, S. pombe
gaattattctgcacaaccatctact

SEQ ID NO: 88664 - DNA, 25 bp, S. pombe
gaattttctaaatttcatgatagtt

SEQ ID NO: 88665 - DNA, 25 bp, S. pombe
gaatctttcaactacatcccttgta

SEQ ID NO: 88666 - DNA, 25 bp, S. pombe
gaattattattttccccatctgata

SEQ ID NO: 88667 - DNA, 25 bp, S. pombe
gaagctaaacaaagtcccacgacga

SEQ ID NO: 88668 - DNA, 25 bp, S. pombe
gaatctaaagttgtccaccggttgt

SEQ ID NO: 88669 - DNA, 25 bp, S. pombe
gaatacaaacttgaatcctgcggtt

SEQ ID NO: 88670 - DNA, 25 bp, S. pombe
gaataatcagaccattaatcctcag

SEQ ID NO: 88671 - DNA, 25 bp, S. pombe
gaatcatttgttgactctgccgttg

SEQ ID NO: 88672 - DNA, 25 bp, S. pombe
gaattatcaagactcctggtaacaa

SEQ ID NO: 88673 - DNA, 25 bp, S. pombe
gaatctatctgcactccggtaaaaa

SEQ ID NO: 88674 - DNA, 25 bp, S. pombe
gaatttgccgaattgtggattcata

SEQ ID NO: 88675 - DNA, 25 bp, S. pombe
gaatattccgacttttttgatcaaa

SEQ ID NO: 88676 - DNA, 25 bp, S. pombe
gaatcataacatattccctttcccc

SEQ ID NO: 88677 - DNA, 25 bp, S. pombe
gaatcccatggctgtcttaattttg

SEQ ID NO: 88678 - DNA, 25 bp, S. pombe
gaatactatcgctttcttcagtttt

SEQ ID NO: 88679 - DNA, 25 bp, S. pombe
gaatataattgctttcctggtttta

SEQ ID NO: 88680 - DNA, 25 bp, S. pombe
gaatatgatactgttaccggcgtta

SEQ ID NO: 88681 - DNA, 25 bp, S. pombe
gaatagtgattctctaccgcagttt

SEQ ID NO: 88682 - DNA, 25 bp, S. pombe
gaatttaatgagaacggcccacctt

SEQ ID NO: 88683 - DNA, 25 bp, S. pombe
gaatatcaacgtgctgtacgccgca

SEQ ID NO: 88684 - DNA, 25 bp, S. pombe
gaataaccgtcgtttcgcaatgagt

SEQ ID NO: 88685 - DNA, 25 bp, S. pombe
gaataccctgtgatttacccatttg

SEQ ID NO: 88686 - DNA, 25 bp, S. pombe
gaatacaccgacatagttcccgatt

SEQ ID NO: 88687 - DNA, 25 bp, S. pombe
gaatacgctcgaattaaacgggctt

SEQ ID NO: 88688 - DNA, 25 bp, S. pombe
gaatttgctcgtatcaactcggtct

SEQ ID NO: 88689 - DNA, 25 bp, S. pombe
gaatatttccattaatacacctgag

SEQ ID NO: 88690 - DNA, 25 bp, S. pombe
gaatcaactcactttcaattcccga

SEQ ID NO: 88691 - DNA, 25 bp, S. pombe
gaatagtttcaaatcttacgccgtt

SEQ ID NO: 88692 - DNA, 25 bp, S. pombe
gaatggtgtaactacttccggcact

SEQ ID NO: 88693 - DNA, 25 bp, S. pombe
gaatgcacttgatcaattacgccga

SEQ ID NO: 88694 - DNA, 25 bp, S. pombe
gaatcctttgacgttgtcttcagca

SEQ ID NO: 88695 - DNA, 25 bp, S. pombe
gaatcagctttgcagcatttcattg

SEQ ID NO: 88696 - DNA, 25 bp, S. pombe
gaatcgatcctgctaaggtttcggc

SEQ ID NO: 88697 - DNA, 25 bp, S. pombe
gaatttatccctgcagatgtttctg

SEQ ID NO: 88698 - DNA, 25 bp, S. pombe
gaatacatcacgttcatacatccct

SEQ ID NO: 88699 - DNA, 25 bp, S. pombe
gaatatcatgctctctaacattggt

SEQ ID NO: 88700 - DNA, 25 bp, S. pombe
gaatcgactggactgatacttcaag

SEQ ID NO: 88701 - DNA, 25 bp, S. pombe
gaatccagtctcagcaattaaaatc

SEQ ID NO: 88702 - DNA, 25 bp, S. pombe
gaatccgttgactcatcaaattcag

SEQ ID NO: 88703 - DNA, 25 bp, S. pombe
gaatcattcttactcgaaaaccgat

SEQ ID NO: 88704 - DNA, 25 bp, S. pombe
gaatttcattttgttggtcctctta

SEQ ID NO: 88705 - DNA, 25 bp, S. pombe
gaatttttcttcttatgccacgttt

SEQ ID NO: 88706 - DNA, 25 bp, S. pombe
gaatttgttgtttttctccttgtat

SEQ ID NO: 88707 - DNA, 25 bp, S. pombe
gaatttatcaactacttgtccgatt

SEQ ID NO: 88708 - DNA, 25 bp, S. pombe
gaatctggaaattggccttgcgact

SEQ ID NO: 88709 - DNA, 25 bp, S. pombe
gaatcaggactttctcaaataaaaa

SEQ ID NO: 88710 - DNA, 25 bp, S. pombe
gaatcaggccttgcatcatgaatca

SEQ ID NO: 88711 - DNA, 25 bp, S. pombe
gaatcagcgccttctaccaatggtg

SEQ ID NO: 88712 - DNA, 25 bp, S. pombe
gaatgacttcccttactggcaaggt

SEQ ID NO: 88713 - DNA, 25 bp, S. pombe
gaatacgtttgctttcatatgcgat

SEQ ID NO: 88714 - DNA, 25 bp, S. pombe
gaatatcatctcaagcatttggcaa

SEQ ID NO: 88715 - DNA, 25 bp, S. pombe
gaatatctcgcttcagctatcgtga

SEQ ID NO: 88716 - DNA, 25 bp, S. pombe
gaatatctcctttcgtcgtcggaaa

SEQ ID NO: 88717 - DNA, 25 bp, S. pombe
gaacctactaatgccctggacattg

SEQ ID NO: 88718 - DNA, 25 bp, S. pombe
gaatacccaaacaaaggactctatc

SEQ ID NO: 88719 - DNA, 25 bp, S. pombe
gaatcaatcttcctcaagtgcagca

SEQ ID NO: 88720 - DNA, 25 bp, S. pombe
gaatcaatgctcgttcagcttgcgc

SEQ ID NO: 88721 - DNA, 25 bp, S. pombe
gaatatatggcaattcgctttgctt

SEQ ID NO: 88722 - DNA, 25 bp, S. pombe
gaataagtatatccccaagcaagta

SEQ ID NO: 88723 - DNA, 25 bp, S. pombe
gaatttgtacatactcgaccgctgc

SEQ ID NO: 88724 - DNA, 25 bp, S. pombe
gaatttgtcattgatcgtccagagc

SEQ ID NO: 88725 - DNA, 25 bp, S. pombe
gaatttctcctaatttgcactggcc

SEQ ID NO: 88726 - DNA, 25 bp, S. pombe
gaatttgacttttgttgactatgct

SEQ ID NO: 88727 - DNA, 25 bp, S. pombe
gaatttccttctagtgatacatctt

SEQ ID NO: 88728 - DNA, 25 bp, S. pombe
gaatttcccttcaactaagctctta

SEQ ID NO: 88729 - DNA, 25 bp, S. pombe
gaatttgccccacaatcattctctt

SEQ ID NO: 88730 - DNA, 25 bp, S. pombe
gaatttgaccctgtttcatctttga

SEQ ID NO: 88731 - DNA, 25 bp, S. pombe
gaatgacaagccctgctttcaagta

SEQ ID NO: 88732 - DNA, 25 bp, S. pombe
gaaggactggctctttagaaaccgg

SEQ ID NO: 88733 - DNA, 25 bp, S. pombe
gaatgctcgggaaggtttaaaccat

SEQ ID NO: 88734 - DNA, 25 bp, S. pombe
gaagtccccaagagaatcaaaccat

SEQ ID NO: 88735 - DNA, 25 bp, S. pombe
gaacctacaaacagaactaagcact

SEQ ID NO: 88736 - DNA, 25 bp, S. pombe
gaatcctgaaatgcctccaaaacgt

SEQ ID NO: 88737 - DNA, 25 bp, S. pombe
gaatttgatcatgcgctttctttac

SEQ ID NO: 88738 - DNA, 25 bp, S. pombe
gaatcattactatcgttatggtgaa

SEQ ID NO: 88739 - DNA, 25 bp, S. pombe
gaatagctcccgtttggatgatccc

SEQ ID NO: 88740 - DNA, 25 bp, S. pombe
gaatttgtcgtttctgtcaaaccag

SEQ ID NO: 88741 - DNA, 25 bp, S. pombe
gaatctggtcagttccgtcaactta

SEQ ID NO: 88742 - DNA, 25 bp, S. pombe
gaatatctctgttcctcaaattagc

SEQ ID NO: 88743 - DNA, 25 bp, S. pombe
gaatatgtggtctccttttcacgat

SEQ ID NO: 88744 - DNA, 25 bp, S. pombe
gaatatgtttgctggtgatttcctt

SEQ ID NO: 88745 - DNA, 25 bp, S. pombe
gaatctggttcagacctgaccgata

SEQ ID NO: 88746 - DNA, 25 bp, S. pombe
gaatcgaattcctcagttgccgtag

SEQ ID NO: 88747 - DNA, 25 bp, S. pombe
gaatatttatgcaacctggagtcca

SEQ ID NO: 88748 - DNA, 25 bp, S. pombe
gaatcacgtctttcatcggttgctc

SEQ ID NO: 88749 - DNA, 25 bp, S. pombe
gaatatggcgttgctgcaggtctcg

SEQ ID NO: 88750 - DNA, 25 bp, S. pombe
gaatcgatggttgccagtgctcgtc

SEQ ID NO: 88751 - DNA, 25 bp, S. pombe
gaatcgtcgtgctttactggcgtcg

SEQ ID NO: 88752 - DNA, 25 bp, S. pombe
gaatagtcgtcaattatgccagtgt

SEQ ID NO: 88753 - DNA, 25 bp, S. pombe
gaatatctcttctaatggccgtgct

SEQ ID NO: 88754 - DNA, 25 bp, S. pombe
gaatatgtcgcctacagagactatt

SEQ ID NO: 88755 - DNA, 25 bp, S. pombe
gaataaccttgacgactctttgaat

SEQ ID NO: 88756 - DNA, 25 bp, S. pombe
gaatattcacttcgcgtttttgcaa

SEQ ID NO: 88757 - DNA, 25 bp, S. pombe
gaatacagcgatcctgtgacctctt

SEQ ID NO: 88758 - DNA, 25 bp, S. pombe
gaatatggctatgctcaacctgctg

SEQ ID NO: 88759 - DNA, 25 bp, S. pombe
gaatttgctctctgtgactgatcca

SEQ ID NO: 88760 - DNA, 25 bp, S. pombe
gaataccaaccctgctgatcaaaat

SEQ ID NO: 88761 - DNA, 25 bp, S. pombe
gaatactggctcttgttgtacatct

SEQ ID NO: 88762 - DNA, 25 bp, S. pombe
gaatatcggaacactttcatccacg

SEQ ID NO: 88763 - DNA, 25 bp, S. pombe
gaatctgaggatttagccctccgca

SEQ ID NO: 88764 - DNA, 25 bp, S. pombe
gaatctgaggcaactacttccaccg

SEQ ID NO: 88765 - DNA, 25 bp, S. pombe
gaatattcttccaagggtcctctaa

SEQ ID NO: 88766 - DNA, 25 bp, S. pombe
gaatacgctttcatggaacctttac

SEQ ID NO: 88767 - DNA, 25 bp, S. pombe
gaatgacgggttcgaagagctttta

SEQ ID NO: 88768 - DNA, 25 bp, S. pombe
gaatgtcccgttgaacctggtatca

SEQ ID NO: 88769 - DNA, 25 bp, S. pombe
gaatagctcgcttccaatttggtcc

SEQ ID NO: 88770 - DNA, 25 bp, S. pombe
gaatatgtcggcttccgagtcgcaa

SEQ ID NO: 88771 - DNA, 25 bp, S. pombe
gaatatgccagtttccaggctggag

SEQ ID NO: 88772 - DNA, 25 bp, S. pombe
gaatattgctagacttttgtgccaa

SEQ ID NO: 88773 - DNA, 25 bp, S. pombe
gaatattgctctccttcgtcaaaga

SEQ ID NO: 88774 - DNA, 25 bp, S. pombe
gaatattgctctacactcctgaaaa

SEQ ID NO: 88775 - DNA, 25 bp, S. pombe
gaatatgtatcttccagccagcaag

SEQ ID NO: 88776 - DNA, 25 bp, S. pombe
gaatatgctggattacttccaacgt

SEQ ID NO: 88777 - DNA, 25 bp, S. pombe
gaatcatgctggcactgcaaccaac

SEQ ID NO: 88778 - DNA, 25 bp, S. pombe
gaatccagtttccaaaccgaagtca

SEQ ID NO: 88779 - DNA, 25 bp, S. pombe
gaatgcctttttcaagtgcgacctt

SEQ ID NO: 88780 - DNA, 25 bp, S. pombe
gaatactcctttcaataccgcctat

SEQ ID NO: 88781 - DNA, 25 bp, S. pombe
gaataccttttgctataattgcttc

SEQ ID NO: 88782 - DNA, 25 bp, S. pombe
gaatatctcccaagcttcaaatttt

SEQ ID NO: 88783 - DNA, 25 bp, S. pombe
gaatagctctccaattaaggattgt

SEQ ID NO: 88784 - DNA, 25 bp, S. pombe
gaatagcttgctgcctgaatcaata

SEQ ID NO: 88785 - DNA, 25 bp, S. pombe
gaatataacacttctccatttgcga

SEQ ID NO: 88786 - DNA, 25 bp, S. pombe
gaatggaacccagcgaacacctgaa

SEQ ID NO: 88787 - DNA, 25 bp, S. pombe
gaatccattcgtccaagctgaataa

SEQ ID NO: 88788 - DNA, 25 bp, S. pombe
gaatacattccatcttcgttgcaac

SEQ ID NO: 88789 - DNA, 25 bp, S. pombe
gaatacttcagcttcgtcagttggc

SEQ ID NO: 88790 - DNA, 25 bp, S. pombe
gaatatgccaagactgtgctcgact

SEQ ID NO: 88791 - DNA, 25 bp, S. pombe
gaatatgccacgattactcagagat

SEQ ID NO: 88792 - DNA, 25 bp, S. pombe
gaatatgtccgtaactctcatgaca

SEQ ID NO: 88793 - DNA, 25 bp, S. pombe
gaatagtgcggatttctctaacaaa

SEQ ID NO: 88794 - DNA, 25 bp, S. pombe
gaatagttggcgttcatctacaaaa

SEQ ID NO: 88795 - DNA, 25 bp, S. pombe
gaatactttttgtggcacccctgaa

SEQ ID NO: 88796 - DNA, 25 bp, S. pombe
gaatacttttgtttgtgtcaccgga

SEQ ID NO: 88797 - DNA, 25 bp, S. pombe
gaatcagttcttcttggtaaccgtg

SEQ ID NO: 88798 - DNA, 25 bp, S. pombe
gaatatcttttcgttgatgttgcaa

SEQ ID NO: 88799 - DNA, 25 bp, S. pombe
gaatacgttcacataatgccgtctg

SEQ ID NO: 88800 - DNA, 25 bp, S. pombe
gaatacgtgttcagacatcctggct

SEQ ID NO: 88801 - DNA, 25 bp, S. pombe
gaatcgctctttgtaattcgggatt

SEQ ID NO: 88802 - DNA, 25 bp, S. pombe
gaatctcattctaagcgcacaacac

SEQ ID NO: 88803 - DNA, 25 bp, S. pombe
gaatctgctgttcagaccaagtcat

SEQ ID NO: 88804 - DNA, 25 bp, S. pombe
gaatctcgtttaacttcagtattgt

SEQ ID NO: 88805 - DNA, 25 bp, S. pombe
gattccgttagtctttgcctaagca

SEQ ID NO: 88806 - DNA, 25 bp, S. pombe
gaatctacctcttctagttcctttt

SEQ ID NO: 88807 - DNA, 25 bp, S. pombe
gaataatcccgaatcacttgcccaa

SEQ ID NO: 88808 - DNA, 25 bp, S. pombe
gaatgaacagcccaaccttaagaaa

SEQ ID NO: 88809 - DNA, 25 bp, S. pombe
gaatacgcgatcgttttcgtggaac

SEQ ID NO: 88810 - DNA, 25 bp, S. pombe
gaatacgctgacgatgtttctgata

SEQ ID NO: 88811 - DNA, 25 bp, S. pombe
gaatatgcgtctgctttatcaaaaa

SEQ ID NO: 88812 - DNA, 25 bp, S. pombe
gaatgtacccctgctaagaagaagt

SEQ ID NO: 88813 - DNA, 25 bp, S. pombe
gaatctacgttttcgcaaaagcggt

SEQ ID NO: 88814 - DNA, 25 bp, S. pombe
gaatcccgagttacgtacaagtcat

SEQ ID NO: 88815 - DNA, 25 bp, S. pombe
gaatccctggtgtatggtttcaatt

SEQ ID NO: 88816 - DNA, 25 bp, S. pombe
gaatcggcggtgtttactccaatgt

SEQ ID NO: 88817 - DNA, 25 bp, S. pombe
gaatcccctgtttctaatcgaaggc

SEQ ID NO: 88818 - DNA, 25 bp, S. pombe
gaatcctgcggttggacaactcaat

SEQ ID NO: 88819 - DNA, 25 bp, S. pombe
gaatgttccttttactacccataag

SEQ ID NO: 88820 - DNA, 25 bp, S. pombe
gaatgccaggttcttccaatcgaag

SEQ ID NO: 88821 - DNA, 25 bp, S. pombe
gaatactccttgttttctcgtgata

SEQ ID NO: 88822 - DNA, 25 bp, S. pombe
gaatactccttattttgctcctatt

SEQ ID NO: 88823 - DNA, 25 bp, S. pombe
gaataccattccaagtatcccacat

SEQ ID NO: 88824 - DNA, 25 bp, S. pombe
gaatacctccgttgaatctgagcta

SEQ ID NO: 88825 - DNA, 25 bp, S. pombe
gaaaagcaaacctgattcctccgac

SEQ ID NO: 88826 - DNA, 25 bp, S. pombe
gaatactggaagtcgcacacctgcg

SEQ ID NO: 88827 - DNA, 25 bp, S. pombe
gaatgagcatgagcactgctaccca

SEQ ID NO: 88828 - DNA, 25 bp, S. pombe
gaatagcatgactcctttaatctct

SEQ ID NO: 88829 - DNA, 25 bp, S. pombe
gaaggagcatcatcgtcttttccag

SEQ ID NO: 88830 - DNA, 25 bp, S. pombe
gaaggcgatcgagcttttgctaaac

SEQ ID NO: 88831 - DNA, 25 bp, S. pombe
gaatgccaagagctcattgtctgtt

SEQ ID NO: 88832 - DNA, 25 bp, S. pombe
gaatctgacataccttctggtggtg

SEQ ID NO: 88833 - DNA, 25 bp, S. pombe
gaatcttcttcgtgctcattatgga

SEQ ID NO: 88834 - DNA, 25 bp, S. pombe
gaatcctctaggttgtcttctttat

SEQ ID NO: 88835 - DNA, 25 bp, S. pombe
gaatcatccactttctggtgtacag

SEQ ID NO: 88836 - DNA, 25 bp, S. pombe
gaatagacaccttctttcattcgtg

SEQ ID NO: 88837 - DNA, 25 bp, S. pombe
gaatagacaccttttacatcctgct

SEQ ID NO: 88838 - DNA, 25 bp, S. pombe
gaatagagcttctttctctttgtaa

SEQ ID NO: 88839 - DNA, 25 bp, S. pombe
gaatcaactctgttggctccttcaa

SEQ ID NO: 88840 - DNA, 25 bp, S. pombe
gaatcaactatgtcttgtcctatga

SEQ ID NO: 88841 - DNA, 25 bp, S. pombe
gaatcactgcattggtatagcctta

SEQ ID NO: 88842 - DNA, 25 bp, S. pombe
gaatacttcttgtcaatcgtggcct

SEQ ID NO: 88843 - DNA, 25 bp, S. pombe
gaatgccttattacagcacggtcaa

SEQ ID NO: 88844 - DNA, 25 bp, S. pombe
gaatgccgtgaccaagagcacttat

SEQ ID NO: 88845 - DNA, 25 bp, S. pombe
gaatcaaccactctgatgtctgatg

SEQ ID NO: 88846 - DNA, 25 bp, S. pombe
gaatcatactgcttcagcacctttg

SEQ ID NO: 88847 - DNA, 25 bp, S. pombe
gaatacatcaccacacttcaatcag

SEQ ID NO: 88848 - DNA, 25 bp, S. pombe
gaatactccaaacctatcaacacga

SEQ ID NO: 88849 - DNA, 25 bp, S. pombe
gaaaccatcccgctactacgagtaa

SEQ ID NO: 88850 - DNA, 25 bp, S. pombe
gaatccaaccctactactacagagt

SEQ ID NO: 88851 - DNA, 25 bp, S. pombe
gaatcttcccaaaccgatacttcta

SEQ ID NO: 88852 - DNA, 25 bp, S. pombe
gaataccagattatccagaggcatt

SEQ ID NO: 88853 - DNA, 25 bp, S. pombe
gaatacctgcgccttactagtttag

SEQ ID NO: 88854 - DNA, 25 bp, S. pombe
gaatccgcatcagcttattttttgg

SEQ ID NO: 88855 - DNA, 25 bp, S. pombe
gaatccagatcttactacttttgtg

SEQ ID NO: 88856 - DNA, 25 bp, S. pombe
gaatgcaatgaaaggctacaaggat

SEQ ID NO: 88857 - DNA, 25 bp, S. pombe
gaatctcagattgtcactcaaggat

SEQ ID NO: 88858 - DNA, 25 bp, S. pombe
gaatctcaatctgtcctgtggttac

SEQ ID NO: 88859 - DNA, 25 bp, S. pombe
gaatcgcaggctttccatgggatct

SEQ ID NO: 88860 - DNA, 25 bp, S. pombe
gaatgccaactatcacgaggtgcga

SEQ ID NO: 88861 - DNA, 25 bp, S. pombe
gaatccatcaacgagggcgaaactg

SEQ ID NO: 88862 - DNA, 25 bp, S. pombe
gaatctactacattatccacagctc

SEQ ID NO: 88863 - DNA, 25 bp, S. pombe
gaatacgcagacttccattacaacg

SEQ ID NO: 88864 - DNA, 25 bp, S. pombe
gaatcacagatgacactcctcaaca

SEQ ID NO: 88865 - DNA, 25 bp, S. pombe
gaatcactgcagatcctacatacaa

SEQ ID NO: 88866 - DNA, 25 bp, S. pombe
gaatcatctggactgcttcatgatg

SEQ ID NO: 88867 - DNA, 25 bp, S. pombe
gaatcactggaatctactttagcta

SEQ ID NO: 88868 - DNA, 25 bp, S. pombe
gaatcctagcactacggctttgaaa

SEQ ID NO: 88869 - DNA, 25 bp, S. pombe
gaatctgctttctatatggttggta

SEQ ID NO: 88870 - DNA, 25 bp, S. pombe
gaatcttagttgctgcctgcgatac

SEQ ID NO: 88871 - DNA, 25 bp, S. pombe
gaatctccaattgggcaatctccac

SEQ ID NO: 88872 - DNA, 25 bp, S. pombe
gaatcagtcttccttgaaatggcaa

SEQ ID NO: 88873 - DNA, 25 bp, S. pombe
gaatctcctttatctgacgaaacag

SEQ ID NO: 88874 - DNA, 25 bp, S. pombe
gaatcccgtttctttgcctaatcag

SEQ ID NO: 88875 - DNA, 25 bp, S. pombe
gaatccggcattagtttcctagaga

SEQ ID NO: 88876 - DNA, 25 bp, S. pombe
gaatccgagcttgctgcttttaata

SEQ ID NO: 88877 - DNA, 25 bp, S. pombe
gaatacacagccttcgccagttgaa

SEQ ID NO: 88878 - DNA, 25 bp, S. pombe
gaatcacacaggtatccatcattat

SEQ ID NO: 88879 - DNA, 25 bp, S. pombe
gaatctcatatgctatctaagtatc

SEQ ID NO: 88880 - DNA, 25 bp, S. pombe
gaatcgtcgccgaaaatgacagcag

SEQ ID NO: 88881 - DNA, 25 bp, S. pombe
gaatcaattcgatctgacttactga

SEQ ID NO: 88882 - DNA, 25 bp, S. pombe
gaatctttctacttgacttttgcac

SEQ ID NO: 88883 - DNA, 25 bp, S. pombe
gaatctattcttatgacccttccat

SEQ ID NO: 88884 - DNA, 25 bp, S. pombe
gaatctgatgttattgtcccaggta

SEQ ID NO: 88885 - DNA, 25 bp, S. pombe
gaatctgatttttctggtccaggtg

SEQ ID NO: 88886 - DNA, 25 bp, S. pombe
gaatcatgttttctagatccagcga

SEQ ID NO: 88887 - DNA, 25 bp, S. pombe
gacattttcttcgtagcaggaggac

SEQ ID NO: 88888 - DNA, 25 bp, S. pombe
gaatcaatctgttatttatgccgta

SEQ ID NO: 88889 - DNA, 25 bp, S. pombe
gaatcatctcttgttttctcaaacc

SEQ ID NO: 88890 - DNA, 25 bp, S. pombe
gaatacatgtgcttccttttcaaga

SEQ ID NO: 88891 - DNA, 25 bp, S. pombe
gaatgacttccgtttagtaatcaac

SEQ ID NO: 88892 - DNA, 25 bp, S. pombe
gaatcacttcggtttcatgtttcac

SEQ ID NO: 88893 - DNA, 25 bp, S. pombe
gaatcactaccgatccattttcatc

SEQ ID NO: 88894 - DNA, 25 bp, S. pombe
gaatcatgttcttggtatcgttttt

SEQ ID NO: 88895 - DNA, 25 bp, S. pombe
gaatctgccattttttcggttttag

SEQ ID NO: 88896 - DNA, 25 bp, S. pombe
gaatcagctaaattgttgcgcgtat

SEQ ID NO: 88897 - DNA, 25 bp, S. pombe
gaatctgcccaaagtgataccgtct

SEQ ID NO: 88898 - DNA, 25 bp, S. pombe
gaatcagctccgactactgcaggtt

SEQ ID NO: 88899 - DNA, 25 bp, S. pombe
gaataatttgcttcctcagtggtat

SEQ ID NO: 88900 - DNA, 25 bp, S. pombe
gaatgaatctatcaactcctcctcc

SEQ ID NO: 88901 - DNA, 25 bp, S. pombe
gaatctgaaacatgaccgacctttt

SEQ ID NO: 88902 - DNA, 25 bp, S. pombe
gaatgccgaaacagccgaactcgtt

SEQ ID NO: 88903 - DNA, 25 bp, S. pombe
gaatgacacgatgggattccccttt

SEQ ID NO: 88904 - DNA, 25 bp, S. pombe
gaatgaccgattcagtgatccctat

SEQ ID NO: 88905 - DNA, 25 bp, S. pombe
gaatacagctgttcctttccagaat

SEQ ID NO: 88906 - DNA, 25 bp, S. pombe
gaatgaacgtccattgggccacagc

SEQ ID NO: 88907 - DNA, 25 bp, S. pombe
gaataagtcatccttcgaccacatt

SEQ ID NO: 88908 - DNA, 25 bp, S. pombe
gaatctcttcgaaatggtaccgtta

SEQ ID NO: 88909 - DNA, 25 bp, S. pombe
gaatcttctcgcgaaggtctcggtt

SEQ ID NO: 88910 - DNA, 25 bp, S. pombe
gaatcagaatccaattgcggctcct

SEQ ID NO: 88911 - DNA, 25 bp, S. pombe
gaatggcttaaatcatctcacccgg

SEQ ID NO: 88912 - DNA, 25 bp, S. pombe
gaatgccaaaaatcttcccgctgct

SEQ ID NO: 88913 - DNA, 25 bp, S. pombe
gaatcacctggagtcttatgcatat

SEQ ID NO: 88914 - DNA, 25 bp, S. pombe
gaatctcactcactgaagttttcta

SEQ ID NO: 88915 - DNA, 25 bp, S. pombe
gaatccgctttggttcatatgcaaa

SEQ ID NO: 88916 - DNA, 25 bp, S. pombe
gaatccagctcgtgacttgggacct

SEQ ID NO: 88917 - DNA, 25 bp, S. pombe
gaatcggctcatattaaacaatcgt

SEQ ID NO: 88918 - DNA, 25 bp, S. pombe
gaatcgactttctaaatactacgtg

SEQ ID NO: 88919 - DNA, 25 bp, S. pombe
gaatcaactatgcttttacccgtgc

SEQ ID NO: 88920 - DNA, 25 bp, S. pombe
gaatctttcttcattttcttcggtc

SEQ ID NO: 88921 - DNA, 25 bp, S. pombe
gaatctttctctaacgtttctcgaa

SEQ ID NO: 88922 - DNA, 25 bp, S. pombe
gaatcttgcttctcattttatcgct

SEQ ID NO: 88923 - DNA, 25 bp, S. pombe
gaatctttcctctttttacattatg

SEQ ID NO: 88924 - DNA, 25 bp, S. pombe
gaatctcttccgtatttggctattt

SEQ ID NO: 88925 - DNA, 25 bp, S. pombe
gaatcatctggagccttttgctaat

SEQ ID NO: 88926 - DNA, 25 bp, S. pombe
gaatcgtcgaaccttatgttatgta

SEQ ID NO: 88927 - DNA, 25 bp, S. pombe
gaatctgccaaggagctttttcgtt

SEQ ID NO: 88928 - DNA, 25 bp, S. pombe
gaatctgagaaagctactcctcctt

SEQ ID NO: 88929 - DNA, 25 bp, S. pombe
gaatcgtgaacaacctacttcattg

SEQ ID NO: 88930 - DNA, 25 bp, S. pombe
gaatgggcacttcaccgtaaggtta

SEQ ID NO: 88931 - DNA, 25 bp, S. pombe
gaatgcggcctggttgcatctcgag

SEQ ID NO: 88932 - DNA, 25 bp, S. pombe
gaatgcatgcttaagcagctggaga

SEQ ID NO: 88933 - DNA, 25 bp, S. pombe
gaatgaaattcccagtcaggctagc

SEQ ID NO: 88934 - DNA, 25 bp, S. pombe
gaatcacggtcttcaatcttgcatg

SEQ ID NO: 88935 - DNA, 25 bp, S. pombe
gaatcagcacactacgactactaat

SEQ ID NO: 88936 - DNA, 25 bp, S. pombe
gaatcataccattcggtctgacacc

SEQ ID NO: 88937 - DNA, 25 bp, S. pombe
gaatgcgttcaagcctttggtcttc

SEQ ID NO: 88938 - DNA, 25 bp, S. pombe
gaatccatgtcattcactcgataaa

SEQ ID NO: 88939 - DNA, 25 bp, S. pombe
gaatccatttcttctgacagtgcat

SEQ ID NO: 88940 - DNA, 25 bp, S. pombe
gaatgagatgcccatatctcctctg

SEQ ID NO: 88941 - DNA, 25 bp, S. pombe
gaatcgggacagatgctactatggc

SEQ ID NO: 88942 - DNA, 25 bp, S. pombe
gaatccgaatcttatgcatgactca

SEQ ID NO: 88943 - DNA, 25 bp, S. pombe
gaatctgccaaaattgcatatctca

SEQ ID NO: 88944 - DNA, 25 bp, S. pombe
gaaggcaactgtttgtgcaaagcta

SEQ ID NO: 88945 - DNA, 25 bp, S. pombe
tgaaggccccggcaaaggaatccaa

SEQ ID NO: 88946 - DNA, 25 bp, S. pombe
gaagaaccgccgctaatgggtacaa

SEQ ID NO: 88947 - DNA, 25 bp, S. pombe
gaagtcgagcctatttgggccacta

SEQ ID NO: 88948 - DNA, 25 bp, S. pombe
gaatggaggcctcttatcggtcagc

SEQ ID NO: 88949 - DNA, 25 bp, S. pombe
gaaggcggcaaaaaccacgacaatt

SEQ ID NO: 88950 - DNA, 25 bp, S. pombe
gaatccacaatcactccaaaagctt

SEQ ID NO: 88951 - DNA, 25 bp, S. pombe
gaatccaaatcgacctctcaaagtg

SEQ ID NO: 88952 - DNA, 25 bp, S. pombe
gaatcccgtcgttatctcaatatgt

SEQ ID NO: 88953 - DNA, 25 bp, S. pombe
gaatgcggctgttcttacgaaaccc

SEQ ID NO: 88954 - DNA, 25 bp, S. pombe
gaatccatgcccgtaagtagtaaag

SEQ ID NO: 88955 - DNA, 25 bp, S. pombe
gaatgcgtggccgtaaacgtaccat

SEQ ID NO: 88956 - DNA, 25 bp, S. pombe
gaatcgtgactcttgggctctaaac

SEQ ID NO: 88957 - DNA, 25 bp, S. pombe
gaatctaagcttcgtcatttggtta

SEQ ID NO: 88958 - DNA, 25 bp, S. pombe
gaatcctcagttgtcttgatggtta

SEQ ID NO: 88959 - DNA, 25 bp, S. pombe
gaagcttcatttcaagggtttgcag

SEQ ID NO: 88960 - DNA, 25 bp, S. pombe
gaatcagtatctaccactagcgttc

SEQ ID NO: 88961 - DNA, 25 bp, S. pombe
gaatccgatatccatgcctagcaat

SEQ ID NO: 88962 - DNA, 25 bp, S. pombe
gaatccgttgccgtcaagcattacg

SEQ ID NO: 88963 - DNA, 25 bp, S. pombe
gaatctggttctagcttactatact

SEQ ID NO: 88964 - DNA, 25 bp, S. pombe
gaatcaggtgtccagttttctaatt

SEQ ID NO: 88965 - DNA, 25 bp, S. pombe
gaatctggatcctcagctttccgat

SEQ ID NO: 88966 - DNA, 25 bp, S. pombe
gaatctgaagctcgtccaactcgtg

SEQ ID NO: 88967 - DNA, 25 bp, S. pombe
gaatgcgaactgaaaccactattga

SEQ ID NO: 88968 - DNA, 25 bp, S. pombe
gaatcttctttatctctagaggcag

SEQ ID NO: 88969 - DNA, 25 bp, S. pombe
gaatcatatttctcatcgctgaatg

SEQ ID NO: 88970 - DNA, 25 bp, S. pombe
gaagtattcatgtgctcggtggtcc

SEQ ID NO: 88971 - DNA, 25 bp, S. pombe
gaatcttcccagtgcagatgcgtat

SEQ ID NO: 88972 - DNA, 25 bp, S. pombe
gaatcatccccttcagaatctggtt

SEQ ID NO: 88973 - DNA, 25 bp, S. pombe
gaatctcgaccagaaattgcctatg

SEQ ID NO: 88974 - DNA, 25 bp, S. pombe
gaatctgtcctacaacaggctttgc

SEQ ID NO: 88975 - DNA, 25 bp, S. pombe
gaatgctactcgatggcatacactt

SEQ ID NO: 88976 - DNA, 25 bp, S. pombe
gaatgctacgaatggtacctctcaa

SEQ ID NO: 88977 - DNA, 25 bp, S. pombe
gaatctcacgatttttaccatgcta

SEQ ID NO: 88978 - DNA, 25 bp, S. pombe
gaatctcaaatgtctcttccgctta

SEQ ID NO: 88979 - DNA, 25 bp, S. pombe
gaatctgctttggtctcagcatgca

SEQ ID NO: 88980 - DNA, 25 bp, S. pombe
gactttaattccagctttaatctta

SEQ ID NO: 88981 - DNA, 25 bp, S. pombe
gacttcaatttctttttcccaatct

SEQ ID NO: 88982 - DNA, 25 bp, S. pombe
gacatagtacttcctttacctggtc

SEQ ID NO: 88983 - DNA, 25 bp, S. pombe
gaatgatgctactctttgttctgct

SEQ ID NO: 88984 - DNA, 25 bp, S. pombe
gaatgccatcaaatctcgtgctgag

SEQ ID NO: 88985 - DNA, 25 bp, S. pombe
gaatctctgcatactcaaggctaca

SEQ ID NO: 88986 - DNA, 25 bp, S. pombe
gaatcggctgatccaacggcgattt

SEQ ID NO: 88987 - DNA, 25 bp, S. pombe
gaatgatacattcccaagtctggtt

SEQ ID NO: 88988 - DNA, 25 bp, S. pombe
gaatgacgatttccttaccagatat

SEQ ID NO: 88989 - DNA, 25 bp, S. pombe
gaatgacgattgttgctcgaccaat

SEQ ID NO: 88990 - DNA, 25 bp, S. pombe
gaatgtcccttctatgaaagcgtca

SEQ ID NO: 88991 - DNA, 25 bp, S. pombe
gaatctccagtaccgaatcctgtag

SEQ ID NO: 88992 - DNA, 25 bp, S. pombe
gaatcgactgtaccgacaatcgctt

SEQ ID NO: 88993 - DNA, 25 bp, S. pombe
gaatcgcctgcttccgaaattatca

SEQ ID NO: 88994 - DNA, 25 bp, S. pombe
gaatcgccgtgctaaagaattgcta

SEQ ID NO: 88995 - DNA, 25 bp, S. pombe
gaatctgccgacttaaagcattgca

SEQ ID NO: 88996 - DNA, 25 bp, S. pombe
gaatctgagcgcattgaaactttga

SEQ ID NO: 88997 - DNA, 25 bp, S. pombe
gaatctgtacatgccgatatcgcta

SEQ ID NO: 88998 - DNA, 25 bp, S. pombe
gaatctgtatcttcccattatgtta

SEQ ID NO: 88999 - DNA, 25 bp, S. pombe
gaatcgtagctatcgttgcaggaac

SEQ ID NO: 89000 - DNA, 25 bp, S. pombe
gaatcggccattcctgtccaggaaa

SEQ ID NO: 89001 - DNA, 25 bp, S. pombe
gaatctcaagaaactcctgtgcatt

SEQ ID NO: 89002 - DNA, 25 bp, S. pombe
gaatcctaaaaaaggcgctcgttat

SEQ ID NO: 89003 - DNA, 25 bp, S. pombe
gaatctctttttcagtttctttcaa

SEQ ID NO: 89004 - DNA, 25 bp, S. pombe
gaatcgtcttttggaactgtttatc

SEQ ID NO: 89005 - DNA, 25 bp, S. pombe
gaatggaagcccgtgaacgaaacaa

SEQ ID NO: 89006 - DNA, 25 bp, S. pombe
gaaggaacatctgctgatcgtgaaa

SEQ ID NO: 89007 - DNA, 25 bp, S. pombe
gaatgaactccaatcttcgactgag

SEQ ID NO: 89008 - DNA, 25 bp, S. pombe
gaatgaaacgctactggaaccagga

SEQ ID NO: 89009 - DNA, 25 bp, S. pombe
gaatgcctcacggactcgtattgta

SEQ ID NO: 89010 - DNA, 25 bp, S. pombe
gaatgttggctttctactgattgta

SEQ ID NO: 89011 - DNA, 25 bp, S. pombe
gaatgttgctagtcctactgatagt

SEQ ID NO: 89012 - DNA, 25 bp, S. pombe
gaatcgttggatttggctatatgac

SEQ ID NO: 89013 - DNA, 25 bp, S. pombe
gaatgtttaccaatgctaatcgact

SEQ ID NO: 89014 - DNA, 25 bp, S. pombe
gaatgacttggtctctgatgacatg

SEQ ID NO: 89015 - DNA, 25 bp, S. pombe
gaatgactgtttcctctgtgaggtc

SEQ ID NO: 89016 - DNA, 25 bp, S. pombe
gaatgcagttgctatgccttgggaa

SEQ ID NO: 89017 - DNA, 25 bp, S. pombe
gaatgatatggcttctacggtacaa

SEQ ID NO: 89018 - DNA, 25 bp, S. pombe
gaatgcaatctgttcaatcggtcga

SEQ ID NO: 89019 - DNA, 25 bp, S. pombe
gaatgcttaggtttggatgctcgaa

SEQ ID NO: 89020 - DNA, 25 bp, S. pombe
gaatcctgcatcgttgctcttgata

SEQ ID NO: 89021 - DNA, 25 bp, S. pombe
gaatcgtgtctttgcatctttaagt

SEQ ID NO: 89022 - DNA, 25 bp, S. pombe
gaatcgtcgctttgtttcatttgtt

SEQ ID NO: 89023 - DNA, 25 bp, S. pombe
gaatccccttcgtatgtatttgcct

SEQ ID NO: 89024 - DNA, 25 bp, S. pombe
gaatcccctatgacttttcttcaaa

SEQ ID NO: 89025 - DNA, 25 bp, S. pombe
gaatctctctgttgatttggctacg

SEQ ID NO: 89026 - DNA, 25 bp, S. pombe
gaatccatcgtgcattcaggttcga

SEQ ID NO: 89027 - DNA, 25 bp, S. pombe
gaatcgccgataattccttgaaaga

SEQ ID NO: 89028 - DNA, 25 bp, S. pombe
gaatgaacctaacttctacccttat

SEQ ID NO: 89029 - DNA, 25 bp, S. pombe
gaaggatcctcgttttaccgttcat

SEQ ID NO: 89030 - DNA, 25 bp, S. pombe
gaaggtgagccgtttaatcctgcta

SEQ ID NO: 89031 - DNA, 25 bp, S. pombe
gagggtcaggaagctggtcccatca

SEQ ID NO: 89032 - DNA, 25 bp, S. pombe
gaagaaccgcaaggctattctccca

SEQ ID NO: 89033 - DNA, 25 bp, S. pombe
gaatggaccggctttttgaaagagc

SEQ ID NO: 89034 - DNA, 25 bp, S. pombe
gaaggcgatctcttagttgcggaag

SEQ ID NO: 89035 - DNA, 25 bp, S. pombe
gaaggcttattttgactcggaagga

SEQ ID NO: 89036 - DNA, 25 bp, S. pombe
gaatcgtctcaagcaagacacgctt

SEQ ID NO: 89037 - DNA, 25 bp, S. pombe
gaggttttgctacaccaatttccgt

SEQ ID NO: 89038 - DNA, 25 bp, S. pombe
gaagttctttttccttttgctagat

SEQ ID NO: 89039 - DNA, 25 bp, S. pombe
gaatgatttttgtacctcttggcta

SEQ ID NO: 89040 - DNA, 25 bp, S. pombe
gaatgtcggttatcgcatttggaaa

SEQ ID NO: 89041 - DNA, 25 bp, S. pombe
gaatgccaaggctgctgctcgccat

SEQ ID NO: 89042 - DNA, 25 bp, S. pombe
gaatgccaaggttgctgctcgtcgt

SEQ ID NO: 89043 - DNA, 25 bp, S. pombe
gaatgtttatttttcgctccgaatt

SEQ ID NO: 89044 - DNA, 25 bp, S. pombe
gaatgatttttctaaacccgatgat

SEQ ID NO: 89045 - DNA, 25 bp, S. pombe
gaatgtctatttcaacctcatctgg

SEQ ID NO: 89046 - DNA, 25 bp, S. pombe
gaatgttaaagctcctcatgttcct

SEQ ID NO: 89047 - DNA, 25 bp, S. pombe
gaatggaacaaggtcatccctccta

SEQ ID NO: 89048 - DNA, 25 bp, S. pombe
gaaggctaatctcgttcggtactat

SEQ ID NO: 89049 - DNA, 25 bp, S. pombe
gaatgccaaacttgttgccgttaag

SEQ ID NO: 89050 - DNA, 25 bp, S. pombe
gaatgcgaatacgttttgcgccgaa

SEQ ID NO: 89051 - DNA, 25 bp, S. pombe
gaatgttgctacgtttgtccggaca

SEQ ID NO: 89052 - DNA, 25 bp, S. pombe
gaatgcttttcgctttcaagagaca

SEQ ID NO: 89053 - DNA, 25 bp, S. pombe
gaatcctttgcgatgttgccaatga

SEQ ID NO: 89054 - DNA, 25 bp, S. pombe
gaatgcagctttctatggtccaagg

SEQ ID NO: 89055 - DNA, 25 bp, S. pombe
gaatgtgctacttcgtaaagacctt

SEQ ID NO: 89056 - DNA, 25 bp, S. pombe
gaaggtcgccttttggaagtctttg

SEQ ID NO: 89057 - DNA, 25 bp, S. pombe
gaaggaaccttctttatcgtcctct

SEQ ID NO: 89058 - DNA, 25 bp, S. pombe
gaagggcaagaagcctttcccaatc

SEQ ID NO: 89059 - DNA, 25 bp, S. pombe
gaatcggtactgacatccaagcaac

SEQ ID NO: 89060 - DNA, 25 bp, S. pombe
gaatgctgcttacaattcccttgaa

SEQ ID NO: 89061 - DNA, 25 bp, S. pombe
gaatgctgtttcaaaggcccttgga

SEQ ID NO: 89062 - DNA, 25 bp, S. pombe
gaatgtgacgatcctagtgctcgcg

SEQ ID NO: 89063 - DNA, 25 bp, S. pombe
gaagtatgcaatcccgcatttgcgt

SEQ ID NO: 89064 - DNA, 25 bp, S. pombe
gaatgtctcaaatgccaggtggtct

SEQ ID NO: 89065 - DNA, 25 bp, S. pombe
gaatgctcaagattactcggcttta

SEQ ID NO: 89066 - DNA, 25 bp, S. pombe
gaatgctcacacaaactctggcgtg

SEQ ID NO: 89067 - DNA, 25 bp, S. pombe
gaatgcctggcaaacgttaacgatg

SEQ ID NO: 89068 - DNA, 25 bp, S. pombe
gactttattactgtttccaagggag

SEQ ID NO: 89069 - DNA, 25 bp, S. pombe
gacccgattgcctctcgtaaaggaa

SEQ ID NO: 89070 - DNA, 25 bp, S. pombe
gaatgctttccctctcgtaaaagaa

SEQ ID NO: 89071 - DNA, 25 bp, S. pombe
gaatggcttttgttccgtactacta

SEQ ID NO: 89072 - DNA, 25 bp, S. pombe
gaatgcctttctttccgattgatta

SEQ ID NO: 89073 - DNA, 25 bp, S. pombe
gaatcccttcttactaattttgacg

SEQ ID NO: 89074 - DNA, 25 bp, S. pombe
gaatccgctattttgcaaaggcttg

SEQ ID NO: 89075 - DNA, 25 bp, S. pombe
gaatcctgattttgtcaagccttca

SEQ ID NO: 89076 - DNA, 25 bp, S. pombe
gaatgcacatttcctgatatacggg

SEQ ID NO: 89077 - DNA, 25 bp, S. pombe
gaatgccgattcctaatgacgggaa

SEQ ID NO: 89078 - DNA, 25 bp, S. pombe
gaatgctaatagtaccaccgtcgca

SEQ ID NO: 89079 - DNA, 25 bp, S. pombe
gaatgtcgaagcttccaatgcccaa

SEQ ID NO: 89080 - DNA, 25 bp, S. pombe
gaatgtctgaacgttcgctgggcaa

SEQ ID NO: 89081 - DNA, 25 bp, S. pombe
gaatccatgaacgttctgctgccat

SEQ ID NO: 89082 - DNA, 25 bp, S. pombe
gaatggcatgaacccactcgcattt

SEQ ID NO: 89083 - DNA, 25 bp, S. pombe
gaatgctcctatatgtccaatttaa

SEQ ID NO: 89084 - DNA, 25 bp, S. pombe
gaatgcaggcaaaccttctggtata

SEQ ID NO: 89085 - DNA, 25 bp, S. pombe
gaatgcagccaaatctttatctatt

SEQ ID NO: 89086 - DNA, 25 bp, S. pombe
gaatccgctgctctagagttgcaaa

SEQ ID NO: 89087 - DNA, 25 bp, S. pombe
gaatgccgtttttgcttcatgatag

SEQ ID NO: 89088 - DNA, 25 bp, S. pombe
gaatgcggatatcggtactactaca

SEQ ID NO: 89089 - DNA, 25 bp, S. pombe
gaaggaaattgacgccgcttacgcc

SEQ ID NO: 89090 - DNA, 25 bp, S. pombe
gaatgcgccgttggactgatggtaa

SEQ ID NO: 89091 - DNA, 25 bp, S. pombe
gaatcctctgcgaaacaagtctagt

SEQ ID NO: 89092 - DNA, 25 bp, S. pombe
gaagctacaggtttattctgtttaa

SEQ ID NO: 89093 - DNA, 25 bp, S. pombe
gaatgcttcaaccagatttgccgat

SEQ ID NO: 89094 - DNA, 25 bp, S. pombe
gaatgctccattcactatttcagat

SEQ ID NO: 89095 - DNA, 25 bp, S. pombe
gaatgctccattcatcatgcctatt

SEQ ID NO: 89096 - DNA, 25 bp, S. pombe
gaatgctcgcattagttcacgtatt

SEQ ID NO: 89097 - DNA, 25 bp, S. pombe
gaatgctagctcgatttcttggtta

SEQ ID NO: 89098 - DNA, 25 bp, S. pombe
gaatgctcattacccttggtgagga

SEQ ID NO: 89099 - DNA, 25 bp, S. pombe
gaatgtattcatccgttcgcatggg

SEQ ID NO: 89100 - DNA, 25 bp, S. pombe
gaatgtttcttctatgcctaggcgc

SEQ ID NO: 89101 - DNA, 25 bp, S. pombe
gaagttttaacagccagactcccca

SEQ ID NO: 89102 - DNA, 25 bp, S. pombe
gaatggactactcgagcttcacatc

SEQ ID NO: 89103 - DNA, 25 bp, S. pombe
gaatggatgttgatgccgcagaaga

SEQ ID NO: 89104 - DNA, 25 bp, S. pombe
gaatgaatcacctgtcagcaaccaa

SEQ ID NO: 89105 - DNA, 25 bp, S. pombe
gaagaagctaccgtaatgaccgaaa

SEQ ID NO: 89106 - DNA, 25 bp, S. pombe
gaagggtctccgtgtgaccgtcaag

SEQ ID NO: 89107 - DNA, 25 bp, S. pombe
gaagggcccatcgtttaacattcca

SEQ ID NO: 89108 - DNA, 25 bp, S. pombe
gaatggacccattgtttttgcacaa

SEQ ID NO: 89109 - DNA, 25 bp, S. pombe
gaaggaacccgtggtagtgccaaag

SEQ ID NO: 89110 - DNA, 25 bp, S. pombe
gaatgggcaaccactcacgagtttt

SEQ ID NO: 89111 - DNA, 25 bp, S. pombe
gaatgggcccttgttgttaatgaat

SEQ ID NO: 89112 - DNA, 25 bp, S. pombe
tgacaaatttaatcccgagaccgtg

SEQ ID NO: 89113 - DNA, 25 bp, S. pombe
gaagaatattaagcccggtcctttg

SEQ ID NO: 89114 - DNA, 25 bp, S. pombe
gaaggtataactcccgctaacattg

SEQ ID NO: 89115 - DNA, 25 bp, S. pombe
gaatgtgaacccgttttccaaagct

SEQ ID NO: 89116 - DNA, 25 bp, S. pombe
gaagtcgaagtctccaaacaacctg

SEQ ID NO: 89117 - DNA, 25 bp, S. pombe
gaatgatcttctacacgagactgaa

SEQ ID NO: 89118 - DNA, 25 bp, S. pombe
gaatgtattgcaaaatgtgccgaca

SEQ ID NO: 89119 - DNA, 25 bp, S. pombe
gaaggcacatctgaacagaccgaag

SEQ ID NO: 89120 - DNA, 25 bp, S. pombe
gaaggattcgtacaagccgtaacca

SEQ ID NO: 89121 - DNA, 25 bp, S. pombe
gaatggttcagttcgaagcacgcta

SEQ ID NO: 89122 - DNA, 25 bp, S. pombe
gaatgagtctagtaggcaggcccat

SEQ ID NO: 89123 - DNA, 25 bp, S. pombe
gaatgcgatatttcacgttgccctt

SEQ ID NO: 89124 - DNA, 25 bp, S. pombe
gaatggtttcactgcttgctttatc

SEQ ID NO: 89125 - DNA, 25 bp, S. pombe
gaaggctaccctatagtatttgcca

SEQ ID NO: 89126 - DNA, 25 bp, S. pombe
gaatggtaccgtttatgtttctaca

SEQ ID NO: 89127 - DNA, 25 bp, S. pombe
gaatgggttattgcttcctgactcc

SEQ ID NO: 89128 - DNA, 25 bp, S. pombe
gaatggctttctaccaatcttaaga

SEQ ID NO: 89129 - DNA, 25 bp, S. pombe
gaatgcatccttacccgttgatgaa

SEQ ID NO: 89130 - DNA, 25 bp, S. pombe
gaatccattgccgaccatatgtata

SEQ ID NO: 89131 - DNA, 25 bp, S. pombe
gaatgcccgccgaacatatgttcat

SEQ ID NO: 89132 - DNA, 25 bp, S. pombe
gaatgaactggctatcgatgatcaa

SEQ ID NO: 89133 - DNA, 25 bp, S. pombe
gaatgtacggcatatgtatcaacta

SEQ ID NO: 89134 - DNA, 25 bp, S. pombe
gaatgcgtcgaaacacagcttaata

SEQ ID NO: 89135 - DNA, 25 bp, S. pombe
gaatgctgccagtgaacctctcaaa

SEQ ID NO: 89136 - DNA, 25 bp, S. pombe
gaatgctgatggtgaattgtcttac

SEQ ID NO: 89137 - DNA, 25 bp, S. pombe
gaatgctagggtcgatttttacaac

SEQ ID NO: 89138 - DNA, 25 bp, S. pombe
gaatccagcttgtcgttttatccac

SEQ ID NO: 89139 - DNA, 25 bp, S. pombe
gaatgccagctcttcgattgaaacc

SEQ ID NO: 89140 - DNA, 25 bp, S. pombe
gaaggcatgcttgtttttgcaggca

SEQ ID NO: 89141 - DNA, 25 bp, S. pombe
gaaggctgtgtctatgcttttggtc

SEQ ID NO: 89142 - DNA, 25 bp, S. pombe
gaaggcttgacattcgttcggttcc

SEQ ID NO: 89143 - DNA, 25 bp, S. pombe
gacgttttagatgcttggaccactc

SEQ ID NO: 89144 - DNA, 25 bp, S. pombe
gaagatttcgtcacgtggaccgaca

SEQ ID NO: 89145 - DNA, 25 bp, S. pombe
gaatgctcagttctttacttcgcta

SEQ ID NO: 89146 - DNA, 25 bp, S. pombe
gaatgcatgcttactaactcgcgat

SEQ ID NO: 89147 - DNA, 25 bp, S. pombe
gaatgcgattatgctgaccttatga

SEQ ID NO: 89148 - DNA, 25 bp, S. pombe
gaatgctgaagttttcttccatttg

SEQ ID NO: 89149 - DNA, 25 bp, S. pombe
gaatgctgcaggtcaaccttcttta

SEQ ID NO: 89150 - DNA, 25 bp, S. pombe
gaatgccaattttccttcagttaaa

SEQ ID NO: 89151 - DNA, 25 bp, S. pombe
gaatgagacactttccttcgtatct

SEQ ID NO: 89152 - DNA, 25 bp, S. pombe
gaatgagtcaattcctgttgtggac

SEQ ID NO: 89153 - DNA, 25 bp, S. pombe
gaatgactcatttccctatggtggt

SEQ ID NO: 89154 - DNA, 25 bp, S. pombe
gaaggcctgttacatgctagcagct

SEQ ID NO: 89155 - DNA, 25 bp, S. pombe
gaatgcgttttcatatgctgaggct

SEQ ID NO: 89156 - DNA, 25 bp, S. pombe
gaatggcctcatttttgctgacctt

SEQ ID NO: 89157 - DNA, 25 bp, S. pombe
gaatgcctccattcatctgatttag

SEQ ID NO: 89158 - DNA, 25 bp, S. pombe
gaatgcgtgccattgccgatgataa

SEQ ID NO: 89159 - DNA, 25 bp, S. pombe
gaatgcgtgcaattggctttgaaca

SEQ ID NO: 89160 - DNA, 25 bp, S. pombe
gaatgcgtccaaggctttgtatcaa

SEQ ID NO: 89161 - DNA, 25 bp, S. pombe
gaatgcgcattgatcctgctttgga

SEQ ID NO: 89162 - DNA, 25 bp, S. pombe
gaaggctgctattcgtgatcctaat

SEQ ID NO: 89163 - DNA, 25 bp, S. pombe
gaatgaccctaatattgccaacatg

SEQ ID NO: 89164 - DNA, 25 bp, S. pombe
gaaggactctatggactctcctcaa

SEQ ID NO: 89165 - DNA, 25 bp, S. pombe
gaaggacttaatgctctacgtgaaa

SEQ ID NO: 89166 - DNA, 25 bp, S. pombe
gaaggaggccgttgctcttttgaag

SEQ ID NO: 89167 - DNA, 25 bp, S. pombe
gaatggttccatttaccttgcgttg

SEQ ID NO: 89168 - DNA, 25 bp, S. pombe
gaatggttcgctagaccttccttat

SEQ ID NO: 89169 - DNA, 25 bp, S. pombe
gaatgttttgtttgccttcatcctt

SEQ ID NO: 89170 - DNA, 25 bp, S. pombe
gaatgcgctttcaatgttctatcat

SEQ ID NO: 89171 - DNA, 25 bp, S. pombe
gaatgcggtccttgtatatgaatct

SEQ ID NO: 89172 - DNA, 25 bp, S. pombe
gaaggcgctgcatctgttatgtcaa

SEQ ID NO: 89173 - DNA, 25 bp, S. pombe
gaaggagccccggagcttgacgtta

SEQ ID NO: 89174 - DNA, 25 bp, S. pombe
gaaggtccaactacaggcgtcgtat

SEQ ID NO: 89175 - DNA, 25 bp, S. pombe
gaatggaatttccaccaagtctcgt

SEQ ID NO: 89176 - DNA, 25 bp, S. pombe
gaaggcattattgagctagcgcaga

SEQ ID NO: 89177 - DNA, 25 bp, S. pombe
gaatgcagcttatcttgctacagga

SEQ ID NO: 89178 - DNA, 25 bp, S. pombe
gaatgttacactttctactgctaaa

SEQ ID NO: 89179 - DNA, 25 bp, S. pombe
gaatggctaagtgtgcttcgcgcaa

SEQ ID NO: 89180 - DNA, 25 bp, S. pombe
gaatgtcccactgtatttggcagca

SEQ ID NO: 89181 - DNA, 25 bp, S. pombe
gaatggcccgctaatttttggaggt

SEQ ID NO: 89182 - DNA, 25 bp, S. pombe
gaaggacatgcgctagtactttatg

SEQ ID NO: 89183 - DNA, 25 bp, S. pombe
gaatgtcagttatcacctgtgggat

SEQ ID NO: 89184 - DNA, 25 bp, S. pombe
gaaggaatattttctgaggcgcaaa

SEQ ID NO: 89185 - DNA, 25 bp, S. pombe
gaaggttattttacggatgccaagc

SEQ ID NO: 89186 - DNA, 25 bp, S. pombe
gaatggtctactatactggtcgcta

SEQ ID NO: 89187 - DNA, 25 bp, S. pombe
gaatgatactactccacaaactgtt

SEQ ID NO: 89188 - DNA, 25 bp, S. pombe
gaatgatctacccaagaatccttac

SEQ ID NO: 89189 - DNA, 25 bp, S. pombe
gaaggatcctaagcgtcttttcgag

SEQ ID NO: 89190 - DNA, 25 bp, S. pombe
gaaggatcccaagcgtctttttgaa

SEQ ID NO: 89191 - DNA, 25 bp, S. pombe
gaatggacactggtttgtttgggaa

SEQ ID NO: 89192 - DNA, 25 bp, S. pombe
gaatggcgacgttttcgatttcgaa

SEQ ID NO: 89193 - DNA, 25 bp, S. pombe
gaatgtgctctcatttccgatgttc

SEQ ID NO: 89194 - DNA, 25 bp, S. pombe
gaatgtcctcattttgccagcaaat

SEQ ID NO: 89195 - DNA, 25 bp, S. pombe
gaatgtcaaatcttctccatcacag

SEQ ID NO: 89196 - DNA, 25 bp, S. pombe
gaatgaaaatgtccctttccttcct

SEQ ID NO: 89197 - DNA, 25 bp, S. pombe
gaatgaaacttgtcgttctcccggt

SEQ ID NO: 89198 - DNA, 25 bp, S. pombe
gaatgattcgtgataccagcagatt

SEQ ID NO: 89199 - DNA, 25 bp, S. pombe
gaagttcgtgaaccaaggctctttg

SEQ ID NO: 89200 - DNA, 25 bp, S. pombe
gaaggcatcgaagcaaaccctgatt

SEQ ID NO: 89201 - DNA, 25 bp, S. pombe
gaatgtactgtttgcggaaatcgct

SEQ ID NO: 89202 - DNA, 25 bp, S. pombe
gaaggtatcttcttttctggatcgt

SEQ ID NO: 89203 - DNA, 25 bp, S. pombe
gaaggcacatgctcaggtcaatatg

SEQ ID NO: 89204 - DNA, 25 bp, S. pombe
gaagtgcacatcaacgattacaagc

SEQ ID NO: 89205 - DNA, 25 bp, S. pombe
gaagtgccaaagacgctgccatgca

SEQ ID NO: 89206 - DNA, 25 bp, S. pombe
gaatggtaactggaagctctctaat

SEQ ID NO: 89207 - DNA, 25 bp, S. pombe
gaaggatatgcttttacccctttca

SEQ ID NO: 89208 - DNA, 25 bp, S. pombe
gaatggatatgagcttccctgccgc

SEQ ID NO: 89209 - DNA, 25 bp, S. pombe
gaatgtaatgtccaatcctgctgcc

SEQ ID NO: 89210 - DNA, 25 bp, S. pombe
gaatgacacctctgcgaaacgtatg

SEQ ID NO: 89211 - DNA, 25 bp, S. pombe
gaatgtctcccatggatccaggtta

SEQ ID NO: 89212 - DNA, 25 bp, S. pombe
gaaggcgttaaccttgcttgcggta

SEQ ID NO: 89213 - DNA, 25 bp, S. pombe
gaaggtcttacctcagttggtgtca

SEQ ID NO: 89214 - DNA, 25 bp, S. pombe
gaagtttgcgaccaccttatttgta

SEQ ID NO: 89215 - DNA, 25 bp, S. pombe
gaaggctcggaaaccctctgatttt

SEQ ID NO: 89216 - DNA, 25 bp, S. pombe
gaaggtcggatgctttcattttttg

SEQ ID NO: 89217 - DNA, 25 bp, S. pombe
gaatggttcagctctccatggatgt

SEQ ID NO: 89218 - DNA, 25 bp, S. pombe
gaatgtccgtctagaatatttgatc

SEQ ID NO: 89219 - DNA, 25 bp, S. pombe
gaatgagtttgaatttcctgccaat

SEQ ID NO: 89220 - DNA, 25 bp, S. pombe
gaatgttctcgagtatttctctcaa

SEQ ID NO: 89221 - DNA, 25 bp, S. pombe
gaaggcctagttttcactctaaatc

SEQ ID NO: 89222 - DNA, 25 bp, S. pombe
gaatgagttcttcacacagtcaaaa

SEQ ID NO: 89223 - DNA, 25 bp, S. pombe
gaatggcatactgagctacttgata

SEQ ID NO: 89224 - DNA, 25 bp, S. pombe
gaaggccaaagctgtttctcgtgtt

SEQ ID NO: 89225 - DNA, 25 bp, S. pombe
gaaggcgaaggatgcttttcagctt

SEQ ID NO: 89226 - DNA, 25 bp, S. pombe
gaatggtgaaacagcctctatagaa

SEQ ID NO: 89227 - DNA, 25 bp, S. pombe
gaaggtaatatcatcccacaagtag

SEQ ID NO: 89228 - DNA, 25 bp, S. pombe
gaaggtatgcttttcccaatgagga

SEQ ID NO: 89229 - DNA, 25 bp, S. pombe
gaaggcttttattcctcctgaagag

SEQ ID NO: 89230 - DNA, 25 bp, S. pombe
gaatgtgctccatttacaaccggaa

SEQ ID NO: 89231 - DNA, 25 bp, S. pombe
gaatgatcttcttcccaaatctggt

SEQ ID NO: 89232 - DNA, 25 bp, S. pombe
gaatgtttcgatgctaccacaggga

SEQ ID NO: 89233 - DNA, 25 bp, S. pombe
gaatggctgttgtttaccctcaaga

SEQ ID NO: 89234 - DNA, 25 bp, S. pombe
gaatggcgggtcttatcttcgcgaa

SEQ ID NO: 89235 - DNA, 25 bp, S. pombe
gaaggcggttctattccagtaactg

SEQ ID NO: 89236 - DNA, 25 bp, S. pombe
gaagtcacatttacgttccttaact

SEQ ID NO: 89237 - DNA, 25 bp, S. pombe
gaaggcctattcgtggtcgtcaaaa

SEQ ID NO: 89238 - DNA, 25 bp, S. pombe
gaatgtgcctttttgttttcaccaa

SEQ ID NO: 89239 - DNA, 25 bp, S. pombe
gaatgtctgcagatacaggttagtt

SEQ ID NO: 89240 - DNA, 25 bp, S. pombe
gaatgtgtatgttattcgttacttg

SEQ ID NO: 89241 - DNA, 25 bp, S. pombe
gaatggccattttgacagaacttgc

SEQ ID NO: 89242 - DNA, 25 bp, S. pombe
gaatgtctccacctaaaactatcca

SEQ ID NO: 89243 - DNA, 25 bp, S. pombe
gaatgttcaacacagacccaatcca

SEQ ID NO: 89244 - DNA, 25 bp, S. pombe
gaatgtgtcctccagataccagaat

SEQ ID NO: 89245 - DNA, 25 bp, S. pombe
gaatggtcacactatatccccagga

SEQ ID NO: 89246 - DNA, 25 bp, S. pombe
gaatggatccacaaatctaccgcaa

SEQ ID NO: 89247 - DNA, 25 bp, S. pombe
gaatggtgccaatatgcttcttcag

SEQ ID NO: 89248 - DNA, 25 bp, S. pombe
gaaggtgccggtacatctctacgtg

SEQ ID NO: 89249 - DNA, 25 bp, S. pombe
gaaggattcgacgttcccaagtcaa

SEQ ID NO: 89250 - DNA, 25 bp, S. pombe
gaaggccaacgattttcgcgttagc

SEQ ID NO: 89251 - DNA, 25 bp, S. pombe
gaaggtttactgatgatccgccgac

SEQ ID NO: 89252 - DNA, 25 bp, S. pombe
gaaggtattgcccatgtttctcgtc

SEQ ID NO: 89253 - DNA, 25 bp, S. pombe
gaaggctggacctcgtcaggacatg

SEQ ID NO: 89254 - DNA, 25 bp, S. pombe
gaagtgcgacaatcctgtaatttct

SEQ ID NO: 89255 - DNA, 25 bp, S. pombe
gaaggctgacactctgtatttttca

SEQ ID NO: 89256 - DNA, 25 bp, S. pombe
gaaggtactaatcaacccggcgctt

SEQ ID NO: 89257 - DNA, 25 bp, S. pombe
gaatggttggcttcgtcctagagac

SEQ ID NO: 89258 - DNA, 25 bp, S. pombe
gaatgtgttgcagaagcccttgaac

SEQ ID NO: 89259 - DNA, 25 bp, S. pombe
gaatggtgtcgctaatcaagttaac

SEQ ID NO: 89260 - DNA, 25 bp, S. pombe
gaaggagatatctcggatccgcctc

SEQ ID NO: 89261 - DNA, 25 bp, S. pombe
gaagtccaaactggtgtcggctcta

SEQ ID NO: 89262 - DNA, 25 bp, S. pombe
gaatgtctcaaaacgatcctgcgga

SEQ ID NO: 89263 - DNA, 25 bp, S. pombe
gaatggcatcgctaacgaattcgcg

SEQ ID NO: 89264 - DNA, 25 bp, S. pombe
gaatggcatttactcgctatattgt

SEQ ID NO: 89265 - DNA, 25 bp, S. pombe
gaatggtttattcttcttccaaact

SEQ ID NO: 89266 - DNA, 25 bp, S. pombe
gaaggtaccctgctaaatgtctatg

SEQ ID NO: 89267 - DNA, 25 bp, S. pombe
gaaggttcgggttcaatgtctacca

SEQ ID NO: 89268 - DNA, 25 bp, S. pombe
gaaggatgtcgctgttcaagttaca

SEQ ID NO: 89269 - DNA, 25 bp, S. pombe
gaaggagtccgagtttactttgcaa

SEQ ID NO: 89270 - DNA, 25 bp, S. pombe
gaaggcgtcgtcttttgaccttaca

SEQ ID NO: 89271 - DNA, 25 bp, S. pombe
gaatggttggtcttttaccgcatcc

SEQ ID NO: 89272 - DNA, 25 bp, S. pombe
gaaggctgactttttatgcctccat

SEQ ID NO: 89273 - DNA, 25 bp, S. pombe
gaatggtattctcaattgccctcat

SEQ ID NO: 89274 - DNA, 25 bp, S. pombe
gaaggttcctgtaactcaggtcgac

SEQ ID NO: 89275 - DNA, 25 bp, S. pombe
gaaggtttgctctgacttggtcaac

SEQ ID NO: 89276 - DNA, 25 bp, S. pombe
gaaggatcgagaacagaccagaaat

SEQ ID NO: 89277 - DNA, 25 bp, S. pombe
gaaggtgcaggtgataataacaatt

SEQ ID NO: 89278 - DNA, 25 bp, S. pombe
gaaggctagtgttcttcgtcattaa

SEQ ID NO: 89279 - DNA, 25 bp, S. pombe
gaagtttacgtactcagtctgctag

SEQ ID NO: 89280 - DNA, 25 bp, S. pombe
gaagtataacgtctccatggctacc

SEQ ID NO: 89281 - DNA, 25 bp, S. pombe
gaagttaactattgtcgacgatcac

SEQ ID NO: 89282 - DNA, 25 bp, S. pombe
gaaggtgcacaacgtgacgctatta

SEQ ID NO: 89283 - DNA, 25 bp, S. pombe
gaaggatgcacgtcttgaggctaaa

SEQ ID NO: 89284 - DNA, 25 bp, S. pombe
gaatgtggatccttctacagtatat

SEQ ID NO: 89285 - DNA, 25 bp, S. pombe
gagtgctgggtgtccaacgttagtt

SEQ ID NO: 89286 - DNA, 25 bp, S. pombe
gaagcggtttgcatactcttagttt

SEQ ID NO: 89287 - DNA, 25 bp, S. pombe
gaaggcgttttcagctctttcagaa

SEQ ID NO: 89288 - DNA, 25 bp, S. pombe
gaatgggctgtcttctctggtaaca

SEQ ID NO: 89289 - DNA, 25 bp, S. pombe
gaaggagcttcgtatctccaagctt

SEQ ID NO: 89290 - DNA, 25 bp, S. pombe
gaaggtctacggtggactcaactat

SEQ ID NO: 89291 - DNA, 25 bp, S. pombe
gaaggaattttaggcgcactccctc

SEQ ID NO: 89292 - DNA, 25 bp, S. pombe
gaagggatctcattagcggttccta

SEQ ID NO: 89293 - DNA, 25 bp, S. pombe
gaagtgccggacgacgaagaatcat

SEQ ID NO: 89294 - DNA, 25 bp, S. pombe
gaaggccgccagaaaatatgtatca

SEQ ID NO: 89295 - DNA, 25 bp, S. pombe
gaaggccggcataattttcataact

SEQ ID NO: 89296 - DNA, 25 bp, S. pombe
gaaggctcggcaaatctattatcgt

SEQ ID NO: 89297 - DNA, 25 bp, S. pombe
gaagtctcggaatcaatgttactga

SEQ ID NO: 89298 - DNA, 25 bp, S. pombe
gaagttcggcaatgagagtgtccat

SEQ ID NO: 89299 - DNA, 25 bp, S. pombe
gaaggcatgccctcaaagagttcct

SEQ ID NO: 89300 - DNA, 25 bp, S. pombe
gaaggctcacttgaacaagatccga

SEQ ID NO: 89301 - DNA, 25 bp, S. pombe
gaaggccacagtcaacgaaccgata

SEQ ID NO: 89302 - DNA, 25 bp, S. pombe
gaagtctcacatcggactcaatgga

SEQ ID NO: 89303 - DNA, 25 bp, S. pombe
gaagtcgcatatgaatctacggatc

SEQ ID NO: 89304 - DNA, 25 bp, S. pombe
gaagggctacaaactacgtgctcta

SEQ ID NO: 89305 - DNA, 25 bp, S. pombe
gaaggtggtcaaactcctatcacca

SEQ ID NO: 89306 - DNA, 25 bp, S. pombe
gaaggaattcgagccctgaatcagg

SEQ ID NO: 89307 - DNA, 25 bp, S. pombe
gaaggcagcatgtctcccgttgcaa

SEQ ID NO: 89308 - DNA, 25 bp, S. pombe
gaatggtttccaatgcatgcgtcaa

SEQ ID NO: 89309 - DNA, 25 bp, S. pombe
gaaggtttcacaattgcgtatcccc

SEQ ID NO: 89310 - DNA, 25 bp, S. pombe
gaaggattccatatcacgtcttttg

SEQ ID NO: 89311 - DNA, 25 bp, S. pombe
gaaggccgcatttatgtttatttac

SEQ ID NO: 89312 - DNA, 25 bp, S. pombe
gaaggccatctttattttcattgat

SEQ ID NO: 89313 - DNA, 25 bp, S. pombe
gaaggctctttgtcatcttatccaa

SEQ ID NO: 89314 - DNA, 25 bp, S. pombe
gaaggcacctcctttgaagtaccaa

SEQ ID NO: 89315 - DNA, 25 bp, S. pombe
gaaggattccttgacagtgcccaat

SEQ ID NO: 89316 - DNA, 25 bp, S. pombe
gaaggtgttttggaccagcctatta

SEQ ID NO: 89317 - DNA, 25 bp, S. pombe
gaaggtttattctacggacaatgta

SEQ ID NO: 89318 - DNA, 25 bp, S. pombe
gaaggcttacatacaacgggcattt

SEQ ID NO: 89319 - DNA, 25 bp, S. pombe
gaaggtctagctaaacatgtagcta

SEQ ID NO: 89320 - DNA, 25 bp, S. pombe
gaaggcacattgctacaactctaat

SEQ ID NO: 89321 - DNA, 25 bp, S. pombe
gaagaccttccctctaatgtatttg

SEQ ID NO: 89322 - DNA, 25 bp, S. pombe
gaagtttacacagcttttatccttt

SEQ ID NO: 89323 - DNA, 25 bp, S. pombe
gaagtcttagctgccgatttatctt

SEQ ID NO: 89324 - DNA, 25 bp, S. pombe
gaagtatgaagcctcccattattcc

SEQ ID NO: 89325 - DNA, 25 bp, S. pombe
gaaggcccggattctcattatgaac

SEQ ID NO: 89326 - DNA, 25 bp, S. pombe
gaagtccctggaatcgataagcaaa

SEQ ID NO: 89327 - DNA, 25 bp, S. pombe
gaaggccgcttctgagtctgaaaag

SEQ ID NO: 89328 - DNA, 25 bp, S. pombe
gaaggattccggtcagttcctatcc

SEQ ID NO: 89329 - DNA, 25 bp, S. pombe
gaaggcaattcgtataatcccacat

SEQ ID NO: 89330 - DNA, 25 bp, S. pombe
gaaggtcaacactcatttgtttcga

SEQ ID NO: 89331 - DNA, 25 bp, S. pombe
gaacagtccccgcttttattcaatt

SEQ ID NO: 89332 - DNA, 25 bp, S. pombe
gaaggtcccattcgtttattaggcg

SEQ ID NO: 89333 - DNA, 25 bp, S. pombe
gaagggtcttctattcttatttatg

SEQ ID NO: 89334 - DNA, 25 bp, S. pombe
gaaggcgcctttactatggtgtgtt

SEQ ID NO: 89335 - DNA, 25 bp, S. pombe
gaaggcttttgaacttggcgcgatc

SEQ ID NO: 89336 - DNA, 25 bp, S. pombe
gaagtaactcatccacgtggtcgac

SEQ ID NO: 89337 - DNA, 25 bp, S. pombe
gaagtcgggctccttatggaatgaa

SEQ ID NO: 89338 - DNA, 25 bp, S. pombe
gaaggtgttcgccatatcatggtat

SEQ ID NO: 89339 - DNA, 25 bp, S. pombe
gaagggcttgctctgtatgtactcg

SEQ ID NO: 89340 - DNA, 25 bp, S. pombe
gaagtgttgggctagctgttataca

SEQ ID NO: 89341 - DNA, 25 bp, S. pombe
gaaggcttacgtcttgccatggaaa

SEQ ID NO: 89342 - DNA, 25 bp, S. pombe
gaagcttttccgtttgtatggacga

SEQ ID NO: 89343 - DNA, 25 bp, S. pombe
gaagttttaaccctcgatcagcttg

SEQ ID NO: 89344 - DNA, 25 bp, S. pombe
gaagtgtttccctccagagttcgtg

SEQ ID NO: 89345 - DNA, 25 bp, S. pombe
gaagttggtacgctttttaatgaag

SEQ ID NO: 89346 - DNA, 25 bp, S. pombe
gaagttgagcttgggtacttggcaa

SEQ ID NO: 89347 - DNA, 25 bp, S. pombe
gaaggctgagaagctccgtcaatct

SEQ ID NO: 89348 - DNA, 25 bp, S. pombe
gaaggagttcctcccgaaactgaat

SEQ ID NO: 89349 - DNA, 25 bp, S. pombe
gaagagaactcctcggattcacgaa

SEQ ID NO: 89350 - DNA, 25 bp, S. pombe
gaagtaatgtcacctcttgccaaat

SEQ ID NO: 89351 - DNA, 25 bp, S. pombe
gaaggcaatgtaatcgagcgtatct

SEQ ID NO: 89352 - DNA, 25 bp, S. pombe
gaaggctcttgaatcgggctgtatc

SEQ ID NO: 89353 - DNA, 25 bp, S. pombe
gaaggctcgtgctttgggtgtcaaa

SEQ ID NO: 89354 - DNA, 25 bp, S. pombe
gaaggctcctgattatgttgttaaa

SEQ ID NO: 89355 - DNA, 25 bp, S. pombe
gaaggttttcgagtctgtctacaag

SEQ ID NO: 89356 - DNA, 25 bp, S. pombe
gaaggatttttgaccgattcacaag

SEQ ID NO: 89357 - DNA, 25 bp, S. pombe
gaagttttatgtaacgatcgtctag

SEQ ID NO: 89358 - DNA, 25 bp, S. pombe
gaagattttgttcacgttcctactc

SEQ ID NO: 89359 - DNA, 25 bp, S. pombe
gaaggctcttttggatttagctcat

SEQ ID NO: 89360 - DNA, 25 bp, S. pombe
gaaggactctcaacctgatgttcaa

SEQ ID NO: 89361 - DNA, 25 bp, S. pombe
gaaggcactgttactgcgcatggta

SEQ ID NO: 89362 - DNA, 25 bp, S. pombe
gaagggtttaattcgccgtctgtca

SEQ ID NO: 89363 - DNA, 25 bp, S. pombe
gaaggattgttctctccaaatgaag

SEQ ID NO: 89364 - DNA, 25 bp, S. pombe
gaaggttgctcttgatactcttttc

SEQ ID NO: 89365 - DNA, 25 bp, S. pombe
gaaggactcaccaattacgggttca

SEQ ID NO: 89366 - DNA, 25 bp, S. pombe
gaaggacacaattatacttgctcaa

SEQ ID NO: 89367 - DNA, 25 bp, S. pombe
gaaggagcgcaagcatcaattgaca

SEQ ID NO: 89368 - DNA, 25 bp, S. pombe
gaactgaccatccttgaaaatccca

SEQ ID NO: 89369 - DNA, 25 bp, S. pombe
gaagggcctgattccaaggacattc

SEQ ID NO: 89370 - DNA, 25 bp, S. pombe
gaaggcatcttgtcctctatgcaat

SEQ ID NO: 89371 - DNA, 25 bp, S. pombe
gaagcagttccctctcaaaaggctg

SEQ ID NO: 89372 - DNA, 25 bp, S. pombe
gaaggctttgacttctctcatgaag

SEQ ID NO: 89373 - DNA, 25 bp, S. pombe
gaaggcttcagttattcgcatctcc

SEQ ID NO: 89374 - DNA, 25 bp, S. pombe
gaaggttcctatataccgctcatct

SEQ ID NO: 89375 - DNA, 25 bp, S. pombe
gaaggttcttcttgatatcgagcaa

SEQ ID NO: 89376 - DNA, 25 bp, S. pombe
gaaggtctttcgtaatcatggatga

SEQ ID NO: 89377 - DNA, 25 bp, S. pombe
gaaggtctcgagttaacattgatga

SEQ ID NO: 89378 - DNA, 25 bp, S. pombe
gaaggtgtcgcgaatcccatcatgg

SEQ ID NO: 89379 - DNA, 25 bp, S. pombe
gaaggactccgattcacgatatggg

SEQ ID NO: 89380 - DNA, 25 bp, S. pombe
gaaggagctcctacttaacattggt

SEQ ID NO: 89381 - DNA, 25 bp, S. pombe
gaagcgggcgttccattttctatta

SEQ ID NO: 89382 - DNA, 25 bp, S. pombe
gaagtccattttcatttccttgaag

SEQ ID NO: 89383 - DNA, 25 bp, S. pombe
gaagtccatattgggagcacctttg

SEQ ID NO: 89384 - DNA, 25 bp, S. pombe
gaagtccttcgccaacataatgctg

SEQ ID NO: 89385 - DNA, 25 bp, S. pombe
gaagcttcttcccaaccaattaaga

SEQ ID NO: 89386 - DNA, 25 bp, S. pombe
gaagtcaattctatcctattcatca

SEQ ID NO: 89387 - DNA, 25 bp, S. pombe
gaagttttgctcaacctattactga

SEQ ID NO: 89388 - DNA, 25 bp, S. pombe
gaagggcttccaggtgtttgataaa

SEQ ID NO: 89389 - DNA, 25 bp, S. pombe
tgaagttcttcgtgttcgtggtacc

SEQ ID NO: 89390 - DNA, 25 bp, S. pombe
gaaggtcttccatgtcttgttgata

SEQ ID NO: 89391 - DNA, 25 bp, S. pombe
gaaggatatctctttggttgattac

SEQ ID NO: 89392 - DNA, 25 bp, S. pombe
gaaggaactcatcgcatctgttatt

SEQ ID NO: 89393 - DNA, 25 bp, S. pombe
gaagtggacttgaatcagaatactc

SEQ ID NO: 89394 - DNA, 25 bp, S. pombe
gaagtttctgctatcaaatcatcac

SEQ ID NO: 89395 - DNA, 25 bp, S. pombe
gaggttacctcgtgtacgtagcgca

SEQ ID NO: 89396 - DNA, 25 bp, S. pombe
gaagttacttggtttcacgttctgg

SEQ ID NO: 89397 - DNA, 25 bp, S. pombe
gaagtaatcattgtttcccctctgt

SEQ ID NO: 89398 - DNA, 25 bp, S. pombe
gaagagacagccgttttacctaatg

SEQ ID NO: 89399 - DNA, 25 bp, S. pombe
gaaggaccctgctgttgaatcaaaa

SEQ ID NO: 89400 - DNA, 25 bp, S. pombe
gaaggcacacgtgggtcgaatcaca

SEQ ID NO: 89401 - DNA, 25 bp, S. pombe
gaagatggcactttgaatcgagcaa

SEQ ID NO: 89402 - DNA, 25 bp, S. pombe
gaagggccatcagatctaagcagac

SEQ ID NO: 89403 - DNA, 25 bp, S. pombe
gaaggaaccactggagctcgtacat

SEQ ID NO: 89404 - DNA, 25 bp, S. pombe
gaaggatactctacgactcgttcat

SEQ ID NO: 89405 - DNA, 25 bp, S. pombe
gaagtgactgcaaaaagcgctccta

SEQ ID NO: 89406 - DNA, 25 bp, S. pombe
gaaggacagctttcaacttctcctc

SEQ ID NO: 89407 - DNA, 25 bp, S. pombe
gaaggtcgtctgaaggcagcttcct

SEQ ID NO: 89408 - DNA, 25 bp, S. pombe
gaagtgggttgcagtacctaatctt

SEQ ID NO: 89409 - DNA, 25 bp, S. pombe
gaagtggttgtccaaaacgcatatg

SEQ ID NO: 89410 - DNA, 25 bp, S. pombe
gaagagaccgataaggacaaggcct

SEQ ID NO: 89411 - DNA, 25 bp, S. pombe
gaaggacctgaaaatatcaatcctt

SEQ ID NO: 89412 - DNA, 25 bp, S. pombe
gaaggacctactgaaacaccgtatg

SEQ ID NO: 89413 - DNA, 25 bp, S. pombe
gaagatgtcttggacgacttgggtt

SEQ ID NO: 89414 - DNA, 25 bp, S. pombe
gaagatacattggactcccttcctc

SEQ ID NO: 89415 - DNA, 25 bp, S. pombe
gaagtgctgttgagagctcgcgctt

SEQ ID NO: 89416 - DNA, 25 bp, S. pombe
gaagtcctatattggtcctcgtatt

SEQ ID NO: 89417 - DNA, 25 bp, S. pombe
gaagttttaccaatctttcctggag

SEQ ID NO: 89418 - DNA, 25 bp, S. pombe
gaagtttacctaacccattgcttga

SEQ ID NO: 89419 - DNA, 25 bp, S. pombe
gaagcagtaagttcttcctcagctt

SEQ ID NO: 89420 - DNA, 25 bp, S. pombe
gaagtgaattcttatcccgatttta

SEQ ID NO: 89421 - DNA, 25 bp, S. pombe
gaagtaacttctcctcgtgagttta

SEQ ID NO: 89422 - DNA, 25 bp, S. pombe
gaaggttcctcaatgaaagttgcta

SEQ ID NO: 89423 - DNA, 25 bp, S. pombe
gaaggttcactgatccgcatgttca

SEQ ID NO: 89424 - DNA, 25 bp, S. pombe
gaagcttactttcggtattcggata

SEQ ID NO: 89425 - DNA, 25 bp, S. pombe
gaagtttactatcggcattacggta

SEQ ID NO: 89426 - DNA, 25 bp, S. pombe
gaagtgattggactttacaaagcaa

SEQ ID NO: 89427 - DNA, 25 bp, S. pombe
gaaggtcttccgatatagctcgcat

SEQ ID NO: 89428 - DNA, 25 bp, S. pombe
gaagggaatctgtcacgcgacacga

SEQ ID NO: 89429 - DNA, 25 bp, S. pombe
gaagaattcaagctgcctttgcggg

SEQ ID NO: 89430 - DNA, 25 bp, S. pombe
gaagtgttcaattcctgtttcaacg

SEQ ID NO: 89431 - DNA, 25 bp, S. pombe
gaagttactagctcctctcaaaaag

SEQ ID NO: 89432 - DNA, 25 bp, S. pombe
gaagcgaagtacacctgtcctgaaa

SEQ ID NO: 89433 - DNA, 25 bp, S. pombe
gaaggatattaagcctgccgataaa

SEQ ID NO: 89434 - DNA, 25 bp, S. pombe
gaaggatctattttccatcgcgtta

SEQ ID NO: 89435 - DNA, 25 bp, S. pombe
gaagattctttagacgccgttccta

SEQ ID NO: 89436 - DNA, 25 bp, S. pombe
gaagtaggagacttccctccagaag

SEQ ID NO: 89437 - DNA, 25 bp, S. pombe
gaaggtggttttttccatgcaacat

SEQ ID NO: 89438 - DNA, 25 bp, S. pombe
gaagagtggtttcttccgccgcaag

SEQ ID NO: 89439 - DNA, 25 bp, S. pombe
gaaggagttcttcctacttccaaag

SEQ ID NO: 89440 - DNA, 25 bp, S. pombe
gaagacgttcttcttttcgagaact

SEQ ID NO: 89441 - DNA, 25 bp, S. pombe
gaagacctacttcaggatctcgaag

SEQ ID NO: 89442 - DNA, 25 bp, S. pombe
gaaggtcgtgctcatattttacgca

SEQ ID NO: 89443 - DNA, 25 bp, S. pombe
gaagatgttggttccttttgcgcaa

SEQ ID NO: 89444 - DNA, 25 bp, S. pombe
gaagttttggatactgagtcctcag

SEQ ID NO: 89445 - DNA, 25 bp, S. pombe
gaagtcattgtgcatccggatcatc

SEQ ID NO: 89446 - DNA, 25 bp, S. pombe
gaagtcaccgactacgagcatactc

SEQ ID NO: 89447 - DNA, 25 bp, S. pombe
gaagtcaatggttataccgcccata

SEQ ID NO: 89448 - DNA, 25 bp, S. pombe
gaagagaagacactggagacgtacc

SEQ ID NO: 89449 - DNA, 25 bp, S. pombe
gaagtatctattaagcacgccgtgg

SEQ ID NO: 89450 - DNA, 25 bp, S. pombe
gaaggtcttgtaggcgccaacgaaa

SEQ ID NO: 89451 - DNA, 25 bp, S. pombe
gaaggtgttgtacgctcgcagaaac

SEQ ID NO: 89452 - DNA, 25 bp, S. pombe
gaaggattacagattgcccggagat

SEQ ID NO: 89453 - DNA, 25 bp, S. pombe
gaagtgattatcgtcgtcctcatga

SEQ ID NO: 89454 - DNA, 25 bp, S. pombe
gaagtcattaggaaccgctcaataa

SEQ ID NO: 89455 - DNA, 25 bp, S. pombe
gaagtcggatcgtggcagcgctatt

SEQ ID NO: 89456 - DNA, 25 bp, S. pombe
gaaggtgatatttactctcccaatg

SEQ ID NO: 89457 - DNA, 25 bp, S. pombe
gaagtagttttcacctccaatgaag

SEQ ID NO: 89458 - DNA, 25 bp, S. pombe
gaagtctcgtagtccaaaatatgtt

SEQ ID NO: 89459 - DNA, 25 bp, S. pombe
gaagtctcaagcttctaaaaagaaa

SEQ ID NO: 89460 - DNA, 25 bp, S. pombe
gaagatttggcacctgaaaccgaaa

SEQ ID NO: 89461 - DNA, 25 bp, S. pombe
gaagtctcttctctaaactctcaaa

SEQ ID NO: 89462 - DNA, 25 bp, S. pombe
gaagttgtttctcaaatctccgctt

SEQ ID NO: 89463 - DNA, 25 bp, S. pombe
gaagattactcccaaaatcctggtt

SEQ ID NO: 89464 - DNA, 25 bp, S. pombe
gaagttacccgctggtgccaagttt

SEQ ID NO: 89465 - DNA, 25 bp, S. pombe
gaaggtgtcgcgtcatgcttactac

SEQ ID NO: 89466 - DNA, 25 bp, S. pombe
gaaggtccatgaggcaagtttccca

SEQ ID NO: 89467 - DNA, 25 bp, S. pombe
gaagttgacagtgtatctcgtgtac

SEQ ID NO: 89468 - DNA, 25 bp, S. pombe
gaagctgatgtcagtgacccacgtt

SEQ ID NO: 89469 - DNA, 25 bp, S. pombe
gaagagatgattttggctgcccgta

SEQ ID NO: 89470 - DNA, 25 bp, S. pombe
gaagtattccctgacaatttctcat

SEQ ID NO: 89471 - DNA, 25 bp, S. pombe
gaagttgtccaatttcaaatgtcta

SEQ ID NO: 89472 - DNA, 25 bp, S. pombe
gaagttttgcatccatttcgcactg

SEQ ID NO: 89473 - DNA, 25 bp, S. pombe
gaagtttcttgatgaacgtcctgaa

SEQ ID NO: 89474 - DNA, 25 bp, S. pombe
gaagatgattccaccaacggatccc

SEQ ID NO: 89475 - DNA, 25 bp, S. pombe
gaagtggcagttcccaaatcacaga

SEQ ID NO: 89476 - DNA, 25 bp, S. pombe
gaagtgaagtcttcgatctcccctt

SEQ ID NO: 89477 - DNA, 25 bp, S. pombe
gaagggatgtcttccacttcatctt

SEQ ID NO: 89478 - DNA, 25 bp, S. pombe
gaagttatgtcttaccaagtctcaa

SEQ ID NO: 89479 - DNA, 25 bp, S. pombe
gaagtttgacttttcaaatgccatc

SEQ ID NO: 89480 - DNA, 25 bp, S. pombe
gaagttcaagtttctccagaggcac

SEQ ID NO: 89481 - DNA, 25 bp, S. pombe
gaagttgtcccagaagtcagcacgg

SEQ ID NO: 89482 - DNA, 25 bp, S. pombe
gaagtggttccaacaatgctccagc

SEQ ID NO: 89483 - DNA, 25 bp, S. pombe
gaagtggtgatttacgtgctcgcat

SEQ ID NO: 89484 - DNA, 25 bp, S. pombe
gaagggtctgttgcatgttcgactt

SEQ ID NO: 89485 - DNA, 25 bp, S. pombe
gaagggctttgtacgtttgtagact

SEQ ID NO: 89486 - DNA, 25 bp, S. pombe
gaagtgactgtatggccggatgaac

SEQ ID NO: 89487 - DNA, 25 bp, S. pombe
gaagtgctctttaccatcctttgac

SEQ ID NO: 89488 - DNA, 25 bp, S. pombe
gaaggtgtcttgactgatccagttt

SEQ ID NO: 89489 - DNA, 25 bp, S. pombe
gaagggatcatcttgcttatcgtag

SEQ ID NO: 89490 - DNA, 25 bp, S. pombe
gaagtggctgctatgttcatttctg

SEQ ID NO: 89491 - DNA, 25 bp, S. pombe
gaagtggctttgctgcttgatttat

SEQ ID NO: 89492 - DNA, 25 bp, S. pombe
gaagggtatccagccgttgctaatc

SEQ ID NO: 89493 - DNA, 25 bp, S. pombe
gaagagcttcttttcggtcggttag

SEQ ID NO: 89494 - DNA, 25 bp, S. pombe
gaagagcccgaacccgaggtacaat

SEQ ID NO: 89495 - DNA, 25 bp, S. pombe
gaccattccgtacccgaaggacaag

SEQ ID NO: 89496 - DNA, 25 bp, S. pombe
gaagttatccgttaaaaatgccgct

SEQ ID NO: 89497 - DNA, 25 bp, S. pombe
gaagttcaacacttttgccctagaa

SEQ ID NO: 89498 - DNA, 25 bp, S. pombe
gaagtaccaatttaacgttgctatg

SEQ ID NO: 89499 - DNA, 25 bp, S. pombe
gaagttccggatttagctattcttg

SEQ ID NO: 89500 - DNA, 25 bp, S. pombe
gaagttcacgacgttactaacgcaa

SEQ ID NO: 89501 - DNA, 25 bp, S. pombe
gaagtcacttgctttggctacgaag

SEQ ID NO: 89502 - DNA, 25 bp, S. pombe
gaagtatttctcctgttactgaaca

SEQ ID NO: 89503 - DNA, 25 bp, S. pombe
gaagtctccttttttgtctgatgca

SEQ ID NO: 89504 - DNA, 25 bp, S. pombe
gaagtccccttttccttgatgaagc

SEQ ID NO: 89505 - DNA, 25 bp, S. pombe
gaagtccgctcatttgagtcatttg

SEQ ID NO: 89506 - DNA, 25 bp, S. pombe
gaagtcgcctatttcaacacatctg

SEQ ID NO: 89507 - DNA, 25 bp, S. pombe
gaagtatgtgcgaaccaaacccaaa

SEQ ID NO: 89508 - DNA, 25 bp, S. pombe
gaagctagggttggctacagctccc

SEQ ID NO: 89509 - DNA, 25 bp, S. pombe
gaagtgttatgctccatgttgcaac

SEQ ID NO: 89510 - DNA, 25 bp, S. pombe
gaagggtcatctgcttattctgata

SEQ ID NO: 89511 - DNA, 25 bp, S. pombe
gaagttgtttgcactaccgaggaat

SEQ ID NO: 89512 - DNA, 25 bp, S. pombe
gaagtcttcaacattagccacgtga

SEQ ID NO: 89513 - DNA, 25 bp, S. pombe
gaagtcgaaaaaatcctctgggcca

SEQ ID NO: 89514 - DNA, 25 bp, S. pombe
gaagtcgagaaaccctctgctgagg

SEQ ID NO: 89515 - DNA, 25 bp, S. pombe
gaagatctacaatggtctcctagtg

SEQ ID NO: 89516 - DNA, 25 bp, S. pombe
gaagtcaccctcttttcatgaaaat

SEQ ID NO: 89517 - DNA, 25 bp, S. pombe
gaagtggccttgctgatgctcaaag

SEQ ID NO: 89518 - DNA, 25 bp, S. pombe
gaagtaatgcccatggcctatgctt

SEQ ID NO: 89519 - DNA, 25 bp, S. pombe
gaagtgttccggtaaaggttgctct

SEQ ID NO: 89520 - DNA, 25 bp, S. pombe
gaagggctagctatcatgaatcgtt

SEQ ID NO: 89521 - DNA, 25 bp, S. pombe
gaagtccaagccatctattctgata

SEQ ID NO: 89522 - DNA, 25 bp, S. pombe
gaagtccttgaccatcgtttgtaca

SEQ ID NO: 89523 - DNA, 25 bp, S. pombe
gatagacgatccagttttttaccca

SEQ ID NO: 89524 - DNA, 25 bp, S. pombe
gaagtggacctgcttttgttgctac

SEQ ID NO: 89525 - DNA, 25 bp, S. pombe
gaagacaaatccatttcggtcgaaa

SEQ ID NO: 89526 - DNA, 25 bp, S. pombe
gaagtcataggccagttaccagatg

SEQ ID NO: 89527 - DNA, 25 bp, S. pombe
gaagtactacgccatatcatgccca

SEQ ID NO: 89528 - DNA, 25 bp, S. pombe
gaagtactaatgcatcatcccgaat

SEQ ID NO: 89529 - DNA, 25 bp, S. pombe
gaagtatcggctttcacattctcca

SEQ ID NO: 89530 - DNA, 25 bp, S. pombe
gaagtctcaaatgggttgcagatca

SEQ ID NO: 89531 - DNA, 25 bp, S. pombe
gaagtgctgatgtccgtgttaattt

SEQ ID NO: 89532 - DNA, 25 bp, S. pombe
gaagttgaacaaattgcgtacgcta

SEQ ID NO: 89533 - DNA, 25 bp, S. pombe
gaagtaatacaaccaggcccctata

SEQ ID NO: 89534 - DNA, 25 bp, S. pombe
gaggaggaaaccatcattgaccgaa

SEQ ID NO: 89535 - DNA, 25 bp, S. pombe
gaagtttacaccacattgagtccaa

SEQ ID NO: 89536 - DNA, 25 bp, S. pombe
gaagtaaaactgctttgctggacaa

SEQ ID NO: 89537 - DNA, 25 bp, S. pombe
gaagtgtttgggatttctcctgaac

SEQ ID NO: 89538 - DNA, 25 bp, S. pombe
gaagtgcagtcgagtttacagtcta

SEQ ID NO: 89539 - DNA, 25 bp, S. pombe
gaagtcagccgcactttagattctc

SEQ ID NO: 89540 - DNA, 25 bp, S. pombe
gaagtccctgcactctatgttattt

SEQ ID NO: 89541 - DNA, 25 bp, S. pombe
gaagacctagccagccatgatatct

SEQ ID NO: 89542 - DNA, 25 bp, S. pombe
gaagaaagccgtcccattacaagag

SEQ ID NO: 89543 - DNA, 25 bp, S. pombe
gaagcaaaacctcccaaagcaactt

SEQ ID NO: 89544 - DNA, 25 bp, S. pombe
gaagagtatttaacattccgccaat

SEQ ID NO: 89545 - DNA, 25 bp, S. pombe
gaagtttcttcaacatttcccagca

SEQ ID NO: 89546 - DNA, 25 bp, S. pombe
gaagatcgttgtcggttataccaaa

SEQ ID NO: 89547 - DNA, 25 bp, S. pombe
gaagaagctttactttgggcgcata

SEQ ID NO: 89548 - DNA, 25 bp, S. pombe
gaagatttcgatactgttagggcta

SEQ ID NO: 89549 - DNA, 25 bp, S. pombe
gaagtttcgactttgcgacgccata

SEQ ID NO: 89550 - DNA, 25 bp, S. pombe
gaagtttgttcctacgcatagccat

SEQ ID NO: 89551 - DNA, 25 bp, S. pombe
gaagtgctcgataccgatgcttgta

SEQ ID NO: 89552 - DNA, 25 bp, S. pombe
gaagtaccactttgcaggtggcata

SEQ ID NO: 89553 - DNA, 25 bp, S. pombe
gaagtcactgatttagcgcgaggat

SEQ ID NO: 89554 - DNA, 25 bp, S. pombe
gaagtgcacgattctatcacgcttt

SEQ ID NO: 89555 - DNA, 25 bp, S. pombe
gaagattcctttactccttggttct

SEQ ID NO: 89556 - DNA, 25 bp, S. pombe
gaagttccctatactgcttatattt

SEQ ID NO: 89557 - DNA, 25 bp, S. pombe
gaagaatatcttcctttcgtactat

SEQ ID NO: 89558 - DNA, 25 bp, S. pombe
gaagttgctgtcgagttgtcgtctc

SEQ ID NO: 89559 - DNA, 25 bp, S. pombe
gaagttcgcccgagagcgatcgcaa

SEQ ID NO: 89560 - DNA, 25 bp, S. pombe
gaagtatcaccctacagaagtccat

SEQ ID NO: 89561 - DNA, 25 bp, S. pombe
gaagtactcctccataaagttcttg

SEQ ID NO: 89562 - DNA, 25 bp, S. pombe
gaagagcaccttcgactgaatgatt

SEQ ID NO: 89563 - DNA, 25 bp, S. pombe
gaagtcctgaagtacaagctgctgt

SEQ ID NO: 89564 - DNA, 25 bp, S. pombe
gaagtcgtagagtctcgtgctggcc

SEQ ID NO: 89565 - DNA, 25 bp, S. pombe
gaagtcgatggaggtctctctttaa

SEQ ID NO: 89566 - DNA, 25 bp, S. pombe
gaagatcattaagcctactgtccct

SEQ ID NO: 89567 - DNA, 25 bp, S. pombe
gaagtacgaccgcttctgacattct

SEQ ID NO: 89568 - DNA, 25 bp, S. pombe
gaagatgacaactctttacgcttga

SEQ ID NO: 89569 - DNA, 25 bp, S. pombe
gaagtgcgcatgaatcctcggcaaa

SEQ ID NO: 89570 - DNA, 25 bp, S. pombe
gaagtgcgctgaatactcctgctat

SEQ ID NO: 89571 - DNA, 25 bp, S. pombe
gaagatgcgtacttctccaaaaagt

SEQ ID NO: 89572 - DNA, 25 bp, S. pombe
gaagaacctatttacgaacctcctg

SEQ ID NO: 89573 - DNA, 25 bp, S. pombe
gaagacgcttcaatctacgaacttg

SEQ ID NO: 89574 - DNA, 25 bp, S. pombe
gaagacgttcttgaaactcgctcca

SEQ ID NO: 89575 - DNA, 25 bp, S. pombe
gaagagtgttgctgccaaacttgaa

SEQ ID NO: 89576 - DNA, 25 bp, S. pombe
gaagagcgattgtgcctggattttt

SEQ ID NO: 89577 - DNA, 25 bp, S. pombe
gagaccgggtcttcataactttctt

SEQ ID NO: 89578 - DNA, 25 bp, S. pombe
gaagcgagtttcacaagaagttctt

SEQ ID NO: 89579 - DNA, 25 bp, S. pombe
gaacgatgtttactatagcggtggt

SEQ ID NO: 89580 - DNA, 25 bp, S. pombe
gaactgctgtccctcaatacgttgg

SEQ ID NO: 89581 - DNA, 25 bp, S. pombe
gaagtcgtctcagcaatgattggtg

SEQ ID NO: 89582 - DNA, 25 bp, S. pombe
gaagactatcgagcaaatttggaac

SEQ ID NO: 89583 - DNA, 25 bp, S. pombe
gaagtcatgcacctgtttcggattc

SEQ ID NO: 89584 - DNA, 25 bp, S. pombe
gaagtcctatggattagccagtcat

SEQ ID NO: 89585 - DNA, 25 bp, S. pombe
gaagtcacttcgatatgctgtttat

SEQ ID NO: 89586 - DNA, 25 bp, S. pombe
gaagactttgagactagcgtttcac

SEQ ID NO: 89587 - DNA, 25 bp, S. pombe
gaagtttagcgaatgctcagcattt

SEQ ID NO: 89588 - DNA, 25 bp, S. pombe
gaagttcgcgaagctctcgaagatt

SEQ ID NO: 89589 - DNA, 25 bp, S. pombe
gaagctgcccgtgaactaactggta

SEQ ID NO: 89590 - DNA, 25 bp, S. pombe
gaagtttttcaggagcacgattggt

SEQ ID NO: 89591 - DNA, 25 bp, S. pombe
gaagtcgttttcatccatgctagca

SEQ ID NO: 89592 - DNA, 25 bp, S. pombe
gaagtttgaccccttgcgaaataga

SEQ ID NO: 89593 - DNA, 25 bp, S. pombe
gaagtcttgctttttcctcatatga

SEQ ID NO: 89594 - DNA, 25 bp, S. pombe
gaagtctccttgaacaactagcaga

SEQ ID NO: 89595 - DNA, 25 bp, S. pombe
gaagtctctctttgcattgacactg

SEQ ID NO: 89596 - DNA, 25 bp, S. pombe
gaagttcatccaatgctctgtatct

SEQ ID NO: 89597 - DNA, 25 bp, S. pombe
gaagttcaatgcagtttgtctcact

SEQ ID NO: 89598 - DNA, 25 bp, S. pombe
gaagagtcactaagctttttcaatt

SEQ ID NO: 89599 - DNA, 25 bp, S. pombe
gaagatgctcatgtcctagtggctc

SEQ ID NO: 89600 - DNA, 25 bp, S. pombe
gaagatgtctgtgttcatggcccgg

SEQ ID NO: 89601 - DNA, 25 bp, S. pombe
gaagattctgctaaaaagcccgaat

SEQ ID NO: 89602 - DNA, 25 bp, S. pombe
gaagatcatagtttgcccggttggg

SEQ ID NO: 89603 - DNA, 25 bp, S. pombe
gaagctctcagtcaaactcgttcag

SEQ ID NO: 89604 - DNA, 25 bp, S. pombe
gaagagcaacttccaggccaaactt

SEQ ID NO: 89605 - DNA, 25 bp, S. pombe
gaagagatagttcccctaagcgtcg

SEQ ID NO: 89606 - DNA, 25 bp, S. pombe
gaagagtctgtttacgcgcaagccc

SEQ ID NO: 89607 - DNA, 25 bp, S. pombe
gaagcacctgtatactaaacgtcgc

SEQ ID NO: 89608 - DNA, 25 bp, S. pombe
gaagagttattcgtcctgccaaggt

SEQ ID NO: 89609 - DNA, 25 bp, S. pombe
gaagaagtagatatcccgaagcgta

SEQ ID NO: 89610 - DNA, 25 bp, S. pombe
gaagacgttgttgccatccaacttg

SEQ ID NO: 89611 - DNA, 25 bp, S. pombe
gaagattcccatcctacaagcaatt

SEQ ID NO: 89612 - DNA, 25 bp, S. pombe
gaacctccagcactatggcaagaac

SEQ ID NO: 89613 - DNA, 25 bp, S. pombe
gaagatacacaactacagcctcata

SEQ ID NO: 89614 - DNA, 25 bp, S. pombe
gaagaacacacctacacggatccgg

SEQ ID NO: 89615 - DNA, 25 bp, S. pombe
gaagattccagcagcgactctgaat

SEQ ID NO: 89616 - DNA, 25 bp, S. pombe
gatactttcgaagagcttgccggct

SEQ ID NO: 89617 - DNA, 25 bp, S. pombe
gaagttgtcgagcaaaactccatgt

SEQ ID NO: 89618 - DNA, 25 bp, S. pombe
gaagttaccagatacacgccagagt

SEQ ID NO: 89619 - DNA, 25 bp, S. pombe
gaagatataccgaataagcgcgcta

SEQ ID NO: 89620 - DNA, 25 bp, S. pombe
gaagcttaaatctccggtgtatcta

SEQ ID NO: 89621 - DNA, 25 bp, S. pombe
gaagttggccgctggattgttgatt

SEQ ID NO: 89622 - DNA, 25 bp, S. pombe
gaagttcacccttggatgattgtct

SEQ ID NO: 89623 - DNA, 25 bp, S. pombe
gaagttatctcctttgatgcactgg

SEQ ID NO: 89624 - DNA, 25 bp, S. pombe
gaagttactacattagctgctgctg

SEQ ID NO: 89625 - DNA, 25 bp, S. pombe
gaagtttctgaattactgcccaaag

SEQ ID NO: 89626 - DNA, 25 bp, S. pombe
gaagtttctcaagcattagccgaag

SEQ ID NO: 89627 - DNA, 25 bp, S. pombe
gaagttatacctgctccaactgaag

SEQ ID NO: 89628 - DNA, 25 bp, S. pombe
gaagctttcacctagttctttgaga

SEQ ID NO: 89629 - DNA, 25 bp, S. pombe
gaagatttggacttgcttgaaccac

SEQ ID NO: 89630 - DNA, 25 bp, S. pombe
gaagtttggagccttattatgccgc

SEQ ID NO: 89631 - DNA, 25 bp, S. pombe
gaagttgtgaatcttatgtcagctc

SEQ ID NO: 89632 - DNA, 25 bp, S. pombe
gaagttgtgtctgcttatggcgcca

SEQ ID NO: 89633 - DNA, 25 bp, S. pombe
gaagttgcatttacgtcttactgat

SEQ ID NO: 89634 - DNA, 25 bp, S. pombe
gaagttgccttacctgctaatgctg

SEQ ID NO: 89635 - DNA, 25 bp, S. pombe
gaagatttcccattgatgcctgcag

SEQ ID NO: 89636 - DNA, 25 bp, S. pombe
gaagatttcacgtttgacgccggta

SEQ ID NO: 89637 - DNA, 25 bp, S. pombe
gaagttatgtttttccatcccgagg

SEQ ID NO: 89638 - DNA, 25 bp, S. pombe
gaagtttgtcatgtctccatgcaca

SEQ ID NO: 89639 - DNA, 25 bp, S. pombe
gaagtttggcatatctagcaccaga

SEQ ID NO: 89640 - DNA, 25 bp, S. pombe
gaagttgtattttctgacaccgcat

SEQ ID NO: 89641 - DNA, 25 bp, S. pombe
gaagtatgttcaatcacgaccgtca

SEQ ID NO: 89642 - DNA, 25 bp, S. pombe
gaagattgttctccaaagcaggtta

SEQ ID NO: 89643 - DNA, 25 bp, S. pombe
gaagattgttatccccaggtttcac

SEQ ID NO: 89644 - DNA, 25 bp, S. pombe
gaagagaaagctcctctttggaaaa

SEQ ID NO: 89645 - DNA, 25 bp, S. pombe
gaagacgctgaagaggctaggacct

SEQ ID NO: 89646 - DNA, 25 bp, S. pombe
taagaagtatcctgggttatcccgt

SEQ ID NO: 89647 - DNA, 25 bp, S. pombe
gaagaactgtccttgggttataccg

SEQ ID NO: 89648 - DNA, 25 bp, S. pombe
gaagagggcatccactgcaacttga

SEQ ID NO: 89649 - DNA, 25 bp, S. pombe
gaagatcgcgactatgtcattcagt

SEQ ID NO: 89650 - DNA, 25 bp, S. pombe
gaagattatcatcagctttaccttg

SEQ ID NO: 89651 - DNA, 25 bp, S. pombe
gaagattcacttgctctaaacatcg

SEQ ID NO: 89652 - DNA, 25 bp, S. pombe
gaagttcctacaactcaacctgatg

SEQ ID NO: 89653 - DNA, 25 bp, S. pombe
gaagttctcggctacggatcacgta

SEQ ID NO: 89654 - DNA, 25 bp, S. pombe
gacgaccttgccttgtggattggga

SEQ ID NO: 89655 - DNA, 25 bp, S. pombe
gaagaccttgcacttgcattcttga

SEQ ID NO: 89656 - DNA, 25 bp, S. pombe
gaagacctgttcctgaagcacgact

SEQ ID NO: 89657 - DNA, 25 bp, S. pombe
gaagatccagtttcaagcaacgagt

SEQ ID NO: 89658 - DNA, 25 bp, S. pombe
gaagatcgactatcagtgcaacgta

SEQ ID NO: 89659 - DNA, 25 bp, S. pombe
gaagatcgatcaaagccagcgtcag

SEQ ID NO: 89660 - DNA, 25 bp, S. pombe
gaagatgcgtcttcatccgatgaag

SEQ ID NO: 89661 - DNA, 25 bp, S. pombe
gaagaagcttgaccaatccacagaa

SEQ ID NO: 89662 - DNA, 25 bp, S. pombe
gaagatgtacgcttactcctgcaag

SEQ ID NO: 89663 - DNA, 25 bp, S. pombe
gaagaaggtccaacgtgcctatggt

SEQ ID NO: 89664 - DNA, 25 bp, S. pombe
gaagaaggtcctttggcacatgcag

SEQ ID NO: 89665 - DNA, 25 bp, S. pombe
gaagatggcgtctttgcttccaaag

SEQ ID NO: 89666 - DNA, 25 bp, S. pombe
gaagatgatttgttgcctagcagtt

SEQ ID NO: 89667 - DNA, 25 bp, S. pombe
gaagatgcttcgagacttcgtcttt

SEQ ID NO: 89668 - DNA, 25 bp, S. pombe
gaagactcgagaatgtctacttctt

SEQ ID NO: 89669 - DNA, 25 bp, S. pombe
gaagcaccggagatgatacccagta

SEQ ID NO: 89670 - DNA, 25 bp, S. pombe
gaagcccgtattagagacccttatg

SEQ ID NO: 89671 - DNA, 25 bp, S. pombe
gaagagtagtactggttccctacct

SEQ ID NO: 89672 - DNA, 25 bp, S. pombe
gaagcattggaatcggtatccccat

SEQ ID NO: 89673 - DNA, 25 bp, S. pombe
gaagacgaattggagcttcctccca

SEQ ID NO: 89674 - DNA, 25 bp, S. pombe
gaagaccaatggctcagttctcaaa

SEQ ID NO: 89675 - DNA, 25 bp, S. pombe
gaagaatctgttcgcgcaattagtc

SEQ ID NO: 89676 - DNA, 25 bp, S. pombe
gaagaatgccgttcgcaactcagta

SEQ ID NO: 89677 - DNA, 25 bp, S. pombe
gaagatatggctgcccaagctcgtg

SEQ ID NO: 89678 - DNA, 25 bp, S. pombe
gaagatttctatgatggccgcgatt

SEQ ID NO: 89679 - DNA, 25 bp, S. pombe
gaagttgcttatgctgtgcctggaa

SEQ ID NO: 89680 - DNA, 25 bp, S. pombe
gaagatattcgtttgctgatcgcaa

SEQ ID NO: 89681 - DNA, 25 bp, S. pombe
gaagacagcgatagcccttgggcta

SEQ ID NO: 89682 - DNA, 25 bp, S. pombe
gaagattcaactgctcaaacgtgta

SEQ ID NO: 89683 - DNA, 25 bp, S. pombe
gaagatgtctgtgtcgctgaacgtt

SEQ ID NO: 89684 - DNA, 25 bp, S. pombe
gaagatctcataaacgctgccggtg

SEQ ID NO: 89685 - DNA, 25 bp, S. pombe
gaagaaaatgatcagcccgcaggaa

SEQ ID NO: 89686 - DNA, 25 bp, S. pombe
gaagaatggcatttactcgctatat

SEQ ID NO: 89687 - DNA, 25 bp, S. pombe
gaagagatgccttggcttcgtgata

SEQ ID NO: 89688 - DNA, 25 bp, S. pombe
gaagcgttttggatagtcctgagct

SEQ ID NO: 89689 - DNA, 25 bp, S. pombe
gaagcgtctattgatttttcgacta

SEQ ID NO: 89690 - DNA, 25 bp, S. pombe
gaagaggctcatcaacttttggtat

SEQ ID NO: 89691 - DNA, 25 bp, S. pombe
gaagatcccgtatttcccaagaagg

SEQ ID NO: 89692 - DNA, 25 bp, S. pombe
gaagattctctattttccacattaa

SEQ ID NO: 89693 - DNA, 25 bp, S. pombe
gaagttgatctttttacagctgaaa

SEQ ID NO: 89694 - DNA, 25 bp, S. pombe
gaagttgatgctctatctgctttag

SEQ ID NO: 89695 - DNA, 25 bp, S. pombe
gacagtagagcttcagatcggtttg

SEQ ID NO: 89696 - DNA, 25 bp, S. pombe
gaagatggtactgacgcggctctca

SEQ ID NO: 89697 - DNA, 25 bp, S. pombe
gaagttctgaagtcccaagcacgaa

SEQ ID NO: 89698 - DNA, 25 bp, S. pombe
gaagacgagctttctggtcttaaaa

SEQ ID NO: 89699 - DNA, 25 bp, S. pombe
gaagttgatctttctgagtcttata

SEQ ID NO: 89700 - DNA, 25 bp, S. pombe
gaagagacctgtttttacgatgttt

SEQ ID NO: 89701 - DNA, 25 bp, S. pombe
gaagcacctgccgactttgagtttt

SEQ ID NO: 89702 - DNA, 25 bp, S. pombe
gaagatcgccttgctcttgaatttt

SEQ ID NO: 89703 - DNA, 25 bp, S. pombe
gaagttgccgagcagcgtgatccaa

SEQ ID NO: 89704 - DNA, 25 bp, S. pombe
gaagatactactccatctgatgcca

SEQ ID NO: 89705 - DNA, 25 bp, S. pombe
gaagcttcacaaaacgacgtctccg

SEQ ID NO: 89706 - DNA, 25 bp, S. pombe
gaagttgacaaatcgcgctacatcc

SEQ ID NO: 89707 - DNA, 25 bp, S. pombe
gaacgtactgaaccgtcttatccgt

SEQ ID NO: 89708 - DNA, 25 bp, S. pombe
gaagaatgccctgctttgggaagat

SEQ ID NO: 89709 - DNA, 25 bp, S. pombe
gaagaaggttcatcgcagctttaag

SEQ ID NO: 89710 - DNA, 25 bp, S. pombe
gaagaaggttcatcgtagcttcaaa

SEQ ID NO: 89711 - DNA, 25 bp, S. pombe
gaagaaggttcatcgtagcttcaaa

SEQ ID NO: 89712 - DNA, 25 bp, S. pombe
gaagattttcgcacggatccatata

SEQ ID NO: 89713 - DNA, 25 bp, S. pombe
gaagatattccagctcgtgaccgaa

SEQ ID NO: 89714 - DNA, 25 bp, S. pombe
gaagaagcctcatactacaccaaag

SEQ ID NO: 89715 - DNA, 25 bp, S. pombe
gaagaccgtgttccattattgcaag

SEQ ID NO: 89716 - DNA, 25 bp, S. pombe
gaagaccctattattgagccggaca

SEQ ID NO: 89717 - DNA, 25 bp, S. pombe
gaagacacacatcctactttactgg

SEQ ID NO: 89718 - DNA, 25 bp, S. pombe
gaagctgaagcttgcgtaaggttaa

SEQ ID NO: 89719 - DNA, 25 bp, S. pombe
gaagcttcagctcgccataacgaaa

SEQ ID NO: 89720 - DNA, 25 bp, S. pombe
gaagatgttcttgcatatgacgaag

SEQ ID NO: 89721 - DNA, 25 bp, S. pombe
gaagagtcacttacggatgctatat

SEQ ID NO: 89722 - DNA, 25 bp, S. pombe
gaagattccaacttgcgttatcctt

SEQ ID NO: 89723 - DNA, 25 bp, S. pombe
gaagaattcggtcgcgctacttcat

SEQ ID NO: 89724 - DNA, 25 bp, S. pombe
gaagcactggcgctaccatagtgtt

SEQ ID NO: 89725 - DNA, 25 bp, S. pombe
gaagaggtgcgctttccacaatatt

SEQ ID NO: 89726 - DNA, 25 bp, S. pombe
gaagatgcaattcgcggtgatccca

SEQ ID NO: 89727 - DNA, 25 bp, S. pombe
gaagcgtaacaatcgtgagtccaac

SEQ ID NO: 89728 - DNA, 25 bp, S. pombe
gaagattcctacaaccttgcgtgaa

SEQ ID NO: 89729 - DNA, 25 bp, S. pombe
gaagagatctctttacttttggaag

SEQ ID NO: 89730 - DNA, 25 bp, S. pombe
gaagagcactcttcaacccattgag

SEQ ID NO: 89731 - DNA, 25 bp, S. pombe
gaagagctcgtcttgttgctgaaac

SEQ ID NO: 89732 - DNA, 25 bp, S. pombe
gaagatgtcactcggttgctagaac

SEQ ID NO: 89733 - DNA, 25 bp, S. pombe
gaagatgacgctccttatgcttaca

SEQ ID NO: 89734 - DNA, 25 bp, S. pombe
gaagatacgccctatgatccaattg

SEQ ID NO: 89735 - DNA, 25 bp, S. pombe
gaagatgacctttaacaccgattat

SEQ ID NO: 89736 - DNA, 25 bp, S. pombe
gaagcagatccccttaactttaatg

SEQ ID NO: 89737 - DNA, 25 bp, S. pombe
gaagaacggccgaaagctactaaga

SEQ ID NO: 89738 - DNA, 25 bp, S. pombe
gaagcaacgtcctcaattacataga

SEQ ID NO: 89739 - DNA, 25 bp, S. pombe
gaagatcaactctatcctgggcaaa

SEQ ID NO: 89740 - DNA, 25 bp, S. pombe
gaagcaaatcagagtctttcacagc

SEQ ID NO: 89741 - DNA, 25 bp, S. pombe
gaagagctatatccgtcgttagatc

SEQ ID NO: 89742 - DNA, 25 bp, S. pombe
gaagagaacattcgccgtcatagta

SEQ ID NO: 89743 - DNA, 25 bp, S. pombe
gaagaagacgtccaagctgctcaag

SEQ ID NO: 89744 - DNA, 25 bp, S. pombe
gaagacccgatccacaaacatatct

SEQ ID NO: 89745 - DNA, 25 bp, S. pombe
gaagaccctgatgccgctaatgagc

SEQ ID NO: 89746 - DNA, 25 bp, S. pombe
gaagatgccctaactgctttgaaac

SEQ ID NO: 89747 - DNA, 25 bp, S. pombe
gaagaatctccgtatcaattgacaa

SEQ ID NO: 89748 - DNA, 25 bp, S. pombe
gaagaaccaccacttgaaggatcag

SEQ ID NO: 89749 - DNA, 25 bp, S. pombe
gaacacttggctttaaaccccaatg

SEQ ID NO: 89750 - DNA, 25 bp, S. pombe
gaagagcttttacaaacctccaaga

SEQ ID NO: 89751 - DNA, 25 bp, S. pombe
gaagacacttctttggagacgccca

SEQ ID NO: 89752 - DNA, 25 bp, S. pombe
gaagatgtgttaaccttacgagaca

SEQ ID NO: 89753 - DNA, 25 bp, S. pombe
gaagaagctcataccggtccgacta

SEQ ID NO: 89754 - DNA, 25 bp, S. pombe
gaagagcttgagtccggtcctaaaa

SEQ ID NO: 89755 - DNA, 25 bp, S. pombe
gaagatgtgtcttttgggtccaaaa

SEQ ID NO: 89756 - DNA, 25 bp, S. pombe
gaagagatacttttggcggccatga

SEQ ID NO: 89757 - DNA, 25 bp, S. pombe
gaagacgacgacttggacgctgata

SEQ ID NO: 89758 - DNA, 25 bp, S. pombe
gaagaccgccattcgtgagcgtgat

SEQ ID NO: 89759 - DNA, 25 bp, S. pombe
gaagatcctttcgagatttcacata

SEQ ID NO: 89760 - DNA, 25 bp, S. pombe
gaagctactttcgagttggatgcca

SEQ ID NO: 89761 - DNA, 25 bp, S. pombe
gaagcaattttctgactggtctttc

SEQ ID NO: 89762 - DNA, 25 bp, S. pombe
gaagaatctccttttcgttggtgtt

SEQ ID NO: 89763 - DNA, 25 bp, S. pombe
gaagacgccactattctgttgcgtg

SEQ ID NO: 89764 - DNA, 25 bp, S. pombe
gaagccccaatttactttgatttcg

SEQ ID NO: 89765 - DNA, 25 bp, S. pombe
gaagacgcacgttctaccgttattc

SEQ ID NO: 89766 - DNA, 25 bp, S. pombe
gaagagacggtgtctcacccttttc

SEQ ID NO: 89767 - DNA, 25 bp, S. pombe
gaagaaagccctggaaccttgttct

SEQ ID NO: 89768 - DNA, 25 bp, S. pombe
gaagacgtcctcgtgtacgtttaga

SEQ ID NO: 89769 - DNA, 25 bp, S. pombe
gaagacccactgattgagcgtttat

SEQ ID NO: 89770 - DNA, 25 bp, S. pombe
gaagatgccttgtacgcttccaaga

SEQ ID NO: 89771 - DNA, 25 bp, S. pombe
gaagatcccagagcgttacaagaaa

SEQ ID NO: 89772 - DNA, 25 bp, S. pombe
gaagcattccaaccttttgaccaaa

SEQ ID NO: 89773 - DNA, 25 bp, S. pombe
gaagagccacttaatctattcccta

SEQ ID NO: 89774 - DNA, 25 bp, S. pombe
gaagacattcaaaacagccatcgat

SEQ ID NO: 89775 - DNA, 25 bp, S. pombe
gaagcacttttcataccatccaaaa

SEQ ID NO: 89776 - DNA, 25 bp, S. pombe
gaagacgtccattcagaccagtttt

SEQ ID NO: 89777 - DNA, 25 bp, S. pombe
gaagacttgccatgaacagattttt

SEQ ID NO: 89778 - DNA, 25 bp, S. pombe
gaagagcgtctatcaatcgttttca

SEQ ID NO: 89779 - DNA, 25 bp, S. pombe
gaagacgttctcaagtgcatggatt

SEQ ID NO: 89780 - DNA, 25 bp, S. pombe
gaacctgaacctaactattggcaat

SEQ ID NO: 89781 - DNA, 25 bp, S. pombe
gaacaaagggttcaagtcattacaa

SEQ ID NO: 89782 - DNA, 25 bp, S. pombe
gaagaaacgcgtgagacgccttaaa

SEQ ID NO: 89783 - DNA, 25 bp, S. pombe
gaagagatcactcatcgtccattgc

SEQ ID NO: 89784 - DNA, 25 bp, S. pombe
gaagagtgcattccaccatcaatcc

SEQ ID NO: 89785 - DNA, 25 bp, S. pombe
gaagcagtattactcaccgacgctg

SEQ ID NO: 89786 - DNA, 25 bp, S. pombe
gaagagcgtatccattccaagcgtg

SEQ ID NO: 89787 - DNA, 25 bp, S. pombe
gaagctccgaccaaactcatgaaat

SEQ ID NO: 89788 - DNA, 25 bp, S. pombe
gaaccaataccggaatgctggaatt

SEQ ID NO: 89789 - DNA, 25 bp, S. pombe
gaagacgccagcacgaatttcaaac

SEQ ID NO: 89790 - DNA, 25 bp, S. pombe
gaagacgctgcgtttgccttgaaac

SEQ ID NO: 89791 - DNA, 25 bp, S. pombe
gaagagtacgaattgccattgctaa

SEQ ID NO: 89792 - DNA, 25 bp, S. pombe
gaagaactgctacctcacattttga

SEQ ID NO: 89793 - DNA, 25 bp, S. pombe
gaagagcagcctactcaactttctg

SEQ ID NO: 89794 - DNA, 25 bp, S. pombe
gaagaagccttctaagtctgccatg

SEQ ID NO: 89795 - DNA, 25 bp, S. pombe
gaagaaatacgctagccactcaatt

SEQ ID NO: 89796 - DNA, 25 bp, S. pombe
gaagaaatcacttcgcgacctcatc

SEQ ID NO: 89797 - DNA, 25 bp, S. pombe
gaagaggtccactgctgacactgca

SEQ ID NO: 89798 - DNA, 25 bp, S. pombe
gaagagcgtcgttttgtcatcgaag

SEQ ID NO: 89799 - DNA, 25 bp, S. pombe
gaagactccgtcgatctttcgaagt

SEQ ID NO: 89800 - DNA, 25 bp, S. pombe
gaagagcctattcttgcttctacct

SEQ ID NO: 89801 - DNA, 25 bp, S. pombe
gaagacagccttgtcagcagcaaag

SEQ ID NO: 89802 - DNA, 25 bp, S. pombe
gaagcagcaatttctccaagtatat

SEQ ID NO: 89803 - DNA, 25 bp, S. pombe
gaagcgcaatatttcctcggaggtt

SEQ ID NO: 89804 - DNA, 25 bp, S. pombe
gaagcttgcctacaacgtgagccta

SEQ ID NO: 89805 - DNA, 25 bp, S. pombe
gaagcttggtactatacctcgctgc

SEQ ID NO: 89806 - DNA, 25 bp, S. pombe
gaagacagccgactcatttattaca

SEQ ID NO: 89807 - DNA, 25 bp, S. pombe
gaagcacatggctctttccaataca

SEQ ID NO: 89808 - DNA, 25 bp, S. pombe
gaagacaagcctcgttcagctataa

SEQ ID NO: 89809 - DNA, 25 bp, S. pombe
gaagaaaccaacatgccagtcaaat

SEQ ID NO: 89810 - DNA, 25 bp, S. pombe
gaagacgatatatctgccggcggat

SEQ ID NO: 89811 - DNA, 25 bp, S. pombe
gaagacgttgctgctgccggttcag

SEQ ID NO: 89812 - DNA, 25 bp, S. pombe
gaagagcttgctaaaatcgaaactg

SEQ ID NO: 89813 - DNA, 25 bp, S. pombe
gaagcacttgcctacaatcgaaatg

SEQ ID NO: 89814 - DNA, 25 bp, S. pombe
gaagctacttcagcattagacggtg

SEQ ID NO: 89815 - DNA, 25 bp, S. pombe
gaagaagagtttccgtcaccgtatt

SEQ ID NO: 89816 - DNA, 25 bp, S. pombe
gaagcttacttccaagcaagtgaga

SEQ ID NO: 89817 - DNA, 25 bp, S. pombe
gaagacgacggctctaagtccagca

SEQ ID NO: 89818 - DNA, 25 bp, S. pombe
gaagactcaaggtgccggtctccaa

SEQ ID NO: 89819 - DNA, 25 bp, S. pombe
gacagtcgacggtgccttttctaaa

SEQ ID NO: 89820 - DNA, 25 bp, S. pombe
gaagcgcgttggtggtatgtatctc

SEQ ID NO: 89821 - DNA, 25 bp, S. pombe
gaagcttactcgtggtgttatgttt

SEQ ID NO: 89822 - DNA, 25 bp, S. pombe
gaagctatactcgaccttaaacggg

SEQ ID NO: 89823 - DNA, 25 bp, S. pombe
gaagactggtcattgcttgatcgca

SEQ ID NO: 89824 - DNA, 25 bp, S. pombe
gaagcatgctttaggcttgcatacc

SEQ ID NO: 89825 - DNA, 25 bp, S. pombe
gaagcagtctgttggatttccagcc

SEQ ID NO: 89826 - DNA, 25 bp, S. pombe
gaagctattcttttagcgcgccgga

SEQ ID NO: 89827 - DNA, 25 bp, S. pombe
gaagcatttttgtttggactcgagc

SEQ ID NO: 89828 - DNA, 25 bp, S. pombe
gaagcttttgcaccaaattctacat

SEQ ID NO: 89829 - DNA, 25 bp, S. pombe
gaagagcctatttcgtttacagaag

SEQ ID NO: 89830 - DNA, 25 bp, S. pombe
gaagagcgtatcgtcagtgttcaac

SEQ ID NO: 89831 - DNA, 25 bp, S. pombe
gaagaatgtactgcccgtgttacaa

SEQ ID NO: 89832 - DNA, 25 bp, S. pombe
gaagaaatcctgcacgtgttaatca

SEQ ID NO: 89833 - DNA, 25 bp, S. pombe
gaagcaatacctgacgttgtgcatt

SEQ ID NO: 89834 - DNA, 25 bp, S. pombe
gaacttctcagaaacttaaggtctt

SEQ ID NO: 89835 - DNA, 25 bp, S. pombe
gaagaattcgaccttgatcaggatg

SEQ ID NO: 89836 - DNA, 25 bp, S. pombe
gaagaaaccagtcgcttctcatgaa

SEQ ID NO: 89837 - DNA, 25 bp, S. pombe
gaagaagcgcactactcaagcgaaa

SEQ ID NO: 89838 - DNA, 25 bp, S. pombe
gaagacaggcgcaacagctgtgcaa

SEQ ID NO: 89839 - DNA, 25 bp, S. pombe
gaagacatagcagagcccatccaat

SEQ ID NO: 89840 - DNA, 25 bp, S. pombe
gaagctttcagacgctgccacaaat

SEQ ID NO: 89841 - DNA, 25 bp, S. pombe
gaagctggacggacacttgaacctc

SEQ ID NO: 89842 - DNA, 25 bp, S. pombe
gaagcgaaattgtgggccgacctct

SEQ ID NO: 89843 - DNA, 25 bp, S. pombe
gaagctactttgttgggaacgtgca

SEQ ID NO: 89844 - DNA, 25 bp, S. pombe
gaagcattcattctttttacctgca

SEQ ID NO: 89845 - DNA, 25 bp, S. pombe
gaagagccttcacgttatgactatg

SEQ ID NO: 89846 - DNA, 25 bp, S. pombe
gaagcagacggctaatcgcagacaa

SEQ ID NO: 89847 - DNA, 25 bp, S. pombe
gaagcatacaatccatctagcaaat

SEQ ID NO: 89848 - DNA, 25 bp, S. pombe
gaagcaatttgctgccaagggcatc

SEQ ID NO: 89849 - DNA, 25 bp, S. pombe
gaagcatttgtctatgaccctttga

SEQ ID NO: 89850 - DNA, 25 bp, S. pombe
gaagcaatgttctatcgttctagta

SEQ ID NO: 89851 - DNA, 25 bp, S. pombe
gaagactgtccagcgtgcttatggc

SEQ ID NO: 89852 - DNA, 25 bp, S. pombe
gaagaaatgctacgtggccatcaca

SEQ ID NO: 89853 - DNA, 25 bp, S. pombe
gaagaacgaagacgcctctcagcag

SEQ ID NO: 89854 - DNA, 25 bp, S. pombe
gaagactaattttgtaccgctggtt

SEQ ID NO: 89855 - DNA, 25 bp, S. pombe
gaagcttcaatctgtaatcacccag

SEQ ID NO: 89856 - DNA, 25 bp, S. pombe
gaagctgcttatcttgaaaacctta

SEQ ID NO: 89857 - DNA, 25 bp, S. pombe
gaagcttccgccatcaaagaactta

SEQ ID NO: 89858 - DNA, 25 bp, S. pombe
gaagcatttcgtccattagcggttt

SEQ ID NO: 89859 - DNA, 25 bp, S. pombe
gacggttacaccattgagcgtttaa

SEQ ID NO: 89860 - DNA, 25 bp, S. pombe
gaagcgtatcactcctatgggtggt

SEQ ID NO: 89861 - DNA, 25 bp, S. pombe
gaagacgccttattatgactccgga

SEQ ID NO: 89862 - DNA, 25 bp, S. pombe
gaagacgtctctaaatatcccgatt

SEQ ID NO: 89863 - DNA, 25 bp, S. pombe
gaagacgatgttgatttccaagatt

SEQ ID NO: 89864 - DNA, 25 bp, S. pombe
gaagacacttcgtattcccagaaat

SEQ ID NO: 89865 - DNA, 25 bp, S. pombe
gaagcaatcacagtcctggtctcaa

SEQ ID NO: 89866 - DNA, 25 bp, S. pombe
gaagactcaatgtagccatcacaag

SEQ ID NO: 89867 - DNA, 25 bp, S. pombe
gaagcagctgaaacgccatgcgaaa

SEQ ID NO: 89868 - DNA, 25 bp, S. pombe
gaagactttgtccatcagcaacaga

SEQ ID NO: 89869 - DNA, 25 bp, S. pombe
gaagcgtgttatcccaaccggttat

SEQ ID NO: 89870 - DNA, 25 bp, S. pombe
gaagcgttaagcgtcttcgtcgtga

SEQ ID NO: 89871 - DNA, 25 bp, S. pombe
gaactttgtaacattcgtctctacg

SEQ ID NO: 89872 - DNA, 25 bp, S. pombe
gaagcatttgcctcagctatttctc

SEQ ID NO: 89873 - DNA, 25 bp, S. pombe
gaagcttgaatctcgctatcgtacg

SEQ ID NO: 89874 - DNA, 25 bp, S. pombe
gagacctactttgggaacggcggca

SEQ ID NO: 89875 - DNA, 25 bp, S. pombe
gaagactactttgggcataagctgc

SEQ ID NO: 89876 - DNA, 25 bp, S. pombe
gaagcatatcaagtcctttcaagtg

SEQ ID NO: 89877 - DNA, 25 bp, S. pombe
gaagcagcatgacacaccgttgagt

SEQ ID NO: 89878 - DNA, 25 bp, S. pombe
gaagcacttgactatccgatcaggt

SEQ ID NO: 89879 - DNA, 25 bp, S. pombe
gaagcactttccaaccatcgagtaa

SEQ ID NO: 89880 - DNA, 25 bp, S. pombe
gaagcagctattcatgacctcgaaa

SEQ ID NO: 89881 - DNA, 25 bp, S. pombe
gaacaccccgttattgacgttgttg

SEQ ID NO: 89882 - DNA, 25 bp, S. pombe
gaagaagctgaggaaccccaagaag

SEQ ID NO: 89883 - DNA, 25 bp, S. pombe
gaagaatgcgcaaaaccctcaagaa

SEQ ID NO: 89884 - DNA, 25 bp, S. pombe
gaagaatctgtaaagcgcccggaca

SEQ ID NO: 89885 - DNA, 25 bp, S. pombe
gaaaccgttggatgcttctcgtaaa

SEQ ID NO: 89886 - DNA, 25 bp, S. pombe
gaacgggcggagagtattcgacaaa

SEQ ID NO: 89887 - DNA, 25 bp, S. pombe
gaacgtgggtcgtgcttatcccgaa

SEQ ID NO: 89888 - DNA, 25 bp, S. pombe
gaacggtcgtgaacgagatccccga

SEQ ID NO: 89889 - DNA, 25 bp, S. pombe
gaagcttgtttaccagtgatcccga

SEQ ID NO: 89890 - DNA, 25 bp, S. pombe
gaagccattgccgagatccaagatg

SEQ ID NO: 89891 - DNA, 25 bp, S. pombe
gaagaattcgctagctgcagtcatt

SEQ ID NO: 89892 - DNA, 25 bp, S. pombe
gaagaatgtttaccactgactcaaa

SEQ ID NO: 89893 - DNA, 25 bp, S. pombe
gaagaatccgttcgtgcttggcctg

SEQ ID NO: 89894 - DNA, 25 bp, S. pombe
gaagacaccgttatgcatttcgtga

SEQ ID NO: 89895 - DNA, 25 bp, S. pombe
gaagacaccactcaggctttttatg

SEQ ID NO: 89896 - DNA, 25 bp, S. pombe
gaagcacccttccaagagcaatttt

SEQ ID NO: 89897 - DNA, 25 bp, S. pombe
gaagccgctgttcgcctggtagaat

SEQ ID NO: 89898 - DNA, 25 bp, S. pombe
gaagctagcttaatccggtcaatgc

SEQ ID NO: 89899 - DNA, 25 bp, S. pombe
gaagcaatccttaatcgggcattca

SEQ ID NO: 89900 - DNA, 25 bp, S. pombe
gaagctaaattaatctgggcaggag

SEQ ID NO: 89901 - DNA, 25 bp, S. pombe
gaagcttctaaatcattggcctatg

SEQ ID NO: 89902 - DNA, 25 bp, S. pombe
gaagcttctaacactagcgagcaag

SEQ ID NO: 89903 - DNA, 25 bp, S. pombe
gaagctgtcaattccccagtagtag

SEQ ID NO: 89904 - DNA, 25 bp, S. pombe
gaagctcaagctgactccagtacta

SEQ ID NO: 89905 - DNA, 25 bp, S. pombe
gaagctcttgctatggccggttgta

SEQ ID NO: 89906 - DNA, 25 bp, S. pombe
gaagcctccctaccaaatttatcta

SEQ ID NO: 89907 - DNA, 25 bp, S. pombe
gaagcatccggcgtttcatgaaact

SEQ ID NO: 89908 - DNA, 25 bp, S. pombe
gaagcttctccattgtacgcaaaca

SEQ ID NO: 89909 - DNA, 25 bp, S. pombe
gaagcttcctaatattcttacaatg

SEQ ID NO: 89910 - DNA, 25 bp, S. pombe
gaagcaacttgtttctaagatccaa

SEQ ID NO: 89911 - DNA, 25 bp, S. pombe
gaagaacttgcttttctaagactac

SEQ ID NO: 89912 - DNA, 25 bp, S. pombe
gaagcttttgctttcttaaatcttt

SEQ ID NO: 89913 - DNA, 25 bp, S. pombe
gaagcgattcgactgtttttgacca

SEQ ID NO: 89914 - DNA, 25 bp, S. pombe
gaagctattagagtcctcgtcgttc

SEQ ID NO: 89915 - DNA, 25 bp, S. pombe
gaagcatttgtgttgttgcactcaa

SEQ ID NO: 89916 - DNA, 25 bp, S. pombe
gaagcattctctttccttagaggat

SEQ ID NO: 89917 - DNA, 25 bp, S. pombe
gaagctgtcctatgtttagcactgg

SEQ ID NO: 89918 - DNA, 25 bp, S. pombe
gaagctgggcaagactcaacgaata

SEQ ID NO: 89919 - DNA, 25 bp, S. pombe
gaagctgaagctacaatgcctccat

SEQ ID NO: 89920 - DNA, 25 bp, S. pombe
gaagcaaagctacaatctcgatttt

SEQ ID NO: 89921 - DNA, 25 bp, S. pombe
gaagaaagccggtcatccagcttca

SEQ ID NO: 89922 - DNA, 25 bp, S. pombe
gaagcacaagctgggtgtacctttg

SEQ ID NO: 89923 - DNA, 25 bp, S. pombe
gaagaagccatctatttgtccgata

SEQ ID NO: 89924 - DNA, 25 bp, S. pombe
gaagaacatgattgccgctgctcgt

SEQ ID NO: 89925 - DNA, 25 bp, S. pombe
gaagcatcttgaggcgttgccagat

SEQ ID NO: 89926 - DNA, 25 bp, S. pombe
gaagcttttacgtcaacaggtgcgt

SEQ ID NO: 89927 - DNA, 25 bp, S. pombe
gaagcttttccatacacttgatcgc

SEQ ID NO: 89928 - DNA, 25 bp, S. pombe
gaagctgtcttcattacacttggag

SEQ ID NO: 89929 - DNA, 25 bp, S. pombe
gaagcccttcctgaaattagacgtc

SEQ ID NO: 89930 - DNA, 25 bp, S. pombe
gaagctctgtctataggtttaccaa

SEQ ID NO: 89931 - DNA, 25 bp, S. pombe
gaacgagtgcagttctacgccaatc

SEQ ID NO: 89932 - DNA, 25 bp, S. pombe
gaaccctgagtttacgacaagaatt

SEQ ID NO: 89933 - DNA, 25 bp, S. pombe
gaagcccaattttacctaggcaagc

SEQ ID NO: 89934 - DNA, 25 bp, S. pombe
gaagcagcccgtttaattagtgaag

SEQ ID NO: 89935 - DNA, 25 bp, S. pombe
gaacgcaaagcttccagtcaggtaa

SEQ ID NO: 89936 - DNA, 25 bp, S. pombe
gaagccggcctcaaaatactaaaca

SEQ ID NO: 89937 - DNA, 25 bp, S. pombe
gaagctgtgctcctacgggattaat

SEQ ID NO: 89938 - DNA, 25 bp, S. pombe
gaagcttcacctaacagcgatgctc

SEQ ID NO: 89939 - DNA, 25 bp, S. pombe
gaagcattacttgaccgttcctaag

SEQ ID NO: 89940 - DNA, 25 bp, S. pombe
gaagcaaagcctgagcctgtaccag

SEQ ID NO: 89941 - DNA, 25 bp, S. pombe
gaagaagcaaacgagcctgttcaag

SEQ ID NO: 89942 - DNA, 25 bp, S. pombe
gaagaagtatgatgcctgctttaac

SEQ ID NO: 89943 - DNA, 25 bp, S. pombe
gaagcattattgtcgctcggttgaa

SEQ ID NO: 89944 - DNA, 25 bp, S. pombe
gaacgaattaactgccatcaaaggt

SEQ ID NO: 89945 - DNA, 25 bp, S. pombe
gaagctgctattaccgaagaatccg

SEQ ID NO: 89946 - DNA, 25 bp, S. pombe
gaagctgctgctgctgcacagaaaa

SEQ ID NO: 89947 - DNA, 25 bp, S. pombe
gaagctgctgcaaatacgaaggaca

SEQ ID NO: 89948 - DNA, 25 bp, S. pombe
gaagctatctctttctgagtatcga

SEQ ID NO: 89949 - DNA, 25 bp, S. pombe
gaagcgactctgttcgtgttggcag

SEQ ID NO: 89950 - DNA, 25 bp, S. pombe
gaagctacttcatggttattgaacc

SEQ ID NO: 89951 - DNA, 25 bp, S. pombe
gaagcttcgtactgcatttgctaat

SEQ ID NO: 89952 - DNA, 25 bp, S. pombe
gaacgatggtgagcgcacgtcgaat

SEQ ID NO: 89953 - DNA, 25 bp, S. pombe
gaagcacgtcttgaattattatgtc

SEQ ID NO: 89954 - DNA, 25 bp, S. pombe
gaagctctgcaaaaatccgttggta

SEQ ID NO: 89955 - DNA, 25 bp, S. pombe
gaagctgaacacgtcgcggaacatc

SEQ ID NO: 89956 - DNA, 25 bp, S. pombe
gaagctcgattatgtcttggcactt

SEQ ID NO: 89957 - DNA, 25 bp, S. pombe
gaagcccttttcgttggacatttcg

SEQ ID NO: 89958 - DNA, 25 bp, S. pombe
gaagccagttttgttggtgcctttc

SEQ ID NO: 89959 - DNA, 25 bp, S. pombe
gaagcggctgaagcgttcttggttc

SEQ ID NO: 89960 - DNA, 25 bp, S. pombe
gaagctggtgcggaattccttgcct

SEQ ID NO: 89961 - DNA, 25 bp, S. pombe
gaagcatgcctcctaagacaccatt

SEQ ID NO: 89962 - DNA, 25 bp, S. pombe
gaagcttcatctactaaaccatctg

SEQ ID NO: 89963 - DNA, 25 bp, S. pombe
gaagctcagctttctaaactcatga

SEQ ID NO: 89964 - DNA, 25 bp, S. pombe
gaagcatactctttattacgtcaat

SEQ ID NO: 89965 - DNA, 25 bp, S. pombe
gaagcatccgcattttcagaagact

SEQ ID NO: 89966 - DNA, 25 bp, S. pombe
gaagctcatccatttccaaatattg

SEQ ID NO: 89967 - DNA, 25 bp, S. pombe
gaagcttctcgtaagtacatctttg

SEQ ID NO: 89968 - DNA, 25 bp, S. pombe
gaagcgtgcccgatatgatacattt

SEQ ID NO: 89969 - DNA, 25 bp, S. pombe
gaagcactactgaggctgctcaact

SEQ ID NO: 89970 - DNA, 25 bp, S. pombe
gaacactagcatagtgcctgcacat

SEQ ID NO: 89971 - DNA, 25 bp, S. pombe
gaagaatgtgtcgtcccagctgcca

SEQ ID NO: 89972 - DNA, 25 bp, S. pombe
gaagcattcggataccacaactcaa

SEQ ID NO: 89973 - DNA, 25 bp, S. pombe
gaagcaatccgtgtctatcttgatc

SEQ ID NO: 89974 - DNA, 25 bp, S. pombe
gaagaatccttctattatgctttta

SEQ ID NO: 89975 - DNA, 25 bp, S. pombe
gaagctagactttcttcactttcta

SEQ ID NO: 89976 - DNA, 25 bp, S. pombe
gaagcaaattgcctttcaccgaaaa

SEQ ID NO: 89977 - DNA, 25 bp, S. pombe
gaagcaggatatgttcgccccaaaa

SEQ ID NO: 89978 - DNA, 25 bp, S. pombe
gaagcaagtctacatacctttatgg

SEQ ID NO: 89979 - DNA, 25 bp, S. pombe
gaagcgccttcggatatagtcttta

SEQ ID NO: 89980 - DNA, 25 bp, S. pombe
gaagcagccgtcgaagtttgttgat

SEQ ID NO: 89981 - DNA, 25 bp, S. pombe
gaagcactcttctatgttgttttat

SEQ ID NO: 89982 - DNA, 25 bp, S. pombe
gaagcacccttcattcgtttcaaat

SEQ ID NO: 89983 - DNA, 25 bp, S. pombe
gaaccgttagacacacctgagcagg

SEQ ID NO: 89984 - DNA, 25 bp, S. pombe
gaactttggcgctctcaaggttaaa

SEQ ID NO: 89985 - DNA, 25 bp, S. pombe
gaagcgttcggacctatagcagcat

SEQ ID NO: 89986 - DNA, 25 bp, S. pombe
gaagctttgcggtccattgattgat

SEQ ID NO: 89987 - DNA, 25 bp, S. pombe
gaagcaatctacctccattagtgag

SEQ ID NO: 89988 - DNA, 25 bp, S. pombe
gaagcaactaatcccattctacgaa

SEQ ID NO: 89989 - DNA, 25 bp, S. pombe
gaagcactctactccatgttgattt

SEQ ID NO: 89990 - DNA, 25 bp, S. pombe
gaagcggcatgggattcgttcctct

SEQ ID NO: 89991 - DNA, 25 bp, S. pombe
gaacctgagggtgagttcgagctca

SEQ ID NO: 89992 - DNA, 25 bp, S. pombe
gaacctcttggtgagttccaactta

SEQ ID NO: 89993 - DNA, 25 bp, S. pombe
gaagcctgatgatgataccgtctat

SEQ ID NO: 89994 - DNA, 25 bp, S. pombe
gaagctgtcgaatatactgttccta

SEQ ID NO: 89995 - DNA, 25 bp, S. pombe
gaacgatcggtcaatacgtctgtgt

SEQ ID NO: 89996 - DNA, 25 bp, S. pombe
gaagcgccgggcaaaatatctggtg

SEQ ID NO: 89997 - DNA, 25 bp, S. pombe
gaagctgtcactttcaaattctggt

SEQ ID NO: 89998 - DNA, 25 bp, S. pombe
gaagccttctgagggaattgtttcc

SEQ ID NO: 89999 - DNA, 25 bp, S. pombe
gaagcacttttcctttcgcatgtgt

SEQ ID NO: 90000 - DNA, 25 bp, S. pombe
gaagcattatctgtggtacgtcaaa

SEQ ID NO: 90001 - DNA, 25 bp, S. pombe
gaacttatacgtccttcttcaactt

SEQ ID NO: 90002 - DNA, 25 bp, S. pombe
gaagctacgcagttgtacactccga

SEQ ID NO: 90003 - DNA, 25 bp, S. pombe
gaagctaccttattgacaatccgaa

SEQ ID NO: 90004 - DNA, 25 bp, S. pombe
gaagctattttattggcatgtccac

SEQ ID NO: 90005 - DNA, 25 bp, S. pombe
gaagcatcagccaatcttgagagat

SEQ ID NO: 90006 - DNA, 25 bp, S. pombe
gaagctcagcatgcctattcagcag

SEQ ID NO: 90007 - DNA, 25 bp, S. pombe
gaagctacattcctttcgaaattgc

SEQ ID NO: 90008 - DNA, 25 bp, S. pombe
gaagcaggccaccaagaagtccaaa

SEQ ID NO: 90009 - DNA, 25 bp, S. pombe
gaagctagaaaacaacaactcgaaa

SEQ ID NO: 90010 - DNA, 25 bp, S. pombe
gaagcctttgaacaatcgactccaa

SEQ ID NO: 90011 - DNA, 25 bp, S. pombe
gaagctgaatactggccgatgatat

SEQ ID NO: 90012 - DNA, 25 bp, S. pombe
gaagcgaccatttgagcctgaattt

SEQ ID NO: 90013 - DNA, 25 bp, S. pombe
gaactaagcacttatgtcgaaagtt

SEQ ID NO: 90014 - DNA, 25 bp, S. pombe
gaagctccagttatcgctcaaacga

SEQ ID NO: 90015 - DNA, 25 bp, S. pombe
gaagctctcaggtttggtgcaaaaa

SEQ ID NO: 90016 - DNA, 25 bp, S. pombe
gaagcccaggcatttgctgctgaaa

SEQ ID NO: 90017 - DNA, 25 bp, S. pombe
gaaccatcgttcttcctaataactc

SEQ ID NO: 90018 - DNA, 25 bp, S. pombe
gaagcctcggtggtctagaatcaac

SEQ ID NO: 90019 - DNA, 25 bp, S. pombe
gaagctcaggttgtcaagattcccc

SEQ ID NO: 90020 - DNA, 25 bp, S. pombe
gaagctagtgactcagaggctgcta

SEQ ID NO: 90021 - DNA, 25 bp, S. pombe
gaacaccatcagtgcgactggctat

SEQ ID NO: 90022 - DNA, 25 bp, S. pombe
gaagctcagatgattcccgatgtcc

SEQ ID NO: 90023 - DNA, 25 bp, S. pombe
gaagctcgtggtggccctatggata

SEQ ID NO: 90024 - DNA, 25 bp, S. pombe
gaagccgctcgtgccaatgatatta

SEQ ID NO: 90025 - DNA, 25 bp, S. pombe
gaagccatgcttcgtaaagttccag

SEQ ID NO: 90026 - DNA, 25 bp, S. pombe
gaagcctttggcaatcatcgttccc

SEQ ID NO: 90027 - DNA, 25 bp, S. pombe
gaagctcttcttcatcctgtacata

SEQ ID NO: 90028 - DNA, 25 bp, S. pombe
gaagcttcatgccaagcgttctcaa

SEQ ID NO: 90029 - DNA, 25 bp, S. pombe
gaagctttgaagtctttctctgaga

SEQ ID NO: 90030 - DNA, 25 bp, S. pombe
gaactcaaagttcttcctggtcaag

SEQ ID NO: 90031 - DNA, 25 bp, S. pombe
gaagctaacattattcctcctttaa

SEQ ID NO: 90032 - DNA, 25 bp, S. pombe
gaagctgacaacgtttactctattt

SEQ ID NO: 90033 - DNA, 25 bp, S. pombe
gaagcgtcgattccagttgtgcaga

SEQ ID NO: 90034 - DNA, 25 bp, S. pombe
gaagctgttgatgccaagtggaatt

SEQ ID NO: 90035 - DNA, 25 bp, S. pombe
gaagcagtctcaatctccaaatgga

SEQ ID NO: 90036 - DNA, 25 bp, S. pombe
gaagctttgagtgcgctcattcgat

SEQ ID NO: 90037 - DNA, 25 bp, S. pombe
gaagctattgtagccgctcttgatc

SEQ ID NO: 90038 - DNA, 25 bp, S. pombe
gaagctataattgccgcagctgcca

SEQ ID NO: 90039 - DNA, 25 bp, S. pombe
gaagcttgaatcgtctggctctcaa

SEQ ID NO: 90040 - DNA, 25 bp, S. pombe
gaagctccagctcatgcattgctta

SEQ ID NO: 90041 - DNA, 25 bp, S. pombe
gaagctttgctcttcttgcttgaag

SEQ ID NO: 90042 - DNA, 25 bp, S. pombe
gaagcctattcattgggcatggaat

SEQ ID NO: 90043 - DNA, 25 bp, S. pombe
gaagctgctaaagtgtcctatagac

SEQ ID NO: 90044 - DNA, 25 bp, S. pombe
gaagcgtatacaggtcagccatgga

SEQ ID NO: 90045 - DNA, 25 bp, S. pombe
gaagctgcctaccagaatgctcaga

SEQ ID NO: 90046 - DNA, 25 bp, S. pombe
gaagctgctcaatttttacctgctg

SEQ ID NO: 90047 - DNA, 25 bp, S. pombe
gaagctctccacagtctatgtctag

SEQ ID NO: 90048 - DNA, 25 bp, S. pombe
gaagcttctactcgtactgtcatac

SEQ ID NO: 90049 - DNA, 25 bp, S. pombe
gaagctctcgttatgatcgactcta

SEQ ID NO: 90050 - DNA, 25 bp, S. pombe
gaagcctgcacttttgcatagtcgc

SEQ ID NO: 90051 - DNA, 25 bp, S. pombe
gaagcttgccaaacctagctgcaaa

SEQ ID NO: 90052 - DNA, 25 bp, S. pombe
gaagcttgcttgttctctattcaat

SEQ ID NO: 90053 - DNA, 25 bp, S. pombe
gaagccgcattttgcttatgccttc

SEQ ID NO: 90054 - DNA, 25 bp, S. pombe
gaagcggcatttggctctaatgttt

SEQ ID NO: 90055 - DNA, 25 bp, S. pombe
gaagcttattcctttttctaaacag

SEQ ID NO: 90056 - DNA, 25 bp, S. pombe
gaagccgattcccttttcgaagagg

SEQ ID NO: 90057 - DNA, 25 bp, S. pombe
gaagctgctgactccttttcgaaat

SEQ ID NO: 90058 - DNA, 25 bp, S. pombe
gaagctgctgaaccttttttgacat

SEQ ID NO: 90059 - DNA, 25 bp, S. pombe
gaagcgtaccgatcatctggaggaa

SEQ ID NO: 90060 - DNA, 25 bp, S. pombe
gaagcgaagcccgatcaaattgaca

SEQ ID NO: 90061 - DNA, 25 bp, S. pombe
gaagctatcgctgtgggtattgcac

SEQ ID NO: 90062 - DNA, 25 bp, S. pombe
gaagctattgttcgtggctatatca

SEQ ID NO: 90063 - DNA, 25 bp, S. pombe
gaagctgatttacgtgcctataccc

SEQ ID NO: 90064 - DNA, 25 bp, S. pombe
gaagctgtattctgtctctatactc

SEQ ID NO: 90065 - DNA, 25 bp, S. pombe
gaacggacacgtcgtcatcaagggc

SEQ ID NO: 90066 - DNA, 25 bp, S. pombe
gaagctggacacatggttcctttca

SEQ ID NO: 90067 - DNA, 25 bp, S. pombe
gaagctagtcacatggttccatacg

SEQ ID NO: 90068 - DNA, 25 bp, S. pombe
gaagcgtctattgatgcgattacac

SEQ ID NO: 90069 - DNA, 25 bp, S. pombe
gaagctgttgctaatcgaccaagca

SEQ ID NO: 90070 - DNA, 25 bp, S. pombe
gaagctgttgctcacgatggccgtt

SEQ ID NO: 90071 - DNA, 25 bp, S. pombe
gaacgtgcacgccagtatggtcgta

SEQ ID NO: 90072 - DNA, 25 bp, S. pombe
gaacgcaatggcgatatgttgccct

SEQ ID NO: 90073 - DNA, 25 bp, S. pombe
gaagcgcacattagcatctggtctc

SEQ ID NO: 90074 - DNA, 25 bp, S. pombe
gaagctatccatgtcgatttcaact

SEQ ID NO: 90075 - DNA, 25 bp, S. pombe
gaagcttttcgtcgtttgcaaatcc

SEQ ID NO: 90076 - DNA, 25 bp, S. pombe
gaagctcgcttcagcattttgcaaa

SEQ ID NO: 90077 - DNA, 25 bp, S. pombe
gaagctgagtggtctctttttaaaa

SEQ ID NO: 90078 - DNA, 25 bp, S. pombe
gaagctgaatcttgactttcttaaa

SEQ ID NO: 90079 - DNA, 25 bp, S. pombe
gaagctagttctcttcaagctcaag

SEQ ID NO: 90080 - DNA, 25 bp, S. pombe
gaagctgtgtatccaccgaagtcaa

SEQ ID NO: 90081 - DNA, 25 bp, S. pombe
gaagctggcatacccgagagacgat

SEQ ID NO: 90082 - DNA, 25 bp, S. pombe
gaagcctttcgagatttctacatca

SEQ ID NO: 90083 - DNA, 25 bp, S. pombe
gaagcgttatcgttttttatcgcaa

SEQ ID NO: 90084 - DNA, 25 bp, S. pombe
gaagctggtcttcttattcccagaa

SEQ ID NO: 90085 - DNA, 25 bp, S. pombe
gaagctggtcttcaaatgtctttgg

SEQ ID NO: 90086 - DNA, 25 bp, S. pombe
gaagcgatggtttctatcacccagc

SEQ ID NO: 90087 - DNA, 25 bp, S. pombe
gaagctgaagactctggagcccaag

SEQ ID NO: 90088 - DNA, 25 bp, S. pombe
gaagccgccgagtctcaactcgaag

SEQ ID NO: 90089 - DNA, 25 bp, S. pombe
gaacgccgatgatgacacccgaaga

SEQ ID NO: 90090 - DNA, 25 bp, S. pombe
gaagctcaagatttcattcccggaa

SEQ ID NO: 90091 - DNA, 25 bp, S. pombe
gaactggtcttactaagcaccctta

SEQ ID NO: 90092 - DNA, 25 bp, S. pombe
gaagctttcgtttacgatcctctta

SEQ ID NO: 90093 - DNA, 25 bp, S. pombe
gaagcgttgtcgctacaagcgcttt

SEQ ID NO: 90094 - DNA, 25 bp, S. pombe
gaagcgttgcaagcatttcgagctt

SEQ ID NO: 90095 - DNA, 25 bp, S. pombe
gaagcgtagtgagctctccgatgat

SEQ ID NO: 90096 - DNA, 25 bp, S. pombe
gaagcctagtcaatcgaagtgccgc

SEQ ID NO: 90097 - DNA, 25 bp, S. pombe
gaagccttgtccagatactacagtt

SEQ ID NO: 90098 - DNA, 25 bp, S. pombe
gaacccattctgctgagactgatcg

SEQ ID NO: 90099 - DNA, 25 bp, S. pombe
gaagctctaattcctagtcttttgg

SEQ ID NO: 90100 - DNA, 25 bp, S. pombe
gaagctgttttttcgctttttggat

SEQ ID NO: 90101 - DNA, 25 bp, S. pombe
gaagccctacccgttttgtagatga

SEQ ID NO: 90102 - DNA, 25 bp, S. pombe
gaaccctacctttattcgttgtgca

SEQ ID NO: 90103 - DNA, 25 bp, S. pombe
gaagcgcctaagtttagtatccttt

SEQ ID NO: 90104 - DNA, 25 bp, S. pombe
gaagctcccaatactcgtgaagcat

SEQ ID NO: 90105 - DNA, 25 bp, S. pombe
gaagccgactttgctgtacaaatct

SEQ ID NO: 90106 - DNA, 25 bp, S. pombe
gaagcccttcataattggttggttg

SEQ ID NO: 90107 - DNA, 25 bp, S. pombe
gaagcgcatttatgtttttctctgg

SEQ ID NO: 90108 - DNA, 25 bp, S. pombe
gaagctctttgcagattattgttcg

SEQ ID NO: 90109 - DNA, 25 bp, S. pombe
gaactcctcgtgcattatggtacat

SEQ ID NO: 90110 - DNA, 25 bp, S. pombe
gaagctcctctgatcagttcagtaa

SEQ ID NO: 90111 - DNA, 25 bp, S. pombe
gaagccaactcttcagctgacgaaa

SEQ ID NO: 90112 - DNA, 25 bp, S. pombe
gaagctgaactttctgctgaagaga

SEQ ID NO: 90113 - DNA, 25 bp, S. pombe
gaagctgatcccaattctcaaaaag

SEQ ID NO: 90114 - DNA, 25 bp, S. pombe
gaagctgctccagtaatgctgaaaa

SEQ ID NO: 90115 - DNA, 25 bp, S. pombe
gaagctgccaatttgtggaccgatc

SEQ ID NO: 90116 - DNA, 25 bp, S. pombe
gaagctgccgaatttgttcacgtaa

SEQ ID NO: 90117 - DNA, 25 bp, S. pombe
gaagctgaaaatactatgcccttca

SEQ ID NO: 90118 - DNA, 25 bp, S. pombe
gaacgattcccaattccgatgtaat

SEQ ID NO: 90119 - DNA, 25 bp, S. pombe
gaacgtattccttttcgtagctggg

SEQ ID NO: 90120 - DNA, 25 bp, S. pombe
gaacgttgttttgtcgaagcctcga

SEQ ID NO: 90121 - DNA, 25 bp, S. pombe
gaagcctttgtttttaatactgtcg

SEQ ID NO: 90122 - DNA, 25 bp, S. pombe
gaagcggtcgttactataaggttag

SEQ ID NO: 90123 - DNA, 25 bp, S. pombe
gaagcgttctgaatccgatgtagag

SEQ ID NO: 90124 - DNA, 25 bp, S. pombe
gaagcgcatttgaatcccgtgaaaa

SEQ ID NO: 90125 - DNA, 25 bp, S. pombe
gaagctgcatctttcattccagtat

SEQ ID NO: 90126 - DNA, 25 bp, S. pombe
gaacccgggctcaaattggtttgtg

SEQ ID NO: 90127 - DNA, 25 bp, S. pombe
gaacccgtgggcattgtttattctc

SEQ ID NO: 90128 - DNA, 25 bp, S. pombe
gaactgtcggcaaagcttacccaac

SEQ ID NO: 90129 - DNA, 25 bp, S. pombe
gaacccggtgtgtcaaatattcctg

SEQ ID NO: 90130 - DNA, 25 bp, S. pombe
gaacccggcgttgaatattcttgcg

SEQ ID NO: 90131 - DNA, 25 bp, S. pombe
gaaccaattagtgcacaaatgggaa

SEQ ID NO: 90132 - DNA, 25 bp, S. pombe
gaacgatgagtgtcgccgtcttaaa

SEQ ID NO: 90133 - DNA, 25 bp, S. pombe
gaacgactttcgtgtcttcaggcaa

SEQ ID NO: 90134 - DNA, 25 bp, S. pombe
gaacctccacattatgattccgacg

SEQ ID NO: 90135 - DNA, 25 bp, S. pombe
gaagcctcgcaagttcaaagtacta

SEQ ID NO: 90136 - DNA, 25 bp, S. pombe
gaagccctgcatacccataaaatta

SEQ ID NO: 90137 - DNA, 25 bp, S. pombe
gaagcccgtattgctagtgtcatgg

SEQ ID NO: 90138 - DNA, 25 bp, S. pombe
gaactagctttctggccggttgatc

SEQ ID NO: 90139 - DNA, 25 bp, S. pombe
gaagcgtcttattcatcgtggtaag

SEQ ID NO: 90140 - DNA, 25 bp, S. pombe
gaagcgcctcttacaattgttacag

SEQ ID NO: 90141 - DNA, 25 bp, S. pombe
gaagccgacttgattcgggatcaac

SEQ ID NO: 90142 - DNA, 25 bp, S. pombe
gaacgttaaagaacaggagcacctt

SEQ ID NO: 90143 - DNA, 25 bp, S. pombe
gaaccttctgatttgatcggacctg

SEQ ID NO: 90144 - DNA, 25 bp, S. pombe
gaagccatcaaatgttgacgaacaa

SEQ ID NO: 90145 - DNA, 25 bp, S. pombe
gactccgggccgatcttagacaaag

SEQ ID NO: 90146 - DNA, 25 bp, S. pombe
gaaccgttaagtttctctttgccag

SEQ ID NO: 90147 - DNA, 25 bp, S. pombe
gaaccgggaagtttcattgtcattc

SEQ ID NO: 90148 - DNA, 25 bp, S. pombe
gaagccccgagatgttttgatcacc

SEQ ID NO: 90149 - DNA, 25 bp, S. pombe
gaagccattcaagcatctaatccta

SEQ ID NO: 90150 - DNA, 25 bp, S. pombe
gaagccttaggttttcatccaaatg

SEQ ID NO: 90151 - DNA, 25 bp, S. pombe
gaagcgcgaaagcacatattcctga

SEQ ID NO: 90152 - DNA, 25 bp, S. pombe
gaacctgtcattcatttgaacgtga

SEQ ID NO: 90153 - DNA, 25 bp, S. pombe
gaacctgccaacttagtaccgttag

SEQ ID NO: 90154 - DNA, 25 bp, S. pombe
gaagcgcccagcgtattagcgatga

SEQ ID NO: 90155 - DNA, 25 bp, S. pombe
gaagcgtatgctctacatcgttgat

SEQ ID NO: 90156 - DNA, 25 bp, S. pombe
gaagcccactataagcttgcactag

SEQ ID NO: 90157 - DNA, 25 bp, S. pombe
gaagcgcctgattctgctgatggaa

SEQ ID NO: 90158 - DNA, 25 bp, S. pombe
gaagcggctatacgtgagcatcaaa

SEQ ID NO: 90159 - DNA, 25 bp, S. pombe
gaagctggtgctacccatatcgata

SEQ ID NO: 90160 - DNA, 25 bp, S. pombe
gaagctgttgctactgttctcaata

SEQ ID NO: 90161 - DNA, 25 bp, S. pombe
gaagcgtccttcttttcatgacaaa

SEQ ID NO: 90162 - DNA, 25 bp, S. pombe
gaaccgtcttcttctttaacaaatg

SEQ ID NO: 90163 - DNA, 25 bp, S. pombe
gaaccaacctggatctttatcattg

SEQ ID NO: 90164 - DNA, 25 bp, S. pombe
gaaccaagcgcattctcgttctaaa

SEQ ID NO: 90165 - DNA, 25 bp, S. pombe
gaagcgcctttatgattgtgattta

SEQ ID NO: 90166 - DNA, 25 bp, S. pombe
gaacctgtttttgtcattggagcct

SEQ ID NO: 90167 - DNA, 25 bp, S. pombe
gaacgcgctcgtattttgggaactc

SEQ ID NO: 90168 - DNA, 25 bp, S. pombe
gaaccatgcacgtgtcattagggaa

SEQ ID NO: 90169 - DNA, 25 bp, S. pombe
gaacgcctagtcaaagttttcaaca

SEQ ID NO: 90170 - DNA, 25 bp, S. pombe
gaagcgggaggtgatcctcatatta

SEQ ID NO: 90171 - DNA, 25 bp, S. pombe
gaacatgctggagctgaagccatat

SEQ ID NO: 90172 - DNA, 25 bp, S. pombe
gaagcctaaagcaaagcctacgtta

SEQ ID NO: 90173 - DNA, 25 bp, S. pombe
gaacgaaagaaatctcatgctaatg

SEQ ID NO: 90174 - DNA, 25 bp, S. pombe
gaaccacttggagtcttatgcttac

SEQ ID NO: 90175 - DNA, 25 bp, S. pombe
gaagcccgatgtcttgttcattaaa

SEQ ID NO: 90176 - DNA, 25 bp, S. pombe
gaagcggctgatattgtttccaaag

SEQ ID NO: 90177 - DNA, 25 bp, S. pombe
gaagccctacagaagttggacaatt

SEQ ID NO: 90178 - DNA, 25 bp, S. pombe
gaagccacttcagctttggacacta

SEQ ID NO: 90179 - DNA, 25 bp, S. pombe
gaagcgactctagcttttgcatcaa

SEQ ID NO: 90180 - DNA, 25 bp, S. pombe
gaagcgttggctagagttcgcgcaa

SEQ ID NO: 90181 - DNA, 25 bp, S. pombe
gaacctggcgacatgctttatttac

SEQ ID NO: 90182 - DNA, 25 bp, S. pombe
gaagcctagcgatttggttcatatc

SEQ ID NO: 90183 - DNA, 25 bp, S. pombe
gaacctcaaggatgggactcgtact

SEQ ID NO: 90184 - DNA, 25 bp, S. pombe
gaagccggtgtattgttatatccca

SEQ ID NO: 90185 - DNA, 25 bp, S. pombe
gaaccaagacctttgtcggtgacct

SEQ ID NO: 90186 - DNA, 25 bp, S. pombe
gaaccgatatcctgttgttatgcat

SEQ ID NO: 90187 - DNA, 25 bp, S. pombe
gaaccaattatcgttgtcctacttg

SEQ ID NO: 90188 - DNA, 25 bp, S. pombe
gaagcgaattctcctattacaactg

SEQ ID NO: 90189 - DNA, 25 bp, S. pombe
gaaccagttcttattccagttaagc

SEQ ID NO: 90190 - DNA, 25 bp, S. pombe
gaaccacttcctgattcgcttttaa

SEQ ID NO: 90191 - DNA, 25 bp, S. pombe
gaacaacattttctattccaaccgt

SEQ ID NO: 90192 - DNA, 25 bp, S. pombe
gaacctttgcttctttcaaagcctt

SEQ ID NO: 90193 - DNA, 25 bp, S. pombe
gaacgtttgccctttatggaggcct

SEQ ID NO: 90194 - DNA, 25 bp, S. pombe
gaacttttgggatttcttgggcgat

SEQ ID NO: 90195 - DNA, 25 bp, S. pombe
gaagccaacgttcactccagaagag

SEQ ID NO: 90196 - DNA, 25 bp, S. pombe
gaagccaacgtttcaatccctaaag

SEQ ID NO: 90197 - DNA, 25 bp, S. pombe
gaaccaacagtttcgtcgtgtcaga

SEQ ID NO: 90198 - DNA, 25 bp, S. pombe
gaagcctacacaaatcgcattggta

SEQ ID NO: 90199 - DNA, 25 bp, S. pombe
gaacgtgtcggtcaaagatttgctg

SEQ ID NO: 90200 - DNA, 25 bp, S. pombe
gaacggctcggcatcagaagaaatt

SEQ ID NO: 90201 - DNA, 25 bp, S. pombe
gaagcgctttcagtcgctcaatcaa

SEQ ID NO: 90202 - DNA, 25 bp, S. pombe
gaacatgctataaggacaccagtct

SEQ ID NO: 90203 - DNA, 25 bp, S. pombe
gaagccattttattgtctactctat

SEQ ID NO: 90204 - DNA, 25 bp, S. pombe
gaagccgatatttacgctcatgcca

SEQ ID NO: 90205 - DNA, 25 bp, S. pombe
gaagccggtattggtggccttgaaa

SEQ ID NO: 90206 - DNA, 25 bp, S. pombe
gaagccttgccgaattgtgtcttgg

SEQ ID NO: 90207 - DNA, 25 bp, S. pombe
gaagccatcgaagcacttgagcaat

SEQ ID NO: 90208 - DNA, 25 bp, S. pombe
gaaaatcagaaaccaagagtgtacg

SEQ ID NO: 90209 - DNA, 25 bp, S. pombe
gaaaaaacgcgtgcgtcgtctcaaa

SEQ ID NO: 90210 - DNA, 25 bp, S. pombe
gaaaaaatcggcctgcgctttaaag

SEQ ID NO: 90211 - DNA, 25 bp, S. pombe
gaaaatccacggttccttaatcagc

SEQ ID NO: 90212 - DNA, 25 bp, S. pombe
gaacctccaaagtacacttcaacct

SEQ ID NO: 90213 - DNA, 25 bp, S. pombe
gaagccctgacaaaaaatcgaccca

SEQ ID NO: 90214 - DNA, 25 bp, S. pombe
gaaaatctagcgaaagtccatccag

SEQ ID NO: 90215 - DNA, 25 bp, S. pombe
gaacgtgcaatcactggccaacctg

SEQ ID NO: 90216 - DNA, 25 bp, S. pombe
gaacgagcaattgctgcagcaccat

SEQ ID NO: 90217 - DNA, 25 bp, S. pombe
gaagccttggatgcagacgacatgt

SEQ ID NO: 90218 - DNA, 25 bp, S. pombe
gaagccactatacctcagtctttag

SEQ ID NO: 90219 - DNA, 25 bp, S. pombe
gaaccacacactacttttctttggg

SEQ ID NO: 90220 - DNA, 25 bp, S. pombe
gaacggccacaagttattcttctgc

SEQ ID NO: 90221 - DNA, 25 bp, S. pombe
gaacgccgaaacttatttgcaccgc

SEQ ID NO: 90222 - DNA, 25 bp, S. pombe
gaactcttgatttctggtttgccag

SEQ ID NO: 90223 - DNA, 25 bp, S. pombe
gaacgcttgatcacgtgtcaccagg

SEQ ID NO: 90224 - DNA, 25 bp, S. pombe
gaactttgggtgacacactcggcac

SEQ ID NO: 90225 - DNA, 25 bp, S. pombe
gaagccatgtttttatctcgtgtag

SEQ ID NO: 90226 - DNA, 25 bp, S. pombe
gaaccactggttttgcattgattta

SEQ ID NO: 90227 - DNA, 25 bp, S. pombe
gaagcccgagtttcagcattgtttg

SEQ ID NO: 90228 - DNA, 25 bp, S. pombe
gaacgcgatatgtcggtacctgttt

SEQ ID NO: 90229 - DNA, 25 bp, S. pombe
gaaccagcttcacgagctacgttat

SEQ ID NO: 90230 - DNA, 25 bp, S. pombe
gaacgattattcctgaagctgctcc

SEQ ID NO: 90231 - DNA, 25 bp, S. pombe
gaacgctcatcatcggaagctgctg

SEQ ID NO: 90232 - DNA, 25 bp, S. pombe
gaacgagcattctgatcaatattta

SEQ ID NO: 90233 - DNA, 25 bp, S. pombe
gaacggttcgtcttcaactatggga

SEQ ID NO: 90234 - DNA, 25 bp, S. pombe
gaacgcgagtccgagtcaatattga

SEQ ID NO: 90235 - DNA, 25 bp, S. pombe
gaagccgaaaccaaatgccaacttt

SEQ ID NO: 90236 - DNA, 25 bp, S. pombe
gaacctaataccgaagacctctctt

SEQ ID NO: 90237 - DNA, 25 bp, S. pombe
gaacctttacgtgatgctacctttg

SEQ ID NO: 90238 - DNA, 25 bp, S. pombe
gaactgacaaaccagcctttttctg

SEQ ID NO: 90239 - DNA, 25 bp, S. pombe
gaacgaaccatccttctgcaatcag

SEQ ID NO: 90240 - DNA, 25 bp, S. pombe
gaagcctacgacatgattcaatcca

SEQ ID NO: 90241 - DNA, 25 bp, S. pombe
gaacctacccacattgagatccaag

SEQ ID NO: 90242 - DNA, 25 bp, S. pombe
gaagccttgtttttggaatcatccc

SEQ ID NO: 90243 - DNA, 25 bp, S. pombe
gaagccttgtgtatgctcgagtatc

SEQ ID NO: 90244 - DNA, 25 bp, S. pombe
gaagccttatgaattctcgactaat

SEQ ID NO: 90245 - DNA, 25 bp, S. pombe
gaacagcttcagttgatgctcgatt

SEQ ID NO: 90246 - DNA, 25 bp, S. pombe
gaacgcattcgtagagccgctgaac

SEQ ID NO: 90247 - DNA, 25 bp, S. pombe
gaaccactgatcactgatgcttcat

SEQ ID NO: 90248 - DNA, 25 bp, S. pombe
gaactcgtatgatgcgatcgcttgg

SEQ ID NO: 90249 - DNA, 25 bp, S. pombe
gaaccagtagattcggccatgattg

SEQ ID NO: 90250 - DNA, 25 bp, S. pombe
gaaccagcttattcgacgcaggtgc

SEQ ID NO: 90251 - DNA, 25 bp, S. pombe
gaacctgaatttcgacttcctatgg

SEQ ID NO: 90252 - DNA, 25 bp, S. pombe
gaagccttatttaactctacatctg

SEQ ID NO: 90253 - DNA, 25 bp, S. pombe
gaagcctttattagatgctccaagt

SEQ ID NO: 90254 - DNA, 25 bp, S. pombe
gaacctctttgcgttgctgtcaaga

SEQ ID NO: 90255 - DNA, 25 bp, S. pombe
gaactctcaggaattttacggacga

SEQ ID NO: 90256 - DNA, 25 bp, S. pombe
gaactcggttttactactggtcaga

SEQ ID NO: 90257 - DNA, 25 bp, S. pombe
gaactctgggcttatcctttttcaa

SEQ ID NO: 90258 - DNA, 25 bp, S. pombe
gaacctaatgtgaatgtcccttcta

SEQ ID NO: 90259 - DNA, 25 bp, S. pombe
gaacgaagagtcattcccttctcac

SEQ ID NO: 90260 - DNA, 25 bp, S. pombe
gaacgattggactcttcggtatctg

SEQ ID NO: 90261 - DNA, 25 bp, S. pombe
gaacggttacagactttgcgatttt

SEQ ID NO: 90262 - DNA, 25 bp, S. pombe
gaacgtttaccacaagcactttctt

SEQ ID NO: 90263 - DNA, 25 bp, S. pombe
gaacgactcattgcccaaggttttt

SEQ ID NO: 90264 - DNA, 25 bp, S. pombe
gaaccctgattctttagagctactt

SEQ ID NO: 90265 - DNA, 25 bp, S. pombe
gaacgacattctatttaacggcata

SEQ ID NO: 90266 - DNA, 25 bp, S. pombe
gaacctaatacacttctcggtgaga

SEQ ID NO: 90267 - DNA, 25 bp, S. pombe
gaactggatcattagccgctggaaa

SEQ ID NO: 90268 - DNA, 25 bp, S. pombe
gaactctcccatgatctcaatttgg

SEQ ID NO: 90269 - DNA, 25 bp, S. pombe
gaacccagtcgtccacactgtggaa

SEQ ID NO: 90270 - DNA, 25 bp, S. pombe
gaacgtgttggtcgctactgctcca

SEQ ID NO: 90271 - DNA, 25 bp, S. pombe
gaacgctttgtgtctctatcaatcc

SEQ ID NO: 90272 - DNA, 25 bp, S. pombe
gaaccagttcaagtgcacatgcaag

SEQ ID NO: 90273 - DNA, 25 bp, S. pombe
gaaccatacacctctataccattag

SEQ ID NO: 90274 - DNA, 25 bp, S. pombe
gaacctcaatctatcattacctttg

SEQ ID NO: 90275 - DNA, 25 bp, S. pombe
gaacgaagacttgtgagcccagatg

SEQ ID NO: 90276 - DNA, 25 bp, S. pombe
gaaccggccatttttattcaacata

SEQ ID NO: 90277 - DNA, 25 bp, S. pombe
gaaccttcctttttctcctatgaag

SEQ ID NO: 90278 - DNA, 25 bp, S. pombe
gaacctatcctaacttccatcaaaa

SEQ ID NO: 90279 - DNA, 25 bp, S. pombe
gaaccttggtgtttgctcatagaga

SEQ ID NO: 90280 - DNA, 25 bp, S. pombe
gaaccactgtttttgtccatggaag

SEQ ID NO: 90281 - DNA, 25 bp, S. pombe
gaaccatggtattttcgccaagtca

SEQ ID NO: 90282 - DNA, 25 bp, S. pombe
gaacgaaaccacttgcctaatctgc

SEQ ID NO: 90283 - DNA, 25 bp, S. pombe
gaactgacaaccgtttggaccttat

SEQ ID NO: 90284 - DNA, 25 bp, S. pombe
gaagccaacagttatttcaccattt

SEQ ID NO: 90285 - DNA, 25 bp, S. pombe
gaaccaatggtgtttgtcccatctc

SEQ ID NO: 90286 - DNA, 25 bp, S. pombe
gaactcaagaaagaggtgctgcaca

SEQ ID NO: 90287 - DNA, 25 bp, S. pombe
gaacctgaggagattgtggagcaca

SEQ ID NO: 90288 - DNA, 25 bp, S. pombe
gaaccattagtgagtttccgcgaac

SEQ ID NO: 90289 - DNA, 25 bp, S. pombe
gaaccatttttgtatattccccaga

SEQ ID NO: 90290 - DNA, 25 bp, S. pombe
gaacgttgtcgtttctttgcaaaat

SEQ ID NO: 90291 - DNA, 25 bp, S. pombe
gaaccatcttggaatcttacagacg

SEQ ID NO: 90292 - DNA, 25 bp, S. pombe
gaacctgttactttgaacgccatat

SEQ ID NO: 90293 - DNA, 25 bp, S. pombe
gaaccttaagcattgatgacccaaa

SEQ ID NO: 90294 - DNA, 25 bp, S. pombe
gaaccatctgtgtcattaacgctaa

SEQ ID NO: 90295 - DNA, 25 bp, S. pombe
gaaccttttcttaaccgatatccag

SEQ ID NO: 90296 - DNA, 25 bp, S. pombe
gaaccggagttaattgccttgatgg

SEQ ID NO: 90297 - DNA, 25 bp, S. pombe
gaaccgtattatatgctacttgctg

SEQ ID NO: 90298 - DNA, 25 bp, S. pombe
gaactcgacactggaatcttgcact

SEQ ID NO: 90299 - DNA, 25 bp, S. pombe
gaactcatggccatgattcttgcct

SEQ ID NO: 90300 - DNA, 25 bp, S. pombe
gaactctggtctcgtagtggtgctc

SEQ ID NO: 90301 - DNA, 25 bp, S. pombe
gaactttatcatgtaattgccagac

SEQ ID NO: 90302 - DNA, 25 bp, S. pombe
gaactttgtttcaaatctcgcccgg

SEQ ID NO: 90303 - DNA, 25 bp, S. pombe
gaacctctgctcaacgaactcgtat

SEQ ID NO: 90304 - DNA, 25 bp, S. pombe
gaaccattgaagacacatcctgcag

SEQ ID NO: 90305 - DNA, 25 bp, S. pombe
gaacctgtcaatcacgatctgagct

SEQ ID NO: 90306 - DNA, 25 bp, S. pombe
gaacgctccaagcaaatctctttat

SEQ ID NO: 90307 - DNA, 25 bp, S. pombe
gaacccagcatgcaagatgattctt

SEQ ID NO: 90308 - DNA, 25 bp, S. pombe
gaaccacagttaacatttcttccta

SEQ ID NO: 90309 - DNA, 25 bp, S. pombe
gaaccggtgatccaactaatgtcga

SEQ ID NO: 90310 - DNA, 25 bp, S. pombe
gaacctggtctccaatgttaccaag

SEQ ID NO: 90311 - DNA, 25 bp, S. pombe
gaaccttctcctaatgttatctacg

SEQ ID NO: 90312 - DNA, 25 bp, S. pombe
gaaccttccggtaaatctctgagtg

SEQ ID NO: 90313 - DNA, 25 bp, S. pombe
gaacgttttctcattctttcaaagt

SEQ ID NO: 90314 - DNA, 25 bp, S. pombe
gaaccagtttctatctttgtcagtt

SEQ ID NO: 90315 - DNA, 25 bp, S. pombe
gaaccctattttatccgtagtctct

SEQ ID NO: 90316 - DNA, 25 bp, S. pombe
gaacccgtcatcaatatacccgttg

SEQ ID NO: 90317 - DNA, 25 bp, S. pombe
gaacccctacaaaatcgacttctgt

SEQ ID NO: 90318 - DNA, 25 bp, S. pombe
gaacctcaaccagtcgagacacatg

SEQ ID NO: 90319 - DNA, 25 bp, S. pombe
gaaccgttgctcctcatcagaaatt

SEQ ID NO: 90320 - DNA, 25 bp, S. pombe
gaacctgacctttgctcgcatagtt

SEQ ID NO: 90321 - DNA, 25 bp, S. pombe
gaacctgatcgtttgcttgttaaat

SEQ ID NO: 90322 - DNA, 25 bp, S. pombe
gacacctccgatcttttttcaattt

SEQ ID NO: 90323 - DNA, 25 bp, S. pombe
gaactttccgttatgtctttttgat

SEQ ID NO: 90324 - DNA, 25 bp, S. pombe
gaactttggcgtgttcttttctcct

SEQ ID NO: 90325 - DNA, 25 bp, S. pombe
gaactcgtgcagcttgaaagacatt

SEQ ID NO: 90326 - DNA, 25 bp, S. pombe
gaactcctgtcgacttaaatgcatg

SEQ ID NO: 90327 - DNA, 25 bp, S. pombe
gaacgccgccaacgatttagacaat

SEQ ID NO: 90328 - DNA, 25 bp, S. pombe
gaacgtgaggtttcttcagaactct

SEQ ID NO: 90329 - DNA, 25 bp, S. pombe
gaacgttcgtttttgcattatctgt

SEQ ID NO: 90330 - DNA, 25 bp, S. pombe
gaacctccgattattcatgtgtctt

SEQ ID NO: 90331 - DNA, 25 bp, S. pombe
gaaccttcgactaccgttattactg

SEQ ID NO: 90332 - DNA, 25 bp, S. pombe
gaaccttatccattccgactttttg

SEQ ID NO: 90333 - DNA, 25 bp, S. pombe
gaaccatttatgatctcgctttttt

SEQ ID NO: 90334 - DNA, 25 bp, S. pombe
gaacctttcgtgatcactgcaactt

SEQ ID NO: 90335 - DNA, 25 bp, S. pombe
gaactattacgatcccatgcaaatg

SEQ ID NO: 90336 - DNA, 25 bp, S. pombe
gaacgacgaggttcttctctctggt

SEQ ID NO: 90337 - DNA, 25 bp, S. pombe
gaacgtcgatgatgctttcttcggt

SEQ ID NO: 90338 - DNA, 25 bp, S. pombe
gaacctatatctctcgtatgcaacg

SEQ ID NO: 90339 - DNA, 25 bp, S. pombe
gaacctgcatttgtcgaagctgttg

SEQ ID NO: 90340 - DNA, 25 bp, S. pombe
gaacctatgcttgtgctatattggc

SEQ ID NO: 90341 - DNA, 25 bp, S. pombe
gaaccgtcttacgttttgcgtgcaa

SEQ ID NO: 90342 - DNA, 25 bp, S. pombe
gaaccgttcgagttggtattgtaca

SEQ ID NO: 90343 - DNA, 25 bp, S. pombe
gaaccttgttaatatttggcggcat

SEQ ID NO: 90344 - DNA, 25 bp, S. pombe
gaaccatttatttcctttggcggca

SEQ ID NO: 90345 - DNA, 25 bp, S. pombe
gaacctttattctctgataacgacg

SEQ ID NO: 90346 - DNA, 25 bp, S. pombe
gaacctattactgctcttaaccagc

SEQ ID NO: 90347 - DNA, 25 bp, S. pombe
gaactattattcgactacttcgcca

SEQ ID NO: 90348 - DNA, 25 bp, S. pombe
gaacagctggacttcgaaatcggac

SEQ ID NO: 90349 - DNA, 25 bp, S. pombe
gaacagcgtgatgcccaagcgttta

SEQ ID NO: 90350 - DNA, 25 bp, S. pombe
gaaatcggttcccaacgttagctat

SEQ ID NO: 90351 - DNA, 25 bp, S. pombe
gaaaccgtcgcaggactttttgctg

SEQ ID NO: 90352 - DNA, 25 bp, S. pombe
gaactccccgatgattttttgcgtg

SEQ ID NO: 90353 - DNA, 25 bp, S. pombe
gaacctccttatgtacctgatgatt

SEQ ID NO: 90354 - DNA, 25 bp, S. pombe
gaacccgttcaaggcatttgtgtgt

SEQ ID NO: 90355 - DNA, 25 bp, S. pombe
gaacctttcatcagagctttagact

SEQ ID NO: 90356 - DNA, 25 bp, S. pombe
gaacgccttatcagatggttagctt

SEQ ID NO: 90357 - DNA, 25 bp, S. pombe
gaacgacattcaacgagatttagct

SEQ ID NO: 90358 - DNA, 25 bp, S. pombe
gaaccctctgctatggaatattgct

SEQ ID NO: 90359 - DNA, 25 bp, S. pombe
gaacccttgtacctgttgattttga

SEQ ID NO: 90360 - DNA, 25 bp, S. pombe
gaacccttctgaacttttatctgat

SEQ ID NO: 90361 - DNA, 25 bp, S. pombe
gaacgcatgaaagctctcggtgtat

SEQ ID NO: 90362 - DNA, 25 bp, S. pombe
gaacgaatctatacttggactcact

SEQ ID NO: 90363 - DNA, 25 bp, S. pombe
gaacgcttctggattcttgtactta

SEQ ID NO: 90364 - DNA, 25 bp, S. pombe
gaacgcttgcatttttcatggtcgc

SEQ ID NO: 90365 - DNA, 25 bp, S. pombe
gaacctcatgcttttgtcgaacagt

SEQ ID NO: 90366 - DNA, 25 bp, S. pombe
gaaccgtgctactttcgatacaggc

SEQ ID NO: 90367 - DNA, 25 bp, S. pombe
gaacctcaatatacttcctccagat

SEQ ID NO: 90368 - DNA, 25 bp, S. pombe
gaacctggttttacagcaactgaat

SEQ ID NO: 90369 - DNA, 25 bp, S. pombe
gaacttcgtcgggtatctggatttg

SEQ ID NO: 90370 - DNA, 25 bp, S. pombe
gaacttcaccagatttcttgtcttg

SEQ ID NO: 90371 - DNA, 25 bp, S. pombe
gaaccccaagcgattgaggatcacc

SEQ ID NO: 90372 - DNA, 25 bp, S. pombe
gaacttccaacgcactaggctacaa

SEQ ID NO: 90373 - DNA, 25 bp, S. pombe
gacaaggtccccactacttacaagt

SEQ ID NO: 90374 - DNA, 25 bp, S. pombe
gaaactgtacccatatccctaaagt

SEQ ID NO: 90375 - DNA, 25 bp, S. pombe
gaaccctacaactttactcactatt

SEQ ID NO: 90376 - DNA, 25 bp, S. pombe
gaacgcatacaaacggatccctcat

SEQ ID NO: 90377 - DNA, 25 bp, S. pombe
gaacgtgccagaacgaagtagctca

SEQ ID NO: 90378 - DNA, 25 bp, S. pombe
gaaccgcaatgatgcccaatactca

SEQ ID NO: 90379 - DNA, 25 bp, S. pombe
gaacctgaagctgctcaaactgcca

SEQ ID NO: 90380 - DNA, 25 bp, S. pombe
gaactcgtcagctcggcggagaaag

SEQ ID NO: 90381 - DNA, 25 bp, S. pombe
gaacatggtgcctcttctgaagaag

SEQ ID NO: 90382 - DNA, 25 bp, S. pombe
gaactggctcgtcaatctgtaaact

SEQ ID NO: 90383 - DNA, 25 bp, S. pombe
gaacactgtcgactgaatcgctaaa

SEQ ID NO: 90384 - DNA, 25 bp, S. pombe
gaacatcttcggtcaaatgcagcaa

SEQ ID NO: 90385 - DNA, 25 bp, S. pombe
gaactctatcatgtcatcttctgaa

SEQ ID NO: 90386 - DNA, 25 bp, S. pombe
gaacgcgtgctgctgactatatcaa

SEQ ID NO: 90387 - DNA, 25 bp, S. pombe
gaacgtcgatagtatggataccctt

SEQ ID NO: 90388 - DNA, 25 bp, S. pombe
gaacggacttcggattcaaaatcat

SEQ ID NO: 90389 - DNA, 25 bp, S. pombe
gaactcgtgtccatgttgtagccaa

SEQ ID NO: 90390 - DNA, 25 bp, S. pombe
gaaccctcttcaatttctaggccag

SEQ ID NO: 90391 - DNA, 25 bp, S. pombe
gaacccttctataaatcgggctaag

SEQ ID NO: 90392 - DNA, 25 bp, S. pombe
gaacccactggatgtcttagctttg

SEQ ID NO: 90393 - DNA, 25 bp, S. pombe
gaacgccctggagctttatgtaagt

SEQ ID NO: 90394 - DNA, 25 bp, S. pombe
gaacgtggtccaatcactatttaca

SEQ ID NO: 90395 - DNA, 25 bp, S. pombe
gaacgggtcgcaaatttgtagtaca

SEQ ID NO: 90396 - DNA, 25 bp, S. pombe
gaacgagagccactttttctcattg

SEQ ID NO: 90397 - DNA, 25 bp, S. pombe
gaacgcaaacccttatagcaccaat

SEQ ID NO: 90398 - DNA, 25 bp, S. pombe
gaacatggaagcactatatcgacaa

SEQ ID NO: 90399 - DNA, 25 bp, S. pombe
gaacgtgaagctcccgaagacattt

SEQ ID NO: 90400 - DNA, 25 bp, S. pombe
gaacgctacattccacgtatttttg

SEQ ID NO: 90401 - DNA, 25 bp, S. pombe
gaacgtgcacttcaacaatctttgg

SEQ ID NO: 90402 - DNA, 25 bp, S. pombe
gaactcgttagtgtcagtactgtga

SEQ ID NO: 90403 - DNA, 25 bp, S. pombe
gaacgactgattgcttttctagaag

SEQ ID NO: 90404 - DNA, 25 bp, S. pombe
gaacaccttcagttagtgatcgcag

SEQ ID NO: 90405 - DNA, 25 bp, S. pombe
gaaccgttcttcaagctatggcaga

SEQ ID NO: 90406 - DNA, 25 bp, S. pombe
gaacgctgttgctttagccatggaa

SEQ ID NO: 90407 - DNA, 25 bp, S. pombe
gaacgatgccatggctttgcttttt

SEQ ID NO: 90408 - DNA, 25 bp, S. pombe
gaacgatacgtgctattctcaacga

SEQ ID NO: 90409 - DNA, 25 bp, S. pombe
gaaattcgaggcctacatttaccct

SEQ ID NO: 90410 - DNA, 25 bp, S. pombe
gaactttccacgctagtatcaaact

SEQ ID NO: 90411 - DNA, 25 bp, S. pombe
gaacgtttccgtacaattactagct

SEQ ID NO: 90412 - DNA, 25 bp, S. pombe
gaacttcttccgtacaatggatgcg

SEQ ID NO: 90413 - DNA, 25 bp, S. pombe
gaacgcatattgtctgcccatacaa

SEQ ID NO: 90414 - DNA, 25 bp, S. pombe
gaacgctgttgagtatgccaagcaa

SEQ ID NO: 90415 - DNA, 25 bp, S. pombe
gaacaggtagcagatgcctcacagt

SEQ ID NO: 90416 - DNA, 25 bp, S. pombe
gaactatatgcttatttcggttgat

SEQ ID NO: 90417 - DNA, 25 bp, S. pombe
gaacatcatgccttatttcggaagc

SEQ ID NO: 90418 - DNA, 25 bp, S. pombe
gaacttcctaagcatgcattgaatg

SEQ ID NO: 90419 - DNA, 25 bp, S. pombe
gaacgtgcttttcttcgtgaacgca

SEQ ID NO: 90420 - DNA, 25 bp, S. pombe
gaacgtgattttgtaccagcagagg

SEQ ID NO: 90421 - DNA, 25 bp, S. pombe
gaacatcgcagcagccgctatgaac

SEQ ID NO: 90422 - DNA, 25 bp, S. pombe
gaactggcagctcattttcagcaga

SEQ ID NO: 90423 - DNA, 25 bp, S. pombe
gaacgggctagttattcacatgact

SEQ ID NO: 90424 - DNA, 25 bp, S. pombe
gaacatgtgtatccatttgtccctg

SEQ ID NO: 90425 - DNA, 25 bp, S. pombe
gaacgtctgataaacatgcctgtcc

SEQ ID NO: 90426 - DNA, 25 bp, S. pombe
gaactgatcgagactagcattcgtc

SEQ ID NO: 90427 - DNA, 25 bp, S. pombe
gaacgactgctggacaggtatctca

SEQ ID NO: 90428 - DNA, 25 bp, S. pombe
gaacaggctggatttactccttact

SEQ ID NO: 90429 - DNA, 25 bp, S. pombe
gaacggctagttaacgcagctctga

SEQ ID NO: 90430 - DNA, 25 bp, S. pombe
gaacgtggtttaatgatctctggag

SEQ ID NO: 90431 - DNA, 25 bp, S. pombe
gtactatgcaaaaaacatccgagac

SEQ ID NO: 90432 - DNA, 25 bp, S. pombe
gttcttactttaactcgcgaagctt

SEQ ID NO: 90433 - DNA, 25 bp, S. pombe
gttaagaacgttgccggtcacttgt

SEQ ID NO: 90434 - DNA, 25 bp, S. pombe
gaactagaggattttgcaacccaaa

SEQ ID NO: 90435 - DNA, 25 bp, S. pombe
gaacgtcgtgctgcaagactcctta

SEQ ID NO: 90436 - DNA, 25 bp, S. pombe
gaacgccgcttcgatgaggtgtttg

SEQ ID NO: 90437 - DNA, 25 bp, S. pombe
gaacgccaattctatgactctttag

SEQ ID NO: 90438 - DNA, 25 bp, S. pombe
ggacgctacttatcccgttgaaata

SEQ ID NO: 90439 - DNA, 25 bp, S. pombe
gaactcttggcaactagcagctttt

SEQ ID NO: 90440 - DNA, 25 bp, S. pombe
gaactatcaccgacaagaatccttg

SEQ ID NO: 90441 - DNA, 25 bp, S. pombe
gaactttattccctcgtgtaattgt

SEQ ID NO: 90442 - DNA, 25 bp, S. pombe
gaactttaatcccagccatgttgat

SEQ ID NO: 90443 - DNA, 25 bp, S. pombe
gaacagttcacttctgtcgaggctc

SEQ ID NO: 90444 - DNA, 25 bp, S. pombe
gaactctcgcatgtatccttgattt

SEQ ID NO: 90445 - DNA, 25 bp, S. pombe
gaaatgcttgcagaacaccttgttg

SEQ ID NO: 90446 - DNA, 25 bp, S. pombe
gaacagcttacgtttccttgttgat

SEQ ID NO: 90447 - DNA, 25 bp, S. pombe
gaacgtcgaatagtacctgctgctt

SEQ ID NO: 90448 - DNA, 25 bp, S. pombe
gaacagtctctgaagtccctgttta

SEQ ID NO: 90449 - DNA, 25 bp, S. pombe
gaacgccacatacttgatactcttg

SEQ ID NO: 90450 - DNA, 25 bp, S. pombe
gaacgctccatatgtcgaatgctct

SEQ ID NO: 90451 - DNA, 25 bp, S. pombe
gaacgccgcataagtctgatatcca

SEQ ID NO: 90452 - DNA, 25 bp, S. pombe
gaacgcctctaaagatgccattcaa

SEQ ID NO: 90453 - DNA, 25 bp, S. pombe
gaacgctttaatagtggcagaaaac

SEQ ID NO: 90454 - DNA, 25 bp, S. pombe
gaacgctgatattatactccctcaa

SEQ ID NO: 90455 - DNA, 25 bp, S. pombe
gaacggaaatgctgtcaactcaaaa

SEQ ID NO: 90456 - DNA, 25 bp, S. pombe
gaactgggttccgataactcagagt

SEQ ID NO: 90457 - DNA, 25 bp, S. pombe
gacatggcggtttctcaacttcgaa

SEQ ID NO: 90458 - DNA, 25 bp, S. pombe
gacagtgggtcattccaaacatcaa

SEQ ID NO: 90459 - DNA, 25 bp, S. pombe
gaacttttactttggctatcgcgtc

SEQ ID NO: 90460 - DNA, 25 bp, S. pombe
gaactactttcaatgggctttccca

SEQ ID NO: 90461 - DNA, 25 bp, S. pombe
gaacgtgccttgtatcattggtgcc

SEQ ID NO: 90462 - DNA, 25 bp, S. pombe
gaactgattcgtcttggtgtgcctt

SEQ ID NO: 90463 - DNA, 25 bp, S. pombe
gaacgcacctgttttagttgatttg

SEQ ID NO: 90464 - DNA, 25 bp, S. pombe
gaacgacgatgtttccgaagctctt

SEQ ID NO: 90465 - DNA, 25 bp, S. pombe
gaacgtcggtttaaagcagctttga

SEQ ID NO: 90466 - DNA, 25 bp, S. pombe
gaacgtcaagttagggctcagcaga

SEQ ID NO: 90467 - DNA, 25 bp, S. pombe
gaactgttagtcgtcctcatggaaa

SEQ ID NO: 90468 - DNA, 25 bp, S. pombe
gaactttactccgactatgtactca

SEQ ID NO: 90469 - DNA, 25 bp, S. pombe
gaacttctaatctaggctctgaaca

SEQ ID NO: 90470 - DNA, 25 bp, S. pombe
gaactcttgaacgattctagcagta

SEQ ID NO: 90471 - DNA, 25 bp, S. pombe
gaactcatttgactttttggctgca

SEQ ID NO: 90472 - DNA, 25 bp, S. pombe
gaacgcagttgaatcgtttggcgat

SEQ ID NO: 90473 - DNA, 25 bp, S. pombe
gaacgtattcctggcagtgtgcgta

SEQ ID NO: 90474 - DNA, 25 bp, S. pombe
gaacgtatcaccgacagttgacaac

SEQ ID NO: 90475 - DNA, 25 bp, S. pombe
gaacgtattcgtccagatcaaacac

SEQ ID NO: 90476 - DNA, 25 bp, S. pombe
gacacgtttctttctagtaagcaat

SEQ ID NO: 90477 - DNA, 25 bp, S. pombe
gaactactttatagcctttcgatgc

SEQ ID NO: 90478 - DNA, 25 bp, S. pombe
gaacgatctccatggataggtccca

SEQ ID NO: 90479 - DNA, 25 bp, S. pombe
gaacgatttcatttctattgctaat

SEQ ID NO: 90480 - DNA, 25 bp, S. pombe
gaacgacttatttctatacctgatg

SEQ ID NO: 90481 - DNA, 25 bp, S. pombe
gaacgttgtatctccagcacctaat

SEQ ID NO: 90482 - DNA, 25 bp, S. pombe
gaacgtagtttccaaacgctctgat

SEQ ID NO: 90483 - DNA, 25 bp, S. pombe
gaactaggagtttcttcaaggctga

SEQ ID NO: 90484 - DNA, 25 bp, S. pombe
gaactggattccttggcttgttcaa

SEQ ID NO: 90485 - DNA, 25 bp, S. pombe
gaactcttccgccaaatgctagtgg

SEQ ID NO: 90486 - DNA, 25 bp, S. pombe
gaactttacccaacctggtggtgat

SEQ ID NO: 90487 - DNA, 25 bp, S. pombe
gaactgagcgtcctttgattaccac

SEQ ID NO: 90488 - DNA, 25 bp, S. pombe
gaactggtcgtattcctcaaactga

SEQ ID NO: 90489 - DNA, 25 bp, S. pombe
gaactggttgattcatcgctatact

SEQ ID NO: 90490 - DNA, 25 bp, S. pombe
gaacttgcattagacgctcaacgat

SEQ ID NO: 90491 - DNA, 25 bp, S. pombe
gaacaaagacgtaggtggtgcctta

SEQ ID NO: 90492 - DNA, 25 bp, S. pombe
gaacgttccttcaaaatggtccaag

SEQ ID NO: 90493 - DNA, 25 bp, S. pombe
gaacagttccttatattggaccata

SEQ ID NO: 90494 - DNA, 25 bp, S. pombe
gaactttgctttgtatttgctggct

SEQ ID NO: 90495 - DNA, 25 bp, S. pombe
gaactttggtaactcaatctgcgga

SEQ ID NO: 90496 - DNA, 25 bp, S. pombe
gaacgtttggatccttacgctaaag

SEQ ID NO: 90497 - DNA, 25 bp, S. pombe
gaacgtatgttgtgcttacctggat

SEQ ID NO: 90498 - DNA, 25 bp, S. pombe
gaacgtttatcttctttccgagatg

SEQ ID NO: 90499 - DNA, 25 bp, S. pombe
gaacagctgaggatgtcactgacca

SEQ ID NO: 90500 - DNA, 25 bp, S. pombe
gaacatgctgcacgtaccgctaaag

SEQ ID NO: 90501 - DNA, 25 bp, S. pombe
gaactatgaaaactattcctgcctt

SEQ ID NO: 90502 - DNA, 25 bp, S. pombe
gaactcatcagtgttattcctccta

SEQ ID NO: 90503 - DNA, 25 bp, S. pombe
gaactcatcacagattttgtcttcc

SEQ ID NO: 90504 - DNA, 25 bp, S. pombe
gaactgattgcagattttatgctca

SEQ ID NO: 90505 - DNA, 25 bp, S. pombe
gaacgattatttattggctgctcaa

SEQ ID NO: 90506 - DNA, 25 bp, S. pombe
gaacggtcttcaagatcacacactg

SEQ ID NO: 90507 - DNA, 25 bp, S. pombe
gacactggtacccttgaaacttata

SEQ ID NO: 90508 - DNA, 25 bp, S. pombe
gaacagtttcggcttcactttataa

SEQ ID NO: 90509 - DNA, 25 bp, S. pombe
gaactacttccatattacgacgtcg

SEQ ID NO: 90510 - DNA, 25 bp, S. pombe
gaacgtcaaccaattgctctcgaaa

SEQ ID NO: 90511 - DNA, 25 bp, S. pombe
gaactagatttggtaactttgcgac

SEQ ID NO: 90512 - DNA, 25 bp, S. pombe
gaactcatgtctgtaacctcttgga

SEQ ID NO: 90513 - DNA, 25 bp, S. pombe
gaactttcctcccatagatgctgaa

SEQ ID NO: 90514 - DNA, 25 bp, S. pombe
gaacttttgcctcgtattgctgtcc

SEQ ID NO: 90515 - DNA, 25 bp, S. pombe
gaactttttgatgcactgttttcac

SEQ ID NO: 90516 - DNA, 25 bp, S. pombe
gaactcctctattattcgtcatgct

SEQ ID NO: 90517 - DNA, 25 bp, S. pombe
gaacagctccaagtatgccatatga

SEQ ID NO: 90518 - DNA, 25 bp, S. pombe
gaacactgctaatgagcctcatgaa

SEQ ID NO: 90519 - DNA, 25 bp, S. pombe
gaactcgataaaacacctgaacttt

SEQ ID NO: 90520 - DNA, 25 bp, S. pombe
gaactgactcatttcattccctaaa

SEQ ID NO: 90521 - DNA, 25 bp, S. pombe
gaactcgttgtgtaacatcgctgat

SEQ ID NO: 90522 - DNA, 25 bp, S. pombe
gaacttgaatccattccggtagcga

SEQ ID NO: 90523 - DNA, 25 bp, S. pombe
gaacttgaacctctttcagtagcca

SEQ ID NO: 90524 - DNA, 25 bp, S. pombe
gaaaaagacctctactggttcggct

SEQ ID NO: 90525 - DNA, 25 bp, S. pombe
ggaatggaagctcctttgtttcgga

SEQ ID NO: 90526 - DNA, 25 bp, S. pombe
gaactggaagctactgtttttcaac

SEQ ID NO: 90527 - DNA, 25 bp, S. pombe
gaacggacacttgtttctgtaattg

SEQ ID NO: 90528 - DNA, 25 bp, S. pombe
gaacatccctttctacctattttga

SEQ ID NO: 90529 - DNA, 25 bp, S. pombe
gaactccacgcctttaagtcaattg

SEQ ID NO: 90530 - DNA, 25 bp, S. pombe
gaacagcctccttggttatttttgg

SEQ ID NO: 90531 - DNA, 25 bp, S. pombe
gaacaccatccatagctaatcagtc

SEQ ID NO: 90532 - DNA, 25 bp, S. pombe
gaacttgccgatatatacgtgtcag

SEQ ID NO: 90533 - DNA, 25 bp, S. pombe
gaacttccgttattttctccatacg

SEQ ID NO: 90534 - DNA, 25 bp, S. pombe
gaacttgtatctggtgatttccctt

SEQ ID NO: 90535 - DNA, 25 bp, S. pombe
gaacattgttttgggcgcatctaaa

SEQ ID NO: 90536 - DNA, 25 bp, S. pombe
gaacttcttatttctcataatatac

SEQ ID NO: 90537 - DNA, 25 bp, S. pombe
gaacattcaaagtgctcgacgattt

SEQ ID NO: 90538 - DNA, 25 bp, S. pombe
gaactgccctactgtgcttggttat

SEQ ID NO: 90539 - DNA, 25 bp, S. pombe
gaacgtggagaacgccttgattctt

SEQ ID NO: 90540 - DNA, 25 bp, S. pombe
gaaaatgtaaatcgcccgcttcttt

SEQ ID NO: 90541 - DNA, 25 bp, S. pombe
gaacaagatcgtctcagcgggaaat

SEQ ID NO: 90542 - DNA, 25 bp, S. pombe
gaaaatacagctcatcgggttacta

SEQ ID NO: 90543 - DNA, 25 bp, S. pombe
gaacatgttccgttccaggattact

SEQ ID NO: 90544 - DNA, 25 bp, S. pombe
gaacattgctcgtgttgacggcact

SEQ ID NO: 90545 - DNA, 25 bp, S. pombe
gaactttgacatccctaatggcaag

SEQ ID NO: 90546 - DNA, 25 bp, S. pombe
gaactgaatgctatccttcttgatg

SEQ ID NO: 90547 - DNA, 25 bp, S. pombe
gaacatcattgcaaggccggtgcta

SEQ ID NO: 90548 - DNA, 25 bp, S. pombe
gaacaaacttcgtagctcaggcact

SEQ ID NO: 90549 - DNA, 25 bp, S. pombe
gaacacggcttgtacgttggagtta

SEQ ID NO: 90550 - DNA, 25 bp, S. pombe
gaactcgactttgcgttttgtatcc

SEQ ID NO: 90551 - DNA, 25 bp, S. pombe
gacacccgtattgttgtttttcact

SEQ ID NO: 90552 - DNA, 25 bp, S. pombe
gaaaatttagcacctttagcaccct

SEQ ID NO: 90553 - DNA, 25 bp, S. pombe
gaaaattttggtctcaacctccagg

SEQ ID NO: 90554 - DNA, 25 bp, S. pombe
gacggaatttcgatttaccttcaga

SEQ ID NO: 90555 - DNA, 25 bp, S. pombe
gacagcttggttcaaatttccctaa

SEQ ID NO: 90556 - DNA, 25 bp, S. pombe
gaactggagtctcaaatatcctcta

SEQ ID NO: 90557 - DNA, 25 bp, S. pombe
taacgaggccgagaaacgtgtacaa

SEQ ID NO: 90558 - DNA, 25 bp, S. pombe
gaaaccttcaacgtacttatggcga

SEQ ID NO: 90559 - DNA, 25 bp, S. pombe
gaaatcctaaaacggcttgtgaaga

SEQ ID NO: 90560 - DNA, 25 bp, S. pombe
gtaaggctccaatcgccgggaaaat

SEQ ID NO: 90561 - DNA, 25 bp, S. pombe
gaaaattctatattcaacggcgttt

SEQ ID NO: 90562 - DNA, 25 bp, S. pombe
gaactattgtatcgtcgaccctttt

SEQ ID NO: 90563 - DNA, 25 bp, S. pombe
gaacttcgtattacatggcgcctga

SEQ ID NO: 90564 - DNA, 25 bp, S. pombe
gaactgtcttttaatgcgcgagctt

SEQ ID NO: 90565 - DNA, 25 bp, S. pombe
gaacaccattttacgccggctttgg

SEQ ID NO: 90566 - DNA, 25 bp, S. pombe
gaactttttgctaccaactttggtg

SEQ ID NO: 90567 - DNA, 25 bp, S. pombe
gaacttttatctacgccttattgcc

SEQ ID NO: 90568 - DNA, 25 bp, S. pombe
gaaaattagatctcgttctttccca

SEQ ID NO: 90569 - DNA, 25 bp, S. pombe
gaaaaccaatcctgctgtttaccgt

SEQ ID NO: 90570 - DNA, 25 bp, S. pombe
gaaaacccaacaagccggtgtggag

SEQ ID NO: 90571 - DNA, 25 bp, S. pombe
gaactgatgaacttttcgcttacgt

SEQ ID NO: 90572 - DNA, 25 bp, S. pombe
gaactgctgcaacttttactcaaat

SEQ ID NO: 90573 - DNA, 25 bp, S. pombe
gaacttgcacagcttttccaggata

SEQ ID NO: 90574 - DNA, 25 bp, S. pombe
gaaaatgcaccgctttcggaaagtt

SEQ ID NO: 90575 - DNA, 25 bp, S. pombe
gaaaataccgtagtatcgaccacgt

SEQ ID NO: 90576 - DNA, 25 bp, S. pombe
gaacatattaaatcctcaacccctg

SEQ ID NO: 90577 - DNA, 25 bp, S. pombe
gaaattgaacaaaaacctcctcgat

SEQ ID NO: 90578 - DNA, 25 bp, S. pombe
gaacatatccaacgtgccaaggccg

SEQ ID NO: 90579 - DNA, 25 bp, S. pombe
gaaactgtcacagcgtaaacgggat

SEQ ID NO: 90580 - DNA, 25 bp, S. pombe
gaactatgctacactacgaacggga

SEQ ID NO: 90581 - DNA, 25 bp, S. pombe
gaacttctcatcagccttgcaaaag

SEQ ID NO: 90582 - DNA, 25 bp, S. pombe
gaacttcatcgttgctttgaggaca

SEQ ID NO: 90583 - DNA, 25 bp, S. pombe
gaacttgaggacatcattgtgcgaa

SEQ ID NO: 90584 - DNA, 25 bp, S. pombe
gaacttgtgtcacttgattgtggac

SEQ ID NO: 90585 - DNA, 25 bp, S. pombe
gaacttgctgctgttgaatgtcccg

SEQ ID NO: 90586 - DNA, 25 bp, S. pombe
gaacttgctttgtgggatactgctg

SEQ ID NO: 90587 - DNA, 25 bp, S. pombe
gaactttgttttccaataccgtcag

SEQ ID NO: 90588 - DNA, 25 bp, S. pombe
gaacttgtttgtttacatagcacag

SEQ ID NO: 90589 - DNA, 25 bp, S. pombe
gaactagtgttctttcagcattcaa

SEQ ID NO: 90590 - DNA, 25 bp, S. pombe
gaactccttttgaacattggctctg

SEQ ID NO: 90591 - DNA, 25 bp, S. pombe
gaactgagattccattacctgtaca

SEQ ID NO: 90592 - DNA, 25 bp, S. pombe
gaactcgcatcccataaactcgaat

SEQ ID NO: 90593 - DNA, 25 bp, S. pombe
gaactcgccaaatacattctgcaca

SEQ ID NO: 90594 - DNA, 25 bp, S. pombe
gaaaaacctggtgtactcgcaaatt

SEQ ID NO: 90595 - DNA, 25 bp, S. pombe
gaaaaagtgggtctccttgtatctt

SEQ ID NO: 90596 - DNA, 25 bp, S. pombe
gaacaagccggtcttagtcctgatg

SEQ ID NO: 90597 - DNA, 25 bp, S. pombe
gaactaatccttcttcgactgctgt

SEQ ID NO: 90598 - DNA, 25 bp, S. pombe
gaactcaacctacatctcgatacta

SEQ ID NO: 90599 - DNA, 25 bp, S. pombe
gaactaccttgccaaccgtgttaat

SEQ ID NO: 90600 - DNA, 25 bp, S. pombe
gaactcccttgcaacagtcgattta

SEQ ID NO: 90601 - DNA, 25 bp, S. pombe
gaactgaactgctaccaggcgatta

SEQ ID NO: 90602 - DNA, 25 bp, S. pombe
gaacattactcgacacatggcagca

SEQ ID NO: 90603 - DNA, 25 bp, S. pombe
gaacatgctttcacttgtcgggtac

SEQ ID NO: 90604 - DNA, 25 bp, S. pombe
gaacactcggccatcagtatctaaa

SEQ ID NO: 90605 - DNA, 25 bp, S. pombe
gactataacccaagcttacgatcca

SEQ ID NO: 90606 - DNA, 25 bp, S. pombe
gaacatggcgcgtaacttgatgcaa

SEQ ID NO: 90607 - DNA, 25 bp, S. pombe
gaacactcctcgttttcaggcaatt

SEQ ID NO: 90608 - DNA, 25 bp, S. pombe
gaacttgcccacttattttcggaag

SEQ ID NO: 90609 - DNA, 25 bp, S. pombe
gaacttggaccattctgttgtcgat

SEQ ID NO: 90610 - DNA, 25 bp, S. pombe
gaacatcatccagttttgtctacag

SEQ ID NO: 90611 - DNA, 25 bp, S. pombe
gaacaccaaaagtatgctccctaaa

SEQ ID NO: 90612 - DNA, 25 bp, S. pombe
gaaaacggtggtcttgctgctgctc

SEQ ID NO: 90613 - DNA, 25 bp, S. pombe
gaaaaggtgcttcaagttgcctcct

SEQ ID NO: 90614 - DNA, 25 bp, S. pombe
gaaaagtccttctcagtggtccact

SEQ ID NO: 90615 - DNA, 25 bp, S. pombe
gaactctgttaccagctgtcatgga

SEQ ID NO: 90616 - DNA, 25 bp, S. pombe
gaacaacatgtagtcagcgtcggta

SEQ ID NO: 90617 - DNA, 25 bp, S. pombe
gaacaggctgtcgatcgagcacata

SEQ ID NO: 90618 - DNA, 25 bp, S. pombe
gaacatgtgctgtattggctatcca

SEQ ID NO: 90619 - DNA, 25 bp, S. pombe
gaacagaggttcttctacgcattct

SEQ ID NO: 90620 - DNA, 25 bp, S. pombe
gaacttgtgttcagtagctcaatgt

SEQ ID NO: 90621 - DNA, 25 bp, S. pombe
gaacttctcgatatttatgctcaat

SEQ ID NO: 90622 - DNA, 25 bp, S. pombe
gaactttttgatcttcgctggtgtt

SEQ ID NO: 90623 - DNA, 25 bp, S. pombe
gaacttttttctttccagctggctt

SEQ ID NO: 90624 - DNA, 25 bp, S. pombe
gaacacccttacttcgaaagactgt

SEQ ID NO: 90625 - DNA, 25 bp, S. pombe
gaaacgtttacacctcaagaggctg

SEQ ID NO: 90626 - DNA, 25 bp, S. pombe
gaaacggtttacgatgccacggcta

SEQ ID NO: 90627 - DNA, 25 bp, S. pombe
gaaaacgttcaagacgctcgtcgag

SEQ ID NO: 90628 - DNA, 25 bp, S. pombe
gaacaactttaatcctcgtctcgac

SEQ ID NO: 90629 - DNA, 25 bp, S. pombe
gagactacgaaaattcctcgttcga

SEQ ID NO: 90630 - DNA, 25 bp, S. pombe
gaacatgtccttttacaatcactct

SEQ ID NO: 90631 - DNA, 25 bp, S. pombe
gaacttggtttatgtcagtctgctt

SEQ ID NO: 90632 - DNA, 25 bp, S. pombe
gaacatgtggttatcccaagtgcaa

SEQ ID NO: 90633 - DNA, 25 bp, S. pombe
gaactttgtctctagtatacttata

SEQ ID NO: 90634 - DNA, 25 bp, S. pombe
gaacttccctatttatcatctgtcg

SEQ ID NO: 90635 - DNA, 25 bp, S. pombe
gaacatccattttatgtccttgtgg

SEQ ID NO: 90636 - DNA, 25 bp, S. pombe
gaacatccattaactcttgctcagt

SEQ ID NO: 90637 - DNA, 25 bp, S. pombe
gaactattctattctctgtgatcgt

SEQ ID NO: 90638 - DNA, 25 bp, S. pombe
gaactatacttttgatgctcctgct

SEQ ID NO: 90639 - DNA, 25 bp, S. pombe
gaactatgatcgtgcaggtcgctct

SEQ ID NO: 90640 - DNA, 25 bp, S. pombe
gaacaccagtgaaaactcagtcgaa

SEQ ID NO: 90641 - DNA, 25 bp, S. pombe
gaacatttttgcgtcgtccaactgg

SEQ ID NO: 90642 - DNA, 25 bp, S. pombe
gaacttgctaagcactgtagccccg

SEQ ID NO: 90643 - DNA, 25 bp, S. pombe
gaacatcagctgacgttttccgggc

SEQ ID NO: 90644 - DNA, 25 bp, S. pombe
gaaacatcagctctaacagtcagtg

SEQ ID NO: 90645 - DNA, 25 bp, S. pombe
gaaattcgcaaatggtatcgtcgcc

SEQ ID NO: 90646 - DNA, 25 bp, S. pombe
gaacactgcgactttaaacagctta

SEQ ID NO: 90647 - DNA, 25 bp, S. pombe
gaacatgtccttatcattttccaat

SEQ ID NO: 90648 - DNA, 25 bp, S. pombe
gaacagttgcaaatacccttccatc

SEQ ID NO: 90649 - DNA, 25 bp, S. pombe
gaacagattcaactcgccaattcgt

SEQ ID NO: 90650 - DNA, 25 bp, S. pombe
gaacatacccatttaaattccagag

SEQ ID NO: 90651 - DNA, 25 bp, S. pombe
gaaacatccggacaatcctttcaat

SEQ ID NO: 90652 - DNA, 25 bp, S. pombe
gaaaatgccgccgagattgaaatgc

SEQ ID NO: 90653 - DNA, 25 bp, S. pombe
gaacattcgtccgagatcgtcaatg

SEQ ID NO: 90654 - DNA, 25 bp, S. pombe
gaacttgagcaagcgtctgccagct

SEQ ID NO: 90655 - DNA, 25 bp, S. pombe
gacttatttacctagcatacctcag

SEQ ID NO: 90656 - DNA, 25 bp, S. pombe
gactttgtttactcgacctattcct

SEQ ID NO: 90657 - DNA, 25 bp, S. pombe
gaacaagcagaaactccgatccctt

SEQ ID NO: 90658 - DNA, 25 bp, S. pombe
gaacaagcaaggatgcgctcactct

SEQ ID NO: 90659 - DNA, 25 bp, S. pombe
gaacaccacaatgattgcccaaggt

SEQ ID NO: 90660 - DNA, 25 bp, S. pombe
gaacaccatattggatggcccctga

SEQ ID NO: 90661 - DNA, 25 bp, S. pombe
gactactgagctccgtcgtaaattg

SEQ ID NO: 90662 - DNA, 25 bp, S. pombe
gaacagtacatcaccggtcaaacaa

SEQ ID NO: 90663 - DNA, 25 bp, S. pombe
gaaaatgaatgactcctacactcca

SEQ ID NO: 90664 - DNA, 25 bp, S. pombe
ttgaaaaaactcctgacggagaaga

SEQ ID NO: 90665 - DNA, 25 bp, S. pombe
gaaaagtcttcctcctgacgtataa

SEQ ID NO: 90666 - DNA, 25 bp, S. pombe
gaaacaaccagagcccgaagaaata

SEQ ID NO: 90667 - DNA, 25 bp, S. pombe
gaaattgaccaacccagaaacgatt

SEQ ID NO: 90668 - DNA, 25 bp, S. pombe
gaacagtctatccaactcgtacaga

SEQ ID NO: 90669 - DNA, 25 bp, S. pombe
gaacattttctcgattgctgaatct

SEQ ID NO: 90670 - DNA, 25 bp, S. pombe
gaacttatctctcattctaatcgca

SEQ ID NO: 90671 - DNA, 25 bp, S. pombe
gaacttgctcttcatactcaattga

SEQ ID NO: 90672 - DNA, 25 bp, S. pombe
gaacttgcctgtatcatctgatctt

SEQ ID NO: 90673 - DNA, 25 bp, S. pombe
gaacttggatgtgatcattgtttac

SEQ ID NO: 90674 - DNA, 25 bp, S. pombe
gaacatccggatgtctttttccata

SEQ ID NO: 90675 - DNA, 25 bp, S. pombe
gaaaacgttttgcaacccttgctcg

SEQ ID NO: 90676 - DNA, 25 bp, S. pombe
gaacatcaacgagagctggaggcag

SEQ ID NO: 90677 - DNA, 25 bp, S. pombe
gaaacaccgcaatgcattgggcagc

SEQ ID NO: 90678 - DNA, 25 bp, S. pombe
gaacttatactcttcctcgtatctt

SEQ ID NO: 90679 - DNA, 25 bp, S. pombe
gaacttaacttccatctcgatacta

SEQ ID NO: 90680 - DNA, 25 bp, S. pombe
gaacttggacaattagctgctgaca

SEQ ID NO: 90681 - DNA, 25 bp, S. pombe
gaaaagctggcccaaccttcgagaa

SEQ ID NO: 90682 - DNA, 25 bp, S. pombe
gaaaatttcaaatgcagcccagctg

SEQ ID NO: 90683 - DNA, 25 bp, S. pombe
gaacattcttgcaactcttaaccct

SEQ ID NO: 90684 - DNA, 25 bp, S. pombe
gaacaggcagttatacctttggatg

SEQ ID NO: 90685 - DNA, 25 bp, S. pombe
gaacaattctttgcacaatttcgat

SEQ ID NO: 90686 - DNA, 25 bp, S. pombe
gaacattttttctattgcttccgat

SEQ ID NO: 90687 - DNA, 25 bp, S. pombe
gaacatccgtttgagtctggtccaa

SEQ ID NO: 90688 - DNA, 25 bp, S. pombe
gaacaccgttgctgaggaggcccaa

SEQ ID NO: 90689 - DNA, 25 bp, S. pombe
gaaaatgctttctgaggttcccgaa

SEQ ID NO: 90690 - DNA, 25 bp, S. pombe
gaaaatctattttgccgtctgccgg

SEQ ID NO: 90691 - DNA, 25 bp, S. pombe
gaacacagaacccaagctgcttagg

SEQ ID NO: 90692 - DNA, 25 bp, S. pombe
gaacacgtaccgtattcggatgcgt

SEQ ID NO: 90693 - DNA, 25 bp, S. pombe
gaacaagcccctctcaatggtttga

SEQ ID NO: 90694 - DNA, 25 bp, S. pombe
gaaaagccaggtctcttagatctta

SEQ ID NO: 90695 - DNA, 25 bp, S. pombe
gaaaattccgttcgtttgcaactga

SEQ ID NO: 90696 - DNA, 25 bp, S. pombe
gaacatgttctccagatctgtttcc

SEQ ID NO: 90697 - DNA, 25 bp, S. pombe
gaacatgttcttcgcatcgtacctg

SEQ ID NO: 90698 - DNA, 25 bp, S. pombe
gaacattacttcgattgtacctccc

SEQ ID NO: 90699 - DNA, 25 bp, S. pombe
gaacaaacttaccttaatcctgcca

SEQ ID NO: 90700 - DNA, 25 bp, S. pombe
gaacactgaaaaccgctttgctggc

SEQ ID NO: 90701 - DNA, 25 bp, S. pombe
gaaactgaagaggacgtgtatcggc

SEQ ID NO: 90702 - DNA, 25 bp, S. pombe
gaaaatacacaggtgcgccatccac

SEQ ID NO: 90703 - DNA, 25 bp, S. pombe
gaaacaagccggagatcctaccaaa

SEQ ID NO: 90704 - DNA, 25 bp, S. pombe
gaaaattcctatgctgaaacaccta

SEQ ID NO: 90705 - DNA, 25 bp, S. pombe
gaaaatcctgatgccgaattccgtt

SEQ ID NO: 90706 - DNA, 25 bp, S. pombe
gaacacgcttattagtaattccgat

SEQ ID NO: 90707 - DNA, 25 bp, S. pombe
gaacattcttattcctcatcttcag

SEQ ID NO: 90708 - DNA, 25 bp, S. pombe
gaaaatctggctcgcagcattcaag

SEQ ID NO: 90709 - DNA, 25 bp, S. pombe
gaaaaccacaaacgccagattacaa

SEQ ID NO: 90710 - DNA, 25 bp, S. pombe
gaacatccgagctttttgtcttcac

SEQ ID NO: 90711 - DNA, 25 bp, S. pombe
gaacaccacttctatctggaacagt

SEQ ID NO: 90712 - DNA, 25 bp, S. pombe
gaaaatgttcccgactacactgaat

SEQ ID NO: 90713 - DNA, 25 bp, S. pombe
gaacatattatcatcgctggaccga

SEQ ID NO: 90714 - DNA, 25 bp, S. pombe
gaacatgcagcaaccggttaccaaa

SEQ ID NO: 90715 - DNA, 25 bp, S. pombe
gaacatgaagctgccattctcttaa

SEQ ID NO: 90716 - DNA, 25 bp, S. pombe
gaaaaccatcccctgtaaagaccat

SEQ ID NO: 90717 - DNA, 25 bp, S. pombe
gaacattcgtcgttgcctaaaaact

SEQ ID NO: 90718 - DNA, 25 bp, S. pombe
gaacagtttgcttctcctgaaataa

SEQ ID NO: 90719 - DNA, 25 bp, S. pombe
gaacagatttttcacgacagcaata

SEQ ID NO: 90720 - DNA, 25 bp, S. pombe
gaacatgtttctaatgacagtccaa

SEQ ID NO: 90721 - DNA, 25 bp, S. pombe
tccaacgtcgacatactcagggtac

SEQ ID NO: 90722 - DNA, 25 bp, S. pombe
gaacattggcgaatttggcacccat

SEQ ID NO: 90723 - DNA, 25 bp, S. pombe
gaacacgttggcatcattgagaaat

SEQ ID NO: 90724 - DNA, 25 bp, S. pombe
gaaaaatggcttccgacgcttctga

SEQ ID NO: 90725 - DNA, 25 bp, S. pombe
gaaactcaggttccttacgatccga

SEQ ID NO: 90726 - DNA, 25 bp, S. pombe
gaaacgaagtcgcttactgtccgga

SEQ ID NO: 90727 - DNA, 25 bp, S. pombe
gaaaagatagttctccctcttcgga

SEQ ID NO: 90728 - DNA, 25 bp, S. pombe
gaaaaaaggattcccctcttgcgca

SEQ ID NO: 90729 - DNA, 25 bp, S. pombe
gaaacaaagttaacccagcgtcaat

SEQ ID NO: 90730 - DNA, 25 bp, S. pombe
gaaaacagtacaacataatgcacat

SEQ ID NO: 90731 - DNA, 25 bp, S. pombe
gaaaaactacatccgggcacttttg

SEQ ID NO: 90732 - DNA, 25 bp, S. pombe
gaaaggcctcaagctggaattttta

SEQ ID NO: 90733 - DNA, 25 bp, S. pombe
gaaactccctaacgtatcagatgtt

SEQ ID NO: 90734 - DNA, 25 bp, S. pombe
gaacattgccgttattgactgtggt

SEQ ID NO: 90735 - DNA, 25 bp, S. pombe
gaaatgcaagcctctggtacctttt

SEQ ID NO: 90736 - DNA, 25 bp, S. pombe
gaaaagccttctcaaaaagatttat

SEQ ID NO: 90737 - DNA, 25 bp, S. pombe
gaaaagcacttattgccgccaaatt

SEQ ID NO: 90738 - DNA, 25 bp, S. pombe
gaaaagtctcaattgccagccgaag

SEQ ID NO: 90739 - DNA, 25 bp, S. pombe
gaaaagtctatgttgccggcattac

SEQ ID NO: 90740 - DNA, 25 bp, S. pombe
gaaaaccaacaggagcaccggctat

SEQ ID NO: 90741 - DNA, 25 bp, S. pombe
gaaaatcttgagcttcctactttcc

SEQ ID NO: 90742 - DNA, 25 bp, S. pombe
gaaaacctggaaccgctatgtcttt

SEQ ID NO: 90743 - DNA, 25 bp, S. pombe
gaaaaggcggcgaccgagcttcttt

SEQ ID NO: 90744 - DNA, 25 bp, S. pombe
gaaaacggtcgaacgctgataattt

SEQ ID NO: 90745 - DNA, 25 bp, S. pombe
gaaaactgagtccttgacgattaac

SEQ ID NO: 90746 - DNA, 25 bp, S. pombe
gaaaggccattctcgatttagtcaa

SEQ ID NO: 90747 - DNA, 25 bp, S. pombe
gaaaatggtcacttgtcgggacaat

SEQ ID NO: 90748 - DNA, 25 bp, S. pombe
gaaaatacatcatcttccgacgctg

SEQ ID NO: 90749 - DNA, 25 bp, S. pombe
gaacacaattctccctatcattata

SEQ ID NO: 90750 - DNA, 25 bp, S. pombe
gaacatagctgtgcgccaatttgat

SEQ ID NO: 90751 - DNA, 25 bp, S. pombe
gaacaacgaatctgcaatctgtgaa

SEQ ID NO: 90752 - DNA, 25 bp, S. pombe
gaacagttgctattacactctgaaa

SEQ ID NO: 90753 - DNA, 25 bp, S. pombe
gaacatgttcatttaccgctggata

SEQ ID NO: 90754 - DNA, 25 bp, S. pombe
gaaaacgctggatctcggagaagca

SEQ ID NO: 90755 - DNA, 25 bp, S. pombe
gaaaacctctttctatttggctcaa

SEQ ID NO: 90756 - DNA, 25 bp, S. pombe
gaaaatttctttgttcattatcctt

SEQ ID NO: 90757 - DNA, 25 bp, S. pombe
gaaaagtcgtttgcattactcagaa

SEQ ID NO: 90758 - DNA, 25 bp, S. pombe
gaaaaccatgtgcaggcattccctg

SEQ ID NO: 90759 - DNA, 25 bp, S. pombe
gaaaacattcgttaattaccttgat

SEQ ID NO: 90760 - DNA, 25 bp, S. pombe
gaaaaactcgagcagtccggtcaat

SEQ ID NO: 90761 - DNA, 25 bp, S. pombe
gaaaatgaacgaaaggccacttcta

SEQ ID NO: 90762 - DNA, 25 bp, S. pombe
gaaaagtaccatctcgcaacatttg

SEQ ID NO: 90763 - DNA, 25 bp, S. pombe
gaacacgtttatcgcttgaagggaa

SEQ ID NO: 90764 - DNA, 25 bp, S. pombe
gaaaagtcctatccttctagtggaa

SEQ ID NO: 90765 - DNA, 25 bp, S. pombe
gaaaagcttccgacgtacttagagg

SEQ ID NO: 90766 - DNA, 25 bp, S. pombe
gaaatatttcgtcaactcggtgatt

SEQ ID NO: 90767 - DNA, 25 bp, S. pombe
gaaaatttccatccaattcgcgtga

SEQ ID NO: 90768 - DNA, 25 bp, S. pombe
gaacaaaagctctccctgaagtaga

SEQ ID NO: 90769 - DNA, 25 bp, S. pombe
gaacatccttgttccaggtatgtct

SEQ ID NO: 90770 - DNA, 25 bp, S. pombe
gaacaagctattgccaggtcatcct

SEQ ID NO: 90771 - DNA, 25 bp, S. pombe
gaacaagtttcagcggctcactggc

SEQ ID NO: 90772 - DNA, 25 bp, S. pombe
gaaaatgaaatcgttccggccaagg

SEQ ID NO: 90773 - DNA, 25 bp, S. pombe
gaaaagacaccgtatcccgcgaatg

SEQ ID NO: 90774 - DNA, 25 bp, S. pombe
gtaaaaccatggatgggcgcaaatg

SEQ ID NO: 90775 - DNA, 25 bp, S. pombe
gaaaacactactgtcctcaatgaat

SEQ ID NO: 90776 - DNA, 25 bp, S. pombe
gacacgaaccttctgaaacaattgt

SEQ ID NO: 90777 - DNA, 25 bp, S. pombe
gagacaacgttaccaaggcccaaag

SEQ ID NO: 90778 - DNA, 25 bp, S. pombe
gaacacgaaactctatcaggaatgg

SEQ ID NO: 90779 - DNA, 25 bp, S. pombe
gaaactgttcctacaaacgaagctg

SEQ ID NO: 90780 - DNA, 25 bp, S. pombe
gaaaatggtttacgcacctacctga

SEQ ID NO: 90781 - DNA, 25 bp, S. pombe
gaaaagcgtatttacattcccctgc

SEQ ID NO: 90782 - DNA, 25 bp, S. pombe
gaaagattgttttccaaccccatgt

SEQ ID NO: 90783 - DNA, 25 bp, S. pombe
gaaaattgtaaaccctcccagattg

SEQ ID NO: 90784 - DNA, 25 bp, S. pombe
gaaaattgccaatacgcgtccaggt

SEQ ID NO: 90785 - DNA, 25 bp, S. pombe
gaaaattcaacacatctccacaaag

SEQ ID NO: 90786 - DNA, 25 bp, S. pombe
gaaacagtacctacgcgtaaacagt

SEQ ID NO: 90787 - DNA, 25 bp, S. pombe
gaaacgcgtgagacgccttaaacgt

SEQ ID NO: 90788 - DNA, 25 bp, S. pombe
gaaaatgctgcacatctaggatatt

SEQ ID NO: 90789 - DNA, 25 bp, S. pombe
gaaaatgctgctctatcggctactc

SEQ ID NO: 90790 - DNA, 25 bp, S. pombe
ggcaaacgtccctcaaagtagtagt

SEQ ID NO: 90791 - DNA, 25 bp, S. pombe
gaaaagtcatcatctagccaggaaa

SEQ ID NO: 90792 - DNA, 25 bp, S. pombe
gaacaactctcacggatcaggaaat

SEQ ID NO: 90793 - DNA, 25 bp, S. pombe
gaacaagctgccatgactacggaat

SEQ ID NO: 90794 - DNA, 25 bp, S. pombe
gaacaagcgccaatctcaacttaaa

SEQ ID NO: 90795 - DNA, 25 bp, S. pombe
gaaacgttgcacgactattcgaatt

SEQ ID NO: 90796 - DNA, 25 bp, S. pombe
gaacacagtcatgcgatgagtctac

SEQ ID NO: 90797 - DNA, 25 bp, S. pombe
gaaaacccgcaggattgaacgccgc

SEQ ID NO: 90798 - DNA, 25 bp, S. pombe
gaaaaccccgatttagatcctacag

SEQ ID NO: 90799 - DNA, 25 bp, S. pombe
gaacaacccaagaattcctccaata

SEQ ID NO: 90800 - DNA, 25 bp, S. pombe
gaacaaatgtatcccgcacctgtac

SEQ ID NO: 90801 - DNA, 25 bp, S. pombe
gaacacattttggagggatcctcaa

SEQ ID NO: 90802 - DNA, 25 bp, S. pombe
gaacaatatcgctctcgctcacatg

SEQ ID NO: 90803 - DNA, 25 bp, S. pombe
gaacacatttcaactgctactggag

SEQ ID NO: 90804 - DNA, 25 bp, S. pombe
gaacacttaccacctgttacagaag

SEQ ID NO: 90805 - DNA, 25 bp, S. pombe
gaacactttcaacctttgctagaga

SEQ ID NO: 90806 - DNA, 25 bp, S. pombe
gaacaccgaagtctctgacgcaagt

SEQ ID NO: 90807 - DNA, 25 bp, S. pombe
gaacacctacgtatatggcgccaga

SEQ ID NO: 90808 - DNA, 25 bp, S. pombe
gaacacctcaccattctgtagttga

SEQ ID NO: 90809 - DNA, 25 bp, S. pombe
gaacactagcattttatggttatga

SEQ ID NO: 90810 - DNA, 25 bp, S. pombe
gaacactagcactttatgaacgtga

SEQ ID NO: 90811 - DNA, 25 bp, S. pombe
gaacaacaagccctttctcatatga

SEQ ID NO: 90812 - DNA, 25 bp, S. pombe
gaaaatcacagctgaccaagatcaa

SEQ ID NO: 90813 - DNA, 25 bp, S. pombe
gaaaatcaactctccaaacctttgc

SEQ ID NO: 90814 - DNA, 25 bp, S. pombe
gaaaaccattactcgaacctatctt

SEQ ID NO: 90815 - DNA, 25 bp, S. pombe
gaaaacgtcgacagccgtctaatag

SEQ ID NO: 90816 - DNA, 25 bp, S. pombe
gaaaccagttcctgaggctcgttta

SEQ ID NO: 90817 - DNA, 25 bp, S. pombe
gaaaatttgtcccttccgagaagct

SEQ ID NO: 90818 - DNA, 25 bp, S. pombe
gaaaatcttatgtcacgtccgatga

SEQ ID NO: 90819 - DNA, 25 bp, S. pombe
gaacaatgcgcaatggctgcctggt

SEQ ID NO: 90820 - DNA, 25 bp, S. pombe
gaacaacctctgtgctcatgagttt

SEQ ID NO: 90821 - DNA, 25 bp, S. pombe
gaaaatctttgtcgacaggctctat

SEQ ID NO: 90822 - DNA, 25 bp, S. pombe
gaaacaatagccgtggccgtcgacg

SEQ ID NO: 90823 - DNA, 25 bp, S. pombe
gaaaatcttctctttcggtcggaag

SEQ ID NO: 90824 - DNA, 25 bp, S. pombe
gaaaatccttttatcgcccatgaat

SEQ ID NO: 90825 - DNA, 25 bp, S. pombe
gaaaattttactaccgcagctcgtc

SEQ ID NO: 90826 - DNA, 25 bp, S. pombe
gaaaaccttagtgccaatgcggcct

SEQ ID NO: 90827 - DNA, 25 bp, S. pombe
gaaaacgtttacttcaccattggct

SEQ ID NO: 90828 - DNA, 25 bp, S. pombe
gaaaatctggccacgaactcgtcag

SEQ ID NO: 90829 - DNA, 25 bp, S. pombe
gaaaactggctaccgatacttctcg

SEQ ID NO: 90830 - DNA, 25 bp, S. pombe
gaaaacattgacacagccctacttt

SEQ ID NO: 90831 - DNA, 25 bp, S. pombe
gaaaatgccgtattccaatctttgt

SEQ ID NO: 90832 - DNA, 25 bp, S. pombe
gaaaatcccgaatctcattctggtg

SEQ ID NO: 90833 - DNA, 25 bp, S. pombe
gaaaatcatcatcacctccattatc

SEQ ID NO: 90834 - DNA, 25 bp, S. pombe
gaaaatctctctaggcgtgttatcc

SEQ ID NO: 90835 - DNA, 25 bp, S. pombe
gaacaagctttacgtgctgctcgtc

SEQ ID NO: 90836 - DNA, 25 bp, S. pombe
gaacaactggtgaggctgccgatta

SEQ ID NO: 90837 - DNA, 25 bp, S. pombe
gaacaattcgttatgctgcctatgg

SEQ ID NO: 90838 - DNA, 25 bp, S. pombe
gaacacagtgctaagcgtcgcagtt

SEQ ID NO: 90839 - DNA, 25 bp, S. pombe
gaaaatgttactctgtacgctcctt

SEQ ID NO: 90840 - DNA, 25 bp, S. pombe
gaaaagttatcacggtttgccaatg

SEQ ID NO: 90841 - DNA, 25 bp, S. pombe
gaaaagtttctcgagttgggcaata

SEQ ID NO: 90842 - DNA, 25 bp, S. pombe
gaaaatttcggcgtcattgggatta

SEQ ID NO: 90843 - DNA, 25 bp, S. pombe
gaacactgctgttgaatcttccacc

SEQ ID NO: 90844 - DNA, 25 bp, S. pombe
gaaacatttagctagtctccatgag

SEQ ID NO: 90845 - DNA, 25 bp, S. pombe
gaacaattagcggatgctgccctaa

SEQ ID NO: 90846 - DNA, 25 bp, S. pombe
gaacaacgacgttcatgagcctgtt

SEQ ID NO: 90847 - DNA, 25 bp, S. pombe
gtattttacctgaggaaatccccat

SEQ ID NO: 90848 - DNA, 25 bp, S. pombe
gacagtcttaacttcatacaaattg

SEQ ID NO: 90849 - DNA, 25 bp, S. pombe
gacagaatgtccacctaaaatgatt

SEQ ID NO: 90850 - DNA, 25 bp, S. pombe
gaaacgtctttcctaaaatcattgt

SEQ ID NO: 90851 - DNA, 25 bp, S. pombe
gaacactttatgcttctcacttatc

SEQ ID NO: 90852 - DNA, 25 bp, S. pombe
gaacaattttgggtgctcctccagc

SEQ ID NO: 90853 - DNA, 25 bp, S. pombe
gaacaattatgccaagtctccacct

SEQ ID NO: 90854 - DNA, 25 bp, S. pombe
gaaaatatctcggtcgacttccaat

SEQ ID NO: 90855 - DNA, 25 bp, S. pombe
gaacaacctctgattactttacaaa

SEQ ID NO: 90856 - DNA, 25 bp, S. pombe
gaaaatctcctcatgacttagtcta

SEQ ID NO: 90857 - DNA, 25 bp, S. pombe
gaaaatctcaccttggttttgtcca

SEQ ID NO: 90858 - DNA, 25 bp, S. pombe
gaaacactaccggttacgctggtcg

SEQ ID NO: 90859 - DNA, 25 bp, S. pombe
gaaacaaaccacgtttcctgcctat

SEQ ID NO: 90860 - DNA, 25 bp, S. pombe
gaacaaggcacctgcatctggagat

SEQ ID NO: 90861 - DNA, 25 bp, S. pombe
gaaaaacctgcactaccggatgcta

SEQ ID NO: 90862 - DNA, 25 bp, S. pombe
gaaaaatgcttgacgcccgaatgat

SEQ ID NO: 90863 - DNA, 25 bp, S. pombe
gaaaagtcatctacccacggatgga

SEQ ID NO: 90864 - DNA, 25 bp, S. pombe
gaaaaggttctcttcttagagctga

SEQ ID NO: 90865 - DNA, 25 bp, S. pombe
gaaaaggttccattctatttatcaa

SEQ ID NO: 90866 - DNA, 25 bp, S. pombe
gaacaacattcttcttccaagcgta

SEQ ID NO: 90867 - DNA, 25 bp, S. pombe
gaaaaactgtccaacgactcacctt

SEQ ID NO: 90868 - DNA, 25 bp, S. pombe
gaaaaagcaattaagtctggcccaa

SEQ ID NO: 90869 - DNA, 25 bp, S. pombe
gaaaaagatcaagtcgtcgccaaag

SEQ ID NO: 90870 - DNA, 25 bp, S. pombe
gaacaaaatgatttccttgcctaag

SEQ ID NO: 90871 - DNA, 25 bp, S. pombe
gaaagtccagtttaacggtgcaata

SEQ ID NO: 90872 - DNA, 25 bp, S. pombe
gaaacccgttcggactggtgacgat

SEQ ID NO: 90873 - DNA, 25 bp, S. pombe
gaaaaccgttctgttggtgctaata

SEQ ID NO: 90874 - DNA, 25 bp, S. pombe
gaaaaaccttgtcattacgcatata

SEQ ID NO: 90875 - DNA, 25 bp, S. pombe
gaaaatgaactttctcttcctgcat

SEQ ID NO: 90876 - DNA, 25 bp, S. pombe
gaacaagagttgcatcgctacgaaa

SEQ ID NO: 90877 - DNA, 25 bp, S. pombe
gaaaaggcaatcactggactccatc

SEQ ID NO: 90878 - DNA, 25 bp, S. pombe
gaaaagccgtcaatctggaaccctt

SEQ ID NO: 90879 - DNA, 25 bp, S. pombe
gaaaacattgcctcttcggtttcaa

SEQ ID NO: 90880 - DNA, 25 bp, S. pombe
gaaaatctttctactacggtcctca

SEQ ID NO: 90881 - DNA, 25 bp, S. pombe
gaaaacgtatctgcttctgcgtcca

SEQ ID NO: 90882 - DNA, 25 bp, S. pombe
gaaaatgagggtccatccgttctct

SEQ ID NO: 90883 - DNA, 25 bp, S. pombe
gaaacttgggtgatgctctacttac

SEQ ID NO: 90884 - DNA, 25 bp, S. pombe
gaaaaggcagcaccttctgcaatag

SEQ ID NO: 90885 - DNA, 25 bp, S. pombe
gaaaatggctctgacacttaccgct

SEQ ID NO: 90886 - DNA, 25 bp, S. pombe
gaaaatgtccgttccatcttcttta

SEQ ID NO: 90887 - DNA, 25 bp, S. pombe
gaaaatgcttcagtttcttttttga

SEQ ID NO: 90888 - DNA, 25 bp, S. pombe
gaaaatctatacgtccttggtgtta

SEQ ID NO: 90889 - DNA, 25 bp, S. pombe
gaaaaatttgcctctgcggatcagc

SEQ ID NO: 90890 - DNA, 25 bp, S. pombe
gaaaagtgtctcctgttaaacgtga

SEQ ID NO: 90891 - DNA, 25 bp, S. pombe
gaaaatcgtttgctatcatctccag

SEQ ID NO: 90892 - DNA, 25 bp, S. pombe
gaaaatcttcttcttgaccggtttg

SEQ ID NO: 90893 - DNA, 25 bp, S. pombe
gaaaatagcctttaccaccaatcat

SEQ ID NO: 90894 - DNA, 25 bp, S. pombe
gaaaatttcttctccactacattgg

SEQ ID NO: 90895 - DNA, 25 bp, S. pombe
gaacaaggtctataccctgctgaag

SEQ ID NO: 90896 - DNA, 25 bp, S. pombe
gaaactggtagcgttccttggtcaa

SEQ ID NO: 90897 - DNA, 25 bp, S. pombe
gaaaatggtgatttgacctcgcctc

SEQ ID NO: 90898 - DNA, 25 bp, S. pombe
gaaaaatctttggacctccttcgct

SEQ ID NO: 90899 - DNA, 25 bp, S. pombe
gaaaactcttgttacttccattccg

SEQ ID NO: 90900 - DNA, 25 bp, S. pombe
gaaaacacctttcctaacattctcg

SEQ ID NO: 90901 - DNA, 25 bp, S. pombe
gaaacaatgccctgtatgtacgccc

SEQ ID NO: 90902 - DNA, 25 bp, S. pombe
gaaaaccacctgtaatgtctttgca

SEQ ID NO: 90903 - DNA, 25 bp, S. pombe
gaaaaacccaaagctcgtgcatcta

SEQ ID NO: 90904 - DNA, 25 bp, S. pombe
gaaaattcagctcccgatagcttat

SEQ ID NO: 90905 - DNA, 25 bp, S. pombe
gaaaattcactcttcgcgacgttcc

SEQ ID NO: 90906 - DNA, 25 bp, S. pombe
gaaatttcatgtgtcggtcttagcg

SEQ ID NO: 90907 - DNA, 25 bp, S. pombe
gaaaattttgctacctctttgggct

SEQ ID NO: 90908 - DNA, 25 bp, S. pombe
gaaaatatcacttttgacgcacaag

SEQ ID NO: 90909 - DNA, 25 bp, S. pombe
gaaaagccgtgttgtgtttgcagca

SEQ ID NO: 90910 - DNA, 25 bp, S. pombe
gaaaagcctgtatttgtgacgagat

SEQ ID NO: 90911 - DNA, 25 bp, S. pombe
gaaatgaccacgattacaggcccca

SEQ ID NO: 90912 - DNA, 25 bp, S. pombe
gaaacctttgtttagccaatacaga

SEQ ID NO: 90913 - DNA, 25 bp, S. pombe
gaaaatctgcccataatgccaaagt

SEQ ID NO: 90914 - DNA, 25 bp, S. pombe
gaaaatgcccgaaatctcttatcaa

SEQ ID NO: 90915 - DNA, 25 bp, S. pombe
gaaacagtagtagcatcggattaag

SEQ ID NO: 90916 - DNA, 25 bp, S. pombe
gaaaagttctatctcggcttcgatg

SEQ ID NO: 90917 - DNA, 25 bp, S. pombe
gaaaatctgccaacaacccgttcat

SEQ ID NO: 90918 - DNA, 25 bp, S. pombe
gaaaagatccctggagccaatcctg

SEQ ID NO: 90919 - DNA, 25 bp, S. pombe
gaaaagtgccaagatcgatgctact

SEQ ID NO: 90920 - DNA, 25 bp, S. pombe
gaaacattgccatgatgacggataa

SEQ ID NO: 90921 - DNA, 25 bp, S. pombe
gaaaatatccctcctatgctagtga

SEQ ID NO: 90922 - DNA, 25 bp, S. pombe
gaaaatctactcagcgcatacgcga

SEQ ID NO: 90923 - DNA, 25 bp, S. pombe
gaaaatcttgtcacgcacacacagt

SEQ ID NO: 90924 - DNA, 25 bp, S. pombe
gaaaactgatccttctaccaaagaa

SEQ ID NO: 90925 - DNA, 25 bp, S. pombe
gaaaattttatacatgctgccgaaa

SEQ ID NO: 90926 - DNA, 25 bp, S. pombe
gaaactagtgctaaagcgggtcaca

SEQ ID NO: 90927 - DNA, 25 bp, S. pombe
gaaacggcggtatggtggtcaacaa

SEQ ID NO: 90928 - DNA, 25 bp, S. pombe
gaaatcgtcggttatggtagccatt

SEQ ID NO: 90929 - DNA, 25 bp, S. pombe
gaaacagtccgtcagaagcagttgg

SEQ ID NO: 90930 - DNA, 25 bp, S. pombe
gaaatcccacgtgaaacagtctcag

SEQ ID NO: 90931 - DNA, 25 bp, S. pombe
gaaacccggtacaaacgtatcagat

SEQ ID NO: 90932 - DNA, 25 bp, S. pombe
gaaaccgcaagtttaccgtcatctt

SEQ ID NO: 90933 - DNA, 25 bp, S. pombe
gaaacccgaacatcgactatcactt

SEQ ID NO: 90934 - DNA, 25 bp, S. pombe
gaaaaactagactcgaaggctcttc

SEQ ID NO: 90935 - DNA, 25 bp, S. pombe
gaaacttgcccagcatgtgaagcta

SEQ ID NO: 90936 - DNA, 25 bp, S. pombe
gaaaatcagcttcgtcgtcacaatt

SEQ ID NO: 90937 - DNA, 25 bp, S. pombe
gaaaactgctgtcgacgtatcagat

SEQ ID NO: 90938 - DNA, 25 bp, S. pombe
gaaaactgcttcaagtattccatga

SEQ ID NO: 90939 - DNA, 25 bp, S. pombe
gaaaagtggtgtgccacgtctttta

SEQ ID NO: 90940 - DNA, 25 bp, S. pombe
gaaaatgatggtcgtcctagtctta

SEQ ID NO: 90941 - DNA, 25 bp, S. pombe
gaaaatgtcgtttgctttgccttgc

SEQ ID NO: 90942 - DNA, 25 bp, S. pombe
gaaaatcgacaacgtctccagaaag

SEQ ID NO: 90943 - DNA, 25 bp, S. pombe
gaaaaccttactctcatatgttcct

SEQ ID NO: 90944 - DNA, 25 bp, S. pombe
gaaagcttcgtaaggccaagtctga

SEQ ID NO: 90945 - DNA, 25 bp, S. pombe
gacaggaacggtttcggctttacag

SEQ ID NO: 90946 - DNA, 25 bp, S. pombe
gaaaatgcctcttcagaagtgtcta

SEQ ID NO: 90947 - DNA, 25 bp, S. pombe
gaaaaggtcgtcaacatggctgtca

SEQ ID NO: 90948 - DNA, 25 bp, S. pombe
gaaaagtcattcacctgctattaaa

SEQ ID NO: 90949 - DNA, 25 bp, S. pombe
gaaaaggctgtttccgctacagtac

SEQ ID NO: 90950 - DNA, 25 bp, S. pombe
gaaaaagctgtggaccgttcctacg

SEQ ID NO: 90951 - DNA, 25 bp, S. pombe
gaaaaagctcgaagcggccatccta

SEQ ID NO: 90952 - DNA, 25 bp, S. pombe
gaaaactgtagccacctctaatcta

SEQ ID NO: 90953 - DNA, 25 bp, S. pombe
gaaaacttccagacctgctgatcat

SEQ ID NO: 90954 - DNA, 25 bp, S. pombe
gaaaatgcccctatgcttgacaagc

SEQ ID NO: 90955 - DNA, 25 bp, S. pombe
gaaaagccctctgtggtgtatacta

SEQ ID NO: 90956 - DNA, 25 bp, S. pombe
gaaaaccacgcttctggtggtcgtt

SEQ ID NO: 90957 - DNA, 25 bp, S. pombe
gaaaagaatccatctcgctctgatc

SEQ ID NO: 90958 - DNA, 25 bp, S. pombe
gaaacagagagcctgactgcccatt

SEQ ID NO: 90959 - DNA, 25 bp, S. pombe
gaaaaagatccgtctcgccatcttc

SEQ ID NO: 90960 - DNA, 25 bp, S. pombe
gaaactcgtattctcaaacctctta

SEQ ID NO: 90961 - DNA, 25 bp, S. pombe
gaaaaagtcgtccatccttgatatt

SEQ ID NO: 90962 - DNA, 25 bp, S. pombe
gaaaacatgtggtccatccgtgcta

SEQ ID NO: 90963 - DNA, 25 bp, S. pombe
gaaaagcttcttagacttggccaag

SEQ ID NO: 90964 - DNA, 25 bp, S. pombe
gaaaatgccgaatccttaccagaaa

SEQ ID NO: 90965 - DNA, 25 bp, S. pombe
gaaacgacctcatactatcattacg

SEQ ID NO: 90966 - DNA, 25 bp, S. pombe
gaaacaagcagttcccgaaattgag

SEQ ID NO: 90967 - DNA, 25 bp, S. pombe
gaaaaccggttcttcactacatacg

SEQ ID NO: 90968 - DNA, 25 bp, S. pombe
gaaaagcctctgatcgtcaacgtga

SEQ ID NO: 90969 - DNA, 25 bp, S. pombe
gaaaatgttgcactcatcgcttata

SEQ ID NO: 90970 - DNA, 25 bp, S. pombe
gaaaagcttgatccagctctcgttc

SEQ ID NO: 90971 - DNA, 25 bp, S. pombe
gaaaagattctttcccttcaacgtg

SEQ ID NO: 90972 - DNA, 25 bp, S. pombe
gaaaatgttccaacgcgtagccagt

SEQ ID NO: 90973 - DNA, 25 bp, S. pombe
gaaaagtgtgccaactctcgagccg

SEQ ID NO: 90974 - DNA, 25 bp, S. pombe
gaaaagttacgactgctgccgccga

SEQ ID NO: 90975 - DNA, 25 bp, S. pombe
gaaaagttacaagggccgcggtcat

SEQ ID NO: 90976 - DNA, 25 bp, S. pombe
gaaaaaatccttcgcgcttttgagc

SEQ ID NO: 90977 - DNA, 25 bp, S. pombe
gaaaaaaccttcgtgctgttctcaa

SEQ ID NO: 90978 - DNA, 25 bp, S. pombe
gaaaaaccctcgtgctgttctaacg

SEQ ID NO: 90979 - DNA, 25 bp, S. pombe
gaaaaacctctggacgtggtcataa

SEQ ID NO: 90980 - DNA, 25 bp, S. pombe
gaaaaatttccttggttcgtgcgcg

SEQ ID NO: 90981 - DNA, 25 bp, S. pombe
gaaaactttcctaagctttgagcga

SEQ ID NO: 90982 - DNA, 25 bp, S. pombe
gaaaacgttcacattctttgcgatt

SEQ ID NO: 90983 - DNA, 25 bp, S. pombe
gaaaacgatccttttgcttctcgaa

SEQ ID NO: 90984 - DNA, 25 bp, S. pombe
gaaaacacgttctttgctactcgac

SEQ ID NO: 90985 - DNA, 25 bp, S. pombe
gaaaacgttcttcgtctcgtagtga

SEQ ID NO: 90986 - DNA, 25 bp, S. pombe
gaaatactcgtcctcgaagtcgatc

SEQ ID NO: 90987 - DNA, 25 bp, S. pombe
gaaaacgttagtggcatccgtatga

SEQ ID NO: 90988 - DNA, 25 bp, S. pombe
gaaaaggtctcatttgtccgcatta

SEQ ID NO: 90989 - DNA, 25 bp, S. pombe
gaaaaggcagatcatcctccatctt

SEQ ID NO: 90990 - DNA, 25 bp, S. pombe
gaaactactacgttttatcgggcag

SEQ ID NO: 90991 - DNA, 25 bp, S. pombe
gaaacgcactaaacgtgttcgccga

SEQ ID NO: 90992 - DNA, 25 bp, S. pombe
gaaacttcatacgtaggttcacctg

SEQ ID NO: 90993 - DNA, 25 bp, S. pombe
gaaaaggtgcaaagcccttatccta

SEQ ID NO: 90994 - DNA, 25 bp, S. pombe
gaaaaggttcctctgatgacccaat

SEQ ID NO: 90995 - DNA, 25 bp, S. pombe
gaaaactcttaaacgggcgcgcgat

SEQ ID NO: 90996 - DNA, 25 bp, S. pombe
gaaagattatactgtcgaacccggg

SEQ ID NO: 90997 - DNA, 25 bp, S. pombe
gaaactttacatcttaacgccgcca

SEQ ID NO: 90998 - DNA, 25 bp, S. pombe
gaaactttcagatgagtaccaccgt

SEQ ID NO: 90999 - DNA, 25 bp, S. pombe
gaaaactgtcaacgaggaccccatt

SEQ ID NO: 91000 - DNA, 25 bp, S. pombe
gaaaacattacgctgagtgccccat

SEQ ID NO: 91001 - DNA, 25 bp, S. pombe
gagttcgcgcaaaaccggaaactgt

SEQ ID NO: 91002 - DNA, 25 bp, S. pombe
gaaaccacctacacaaggtcttgaa

SEQ ID NO: 91003 - DNA, 25 bp, S. pombe
gaaaacacagatccgtcaaggttcg

SEQ ID NO: 91004 - DNA, 25 bp, S. pombe
gaaaagctgcctggcgtccattttt

SEQ ID NO: 91005 - DNA, 25 bp, S. pombe
gaaaagctgcagactttccttcgct

SEQ ID NO: 91006 - DNA, 25 bp, S. pombe
gaaaacgtattgtatccgatcgcat

SEQ ID NO: 91007 - DNA, 25 bp, S. pombe
gaaaactacagttcctagcattgaa

SEQ ID NO: 91008 - DNA, 25 bp, S. pombe
gaaaagcttagttttgcaagagcaa

SEQ ID NO: 91009 - DNA, 25 bp, S. pombe
gaaaagcttccattttgcgtgaaaa

SEQ ID NO: 91010 - DNA, 25 bp, S. pombe
gaaaactacgcctattctttgaaag

SEQ ID NO: 91011 - DNA, 25 bp, S. pombe
gaaaaacacacctgattgctatgat

SEQ ID NO: 91012 - DNA, 25 bp, S. pombe
gaaacctgaaccttgtatcactgtc

SEQ ID NO: 91013 - DNA, 25 bp, S. pombe
gaaacggtctggtcattcctattcc

SEQ ID NO: 91014 - DNA, 25 bp, S. pombe
gaaacaagcctgcagctgctgttac

SEQ ID NO: 91015 - DNA, 25 bp, S. pombe
gaaaaacctcatcctgttttcacac

SEQ ID NO: 91016 - DNA, 25 bp, S. pombe
gaaacttcttccgttattcgtctct

SEQ ID NO: 91017 - DNA, 25 bp, S. pombe
gaaaaccttggtttgcatcacaccc

SEQ ID NO: 91018 - DNA, 25 bp, S. pombe
gaaaactctcgtttagctatccctt

SEQ ID NO: 91019 - DNA, 25 bp, S. pombe
gaaaacctatcttgtactccctgtg

SEQ ID NO: 91020 - DNA, 25 bp, S. pombe
gaaacacctttgtcaatttccgatt

SEQ ID NO: 91021 - DNA, 25 bp, S. pombe
gaaaaagcttctatgcacgctccag

SEQ ID NO: 91022 - DNA, 25 bp, S. pombe
gaaagagttgaacggtatcaccaag

SEQ ID NO: 91023 - DNA, 25 bp, S. pombe
gaaaaatatgctagcccagatgata

SEQ ID NO: 91024 - DNA, 25 bp, S. pombe
tgataacgtccgaacttggtttagt

SEQ ID NO: 91025 - DNA, 25 bp, S. pombe
gaaactaccggccttggttgtgaca

SEQ ID NO: 91026 - DNA, 25 bp, S. pombe
gaaaccaacttgcaaggcgcttagc

SEQ ID NO: 91027 - DNA, 25 bp, S. pombe
gaaactatcaaacgtgctcacgctg

SEQ ID NO: 91028 - DNA, 25 bp, S. pombe
gaaacaaagctttctgtgaaggaga

SEQ ID NO: 91029 - DNA, 25 bp, S. pombe
gaaacaaactccttttatgggcaga

SEQ ID NO: 91030 - DNA, 25 bp, S. pombe
gaaactgaacgacctcatgatacta

SEQ ID NO: 91031 - DNA, 25 bp, S. pombe
gaaactcaagctgactcaatcgcta

SEQ ID NO: 91032 - DNA, 25 bp, S. pombe
gaaacactggaagaagcacctgaga

SEQ ID NO: 91033 - DNA, 25 bp, S. pombe
gaaaccgttctattggtaccaagct

SEQ ID NO: 91034 - DNA, 25 bp, S. pombe
gaaaccagtttttcagactcttcaa

SEQ ID NO: 91035 - DNA, 25 bp, S. pombe
gaaaacaggcatttggagaccccaa

SEQ ID NO: 91036 - DNA, 25 bp, S. pombe
gaaaaccgcatttggacagctccct

SEQ ID NO: 91037 - DNA, 25 bp, S. pombe
gaaaacaagtctggtgcctccacga

SEQ ID NO: 91038 - DNA, 25 bp, S. pombe
gaaaacaagtcttctgtgtccacag

SEQ ID NO: 91039 - DNA, 25 bp, S. pombe
gaaacacttttgatcggccaagcta

SEQ ID NO: 91040 - DNA, 25 bp, S. pombe
gaaacacttttagccgacaacgatg

SEQ ID NO: 91041 - DNA, 25 bp, S. pombe
gaaacgtttaaaccgatcagtcgag

SEQ ID NO: 91042 - DNA, 25 bp, S. pombe
gaaacagttctgtaagccgctcttc

SEQ ID NO: 91043 - DNA, 25 bp, S. pombe
gaaacagccttgtctttggctttcc

SEQ ID NO: 91044 - DNA, 25 bp, S. pombe
gaaacagctcggtcttttttatcca

SEQ ID NO: 91045 - DNA, 25 bp, S. pombe
gaaacagctggccattttgtcttga

SEQ ID NO: 91046 - DNA, 25 bp, S. pombe
gaaagcggctggacatcgtgactct

SEQ ID NO: 91047 - DNA, 25 bp, S. pombe
gaaacgatgggcaacagtcctttag

SEQ ID NO: 91048 - DNA, 25 bp, S. pombe
gaaactatagctcacattcctttgg

SEQ ID NO: 91049 - DNA, 25 bp, S. pombe
gaaacagtgctttggctggcttggc

SEQ ID NO: 91050 - DNA, 25 bp, S. pombe
gaaacctcgttaccgactggtgata

SEQ ID NO: 91051 - DNA, 25 bp, S. pombe
gaaacttggttagctgcctatgtaa

SEQ ID NO: 91052 - DNA, 25 bp, S. pombe
gaaacttctttctatcgtcatatgt

SEQ ID NO: 91053 - DNA, 25 bp, S. pombe
gaaactttttgctttgcgattaccg

SEQ ID NO: 91054 - DNA, 25 bp, S. pombe
gaaaaagtcgttctcctccgcaatc

SEQ ID NO: 91055 - DNA, 25 bp, S. pombe
gaaaaaatctgccttttctccgcaa

SEQ ID NO: 91056 - DNA, 25 bp, S. pombe
gaaacatttggtcctgttggcgctt

SEQ ID NO: 91057 - DNA, 25 bp, S. pombe
gaaacactccgtggttttgatcgtt

SEQ ID NO: 91058 - DNA, 25 bp, S. pombe
gaaacttccggtttgcttacagata

SEQ ID NO: 91059 - DNA, 25 bp, S. pombe
gaaagaattcgtacagtgcttgaag

SEQ ID NO: 91060 - DNA, 25 bp, S. pombe
gaaaacatgtcacctgcacttataa

SEQ ID NO: 91061 - DNA, 25 bp, S. pombe
gaaagccagaattgcagttgagttt

SEQ ID NO: 91062 - DNA, 25 bp, S. pombe
gaaatcgaaatacgcaatcagttgt

SEQ ID NO: 91063 - DNA, 25 bp, S. pombe
gaaacggcgaatggatcaagatctt

SEQ ID NO: 91064 - DNA, 25 bp, S. pombe
gaaagttcatccgattcagatagtg

SEQ ID NO: 91065 - DNA, 25 bp, S. pombe
gaaactgtctccgttgaggatgctt

SEQ ID NO: 91066 - DNA, 25 bp, S. pombe
gaaacttcaacttaacaaactcacg

SEQ ID NO: 91067 - DNA, 25 bp, S. pombe
gaaacgtttaaatcacgtctggaag

SEQ ID NO: 91068 - DNA, 25 bp, S. pombe
gacaccttttgagattagtactgga

SEQ ID NO: 91069 - DNA, 25 bp, S. pombe
gaaacttataacttgtcgtccagga

SEQ ID NO: 91070 - DNA, 25 bp, S. pombe
gaaacaatcccaagctacgtcaaga

SEQ ID NO: 91071 - DNA, 25 bp, S. pombe
tcaggacgacaaccttaccttggta

SEQ ID NO: 91072 - DNA, 25 bp, S. pombe
tattgggaaacctgtccttgttcgt

SEQ ID NO: 91073 - DNA, 25 bp, S. pombe
tgttcgtggagacaacaaggttttc

SEQ ID NO: 91074 - DNA, 25 bp, S. pombe
gatctcgaaaagtttacggtgttct

SEQ ID NO: 91075 - DNA, 25 bp, S. pombe
gagcccaaaattcatcctggtcttt

SEQ ID NO: 91076 - DNA, 25 bp, S. pombe
gaaacactagttcaactggcatctt

SEQ ID NO: 91077 - DNA, 25 bp, S. pombe
gaaacttcgtgcacaatcatggatc

SEQ ID NO: 91078 - DNA, 25 bp, S. pombe
gaaacttggtgctcattgcatgtca

SEQ ID NO: 91079 - DNA, 25 bp, S. pombe
gaaacgacgtgctcactctgatagg

SEQ ID NO: 91080 - DNA, 25 bp, S. pombe
gaaactgagccttccacttgtaaag

SEQ ID NO: 91081 - DNA, 25 bp, S. pombe
gaaactagcttttccattttcaaag

SEQ ID NO: 91082 - DNA, 25 bp, S. pombe
gaaacaggtctcaaacccaacggag

SEQ ID NO: 91083 - DNA, 25 bp, S. pombe
gaaaacagctcttaagttgcactaa

SEQ ID NO: 91084 - DNA, 25 bp, S. pombe
gaaaaagcgttccttatcctggcat

SEQ ID NO: 91085 - DNA, 25 bp, S. pombe
gagaaaacgtatctttttggtgccg

SEQ ID NO: 91086 - DNA, 25 bp, S. pombe
gaaaaacgatatttcttccgccgca

SEQ ID NO: 91087 - DNA, 25 bp, S. pombe
gaaaaaagcaagtctcgatccgtcg

SEQ ID NO: 91088 - DNA, 25 bp, S. pombe
gaaaacagacaaccctgatgccacc

SEQ ID NO: 91089 - DNA, 25 bp, S. pombe
gaaaaaatcattcccattgctgcaa

SEQ ID NO: 91090 - DNA, 25 bp, S. pombe
gaaaaaatcattcgcctccgtgctg

SEQ ID NO: 91091 - DNA, 25 bp, S. pombe
gaaaacaaattcctcgcttgggcca

SEQ ID NO: 91092 - DNA, 25 bp, S. pombe
gaaaacagcatttcaccgtttgcct

SEQ ID NO: 91093 - DNA, 25 bp, S. pombe
gaaaaactctttgcgctgatcgaag

SEQ ID NO: 91094 - DNA, 25 bp, S. pombe
gaaaaactcaatgctcatgctttag

SEQ ID NO: 91095 - DNA, 25 bp, S. pombe
gaaaaactggcatccatgattctgg

SEQ ID NO: 91096 - DNA, 25 bp, S. pombe
gaaacactgttcgagagctcaagct

SEQ ID NO: 91097 - DNA, 25 bp, S. pombe
gaaacagcgttcctatctatactca

SEQ ID NO: 91098 - DNA, 25 bp, S. pombe
gaaacggatacatttggcgctgaag

SEQ ID NO: 91099 - DNA, 25 bp, S. pombe
gaaacttcatcatcttcgggacaga

SEQ ID NO: 91100 - DNA, 25 bp, S. pombe
gaaacattactctgtgtgcggacaa

SEQ ID NO: 91101 - DNA, 25 bp, S. pombe
gaaacagttgctttaatcgtgctag

SEQ ID NO: 91102 - DNA, 25 bp, S. pombe
gaaacttggagctggtcgatcatta

SEQ ID NO: 91103 - DNA, 25 bp, S. pombe
gaaactatggccttgttcaatctga

SEQ ID NO: 91104 - DNA, 25 bp, S. pombe
gaaacccaaatgctgtgagtctgaa

SEQ ID NO: 91105 - DNA, 25 bp, S. pombe
gaaactcctgagcaagtgatagcca

SEQ ID NO: 91106 - DNA, 25 bp, S. pombe
gaaactcgaaatcgcatttgggccg

SEQ ID NO: 91107 - DNA, 25 bp, S. pombe
gaaacctccaaaatttctgccgtgg

SEQ ID NO: 91108 - DNA, 25 bp, S. pombe
gaaaccgacactagtccaggatcgt

SEQ ID NO: 91109 - DNA, 25 bp, S. pombe
gaaacttggcctatgctacagtctt

SEQ ID NO: 91110 - DNA, 25 bp, S. pombe
gaaacaattgcctttgctaaacagt

SEQ ID NO: 91111 - DNA, 25 bp, S. pombe
gaaaccgatcccgaccatttgaaat

SEQ ID NO: 91112 - DNA, 25 bp, S. pombe
gaaaccggcctctatccaaaggaat

SEQ ID NO: 91113 - DNA, 25 bp, S. pombe
gaaacgagccttttccaacattgtt

SEQ ID NO: 91114 - DNA, 25 bp, S. pombe
gaaatagacctttttaccatatcgt

SEQ ID NO: 91115 - DNA, 25 bp, S. pombe
gaaaaatcctggtcaaccgctactt

SEQ ID NO: 91116 - DNA, 25 bp, S. pombe
gaaacttgcaagttcttcattcgaa

SEQ ID NO: 91117 - DNA, 25 bp, S. pombe
gaaaccatatgatccgagcgctgta

SEQ ID NO: 91118 - DNA, 25 bp, S. pombe
gaaacagccatgtgattttgtcgta

SEQ ID NO: 91119 - DNA, 25 bp, S. pombe
gaaaccggaattacctgctgctaaa

SEQ ID NO: 91120 - DNA, 25 bp, S. pombe
gaaactccgacgaattctggttcta

SEQ ID NO: 91121 - DNA, 25 bp, S. pombe
gaaagcctcgggatttggacaaaca

SEQ ID NO: 91122 - DNA, 25 bp, S. pombe
gaaactttacagtcgctatcagtag

SEQ ID NO: 91123 - DNA, 25 bp, S. pombe
gaaacactttattccttactggata

SEQ ID NO: 91124 - DNA, 25 bp, S. pombe
gaaaaattcttgaccgtccttcatg

SEQ ID NO: 91125 - DNA, 25 bp, S. pombe
gaaaaattttcacatgtcccattga

SEQ ID NO: 91126 - DNA, 25 bp, S. pombe
gaaacatttacatcctgaaactcat

SEQ ID NO: 91127 - DNA, 25 bp, S. pombe
gaaacacggactgttggaactccaa

SEQ ID NO: 91128 - DNA, 25 bp, S. pombe
gaaacatccgtttgcttgctgatgg

SEQ ID NO: 91129 - DNA, 25 bp, S. pombe
gaaactccgtgactttttggaatcg

SEQ ID NO: 91130 - DNA, 25 bp, S. pombe
gaaacacctctctttgtttgcgaaa

SEQ ID NO: 91131 - DNA, 25 bp, S. pombe
gacaataacctcctttattcgggag

SEQ ID NO: 91132 - DNA, 25 bp, S. pombe
gactctcaagtcagcattaaacggt

SEQ ID NO: 91133 - DNA, 25 bp, S. pombe
gactgtcaagttgaaagaacgactt

SEQ ID NO: 91134 - DNA, 25 bp, S. pombe
gaaacaagaatgtcctgctccgttg

SEQ ID NO: 91135 - DNA, 25 bp, S. pombe
gaaatacgtcagtttccctgcaatg

SEQ ID NO: 91136 - DNA, 25 bp, S. pombe
gaaaaagctgcaccagtccctaaaa

SEQ ID NO: 91137 - DNA, 25 bp, S. pombe
gaaacaaaagttagccgctgggcaa

SEQ ID NO: 91138 - DNA, 25 bp, S. pombe
gaaagcactactgtacccaaacgat

SEQ ID NO: 91139 - DNA, 25 bp, S. pombe
gaaagggcgcctacttctgaaagta

SEQ ID NO: 91140 - DNA, 25 bp, S. pombe
gaaacgacaaattcttctcttaagg

SEQ ID NO: 91141 - DNA, 25 bp, S. pombe
gaaacctcaaactcagctgctttct

SEQ ID NO: 91142 - DNA, 25 bp, S. pombe
gaaatcggaaaactcgctgttcctc

SEQ ID NO: 91143 - DNA, 25 bp, S. pombe
gaaacacttactcgcaaggtaccag

SEQ ID NO: 91144 - DNA, 25 bp, S. pombe
gaaactaaacctcagcgctactatg

SEQ ID NO: 91145 - DNA, 25 bp, S. pombe
gaaactgttaccagacctcgtgctg

SEQ ID NO: 91146 - DNA, 25 bp, S. pombe
gaaacttgctcgatcgttgctattt

SEQ ID NO: 91147 - DNA, 25 bp, S. pombe
gaaactctgtcaattcgtggaaata

SEQ ID NO: 91148 - DNA, 25 bp, S. pombe
gaaacaatgcacgtctgtaacaact

SEQ ID NO: 91149 - DNA, 25 bp, S. pombe
gaaatccaatgtctcactcacaaac

SEQ ID NO: 91150 - DNA, 25 bp, S. pombe
gaaacagatttcatccctcaaactc

SEQ ID NO: 91151 - DNA, 25 bp, S. pombe
gaaaccagcttcaattgcctaacac

SEQ ID NO: 91152 - DNA, 25 bp, S. pombe
gaaacccttagattggatcctccag

SEQ ID NO: 91153 - DNA, 25 bp, S. pombe
gaaactccatcgtaaaggccagtaa

SEQ ID NO: 91154 - DNA, 25 bp, S. pombe
gaaaccgaagccaccagctatgttg

SEQ ID NO: 91155 - DNA, 25 bp, S. pombe
tgaaaggttgggttcctccacaagt

SEQ ID NO: 91156 - DNA, 25 bp, S. pombe
gaaacagctaagattgccgccaaag

SEQ ID NO: 91157 - DNA, 25 bp, S. pombe
gaaagcaatcaagaactaccggttt

SEQ ID NO: 91158 - DNA, 25 bp, S. pombe
gaaagacataccaagcaattagccg

SEQ ID NO: 91159 - DNA, 25 bp, S. pombe
gaaactgctctaaaggctgtggaaa

SEQ ID NO: 91160 - DNA, 25 bp, S. pombe
gaaactgcttcccatgatgctggag

SEQ ID NO: 91161 - DNA, 25 bp, S. pombe
gaaacagcctgacgttgctagcagt

SEQ ID NO: 91162 - DNA, 25 bp, S. pombe
gaaacacctacgaatctacgtttga

SEQ ID NO: 91163 - DNA, 25 bp, S. pombe
gaaaccctctatgttccagatactc

SEQ ID NO: 91164 - DNA, 25 bp, S. pombe
gaaacgccttcaacttcagaatctt

SEQ ID NO: 91165 - DNA, 25 bp, S. pombe
gaaacgctttctcttcgtatggagc

SEQ ID NO: 91166 - DNA, 25 bp, S. pombe
gaaactcgttctattcagtcataag

SEQ ID NO: 91167 - DNA, 25 bp, S. pombe
gaaagagccctctaaccaagcttct

SEQ ID NO: 91168 - DNA, 25 bp, S. pombe
gaaagccacaccagccgaattattg

SEQ ID NO: 91169 - DNA, 25 bp, S. pombe
gaaacaggcggttgtccacacgctg

SEQ ID NO: 91170 - DNA, 25 bp, S. pombe
gaaagcctcaggaccgaatcattag

SEQ ID NO: 91171 - DNA, 25 bp, S. pombe
gaaacgtggcttcactttccacatt

SEQ ID NO: 91172 - DNA, 25 bp, S. pombe
gaaactcgatttcaccatttgctga

SEQ ID NO: 91173 - DNA, 25 bp, S. pombe
gaaactcagttggagacctttgatg

SEQ ID NO: 91174 - DNA, 25 bp, S. pombe
gaaactcatcttcagccatgcaaat

SEQ ID NO: 91175 - DNA, 25 bp, S. pombe
gaaactccagatcacagcatcgaaa

SEQ ID NO: 91176 - DNA, 25 bp, S. pombe
gaaactgctgagaacactgggaata

SEQ ID NO: 91177 - DNA, 25 bp, S. pombe
gaaagtcaactatcgctggttttaa

SEQ ID NO: 91178 - DNA, 25 bp, S. pombe
gaaagccagttatcgagttccgtat

SEQ ID NO: 91179 - DNA, 25 bp, S. pombe
gaaagccgttaaagctcttcgagat

SEQ ID NO: 91180 - DNA, 25 bp, S. pombe
gaaaccggctgatcgtaacaacgtc

SEQ ID NO: 91181 - DNA, 25 bp, S. pombe
gaaagccttattatcttaccgacga

SEQ ID NO: 91182 - DNA, 25 bp, S. pombe
gaaaggcttaacaaggccaccgttg

SEQ ID NO: 91183 - DNA, 25 bp, S. pombe
gaaaccggatacatgtgccccgtag

SEQ ID NO: 91184 - DNA, 25 bp, S. pombe
gacaaggccttttgggaacacctga

SEQ ID NO: 91185 - DNA, 25 bp, S. pombe
gaaaggtgcctttggagaatctcct

SEQ ID NO: 91186 - DNA, 25 bp, S. pombe
gaaagatgtcccatggtcgattact

SEQ ID NO: 91187 - DNA, 25 bp, S. pombe
gaaagttcctttagccagtcgagtg

SEQ ID NO: 91188 - DNA, 25 bp, S. pombe
gaaacttcctttagaatctatggac

SEQ ID NO: 91189 - DNA, 25 bp, S. pombe
gaaactgtcggctacgtatctatgg

SEQ ID NO: 91190 - DNA, 25 bp, S. pombe
gaaagccttcggtgagttttctcag

SEQ ID NO: 91191 - DNA, 25 bp, S. pombe
gaaatcgttactctttggtgctcga

SEQ ID NO: 91192 - DNA, 25 bp, S. pombe
gaaaggtttcctgcgttagatgctt

SEQ ID NO: 91193 - DNA, 25 bp, S. pombe
gaaacttttcctgctgatcttgatt

SEQ ID NO: 91194 - DNA, 25 bp, S. pombe
gaaacttcattttccgatcgtcttg

SEQ ID NO: 91195 - DNA, 25 bp, S. pombe
gaaactcttgattcccgaggattct

SEQ ID NO: 91196 - DNA, 25 bp, S. pombe
gaaatccttgaagccagtaccgatc

SEQ ID NO: 91197 - DNA, 25 bp, S. pombe
gaaatactttactcctgacctgatg

SEQ ID NO: 91198 - DNA, 25 bp, S. pombe
gaaacctttacattcgcttccatgt

SEQ ID NO: 91199 - DNA, 25 bp, S. pombe
gaaacatctgttggttctcttccaa

SEQ ID NO: 91200 - DNA, 25 bp, S. pombe
gaaacatcgatttggctcttaagca

SEQ ID NO: 91201 - DNA, 25 bp, S. pombe
gaaactgtggttttgtccgccaagg

SEQ ID NO: 91202 - DNA, 25 bp, S. pombe
gaaacgtggtcttgattacctgcaa

SEQ ID NO: 91203 - DNA, 25 bp, S. pombe
gaaactccagcttctgtacaagaca

SEQ ID NO: 91204 - DNA, 25 bp, S. pombe
gaaagcttgcctactgctgaagatc

SEQ ID NO: 91205 - DNA, 25 bp, S. pombe
gaaacttgcttatctatcctcgatt

SEQ ID NO: 91206 - DNA, 25 bp, S. pombe
gaaacttgcagtttttccctctaat

SEQ ID NO: 91207 - DNA, 25 bp, S. pombe
gaaacttctcgtattcaagccaaga

SEQ ID NO: 91208 - DNA, 25 bp, S. pombe
gaaagcagaaacttaattccgcctt

SEQ ID NO: 91209 - DNA, 25 bp, S. pombe
gaaagaattttgttacgccctcaag

SEQ ID NO: 91210 - DNA, 25 bp, S. pombe
gaaatactgaaaccgctttcctccg

SEQ ID NO: 91211 - DNA, 25 bp, S. pombe
gaaacttgtgaactggctattgccc

SEQ ID NO: 91212 - DNA, 25 bp, S. pombe
gaaacttgctgaaaggttgcctctc

SEQ ID NO: 91213 - DNA, 25 bp, S. pombe
gaaacttgtcaacgttcacaatcga

SEQ ID NO: 91214 - DNA, 25 bp, S. pombe
gaaagcaattctaggtctccttcta

SEQ ID NO: 91215 - DNA, 25 bp, S. pombe
gaaagtaccgagctcgctacttctg

SEQ ID NO: 91216 - DNA, 25 bp, S. pombe
gaaattggctgatgtccgtacttta

SEQ ID NO: 91217 - DNA, 25 bp, S. pombe
gaaagcattatcattccctaccttt

SEQ ID NO: 91218 - DNA, 25 bp, S. pombe
gaaacttgtcaatcctcagggtact

SEQ ID NO: 91219 - DNA, 25 bp, S. pombe
gaaacttctttccatctaccgaatc

SEQ ID NO: 91220 - DNA, 25 bp, S. pombe
gaaactatttttcgtggtgctagaa

SEQ ID NO: 91221 - DNA, 25 bp, S. pombe
gaaacttcgttcaggtgtgccagta

SEQ ID NO: 91222 - DNA, 25 bp, S. pombe
gaaacttcgattacactggctcaga

SEQ ID NO: 91223 - DNA, 25 bp, S. pombe
gaaacttatcttttgcacctagcgt

SEQ ID NO: 91224 - DNA, 25 bp, S. pombe
gaaactagattctttgccctctacg

SEQ ID NO: 91225 - DNA, 25 bp, S. pombe
gaaactaattcctatgactcttgga

SEQ ID NO: 91226 - DNA, 25 bp, S. pombe
gaaactcagcattctcttttgaagg

SEQ ID NO: 91227 - DNA, 25 bp, S. pombe
gaaagccaatttctcgttgaccgta

SEQ ID NO: 91228 - DNA, 25 bp, S. pombe
gaaacccatggtcatcatgttgaca

SEQ ID NO: 91229 - DNA, 25 bp, S. pombe
gaaaccttagtgctgacattcctgc

SEQ ID NO: 91230 - DNA, 25 bp, S. pombe
gaaacctctactactaatgtcgctg

SEQ ID NO: 91231 - DNA, 25 bp, S. pombe
gaaaccagctttgcaattgttgcgt

SEQ ID NO: 91232 - DNA, 25 bp, S. pombe
gaaagaactcttgaagcgccgcgat

SEQ ID NO: 91233 - DNA, 25 bp, S. pombe
gaaagtactgttttgcagctcctaa

SEQ ID NO: 91234 - DNA, 25 bp, S. pombe
gaaactatggtcacacagcaccaaa

SEQ ID NO: 91235 - DNA, 25 bp, S. pombe
gaaactcttgttgtgcttgatccag

SEQ ID NO: 91236 - DNA, 25 bp, S. pombe
gaaactttgttgtctgcgctgtatt

SEQ ID NO: 91237 - DNA, 25 bp, S. pombe
gaaactttgctacgtcgctttggac

SEQ ID NO: 91238 - DNA, 25 bp, S. pombe
gaaactggtcttcgttgcttagaga

SEQ ID NO: 91239 - DNA, 25 bp, S. pombe
gaaactgaacttactgattcaccaa

SEQ ID NO: 91240 - DNA, 25 bp, S. pombe
gaaactctatttgcactgccgacag

SEQ ID NO: 91241 - DNA, 25 bp, S. pombe
gaaactgttcgatttttggcaattg

SEQ ID NO: 91242 - DNA, 25 bp, S. pombe
gaaagctgtctacgttcttggtatt

SEQ ID NO: 91243 - DNA, 25 bp, S. pombe
gaaactgttcatcgtctgctatgct

SEQ ID NO: 91244 - DNA, 25 bp, S. pombe
gaaactaagttcgttcttgtggata

SEQ ID NO: 91245 - DNA, 25 bp, S. pombe
gaaaccagctgttccttctgaaaga

SEQ ID NO: 91246 - DNA, 25 bp, S. pombe
gaaacgtctgttgctcctgaaaaag

SEQ ID NO: 91247 - DNA, 25 bp, S. pombe
gaaacgttactactgcacttcaacc

SEQ ID NO: 91248 - DNA, 25 bp, S. pombe
gaaactgtattccaacgattgcaac

SEQ ID NO: 91249 - DNA, 25 bp, S. pombe
gaaacgctgaaccaactgagacata

SEQ ID NO: 91250 - DNA, 25 bp, S. pombe
gaaagcgaatacaagaccaatatag

SEQ ID NO: 91251 - DNA, 25 bp, S. pombe
gacaacggcggctgcaatgaattca

SEQ ID NO: 91252 - DNA, 25 bp, S. pombe
gaaacgattactggcacaatttgca

SEQ ID NO: 91253 - DNA, 25 bp, S. pombe
gaaactgatcctttgcaaattgcca

SEQ ID NO: 91254 - DNA, 25 bp, S. pombe
gaaactatgcttatcagactctcaa

SEQ ID NO: 91255 - DNA, 25 bp, S. pombe
gaaactcgccgaagaggctgctcga

SEQ ID NO: 91256 - DNA, 25 bp, S. pombe
gagaaggcccatatggattcgtcca

SEQ ID NO: 91257 - DNA, 25 bp, S. pombe
gaaagcaccaatctggtccttctaa

SEQ ID NO: 91258 - DNA, 25 bp, S. pombe
gactacgaccgtcttaatcttgaga

SEQ ID NO: 91259 - DNA, 25 bp, S. pombe
gaaacgatccgtttgaacactagaa

SEQ ID NO: 91260 - DNA, 25 bp, S. pombe
gaaagttatagcagtcatccatcag

SEQ ID NO: 91261 - DNA, 25 bp, S. pombe
gaaactcttcgttcttgcattcaag

SEQ ID NO: 91262 - DNA, 25 bp, S. pombe
gaaagggtgcagaccatgcccgaaa

SEQ ID NO: 91263 - DNA, 25 bp, S. pombe
gaaaggcaatgccacagcagtcgcc

SEQ ID NO: 91264 - DNA, 25 bp, S. pombe
gaaagcgaatcaacagcatccccgg

SEQ ID NO: 91265 - DNA, 25 bp, S. pombe
gaaagcagacaatcagactctccaa

SEQ ID NO: 91266 - DNA, 25 bp, S. pombe
gaaacgtatattagactcagctcaa

SEQ ID NO: 91267 - DNA, 25 bp, S. pombe
gaaacgtgctttagccaagtctgaa

SEQ ID NO: 91268 - DNA, 25 bp, S. pombe
gaaacgtcttccacaaatctgccaa

SEQ ID NO: 91269 - DNA, 25 bp, S. pombe
gaaaccttcgatgcacttgttgaca

SEQ ID NO: 91270 - DNA, 25 bp, S. pombe
gaaagacttcagtaccacgttcacc

SEQ ID NO: 91271 - DNA, 25 bp, S. pombe
gaaagaatacgcgttactgttcccg

SEQ ID NO: 91272 - DNA, 25 bp, S. pombe
gaaatattttctgctactccttgtc

SEQ ID NO: 91273 - DNA, 25 bp, S. pombe
gaaatgctatatgccacgactcctt

SEQ ID NO: 91274 - DNA, 25 bp, S. pombe
gaaagcttcattcactgacttctct

SEQ ID NO: 91275 - DNA, 25 bp, S. pombe
gaaagagcactggtcggtgccgatt

SEQ ID NO: 91276 - DNA, 25 bp, S. pombe
gaaagccattcaagagcgccaagat

SEQ ID NO: 91277 - DNA, 25 bp, S. pombe
gaaaccctcatgatgcctttgaaat

SEQ ID NO: 91278 - DNA, 25 bp, S. pombe
gaaagatcactcacaccggtgctat

SEQ ID NO: 91279 - DNA, 25 bp, S. pombe
gaaactgttacacacgaatccatgt

SEQ ID NO: 91280 - DNA, 25 bp, S. pombe
gaaagattctacacgccatattttg

SEQ ID NO: 91281 - DNA, 25 bp, S. pombe
gaaagtcttaatcgcatcgcttctc

SEQ ID NO: 91282 - DNA, 25 bp, S. pombe
gaaactgttacacctcttcctcgtg

SEQ ID NO: 91283 - DNA, 25 bp, S. pombe
gaaacctgcggaatctcgtgaacaa

SEQ ID NO: 91284 - DNA, 25 bp, S. pombe
gaaacctgctgaaactcgcgcaaag

SEQ ID NO: 91285 - DNA, 25 bp, S. pombe
gaaaccgcgatttgctagtatgcgt

SEQ ID NO: 91286 - DNA, 25 bp, S. pombe
gaaatggctggttatgctacggctt

SEQ ID NO: 91287 - DNA, 25 bp, S. pombe
gaaaggccgcaagttaccgttgaag

SEQ ID NO: 91288 - DNA, 25 bp, S. pombe
gaaagccgaatctacaaacctattt

SEQ ID NO: 91289 - DNA, 25 bp, S. pombe
gaaagcggttcttctacaacttttg

SEQ ID NO: 91290 - DNA, 25 bp, S. pombe
gaaaccgctatcattccattttttg

SEQ ID NO: 91291 - DNA, 25 bp, S. pombe
gaaaccggacttaacatcttacttg

SEQ ID NO: 91292 - DNA, 25 bp, S. pombe
gaaactggacatatcaaattgttca

SEQ ID NO: 91293 - DNA, 25 bp, S. pombe
gaaactggcattcctcaatcctttg

SEQ ID NO: 91294 - DNA, 25 bp, S. pombe
gaaactgagcttgccgatctttttt

SEQ ID NO: 91295 - DNA, 25 bp, S. pombe
gaaactggtgttgccacttttctat

SEQ ID NO: 91296 - DNA, 25 bp, S. pombe
gtttcggtcgtcaactggtttcaag

SEQ ID NO: 91297 - DNA, 25 bp, S. pombe
gaaacgaggactcctacggacacac

SEQ ID NO: 91298 - DNA, 25 bp, S. pombe
gaaaccattactcttcatgcgaaac

SEQ ID NO: 91299 - DNA, 25 bp, S. pombe
gaaacgttatctcttgcagcctcaa

SEQ ID NO: 91300 - DNA, 25 bp, S. pombe
gaaaccgagatagcttctcttgatg

SEQ ID NO: 91301 - DNA, 25 bp, S. pombe
gaaaccatacttgcgatcccaatta

SEQ ID NO: 91302 - DNA, 25 bp, S. pombe
gaaagttgactgaccgtctccgtaa

SEQ ID NO: 91303 - DNA, 25 bp, S. pombe
gaaaggaacgttcgtccacgctcaa

SEQ ID NO: 91304 - DNA, 25 bp, S. pombe
gaaaggaagcccctgctgcaattgg

SEQ ID NO: 91305 - DNA, 25 bp, S. pombe
gaaaggatcgaacgcctggcattta

SEQ ID NO: 91306 - DNA, 25 bp, S. pombe
gaaatggacttcctggccttgttaa

SEQ ID NO: 91307 - DNA, 25 bp, S. pombe
gaaagaagcttgcaccgttccagaa

SEQ ID NO: 91308 - DNA, 25 bp, S. pombe
gaaagagacattcagcggtatcgcc

SEQ ID NO: 91309 - DNA, 25 bp, S. pombe
gaaatcctcgaattggccggtaatg

SEQ ID NO: 91310 - DNA, 25 bp, S. pombe
gaaacgcttgtatgttaggccagag

SEQ ID NO: 91311 - DNA, 25 bp, S. pombe
gaaacctacttggatcacgctggtg

SEQ ID NO: 91312 - DNA, 25 bp, S. pombe
gaaacgcccgattcttttagcgtag

SEQ ID NO: 91313 - DNA, 25 bp, S. pombe
gaaatcgtcccggagcttactgaaa

SEQ ID NO: 91314 - DNA, 25 bp, S. pombe
gaaacgtctgccatttttgagaaag

SEQ ID NO: 91315 - DNA, 25 bp, S. pombe
gaaacgcttgatattgctataggca

SEQ ID NO: 91316 - DNA, 25 bp, S. pombe
gaaaccttttatttgctcagtgcca

SEQ ID NO: 91317 - DNA, 25 bp, S. pombe
gaaacggttgattagtcggtgtctt

SEQ ID NO: 91318 - DNA, 25 bp, S. pombe
gaaagctaagtctcgaaacgttact

SEQ ID NO: 91319 - DNA, 25 bp, S. pombe
gaaagctcaacctcgcaatcaaatg

SEQ ID NO: 91320 - DNA, 25 bp, S. pombe
gaaagtggacctttgcccagagttt

SEQ ID NO: 91321 - DNA, 25 bp, S. pombe
gaaaggttgcatctagtctaactgt

SEQ ID NO: 91322 - DNA, 25 bp, S. pombe
gaaacgatacaacccaactactaag

SEQ ID NO: 91323 - DNA, 25 bp, S. pombe
gaaacgctcggcttctgattataac

SEQ ID NO: 91324 - DNA, 25 bp, S. pombe
gaaacgctattctcatactcatcaa

SEQ ID NO: 91325 - DNA, 25 bp, S. pombe
gaaacgcttgaagagcagtctcaat

SEQ ID NO: 91326 - DNA, 25 bp, S. pombe
gactccgtttacctatttgatcgaa

SEQ ID NO: 91327 - DNA, 25 bp, S. pombe
gacccgtctaacctatttacaggct

SEQ ID NO: 91328 - DNA, 25 bp, S. pombe
gacaccaatctatcttttctaaccg

SEQ ID NO: 91329 - DNA, 25 bp, S. pombe
gacaccaccgaagttgatttcaccg

SEQ ID NO: 91330 - DNA, 25 bp, S. pombe
gaaagacggagatttataccaacgg

SEQ ID NO: 91331 - DNA, 25 bp, S. pombe
gaaagagctggcctttagttccact

SEQ ID NO: 91332 - DNA, 25 bp, S. pombe
gaaagcattgcctttttactgccct

SEQ ID NO: 91333 - DNA, 25 bp, S. pombe
gaaagtgcgccttttttgatgaaac

SEQ ID NO: 91334 - DNA, 25 bp, S. pombe
gaaagcttccatcttctagtacttc

SEQ ID NO: 91335 - DNA, 25 bp, S. pombe
gaaagttactcctatgctagtgatg

SEQ ID NO: 91336 - DNA, 25 bp, S. pombe
gacactttttcgtcactgagactgc

SEQ ID NO: 91337 - DNA, 25 bp, S. pombe
gaaagactgttaccgcgaatgctaa

SEQ ID NO: 91338 - DNA, 25 bp, S. pombe
gaaagaatcggctccgactcagcat

SEQ ID NO: 91339 - DNA, 25 bp, S. pombe
gaaagaaagcctgctcgacatcctc

SEQ ID NO: 91340 - DNA, 25 bp, S. pombe
gaaagaaagcacgttcatcccactc

SEQ ID NO: 91341 - DNA, 25 bp, S. pombe
gaaattgaacgtccccgttgaagca

SEQ ID NO: 91342 - DNA, 25 bp, S. pombe
gaaattcacttcatccggttgacga

SEQ ID NO: 91343 - DNA, 25 bp, S. pombe
gaaatccgtgtcttccagggtgaac

SEQ ID NO: 91344 - DNA, 25 bp, S. pombe
gaaacccttcttagctgggctgcta

SEQ ID NO: 91345 - DNA, 25 bp, S. pombe
gaaacctttcgtcctgatgtgatta

SEQ ID NO: 91346 - DNA, 25 bp, S. pombe
gaaacctttcgtgcattcgatcatc

SEQ ID NO: 91347 - DNA, 25 bp, S. pombe
gaaagcagagttagaacgacgcctt

SEQ ID NO: 91348 - DNA, 25 bp, S. pombe
gaaagccagggccttcactgctgaa

SEQ ID NO: 91349 - DNA, 25 bp, S. pombe
gaaatccaaggccttgccgctggtt

SEQ ID NO: 91350 - DNA, 25 bp, S. pombe
gaaagtattacacagtcccgaccga

SEQ ID NO: 91351 - DNA, 25 bp, S. pombe
gaaagtggtttcattacgccgcatt

SEQ ID NO: 91352 - DNA, 25 bp, S. pombe
gaaaggagcttctctataccacctg

SEQ ID NO: 91353 - DNA, 25 bp, S. pombe
gaaatgggttcgttatatattcctg

SEQ ID NO: 91354 - DNA, 25 bp, S. pombe
gaaaggctggtcctgttgttaccga

SEQ ID NO: 91355 - DNA, 25 bp, S. pombe
gaaagcaatcgtatggtttactcca

SEQ ID NO: 91356 - DNA, 25 bp, S. pombe
gaaagcagaggtaccccttacatcc

SEQ ID NO: 91357 - DNA, 25 bp, S. pombe
gagcggtttaaggaagaggacattt

SEQ ID NO: 91358 - DNA, 25 bp, S. pombe
gaaagcttccccaaagcagcaagtg

SEQ ID NO: 91359 - DNA, 25 bp, S. pombe
gaaaccatttcttcttgtgatttga

SEQ ID NO: 91360 - DNA, 25 bp, S. pombe
gaaagccttgctcaatttgatctta

SEQ ID NO: 91361 - DNA, 25 bp, S. pombe
gaaagcattcacattccttggttag

SEQ ID NO: 91362 - DNA, 25 bp, S. pombe
gaaagcttactgactcgtatgcatg

SEQ ID NO: 91363 - DNA, 25 bp, S. pombe
gaaatcctactactggtacaatctg

SEQ ID NO: 91364 - DNA, 25 bp, S. pombe
gaaagcgatccttgtactagcaatt

SEQ ID NO: 91365 - DNA, 25 bp, S. pombe
gaaaggtctccttcctaaatgtaat

SEQ ID NO: 91366 - DNA, 25 bp, S. pombe
gaaaggatcttcttcacaaaaggaa

SEQ ID NO: 91367 - DNA, 25 bp, S. pombe
gaaaggatctgtctcaattgattta

SEQ ID NO: 91368 - DNA, 25 bp, S. pombe
gaaagcgtcttgctcatcttgaaaa

SEQ ID NO: 91369 - DNA, 25 bp, S. pombe
gaaagctcttgttgattccaaacca

SEQ ID NO: 91370 - DNA, 25 bp, S. pombe
gaaagccttttcttacaacgcaaga

SEQ ID NO: 91371 - DNA, 25 bp, S. pombe
gaaagcccgtctggtatttgccaat

SEQ ID NO: 91372 - DNA, 25 bp, S. pombe
gaaagcagccgtacgtattccaaag

SEQ ID NO: 91373 - DNA, 25 bp, S. pombe
gaaaccagcacgaattagtcccatc

SEQ ID NO: 91374 - DNA, 25 bp, S. pombe
gaaagcgctattcatacgacagtta

SEQ ID NO: 91375 - DNA, 25 bp, S. pombe
gaaagcgaattgcttcgtcagtttt

SEQ ID NO: 91376 - DNA, 25 bp, S. pombe
gaaagacagacacgaacaccaatta

SEQ ID NO: 91377 - DNA, 25 bp, S. pombe
gaaagacaaccataatcatccaata

SEQ ID NO: 91378 - DNA, 25 bp, S. pombe
gaaaccgacatatatgctgccccta

SEQ ID NO: 91379 - DNA, 25 bp, S. pombe
gaaagcctctgttgatcatggtaat

SEQ ID NO: 91380 - DNA, 25 bp, S. pombe
gaaacctatatctactctcatccaa

SEQ ID NO: 91381 - DNA, 25 bp, S. pombe
gaaacctgtgtctcttgccaagtat

SEQ ID NO: 91382 - DNA, 25 bp, S. pombe
gaaaccattcctcttcgcaaattgg

SEQ ID NO: 91383 - DNA, 25 bp, S. pombe
gaaaccttggatctgtcgaatatat

SEQ ID NO: 91384 - DNA, 25 bp, S. pombe
gaaagcatcttttggttcgtcgaaa

SEQ ID NO: 91385 - DNA, 25 bp, S. pombe
gaaagctcttttgctgttttaccaa

SEQ ID NO: 91386 - DNA, 25 bp, S. pombe
gaaagaggccttccaacagcagctt

SEQ ID NO: 91387 - DNA, 25 bp, S. pombe
gaaagaggcacttgctctccgagtc

SEQ ID NO: 91388 - DNA, 25 bp, S. pombe
gaaagactgctttgctctcaagttt

SEQ ID NO: 91389 - DNA, 25 bp, S. pombe
gaaagactttggtccattcgattat

SEQ ID NO: 91390 - DNA, 25 bp, S. pombe
gaaagtcatgtttcagcccctggta

SEQ ID NO: 91391 - DNA, 25 bp, S. pombe
gaaagaatctgttccagcacccgat

SEQ ID NO: 91392 - DNA, 25 bp, S. pombe
gaaagcgatttaccagcacctcaag

SEQ ID NO: 91393 - DNA, 25 bp, S. pombe
gaaagcgtttcatccatgcttaagg

SEQ ID NO: 91394 - DNA, 25 bp, S. pombe
gaaatcgtttgagaatgcttcccag

SEQ ID NO: 91395 - DNA, 25 bp, S. pombe
gaaatgttcctgttcgttacgaccg

SEQ ID NO: 91396 - DNA, 25 bp, S. pombe
gaaatgttcctgttcagtttagtca

SEQ ID NO: 91397 - DNA, 25 bp, S. pombe
gaaagtcgtcttttatctctaaatt

SEQ ID NO: 91398 - DNA, 25 bp, S. pombe
gaaagtgttgctttttccttaactg

SEQ ID NO: 91399 - DNA, 25 bp, S. pombe
gaaaggtcttctgaatcctaaagga

SEQ ID NO: 91400 - DNA, 25 bp, S. pombe
gaaaggtcgttcagcatctcatata

SEQ ID NO: 91401 - DNA, 25 bp, S. pombe
gaaataccggcatctgattccattg

SEQ ID NO: 91402 - DNA, 25 bp, S. pombe
gaaagctggactttactccgatcac

SEQ ID NO: 91403 - DNA, 25 bp, S. pombe
gaaagttcacatttagcctccacac

SEQ ID NO: 91404 - DNA, 25 bp, S. pombe
gaaagatacatggaccttccgcaat

SEQ ID NO: 91405 - DNA, 25 bp, S. pombe
gaaatccccttatctaatgcaacaa

SEQ ID NO: 91406 - DNA, 25 bp, S. pombe
gaaattatccgttttatcagaccaa

SEQ ID NO: 91407 - DNA, 25 bp, S. pombe
gaaagtgtcggttctataccaccca

SEQ ID NO: 91408 - DNA, 25 bp, S. pombe
gaaaggtcgctcaagttactccggt

SEQ ID NO: 91409 - DNA, 25 bp, S. pombe
gaaaggttgctttagtcactcgcgg

SEQ ID NO: 91410 - DNA, 25 bp, S. pombe
gaaaggtctctttacctcgtatgta

SEQ ID NO: 91411 - DNA, 25 bp, S. pombe
gaaatgggcctagcatcaactactc

SEQ ID NO: 91412 - DNA, 25 bp, S. pombe
gaaagcttccttgcctgatatatcc

SEQ ID NO: 91413 - DNA, 25 bp, S. pombe
gaaagctaccacaactgtgcctgat

SEQ ID NO: 91414 - DNA, 25 bp, S. pombe
gaaatcgcacctgcattgaatgctg

SEQ ID NO: 91415 - DNA, 25 bp, S. pombe
gaaatcgcaagtactcgtgttgcaa

SEQ ID NO: 91416 - DNA, 25 bp, S. pombe
gaaatgctcgtggtcaacgtctttt

SEQ ID NO: 91417 - DNA, 25 bp, S. pombe
gaaatcattagctcaagcgtacctt

SEQ ID NO: 91418 - DNA, 25 bp, S. pombe
gaaagccttttggagggtgtctcat

SEQ ID NO: 91419 - DNA, 25 bp, S. pombe
gaaagccattttaccgaatgcagat

SEQ ID NO: 91420 - DNA, 25 bp, S. pombe
gaaagccttgatactcttatcagag

SEQ ID NO: 91421 - DNA, 25 bp, S. pombe
gaaagcagtattaccttcactagtg

SEQ ID NO: 91422 - DNA, 25 bp, S. pombe
gaaattgtgtctaccattaccaagg

SEQ ID NO: 91423 - DNA, 25 bp, S. pombe
gaaagtcttttactgaacaaggcaa

SEQ ID NO: 91424 - DNA, 25 bp, S. pombe
gaaagtccttcaattggacctggaa

SEQ ID NO: 91425 - DNA, 25 bp, S. pombe
gaaagtgtttccgagcgacctgaaa

SEQ ID NO: 91426 - DNA, 25 bp, S. pombe
gaaagagtggcattcctaagctgaa

SEQ ID NO: 91427 - DNA, 25 bp, S. pombe
gaaagcttagacatcttcctcttgt

SEQ ID NO: 91428 - DNA, 25 bp, S. pombe
gaaatttacagcttttaggccctct

SEQ ID NO: 91429 - DNA, 25 bp, S. pombe
gaaagattcgctcactttgagtgac

SEQ ID NO: 91430 - DNA, 25 bp, S. pombe
gaaagcccatgcatgttgttgaaca

SEQ ID NO: 91431 - DNA, 25 bp, S. pombe
gaaagatcctgttgttttaccgaga

SEQ ID NO: 91432 - DNA, 25 bp, S. pombe
gacaactgctcactattttggtcgt

SEQ ID NO: 91433 - DNA, 25 bp, S. pombe
gaaagcctcagttatttttgtacca

SEQ ID NO: 91434 - DNA, 25 bp, S. pombe
gaaagtgtggttaccgttctctcaa

SEQ ID NO: 91435 - DNA, 25 bp, S. pombe
gaaagctctcgaaacctttctcgaa

SEQ ID NO: 91436 - DNA, 25 bp, S. pombe
gaaagcttgtccagctggcttgaaa

SEQ ID NO: 91437 - DNA, 25 bp, S. pombe
gaaagttccagtttgcctatcattt

SEQ ID NO: 91438 - DNA, 25 bp, S. pombe
gaaagcttgccgatcatcgttattt

SEQ ID NO: 91439 - DNA, 25 bp, S. pombe
gaaagctctgccgtttcattaagcg

SEQ ID NO: 91440 - DNA, 25 bp, S. pombe
gaaagtatggaccacctcatggaat

SEQ ID NO: 91441 - DNA, 25 bp, S. pombe
gaaagagattaccacaccacagaat

SEQ ID NO: 91442 - DNA, 25 bp, S. pombe
gaaattaaatcgcttccggatcgag

SEQ ID NO: 91443 - DNA, 25 bp, S. pombe
gaaatctgggctgtgtttatagcac

SEQ ID NO: 91444 - DNA, 25 bp, S. pombe
gaaatccggctttggtttgaacttg

SEQ ID NO: 91445 - DNA, 25 bp, S. pombe
gaaatcgtcaactatggttccactt

SEQ ID NO: 91446 - DNA, 25 bp, S. pombe
gaaattacaaatatagctcctacgg

SEQ ID NO: 91447 - DNA, 25 bp, S. pombe
gaaagtacaacagctacctctacct

SEQ ID NO: 91448 - DNA, 25 bp, S. pombe
gaaagcgtgtaactattcaacccaa

SEQ ID NO: 91449 - DNA, 25 bp, S. pombe
gaaagctttgcatggtgttactcat

SEQ ID NO: 91450 - DNA, 25 bp, S. pombe
gaaagctgccactgaaggttctgaa

SEQ ID NO: 91451 - DNA, 25 bp, S. pombe
gaaagcatgctcaagttcaattgga

SEQ ID NO: 91452 - DNA, 25 bp, S. pombe
gaaagctgcttccattgctgttgaa

SEQ ID NO: 91453 - DNA, 25 bp, S. pombe
gaaatcgtaggtgctaatcctgcta

SEQ ID NO: 91454 - DNA, 25 bp, S. pombe
gaaatcaagcggtggttcctccttc

SEQ ID NO: 91455 - DNA, 25 bp, S. pombe
gaaagtctgcttcaaaggctcctaa

SEQ ID NO: 91456 - DNA, 25 bp, S. pombe
gaaatcttggttcatcggtgccaca

SEQ ID NO: 91457 - DNA, 25 bp, S. pombe
gaaagctactacttactggatcaag

SEQ ID NO: 91458 - DNA, 25 bp, S. pombe
gaaagctagtctttttgttcgtgac

SEQ ID NO: 91459 - DNA, 25 bp, S. pombe
gaaatccatgttgttttccctacac

SEQ ID NO: 91460 - DNA, 25 bp, S. pombe
gaaatcgaacatttttgaaccgaag

SEQ ID NO: 91461 - DNA, 25 bp, S. pombe
gaaagctattctaatcctatcccag

SEQ ID NO: 91462 - DNA, 25 bp, S. pombe
gaaagattctgtcgttgctgctgcc

SEQ ID NO: 91463 - DNA, 25 bp, S. pombe
gaaagcatctttcttctggagggaa

SEQ ID NO: 91464 - DNA, 25 bp, S. pombe
gaaatgacatttcgtccttcggact

SEQ ID NO: 91465 - DNA, 25 bp, S. pombe
gaaatagctgctaatggccccatcg

SEQ ID NO: 91466 - DNA, 25 bp, S. pombe
gaaagcatagctctcatacgaatca

SEQ ID NO: 91467 - DNA, 25 bp, S. pombe
gaaatgaatcagtatctcgccctca

SEQ ID NO: 91468 - DNA, 25 bp, S. pombe
gaaatgaatagccttctcgccaatc

SEQ ID NO: 91469 - DNA, 25 bp, S. pombe
gacactcgtactcattactatttga

SEQ ID NO: 91470 - DNA, 25 bp, S. pombe
gacactagtgcagaattactttcgc

SEQ ID NO: 91471 - DNA, 25 bp, S. pombe
gacagcgatgatcctcaaaagttta

SEQ ID NO: 91472 - DNA, 25 bp, S. pombe
gaaagagtcagcagaaggcttctga

SEQ ID NO: 91473 - DNA, 25 bp, S. pombe
gaaagagcccatacaagatttgaga

SEQ ID NO: 91474 - DNA, 25 bp, S. pombe
gaaagagcctgtgcatatgttttaa

SEQ ID NO: 91475 - DNA, 25 bp, S. pombe
gaaagatgccttgtttgtctatcaa

SEQ ID NO: 91476 - DNA, 25 bp, S. pombe
gaaatggctccattgtttacgtcaa

SEQ ID NO: 91477 - DNA, 25 bp, S. pombe
gaaagtctgtccttcaaaacactat

SEQ ID NO: 91478 - DNA, 25 bp, S. pombe
gaaagcaagccatcaccatcaagag

SEQ ID NO: 91479 - DNA, 25 bp, S. pombe
gaaatccttcacagtcgtattgact

SEQ ID NO: 91480 - DNA, 25 bp, S. pombe
gaaattgattccattctttccgctc

SEQ ID NO: 91481 - DNA, 25 bp, S. pombe
gaaattgagtactcctacccagtgc

SEQ ID NO: 91482 - DNA, 25 bp, S. pombe
gaaagaagcaattcaccctcctata

SEQ ID NO: 91483 - DNA, 25 bp, S. pombe
gaaagaggcagaggccttccctgaa

SEQ ID NO: 91484 - DNA, 25 bp, S. pombe
gaaattcagcaacgcgttgcccatg

SEQ ID NO: 91485 - DNA, 25 bp, S. pombe
gaaatcacttggctacatccgacat

SEQ ID NO: 91486 - DNA, 25 bp, S. pombe
gaaatcgtttccttgcagacgttaa

SEQ ID NO: 91487 - DNA, 25 bp, S. pombe
gaaattgcttctctagcaggcgtat

SEQ ID NO: 91488 - DNA, 25 bp, S. pombe
gaaattgacgctgctaatactgctg

SEQ ID NO: 91489 - DNA, 25 bp, S. pombe
gaaagatttctctacaagttaacgt

SEQ ID NO: 91490 - DNA, 25 bp, S. pombe
gaaagatgtacctgccgttcagtcg

SEQ ID NO: 91491 - DNA, 25 bp, S. pombe
gaaagactccagtgtgcttcttcca

SEQ ID NO: 91492 - DNA, 25 bp, S. pombe
gaaagatgctacctcgtttgaacga

SEQ ID NO: 91493 - DNA, 25 bp, S. pombe
gaaagagctcttttttatgcaacaa

SEQ ID NO: 91494 - DNA, 25 bp, S. pombe
gaaagagccattccttctgaaatga

SEQ ID NO: 91495 - DNA, 25 bp, S. pombe
gaaagggcatcagctatcgccaatt

SEQ ID NO: 91496 - DNA, 25 bp, S. pombe
gaaattgcgcacgtctacaaaactg

SEQ ID NO: 91497 - DNA, 25 bp, S. pombe
gaaatgtgcagcttccttctaaact

SEQ ID NO: 91498 - DNA, 25 bp, S. pombe
gaaatgccaccatggtctccaaggt

SEQ ID NO: 91499 - DNA, 25 bp, S. pombe
gacacaccaccacggctttctaaat

SEQ ID NO: 91500 - DNA, 25 bp, S. pombe
gacagccataactcccattggtggt

SEQ ID NO: 91501 - DNA, 25 bp, S. pombe
gacacctcaagaaaccattcgtagt

SEQ ID NO: 91502 - DNA, 25 bp, S. pombe
gacaactcacgatacaaagggactt

SEQ ID NO: 91503 - DNA, 25 bp, S. pombe
gaaagtccctttaaatgatgcgata

SEQ ID NO: 91504 - DNA, 25 bp, S. pombe
gaaagtcacccaaaggactgcgtca

SEQ ID NO: 91505 - DNA, 25 bp, S. pombe
gaaagaacgcacatccagtcgatta

SEQ ID NO: 91506 - DNA, 25 bp, S. pombe
gaaaggcttgttctcttccaattca

SEQ ID NO: 91507 - DNA, 25 bp, S. pombe
gaaagtccttacacattttggtcaa

SEQ ID NO: 91508 - DNA, 25 bp, S. pombe
gaaagtcctattagtttcttctgct

SEQ ID NO: 91509 - DNA, 25 bp, S. pombe
gaaagttctttgcttcataacagta

SEQ ID NO: 91510 - DNA, 25 bp, S. pombe
gaaatcttatgcctctctacttagt

SEQ ID NO: 91511 - DNA, 25 bp, S. pombe
gaaatcactatcaatcattatctgt

SEQ ID NO: 91512 - DNA, 25 bp, S. pombe
gaaatccgccaagtcaatcgtgcct

SEQ ID NO: 91513 - DNA, 25 bp, S. pombe
gaaagtcgccagatcactcaagtct

SEQ ID NO: 91514 - DNA, 25 bp, S. pombe
gaaagatgtcgcatttgccggctat

SEQ ID NO: 91515 - DNA, 25 bp, S. pombe
gaaagatgtctcgtttgtcggtaga

SEQ ID NO: 91516 - DNA, 25 bp, S. pombe
gaaagttactgcttcaatccgctat

SEQ ID NO: 91517 - DNA, 25 bp, S. pombe
gaaagaccttttgctcagagtcgaa

SEQ ID NO: 91518 - DNA, 25 bp, S. pombe
gaaatccctttcacactaatccaat

SEQ ID NO: 91519 - DNA, 25 bp, S. pombe
gaaatctcgtcctaaagctttcctt

SEQ ID NO: 91520 - DNA, 25 bp, S. pombe
gaaatacggccttgaagctggttca

SEQ ID NO: 91521 - DNA, 25 bp, S. pombe
gaaaggcctccgattcaggtatcac

SEQ ID NO: 91522 - DNA, 25 bp, S. pombe
gaaagtttcagtgcacgtcttcaaa

SEQ ID NO: 91523 - DNA, 25 bp, S. pombe
gaaagttacaatgctccctttgcaa

SEQ ID NO: 91524 - DNA, 25 bp, S. pombe
gaaagtcatggcatgcctccccttc

SEQ ID NO: 91525 - DNA, 25 bp, S. pombe
gaaattacgctttcctacgaggacg

SEQ ID NO: 91526 - DNA, 25 bp, S. pombe
gaaataaatgctttggcccctgaac

SEQ ID NO: 91527 - DNA, 25 bp, S. pombe
gaaagtgaagctctccagcatcctt

SEQ ID NO: 91528 - DNA, 25 bp, S. pombe
gacaagaacgtctcgcacttttttg

SEQ ID NO: 91529 - DNA, 25 bp, S. pombe
gacaaggtcgcctctgcttttacct

SEQ ID NO: 91530 - DNA, 25 bp, S. pombe
gaaagttctggctcctatgttcatc

SEQ ID NO: 91531 - DNA, 25 bp, S. pombe
gaaagtatctgcttctcctagtgtc

SEQ ID NO: 91532 - DNA, 25 bp, S. pombe
gaaatgctgtcactccaaaaacttt

SEQ ID NO: 91533 - DNA, 25 bp, S. pombe
gaaagatctcagtccaattccacct

SEQ ID NO: 91534 - DNA, 25 bp, S. pombe
gaaatttccggcaaccataagtcta

SEQ ID NO: 91535 - DNA, 25 bp, S. pombe
gaaaggcaccgtgtttcatggttta

SEQ ID NO: 91536 - DNA, 25 bp, S. pombe
gaaaggccatacttcttatcagcgt

SEQ ID NO: 91537 - DNA, 25 bp, S. pombe
gaaatttgatcgcaactgcctccat

SEQ ID NO: 91538 - DNA, 25 bp, S. pombe
gacaagtctacgcaattgcccatgt

SEQ ID NO: 91539 - DNA, 25 bp, S. pombe
gacaagcccgaaactttcaactcat

SEQ ID NO: 91540 - DNA, 25 bp, S. pombe
gaaatcgccccagttatttaacaat

SEQ ID NO: 91541 - DNA, 25 bp, S. pombe
gaaagtcctcacattgattctgaag

SEQ ID NO: 91542 - DNA, 25 bp, S. pombe
gaaagtatctcttcacccattaagg

SEQ ID NO: 91543 - DNA, 25 bp, S. pombe
gaaagttgctcgtatcatccaaaga

SEQ ID NO: 91544 - DNA, 25 bp, S. pombe
gaaagtatgcgcgtatcatccaaaa

SEQ ID NO: 91545 - DNA, 25 bp, S. pombe
gaaagttgcatctcctgaaaacagt

SEQ ID NO: 91546 - DNA, 25 bp, S. pombe
gaaagtctgccagctctgcaaaatc

SEQ ID NO: 91547 - DNA, 25 bp, S. pombe
gaaagttgccgagtctaccaatgct

SEQ ID NO: 91548 - DNA, 25 bp, S. pombe
gaaatcattcctgttacactagctg

SEQ ID NO: 91549 - DNA, 25 bp, S. pombe
tacctaaagggtaccgtcagcgcag

SEQ ID NO: 91550 - DNA, 25 bp, S. pombe
gatactagcaaggtttcgtcgggaa

SEQ ID NO: 91551 - DNA, 25 bp, S. pombe
gactcaaaacattggctttccctgg

SEQ ID NO: 91552 - DNA, 25 bp, S. pombe
gacaaacaaacgattggccctcact

SEQ ID NO: 91553 - DNA, 25 bp, S. pombe
gaaatcatcgctgagtacgacgcta

SEQ ID NO: 91554 - DNA, 25 bp, S. pombe
gacacattgccctcggtgatgaaat

SEQ ID NO: 91555 - DNA, 25 bp, S. pombe
gaaatctgtgccttctagtgggaat

SEQ ID NO: 91556 - DNA, 25 bp, S. pombe
gaaattgatgaccatcgttctggta

SEQ ID NO: 91557 - DNA, 25 bp, S. pombe
gaaatgatacaactcgctctctgat

SEQ ID NO: 91558 - DNA, 25 bp, S. pombe
gaaattatctatctgcctggacact

SEQ ID NO: 91559 - DNA, 25 bp, S. pombe
gacaatttgacactgggcactacat

SEQ ID NO: 91560 - DNA, 25 bp, S. pombe
gaaatgtctcaaaggcatcccgaac

SEQ ID NO: 91561 - DNA, 25 bp, S. pombe
gaaatgctcttatggaaccgaagtt

SEQ ID NO: 91562 - DNA, 25 bp, S. pombe
gaaagtcatactcagcttcctatat

SEQ ID NO: 91563 - DNA, 25 bp, S. pombe
gacaatgacaagcttggtgatccta

SEQ ID NO: 91564 - DNA, 25 bp, S. pombe
gaaatgtcacagctattcgtcctga

SEQ ID NO: 91565 - DNA, 25 bp, S. pombe
gaaaggaagcgatctccatctccaa

SEQ ID NO: 91566 - DNA, 25 bp, S. pombe
gacaagtgggacacctatctcacac

SEQ ID NO: 91567 - DNA, 25 bp, S. pombe
gaaattctggactttactggactag

SEQ ID NO: 91568 - DNA, 25 bp, S. pombe
gaaatcattttctagttcggcctct

SEQ ID NO: 91569 - DNA, 25 bp, S. pombe
gaaatctacttttcgattggctcct

SEQ ID NO: 91570 - DNA, 25 bp, S. pombe
gaaatctcactttaggttcgtccaa

SEQ ID NO: 91571 - DNA, 25 bp, S. pombe
gacaaagtcttgtggtaccctcaaa

SEQ ID NO: 91572 - DNA, 25 bp, S. pombe
gacaacaggatttccggacgcctta

SEQ ID NO: 91573 - DNA, 25 bp, S. pombe
gaaattccgggcattacacgctgtt

SEQ ID NO: 91574 - DNA, 25 bp, S. pombe
gaaatacctttcagtgacacgcgtt

SEQ ID NO: 91575 - DNA, 25 bp, S. pombe
gaaataccattgagcgatgccagaa

SEQ ID NO: 91576 - DNA, 25 bp, S. pombe
gaaagtgctttacctgatgctagaa

SEQ ID NO: 91577 - DNA, 25 bp, S. pombe
gaaatgctgtgtctacttgcaagag

SEQ ID NO: 91578 - DNA, 25 bp, S. pombe
gaaattgagccgtcacgtagctcct

SEQ ID NO: 91579 - DNA, 25 bp, S. pombe
gaaattggccgacggtctctttcga

SEQ ID NO: 91580 - DNA, 25 bp, S. pombe
gaaatattctctagcggtggtccca

SEQ ID NO: 91581 - DNA, 25 bp, S. pombe
gaaattttcccgttggcgacagcat

SEQ ID NO: 91582 - DNA, 25 bp, S. pombe
gaaatttctaccgaatccgtcgctg

SEQ ID NO: 91583 - DNA, 25 bp, S. pombe
gaaattactagctgataccccttac

SEQ ID NO: 91584 - DNA, 25 bp, S. pombe
gaaatctttgcctgttgttgttgaa

SEQ ID NO: 91585 - DNA, 25 bp, S. pombe
gaaattccgactgactttgttgata

SEQ ID NO: 91586 - DNA, 25 bp, S. pombe
gaaatgctgccgaacatgttactgc

SEQ ID NO: 91587 - DNA, 25 bp, S. pombe
gaaagtgttgctaaccccatcatgg

SEQ ID NO: 91588 - DNA, 25 bp, S. pombe
gaaagtgttgcaattctccctcaat

SEQ ID NO: 91589 - DNA, 25 bp, S. pombe
gaaaggcttgttatccatctcgaga

SEQ ID NO: 91590 - DNA, 25 bp, S. pombe
gaaagtggtcgtgctattcccaatc

SEQ ID NO: 91591 - DNA, 25 bp, S. pombe
gaaagtggttctgctcttcttaaca

SEQ ID NO: 91592 - DNA, 25 bp, S. pombe
gaaatcccgttttattctctagtcg

SEQ ID NO: 91593 - DNA, 25 bp, S. pombe
gaaatcatgctttgtttagaactcg

SEQ ID NO: 91594 - DNA, 25 bp, S. pombe
gacaagcttgtcgttgtcgacttct

SEQ ID NO: 91595 - DNA, 25 bp, S. pombe
gaaatggccaagtatcctcagataa

SEQ ID NO: 91596 - DNA, 25 bp, S. pombe
gaaaggacaatgttctctctgagaa

SEQ ID NO: 91597 - DNA, 25 bp, S. pombe
gaaatggccgatcattcctagaatg

SEQ ID NO: 91598 - DNA, 25 bp, S. pombe
gaaatactgacgtcgaacaaccatt

SEQ ID NO: 91599 - DNA, 25 bp, S. pombe
gaaatcctgaatccgctaccaatgt

SEQ ID NO: 91600 - DNA, 25 bp, S. pombe
gaaatgctcttcaagccgtccaaaa

SEQ ID NO: 91601 - DNA, 25 bp, S. pombe
gaaatctttcgcgatctaagcacca

SEQ ID NO: 91602 - DNA, 25 bp, S. pombe
gaaatccgatgatcttcaacatgta

SEQ ID NO: 91603 - DNA, 25 bp, S. pombe
gacacttcggttcttcgttatggac

SEQ ID NO: 91604 - DNA, 25 bp, S. pombe
gacacgccggttctaagtttgtcta

SEQ ID NO: 91605 - DNA, 25 bp, S. pombe
gacgaccaggcgcaaaggtttttat

SEQ ID NO: 91606 - DNA, 25 bp, S. pombe
gaaatttgtgcccaaagcatccata

SEQ ID NO: 91607 - DNA, 25 bp, S. pombe
gaaatataccaccatagctcggaaa

SEQ ID NO: 91608 - DNA, 25 bp, S. pombe
gaaatggatcccgaaggcttcaata

SEQ ID NO: 91609 - DNA, 25 bp, S. pombe
gaaatccatcttggcagtaccgagt

SEQ ID NO: 91610 - DNA, 25 bp, S. pombe
gaaatggaagcaacaccttctccag

SEQ ID NO: 91611 - DNA, 25 bp, S. pombe
gaaatggaatgcatcccgaccacat

SEQ ID NO: 91612 - DNA, 25 bp, S. pombe
gaaaggattgccacttcccaataat

SEQ ID NO: 91613 - DNA, 25 bp, S. pombe
gaaatgaactggtctccctatcaaa

SEQ ID NO: 91614 - DNA, 25 bp, S. pombe
gaaattacgtgctttcgtacaaact

SEQ ID NO: 91615 - DNA, 25 bp, S. pombe
gaaattacagtgtcatccgcttcct

SEQ ID NO: 91616 - DNA, 25 bp, S. pombe
gaaatttgcctagaagctgctcagc

SEQ ID NO: 91617 - DNA, 25 bp, S. pombe
gaaatttgccgtgaacgtctcgcac

SEQ ID NO: 91618 - DNA, 25 bp, S. pombe
gaaattatcgttctcctagtgcttt

SEQ ID NO: 91619 - DNA, 25 bp, S. pombe
gaaatttctgtttttgtggctgatt

SEQ ID NO: 91620 - DNA, 25 bp, S. pombe
gaaatcttattccttttgccgtggt

SEQ ID NO: 91621 - DNA, 25 bp, S. pombe
gaaatttctagtgcgttccgacaat

SEQ ID NO: 91622 - DNA, 25 bp, S. pombe
gaaattcagaccagcgttgacccga

SEQ ID NO: 91623 - DNA, 25 bp, S. pombe
gaaattctggcctagcgttgctcga

SEQ ID NO: 91624 - DNA, 25 bp, S. pombe
gacacaggcttcgtgggttgctcaa

SEQ ID NO: 91625 - DNA, 25 bp, S. pombe
gaaatttatcctccgaatttacctg

SEQ ID NO: 91626 - DNA, 25 bp, S. pombe
gaaatgttcaatcccataatcgtgg

SEQ ID NO: 91627 - DNA, 25 bp, S. pombe
gaaatgtcactcatatcctgcttga

SEQ ID NO: 91628 - DNA, 25 bp, S. pombe
gaaatgtccatcctgtaatgctaca

SEQ ID NO: 91629 - DNA, 25 bp, S. pombe
gacaatgcgcaaatctgctgctagg

SEQ ID NO: 91630 - DNA, 25 bp, S. pombe
gaaatctgctgcatccgcaaagtca

SEQ ID NO: 91631 - DNA, 25 bp, S. pombe
gacaacttgcatcccaattgagcta

SEQ ID NO: 91632 - DNA, 25 bp, S. pombe
gacaatgggttatctagcaccggaa

SEQ ID NO: 91633 - DNA, 25 bp, S. pombe
gaaatgtgagatccctcttcacctt

SEQ ID NO: 91634 - DNA, 25 bp, S. pombe
gacaagtgttgtttgttcccttcga

SEQ ID NO: 91635 - DNA, 25 bp, S. pombe
gaaattttttatggctccctctcaa

SEQ ID NO: 91636 - DNA, 25 bp, S. pombe
gaaatcttggataacgcctgcttga

SEQ ID NO: 91637 - DNA, 25 bp, S. pombe
gaaatcttggacttctgcgtctggc

SEQ ID NO: 91638 - DNA, 25 bp, S. pombe
gaaatcctcagaatggccttgtaat

SEQ ID NO: 91639 - DNA, 25 bp, S. pombe
gaaattctctagcatctaggctggg

SEQ ID NO: 91640 - DNA, 25 bp, S. pombe
gaaattctaacgtttgcagcgactg

SEQ ID NO: 91641 - DNA, 25 bp, S. pombe
gaaatcctcaatttgttgcgtccgc

SEQ ID NO: 91642 - DNA, 25 bp, S. pombe
gaaatccaagtctgttctgtcgtct

SEQ ID NO: 91643 - DNA, 25 bp, S. pombe
gaaatttacgcttcaagggctcagt

SEQ ID NO: 91644 - DNA, 25 bp, S. pombe
gaaattttcatcttccacggcaagt

SEQ ID NO: 91645 - DNA, 25 bp, S. pombe
gaaatgttttcttccaatgcgcagg

SEQ ID NO: 91646 - DNA, 25 bp, S. pombe
gaaatgctacctgatccaatgccgg

SEQ ID NO: 91647 - DNA, 25 bp, S. pombe
gaaatttatggtctcttatgcctaa

SEQ ID NO: 91648 - DNA, 25 bp, S. pombe
gaaatgcttccacctctttttgaaa

SEQ ID NO: 91649 - DNA, 25 bp, S. pombe
gaaatgctatctgttcagcctgaca

SEQ ID NO: 91650 - DNA, 25 bp, S. pombe
gaaatcattgaggtcgcccgtacta

SEQ ID NO: 91651 - DNA, 25 bp, S. pombe
gagcatttaaacgaccctatggcgg

SEQ ID NO: 91652 - DNA, 25 bp, S. pombe
gaaattgggcttctctcaagttaag

SEQ ID NO: 91653 - DNA, 25 bp, S. pombe
gaaatctgcttctcaggtttcctat

SEQ ID NO: 91654 - DNA, 25 bp, S. pombe
gaaattcctagcaaagacgatcctt

SEQ ID NO: 91655 - DNA, 25 bp, S. pombe
gaaattcaccagaaaacctctattt

SEQ ID NO: 91656 - DNA, 25 bp, S. pombe
gaaatatatccgacagcaccttctg

SEQ ID NO: 91657 - DNA, 25 bp, S. pombe
gaaattgcacgcctcgaaaatcaaa

SEQ ID NO: 91658 - DNA, 25 bp, S. pombe
gaaatcttgcttccctttatcttac

SEQ ID NO: 91659 - DNA, 25 bp, S. pombe
gaaatgcgccaatgtgctgctttac

SEQ ID NO: 91660 - DNA, 25 bp, S. pombe
gaaattgcgctatgttccttgcagc

SEQ ID NO: 91661 - DNA, 25 bp, S. pombe
gaaatgcactcttagttccgatcat

SEQ ID NO: 91662 - DNA, 25 bp, S. pombe
gaaatgcttgcttggctgtgtcgaa

SEQ ID NO: 91663 - DNA, 25 bp, S. pombe
gaaatgccgattgctcgtgctggac

SEQ ID NO: 91664 - DNA, 25 bp, S. pombe
gacttaaatgaatccccgtccaggc

SEQ ID NO: 91665 - DNA, 25 bp, S. pombe
gacatacgggagattcctcgtccta

SEQ ID NO: 91666 - DNA, 25 bp, S. pombe
gacaacaagtggtttcgctacctta

SEQ ID NO: 91667 - DNA, 25 bp, S. pombe
gaaattacgaaatcctatcccacgc

SEQ ID NO: 91668 - DNA, 25 bp, S. pombe
gaaattatcaaatccgtatccggtg

SEQ ID NO: 91669 - DNA, 25 bp, S. pombe
gaaattttgctatcgcgtatcggtt

SEQ ID NO: 91670 - DNA, 25 bp, S. pombe
gaaatgctactcaacgtggatccga

SEQ ID NO: 91671 - DNA, 25 bp, S. pombe
gaaatctacaacagggatgctctaa

SEQ ID NO: 91672 - DNA, 25 bp, S. pombe
gaaatttatgcaacgcgctcgaggc

SEQ ID NO: 91673 - DNA, 25 bp, S. pombe
gaaattcatacaatggcgtgccacg

SEQ ID NO: 91674 - DNA, 25 bp, S. pombe
gaaatcaactctttatgtcaacagg

SEQ ID NO: 91675 - DNA, 25 bp, S. pombe
gaaatcgagtcaagtcttcaaggaa

SEQ ID NO: 91676 - DNA, 25 bp, S. pombe
gaaatttctgcagagcccactaaag

SEQ ID NO: 91677 - DNA, 25 bp, S. pombe
gacaattccattgagaccactaata

SEQ ID NO: 91678 - DNA, 25 bp, S. pombe
gaaattacaccaagcaccagcgaat

SEQ ID NO: 91679 - DNA, 25 bp, S. pombe
gaaatctacccaatcatcttctatg

SEQ ID NO: 91680 - DNA, 25 bp, S. pombe
gaaatataccgcgatcttgatgaag

SEQ ID NO: 91681 - DNA, 25 bp, S. pombe
gaaatctttctcgtactggttcaga

SEQ ID NO: 91682 - DNA, 25 bp, S. pombe
gaaatcggatgtgttatcgctcaag

SEQ ID NO: 91683 - DNA, 25 bp, S. pombe
gacaagggcacacagacgttcaact

SEQ ID NO: 91684 - DNA, 25 bp, S. pombe
gaccgggtagttgcagctttactga

SEQ ID NO: 91685 - DNA, 25 bp, S. pombe
gacgggttcaacaccttggagtgaa

SEQ ID NO: 91686 - DNA, 25 bp, S. pombe
gaaatttaccatccttgtggccaag

SEQ ID NO: 91687 - DNA, 25 bp, S. pombe
gaaattgtaactcctacttcaacag

SEQ ID NO: 91688 - DNA, 25 bp, S. pombe
gaaatttctccaatcgccataaacc

SEQ ID NO: 91689 - DNA, 25 bp, S. pombe
gacaacttgccaaggccgtagggtt

SEQ ID NO: 91690 - DNA, 25 bp, S. pombe
gaaatctctcaaagtccgtttggca

SEQ ID NO: 91691 - DNA, 25 bp, S. pombe
gaaattgatgaatacgcttccaaga

SEQ ID NO: 91692 - DNA, 25 bp, S. pombe
gaaatatttcttgctcttgagtcac

SEQ ID NO: 91693 - DNA, 25 bp, S. pombe
gaaattcattctacacctggtgtcc

SEQ ID NO: 91694 - DNA, 25 bp, S. pombe
gaaattgcctatacccgttcgtaga

SEQ ID NO: 91695 - DNA, 25 bp, S. pombe
gaaattcctaatcccgcacgtgtgg

SEQ ID NO: 91696 - DNA, 25 bp, S. pombe
gacaaaccatatgagctcgtagaac

SEQ ID NO: 91697 - DNA, 25 bp, S. pombe
gaaataccatcacttgcatcctgaa

SEQ ID NO: 91698 - DNA, 25 bp, S. pombe
gaaatacagacactactctccaact

SEQ ID NO: 91699 - DNA, 25 bp, S. pombe
gaaataaccgctactcgcaacgatt

SEQ ID NO: 91700 - DNA, 25 bp, S. pombe
gacaatctacacgtgcccaaaatga

SEQ ID NO: 91701 - DNA, 25 bp, S. pombe
gacaacgtcgagaatgcctaccatt

SEQ ID NO: 91702 - DNA, 25 bp, S. pombe
gacactcgtagtggagctcttcctt

SEQ ID NO: 91703 - DNA, 25 bp, S. pombe
gacacattatggatggatccctctt

SEQ ID NO: 91704 - DNA, 25 bp, S. pombe
gaaatctacgtgacttctccttttt

SEQ ID NO: 91705 - DNA, 25 bp, S. pombe
gaaatcttcttttcctacttcttct

SEQ ID NO: 91706 - DNA, 25 bp, S. pombe
gacaaagactttctcgaatccgaag

SEQ ID NO: 91707 - DNA, 25 bp, S. pombe
gaaatatttgcatctttaccggaac

SEQ ID NO: 91708 - DNA, 25 bp, S. pombe
gaaatcatctgctatccgaagtgga

SEQ ID NO: 91709 - DNA, 25 bp, S. pombe
gaaatatctgcaatgtcgaatggac

SEQ ID NO: 91710 - DNA, 25 bp, S. pombe
gacacaatgccgtttcgttgtttaa

SEQ ID NO: 91711 - DNA, 25 bp, S. pombe
gacaaggccttaaaaacgattcgca

SEQ ID NO: 91712 - DNA, 25 bp, S. pombe
gacaaggttcgtaaagccgtctcga

SEQ ID NO: 91713 - DNA, 25 bp, S. pombe
gataacgcccgtatacggcttcagg

SEQ ID NO: 91714 - DNA, 25 bp, S. pombe
gaaattcccgagtttatgtcttcaa

SEQ ID NO: 91715 - DNA, 25 bp, S. pombe
gaaattggtcctcgctttgtaatga

SEQ ID NO: 91716 - DNA, 25 bp, S. pombe
gaaattcgtcctggtattgttacaa

SEQ ID NO: 91717 - DNA, 25 bp, S. pombe
gaaattattcctctttgtctcagaa

SEQ ID NO: 91718 - DNA, 25 bp, S. pombe
gaaattcttcgtctttatccgtata

SEQ ID NO: 91719 - DNA, 25 bp, S. pombe
gacaaggttgttgctttaccctgta

SEQ ID NO: 91720 - DNA, 25 bp, S. pombe
gacaacgttttaccgattccattgc

SEQ ID NO: 91721 - DNA, 25 bp, S. pombe
gaaattgcttttacccatctccaat

SEQ ID NO: 91722 - DNA, 25 bp, S. pombe
gacaattctgacaagttccctacgc

SEQ ID NO: 91723 - DNA, 25 bp, S. pombe
gacaactaagcattgttccagctag

SEQ ID NO: 91724 - DNA, 25 bp, S. pombe
gacaactgataagcccatcgtctta

SEQ ID NO: 91725 - DNA, 25 bp, S. pombe
gaaattcagaattcgcctactttgg

SEQ ID NO: 91726 - DNA, 25 bp, S. pombe
gacaacccatattcgccaagcttta

SEQ ID NO: 91727 - DNA, 25 bp, S. pombe
gacaaactctgattcgactttaggg

SEQ ID NO: 91728 - DNA, 25 bp, S. pombe
gacaattttgaagtgcctgttgaac

SEQ ID NO: 91729 - DNA, 25 bp, S. pombe
gaaattgcacgcttagacttttaca

SEQ ID NO: 91730 - DNA, 25 bp, S. pombe
gacaatagccatctcttggtgcatc

SEQ ID NO: 91731 - DNA, 25 bp, S. pombe
gaaattcgcattcgcttttcagcag

SEQ ID NO: 91732 - DNA, 25 bp, S. pombe
gactactccatttgttgtgtcggaa

SEQ ID NO: 91733 - DNA, 25 bp, S. pombe
gacaaccgcatatttcttttggaaa

SEQ ID NO: 91734 - DNA, 25 bp, S. pombe
gacaatgccgaacaaccctggaaga

SEQ ID NO: 91735 - DNA, 25 bp, S. pombe
gacagagcctgctggtatctataat

SEQ ID NO: 91736 - DNA, 25 bp, S. pombe
gacaagctcgcaaacttccaaggta

SEQ ID NO: 91737 - DNA, 25 bp, S. pombe
gaaatattgccgacttttactagcg

SEQ ID NO: 91738 - DNA, 25 bp, S. pombe
gacaaggccctttctattttcaatg

SEQ ID NO: 91739 - DNA, 25 bp, S. pombe
gaaattatcgatacggctggtcaag

SEQ ID NO: 91740 - DNA, 25 bp, S. pombe
gacaaattcagcaccttcattagga

SEQ ID NO: 91741 - DNA, 25 bp, S. pombe
gacaatgagtcaatggcttccgaag

SEQ ID NO: 91742 - DNA, 25 bp, S. pombe
gacaaaatccttcgtttcgcgagtt

SEQ ID NO: 91743 - DNA, 25 bp, S. pombe
gacaccactatgttacggaccgatt

SEQ ID NO: 91744 - DNA, 25 bp, S. pombe
gaaatatcatatccttgtcggcatt

SEQ ID NO: 91745 - DNA, 25 bp, S. pombe
gaaattcccagctaatgcggcatct

SEQ ID NO: 91746 - DNA, 25 bp, S. pombe
gaaatttcaaatcatggccgctcca

SEQ ID NO: 91747 - DNA, 25 bp, S. pombe
gaaattatccaagtcgagcctttga

SEQ ID NO: 91748 - DNA, 25 bp, S. pombe
gaaatttgcaagttccctcaagtct

SEQ ID NO: 91749 - DNA, 25 bp, S. pombe
gaaatttccgcttcctgtaataatg

SEQ ID NO: 91750 - DNA, 25 bp, S. pombe
gaaatttcacttccacctgttaatt

SEQ ID NO: 91751 - DNA, 25 bp, S. pombe
gaaatatccgttgcatccagtaatt

SEQ ID NO: 91752 - DNA, 25 bp, S. pombe
gacattacctgaatggcttcgtcct

SEQ ID NO: 91753 - DNA, 25 bp, S. pombe
gaaattctttcagggatgcgcataa

SEQ ID NO: 91754 - DNA, 25 bp, S. pombe
gactcgggttttgtcgctataaacg

SEQ ID NO: 91755 - DNA, 25 bp, S. pombe
gaccgcaaggacttgatcgttcgca

SEQ ID NO: 91756 - DNA, 25 bp, S. pombe
gacatgcactagttattcccaagga

SEQ ID NO: 91757 - DNA, 25 bp, S. pombe
gacactcttgagcttccaaaggaga

SEQ ID NO: 91758 - DNA, 25 bp, S. pombe
gacaatcgcaataactacatctcat

SEQ ID NO: 91759 - DNA, 25 bp, S. pombe
gacaaggaagtattcgctccatctt

SEQ ID NO: 91760 - DNA, 25 bp, S. pombe
gacaagcatcagaagttgcgcatga

SEQ ID NO: 91761 - DNA, 25 bp, S. pombe
gacacacctggccttctggaagaag

SEQ ID NO: 91762 - DNA, 25 bp, S. pombe
gacagcaccattgcatgccgaggaa

SEQ ID NO: 91763 - DNA, 25 bp, S. pombe
gaaattgctatcttggcgacgcttt

SEQ ID NO: 91764 - DNA, 25 bp, S. pombe
gaaattctttctaggatctgcttta

SEQ ID NO: 91765 - DNA, 25 bp, S. pombe
gacaattgctgctccggagttttat

SEQ ID NO: 91766 - DNA, 25 bp, S. pombe
gaaattttgacaccaggctcttaca

SEQ ID NO: 91767 - DNA, 25 bp, S. pombe
gattaccttaggtaggtccttgact

SEQ ID NO: 91768 - DNA, 25 bp, S. pombe
gacaataccccgtttatctgtggat

SEQ ID NO: 91769 - DNA, 25 bp, S. pombe
gacaattccacagggtcgtcttgat

SEQ ID NO: 91770 - DNA, 25 bp, S. pombe
gaaatttattcagtcttccccgtat

SEQ ID NO: 91771 - DNA, 25 bp, S. pombe
gaaattgaatctactttgcccgcag

SEQ ID NO: 91772 - DNA, 25 bp, S. pombe
gaaattgaatctactcctgttggag

SEQ ID NO: 91773 - DNA, 25 bp, S. pombe
gacaaacaggtcttccttctggaag

SEQ ID NO: 91774 - DNA, 25 bp, S. pombe
gaaattttgtgaagtccctcgagaa

SEQ ID NO: 91775 - DNA, 25 bp, S. pombe
gaaattgttttcctctcagattaat

SEQ ID NO: 91776 - DNA, 25 bp, S. pombe
gaaattcaatctcgccttacttatg

SEQ ID NO: 91777 - DNA, 25 bp, S. pombe
gaaattctcgtgtgttcggtctgca

SEQ ID NO: 91778 - DNA, 25 bp, S. pombe
gaaattctggtgttgttcgtgctcg

SEQ ID NO: 91779 - DNA, 25 bp, S. pombe
gacaattgtggccttttacttcgtt

SEQ ID NO: 91780 - DNA, 25 bp, S. pombe
gacaccattacctttatgactctca

SEQ ID NO: 91781 - DNA, 25 bp, S. pombe
gacaccaacacctttgaatgcttgc

SEQ ID NO: 91782 - DNA, 25 bp, S. pombe
gacagtacgcgagcagcaatactgc

SEQ ID NO: 91783 - DNA, 25 bp, S. pombe
gacatgccaaggtccacattgttgc

SEQ ID NO: 91784 - DNA, 25 bp, S. pombe
gacagcattgcaagatcaccggtga

SEQ ID NO: 91785 - DNA, 25 bp, S. pombe
gacaagcgatcatctctggagacga

SEQ ID NO: 91786 - DNA, 25 bp, S. pombe
gacagctatcgcatggatcgcttag

SEQ ID NO: 91787 - DNA, 25 bp, S. pombe
gacgcttcaaatcgatggttaccat

SEQ ID NO: 91788 - DNA, 25 bp, S. pombe
gacagtttgtacgtttctaccatac

SEQ ID NO: 91789 - DNA, 25 bp, S. pombe
gacattgacgaacttggtaccttag

SEQ ID NO: 91790 - DNA, 25 bp, S. pombe
gacatgtgacattaaggacccttta

SEQ ID NO: 91791 - DNA, 25 bp, S. pombe
gacagtgcatacgaaggaactcctg

SEQ ID NO: 91792 - DNA, 25 bp, S. pombe
gacacgtcaaatcgcgaaaactttt

SEQ ID NO: 91793 - DNA, 25 bp, S. pombe
gactcgccgaatcaaaagctttatt

SEQ ID NO: 91794 - DNA, 25 bp, S. pombe
gacagcctcgttcaataagtttttc

SEQ ID NO: 91795 - DNA, 25 bp, S. pombe
gacactgctcttgaaaaaggtggat

SEQ ID NO: 91796 - DNA, 25 bp, S. pombe
gacaccttctataactaagccggaa

SEQ ID NO: 91797 - DNA, 25 bp, S. pombe
gacagcagtggcctcgacaagcaaa

SEQ ID NO: 91798 - DNA, 25 bp, S. pombe
gacactgtcattcctgaagccaaat

SEQ ID NO: 91799 - DNA, 25 bp, S. pombe
gacactatatctctacagccaagga

SEQ ID NO: 91800 - DNA, 25 bp, S. pombe
gacagtagtttcaatcccaatggta

SEQ ID NO: 91801 - DNA, 25 bp, S. pombe
gacttagttcgttctacaaggtttg

SEQ ID NO: 91802 - DNA, 25 bp, S. pombe
gacactgttccgaaggttatcactg

SEQ ID NO: 91803 - DNA, 25 bp, S. pombe
gacaaatctcctcttgatgcttacg

SEQ ID NO: 91804 - DNA, 25 bp, S. pombe
gacaactgcatcaatcttccgttat

SEQ ID NO: 91805 - DNA, 25 bp, S. pombe
gacacctgatcaaaacgctttagtt

SEQ ID NO: 91806 - DNA, 25 bp, S. pombe
gaaattgcacacttggagcgtgtac

SEQ ID NO: 91807 - DNA, 25 bp, S. pombe
gaaattgccttgacttagccgaaga

SEQ ID NO: 91808 - DNA, 25 bp, S. pombe
gaaattgcccgcatatatgcatcga

SEQ ID NO: 91809 - DNA, 25 bp, S. pombe
gacaattgtcccatacagtcaccaa

SEQ ID NO: 91810 - DNA, 25 bp, S. pombe
gaaattgtcctttacgctcattata

SEQ ID NO: 91811 - DNA, 25 bp, S. pombe
gaaattctcgtcttctcgattttac

SEQ ID NO: 91812 - DNA, 25 bp, S. pombe
gaaattcttgattccttctttggga

SEQ ID NO: 91813 - DNA, 25 bp, S. pombe
gacaaagtctttactgttttatgac

SEQ ID NO: 91814 - DNA, 25 bp, S. pombe
gacaaaactttctttgctccagcta

SEQ ID NO: 91815 - DNA, 25 bp, S. pombe
gacaaacagtcgtccttaaagctga

SEQ ID NO: 91816 - DNA, 25 bp, S. pombe
gacaggacgtcgacaatttgcttga

SEQ ID NO: 91817 - DNA, 25 bp, S. pombe
gtcaaacgtcgccaacggttaatcg

SEQ ID NO: 91818 - DNA, 25 bp, S. pombe
gacaaaccttccacgtgttgaactt

SEQ ID NO: 91819 - DNA, 25 bp, S. pombe
gacactgatgccttatgaccgaaca

SEQ ID NO: 91820 - DNA, 25 bp, S. pombe
gacaatgatggctttgcttcgaaaa

SEQ ID NO: 91821 - DNA, 25 bp, S. pombe
gacaagccagtccatcagttatatt

SEQ ID NO: 91822 - DNA, 25 bp, S. pombe
gacactaatactgaacgcgcactat

SEQ ID NO: 91823 - DNA, 25 bp, S. pombe
gacaagttaagttttctcctgctga

SEQ ID NO: 91824 - DNA, 25 bp, S. pombe
gacatggttgcgtgggccaattcta

SEQ ID NO: 91825 - DNA, 25 bp, S. pombe
gacaagctctcatctgatctatcta

SEQ ID NO: 91826 - DNA, 25 bp, S. pombe
gacagtattgttcgtggtaccacct

SEQ ID NO: 91827 - DNA, 25 bp, S. pombe
gacacattaattcagctaggccata

SEQ ID NO: 91828 - DNA, 25 bp, S. pombe
gacattaagtctccgtttgaacaag

SEQ ID NO: 91829 - DNA, 25 bp, S. pombe
gacttcccttggtctttgaacaaat

SEQ ID NO: 91830 - DNA, 25 bp, S. pombe
gacaatttcttggtttcaccttcaa

SEQ ID NO: 91831 - DNA, 25 bp, S. pombe
gacaattttcgagcttactttcagg

SEQ ID NO: 91832 - DNA, 25 bp, S. pombe
gacactttacaagccctattatcta

SEQ ID NO: 91833 - DNA, 25 bp, S. pombe
gacaaaattattcagcgcggcatgg

SEQ ID NO: 91834 - DNA, 25 bp, S. pombe
gacaagaaatttccaccaggccgtt

SEQ ID NO: 91835 - DNA, 25 bp, S. pombe
gacaacttgtttacactcgtcccta

SEQ ID NO: 91836 - DNA, 25 bp, S. pombe
gacatttgactggtcctcgtactgt

SEQ ID NO: 91837 - DNA, 25 bp, S. pombe
gacaatccatattcgtttcctatca

SEQ ID NO: 91838 - DNA, 25 bp, S. pombe
gacaatccttttaattccttcggtg

SEQ ID NO: 91839 - DNA, 25 bp, S. pombe
gagttacttcctgactcttttggtc

SEQ ID NO: 91840 - DNA, 25 bp, S. pombe
gacattagttccacaacatcttcgg

SEQ ID NO: 91841 - DNA, 25 bp, S. pombe
gacttcgtttcaaccaattcctagg

SEQ ID NO: 91842 - DNA, 25 bp, S. pombe
gacataatccttcaattgcgacttt

SEQ ID NO: 91843 - DNA, 25 bp, S. pombe
gacaatttatcgctttcagaccttg

SEQ ID NO: 91844 - DNA, 25 bp, S. pombe
gacactcccacgagattagcagcat

SEQ ID NO: 91845 - DNA, 25 bp, S. pombe
gacaaggatgctcgttttcactata

SEQ ID NO: 91846 - DNA, 25 bp, S. pombe
gaaattggcaggatttccttcacaa

SEQ ID NO: 91847 - DNA, 25 bp, S. pombe
gacagcttcctggaattctttcagt

SEQ ID NO: 91848 - DNA, 25 bp, S. pombe
gacacctgcgtggaattctggaagt

SEQ ID NO: 91849 - DNA, 25 bp, S. pombe
gacataccgtttatgctggaggcta

SEQ ID NO: 91850 - DNA, 25 bp, S. pombe
gacaaaccatttaagctcgacgata

SEQ ID NO: 91851 - DNA, 25 bp, S. pombe
gacaaaactgatatagcgccggaat

SEQ ID NO: 91852 - DNA, 25 bp, S. pombe
gacatgctaaatgggttacccttta

SEQ ID NO: 91853 - DNA, 25 bp, S. pombe
gattttcgtcaagactttgaccgga

SEQ ID NO: 91854 - DNA, 25 bp, S. pombe
gacatttctctatgggtgttgccga

SEQ ID NO: 91855 - DNA, 25 bp, S. pombe
gacagtacttgatccgttagccgat

SEQ ID NO: 91856 - DNA, 25 bp, S. pombe
gacagatcctttatcgttacctatt

SEQ ID NO: 91857 - DNA, 25 bp, S. pombe
gacaaccttacttggcttgatgcta

SEQ ID NO: 91858 - DNA, 25 bp, S. pombe
gacaagtatttcttctgcttctgct

SEQ ID NO: 91859 - DNA, 25 bp, S. pombe
gacaatcgtgtatctgaggagcata

SEQ ID NO: 91860 - DNA, 25 bp, S. pombe
gacaatctggtatgcttgctgctgc

SEQ ID NO: 91861 - DNA, 25 bp, S. pombe
gacaactcttatggaatgcatcgtg

SEQ ID NO: 91862 - DNA, 25 bp, S. pombe
gacaagccttttcacacacaataat

SEQ ID NO: 91863 - DNA, 25 bp, S. pombe
gacaagctgcttttaaccacgggag

SEQ ID NO: 91864 - DNA, 25 bp, S. pombe
gacacttctttcattgaacggccag

SEQ ID NO: 91865 - DNA, 25 bp, S. pombe
gacaagatgcgtcaacaagccttag

SEQ ID NO: 91866 - DNA, 25 bp, S. pombe
gacaagcttctaaacaacctcaacg

SEQ ID NO: 91867 - DNA, 25 bp, S. pombe
gacagcgctcaatacatgtgccaaa

SEQ ID NO: 91868 - DNA, 25 bp, S. pombe
gacaggcatcagcatggctaccatg

SEQ ID NO: 91869 - DNA, 25 bp, S. pombe
gacaatcaagttttggcctgtgtga

SEQ ID NO: 91870 - DNA, 25 bp, S. pombe
gacacataagtttttactggcgact

SEQ ID NO: 91871 - DNA, 25 bp, S. pombe
gacaaggctcgtcgtttgggttaca

SEQ ID NO: 91872 - DNA, 25 bp, S. pombe
gacaggcagcatgtttttgggatct

SEQ ID NO: 91873 - DNA, 25 bp, S. pombe
gacaggtcaagttcagttggttgct

SEQ ID NO: 91874 - DNA, 25 bp, S. pombe
gacacgatggttctttagcaaataa

SEQ ID NO: 91875 - DNA, 25 bp, S. pombe
gacacagtgtatttcgacttgcaac

SEQ ID NO: 91876 - DNA, 25 bp, S. pombe
gacacagttgtatcgcgttctggca

SEQ ID NO: 91877 - DNA, 25 bp, S. pombe
gacatggtttagcacctttgcaatt

SEQ ID NO: 91878 - DNA, 25 bp, S. pombe
gacttggcgggcgacattatacaaa

SEQ ID NO: 91879 - DNA, 25 bp, S. pombe
gacttgttacgcgatcatttccaaa

SEQ ID NO: 91880 - DNA, 25 bp, S. pombe
gactgttatccggtgctttaagggc

SEQ ID NO: 91881 - DNA, 25 bp, S. pombe
gacaggactcatcactgccaaagtg

SEQ ID NO: 91882 - DNA, 25 bp, S. pombe
gacaactccagttcaaatacccatt

SEQ ID NO: 91883 - DNA, 25 bp, S. pombe
gacaagctcccagaagaactctgat

SEQ ID NO: 91884 - DNA, 25 bp, S. pombe
gacaagctcgtttagcacaacttca

SEQ ID NO: 91885 - DNA, 25 bp, S. pombe
gacagaccagatcctattgctgctg

SEQ ID NO: 91886 - DNA, 25 bp, S. pombe
gacagcagccaactccattgattgg

SEQ ID NO: 91887 - DNA, 25 bp, S. pombe
gacagcagtattcctaagcatcgtg

SEQ ID NO: 91888 - DNA, 25 bp, S. pombe
gacaactcattttccaagtctcttg

SEQ ID NO: 91889 - DNA, 25 bp, S. pombe
gacagacttgtatacgagggctttg

SEQ ID NO: 91890 - DNA, 25 bp, S. pombe
gacatgactctaaaactctgggact

SEQ ID NO: 91891 - DNA, 25 bp, S. pombe
gacacccttacattgacagctggat

SEQ ID NO: 91892 - DNA, 25 bp, S. pombe
gacactccgtagtctattgcgatgt

SEQ ID NO: 91893 - DNA, 25 bp, S. pombe
gacacatcatcgagactaggcattg

SEQ ID NO: 91894 - DNA, 25 bp, S. pombe
gatccaagttcgattttcggtccta

SEQ ID NO: 91895 - DNA, 25 bp, S. pombe
gacacaaattcgcttacactcacat

SEQ ID NO: 91896 - DNA, 25 bp, S. pombe
gacaaatatcgccaagtacctcaca

SEQ ID NO: 91897 - DNA, 25 bp, S. pombe
gacagatcatttcgttcttcttcaa

SEQ ID NO: 91898 - DNA, 25 bp, S. pombe
gacacgtttctactcatgcaattta

SEQ ID NO: 91899 - DNA, 25 bp, S. pombe
gacacccttcattctagcaatgcaa

SEQ ID NO: 91900 - DNA, 25 bp, S. pombe
gacaacttcatattacagctcctgg

SEQ ID NO: 91901 - DNA, 25 bp, S. pombe
gacagaatttcttccactatctgga

SEQ ID NO: 91902 - DNA, 25 bp, S. pombe
gacaacattctgtaaattccccacc

SEQ ID NO: 91903 - DNA, 25 bp, S. pombe
gacaagaatgcccacagtctgagac

SEQ ID NO: 91904 - DNA, 25 bp, S. pombe
gacacatcatgttgggaggcctatt

SEQ ID NO: 91905 - DNA, 25 bp, S. pombe
gacactattccgtaaggctaccaag

SEQ ID NO: 91906 - DNA, 25 bp, S. pombe
gacacattccgcgatggatacattg

SEQ ID NO: 91907 - DNA, 25 bp, S. pombe
gacagcggccttgatgtcaacgata

SEQ ID NO: 91908 - DNA, 25 bp, S. pombe
gacacacccttctatggaatcctat

SEQ ID NO: 91909 - DNA, 25 bp, S. pombe
gacaaccaccaaatgtgacccttac

SEQ ID NO: 91910 - DNA, 25 bp, S. pombe
gacagaatcccaatgaacccgtatt

SEQ ID NO: 91911 - DNA, 25 bp, S. pombe
gacagcatgttgaggaacccgctct

SEQ ID NO: 91912 - DNA, 25 bp, S. pombe
gacagttctgtgagataaccttcat

SEQ ID NO: 91913 - DNA, 25 bp, S. pombe
gacagtgtttatgacgatccttcgt

SEQ ID NO: 91914 - DNA, 25 bp, S. pombe
gacagttttcgaacgtgtttgccta

SEQ ID NO: 91915 - DNA, 25 bp, S. pombe
gacaaaatatcttctggcggctcta

SEQ ID NO: 91916 - DNA, 25 bp, S. pombe
gacaacttgatactttacgacttct

SEQ ID NO: 91917 - DNA, 25 bp, S. pombe
gacacccttaccttcatcaaagttt

SEQ ID NO: 91918 - DNA, 25 bp, S. pombe
gacttggcaatttccgaatgaccta

SEQ ID NO: 91919 - DNA, 25 bp, S. pombe
gactgtgcagcattgggccgaacct

SEQ ID NO: 91920 - DNA, 25 bp, S. pombe
gacactaccgccgtttttgaacagt

SEQ ID NO: 91921 - DNA, 25 bp, S. pombe
gacagctccccatgtgattttgaag

SEQ ID NO: 91922 - DNA, 25 bp, S. pombe
gacagggcagttttcatttatccta

SEQ ID NO: 91923 - DNA, 25 bp, S. pombe
gacaggtctttaaattctcatctta

SEQ ID NO: 91924 - DNA, 25 bp, S. pombe
gacagcgtattaaacattcctccaa

SEQ ID NO: 91925 - DNA, 25 bp, S. pombe
gagcatcggcaaactcacttagcgt

SEQ ID NO: 91926 - DNA, 25 bp, S. pombe
gacagcttgcaaactattctggaat

SEQ ID NO: 91927 - DNA, 25 bp, S. pombe
gacagcgctggaacttctcgatgaa

SEQ ID NO: 91928 - DNA, 25 bp, S. pombe
gatacgaataatcccacccggtgga

SEQ ID NO: 91929 - DNA, 25 bp, S. pombe
gagcttcccgaagtacttcacggaa

SEQ ID NO: 91930 - DNA, 25 bp, S. pombe
gacactatgcatgaattgagctcat

SEQ ID NO: 91931 - DNA, 25 bp, S. pombe
gacatgctttcaaatttcttcccaa

SEQ ID NO: 91932 - DNA, 25 bp, S. pombe
gacagaggtcggatttctttcctcc

SEQ ID NO: 91933 - DNA, 25 bp, S. pombe
gacagtgaacttcgacgctttctac

SEQ ID NO: 91934 - DNA, 25 bp, S. pombe
gacagaagatgtacgtcctccttac

SEQ ID NO: 91935 - DNA, 25 bp, S. pombe
gacacatttcagtcaacgctcttat

SEQ ID NO: 91936 - DNA, 25 bp, S. pombe
gacagcctatcgtcaaacctgttta

SEQ ID NO: 91937 - DNA, 25 bp, S. pombe
gacatcaaacaattctctccctatt

SEQ ID NO: 91938 - DNA, 25 bp, S. pombe
gacacggaagcatttcaccaacgat

SEQ ID NO: 91939 - DNA, 25 bp, S. pombe
gacagcccagttggtttagcaggtt

SEQ ID NO: 91940 - DNA, 25 bp, S. pombe
gacacgctatattagttctgctgag

SEQ ID NO: 91941 - DNA, 25 bp, S. pombe
gacacatctattagagccagacttc

SEQ ID NO: 91942 - DNA, 25 bp, S. pombe
gacactttgatcaaccaacttccag

SEQ ID NO: 91943 - DNA, 25 bp, S. pombe
gacacatttatcatatctaccctca

SEQ ID NO: 91944 - DNA, 25 bp, S. pombe
gacagcaatcagctttccatttatg

SEQ ID NO: 91945 - DNA, 25 bp, S. pombe
gacagccatcagctctatctttaat

SEQ ID NO: 91946 - DNA, 25 bp, S. pombe
gacatttcggatgtttctggtcaac

SEQ ID NO: 91947 - DNA, 25 bp, S. pombe
gacttccctccatgatgatcggttg

SEQ ID NO: 91948 - DNA, 25 bp, S. pombe
gactatagctcttacggatcgtttc

SEQ ID NO: 91949 - DNA, 25 bp, S. pombe
gacagctttttcagtcgtgtttttg

SEQ ID NO: 91950 - DNA, 25 bp, S. pombe
gacacattttacagcacctttggaa

SEQ ID NO: 91951 - DNA, 25 bp, S. pombe
gacatcaggtgttccatttggctta

SEQ ID NO: 91952 - DNA, 25 bp, S. pombe
gacaccgctattccattgcgtgaaa

SEQ ID NO: 91953 - DNA, 25 bp, S. pombe
gacatccggatgcatttaattgaat

SEQ ID NO: 91954 - DNA, 25 bp, S. pombe
gacactccagactttttatgggact

SEQ ID NO: 91955 - DNA, 25 bp, S. pombe
gacttatcgtggtcgacctgtagaa

SEQ ID NO: 91956 - DNA, 25 bp, S. pombe
gacattgtcgttgctcaccatgata

SEQ ID NO: 91957 - DNA, 25 bp, S. pombe
gacagcaattggttccgctatcagc

SEQ ID NO: 91958 - DNA, 25 bp, S. pombe
gacactcattaggtggcgctactgc

SEQ ID NO: 91959 - DNA, 25 bp, S. pombe
gacagttgtgtcatccgaggaagca

SEQ ID NO: 91960 - DNA, 25 bp, S. pombe
gacagattctgtctatgcctggaaa

SEQ ID NO: 91961 - DNA, 25 bp, S. pombe
gacagattttctggcattgctcaaa

SEQ ID NO: 91962 - DNA, 25 bp, S. pombe
gacagtctctctaatgcttacgatg

SEQ ID NO: 91963 - DNA, 25 bp, S. pombe
gacagcttggatgatttacgtttag

SEQ ID NO: 91964 - DNA, 25 bp, S. pombe
gacacgctcgcttatttacgttgtg

SEQ ID NO: 91965 - DNA, 25 bp, S. pombe
gacacctctgatatttggcttgctt

SEQ ID NO: 91966 - DNA, 25 bp, S. pombe
gacacaatcgttttggagttgcatt

SEQ ID NO: 91967 - DNA, 25 bp, S. pombe
gacactatcttatgttggttcacac

SEQ ID NO: 91968 - DNA, 25 bp, S. pombe
gactgggttagaaaggctcatcctg

SEQ ID NO: 91969 - DNA, 25 bp, S. pombe
gacagcagggctaaacggtactttt

SEQ ID NO: 91970 - DNA, 25 bp, S. pombe
gacagcacggtatgactggtttcat

SEQ ID NO: 91971 - DNA, 25 bp, S. pombe
gacgttgaacggtgccagtttgaat

SEQ ID NO: 91972 - DNA, 25 bp, S. pombe
gacagatcatatacggacgccgttt

SEQ ID NO: 91973 - DNA, 25 bp, S. pombe
gacattttgaatttcgccggtcaat

SEQ ID NO: 91974 - DNA, 25 bp, S. pombe
gacattttttcacccttaagccact

SEQ ID NO: 91975 - DNA, 25 bp, S. pombe
gacttgcaaggtttccttttcgact

SEQ ID NO: 91976 - DNA, 25 bp, S. pombe
gacagctgtcgaaaagtatctaaac

SEQ ID NO: 91977 - DNA, 25 bp, S. pombe
gacagcttgcgaaactttttgatca

SEQ ID NO: 91978 - DNA, 25 bp, S. pombe
gacacttctcgttctatcattcgta

SEQ ID NO: 91979 - DNA, 25 bp, S. pombe
gacactatcctttcttctgacaatt

SEQ ID NO: 91980 - DNA, 25 bp, S. pombe
gacacttgacaagccaggatcgagt

SEQ ID NO: 91981 - DNA, 25 bp, S. pombe
gacacgaaaaactaataattgctga

SEQ ID NO: 91982 - DNA, 25 bp, S. pombe
gacacggttgattcacatttattgc

SEQ ID NO: 91983 - DNA, 25 bp, S. pombe
gacatttcagcacaactcgagcgat

SEQ ID NO: 91984 - DNA, 25 bp, S. pombe
gacagtattgatcagcggcgagaat

SEQ ID NO: 91985 - DNA, 25 bp, S. pombe
gacactgaggtgacggctactacca

SEQ ID NO: 91986 - DNA, 25 bp, S. pombe
gacatcgaagctttgcaatcacaac

SEQ ID NO: 91987 - DNA, 25 bp, S. pombe
gacacgtttgtatcttgcgcgattc

SEQ ID NO: 91988 - DNA, 25 bp, S. pombe
gacactgttttctcttggattctaa

SEQ ID NO: 91989 - DNA, 25 bp, S. pombe
gaccgtagagctgtcaatgccgcca

SEQ ID NO: 91990 - DNA, 25 bp, S. pombe
gactcggtactttgaagcgtgccaa

SEQ ID NO: 91991 - DNA, 25 bp, S. pombe
gactttgcgaacataccgcggtatg

SEQ ID NO: 91992 - DNA, 25 bp, S. pombe
gacaccttggtcattgattgattcg

SEQ ID NO: 91993 - DNA, 25 bp, S. pombe
gactttgacgtctcaatgggaacct

SEQ ID NO: 91994 - DNA, 25 bp, S. pombe
gacttggtcgtttccagttggatac

SEQ ID NO: 91995 - DNA, 25 bp, S. pombe
gacacggaacgaagctcgctatcat

SEQ ID NO: 91996 - DNA, 25 bp, S. pombe
gacagcgtgaacttgatgcgggaca

SEQ ID NO: 91997 - DNA, 25 bp, S. pombe
gacatttggacttgatatacttgat

SEQ ID NO: 91998 - DNA, 25 bp, S. pombe
gacacctgagacaaaaactgctgac

SEQ ID NO: 91999 - DNA, 25 bp, S. pombe
gagcctcaggaagaaagcgtaccga

SEQ ID NO: 92000 - DNA, 25 bp, S. pombe
gagttctacctataagtgttcgacg

SEQ ID NO: 92001 - DNA, 25 bp, S. pombe
gactttagcttattccgtcgttaca

SEQ ID NO: 92002 - DNA, 25 bp, S. pombe
gactttacttaccaaccgttatgct

SEQ ID NO: 92003 - DNA, 25 bp, S. pombe
gacttcttctatgcctttacagggt

SEQ ID NO: 92004 - DNA, 25 bp, S. pombe
gaccctcggttcgttttcaagctgg

SEQ ID NO: 92005 - DNA, 25 bp, S. pombe
gacacctcggttgatatttctgcaa

SEQ ID NO: 92006 - DNA, 25 bp, S. pombe
gactcctggttcaacggtcttcaaa

SEQ ID NO: 92007 - DNA, 25 bp, S. pombe
gacacgtagcgtatctcttttacaa

SEQ ID NO: 92008 - DNA, 25 bp, S. pombe
gacaggaatgcgtacactcgattta

SEQ ID NO: 92009 - DNA, 25 bp, S. pombe
gacagtgaatcatatcgccgttttg

SEQ ID NO: 92010 - DNA, 25 bp, S. pombe
gacattcttcgacaggttactcaaa

SEQ ID NO: 92011 - DNA, 25 bp, S. pombe
gacttgcatatgcagcgtgctgtta

SEQ ID NO: 92012 - DNA, 25 bp, S. pombe
gacatttggcattctgatcgctgaa

SEQ ID NO: 92013 - DNA, 25 bp, S. pombe
gactggtaagcacggacatgccaag

SEQ ID NO: 92014 - DNA, 25 bp, S. pombe
gactccaaggaggaagcccaatttt

SEQ ID NO: 92015 - DNA, 25 bp, S. pombe
gacagaatcaccatgcattataccg

SEQ ID NO: 92016 - DNA, 25 bp, S. pombe
gacaggtatgccttttgatcccgag

SEQ ID NO: 92017 - DNA, 25 bp, S. pombe
gacaggaactattttgagcagctcg

SEQ ID NO: 92018 - DNA, 25 bp, S. pombe
gacatcgaccgatacgagcagacta

SEQ ID NO: 92019 - DNA, 25 bp, S. pombe
gacagctactggtttagcacctgaa

SEQ ID NO: 92020 - DNA, 25 bp, S. pombe
gacagtactggctaaaacatctcga

SEQ ID NO: 92021 - DNA, 25 bp, S. pombe
gacatttagaccttcagcagtttat

SEQ ID NO: 92022 - DNA, 25 bp, S. pombe
gactttgctacccagaaatctttgc

SEQ ID NO: 92023 - DNA, 25 bp, S. pombe
gacatgtagctagccgacaggattt

SEQ ID NO: 92024 - DNA, 25 bp, S. pombe
gacatgagcgtctactagctattga

SEQ ID NO: 92025 - DNA, 25 bp, S. pombe
gacggagaagcctcgttacgatctt

SEQ ID NO: 92026 - DNA, 25 bp, S. pombe
gacagctatgatttctttaaccatt

SEQ ID NO: 92027 - DNA, 25 bp, S. pombe
gacttcgtgacaaccctatgttttg

SEQ ID NO: 92028 - DNA, 25 bp, S. pombe
gacttcgatactttccttggtgact

SEQ ID NO: 92029 - DNA, 25 bp, S. pombe
gacttctaatatttaccgctggacc

SEQ ID NO: 92030 - DNA, 25 bp, S. pombe
gacttgctaaacttgatgctcccga

SEQ ID NO: 92031 - DNA, 25 bp, S. pombe
gacatggtaaaagactcgccgaatc

SEQ ID NO: 92032 - DNA, 25 bp, S. pombe
gacattgctagaactgctctcgttt

SEQ ID NO: 92033 - DNA, 25 bp, S. pombe
gacttggtttcggagctgttgtagc

SEQ ID NO: 92034 - DNA, 25 bp, S. pombe
gacgtctttcgttacttttcgcagt

SEQ ID NO: 92035 - DNA, 25 bp, S. pombe
gagctttactgggaactttgggcaa

SEQ ID NO: 92036 - DNA, 25 bp, S. pombe
gacttctttggaaacgttcgtgaca

SEQ ID NO: 92037 - DNA, 25 bp, S. pombe
gactagcttataattcccttcttaa

SEQ ID NO: 92038 - DNA, 25 bp, S. pombe
gagttcccaattttcgctactttat

SEQ ID NO: 92039 - DNA, 25 bp, S. pombe
gacattctaacgctttcgaagtctt

SEQ ID NO: 92040 - DNA, 25 bp, S. pombe
gacagtgctagctcttaatcaggac

SEQ ID NO: 92041 - DNA, 25 bp, S. pombe
gacagtctccttgaatatcagcaga

SEQ ID NO: 92042 - DNA, 25 bp, S. pombe
gactatgctgactacgaggctcatg

SEQ ID NO: 92043 - DNA, 25 bp, S. pombe
gacattgatggtttgccttctcaaa

SEQ ID NO: 92044 - DNA, 25 bp, S. pombe
gacatcaaggctcgtttggtgactg

SEQ ID NO: 92045 - DNA, 25 bp, S. pombe
gacattctggaatttttgcgacacc

SEQ ID NO: 92046 - DNA, 25 bp, S. pombe
gacaggcctgatctagacatgtaca

SEQ ID NO: 92047 - DNA, 25 bp, S. pombe
gacaggttatctttacttccagtga

SEQ ID NO: 92048 - DNA, 25 bp, S. pombe
gacatcagtttacttgcaaggccat

SEQ ID NO: 92049 - DNA, 25 bp, S. pombe
gacatcagttttccgagaggccttt

SEQ ID NO: 92050 - DNA, 25 bp, S. pombe
gactccttacgctgagaagcctatt

SEQ ID NO: 92051 - DNA, 25 bp, S. pombe
gacttcttggtaaacttggcaggct

SEQ ID NO: 92052 - DNA, 25 bp, S. pombe
gactttaagcccaatgttgaccctg

SEQ ID NO: 92053 - DNA, 25 bp, S. pombe
gacattgttgtttttggacgtgcct

SEQ ID NO: 92054 - DNA, 25 bp, S. pombe
gacagctttgctatctggatggctt

SEQ ID NO: 92055 - DNA, 25 bp, S. pombe
gacagcacctgatgtagtaccttca

SEQ ID NO: 92056 - DNA, 25 bp, S. pombe
gacagagtctatatagctcccgaaa

SEQ ID NO: 92057 - DNA, 25 bp, S. pombe
gacatctcgtggtcattttctcgaa

SEQ ID NO: 92058 - DNA, 25 bp, S. pombe
gactacgtcggcttcttgattggat

SEQ ID NO: 92059 - DNA, 25 bp, S. pombe
gactaacacccgaattactgatttg

SEQ ID NO: 92060 - DNA, 25 bp, S. pombe
gacatgcctttaagtgatgaccgag

SEQ ID NO: 92061 - DNA, 25 bp, S. pombe
gacagtgaccttgactacgcatatt

SEQ ID NO: 92062 - DNA, 25 bp, S. pombe
gacagtgaccgtatggatcgtttaa

SEQ ID NO: 92063 - DNA, 25 bp, S. pombe
gacttcccgtgcatagtagctttaa

SEQ ID NO: 92064 - DNA, 25 bp, S. pombe
gacatcgctggcgtcgttgatttta

SEQ ID NO: 92065 - DNA, 25 bp, S. pombe
gacagttggcatggttcttcggaag

SEQ ID NO: 92066 - DNA, 25 bp, S. pombe
gacatggtttataatcccagcaaca

SEQ ID NO: 92067 - DNA, 25 bp, S. pombe
gacatggagttttaccctgaatgct

SEQ ID NO: 92068 - DNA, 25 bp, S. pombe
gacattgacgatttacgccgacata

SEQ ID NO: 92069 - DNA, 25 bp, S. pombe
gacatgctataatgccacagttgta

SEQ ID NO: 92070 - DNA, 25 bp, S. pombe
gacttttattgctatccttggatcg

SEQ ID NO: 92071 - DNA, 25 bp, S. pombe
gacattgatcgtattccacatcgta

SEQ ID NO: 92072 - DNA, 25 bp, S. pombe
gacagttcttcccttaaccagagtt

SEQ ID NO: 92073 - DNA, 25 bp, S. pombe
gacattgtcccgtatactacttata

SEQ ID NO: 92074 - DNA, 25 bp, S. pombe
gacatgtccacctctaagactggta

SEQ ID NO: 92075 - DNA, 25 bp, S. pombe
gacatgctggcatcgtttagtatcg

SEQ ID NO: 92076 - DNA, 25 bp, S. pombe
gacatgctgtcattttaccagtcaa

SEQ ID NO: 92077 - DNA, 25 bp, S. pombe
gacagttaggctaccattgctcctt

SEQ ID NO: 92078 - DNA, 25 bp, S. pombe
gacagtctaacaaaatgcttccttt

SEQ ID NO: 92079 - DNA, 25 bp, S. pombe
gacagtctatcgcaaatctcttcgc

SEQ ID NO: 92080 - DNA, 25 bp, S. pombe
gactttcatggattcggtggctagc

SEQ ID NO: 92081 - DNA, 25 bp, S. pombe
gacattcgtgcttctgctgagatat

SEQ ID NO: 92082 - DNA, 25 bp, S. pombe
gacatgtcttgacttctagaacagg

SEQ ID NO: 92083 - DNA, 25 bp, S. pombe
gacttggttctgattcagcgactga

SEQ ID NO: 92084 - DNA, 25 bp, S. pombe
gacttatggtcgtgttgctccaaga

SEQ ID NO: 92085 - DNA, 25 bp, S. pombe
gactcgtatcattcaagtcgcctac

SEQ ID NO: 92086 - DNA, 25 bp, S. pombe
gacagtattttgctttctttgccag

SEQ ID NO: 92087 - DNA, 25 bp, S. pombe
gacttactaaatatacctcatggag

SEQ ID NO: 92088 - DNA, 25 bp, S. pombe
gacttcctaactcctcaaactgaat

SEQ ID NO: 92089 - DNA, 25 bp, S. pombe
gacattcctaccgactcaaaggcat

SEQ ID NO: 92090 - DNA, 25 bp, S. pombe
gacatatctttcaaattcatgccca

SEQ ID NO: 92091 - DNA, 25 bp, S. pombe
gacttctttacgaatgtttccccat

SEQ ID NO: 92092 - DNA, 25 bp, S. pombe
gacttctttcaacatgtactttccg

SEQ ID NO: 92093 - DNA, 25 bp, S. pombe
gacttattacgacgatctgcacttt

SEQ ID NO: 92094 - DNA, 25 bp, S. pombe
gacttatcctctcccactaaaaaag

SEQ ID NO: 92095 - DNA, 25 bp, S. pombe
gacatcgaccagaggcattgccaat

SEQ ID NO: 92096 - DNA, 25 bp, S. pombe
gactcaaatgcaggtggattccaat

SEQ ID NO: 92097 - DNA, 25 bp, S. pombe
gactagcagattgatggacttcctt

SEQ ID NO: 92098 - DNA, 25 bp, S. pombe
gacatattctcctagcgaagcttct

SEQ ID NO: 92099 - DNA, 25 bp, S. pombe
gacttcctcgcggtatcaattgtta

SEQ ID NO: 92100 - DNA, 25 bp, S. pombe
gactccctgggtttgctagtgatga

SEQ ID NO: 92101 - DNA, 25 bp, S. pombe
gactcccgagcgtatgatgcaaaat

SEQ ID NO: 92102 - DNA, 25 bp, S. pombe
gacttcagccctattgcaaatctta

SEQ ID NO: 92103 - DNA, 25 bp, S. pombe
gactcgggatcctcatttaactcat

SEQ ID NO: 92104 - DNA, 25 bp, S. pombe
gactcgaaacctaatctctcaactt

SEQ ID NO: 92105 - DNA, 25 bp, S. pombe
gacatcccgaagtatttgtttgcta

SEQ ID NO: 92106 - DNA, 25 bp, S. pombe
gacatccctgatactcttttgtttg

SEQ ID NO: 92107 - DNA, 25 bp, S. pombe
gacatcgtctgtaagttctttctgg

SEQ ID NO: 92108 - DNA, 25 bp, S. pombe
gacatcggtgtcaagttccttcaat

SEQ ID NO: 92109 - DNA, 25 bp, S. pombe
gactcaatgtcagcgatgccaagga

SEQ ID NO: 92110 - DNA, 25 bp, S. pombe
gactttctccggatagctgcaattt

SEQ ID NO: 92111 - DNA, 25 bp, S. pombe
gacttgatgactcgtggtgaacctc

SEQ ID NO: 92112 - DNA, 25 bp, S. pombe
gacttcaagcttgtatgttcctgga

SEQ ID NO: 92113 - DNA, 25 bp, S. pombe
gactttggtacaattgtctccgaga

SEQ ID NO: 92114 - DNA, 25 bp, S. pombe
gacattctgttactaatcctgacga

SEQ ID NO: 92115 - DNA, 25 bp, S. pombe
gacttctgagtctgaacgtgagcta

SEQ ID NO: 92116 - DNA, 25 bp, S. pombe
gacatttgccccatacaatgctatg

SEQ ID NO: 92117 - DNA, 25 bp, S. pombe
gacatttccctttatcttgcttgga

SEQ ID NO: 92118 - DNA, 25 bp, S. pombe
gacatgttacagattgctatagcaa

SEQ ID NO: 92119 - DNA, 25 bp, S. pombe
gacagtggttgaccttatacccaat

SEQ ID NO: 92120 - DNA, 25 bp, S. pombe
gactacggtgttcctaatggctaca

SEQ ID NO: 92121 - DNA, 25 bp, S. pombe
gactatgcggatgactttgatgact

SEQ ID NO: 92122 - DNA, 25 bp, S. pombe
gacttgggctgttgctggtgataca

SEQ ID NO: 92123 - DNA, 25 bp, S. pombe
gacttgtcctgttatgagtgctgca

SEQ ID NO: 92124 - DNA, 25 bp, S. pombe
gacttgatcaacgttttggcctcta

SEQ ID NO: 92125 - DNA, 25 bp, S. pombe
gacttcaaccatttcacgtaatcta

SEQ ID NO: 92126 - DNA, 25 bp, S. pombe
gactttgacgatctttcacaggttg

SEQ ID NO: 92127 - DNA, 25 bp, S. pombe
gacttggtccgccatttcaatggtg

SEQ ID NO: 92128 - DNA, 25 bp, S. pombe
gacatatggtcccttacgaagaatt

SEQ ID NO: 92129 - DNA, 25 bp, S. pombe
gacattgcttctggtaactgccata

SEQ ID NO: 92130 - DNA, 25 bp, S. pombe
gacattgctgttgctgagttgcctc

SEQ ID NO: 92131 - DNA, 25 bp, S. pombe
gacttcgtcatccagatgttcctaa

SEQ ID NO: 92132 - DNA, 25 bp, S. pombe
gacgagtgattccttttagtgcccg

SEQ ID NO: 92133 - DNA, 25 bp, S. pombe
gagcggtcatttgtttcagttacga

SEQ ID NO: 92134 - DNA, 25 bp, S. pombe
gacttctgttcatacacgacgtaag

SEQ ID NO: 92135 - DNA, 25 bp, S. pombe
gacttttacacttatgctcgggatg

SEQ ID NO: 92136 - DNA, 25 bp, S. pombe
gaccttacaaagtcatcctctagca

SEQ ID NO: 92137 - DNA, 25 bp, S. pombe
gacatctttccaagacatcttctcg

SEQ ID NO: 92138 - DNA, 25 bp, S. pombe
gactatttacatatctgcggcttca

SEQ ID NO: 92139 - DNA, 25 bp, S. pombe
gaccagacagacacatccgaatcga

SEQ ID NO: 92140 - DNA, 25 bp, S. pombe
gacattgtcaacagtttagatggaa

SEQ ID NO: 92141 - DNA, 25 bp, S. pombe
gacatcttcaacttgctattcgagg

SEQ ID NO: 92142 - DNA, 25 bp, S. pombe
gacatcattctttcatgttcctcag

SEQ ID NO: 92143 - DNA, 25 bp, S. pombe
gacatgactatgttcctgcttttga

SEQ ID NO: 92144 - DNA, 25 bp, S. pombe
gacatgcttatgaccctcgtattga

SEQ ID NO: 92145 - DNA, 25 bp, S. pombe
gacatgaatcttactcttgacatta

SEQ ID NO: 92146 - DNA, 25 bp, S. pombe
gactttccatactttgcaattgagg

SEQ ID NO: 92147 - DNA, 25 bp, S. pombe
gacatcaagttactcttcacctata

SEQ ID NO: 92148 - DNA, 25 bp, S. pombe
gactgctcatgatttctccaaggaa

SEQ ID NO: 92149 - DNA, 25 bp, S. pombe
gacttgatttgttcccaggtacttt

SEQ ID NO: 92150 - DNA, 25 bp, S. pombe
gacattgatttttcctcccgattat

SEQ ID NO: 92151 - DNA, 25 bp, S. pombe
gactttttatgcatccactgcggta

SEQ ID NO: 92152 - DNA, 25 bp, S. pombe
gactatgttgtcgagtaccgcggaa

SEQ ID NO: 92153 - DNA, 25 bp, S. pombe
gactacttgcgcagtgacttggtaa

SEQ ID NO: 92154 - DNA, 25 bp, S. pombe
gacattcaaggcgttcttcgtgaag

SEQ ID NO: 92155 - DNA, 25 bp, S. pombe
gactcgaagtgtttgctgtaaccaa

SEQ ID NO: 92156 - DNA, 25 bp, S. pombe
gacttgaaggtatttgtatccacga

SEQ ID NO: 92157 - DNA, 25 bp, S. pombe
gactatttcattacggtgtcgactt

SEQ ID NO: 92158 - DNA, 25 bp, S. pombe
gactattgatcaacccgattcgaat

SEQ ID NO: 92159 - DNA, 25 bp, S. pombe
gacattgactcattaccttggcaca

SEQ ID NO: 92160 - DNA, 25 bp, S. pombe
gacatgctgaacttatcgctataga

SEQ ID NO: 92161 - DNA, 25 bp, S. pombe
gacatcgaagagcaccttgaggatt

SEQ ID NO: 92162 - DNA, 25 bp, S. pombe
gacatcacaacatatcttcaagtgt

SEQ ID NO: 92163 - DNA, 25 bp, S. pombe
gacataactttgattctgattctat

SEQ ID NO: 92164 - DNA, 25 bp, S. pombe
gacattcgtgtaatcatcctttcaa

SEQ ID NO: 92165 - DNA, 25 bp, S. pombe
gacatctaatatttacctttccatt

SEQ ID NO: 92166 - DNA, 25 bp, S. pombe
gactataatgctttggcgacccagt

SEQ ID NO: 92167 - DNA, 25 bp, S. pombe
gacttggtgtttcgtaccacactta

SEQ ID NO: 92168 - DNA, 25 bp, S. pombe
gagctattgaattggccaagtccgt

SEQ ID NO: 92169 - DNA, 25 bp, S. pombe
gactgttgatcgtaaaaatgccctt

SEQ ID NO: 92170 - DNA, 25 bp, S. pombe
gacattgttcttttgtttggcgcag

SEQ ID NO: 92171 - DNA, 25 bp, S. pombe
gacttgacattgactggatttcccg

SEQ ID NO: 92172 - DNA, 25 bp, S. pombe
gacttgcctgtgtttttctttatag

SEQ ID NO: 92173 - DNA, 25 bp, S. pombe
gactgcctcgttttgtcctgttaaa

SEQ ID NO: 92174 - DNA, 25 bp, S. pombe
gacattatctattttcttccgctat

SEQ ID NO: 92175 - DNA, 25 bp, S. pombe
gacatctatttcttacattcaccca

SEQ ID NO: 92176 - DNA, 25 bp, S. pombe
gacatcacctgtatctctggagatc

SEQ ID NO: 92177 - DNA, 25 bp, S. pombe
gactcaacattgatctcagggtcaa

SEQ ID NO: 92178 - DNA, 25 bp, S. pombe
gactccctagagctcacgattcaaa

SEQ ID NO: 92179 - DNA, 25 bp, S. pombe
gacttcttcactcatcatcagattc

SEQ ID NO: 92180 - DNA, 25 bp, S. pombe
gactcgatttggcattggatttact

SEQ ID NO: 92181 - DNA, 25 bp, S. pombe
gactcgtactggtcattcgatttct

SEQ ID NO: 92182 - DNA, 25 bp, S. pombe
gactcaccttcgaacacatcattgt

SEQ ID NO: 92183 - DNA, 25 bp, S. pombe
gactatactactcatccattttcgg

SEQ ID NO: 92184 - DNA, 25 bp, S. pombe
gacttgtctatgtttgccattgctg

SEQ ID NO: 92185 - DNA, 25 bp, S. pombe
gacttgacattgattgctcgtgctc

SEQ ID NO: 92186 - DNA, 25 bp, S. pombe
gacattgatctacaaggcgttcttc

SEQ ID NO: 92187 - DNA, 25 bp, S. pombe
gactagtcgaaaggagcagctggat

SEQ ID NO: 92188 - DNA, 25 bp, S. pombe
gactttgttgcccatgatcttaatc

SEQ ID NO: 92189 - DNA, 25 bp, S. pombe
gactcatgatttcctcagatgcttg

SEQ ID NO: 92190 - DNA, 25 bp, S. pombe
gagcatgcagcacctttgagagtat

SEQ ID NO: 92191 - DNA, 25 bp, S. pombe
gactcagcagcccatcaagagcttg

SEQ ID NO: 92192 - DNA, 25 bp, S. pombe
gacattaacactcctgaatcttctc

SEQ ID NO: 92193 - DNA, 25 bp, S. pombe
gacattttgagctactttccttctt

SEQ ID NO: 92194 - DNA, 25 bp, S. pombe
gacatttttcttcttgccattcttt

SEQ ID NO: 92195 - DNA, 25 bp, S. pombe
gacttattgtttcatcgcgatcgtg

SEQ ID NO: 92196 - DNA, 25 bp, S. pombe
gactttattatacccatgcgaccga

SEQ ID NO: 92197 - DNA, 25 bp, S. pombe
gactaatgtttttgggctacgctgt

SEQ ID NO: 92198 - DNA, 25 bp, S. pombe
gacctttttaacactactgctgatg

SEQ ID NO: 92199 - DNA, 25 bp, S. pombe
gactcttttaccgacaatccagttg

SEQ ID NO: 92200 - DNA, 25 bp, S. pombe
gactttgtgtcatcgaaacgcaatg

SEQ ID NO: 92201 - DNA, 25 bp, S. pombe
gacttgcgaggtcatttggtgtccc

SEQ ID NO: 92202 - DNA, 25 bp, S. pombe
gactctgccgacagcaatcgtatat

SEQ ID NO: 92203 - DNA, 25 bp, S. pombe
gactctatccctactgtcgttgtcg

SEQ ID NO: 92204 - DNA, 25 bp, S. pombe
gacattcgtatcatcagcggtgtgt

SEQ ID NO: 92205 - DNA, 25 bp, S. pombe
gacattctattatcatcggcttatt

SEQ ID NO: 92206 - DNA, 25 bp, S. pombe
gacttgtccgcagagaacgattcaa

SEQ ID NO: 92207 - DNA, 25 bp, S. pombe
gaggtatacctcagaagcccttcga

SEQ ID NO: 92208 - DNA, 25 bp, S. pombe
gacgttaatttcaccgggcgaatag

SEQ ID NO: 92209 - DNA, 25 bp, S. pombe
gactatctgtttccggatacggcga

SEQ ID NO: 92210 - DNA, 25 bp, S. pombe
gacttgtttcctcctgatactgaga

SEQ ID NO: 92211 - DNA, 25 bp, S. pombe
gacattaattggacgcttgttgccc

SEQ ID NO: 92212 - DNA, 25 bp, S. pombe
gactcaaatcggttgcttttgcctt

SEQ ID NO: 92213 - DNA, 25 bp, S. pombe
gacttatggtcctgtggttggaaac

SEQ ID NO: 92214 - DNA, 25 bp, S. pombe
gactttggtgaatcgccttgaacaa

SEQ ID NO: 92215 - DNA, 25 bp, S. pombe
gacgttacagacgtcccggatgtta

SEQ ID NO: 92216 - DNA, 25 bp, S. pombe
gacttctttgctacttggtgtggac

SEQ ID NO: 92217 - DNA, 25 bp, S. pombe
gacttcgtagctcctgtcaatggaa

SEQ ID NO: 92218 - DNA, 25 bp, S. pombe
gactcggtcagattcttcattcaat

SEQ ID NO: 92219 - DNA, 25 bp, S. pombe
gactgcccgaagtcatgctcgtaaa

SEQ ID NO: 92220 - DNA, 25 bp, S. pombe
gacggatgctaaaaacttcgaccaa

SEQ ID NO: 92221 - DNA, 25 bp, S. pombe
gacttaatcgaaaagctactttgct

SEQ ID NO: 92222 - DNA, 25 bp, S. pombe
gacttttcagaaaccagaccattgg

SEQ ID NO: 92223 - DNA, 25 bp, S. pombe
gacttgactgaccatgacaatcccg

SEQ ID NO: 92224 - DNA, 25 bp, S. pombe
gactgctggaacttatctattcaca

SEQ ID NO: 92225 - DNA, 25 bp, S. pombe
gactctggatttcgtggtggctatc

SEQ ID NO: 92226 - DNA, 25 bp, S. pombe
gacttggaaatgacggatgcctctt

SEQ ID NO: 92227 - DNA, 25 bp, S. pombe
gacttctctcagcttggagcaatta

SEQ ID NO: 92228 - DNA, 25 bp, S. pombe
gactcttttggtccagatgatttga

SEQ ID NO: 92229 - DNA, 25 bp, S. pombe
gactttgctactgaagatgcgctta

SEQ ID NO: 92230 - DNA, 25 bp, S. pombe
gactgctcaatatattcgatccctt

SEQ ID NO: 92231 - DNA, 25 bp, S. pombe
gacgtcgacgaagtgcgcaaaattc

SEQ ID NO: 92232 - DNA, 25 bp, S. pombe
gacggaataccttcaaaccttactg

SEQ ID NO: 92233 - DNA, 25 bp, S. pombe
gactttgcgtttttagagcctccag

SEQ ID NO: 92234 - DNA, 25 bp, S. pombe
gacattgtctgtttccaaggctcac

SEQ ID NO: 92235 - DNA, 25 bp, S. pombe
gacttgccatgttatcgtagatcca

SEQ ID NO: 92236 - DNA, 25 bp, S. pombe
gacttgccttcatcagattatcaga

SEQ ID NO: 92237 - DNA, 25 bp, S. pombe
gacttggctttctatgtctttcaat

SEQ ID NO: 92238 - DNA, 25 bp, S. pombe
gacttgtatgaatctgtacgctcaa

SEQ ID NO: 92239 - DNA, 25 bp, S. pombe
gactacatattcagcatggccgtga

SEQ ID NO: 92240 - DNA, 25 bp, S. pombe
gactgacatgtcattgcgatttgca

SEQ ID NO: 92241 - DNA, 25 bp, S. pombe
gactgtatgcatgtctggcaggctt

SEQ ID NO: 92242 - DNA, 25 bp, S. pombe
gactgcttagatgctgctgtggcta

SEQ ID NO: 92243 - DNA, 25 bp, S. pombe
gacggctgatattcttgttgcaact

SEQ ID NO: 92244 - DNA, 25 bp, S. pombe
gactgttacatctttggatgttgtc

SEQ ID NO: 92245 - DNA, 25 bp, S. pombe
gagcttctcacattcgtacagttgg

SEQ ID NO: 92246 - DNA, 25 bp, S. pombe
gactgtcgaattcaaaatgcgtgct

SEQ ID NO: 92247 - DNA, 25 bp, S. pombe
gacgtgggatttgcacctggatcat

SEQ ID NO: 92248 - DNA, 25 bp, S. pombe
gacttcgttctttacgctggcatta

SEQ ID NO: 92249 - DNA, 25 bp, S. pombe
gacttcatttgtcgaacagcgtatt

SEQ ID NO: 92250 - DNA, 25 bp, S. pombe
gactagttcgtgttacgccttttga

SEQ ID NO: 92251 - DNA, 25 bp, S. pombe
gttcgttcagttaatcgacctgtta

SEQ ID NO: 92252 - DNA, 25 bp, S. pombe
gttgatgttcgaggtttcccgtata

SEQ ID NO: 92253 - DNA, 25 bp, S. pombe
gacttttgagggtttctccgttgat

SEQ ID NO: 92254 - DNA, 25 bp, S. pombe
gacttttggtttttccgcaggacat

SEQ ID NO: 92255 - DNA, 25 bp, S. pombe
gacttactggtcgtttcctcaaaat

SEQ ID NO: 92256 - DNA, 25 bp, S. pombe
gacttcttagacgttacgacggcta

SEQ ID NO: 92257 - DNA, 25 bp, S. pombe
gactttatggacttctgacgccgaa

SEQ ID NO: 92258 - DNA, 25 bp, S. pombe
gactcttggtgatgactggcccaat

SEQ ID NO: 92259 - DNA, 25 bp, S. pombe
gactttggacacttttctgatggag

SEQ ID NO: 92260 - DNA, 25 bp, S. pombe
gactagtggccgttctgatgacaac

SEQ ID NO: 92261 - DNA, 25 bp, S. pombe
gactacttcctttagcagtgcaagt

SEQ ID NO: 92262 - DNA, 25 bp, S. pombe
gactactgcccaatggactacttgt

SEQ ID NO: 92263 - DNA, 25 bp, S. pombe
gactttgccaacaagacgtctatgt

SEQ ID NO: 92264 - DNA, 25 bp, S. pombe
gacttctcgctttggttgttatgct

SEQ ID NO: 92265 - DNA, 25 bp, S. pombe
gactattcaagcatcttttctccga

SEQ ID NO: 92266 - DNA, 25 bp, S. pombe
gacttcttacacttatcgatttggc

SEQ ID NO: 92267 - DNA, 25 bp, S. pombe
gacttcttggtttttgcttttctct

SEQ ID NO: 92268 - DNA, 25 bp, S. pombe
gacttctatgatatatccgcttttt

SEQ ID NO: 92269 - DNA, 25 bp, S. pombe
gactcaactaattcacttccttcaa

SEQ ID NO: 92270 - DNA, 25 bp, S. pombe
gactgaattaatgccttgctcccat

SEQ ID NO: 92271 - DNA, 25 bp, S. pombe
gacgaatcggaatatgaccctatgg

SEQ ID NO: 92272 - DNA, 25 bp, S. pombe
gactgaatccgtgaatgaccgtaca

SEQ ID NO: 92273 - DNA, 25 bp, S. pombe
gactgatcaattggctactttagaa

SEQ ID NO: 92274 - DNA, 25 bp, S. pombe
gactctgcctatgatgcggccgaga

SEQ ID NO: 92275 - DNA, 25 bp, S. pombe
gactgccatttcgaagagctccaac

SEQ ID NO: 92276 - DNA, 25 bp, S. pombe
gacgaagagctcgacatgctgccaa

SEQ ID NO: 92277 - DNA, 25 bp, S. pombe
gacgaagaatctacatggcccggtg

SEQ ID NO: 92278 - DNA, 25 bp, S. pombe
gacgaaattcagatgccaccggacc

SEQ ID NO: 92279 - DNA, 25 bp, S. pombe
gacttcaactttctgtatgcaacga

SEQ ID NO: 92280 - DNA, 25 bp, S. pombe
gactgcagcccttcaattatagacg

SEQ ID NO: 92281 - DNA, 25 bp, S. pombe
gactcggcactttttacaacttttg

SEQ ID NO: 92282 - DNA, 25 bp, S. pombe
gactttttatatcctctcctactat

SEQ ID NO: 92283 - DNA, 25 bp, S. pombe
gacgtgactatatggtctcgtagtt

SEQ ID NO: 92284 - DNA, 25 bp, S. pombe
gactgatggtgcttttaccgtagaa

SEQ ID NO: 92285 - DNA, 25 bp, S. pombe
gactgtgtgtttgaacccgaaccta

SEQ ID NO: 92286 - DNA, 25 bp, S. pombe
gactgaatcttctttcggaaaccgt

SEQ ID NO: 92287 - DNA, 25 bp, S. pombe
gactactcttcattcatcggacata

SEQ ID NO: 92288 - DNA, 25 bp, S. pombe
gactttttctgttcctgaagagctt

SEQ ID NO: 92289 - DNA, 25 bp, S. pombe
gactcatttatccagtcaaatccga

SEQ ID NO: 92290 - DNA, 25 bp, S. pombe
gactccattgcaactaacactcatt

SEQ ID NO: 92291 - DNA, 25 bp, S. pombe
gactgcccttcgtcaaatggctgag

SEQ ID NO: 92292 - DNA, 25 bp, S. pombe
gactcccaatcgtctcttggtagtt

SEQ ID NO: 92293 - DNA, 25 bp, S. pombe
gacttactcttcctattctgtggtt

SEQ ID NO: 92294 - DNA, 25 bp, S. pombe
gactgcttcctgtgaatctttagtg

SEQ ID NO: 92295 - DNA, 25 bp, S. pombe
gactaccaactgtgattgactcaat

SEQ ID NO: 92296 - DNA, 25 bp, S. pombe
gacgtacaacgttatatcctcaatg

SEQ ID NO: 92297 - DNA, 25 bp, S. pombe
gactgtcccagagaattccactatt

SEQ ID NO: 92298 - DNA, 25 bp, S. pombe
gactcctgcacgatcgttagattca

SEQ ID NO: 92299 - DNA, 25 bp, S. pombe
gacttatggcgcagcggaatggaca

SEQ ID NO: 92300 - DNA, 25 bp, S. pombe
gacttcttgcgctgggaatcgaaac

SEQ ID NO: 92301 - DNA, 25 bp, S. pombe
gactggaccagctttgtgacattca

SEQ ID NO: 92302 - DNA, 25 bp, S. pombe
gactttatttgtatgacttctcctg

SEQ ID NO: 92303 - DNA, 25 bp, S. pombe
gactttcattttcaacgtgctgcag

SEQ ID NO: 92304 - DNA, 25 bp, S. pombe
gactttaactggtatggcgtgtgca

SEQ ID NO: 92305 - DNA, 25 bp, S. pombe
gacgttccatctgttgccggtgcaa

SEQ ID NO: 92306 - DNA, 25 bp, S. pombe
gacttatacgtcctacttctaactt

SEQ ID NO: 92307 - DNA, 25 bp, S. pombe
gactaaatttcacacgagccggtat

SEQ ID NO: 92308 - DNA, 25 bp, S. pombe
gactggtgggcttttggtgtactaa

SEQ ID NO: 92309 - DNA, 25 bp, S. pombe
gacggcgcgaattctgttcataacc

SEQ ID NO: 92310 - DNA, 25 bp, S. pombe
gactatgcgcgatcactattctgaa

SEQ ID NO: 92311 - DNA, 25 bp, S. pombe
gactatgtgccaactgtattcgata

SEQ ID NO: 92312 - DNA, 25 bp, S. pombe
gacttttcatctttactctctcaat

SEQ ID NO: 92313 - DNA, 25 bp, S. pombe
gactctcttcactctattgttcaga

SEQ ID NO: 92314 - DNA, 25 bp, S. pombe
gactatatctactctcttttaaccg

SEQ ID NO: 92315 - DNA, 25 bp, S. pombe
gactatcacttcatgtttagcacga

SEQ ID NO: 92316 - DNA, 25 bp, S. pombe
gactttctgcctatgttatcagcta

SEQ ID NO: 92317 - DNA, 25 bp, S. pombe
gacgaacccttttttagctgaccag

SEQ ID NO: 92318 - DNA, 25 bp, S. pombe
gatcaacccgcagatttaactaccg

SEQ ID NO: 92319 - DNA, 25 bp, S. pombe
gacttttttctcgtatctttgtgcg

SEQ ID NO: 92320 - DNA, 25 bp, S. pombe
gacttttctgtaactatgattcttg

SEQ ID NO: 92321 - DNA, 25 bp, S. pombe
gactcttacctaacgagacttgtgg

SEQ ID NO: 92322 - DNA, 25 bp, S. pombe
gactattcaagaagctggtagcatt

SEQ ID NO: 92323 - DNA, 25 bp, S. pombe
gacgatatcgtcctagagatagcac

SEQ ID NO: 92324 - DNA, 25 bp, S. pombe
gacgtgtcccaaaacagcactattg

SEQ ID NO: 92325 - DNA, 25 bp, S. pombe
gacgttgcatccgaggacctaattg

SEQ ID NO: 92326 - DNA, 25 bp, S. pombe
gacgttcctcctcagttaatgttta

SEQ ID NO: 92327 - DNA, 25 bp, S. pombe
gactgtacgttaaggccaagcatct

SEQ ID NO: 92328 - DNA, 25 bp, S. pombe
gactattcggtaattcctacttctt

SEQ ID NO: 92329 - DNA, 25 bp, S. pombe
gactattcaggttattgacttttcc

SEQ ID NO: 92330 - DNA, 25 bp, S. pombe
gactctgtcgatgttcctgttatta

SEQ ID NO: 92331 - DNA, 25 bp, S. pombe
gacttatcagatgctcctcgacttt

SEQ ID NO: 92332 - DNA, 25 bp, S. pombe
gactaatagctcgatatcctgcgcg

SEQ ID NO: 92333 - DNA, 25 bp, S. pombe
gactatcattcgttttgcagctgga

SEQ ID NO: 92334 - DNA, 25 bp, S. pombe
gactagcttcgactttgatcatgtt

SEQ ID NO: 92335 - DNA, 25 bp, S. pombe
gactcacattctggtgttcttttgc

SEQ ID NO: 92336 - DNA, 25 bp, S. pombe
gactacaatctctgccatttttgga

SEQ ID NO: 92337 - DNA, 25 bp, S. pombe
gactttcggcactatggcttagctt

SEQ ID NO: 92338 - DNA, 25 bp, S. pombe
gactttaagcacttccattgccatt

SEQ ID NO: 92339 - DNA, 25 bp, S. pombe
gacttttcctttgatgatgctactg

SEQ ID NO: 92340 - DNA, 25 bp, S. pombe
gactttatcctttctcattgcattt

SEQ ID NO: 92341 - DNA, 25 bp, S. pombe
gactttacatgtatcttgggcactt

SEQ ID NO: 92342 - DNA, 25 bp, S. pombe
gactaaacttaaataaggcactcat

SEQ ID NO: 92343 - DNA, 25 bp, S. pombe
gactgacaaccgtgataagcctctt

SEQ ID NO: 92344 - DNA, 25 bp, S. pombe
gactgttaccaacgtcaagcgtctt

SEQ ID NO: 92345 - DNA, 25 bp, S. pombe
gacggctacgttcaaggtcacctag

SEQ ID NO: 92346 - DNA, 25 bp, S. pombe
gacggtagcaagacacttttctgga

SEQ ID NO: 92347 - DNA, 25 bp, S. pombe
gacggaacaagtgccttttctgcaa

SEQ ID NO: 92348 - DNA, 25 bp, S. pombe
gacggtaccaaatctctggttctta

SEQ ID NO: 92349 - DNA, 25 bp, S. pombe
gagcgactaaaaaaccatacttctt

SEQ ID NO: 92350 - DNA, 25 bp, S. pombe
gacgaccccagagtactgcaagttt

SEQ ID NO: 92351 - DNA, 25 bp, S. pombe
gactatcgctttatcattcttattc

SEQ ID NO: 92352 - DNA, 25 bp, S. pombe
gactcacatgttatccttatttgct

SEQ ID NO: 92353 - DNA, 25 bp, S. pombe
gactactttctctgattctgttatc

SEQ ID NO: 92354 - DNA, 25 bp, S. pombe
gactacgctttcctgtattgttcaa

SEQ ID NO: 92355 - DNA, 25 bp, S. pombe
gactccattcctgcttttattacaa

SEQ ID NO: 92356 - DNA, 25 bp, S. pombe
gactcttctccaactaaacgttcaa

SEQ ID NO: 92357 - DNA, 25 bp, S. pombe
gactctttttaccacgacgatacaa

SEQ ID NO: 92358 - DNA, 25 bp, S. pombe
gactttggcgtatcaggtcagttgg

SEQ ID NO: 92359 - DNA, 25 bp, S. pombe
gacgttaacttgttcttgtctcgcg

SEQ ID NO: 92360 - DNA, 25 bp, S. pombe
gagttagaacgacgccttgaggaaa

SEQ ID NO: 92361 - DNA, 25 bp, S. pombe
gagcttcaaggcacccagaactaat

SEQ ID NO: 92362 - DNA, 25 bp, S. pombe
gacgaaagtttccttgccatcgagg

SEQ ID NO: 92363 - DNA, 25 bp, S. pombe
gacgaacgtcctctcttaaaaacag

SEQ ID NO: 92364 - DNA, 25 bp, S. pombe
gagcgtacgtactttcggaattgga

SEQ ID NO: 92365 - DNA, 25 bp, S. pombe
gacggaagccacttttgaaatcgaa

SEQ ID NO: 92366 - DNA, 25 bp, S. pombe
gactctaatgattctgcatctccga

SEQ ID NO: 92367 - DNA, 25 bp, S. pombe
gactacttctcatttaagctcttcc

SEQ ID NO: 92368 - DNA, 25 bp, S. pombe
gactagtaatcctgctgagctcttt

SEQ ID NO: 92369 - DNA, 25 bp, S. pombe
gactatttatcagcctagcgcagtt

SEQ ID NO: 92370 - DNA, 25 bp, S. pombe
gacgatttttccataccaggtgctt

SEQ ID NO: 92371 - DNA, 25 bp, S. pombe
gactgtttttatggatggcccctat

SEQ ID NO: 92372 - DNA, 25 bp, S. pombe
gactactttgtctatattgcccttt

SEQ ID NO: 92373 - DNA, 25 bp, S. pombe
gactacttagattgtttcggtgatt

SEQ ID NO: 92374 - DNA, 25 bp, S. pombe
gacgactggacataatgcctgcgga

SEQ ID NO: 92375 - DNA, 25 bp, S. pombe
gacggaaactagtcattcgggctat

SEQ ID NO: 92376 - DNA, 25 bp, S. pombe
gactagcaatgccttttatatgaaa

SEQ ID NO: 92377 - DNA, 25 bp, S. pombe
gacgtcggagactgttttcaatgat

SEQ ID NO: 92378 - DNA, 25 bp, S. pombe
gactgtcaggtctcttgtatggaat

SEQ ID NO: 92379 - DNA, 25 bp, S. pombe
gactccaacaaaatcctggtcgttt

SEQ ID NO: 92380 - DNA, 25 bp, S. pombe
gactcaaacagatttggcttccgtt

SEQ ID NO: 92381 - DNA, 25 bp, S. pombe
gactctgatcacaaatctggcttta

SEQ ID NO: 92382 - DNA, 25 bp, S. pombe
gactgctgtaactatgcgtgctgtg

SEQ ID NO: 92383 - DNA, 25 bp, S. pombe
gactcttcgtcttccatgtttgatt

SEQ ID NO: 92384 - DNA, 25 bp, S. pombe
gactgtgtcgtttccttatgggatt

SEQ ID NO: 92385 - DNA, 25 bp, S. pombe
gactggtgcgctatccaaaaggcat

SEQ ID NO: 92386 - DNA, 25 bp, S. pombe
gactggaccagaactctgatttcga

SEQ ID NO: 92387 - DNA, 25 bp, S. pombe
gacgtacatcatttgttcgtatcga

SEQ ID NO: 92388 - DNA, 25 bp, S. pombe
gacctaacatttcgaatggtggcat

SEQ ID NO: 92389 - DNA, 25 bp, S. pombe
gactacactctttctagcaacggac

SEQ ID NO: 92390 - DNA, 25 bp, S. pombe
gactcttttgaactgattaccgcat

SEQ ID NO: 92391 - DNA, 25 bp, S. pombe
gactaccattacgattgctcacaaa

SEQ ID NO: 92392 - DNA, 25 bp, S. pombe
gactctgaattacgttctcctctat

SEQ ID NO: 92393 - DNA, 25 bp, S. pombe
gacgttgctcattatttagacccgg

SEQ ID NO: 92394 - DNA, 25 bp, S. pombe
gactctaaggtcagtggtgtcgtta

SEQ ID NO: 92395 - DNA, 25 bp, S. pombe
gacggaattgtttgttcgcccatgc

SEQ ID NO: 92396 - DNA, 25 bp, S. pombe
gactggatatttgttatagcccaac

SEQ ID NO: 92397 - DNA, 25 bp, S. pombe
gactggctccttatacttatgatac

SEQ ID NO: 92398 - DNA, 25 bp, S. pombe
gacgttctattacacttgagtttca

SEQ ID NO: 92399 - DNA, 25 bp, S. pombe
gacgttctcgttgacctaaatccaa

SEQ ID NO: 92400 - DNA, 25 bp, S. pombe
gactagcatattttaatcccgcatt

SEQ ID NO: 92401 - DNA, 25 bp, S. pombe
gactcagattcatttttccctcaat

SEQ ID NO: 92402 - DNA, 25 bp, S. pombe
gactcggaatttttgcagcatctag

SEQ ID NO: 92403 - DNA, 25 bp, S. pombe
gactcggatttatctgaatcttcta

SEQ ID NO: 92404 - DNA, 25 bp, S. pombe
gacggtaccttgatgctttgggatc

SEQ ID NO: 92405 - DNA, 25 bp, S. pombe
gacgtctgcgccagtttttgggaaa

SEQ ID NO: 92406 - DNA, 25 bp, S. pombe
gacgtgccagtatgtctattgctgt

SEQ ID NO: 92407 - DNA, 25 bp, S. pombe
gactcacgcaactattgcaagcttt

SEQ ID NO: 92408 - DNA, 25 bp, S. pombe
gactcatagagcaatttcgcaagtt

SEQ ID NO: 92409 - DNA, 25 bp, S. pombe
gactctgccgttgctgacaacgatg

SEQ ID NO: 92410 - DNA, 25 bp, S. pombe
gactaccggtgaaatgccatccatg

SEQ ID NO: 92411 - DNA, 25 bp, S. pombe
gactacttggtaacgcgatcgattt

SEQ ID NO: 92412 - DNA, 25 bp, S. pombe
gactacattgctcaagcaggcctat

SEQ ID NO: 92413 - DNA, 25 bp, S. pombe
gacgtcggacatactgacgagcctt

SEQ ID NO: 92414 - DNA, 25 bp, S. pombe
gactctcatttgtcgcatactttat

SEQ ID NO: 92415 - DNA, 25 bp, S. pombe
gactctgactgggagctgatttcat

SEQ ID NO: 92416 - DNA, 25 bp, S. pombe
gactggagactcaggagcttgcaat

SEQ ID NO: 92417 - DNA, 25 bp, S. pombe
gactcgaatcgcagctagttgaatt

SEQ ID NO: 92418 - DNA, 25 bp, S. pombe
gacggacatcctagcttttgtcaat

SEQ ID NO: 92419 - DNA, 25 bp, S. pombe
gactctgacattttcatttgggact

SEQ ID NO: 92420 - DNA, 25 bp, S. pombe
gactcgtcattcttcgtggtgagtt

SEQ ID NO: 92421 - DNA, 25 bp, S. pombe
gactcgttttcagggagctagccat

SEQ ID NO: 92422 - DNA, 25 bp, S. pombe
gactcagcttttaaggtatggccga

SEQ ID NO: 92423 - DNA, 25 bp, S. pombe
gactcaatctttcttttggcactat

SEQ ID NO: 92424 - DNA, 25 bp, S. pombe
gacgttgccagtcaagttaacagag

SEQ ID NO: 92425 - DNA, 25 bp, S. pombe
gacgtacttggacagtcaaccatat

SEQ ID NO: 92426 - DNA, 25 bp, S. pombe
gactaagcgtttgtctgcgcactta

SEQ ID NO: 92427 - DNA, 25 bp, S. pombe
gacggaatctttgtcggtcttcaca

SEQ ID NO: 92428 - DNA, 25 bp, S. pombe
gactcactgttttcgctgctggtaa

SEQ ID NO: 92429 - DNA, 25 bp, S. pombe
gacgaggcacctgaagaacttgagc

SEQ ID NO: 92430 - DNA, 25 bp, S. pombe
gacgatcaacctacaattattcccc

SEQ ID NO: 92431 - DNA, 25 bp, S. pombe
gactgttaccctcgattttaaagct

SEQ ID NO: 92432 - DNA, 25 bp, S. pombe
gagaccttttcccaatttcttacat

SEQ ID NO: 92433 - DNA, 25 bp, S. pombe
ggagcaccttactcaagttttggaa

SEQ ID NO: 92434 - DNA, 25 bp, S. pombe
gaccgttgtgtatcgaaatactttg

SEQ ID NO: 92435 - DNA, 25 bp, S. pombe
gactcgttgggttgaagcttactta

SEQ ID NO: 92436 - DNA, 25 bp, S. pombe
gaggtacaccggattgcccttttga

SEQ ID NO: 92437 - DNA, 25 bp, S. pombe
gacgggacgttacctattcattcta

SEQ ID NO: 92438 - DNA, 25 bp, S. pombe
gactgggaggcaccgttatttttca

SEQ ID NO: 92439 - DNA, 25 bp, S. pombe
gacggttttggagctacttctataa

SEQ ID NO: 92440 - DNA, 25 bp, S. pombe
gacggttgcacgaaatcttcatttt

SEQ ID NO: 92441 - DNA, 25 bp, S. pombe
gactcgatgttttattcgttggcta

SEQ ID NO: 92442 - DNA, 25 bp, S. pombe
gacggagtacgtttagaatcttgca

SEQ ID NO: 92443 - DNA, 25 bp, S. pombe
gacggtcgtcaacaatagattccaa

SEQ ID NO: 92444 - DNA, 25 bp, S. pombe
gacggctcggaaatagacgttccca

SEQ ID NO: 92445 - DNA, 25 bp, S. pombe
gactcgtttctttcatgacttctga

SEQ ID NO: 92446 - DNA, 25 bp, S. pombe
gactctttgcttaatcatactggtg

SEQ ID NO: 92447 - DNA, 25 bp, S. pombe
gactgctgtgactttgaacgccttt

SEQ ID NO: 92448 - DNA, 25 bp, S. pombe
gactgggccatcagaatcagcattt

SEQ ID NO: 92449 - DNA, 25 bp, S. pombe
gacggtcgcatgaacaatcgtgcta

SEQ ID NO: 92450 - DNA, 25 bp, S. pombe
gacgtatgctgctacaattacttct

SEQ ID NO: 92451 - DNA, 25 bp, S. pombe
gacgtataacagttcctccagtaat

SEQ ID NO: 92452 - DNA, 25 bp, S. pombe
gactggtggactttaggtgtgctac

SEQ ID NO: 92453 - DNA, 25 bp, S. pombe
gactggtcgcgttaattggtgcttc

SEQ ID NO: 92454 - DNA, 25 bp, S. pombe
gactggtatgctgcttatggcgaaa

SEQ ID NO: 92455 - DNA, 25 bp, S. pombe
gactgcggacatgctagcgactgat

SEQ ID NO: 92456 - DNA, 25 bp, S. pombe
gactctttatgtgtggctgttggaa

SEQ ID NO: 92457 - DNA, 25 bp, S. pombe
gactcatttattgtggttgtgcctt

SEQ ID NO: 92458 - DNA, 25 bp, S. pombe
gactgattttgtgcgctggattcta

SEQ ID NO: 92459 - DNA, 25 bp, S. pombe
gactgtttctgatgctagcgatctt

SEQ ID NO: 92460 - DNA, 25 bp, S. pombe
gactgttctcaattgcatgctttaa

SEQ ID NO: 92461 - DNA, 25 bp, S. pombe
gactctattacatgctggtttacaa

SEQ ID NO: 92462 - DNA, 25 bp, S. pombe
gagctccgtatctccaaattggttc

SEQ ID NO: 92463 - DNA, 25 bp, S. pombe
gactgccagtatgaccaacggatat

SEQ ID NO: 92464 - DNA, 25 bp, S. pombe
gactgtgaagcgtttttgccgaaaa

SEQ ID NO: 92465 - DNA, 25 bp, S. pombe
gacgacattttctttggtggaacag

SEQ ID NO: 92466 - DNA, 25 bp, S. pombe
gacgatcattatggccttggcgagc

SEQ ID NO: 92467 - DNA, 25 bp, S. pombe
gacgtagctggtggcagtagcacac

SEQ ID NO: 92468 - DNA, 25 bp, S. pombe
gacgtactggtcgtgctggagctaa

SEQ ID NO: 92469 - DNA, 25 bp, S. pombe
gactgtatgcgcattcttcgtgaaa

SEQ ID NO: 92470 - DNA, 25 bp, S. pombe
gactgtactcttccatctagatcaa

SEQ ID NO: 92471 - DNA, 25 bp, S. pombe
gacgttcagaatcggtagagctttt

SEQ ID NO: 92472 - DNA, 25 bp, S. pombe
gtatccctttggaagagtttgcctg

SEQ ID NO: 92473 - DNA, 25 bp, S. pombe
gagagtccaagttcgcaaaaaccta

SEQ ID NO: 92474 - DNA, 25 bp, S. pombe
gactccctggtccttatgtgaaatg

SEQ ID NO: 92475 - DNA, 25 bp, S. pombe
gactcctcgtccattagttttggat

SEQ ID NO: 92476 - DNA, 25 bp, S. pombe
gacgcaacttgatcaggttcggcag

SEQ ID NO: 92477 - DNA, 25 bp, S. pombe
gactgcatcaaattccggtgtcgaa

SEQ ID NO: 92478 - DNA, 25 bp, S. pombe
gacgaccaccgttctggcaaaattg

SEQ ID NO: 92479 - DNA, 25 bp, S. pombe
gacggccaattccatagacacactg

SEQ ID NO: 92480 - DNA, 25 bp, S. pombe
gacgatacagcagatattcacgagt

SEQ ID NO: 92481 - DNA, 25 bp, S. pombe
gactgaacagagaaaatgcgcgaat

SEQ ID NO: 92482 - DNA, 25 bp, S. pombe
gactgctgttgcctccataaaagta

SEQ ID NO: 92483 - DNA, 25 bp, S. pombe
gacgtgtcacatcccgaagcaagta

SEQ ID NO: 92484 - DNA, 25 bp, S. pombe
gagcgtttgcagcagctactactga

SEQ ID NO: 92485 - DNA, 25 bp, S. pombe
gacctcccggatgtaaatatttcta

SEQ ID NO: 92486 - DNA, 25 bp, S. pombe
gactgctgactggtgttggaatcat

SEQ ID NO: 92487 - DNA, 25 bp, S. pombe
gactgatccttctttggcagatgca

SEQ ID NO: 92488 - DNA, 25 bp, S. pombe
gacgattatctttccgatgaacaag

SEQ ID NO: 92489 - DNA, 25 bp, S. pombe
gacgatccttatgatcctgaaaagg

SEQ ID NO: 92490 - DNA, 25 bp, S. pombe
gacggtggtagcgatcctgacaaca

SEQ ID NO: 92491 - DNA, 25 bp, S. pombe
gactgctgcttcgtggatacgcaat

SEQ ID NO: 92492 - DNA, 25 bp, S. pombe
gactgaatttcttgctaaacttgcg

SEQ ID NO: 92493 - DNA, 25 bp, S. pombe
gactggacttttgtacctcctaatg

SEQ ID NO: 92494 - DNA, 25 bp, S. pombe
gactgtacctaccaataactcgtta

SEQ ID NO: 92495 - DNA, 25 bp, S. pombe
gactgcttcgcgtgataaattcgtt

SEQ ID NO: 92496 - DNA, 25 bp, S. pombe
gacgctcacgtctgcaaattgggtt

SEQ ID NO: 92497 - DNA, 25 bp, S. pombe
gacgatgctgtgcaagtagatgcta

SEQ ID NO: 92498 - DNA, 25 bp, S. pombe
gacgacgagggctttgctattacga

SEQ ID NO: 92499 - DNA, 25 bp, S. pombe
gactgggcttgttggcattagtgca

SEQ ID NO: 92500 - DNA, 25 bp, S. pombe
gacggcgcatctcttcaaacaatgt

SEQ ID NO: 92501 - DNA, 25 bp, S. pombe
gacgaggagtggtctcaacatcgaa

SEQ ID NO: 92502 - DNA, 25 bp, S. pombe
gacgtaacagatcctagctcagttg

SEQ ID NO: 92503 - DNA, 25 bp, S. pombe
gactgtgatcgcattcatagccgtt

SEQ ID NO: 92504 - DNA, 25 bp, S. pombe
gactccattctattctattctttgc

SEQ ID NO: 92505 - DNA, 25 bp, S. pombe
gacgattacaattttggtactcttc

SEQ ID NO: 92506 - DNA, 25 bp, S. pombe
gactggtccacttttactggtgtta

SEQ ID NO: 92507 - DNA, 25 bp, S. pombe
gacgtggtcaaatttccggtggtat

SEQ ID NO: 92508 - DNA, 25 bp, S. pombe
gacgtgtatcaacgcgtttcgtaca

SEQ ID NO: 92509 - DNA, 25 bp, S. pombe
gacgttcatacgctggttctacaag

SEQ ID NO: 92510 - DNA, 25 bp, S. pombe
gacgaatgaacgttccttatgctaa

SEQ ID NO: 92511 - DNA, 25 bp, S. pombe
gacgataccatccaattatctctta

SEQ ID NO: 92512 - DNA, 25 bp, S. pombe
gacgccagttctcgaaggtttttat

SEQ ID NO: 92513 - DNA, 25 bp, S. pombe
gacggacgcagtaagcaagcttcca

SEQ ID NO: 92514 - DNA, 25 bp, S. pombe
gacgttcctggtgtttttcaatctc

SEQ ID NO: 92515 - DNA, 25 bp, S. pombe
gacgttactggtgattctctggaag

SEQ ID NO: 92516 - DNA, 25 bp, S. pombe
gactgttactgtttattccgatgaa

SEQ ID NO: 92517 - DNA, 25 bp, S. pombe
gacgggtttccttgtataaatggct

SEQ ID NO: 92518 - DNA, 25 bp, S. pombe
gactgtggctttccttctgttcaag

SEQ ID NO: 92519 - DNA, 25 bp, S. pombe
gacgtggctttggaacttgtcaaaa

SEQ ID NO: 92520 - DNA, 25 bp, S. pombe
gacggattcagcgacttagatgttg

SEQ ID NO: 92521 - DNA, 25 bp, S. pombe
gactggtactccattggtctttgga

SEQ ID NO: 92522 - DNA, 25 bp, S. pombe
gactgcttcagagaatccgtggttc

SEQ ID NO: 92523 - DNA, 25 bp, S. pombe
gactgaaaatgcatgccgggctgcc

SEQ ID NO: 92524 - DNA, 25 bp, S. pombe
gacggaactttatgtgcgactgcta

SEQ ID NO: 92525 - DNA, 25 bp, S. pombe
gacgtcctttcaaatcatctggtgg

SEQ ID NO: 92526 - DNA, 25 bp, S. pombe
gactgggtttattttgctgctgatg

SEQ ID NO: 92527 - DNA, 25 bp, S. pombe
gactgttggtaatgtgctgcctgtt

SEQ ID NO: 92528 - DNA, 25 bp, S. pombe
gactgttggtattggtgccggtcaa

SEQ ID NO: 92529 - DNA, 25 bp, S. pombe
gacgttgtgatggttacattcttga

SEQ ID NO: 92530 - DNA, 25 bp, S. pombe
gactgtatatgtctgcatcctactc

SEQ ID NO: 92531 - DNA, 25 bp, S. pombe
gactgagcttgttgatcctgatact

SEQ ID NO: 92532 - DNA, 25 bp, S. pombe
gacgtgcaatattcgtgctttcgat

SEQ ID NO: 92533 - DNA, 25 bp, S. pombe
gacgatgaattgtcccttcccaaag

SEQ ID NO: 92534 - DNA, 25 bp, S. pombe
gacgaagtccattatttcccggtga

SEQ ID NO: 92535 - DNA, 25 bp, S. pombe
gacgtcgacttacggcccatataat

SEQ ID NO: 92536 - DNA, 25 bp, S. pombe
gactggtgattattccgctcaagct

SEQ ID NO: 92537 - DNA, 25 bp, S. pombe
gacgctgctcgggatgaatttattg

SEQ ID NO: 92538 - DNA, 25 bp, S. pombe
gacgcaaacctgtccatgcaaggat

SEQ ID NO: 92539 - DNA, 25 bp, S. pombe
gaccctgatcccataaacgtaaacg

SEQ ID NO: 92540 - DNA, 25 bp, S. pombe
gacccttcattaacattacgccaaa

SEQ ID NO: 92541 - DNA, 25 bp, S. pombe
gacggctacctctcttcaaaacaaa

SEQ ID NO: 92542 - DNA, 25 bp, S. pombe
gactggtactgttgtttctaccaag

SEQ ID NO: 92543 - DNA, 25 bp, S. pombe
tgacgggaccgctgtatttacctaa

SEQ ID NO: 92544 - DNA, 25 bp, S. pombe
gactggtacgcctggtttaactact

SEQ ID NO: 92545 - DNA, 25 bp, S. pombe
gactggtgtccatttatttcgaata

SEQ ID NO: 92546 - DNA, 25 bp, S. pombe
gacgtcgctttgctagtgagtttac

SEQ ID NO: 92547 - DNA, 25 bp, S. pombe
gacggacgtactctttcagattaca

SEQ ID NO: 92548 - DNA, 25 bp, S. pombe
gacgtcactgtttacttttattcca

SEQ ID NO: 92549 - DNA, 25 bp, S. pombe
gacggcacgttgaacttttgctttc

SEQ ID NO: 92550 - DNA, 25 bp, S. pombe
gacgaaatttcctctggttatgatg

SEQ ID NO: 92551 - DNA, 25 bp, S. pombe
gacgatgtatttgcccggtgttgga

SEQ ID NO: 92552 - DNA, 25 bp, S. pombe
gactgttttcttcatcgactgttcg

SEQ ID NO: 92553 - DNA, 25 bp, S. pombe
gagctactttctatgtcgatcgtgc

SEQ ID NO: 92554 - DNA, 25 bp, S. pombe
gagcttttcgttactggtcgtttag

SEQ ID NO: 92555 - DNA, 25 bp, S. pombe
gacgtttcgattgaggtccttgata

SEQ ID NO: 92556 - DNA, 25 bp, S. pombe
gacgacttagttgaattccctattg

SEQ ID NO: 92557 - DNA, 25 bp, S. pombe
gacgtcaggagcttcctacggtaaa

SEQ ID NO: 92558 - DNA, 25 bp, S. pombe
gactgtgttggttgcgaacgctgtc

SEQ ID NO: 92559 - DNA, 25 bp, S. pombe
gactggtattgttgctcaagccgat

SEQ ID NO: 92560 - DNA, 25 bp, S. pombe
gaccaaggtcacgtatttctttcaa

SEQ ID NO: 92561 - DNA, 25 bp, S. pombe
gacctaatgcttctcgttttatcag

SEQ ID NO: 92562 - DNA, 25 bp, S. pombe
gacggcccttgcaaagtgtctttta

SEQ ID NO: 92563 - DNA, 25 bp, S. pombe
gacggcggacatgatgatttgtatt

SEQ ID NO: 92564 - DNA, 25 bp, S. pombe
gactgtccgttcatctcgtgattta

SEQ ID NO: 92565 - DNA, 25 bp, S. pombe
gacgtacagttgatctcgcttaaag

SEQ ID NO: 92566 - DNA, 25 bp, S. pombe
gacgacggtttaacagtctgtccac

SEQ ID NO: 92567 - DNA, 25 bp, S. pombe
gacgaggtctttcaagtctgtcctt

SEQ ID NO: 92568 - DNA, 25 bp, S. pombe
gacgaggtacctgaactggtgtcct

SEQ ID NO: 92569 - DNA, 25 bp, S. pombe
gatcgtttacgtgaagctggtttta

SEQ ID NO: 92570 - DNA, 25 bp, S. pombe
gacgttttcgtcaccaaggcttgga

SEQ ID NO: 92571 - DNA, 25 bp, S. pombe
gacgttttcgagttcatcaacctta

SEQ ID NO: 92572 - DNA, 25 bp, S. pombe
gacgtgatttgccagttcgctatgc

SEQ ID NO: 92573 - DNA, 25 bp, S. pombe
gacggctttgaatctcgtagcggat

SEQ ID NO: 92574 - DNA, 25 bp, S. pombe
gacgacttaacatctttaccctatc

SEQ ID NO: 92575 - DNA, 25 bp, S. pombe
gacgacattaaatcacattgggcac

SEQ ID NO: 92576 - DNA, 25 bp, S. pombe
gacggcttgtgatcagtcatccaat

SEQ ID NO: 92577 - DNA, 25 bp, S. pombe
tattcgttaaacttgttccggcagg

SEQ ID NO: 92578 - DNA, 25 bp, S. pombe
gacgtttggttcgttgcttggatta

SEQ ID NO: 92579 - DNA, 25 bp, S. pombe
gagcttttcgaaattccaggtacct

SEQ ID NO: 92580 - DNA, 25 bp, S. pombe
gacgattatcccacatctgacggta

SEQ ID NO: 92581 - DNA, 25 bp, S. pombe
gacgttcaatccgacactagcgaga

SEQ ID NO: 92582 - DNA, 25 bp, S. pombe
gacgattatgttgcgactgacgata

SEQ ID NO: 92583 - DNA, 25 bp, S. pombe
gacgatgttgaagccattcttttag

SEQ ID NO: 92584 - DNA, 25 bp, S. pombe
gacgttgtaaacttccttcattggg

SEQ ID NO: 92585 - DNA, 25 bp, S. pombe
gtcgtttctactttggagcgtcgtt

SEQ ID NO: 92586 - DNA, 25 bp, S. pombe
gaccatttttctttcgagaacgttg

SEQ ID NO: 92587 - DNA, 25 bp, S. pombe
gaccattaatcgttcggttatcaat

SEQ ID NO: 92588 - DNA, 25 bp, S. pombe
gacgaatcagtttttgcttgggcca

SEQ ID NO: 92589 - DNA, 25 bp, S. pombe
gacggaacttgttttatcagcgcca

SEQ ID NO: 92590 - DNA, 25 bp, S. pombe
gacggatacggattatttcgcagct

SEQ ID NO: 92591 - DNA, 25 bp, S. pombe
gacggttctcttggttattatcctt

SEQ ID NO: 92592 - DNA, 25 bp, S. pombe
gactggctatttgcgtttatgattt

SEQ ID NO: 92593 - DNA, 25 bp, S. pombe
gacggtctcgtatgttttgttgctc

SEQ ID NO: 92594 - DNA, 25 bp, S. pombe
gacggatttgtttacttctgttcgc

SEQ ID NO: 92595 - DNA, 25 bp, S. pombe
gacggtttggttattcgcaagccta

SEQ ID NO: 92596 - DNA, 25 bp, S. pombe
gaccgtttggttcttctgaagcgac

SEQ ID NO: 92597 - DNA, 25 bp, S. pombe
gacggattttcttcccaatgaacta

SEQ ID NO: 92598 - DNA, 25 bp, S. pombe
gacggtgttctttccgctgaaggaa

SEQ ID NO: 92599 - DNA, 25 bp, S. pombe
gacgtggttgtcctcaatttttgaa

SEQ ID NO: 92600 - DNA, 25 bp, S. pombe
gacggttgtctcaactttgtcgatg

SEQ ID NO: 92601 - DNA, 25 bp, S. pombe
gacggtttcacattgcgatctttat

SEQ ID NO: 92602 - DNA, 25 bp, S. pombe
gacgcgatattcctctgatgacaga

SEQ ID NO: 92603 - DNA, 25 bp, S. pombe
gacgtgatgcccattgactgtcagg

SEQ ID NO: 92604 - DNA, 25 bp, S. pombe
gacggatcgctctattatttcatgt

SEQ ID NO: 92605 - DNA, 25 bp, S. pombe
gacggacgttatgaagctgctgatg

SEQ ID NO: 92606 - DNA, 25 bp, S. pombe
gacgggtcttgctacggatgttcag

SEQ ID NO: 92607 - DNA, 25 bp, S. pombe
gacgttttccctcctgattataaca

SEQ ID NO: 92608 - DNA, 25 bp, S. pombe
gacgccttggacgatgtcgattcat

SEQ ID NO: 92609 - DNA, 25 bp, S. pombe
gacgagctttggatgtctcattatc

SEQ ID NO: 92610 - DNA, 25 bp, S. pombe
gacgaatactcccaatctggatgag

SEQ ID NO: 92611 - DNA, 25 bp, S. pombe
gacgaaacccgcattcaagagttga

SEQ ID NO: 92612 - DNA, 25 bp, S. pombe
gacgtgattccttctattcaagttt

SEQ ID NO: 92613 - DNA, 25 bp, S. pombe
gacggttctcattattatgcggcat

SEQ ID NO: 92614 - DNA, 25 bp, S. pombe
gaccgtggtctacagatgaggctat

SEQ ID NO: 92615 - DNA, 25 bp, S. pombe
gacgttgaatcttacgctcattcct

SEQ ID NO: 92616 - DNA, 25 bp, S. pombe
gacgataggatttctcgtttcctta

SEQ ID NO: 92617 - DNA, 25 bp, S. pombe
gacgaaggcgtgttagtatatccaa

SEQ ID NO: 92618 - DNA, 25 bp, S. pombe
gacgacaagttgttagccgacccta

SEQ ID NO: 92619 - DNA, 25 bp, S. pombe
gacgagagtttataccaggctttta

SEQ ID NO: 92620 - DNA, 25 bp, S. pombe
gacgagtatattcaaccccttatct

SEQ ID NO: 92621 - DNA, 25 bp, S. pombe
gacgttcttcttctaacgctactaa

SEQ ID NO: 92622 - DNA, 25 bp, S. pombe
gacgttgtttctctacagttttgca

SEQ ID NO: 92623 - DNA, 25 bp, S. pombe
gacgtctttgttatccgttttcact

SEQ ID NO: 92624 - DNA, 25 bp, S. pombe
gacgtcgttttgattcgggtgtcga

SEQ ID NO: 92625 - DNA, 25 bp, S. pombe
gacgactttttggtatgggcgattt

SEQ ID NO: 92626 - DNA, 25 bp, S. pombe
gacgtcctctatttgctgggtcaaa

SEQ ID NO: 92627 - DNA, 25 bp, S. pombe
gacgtctacgactttggcgatcaaa

SEQ ID NO: 92628 - DNA, 25 bp, S. pombe
gacgactacaactttccgaaggctt

SEQ ID NO: 92629 - DNA, 25 bp, S. pombe
gacgatatcatggaagcctcccaga

SEQ ID NO: 92630 - DNA, 25 bp, S. pombe
gacgcatggcacgaagcccaaagaa

SEQ ID NO: 92631 - DNA, 25 bp, S. pombe
gacgcgagcctcagcaagcacaaaa

SEQ ID NO: 92632 - DNA, 25 bp, S. pombe
gacggtgtcacttcatcagacgaaa

SEQ ID NO: 92633 - DNA, 25 bp, S. pombe
gacgactgtaattccgaccaaactg

SEQ ID NO: 92634 - DNA, 25 bp, S. pombe
gacgagcggagatccatatgttcaa

SEQ ID NO: 92635 - DNA, 25 bp, S. pombe
gacgtaacgtctcatcattatacta

SEQ ID NO: 92636 - DNA, 25 bp, S. pombe
gacgtgcccgtttatatattattga

SEQ ID NO: 92637 - DNA, 25 bp, S. pombe
gacgttgctcgttccatttatatta

SEQ ID NO: 92638 - DNA, 25 bp, S. pombe
gacggttcctcacgtttgatcatta

SEQ ID NO: 92639 - DNA, 25 bp, S. pombe
gacggataattacatttcacttgaa

SEQ ID NO: 92640 - DNA, 25 bp, S. pombe
gacggtgtttatctttacttcgaag

SEQ ID NO: 92641 - DNA, 25 bp, S. pombe
gacgtgactttggtgaagctcaact

SEQ ID NO: 92642 - DNA, 25 bp, S. pombe
gacgttaacgatgttgcgcaagctt

SEQ ID NO: 92643 - DNA, 25 bp, S. pombe
gacgttactcttacttcgaagcatt

SEQ ID NO: 92644 - DNA, 25 bp, S. pombe
gacgggaattatctcacaatatctt

SEQ ID NO: 92645 - DNA, 25 bp, S. pombe
gacggtgattctactgaaacatctt

SEQ ID NO: 92646 - DNA, 25 bp, S. pombe
gacggtgcccacagtatcaatgaga

SEQ ID NO: 92647 - DNA, 25 bp, S. pombe
gacgaggaaccatctgatctcataa

SEQ ID NO: 92648 - DNA, 25 bp, S. pombe
gacgtggagatctttctgctcgaaa

SEQ ID NO: 92649 - DNA, 25 bp, S. pombe
gacgcagtagtgtctcttctcgaga

SEQ ID NO: 92650 - DNA, 25 bp, S. pombe
gacgttagtaactttgctgatgatc

SEQ ID NO: 92651 - DNA, 25 bp, S. pombe
gaccgttttagttcaatgtcctaag

SEQ ID NO: 92652 - DNA, 25 bp, S. pombe
gacgtttcttcgacggagccagtaa

SEQ ID NO: 92653 - DNA, 25 bp, S. pombe
gacgagcttcgtgatccaaattgca

SEQ ID NO: 92654 - DNA, 25 bp, S. pombe
gacgacttgcgtgcagaactttcat

SEQ ID NO: 92655 - DNA, 25 bp, S. pombe
gacggtgaaattgttgctcctataa

SEQ ID NO: 92656 - DNA, 25 bp, S. pombe
gacgtcttgactgggttgtccttga

SEQ ID NO: 92657 - DNA, 25 bp, S. pombe
gacgtttggcatctgttgtcgccaa

SEQ ID NO: 92658 - DNA, 25 bp, S. pombe
gacgtagcgaagtctacagctcctg

SEQ ID NO: 92659 - DNA, 25 bp, S. pombe
gacgttgttttcgaatgatccatgg

SEQ ID NO: 92660 - DNA, 25 bp, S. pombe
gatcccgttattgaagcgcatgaag

SEQ ID NO: 92661 - DNA, 25 bp, S. pombe
gacgattttatttctcatgccaaag

SEQ ID NO: 92662 - DNA, 25 bp, S. pombe
gacgagctgtactttatcctaatat

SEQ ID NO: 92663 - DNA, 25 bp, S. pombe
gacgcagagcgaactgttttactaa

SEQ ID NO: 92664 - DNA, 25 bp, S. pombe
gaccgattggtcttctatagatcca

SEQ ID NO: 92665 - DNA, 25 bp, S. pombe
gaccgatttttggttcaatggcctg

SEQ ID NO: 92666 - DNA, 25 bp, S. pombe
gacgttgccaatgtcgttgctgaga

SEQ ID NO: 92667 - DNA, 25 bp, S. pombe
gacgttcctgactatggattgctga

SEQ ID NO: 92668 - DNA, 25 bp, S. pombe
gacgttgacacctgttatgcttatt

SEQ ID NO: 92669 - DNA, 25 bp, S. pombe
gacgttggcttctgtgatagcttta

SEQ ID NO: 92670 - DNA, 25 bp, S. pombe
gacgttggctttttgctgagtcaag

SEQ ID NO: 92671 - DNA, 25 bp, S. pombe
gacgttgctgcttctgagttgtata

SEQ ID NO: 92672 - DNA, 25 bp, S. pombe
gacgtgcggctcctggtatgtttat

SEQ ID NO: 92673 - DNA, 25 bp, S. pombe
gacgggctcgagtgtattatttaat

SEQ ID NO: 92674 - DNA, 25 bp, S. pombe
gacgttctgcgtttggaccctaaat

SEQ ID NO: 92675 - DNA, 25 bp, S. pombe
gacgttcaacgggattctccaatta

SEQ ID NO: 92676 - DNA, 25 bp, S. pombe
gacgtgacagccgatgatacttttg

SEQ ID NO: 92677 - DNA, 25 bp, S. pombe
gacgtgtcgtaggatatgttcttgc

SEQ ID NO: 92678 - DNA, 25 bp, S. pombe
gacgtccgtggccttgttcaacaaa

SEQ ID NO: 92679 - DNA, 25 bp, S. pombe
gacgaacatctacatcctgaaaaag

SEQ ID NO: 92680 - DNA, 25 bp, S. pombe
gacgagcacgcagcctttcaaatat

SEQ ID NO: 92681 - DNA, 25 bp, S. pombe
gacgcgtcctcgcttatacgaagag

SEQ ID NO: 92682 - DNA, 25 bp, S. pombe
gacgtgggccaggtgtacaagcaaa

SEQ ID NO: 92683 - DNA, 25 bp, S. pombe
gacgttattatcctcatgttcacaa

SEQ ID NO: 92684 - DNA, 25 bp, S. pombe
gacgttattatcaacattcttcttt

SEQ ID NO: 92685 - DNA, 25 bp, S. pombe
gacgttagcaagatcactcagtttt

SEQ ID NO: 92686 - DNA, 25 bp, S. pombe
gaccctcgttctgccaagtttgttg

SEQ ID NO: 92687 - DNA, 25 bp, S. pombe
gagaccacgttaaccagttttctat

SEQ ID NO: 92688 - DNA, 25 bp, S. pombe
gaccccgataattccagagacgtta

SEQ ID NO: 92689 - DNA, 25 bp, S. pombe
gacgctccaaacttttgtccgcagt

SEQ ID NO: 92690 - DNA, 25 bp, S. pombe
gacgtccatcaactgtataatcccg

SEQ ID NO: 92691 - DNA, 25 bp, S. pombe
gaccccgattggtattatgtccgcg

SEQ ID NO: 92692 - DNA, 25 bp, S. pombe
gaccccggagcagcaatgatgtttg

SEQ ID NO: 92693 - DNA, 25 bp, S. pombe
gacgacctatactggtgtcagactt

SEQ ID NO: 92694 - DNA, 25 bp, S. pombe
gacgaacttcatataaatcacaccg

SEQ ID NO: 92695 - DNA, 25 bp, S. pombe
gacgaaacagcatcacaggacctaa

SEQ ID NO: 92696 - DNA, 25 bp, S. pombe
gacccaatcctttttggactactgc

SEQ ID NO: 92697 - DNA, 25 bp, S. pombe
gacctttgaacttcgtaagcaatcg

SEQ ID NO: 92698 - DNA, 25 bp, S. pombe
gacgcttcagaatctcctatggttc

SEQ ID NO: 92699 - DNA, 25 bp, S. pombe
gaccattactggagaggcgcttaca

SEQ ID NO: 92700 - DNA, 25 bp, S. pombe
gacgacgtgattgctcatcaaagag

SEQ ID NO: 92701 - DNA, 25 bp, S. pombe
gacgttcatgcagtcgctgatctac

SEQ ID NO: 92702 - DNA, 25 bp, S. pombe
gacgagacattgacgatccctgagg

SEQ ID NO: 92703 - DNA, 25 bp, S. pombe
gacgacattccatatgctagcgatg

SEQ ID NO: 92704 - DNA, 25 bp, S. pombe
gacgaatctacttcatcgatgcggt

SEQ ID NO: 92705 - DNA, 25 bp, S. pombe
gacgatttgagatcatcagttgacg

SEQ ID NO: 92706 - DNA, 25 bp, S. pombe
gacgatattgtttctggtgtacgca

SEQ ID NO: 92707 - DNA, 25 bp, S. pombe
gacgttgtgtcttctgatcgtacag

SEQ ID NO: 92708 - DNA, 25 bp, S. pombe
gacgttttccatccatcaacagagt

SEQ ID NO: 92709 - DNA, 25 bp, S. pombe
gacgagttaccacatcagaagctta

SEQ ID NO: 92710 - DNA, 25 bp, S. pombe
gacgctcttaccaatcgcaaagtta

SEQ ID NO: 92711 - DNA, 25 bp, S. pombe
gacgctcgaactaccgagtggttaa

SEQ ID NO: 92712 - DNA, 25 bp, S. pombe
gacgtagcttttttagccgccgaat

SEQ ID NO: 92713 - DNA, 25 bp, S. pombe
gacgaattttttccactcgccaaca

SEQ ID NO: 92714 - DNA, 25 bp, S. pombe
gacgaactgctatttccaacattca

SEQ ID NO: 92715 - DNA, 25 bp, S. pombe
gacgaagctcggtttcatgactttt

SEQ ID NO: 92716 - DNA, 25 bp, S. pombe
gaccggaaagactatcacccttgag

SEQ ID NO: 92717 - DNA, 25 bp, S. pombe
gacccgtaagacttactgtcctggt

SEQ ID NO: 92718 - DNA, 25 bp, S. pombe
gatccaactgggattactttcggta

SEQ ID NO: 92719 - DNA, 25 bp, S. pombe
gagccaacatggactggtacctcct

SEQ ID NO: 92720 - DNA, 25 bp, S. pombe
gacgaccgtaccctgaatgtatgga

SEQ ID NO: 92721 - DNA, 25 bp, S. pombe
gaccttgtgcacgtatacagcgatt

SEQ ID NO: 92722 - DNA, 25 bp, S. pombe
gacgatttggtggtcatcgctccaa

SEQ ID NO: 92723 - DNA, 25 bp, S. pombe
gacgagactttgacaatccccaagg

SEQ ID NO: 92724 - DNA, 25 bp, S. pombe
gacgagactttgacttaccatctga

SEQ ID NO: 92725 - DNA, 25 bp, S. pombe
gacgaggttatcattatgccactgc

SEQ ID NO: 92726 - DNA, 25 bp, S. pombe
gacgctggtcaaacagttcctcatg

SEQ ID NO: 92727 - DNA, 25 bp, S. pombe
gacgcatcttttaagttccttccta

SEQ ID NO: 92728 - DNA, 25 bp, S. pombe
gacgatgttattctcgtggcctatt

SEQ ID NO: 92729 - DNA, 25 bp, S. pombe
gacgatgaaagtctgtgcttccatt

SEQ ID NO: 92730 - DNA, 25 bp, S. pombe
gagcaggcagacagaacgcgttata

SEQ ID NO: 92731 - DNA, 25 bp, S. pombe
gacccagatgctcaacaatggcttg

SEQ ID NO: 92732 - DNA, 25 bp, S. pombe
gacgcgatggttcgacaagtgcata

SEQ ID NO: 92733 - DNA, 25 bp, S. pombe
gaggctattcggtcggattacaaat

SEQ ID NO: 92734 - DNA, 25 bp, S. pombe
gaccttagctaatggattccgtatg

SEQ ID NO: 92735 - DNA, 25 bp, S. pombe
gacgttctgttatacaaccatcaag

SEQ ID NO: 92736 - DNA, 25 bp, S. pombe
gacccagtaggcactttcactgaag

SEQ ID NO: 92737 - DNA, 25 bp, S. pombe
gacccttacgcctgtatatctacaa

SEQ ID NO: 92738 - DNA, 25 bp, S. pombe
gaccatcggacccattgttgtgaaa

SEQ ID NO: 92739 - DNA, 25 bp, S. pombe
gacccaatgccactacttttttgta

SEQ ID NO: 92740 - DNA, 25 bp, S. pombe
gacgaagacttcatccaggatcgct

SEQ ID NO: 92741 - DNA, 25 bp, S. pombe
gacgacaatctatttcactgggctt

SEQ ID NO: 92742 - DNA, 25 bp, S. pombe
gaccatctattttctacgttttaca

SEQ ID NO: 92743 - DNA, 25 bp, S. pombe
gaccctgtttcagttttttgtgacg

SEQ ID NO: 92744 - DNA, 25 bp, S. pombe
gacccgatggtcgttatgttcgttt

SEQ ID NO: 92745 - DNA, 25 bp, S. pombe
gagccaatgcatattcctttaggtg

SEQ ID NO: 92746 - DNA, 25 bp, S. pombe
gaccaacgatttgactctatggagc

SEQ ID NO: 92747 - DNA, 25 bp, S. pombe
gacccacatgatttgtacttttccc

SEQ ID NO: 92748 - DNA, 25 bp, S. pombe
gacgacttatctagcactgtgcata

SEQ ID NO: 92749 - DNA, 25 bp, S. pombe
gacgagctgtatttctcgctaatga

SEQ ID NO: 92750 - DNA, 25 bp, S. pombe
gacgatgttttttcttcagatgcaa

SEQ ID NO: 92751 - DNA, 25 bp, S. pombe
gaccattgctcaccgtattaatact

SEQ ID NO: 92752 - DNA, 25 bp, S. pombe
gacccttagaaaccatacgcgcttg

SEQ ID NO: 92753 - DNA, 25 bp, S. pombe
gaccatcccaaaatttacctctatt

SEQ ID NO: 92754 - DNA, 25 bp, S. pombe
gatccattcctggtccgaacaaaag

SEQ ID NO: 92755 - DNA, 25 bp, S. pombe
gacgatttcatggtccaagacttca

SEQ ID NO: 92756 - DNA, 25 bp, S. pombe
gacgaatctgcagtttctgatgaat

SEQ ID NO: 92757 - DNA, 25 bp, S. pombe
gacgctggtggaaagattcttggtt

SEQ ID NO: 92758 - DNA, 25 bp, S. pombe
gaccacgttaagaattttgcgagat

SEQ ID NO: 92759 - DNA, 25 bp, S. pombe
gagccggactggttgattcgtttat

SEQ ID NO: 92760 - DNA, 25 bp, S. pombe
gacctgaagaggctttgagctcgct

SEQ ID NO: 92761 - DNA, 25 bp, S. pombe
gaccgcacggtcaaccaaactttga

SEQ ID NO: 92762 - DNA, 25 bp, S. pombe
gacgcatgcaggcttttggattttt

SEQ ID NO: 92763 - DNA, 25 bp, S. pombe
gacgaaagcttgtcttcatttattg

SEQ ID NO: 92764 - DNA, 25 bp, S. pombe
gacgacgttgtctttcattatgatg

SEQ ID NO: 92765 - DNA, 25 bp, S. pombe
gacgatgctattactttttcaatta

SEQ ID NO: 92766 - DNA, 25 bp, S. pombe
gacctcttttgttggttacttggtg

SEQ ID NO: 92767 - DNA, 25 bp, S. pombe
gaccgtttggtgtgacaactttgtt

SEQ ID NO: 92768 - DNA, 25 bp, S. pombe
gaccgtttggtgttgctttgttaat

SEQ ID NO: 92769 - DNA, 25 bp, S. pombe
gacgacttagttttatctgggatga

SEQ ID NO: 92770 - DNA, 25 bp, S. pombe
gacgcatctatgcttcgttgataca

SEQ ID NO: 92771 - DNA, 25 bp, S. pombe
gaccataatggtacagattgctgcc

SEQ ID NO: 92772 - DNA, 25 bp, S. pombe
gacgaaaattattccatccctctca

SEQ ID NO: 92773 - DNA, 25 bp, S. pombe
gacgagttttgttctgatcccacta

SEQ ID NO: 92774 - DNA, 25 bp, S. pombe
gacgagcagattcccattttaaatt

SEQ ID NO: 92775 - DNA, 25 bp, S. pombe
gacgccactagtactccattagaaa

SEQ ID NO: 92776 - DNA, 25 bp, S. pombe
gaccttgaatccaccttagttgtaa

SEQ ID NO: 92777 - DNA, 25 bp, S. pombe
gaccgtatggttgccgaagctgaga

SEQ ID NO: 92778 - DNA, 25 bp, S. pombe
gacccgactttaacgttcatgagct

SEQ ID NO: 92779 - DNA, 25 bp, S. pombe
gaccgtagtcgtaaactcgaattat

SEQ ID NO: 92780 - DNA, 25 bp, S. pombe
gacccaaccgttaagcaattgattt

SEQ ID NO: 92781 - DNA, 25 bp, S. pombe
gagcctttccgtaaacattgtttgg

SEQ ID NO: 92782 - DNA, 25 bp, S. pombe
gacgctttgaaggacactgctgagt

SEQ ID NO: 92783 - DNA, 25 bp, S. pombe
gacgcatttacattacaattagcat

SEQ ID NO: 92784 - DNA, 25 bp, S. pombe
gacgcatatttattccgtgctgcct

SEQ ID NO: 92785 - DNA, 25 bp, S. pombe
gacgaaattgcttcatggagcccat

SEQ ID NO: 92786 - DNA, 25 bp, S. pombe
gacgcaagcttttcatgtgtgtcct

SEQ ID NO: 92787 - DNA, 25 bp, S. pombe
gacgctgagaccgatgatttcctta

SEQ ID NO: 92788 - DNA, 25 bp, S. pombe
gacgctatcatgcaagattttcgac

SEQ ID NO: 92789 - DNA, 25 bp, S. pombe
gaccccgagtaactgcatctggcaa

SEQ ID NO: 92790 - DNA, 25 bp, S. pombe
gaccgctcaggaaagtctacccaat

SEQ ID NO: 92791 - DNA, 25 bp, S. pombe
gattctcggtaaacttcgttcgttg

SEQ ID NO: 92792 - DNA, 25 bp, S. pombe
gacctttaaatcctaccttgttgca

SEQ ID NO: 92793 - DNA, 25 bp, S. pombe
gatacggttaccatgacccaggctt

SEQ ID NO: 92794 - DNA, 25 bp, S. pombe
gaggcacgttgacatttccggttcg

SEQ ID NO: 92795 - DNA, 25 bp, S. pombe
gacgaacttcgaatttcagccgtta

SEQ ID NO: 92796 - DNA, 25 bp, S. pombe
gaccttgttctgttcctgagggaaa

SEQ ID NO: 92797 - DNA, 25 bp, S. pombe
gacctggtctattctttttggcgaa

SEQ ID NO: 92798 - DNA, 25 bp, S. pombe
gacctgtggagcttttacacgggat

SEQ ID NO: 92799 - DNA, 25 bp, S. pombe
gacctttttacaattcaaatcctat

SEQ ID NO: 92800 - DNA, 25 bp, S. pombe
gacctttattccttctcaaacacat

SEQ ID NO: 92801 - DNA, 25 bp, S. pombe
gaccggtttctgtttgaaggcagca

SEQ ID NO: 92802 - DNA, 25 bp, S. pombe
gaccggcttctcagttgtacgatat

SEQ ID NO: 92803 - DNA, 25 bp, S. pombe
gaccgtcgtataatccttacagtta

SEQ ID NO: 92804 - DNA, 25 bp, S. pombe
gaccgtcgtataattctttcagctt

SEQ ID NO: 92805 - DNA, 25 bp, S. pombe
gacgcgttttatatgctaatgagca

SEQ ID NO: 92806 - DNA, 25 bp, S. pombe
gacgcgtctagtaaatttctcaatc

SEQ ID NO: 92807 - DNA, 25 bp, S. pombe
gaccaccaatcccaagttcaattgt

SEQ ID NO: 92808 - DNA, 25 bp, S. pombe
gacgcagtcagcagccagagttata

SEQ ID NO: 92809 - DNA, 25 bp, S. pombe
gacgctactttactgaattctttga

SEQ ID NO: 92810 - DNA, 25 bp, S. pombe
gagcgagttttagccttacaagaca

SEQ ID NO: 92811 - DNA, 25 bp, S. pombe
gaccttccttttctgttcaatacat

SEQ ID NO: 92812 - DNA, 25 bp, S. pombe
gaccatcttttcactcatttcttgg

SEQ ID NO: 92813 - DNA, 25 bp, S. pombe
gacgaatttgtgcttttctccatta

SEQ ID NO: 92814 - DNA, 25 bp, S. pombe
gacgaattcttcttcaatttctatt

SEQ ID NO: 92815 - DNA, 25 bp, S. pombe
gacgctaatctttctaatgttccaa

SEQ ID NO: 92816 - DNA, 25 bp, S. pombe
gaccatcaacttagccaattaccac

SEQ ID NO: 92817 - DNA, 25 bp, S. pombe
gttagtgttcactgcgttcagacgt

SEQ ID NO: 92818 - DNA, 25 bp, S. pombe
gaccaggttttgagcctattacgga

SEQ ID NO: 92819 - DNA, 25 bp, S. pombe
gacgaacctactggagaagctgctt

SEQ ID NO: 92820 - DNA, 25 bp, S. pombe
gacgaactccacaaagtcattctta

SEQ ID NO: 92821 - DNA, 25 bp, S. pombe
gacgaattctcgatggtatgctcat

SEQ ID NO: 92822 - DNA, 25 bp, S. pombe
gacgcatttcgtaatggtgtcttta

SEQ ID NO: 92823 - DNA, 25 bp, S. pombe
gacgctttcttggatgactgtgttt

SEQ ID NO: 92824 - DNA, 25 bp, S. pombe
gacgcgtacttgtttcgagctgctt

SEQ ID NO: 92825 - DNA, 25 bp, S. pombe
gacgcctgtcggtattagtggttgc

SEQ ID NO: 92826 - DNA, 25 bp, S. pombe
gaccgactccttgatgatccaattg

SEQ ID NO: 92827 - DNA, 25 bp, S. pombe
gagttggcgaacatcgttcctggat

SEQ ID NO: 92828 - DNA, 25 bp, S. pombe
gaccgcaaggatgaaactggccgat

SEQ ID NO: 92829 - DNA, 25 bp, S. pombe
gacctattttcttaactatcaccca

SEQ ID NO: 92830 - DNA, 25 bp, S. pombe
gacgcgttttaattcctttcgcatt

SEQ ID NO: 92831 - DNA, 25 bp, S. pombe
gacgcacagtttgttcctaacctga

SEQ ID NO: 92832 - DNA, 25 bp, S. pombe
gaccaagtctgtatccaaaacctca

SEQ ID NO: 92833 - DNA, 25 bp, S. pombe
gaccaatgtcttacgctaaagcaca

SEQ ID NO: 92834 - DNA, 25 bp, S. pombe
gacctcgattttctaacaccttact

SEQ ID NO: 92835 - DNA, 25 bp, S. pombe
gaccctttattcgtagattgccaga

SEQ ID NO: 92836 - DNA, 25 bp, S. pombe
gaccgcgttactcgtaatggcgata

SEQ ID NO: 92837 - DNA, 25 bp, S. pombe
gacgccagttattagctcgcgaaga

SEQ ID NO: 92838 - DNA, 25 bp, S. pombe
gaccgattctactattcccattagc

SEQ ID NO: 92839 - DNA, 25 bp, S. pombe
gacgctacagcgcttggcagatgaa

SEQ ID NO: 92840 - DNA, 25 bp, S. pombe
gacgccgccggatttgaaagacaaa

SEQ ID NO: 92841 - DNA, 25 bp, S. pombe
gacctacgttggctttacgtgcaaa

SEQ ID NO: 92842 - DNA, 25 bp, S. pombe
gaccctggtgcttatatgtttcgac

SEQ ID NO: 92843 - DNA, 25 bp, S. pombe
gaccagttcttttcaggtccaggaa

SEQ ID NO: 92844 - DNA, 25 bp, S. pombe
gaccgattttgaagagttccagcaa

SEQ ID NO: 92845 - DNA, 25 bp, S. pombe
gaccaggattccatgctagttacac

SEQ ID NO: 92846 - DNA, 25 bp, S. pombe
gacgcagtttgctgtgctatctcaa

SEQ ID NO: 92847 - DNA, 25 bp, S. pombe
gacgcatctgctacttattttgcta

SEQ ID NO: 92848 - DNA, 25 bp, S. pombe
gaccctgaatttttgcgtgccaata

SEQ ID NO: 92849 - DNA, 25 bp, S. pombe
gatccccaagatcaatccttaggta

SEQ ID NO: 92850 - DNA, 25 bp, S. pombe
gacctttaggtgaaatagctctcga

SEQ ID NO: 92851 - DNA, 25 bp, S. pombe
gacctaccagttcactttctgatga

SEQ ID NO: 92852 - DNA, 25 bp, S. pombe
gaccttcggattctcgattgctgaa

SEQ ID NO: 92853 - DNA, 25 bp, S. pombe
gacgcctcagcccattaaaattcgt

SEQ ID NO: 92854 - DNA, 25 bp, S. pombe
gacgaatgaaactgtctctattgag

SEQ ID NO: 92855 - DNA, 25 bp, S. pombe
gaccagcaaaatcatcttcttccaa

SEQ ID NO: 92856 - DNA, 25 bp, S. pombe
gacccaaatacgtcttctgtgacta

SEQ ID NO: 92857 - DNA, 25 bp, S. pombe
gacgaatcaaacttcttcaacctta

SEQ ID NO: 92858 - DNA, 25 bp, S. pombe
gaccattctcttcttaactacattg

SEQ ID NO: 92859 - DNA, 25 bp, S. pombe
gacgctttagcttctgttacactta

SEQ ID NO: 92860 - DNA, 25 bp, S. pombe
gacgctttagctgctgttgagctta

SEQ ID NO: 92861 - DNA, 25 bp, S. pombe
gacgctgaaggtcgccaaattcctg

SEQ ID NO: 92862 - DNA, 25 bp, S. pombe
gacgctcaggcgacgatttcatggt

SEQ ID NO: 92863 - DNA, 25 bp, S. pombe
gaccttgatgaactgtttgcccttg

SEQ ID NO: 92864 - DNA, 25 bp, S. pombe
gaccctgtaggcgtttccaacgatg

SEQ ID NO: 92865 - DNA, 25 bp, S. pombe
gacctctggcgacgctttgtaaaaa

SEQ ID NO: 92866 - DNA, 25 bp, S. pombe
gagcgcaaggaacgtttcaacgcca

SEQ ID NO: 92867 - DNA, 25 bp, S. pombe
gaccctctaaatcatatcgccataa

SEQ ID NO: 92868 - DNA, 25 bp, S. pombe
gaccctagtgttcatacagctgcta

SEQ ID NO: 92869 - DNA, 25 bp, S. pombe
gaccctagtgcttatgctcaacgta

SEQ ID NO: 92870 - DNA, 25 bp, S. pombe
gaccgcaggcggctcaatattggaa

SEQ ID NO: 92871 - DNA, 25 bp, S. pombe
gacgcattcggccaaaatcactttc

SEQ ID NO: 92872 - DNA, 25 bp, S. pombe
gacgctagccccaaagaccgtatat

SEQ ID NO: 92873 - DNA, 25 bp, S. pombe
gaccctccctacgatggtggtgtta

SEQ ID NO: 92874 - DNA, 25 bp, S. pombe
gaccgatgtccctgatactgggtta

SEQ ID NO: 92875 - DNA, 25 bp, S. pombe
gaccgatgtgccgtcgcagaatcga

SEQ ID NO: 92876 - DNA, 25 bp, S. pombe
gaccgtggcccattcattgatcaat

SEQ ID NO: 92877 - DNA, 25 bp, S. pombe
gaccgatggccgtatgtatccagaa

SEQ ID NO: 92878 - DNA, 25 bp, S. pombe
gacgcgattgctggcattgtttcta

SEQ ID NO: 92879 - DNA, 25 bp, S. pombe
gaccctcttcaaatgttctttgcca

SEQ ID NO: 92880 - DNA, 25 bp, S. pombe
gaccaacctttcaccattttatcaa

SEQ ID NO: 92881 - DNA, 25 bp, S. pombe
gaccgaccttttactgtttctatgg

SEQ ID NO: 92882 - DNA, 25 bp, S. pombe
gacccactgatcacttcgattttag

SEQ ID NO: 92883 - DNA, 25 bp, S. pombe
gacccacgttttgctgctctatata

SEQ ID NO: 92884 - DNA, 25 bp, S. pombe
gacccatgcattagtatccttctta

SEQ ID NO: 92885 - DNA, 25 bp, S. pombe
gacctaatgatcctcaaccacatat

SEQ ID NO: 92886 - DNA, 25 bp, S. pombe
gagcgccaagcgttcagatgcagca

SEQ ID NO: 92887 - DNA, 25 bp, S. pombe
gagctgctaacgctccagaggttag

SEQ ID NO: 92888 - DNA, 25 bp, S. pombe
gacgccactattctgttgcgtgaaa

SEQ ID NO: 92889 - DNA, 25 bp, S. pombe
gacgctccttttactgtcaatgaaa

SEQ ID NO: 92890 - DNA, 25 bp, S. pombe
gacgctgactttataaaaccattgg

SEQ ID NO: 92891 - DNA, 25 bp, S. pombe
gagcctgttactgttgaaaccgtga

SEQ ID NO: 92892 - DNA, 25 bp, S. pombe
gaccatccttcgcttgtatcaaacg

SEQ ID NO: 92893 - DNA, 25 bp, S. pombe
gaccggcttatcctgctgatgagag

SEQ ID NO: 92894 - DNA, 25 bp, S. pombe
gacgctcctgaatatatgcctgcta

SEQ ID NO: 92895 - DNA, 25 bp, S. pombe
gacgctattgaattactctctgcta

SEQ ID NO: 92896 - DNA, 25 bp, S. pombe
gacgctgatctgcaaacctcaattt

SEQ ID NO: 92897 - DNA, 25 bp, S. pombe
gacccctcaattgccggttgaatac

SEQ ID NO: 92898 - DNA, 25 bp, S. pombe
gaccaccgatggtaccaccaaggat

SEQ ID NO: 92899 - DNA, 25 bp, S. pombe
gacccggtggatttaatcgtccatt

SEQ ID NO: 92900 - DNA, 25 bp, S. pombe
gaccttcgtcgaggaaatcttcctg

SEQ ID NO: 92901 - DNA, 25 bp, S. pombe
gaccccgtctgcgatgaattttttg

SEQ ID NO: 92902 - DNA, 25 bp, S. pombe
gacgccttgaggaaaatacatatca

SEQ ID NO: 92903 - DNA, 25 bp, S. pombe
gaccgcttcattagacaccaacatt

SEQ ID NO: 92904 - DNA, 25 bp, S. pombe
gagcttgcccgtaagcccaaatatg

SEQ ID NO: 92905 - DNA, 25 bp, S. pombe
gaccaaagcattaatttccctaggg

SEQ ID NO: 92906 - DNA, 25 bp, S. pombe
gacccagacgactatattcaccgag

SEQ ID NO: 92907 - DNA, 25 bp, S. pombe
gacgccggctatgatggctcagtat

SEQ ID NO: 92908 - DNA, 25 bp, S. pombe
gaccctgatgcaaagatggccgtat

SEQ ID NO: 92909 - DNA, 25 bp, S. pombe
gaccgctctgtgaaggatcttgcta

SEQ ID NO: 92910 - DNA, 25 bp, S. pombe
gacgcgtgcatgttacagtcttcaa

SEQ ID NO: 92911 - DNA, 25 bp, S. pombe
gacgcgctgcttaaggtagatcaaa

SEQ ID NO: 92912 - DNA, 25 bp, S. pombe
gaccatgttggtcgcatacagacga

SEQ ID NO: 92913 - DNA, 25 bp, S. pombe
gagcgtcagactgcaacgttggctt

SEQ ID NO: 92914 - DNA, 25 bp, S. pombe
gaccctatggatactgacacttctg

SEQ ID NO: 92915 - DNA, 25 bp, S. pombe
gaccgttactacatatgcacctaca

SEQ ID NO: 92916 - DNA, 25 bp, S. pombe
gacctttacttcctgtttatccaga

SEQ ID NO: 92917 - DNA, 25 bp, S. pombe
gaccaaggttatttgtcccgtgaca

SEQ ID NO: 92918 - DNA, 25 bp, S. pombe
gacctagagtttgtcggacttgtca

SEQ ID NO: 92919 - DNA, 25 bp, S. pombe
gacgccaaatcgatggtttctttac

SEQ ID NO: 92920 - DNA, 25 bp, S. pombe
gacgccaaacgtgttatcttcttta

SEQ ID NO: 92921 - DNA, 25 bp, S. pombe
gacccgtaggcttattgatctttta

SEQ ID NO: 92922 - DNA, 25 bp, S. pombe
gaccctgctggtttctatattggtt

SEQ ID NO: 92923 - DNA, 25 bp, S. pombe
gatccaggatggtgactttgtattc

SEQ ID NO: 92924 - DNA, 25 bp, S. pombe
gacctgatgccccagtaagctggag

SEQ ID NO: 92925 - DNA, 25 bp, S. pombe
gaccgtcagctcatgagaccttgat

SEQ ID NO: 92926 - DNA, 25 bp, S. pombe
gagccatctatacgcattatctgca

SEQ ID NO: 92927 - DNA, 25 bp, S. pombe
gaccggaactcttttggcattgcaa

SEQ ID NO: 92928 - DNA, 25 bp, S. pombe
gattcgttactgaacttggtcgtat

SEQ ID NO: 92929 - DNA, 25 bp, S. pombe
gaccgattcacagagttcgatcttt

SEQ ID NO: 92930 - DNA, 25 bp, S. pombe
gagcggttacgtactttacttatat

SEQ ID NO: 92931 - DNA, 25 bp, S. pombe
gagggaacctttgttgtttatgcat

SEQ ID NO: 92932 - DNA, 25 bp, S. pombe
gagcgcgaagccgtcttttctaaac

SEQ ID NO: 92933 - DNA, 25 bp, S. pombe
gaccaaagctatggcgtttcttcaa

SEQ ID NO: 92934 - DNA, 25 bp, S. pombe
gagcaaaaacccgtatgagtcttta

SEQ ID NO: 92935 - DNA, 25 bp, S. pombe
gagctcaaaaactcctttcttaggg

SEQ ID NO: 92936 - DNA, 25 bp, S. pombe
gagcgctattaaccaagtcgtcact

SEQ ID NO: 92937 - DNA, 25 bp, S. pombe
gacctcacttattctcaatggctat

SEQ ID NO: 92938 - DNA, 25 bp, S. pombe
gagcctttgtttttagtctactatc

SEQ ID NO: 92939 - DNA, 25 bp, S. pombe
gacccctttgagaaccttgatgaaa

SEQ ID NO: 92940 - DNA, 25 bp, S. pombe
gaccaggattgggaacttcttgaaa

SEQ ID NO: 92941 - DNA, 25 bp, S. pombe
gagcccgtaggccatgatatacagc

SEQ ID NO: 92942 - DNA, 25 bp, S. pombe
gaccctgtagctcgtgaagatcatg

SEQ ID NO: 92943 - DNA, 25 bp, S. pombe
gacccttccgtcgtatgcttgaata

SEQ ID NO: 92944 - DNA, 25 bp, S. pombe
gaccgctgatagtttgtcgtatccc

SEQ ID NO: 92945 - DNA, 25 bp, S. pombe
gaccgtgaagctttgcgtaactcga

SEQ ID NO: 92946 - DNA, 25 bp, S. pombe
gaccacattcgtgttttacttgaaa

SEQ ID NO: 92947 - DNA, 25 bp, S. pombe
gaccgtatcgctgatgaatttgcaa

SEQ ID NO: 92948 - DNA, 25 bp, S. pombe
gaccggatctccctatattatgaac

SEQ ID NO: 92949 - DNA, 25 bp, S. pombe
gaccgctgtccctatattgattgga

SEQ ID NO: 92950 - DNA, 25 bp, S. pombe
gaccgctatcactttactgttggga

SEQ ID NO: 92951 - DNA, 25 bp, S. pombe
gaccgcatttgatatagctgtttcg

SEQ ID NO: 92952 - DNA, 25 bp, S. pombe
gagcggatgttattcggtacttcgt

SEQ ID NO: 92953 - DNA, 25 bp, S. pombe
gacctgtctctatcattcatttcga

SEQ ID NO: 92954 - DNA, 25 bp, S. pombe
gaccgtgcgctgaacattgttccaa

SEQ ID NO: 92955 - DNA, 25 bp, S. pombe
gaccgtcatatcaacctgtctgatt

SEQ ID NO: 92956 - DNA, 25 bp, S. pombe
gagcactttttatcgcttcaggatc

SEQ ID NO: 92957 - DNA, 25 bp, S. pombe
gaccttttcgtttgtgtgcattgta

SEQ ID NO: 92958 - DNA, 25 bp, S. pombe
gaccttttcgccgttggattatcga

SEQ ID NO: 92959 - DNA, 25 bp, S. pombe
gaccttttatgcgtctttcttacga

SEQ ID NO: 92960 - DNA, 25 bp, S. pombe
gaccgattgccatgtttcgcttaag

SEQ ID NO: 92961 - DNA, 25 bp, S. pombe
gaccaggacacattgttcccttaag

SEQ ID NO: 92962 - DNA, 25 bp, S. pombe
gaccgagctagttatactcctcaac

SEQ ID NO: 92963 - DNA, 25 bp, S. pombe
gacctggtagtatcagcaccgctga

SEQ ID NO: 92964 - DNA, 25 bp, S. pombe
gagcccgtcgtattcaccgactagt

SEQ ID NO: 92965 - DNA, 25 bp, S. pombe
gagccatcccagtatgtcaacgacg

SEQ ID NO: 92966 - DNA, 25 bp, S. pombe
gagtaccacagactgagttcaggcg

SEQ ID NO: 92967 - DNA, 25 bp, S. pombe
gaccacggtagccactgtaaatcat

SEQ ID NO: 92968 - DNA, 25 bp, S. pombe
gaccaacaatgattccgctcaaact

SEQ ID NO: 92969 - DNA, 25 bp, S. pombe
gaccaaatcatttccaccaattcta

SEQ ID NO: 92970 - DNA, 25 bp, S. pombe
gaccatgtcctcatctacttttatt

SEQ ID NO: 92971 - DNA, 25 bp, S. pombe
gagcgaagccatatttgccattaat

SEQ ID NO: 92972 - DNA, 25 bp, S. pombe
gaccatggagcccattttcatttag

SEQ ID NO: 92973 - DNA, 25 bp, S. pombe
gaccgcgattcttctatacttgttt

SEQ ID NO: 92974 - DNA, 25 bp, S. pombe
gagctcggtttccttcgttatttga

SEQ ID NO: 92975 - DNA, 25 bp, S. pombe
gaccagggtctttcatgaggcatat

SEQ ID NO: 92976 - DNA, 25 bp, S. pombe
gaccatggtgtttttgtgccattca

SEQ ID NO: 92977 - DNA, 25 bp, S. pombe
gacccctctgacgttgatttactaa

SEQ ID NO: 92978 - DNA, 25 bp, S. pombe
gaccactcgtcgcttacatttaaat

SEQ ID NO: 92979 - DNA, 25 bp, S. pombe
gaccgtattgtttatttctcatttg

SEQ ID NO: 92980 - DNA, 25 bp, S. pombe
gaccgcatactgtctacttggtttt

SEQ ID NO: 92981 - DNA, 25 bp, S. pombe
gaccactacggcgactttacattta

SEQ ID NO: 92982 - DNA, 25 bp, S. pombe
tgaccgctatcgctaaattaacact

SEQ ID NO: 92983 - DNA, 25 bp, S. pombe
gagcccttcgtatacattaatcctg

SEQ ID NO: 92984 - DNA, 25 bp, S. pombe
gagctaccggtgtgtgtatcttgaa

SEQ ID NO: 92985 - DNA, 25 bp, S. pombe
gatcccggacagaaacttgccattt

SEQ ID NO: 92986 - DNA, 25 bp, S. pombe
gacctcgataaatgctctcataccg

SEQ ID NO: 92987 - DNA, 25 bp, S. pombe
gaccagagattatcccgtcaatcag

SEQ ID NO: 92988 - DNA, 25 bp, S. pombe
gatccgaactcgtctgttaaacctt

SEQ ID NO: 92989 - DNA, 25 bp, S. pombe
gaggcaaaccgtgagcttcatgagc

SEQ ID NO: 92990 - DNA, 25 bp, S. pombe
gagccgacaatcctaccatcaaaga

SEQ ID NO: 92991 - DNA, 25 bp, S. pombe
gagcgcgcagttcgtacttggaaac

SEQ ID NO: 92992 - DNA, 25 bp, S. pombe
gaccgatagtctcgcatttggtata

SEQ ID NO: 92993 - DNA, 25 bp, S. pombe
gaccatggagatttggacgaccaaa

SEQ ID NO: 92994 - DNA, 25 bp, S. pombe
gaccaggcagcaattcgacgagaat

SEQ ID NO: 92995 - DNA, 25 bp, S. pombe
gaccattctatctttgaggccttta

SEQ ID NO: 92996 - DNA, 25 bp, S. pombe
gagcttttaaactacaccgtgtgca

SEQ ID NO: 92997 - DNA, 25 bp, S. pombe
gaccatctttatgagagccgtcggt

SEQ ID NO: 92998 - DNA, 25 bp, S. pombe
gagcgttctgcagattgttttcggc

SEQ ID NO: 92999 - DNA, 25 bp, S. pombe
gagcctttatccgaaattgggtcta

SEQ ID NO: 93000 - DNA, 25 bp, S. pombe
gaggtctttcgccagatttgaactc

SEQ ID NO: 93001 - DNA, 25 bp, S. pombe
gagcgtgctgatcttggtttgaaca

SEQ ID NO: 93002 - DNA, 25 bp, S. pombe
gagcgtgttcctgttttcgagaaga

SEQ ID NO: 93003 - DNA, 25 bp, S. pombe
gagctttagtccgaattcctccttc

SEQ ID NO: 93004 - DNA, 25 bp, S. pombe
gaccttttcccaatcatcttttgat

SEQ ID NO: 93005 - DNA, 25 bp, S. pombe
gacctcgtactcgttatgattttgt

SEQ ID NO: 93006 - DNA, 25 bp, S. pombe
gaccggtcaattcccagctaattat

SEQ ID NO: 93007 - DNA, 25 bp, S. pombe
gagccggtatatctctactacagaa

SEQ ID NO: 93008 - DNA, 25 bp, S. pombe
gagcgcgtaatacaatccaagcgaa

SEQ ID NO: 93009 - DNA, 25 bp, S. pombe
gagccggtattatccacagtacaag

SEQ ID NO: 93010 - DNA, 25 bp, S. pombe
gagccgttacctacctatgaacaat

SEQ ID NO: 93011 - DNA, 25 bp, S. pombe
gagccgctgaacttacacgtaatga

SEQ ID NO: 93012 - DNA, 25 bp, S. pombe
gagccgcgaagaataacgaaatcag

SEQ ID NO: 93013 - DNA, 25 bp, S. pombe
gagcttaagattcctgttcgcatga

SEQ ID NO: 93014 - DNA, 25 bp, S. pombe
gacctacaatgttttcacggcgagc

SEQ ID NO: 93015 - DNA, 25 bp, S. pombe
gacctggtatgttcattctcgtcag

SEQ ID NO: 93016 - DNA, 25 bp, S. pombe
gacctgctgaaattgcattctcgta

SEQ ID NO: 93017 - DNA, 25 bp, S. pombe
gacctctgttgagtattcacactga

SEQ ID NO: 93018 - DNA, 25 bp, S. pombe
gagaccgacttggaagcacctagtt

SEQ ID NO: 93019 - DNA, 25 bp, S. pombe
gagcgtcgtttgcaaactcaagtct

SEQ ID NO: 93020 - DNA, 25 bp, S. pombe
gagcggtttcttcctactaaatcat

SEQ ID NO: 93021 - DNA, 25 bp, S. pombe
gagcggtgagtttttacaagccaat

SEQ ID NO: 93022 - DNA, 25 bp, S. pombe
gagctgcctcgtatttacaacaggt

SEQ ID NO: 93023 - DNA, 25 bp, S. pombe
gagctccttgctgcttataaacgcg

SEQ ID NO: 93024 - DNA, 25 bp, S. pombe
gaccatgtgtgtctggcgctatgaa

SEQ ID NO: 93025 - DNA, 25 bp, S. pombe
gacctgtgagtcttgctcgattgaa

SEQ ID NO: 93026 - DNA, 25 bp, S. pombe
gaccagacttgcaacaacttgcggt

SEQ ID NO: 93027 - DNA, 25 bp, S. pombe
gagccattgttatcacgtactcctc

SEQ ID NO: 93028 - DNA, 25 bp, S. pombe
gaccttttagaaatgggatgcctca

SEQ ID NO: 93029 - DNA, 25 bp, S. pombe
gagcctttcaatactgctcgaaacc

SEQ ID NO: 93030 - DNA, 25 bp, S. pombe
gagcgagttatttctttgaaccccg

SEQ ID NO: 93031 - DNA, 25 bp, S. pombe
gagcgtgttgataccttgatgaagc

SEQ ID NO: 93032 - DNA, 25 bp, S. pombe
gagcgtgttctcatcaagattgcct

SEQ ID NO: 93033 - DNA, 25 bp, S. pombe
gagctgaaagcgtctgcaccgatat

SEQ ID NO: 93034 - DNA, 25 bp, S. pombe
gagccgcagctaccaaatatcgatt

SEQ ID NO: 93035 - DNA, 25 bp, S. pombe
gagtcagcagtttcaaaaggcttac

SEQ ID NO: 93036 - DNA, 25 bp, S. pombe
gaccaagtctcgatcatttcactag

SEQ ID NO: 93037 - DNA, 25 bp, S. pombe
gagcctacagctttgtatttgcagc

SEQ ID NO: 93038 - DNA, 25 bp, S. pombe
gacctgcccatagcgttcatgaaaa

SEQ ID NO: 93039 - DNA, 25 bp, S. pombe
gagccagacgcttcggttgataaca

SEQ ID NO: 93040 - DNA, 25 bp, S. pombe
gagccaacctatcggatcctgaaaa

SEQ ID NO: 93041 - DNA, 25 bp, S. pombe
gagcttgagactcttcgtacaaagt

SEQ ID NO: 93042 - DNA, 25 bp, S. pombe
gagcgtgagcttcttcttgcaaaag

SEQ ID NO: 93043 - DNA, 25 bp, S. pombe
gagcgtcgtaccatcttcaaggagt

SEQ ID NO: 93044 - DNA, 25 bp, S. pombe
gagcgctcagtagatcctaataatg

SEQ ID NO: 93045 - DNA, 25 bp, S. pombe
gagcatgcaatcaactggttaccaa

SEQ ID NO: 93046 - DNA, 25 bp, S. pombe
gagcgcaacaactcattgactgctg

SEQ ID NO: 93047 - DNA, 25 bp, S. pombe
gagccattagcagccttgttgcaga

SEQ ID NO: 93048 - DNA, 25 bp, S. pombe
gaccttctgaggattttgctaacat

SEQ ID NO: 93049 - DNA, 25 bp, S. pombe
gaccacgctttatttctgtcaagaa

SEQ ID NO: 93050 - DNA, 25 bp, S. pombe
gaccttgcgttatattggcctgaca

SEQ ID NO: 93051 - DNA, 25 bp, S. pombe
gacctatttggtgctgtttgtgaac

SEQ ID NO: 93052 - DNA, 25 bp, S. pombe
gagcctgatgttgatcttcctggac

SEQ ID NO: 93053 - DNA, 25 bp, S. pombe
gacctttatttcttgctctgatacc

SEQ ID NO: 93054 - DNA, 25 bp, S. pombe
gaccattccttgtatttctgactgt

SEQ ID NO: 93055 - DNA, 25 bp, S. pombe
gaccagccactatgatttatttatg

SEQ ID NO: 93056 - DNA, 25 bp, S. pombe
gacctttgagattgtggctacctta

SEQ ID NO: 93057 - DNA, 25 bp, S. pombe
gaccttgacgagttacgccagtttt

SEQ ID NO: 93058 - DNA, 25 bp, S. pombe
gaccttaccagctacatcgagagag

SEQ ID NO: 93059 - DNA, 25 bp, S. pombe
gagccactaagtccaatgctggtgt

SEQ ID NO: 93060 - DNA, 25 bp, S. pombe
gagcctgaaagtccatatctgttat

SEQ ID NO: 93061 - DNA, 25 bp, S. pombe
gaccaagtcacttttgagcgggaca

SEQ ID NO: 93062 - DNA, 25 bp, S. pombe
gacctattcactttgttgcagcaga

SEQ ID NO: 93063 - DNA, 25 bp, S. pombe
gaccttgttgctcccaatgaacatg

SEQ ID NO: 93064 - DNA, 25 bp, S. pombe
gagccatttacttcagcgagacata

SEQ ID NO: 93065 - DNA, 25 bp, S. pombe
gagctattcacggacaggagcataa

SEQ ID NO: 93066 - DNA, 25 bp, S. pombe
gagcagtccctctaagtggcatgga

SEQ ID NO: 93067 - DNA, 25 bp, S. pombe
gagcgtccctcaagatttgcgagac

SEQ ID NO: 93068 - DNA, 25 bp, S. pombe
gaccagctaatgtttttccagattt

SEQ ID NO: 93069 - DNA, 25 bp, S. pombe
gagcccaatgtatcttttctagcag

SEQ ID NO: 93070 - DNA, 25 bp, S. pombe
gagcccatcgtattcgcctactagt

SEQ ID NO: 93071 - DNA, 25 bp, S. pombe
gaccattcgcaaacgcttcaaagat

SEQ ID NO: 93072 - DNA, 25 bp, S. pombe
gagcagcctgatgaaccaaacgtaa

SEQ ID NO: 93073 - DNA, 25 bp, S. pombe
gaccacttctcctatgtcaatggaa

SEQ ID NO: 93074 - DNA, 25 bp, S. pombe
gagcagcaatactgctattccgtta

SEQ ID NO: 93075 - DNA, 25 bp, S. pombe
gagcagcaatactgctattccgtta

SEQ ID NO: 93076 - DNA, 25 bp, S. pombe
gaccacggacgaatctaatttctca

SEQ ID NO: 93077 - DNA, 25 bp, S. pombe
gatcgcaagtcggtttaactcccat

SEQ ID NO: 93078 - DNA, 25 bp, S. pombe
gagcctaacggtactaagcgtccat

SEQ ID NO: 93079 - DNA, 25 bp, S. pombe
gagccaaatgctcttcaaaggttta

SEQ ID NO: 93080 - DNA, 25 bp, S. pombe
gagcgaatgcttgcttcaaaggctt

SEQ ID NO: 93081 - DNA, 25 bp, S. pombe
gagccagtgcctgtagaaactctgt

SEQ ID NO: 93082 - DNA, 25 bp, S. pombe
gagcaagcacgcgactatgtttatg

SEQ ID NO: 93083 - DNA, 25 bp, S. pombe
gaccactttcgtttgccagtatgga

SEQ ID NO: 93084 - DNA, 25 bp, S. pombe
gagcctcgactttttgctcgattgg

SEQ ID NO: 93085 - DNA, 25 bp, S. pombe
gaccacggatcggacaccaattgag

SEQ ID NO: 93086 - DNA, 25 bp, S. pombe
gaccttggtcagaatcacgattttg

SEQ ID NO: 93087 - DNA, 25 bp, S. pombe
gagccgctagtatacatgctgccca

SEQ ID NO: 93088 - DNA, 25 bp, S. pombe
gagcgtatgctagttcgatctggga

SEQ ID NO: 93089 - DNA, 25 bp, S. pombe
gagctgtcactctatgtggttggat

SEQ ID NO: 93090 - DNA, 25 bp, S. pombe
gagcattacgaacttttggatcccc

SEQ ID NO: 93091 - DNA, 25 bp, S. pombe
gagcttcaatctgttgttcaacctg

SEQ ID NO: 93092 - DNA, 25 bp, S. pombe
gagcctagcactgttgttaccacta

SEQ ID NO: 93093 - DNA, 25 bp, S. pombe
gagcgtaacttttttactcctaatg

SEQ ID NO: 93094 - DNA, 25 bp, S. pombe
gagcctccgattattccaaagcttg

SEQ ID NO: 93095 - DNA, 25 bp, S. pombe
gagcctgtaccaagactcatgtcaa

SEQ ID NO: 93096 - DNA, 25 bp, S. pombe
gagccaatgctgcagactttgtcac

SEQ ID NO: 93097 - DNA, 25 bp, S. pombe
gagccttctgcttatcttgattcag

SEQ ID NO: 93098 - DNA, 25 bp, S. pombe
gagcctgaccaagagatgcatacta

SEQ ID NO: 93099 - DNA, 25 bp, S. pombe
gagcactatgcctcgattaacatta

SEQ ID NO: 93100 - DNA, 25 bp, S. pombe
gagcgattgccatagtgatcccatt

SEQ ID NO: 93101 - DNA, 25 bp, S. pombe
gaccaagatactgagaagccatcaa

SEQ ID NO: 93102 - DNA, 25 bp, S. pombe
gagccgtgctagaagaattccttta

SEQ ID NO: 93103 - DNA, 25 bp, S. pombe
gaggctggacaattggttgaccttt

SEQ ID NO: 93104 - DNA, 25 bp, S. pombe
gagccttcagctttagattaccttt

SEQ ID NO: 93105 - DNA, 25 bp, S. pombe
gagcttggactaccgatgaactctt

SEQ ID NO: 93106 - DNA, 25 bp, S. pombe
gagcgctgtaattacctcagtgctg

SEQ ID NO: 93107 - DNA, 25 bp, S. pombe
gagcgccttatggatgtacaacttt

SEQ ID NO: 93108 - DNA, 25 bp, S. pombe
gagcgccaagatatgtcagattttt

SEQ ID NO: 93109 - DNA, 25 bp, S. pombe
gagcataacgatgtccgattcttct

SEQ ID NO: 93110 - DNA, 25 bp, S. pombe
gagcttactttcagggtccattgat

SEQ ID NO: 93111 - DNA, 25 bp, S. pombe
gagctatatcacaacgttactacga

SEQ ID NO: 93112 - DNA, 25 bp, S. pombe
gagccagtaggatctttgcccaaga

SEQ ID NO: 93113 - DNA, 25 bp, S. pombe
gagccagttctacgatctgtgcaca

SEQ ID NO: 93114 - DNA, 25 bp, S. pombe
gagccgttactcctggtcaagtcat

SEQ ID NO: 93115 - DNA, 25 bp, S. pombe
gagctcagggtatgcgtccagtgac

SEQ ID NO: 93116 - DNA, 25 bp, S. pombe
gagcttgttgtgcagtttccagatt

SEQ ID NO: 93117 - DNA, 25 bp, S. pombe
gaccagcttgagcagtcagaagaaa

SEQ ID NO: 93118 - DNA, 25 bp, S. pombe
gagcctgttgctccttcaaaagata

SEQ ID NO: 93119 - DNA, 25 bp, S. pombe
gagccaattgctcattcagtagatt

SEQ ID NO: 93120 - DNA, 25 bp, S. pombe
gagcgatcatgccaaattcagttgt

SEQ ID NO: 93121 - DNA, 25 bp, S. pombe
gaccaacttgcttgtccagatgcat

SEQ ID NO: 93122 - DNA, 25 bp, S. pombe
gaccagcttttacatcttcattcat

SEQ ID NO: 93123 - DNA, 25 bp, S. pombe
gaccagaatttacttctcagcctac

SEQ ID NO: 93124 - DNA, 25 bp, S. pombe
gaccaatcttatactttcagactca

SEQ ID NO: 93125 - DNA, 25 bp, S. pombe
gagcctttatttgctgtcgttgaaa

SEQ ID NO: 93126 - DNA, 25 bp, S. pombe
gagcctttaacttctgaggtcgaaa

SEQ ID NO: 93127 - DNA, 25 bp, S. pombe
gagctcgagttgttcagggtcattt

SEQ ID NO: 93128 - DNA, 25 bp, S. pombe
gagcagcctcaacaagcttttcatg

SEQ ID NO: 93129 - DNA, 25 bp, S. pombe
gagcctgagtacttatttacccgca

SEQ ID NO: 93130 - DNA, 25 bp, S. pombe
gagcttttagctaatctcggtaact

SEQ ID NO: 93131 - DNA, 25 bp, S. pombe
gagcttcctatgcacatgctaggct

SEQ ID NO: 93132 - DNA, 25 bp, S. pombe
gagcattgcgtatcactgttggcac

SEQ ID NO: 93133 - DNA, 25 bp, S. pombe
gagaagcgtaacacccgacgtgaaa

SEQ ID NO: 93134 - DNA, 25 bp, S. pombe
gagacaggtacctccaactttggta

SEQ ID NO: 93135 - DNA, 25 bp, S. pombe
gagcgcttgttggtcatcgtattat

SEQ ID NO: 93136 - DNA, 25 bp, S. pombe
gagccattgttcgtactggaatcac

SEQ ID NO: 93137 - DNA, 25 bp, S. pombe
gaccactggtctttctaagcttgca

SEQ ID NO: 93138 - DNA, 25 bp, S. pombe
gagcccggattgtactgagagcctt

SEQ ID NO: 93139 - DNA, 25 bp, S. pombe
gagcagggcgatgtaattcccgaaa

SEQ ID NO: 93140 - DNA, 25 bp, S. pombe
gagggaggtcctattccgttagata

SEQ ID NO: 93141 - DNA, 25 bp, S. pombe
gaggaaacttcgcttccttagagaa

SEQ ID NO: 93142 - DNA, 25 bp, S. pombe
gaggataagcttcatttcgtccaaa

SEQ ID NO: 93143 - DNA, 25 bp, S. pombe
gagcctttagacactgtttcctcat

SEQ ID NO: 93144 - DNA, 25 bp, S. pombe
gagccaggcattattccaggtttta

SEQ ID NO: 93145 - DNA, 25 bp, S. pombe
gagccagaattgacgcgccaggtgt

SEQ ID NO: 93146 - DNA, 25 bp, S. pombe
gagcgacccgtaatgcaagaattgc

SEQ ID NO: 93147 - DNA, 25 bp, S. pombe
gagattttgtatgaaccccttaaag

SEQ ID NO: 93148 - DNA, 25 bp, S. pombe
gagctgctttattctttacccgtaa

SEQ ID NO: 93149 - DNA, 25 bp, S. pombe
gagcctttacctatcaactgtctaa

SEQ ID NO: 93150 - DNA, 25 bp, S. pombe
gagctccaaacggtccaactgtaaa

SEQ ID NO: 93151 - DNA, 25 bp, S. pombe
gagcctgctgacaaccaaatagatt

SEQ ID NO: 93152 - DNA, 25 bp, S. pombe
gagctgccgcatctgtacaaaacaa

SEQ ID NO: 93153 - DNA, 25 bp, S. pombe
gagctgctgctaatggtgccccaaa

SEQ ID NO: 93154 - DNA, 25 bp, S. pombe
gagcttaattcttctcccgaagtca

SEQ ID NO: 93155 - DNA, 25 bp, S. pombe
gagcttattcgcctattgccagaag

SEQ ID NO: 93156 - DNA, 25 bp, S. pombe
gagcgctataagcatattcctgaaa

SEQ ID NO: 93157 - DNA, 25 bp, S. pombe
gataacgaggctttactttaccaag

SEQ ID NO: 93158 - DNA, 25 bp, S. pombe
gagaacgtcgtgcttttaggtgaat

SEQ ID NO: 93159 - DNA, 25 bp, S. pombe
gagccacactttagtctgattactg

SEQ ID NO: 93160 - DNA, 25 bp, S. pombe
gagccacgttacgactctacatgga

SEQ ID NO: 93161 - DNA, 25 bp, S. pombe
gagccactatggcaacctttggagg

SEQ ID NO: 93162 - DNA, 25 bp, S. pombe
gagccactattgctgtttcttgggc

SEQ ID NO: 93163 - DNA, 25 bp, S. pombe
gagctatggatttgcctataaccgc

SEQ ID NO: 93164 - DNA, 25 bp, S. pombe
gagctgattgtgtcggcatgtctac

SEQ ID NO: 93165 - DNA, 25 bp, S. pombe
gagcgtttccagcttgagtttcacg

SEQ ID NO: 93166 - DNA, 25 bp, S. pombe
gagcctacagctattgttgctttcc

SEQ ID NO: 93167 - DNA, 25 bp, S. pombe
gagcctactgccagttggctatgat

SEQ ID NO: 93168 - DNA, 25 bp, S. pombe
gagcacataccccagttggtggaaa

SEQ ID NO: 93169 - DNA, 25 bp, S. pombe
gagtcaaccgactaatctagggagg

SEQ ID NO: 93170 - DNA, 25 bp, S. pombe
gagccattgcttacattaccagtca

SEQ ID NO: 93171 - DNA, 25 bp, S. pombe
gagcgcaactcactttatctgacga

SEQ ID NO: 93172 - DNA, 25 bp, S. pombe
gagcgctcatcacatggagttcttc

SEQ ID NO: 93173 - DNA, 25 bp, S. pombe
gagcgccacataattacttcttcac

SEQ ID NO: 93174 - DNA, 25 bp, S. pombe
gagcccgcaatcttttttatcaagg

SEQ ID NO: 93175 - DNA, 25 bp, S. pombe
gagccacgtttgatgactcaatatc

SEQ ID NO: 93176 - DNA, 25 bp, S. pombe
gagccattgaggacttgatccctga

SEQ ID NO: 93177 - DNA, 25 bp, S. pombe
gagcttgggtacatggccgctcaag

SEQ ID NO: 93178 - DNA, 25 bp, S. pombe
gagccttcgttgaagcaggtcatta

SEQ ID NO: 93179 - DNA, 25 bp, S. pombe
gagctttcgtcaaatgaggttcgca

SEQ ID NO: 93180 - DNA, 25 bp, S. pombe
gagcttctctttttcaggcttggag

SEQ ID NO: 93181 - DNA, 25 bp, S. pombe
gagcttacttgttcagagcctttaa

SEQ ID NO: 93182 - DNA, 25 bp, S. pombe
gagcctattcgatctcgtacgttaa

SEQ ID NO: 93183 - DNA, 25 bp, S. pombe
gagccatcttcataatcgtccaatt

SEQ ID NO: 93184 - DNA, 25 bp, S. pombe
gagctattcgcaaactgcgtccaat

SEQ ID NO: 93185 - DNA, 25 bp, S. pombe
gagctttccactttgcgtaaatttc

SEQ ID NO: 93186 - DNA, 25 bp, S. pombe
gagcctccggacttaatggaatttt

SEQ ID NO: 93187 - DNA, 25 bp, S. pombe
ggcactccgggcttttacaaagtat

SEQ ID NO: 93188 - DNA, 25 bp, S. pombe
gagacccgcgtctgttagacaaata

SEQ ID NO: 93189 - DNA, 25 bp, S. pombe
gagcccgtgagcgttttaaaaatca

SEQ ID NO: 93190 - DNA, 25 bp, S. pombe
gagcccttctcagttttcaaatcaa

SEQ ID NO: 93191 - DNA, 25 bp, S. pombe
gagcctttaactcttgacgaagaat

SEQ ID NO: 93192 - DNA, 25 bp, S. pombe
gagccttctatcactttaccaaaat

SEQ ID NO: 93193 - DNA, 25 bp, S. pombe
gagcttcaaaagcttatggcttata

SEQ ID NO: 93194 - DNA, 25 bp, S. pombe
gagcctgtagacaaacttccacttt

SEQ ID NO: 93195 - DNA, 25 bp, S. pombe
gagccttcaggtacatatttccgtt

SEQ ID NO: 93196 - DNA, 25 bp, S. pombe
gagaactgggttctgttacctcatc

SEQ ID NO: 93197 - DNA, 25 bp, S. pombe
gagaaggtcttaccattatccctcc

SEQ ID NO: 93198 - DNA, 25 bp, S. pombe
gagcagctgctatcaaagaccatac

SEQ ID NO: 93199 - DNA, 25 bp, S. pombe
gagcgatgatgatgcaaattctata

SEQ ID NO: 93200 - DNA, 25 bp, S. pombe
gagctgagaaacctcctgtacacac

SEQ ID NO: 93201 - DNA, 25 bp, S. pombe
gagcatgccagtacgttggtaacac

SEQ ID NO: 93202 - DNA, 25 bp, S. pombe
gagctgtcgatagtttggccccact

SEQ ID NO: 93203 - DNA, 25 bp, S. pombe
gagctctttgccgagtacaaatcat

SEQ ID NO: 93204 - DNA, 25 bp, S. pombe
gagcctccgagcgtgctgaaagaga

SEQ ID NO: 93205 - DNA, 25 bp, S. pombe
gagcgccccactatgatcaaatatg

SEQ ID NO: 93206 - DNA, 25 bp, S. pombe
gagctgcctctgctgtaattactag

SEQ ID NO: 93207 - DNA, 25 bp, S. pombe
gagctgtttcagcttcttcggtaaa

SEQ ID NO: 93208 - DNA, 25 bp, S. pombe
gagctttacgtgatactctttcaaa

SEQ ID NO: 93209 - DNA, 25 bp, S. pombe
gagccgtcaaggtccgcaagcataa

SEQ ID NO: 93210 - DNA, 25 bp, S. pombe
gagcctgtaagctgctagaccaaat

SEQ ID NO: 93211 - DNA, 25 bp, S. pombe
gagcgcttagagtgcttactggaaa

SEQ ID NO: 93212 - DNA, 25 bp, S. pombe
gagcgtacaggaagcttactcgaca

SEQ ID NO: 93213 - DNA, 25 bp, S. pombe
gagctcatcgtatcggtcagcaaaa

SEQ ID NO: 93214 - DNA, 25 bp, S. pombe
gagctgcatcggtggtctccaaaac

SEQ ID NO: 93215 - DNA, 25 bp, S. pombe
gagcgcattcattcatatctacagt

SEQ ID NO: 93216 - DNA, 25 bp, S. pombe
gagcgcgtgctaatcatatggaatc

SEQ ID NO: 93217 - DNA, 25 bp, S. pombe
gagcgttgattttttgacatcttct

SEQ ID NO: 93218 - DNA, 25 bp, S. pombe
gagcggcttagattgcatttttcag

SEQ ID NO: 93219 - DNA, 25 bp, S. pombe
gagcggctttctgaagctgtgcaat

SEQ ID NO: 93220 - DNA, 25 bp, S. pombe
gagcatttgtcgtgcaagagtctaa

SEQ ID NO: 93221 - DNA, 25 bp, S. pombe
gagcattggctctccgaatttactg

SEQ ID NO: 93222 - DNA, 25 bp, S. pombe
gagcatgctgcctccaaattggaaa

SEQ ID NO: 93223 - DNA, 25 bp, S. pombe
gagctcgctctgacggtaatgggaa

SEQ ID NO: 93224 - DNA, 25 bp, S. pombe
gagatcgatgctcagttgcaagctg

SEQ ID NO: 93225 - DNA, 25 bp, S. pombe
gagcgtgctgtggatgttcaatgtt

SEQ ID NO: 93226 - DNA, 25 bp, S. pombe
gagctgctggtggatccgagattac

SEQ ID NO: 93227 - DNA, 25 bp, S. pombe
gagctaggtcctgagaagtatcgaa

SEQ ID NO: 93228 - DNA, 25 bp, S. pombe
gagctgaaccctataattgatcgta

SEQ ID NO: 93229 - DNA, 25 bp, S. pombe
gagctggagctctgttagtgtataa

SEQ ID NO: 93230 - DNA, 25 bp, S. pombe
gagcgtaatgaattcctcaattcca

SEQ ID NO: 93231 - DNA, 25 bp, S. pombe
gagctgttttcgattcagagtccga

SEQ ID NO: 93232 - DNA, 25 bp, S. pombe
gagcgtcatttggtgttagagtaca

SEQ ID NO: 93233 - DNA, 25 bp, S. pombe
gagcttccaggaattatgagccgtg

SEQ ID NO: 93234 - DNA, 25 bp, S. pombe
gagcatctagagcacttaacttctg

SEQ ID NO: 93235 - DNA, 25 bp, S. pombe
gagctagacagttttgaaccgatca

SEQ ID NO: 93236 - DNA, 25 bp, S. pombe
gagagtaatgttgtatcacccgatg

SEQ ID NO: 93237 - DNA, 25 bp, S. pombe
gagttgagcaatttttcctccgtcc

SEQ ID NO: 93238 - DNA, 25 bp, S. pombe
gagtttttaattcacgctgcagacg

SEQ ID NO: 93239 - DNA, 25 bp, S. pombe
gagaggagtatgcacccgtatcgat

SEQ ID NO: 93240 - DNA, 25 bp, S. pombe
gatgcgaatccagacaccggaggtt

SEQ ID NO: 93241 - DNA, 25 bp, S. pombe
gagcgcccgcgcatatggtgaaaca

SEQ ID NO: 93242 - DNA, 25 bp, S. pombe
gagcagcccgtattcttttgaagga

SEQ ID NO: 93243 - DNA, 25 bp, S. pombe
gagcgcctctatttctttcagaaaa

SEQ ID NO: 93244 - DNA, 25 bp, S. pombe
gagcgacgcttctttactcgataaa

SEQ ID NO: 93245 - DNA, 25 bp, S. pombe
gagcatgcgccttctttacttgaag

SEQ ID NO: 93246 - DNA, 25 bp, S. pombe
gagcccaatttagagcctgacgatc

SEQ ID NO: 93247 - DNA, 25 bp, S. pombe
gagaatctggtgatcgtctcacccg

SEQ ID NO: 93248 - DNA, 25 bp, S. pombe
gagacttgagtaccttggctgaccc

SEQ ID NO: 93249 - DNA, 25 bp, S. pombe
gagcatttcgttgttcggagacccg

SEQ ID NO: 93250 - DNA, 25 bp, S. pombe
gagctttcggatcttcggtatgcat

SEQ ID NO: 93251 - DNA, 25 bp, S. pombe
gagcttgccggtcctttgaaaatct

SEQ ID NO: 93252 - DNA, 25 bp, S. pombe
gagcttcctcctctattgaatacat

SEQ ID NO: 93253 - DNA, 25 bp, S. pombe
gagcttactccattttacctatcga

SEQ ID NO: 93254 - DNA, 25 bp, S. pombe
gaggaacgagcctactaccgacaag

SEQ ID NO: 93255 - DNA, 25 bp, S. pombe
gagcgacatctgctatgagccaatc

SEQ ID NO: 93256 - DNA, 25 bp, S. pombe
gagctcgtctttgcaacagttggaa

SEQ ID NO: 93257 - DNA, 25 bp, S. pombe
gagctcgcgctcattacaatttaaa

SEQ ID NO: 93258 - DNA, 25 bp, S. pombe
gagcggagccgttacagttgttaaa

SEQ ID NO: 93259 - DNA, 25 bp, S. pombe
gagcttgatgccgtacagcaatttt

SEQ ID NO: 93260 - DNA, 25 bp, S. pombe
gagctatgtagcttaacactggact

SEQ ID NO: 93261 - DNA, 25 bp, S. pombe
gagctgaacagcttttactggattt

SEQ ID NO: 93262 - DNA, 25 bp, S. pombe
gagcaatggcctaatcttccgatac

SEQ ID NO: 93263 - DNA, 25 bp, S. pombe
ggcaaaatcttatctccaaagtggg

SEQ ID NO: 93264 - DNA, 25 bp, S. pombe
gagcgtatcgctatacccaagactt

SEQ ID NO: 93265 - DNA, 25 bp, S. pombe
gagctgtatgatctttcccaggaca

SEQ ID NO: 93266 - DNA, 25 bp, S. pombe
gagcttcagcaaatcttctccaagt

SEQ ID NO: 93267 - DNA, 25 bp, S. pombe
gagcgatctcaagtttcctacagaa

SEQ ID NO: 93268 - DNA, 25 bp, S. pombe
gagcgtatttatgctgcttccagag

SEQ ID NO: 93269 - DNA, 25 bp, S. pombe
gagcaaccttatgccttagaagcca

SEQ ID NO: 93270 - DNA, 25 bp, S. pombe
gatatatctttgtggttccggaaat

SEQ ID NO: 93271 - DNA, 25 bp, S. pombe
gagcagccattaaggactttgtcca

SEQ ID NO: 93272 - DNA, 25 bp, S. pombe
gagcgcgtatgtaaactgttgtact

SEQ ID NO: 93273 - DNA, 25 bp, S. pombe
gagctcagtattattagtctggtca

SEQ ID NO: 93274 - DNA, 25 bp, S. pombe
gagctgctattcatctttatcgtga

SEQ ID NO: 93275 - DNA, 25 bp, S. pombe
gagctctgcttatacattcttatgg

SEQ ID NO: 93276 - DNA, 25 bp, S. pombe
gagcttatagctacggacccattta

SEQ ID NO: 93277 - DNA, 25 bp, S. pombe
gagcttataggtttatccactgttc

SEQ ID NO: 93278 - DNA, 25 bp, S. pombe
gagctcttcgatttcacacgatgag

SEQ ID NO: 93279 - DNA, 25 bp, S. pombe
gagtttcagcgctcatactggtgat

SEQ ID NO: 93280 - DNA, 25 bp, S. pombe
gatgtattacctttacgggtctcca

SEQ ID NO: 93281 - DNA, 25 bp, S. pombe
gagcatctttgcatgtatcaactac

SEQ ID NO: 93282 - DNA, 25 bp, S. pombe
gagcacttcctcttaaagttgcgga

SEQ ID NO: 93283 - DNA, 25 bp, S. pombe
gagcagtgtctttgaaaaaccggaa

SEQ ID NO: 93284 - DNA, 25 bp, S. pombe
gagcgtgttcttcatggagatcccg

SEQ ID NO: 93285 - DNA, 25 bp, S. pombe
gagctgtttcttcctgatgagtatc

SEQ ID NO: 93286 - DNA, 25 bp, S. pombe
gagcgtcttttatctgtttacaacc

SEQ ID NO: 93287 - DNA, 25 bp, S. pombe
gagcgtgcttcaaacactgactcat

SEQ ID NO: 93288 - DNA, 25 bp, S. pombe
gagcgtgtcttgactactgactata

SEQ ID NO: 93289 - DNA, 25 bp, S. pombe
gagctcctctggtttatttgacaat

SEQ ID NO: 93290 - DNA, 25 bp, S. pombe
gagcacgcttagagtctttgaatct

SEQ ID NO: 93291 - DNA, 25 bp, S. pombe
gagcttgcctacatcgttctgaatt

SEQ ID NO: 93292 - DNA, 25 bp, S. pombe
gagctatcttacatggtgtcttgaa

SEQ ID NO: 93293 - DNA, 25 bp, S. pombe
gagctttctgaagggtttcttgacg

SEQ ID NO: 93294 - DNA, 25 bp, S. pombe
gagcttccgaatattataatctgtg

SEQ ID NO: 93295 - DNA, 25 bp, S. pombe
gagcatccgatgtgtctgatacagc

SEQ ID NO: 93296 - DNA, 25 bp, S. pombe
gagctatccttctacttcgatgagt

SEQ ID NO: 93297 - DNA, 25 bp, S. pombe
gagctacacagcatcaatccgtggt

SEQ ID NO: 93298 - DNA, 25 bp, S. pombe
gagctatccagtttatccagggtta

SEQ ID NO: 93299 - DNA, 25 bp, S. pombe
gagctctccgatgattcaagtgatt

SEQ ID NO: 93300 - DNA, 25 bp, S. pombe
gagcttgctcgtcaacaaggtcttt

SEQ ID NO: 93301 - DNA, 25 bp, S. pombe
gagctgcttcttcaatcaaacatat

SEQ ID NO: 93302 - DNA, 25 bp, S. pombe
gagctggttgctctgtataacgttt

SEQ ID NO: 93303 - DNA, 25 bp, S. pombe
gagacctacccagagtttacatacg

SEQ ID NO: 93304 - DNA, 25 bp, S. pombe
gagaccaccccaagttatttgctag

SEQ ID NO: 93305 - DNA, 25 bp, S. pombe
gataaccctactttccgttggcaga

SEQ ID NO: 93306 - DNA, 25 bp, S. pombe
gagcaaacgaatttccccacgaatg

SEQ ID NO: 93307 - DNA, 25 bp, S. pombe
gagctgaactttaccttaccaatcg

SEQ ID NO: 93308 - DNA, 25 bp, S. pombe
gagcagcaacttttctcaatacaga

SEQ ID NO: 93309 - DNA, 25 bp, S. pombe
gagcatatacttctgccaagcagct

SEQ ID NO: 93310 - DNA, 25 bp, S. pombe
gagcatatctttctccaacttttga

SEQ ID NO: 93311 - DNA, 25 bp, S. pombe
gagcttcttcatgttggagggttac

SEQ ID NO: 93312 - DNA, 25 bp, S. pombe
gagcttcctcctgttgatgttttaa

SEQ ID NO: 93313 - DNA, 25 bp, S. pombe
gagaataaacacctctcctttgttt

SEQ ID NO: 93314 - DNA, 25 bp, S. pombe
gagcactgtaaatcagccgttcgtt

SEQ ID NO: 93315 - DNA, 25 bp, S. pombe
gagaattccgtatcccgttattact

SEQ ID NO: 93316 - DNA, 25 bp, S. pombe
gagaatggcagcatcaaacttttca

SEQ ID NO: 93317 - DNA, 25 bp, S. pombe
gagcacggagaccatttcaacttca

SEQ ID NO: 93318 - DNA, 25 bp, S. pombe
gagcagtgcaaacgtttcttcttac

SEQ ID NO: 93319 - DNA, 25 bp, S. pombe
gagcagtgctaatgccttcggataa

SEQ ID NO: 93320 - DNA, 25 bp, S. pombe
gagaaggctcaaaaccccatgaagg

SEQ ID NO: 93321 - DNA, 25 bp, S. pombe
gagacttttcgattccttaacacgt

SEQ ID NO: 93322 - DNA, 25 bp, S. pombe
gagcacgcaccctacgaaggaatta

SEQ ID NO: 93323 - DNA, 25 bp, S. pombe
gagcgtggctcttcccaaggaataa

SEQ ID NO: 93324 - DNA, 25 bp, S. pombe
gagcagcagtgtatcccggcagaaa

SEQ ID NO: 93325 - DNA, 25 bp, S. pombe
tctacggtacaagaagctttaaata

SEQ ID NO: 93326 - DNA, 25 bp, S. pombe
gataccccaaaagacgacgtttgtg

SEQ ID NO: 93327 - DNA, 25 bp, S. pombe
ggaccggtcaaaaacttgcacctca

SEQ ID NO: 93328 - DNA, 25 bp, S. pombe
gagacggtgtaatatactttcccaa

SEQ ID NO: 93329 - DNA, 25 bp, S. pombe
gagaccgtcaaatatgtgtttccca

SEQ ID NO: 93330 - DNA, 25 bp, S. pombe
gagaccccggagtaatttctggtat

SEQ ID NO: 93331 - DNA, 25 bp, S. pombe
gagcttacctttttcatttatgcct

SEQ ID NO: 93332 - DNA, 25 bp, S. pombe
gagcttgacctcatttttaatttcg

SEQ ID NO: 93333 - DNA, 25 bp, S. pombe
gagtcagtgtcaccgatgcttgcat

SEQ ID NO: 93334 - DNA, 25 bp, S. pombe
gagctagtatccgagtctgcgcaga

SEQ ID NO: 93335 - DNA, 25 bp, S. pombe
gagcatgtgtcagccaattccatat

SEQ ID NO: 93336 - DNA, 25 bp, S. pombe
gagcttgcacctgaatatcctgata

SEQ ID NO: 93337 - DNA, 25 bp, S. pombe
gagcttgtccttagagacgcttcaa

SEQ ID NO: 93338 - DNA, 25 bp, S. pombe
gagcatgttggacccgatactcgaa

SEQ ID NO: 93339 - DNA, 25 bp, S. pombe
gagcaacttgagtacaacccgacta

SEQ ID NO: 93340 - DNA, 25 bp, S. pombe
gagcaagtacctagtcaatccaaca

SEQ ID NO: 93341 - DNA, 25 bp, S. pombe
gagcaaagccgcaagactcttaagc

SEQ ID NO: 93342 - DNA, 25 bp, S. pombe
gagcggcatattttgatccttctaa

SEQ ID NO: 93343 - DNA, 25 bp, S. pombe
gagcggatgttgtatctttcactaa

SEQ ID NO: 93344 - DNA, 25 bp, S. pombe
gagcatctctattccttatacaaaa

SEQ ID NO: 93345 - DNA, 25 bp, S. pombe
gagctgatcgctttgaatgaacaca

SEQ ID NO: 93346 - DNA, 25 bp, S. pombe
gagaacggagactcgatcttcgatt

SEQ ID NO: 93347 - DNA, 25 bp, S. pombe
gagctattcgtttactgcgtatcat

SEQ ID NO: 93348 - DNA, 25 bp, S. pombe
gagctttatcaagtactttaccaga

SEQ ID NO: 93349 - DNA, 25 bp, S. pombe
gagattcgtacacgaccttaccaag

SEQ ID NO: 93350 - DNA, 25 bp, S. pombe
gagctatgacttctcttgttcaaga

SEQ ID NO: 93351 - DNA, 25 bp, S. pombe
gagctgattgaatccactttctcaa

SEQ ID NO: 93352 - DNA, 25 bp, S. pombe
gagcaattcatacgctgagccgtca

SEQ ID NO: 93353 - DNA, 25 bp, S. pombe
gagcaagtcttgagcgcgtgttata

SEQ ID NO: 93354 - DNA, 25 bp, S. pombe
gagcaagctttgatcactgtaggca

SEQ ID NO: 93355 - DNA, 25 bp, S. pombe
gagcaattttggcacgtgcgcgcac

SEQ ID NO: 93356 - DNA, 25 bp, S. pombe
gagctcgctcttgacactgacaaaa

SEQ ID NO: 93357 - DNA, 25 bp, S. pombe
gagctcctgttacgtatggccaaaa

SEQ ID NO: 93358 - DNA, 25 bp, S. pombe
gagctccaggtgtttctgattgtta

SEQ ID NO: 93359 - DNA, 25 bp, S. pombe
gagctcgagagttacctggcgttaa

SEQ ID NO: 93360 - DNA, 25 bp, S. pombe
gagaaacttccgaagccggcgtgaa

SEQ ID NO: 93361 - DNA, 25 bp, S. pombe
gagaaactcgcgttggtcgttggaa

SEQ ID NO: 93362 - DNA, 25 bp, S. pombe
gataactttctttctttgttgcgtc

SEQ ID NO: 93363 - DNA, 25 bp, S. pombe
gagaatccttgattacgccgggaga

SEQ ID NO: 93364 - DNA, 25 bp, S. pombe
gagcaaacttatttcgatccggaag

SEQ ID NO: 93365 - DNA, 25 bp, S. pombe
gagcaaaattacatggcccaggagt

SEQ ID NO: 93366 - DNA, 25 bp, S. pombe
gagcaccaggttgctgtgccgaaat

SEQ ID NO: 93367 - DNA, 25 bp, S. pombe
gagaaaccatcgactacatctgacg

SEQ ID NO: 93368 - DNA, 25 bp, S. pombe
gagaacccacgaagtcatgctcttg

SEQ ID NO: 93369 - DNA, 25 bp, S. pombe
gagacctattagagcatcccggcgg

SEQ ID NO: 93370 - DNA, 25 bp, S. pombe
gagaacttctacagacccttcatgg

SEQ ID NO: 93371 - DNA, 25 bp, S. pombe
gagcagattctcgactacaacagtg

SEQ ID NO: 93372 - DNA, 25 bp, S. pombe
gagaagtcgacgtttggcaaaatag

SEQ ID NO: 93373 - DNA, 25 bp, S. pombe
gagcaggctggaagctacccaacaa

SEQ ID NO: 93374 - DNA, 25 bp, S. pombe
gagcattgctggtcgtatcggcaga

SEQ ID NO: 93375 - DNA, 25 bp, S. pombe
gagcattatggatcacatctcctga

SEQ ID NO: 93376 - DNA, 25 bp, S. pombe
gagcttagaggctacagtccgcggt

SEQ ID NO: 93377 - DNA, 25 bp, S. pombe
gatgggaaacgttggctctctaata

SEQ ID NO: 93378 - DNA, 25 bp, S. pombe
gagggaacgccatcgtctgaaatgt

SEQ ID NO: 93379 - DNA, 25 bp, S. pombe
gagcttggttaattccttttcatga

SEQ ID NO: 93380 - DNA, 25 bp, S. pombe
gagcttgctgctaattaccttttcg

SEQ ID NO: 93381 - DNA, 25 bp, S. pombe
gagcttgtcaaattacctcacaggc

SEQ ID NO: 93382 - DNA, 25 bp, S. pombe
gagctagtgcagtatatcacccgca

SEQ ID NO: 93383 - DNA, 25 bp, S. pombe
gagcagagcttttaatcacgtatgg

SEQ ID NO: 93384 - DNA, 25 bp, S. pombe
gagcttctcgtgaatatcctatcgc

SEQ ID NO: 93385 - DNA, 25 bp, S. pombe
gagctaccgctgaatatttgtcgaa

SEQ ID NO: 93386 - DNA, 25 bp, S. pombe
gagaaaatgccttttagtcccgcaa

SEQ ID NO: 93387 - DNA, 25 bp, S. pombe
gagcagtgggtttcacatcattcaa

SEQ ID NO: 93388 - DNA, 25 bp, S. pombe
gagcagtggtgttattccttccaac

SEQ ID NO: 93389 - DNA, 25 bp, S. pombe
gagcagcgaatttgttcccattgaa

SEQ ID NO: 93390 - DNA, 25 bp, S. pombe
gagcatcaagctctattcgctgttg

SEQ ID NO: 93391 - DNA, 25 bp, S. pombe
gagcaaacttttactgctcgtcctg

SEQ ID NO: 93392 - DNA, 25 bp, S. pombe
gagaagtattttacaccgtcgcgat

SEQ ID NO: 93393 - DNA, 25 bp, S. pombe
gagaaagttttgcaaccctccattc

SEQ ID NO: 93394 - DNA, 25 bp, S. pombe
gagcatactatcattcttcacccta

SEQ ID NO: 93395 - DNA, 25 bp, S. pombe
gagctatccaatttcaatcccgtag

SEQ ID NO: 93396 - DNA, 25 bp, S. pombe
gagctagaactcttcaacgtcgtag

SEQ ID NO: 93397 - DNA, 25 bp, S. pombe
gagctatcgcataattcgtcttcta

SEQ ID NO: 93398 - DNA, 25 bp, S. pombe
gagcatatccaatacgcagttatcc

SEQ ID NO: 93399 - DNA, 25 bp, S. pombe
gagaactgtgtcattaccggtaatc

SEQ ID NO: 93400 - DNA, 25 bp, S. pombe
gagaagctaactttaccgttaccag

SEQ ID NO: 93401 - DNA, 25 bp, S. pombe
gagaaaatgactcctgactcctcca

SEQ ID NO: 93402 - DNA, 25 bp, S. pombe
gagcaaacgaattcttctgcctcct

SEQ ID NO: 93403 - DNA, 25 bp, S. pombe
gtgctcaaatatcatcggatcctgc

SEQ ID NO: 93404 - DNA, 25 bp, S. pombe
gagtcgaacgcaagggccagtttta

SEQ ID NO: 93405 - DNA, 25 bp, S. pombe
gagcaggtatccaaaggtccttgaa

SEQ ID NO: 93406 - DNA, 25 bp, S. pombe
gagaccttcacaagacctgatgcat

SEQ ID NO: 93407 - DNA, 25 bp, S. pombe
gagcacctttcaaacctatatagag

SEQ ID NO: 93408 - DNA, 25 bp, S. pombe
gagaccgctcgctgtctggaaaaag

SEQ ID NO: 93409 - DNA, 25 bp, S. pombe
gagacttcctattaatccaaaactt

SEQ ID NO: 93410 - DNA, 25 bp, S. pombe
gagcacgtggtggtaaacccataat

SEQ ID NO: 93411 - DNA, 25 bp, S. pombe
gagcttggagatgtattattcttaa

SEQ ID NO: 93412 - DNA, 25 bp, S. pombe
gagcttgatgaaaaccttccttata

SEQ ID NO: 93413 - DNA, 25 bp, S. pombe
gagtcctaagctattaccttctgaa

SEQ ID NO: 93414 - DNA, 25 bp, S. pombe
gagaagttttgccagtatccgatta

SEQ ID NO: 93415 - DNA, 25 bp, S. pombe
gagaaggtgcttgatgttttcattg

SEQ ID NO: 93416 - DNA, 25 bp, S. pombe
gagcaacttctatctgttttgaatg

SEQ ID NO: 93417 - DNA, 25 bp, S. pombe
gagcagcactctttaaattgggcca

SEQ ID NO: 93418 - DNA, 25 bp, S. pombe
gagcatgcattgaagcaagccgctt

SEQ ID NO: 93419 - DNA, 25 bp, S. pombe
gagcatatcgctagcaacagcctta

SEQ ID NO: 93420 - DNA, 25 bp, S. pombe
gagtcgcagatgacaagggcctttt

SEQ ID NO: 93421 - DNA, 25 bp, S. pombe
gagaatggctcttcttgagtgacaa

SEQ ID NO: 93422 - DNA, 25 bp, S. pombe
gagaatacatcgctaactctgctaa

SEQ ID NO: 93423 - DNA, 25 bp, S. pombe
gagaatgtcgcgtttggagctttaa

SEQ ID NO: 93424 - DNA, 25 bp, S. pombe
gagcaacgccgacacatataagagt

SEQ ID NO: 93425 - DNA, 25 bp, S. pombe
gagcagctactattgaggctttcag

SEQ ID NO: 93426 - DNA, 25 bp, S. pombe
gagcagtctgtttccaatgtacgcg

SEQ ID NO: 93427 - DNA, 25 bp, S. pombe
gagaatatgctagtccaggagtttc

SEQ ID NO: 93428 - DNA, 25 bp, S. pombe
gagcttcctcagaaactggtcgatc

SEQ ID NO: 93429 - DNA, 25 bp, S. pombe
gagcttctccaaacactgctttgaa

SEQ ID NO: 93430 - DNA, 25 bp, S. pombe
gagcattctctatgttcatctttga

SEQ ID NO: 93431 - DNA, 25 bp, S. pombe
gagcatgctccttctattattttca

SEQ ID NO: 93432 - DNA, 25 bp, S. pombe
gagcagccactgttgttgaaggtat

SEQ ID NO: 93433 - DNA, 25 bp, S. pombe
gagcagcagtcattgttggcagagc

SEQ ID NO: 93434 - DNA, 25 bp, S. pombe
gagcagcagctactatttcagaaac

SEQ ID NO: 93435 - DNA, 25 bp, S. pombe
gagcagctggtgctttcaaccaatt

SEQ ID NO: 93436 - DNA, 25 bp, S. pombe
gagcagcggttttcagaaccattct

SEQ ID NO: 93437 - DNA, 25 bp, S. pombe
gagcatgtagccactttatctggat

SEQ ID NO: 93438 - DNA, 25 bp, S. pombe
gagcagcattcacatttttcactat

SEQ ID NO: 93439 - DNA, 25 bp, S. pombe
gagcaggaaccaatcgatcatatca

SEQ ID NO: 93440 - DNA, 25 bp, S. pombe
gagcacccaggtggtcaaggccttt

SEQ ID NO: 93441 - DNA, 25 bp, S. pombe
gagcatcaactcaatcaatcgtcaa

SEQ ID NO: 93442 - DNA, 25 bp, S. pombe
gagaaaaacccgtcctgcattaata

SEQ ID NO: 93443 - DNA, 25 bp, S. pombe
gagaaaacttcctcaaggttacatt

SEQ ID NO: 93444 - DNA, 25 bp, S. pombe
gagaaagccaagttcaaccgccact

SEQ ID NO: 93445 - DNA, 25 bp, S. pombe
gagaaccgaaaagcgctgccgacta

SEQ ID NO: 93446 - DNA, 25 bp, S. pombe
gagaacctaaactgcggactattga

SEQ ID NO: 93447 - DNA, 25 bp, S. pombe
gagaacaagttgatgccgcagaaat

SEQ ID NO: 93448 - DNA, 25 bp, S. pombe
gagcacttcctgatgctattctaga

SEQ ID NO: 93449 - DNA, 25 bp, S. pombe
gagactgctcttcgtgtatgggatt

SEQ ID NO: 93450 - DNA, 25 bp, S. pombe
gagcattttatcatgttgtcagatt

SEQ ID NO: 93451 - DNA, 25 bp, S. pombe
gagactattcatgctccagtaatca

SEQ ID NO: 93452 - DNA, 25 bp, S. pombe
gataaccttcttcaaacttgtaact

SEQ ID NO: 93453 - DNA, 25 bp, S. pombe
ggaaccgttgttgagatccgtaact

SEQ ID NO: 93454 - DNA, 25 bp, S. pombe
gagaaccagtctttacaggccgata

SEQ ID NO: 93455 - DNA, 25 bp, S. pombe
gagaacttggtcctcactggagaga

SEQ ID NO: 93456 - DNA, 25 bp, S. pombe
gagaacttgtccctcttatggatga

SEQ ID NO: 93457 - DNA, 25 bp, S. pombe
gagcaattctccatggttgcgcgaa

SEQ ID NO: 93458 - DNA, 25 bp, S. pombe
gagaagcagctgtaacgcacgtttt

SEQ ID NO: 93459 - DNA, 25 bp, S. pombe
gagacccgtgccgtaggtttgatta

SEQ ID NO: 93460 - DNA, 25 bp, S. pombe
gagaaactccttatcgtcgtattga

SEQ ID NO: 93461 - DNA, 25 bp, S. pombe
gagaaactttttccagatcctacta

SEQ ID NO: 93462 - DNA, 25 bp, S. pombe
gagaacctttatttaatcattgaca

SEQ ID NO: 93463 - DNA, 25 bp, S. pombe
gagaactctgttattcaatcatgtc

SEQ ID NO: 93464 - DNA, 25 bp, S. pombe
gagcaagcttcagaattttaccagt

SEQ ID NO: 93465 - DNA, 25 bp, S. pombe
gagcaatgatgttccacttcttgtg

SEQ ID NO: 93466 - DNA, 25 bp, S. pombe
gagcaaatttgaacgtacacaggac

SEQ ID NO: 93467 - DNA, 25 bp, S. pombe
gagcaaattctttggttccgtgaat

SEQ ID NO: 93468 - DNA, 25 bp, S. pombe
gagaaacttctcaaaccctgcgggt

SEQ ID NO: 93469 - DNA, 25 bp, S. pombe
gagaatggtttcttccaaaccagaa

SEQ ID NO: 93470 - DNA, 25 bp, S. pombe
gagacgttacgttcacgaggccttt

SEQ ID NO: 93471 - DNA, 25 bp, S. pombe
ggacgtaagcgtcttatggctccta

SEQ ID NO: 93472 - DNA, 25 bp, S. pombe
gagcaagtttctctttactggtcat

SEQ ID NO: 93473 - DNA, 25 bp, S. pombe
gagaaattcccgaacgccgcatttt

SEQ ID NO: 93474 - DNA, 25 bp, S. pombe
gatgatttttacttcggcccttttg

SEQ ID NO: 93475 - DNA, 25 bp, S. pombe
gagcaaatttctgccggtgtcacta

SEQ ID NO: 93476 - DNA, 25 bp, S. pombe
gagaatttgctttacgcttggttgc

SEQ ID NO: 93477 - DNA, 25 bp, S. pombe
gagaattgtcaatgtcgacacgaaa

SEQ ID NO: 93478 - DNA, 25 bp, S. pombe
gagaaacctgactaatgcctctgta

SEQ ID NO: 93479 - DNA, 25 bp, S. pombe
gagaatctcgatcctaatgctaatg

SEQ ID NO: 93480 - DNA, 25 bp, S. pombe
gagaatctcggacaagctgcaaagc

SEQ ID NO: 93481 - DNA, 25 bp, S. pombe
gagaatacgacaaattaccgctaaa

SEQ ID NO: 93482 - DNA, 25 bp, S. pombe
gagacgactggtgcaaacaacccaa

SEQ ID NO: 93483 - DNA, 25 bp, S. pombe
gagaatcttgttgcctcactgtcag

SEQ ID NO: 93484 - DNA, 25 bp, S. pombe
gagcaccttttagtcatcctgtaaa

SEQ ID NO: 93485 - DNA, 25 bp, S. pombe
gagcacgctgattccaattccgatt

SEQ ID NO: 93486 - DNA, 25 bp, S. pombe
gagactctggcggtgtttggacaac

SEQ ID NO: 93487 - DNA, 25 bp, S. pombe
gagaatgagccactagaaccctatg

SEQ ID NO: 93488 - DNA, 25 bp, S. pombe
gagaataccaagtcgatccctaatg

SEQ ID NO: 93489 - DNA, 25 bp, S. pombe
gagacaacgattccttccaatttgg

SEQ ID NO: 93490 - DNA, 25 bp, S. pombe
gagtaacttacctatttgatttgga

SEQ ID NO: 93491 - DNA, 25 bp, S. pombe
gagcagatatctaaccttttactta

SEQ ID NO: 93492 - DNA, 25 bp, S. pombe
gagaacatcatatacctgccaaggt

SEQ ID NO: 93493 - DNA, 25 bp, S. pombe
gagaagacgtgcttacgcccagtta

SEQ ID NO: 93494 - DNA, 25 bp, S. pombe
gagcagctttaccttgtgaagcctt

SEQ ID NO: 93495 - DNA, 25 bp, S. pombe
gagcactattacttatggtacttta

SEQ ID NO: 93496 - DNA, 25 bp, S. pombe
gagcacctttgcatcttctaggagt

SEQ ID NO: 93497 - DNA, 25 bp, S. pombe
gagacccttgctccttctaagggag

SEQ ID NO: 93498 - DNA, 25 bp, S. pombe
gagacaacttcgattccaacagtgg

SEQ ID NO: 93499 - DNA, 25 bp, S. pombe
gagacgatctttatccctacgtttt

SEQ ID NO: 93500 - DNA, 25 bp, S. pombe
gagacaggtctactccgccaaagtt

SEQ ID NO: 93501 - DNA, 25 bp, S. pombe
gagaccgtttccaagggcaacctga

SEQ ID NO: 93502 - DNA, 25 bp, S. pombe
gagcaaccctatcaatcttcaaagc

SEQ ID NO: 93503 - DNA, 25 bp, S. pombe
gagcaaagccaaaagcgtaccgatg

SEQ ID NO: 93504 - DNA, 25 bp, S. pombe
gagaacctcaaaatccaacctgatg

SEQ ID NO: 93505 - DNA, 25 bp, S. pombe
gagacgcagtctctactggatccag

SEQ ID NO: 93506 - DNA, 25 bp, S. pombe
gagatcgaattagacattgatccaa

SEQ ID NO: 93507 - DNA, 25 bp, S. pombe
gatggaagtcttaagccggctatcg

SEQ ID NO: 93508 - DNA, 25 bp, S. pombe
gagcaacatgatattccctttttgg

SEQ ID NO: 93509 - DNA, 25 bp, S. pombe
gagcaacttcttaatggcgttttga

SEQ ID NO: 93510 - DNA, 25 bp, S. pombe
gagacttttgctattcgttttgcaa

SEQ ID NO: 93511 - DNA, 25 bp, S. pombe
gagattgtaagtcgccgttggtttt

SEQ ID NO: 93512 - DNA, 25 bp, S. pombe
gagaagacaggtaccgtttctctta

SEQ ID NO: 93513 - DNA, 25 bp, S. pombe
gagacgcctagtaccgttattcata

SEQ ID NO: 93514 - DNA, 25 bp, S. pombe
gagacgctctaggatcggcttgtta

SEQ ID NO: 93515 - DNA, 25 bp, S. pombe
gagcaagctctttatcgtgcaggtt

SEQ ID NO: 93516 - DNA, 25 bp, S. pombe
gagaagctcttgaatcctggtggtc

SEQ ID NO: 93517 - DNA, 25 bp, S. pombe
gagcaagtccaaatctggcgccgtt

SEQ ID NO: 93518 - DNA, 25 bp, S. pombe
gagcaagtcgctaactggcaacaat

SEQ ID NO: 93519 - DNA, 25 bp, S. pombe
ggaggaaatcctgatccccttcgaa

SEQ ID NO: 93520 - DNA, 25 bp, S. pombe
gagagagaacgcctagatccccttt

SEQ ID NO: 93521 - DNA, 25 bp, S. pombe
gagcactcgacatcttatacttggg

SEQ ID NO: 93522 - DNA, 25 bp, S. pombe
gatgactggaaatgaaccccttttg

SEQ ID NO: 93523 - DNA, 25 bp, S. pombe
gagactgtcaagtgaacctccatct

SEQ ID NO: 93524 - DNA, 25 bp, S. pombe
gagaactaaaaattgccgaacgcga

SEQ ID NO: 93525 - DNA, 25 bp, S. pombe
gattaccttcgatctgttttcccgt

SEQ ID NO: 93526 - DNA, 25 bp, S. pombe
gatgcaagccttcacttgttttccc

SEQ ID NO: 93527 - DNA, 25 bp, S. pombe
gagcaatcagacgattcttcctctt

SEQ ID NO: 93528 - DNA, 25 bp, S. pombe
gagaatcgctcttttatgatcttca

SEQ ID NO: 93529 - DNA, 25 bp, S. pombe
gagaacgatgcatctttggatatca

SEQ ID NO: 93530 - DNA, 25 bp, S. pombe
gagaatcactcttctgatgctcgtg

SEQ ID NO: 93531 - DNA, 25 bp, S. pombe
gagaatacttacaatccgatgatgc

SEQ ID NO: 93532 - DNA, 25 bp, S. pombe
gagaactttgacttcaccatgacaa

SEQ ID NO: 93533 - DNA, 25 bp, S. pombe
gagagcgtgtagactgtagttacta

SEQ ID NO: 93534 - DNA, 25 bp, S. pombe
gagaatggtgccgaagaccgctctg

SEQ ID NO: 93535 - DNA, 25 bp, S. pombe
gatatatcatgacacgaaggccgga

SEQ ID NO: 93536 - DNA, 25 bp, S. pombe
gagaagatgattcctacccttcacg

SEQ ID NO: 93537 - DNA, 25 bp, S. pombe
gagatcgtagtgctttacttcaaca

SEQ ID NO: 93538 - DNA, 25 bp, S. pombe
gagactatgtctcgtcatttcaagt

SEQ ID NO: 93539 - DNA, 25 bp, S. pombe
gagactcgtcaccaagttacagcgg

SEQ ID NO: 93540 - DNA, 25 bp, S. pombe
gagacagcagttccagatatagcaa

SEQ ID NO: 93541 - DNA, 25 bp, S. pombe
gagcaattgctagcacttacacaaa

SEQ ID NO: 93542 - DNA, 25 bp, S. pombe
gagaagttcgcccatgtgtccaaat

SEQ ID NO: 93543 - DNA, 25 bp, S. pombe
gagaaggtccccaagtgcatcaaag

SEQ ID NO: 93544 - DNA, 25 bp, S. pombe
gagaactgtgtcttgccatgtgtcc

SEQ ID NO: 93545 - DNA, 25 bp, S. pombe
gagcaattgcttgtctcatttcaac

SEQ ID NO: 93546 - DNA, 25 bp, S. pombe
gagaatatctcaaccctcttatgct

SEQ ID NO: 93547 - DNA, 25 bp, S. pombe
gagaatttactcgatatgggcctat

SEQ ID NO: 93548 - DNA, 25 bp, S. pombe
gagaatttcgtcatgatggtgccaa

SEQ ID NO: 93549 - DNA, 25 bp, S. pombe
gagaattgtcgtacgtggtgctact

SEQ ID NO: 93550 - DNA, 25 bp, S. pombe
gagaacaagattgccggccgtatcg

SEQ ID NO: 93551 - DNA, 25 bp, S. pombe
gtaaaaattcccatgtcctcggtga

SEQ ID NO: 93552 - DNA, 25 bp, S. pombe
gtatcaaatactcaactttacggga

SEQ ID NO: 93553 - DNA, 25 bp, S. pombe
gttccagtaccattccttaacggag

SEQ ID NO: 93554 - DNA, 25 bp, S. pombe
gagaaaatgtctgtcgttcctttaa

SEQ ID NO: 93555 - DNA, 25 bp, S. pombe
gaggctgtcctagacgaaaccgaca

SEQ ID NO: 93556 - DNA, 25 bp, S. pombe
gagagctatattatggcgaccaacg

SEQ ID NO: 93557 - DNA, 25 bp, S. pombe
gagtccagttcaaccggtaatcact

SEQ ID NO: 93558 - DNA, 25 bp, S. pombe
gagaagatggtctagctgctgtcct

SEQ ID NO: 93559 - DNA, 25 bp, S. pombe
gagacaatcttctctgttcgatcgc

SEQ ID NO: 93560 - DNA, 25 bp, S. pombe
gagacctttattaattttcctgtgg

SEQ ID NO: 93561 - DNA, 25 bp, S. pombe
gagaggtttcctaatttggcctatt

SEQ ID NO: 93562 - DNA, 25 bp, S. pombe
gagacaccgttgagctcacagggaa

SEQ ID NO: 93563 - DNA, 25 bp, S. pombe
gagaccccagtttatcccgatagag

SEQ ID NO: 93564 - DNA, 25 bp, S. pombe
gagagcccatcgatgttcctaaaaa

SEQ ID NO: 93565 - DNA, 25 bp, S. pombe
gagagctacagtaccaaccgttacg

SEQ ID NO: 93566 - DNA, 25 bp, S. pombe
gagaaagcaccgtttttcttgcctt

SEQ ID NO: 93567 - DNA, 25 bp, S. pombe
gagacaatacccttctttcttacgt

SEQ ID NO: 93568 - DNA, 25 bp, S. pombe
gagaattcacctcaattaccagaaa

SEQ ID NO: 93569 - DNA, 25 bp, S. pombe
gagaacaagcgcgtcaagatgaaat

SEQ ID NO: 93570 - DNA, 25 bp, S. pombe
gagaattaccacaagccaagcgcga

SEQ ID NO: 93571 - DNA, 25 bp, S. pombe
gagaaaacgtctccgctctcaagag

SEQ ID NO: 93572 - DNA, 25 bp, S. pombe
gagaaagacttacccttcagaggat

SEQ ID NO: 93573 - DNA, 25 bp, S. pombe
gagactcgtggcattggcggtattt

SEQ ID NO: 93574 - DNA, 25 bp, S. pombe
gagaacttggcttagattcactatc

SEQ ID NO: 93575 - DNA, 25 bp, S. pombe
gagaacgtaactcctgtcaacgaga

SEQ ID NO: 93576 - DNA, 25 bp, S. pombe
gagacacctgacatttagtgagcaa

SEQ ID NO: 93577 - DNA, 25 bp, S. pombe
gagagcatccttggtttacgtgaac

SEQ ID NO: 93578 - DNA, 25 bp, S. pombe
gagaatgcctcgcttttggctcaag

SEQ ID NO: 93579 - DNA, 25 bp, S. pombe
gagacgtgtgtacttcaaatgcgga

SEQ ID NO: 93580 - DNA, 25 bp, S. pombe
gagatcctggaacactgagtcattt

SEQ ID NO: 93581 - DNA, 25 bp, S. pombe
gagtcttcgaagtactggtgcgcga

SEQ ID NO: 93582 - DNA, 25 bp, S. pombe
gagacttggtatgactgttgctcga

SEQ ID NO: 93583 - DNA, 25 bp, S. pombe
gagagtgtttacagcgttgccttct

SEQ ID NO: 93584 - DNA, 25 bp, S. pombe
gagagaagctgccaaggccgctact

SEQ ID NO: 93585 - DNA, 25 bp, S. pombe
gagaaatgcgtatcgccgctattcc

SEQ ID NO: 93586 - DNA, 25 bp, S. pombe
gagaagatgcgttcaatgtccatat

SEQ ID NO: 93587 - DNA, 25 bp, S. pombe
gagaatgacttgttcctcaatgcta

SEQ ID NO: 93588 - DNA, 25 bp, S. pombe
gagaaacaagcttacctatccaaat

SEQ ID NO: 93589 - DNA, 25 bp, S. pombe
gagaaatcctttgcgtatcccaatt

SEQ ID NO: 93590 - DNA, 25 bp, S. pombe
gagacccgatgaacccatgtttgga

SEQ ID NO: 93591 - DNA, 25 bp, S. pombe
gagtcgggttttgttgatgatccta

SEQ ID NO: 93592 - DNA, 25 bp, S. pombe
gagtgctgggttattcctattctaa

SEQ ID NO: 93593 - DNA, 25 bp, S. pombe
gagacgggcagtactttgccgttta

SEQ ID NO: 93594 - DNA, 25 bp, S. pombe
gagactcttgatcatctttgcactg

SEQ ID NO: 93595 - DNA, 25 bp, S. pombe
gagacttatatctggcgacggcttt

SEQ ID NO: 93596 - DNA, 25 bp, S. pombe
gatgttcatagagggacgacgctta

SEQ ID NO: 93597 - DNA, 25 bp, S. pombe
gagaagcgacattcgcaaaccctga

SEQ ID NO: 93598 - DNA, 25 bp, S. pombe
gagagcagcccgattcaatattttg

SEQ ID NO: 93599 - DNA, 25 bp, S. pombe
gagaagctccgttgaccttaataca

SEQ ID NO: 93600 - DNA, 25 bp, S. pombe
gagaagctgggttgactatggttca

SEQ ID NO: 93601 - DNA, 25 bp, S. pombe
gagacagctggactaacatcacgaa

SEQ ID NO: 93602 - DNA, 25 bp, S. pombe
gagagactgacttcgaccatcattg

SEQ ID NO: 93603 - DNA, 25 bp, S. pombe
gagaaacattagaccctactgggaa

SEQ ID NO: 93604 - DNA, 25 bp, S. pombe
gagaaaatatccaccacactgcatt

SEQ ID NO: 93605 - DNA, 25 bp, S. pombe
gagaaatgaaccctgtaacacttat

SEQ ID NO: 93606 - DNA, 25 bp, S. pombe
gagaacgctgacactcttggtatca

SEQ ID NO: 93607 - DNA, 25 bp, S. pombe
gagtacaaagcatgcgccgcaatct

SEQ ID NO: 93608 - DNA, 25 bp, S. pombe
gagataaaacatccgccgtgcttgt

SEQ ID NO: 93609 - DNA, 25 bp, S. pombe
gagaacgcacacacaatgatcgcta

SEQ ID NO: 93610 - DNA, 25 bp, S. pombe
gagaagcctcgagcatttttagaaa

SEQ ID NO: 93611 - DNA, 25 bp, S. pombe
gagaacacagaagcgtcttgctgcc

SEQ ID NO: 93612 - DNA, 25 bp, S. pombe
gagacacaacagctacttcgagagt

SEQ ID NO: 93613 - DNA, 25 bp, S. pombe
gagaaactgtgcaagctcctcctga

SEQ ID NO: 93614 - DNA, 25 bp, S. pombe
gagaagcactgttcatcgtgttcga

SEQ ID NO: 93615 - DNA, 25 bp, S. pombe
gagaaatctgctccattgttactga

SEQ ID NO: 93616 - DNA, 25 bp, S. pombe
gagaaacttctccttcatagtaaca

SEQ ID NO: 93617 - DNA, 25 bp, S. pombe
gagttggtcttccaattacctccaa

SEQ ID NO: 93618 - DNA, 25 bp, S. pombe
gagactttagttcattcctctttca

SEQ ID NO: 93619 - DNA, 25 bp, S. pombe
gagacgttatttcaaagctccttaa

SEQ ID NO: 93620 - DNA, 25 bp, S. pombe
gagagtgttacttgcggaactcctt

SEQ ID NO: 93621 - DNA, 25 bp, S. pombe
gagagtgttctatcccagttaaata

SEQ ID NO: 93622 - DNA, 25 bp, S. pombe
gagaaagtcatagcactcctcatga

SEQ ID NO: 93623 - DNA, 25 bp, S. pombe
gagagagcgcgatgatctgaaaaat

SEQ ID NO: 93624 - DNA, 25 bp, S. pombe
gagacattgcacatgctccatttgc

SEQ ID NO: 93625 - DNA, 25 bp, S. pombe
gagacattgcattctgacatctatt

SEQ ID NO: 93626 - DNA, 25 bp, S. pombe
gatcgttcagttaccaattttaccg

SEQ ID NO: 93627 - DNA, 25 bp, S. pombe
gagacgatcgttgcctattttcacc

SEQ ID NO: 93628 - DNA, 25 bp, S. pombe
gagaccttgctgctgctgaaagtaa

SEQ ID NO: 93629 - DNA, 25 bp, S. pombe
gagagctcaagtcactacaatggaa

SEQ ID NO: 93630 - DNA, 25 bp, S. pombe
gagagcaactggttatccggccatc

SEQ ID NO: 93631 - DNA, 25 bp, S. pombe
gagaaatatccatctttcaagaaga

SEQ ID NO: 93632 - DNA, 25 bp, S. pombe
gagaaatcccctagtgtgtatgaaa

SEQ ID NO: 93633 - DNA, 25 bp, S. pombe
gagacatatcccctttgggttcaag

SEQ ID NO: 93634 - DNA, 25 bp, S. pombe
gagagaggactttttacttcacata

SEQ ID NO: 93635 - DNA, 25 bp, S. pombe
gagagggttgcttattatgctttaa

SEQ ID NO: 93636 - DNA, 25 bp, S. pombe
gagaacactccaccatcaggttgtt

SEQ ID NO: 93637 - DNA, 25 bp, S. pombe
gagaacacttcaacatcgctggaga

SEQ ID NO: 93638 - DNA, 25 bp, S. pombe
gagagggcttcttttgctaggatta

SEQ ID NO: 93639 - DNA, 25 bp, S. pombe
gagacggatgactctttcatagctc

SEQ ID NO: 93640 - DNA, 25 bp, S. pombe
gagacttctaatcctgtttcagcta

SEQ ID NO: 93641 - DNA, 25 bp, S. pombe
gagactatgatatggctgcacttgg

SEQ ID NO: 93642 - DNA, 25 bp, S. pombe
gagagcctgttgtttcagttgtcaa

SEQ ID NO: 93643 - DNA, 25 bp, S. pombe
gagagcaaatgtttccggtggatta

SEQ ID NO: 93644 - DNA, 25 bp, S. pombe
gagacataacctgccgctatggaaa

SEQ ID NO: 93645 - DNA, 25 bp, S. pombe
gagaaacgctattttgtcataccaa

SEQ ID NO: 93646 - DNA, 25 bp, S. pombe
gttgcaatgcgtgtctttttcgtta

SEQ ID NO: 93647 - DNA, 25 bp, S. pombe
gagaccgcttcatttttgcaacaga

SEQ ID NO: 93648 - DNA, 25 bp, S. pombe
gagaacactctctattggtcccaga

SEQ ID NO: 93649 - DNA, 25 bp, S. pombe
gagaccacttgtcactttttgactg

SEQ ID NO: 93650 - DNA, 25 bp, S. pombe
gagactcctgttcgaattttgtcat

SEQ ID NO: 93651 - DNA, 25 bp, S. pombe
gagactatctcccaagctttactta

SEQ ID NO: 93652 - DNA, 25 bp, S. pombe
gagagcttcctacagacggactgaa

SEQ ID NO: 93653 - DNA, 25 bp, S. pombe
gagtttacttgttgacggccgtgac

SEQ ID NO: 93654 - DNA, 25 bp, S. pombe
gagttctggttctgggtgccacgaa

SEQ ID NO: 93655 - DNA, 25 bp, S. pombe
gagttcggcggctgtaacggctaac

SEQ ID NO: 93656 - DNA, 25 bp, S. pombe
gatgttgcccggtgaaaacactacc

SEQ ID NO: 93657 - DNA, 25 bp, S. pombe
gagatttccctttataagttgctta

SEQ ID NO: 93658 - DNA, 25 bp, S. pombe
gagactgatattgcacttcctgata

SEQ ID NO: 93659 - DNA, 25 bp, S. pombe
gagaaatgtcgcatccttcatccag

SEQ ID NO: 93660 - DNA, 25 bp, S. pombe
gagaaatgttgctgatcacccggac

SEQ ID NO: 93661 - DNA, 25 bp, S. pombe
gagagcatacattttccaagacgaa

SEQ ID NO: 93662 - DNA, 25 bp, S. pombe
gagagtgccttcatggacagatcga

SEQ ID NO: 93663 - DNA, 25 bp, S. pombe
gagacttctgacattgacgatcgtt

SEQ ID NO: 93664 - DNA, 25 bp, S. pombe
gagacgtttattcattccaaggaca

SEQ ID NO: 93665 - DNA, 25 bp, S. pombe
gagagcttctaaaccgctggaaact

SEQ ID NO: 93666 - DNA, 25 bp, S. pombe
gagattttaattccgtccaaggcag

SEQ ID NO: 93667 - DNA, 25 bp, S. pombe
gagactttaaaaaccgcttgtgcag

SEQ ID NO: 93668 - DNA, 25 bp, S. pombe
gatgtcgttgaagctactcgtagaa

SEQ ID NO: 93669 - DNA, 25 bp, S. pombe
gagacgcaatgttggcaagacttaa

SEQ ID NO: 93670 - DNA, 25 bp, S. pombe
gagactcaagcccatgcaacatctt

SEQ ID NO: 93671 - DNA, 25 bp, S. pombe
gagtctccgacagtgcaagctgcta

SEQ ID NO: 93672 - DNA, 25 bp, S. pombe
gagagcgctcgtctgaagctaatca

SEQ ID NO: 93673 - DNA, 25 bp, S. pombe
gagacatacgcctgttgctgaagat

SEQ ID NO: 93674 - DNA, 25 bp, S. pombe
gagactgatcgcatctttggcaagg

SEQ ID NO: 93675 - DNA, 25 bp, S. pombe
gagacagagtcttctaataccaccc

SEQ ID NO: 93676 - DNA, 25 bp, S. pombe
gagatgactactaacattcctcctc

SEQ ID NO: 93677 - DNA, 25 bp, S. pombe
gagatcgtagtcatattcctggtaa

SEQ ID NO: 93678 - DNA, 25 bp, S. pombe
gagacgctactagattcctgcgtat

SEQ ID NO: 93679 - DNA, 25 bp, S. pombe
gagaggtctcaaggttgggcacaaa

SEQ ID NO: 93680 - DNA, 25 bp, S. pombe
gagaggaccaagcttctgctgaaga

SEQ ID NO: 93681 - DNA, 25 bp, S. pombe
gagatggaagctttacaacgtttat

SEQ ID NO: 93682 - DNA, 25 bp, S. pombe
gagtacgttaccattcaaccgacta

SEQ ID NO: 93683 - DNA, 25 bp, S. pombe
gagttgcaggagtcagttacaccca

SEQ ID NO: 93684 - DNA, 25 bp, S. pombe
gagagcgcttgatcctggaacgtga

SEQ ID NO: 93685 - DNA, 25 bp, S. pombe
gagactggctacgttggtactgtta

SEQ ID NO: 93686 - DNA, 25 bp, S. pombe
gagacttttgcgaagcttaccatga

SEQ ID NO: 93687 - DNA, 25 bp, S. pombe
gagattaattcgtcgcgtcacaaat

SEQ ID NO: 93688 - DNA, 25 bp, S. pombe
gagactgtattttctgcttctaacg

SEQ ID NO: 93689 - DNA, 25 bp, S. pombe
gagagagttttgaccccaagattgt

SEQ ID NO: 93690 - DNA, 25 bp, S. pombe
gagactttattcacagccaaacgct

SEQ ID NO: 93691 - DNA, 25 bp, S. pombe
gagacttttgacatcaccgaccgtg

SEQ ID NO: 93692 - DNA, 25 bp, S. pombe
gagtagtcgccagggagtctatctc

SEQ ID NO: 93693 - DNA, 25 bp, S. pombe
gagacgccgtaaggtgtaccctatt

SEQ ID NO: 93694 - DNA, 25 bp, S. pombe
gagactgttgtttcattctgctttg

SEQ ID NO: 93695 - DNA, 25 bp, S. pombe
gagacttctgaatcatctgcgtttc

SEQ ID NO: 93696 - DNA, 25 bp, S. pombe
gagagttcaaggtcagcagcagtaa

SEQ ID NO: 93697 - DNA, 25 bp, S. pombe
gagagactttgtttcatcgatttca

SEQ ID NO: 93698 - DNA, 25 bp, S. pombe
gagacgctcaagtatctgtaccttc

SEQ ID NO: 93699 - DNA, 25 bp, S. pombe
gagactgtgatgagctctttgccga

SEQ ID NO: 93700 - DNA, 25 bp, S. pombe
gagactgctcatgtcgtagtccaaa

SEQ ID NO: 93701 - DNA, 25 bp, S. pombe
gagacggtttagtagctgcacgaca

SEQ ID NO: 93702 - DNA, 25 bp, S. pombe
gagacgcgattctagtggtgactta

SEQ ID NO: 93703 - DNA, 25 bp, S. pombe
gagagccgtctgagtttgagcgtca

SEQ ID NO: 93704 - DNA, 25 bp, S. pombe
gagagcaggctaccacagtcgactt

SEQ ID NO: 93705 - DNA, 25 bp, S. pombe
gagagctggaagtatgctccccttt

SEQ ID NO: 93706 - DNA, 25 bp, S. pombe
gagactatacacaaccagctgctag

SEQ ID NO: 93707 - DNA, 25 bp, S. pombe
gagttaaatctattctctgaagagg

SEQ ID NO: 93708 - DNA, 25 bp, S. pombe
gagttgtcaattcacttccaccgga

SEQ ID NO: 93709 - DNA, 25 bp, S. pombe
gagtagaacaaatccagctctgtgc

SEQ ID NO: 93710 - DNA, 25 bp, S. pombe
gagatcacctcagataaactcttgt

SEQ ID NO: 93711 - DNA, 25 bp, S. pombe
gagatctacacctaaacccgtggta

SEQ ID NO: 93712 - DNA, 25 bp, S. pombe
gagattaccaaacaggcacgtcgtt

SEQ ID NO: 93713 - DNA, 25 bp, S. pombe
gagtttcttaatcaggcatttcgtg

SEQ ID NO: 93714 - DNA, 25 bp, S. pombe
gagttccgtttgagccttatacgca

SEQ ID NO: 93715 - DNA, 25 bp, S. pombe
gagttcgtggttaagcatcctttgt

SEQ ID NO: 93716 - DNA, 25 bp, S. pombe
gagatccgtcaaagtaccaattttt

SEQ ID NO: 93717 - DNA, 25 bp, S. pombe
gagaggcaaatgcatatacgtattt

SEQ ID NO: 93718 - DNA, 25 bp, S. pombe
gagactgccattgctcatgctaaaa

SEQ ID NO: 93719 - DNA, 25 bp, S. pombe
gagacgctctattgcaaccgaacat

SEQ ID NO: 93720 - DNA, 25 bp, S. pombe
gagactgatgcttctgtcaatggat

SEQ ID NO: 93721 - DNA, 25 bp, S. pombe
gagactggtcctctatgcgattttc

SEQ ID NO: 93722 - DNA, 25 bp, S. pombe
gagagcggacctggtatcgtttacc

SEQ ID NO: 93723 - DNA, 25 bp, S. pombe
gagatgcctccaaagtatcgtaata

SEQ ID NO: 93724 - DNA, 25 bp, S. pombe
gagagtcatcaaacttacctgaata

SEQ ID NO: 93725 - DNA, 25 bp, S. pombe
gagattgatgagaactatcaccgac

SEQ ID NO: 93726 - DNA, 25 bp, S. pombe
gagtatatgcacagcggtcagcgaa

SEQ ID NO: 93727 - DNA, 25 bp, S. pombe
gagttggacagcctttccgaggaat

SEQ ID NO: 93728 - DNA, 25 bp, S. pombe
gagacgaactcgtttctgacgccta

SEQ ID NO: 93729 - DNA, 25 bp, S. pombe
gagacgtcaatgcatttttcaactt

SEQ ID NO: 93730 - DNA, 25 bp, S. pombe
gagatggtagatttcttttcttctt

SEQ ID NO: 93731 - DNA, 25 bp, S. pombe
gagaccccttattgtttgctcatag

SEQ ID NO: 93732 - DNA, 25 bp, S. pombe
gagatctgtccaacgaggtcatcaa

SEQ ID NO: 93733 - DNA, 25 bp, S. pombe
gagactcgcaacctatcactcaaag

SEQ ID NO: 93734 - DNA, 25 bp, S. pombe
gagttccccagccaaatcaagagat

SEQ ID NO: 93735 - DNA, 25 bp, S. pombe
gagttcttcctgtccagtcgaagat

SEQ ID NO: 93736 - DNA, 25 bp, S. pombe
gagactcgtgggtgattcaatcaat

SEQ ID NO: 93737 - DNA, 25 bp, S. pombe
gagagtgggccaactgtttcacttt

SEQ ID NO: 93738 - DNA, 25 bp, S. pombe
gagagtcgggctattatttgctata

SEQ ID NO: 93739 - DNA, 25 bp, S. pombe
gagagttgctggcttttcatgacta

SEQ ID NO: 93740 - DNA, 25 bp, S. pombe
gagactgaaccagctttaatcgcag

SEQ ID NO: 93741 - DNA, 25 bp, S. pombe
gagtatagatccttctcctgagtcc

SEQ ID NO: 93742 - DNA, 25 bp, S. pombe
gagatattctcgattgcctggccga

SEQ ID NO: 93743 - DNA, 25 bp, S. pombe
gagagttaaagcctcgagtcgtaat

SEQ ID NO: 93744 - DNA, 25 bp, S. pombe
gagatgatgaaactcccgcgccaga

SEQ ID NO: 93745 - DNA, 25 bp, S. pombe
gagtatgaaacttcatccccggttg

SEQ ID NO: 93746 - DNA, 25 bp, S. pombe
gatctagaacgtcaaccatcttcgc

SEQ ID NO: 93747 - DNA, 25 bp, S. pombe
gaggaaccaaactctgttgttgcag

SEQ ID NO: 93748 - DNA, 25 bp, S. pombe
gaggaaccgttctcatactattgga

SEQ ID NO: 93749 - DNA, 25 bp, S. pombe
gatggtaaatcagcaccgggatact

SEQ ID NO: 93750 - DNA, 25 bp, S. pombe
gaggctctaaagcacccgtatgtag

SEQ ID NO: 93751 - DNA, 25 bp, S. pombe
gagtccaactcatgttttcattcgt

SEQ ID NO: 93752 - DNA, 25 bp, S. pombe
gagatcgacttcagtgctcttcaac

SEQ ID NO: 93753 - DNA, 25 bp, S. pombe
gagagcgttctcattatttgcccac

SEQ ID NO: 93754 - DNA, 25 bp, S. pombe
gagacctattctggctatttactac

SEQ ID NO: 93755 - DNA, 25 bp, S. pombe
gagaccttgggtatcaacattccac

SEQ ID NO: 93756 - DNA, 25 bp, S. pombe
gagatgaaacttcgccaccgtaagc

SEQ ID NO: 93757 - DNA, 25 bp, S. pombe
gagagaagcctcaagccacatactt

SEQ ID NO: 93758 - DNA, 25 bp, S. pombe
gagtcattggcgctatttttggatt

SEQ ID NO: 93759 - DNA, 25 bp, S. pombe
gagagttcccgatcttgatgctatc

SEQ ID NO: 93760 - DNA, 25 bp, S. pombe
gagagtcccgaatatgatgctcgta

SEQ ID NO: 93761 - DNA, 25 bp, S. pombe
gagagagccatgcatgattcttcac

SEQ ID NO: 93762 - DNA, 25 bp, S. pombe
gagagtcctagatttcatcatcagc

SEQ ID NO: 93763 - DNA, 25 bp, S. pombe
gagagtatctacttctgcagcataa

SEQ ID NO: 93764 - DNA, 25 bp, S. pombe
gagagattatactccagcagaactg

SEQ ID NO: 93765 - DNA, 25 bp, S. pombe
gagatgtctcccttgctactgagaa

SEQ ID NO: 93766 - DNA, 25 bp, S. pombe
gagaccaaaaactggatgcccttgt

SEQ ID NO: 93767 - DNA, 25 bp, S. pombe
gagagctcgtacaactgccaataat

SEQ ID NO: 93768 - DNA, 25 bp, S. pombe
gagaggatccaattcgtgcattgta

SEQ ID NO: 93769 - DNA, 25 bp, S. pombe
gagagtgccgagtacattgttgcta

SEQ ID NO: 93770 - DNA, 25 bp, S. pombe
gagagcattcgacccacatttgcga

SEQ ID NO: 93771 - DNA, 25 bp, S. pombe
gagagttatacattctgattccgaa

SEQ ID NO: 93772 - DNA, 25 bp, S. pombe
gagaccctagaggtactcatgactg

SEQ ID NO: 93773 - DNA, 25 bp, S. pombe
gagagctttagtggcttccagagat

SEQ ID NO: 93774 - DNA, 25 bp, S. pombe
gagattcaatcgcttgcagtacagg

SEQ ID NO: 93775 - DNA, 25 bp, S. pombe
gagagctttcgatcgcttttgaaga

SEQ ID NO: 93776 - DNA, 25 bp, S. pombe
gagatcttacgtacgttttgcaagc

SEQ ID NO: 93777 - DNA, 25 bp, S. pombe
gagatttacctttgtttgaacgctt

SEQ ID NO: 93778 - DNA, 25 bp, S. pombe
gagataaacgtcttcagcgctatag

SEQ ID NO: 93779 - DNA, 25 bp, S. pombe
gagttgcgctattaggcctcatggc

SEQ ID NO: 93780 - DNA, 25 bp, S. pombe
gagttggccatcatggatccaggca

SEQ ID NO: 93781 - DNA, 25 bp, S. pombe
gagttaatcccgcttatagacaatt

SEQ ID NO: 93782 - DNA, 25 bp, S. pombe
gagagcaaactgtacctaacccaat

SEQ ID NO: 93783 - DNA, 25 bp, S. pombe
gagatggtacttgcctttcgataaa

SEQ ID NO: 93784 - DNA, 25 bp, S. pombe
gagtcaaatcctccggtattggtag

SEQ ID NO: 93785 - DNA, 25 bp, S. pombe
gagttcaacctccttggtctggtaa

SEQ ID NO: 93786 - DNA, 25 bp, S. pombe
gagagtatactattcggcggactag

SEQ ID NO: 93787 - DNA, 25 bp, S. pombe
gagagatcctctaaaagccgttaat

SEQ ID NO: 93788 - DNA, 25 bp, S. pombe
gagagcgtgcctattagccgttcat

SEQ ID NO: 93789 - DNA, 25 bp, S. pombe
gagtcgtacatgttttatcccgtgc

SEQ ID NO: 93790 - DNA, 25 bp, S. pombe
gagagcagctcatcgatcatccaag

SEQ ID NO: 93791 - DNA, 25 bp, S. pombe
gagagcttacctgacattttcttcg

SEQ ID NO: 93792 - DNA, 25 bp, S. pombe
gagagtgatcacttaaccttactta

SEQ ID NO: 93793 - DNA, 25 bp, S. pombe
gagagggtcgtaagcgtttcttcaa

SEQ ID NO: 93794 - DNA, 25 bp, S. pombe
gagattttagaaaagcctgttccaa

SEQ ID NO: 93795 - DNA, 25 bp, S. pombe
gagattcggcatcaactacttgtta

SEQ ID NO: 93796 - DNA, 25 bp, S. pombe
gagataccgattaaccctatacatt

SEQ ID NO: 93797 - DNA, 25 bp, S. pombe
gagatactggtatgactgcccaact

SEQ ID NO: 93798 - DNA, 25 bp, S. pombe
gagatgagctgactagttcccttag

SEQ ID NO: 93799 - DNA, 25 bp, S. pombe
gagagacaccggacatgatctatta

SEQ ID NO: 93800 - DNA, 25 bp, S. pombe
gagagacttgatacatccttcatta

SEQ ID NO: 93801 - DNA, 25 bp, S. pombe
gagagacatggtgccctaattctta

SEQ ID NO: 93802 - DNA, 25 bp, S. pombe
gagtaacgagtcctctgaatctcct

SEQ ID NO: 93803 - DNA, 25 bp, S. pombe
gagatgtttttgaggctgcagcaac

SEQ ID NO: 93804 - DNA, 25 bp, S. pombe
gagagtttgtgagccagcgacaact

SEQ ID NO: 93805 - DNA, 25 bp, S. pombe
gagtatttagctgccgaaatcctcg

SEQ ID NO: 93806 - DNA, 25 bp, S. pombe
gagtactttgcgagcctactactat

SEQ ID NO: 93807 - DNA, 25 bp, S. pombe
gagtactttggattcctcactggct

SEQ ID NO: 93808 - DNA, 25 bp, S. pombe
gagatactcgtaatgtggacctgga

SEQ ID NO: 93809 - DNA, 25 bp, S. pombe
gagagccgaatacctactatgccaa

SEQ ID NO: 93810 - DNA, 25 bp, S. pombe
gagttcatgagtcaggcgattccga

SEQ ID NO: 93811 - DNA, 25 bp, S. pombe
gagatgatcccttcgaatcgtttaa

SEQ ID NO: 93812 - DNA, 25 bp, S. pombe
gagttgcacctttaagagcattaat

SEQ ID NO: 93813 - DNA, 25 bp, S. pombe
gagttcaccatacgtggaatgcgaa

SEQ ID NO: 93814 - DNA, 25 bp, S. pombe
gagattagccaaaccgttgattctt

SEQ ID NO: 93815 - DNA, 25 bp, S. pombe
gagttgagcctcaccagacatggat

SEQ ID NO: 93816 - DNA, 25 bp, S. pombe
gagtatgccgagtaccgagtcgtta

SEQ ID NO: 93817 - DNA, 25 bp, S. pombe
gagatgaaacctttgctttgcgcgt

SEQ ID NO: 93818 - DNA, 25 bp, S. pombe
gagatcgcgaacgttctttgaacat

SEQ ID NO: 93819 - DNA, 25 bp, S. pombe
gagtcccaaagtttgctcaacctta

SEQ ID NO: 93820 - DNA, 25 bp, S. pombe
gagtccaattgtggtatcgaccgtt

SEQ ID NO: 93821 - DNA, 25 bp, S. pombe
gagagtgcattcgtcccaatgaact

SEQ ID NO: 93822 - DNA, 25 bp, S. pombe
gagagtactctctacgttgatcaaa

SEQ ID NO: 93823 - DNA, 25 bp, S. pombe
gagatgttcttgaagctgctcgctt

SEQ ID NO: 93824 - DNA, 25 bp, S. pombe
gagatgctcatctgcaggccagtga

SEQ ID NO: 93825 - DNA, 25 bp, S. pombe
gagatgccaatcaaatgccagctat

SEQ ID NO: 93826 - DNA, 25 bp, S. pombe
gagatcacctacctttgtttaccaa

SEQ ID NO: 93827 - DNA, 25 bp, S. pombe
gagattctcccaagtttaacccaga

SEQ ID NO: 93828 - DNA, 25 bp, S. pombe
gaggttcccattttgtcaaccgata

SEQ ID NO: 93829 - DNA, 25 bp, S. pombe
gagatgatattcttcctaaacccga

SEQ ID NO: 93830 - DNA, 25 bp, S. pombe
gagagtttacccaagagtcccgaag

SEQ ID NO: 93831 - DNA, 25 bp, S. pombe
gagattttccttaaggcgcacctaa

SEQ ID NO: 93832 - DNA, 25 bp, S. pombe
gagagactctttatagtgaaccaga

SEQ ID NO: 93833 - DNA, 25 bp, S. pombe
gagttgagtgctttacccgaattcc

SEQ ID NO: 93834 - DNA, 25 bp, S. pombe
gagatgttgagaaactaccgtatac

SEQ ID NO: 93835 - DNA, 25 bp, S. pombe
gagatgttgctaacttacttgtcaa

SEQ ID NO: 93836 - DNA, 25 bp, S. pombe
gagatgttcgtgatcaacttgccaa

SEQ ID NO: 93837 - DNA, 25 bp, S. pombe
gagattcgtcgcaactagctttgaa

SEQ ID NO: 93838 - DNA, 25 bp, S. pombe
gagttgctgacacattcatttctta

SEQ ID NO: 93839 - DNA, 25 bp, S. pombe
gagttgaagatctctcagccgttga

SEQ ID NO: 93840 - DNA, 25 bp, S. pombe
gagttcgagctcactgaggctattg

SEQ ID NO: 93841 - DNA, 25 bp, S. pombe
gagattgaatgcatcgctcttgaat

SEQ ID NO: 93842 - DNA, 25 bp, S. pombe
gagtaatcagtttccaattggccat

SEQ ID NO: 93843 - DNA, 25 bp, S. pombe
gttgttccatttcaattgcctgcta

SEQ ID NO: 93844 - DNA, 25 bp, S. pombe
gttgtttttcgtcttagcgatcctg

SEQ ID NO: 93845 - DNA, 25 bp, S. pombe
gagttttttcatctttaccattgcg

SEQ ID NO: 93846 - DNA, 25 bp, S. pombe
gagttctcttaaagttcgaccttgg

SEQ ID NO: 93847 - DNA, 25 bp, S. pombe
gagttgtttgccgaattttttgcag

SEQ ID NO: 93848 - DNA, 25 bp, S. pombe
gagttacgccgtgtcattttagatg

SEQ ID NO: 93849 - DNA, 25 bp, S. pombe
gagttcaccgacatcgttttagctt

SEQ ID NO: 93850 - DNA, 25 bp, S. pombe
gagatttatcttatggagtccccaa

SEQ ID NO: 93851 - DNA, 25 bp, S. pombe
gagttgatcgttatgaacaccctaa

SEQ ID NO: 93852 - DNA, 25 bp, S. pombe
gagattttcattatgcaacaccttt

SEQ ID NO: 93853 - DNA, 25 bp, S. pombe
gagattcttccgttaatgacgattt

SEQ ID NO: 93854 - DNA, 25 bp, S. pombe
gagatgtgttcgctctttgatagat

SEQ ID NO: 93855 - DNA, 25 bp, S. pombe
gagattttggtcttacatgctagat

SEQ ID NO: 93856 - DNA, 25 bp, S. pombe
gagatcatctgtggttcgaagacga

SEQ ID NO: 93857 - DNA, 25 bp, S. pombe
gagttagagctcatactgcgtcagt

SEQ ID NO: 93858 - DNA, 25 bp, S. pombe
gagttggctgaggtaccgattgcaa

SEQ ID NO: 93859 - DNA, 25 bp, S. pombe
gagatggcttgtttcttgaccacgc

SEQ ID NO: 93860 - DNA, 25 bp, S. pombe
gagttcatctcaagcgaatccttaa

SEQ ID NO: 93861 - DNA, 25 bp, S. pombe
gagttcatccagaagctaccgaaga

SEQ ID NO: 93862 - DNA, 25 bp, S. pombe
gagatttggcaaagcttacccgata

SEQ ID NO: 93863 - DNA, 25 bp, S. pombe
gagatgccattgtaatcgctccctc

SEQ ID NO: 93864 - DNA, 25 bp, S. pombe
gagatgacctgactgaccttggtgc

SEQ ID NO: 93865 - DNA, 25 bp, S. pombe
gagattttactgaccagctggctca

SEQ ID NO: 93866 - DNA, 25 bp, S. pombe
gagatgtattaactgcagccgtgcc

SEQ ID NO: 93867 - DNA, 25 bp, S. pombe
gagattcttctcaaacgccaaaagc

SEQ ID NO: 93868 - DNA, 25 bp, S. pombe
gagaggtatgcggatgcactagaaa

SEQ ID NO: 93869 - DNA, 25 bp, S. pombe
gagatcgcattgcaagccttgaaga

SEQ ID NO: 93870 - DNA, 25 bp, S. pombe
gagatggttgacacagctgatcaat

SEQ ID NO: 93871 - DNA, 25 bp, S. pombe
gagtcgccattgctggactattcat

SEQ ID NO: 93872 - DNA, 25 bp, S. pombe
gagtccacttttcatctttcaattg

SEQ ID NO: 93873 - DNA, 25 bp, S. pombe
gagatgccacagctatttcttccaa

SEQ ID NO: 93874 - DNA, 25 bp, S. pombe
gagttcctgatgtttcctccgaaat

SEQ ID NO: 93875 - DNA, 25 bp, S. pombe
gagatacatctactaccatggaggt

SEQ ID NO: 93876 - DNA, 25 bp, S. pombe
gagattcatgctttatccttgcagt

SEQ ID NO: 93877 - DNA, 25 bp, S. pombe
gagatgcatctggtcaaccattctt

SEQ ID NO: 93878 - DNA, 25 bp, S. pombe
gagatgcacttttacgttccagagg

SEQ ID NO: 93879 - DNA, 25 bp, S. pombe
gagatgagtttttcctatacctggg

SEQ ID NO: 93880 - DNA, 25 bp, S. pombe
gagaggtataatattcccgcatgtt

SEQ ID NO: 93881 - DNA, 25 bp, S. pombe
gagatgcgtattttgatccacatgt

SEQ ID NO: 93882 - DNA, 25 bp, S. pombe
gagattcttctaatgatatggttca

SEQ ID NO: 93883 - DNA, 25 bp, S. pombe
gagttggattcgctttatcttgccc

SEQ ID NO: 93884 - DNA, 25 bp, S. pombe
gagatcctgattttcttgctaatga

SEQ ID NO: 93885 - DNA, 25 bp, S. pombe
gagatgcctattatccgtgaagctt

SEQ ID NO: 93886 - DNA, 25 bp, S. pombe
gagatatcccatatgtcggaagttg

SEQ ID NO: 93887 - DNA, 25 bp, S. pombe
gagatatcctacactttcacttcat

SEQ ID NO: 93888 - DNA, 25 bp, S. pombe
gagatgtaaacaaatgattcccaag

SEQ ID NO: 93889 - DNA, 25 bp, S. pombe
gagttcaaacgcagagtcattcaat

SEQ ID NO: 93890 - DNA, 25 bp, S. pombe
gagatggtgttttatcatccactaa

SEQ ID NO: 93891 - DNA, 25 bp, S. pombe
gagtgttttttctccgaagcttcta

SEQ ID NO: 93892 - DNA, 25 bp, S. pombe
gagttttgtgttctgcgtactttca

SEQ ID NO: 93893 - DNA, 25 bp, S. pombe
gagttatcttttctactatccctct

SEQ ID NO: 93894 - DNA, 25 bp, S. pombe
gagtaccttgtcaattccttacgga

SEQ ID NO: 93895 - DNA, 25 bp, S. pombe
gagtttgccctctaattcaataccg

SEQ ID NO: 93896 - DNA, 25 bp, S. pombe
gagttctctatcacttacaagccta

SEQ ID NO: 93897 - DNA, 25 bp, S. pombe
gagtacctacaaagacaagccgata

SEQ ID NO: 93898 - DNA, 25 bp, S. pombe
gagttgaccgaacaaggcagccttt

SEQ ID NO: 93899 - DNA, 25 bp, S. pombe
gttcccgtcattctaggtctattaa

SEQ ID NO: 93900 - DNA, 25 bp, S. pombe
gatggtcgcgttgtgctaggttccc

SEQ ID NO: 93901 - DNA, 25 bp, S. pombe
gaggtcgcattaaaccggtttccat

SEQ ID NO: 93902 - DNA, 25 bp, S. pombe
gaggatcgcattcgcaacgctggaa

SEQ ID NO: 93903 - DNA, 25 bp, S. pombe
gagtgctcgcaatatagcgctggaa

SEQ ID NO: 93904 - DNA, 25 bp, S. pombe
gagtttgttgtttccgatgacgacg

SEQ ID NO: 93905 - DNA, 25 bp, S. pombe
gagatctcgaccttatcatcgtttg

SEQ ID NO: 93906 - DNA, 25 bp, S. pombe
gagattcgccaatcccaaagtggat

SEQ ID NO: 93907 - DNA, 25 bp, S. pombe
gagatccaaataccagcatacgcag

SEQ ID NO: 93908 - DNA, 25 bp, S. pombe
gagatgtagcaatggctgagcccta

SEQ ID NO: 93909 - DNA, 25 bp, S. pombe
gagatgcttgtttctctgactgaca

SEQ ID NO: 93910 - DNA, 25 bp, S. pombe
gagatttgtacagtgctgccgacta

SEQ ID NO: 93911 - DNA, 25 bp, S. pombe
gagattggctattggcatcctggta

SEQ ID NO: 93912 - DNA, 25 bp, S. pombe
gagattactcaacctattgatcgtg

SEQ ID NO: 93913 - DNA, 25 bp, S. pombe
gagatgcacaaacaacgctagtcgc

SEQ ID NO: 93914 - DNA, 25 bp, S. pombe
gatgtggaaaggtactcccatcccc

SEQ ID NO: 93915 - DNA, 25 bp, S. pombe
gatttggacggtattcaaccccatg

SEQ ID NO: 93916 - DNA, 25 bp, S. pombe
gagtatctacaatcctgcgggtcaa

SEQ ID NO: 93917 - DNA, 25 bp, S. pombe
gagattaaactttggcctcctattt

SEQ ID NO: 93918 - DNA, 25 bp, S. pombe
gagtatcctttttctggatttccta

SEQ ID NO: 93919 - DNA, 25 bp, S. pombe
gagttggtgttttggccattaccga

SEQ ID NO: 93920 - DNA, 25 bp, S. pombe
gagttgcttactgaacctgatgctt

SEQ ID NO: 93921 - DNA, 25 bp, S. pombe
gagattgccatgaacaaacgtttgt

SEQ ID NO: 93922 - DNA, 25 bp, S. pombe
gagttccgtcaaaagcatgttcagt

SEQ ID NO: 93923 - DNA, 25 bp, S. pombe
gagatcggacaaacagtaccatcat

SEQ ID NO: 93924 - DNA, 25 bp, S. pombe
gagtcggaattgtcccatttaccgc

SEQ ID NO: 93925 - DNA, 25 bp, S. pombe
gagttttattaccaatttccacgtg

SEQ ID NO: 93926 - DNA, 25 bp, S. pombe
gagtttcatgtttagaaccccacgg

SEQ ID NO: 93927 - DNA, 25 bp, S. pombe
gagatattttagtgcctccagtcac

SEQ ID NO: 93928 - DNA, 25 bp, S. pombe
gagattagtcctgtattgatgttca

SEQ ID NO: 93929 - DNA, 25 bp, S. pombe
gagatttcttgctctttggctgtca

SEQ ID NO: 93930 - DNA, 25 bp, S. pombe
gagtggttttctaacggtgattcta

SEQ ID NO: 93931 - DNA, 25 bp, S. pombe
gagtccttttctattgtattctcga

SEQ ID NO: 93932 - DNA, 25 bp, S. pombe
gagtcgcaggttgagctattacgta

SEQ ID NO: 93933 - DNA, 25 bp, S. pombe
gagattcttcctgaaactggtcatt

SEQ ID NO: 93934 - DNA, 25 bp, S. pombe
gagattcattccacgcagcattttt

SEQ ID NO: 93935 - DNA, 25 bp, S. pombe
gagtatccccagatgaatttcttac

SEQ ID NO: 93936 - DNA, 25 bp, S. pombe
gagatcgtcgactcttttcaagttt

SEQ ID NO: 93937 - DNA, 25 bp, S. pombe
gagatttaggtctttggttctacaa

SEQ ID NO: 93938 - DNA, 25 bp, S. pombe
gagatttaaccgacttgatgcctta

SEQ ID NO: 93939 - DNA, 25 bp, S. pombe
gagttaatacttcctcttcagctta

SEQ ID NO: 93940 - DNA, 25 bp, S. pombe
gagtctgaagttttaacgcctgctg

SEQ ID NO: 93941 - DNA, 25 bp, S. pombe
gagtcagtgttttggaatccctcgt

SEQ ID NO: 93942 - DNA, 25 bp, S. pombe
gagtttaatgccaattccacaccaa

SEQ ID NO: 93943 - DNA, 25 bp, S. pombe
gagtaaaattcctcccattcaagac

SEQ ID NO: 93944 - DNA, 25 bp, S. pombe
gaggataaactccttcctttcacgg

SEQ ID NO: 93945 - DNA, 25 bp, S. pombe
gatgcggaaaccgaccgtttacttg

SEQ ID NO: 93946 - DNA, 25 bp, S. pombe
gagtcaactttcgtctagctttcag

SEQ ID NO: 93947 - DNA, 25 bp, S. pombe
gagttactcgatctcttgtacttgt

SEQ ID NO: 93948 - DNA, 25 bp, S. pombe
gagttactcaggcttttggctcatt

SEQ ID NO: 93949 - DNA, 25 bp, S. pombe
gagattactctaactctaggtttca

SEQ ID NO: 93950 - DNA, 25 bp, S. pombe
gagtttaccaagttcgtttcggcat

SEQ ID NO: 93951 - DNA, 25 bp, S. pombe
gagtttgaccaagcctttcttgcga

SEQ ID NO: 93952 - DNA, 25 bp, S. pombe
gagattaatgtttccactaccgaca

SEQ ID NO: 93953 - DNA, 25 bp, S. pombe
gagttttgcgtgttcatcaatctgg

SEQ ID NO: 93954 - DNA, 25 bp, S. pombe
gagttttgcggaccattgacaagga

SEQ ID NO: 93955 - DNA, 25 bp, S. pombe
gagttaatcgcaccgttgacaaccg

SEQ ID NO: 93956 - DNA, 25 bp, S. pombe
gagttgcaacgactaatttcttccg

SEQ ID NO: 93957 - DNA, 25 bp, S. pombe
gagttgcttattgatcgattcccga

SEQ ID NO: 93958 - DNA, 25 bp, S. pombe
gagatttttacagtcacttcagttg

SEQ ID NO: 93959 - DNA, 25 bp, S. pombe
gagattatttccttcaagacagtgg

SEQ ID NO: 93960 - DNA, 25 bp, S. pombe
gagattcattccgatttacatcaca

SEQ ID NO: 93961 - DNA, 25 bp, S. pombe
gagttattgtcgtcatctggtagaa

SEQ ID NO: 93962 - DNA, 25 bp, S. pombe
gatgctacatatccgtttgtcgata

SEQ ID NO: 93963 - DNA, 25 bp, S. pombe
gagtactatgccatgctttctaagg

SEQ ID NO: 93964 - DNA, 25 bp, S. pombe
gagttgcaagccagtatcgttcgag

SEQ ID NO: 93965 - DNA, 25 bp, S. pombe
gagtatttcacttctgagagcccac

SEQ ID NO: 93966 - DNA, 25 bp, S. pombe
gagtctttcctacatgatcctttag

SEQ ID NO: 93967 - DNA, 25 bp, S. pombe
gagtacgacactaaactagctaatg

SEQ ID NO: 93968 - DNA, 25 bp, S. pombe
gagtttgcactcatcgactagctta

SEQ ID NO: 93969 - DNA, 25 bp, S. pombe
gagattatatcgctcggtatgctaa

SEQ ID NO: 93970 - DNA, 25 bp, S. pombe
gagattttatcatcgcggcttcaaa

SEQ ID NO: 93971 - DNA, 25 bp, S. pombe
gagtatattcgatttctcgctaagt

SEQ ID NO: 93972 - DNA, 25 bp, S. pombe
gatttacttgagctccctaatttat

SEQ ID NO: 93973 - DNA, 25 bp, S. pombe
gagttactatatctgctcctcatat

SEQ ID NO: 93974 - DNA, 25 bp, S. pombe
gagttgcaccgtttgatggccaaga

SEQ ID NO: 93975 - DNA, 25 bp, S. pombe
gagttgacgatgtcatctatcccaa

SEQ ID NO: 93976 - DNA, 25 bp, S. pombe
gagttcaatgttttggtcatcttag

SEQ ID NO: 93977 - DNA, 25 bp, S. pombe
gaggacttgtattcggctacttcgt

SEQ ID NO: 93978 - DNA, 25 bp, S. pombe
gagtcaaaggatcaacccaccgtgt

SEQ ID NO: 93979 - DNA, 25 bp, S. pombe
gatgaaaaggacttccgccgtcgca

SEQ ID NO: 93980 - DNA, 25 bp, S. pombe
gagggattttttgctctcgtcgaaa

SEQ ID NO: 93981 - DNA, 25 bp, S. pombe
gagtatgttttttcttccgaatgta

SEQ ID NO: 93982 - DNA, 25 bp, S. pombe
gagttgtttcgatcctcgattacca

SEQ ID NO: 93983 - DNA, 25 bp, S. pombe
gaggaaagccggtgacttgaatcaa

SEQ ID NO: 93984 - DNA, 25 bp, S. pombe
gatgcgggtagtcaggtcacttcac

SEQ ID NO: 93985 - DNA, 25 bp, S. pombe
gagtcggatcgttatggtactacat

SEQ ID NO: 93986 - DNA, 25 bp, S. pombe
gagtagtcggctattcattgccttc

SEQ ID NO: 93987 - DNA, 25 bp, S. pombe
gaggtgaaaccaactactccttcgg

SEQ ID NO: 93988 - DNA, 25 bp, S. pombe
gaggtaaaccagatctttcgtcttt

SEQ ID NO: 93989 - DNA, 25 bp, S. pombe
gggtgaaaccaatccttatttctct

SEQ ID NO: 93990 - DNA, 25 bp, S. pombe
gatgtttgtggccaatgtggtcttt

SEQ ID NO: 93991 - DNA, 25 bp, S. pombe
gagtttagtgccaatgctactgctt

SEQ ID NO: 93992 - DNA, 25 bp, S. pombe
gagttctcagatccaaatttcgatt

SEQ ID NO: 93993 - DNA, 25 bp, S. pombe
gagttgctgctttgaatacacgctt

SEQ ID NO: 93994 - DNA, 25 bp, S. pombe
gaggttcctaacacgattgcggact

SEQ ID NO: 93995 - DNA, 25 bp, S. pombe
gagtttttgaataaggtcatcggca

SEQ ID NO: 93996 - DNA, 25 bp, S. pombe
gagttcttttcggaggagtcctcag

SEQ ID NO: 93997 - DNA, 25 bp, S. pombe
gagttgctattcacggatggtcttc

SEQ ID NO: 93998 - DNA, 25 bp, S. pombe
gagtatcttcttagtgttgttcgtg

SEQ ID NO: 93999 - DNA, 25 bp, S. pombe
gagtcactatttacttcttctgttg

SEQ ID NO: 94000 - DNA, 25 bp, S. pombe
gagtctccggtgactatgcagtctg

SEQ ID NO: 94001 - DNA, 25 bp, S. pombe
gagtttcaggttcgagatgcactaa

SEQ ID NO: 94002 - DNA, 25 bp, S. pombe
gagtttacaattcgcaatctccgcc

SEQ ID NO: 94003 - DNA, 25 bp, S. pombe
gagttatgacagctccacatcaacc

SEQ ID NO: 94004 - DNA, 25 bp, S. pombe
gagtgttacaggacggataccgcat

SEQ ID NO: 94005 - DNA, 25 bp, S. pombe
gagtgttgcctttgacgttgatgct

SEQ ID NO: 94006 - DNA, 25 bp, S. pombe
gagttccaatgtcgcaatttgccgt

SEQ ID NO: 94007 - DNA, 25 bp, S. pombe
gagtagttcagctcttttccgaaat

SEQ ID NO: 94008 - DNA, 25 bp, S. pombe
gagttcaacatggtcttttccgaga

SEQ ID NO: 94009 - DNA, 25 bp, S. pombe
gaggtgagcatgcataccctagatc

SEQ ID NO: 94010 - DNA, 25 bp, S. pombe
gaggtggtggaagattgcaacaaac

SEQ ID NO: 94011 - DNA, 25 bp, S. pombe
gaggtttggaactctcactaccaga

SEQ ID NO: 94012 - DNA, 25 bp, S. pombe
gaggtttgaaggcacttacaccaag

SEQ ID NO: 94013 - DNA, 25 bp, S. pombe
gagttttagacgcttctgacggcaa

SEQ ID NO: 94014 - DNA, 25 bp, S. pombe
gagttttggcctcgtcttactaaag

SEQ ID NO: 94015 - DNA, 25 bp, S. pombe
gagttgttcttttgttctgacagca

SEQ ID NO: 94016 - DNA, 25 bp, S. pombe
gagttgctggttatatgcttggaca

SEQ ID NO: 94017 - DNA, 25 bp, S. pombe
gagtttggtgtggaacttggtccca

SEQ ID NO: 94018 - DNA, 25 bp, S. pombe
gagtctaggttgttgtctttggtaa

SEQ ID NO: 94019 - DNA, 25 bp, S. pombe
gagtatgtacttcctttggctgtat

SEQ ID NO: 94020 - DNA, 25 bp, S. pombe
gagttgcaatgacccttgtagctgt

SEQ ID NO: 94021 - DNA, 25 bp, S. pombe
gagtacccgaccttagatttgatct

SEQ ID NO: 94022 - DNA, 25 bp, S. pombe
gagtcacccgatgattattccgata

SEQ ID NO: 94023 - DNA, 25 bp, S. pombe
gagtaacgatgcttcaacttctaaa

SEQ ID NO: 94024 - DNA, 25 bp, S. pombe
gagtagcagaagtgcctattccaaa

SEQ ID NO: 94025 - DNA, 25 bp, S. pombe
gagtactggcagtggtttcaccaac

SEQ ID NO: 94026 - DNA, 25 bp, S. pombe
gagttcctcaagttccacgatattg

SEQ ID NO: 94027 - DNA, 25 bp, S. pombe
gagtctgcctcaacagtacatcgat

SEQ ID NO: 94028 - DNA, 25 bp, S. pombe
gatcttcctaccattaagggttctg

SEQ ID NO: 94029 - DNA, 25 bp, S. pombe
gttcccttccttcaagaggtcgcta

SEQ ID NO: 94030 - DNA, 25 bp, S. pombe
gagtgtcgctggaccaaagaacttc

SEQ ID NO: 94031 - DNA, 25 bp, S. pombe
gagttcgctcaaatattccatcata

SEQ ID NO: 94032 - DNA, 25 bp, S. pombe
gagttcatcactcctgctgaagatt

SEQ ID NO: 94033 - DNA, 25 bp, S. pombe
gagtgcccctttagaaatcgacgtt

SEQ ID NO: 94034 - DNA, 25 bp, S. pombe
gagtcctcctttattcatcatgaac

SEQ ID NO: 94035 - DNA, 25 bp, S. pombe
gagtccttctaagattccaatcaga

SEQ ID NO: 94036 - DNA, 25 bp, S. pombe
gagtcctccgaaaattacaaccttg

SEQ ID NO: 94037 - DNA, 25 bp, S. pombe
gagtttcctgaaattttcaccgtcg

SEQ ID NO: 94038 - DNA, 25 bp, S. pombe
gagtctttcggtttcactggtgaac

SEQ ID NO: 94039 - DNA, 25 bp, S. pombe
gagttttccacttatcaaggccaat

SEQ ID NO: 94040 - DNA, 25 bp, S. pombe
gagtacctaccttgattgatcacca

SEQ ID NO: 94041 - DNA, 25 bp, S. pombe
gagtacctactttagttgaccacaa

SEQ ID NO: 94042 - DNA, 25 bp, S. pombe
gagtatcgattcttcagtaccgcgt

SEQ ID NO: 94043 - DNA, 25 bp, S. pombe
gagttttttctctaaggcttgcacc

SEQ ID NO: 94044 - DNA, 25 bp, S. pombe
gagtttctcaataaacgccttcccg

SEQ ID NO: 94045 - DNA, 25 bp, S. pombe
gagttttctgttcaagctgctatgc

SEQ ID NO: 94046 - DNA, 25 bp, S. pombe
gagttcttcatgctgtagctctcta

SEQ ID NO: 94047 - DNA, 25 bp, S. pombe
gagtatcgcacttatattgctaccg

SEQ ID NO: 94048 - DNA, 25 bp, S. pombe
gagtattcattgttctaccgtctga

SEQ ID NO: 94049 - DNA, 25 bp, S. pombe
gagtttgatcattcgaaggccacag

SEQ ID NO: 94050 - DNA, 25 bp, S. pombe
gagtctacgctcactgatgaccagt

SEQ ID NO: 94051 - DNA, 25 bp, S. pombe
gagtcgatcctaatcttgacgttga

SEQ ID NO: 94052 - DNA, 25 bp, S. pombe
gagtctgtcgtgaatgccataggtc

SEQ ID NO: 94053 - DNA, 25 bp, S. pombe
gagtctgtgcgagaggaaagcccta

SEQ ID NO: 94054 - DNA, 25 bp, S. pombe
gatgtttgtactctggaagccctaa

SEQ ID NO: 94055 - DNA, 25 bp, S. pombe
gagttttacgttaagcttgctgctg

SEQ ID NO: 94056 - DNA, 25 bp, S. pombe
gagttcttctctaaacgtcagctag

SEQ ID NO: 94057 - DNA, 25 bp, S. pombe
gagtttccagagctatttccagacg

SEQ ID NO: 94058 - DNA, 25 bp, S. pombe
gagttatgcttctgctttatgccaa

SEQ ID NO: 94059 - DNA, 25 bp, S. pombe
gagttctgattatctccttgctata

SEQ ID NO: 94060 - DNA, 25 bp, S. pombe
gagtcttgtctaatcccatggtgac

SEQ ID NO: 94061 - DNA, 25 bp, S. pombe
gagtatcagtcgttcagccacttac

SEQ ID NO: 94062 - DNA, 25 bp, S. pombe
gagtatacatcagtcctaaaggaat

SEQ ID NO: 94063 - DNA, 25 bp, S. pombe
gagtcactactctactaaaacagtt

SEQ ID NO: 94064 - DNA, 25 bp, S. pombe
gagttctattcatttaccacacatt

SEQ ID NO: 94065 - DNA, 25 bp, S. pombe
gagtatcgtccattatctccaagat

SEQ ID NO: 94066 - DNA, 25 bp, S. pombe
gagttcgtgctttttcacatggcat

SEQ ID NO: 94067 - DNA, 25 bp, S. pombe
gagtatgcgctcgtttgtcatgggc

SEQ ID NO: 94068 - DNA, 25 bp, S. pombe
gagtatatctctttcgttgatgagc

SEQ ID NO: 94069 - DNA, 25 bp, S. pombe
gagttatgctcgttattgctgctac

SEQ ID NO: 94070 - DNA, 25 bp, S. pombe
gagttattcagtttcagctgctcaa

SEQ ID NO: 94071 - DNA, 25 bp, S. pombe
gagtttgccctcttgcagcataaaa

SEQ ID NO: 94072 - DNA, 25 bp, S. pombe
gagttagaactctcgctggttatac

SEQ ID NO: 94073 - DNA, 25 bp, S. pombe
gagttttgggatacgctgacttata

SEQ ID NO: 94074 - DNA, 25 bp, S. pombe
gagttcttggtatttgctgccttaa

SEQ ID NO: 94075 - DNA, 25 bp, S. pombe
gagttcttggcgttctcgcaaacaa

SEQ ID NO: 94076 - DNA, 25 bp, S. pombe
gagttcttggtcttttcagcgcaat

SEQ ID NO: 94077 - DNA, 25 bp, S. pombe
gagttcattttaagtcctcagcaat

SEQ ID NO: 94078 - DNA, 25 bp, S. pombe
gagttatcgactacttcgccagagt

SEQ ID NO: 94079 - DNA, 25 bp, S. pombe
gagtttatgaaagtccgcctcacat

SEQ ID NO: 94080 - DNA, 25 bp, S. pombe
gagttatacagcgtgccattgagca

SEQ ID NO: 94081 - DNA, 25 bp, S. pombe
gagttcatacgagtactgcatcagt

SEQ ID NO: 94082 - DNA, 25 bp, S. pombe
gatgcttgcaatcagctagctggca

SEQ ID NO: 94083 - DNA, 25 bp, S. pombe
gagtttattcaaccgacccaatgtt

SEQ ID NO: 94084 - DNA, 25 bp, S. pombe
gagttttatgcaacggacagccaat

SEQ ID NO: 94085 - DNA, 25 bp, S. pombe
gaggtctgggcatcgcgaaaagcac

SEQ ID NO: 94086 - DNA, 25 bp, S. pombe
gagggccttatgctcttaaatacag

SEQ ID NO: 94087 - DNA, 25 bp, S. pombe
gagtcaacacgtttatcgcctgaaa

SEQ ID NO: 94088 - DNA, 25 bp, S. pombe
gagtcaactggatattccttcacag

SEQ ID NO: 94089 - DNA, 25 bp, S. pombe
gagtatccttgcttctactagactt

SEQ ID NO: 94090 - DNA, 25 bp, S. pombe
gagtttatcccaattttcagtgagg

SEQ ID NO: 94091 - DNA, 25 bp, S. pombe
gagtttatctgccaacaggtgtttc

SEQ ID NO: 94092 - DNA, 25 bp, S. pombe
gagtgttttcgctacatttgctttt

SEQ ID NO: 94093 - DNA, 25 bp, S. pombe
gagttttccggagatctgttatttt

SEQ ID NO: 94094 - DNA, 25 bp, S. pombe
gagttacccctagcagaattgatta

SEQ ID NO: 94095 - DNA, 25 bp, S. pombe
gagttacccagcaggcacaatcttt

SEQ ID NO: 94096 - DNA, 25 bp, S. pombe
gagtcgacagtgtcagccatccgat

SEQ ID NO: 94097 - DNA, 25 bp, S. pombe
gagtcgcctcattaatgggtaccac

SEQ ID NO: 94098 - DNA, 25 bp, S. pombe
gagtttttagctatgtacgagcctt

SEQ ID NO: 94099 - DNA, 25 bp, S. pombe
gagtctaatagtcctcgtcaggtgt

SEQ ID NO: 94100 - DNA, 25 bp, S. pombe
gagtcattaatttccgtgcacctac

SEQ ID NO: 94101 - DNA, 25 bp, S. pombe
gatgtttctacatgggatgcctttc

SEQ ID NO: 94102 - DNA, 25 bp, S. pombe
gagtttcaaatttgcgattcttctc

SEQ ID NO: 94103 - DNA, 25 bp, S. pombe
gagtctattgttttggttctttcta

SEQ ID NO: 94104 - DNA, 25 bp, S. pombe
gaggttatatgacactgtcgcccgc

SEQ ID NO: 94105 - DNA, 25 bp, S. pombe
gaggttgaaccactacgcattccta

SEQ ID NO: 94106 - DNA, 25 bp, S. pombe
gagtaatcatccctaatcgtgtaaa

SEQ ID NO: 94107 - DNA, 25 bp, S. pombe
gagtaattccattaacgcgctagaa

SEQ ID NO: 94108 - DNA, 25 bp, S. pombe
gagtgaacatccaaaacccgagaat

SEQ ID NO: 94109 - DNA, 25 bp, S. pombe
gaggaactctaacaccgggtatctt

SEQ ID NO: 94110 - DNA, 25 bp, S. pombe
gaggttggtaagcacaccgctgtta

SEQ ID NO: 94111 - DNA, 25 bp, S. pombe
gagtcccatttaaatcacgcagtct

SEQ ID NO: 94112 - DNA, 25 bp, S. pombe
gagtcccaagttaaatccgctctca

SEQ ID NO: 94113 - DNA, 25 bp, S. pombe
gagtcctctaatttaaatgccccac

SEQ ID NO: 94114 - DNA, 25 bp, S. pombe
gatgtccttgacactacaggcgatt

SEQ ID NO: 94115 - DNA, 25 bp, S. pombe
gagtttgtctcatctgatatgtcat

SEQ ID NO: 94116 - DNA, 25 bp, S. pombe
gagtacgaccttactttgaggttga

SEQ ID NO: 94117 - DNA, 25 bp, S. pombe
gagtgcttaccgacatcggcgacga

SEQ ID NO: 94118 - DNA, 25 bp, S. pombe
gatgacccaaatttagcttaccagc

SEQ ID NO: 94119 - DNA, 25 bp, S. pombe
gagtctggctatatctcctaatgaa

SEQ ID NO: 94120 - DNA, 25 bp, S. pombe
gagtgctgaagttgcatctcaaaag

SEQ ID NO: 94121 - DNA, 25 bp, S. pombe
gagtcatcagctaagagggcacaaa

SEQ ID NO: 94122 - DNA, 25 bp, S. pombe
gagtgcaagcagtaggcggccatta

SEQ ID NO: 94123 - DNA, 25 bp, S. pombe
gagtctgctttcgatgctgctgaaa

SEQ ID NO: 94124 - DNA, 25 bp, S. pombe
gagtgctctccttgatgaacgatct

SEQ ID NO: 94125 - DNA, 25 bp, S. pombe
gaggatgaacgacttgctcaagcta

SEQ ID NO: 94126 - DNA, 25 bp, S. pombe
gagtgcgtccgatttctatactaat

SEQ ID NO: 94127 - DNA, 25 bp, S. pombe
gagtctgtaggtgcagcttactatt

SEQ ID NO: 94128 - DNA, 25 bp, S. pombe
gagtctgaacatcctattgtctcct

SEQ ID NO: 94129 - DNA, 25 bp, S. pombe
gagtttcgattattatctcccgcgt

SEQ ID NO: 94130 - DNA, 25 bp, S. pombe
gagtcatttggcgaacttgtccccg

SEQ ID NO: 94131 - DNA, 25 bp, S. pombe
gagtcatttcggaagttctcccacg

SEQ ID NO: 94132 - DNA, 25 bp, S. pombe
gagtcttgtgcagatattcttcccc

SEQ ID NO: 94133 - DNA, 25 bp, S. pombe
gagtcaatacagatagcatcccaac

SEQ ID NO: 94134 - DNA, 25 bp, S. pombe
gaggttagcggtatccaaggtactt

SEQ ID NO: 94135 - DNA, 25 bp, S. pombe
gagggacaacaacaatccgtttttg

SEQ ID NO: 94136 - DNA, 25 bp, S. pombe
gagtccacacaagccatatttttat

SEQ ID NO: 94137 - DNA, 25 bp, S. pombe
gaggtttgggattccatctcaagca

SEQ ID NO: 94138 - DNA, 25 bp, S. pombe
gagtttgatatgcacatccttccaa

SEQ ID NO: 94139 - DNA, 25 bp, S. pombe
gagtattttgcacccttcatgttca

SEQ ID NO: 94140 - DNA, 25 bp, S. pombe
gagtaattcacttccttctgttaag

SEQ ID NO: 94141 - DNA, 25 bp, S. pombe
gagtatgtttcctataattcagtgg

SEQ ID NO: 94142 - DNA, 25 bp, S. pombe
gagtcgttacctaatgcttctgaag

SEQ ID NO: 94143 - DNA, 25 bp, S. pombe
gagtctgtaactcaggctctattcc

SEQ ID NO: 94144 - DNA, 25 bp, S. pombe
gagtagaacctcgagcttctgtggc

SEQ ID NO: 94145 - DNA, 25 bp, S. pombe
gagtagttcctaatgcttgcattct

SEQ ID NO: 94146 - DNA, 25 bp, S. pombe
gagtcttctctcgttcaagtcttaa

SEQ ID NO: 94147 - DNA, 25 bp, S. pombe
gagtctgttcctgtacagcgtgatt

SEQ ID NO: 94148 - DNA, 25 bp, S. pombe
gagtatgctttctttcaagcgttct

SEQ ID NO: 94149 - DNA, 25 bp, S. pombe
gagtatttcacgactcgtttgcttt

SEQ ID NO: 94150 - DNA, 25 bp, S. pombe
gagtattctcgggtcatttatgctt

SEQ ID NO: 94151 - DNA, 25 bp, S. pombe
gagtcttcggaggtttttgcattta

SEQ ID NO: 94152 - DNA, 25 bp, S. pombe
gagtttgtgtcaattgtcgtcagca

SEQ ID NO: 94153 - DNA, 25 bp, S. pombe
gatgcttgtggtgctactaacccta

SEQ ID NO: 94154 - DNA, 25 bp, S. pombe
gagtttggatgcacctacacacaac

SEQ ID NO: 94155 - DNA, 25 bp, S. pombe
gagtcattggatcttgttcccatag

SEQ ID NO: 94156 - DNA, 25 bp, S. pombe
gagtatttgcactttattcccaagt

SEQ ID NO: 94157 - DNA, 25 bp, S. pombe
gagtattatgcatcgttttcagaaa

SEQ ID NO: 94158 - DNA, 25 bp, S. pombe
gagtacgaccgcaactttcgataga

SEQ ID NO: 94159 - DNA, 25 bp, S. pombe
gagtccaaatcaacgtactgcgaat

SEQ ID NO: 94160 - DNA, 25 bp, S. pombe
gagtcacaaaatcttcgcatcctgc

SEQ ID NO: 94161 - DNA, 25 bp, S. pombe
gagggactagcacaaccgatggttt

SEQ ID NO: 94162 - DNA, 25 bp, S. pombe
gagggacagtcgcaagatgatttac

SEQ ID NO: 94163 - DNA, 25 bp, S. pombe
gagggaaatcctttgcagaaaacca

SEQ ID NO: 94164 - DNA, 25 bp, S. pombe
gagtcaaaagtcgtatatcgttcaa

SEQ ID NO: 94165 - DNA, 25 bp, S. pombe
gagtctcagaattcagctttaaaag

SEQ ID NO: 94166 - DNA, 25 bp, S. pombe
gagtcccgatcacgttgacgaactg

SEQ ID NO: 94167 - DNA, 25 bp, S. pombe
gaggtacgatcctttatggaactaa

SEQ ID NO: 94168 - DNA, 25 bp, S. pombe
gagggacgacgcttagaggttatat

SEQ ID NO: 94169 - DNA, 25 bp, S. pombe
gagggcaccgaatccacagcttgtt

SEQ ID NO: 94170 - DNA, 25 bp, S. pombe
gagtgttttaaataaccattggcta

SEQ ID NO: 94171 - DNA, 25 bp, S. pombe
gagtgttttaaataaccattggcta

SEQ ID NO: 94172 - DNA, 25 bp, S. pombe
gagtacttttcgaagaatccaaaat

SEQ ID NO: 94173 - DNA, 25 bp, S. pombe
gagtatctttcttggatgcaacctt

SEQ ID NO: 94174 - DNA, 25 bp, S. pombe
gagtcatcctcgatcgatcatacag

SEQ ID NO: 94175 - DNA, 25 bp, S. pombe
gagtgttgaaaccacaattcagcca

SEQ ID NO: 94176 - DNA, 25 bp, S. pombe
gagggagttatcttcttatgcatac

SEQ ID NO: 94177 - DNA, 25 bp, S. pombe
gagtccgtacacatagatgttcctg

SEQ ID NO: 94178 - DNA, 25 bp, S. pombe
gagtacatctttcttattgcattgg

SEQ ID NO: 94179 - DNA, 25 bp, S. pombe
gagtatgcgatcttatgtgtccaaa

SEQ ID NO: 94180 - DNA, 25 bp, S. pombe
gagtaatgcatactttgtgccaaga

SEQ ID NO: 94181 - DNA, 25 bp, S. pombe
gagtactgctgattctcttagctct

SEQ ID NO: 94182 - DNA, 25 bp, S. pombe
gagtgcacttgcgactttaattcat

SEQ ID NO: 94183 - DNA, 25 bp, S. pombe
gagtcatcctcctctgataatttag

SEQ ID NO: 94184 - DNA, 25 bp, S. pombe
gagtcattccctaaagtatctgcta

SEQ ID NO: 94185 - DNA, 25 bp, S. pombe
gagtcttgcattgacgtttcctaaa

SEQ ID NO: 94186 - DNA, 25 bp, S. pombe
gagtctcatatctataccttgctta

SEQ ID NO: 94187 - DNA, 25 bp, S. pombe
gagtctaccacagttgccactaaat

SEQ ID NO: 94188 - DNA, 25 bp, S. pombe
gagtctacatcattttccacatcaa

SEQ ID NO: 94189 - DNA, 25 bp, S. pombe
gagtcgatctggtttatgctccaac

SEQ ID NO: 94190 - DNA, 25 bp, S. pombe
gagtaattggcaatcctcccaacgt

SEQ ID NO: 94191 - DNA, 25 bp, S. pombe
gagtactgttgaatcctcagcgaat

SEQ ID NO: 94192 - DNA, 25 bp, S. pombe
gagggttgaaaactccaatgtccat

SEQ ID NO: 94193 - DNA, 25 bp, S. pombe
gagggcttaacattacgcgaattct

SEQ ID NO: 94194 - DNA, 25 bp, S. pombe
gagtgctgcttattcccacgattta

SEQ ID NO: 94195 - DNA, 25 bp, S. pombe
gagtgcgtttgctccagattttcaa

SEQ ID NO: 94196 - DNA, 25 bp, S. pombe
gagtgctgttgctggaggatttccc

SEQ ID NO: 94197 - DNA, 25 bp, S. pombe
gaggaaaacgccactgcaagccata

SEQ ID NO: 94198 - DNA, 25 bp, S. pombe
gagtgggcagatttcgttccagcct

SEQ ID NO: 94199 - DNA, 25 bp, S. pombe
gagtgctgttttgactaccatggac

SEQ ID NO: 94200 - DNA, 25 bp, S. pombe
gagtcttgtcccttctaagaacaat

SEQ ID NO: 94201 - DNA, 25 bp, S. pombe
gagtctatacgtatcaatttgcaac

SEQ ID NO: 94202 - DNA, 25 bp, S. pombe
gagtctgatatgctgttggatttaa

SEQ ID NO: 94203 - DNA, 25 bp, S. pombe
gagtacaagcatattgtgattatga

SEQ ID NO: 94204 - DNA, 25 bp, S. pombe
gagtacggctcttcagtttatgctt

SEQ ID NO: 94205 - DNA, 25 bp, S. pombe
gaggccgtcgtttatgttttcacca

SEQ ID NO: 94206 - DNA, 25 bp, S. pombe
gagtcaagtcctgttttggttgcgt

SEQ ID NO: 94207 - DNA, 25 bp, S. pombe
gatgttaagtcctttatacgaacgt

SEQ ID NO: 94208 - DNA, 25 bp, S. pombe
gatggagtctatcacaccaacgggt

SEQ ID NO: 94209 - DNA, 25 bp, S. pombe
gagtgtacgaaacagagctacttgt

SEQ ID NO: 94210 - DNA, 25 bp, S. pombe
gagtgagtttgctactctcaccact

SEQ ID NO: 94211 - DNA, 25 bp, S. pombe
gagtgtcagtcaaaatatcgcctta

SEQ ID NO: 94212 - DNA, 25 bp, S. pombe
gagtctgcaccacttaagctttctt

SEQ ID NO: 94213 - DNA, 25 bp, S. pombe
gatgtacctgtgttttggcctattc

SEQ ID NO: 94214 - DNA, 25 bp, S. pombe
gatgtagcggtcctttctggtcttc

SEQ ID NO: 94215 - DNA, 25 bp, S. pombe
gaggaccatgtatattctattcgtg

SEQ ID NO: 94216 - DNA, 25 bp, S. pombe
gagtcgctactgtggaacgtggcta

SEQ ID NO: 94217 - DNA, 25 bp, S. pombe
gagtcaccacagttcaaggtcttga

SEQ ID NO: 94218 - DNA, 25 bp, S. pombe
gagtcccaggagtctttctattcaa

SEQ ID NO: 94219 - DNA, 25 bp, S. pombe
gagtggagccttgcggatacagatt

SEQ ID NO: 94220 - DNA, 25 bp, S. pombe
gaggcatttttacagtaccttgaat

SEQ ID NO: 94221 - DNA, 25 bp, S. pombe
gaggattctttgctagtggtcttaa

SEQ ID NO: 94222 - DNA, 25 bp, S. pombe
gagggctattcagtttggttctaaa

SEQ ID NO: 94223 - DNA, 25 bp, S. pombe
gaggtgtcaatttttcttccggcca

SEQ ID NO: 94224 - DNA, 25 bp, S. pombe
gagggtttgtacgtggccttcaatc

SEQ ID NO: 94225 - DNA, 25 bp, S. pombe
gagggttctgttcctctgaaaacct

SEQ ID NO: 94226 - DNA, 25 bp, S. pombe
gaggttctcggctcaagttgaacga

SEQ ID NO: 94227 - DNA, 25 bp, S. pombe
gaggtctaggcactggcatgtctac

SEQ ID NO: 94228 - DNA, 25 bp, S. pombe
gagtctcgcaatgcttcttgttatc

SEQ ID NO: 94229 - DNA, 25 bp, S. pombe
gagggaggtactaatctcgaccata

SEQ ID NO: 94230 - DNA, 25 bp, S. pombe
gaggcggttcgcgaattagttcaac

SEQ ID NO: 94231 - DNA, 25 bp, S. pombe
gaggaccggcttatttcgacaaatc

SEQ ID NO: 94232 - DNA, 25 bp, S. pombe
gttgcaacctgacgttttagaaact

SEQ ID NO: 94233 - DNA, 25 bp, S. pombe
gagtctgccttaccttctggtggaa

SEQ ID NO: 94234 - DNA, 25 bp, S. pombe
gagtctaattatcgttgtttgttca

SEQ ID NO: 94235 - DNA, 25 bp, S. pombe
gaggtcaccgatcgtatcttttcca

SEQ ID NO: 94236 - DNA, 25 bp, S. pombe
gagtcattacatatggcatcttctt

SEQ ID NO: 94237 - DNA, 25 bp, S. pombe
gagtcctaggcggaatgcgcccaaa

SEQ ID NO: 94238 - DNA, 25 bp, S. pombe
gagtctgctgaagatgagtttccta

SEQ ID NO: 94239 - DNA, 25 bp, S. pombe
gagtccgttccatgatttacacaag

SEQ ID NO: 94240 - DNA, 25 bp, S. pombe
gagtccgacatccacacaattacat

SEQ ID NO: 94241 - DNA, 25 bp, S. pombe
gggagcctacatgggaaggaaattc

SEQ ID NO: 94242 - DNA, 25 bp, S. pombe
gatgatacgctatgggaaaacaatt

SEQ ID NO: 94243 - DNA, 25 bp, S. pombe
gatgtacctaacctgcaaaacgttt

SEQ ID NO: 94244 - DNA, 25 bp, S. pombe
gatagctcgtcagcccaaaaggttt

SEQ ID NO: 94245 - DNA, 25 bp, S. pombe
gagtgatcttcccatatccgatgaa

SEQ ID NO: 94246 - DNA, 25 bp, S. pombe
gagtgcacaatcctgtgcttgcatg

SEQ ID NO: 94247 - DNA, 25 bp, S. pombe
gagtgcatctgttgttctagcttca

SEQ ID NO: 94248 - DNA, 25 bp, S. pombe
gagtgctctgtttttgctgatatga

SEQ ID NO: 94249 - DNA, 25 bp, S. pombe
gagtgctcccaattactgctataga

SEQ ID NO: 94250 - DNA, 25 bp, S. pombe
gagtccctagcaataattcaacaag

SEQ ID NO: 94251 - DNA, 25 bp, S. pombe
gagtgctcccgactatattaacaat

SEQ ID NO: 94252 - DNA, 25 bp, S. pombe
gagtctgtcgcttctttggtacaat

SEQ ID NO: 94253 - DNA, 25 bp, S. pombe
gagtcctcttggcttggtgatcaaa

SEQ ID NO: 94254 - DNA, 25 bp, S. pombe
gagtccgtttgttatgtgtctcaaa

SEQ ID NO: 94255 - DNA, 25 bp, S. pombe
gagggttacggattgcattgtctaa

SEQ ID NO: 94256 - DNA, 25 bp, S. pombe
gaggtcgtagcggagtcttgtctaa

SEQ ID NO: 94257 - DNA, 25 bp, S. pombe
gagggcgatcgcaaagttcttaaag

SEQ ID NO: 94258 - DNA, 25 bp, S. pombe
gagtgacgatcgaaacttggcgcaa

SEQ ID NO: 94259 - DNA, 25 bp, S. pombe
gagtgtccttttactgtcatggtgt

SEQ ID NO: 94260 - DNA, 25 bp, S. pombe
gatgttgcacttttgactgacggtc

SEQ ID NO: 94261 - DNA, 25 bp, S. pombe
gtcgggttgtttccctatgcaccgg

SEQ ID NO: 94262 - DNA, 25 bp, S. pombe
gatgctgacgttgtttccattgaga

SEQ ID NO: 94263 - DNA, 25 bp, S. pombe
gaggtgcactcgttaagccatggat

SEQ ID NO: 94264 - DNA, 25 bp, S. pombe
gagtgtccacgaatctgaaatgcca

SEQ ID NO: 94265 - DNA, 25 bp, S. pombe
gagtctctgcctgtaaagctatcaa

SEQ ID NO: 94266 - DNA, 25 bp, S. pombe
gagtctcatcttataaaccaggcat

SEQ ID NO: 94267 - DNA, 25 bp, S. pombe
gagtgctatctttttgaagcgccca

SEQ ID NO: 94268 - DNA, 25 bp, S. pombe
gaggctgttgattctgaaaccgcca

SEQ ID NO: 94269 - DNA, 25 bp, S. pombe
gaggcatttgtgataaacgaaacta

SEQ ID NO: 94270 - DNA, 25 bp, S. pombe
gagtgattgcccctaataatttaat

SEQ ID NO: 94271 - DNA, 25 bp, S. pombe
gaggacgctaatctaaattcttttg

SEQ ID NO: 94272 - DNA, 25 bp, S. pombe
gaggatcctgaaactctacttgttt

SEQ ID NO: 94273 - DNA, 25 bp, S. pombe
gagtcggaacatgatcgcagtttaa

SEQ ID NO: 94274 - DNA, 25 bp, S. pombe
gagtgctttccatcaaaaactgttt

SEQ ID NO: 94275 - DNA, 25 bp, S. pombe
gagtgttaccgacaaatgcctttat

SEQ ID NO: 94276 - DNA, 25 bp, S. pombe
gatcgaccaccgttaatacctatta

SEQ ID NO: 94277 - DNA, 25 bp, S. pombe
gatggaagtacgtttcttcctacga

SEQ ID NO: 94278 - DNA, 25 bp, S. pombe
gagggtgtgtaaaccttcctccaga

SEQ ID NO: 94279 - DNA, 25 bp, S. pombe
gaggttgttcaaaccatccgtccag

SEQ ID NO: 94280 - DNA, 25 bp, S. pombe
gaggttgttgaattcccttctcaag

SEQ ID NO: 94281 - DNA, 25 bp, S. pombe
gagtgctttacttatctcaaccaag

SEQ ID NO: 94282 - DNA, 25 bp, S. pombe
gaggttccctaattcaagcgaagtt

SEQ ID NO: 94283 - DNA, 25 bp, S. pombe
gagtgattcctccaattaacgtttt

SEQ ID NO: 94284 - DNA, 25 bp, S. pombe
gagtgccccattgactcatatcaat

SEQ ID NO: 94285 - DNA, 25 bp, S. pombe
gaggccgctgcagtgctggtcaaaa

SEQ ID NO: 94286 - DNA, 25 bp, S. pombe
gagggcatcgaattccagactgatc

SEQ ID NO: 94287 - DNA, 25 bp, S. pombe
gagtgctgcagccaatttcgactat

SEQ ID NO: 94288 - DNA, 25 bp, S. pombe
gagtgctgatgacctttcaactata

SEQ ID NO: 94289 - DNA, 25 bp, S. pombe
gaggatgcgcaacactactgggaat

SEQ ID NO: 94290 - DNA, 25 bp, S. pombe
gagtgtcctaatcgcgttgttcaac

SEQ ID NO: 94291 - DNA, 25 bp, S. pombe
gagggtcaaatgtacgcccaagtta

SEQ ID NO: 94292 - DNA, 25 bp, S. pombe
gaggtaaccttgtaggcgccgaaat

SEQ ID NO: 94293 - DNA, 25 bp, S. pombe
gaggtgaattactcattgccgcaaa

SEQ ID NO: 94294 - DNA, 25 bp, S. pombe
gaggcccacttagtaatagtcgcaa

SEQ ID NO: 94295 - DNA, 25 bp, S. pombe
gaggtccttctacgaaagatcaggt

SEQ ID NO: 94296 - DNA, 25 bp, S. pombe
gagtgcctatatgtctagccgcaag

SEQ ID NO: 94297 - DNA, 25 bp, S. pombe
gagtggtattcattctgtgtcgaca

SEQ ID NO: 94298 - DNA, 25 bp, S. pombe
gagggtctggcttggctaagtcaaa

SEQ ID NO: 94299 - DNA, 25 bp, S. pombe
gagtgaactccaagacgccgccaaa

SEQ ID NO: 94300 - DNA, 25 bp, S. pombe
gagtccagtgagcatttttccaaac

SEQ ID NO: 94301 - DNA, 25 bp, S. pombe
gagtgagcgtgactttcttcgtcaa

SEQ ID NO: 94302 - DNA, 25 bp, S. pombe
gagtgaggatcttcgtctctcaata

SEQ ID NO: 94303 - DNA, 25 bp, S. pombe
gagtgatgccaaggccatcgttgtc

SEQ ID NO: 94304 - DNA, 25 bp, S. pombe
gagtgatgataatcccagctttggg

SEQ ID NO: 94305 - DNA, 25 bp, S. pombe
gaggtgcaagtcaatcgccattttc

SEQ ID NO: 94306 - DNA, 25 bp, S. pombe
gaggaaattctttggcaattagcca

SEQ ID NO: 94307 - DNA, 25 bp, S. pombe
gaggaaattatgatggccgtaggcc

SEQ ID NO: 94308 - DNA, 25 bp, S. pombe
gaggattacttgagcgccgttcgaa

SEQ ID NO: 94309 - DNA, 25 bp, S. pombe
gaggttttgtgcaacgacgtcttac

SEQ ID NO: 94310 - DNA, 25 bp, S. pombe
gagtgatcaagcgacaccgcatcct

SEQ ID NO: 94311 - DNA, 25 bp, S. pombe
gagtgcttggcggaagcttccagat

SEQ ID NO: 94312 - DNA, 25 bp, S. pombe
gaggttcactacgtggtactcaact

SEQ ID NO: 94313 - DNA, 25 bp, S. pombe
gaggatatggttagccagtcacccc

SEQ ID NO: 94314 - DNA, 25 bp, S. pombe
gaggcaatgagttgtccgctccgct

SEQ ID NO: 94315 - DNA, 25 bp, S. pombe
gaggcaaccttgacagctgctctag

SEQ ID NO: 94316 - DNA, 25 bp, S. pombe
gaggaagctactagggttcccttgt

SEQ ID NO: 94317 - DNA, 25 bp, S. pombe
gaggaaggccgttactatgcaaaaa

SEQ ID NO: 94318 - DNA, 25 bp, S. pombe
gaggaggcccaacttactgagtatg

SEQ ID NO: 94319 - DNA, 25 bp, S. pombe
gagtgtaccttttctggtgacgaca

SEQ ID NO: 94320 - DNA, 25 bp, S. pombe
gagggactcaatatgcaactgttat

SEQ ID NO: 94321 - DNA, 25 bp, S. pombe
gagggcgcgttcaatcagacgaatt

SEQ ID NO: 94322 - DNA, 25 bp, S. pombe
gagggtgttacttatgagcgtttta

SEQ ID NO: 94323 - DNA, 25 bp, S. pombe
gagggttaacatatgacgagactta

SEQ ID NO: 94324 - DNA, 25 bp, S. pombe
gaggcaggctctaaacgattggaaa

SEQ ID NO: 94325 - DNA, 25 bp, S. pombe
gagggcgctataatgtacagtacaa

SEQ ID NO: 94326 - DNA, 25 bp, S. pombe
gaggatgcagcttcggctctagcga

SEQ ID NO: 94327 - DNA, 25 bp, S. pombe
gaggatcaccggtcctgaggatttg

SEQ ID NO: 94328 - DNA, 25 bp, S. pombe
gaggtcgacggctttagagacattt

SEQ ID NO: 94329 - DNA, 25 bp, S. pombe
gaggagcttcagacgggatcagtac

SEQ ID NO: 94330 - DNA, 25 bp, S. pombe
gagtgcatactcagggtcaagctat

SEQ ID NO: 94331 - DNA, 25 bp, S. pombe
gagtgcaccacttgggtatgtcaat

SEQ ID NO: 94332 - DNA, 25 bp, S. pombe
gagtgcaatgtctcacctgttatta

SEQ ID NO: 94333 - DNA, 25 bp, S. pombe
gagtgtattctcgtcaaaggatcca

SEQ ID NO: 94334 - DNA, 25 bp, S. pombe
gagggctactcgtaacggtgcaatt

SEQ ID NO: 94335 - DNA, 25 bp, S. pombe
gagggctctccaaaagactatctag

SEQ ID NO: 94336 - DNA, 25 bp, S. pombe
gagggcaaccattctaatgccacat

SEQ ID NO: 94337 - DNA, 25 bp, S. pombe
gaggtagacacttctatcgtccagc

SEQ ID NO: 94338 - DNA, 25 bp, S. pombe
gagggcttatgcaacacatctttca

SEQ ID NO: 94339 - DNA, 25 bp, S. pombe
gagggctcatcacagcagctatgtt

SEQ ID NO: 94340 - DNA, 25 bp, S. pombe
gatgaggcattttttacccttgccc

SEQ ID NO: 94341 - DNA, 25 bp, S. pombe
gagggatgtctttcaaccgtatcac

SEQ ID NO: 94342 - DNA, 25 bp, S. pombe
gagggtttttcagctaatcacatgt

SEQ ID NO: 94343 - DNA, 25 bp, S. pombe
gagggatttttcgttctcatcatag

SEQ ID NO: 94344 - DNA, 25 bp, S. pombe
gagtggtctccgatatattctccgg

SEQ ID NO: 94345 - DNA, 25 bp, S. pombe
gagtgtatcaccaatgagctttcca

SEQ ID NO: 94346 - DNA, 25 bp, S. pombe
gaggtgatcaaggatatccatgcct

SEQ ID NO: 94347 - DNA, 25 bp, S. pombe
gaggtgacacatgttcattctcatt

SEQ ID NO: 94348 - DNA, 25 bp, S. pombe
gagggaatcgttactcatccatctc

SEQ ID NO: 94349 - DNA, 25 bp, S. pombe
gagggaatcactcgtgtcgctatgc

SEQ ID NO: 94350 - DNA, 25 bp, S. pombe
gaggtcgaacttccttgcaagcaaa

SEQ ID NO: 94351 - DNA, 25 bp, S. pombe
gaggatactaggtctcagtcaaatc

SEQ ID NO: 94352 - DNA, 25 bp, S. pombe
gagtgtatctgaagagccacccaaa

SEQ ID NO: 94353 - DNA, 25 bp, S. pombe
gaggattttgctggacattcgagaa

SEQ ID NO: 94354 - DNA, 25 bp, S. pombe
gaggtttggctactatgctcgacaa

SEQ ID NO: 94355 - DNA, 25 bp, S. pombe
gagggatcgttcacttttttggata

SEQ ID NO: 94356 - DNA, 25 bp, S. pombe
gaggcgtcttacaacttgtttacga

SEQ ID NO: 94357 - DNA, 25 bp, S. pombe
gagggttcatcaccactatgttgga

SEQ ID NO: 94358 - DNA, 25 bp, S. pombe
gaggcggcgttttcggattgattat

SEQ ID NO: 94359 - DNA, 25 bp, S. pombe
gaggaccagggcattttatctttat

SEQ ID NO: 94360 - DNA, 25 bp, S. pombe
gaggcagtcaggcacggtttcttct

SEQ ID NO: 94361 - DNA, 25 bp, S. pombe
gatgggtcaggtccaatttggcaat

SEQ ID NO: 94362 - DNA, 25 bp, S. pombe
gaggagtcaggttcgtcctaatata

SEQ ID NO: 94363 - DNA, 25 bp, S. pombe
gagtgtgggccttttaacagacaaa

SEQ ID NO: 94364 - DNA, 25 bp, S. pombe
gaggtgtggctgcttttaccaatca

SEQ ID NO: 94365 - DNA, 25 bp, S. pombe
gatggcaaagctccggtttctacag

SEQ ID NO: 94366 - DNA, 25 bp, S. pombe
gaggaagcactctcccatattaatg

SEQ ID NO: 94367 - DNA, 25 bp, S. pombe
gaggtcaatgcatttcccgataaat

SEQ ID NO: 94368 - DNA, 25 bp, S. pombe
gagggagacaataccctagcgccaa

SEQ ID NO: 94369 - DNA, 25 bp, S. pombe
gaggagccttacgacgatgacattt

SEQ ID NO: 94370 - DNA, 25 bp, S. pombe
gagtggtatctcagcaagtccgaat

SEQ ID NO: 94371 - DNA, 25 bp, S. pombe
gaggaagactgggacttctctgccc

SEQ ID NO: 94372 - DNA, 25 bp, S. pombe
gaggtcgttgccatttattcactta

SEQ ID NO: 94373 - DNA, 25 bp, S. pombe
gaggtggatctcgtccttttactcc

SEQ ID NO: 94374 - DNA, 25 bp, S. pombe
gagggtcaagcatctcctttgtctt

SEQ ID NO: 94375 - DNA, 25 bp, S. pombe
gagggccaatatcaactttgctcaa

SEQ ID NO: 94376 - DNA, 25 bp, S. pombe
gaggtgctattttcttaggctgcta

SEQ ID NO: 94377 - DNA, 25 bp, S. pombe
gaggccttttaaatcgcaatccaaa

SEQ ID NO: 94378 - DNA, 25 bp, S. pombe
gaggacttatatgttcgaccccaat

SEQ ID NO: 94379 - DNA, 25 bp, S. pombe
gaggagattcttgagcaaacgctga

SEQ ID NO: 94380 - DNA, 25 bp, S. pombe
gaggctgctaaatacataccacgat

SEQ ID NO: 94381 - DNA, 25 bp, S. pombe
gagggcttcaatcactatacatcag

SEQ ID NO: 94382 - DNA, 25 bp, S. pombe
gaggatcctaaatagcttactgaaa

SEQ ID NO: 94383 - DNA, 25 bp, S. pombe
gaggtagtacaagagcattcacgaa

SEQ ID NO: 94384 - DNA, 25 bp, S. pombe
gaggttcactttgagcctattgtca

SEQ ID NO: 94385 - DNA, 25 bp, S. pombe
gaggttttcttctaactatcttgca

SEQ ID NO: 94386 - DNA, 25 bp, S. pombe
gaggttgttcctaggactatttcag

SEQ ID NO: 94387 - DNA, 25 bp, S. pombe
gaggtattccctttgagcgactgtg

SEQ ID NO: 94388 - DNA, 25 bp, S. pombe
gatgtatcttcaccgttagaactta

SEQ ID NO: 94389 - DNA, 25 bp, S. pombe
gaggcaccacctttttgtatggagt

SEQ ID NO: 94390 - DNA, 25 bp, S. pombe
gaggcaccagattacgattctttag

SEQ ID NO: 94391 - DNA, 25 bp, S. pombe
gagggatcacaaaccacgcttgcta

SEQ ID NO: 94392 - DNA, 25 bp, S. pombe
gaggtattatcatcgatccttctaa

SEQ ID NO: 94393 - DNA, 25 bp, S. pombe
gaggtcttaatgttagtctttccac

SEQ ID NO: 94394 - DNA, 25 bp, S. pombe
gaggtctcttgatacattgttagca

SEQ ID NO: 94395 - DNA, 25 bp, S. pombe
gaggtgcatgtcgaacctgttcgtc

SEQ ID NO: 94396 - DNA, 25 bp, S. pombe
gagggatatcctatcgtatatgcca

SEQ ID NO: 94397 - DNA, 25 bp, S. pombe
gagggtcctgcatttagtacgcgtg

SEQ ID NO: 94398 - DNA, 25 bp, S. pombe
gagggattatgcttcttctgctcag

SEQ ID NO: 94399 - DNA, 25 bp, S. pombe
gagggtgctcttttgatcgttctga

SEQ ID NO: 94400 - DNA, 25 bp, S. pombe
gaggaagatgccgacgcctttctac

SEQ ID NO: 94401 - DNA, 25 bp, S. pombe
gaggtttatcagtcagcatgcttaa

SEQ ID NO: 94402 - DNA, 25 bp, S. pombe
gaggatcttgaatctcatcatgtca

SEQ ID NO: 94403 - DNA, 25 bp, S. pombe
gaggatgcttgaacctttggagcaa

SEQ ID NO: 94404 - DNA, 25 bp, S. pombe
gaggtcactgaacatcttcgaggaa

SEQ ID NO: 94405 - DNA, 25 bp, S. pombe
gagggagctaggcttcttactgata

SEQ ID NO: 94406 - DNA, 25 bp, S. pombe
gagggtgctactcaattcactctta

SEQ ID NO: 94407 - DNA, 25 bp, S. pombe
gagggtcttctcgaagtcacgaata

SEQ ID NO: 94408 - DNA, 25 bp, S. pombe
gaggtcctgagggaactccttatga

SEQ ID NO: 94409 - DNA, 25 bp, S. pombe
gaggtttaccataactccttgcaga

SEQ ID NO: 94410 - DNA, 25 bp, S. pombe
gaggtctttccaaacgatgcaacga

SEQ ID NO: 94411 - DNA, 25 bp, S. pombe
gaggttgattttccaccagaactgt

SEQ ID NO: 94412 - DNA, 25 bp, S. pombe
gaggcttacttatttacgaaccatg

SEQ ID NO: 94413 - DNA, 25 bp, S. pombe
gaggtactgccgatcgcaccataaa

SEQ ID NO: 94414 - DNA, 25 bp, S. pombe
gaggattcagcatctttagcttcat

SEQ ID NO: 94415 - DNA, 25 bp, S. pombe
gaggttgtcggtatgcaggctatca

SEQ ID NO: 94416 - DNA, 25 bp, S. pombe
gaggtttccttgttgggtatcgcaa

SEQ ID NO: 94417 - DNA, 25 bp, S. pombe
gaggctaaactttctgttggtctaa

SEQ ID NO: 94418 - DNA, 25 bp, S. pombe
gaggttgaactcatatctacccctt

SEQ ID NO: 94419 - DNA, 25 bp, S. pombe
gaggatcaacgttcgacagtccttg

SEQ ID NO: 94420 - DNA, 25 bp, S. pombe
gaggatccctcatttaaaactttag

SEQ ID NO: 94421 - DNA, 25 bp, S. pombe
gaggatgctcgccatgttcaaaagt

SEQ ID NO: 94422 - DNA, 25 bp, S. pombe
gagggttcacattttatcaagcgtt

SEQ ID NO: 94423 - DNA, 25 bp, S. pombe
gaggtgttgctacatgtatgatact

SEQ ID NO: 94424 - DNA, 25 bp, S. pombe
gaggaatatcctcaccttaccttaa

SEQ ID NO: 94425 - DNA, 25 bp, S. pombe
gaggagattcttcaactcgactctg

SEQ ID NO: 94426 - DNA, 25 bp, S. pombe
gaggccttggagtaatcggtctatt

SEQ ID NO: 94427 - DNA, 25 bp, S. pombe
gatggtccttgggatatggcgtcct

SEQ ID NO: 94428 - DNA, 25 bp, S. pombe
gaggatcatcaacaggagaccccaa

SEQ ID NO: 94429 - DNA, 25 bp, S. pombe
gaggaatcactttcaaggtcggaga

SEQ ID NO: 94430 - DNA, 25 bp, S. pombe
gaggtgccttctgacttaggtgaca

SEQ ID NO: 94431 - DNA, 25 bp, S. pombe
gaggtgccatttgtgcttactgtgc

SEQ ID NO: 94432 - DNA, 25 bp, S. pombe
gaggaagttacactgctcaattcga

SEQ ID NO: 94433 - DNA, 25 bp, S. pombe
gaggcggttacaatcagaactcgca

SEQ ID NO: 94434 - DNA, 25 bp, S. pombe
gaggcagaactaggactttccggtt

SEQ ID NO: 94435 - DNA, 25 bp, S. pombe
gaggcataacttgttgtgtcacgtt

SEQ ID NO: 94436 - DNA, 25 bp, S. pombe
gaggatttcccctttttgcagtaca

SEQ ID NO: 94437 - DNA, 25 bp, S. pombe
gaggatgttctctcttttggaggaa

SEQ ID NO: 94438 - DNA, 25 bp, S. pombe
gaggttgctggttcttttcggcaaa

SEQ ID NO: 94439 - DNA, 25 bp, S. pombe
gaggtgctattgaaatctcttcata

SEQ ID NO: 94440 - DNA, 25 bp, S. pombe
gaggttgcattggtccattggtgta

SEQ ID NO: 94441 - DNA, 25 bp, S. pombe
gaggatttccttgattgcggtaact

SEQ ID NO: 94442 - DNA, 25 bp, S. pombe
gaggcctaaattgtgttctaatata

SEQ ID NO: 94443 - DNA, 25 bp, S. pombe
gaggtcaagctcatgttgtattctt

SEQ ID NO: 94444 - DNA, 25 bp, S. pombe
gatggtcgtccgttgaacagtgttt

SEQ ID NO: 94445 - DNA, 25 bp, S. pombe
gaggtatccctgatggtcttgtaat

SEQ ID NO: 94446 - DNA, 25 bp, S. pombe
gaggttattttgtcattgtccccaa

SEQ ID NO: 94447 - DNA, 25 bp, S. pombe
gatggctcccgaagtggtgaagcaa

SEQ ID NO: 94448 - DNA, 25 bp, S. pombe
gaggctgcttacaagagttcccaat

SEQ ID NO: 94449 - DNA, 25 bp, S. pombe
gaggaggatcctgagcttcgccaag

SEQ ID NO: 94450 - DNA, 25 bp, S. pombe
gaggtagtcctccaagattttcaag

SEQ ID NO: 94451 - DNA, 25 bp, S. pombe
gaggtactacccctatagatgaaat

SEQ ID NO: 94452 - DNA, 25 bp, S. pombe
gaggtttccgcccaagcagatgaga

SEQ ID NO: 94453 - DNA, 25 bp, S. pombe
gaggattctcccaaaagcgatgatt

SEQ ID NO: 94454 - DNA, 25 bp, S. pombe
gaggatctttaatctctacatcgga

SEQ ID NO: 94455 - DNA, 25 bp, S. pombe
gaggttcctggtactattgtcatgt

SEQ ID NO: 94456 - DNA, 25 bp, S. pombe
gaggcttcttctacgggtgatgcta

SEQ ID NO: 94457 - DNA, 25 bp, S. pombe
gaggccctttgtttggtccaagaat

SEQ ID NO: 94458 - DNA, 25 bp, S. pombe
gtaatttttacctcggcaatcaaca

SEQ ID NO: 94459 - DNA, 25 bp, S. pombe
ggaaattttgcctcgcaggaaggaa

SEQ ID NO: 94460 - DNA, 25 bp, S. pombe
ggaaatttgcactacgtcggacgga

SEQ ID NO: 94461 - DNA, 25 bp, S. pombe
gatcgacgctatactatgggtgcta

SEQ ID NO: 94462 - DNA, 25 bp, S. pombe
gaggttatcgttaccacagacaaac

SEQ ID NO: 94463 - DNA, 25 bp, S. pombe
gaggtaccgcttaccgaacagacgt

SEQ ID NO: 94464 - DNA, 25 bp, S. pombe
gaggttcctattatccacaatggcg

SEQ ID NO: 94465 - DNA, 25 bp, S. pombe
gaggttcctgttcatgtctacaaca

SEQ ID NO: 94466 - DNA, 25 bp, S. pombe
gaggcagaagcattgttaacgcaga

SEQ ID NO: 94467 - DNA, 25 bp, S. pombe
gaggattagccttacaacctattat

SEQ ID NO: 94468 - DNA, 25 bp, S. pombe
gaggtattctgcgactatgatttca

SEQ ID NO: 94469 - DNA, 25 bp, S. pombe
gaggttttatattcgctgcactagg

SEQ ID NO: 94470 - DNA, 25 bp, S. pombe
gatggcctccctcttaaatacgaat

SEQ ID NO: 94471 - DNA, 25 bp, S. pombe
gatcgcccttcgtttgacaaaattg

SEQ ID NO: 94472 - DNA, 25 bp, S. pombe
tgattcggctttgcgttcagtttta

SEQ ID NO: 94473 - DNA, 25 bp, S. pombe
gatggaacccacaattaccttttga

SEQ ID NO: 94474 - DNA, 25 bp, S. pombe
gatggaatcctacgatcgagtctat

SEQ ID NO: 94475 - DNA, 25 bp, S. pombe
gaggattcttgcacaggtttcaccc

SEQ ID NO: 94476 - DNA, 25 bp, S. pombe
gaggaatttacccagcagaagactt

SEQ ID NO: 94477 - DNA, 25 bp, S. pombe
gaggttgcttcggagctagcacaag

SEQ ID NO: 94478 - DNA, 25 bp, S. pombe
gaggtttctcgcgatgaatggcaat

SEQ ID NO: 94479 - DNA, 25 bp, S. pombe
gaggatgcttctgccatagttgaaa

SEQ ID NO: 94480 - DNA, 25 bp, S. pombe
gatggtatgagccttggttcgtaaa

SEQ ID NO: 94481 - DNA, 25 bp, S. pombe
gaggccgatcctactaattctggaa

SEQ ID NO: 94482 - DNA, 25 bp, S. pombe
gaggccgatattttcaatttcgcaa

SEQ ID NO: 94483 - DNA, 25 bp, S. pombe
gaggatctattgttgagttctacga

SEQ ID NO: 94484 - DNA, 25 bp, S. pombe
gaggaacttcaaacagctcttcgaa

SEQ ID NO: 94485 - DNA, 25 bp, S. pombe
gaggaacctcgtaagctgcctggag

SEQ ID NO: 94486 - DNA, 25 bp, S. pombe
gaggaaactactaagcccgagaata

SEQ ID NO: 94487 - DNA, 25 bp, S. pombe
gaggcaatatcaccaacatcaggga

SEQ ID NO: 94488 - DNA, 25 bp, S. pombe
gaggacccttcaaaatctacgtgtg

SEQ ID NO: 94489 - DNA, 25 bp, S. pombe
gaggatggatatcgtttcaactgta

SEQ ID NO: 94490 - DNA, 25 bp, S. pombe
gaggatttgaccctgacattgtcca

SEQ ID NO: 94491 - DNA, 25 bp, S. pombe
gaggagttgactcatgtgcttacaa

SEQ ID NO: 94492 - DNA, 25 bp, S. pombe
gaggatgtggccagaacttcgaagt

SEQ ID NO: 94493 - DNA, 25 bp, S. pombe
gaggagctggtcatgaaccccatat

SEQ ID NO: 94494 - DNA, 25 bp, S. pombe
gaggcatcacacaactgtaaaatcg

SEQ ID NO: 94495 - DNA, 25 bp, S. pombe
gaggagcatgataccaccacaaaat

SEQ ID NO: 94496 - DNA, 25 bp, S. pombe
gaggacgatcaagctctcgagaaaa

SEQ ID NO: 94497 - DNA, 25 bp, S. pombe
gaggttgcgaaacttcaagctgaat

SEQ ID NO: 94498 - DNA, 25 bp, S. pombe
gaggaatcggatgctttatctgaat

SEQ ID NO: 94499 - DNA, 25 bp, S. pombe
gaggattcgcttttgttatctgtga

SEQ ID NO: 94500 - DNA, 25 bp, S. pombe
gaggaagttcttcgttctttggaat

SEQ ID NO: 94501 - DNA, 25 bp, S. pombe
gaggaatcagctagcgaatcgtcgc

SEQ ID NO: 94502 - DNA, 25 bp, S. pombe
gaggacgcatccacgaattcaatat

SEQ ID NO: 94503 - DNA, 25 bp, S. pombe
gatggtctccctgcgaagtcaatag

SEQ ID NO: 94504 - DNA, 25 bp, S. pombe
gatgttccctccacgaaagaagcta

SEQ ID NO: 94505 - DNA, 25 bp, S. pombe
gatcttaccgctttcgaagaaatct

SEQ ID NO: 94506 - DNA, 25 bp, S. pombe
gaggaaaccctgtctcatataagca

SEQ ID NO: 94507 - DNA, 25 bp, S. pombe
gaggaagaacctactacagaagaat

SEQ ID NO: 94508 - DNA, 25 bp, S. pombe
gaggatagtgttgatctccctacct

SEQ ID NO: 94509 - DNA, 25 bp, S. pombe
gatgggataccaacggacttacttt

SEQ ID NO: 94510 - DNA, 25 bp, S. pombe
gatgggttcaacagccaccaacttg

SEQ ID NO: 94511 - DNA, 25 bp, S. pombe
gtaggtccaagtcgaccaactttgg

SEQ ID NO: 94512 - DNA, 25 bp, S. pombe
gatggatggtccttttaataccgaa

SEQ ID NO: 94513 - DNA, 25 bp, S. pombe
gaggatggctactttcgcagaaaac

SEQ ID NO: 94514 - DNA, 25 bp, S. pombe
gaggcacttttggatgctctgttgt

SEQ ID NO: 94515 - DNA, 25 bp, S. pombe
gaggcaatttctactcttgttgaga

SEQ ID NO: 94516 - DNA, 25 bp, S. pombe
gaggcccttctcaaatatgctgacg

SEQ ID NO: 94517 - DNA, 25 bp, S. pombe
gaggacttggatcgaatgtattcac

SEQ ID NO: 94518 - DNA, 25 bp, S. pombe
gaggaattggagcaactttcacaag

SEQ ID NO: 94519 - DNA, 25 bp, S. pombe
gaggagcaagctattacagaacagg

SEQ ID NO: 94520 - DNA, 25 bp, S. pombe
gatgtctcccatgtagtaagcctac

SEQ ID NO: 94521 - DNA, 25 bp, S. pombe
gaggctgcagaagcacgtaattctt

SEQ ID NO: 94522 - DNA, 25 bp, S. pombe
gaggcatcataatcgcagcttattt

SEQ ID NO: 94523 - DNA, 25 bp, S. pombe
gaggcattgttgctgaattctattc

SEQ ID NO: 94524 - DNA, 25 bp, S. pombe
gaggatgcaagccaactttcatact

SEQ ID NO: 94525 - DNA, 25 bp, S. pombe
gatggtaagcgaactactcgtccca

SEQ ID NO: 94526 - DNA, 25 bp, S. pombe
gatggatccaggcagcatcgcccat

SEQ ID NO: 94527 - DNA, 25 bp, S. pombe
gatgcgaccggtaatccacaagaat

SEQ ID NO: 94528 - DNA, 25 bp, S. pombe
gatgtcgccgttgatccaaaattag

SEQ ID NO: 94529 - DNA, 25 bp, S. pombe
gatgtccgatttcactcaggtagat

SEQ ID NO: 94530 - DNA, 25 bp, S. pombe
gaggccttgtgtaacatacgtcgta

SEQ ID NO: 94531 - DNA, 25 bp, S. pombe
gaggcacgttttgacaccattgata

SEQ ID NO: 94532 - DNA, 25 bp, S. pombe
gaggcctttttcgattgtcatttga

SEQ ID NO: 94533 - DNA, 25 bp, S. pombe
gaggagttgtctctcattttcgaag

SEQ ID NO: 94534 - DNA, 25 bp, S. pombe
gaggatcctatcgttttattcatga

SEQ ID NO: 94535 - DNA, 25 bp, S. pombe
gaggcagccatgtctttttatgaaa

SEQ ID NO: 94536 - DNA, 25 bp, S. pombe
gaggagtcagctctttcatggttga

SEQ ID NO: 94537 - DNA, 25 bp, S. pombe
gaggatgtcccatttttgcatttca

SEQ ID NO: 94538 - DNA, 25 bp, S. pombe
gaggaccctagttattcagacagca

SEQ ID NO: 94539 - DNA, 25 bp, S. pombe
gatgacatcgagtacgccaaacaga

SEQ ID NO: 94540 - DNA, 25 bp, S. pombe
gaggcatcgccctaacaaatcaatg

SEQ ID NO: 94541 - DNA, 25 bp, S. pombe
gaggctctctcgaaataacaacatg

SEQ ID NO: 94542 - DNA, 25 bp, S. pombe
gaggatccacttagtcatgacactt

SEQ ID NO: 94543 - DNA, 25 bp, S. pombe
gatggaccagtctagttgttaacat

SEQ ID NO: 94544 - DNA, 25 bp, S. pombe
gaggagaagtccatttttgcatatc

SEQ ID NO: 94545 - DNA, 25 bp, S. pombe
gatccgatttcgatggaattcccca

SEQ ID NO: 94546 - DNA, 25 bp, S. pombe
gatcggcattttttggttccttcca

SEQ ID NO: 94547 - DNA, 25 bp, S. pombe
gatcggttccggtgttcaagcttct

SEQ ID NO: 94548 - DNA, 25 bp, S. pombe
gattcgtaacggtcgttcgcagcgg

SEQ ID NO: 94549 - DNA, 25 bp, S. pombe
gtttatttggagtcgtacgcagccc

SEQ ID NO: 94550 - DNA, 25 bp, S. pombe
gaggctaccaaaaccttgaaccgtg

SEQ ID NO: 94551 - DNA, 25 bp, S. pombe
gaggctcttgaatacgtttcccgtg

SEQ ID NO: 94552 - DNA, 25 bp, S. pombe
gaggctctatgcttaacgatttacg

SEQ ID NO: 94553 - DNA, 25 bp, S. pombe
gatggcggctagtgcattatccgta

SEQ ID NO: 94554 - DNA, 25 bp, S. pombe
gatggtgtggatacgctgtacctta

SEQ ID NO: 94555 - DNA, 25 bp, S. pombe
gatgttcaaaccgttcacactatat

SEQ ID NO: 94556 - DNA, 25 bp, S. pombe
gaggcttcaagtgtcaattcatcta

SEQ ID NO: 94557 - DNA, 25 bp, S. pombe
gaggctctcaagtcgtttgttacat

SEQ ID NO: 94558 - DNA, 25 bp, S. pombe
gaggcactaatgagcttcttgaaag

SEQ ID NO: 94559 - DNA, 25 bp, S. pombe
gatggccataaggaccctagtctag

SEQ ID NO: 94560 - DNA, 25 bp, S. pombe
gaggccaacaatgtcagctatgctg

SEQ ID NO: 94561 - DNA, 25 bp, S. pombe
gatggccatacatgttctctattcc

SEQ ID NO: 94562 - DNA, 25 bp, S. pombe
gaggcacgacgacttctaattgcta

SEQ ID NO: 94563 - DNA, 25 bp, S. pombe
gaggagattatctgacactgtcaca

SEQ ID NO: 94564 - DNA, 25 bp, S. pombe
gatggaacattcagtcaaggctcga

SEQ ID NO: 94565 - DNA, 25 bp, S. pombe
gatggaactccggtgatgacccgac

SEQ ID NO: 94566 - DNA, 25 bp, S. pombe
gatgacaaacctgattacgcctacc

SEQ ID NO: 94567 - DNA, 25 bp, S. pombe
gaggcagcatatcttctttcattga

SEQ ID NO: 94568 - DNA, 25 bp, S. pombe
gaggcagcagctctattattgcgag

SEQ ID NO: 94569 - DNA, 25 bp, S. pombe
gaggctgctcatccaaatattgaag

SEQ ID NO: 94570 - DNA, 25 bp, S. pombe
gaggactctagcaatgacattagtt

SEQ ID NO: 94571 - DNA, 25 bp, S. pombe
gaggcagttgcaaaacccgagtcag

SEQ ID NO: 94572 - DNA, 25 bp, S. pombe
gaggaattcaagttccgccatccag

SEQ ID NO: 94573 - DNA, 25 bp, S. pombe
gaggaattccaggttcgacttcaaa

SEQ ID NO: 94574 - DNA, 25 bp, S. pombe
gaggaattgcgtattcaagcccaaa

SEQ ID NO: 94575 - DNA, 25 bp, S. pombe
gaggaatcgctgctttcataccata

SEQ ID NO: 94576 - DNA, 25 bp, S. pombe
gaggcagctcaactcaagcgtcaaa

SEQ ID NO: 94577 - DNA, 25 bp, S. pombe
gaggcctgtagcttctattcaaagt

SEQ ID NO: 94578 - DNA, 25 bp, S. pombe
gatgtaggacctgtaccgcaatact

SEQ ID NO: 94579 - DNA, 25 bp, S. pombe
gatggatggccctttttggaatacc

SEQ ID NO: 94580 - DNA, 25 bp, S. pombe
gaggctgtccgtattcgaggtaatc

SEQ ID NO: 94581 - DNA, 25 bp, S. pombe
gaggcttccgtttacagcgagtaca

SEQ ID NO: 94582 - DNA, 25 bp, S. pombe
gaggcaacaataaccgtcggctcaa

SEQ ID NO: 94583 - DNA, 25 bp, S. pombe
gaggcaacaacagcgtctcttgaga

SEQ ID NO: 94584 - DNA, 25 bp, S. pombe
gatggtcccgaatgtttatactctt

SEQ ID NO: 94585 - DNA, 25 bp, S. pombe
gaggaagctgctgaatttgctcaac

SEQ ID NO: 94586 - DNA, 25 bp, S. pombe
gaggaactccttactggattgccag

SEQ ID NO: 94587 - DNA, 25 bp, S. pombe
gaggaactctgtatttcatacggag

SEQ ID NO: 94588 - DNA, 25 bp, S. pombe
gaggcattgccaagtgaaagtcttt

SEQ ID NO: 94589 - DNA, 25 bp, S. pombe
gaggcggagcaccacataatttcaa

SEQ ID NO: 94590 - DNA, 25 bp, S. pombe
gaggcgtcgtcatcatagcttttat

SEQ ID NO: 94591 - DNA, 25 bp, S. pombe
gaggctttgcactattctcttgaag

SEQ ID NO: 94592 - DNA, 25 bp, S. pombe
gatggccaggaaagctgttgcagat

SEQ ID NO: 94593 - DNA, 25 bp, S. pombe
gatgtcgcaaatggttacgcaagct

SEQ ID NO: 94594 - DNA, 25 bp, S. pombe
gatgatgacccggttatccacgact

SEQ ID NO: 94595 - DNA, 25 bp, S. pombe
gaggcttcagggtctattcttacaa

SEQ ID NO: 94596 - DNA, 25 bp, S. pombe
gaggcttctggttattcttttgaca

SEQ ID NO: 94597 - DNA, 25 bp, S. pombe
gatggtgtcgttcttgttgtccgta

SEQ ID NO: 94598 - DNA, 25 bp, S. pombe
gaggcttttgatctttttgacgtga

SEQ ID NO: 94599 - DNA, 25 bp, S. pombe
gatggctttctaagttgacggcact

SEQ ID NO: 94600 - DNA, 25 bp, S. pombe
gaggctaatctcatatggacgtgca

SEQ ID NO: 94601 - DNA, 25 bp, S. pombe
gaggccatgatagctgctcaagata

SEQ ID NO: 94602 - DNA, 25 bp, S. pombe
gatggcgcagattccgatactatat

SEQ ID NO: 94603 - DNA, 25 bp, S. pombe
gatggtgatccacaattgcgctcat

SEQ ID NO: 94604 - DNA, 25 bp, S. pombe
gatggaaactccttgtgtcatggat

SEQ ID NO: 94605 - DNA, 25 bp, S. pombe
gatggtaaccttcagcttagcgtgt

SEQ ID NO: 94606 - DNA, 25 bp, S. pombe
gaggcggatactactggacaattta

SEQ ID NO: 94607 - DNA, 25 bp, S. pombe
gaggcatggtctttcatcaccaagt

SEQ ID NO: 94608 - DNA, 25 bp, S. pombe
gatggctgaccttccatttatgagt

SEQ ID NO: 94609 - DNA, 25 bp, S. pombe
gaggcttacttattcgttcagcaag

SEQ ID NO: 94610 - DNA, 25 bp, S. pombe
gatgagtttttatactccgaccaag

SEQ ID NO: 94611 - DNA, 25 bp, S. pombe
gatggctgtctgtgaagatcccgat

SEQ ID NO: 94612 - DNA, 25 bp, S. pombe
gatggagatctacataccttcgccg

SEQ ID NO: 94613 - DNA, 25 bp, S. pombe
gatgacaccgtccatacctatgttt

SEQ ID NO: 94614 - DNA, 25 bp, S. pombe
gatgaaccatctcccaagacaaccg

SEQ ID NO: 94615 - DNA, 25 bp, S. pombe
gatgatgcccttaaaaacttcgagt

SEQ ID NO: 94616 - DNA, 25 bp, S. pombe
gatggaatctttagtaccttctgaa

SEQ ID NO: 94617 - DNA, 25 bp, S. pombe
gatggagacgatattccagctttaa

SEQ ID NO: 94618 - DNA, 25 bp, S. pombe
gatggagactactaacacgcttaaa

SEQ ID NO: 94619 - DNA, 25 bp, S. pombe
gaggcagtgaattttgctcccaaag

SEQ ID NO: 94620 - DNA, 25 bp, S. pombe
gaggcaagaacccatgatccacaga

SEQ ID NO: 94621 - DNA, 25 bp, S. pombe
gaggcaggttctactgatccagaga

SEQ ID NO: 94622 - DNA, 25 bp, S. pombe
gaggcgatctgctaaacgtgttaat

SEQ ID NO: 94623 - DNA, 25 bp, S. pombe
gaggctatcaaggtccgtgttcaaa

SEQ ID NO: 94624 - DNA, 25 bp, S. pombe
gaggcatttgtcctttatgatatcg

SEQ ID NO: 94625 - DNA, 25 bp, S. pombe
gatggtggtgtgctttattattgta

SEQ ID NO: 94626 - DNA, 25 bp, S. pombe
gatgtgtaggtgctttttcacgtac

SEQ ID NO: 94627 - DNA, 25 bp, S. pombe
gatgttggtcaagccttacgtttat

SEQ ID NO: 94628 - DNA, 25 bp, S. pombe
gatgttaatcaaaggccgacgtttt

SEQ ID NO: 94629 - DNA, 25 bp, S. pombe
gatgtctcctaaacacggtggtggt

SEQ ID NO: 94630 - DNA, 25 bp, S. pombe
gatggcctccgatacttggttgaaa

SEQ ID NO: 94631 - DNA, 25 bp, S. pombe
gaggccccgacgagtcttgaaaact

SEQ ID NO: 94632 - DNA, 25 bp, S. pombe
gaggcttcccacaagcttcttaaaa

SEQ ID NO: 94633 - DNA, 25 bp, S. pombe
gatggttcccattccttttatattt

SEQ ID NO: 94634 - DNA, 25 bp, S. pombe
gatggaaaccattacttatctttgt

SEQ ID NO: 94635 - DNA, 25 bp, S. pombe
gaggcagaacgctctcttcacgatg

SEQ ID NO: 94636 - DNA, 25 bp, S. pombe
gaggctgaacagctcttatcaaatt

SEQ ID NO: 94637 - DNA, 25 bp, S. pombe
gaggccaccgaacagctcaattctt

SEQ ID NO: 94638 - DNA, 25 bp, S. pombe
gaggctcttagcaaaaccattacat

SEQ ID NO: 94639 - DNA, 25 bp, S. pombe
gaggcatttcctgtatctagtagca

SEQ ID NO: 94640 - DNA, 25 bp, S. pombe
gaggctgatctaagtattttaataa

SEQ ID NO: 94641 - DNA, 25 bp, S. pombe
gatggctactgtgggttggtcaaaa

SEQ ID NO: 94642 - DNA, 25 bp, S. pombe
gatggctttagctctatgactcaat

SEQ ID NO: 94643 - DNA, 25 bp, S. pombe
gaggcctttacagactctcgtgtat

SEQ ID NO: 94644 - DNA, 25 bp, S. pombe
gaggcctttagtcgtgttatccaga

SEQ ID NO: 94645 - DNA, 25 bp, S. pombe
gatggcgttatttcaatttctgcta

SEQ ID NO: 94646 - DNA, 25 bp, S. pombe
gatggtttactcttcttctaaagat

SEQ ID NO: 94647 - DNA, 25 bp, S. pombe
gatggtaagcccacgtaactattta

SEQ ID NO: 94648 - DNA, 25 bp, S. pombe
gatggacaagaacccgatacctatt

SEQ ID NO: 94649 - DNA, 25 bp, S. pombe
gatggactccaagagttcaatgttt

SEQ ID NO: 94650 - DNA, 25 bp, S. pombe
gatggaccaatgttcgttcactgtt

SEQ ID NO: 94651 - DNA, 25 bp, S. pombe
gaggccaaagcgttgtatgcacgtt

SEQ ID NO: 94652 - DNA, 25 bp, S. pombe
gaggcgaaacggaaacaggattctt

SEQ ID NO: 94653 - DNA, 25 bp, S. pombe
gaggctatgcttgctttacgtgaaa

SEQ ID NO: 94654 - DNA, 25 bp, S. pombe
gggctgagcgtccttttggtcaaac

SEQ ID NO: 94655 - DNA, 25 bp, S. pombe
gaggctcttggtccaattgctggaa

SEQ ID NO: 94656 - DNA, 25 bp, S. pombe
gaggcaggtttcacatcatatatca

SEQ ID NO: 94657 - DNA, 25 bp, S. pombe
gaggccattttccatgactctaaag

SEQ ID NO: 94658 - DNA, 25 bp, S. pombe
gaggctgtgacggacttttatctga

SEQ ID NO: 94659 - DNA, 25 bp, S. pombe
gaggctcgttggtcttcgtgaagca

SEQ ID NO: 94660 - DNA, 25 bp, S. pombe
gaggccacttggtcgacatgatgaa

SEQ ID NO: 94661 - DNA, 25 bp, S. pombe
gaggcccatattgctgactggatta

SEQ ID NO: 94662 - DNA, 25 bp, S. pombe
gatgtacgagctttatgacagaact

SEQ ID NO: 94663 - DNA, 25 bp, S. pombe
gatggaccgacttatgacagattca

SEQ ID NO: 94664 - DNA, 25 bp, S. pombe
gatggctcaccaattggagtttcac

SEQ ID NO: 94665 - DNA, 25 bp, S. pombe
gatgtcgtcgcattggttgcaacta

SEQ ID NO: 94666 - DNA, 25 bp, S. pombe
gaggcgtcgcattttcgcgacatta

SEQ ID NO: 94667 - DNA, 25 bp, S. pombe
gatggccatgtgtttaccgagaaag

SEQ ID NO: 94668 - DNA, 25 bp, S. pombe
gataccctttgtatggaaagcccat

SEQ ID NO: 94669 - DNA, 25 bp, S. pombe
gatgttcccttgctcttttactaaa

SEQ ID NO: 94670 - DNA, 25 bp, S. pombe
gtttaaaggaccactgcgacctgtt

SEQ ID NO: 94671 - DNA, 25 bp, S. pombe
gatggcgtaactgctgatggcttta

SEQ ID NO: 94672 - DNA, 25 bp, S. pombe
gatgatgctgtatgctctgcgattg

SEQ ID NO: 94673 - DNA, 25 bp, S. pombe
gatggtattctgtcggtgtacaatc

SEQ ID NO: 94674 - DNA, 25 bp, S. pombe
gatgtatcccctagtttactacaag

SEQ ID NO: 94675 - DNA, 25 bp, S. pombe
gatgtcggcccagagtttgaaaaaa

SEQ ID NO: 94676 - DNA, 25 bp, S. pombe
gatataagacttcagggacaaatta

SEQ ID NO: 94677 - DNA, 25 bp, S. pombe
gatgaaaccgctaagggaactccta

SEQ ID NO: 94678 - DNA, 25 bp, S. pombe
gatgttaatttcctggcttcaatac

SEQ ID NO: 94679 - DNA, 25 bp, S. pombe
gatgattacagttcccgatacggtc

SEQ ID NO: 94680 - DNA, 25 bp, S. pombe
gatggtactatgtctgcgaaccaga

SEQ ID NO: 94681 - DNA, 25 bp, S. pombe
gatggctagtccgtatagtcagcaa

SEQ ID NO: 94682 - DNA, 25 bp, S. pombe
gaggccagacagtacgcgagcagca

SEQ ID NO: 94683 - DNA, 25 bp, S. pombe
gatggtggtagcttatcttctgcta

SEQ ID NO: 94684 - DNA, 25 bp, S. pombe
gatggcccaacgttactgttgaact

SEQ ID NO: 94685 - DNA, 25 bp, S. pombe
gaggctgcgaggattctctacaatg

SEQ ID NO: 94686 - DNA, 25 bp, S. pombe
gaggcgcgaggaattgtctgcaaaa

SEQ ID NO: 94687 - DNA, 25 bp, S. pombe
gatgggagggtctgcttatacaaaa

SEQ ID NO: 94688 - DNA, 25 bp, S. pombe
gatggaagctggactttttacgaca

SEQ ID NO: 94689 - DNA, 25 bp, S. pombe
gatggagcatggttttcgtctacga

SEQ ID NO: 94690 - DNA, 25 bp, S. pombe
gaggcgctgatgttttttctacaga

SEQ ID NO: 94691 - DNA, 25 bp, S. pombe
gatggccgagatactctcttcaaag

SEQ ID NO: 94692 - DNA, 25 bp, S. pombe
gaggccaagtactctcttttgagga

SEQ ID NO: 94693 - DNA, 25 bp, S. pombe
gatggacaagcgctcaatgtggtta

SEQ ID NO: 94694 - DNA, 25 bp, S. pombe
gatggaaatcacatactggcgctta

SEQ ID NO: 94695 - DNA, 25 bp, S. pombe
gtttacgttactgcctaagcggaca

SEQ ID NO: 94696 - DNA, 25 bp, S. pombe
gatttagcacttttttaccggccat

SEQ ID NO: 94697 - DNA, 25 bp, S. pombe
gatttacgcgtgttattaagccgaa

SEQ ID NO: 94698 - DNA, 25 bp, S. pombe
gttcagtcggcgtctatacaggtgc

SEQ ID NO: 94699 - DNA, 25 bp, S. pombe
gatggttctttgtctccaaacactg

SEQ ID NO: 94700 - DNA, 25 bp, S. pombe
gatgttgagaccttcgtcgctaccg

SEQ ID NO: 94701 - DNA, 25 bp, S. pombe
gatggtcacgcgatagcttacgctg

SEQ ID NO: 94702 - DNA, 25 bp, S. pombe
gatggacaccatcgtattgaacttg

SEQ ID NO: 94703 - DNA, 25 bp, S. pombe
gatggcagcacagttcaacaccagc

SEQ ID NO: 94704 - DNA, 25 bp, S. pombe
gatgtcacctctaacggcgaaccat

SEQ ID NO: 94705 - DNA, 25 bp, S. pombe
gatgttttccagtcaccagatccta

SEQ ID NO: 94706 - DNA, 25 bp, S. pombe
gatggactgtgtaacaccctctaac

SEQ ID NO: 94707 - DNA, 25 bp, S. pombe
gatggacttgcacttagttctcgaa

SEQ ID NO: 94708 - DNA, 25 bp, S. pombe
gatgaatttcttgcatttcgtaaaa

SEQ ID NO: 94709 - DNA, 25 bp, S. pombe
gatgagtttgaagatttcgcaacag

SEQ ID NO: 94710 - DNA, 25 bp, S. pombe
gatggttcaactatgctacctgcgt

SEQ ID NO: 94711 - DNA, 25 bp, S. pombe
gatgttgtcaacatttccggccatc

SEQ ID NO: 94712 - DNA, 25 bp, S. pombe
gatgttgaaactcttccatacgcct

SEQ ID NO: 94713 - DNA, 25 bp, S. pombe
gatgtacaacctatctttacgccaa

SEQ ID NO: 94714 - DNA, 25 bp, S. pombe
gatggcacattagcaacgcttcgcg

SEQ ID NO: 94715 - DNA, 25 bp, S. pombe
gatggctcatttggcatatctgctc

SEQ ID NO: 94716 - DNA, 25 bp, S. pombe
gatggctatctttgttgctgtttta

SEQ ID NO: 94717 - DNA, 25 bp, S. pombe
gatggtcagtctttggtagttttag

SEQ ID NO: 94718 - DNA, 25 bp, S. pombe
gatgttcgtcagtgagcttgtttta

SEQ ID NO: 94719 - DNA, 25 bp, S. pombe
gatgaggcccatgatttagtttata

SEQ ID NO: 94720 - DNA, 25 bp, S. pombe
gatggtacctcgtatgatgcggctg

SEQ ID NO: 94721 - DNA, 25 bp, S. pombe
gatggtatcccatagatccggtgag

SEQ ID NO: 94722 - DNA, 25 bp, S. pombe
gatggtatccctcagatggtgcgta

SEQ ID NO: 94723 - DNA, 25 bp, S. pombe
gtgcagtatggccaccagtaggaat

SEQ ID NO: 94724 - DNA, 25 bp, S. pombe
gatgtgtgcatctcaactcataatg

SEQ ID NO: 94725 - DNA, 25 bp, S. pombe
gatggcttgattccagcttcttatg

SEQ ID NO: 94726 - DNA, 25 bp, S. pombe
gatgcacgtgttttcccaaacggaa

SEQ ID NO: 94727 - DNA, 25 bp, S. pombe
gatcctggcgctcttcaaaagggta

SEQ ID NO: 94728 - DNA, 25 bp, S. pombe
gatgacgagactgttcccaagggta

SEQ ID NO: 94729 - DNA, 25 bp, S. pombe
gatgtatccagattttacccaactt

SEQ ID NO: 94730 - DNA, 25 bp, S. pombe
gatggatgcacattttgtccccaga

SEQ ID NO: 94731 - DNA, 25 bp, S. pombe
gatggacttatctttacatgtacgg

SEQ ID NO: 94732 - DNA, 25 bp, S. pombe
gatggctctcgtgtatcagcagtag

SEQ ID NO: 94733 - DNA, 25 bp, S. pombe
gatggctgcctccttaaatggactt

SEQ ID NO: 94734 - DNA, 25 bp, S. pombe
gatgtgtcgcgctgattatatgtac

SEQ ID NO: 94735 - DNA, 25 bp, S. pombe
gatggatctggctcaaattgttcaa

SEQ ID NO: 94736 - DNA, 25 bp, S. pombe
gatggcacttgcagactttgggaca

SEQ ID NO: 94737 - DNA, 25 bp, S. pombe
gatggcacttgcgtacttgttagcg

SEQ ID NO: 94738 - DNA, 25 bp, S. pombe
gatggcaacgcagtgattcttttga

SEQ ID NO: 94739 - DNA, 25 bp, S. pombe
gatgcgtaccgctattttagccgga

SEQ ID NO: 94740 - DNA, 25 bp, S. pombe
gatggtttcgtttttcatgttgtga

SEQ ID NO: 94741 - DNA, 25 bp, S. pombe
gatggcatccgttcgagaaagctta

SEQ ID NO: 94742 - DNA, 25 bp, S. pombe
gatgcgcttttttcaagtactcctc

SEQ ID NO: 94743 - DNA, 25 bp, S. pombe
gatgacccttcgagatgtgacttta

SEQ ID NO: 94744 - DNA, 25 bp, S. pombe
gatgtctcgctttgacgattgcata

SEQ ID NO: 94745 - DNA, 25 bp, S. pombe
gatgtctcacttactcatgttcaat

SEQ ID NO: 94746 - DNA, 25 bp, S. pombe
gatgctgctagcttgttagacggat

SEQ ID NO: 94747 - DNA, 25 bp, S. pombe
gatgtctatgcgatccgactggtac

SEQ ID NO: 94748 - DNA, 25 bp, S. pombe
gatgttaggattactcctcctgttt

SEQ ID NO: 94749 - DNA, 25 bp, S. pombe
gatggaggccatgtatccggttgat

SEQ ID NO: 94750 - DNA, 25 bp, S. pombe
gatggaccttgtgtacgagattata

SEQ ID NO: 94751 - DNA, 25 bp, S. pombe
gatggatcttctgattcgggttata

SEQ ID NO: 94752 - DNA, 25 bp, S. pombe
gatgagtttccaccaattcagttta

SEQ ID NO: 94753 - DNA, 25 bp, S. pombe
gatgggcttttgcttttatctctgc

SEQ ID NO: 94754 - DNA, 25 bp, S. pombe
gatggtggtgtcgttttcattactc

SEQ ID NO: 94755 - DNA, 25 bp, S. pombe
gatgtcaaagtacgtctgcgcgatt

SEQ ID NO: 94756 - DNA, 25 bp, S. pombe
gatggtggacttcaaatgctggttc

SEQ ID NO: 94757 - DNA, 25 bp, S. pombe
gatggttgttgtttatgctctctat

SEQ ID NO: 94758 - DNA, 25 bp, S. pombe
gatggcctttcattttctagagcag

SEQ ID NO: 94759 - DNA, 25 bp, S. pombe
gatggcactttactttctactgccg

SEQ ID NO: 94760 - DNA, 25 bp, S. pombe
gatggcgttatacttgctgcagatt

SEQ ID NO: 94761 - DNA, 25 bp, S. pombe
gatgtcgatgatagtcctctcagtt

SEQ ID NO: 94762 - DNA, 25 bp, S. pombe
gatgttagtctacctccaatagtga

SEQ ID NO: 94763 - DNA, 25 bp, S. pombe
gatgtttttcatctcacaaagcaaa

SEQ ID NO: 94764 - DNA, 25 bp, S. pombe
gatgggcgcaattggcaaatctttt

SEQ ID NO: 94765 - DNA, 25 bp, S. pombe
gatggagccaaaacattgtctcttt

SEQ ID NO: 94766 - DNA, 25 bp, S. pombe
gatgtgaaatccttcttttcttcca

SEQ ID NO: 94767 - DNA, 25 bp, S. pombe
gttggaatccctgttacccataatt

SEQ ID NO: 94768 - DNA, 25 bp, S. pombe
gatgggatttcttacgcattccgaa

SEQ ID NO: 94769 - DNA, 25 bp, S. pombe
gatgggtatctcacaacattccgaa

SEQ ID NO: 94770 - DNA, 25 bp, S. pombe
gatggttatatgaacttggcccttg

SEQ ID NO: 94771 - DNA, 25 bp, S. pombe
gatggttatatcgaccttcgtcatt

SEQ ID NO: 94772 - DNA, 25 bp, S. pombe
gatggtattgtctcacatggagtct

SEQ ID NO: 94773 - DNA, 25 bp, S. pombe
gatggtccttacaaccgtatccaaa

SEQ ID NO: 94774 - DNA, 25 bp, S. pombe
gatggtttcgattaccttggccaaa

SEQ ID NO: 94775 - DNA, 25 bp, S. pombe
gatggtcgctggattccttccaaaa

SEQ ID NO: 94776 - DNA, 25 bp, S. pombe
gatgggcgtcgaattttagtcaaca

SEQ ID NO: 94777 - DNA, 25 bp, S. pombe
gatggagcgctcaaattccttttta

SEQ ID NO: 94778 - DNA, 25 bp, S. pombe
gatggtgacatctaccttcgtttac

SEQ ID NO: 94779 - DNA, 25 bp, S. pombe
gatgtttctaaccagctgtatgcaa

SEQ ID NO: 94780 - DNA, 25 bp, S. pombe
gatggtatcgctcggtgctttgaca

SEQ ID NO: 94781 - DNA, 25 bp, S. pombe
gatggcttaagctctgactcaagaa

SEQ ID NO: 94782 - DNA, 25 bp, S. pombe
gatgacttgaactctcctaattggg

SEQ ID NO: 94783 - DNA, 25 bp, S. pombe
gatgtttctacaactcgctatttcg

SEQ ID NO: 94784 - DNA, 25 bp, S. pombe
gatgttttacattctgcacttggtc

SEQ ID NO: 94785 - DNA, 25 bp, S. pombe
gatgtccttatagtgctgcagctaa

SEQ ID NO: 94786 - DNA, 25 bp, S. pombe
gatggcatacacaaatttcctgact

SEQ ID NO: 94787 - DNA, 25 bp, S. pombe
gatggcaagcaaaaattcctctgat

SEQ ID NO: 94788 - DNA, 25 bp, S. pombe
gatggactacattagctacagcgct

SEQ ID NO: 94789 - DNA, 25 bp, S. pombe
gatggacctatttcttgtctcagtg

SEQ ID NO: 94790 - DNA, 25 bp, S. pombe
gatgatttctttggtctacgggaac

SEQ ID NO: 94791 - DNA, 25 bp, S. pombe
gatgtgcggattggaggcttcaaat

SEQ ID NO: 94792 - DNA, 25 bp, S. pombe
gatgtcgcctccaagtattgtgact

SEQ ID NO: 94793 - DNA, 25 bp, S. pombe
gatgttgctcttcagtatattccta

SEQ ID NO: 94794 - DNA, 25 bp, S. pombe
gatgtatccagtccgtaagcatatg

SEQ ID NO: 94795 - DNA, 25 bp, S. pombe
gatgattcagacgattctatgcaag

SEQ ID NO: 94796 - DNA, 25 bp, S. pombe
gatgtcaatgatcctacagccacag

SEQ ID NO: 94797 - DNA, 25 bp, S. pombe
gatgttcatgactctgtccaagctc

SEQ ID NO: 94798 - DNA, 25 bp, S. pombe
gatggttacctcttgatgtacgaca

SEQ ID NO: 94799 - DNA, 25 bp, S. pombe
gatggagctagtacacctgtgacaa

SEQ ID NO: 94800 - DNA, 25 bp, S. pombe
gatgtgaatctcaaccaattcctga

SEQ ID NO: 94801 - DNA, 25 bp, S. pombe
gatggacgccatatctcggagaaga

SEQ ID NO: 94802 - DNA, 25 bp, S. pombe
gatggtgcccataatacttcggaaa

SEQ ID NO: 94803 - DNA, 25 bp, S. pombe
gatgttacccgtacttttgattccg

SEQ ID NO: 94804 - DNA, 25 bp, S. pombe
gatgttgatccctttttgttttact

SEQ ID NO: 94805 - DNA, 25 bp, S. pombe
gatgtttgctccattggtgattcca

SEQ ID NO: 94806 - DNA, 25 bp, S. pombe
gatgggatccctcatggtcatatca

SEQ ID NO: 94807 - DNA, 25 bp, S. pombe
gatggtgcactcatggatatgttaa

SEQ ID NO: 94808 - DNA, 25 bp, S. pombe
gatgagacatctagtggatttaaac

SEQ ID NO: 94809 - DNA, 25 bp, S. pombe
gatcattccttgatgaagctggcct

SEQ ID NO: 94810 - DNA, 25 bp, S. pombe
gatgatgcccaaagtgacgctcgtt

SEQ ID NO: 94811 - DNA, 25 bp, S. pombe
gatgtcttgtacataacgcctctgc

SEQ ID NO: 94812 - DNA, 25 bp, S. pombe
gatgacactgatgagttacccctag

SEQ ID NO: 94813 - DNA, 25 bp, S. pombe
gatgttctgcaagttacccaaggat

SEQ ID NO: 94814 - DNA, 25 bp, S. pombe
gatgtcgacaagcttccattgcaag

SEQ ID NO: 94815 - DNA, 25 bp, S. pombe
gatgtaatagtcctaccactgctag

SEQ ID NO: 94816 - DNA, 25 bp, S. pombe
gatgtaatagtatgctctcccttga

SEQ ID NO: 94817 - DNA, 25 bp, S. pombe
gatgatattttgacgaccctcgaat

SEQ ID NO: 94818 - DNA, 25 bp, S. pombe
gatgtcatatctgggcaacaactta

SEQ ID NO: 94819 - DNA, 25 bp, S. pombe
gatggattcatactcatccgaccca

SEQ ID NO: 94820 - DNA, 25 bp, S. pombe
gatggttatgagacttcccgccaaa

SEQ ID NO: 94821 - DNA, 25 bp, S. pombe
gatggtttgcattcattttccccaa

SEQ ID NO: 94822 - DNA, 25 bp, S. pombe
gatggttctgcattcacttttgtta

SEQ ID NO: 94823 - DNA, 25 bp, S. pombe
gatggatttgactcttcttctgctg

SEQ ID NO: 94824 - DNA, 25 bp, S. pombe
gatggtgcttctcaattttctgatt

SEQ ID NO: 94825 - DNA, 25 bp, S. pombe
gatgtttttcgttgctctttattta

SEQ ID NO: 94826 - DNA, 25 bp, S. pombe
gatgtcatatttggtcctgcttata

SEQ ID NO: 94827 - DNA, 25 bp, S. pombe
gatgtgcatgttgattcctggtgga

SEQ ID NO: 94828 - DNA, 25 bp, S. pombe
gatgttgaatgctttgcctgcggag

SEQ ID NO: 94829 - DNA, 25 bp, S. pombe
gatgttgcagtgtttccttgtgtat

SEQ ID NO: 94830 - DNA, 25 bp, S. pombe
gatgtatctcatcccaaggcggcta

SEQ ID NO: 94831 - DNA, 25 bp, S. pombe
gatgaaagcacctggactgtcgaag

SEQ ID NO: 94832 - DNA, 25 bp, S. pombe
gatgaaatcggctgtagtaaagaga

SEQ ID NO: 94833 - DNA, 25 bp, S. pombe
gatgattctgtacgccaaggtctta

SEQ ID NO: 94834 - DNA, 25 bp, S. pombe
gatgagatcgactccatcggctctt

SEQ ID NO: 94835 - DNA, 25 bp, S. pombe
gatgaatcgtaacattggcttccta

SEQ ID NO: 94836 - DNA, 25 bp, S. pombe
gatgagcgtactagagtctttccta

SEQ ID NO: 94837 - DNA, 25 bp, S. pombe
gatggtgtctctaagtctattggta

SEQ ID NO: 94838 - DNA, 25 bp, S. pombe
gatgagtacatgcaaggccacttca

SEQ ID NO: 94839 - DNA, 25 bp, S. pombe
gatgtgcaaagcatatcgcccttct

SEQ ID NO: 94840 - DNA, 25 bp, S. pombe
gatgtggtacagttggcctcttgat

SEQ ID NO: 94841 - DNA, 25 bp, S. pombe
gatgggtacaggtgcagctcacatt

SEQ ID NO: 94842 - DNA, 25 bp, S. pombe
gatggtaatccgtctcatgctaatg

SEQ ID NO: 94843 - DNA, 25 bp, S. pombe
gatgttcaattcagtcgaccacctc

SEQ ID NO: 94844 - DNA, 25 bp, S. pombe
gatgttgacattggtgccaaccctt

SEQ ID NO: 94845 - DNA, 25 bp, S. pombe
gatgggaattctgcacaactgccaa

SEQ ID NO: 94846 - DNA, 25 bp, S. pombe
gatgggccttcttcaatacatacga

SEQ ID NO: 94847 - DNA, 25 bp, S. pombe
gatggtgactgtggtactactttga

SEQ ID NO: 94848 - DNA, 25 bp, S. pombe
gatggtgctcgtattctttatgaaa

SEQ ID NO: 94849 - DNA, 25 bp, S. pombe
gatggtattccaagcttcttcaatg

SEQ ID NO: 94850 - DNA, 25 bp, S. pombe
gatggtgatgccgatactccttcca

SEQ ID NO: 94851 - DNA, 25 bp, S. pombe
gatgtatattcactaggcctcagta

SEQ ID NO: 94852 - DNA, 25 bp, S. pombe
gatgtgaattctccaagcctcgaga

SEQ ID NO: 94853 - DNA, 25 bp, S. pombe
gatgggtcttactacactcgaacaa

SEQ ID NO: 94854 - DNA, 25 bp, S. pombe
gatggtgctgttactagcgcaaaca

SEQ ID NO: 94855 - DNA, 25 bp, S. pombe
gatgggctagctagatacgcaaaca

SEQ ID NO: 94856 - DNA, 25 bp, S. pombe
gatgagtaaactacctgagcccgtt

SEQ ID NO: 94857 - DNA, 25 bp, S. pombe
gatgcagttacctacactgaacacg

SEQ ID NO: 94858 - DNA, 25 bp, S. pombe
gatcgtcgagccatcactattacaa

SEQ ID NO: 94859 - DNA, 25 bp, S. pombe
gatggtaattcttctggttcaggga

SEQ ID NO: 94860 - DNA, 25 bp, S. pombe
gatgtataatcatttcccgtccgtc

SEQ ID NO: 94861 - DNA, 25 bp, S. pombe
gatgttaaagttcccgatgccggcg

SEQ ID NO: 94862 - DNA, 25 bp, S. pombe
gatcctattccacggccacgtaaaa

SEQ ID NO: 94863 - DNA, 25 bp, S. pombe
gatgcctacccaccggaaaagagaa

SEQ ID NO: 94864 - DNA, 25 bp, S. pombe
gtcttattttcgctggtaagcagtt

SEQ ID NO: 94865 - DNA, 25 bp, S. pombe
gatccttaccgtcatattggctgta

SEQ ID NO: 94866 - DNA, 25 bp, S. pombe
gatcctaatgcgctgcctatagaat

SEQ ID NO: 94867 - DNA, 25 bp, S. pombe
gatccatactggctagctgagtttg

SEQ ID NO: 94868 - DNA, 25 bp, S. pombe
gatgttcataccgaggaggttccta

SEQ ID NO: 94869 - DNA, 25 bp, S. pombe
gatgattatacgaagctgtgctcct

SEQ ID NO: 94870 - DNA, 25 bp, S. pombe
gatgatattacctatgctttggctt

SEQ ID NO: 94871 - DNA, 25 bp, S. pombe
gatgtttttcgattgtaagcctctt

SEQ ID NO: 94872 - DNA, 25 bp, S. pombe
gatgtttttgaatggctacgcttta

SEQ ID NO: 94873 - DNA, 25 bp, S. pombe
gatgtttgttaatgtgtctccttta

SEQ ID NO: 94874 - DNA, 25 bp, S. pombe
gatgttgcgttagcgatgacccttc

SEQ ID NO: 94875 - DNA, 25 bp, S. pombe
gatgttcgcgtaaagcaacctgtcg

SEQ ID NO: 94876 - DNA, 25 bp, S. pombe
gatgtcacgtcccaagaatttgtcg

SEQ ID NO: 94877 - DNA, 25 bp, S. pombe
gatgatggttacgacagttctcctt

SEQ ID NO: 94878 - DNA, 25 bp, S. pombe
gatgggaaatctcgcgccaagtttt

SEQ ID NO: 94879 - DNA, 25 bp, S. pombe
gatgatgaacaaaccccttctaaat

SEQ ID NO: 94880 - DNA, 25 bp, S. pombe
gatgaaacgcttcgtgtctttaact

SEQ ID NO: 94881 - DNA, 25 bp, S. pombe
gatgtccactggtgtatggctgtta

SEQ ID NO: 94882 - DNA, 25 bp, S. pombe
gatgtacaatggttgaagcctccaa

SEQ ID NO: 94883 - DNA, 25 bp, S. pombe
gatgcttcaaagctaaccgtatgtt

SEQ ID NO: 94884 - DNA, 25 bp, S. pombe
gatgtacatccttttcatgacagca

SEQ ID NO: 94885 - DNA, 25 bp, S. pombe
gatgtcacattttcctttgcatgct

SEQ ID NO: 94886 - DNA, 25 bp, S. pombe
gatgatatcgattcttccacgcatt

SEQ ID NO: 94887 - DNA, 25 bp, S. pombe
gatgatatcgtcaagagcgctcgta

SEQ ID NO: 94888 - DNA, 25 bp, S. pombe
gatgagtatccaatgatgcctccca

SEQ ID NO: 94889 - DNA, 25 bp, S. pombe
gatgattcctatataacctactcgg

SEQ ID NO: 94890 - DNA, 25 bp, S. pombe
gatgattcactttttgacgctcctc

SEQ ID NO: 94891 - DNA, 25 bp, S. pombe
gatcaagaacttttacctcgactgt

SEQ ID NO: 94892 - DNA, 25 bp, S. pombe
gatgagcttcaacaggatctcgtcc

SEQ ID NO: 94893 - DNA, 25 bp, S. pombe
gatgttactggtttgcacgacctag

SEQ ID NO: 94894 - DNA, 25 bp, S. pombe
gatgtacactggtattgccgtcact

SEQ ID NO: 94895 - DNA, 25 bp, S. pombe
gatgattccgtccttgatgatattt

SEQ ID NO: 94896 - DNA, 25 bp, S. pombe
gatgatccccgcgatttggaattca

SEQ ID NO: 94897 - DNA, 25 bp, S. pombe
gatcttcttggcgtttggacttaaa

SEQ ID NO: 94898 - DNA, 25 bp, S. pombe
gatgagcactacgtctacgctttga

SEQ ID NO: 94899 - DNA, 25 bp, S. pombe
gatgtccaaatgtcttcgtttgaga

SEQ ID NO: 94900 - DNA, 25 bp, S. pombe
gatgttacatcggtcctggtttaaa

SEQ ID NO: 94901 - DNA, 25 bp, S. pombe
gatgttagcaaaatcctggtctgaa

SEQ ID NO: 94902 - DNA, 25 bp, S. pombe
gatgaggtagcagagtccagaaaac

SEQ ID NO: 94903 - DNA, 25 bp, S. pombe
gatgacgctagcttatggccagatc

SEQ ID NO: 94904 - DNA, 25 bp, S. pombe
gatgtcgctacgttgctgagggctc

SEQ ID NO: 94905 - DNA, 25 bp, S. pombe
gatgtcttactgttgggttcttcaa

SEQ ID NO: 94906 - DNA, 25 bp, S. pombe
gatgtcaatcttacatggctcctga

SEQ ID NO: 94907 - DNA, 25 bp, S. pombe
gatgtcagacatagctctgcgcgat

SEQ ID NO: 94908 - DNA, 25 bp, S. pombe
gatgcagcagcagctctatcggata

SEQ ID NO: 94909 - DNA, 25 bp, S. pombe
gatgacgatactcctactttgaact

SEQ ID NO: 94910 - DNA, 25 bp, S. pombe
gatgtcttgtctttaaatccacact

SEQ ID NO: 94911 - DNA, 25 bp, S. pombe
gatgtcaactcgtttagatcaactt

SEQ ID NO: 94912 - DNA, 25 bp, S. pombe
gatgattactcgtctatcggacctt

SEQ ID NO: 94913 - DNA, 25 bp, S. pombe
gatgtttctttgtttgctcatgcag

SEQ ID NO: 94914 - DNA, 25 bp, S. pombe
gatgatgtttatcgttctccacgta

SEQ ID NO: 94915 - DNA, 25 bp, S. pombe
gatgagtatttgctgttaccaccct

SEQ ID NO: 94916 - DNA, 25 bp, S. pombe
gatgatgaatctacctctcgacgtc

SEQ ID NO: 94917 - DNA, 25 bp, S. pombe
gatgaaatctatatccgaccacggt

SEQ ID NO: 94918 - DNA, 25 bp, S. pombe
gatgaggattatataccaccacaag

SEQ ID NO: 94919 - DNA, 25 bp, S. pombe
gatgattctgttgataccgaggacg

SEQ ID NO: 94920 - DNA, 25 bp, S. pombe
gatgtctctttcaatccattcgatg

SEQ ID NO: 94921 - DNA, 25 bp, S. pombe
gatgaactccgaaagtgaagcctaa

SEQ ID NO: 94922 - DNA, 25 bp, S. pombe
gatgatgtgaatcctgctccagata

SEQ ID NO: 94923 - DNA, 25 bp, S. pombe
gatgatcgcacttatgccagcaaga

SEQ ID NO: 94924 - DNA, 25 bp, S. pombe
gatgttgatctttctctcgagacag

SEQ ID NO: 94925 - DNA, 25 bp, S. pombe
gatgactggccccaagcctgaaggt

SEQ ID NO: 94926 - DNA, 25 bp, S. pombe
gatgttcatcctggaatgcctcaac

SEQ ID NO: 94927 - DNA, 25 bp, S. pombe
gatgattcatccctaattctcgaca

SEQ ID NO: 94928 - DNA, 25 bp, S. pombe
gatgttgctactcgaatcgtcgaat

SEQ ID NO: 94929 - DNA, 25 bp, S. pombe
gatgttctatcttgttctgtgccat

SEQ ID NO: 94930 - DNA, 25 bp, S. pombe
gatgttcattcttggcctgaggtga

SEQ ID NO: 94931 - DNA, 25 bp, S. pombe
gatgtatcggtctttgtgaaccctc

SEQ ID NO: 94932 - DNA, 25 bp, S. pombe
gatgtcacggttcttgatacgcaga

SEQ ID NO: 94933 - DNA, 25 bp, S. pombe
gatgtactcgtttcttacaagcgaa

SEQ ID NO: 94934 - DNA, 25 bp, S. pombe
gatgtattgcggaatttgaaggtaa

SEQ ID NO: 94935 - DNA, 25 bp, S. pombe
gatgagtcatttcagcagcttagtc

SEQ ID NO: 94936 - DNA, 25 bp, S. pombe
gatgagcttatcgaactggttcagc

SEQ ID NO: 94937 - DNA, 25 bp, S. pombe
gatgttgctattgatctccagtctc

SEQ ID NO: 94938 - DNA, 25 bp, S. pombe
gatgttgacgaattctcttcaggga

SEQ ID NO: 94939 - DNA, 25 bp, S. pombe
gatgttactaatcttgtctcgggac

SEQ ID NO: 94940 - DNA, 25 bp, S. pombe
gatgattcagacttttcttctttat

SEQ ID NO: 94941 - DNA, 25 bp, S. pombe
gatgataaccgaccatcatggctta

SEQ ID NO: 94942 - DNA, 25 bp, S. pombe
gatgtatcaccaactagaccagact

SEQ ID NO: 94943 - DNA, 25 bp, S. pombe
gatgatcacactttcagtttcgatt

SEQ ID NO: 94944 - DNA, 25 bp, S. pombe
gatgatctagctcaacctgggatta

SEQ ID NO: 94945 - DNA, 25 bp, S. pombe
gatgttatatcttcgctatcaagtt

SEQ ID NO: 94946 - DNA, 25 bp, S. pombe
gatgtatatccttagcgtgccattt

SEQ ID NO: 94947 - DNA, 25 bp, S. pombe
gatgtcaattccgagtatgctgcta

SEQ ID NO: 94948 - DNA, 25 bp, S. pombe
gatgctcgaatttctgatcttgctc

SEQ ID NO: 94949 - DNA, 25 bp, S. pombe
gatgtagagatttctgagccgtcaa

SEQ ID NO: 94950 - DNA, 25 bp, S. pombe
gatgctggcaaaatcatggtggtca

SEQ ID NO: 94951 - DNA, 25 bp, S. pombe
gatgcttcatcaagtaggctaggat

SEQ ID NO: 94952 - DNA, 25 bp, S. pombe
gatgatttggatcctagttctcacg

SEQ ID NO: 94953 - DNA, 25 bp, S. pombe
gatgatcggctgtttcatgtttcca

SEQ ID NO: 94954 - DNA, 25 bp, S. pombe
gatgatctgaagtctcgtctcaata

SEQ ID NO: 94955 - DNA, 25 bp, S. pombe
gatgatgctataaaagaccctacta

SEQ ID NO: 94956 - DNA, 25 bp, S. pombe
gatgctgttcacaaaatccccgtac

SEQ ID NO: 94957 - DNA, 25 bp, S. pombe
gatgtttcacaatcatctcgcgctg

SEQ ID NO: 94958 - DNA, 25 bp, S. pombe
gatgtaattctagctcattgcgccg

SEQ ID NO: 94959 - DNA, 25 bp, S. pombe
gttccgtattcgcatggttgattcc

SEQ ID NO: 94960 - DNA, 25 bp, S. pombe
gatgatagtgccactcttcgtgtca

SEQ ID NO: 94961 - DNA, 25 bp, S. pombe
gatgatattccttcacatccgtatc

SEQ ID NO: 94962 - DNA, 25 bp, S. pombe
gatgatatttccgactctgctaagg

SEQ ID NO: 94963 - DNA, 25 bp, S. pombe
gatgccgcttacgattctgtaggaa

SEQ ID NO: 94964 - DNA, 25 bp, S. pombe
gatcgtagatcagttttttccctgg

SEQ ID NO: 94965 - DNA, 25 bp, S. pombe
gatccatgggagctttcttcccttc

SEQ ID NO: 94966 - DNA, 25 bp, S. pombe
gatcctgtgtgtctggtttcgaatt

SEQ ID NO: 94967 - DNA, 25 bp, S. pombe
gatccacgaactctcgaagtactta

SEQ ID NO: 94968 - DNA, 25 bp, S. pombe
gatgttcagattctcgtgttcctga

SEQ ID NO: 94969 - DNA, 25 bp, S. pombe
gatgtttttgtgttattccccaacg

SEQ ID NO: 94970 - DNA, 25 bp, S. pombe
gatgatattcgttatttcctctcaa

SEQ ID NO: 94971 - DNA, 25 bp, S. pombe
gatgagtggtaatgcccgagcttat

SEQ ID NO: 94972 - DNA, 25 bp, S. pombe
gatgttcctaatgccctgatgttta

SEQ ID NO: 94973 - DNA, 25 bp, S. pombe
gatgtatctttagccagcactctac

SEQ ID NO: 94974 - DNA, 25 bp, S. pombe
gatgattttgctgcacaaaccgaca

SEQ ID NO: 94975 - DNA, 25 bp, S. pombe
gatgaagtttctatagcctctacct

SEQ ID NO: 94976 - DNA, 25 bp, S. pombe
gatgaagttgctcttacccaagcgc

SEQ ID NO: 94977 - DNA, 25 bp, S. pombe
gatgttattgatcgccttcgcaatt

SEQ ID NO: 94978 - DNA, 25 bp, S. pombe
gatgattttgatccagcttcggtag

SEQ ID NO: 94979 - DNA, 25 bp, S. pombe
gatgattcaagttcgctgggtgata

SEQ ID NO: 94980 - DNA, 25 bp, S. pombe
gatgctgccttgaatgcttgggatt

SEQ ID NO: 94981 - DNA, 25 bp, S. pombe
gatgatcgtctgaagcagctttaca

SEQ ID NO: 94982 - DNA, 25 bp, S. pombe
gatgatcgttttggtcctacagcta

SEQ ID NO: 94983 - DNA, 25 bp, S. pombe
gatgagcgtatgttgactgttccta

SEQ ID NO: 94984 - DNA, 25 bp, S. pombe
gatgattgtgaattagctgctacga

SEQ ID NO: 94985 - DNA, 25 bp, S. pombe
gatgattttatttccgcgacattgt

SEQ ID NO: 94986 - DNA, 25 bp, S. pombe
gatgttcttctgttaacgactcatg

SEQ ID NO: 94987 - DNA, 25 bp, S. pombe
gatcttctcccgcaatcaaattgat

SEQ ID NO: 94988 - DNA, 25 bp, S. pombe
gatgatttccaagatgctgtcaatt

SEQ ID NO: 94989 - DNA, 25 bp, S. pombe
gatgttgaatcctcttctaacgaag

SEQ ID NO: 94990 - DNA, 25 bp, S. pombe
gatgttgttcctgctattcaacgta

SEQ ID NO: 94991 - DNA, 25 bp, S. pombe
gatgatgcttattctcctcaagtag

SEQ ID NO: 94992 - DNA, 25 bp, S. pombe
gatgatgttcattattgcccagaaa

SEQ ID NO: 94993 - DNA, 25 bp, S. pombe
gatgattttagcacaccggaggaac

SEQ ID NO: 94994 - DNA, 25 bp, S. pombe
gatgccgttcgtgccttggaagaat

SEQ ID NO: 94995 - DNA, 25 bp, S. pombe
gatgaccttggtgactttatagcgg

SEQ ID NO: 94996 - DNA, 25 bp, S. pombe
gatgttgttgaattctgacctcgaa

SEQ ID NO: 94997 - DNA, 25 bp, S. pombe
gatgttgctcaagacgcctatcaat

SEQ ID NO: 94998 - DNA, 25 bp, S. pombe
gatgatctcattcagcaagctttca

SEQ ID NO: 94999 - DNA, 25 bp, S. pombe
gatgttctcagtggccagtgtttaa

SEQ ID NO: 95000 - DNA, 25 bp, S. pombe
gatgattcagataactccagcttag

SEQ ID NO: 95001 - DNA, 25 bp, S. pombe
gatgagcagaaaacgcccacatgaa

SEQ ID NO: 95002 - DNA, 25 bp, S. pombe
gatgactccacatcaccaagtaatt

SEQ ID NO: 95003 - DNA, 25 bp, S. pombe
gatgacaccaactcacatatcggat

SEQ ID NO: 95004 - DNA, 25 bp, S. pombe
gatgttcctttgactttcgctatgc

SEQ ID NO: 95005 - DNA, 25 bp, S. pombe
gatgttgactttacttctgctttaa

SEQ ID NO: 95006 - DNA, 25 bp, S. pombe
gatgttgatattttgctgcactctg

SEQ ID NO: 95007 - DNA, 25 bp, S. pombe
gatgattgacttaggtactggtaac

SEQ ID NO: 95008 - DNA, 25 bp, S. pombe
gatgactattcttcgcgatcagcaa

SEQ ID NO: 95009 - DNA, 25 bp, S. pombe
gatgcttggcaatttcttttcgaca

SEQ ID NO: 95010 - DNA, 25 bp, S. pombe
gatgctactggattcttttacgaac

SEQ ID NO: 95011 - DNA, 25 bp, S. pombe
gatgagatatggtcgcctgtgataa

SEQ ID NO: 95012 - DNA, 25 bp, S. pombe
gatgagtgtgatccctttgataaca

SEQ ID NO: 95013 - DNA, 25 bp, S. pombe
gatgctttcagtcgccttggaatct

SEQ ID NO: 95014 - DNA, 25 bp, S. pombe
gatgctaacgatcccgtcgcagata

SEQ ID NO: 95015 - DNA, 25 bp, S. pombe
gatgatacctatccagagtcagtaa

SEQ ID NO: 95016 - DNA, 25 bp, S. pombe
gatgatcactttgaggtcacagaag

SEQ ID NO: 95017 - DNA, 25 bp, S. pombe
gatgatgagcgtccttccaaaaaag

SEQ ID NO: 95018 - DNA, 25 bp, S. pombe
gatgagataccgtctgtcgaggaaa

SEQ ID NO: 95019 - DNA, 25 bp, S. pombe
gatgagagctccgatgcttacaaga

SEQ ID NO: 95020 - DNA, 25 bp, S. pombe
gatgaatcatccagttccaagcaag

SEQ ID NO: 95021 - DNA, 25 bp, S. pombe
gatgacaagcttttcctaggcgagt

SEQ ID NO: 95022 - DNA, 25 bp, S. pombe
gatgacaatctttctcctttggagt

SEQ ID NO: 95023 - DNA, 25 bp, S. pombe
gatgagacttcctatgatccaagaa

SEQ ID NO: 95024 - DNA, 25 bp, S. pombe
gatgagtctaccttatctactgcaa

SEQ ID NO: 95025 - DNA, 25 bp, S. pombe
gatctaaagaaaggagtcagcaact

SEQ ID NO: 95026 - DNA, 25 bp, S. pombe
gatgctaagcaaactgtacaaaaac

SEQ ID NO: 95027 - DNA, 25 bp, S. pombe
gatgctttcgccttggccaaagaaa

SEQ ID NO: 95028 - DNA, 25 bp, S. pombe
gatgaggtcccattcgtcaaaaaga

SEQ ID NO: 95029 - DNA, 25 bp, S. pombe
gatgaggatccggatttgccaaaaa

SEQ ID NO: 95030 - DNA, 25 bp, S. pombe
gatgatttcgtttccaattccagta

SEQ ID NO: 95031 - DNA, 25 bp, S. pombe
gatgctatatctgttagccgcccag

SEQ ID NO: 95032 - DNA, 25 bp, S. pombe
gatcgcgttttaactcgtctgggtg

SEQ ID NO: 95033 - DNA, 25 bp, S. pombe
gatcctctacacatatttccggttg

SEQ ID NO: 95034 - DNA, 25 bp, S. pombe
gatgcaaatcctttggactggagaa

SEQ ID NO: 95035 - DNA, 25 bp, S. pombe
gatgaagtcaggtgctccttgcaga

SEQ ID NO: 95036 - DNA, 25 bp, S. pombe
gatgaagtctttggccctatgaacc

SEQ ID NO: 95037 - DNA, 25 bp, S. pombe
gatgatattcatcgttccaaccttt

SEQ ID NO: 95038 - DNA, 25 bp, S. pombe
gatgatttatctcttactcctttga

SEQ ID NO: 95039 - DNA, 25 bp, S. pombe
gatgatcttttttggtggcttgcac

SEQ ID NO: 95040 - DNA, 25 bp, S. pombe
gatgatctttcttgtgttcacggtc

SEQ ID NO: 95041 - DNA, 25 bp, S. pombe
gatgagcattggagtcttgcaggaa

SEQ ID NO: 95042 - DNA, 25 bp, S. pombe
gatgacatcttggttcttcttgaat

SEQ ID NO: 95043 - DNA, 25 bp, S. pombe
gatgatgctggtgtatctcttggaa

SEQ ID NO: 95044 - DNA, 25 bp, S. pombe
gatgcagtggatgttctctgggtaa

SEQ ID NO: 95045 - DNA, 25 bp, S. pombe
gatgatcctatgtttttggttgaga

SEQ ID NO: 95046 - DNA, 25 bp, S. pombe
gatgaaatttcagctaccttaagga

SEQ ID NO: 95047 - DNA, 25 bp, S. pombe
gataatcgtccaactaagcttcgtg

SEQ ID NO: 95048 - DNA, 25 bp, S. pombe
gatgagggcatcgaaattacttccg

SEQ ID NO: 95049 - DNA, 25 bp, S. pombe
gatgatggtgtcgtatatccttttc

SEQ ID NO: 95050 - DNA, 25 bp, S. pombe
gatgatgggtcttcagtcagcattt

SEQ ID NO: 95051 - DNA, 25 bp, S. pombe
gatgctaactcattgggaccttctc

SEQ ID NO: 95052 - DNA, 25 bp, S. pombe
gatgcattggtactgcttttcaact

SEQ ID NO: 95053 - DNA, 25 bp, S. pombe
gatgatgttcgcttcttcttagaga

SEQ ID NO: 95054 - DNA, 25 bp, S. pombe
gatgaccagcaattaccttcatgga

SEQ ID NO: 95055 - DNA, 25 bp, S. pombe
gatgccacagaatccctttacaagt

SEQ ID NO: 95056 - DNA, 25 bp, S. pombe
gatgactctattggcgttggttcga

SEQ ID NO: 95057 - DNA, 25 bp, S. pombe
gatgaattgactccttatcttccca

SEQ ID NO: 95058 - DNA, 25 bp, S. pombe
gatgacaacactcttgtcttccatg

SEQ ID NO: 95059 - DNA, 25 bp, S. pombe
gatgaattcgctcgtggacctaatg

SEQ ID NO: 95060 - DNA, 25 bp, S. pombe
gatgaacttgttgagcatgccatgt

SEQ ID NO: 95061 - DNA, 25 bp, S. pombe
gatgaacttgtctggcctagctata

SEQ ID NO: 95062 - DNA, 25 bp, S. pombe
gatgaactcttccttggtactgtac

SEQ ID NO: 95063 - DNA, 25 bp, S. pombe
gatgaatctacgtcttctgtaacag

SEQ ID NO: 95064 - DNA, 25 bp, S. pombe
gatgccaatttcactttgtacaccc

SEQ ID NO: 95065 - DNA, 25 bp, S. pombe
gatgctacatctattcttctttacg

SEQ ID NO: 95066 - DNA, 25 bp, S. pombe
gatctactaaatatgagccttccga

SEQ ID NO: 95067 - DNA, 25 bp, S. pombe
gatcctactaactttgaggtaatcg

SEQ ID NO: 95068 - DNA, 25 bp, S. pombe
gatcctaatcccgttgttgtacttg

SEQ ID NO: 95069 - DNA, 25 bp, S. pombe
gatcctaccaaacgtcttgaagctc

SEQ ID NO: 95070 - DNA, 25 bp, S. pombe
gatgagcttcgggatcctaatacta

SEQ ID NO: 95071 - DNA, 25 bp, S. pombe
gatgatgcccaaactcgaaattcca

SEQ ID NO: 95072 - DNA, 25 bp, S. pombe
gatgatgcctcaacacttgcaactt

SEQ ID NO: 95073 - DNA, 25 bp, S. pombe
gatgatcctctgaaatggcgttctt

SEQ ID NO: 95074 - DNA, 25 bp, S. pombe
gatgatcctgcttatatgcattgct

SEQ ID NO: 95075 - DNA, 25 bp, S. pombe
gatgatcctgcacattctgattttc

SEQ ID NO: 95076 - DNA, 25 bp, S. pombe
gatccagacgataaattgcctcctc

SEQ ID NO: 95077 - DNA, 25 bp, S. pombe
gatgaccgatattaagcccgcgctt

SEQ ID NO: 95078 - DNA, 25 bp, S. pombe
gatcaacgaattcaagccacgttta

SEQ ID NO: 95079 - DNA, 25 bp, S. pombe
gatccacgagtcacagaagccggta

SEQ ID NO: 95080 - DNA, 25 bp, S. pombe
gatgccgaattagcaaagctttcta

SEQ ID NO: 95081 - DNA, 25 bp, S. pombe
gatgctttgaattcggaactttctg

SEQ ID NO: 95082 - DNA, 25 bp, S. pombe
gatgctgaagcattggtcgctacag

SEQ ID NO: 95083 - DNA, 25 bp, S. pombe
gatgaatatcaagcgcagccgggct

SEQ ID NO: 95084 - DNA, 25 bp, S. pombe
gatgaaacaaaaccacttcctctcg

SEQ ID NO: 95085 - DNA, 25 bp, S. pombe
gatgaaacactatttaccgcacccg

SEQ ID NO: 95086 - DNA, 25 bp, S. pombe
gatgaaatcctcttggaagacccca

SEQ ID NO: 95087 - DNA, 25 bp, S. pombe
gatgatggattcaccgttgtccaga

SEQ ID NO: 95088 - DNA, 25 bp, S. pombe
gatgactgcattaaccgccttacca

SEQ ID NO: 95089 - DNA, 25 bp, S. pombe
gatgacttttattccatgatccgat

SEQ ID NO: 95090 - DNA, 25 bp, S. pombe
gatgaccttcaatcagaaccgtctt

SEQ ID NO: 95091 - DNA, 25 bp, S. pombe
gatgaggcttattcacaaacgtgtc

SEQ ID NO: 95092 - DNA, 25 bp, S. pombe
gatgccagcgcgacaatcatacggg

SEQ ID NO: 95093 - DNA, 25 bp, S. pombe
gatgacaaggtcctctacgggaaat

SEQ ID NO: 95094 - DNA, 25 bp, S. pombe
gatgaagaatctttacccagtcaga

SEQ ID NO: 95095 - DNA, 25 bp, S. pombe
gatgctagaaaatcccgcgcacgtg

SEQ ID NO: 95096 - DNA, 25 bp, S. pombe
gatgcgtaagactttccgtgacgat

SEQ ID NO: 95097 - DNA, 25 bp, S. pombe
gatgcgtaggtctcgctgcaatgca

SEQ ID NO: 95098 - DNA, 25 bp, S. pombe
gatcgacaaagctcctgcaatatcc

SEQ ID NO: 95099 - DNA, 25 bp, S. pombe
gatccggaatcaatgggcatacctg

SEQ ID NO: 95100 - DNA, 25 bp, S. pombe
gatcgtatggacatgaggctctctc

SEQ ID NO: 95101 - DNA, 25 bp, S. pombe
gatcgatttcgtttgcggttgaaga

SEQ ID NO: 95102 - DNA, 25 bp, S. pombe
gatgctggtattattgcccataaac

SEQ ID NO: 95103 - DNA, 25 bp, S. pombe
gatgctggtctcactggtcgtaaga

SEQ ID NO: 95104 - DNA, 25 bp, S. pombe
gatgccacctcaacaggctaataag

SEQ ID NO: 95105 - DNA, 25 bp, S. pombe
gatgcgtcgttcgtacaaggcttac

SEQ ID NO: 95106 - DNA, 25 bp, S. pombe
gatgacgaatcagctaccacagaaa

SEQ ID NO: 95107 - DNA, 25 bp, S. pombe
gatgctcttatctcaatcccaaagt

SEQ ID NO: 95108 - DNA, 25 bp, S. pombe
gatgcgcttacgcttatgtcacaag

SEQ ID NO: 95109 - DNA, 25 bp, S. pombe
gatgctgtaacggatattgctcaac

SEQ ID NO: 95110 - DNA, 25 bp, S. pombe
gatgagttatcgtctacgccaagtg

SEQ ID NO: 95111 - DNA, 25 bp, S. pombe
gatcgttaggtcaatcgcctactgc

SEQ ID NO: 95112 - DNA, 25 bp, S. pombe
gatcgatttagtgccatccatactg

SEQ ID NO: 95113 - DNA, 25 bp, S. pombe
gatgcaaagatgtcgtcgttacccc

SEQ ID NO: 95114 - DNA, 25 bp, S. pombe
gatacaagatcatgtgccttcacct

SEQ ID NO: 95115 - DNA, 25 bp, S. pombe
gatgcaaaacatcgcccgtcattga

SEQ ID NO: 95116 - DNA, 25 bp, S. pombe
gatgaatgtaatccaccgtgccagc

SEQ ID NO: 95117 - DNA, 25 bp, S. pombe
gatgaatctgttcagcaagctgccc

SEQ ID NO: 95118 - DNA, 25 bp, S. pombe
gatgaactggcgaatcctatgagaa

SEQ ID NO: 95119 - DNA, 25 bp, S. pombe
gatgaactatcgagctctctgcaga

SEQ ID NO: 95120 - DNA, 25 bp, S. pombe
gatgactactcctcaatggattgac

SEQ ID NO: 95121 - DNA, 25 bp, S. pombe
gatgcccctggtgctatttctgaag

SEQ ID NO: 95122 - DNA, 25 bp, S. pombe
gatgactttggtgcttctgacgaac

SEQ ID NO: 95123 - DNA, 25 bp, S. pombe
gatgacttctcgttctttatcgtac

SEQ ID NO: 95124 - DNA, 25 bp, S. pombe
gatgactggtcgtttttaactcttc

SEQ ID NO: 95125 - DNA, 25 bp, S. pombe
gatgctctttctcttttgaagctgc

SEQ ID NO: 95126 - DNA, 25 bp, S. pombe
gatgacatttacctatttacctgca

SEQ ID NO: 95127 - DNA, 25 bp, S. pombe
gatgactatgtttctctccaagata

SEQ ID NO: 95128 - DNA, 25 bp, S. pombe
gatgagccagctcccaattctaaga

SEQ ID NO: 95129 - DNA, 25 bp, S. pombe
gatgagcatggtcctcaactatacc

SEQ ID NO: 95130 - DNA, 25 bp, S. pombe
gatgacggtcctatcagtgcagaga

SEQ ID NO: 95131 - DNA, 25 bp, S. pombe
gatgctcatcgtgttaatggcagag

SEQ ID NO: 95132 - DNA, 25 bp, S. pombe
gatgcttctgcttgctctataagta

SEQ ID NO: 95133 - DNA, 25 bp, S. pombe
gatgctaccgatgctgatacatgta

SEQ ID NO: 95134 - DNA, 25 bp, S. pombe
gatgctgatgcccttcaaattgcta

SEQ ID NO: 95135 - DNA, 25 bp, S. pombe
gatgctaatgattctccgactcgac

SEQ ID NO: 95136 - DNA, 25 bp, S. pombe
gatgcaatagattgggcgcgctcca

SEQ ID NO: 95137 - DNA, 25 bp, S. pombe
gatgcgaatctgttttggcccaact

SEQ ID NO: 95138 - DNA, 25 bp, S. pombe
gatgcaactggcttatcgcagtctt

SEQ ID NO: 95139 - DNA, 25 bp, S. pombe
gatgaatcccaattgcgagttcttt

SEQ ID NO: 95140 - DNA, 25 bp, S. pombe
gatgacgccgttaccatgattacta

SEQ ID NO: 95141 - DNA, 25 bp, S. pombe
gatgcggtcctttcagcgattaaga

SEQ ID NO: 95142 - DNA, 25 bp, S. pombe
gatgaagtcctatacagaattgctg

SEQ ID NO: 95143 - DNA, 25 bp, S. pombe
gatcgtgtacaagaagttccccatg

SEQ ID NO: 95144 - DNA, 25 bp, S. pombe
gatcgtatacgtaaatctttcccag

SEQ ID NO: 95145 - DNA, 25 bp, S. pombe
gatgaatctacagtaataccctcag

SEQ ID NO: 95146 - DNA, 25 bp, S. pombe
gatgctcctactgaagcaaccttag

SEQ ID NO: 95147 - DNA, 25 bp, S. pombe
gatacatttgccgaacgtcgttctc

SEQ ID NO: 95148 - DNA, 25 bp, S. pombe
gatcctgaggcagctaggctcgttt

SEQ ID NO: 95149 - DNA, 25 bp, S. pombe
gatgccgtcaagtccgagctcgatt

SEQ ID NO: 95150 - DNA, 25 bp, S. pombe
gatccggaatattgtgggtctttag

SEQ ID NO: 95151 - DNA, 25 bp, S. pombe
gatcctaagaaacttggtcgtgttg

SEQ ID NO: 95152 - DNA, 25 bp, S. pombe
gatcctcaaaatatgggtgccgtta

SEQ ID NO: 95153 - DNA, 25 bp, S. pombe
gatgctccaaatttttggcctcgat

SEQ ID NO: 95154 - DNA, 25 bp, S. pombe
gatcgtaagtttatggccgtagacc

SEQ ID NO: 95155 - DNA, 25 bp, S. pombe
gatcgtatcgtcatattggcttggg

SEQ ID NO: 95156 - DNA, 25 bp, S. pombe
gatccctcttattctctggttaggt

SEQ ID NO: 95157 - DNA, 25 bp, S. pombe
gatcctacaggccttagttatccgg

SEQ ID NO: 95158 - DNA, 25 bp, S. pombe
gatgactctcgttacttatcaaggt

SEQ ID NO: 95159 - DNA, 25 bp, S. pombe
gatgacttttggacttcaaggccat

SEQ ID NO: 95160 - DNA, 25 bp, S. pombe
gatgacattcccacttggatgtttg

SEQ ID NO: 95161 - DNA, 25 bp, S. pombe
gatgacttctcttgtgtaatggtaa

SEQ ID NO: 95162 - DNA, 25 bp, S. pombe
gatgcaagccgtcgtctggttataa

SEQ ID NO: 95163 - DNA, 25 bp, S. pombe
gatgccccatggtgtgaagtacgac

SEQ ID NO: 95164 - DNA, 25 bp, S. pombe
gatgccgatttagtttttcacagta

SEQ ID NO: 95165 - DNA, 25 bp, S. pombe
gatgctgagtctgagtttttaaaca

SEQ ID NO: 95166 - DNA, 25 bp, S. pombe
gatgctaatgctaccaatgctacga

SEQ ID NO: 95167 - DNA, 25 bp, S. pombe
gatgaatttgcttactccgatgatg

SEQ ID NO: 95168 - DNA, 25 bp, S. pombe
gatgcaggattcactcttgcaggtg

SEQ ID NO: 95169 - DNA, 25 bp, S. pombe
gatctgcgcatgaatcctcttaatt

SEQ ID NO: 95170 - DNA, 25 bp, S. pombe
gatccggatatctatgctttggcat

SEQ ID NO: 95171 - DNA, 25 bp, S. pombe
gatgctcgcgctcatgaaaggtttc

SEQ ID NO: 95172 - DNA, 25 bp, S. pombe
gatgcacacgtctaaaagggttcaa

SEQ ID NO: 95173 - DNA, 25 bp, S. pombe
gatgaagacgttgaagccgctgaaa

SEQ ID NO: 95174 - DNA, 25 bp, S. pombe
gatgaactcgacaaacctcgtgaaa

SEQ ID NO: 95175 - DNA, 25 bp, S. pombe
gatgaagttcaccaagctcttgagg

SEQ ID NO: 95176 - DNA, 25 bp, S. pombe
gatccttccgatcgtgttcgtgaag

SEQ ID NO: 95177 - DNA, 25 bp, S. pombe
gatgctcccgtaagtttgcaacttg

SEQ ID NO: 95178 - DNA, 25 bp, S. pombe
gatgccaacctaagtctcaagactc

SEQ ID NO: 95179 - DNA, 25 bp, S. pombe
gatccgagaccgttacagagacttc

SEQ ID NO: 95180 - DNA, 25 bp, S. pombe
gatccgtgggctaatttacaaacaa

SEQ ID NO: 95181 - DNA, 25 bp, S. pombe
gatccgtttgtccacttacttgaaa

SEQ ID NO: 95182 - DNA, 25 bp, S. pombe
gatccttggtcttgtttttgcctac

SEQ ID NO: 95183 - DNA, 25 bp, S. pombe
gatgctccttctaaaccttttgtag

SEQ ID NO: 95184 - DNA, 25 bp, S. pombe
gtctcctttacctccatttttattg

SEQ ID NO: 95185 - DNA, 25 bp, S. pombe
gatgcatgactttagacaaccttta

SEQ ID NO: 95186 - DNA, 25 bp, S. pombe
gatgcatatttatacacccgacttt

SEQ ID NO: 95187 - DNA, 25 bp, S. pombe
gatgcattttgaacagcctggctcc

SEQ ID NO: 95188 - DNA, 25 bp, S. pombe
gatgaacctacttctttatcaaagc

SEQ ID NO: 95189 - DNA, 25 bp, S. pombe
gatgaaggctaatctttctgcaaga

SEQ ID NO: 95190 - DNA, 25 bp, S. pombe
gatgaacttctctatttcccaagat

SEQ ID NO: 95191 - DNA, 25 bp, S. pombe
gatgcaaattttatcctcattcagg

SEQ ID NO: 95192 - DNA, 25 bp, S. pombe
gatgcagcaagaagctattcacgca

SEQ ID NO: 95193 - DNA, 25 bp, S. pombe
gatgcttcaagtgcaatcccgagct

SEQ ID NO: 95194 - DNA, 25 bp, S. pombe
gatgcttgtgatgctgttgcaaatc

SEQ ID NO: 95195 - DNA, 25 bp, S. pombe
gatgcttctgccgatgttcatgaac

SEQ ID NO: 95196 - DNA, 25 bp, S. pombe
gatgctttctcgctgctctgtacac

SEQ ID NO: 95197 - DNA, 25 bp, S. pombe
gatgctccggtgcattcgctagcag

SEQ ID NO: 95198 - DNA, 25 bp, S. pombe
gatgcagagttttggtcagtcacgc

SEQ ID NO: 95199 - DNA, 25 bp, S. pombe
gatgcatactctggtggctcagtaa

SEQ ID NO: 95200 - DNA, 25 bp, S. pombe
gatgcttctaaacccattacaagga

SEQ ID NO: 95201 - DNA, 25 bp, S. pombe
gatcctctaacggagaccttcaata

SEQ ID NO: 95202 - DNA, 25 bp, S. pombe
gatgcgcttaatcccagacagattt

SEQ ID NO: 95203 - DNA, 25 bp, S. pombe
gatgcttgcttatgtcaacttctaa

SEQ ID NO: 95204 - DNA, 25 bp, S. pombe
gatgctagttcctactgcacaggta

SEQ ID NO: 95205 - DNA, 25 bp, S. pombe
gatgcatatctgttccgtgcagcat

SEQ ID NO: 95206 - DNA, 25 bp, S. pombe
gatgcttaaacctactcttcagctt

SEQ ID NO: 95207 - DNA, 25 bp, S. pombe
gatcgttgaacctactgctgggtat

SEQ ID NO: 95208 - DNA, 25 bp, S. pombe
gattttgaaggtgcgtggccaaccc

SEQ ID NO: 95209 - DNA, 25 bp, S. pombe
gatccgtgacagtaccgggcgacaa

SEQ ID NO: 95210 - DNA, 25 bp, S. pombe
gatgcactttagaatccgctttgaa

SEQ ID NO: 95211 - DNA, 25 bp, S. pombe
gatgcacttcttgacatcgtcttta

SEQ ID NO: 95212 - DNA, 25 bp, S. pombe
gatgcttacttaaatcctctggaat

SEQ ID NO: 95213 - DNA, 25 bp, S. pombe
gatgcttggtaagactcctgctgaa

SEQ ID NO: 95214 - DNA, 25 bp, S. pombe
gatgcagcttgataatacttctcga

SEQ ID NO: 95215 - DNA, 25 bp, S. pombe
gatgcagcaaattccaccagactta

SEQ ID NO: 95216 - DNA, 25 bp, S. pombe
gatgctgaccgtggccaagatttag

SEQ ID NO: 95217 - DNA, 25 bp, S. pombe
gatgccactttcatcaaggttgatg

SEQ ID NO: 95218 - DNA, 25 bp, S. pombe
gatgcccgagcttctaagtgtggac

SEQ ID NO: 95219 - DNA, 25 bp, S. pombe
gatgccgcaactgcttctgctattg

SEQ ID NO: 95220 - DNA, 25 bp, S. pombe
gatgcgtaatatgcctgctgctgct

SEQ ID NO: 95221 - DNA, 25 bp, S. pombe
gatgctgatatctattccgagttca

SEQ ID NO: 95222 - DNA, 25 bp, S. pombe
gatgcatgtacgtttctattagaca

SEQ ID NO: 95223 - DNA, 25 bp, S. pombe
gatgctcaaccttctgctattataa

SEQ ID NO: 95224 - DNA, 25 bp, S. pombe
gatgccaccccattattattcaaag

SEQ ID NO: 95225 - DNA, 25 bp, S. pombe
gatccagcatatctcgttaccagaa

SEQ ID NO: 95226 - DNA, 25 bp, S. pombe
gatccagcaagtggtactgcaccta

SEQ ID NO: 95227 - DNA, 25 bp, S. pombe
ttactttaagtacaccttctcccat

SEQ ID NO: 95228 - DNA, 25 bp, S. pombe
gtcccttacttatatactgtttcca

SEQ ID NO: 95229 - DNA, 25 bp, S. pombe
gatcccttttgtgaatactgttacc

SEQ ID NO: 95230 - DNA, 25 bp, S. pombe
gatcgtcccacgaaagtagcgaaac

SEQ ID NO: 95231 - DNA, 25 bp, S. pombe
gatgctcattcttttttcttggttg

SEQ ID NO: 95232 - DNA, 25 bp, S. pombe
gatgcttacattgtttcttggatca

SEQ ID NO: 95233 - DNA, 25 bp, S. pombe
gatgctcctcttgttttggaagcaa

SEQ ID NO: 95234 - DNA, 25 bp, S. pombe
gatgcccttgttacgccggaaaaag

SEQ ID NO: 95235 - DNA, 25 bp, S. pombe
gatgccaattcaaccgaagagtcaa

SEQ ID NO: 95236 - DNA, 25 bp, S. pombe
gatccagattcatcctttgacatta

SEQ ID NO: 95237 - DNA, 25 bp, S. pombe
gatgcttctaaaccatttcgcttac

SEQ ID NO: 95238 - DNA, 25 bp, S. pombe
gatgcgttaaactattgggctgcta

SEQ ID NO: 95239 - DNA, 25 bp, S. pombe
gatgcgtgtatatcgttggactaac

SEQ ID NO: 95240 - DNA, 25 bp, S. pombe
gatgcactttgttcgttgatgcacc

SEQ ID NO: 95241 - DNA, 25 bp, S. pombe
gatgctcgctcatgtaggtcgatca

SEQ ID NO: 95242 - DNA, 25 bp, S. pombe
gatgcgcgccaattttacgacaaaa

SEQ ID NO: 95243 - DNA, 25 bp, S. pombe
gatcccgcgttcgttcagaaagaca

SEQ ID NO: 95244 - DNA, 25 bp, S. pombe
gatccccaagatccctcaaaagtga

SEQ ID NO: 95245 - DNA, 25 bp, S. pombe
gataccgactatcagcaaaaggcga

SEQ ID NO: 95246 - DNA, 25 bp, S. pombe
gatgcttcgataatggctctcaact

SEQ ID NO: 95247 - DNA, 25 bp, S. pombe
gatgccacttgaccctcaaattgga

SEQ ID NO: 95248 - DNA, 25 bp, S. pombe
gatgcaatgaacgtctccaacaaat

SEQ ID NO: 95249 - DNA, 25 bp, S. pombe
gatgctaacaatcctttactcggca

SEQ ID NO: 95250 - DNA, 25 bp, S. pombe
gattaacgaactgtatctctccggc

SEQ ID NO: 95251 - DNA, 25 bp, S. pombe
gattattcggactttacctacggag

SEQ ID NO: 95252 - DNA, 25 bp, S. pombe
gatgctactatcctctgaagacgtt

SEQ ID NO: 95253 - DNA, 25 bp, S. pombe
gatgcttctctactcattagtggtg

SEQ ID NO: 95254 - DNA, 25 bp, S. pombe
gatgcattatttgtggagctccagg

SEQ ID NO: 95255 - DNA, 25 bp, S. pombe
gatccatgatttgcaatcctccgga

SEQ ID NO: 95256 - DNA, 25 bp, S. pombe
gatccaattcttaatcgccaggtga

SEQ ID NO: 95257 - DNA, 25 bp, S. pombe
gatgccacatggctttttcaacatg

SEQ ID NO: 95258 - DNA, 25 bp, S. pombe
gatgcacaatgcgtattcctctaga

SEQ ID NO: 95259 - DNA, 25 bp, S. pombe
gatgctattgctttggcacatcctt

SEQ ID NO: 95260 - DNA, 25 bp, S. pombe
gatgctatatgtaatctccccttac

SEQ ID NO: 95261 - DNA, 25 bp, S. pombe
gatgctagatgtaatcctcctcaat

SEQ ID NO: 95262 - DNA, 25 bp, S. pombe
gatgctcgatttagctggcactaat

SEQ ID NO: 95263 - DNA, 25 bp, S. pombe
gatgctattcttttggaagccttta

SEQ ID NO: 95264 - DNA, 25 bp, S. pombe
gatgcttggtctttggaaacttctg

SEQ ID NO: 95265 - DNA, 25 bp, S. pombe
gatcgttatttccttgagtctgcag

SEQ ID NO: 95266 - DNA, 25 bp, S. pombe
gatgcttatgatttggttcgtctcc

SEQ ID NO: 95267 - DNA, 25 bp, S. pombe
gatgctctttataggttctcgtaaa

SEQ ID NO: 95268 - DNA, 25 bp, S. pombe
gatgctcttgaaaaagtccctacca

SEQ ID NO: 95269 - DNA, 25 bp, S. pombe
gatgcttcgcatgttatgacctgca

SEQ ID NO: 95270 - DNA, 25 bp, S. pombe
gatccatcgactttaccggtaactt

SEQ ID NO: 95271 - DNA, 25 bp, S. pombe
gatccttgcaagcattccattttgg

SEQ ID NO: 95272 - DNA, 25 bp, S. pombe
gatccggaaggaattgctactgcat

SEQ ID NO: 95273 - DNA, 25 bp, S. pombe
gatccggaaatgacgcatggcacga

SEQ ID NO: 95274 - DNA, 25 bp, S. pombe
gatcccgaagataagcaagctgttt

SEQ ID NO: 95275 - DNA, 25 bp, S. pombe
gatctcgggctgttcgaaggtttaa

SEQ ID NO: 95276 - DNA, 25 bp, S. pombe
gatcgcgtcgtttgcgtttttacaa

SEQ ID NO: 95277 - DNA, 25 bp, S. pombe
gatgcatcgagccaaacattcttta

SEQ ID NO: 95278 - DNA, 25 bp, S. pombe
gatgcatgctaccaatacgatttta

SEQ ID NO: 95279 - DNA, 25 bp, S. pombe
gatgcttcagatatcccgtatgacc

SEQ ID NO: 95280 - DNA, 25 bp, S. pombe
gatgcgatacttacagagttctcca

SEQ ID NO: 95281 - DNA, 25 bp, S. pombe
gatccatcaaatccaagctgtcgaa

SEQ ID NO: 95282 - DNA, 25 bp, S. pombe
gatcccgaaacagtgcttgcgaatt

SEQ ID NO: 95283 - DNA, 25 bp, S. pombe
gatccagccgatacgtctcttgaat

SEQ ID NO: 95284 - DNA, 25 bp, S. pombe
gatgctcttgttccatttgtcgaaa

SEQ ID NO: 95285 - DNA, 25 bp, S. pombe
gatcctcgtaccatggttgagcaat

SEQ ID NO: 95286 - DNA, 25 bp, S. pombe
gatgccttatagacgtggctttcaa

SEQ ID NO: 95287 - DNA, 25 bp, S. pombe
gatccttacggcgatgatgctttaa

SEQ ID NO: 95288 - DNA, 25 bp, S. pombe
gatcctttattccattgctttagcc

SEQ ID NO: 95289 - DNA, 25 bp, S. pombe
gatcttctactttcatggtatcggc

SEQ ID NO: 95290 - DNA, 25 bp, S. pombe
gtctactgtcggtatcgaaagtgag

SEQ ID NO: 95291 - DNA, 25 bp, S. pombe
gatccctttggattctcgaagtagt

SEQ ID NO: 95292 - DNA, 25 bp, S. pombe
gatcccattagttttggagactcct

SEQ ID NO: 95293 - DNA, 25 bp, S. pombe
gatccaaatgacaaggtttctagga

SEQ ID NO: 95294 - DNA, 25 bp, S. pombe
gatcctactgatgagcctgttgctg

SEQ ID NO: 95295 - DNA, 25 bp, S. pombe
gatgctgaaggtgatattgtccaaa

SEQ ID NO: 95296 - DNA, 25 bp, S. pombe
gatgctcttaatcatcctttaccat

SEQ ID NO: 95297 - DNA, 25 bp, S. pombe
gatctcaaattcatccttttccaat

SEQ ID NO: 95298 - DNA, 25 bp, S. pombe
gatccgaaatataccgtcttgctaa

SEQ ID NO: 95299 - DNA, 25 bp, S. pombe
gatgctcctagcgaatccccatatt

SEQ ID NO: 95300 - DNA, 25 bp, S. pombe
gatctcgtccctaaaattgaagcct

SEQ ID NO: 95301 - DNA, 25 bp, S. pombe
gatcctttcctatccactaccattt

SEQ ID NO: 95302 - DNA, 25 bp, S. pombe
gatgctcatcctaaacactctgaac

SEQ ID NO: 95303 - DNA, 25 bp, S. pombe
gatgctcagcctaaacctcaagtta

SEQ ID NO: 95304 - DNA, 25 bp, S. pombe
gatgcttttgaaaccggttcttgga

SEQ ID NO: 95305 - DNA, 25 bp, S. pombe
gatgcttttggtagtctgtggtcct

SEQ ID NO: 95306 - DNA, 25 bp, S. pombe
gatgccgaggacttatcccgtgata

SEQ ID NO: 95307 - DNA, 25 bp, S. pombe
gatgccgaggatggttctccagaat

SEQ ID NO: 95308 - DNA, 25 bp, S. pombe
gatgccaagaatgcttccaccgatt

SEQ ID NO: 95309 - DNA, 25 bp, S. pombe
gatgccggaatgtctaatactcctt

SEQ ID NO: 95310 - DNA, 25 bp, S. pombe
gatgcccgcaattctacaaacaatg

SEQ ID NO: 95311 - DNA, 25 bp, S. pombe
gatgcccgcattacaaaaaccagac

SEQ ID NO: 95312 - DNA, 25 bp, S. pombe
gatccaaccttaatggtactacttg

SEQ ID NO: 95313 - DNA, 25 bp, S. pombe
gattaatccccgagttgttcttgac

SEQ ID NO: 95314 - DNA, 25 bp, S. pombe
gatgctaatcccatggagttgcttc

SEQ ID NO: 95315 - DNA, 25 bp, S. pombe
gatcccgacgcaatggttgtcttaa

SEQ ID NO: 95316 - DNA, 25 bp, S. pombe
gatcatcccagcaagtggtggactt

SEQ ID NO: 95317 - DNA, 25 bp, S. pombe
tttggccgaaggatgaattgcgacc

SEQ ID NO: 95318 - DNA, 25 bp, S. pombe
gattacccaaactcagccggatagt

SEQ ID NO: 95319 - DNA, 25 bp, S. pombe
gataagtataaagatcgcccgatag

SEQ ID NO: 95320 - DNA, 25 bp, S. pombe
gatgctgatggcttgtggttaattc

SEQ ID NO: 95321 - DNA, 25 bp, S. pombe
gatgcgtagccattgttctaggtaa

SEQ ID NO: 95322 - DNA, 25 bp, S. pombe
gatgccgcacttcatagttttagaa

SEQ ID NO: 95323 - DNA, 25 bp, S. pombe
gatccccgagacctcaataattttg

SEQ ID NO: 95324 - DNA, 25 bp, S. pombe
gatcgccttcgaaaacaaattctag

SEQ ID NO: 95325 - DNA, 25 bp, S. pombe
gatgccgcagtcatttgatactagc

SEQ ID NO: 95326 - DNA, 25 bp, S. pombe
gatgccacagacgtttatcacacat

SEQ ID NO: 95327 - DNA, 25 bp, S. pombe
gatccagcacagaatgttcctcaac

SEQ ID NO: 95328 - DNA, 25 bp, S. pombe
gatcgctgagcatagttcactggca

SEQ ID NO: 95329 - DNA, 25 bp, S. pombe
gatccatggcatatgttcacttcgt

SEQ ID NO: 95330 - DNA, 25 bp, S. pombe
gatgcctggatgcttttacatgcga

SEQ ID NO: 95331 - DNA, 25 bp, S. pombe
gatgccgaaggttatgctcaattag

SEQ ID NO: 95332 - DNA, 25 bp, S. pombe
gatgcgcagaatcgttggtcgttac

SEQ ID NO: 95333 - DNA, 25 bp, S. pombe
gatgccaagttttgcagtgcttcgg

SEQ ID NO: 95334 - DNA, 25 bp, S. pombe
gatgccggcgactatgcagctgcta

SEQ ID NO: 95335 - DNA, 25 bp, S. pombe
gatcgctcgcagaaaggatgctact

SEQ ID NO: 95336 - DNA, 25 bp, S. pombe
gatcctgtttggaaatccgtctcca

SEQ ID NO: 95337 - DNA, 25 bp, S. pombe
gatcgtttcatgttaggcggttcaa

SEQ ID NO: 95338 - DNA, 25 bp, S. pombe
tgatcgggtgtatcgtcgtttgaac

SEQ ID NO: 95339 - DNA, 25 bp, S. pombe
gatgctgggttttctgctaattcac

SEQ ID NO: 95340 - DNA, 25 bp, S. pombe
gatgcggctcttctaaatgattttg

SEQ ID NO: 95341 - DNA, 25 bp, S. pombe
gatgctgatattgatttcgactgga

SEQ ID NO: 95342 - DNA, 25 bp, S. pombe
gatgctgaatcttattatccttctt

SEQ ID NO: 95343 - DNA, 25 bp, S. pombe
gatgctgcacgttactttattctct

SEQ ID NO: 95344 - DNA, 25 bp, S. pombe
gatgctgccgctgatatttatactg

SEQ ID NO: 95345 - DNA, 25 bp, S. pombe
gatgctggcccaaatgctgttattt

SEQ ID NO: 95346 - DNA, 25 bp, S. pombe
gtacgccgcgtacatggaaattcct

SEQ ID NO: 95347 - DNA, 25 bp, S. pombe
ttaccactggtactagccgaattcc

SEQ ID NO: 95348 - DNA, 25 bp, S. pombe
gatgcccaacgtggtccgagaagat

SEQ ID NO: 95349 - DNA, 25 bp, S. pombe
gatgctgttaccgatgttcctgaat

SEQ ID NO: 95350 - DNA, 25 bp, S. pombe
gatgcgattacactcattttctgtt

SEQ ID NO: 95351 - DNA, 25 bp, S. pombe
gatcgtgtatgctttttcgttttat

SEQ ID NO: 95352 - DNA, 25 bp, S. pombe
gatcgacggattattcgctactttg

SEQ ID NO: 95353 - DNA, 25 bp, S. pombe
gatcgaggatgttcactttaactat

SEQ ID NO: 95354 - DNA, 25 bp, S. pombe
gatgctggagaccttttctggcgta

SEQ ID NO: 95355 - DNA, 25 bp, S. pombe
gatgctggactccttaactgaggtt

SEQ ID NO: 95356 - DNA, 25 bp, S. pombe
gatgcccctctccaaaatatacata

SEQ ID NO: 95357 - DNA, 25 bp, S. pombe
gatcgctgctttaatttgtgtacct

SEQ ID NO: 95358 - DNA, 25 bp, S. pombe
gatccacctgctctatatcagacat

SEQ ID NO: 95359 - DNA, 25 bp, S. pombe
gatccattggtattttcagcacatc

SEQ ID NO: 95360 - DNA, 25 bp, S. pombe
gatgccttggatatctttgctgaac

SEQ ID NO: 95361 - DNA, 25 bp, S. pombe
gatcccaatgaaaagtcttgcgttt

SEQ ID NO: 95362 - DNA, 25 bp, S. pombe
gatgccgtgcatacagctattttag

SEQ ID NO: 95363 - DNA, 25 bp, S. pombe
gatgccgtgcatcgagttataatga

SEQ ID NO: 95364 - DNA, 25 bp, S. pombe
gatgccgttgcaattctctttatgt

SEQ ID NO: 95365 - DNA, 25 bp, S. pombe
gatgcctttgtttattgcactattg

SEQ ID NO: 95366 - DNA, 25 bp, S. pombe
gatctggatgatgctaaacctctga

SEQ ID NO: 95367 - DNA, 25 bp, S. pombe
gatgcgaacttattccaatcccaaa

SEQ ID NO: 95368 - DNA, 25 bp, S. pombe
gatcgcatgcacaatcttgcgcagt

SEQ ID NO: 95369 - DNA, 25 bp, S. pombe
gatcctgcatcaatcttggagcatt

SEQ ID NO: 95370 - DNA, 25 bp, S. pombe
gatccattcatgattggcgatacag

SEQ ID NO: 95371 - DNA, 25 bp, S. pombe
gatccttggcctagcatgcagaata

SEQ ID NO: 95372 - DNA, 25 bp, S. pombe
gatccaaatcgactcgtactggctt

SEQ ID NO: 95373 - DNA, 25 bp, S. pombe
gatgccgtcacctatactgagcatg

SEQ ID NO: 95374 - DNA, 25 bp, S. pombe
gatgccgtcgctgaatgcttattaa

SEQ ID NO: 95375 - DNA, 25 bp, S. pombe
gatcctagcctatatgctgtcgtta

SEQ ID NO: 95376 - DNA, 25 bp, S. pombe
gatcttatactgctcgtttgttctc

SEQ ID NO: 95377 - DNA, 25 bp, S. pombe
gatgcgtattctcatggttggtctt

SEQ ID NO: 95378 - DNA, 25 bp, S. pombe
gatgcgtattctcaaattcctgtca

SEQ ID NO: 95379 - DNA, 25 bp, S. pombe
gatccttcctgctaatgaacctgga

SEQ ID NO: 95380 - DNA, 25 bp, S. pombe
gatgccttggcgtaaacctattaac

SEQ ID NO: 95381 - DNA, 25 bp, S. pombe
gatccgaacgtgagagttttactga

SEQ ID NO: 95382 - DNA, 25 bp, S. pombe
gtacagcaattacaggttgtctact

SEQ ID NO: 95383 - DNA, 25 bp, S. pombe
gatctgtcgcgtttgtaacctcaaa

SEQ ID NO: 95384 - DNA, 25 bp, S. pombe
gatccgccgtatttaacattgcaat

SEQ ID NO: 95385 - DNA, 25 bp, S. pombe
gatgccgacgatcaaaatcccgagc

SEQ ID NO: 95386 - DNA, 25 bp, S. pombe
gatccctctattgaagcattccggt

SEQ ID NO: 95387 - DNA, 25 bp, S. pombe
gatcctctgcaatggtacaagccgg

SEQ ID NO: 95388 - DNA, 25 bp, S. pombe
gatcctcgacaacgaatccgcaaaa

SEQ ID NO: 95389 - DNA, 25 bp, S. pombe
gatccccacaatgtcattctggaat

SEQ ID NO: 95390 - DNA, 25 bp, S. pombe
gatcccgtacttttatgttgcctat

SEQ ID NO: 95391 - DNA, 25 bp, S. pombe
gatcccgtgagcctttatgttgaat

SEQ ID NO: 95392 - DNA, 25 bp, S. pombe
gatcctcttattaactggcgccttg

SEQ ID NO: 95393 - DNA, 25 bp, S. pombe
gatcccgcttgtatgctagttcatt

SEQ ID NO: 95394 - DNA, 25 bp, S. pombe
gatgcctgccttctttagtatcaat

SEQ ID NO: 95395 - DNA, 25 bp, S. pombe
gatgccttctttttcgatactcaag

SEQ ID NO: 95396 - DNA, 25 bp, S. pombe
gatcctgtcagttcatgctatggta

SEQ ID NO: 95397 - DNA, 25 bp, S. pombe
gatcctccaaacttcacaaatgctg

SEQ ID NO: 95398 - DNA, 25 bp, S. pombe
gatcgcttcaccttttctaatttgg

SEQ ID NO: 95399 - DNA, 25 bp, S. pombe
gatcctaactccctgtctaatttag

SEQ ID NO: 95400 - DNA, 25 bp, S. pombe
gatcctaacaattgctcctctattt

SEQ ID NO: 95401 - DNA, 25 bp, S. pombe
gatccattagaagtccctctattaa

SEQ ID NO: 95402 - DNA, 25 bp, S. pombe
gatcgcgttacagtcgtcttttcaa

SEQ ID NO: 95403 - DNA, 25 bp, S. pombe
gatcggctattcttcttcagttgta

SEQ ID NO: 95404 - DNA, 25 bp, S. pombe
gatgccttggctgcaaatctgttag

SEQ ID NO: 95405 - DNA, 25 bp, S. pombe
gatcctgcattattacgtcctggtc

SEQ ID NO: 95406 - DNA, 25 bp, S. pombe
gatcgatgagttgacgtacgttctt

SEQ ID NO: 95407 - DNA, 25 bp, S. pombe
gatcaagcagtctccttgtttggca

SEQ ID NO: 95408 - DNA, 25 bp, S. pombe
gatcgacactgcttccaagtttggt

SEQ ID NO: 95409 - DNA, 25 bp, S. pombe
gattacctttccactattggtcagg

SEQ ID NO: 95410 - DNA, 25 bp, S. pombe
gatcctcttttccatactttgttag

SEQ ID NO: 95411 - DNA, 25 bp, S. pombe
gatcctattcgtattgttcgtgata

SEQ ID NO: 95412 - DNA, 25 bp, S. pombe
gatccggcggtcatactggtgaaat

SEQ ID NO: 95413 - DNA, 25 bp, S. pombe
gatccgattggatgtctgctcaaga

SEQ ID NO: 95414 - DNA, 25 bp, S. pombe
gatgccacaccttttacagacgtta

SEQ ID NO: 95415 - DNA, 25 bp, S. pombe
gatgcctgttccattaggttcgaca

SEQ ID NO: 95416 - DNA, 25 bp, S. pombe
gatgccttcttcagtatgtgcttaa

SEQ ID NO: 95417 - DNA, 25 bp, S. pombe
gatcttgtatcgttcgggcttcaat

SEQ ID NO: 95418 - DNA, 25 bp, S. pombe
gatcttccaatagtcgagccttcta

SEQ ID NO: 95419 - DNA, 25 bp, S. pombe
gatcttcctgaagcaacctgtttga

SEQ ID NO: 95420 - DNA, 25 bp, S. pombe
gatccaggactttgtatgctttagc

SEQ ID NO: 95421 - DNA, 25 bp, S. pombe
gatcattggcaagcgtactcgtcaa

SEQ ID NO: 95422 - DNA, 25 bp, S. pombe
gatcggtgttatttccagcaggcat

SEQ ID NO: 95423 - DNA, 25 bp, S. pombe
gatctccatttagcggacaggcttt

SEQ ID NO: 95424 - DNA, 25 bp, S. pombe
gatcctatgttaatcttacacgaca

SEQ ID NO: 95425 - DNA, 25 bp, S. pombe
gatcagttacttctttgtgaacgca

SEQ ID NO: 95426 - DNA, 25 bp, S. pombe
gatcctctcgttcatcttggaacaa

SEQ ID NO: 95427 - DNA, 25 bp, S. pombe
gatcgttctgatcgaggctcacaat

SEQ ID NO: 95428 - DNA, 25 bp, S. pombe
gatcgcataccttccttgaaattcg

SEQ ID NO: 95429 - DNA, 25 bp, S. pombe
gatcctaatggttctcactgtttcg

SEQ ID NO: 95430 - DNA, 25 bp, S. pombe
gatcctgattggtactacgttcgtg

SEQ ID NO: 95431 - DNA, 25 bp, S. pombe
gatctaatccaatgcgacagttatg

SEQ ID NO: 95432 - DNA, 25 bp, S. pombe
gatcaattcaaatggccgtcgacca

SEQ ID NO: 95433 - DNA, 25 bp, S. pombe
gatcaattgaacctgagccggatgt

SEQ ID NO: 95434 - DNA, 25 bp, S. pombe
gatccagttgccgtaggtgctacaa

SEQ ID NO: 95435 - DNA, 25 bp, S. pombe
gatccatttcgccttcagtatgaaa

SEQ ID NO: 95436 - DNA, 25 bp, S. pombe
gatccactcttgctcacaggtgaaa

SEQ ID NO: 95437 - DNA, 25 bp, S. pombe
gatcgtttagaccaaggctcagcca

SEQ ID NO: 95438 - DNA, 25 bp, S. pombe
gatcggaatgatgacgcgctgctta

SEQ ID NO: 95439 - DNA, 25 bp, S. pombe
gatcctgatgactccagtgtgtgga

SEQ ID NO: 95440 - DNA, 25 bp, S. pombe
gatcctgataattcgctggcttgct

SEQ ID NO: 95441 - DNA, 25 bp, S. pombe
gatccaaaatgtcgctcagcatgtt

SEQ ID NO: 95442 - DNA, 25 bp, S. pombe
gatccattcgtcgtattcttcaaag

SEQ ID NO: 95443 - DNA, 25 bp, S. pombe
gatccatcaccttcaattcgtcaag

SEQ ID NO: 95444 - DNA, 25 bp, S. pombe
gatcgcactcatttatcagaccatg

SEQ ID NO: 95445 - DNA, 25 bp, S. pombe
gatccgctttagaagcatgccataa

SEQ ID NO: 95446 - DNA, 25 bp, S. pombe
gatcaagttgccgtggaagccatgt

SEQ ID NO: 95447 - DNA, 25 bp, S. pombe
gatcctgattgctatccaaacgtgg

SEQ ID NO: 95448 - DNA, 25 bp, S. pombe
gatccttctcttttcgctggtttac

SEQ ID NO: 95449 - DNA, 25 bp, S. pombe
gatcccattcgtatccttgttaaga

SEQ ID NO: 95450 - DNA, 25 bp, S. pombe
gatcctcttcttctattggttcaaa

SEQ ID NO: 95451 - DNA, 25 bp, S. pombe
gatcctgctattcttttggttcaaa

SEQ ID NO: 95452 - DNA, 25 bp, S. pombe
gatccagcttattttggcggttaca

SEQ ID NO: 95453 - DNA, 25 bp, S. pombe
gatcgactattcataccgtttctca

SEQ ID NO: 95454 - DNA, 25 bp, S. pombe
gatcgccatttgatactcgctttaa

SEQ ID NO: 95455 - DNA, 25 bp, S. pombe
gatttgcttcagagacgagttctac

SEQ ID NO: 95456 - DNA, 25 bp, S. pombe
gattatgcgcgctcgaaagtactac

SEQ ID NO: 95457 - DNA, 25 bp, S. pombe
gatctactccatacctataatgaaa

SEQ ID NO: 95458 - DNA, 25 bp, S. pombe
gatccctccaagtttagcagcaaag

SEQ ID NO: 95459 - DNA, 25 bp, S. pombe
gatcgtacctggcttgtaactgcag

SEQ ID NO: 95460 - DNA, 25 bp, S. pombe
gatcgtccctagtttctacatatga

SEQ ID NO: 95461 - DNA, 25 bp, S. pombe
gatcctgtatcgaatgcttctttat

SEQ ID NO: 95462 - DNA, 25 bp, S. pombe
gatcgcagctgtaataggtcttcta

SEQ ID NO: 95463 - DNA, 25 bp, S. pombe
gatcggcttagtaggacttccaaat

SEQ ID NO: 95464 - DNA, 25 bp, S. pombe
gatcgcgttttacaagccactaagt

SEQ ID NO: 95465 - DNA, 25 bp, S. pombe
gatccgcttcttaccaacaacgatg

SEQ ID NO: 95466 - DNA, 25 bp, S. pombe
gatcctgatcgttctccatataatg

SEQ ID NO: 95467 - DNA, 25 bp, S. pombe
gatcgtgctcgtttaatatatattc

SEQ ID NO: 95468 - DNA, 25 bp, S. pombe
gatcttccagtaaactaccagtccg

SEQ ID NO: 95469 - DNA, 25 bp, S. pombe
gatctcctacttcaaacggtacagc

SEQ ID NO: 95470 - DNA, 25 bp, S. pombe
gatcttcttgctacgatttcggtac

SEQ ID NO: 95471 - DNA, 25 bp, S. pombe
gatccatcctctgctcataattggt

SEQ ID NO: 95472 - DNA, 25 bp, S. pombe
gatcccactacgtctaatcagcagg

SEQ ID NO: 95473 - DNA, 25 bp, S. pombe
gatcgcattcgtctaaacagctata

SEQ ID NO: 95474 - DNA, 25 bp, S. pombe
gatcgtgaaatgctagatgcacctt

SEQ ID NO: 95475 - DNA, 25 bp, S. pombe
gatcgagagcgtacattgtgcaatc

SEQ ID NO: 95476 - DNA, 25 bp, S. pombe
gataaccatccacgagaatcacctc

SEQ ID NO: 95477 - DNA, 25 bp, S. pombe
gataagcttacgcaacaccttggtt

SEQ ID NO: 95478 - DNA, 25 bp, S. pombe
gatatttttcgcgattactttgagt

SEQ ID NO: 95479 - DNA, 25 bp, S. pombe
gatcgtttgtatccgctgtttattg

SEQ ID NO: 95480 - DNA, 25 bp, S. pombe
gatcctactgatattccaccaattc

SEQ ID NO: 95481 - DNA, 25 bp, S. pombe
gatcctcttggattgtcgacctatg

SEQ ID NO: 95482 - DNA, 25 bp, S. pombe
gatcctgttactagtgcaaccttgg

SEQ ID NO: 95483 - DNA, 25 bp, S. pombe
gatcgcttatattctctgcatgaaa

SEQ ID NO: 95484 - DNA, 25 bp, S. pombe
gatcgtcttgaaattgctgccatgc

SEQ ID NO: 95485 - DNA, 25 bp, S. pombe
gatcgccaagtaaatgccctgctaa

SEQ ID NO: 95486 - DNA, 25 bp, S. pombe
gatcatgagtggctatcgtcacaga

SEQ ID NO: 95487 - DNA, 25 bp, S. pombe
gatccgcatggcttgcatcgtatag

SEQ ID NO: 95488 - DNA, 25 bp, S. pombe
gatcggcggaactgtatcaacgtca

SEQ ID NO: 95489 - DNA, 25 bp, S. pombe
gatcctaagcttttttcaccagcta

SEQ ID NO: 95490 - DNA, 25 bp, S. pombe
gatcctcaattttggcaatcccgaa

SEQ ID NO: 95491 - DNA, 25 bp, S. pombe
gatcctaccgatcgacaaagtccaa

SEQ ID NO: 95492 - DNA, 25 bp, S. pombe
gatcttcttatttgttggttccgca

SEQ ID NO: 95493 - DNA, 25 bp, S. pombe
tgaccttgttggagggttcacaccg

SEQ ID NO: 95494 - DNA, 25 bp, S. pombe
gatcttcgtttgaggagctgcaacc

SEQ ID NO: 95495 - DNA, 25 bp, S. pombe
gatcttcggcttcatggtctaaaca

SEQ ID NO: 95496 - DNA, 25 bp, S. pombe
gatcgttctatttcttcattttgca

SEQ ID NO: 95497 - DNA, 25 bp, S. pombe
gatcgttacagcttttcctgatgtc

SEQ ID NO: 95498 - DNA, 25 bp, S. pombe
gatcgcggatcctctgaattaaaaa

SEQ ID NO: 95499 - DNA, 25 bp, S. pombe
gatccggatcccctgaatggattta

SEQ ID NO: 95500 - DNA, 25 bp, S. pombe
gatctcgttccccttataatgatga

SEQ ID NO: 95501 - DNA, 25 bp, S. pombe
gatctttatcctacagtttaccaaa

SEQ ID NO: 95502 - DNA, 25 bp, S. pombe
gataaactggatatttcaactggcc

SEQ ID NO: 95503 - DNA, 25 bp, S. pombe
taagtcgtagttattcgaccacctc

SEQ ID NO: 95504 - DNA, 25 bp, S. pombe
gatctagtgaccttgaccaatcctc

SEQ ID NO: 95505 - DNA, 25 bp, S. pombe
gatccgatggcgtatgttcaacatt

SEQ ID NO: 95506 - DNA, 25 bp, S. pombe
gatcccaggcattttatcatgtgcg

SEQ ID NO: 95507 - DNA, 25 bp, S. pombe
gatcttgatggctctgttcgtgctc

SEQ ID NO: 95508 - DNA, 25 bp, S. pombe
gatctcgtggttttatgcgtgcaca

SEQ ID NO: 95509 - DNA, 25 bp, S. pombe
gatcctcgacacattatgcttcttg

SEQ ID NO: 95510 - DNA, 25 bp, S. pombe
gatcgcacgattgtcattgcttttt

SEQ ID NO: 95511 - DNA, 25 bp, S. pombe
gatcccgtatccaattgctttttgt

SEQ ID NO: 95512 - DNA, 25 bp, S. pombe
gatcgtttcaaactgcattcgccga

SEQ ID NO: 95513 - DNA, 25 bp, S. pombe
gatcgcttgatgcaattcttcggga

SEQ ID NO: 95514 - DNA, 25 bp, S. pombe
gatcgcaatcatctggtttgacgtt

SEQ ID NO: 95515 - DNA, 25 bp, S. pombe
gatcgccaattggttttgagccttt

SEQ ID NO: 95516 - DNA, 25 bp, S. pombe
gatcgtttctgtgcttttgttgata

SEQ ID NO: 95517 - DNA, 25 bp, S. pombe
gatctggaatgattcatcgtcttcc

SEQ ID NO: 95518 - DNA, 25 bp, S. pombe
gatcatggactgtttcctttccaat

SEQ ID NO: 95519 - DNA, 25 bp, S. pombe
gatcttggatgtggtccttatgcca

SEQ ID NO: 95520 - DNA, 25 bp, S. pombe
gatcgcattttatcgccaattcggt

SEQ ID NO: 95521 - DNA, 25 bp, S. pombe
gatctcaaagttgccgatttcggtt

SEQ ID NO: 95522 - DNA, 25 bp, S. pombe
gatctccctacctatgcagttcgaa

SEQ ID NO: 95523 - DNA, 25 bp, S. pombe
gatcccctcaaaagctgttcatagt

SEQ ID NO: 95524 - DNA, 25 bp, S. pombe
gatcccctaatgaactactttgagc

SEQ ID NO: 95525 - DNA, 25 bp, S. pombe
gatcccttaatcacatacctgaaca

SEQ ID NO: 95526 - DNA, 25 bp, S. pombe
gatcgatttgctttcatctgtggag

SEQ ID NO: 95527 - DNA, 25 bp, S. pombe
gatcgtccttcttattctagctata

SEQ ID NO: 95528 - DNA, 25 bp, S. pombe
gatccccaatttcagggcttttttg

SEQ ID NO: 95529 - DNA, 25 bp, S. pombe
gatctctacgcctacagaggtctta

SEQ ID NO: 95530 - DNA, 25 bp, S. pombe
gatatgccttacttgttggtaccta

SEQ ID NO: 95531 - DNA, 25 bp, S. pombe
ggaatttaccgcacaggctagtact

SEQ ID NO: 95532 - DNA, 25 bp, S. pombe
gatcaaatcatacccttggcaattg

SEQ ID NO: 95533 - DNA, 25 bp, S. pombe
gatcggatttccgacatgccacatt

SEQ ID NO: 95534 - DNA, 25 bp, S. pombe
gatcggtgtctccataatagcgtgt

SEQ ID NO: 95535 - DNA, 25 bp, S. pombe
gatcgggacgaccaaagcgtgcaaa

SEQ ID NO: 95536 - DNA, 25 bp, S. pombe
gatcagggatggtcttacggcgaat

SEQ ID NO: 95537 - DNA, 25 bp, S. pombe
gatcatgtgaaaattctccgcgtaa

SEQ ID NO: 95538 - DNA, 25 bp, S. pombe
gatcattatttgtttagccgtcgaa

SEQ ID NO: 95539 - DNA, 25 bp, S. pombe
gatctcttggtcgagctgaacggga

SEQ ID NO: 95540 - DNA, 25 bp, S. pombe
gataccgtcgagtctaaacatgctg

SEQ ID NO: 95541 - DNA, 25 bp, S. pombe
gatccccatcttatttctagtgtgc

SEQ ID NO: 95542 - DNA, 25 bp, S. pombe
gatcgccctggtttactgagtatgg

SEQ ID NO: 95543 - DNA, 25 bp, S. pombe
gatcgacctcgtgatgtcgctgaaa

SEQ ID NO: 95544 - DNA, 25 bp, S. pombe
gatcgccattccaacatggtattag

SEQ ID NO: 95545 - DNA, 25 bp, S. pombe
gatcgactctagacttcaaggaagc

SEQ ID NO: 95546 - DNA, 25 bp, S. pombe
gatcagtctcttcccttagagaagg

SEQ ID NO: 95547 - DNA, 25 bp, S. pombe
gatatgtatcccttttacgaagtgc

SEQ ID NO: 95548 - DNA, 25 bp, S. pombe
gatcgtgtcactgtattccgtcaag

SEQ ID NO: 95549 - DNA, 25 bp, S. pombe
gatcgagtttgttagacgtggcata

SEQ ID NO: 95550 - DNA, 25 bp, S. pombe
gatcgatggctttttgacattccct

SEQ ID NO: 95551 - DNA, 25 bp, S. pombe
gatcggttatactctattcatgctt

SEQ ID NO: 95552 - DNA, 25 bp, S. pombe
gatctcagagccttaatgttcgttc

SEQ ID NO: 95553 - DNA, 25 bp, S. pombe
gatcgagtctatcgtattcgccgtg

SEQ ID NO: 95554 - DNA, 25 bp, S. pombe
gatcttcaaggccaaacaccattgc

SEQ ID NO: 95555 - DNA, 25 bp, S. pombe
gatctcatgttttcaaaccgccttt

SEQ ID NO: 95556 - DNA, 25 bp, S. pombe
gatctgtgtggattcgattctcgac

SEQ ID NO: 95557 - DNA, 25 bp, S. pombe
gatctagtgcagtcagccattcgtg

SEQ ID NO: 95558 - DNA, 25 bp, S. pombe
gatctactctggtgattctgtaagc

SEQ ID NO: 95559 - DNA, 25 bp, S. pombe
gatcggttggcagctatgctaaact

SEQ ID NO: 95560 - DNA, 25 bp, S. pombe
gatctgtatacgtcgggctgggtta

SEQ ID NO: 95561 - DNA, 25 bp, S. pombe
gatctggaacgaggtacggctcttt

SEQ ID NO: 95562 - DNA, 25 bp, S. pombe
gatctcccctttagatgccaatatt

SEQ ID NO: 95563 - DNA, 25 bp, S. pombe
gatcttcgcctatgtgatgtgaata

SEQ ID NO: 95564 - DNA, 25 bp, S. pombe
gatctcatcccgtatcttgttaaat

SEQ ID NO: 95565 - DNA, 25 bp, S. pombe
gatcattgccggtactgttttgagt

SEQ ID NO: 95566 - DNA, 25 bp, S. pombe
gatctctgcgtagtactggtgttgt

SEQ ID NO: 95567 - DNA, 25 bp, S. pombe
gatctccgtgaaactgttgccaagg

SEQ ID NO: 95568 - DNA, 25 bp, S. pombe
gatctatcctgcttcggtatcgcaa

SEQ ID NO: 95569 - DNA, 25 bp, S. pombe
gatcgattgctctcatggcaactca

SEQ ID NO: 95570 - DNA, 25 bp, S. pombe
gatcattgtttacagttggcatatc

SEQ ID NO: 95571 - DNA, 25 bp, S. pombe
gatctttttgactatttgcctctca

SEQ ID NO: 95572 - DNA, 25 bp, S. pombe
gatcttttggattctttggctgcta

SEQ ID NO: 95573 - DNA, 25 bp, S. pombe
gatcttagtgtgaacatgactccca

SEQ ID NO: 95574 - DNA, 25 bp, S. pombe
gatcttgaggatacagactccacct

SEQ ID NO: 95575 - DNA, 25 bp, S. pombe
gatctcttctatttcttcccaagaa

SEQ ID NO: 95576 - DNA, 25 bp, S. pombe
gatttacttactgctcccgaagact

SEQ ID NO: 95577 - DNA, 25 bp, S. pombe
gttggcaaacctaagggttccgcat

SEQ ID NO: 95578 - DNA, 25 bp, S. pombe
gttgctgaacctcaagggctttcga

SEQ ID NO: 95579 - DNA, 25 bp, S. pombe
gatcagttggtgactggcactctac

SEQ ID NO: 95580 - DNA, 25 bp, S. pombe
gatctgtatgtcacgtacgcaatag

SEQ ID NO: 95581 - DNA, 25 bp, S. pombe
gatcgcatagccgtcaataccaata

SEQ ID NO: 95582 - DNA, 25 bp, S. pombe
gatcagctaacttcaactaccgcga

SEQ ID NO: 95583 - DNA, 25 bp, S. pombe
gatcgtgtgcgtttagctactgaaa

SEQ ID NO: 95584 - DNA, 25 bp, S. pombe
gatctgtgggtctatcgatttgaga

SEQ ID NO: 95585 - DNA, 25 bp, S. pombe
gatctaagcgtttccagccaagttg

SEQ ID NO: 95586 - DNA, 25 bp, S. pombe
gatcaagacggttcaaatgctgggt

SEQ ID NO: 95587 - DNA, 25 bp, S. pombe
gatcatgaacggtcaaggtcctgtt

SEQ ID NO: 95588 - DNA, 25 bp, S. pombe
gatcacacatcagagacagtacctt

SEQ ID NO: 95589 - DNA, 25 bp, S. pombe
gatcaactcgggatatacagttaaa

SEQ ID NO: 95590 - DNA, 25 bp, S. pombe
gatactcttggcctggagagcaata

SEQ ID NO: 95591 - DNA, 25 bp, S. pombe
gatcgaaaagagtcggttgcttcaa

SEQ ID NO: 95592 - DNA, 25 bp, S. pombe
gataaaggctctcccaagattgaaa

SEQ ID NO: 95593 - DNA, 25 bp, S. pombe
gatacaacgctttttcgacgaaatt

SEQ ID NO: 95594 - DNA, 25 bp, S. pombe
gataagtggaggaagaaacgcgtga

SEQ ID NO: 95595 - DNA, 25 bp, S. pombe
gatcagttgaatctacagaacgagg

SEQ ID NO: 95596 - DNA, 25 bp, S. pombe
gatcgtcatcagtcttacagtcaca

SEQ ID NO: 95597 - DNA, 25 bp, S. pombe
gatcgtccgtagtacagctcatgaa

SEQ ID NO: 95598 - DNA, 25 bp, S. pombe
gatcgtgctcagaaggcccatacaa

SEQ ID NO: 95599 - DNA, 25 bp, S. pombe
gatcttgctcattttattctaaccc

SEQ ID NO: 95600 - DNA, 25 bp, S. pombe
gatcttgctcgaatgttttttactg

SEQ ID NO: 95601 - DNA, 25 bp, S. pombe
gatcttgccaacgattcatctttgt

SEQ ID NO: 95602 - DNA, 25 bp, S. pombe
gatcgtcgtagtatttattcttcag

SEQ ID NO: 95603 - DNA, 25 bp, S. pombe
gatcgggctcgaatttattgtctta

SEQ ID NO: 95604 - DNA, 25 bp, S. pombe
gatcggtcgcccttctgagaagaaa

SEQ ID NO: 95605 - DNA, 25 bp, S. pombe
gatcggccgtacctctggacggttc

SEQ ID NO: 95606 - DNA, 25 bp, S. pombe
gatctccatcatactttcaagcacg

SEQ ID NO: 95607 - DNA, 25 bp, S. pombe
gataacacacatctttcatatgttg

SEQ ID NO: 95608 - DNA, 25 bp, S. pombe
gatcggtacatagcgttcccatgaa

SEQ ID NO: 95609 - DNA, 25 bp, S. pombe
gatcaggtcaatgtccttgccaaaa

SEQ ID NO: 95610 - DNA, 25 bp, S. pombe
gatcgatcttatggtcctagtaaaa

SEQ ID NO: 95611 - DNA, 25 bp, S. pombe
gatcgatttttctcaagtcttacag

SEQ ID NO: 95612 - DNA, 25 bp, S. pombe
gatcagtcttgttcctaatgtttac

SEQ ID NO: 95613 - DNA, 25 bp, S. pombe
gatcgtgcttcctcataaagtaact

SEQ ID NO: 95614 - DNA, 25 bp, S. pombe
gatcgtttgtatggtgccacagctt

SEQ ID NO: 95615 - DNA, 25 bp, S. pombe
gatcagttttttcgcaacgttcggg

SEQ ID NO: 95616 - DNA, 25 bp, S. pombe
gatcaggcttttcaattgctttggg

SEQ ID NO: 95617 - DNA, 25 bp, S. pombe
gatcacagtttctccatcattttgg

SEQ ID NO: 95618 - DNA, 25 bp, S. pombe
gatcatatttcctccactttggtga

SEQ ID NO: 95619 - DNA, 25 bp, S. pombe
gatcgtcgtccttaactttggtatt

SEQ ID NO: 95620 - DNA, 25 bp, S. pombe
gatctactctcagaaaactcgttca

SEQ ID NO: 95621 - DNA, 25 bp, S. pombe
gatctatctctcaaaaaccgtgcag

SEQ ID NO: 95622 - DNA, 25 bp, S. pombe
gatcttctccgataccagggcatgg

SEQ ID NO: 95623 - DNA, 25 bp, S. pombe
gatcatcttcctgtcccagaaattg

SEQ ID NO: 95624 - DNA, 25 bp, S. pombe
gatcacattcttttcgttgcgaacg

SEQ ID NO: 95625 - DNA, 25 bp, S. pombe
gatctatacgttcctgatctcaggg

SEQ ID NO: 95626 - DNA, 25 bp, S. pombe
gatcaaacgatcactgcgagggtta

SEQ ID NO: 95627 - DNA, 25 bp, S. pombe
gatttccttcagtttagttttcgct

SEQ ID NO: 95628 - DNA, 25 bp, S. pombe
gattacagccccattagtagtttgt

SEQ ID NO: 95629 - DNA, 25 bp, S. pombe
gatcgtatccctaaaactgctactg

SEQ ID NO: 95630 - DNA, 25 bp, S. pombe
gatcatgtatccttgggaagctcaa

SEQ ID NO: 95631 - DNA, 25 bp, S. pombe
gatctagttatgattcaccctcttc

SEQ ID NO: 95632 - DNA, 25 bp, S. pombe
gatctcaggacttggaagcgcgtta

SEQ ID NO: 95633 - DNA, 25 bp, S. pombe
gatcaccaagaatgaatttaagata

SEQ ID NO: 95634 - DNA, 25 bp, S. pombe
gatcgtgactactactatcctgagt

SEQ ID NO: 95635 - DNA, 25 bp, S. pombe
gatcgtaccattttgaccattgctc

SEQ ID NO: 95636 - DNA, 25 bp, S. pombe
gatcgtacaatttcgttcattcctc

SEQ ID NO: 95637 - DNA, 25 bp, S. pombe
gatcgtacatttccggtcattgaat

SEQ ID NO: 95638 - DNA, 25 bp, S. pombe
gtcaattttcgcaggtacttttccg

SEQ ID NO: 95639 - DNA, 25 bp, S. pombe
gatctctcaatttcttctgtaccat

SEQ ID NO: 95640 - DNA, 25 bp, S. pombe
gatctttgtttgacgtttcacacag

SEQ ID NO: 95641 - DNA, 25 bp, S. pombe
gatctttctactcaaatgtctcgga

SEQ ID NO: 95642 - DNA, 25 bp, S. pombe
gatcttgctctacgcatttactgac

SEQ ID NO: 95643 - DNA, 25 bp, S. pombe
gatcggcagtattagctctctagaa

SEQ ID NO: 95644 - DNA, 25 bp, S. pombe
gatacatttttggcgacagatgggg

SEQ ID NO: 95645 - DNA, 25 bp, S. pombe
gatcaacttgaagaatccatgcgtg

SEQ ID NO: 95646 - DNA, 25 bp, S. pombe
gataacgctaactacttccaatggg

SEQ ID NO: 95647 - DNA, 25 bp, S. pombe
gataatcgattagttctacctatag

SEQ ID NO: 95648 - DNA, 25 bp, S. pombe
gataaatgggcatcgctacgacaaa

SEQ ID NO: 95649 - DNA, 25 bp, S. pombe
gatctgtcttctttgccgcagtcaa

SEQ ID NO: 95650 - DNA, 25 bp, S. pombe
gatcttcagctgtattgggccttac

SEQ ID NO: 95651 - DNA, 25 bp, S. pombe
gatcatgaactgcactatgggtttc

SEQ ID NO: 95652 - DNA, 25 bp, S. pombe
gatcattgaatctacctcggtcttc

SEQ ID NO: 95653 - DNA, 25 bp, S. pombe
gatcataaattgtccatagctgttg

SEQ ID NO: 95654 - DNA, 25 bp, S. pombe
gatcataaagtgtctcagcccagtg

SEQ ID NO: 95655 - DNA, 25 bp, S. pombe
gatctgacatccaagcttatttaca

SEQ ID NO: 95656 - DNA, 25 bp, S. pombe
gatcatgcatcagaagttgtttcat

SEQ ID NO: 95657 - DNA, 25 bp, S. pombe
gatcatggtgccgattcttgtagct

SEQ ID NO: 95658 - DNA, 25 bp, S. pombe
gatcacgatcgccatgtcattggag

SEQ ID NO: 95659 - DNA, 25 bp, S. pombe
gatcatctgtggtacaagctcgcta

SEQ ID NO: 95660 - DNA, 25 bp, S. pombe
gatcatttggtagaacgctttgcag

SEQ ID NO: 95661 - DNA, 25 bp, S. pombe
gatcattattgttctttcgttggca

SEQ ID NO: 95662 - DNA, 25 bp, S. pombe
gataaatctcctgtaactacgcctc

SEQ ID NO: 95663 - DNA, 25 bp, S. pombe
gattaacgcctccaatacaatacct

SEQ ID NO: 95664 - DNA, 25 bp, S. pombe
tgaaaccgacaactcgattttttcg

SEQ ID NO: 95665 - DNA, 25 bp, S. pombe
taacccgaaggctcctgttattaga

SEQ ID NO: 95666 - DNA, 25 bp, S. pombe
gtaccaaggattctagccgtgctac

SEQ ID NO: 95667 - DNA, 25 bp, S. pombe
gatagccttgttaccctttttaatg

SEQ ID NO: 95668 - DNA, 25 bp, S. pombe
gatagggtgtttgactttccaccgt

SEQ ID NO: 95669 - DNA, 25 bp, S. pombe
gatcagttggatttgtaccttccct

SEQ ID NO: 95670 - DNA, 25 bp, S. pombe
gatctcatttttgttcagctttcca

SEQ ID NO: 95671 - DNA, 25 bp, S. pombe
gatcatattctttataagtctcttc

SEQ ID NO: 95672 - DNA, 25 bp, S. pombe
gatctgatttggtttgatgaccttc

SEQ ID NO: 95673 - DNA, 25 bp, S. pombe
gatcaacgcatacagttcgcttcag

SEQ ID NO: 95674 - DNA, 25 bp, S. pombe
gatctacgatctgcagttttgctca

SEQ ID NO: 95675 - DNA, 25 bp, S. pombe
gatctcactgttgttatgactcatg

SEQ ID NO: 95676 - DNA, 25 bp, S. pombe
gatctcagcttcatttctgtcatta

SEQ ID NO: 95677 - DNA, 25 bp, S. pombe
gatacggttgttttagcctatgcta

SEQ ID NO: 95678 - DNA, 25 bp, S. pombe
gatcacgcttctgtgcaaatcaacg

SEQ ID NO: 95679 - DNA, 25 bp, S. pombe
gatcatcagctatttctcaagacaa

SEQ ID NO: 95680 - DNA, 25 bp, S. pombe
gatctcctgtatcgaacaccaagtt

SEQ ID NO: 95681 - DNA, 25 bp, S. pombe
gatctcatcctctgctactttggta

SEQ ID NO: 95682 - DNA, 25 bp, S. pombe
gatcaatctccgaatgaggcaaccg

SEQ ID NO: 95683 - DNA, 25 bp, S. pombe
gatcaagtacgcgagcaggccagac

SEQ ID NO: 95684 - DNA, 25 bp, S. pombe
gatcaatctcgtgagctggcagtaa

SEQ ID NO: 95685 - DNA, 25 bp, S. pombe
gatacttttatggagaacgcaacct

SEQ ID NO: 95686 - DNA, 25 bp, S. pombe
gatactattttgtggcctgaatgcc

SEQ ID NO: 95687 - DNA, 25 bp, S. pombe
gataatggtcgtcctctgaataaac

SEQ ID NO: 95688 - DNA, 25 bp, S. pombe
gataaactttctccgcaacaaattt

SEQ ID NO: 95689 - DNA, 25 bp, S. pombe
gataatcaaaattcaccctcaccat

SEQ ID NO: 95690 - DNA, 25 bp, S. pombe
gataatcaattgtttcgacgacctt

SEQ ID NO: 95691 - DNA, 25 bp, S. pombe
tgaaccgttcgaaaagccctttgat

SEQ ID NO: 95692 - DNA, 25 bp, S. pombe
gattccgattccgtagaacagtttg

SEQ ID NO: 95693 - DNA, 25 bp, S. pombe
gataccgaatcgatccaaacacttg

SEQ ID NO: 95694 - DNA, 25 bp, S. pombe
gatactttcggtagacatcccttca

SEQ ID NO: 95695 - DNA, 25 bp, S. pombe
gataaatcctttcgagacccggcga

SEQ ID NO: 95696 - DNA, 25 bp, S. pombe
gataaccttttgttaactgctcgtt

SEQ ID NO: 95697 - DNA, 25 bp, S. pombe
gataaacttgtttcgattctccttt

SEQ ID NO: 95698 - DNA, 25 bp, S. pombe
gataatctgcgttgtgtttgtcata

SEQ ID NO: 95699 - DNA, 25 bp, S. pombe
gataattgcagctttagttcctcaa

SEQ ID NO: 95700 - DNA, 25 bp, S. pombe
gataatgctggctttgactctagtg

SEQ ID NO: 95701 - DNA, 25 bp, S. pombe
gatcatcaaggcatctgctactctt

SEQ ID NO: 95702 - DNA, 25 bp, S. pombe
gatcatttgccattactctctgatg

SEQ ID NO: 95703 - DNA, 25 bp, S. pombe
gatcagttggcaaatcacgagcttg

SEQ ID NO: 95704 - DNA, 25 bp, S. pombe
gatacggacggttcaagcttgcaca

SEQ ID NO: 95705 - DNA, 25 bp, S. pombe
gatcacgtcgatcttgagaaaggtt

SEQ ID NO: 95706 - DNA, 25 bp, S. pombe
gatcatgttcatccacaagtgtcaa

SEQ ID NO: 95707 - DNA, 25 bp, S. pombe
gatacccaacgtagtatacatgcgt

SEQ ID NO: 95708 - DNA, 25 bp, S. pombe
gatcaccgaacttattctaggcgcc

SEQ ID NO: 95709 - DNA, 25 bp, S. pombe
gataccaggcaggaacttaaccagc

SEQ ID NO: 95710 - DNA, 25 bp, S. pombe
gtaccggttttatgtgtgtctcccg

SEQ ID NO: 95711 - DNA, 25 bp, S. pombe
gataccgtatttaagggattcagcg

SEQ ID NO: 95712 - DNA, 25 bp, S. pombe
gatatgtttgtaccatcgcaggtca

SEQ ID NO: 95713 - DNA, 25 bp, S. pombe
gatcatattattctggcttgtgccc

SEQ ID NO: 95714 - DNA, 25 bp, S. pombe
gatcataattctgcttctattccct

SEQ ID NO: 95715 - DNA, 25 bp, S. pombe
gatcagaaggtccttatgcctccag

SEQ ID NO: 95716 - DNA, 25 bp, S. pombe
gatcaaagttgctgttgcctacatt

SEQ ID NO: 95717 - DNA, 25 bp, S. pombe
gatcaacgatccctttttacattaa

SEQ ID NO: 95718 - DNA, 25 bp, S. pombe
gatacgcccaagcttttggtgctga

SEQ ID NO: 95719 - DNA, 25 bp, S. pombe
gataatcacctactaacttttgctg

SEQ ID NO: 95720 - DNA, 25 bp, S. pombe
gatcttgtatctgctgtggtttata

SEQ ID NO: 95721 - DNA, 25 bp, S. pombe
gatcttgttatctttggttgtctac

SEQ ID NO: 95722 - DNA, 25 bp, S. pombe
gatcatttcatgacatttcctcgtg

SEQ ID NO: 95723 - DNA, 25 bp, S. pombe
gatcaaactggctttcttggtattt

SEQ ID NO: 95724 - DNA, 25 bp, S. pombe
gatcttaagtcatctttcccatttt

SEQ ID NO: 95725 - DNA, 25 bp, S. pombe
gataaaaagcttgttcccgcttctc

SEQ ID NO: 95726 - DNA, 25 bp, S. pombe
gataaataccttgtacccactaaag

SEQ ID NO: 95727 - DNA, 25 bp, S. pombe
gataagcaaccaagttctaccgaga

SEQ ID NO: 95728 - DNA, 25 bp, S. pombe
gatcaagccagacatcatctccgat

SEQ ID NO: 95729 - DNA, 25 bp, S. pombe
gatcagcagccgattacattccata

SEQ ID NO: 95730 - DNA, 25 bp, S. pombe
gatcatgactttgtcatcccggaag

SEQ ID NO: 95731 - DNA, 25 bp, S. pombe
gatcaaccgataatgctcccatggg

SEQ ID NO: 95732 - DNA, 25 bp, S. pombe
gatacaagcgaaagctcgcccggta

SEQ ID NO: 95733 - DNA, 25 bp, S. pombe
gataaactggatatcaccactggtt

SEQ ID NO: 95734 - DNA, 25 bp, S. pombe
gataaaaccaatgcccacgtaaaca

SEQ ID NO: 95735 - DNA, 25 bp, S. pombe
gataatcccgactttgacgatgctc

SEQ ID NO: 95736 - DNA, 25 bp, S. pombe
gatacttctactcgaccagcgaact

SEQ ID NO: 95737 - DNA, 25 bp, S. pombe
gatagacctccaattaccggttttg

SEQ ID NO: 95738 - DNA, 25 bp, S. pombe
gataacccatctatccggttgttat

SEQ ID NO: 95739 - DNA, 25 bp, S. pombe
gatcaactttggcaagcttggcttt

SEQ ID NO: 95740 - DNA, 25 bp, S. pombe
gatcaagcacaagcacaagaaggtt

SEQ ID NO: 95741 - DNA, 25 bp, S. pombe
gatagctcacccaacggtggtttca

SEQ ID NO: 95742 - DNA, 25 bp, S. pombe
gataaagctgttcctcttgagaaaa

SEQ ID NO: 95743 - DNA, 25 bp, S. pombe
gatactatattttccgtggcgccaa

SEQ ID NO: 95744 - DNA, 25 bp, S. pombe
gatacttttcgctcgggtgcaattg

SEQ ID NO: 95745 - DNA, 25 bp, S. pombe
gatcatcgcgttgaagctggccgta

SEQ ID NO: 95746 - DNA, 25 bp, S. pombe
gatcagccgttccattagaatcacc

SEQ ID NO: 95747 - DNA, 25 bp, S. pombe
gataacgtccattccaataatctat

SEQ ID NO: 95748 - DNA, 25 bp, S. pombe
gataactacttagcgaggtcctcaa

SEQ ID NO: 95749 - DNA, 25 bp, S. pombe
gatcaatgagccctcgttatcgttc

SEQ ID NO: 95750 - DNA, 25 bp, S. pombe
gatacccgttggaatttgtttgcct

SEQ ID NO: 95751 - DNA, 25 bp, S. pombe
gataccctacggaatgctcgtttgg

SEQ ID NO: 95752 - DNA, 25 bp, S. pombe
gatcaagggaattcagtgtaataca

SEQ ID NO: 95753 - DNA, 25 bp, S. pombe
gatacctgtgtgttgcctcggacgg

SEQ ID NO: 95754 - DNA, 25 bp, S. pombe
gatagagctggatgctgtccggacc

SEQ ID NO: 95755 - DNA, 25 bp, S. pombe
gatcaaatctgctgtcaacccaaaa

SEQ ID NO: 95756 - DNA, 25 bp, S. pombe
gataagattcgtgaccaacagacaa

SEQ ID NO: 95757 - DNA, 25 bp, S. pombe
gatcaagtccgaattccttcaaaaa

SEQ ID NO: 95758 - DNA, 25 bp, S. pombe
gatactgtcgatgtgaccactttac

SEQ ID NO: 95759 - DNA, 25 bp, S. pombe
gttggatccagagctttttccgtac

SEQ ID NO: 95760 - DNA, 25 bp, S. pombe
gatcaagatccggttgttttccagt

SEQ ID NO: 95761 - DNA, 25 bp, S. pombe
gatcaattcctggacttctttgcgg

SEQ ID NO: 95762 - DNA, 25 bp, S. pombe
gatcatgattgcgttgctcttttct

SEQ ID NO: 95763 - DNA, 25 bp, S. pombe
gatcattcgctggattcttgttcga

SEQ ID NO: 95764 - DNA, 25 bp, S. pombe
gatcattcgcatgtcattcgtcatc

SEQ ID NO: 95765 - DNA, 25 bp, S. pombe
gatcatgtctgagtctggtggtcca

SEQ ID NO: 95766 - DNA, 25 bp, S. pombe
gatcaattattagatgagcccgatt

SEQ ID NO: 95767 - DNA, 25 bp, S. pombe
gatcataattgcctcggatgctcaa

SEQ ID NO: 95768 - DNA, 25 bp, S. pombe
gatcaacacattcctggtgctctaa

SEQ ID NO: 95769 - DNA, 25 bp, S. pombe
gataatgcctgcgtcttggttaata

SEQ ID NO: 95770 - DNA, 25 bp, S. pombe
gatcaagcttcgaagaaccgttctg

SEQ ID NO: 95771 - DNA, 25 bp, S. pombe
gatacaattgccttccttgcaaatg

SEQ ID NO: 95772 - DNA, 25 bp, S. pombe
gataactttagcgatgccccaacta

SEQ ID NO: 95773 - DNA, 25 bp, S. pombe
gatcaagatgccttagatacccaag

SEQ ID NO: 95774 - DNA, 25 bp, S. pombe
gatcacgatccagaatttgctaatt

SEQ ID NO: 95775 - DNA, 25 bp, S. pombe
gatcagtcctgatacgtttgctgga

SEQ ID NO: 95776 - DNA, 25 bp, S. pombe
gatttgaacattccgttacttcgta

SEQ ID NO: 95777 - DNA, 25 bp, S. pombe
gtgtttgggaacctgaagccgtcaa

SEQ ID NO: 95778 - DNA, 25 bp, S. pombe
gtcgttgggcaaaggccacgatgaa

SEQ ID NO: 95779 - DNA, 25 bp, S. pombe
gataaagtatcttcttcccgattaa

SEQ ID NO: 95780 - DNA, 25 bp, S. pombe
gataatgctggaactcgacaccgag

SEQ ID NO: 95781 - DNA, 25 bp, S. pombe
gataactgaatccttgtcgcaagag

SEQ ID NO: 95782 - DNA, 25 bp, S. pombe
gataatctcattcgtgtctggcaag

SEQ ID NO: 95783 - DNA, 25 bp, S. pombe
gataccactgaacgtcatgagctag

SEQ ID NO: 95784 - DNA, 25 bp, S. pombe
gatcacacactgttttcatgctgta

SEQ ID NO: 95785 - DNA, 25 bp, S. pombe
gatcagcatatcactgtcttggtcc

SEQ ID NO: 95786 - DNA, 25 bp, S. pombe
gataatacaccgaattcttccccag

SEQ ID NO: 95787 - DNA, 25 bp, S. pombe
gataggaaatgcatttggagggata

SEQ ID NO: 95788 - DNA, 25 bp, S. pombe
gatacgggaccacgcctgatgaaga

SEQ ID NO: 95789 - DNA, 25 bp, S. pombe
gatcaaataggactgctgctcaaac

SEQ ID NO: 95790 - DNA, 25 bp, S. pombe
gatagtttggcgaatgctcagcaac

SEQ ID NO: 95791 - DNA, 25 bp, S. pombe
gtaccttcacaaagccctgtatggg

SEQ ID NO: 95792 - DNA, 25 bp, S. pombe
gatcaacaggcatgctttctctgga

SEQ ID NO: 95793 - DNA, 25 bp, S. pombe
gataagtatgaacctcccgagagtc

SEQ ID NO: 95794 - DNA, 25 bp, S. pombe
gataatcatacgacaaccgccattc

SEQ ID NO: 95795 - DNA, 25 bp, S. pombe
gatcacaatagctctacaaccttgg

SEQ ID NO: 95796 - DNA, 25 bp, S. pombe
gatagatctgaaacgccaacgctcc

SEQ ID NO: 95797 - DNA, 25 bp, S. pombe
gatcaatctaattctcctacagcag

SEQ ID NO: 95798 - DNA, 25 bp, S. pombe
gataagcttggcatacctacagagg

SEQ ID NO: 95799 - DNA, 25 bp, S. pombe
gatactgaaatcgtaaacgccggag

SEQ ID NO: 95800 - DNA, 25 bp, S. pombe
gataccaatagcgatgacaagcccg

SEQ ID NO: 95801 - DNA, 25 bp, S. pombe
gatcacacagaattgggcagacccg

SEQ ID NO: 95802 - DNA, 25 bp, S. pombe
gatcactagtttggctgctatccca

SEQ ID NO: 95803 - DNA, 25 bp, S. pombe
gatcaagccgactttctcatgaaat

SEQ ID NO: 95804 - DNA, 25 bp, S. pombe
gatcaatctcgagtgcgtctcatta

SEQ ID NO: 95805 - DNA, 25 bp, S. pombe
gatcaactgcgttcgttatcatatt

SEQ ID NO: 95806 - DNA, 25 bp, S. pombe
gatcacatccgtttgcgatatgcaa

SEQ ID NO: 95807 - DNA, 25 bp, S. pombe
gatcagatcgtcgtatgccttgaat

SEQ ID NO: 95808 - DNA, 25 bp, S. pombe
gatcaatccgcagtatcctatatgt

SEQ ID NO: 95809 - DNA, 25 bp, S. pombe
gatacacatgttgcttctgaaggtt

SEQ ID NO: 95810 - DNA, 25 bp, S. pombe
gatactagctgccacttcagaagat

SEQ ID NO: 95811 - DNA, 25 bp, S. pombe
gatcaagtcattcgttttatttcca

SEQ ID NO: 95812 - DNA, 25 bp, S. pombe
gatacgtcgacgcttacatatacca

SEQ ID NO: 95813 - DNA, 25 bp, S. pombe
gatacttctttgctcggtactggaa

SEQ ID NO: 95814 - DNA, 25 bp, S. pombe
gatacattggttctatggtcgccga

SEQ ID NO: 95815 - DNA, 25 bp, S. pombe
gataaatactccttgctaaccaaaa

SEQ ID NO: 95816 - DNA, 25 bp, S. pombe
gatacaagagccctcgaagagtcat

SEQ ID NO: 95817 - DNA, 25 bp, S. pombe
gatacattgttcctctcaaaactca

SEQ ID NO: 95818 - DNA, 25 bp, S. pombe
gatactacttttcaacaactggcaa

SEQ ID NO: 95819 - DNA, 25 bp, S. pombe
gataatgaagactcgactgctgctt

SEQ ID NO: 95820 - DNA, 25 bp, S. pombe
gataatatacaagtttcgtccagct

SEQ ID NO: 95821 - DNA, 25 bp, S. pombe
gataattctccagccagttacaatg

SEQ ID NO: 95822 - DNA, 25 bp, S. pombe
gatcaatttcatctcctgtcttaat

SEQ ID NO: 95823 - DNA, 25 bp, S. pombe
gatcaagatatccttcactgtcgta

SEQ ID NO: 95824 - DNA, 25 bp, S. pombe
gatcacgatttcttgtatctcgata

SEQ ID NO: 95825 - DNA, 25 bp, S. pombe
gataacgatgcttctacagcaccta

SEQ ID NO: 95826 - DNA, 25 bp, S. pombe
gataattttcatcgttctgctagaa

SEQ ID NO: 95827 - DNA, 25 bp, S. pombe
gatagactctcctgattcacttgaa

SEQ ID NO: 95828 - DNA, 25 bp, S. pombe
gataaacgctgttccgacatttgcc

SEQ ID NO: 95829 - DNA, 25 bp, S. pombe
gatacggatttcgttcctggtacat

SEQ ID NO: 95830 - DNA, 25 bp, S. pombe
gatatcggagatccttccatttgga

SEQ ID NO: 95831 - DNA, 25 bp, S. pombe
gatacggtagctgctggcattgtta

SEQ ID NO: 95832 - DNA, 25 bp, S. pombe
gataaggctttagagctctcgaatt

SEQ ID NO: 95833 - DNA, 25 bp, S. pombe
gataacattcttcgctgggacatta

SEQ ID NO: 95834 - DNA, 25 bp, S. pombe
gatacttaaagctggttctgccctt

SEQ ID NO: 95835 - DNA, 25 bp, S. pombe
gatactgtttccagtgttcgccttg

SEQ ID NO: 95836 - DNA, 25 bp, S. pombe
gatacactttttgttctcgacttta

SEQ ID NO: 95837 - DNA, 25 bp, S. pombe
gataattttttgcagctaaccgtta

SEQ ID NO: 95838 - DNA, 25 bp, S. pombe
gataatccgctttatgttccagcac

SEQ ID NO: 95839 - DNA, 25 bp, S. pombe
gataccatggtacacttctgtctgc

SEQ ID NO: 95840 - DNA, 25 bp, S. pombe
gatacacgtaagcatgtctcttcac

SEQ ID NO: 95841 - DNA, 25 bp, S. pombe
gatacactttagttgagctggctca

SEQ ID NO: 95842 - DNA, 25 bp, S. pombe
gatagttccagcattgagtaccaca

SEQ ID NO: 95843 - DNA, 25 bp, S. pombe
gatcaacgatttttgtggcttccaa

SEQ ID NO: 95844 - DNA, 25 bp, S. pombe
gatcaagctgtttttgctccattcg

SEQ ID NO: 95845 - DNA, 25 bp, S. pombe
gataacttcattttccctagtgacg

SEQ ID NO: 95846 - DNA, 25 bp, S. pombe
gataatctgtcgaagtcgtctgact

SEQ ID NO: 95847 - DNA, 25 bp, S. pombe
gatagtgtgcctcaatggacttctt

SEQ ID NO: 95848 - DNA, 25 bp, S. pombe
gatactattggtctcgaatctgctg

SEQ ID NO: 95849 - DNA, 25 bp, S. pombe
gatcaagccgctcgtcaagaagaca

SEQ ID NO: 95850 - DNA, 25 bp, S. pombe
gatacagttgtaatacccttcgcaa

SEQ ID NO: 95851 - DNA, 25 bp, S. pombe
gataccagtttttccaataccacac

SEQ ID NO: 95852 - DNA, 25 bp, S. pombe
gataaactctagctccagcatgtcc

SEQ ID NO: 95853 - DNA, 25 bp, S. pombe
gataatgtattcatccatgccgtcc

SEQ ID NO: 95854 - DNA, 25 bp, S. pombe
gataattttcatctaccgttgcaaa

SEQ ID NO: 95855 - DNA, 25 bp, S. pombe
gataattccaacgatacctccttga

SEQ ID NO: 95856 - DNA, 25 bp, S. pombe
gatcaatgtaaagttcccggctata

SEQ ID NO: 95857 - DNA, 25 bp, S. pombe
gatcaaggtcaacttctccggctaa

SEQ ID NO: 95858 - DNA, 25 bp, S. pombe
gatacgaccaaatttcgcggctaca

SEQ ID NO: 95859 - DNA, 25 bp, S. pombe
gataccaactaataatgcgtgtaca

SEQ ID NO: 95860 - DNA, 25 bp, S. pombe
gataacggcctttcgtgtgaaacac

SEQ ID NO: 95861 - DNA, 25 bp, S. pombe
gataagcgcaccaaagtcactagaa

SEQ ID NO: 95862 - DNA, 25 bp, S. pombe
gataattctaaaactcctcgttcaa

SEQ ID NO: 95863 - DNA, 25 bp, S. pombe
gataatccttgatcctagtcgtcaa

SEQ ID NO: 95864 - DNA, 25 bp, S. pombe
gatacatcctcttccgtaaattcta

SEQ ID NO: 95865 - DNA, 25 bp, S. pombe
gatagattacgctactccacatatt

SEQ ID NO: 95866 - DNA, 25 bp, S. pombe
gatacacttacttcagagcaccgtt

SEQ ID NO: 95867 - DNA, 25 bp, S. pombe
gatacttattattatggttctacta

SEQ ID NO: 95868 - DNA, 25 bp, S. pombe
gataggctcttttttgtttcctgca

SEQ ID NO: 95869 - DNA, 25 bp, S. pombe
gatacatccttgcttttttcagctg

SEQ ID NO: 95870 - DNA, 25 bp, S. pombe
gatactaattccattctttacgccg

SEQ ID NO: 95871 - DNA, 25 bp, S. pombe
gataataatcttggctcctctttac

SEQ ID NO: 95872 - DNA, 25 bp, S. pombe
gataatattgcaacttcctcattta

SEQ ID NO: 95873 - DNA, 25 bp, S. pombe
gataatctcctggttcctcaagtaa

SEQ ID NO: 95874 - DNA, 25 bp, S. pombe
gataatctcatagctaatctccgaa

SEQ ID NO: 95875 - DNA, 25 bp, S. pombe
gatagtccattgataattcccgaaa

SEQ ID NO: 95876 - DNA, 25 bp, S. pombe
gataaccttgtttttccatctggaa

SEQ ID NO: 95877 - DNA, 25 bp, S. pombe
gataacttctggagcatcatcacaa

SEQ ID NO: 95878 - DNA, 25 bp, S. pombe
gataagcttcgtctatatgcactaa

SEQ ID NO: 95879 - DNA, 25 bp, S. pombe
gatacagaatgcgtcaaaaccttga

SEQ ID NO: 95880 - DNA, 25 bp, S. pombe
gatacgatcagcttcagcaaaccta

SEQ ID NO: 95881 - DNA, 25 bp, S. pombe
gatatggtagcctcagaaccgctta

SEQ ID NO: 95882 - DNA, 25 bp, S. pombe
gtacggttcgacttatattgttagc

SEQ ID NO: 95883 - DNA, 25 bp, S. pombe
gatactgctttttaccaacttttat

SEQ ID NO: 95884 - DNA, 25 bp, S. pombe
gataactgtgctatctgcagaaatc

SEQ ID NO: 95885 - DNA, 25 bp, S. pombe
gataaggagcatgccatacctatgg

SEQ ID NO: 95886 - DNA, 25 bp, S. pombe
gataaatatgcagccatcccttgcg

SEQ ID NO: 95887 - DNA, 25 bp, S. pombe
gataactctacttatccctatgctg

SEQ ID NO: 95888 - DNA, 25 bp, S. pombe
gatactatggcaacaccgaggctct

SEQ ID NO: 95889 - DNA, 25 bp, S. pombe
gatacgtgaagatgctcgcgaagct

SEQ ID NO: 95890 - DNA, 25 bp, S. pombe
gatagcatggaacacatccgaagca

SEQ ID NO: 95891 - DNA, 25 bp, S. pombe
gataatgaagcctcacactactctc

SEQ ID NO: 95892 - DNA, 25 bp, S. pombe
gataagcgatcaaagcatctcaaaa

SEQ ID NO: 95893 - DNA, 25 bp, S. pombe
gataagtctatcaagcccaagccat

SEQ ID NO: 95894 - DNA, 25 bp, S. pombe
gatatttccaagttccttgacgctc

SEQ ID NO: 95895 - DNA, 25 bp, S. pombe
gatattattatgcacccttggttcc

SEQ ID NO: 95896 - DNA, 25 bp, S. pombe
gataacttcatcaccttttaatccc

SEQ ID NO: 95897 - DNA, 25 bp, S. pombe
gataaggcatcatcttccatcataa

SEQ ID NO: 95898 - DNA, 25 bp, S. pombe
gataagcgcatttctcatgtctcat

SEQ ID NO: 95899 - DNA, 25 bp, S. pombe
gataacgatttgcattgtcattcca

SEQ ID NO: 95900 - DNA, 25 bp, S. pombe
gataacgatttaaatgtctcctcag

SEQ ID NO: 95901 - DNA, 25 bp, S. pombe
gataacgcaattgccatggctccat

SEQ ID NO: 95902 - DNA, 25 bp, S. pombe
gatagcaagcacactgctcatggcc

SEQ ID NO: 95903 - DNA, 25 bp, S. pombe
gatactacatatgtggcacccgctt

SEQ ID NO: 95904 - DNA, 25 bp, S. pombe
gataccctatttcgacgacgcttta

SEQ ID NO: 95905 - DNA, 25 bp, S. pombe
gatacatcgtacttggaaccctatt

SEQ ID NO: 95906 - DNA, 25 bp, S. pombe
gattactggacctcatggaacactt

SEQ ID NO: 95907 - DNA, 25 bp, S. pombe
gtaccagcgggagacctagttcagt

SEQ ID NO: 95908 - DNA, 25 bp, S. pombe
gtgaccaaaggtacccactttcaag

SEQ ID NO: 95909 - DNA, 25 bp, S. pombe
gataagatcaacttctccgttttcc

SEQ ID NO: 95910 - DNA, 25 bp, S. pombe
gataatgatgcttctacctccgctt

SEQ ID NO: 95911 - DNA, 25 bp, S. pombe
gataatgtccatgatccagctgcct

SEQ ID NO: 95912 - DNA, 25 bp, S. pombe
gatactaccgattcctctttttgta

SEQ ID NO: 95913 - DNA, 25 bp, S. pombe
gatactacggtaacgctttcgatgt

SEQ ID NO: 95914 - DNA, 25 bp, S. pombe
gataaagtacgacgtttgcgctcaa

SEQ ID NO: 95915 - DNA, 25 bp, S. pombe
gatacattgttccaggtcttggcga

SEQ ID NO: 95916 - DNA, 25 bp, S. pombe
gataagttccacaagctgtacgcaa

SEQ ID NO: 95917 - DNA, 25 bp, S. pombe
gatagtagctccaatagcccatctg

SEQ ID NO: 95918 - DNA, 25 bp, S. pombe
gatacattcaccaagtttgcggctt

SEQ ID NO: 95919 - DNA, 25 bp, S. pombe
gatacattcataccacttcgagttt

SEQ ID NO: 95920 - DNA, 25 bp, S. pombe
gataccttatctgttatgatcactg

SEQ ID NO: 95921 - DNA, 25 bp, S. pombe
gatactcgccctgataatgatattg

SEQ ID NO: 95922 - DNA, 25 bp, S. pombe
gatactagttctcaaatgccttcag

SEQ ID NO: 95923 - DNA, 25 bp, S. pombe
gatacggtgtctacaaactctgtca

SEQ ID NO: 95924 - DNA, 25 bp, S. pombe
gatatcgggtttctggttctcatgc

SEQ ID NO: 95925 - DNA, 25 bp, S. pombe
gatatcaagggtctcggtctctcag

SEQ ID NO: 95926 - DNA, 25 bp, S. pombe
gatatgcattggctttcgggtccaa

SEQ ID NO: 95927 - DNA, 25 bp, S. pombe
gatacatctttccttttggaccaca

SEQ ID NO: 95928 - DNA, 25 bp, S. pombe
gatacattaatggttcttcgcacac

SEQ ID NO: 95929 - DNA, 25 bp, S. pombe
gatacattaatcgtttctgggcctt

SEQ ID NO: 95930 - DNA, 25 bp, S. pombe
gatacctcctattaatttcattttc

SEQ ID NO: 95931 - DNA, 25 bp, S. pombe
gatagcggtctttttgcttctttga

SEQ ID NO: 95932 - DNA, 25 bp, S. pombe
gatacctttagatcctagcatgcgg

SEQ ID NO: 95933 - DNA, 25 bp, S. pombe
gatagctccgttttcctaagagcgt

SEQ ID NO: 95934 - DNA, 25 bp, S. pombe
gatagacaggtatttgttcagctaa

SEQ ID NO: 95935 - DNA, 25 bp, S. pombe
gataccctggtgtttccagtcttga

SEQ ID NO: 95936 - DNA, 25 bp, S. pombe
gatatgggaactggtgtcccctttc

SEQ ID NO: 95937 - DNA, 25 bp, S. pombe
gttctaagccttctccggaataaag

SEQ ID NO: 95938 - DNA, 25 bp, S. pombe
gttcaaaccattctccgggaaacat

SEQ ID NO: 95939 - DNA, 25 bp, S. pombe
gataccgcattctctagctacgaaa

SEQ ID NO: 95940 - DNA, 25 bp, S. pombe
gataacgttgtttctgctcagtgca

SEQ ID NO: 95941 - DNA, 25 bp, S. pombe
gataacagttccctcattgcggata

SEQ ID NO: 95942 - DNA, 25 bp, S. pombe
gataaatttctcttgcttcttgcta

SEQ ID NO: 95943 - DNA, 25 bp, S. pombe
gataaatatttccttgtcggtcatg

SEQ ID NO: 95944 - DNA, 25 bp, S. pombe
gatatggatcttgtttgccgagccc

SEQ ID NO: 95945 - DNA, 25 bp, S. pombe
gataaacaagatacggcctccaagg

SEQ ID NO: 95946 - DNA, 25 bp, S. pombe
gatattcctaaattttccgcacctc

SEQ ID NO: 95947 - DNA, 25 bp, S. pombe
gataccaacagcgttcattccaatg

SEQ ID NO: 95948 - DNA, 25 bp, S. pombe
gatacaccccaaatgattgccgaga

SEQ ID NO: 95949 - DNA, 25 bp, S. pombe
gatacatttccggattctagcagag

SEQ ID NO: 95950 - DNA, 25 bp, S. pombe
gatacacctccggattggaagtggt

SEQ ID NO: 95951 - DNA, 25 bp, S. pombe
gatatacctcgctttctgtacagta

SEQ ID NO: 95952 - DNA, 25 bp, S. pombe
gatatatcagctgtgttgccggtat

SEQ ID NO: 95953 - DNA, 25 bp, S. pombe
gatacatcatttcgtgagcctttat

SEQ ID NO: 95954 - DNA, 25 bp, S. pombe
gatacatcatttgctaccattggtg

SEQ ID NO: 95955 - DNA, 25 bp, S. pombe
gataacttatctacacagtctcgaa

SEQ ID NO: 95956 - DNA, 25 bp, S. pombe
gatacagcacaatgcgcgaatttag

SEQ ID NO: 95957 - DNA, 25 bp, S. pombe
gataacaattcacctccttcaaatt

SEQ ID NO: 95958 - DNA, 25 bp, S. pombe
gataacattgctcactcacttgata

SEQ ID NO: 95959 - DNA, 25 bp, S. pombe
gatacgatatgcctactcctggaga

SEQ ID NO: 95960 - DNA, 25 bp, S. pombe
gataccatcgaagcctcggatgcta

SEQ ID NO: 95961 - DNA, 25 bp, S. pombe
gatacttgggcatctccagctgaga

SEQ ID NO: 95962 - DNA, 25 bp, S. pombe
gatatatggatgcttcccgtacgcc

SEQ ID NO: 95963 - DNA, 25 bp, S. pombe
gatatgccgtactgacgcgtgaaga

SEQ ID NO: 95964 - DNA, 25 bp, S. pombe
gatatcggcgacgatgactccaggt

SEQ ID NO: 95965 - DNA, 25 bp, S. pombe
gatacacatgtttgacgaccacagg

SEQ ID NO: 95966 - DNA, 25 bp, S. pombe
gatacacaatcatttcccgaagcaa

SEQ ID NO: 95967 - DNA, 25 bp, S. pombe
gataaagcatcttatcccgagcctt

SEQ ID NO: 95968 - DNA, 25 bp, S. pombe
gataaatcactctcacttgaacctc

SEQ ID NO: 95969 - DNA, 25 bp, S. pombe
gatacagaagtaccttcctctggca

SEQ ID NO: 95970 - DNA, 25 bp, S. pombe
gatacaagcaatgtttctccatgtt

SEQ ID NO: 95971 - DNA, 25 bp, S. pombe
gatacgaaatggattgtgcctctat

SEQ ID NO: 95972 - DNA, 25 bp, S. pombe
gatacgtttactccttcttcaattt

SEQ ID NO: 95973 - DNA, 25 bp, S. pombe
gatacgactgtcattgctccttact

SEQ ID NO: 95974 - DNA, 25 bp, S. pombe
gataccaatctttgcgctatccatg

SEQ ID NO: 95975 - DNA, 25 bp, S. pombe
gatatctggcagtgcttctcaggtc

SEQ ID NO: 95976 - DNA, 25 bp, S. pombe
gatactacagatgctttcgctccat

SEQ ID NO: 95977 - DNA, 25 bp, S. pombe
gataaatcgtttcatcgctccagat

SEQ ID NO: 95978 - DNA, 25 bp, S. pombe
gatagcagacacatcgttacggata

SEQ ID NO: 95979 - DNA, 25 bp, S. pombe
gatactgctccagcgtctagtggaa

SEQ ID NO: 95980 - DNA, 25 bp, S. pombe
gatactcccaatgctggtcgtcaaa

SEQ ID NO: 95981 - DNA, 25 bp, S. pombe
gatacttcacgtgcggttatccgag

SEQ ID NO: 95982 - DNA, 25 bp, S. pombe
gatattccaacttcggtatcccgtt

SEQ ID NO: 95983 - DNA, 25 bp, S. pombe
gatacttcttatagctatgtctcag

SEQ ID NO: 95984 - DNA, 25 bp, S. pombe
gatacaattgctcgtgcaacccgta

SEQ ID NO: 95985 - DNA, 25 bp, S. pombe
gatacatcgtctcgtagcagcacac

SEQ ID NO: 95986 - DNA, 25 bp, S. pombe
gattctggtgctcgctgaggatcaa

SEQ ID NO: 95987 - DNA, 25 bp, S. pombe
gatactgccggtgttactgcttctt

SEQ ID NO: 95988 - DNA, 25 bp, S. pombe
gatagtcctattggcttactgcttt

SEQ ID NO: 95989 - DNA, 25 bp, S. pombe
gatatggctgccctgaaaaagttca

SEQ ID NO: 95990 - DNA, 25 bp, S. pombe
gatatggaccaagctcaacgtgata

SEQ ID NO: 95991 - DNA, 25 bp, S. pombe
gatacgatccagagtcaacagctat

SEQ ID NO: 95992 - DNA, 25 bp, S. pombe
gatacttccgtattgcaagagcaat

SEQ ID NO: 95993 - DNA, 25 bp, S. pombe
gatagagtgactgatgctttcaaac

SEQ ID NO: 95994 - DNA, 25 bp, S. pombe
gatagcaaactctcatgttcaaagt

SEQ ID NO: 95995 - DNA, 25 bp, S. pombe
gatacacatatccaacagtttgcag

SEQ ID NO: 95996 - DNA, 25 bp, S. pombe
gatactttacattctgtttcggctg

SEQ ID NO: 95997 - DNA, 25 bp, S. pombe
gattcttttaatcggcttgcggtga

SEQ ID NO: 95998 - DNA, 25 bp, S. pombe
gatagtttggatccgttttctgagg

SEQ ID NO: 95999 - DNA, 25 bp, S. pombe
gatagcttaggtgccattgtatata

SEQ ID NO: 96000 - DNA, 25 bp, S. pombe
gatagtggtaatcctttttgccttt

SEQ ID NO: 96001 - DNA, 25 bp, S. pombe
gatagtttagacatttcaccctttg

SEQ ID NO: 96002 - DNA, 25 bp, S. pombe
gataccgaaagtctgtaccagcaca

SEQ ID NO: 96003 - DNA, 25 bp, S. pombe
gataccgttacgattactccagcaa

SEQ ID NO: 96004 - DNA, 25 bp, S. pombe
gatagctctacgtggttattcttaa

SEQ ID NO: 96005 - DNA, 25 bp, S. pombe
gatactccaccagttttaatgctta

SEQ ID NO: 96006 - DNA, 25 bp, S. pombe
gatactccatctcttcatcaattgg

SEQ ID NO: 96007 - DNA, 25 bp, S. pombe
gatacttctcctgctggtataaact

SEQ ID NO: 96008 - DNA, 25 bp, S. pombe
gatatcgtgtctacattaggcaatg

SEQ ID NO: 96009 - DNA, 25 bp, S. pombe
gataccgatatctacaccgattacc

SEQ ID NO: 96010 - DNA, 25 bp, S. pombe
gatactaatcactcttctcattcgt

SEQ ID NO: 96011 - DNA, 25 bp, S. pombe
gatacttcatcacttgctacgttgg

SEQ ID NO: 96012 - DNA, 25 bp, S. pombe
gatactatgcgctacattactgaag

SEQ ID NO: 96013 - DNA, 25 bp, S. pombe
gatacgatcgcatcttggttgcagt

SEQ ID NO: 96014 - DNA, 25 bp, S. pombe
gatatcacatcctacttatactgag

SEQ ID NO: 96015 - DNA, 25 bp, S. pombe
gatagcaaatcacctaatgccgcag

SEQ ID NO: 96016 - DNA, 25 bp, S. pombe
gattcaaactgtgagcatgctagat

SEQ ID NO: 96017 - DNA, 25 bp, S. pombe
gatatcacaaatgctgacgcctctg

SEQ ID NO: 96018 - DNA, 25 bp, S. pombe
gatagcaaattagttcccgctgaag

SEQ ID NO: 96019 - DNA, 25 bp, S. pombe
gatatccttttttccgctgtgaaga

SEQ ID NO: 96020 - DNA, 25 bp, S. pombe
gatactttttattactgctctggaa

SEQ ID NO: 96021 - DNA, 25 bp, S. pombe
gatactgttcttatcaaccgtgcaa

SEQ ID NO: 96022 - DNA, 25 bp, S. pombe
gatagcatgggcttgagtcccctta

SEQ ID NO: 96023 - DNA, 25 bp, S. pombe
gatattatagtagtgccgcctgcat

SEQ ID NO: 96024 - DNA, 25 bp, S. pombe
gatagctccatccataaacattcac

SEQ ID NO: 96025 - DNA, 25 bp, S. pombe
gatagctgaatctttagcctctcaa

SEQ ID NO: 96026 - DNA, 25 bp, S. pombe
gatagctaaacctgctcctgcgaat

SEQ ID NO: 96027 - DNA, 25 bp, S. pombe
gatagtaaaccgtcaactcgcacat

SEQ ID NO: 96028 - DNA, 25 bp, S. pombe
gataccaatcccagtgatgctcgaa

SEQ ID NO: 96029 - DNA, 25 bp, S. pombe
gattatcttctttctcaagggcggt

SEQ ID NO: 96030 - DNA, 25 bp, S. pombe
gatatagcctatacgtacagcgggt

SEQ ID NO: 96031 - DNA, 25 bp, S. pombe
gatatctgcgctagatcgtgaatca

SEQ ID NO: 96032 - DNA, 25 bp, S. pombe
gatagcacagctcgacggacacaaa

SEQ ID NO: 96033 - DNA, 25 bp, S. pombe
gatatgccactatgtgcgatgctga

SEQ ID NO: 96034 - DNA, 25 bp, S. pombe
gttcggccgtgttggagtaagtatc

SEQ ID NO: 96035 - DNA, 25 bp, S. pombe
gatatcttagccatacgaccaattg

SEQ ID NO: 96036 - DNA, 25 bp, S. pombe
gatacgtaccacttcaagccatgtt

SEQ ID NO: 96037 - DNA, 25 bp, S. pombe
gataccttcaatgctgatcaagtgg

SEQ ID NO: 96038 - DNA, 25 bp, S. pombe
gatacctcctttttgccagatgcag

SEQ ID NO: 96039 - DNA, 25 bp, S. pombe
gatacctccttgattactgtaccag

SEQ ID NO: 96040 - DNA, 25 bp, S. pombe
gatacctctttgacgtcagttactg

SEQ ID NO: 96041 - DNA, 25 bp, S. pombe
gatatcctgttgttttagattcacg

SEQ ID NO: 96042 - DNA, 25 bp, S. pombe
gataccgttgatattattcgtgcgt

SEQ ID NO: 96043 - DNA, 25 bp, S. pombe
gatactcttgggattttggcttgtt

SEQ ID NO: 96044 - DNA, 25 bp, S. pombe
gataccattgtcttggctttggctt

SEQ ID NO: 96045 - DNA, 25 bp, S. pombe
gtatgctcttacttggacttggcta

SEQ ID NO: 96046 - DNA, 25 bp, S. pombe
gatatgcaggagaccggactttatt

SEQ ID NO: 96047 - DNA, 25 bp, S. pombe
gatatcacggaccacagagcggtat

SEQ ID NO: 96048 - DNA, 25 bp, S. pombe
gatactgcgcttaattgcgtcaagc

SEQ ID NO: 96049 - DNA, 25 bp, S. pombe
gatactccttatttcaatgctggct

SEQ ID NO: 96050 - DNA, 25 bp, S. pombe
gatatccccagcgttagaaccaaac

SEQ ID NO: 96051 - DNA, 25 bp, S. pombe
gatatcgcttatttgaatgtaccac

SEQ ID NO: 96052 - DNA, 25 bp, S. pombe
gatatcgttaaccaagttgctgctc

SEQ ID NO: 96053 - DNA, 25 bp, S. pombe
gattagtttgctcgtaggttgccca

SEQ ID NO: 96054 - DNA, 25 bp, S. pombe
gatataattccttgtaggctccctg

SEQ ID NO: 96055 - DNA, 25 bp, S. pombe
gatatggtccttgctactgtgaaga

SEQ ID NO: 96056 - DNA, 25 bp, S. pombe
gatagtgtcgcctccaactacagag

SEQ ID NO: 96057 - DNA, 25 bp, S. pombe
gatagttaatcttccatactccaaa

SEQ ID NO: 96058 - DNA, 25 bp, S. pombe
gatatgatttgtacgcggctgctga

SEQ ID NO: 96059 - DNA, 25 bp, S. pombe
gatatgatcttcttcgacatcgctc

SEQ ID NO: 96060 - DNA, 25 bp, S. pombe
gatattgctgtcctcaaacgcttaa

SEQ ID NO: 96061 - DNA, 25 bp, S. pombe
gatacgctgcacgattccaaagaga

SEQ ID NO: 96062 - DNA, 25 bp, S. pombe
gatagcctgtcccttttatcaaagt

SEQ ID NO: 96063 - DNA, 25 bp, S. pombe
gatagctcttcttcttataaccaag

SEQ ID NO: 96064 - DNA, 25 bp, S. pombe
gatagcattctttttcactcaaaca

SEQ ID NO: 96065 - DNA, 25 bp, S. pombe
gatttggcttgctttgcctaaattc

SEQ ID NO: 96066 - DNA, 25 bp, S. pombe
gatatcaactgtcgtgtagtcacta

SEQ ID NO: 96067 - DNA, 25 bp, S. pombe
gatattgaagatctgttcagcatta

SEQ ID NO: 96068 - DNA, 25 bp, S. pombe
gataccgattgacgatgtctcccat

SEQ ID NO: 96069 - DNA, 25 bp, S. pombe
gatagcaagtcaagccttcttctag

SEQ ID NO: 96070 - DNA, 25 bp, S. pombe
gatacctcgcattggttgctttatg

SEQ ID NO: 96071 - DNA, 25 bp, S. pombe
gatatgctgtcgttgcttttcttag

SEQ ID NO: 96072 - DNA, 25 bp, S. pombe
gatatagcacttcccgatgttgcga

SEQ ID NO: 96073 - DNA, 25 bp, S. pombe
gatatacctcggcttatcgtcgaaa

SEQ ID NO: 96074 - DNA, 25 bp, S. pombe
gtaccttcagggtttgcagctcaag

SEQ ID NO: 96075 - DNA, 25 bp, S. pombe
gatacctctcgcgaatattactcaa

SEQ ID NO: 96076 - DNA, 25 bp, S. pombe
gatacctccgatcagcttgaatcat

SEQ ID NO: 96077 - DNA, 25 bp, S. pombe
gataccattcttggatcctacctat

SEQ ID NO: 96078 - DNA, 25 bp, S. pombe
gatacggattatgcgttcactccat

SEQ ID NO: 96079 - DNA, 25 bp, S. pombe
gatatcgctttagcagcttctcaaa

SEQ ID NO: 96080 - DNA, 25 bp, S. pombe
gattactttaagatttcccgagcaa

SEQ ID NO: 96081 - DNA, 25 bp, S. pombe
gatttgctcgtaaagtcttacccca

SEQ ID NO: 96082 - DNA, 25 bp, S. pombe
gatatggcctataaagctctttcgc

SEQ ID NO: 96083 - DNA, 25 bp, S. pombe
gatagctcttgtgatgttccacttc

SEQ ID NO: 96084 - DNA, 25 bp, S. pombe
gatatcgtcttttctgatgatccaa

SEQ ID NO: 96085 - DNA, 25 bp, S. pombe
gataccttgtattcttgcatccgaa

SEQ ID NO: 96086 - DNA, 25 bp, S. pombe
gataggccctactattactgggtgg

SEQ ID NO: 96087 - DNA, 25 bp, S. pombe
gatagttcctacttctacatgcact

SEQ ID NO: 96088 - DNA, 25 bp, S. pombe
gatagtaactactctactcatgtat

SEQ ID NO: 96089 - DNA, 25 bp, S. pombe
gatatgttactttctttgccagctg

SEQ ID NO: 96090 - DNA, 25 bp, S. pombe
gatagaatcacggttgtctccccaa

SEQ ID NO: 96091 - DNA, 25 bp, S. pombe
gatatatttagttattcattcccaa

SEQ ID NO: 96092 - DNA, 25 bp, S. pombe
gatatcaaccctcaacagtacgaac

SEQ ID NO: 96093 - DNA, 25 bp, S. pombe
gatatgaagtttgaccctactgcaa

SEQ ID NO: 96094 - DNA, 25 bp, S. pombe
gatatattttagacaccggtgccgc

SEQ ID NO: 96095 - DNA, 25 bp, S. pombe
gatatgttcttcatcaccagcaggt

SEQ ID NO: 96096 - DNA, 25 bp, S. pombe
gatattcgtgtttcacagctcagag

SEQ ID NO: 96097 - DNA, 25 bp, S. pombe
gatttgactgttcgtaccgttacta

SEQ ID NO: 96098 - DNA, 25 bp, S. pombe
gatttggctgccttgggtttcgact

SEQ ID NO: 96099 - DNA, 25 bp, S. pombe
gatttggtaattcactttgctggat

SEQ ID NO: 96100 - DNA, 25 bp, S. pombe
gataccgatggaattgatccgcaaa

SEQ ID NO: 96101 - DNA, 25 bp, S. pombe
gataggtgccttaacttcaaccaca

SEQ ID NO: 96102 - DNA, 25 bp, S. pombe
gatttccctagtatcctaagtacca

SEQ ID NO: 96103 - DNA, 25 bp, S. pombe
gatatcccataacccaactcaatgt

SEQ ID NO: 96104 - DNA, 25 bp, S. pombe
gatacccatcttccaaaaacagtgt

SEQ ID NO: 96105 - DNA, 25 bp, S. pombe
gataccgcttacacactagttcgag

SEQ ID NO: 96106 - DNA, 25 bp, S. pombe
gatacgcctcttaatacttctagtt

SEQ ID NO: 96107 - DNA, 25 bp, S. pombe
gatagacctttgactcctttttcat

SEQ ID NO: 96108 - DNA, 25 bp, S. pombe
gatatcacctgtcttgttgttcgtc

SEQ ID NO: 96109 - DNA, 25 bp, S. pombe
gatatgcaccgtaccattctttatg

SEQ ID NO: 96110 - DNA, 25 bp, S. pombe
gatacctctctcagttctgtttgaa

SEQ ID NO: 96111 - DNA, 25 bp, S. pombe
gatagaaactcttcgcatgctcttt

SEQ ID NO: 96112 - DNA, 25 bp, S. pombe
gatatcgaatatatgcctcctcctg

SEQ ID NO: 96113 - DNA, 25 bp, S. pombe
gatagtattccattcaattgcccat

SEQ ID NO: 96114 - DNA, 25 bp, S. pombe
gatagcatttcttttcaatcacctc

SEQ ID NO: 96115 - DNA, 25 bp, S. pombe
gatattttcaaaaaggtcgtcaata

SEQ ID NO: 96116 - DNA, 25 bp, S. pombe
gatattttgtttgaggacgttcctg

SEQ ID NO: 96117 - DNA, 25 bp, S. pombe
gttgttaaccgagccatcactgaat

SEQ ID NO: 96118 - DNA, 25 bp, S. pombe
gatttcgagccggttttcttgaatg

SEQ ID NO: 96119 - DNA, 25 bp, S. pombe
gatatatccaccagttttgccttta

SEQ ID NO: 96120 - DNA, 25 bp, S. pombe
gatttggaagattggctcggctcag

SEQ ID NO: 96121 - DNA, 25 bp, S. pombe
gatattggtgtctacttcgaggcaa

SEQ ID NO: 96122 - DNA, 25 bp, S. pombe
gatagccttagagaccattgcgact

SEQ ID NO: 96123 - DNA, 25 bp, S. pombe
gatagctttgttcttttgttccagg

SEQ ID NO: 96124 - DNA, 25 bp, S. pombe
gatatatcttctactgcaagttcga

SEQ ID NO: 96125 - DNA, 25 bp, S. pombe
gatatcccacctgagatggttttag

SEQ ID NO: 96126 - DNA, 25 bp, S. pombe
gatatgagcccatttattgatgact

SEQ ID NO: 96127 - DNA, 25 bp, S. pombe
gataggcctccaatttcagaattag

SEQ ID NO: 96128 - DNA, 25 bp, S. pombe
gatatatcctctctttcaaatttgt

SEQ ID NO: 96129 - DNA, 25 bp, S. pombe
gattatctgcgtctggaaagtctac

SEQ ID NO: 96130 - DNA, 25 bp, S. pombe
gatttcggtagttcgagccttacga

SEQ ID NO: 96131 - DNA, 25 bp, S. pombe
gatttccgtagagcagacccgtagg

SEQ ID NO: 96132 - DNA, 25 bp, S. pombe
gttccaacagggttcctgtacagga

SEQ ID NO: 96133 - DNA, 25 bp, S. pombe
gatagttctaacctccagactgata

SEQ ID NO: 96134 - DNA, 25 bp, S. pombe
gatattgccatggagcgcggccaaa

SEQ ID NO: 96135 - DNA, 25 bp, S. pombe
gatattccagagcatcgcatgagca

SEQ ID NO: 96136 - DNA, 25 bp, S. pombe
gatttcagcagatagcgttcgttat

SEQ ID NO: 96137 - DNA, 25 bp, S. pombe
gatttggctgactggacactcatta

SEQ ID NO: 96138 - DNA, 25 bp, S. pombe
gatttggtgactgtatggcgcattc

SEQ ID NO: 96139 - DNA, 25 bp, S. pombe
gatattcttccccttgtcaaaaagg

SEQ ID NO: 96140 - DNA, 25 bp, S. pombe
gatatcactaaccataactcttttg

SEQ ID NO: 96141 - DNA, 25 bp, S. pombe
gatagtgcttccgagacatgctctt

SEQ ID NO: 96142 - DNA, 25 bp, S. pombe
gatagctttcgcaaacatttccgtg

SEQ ID NO: 96143 - DNA, 25 bp, S. pombe
gatagttgtgttgccattcatccta

SEQ ID NO: 96144 - DNA, 25 bp, S. pombe
gatagtgcttttggctttagcgcca

SEQ ID NO: 96145 - DNA, 25 bp, S. pombe
gatatgtgcttgacccatgtagggc

SEQ ID NO: 96146 - DNA, 25 bp, S. pombe
gatttgttgtccaagctcgagcctc

SEQ ID NO: 96147 - DNA, 25 bp, S. pombe
gatatctttgatgctttccaactag

SEQ ID NO: 96148 - DNA, 25 bp, S. pombe
gatatctattttcctcttgcaacat

SEQ ID NO: 96149 - DNA, 25 bp, S. pombe
gatatctcgatcatctatgccgaac

SEQ ID NO: 96150 - DNA, 25 bp, S. pombe
gatatatcgaccctacgttcagtac

SEQ ID NO: 96151 - DNA, 25 bp, S. pombe
gatatgtctaagttttctctgggaa

SEQ ID NO: 96152 - DNA, 25 bp, S. pombe
gatatgtttaagacttccgcagaag

SEQ ID NO: 96153 - DNA, 25 bp, S. pombe
gatagtttctccaaggcattgtgta

SEQ ID NO: 96154 - DNA, 25 bp, S. pombe
gatttgactctttatcgggaaactt

SEQ ID NO: 96155 - DNA, 25 bp, S. pombe
gatttggtcttggtcgtagggttca

SEQ ID NO: 96156 - DNA, 25 bp, S. pombe
gatatgcttttcgatccatgtgtct

SEQ ID NO: 96157 - DNA, 25 bp, S. pombe
gatagtgccgtcaatgccatttgct

SEQ ID NO: 96158 - DNA, 25 bp, S. pombe
gatttccggaactcgctatgatagc

SEQ ID NO: 96159 - DNA, 25 bp, S. pombe
gatttggccagtgatgcgtactttt

SEQ ID NO: 96160 - DNA, 25 bp, S. pombe
gatatcaatcgcatagctgaccgta

SEQ ID NO: 96161 - DNA, 25 bp, S. pombe
gatatctcgttgttgaatgctccta

SEQ ID NO: 96162 - DNA, 25 bp, S. pombe
gatatgccagtttccaatgctcgga

SEQ ID NO: 96163 - DNA, 25 bp, S. pombe
gatatatcttcttcatggcgacaaa

SEQ ID NO: 96164 - DNA, 25 bp, S. pombe
gatatggctcttacttctgatggaa

SEQ ID NO: 96165 - DNA, 25 bp, S. pombe
gatattgaagcaactgggccacgtg

SEQ ID NO: 96166 - DNA, 25 bp, S. pombe
gatatcatgaaaacgagacctccta

SEQ ID NO: 96167 - DNA, 25 bp, S. pombe
gatattacaaaccagacctcaccat

SEQ ID NO: 96168 - DNA, 25 bp, S. pombe
gatttatcaagcaggaggcgcacct

SEQ ID NO: 96169 - DNA, 25 bp, S. pombe
gatttgcagaacacatgccagcgcc

SEQ ID NO: 96170 - DNA, 25 bp, S. pombe
gatattgcagctttgaaggatccac

SEQ ID NO: 96171 - DNA, 25 bp, S. pombe
gatattcaggtattgtccgccagtc

SEQ ID NO: 96172 - DNA, 25 bp, S. pombe
gatattcagcacatagctccaccag

SEQ ID NO: 96173 - DNA, 25 bp, S. pombe
gatatacttcaaaatctctctgcga

SEQ ID NO: 96174 - DNA, 25 bp, S. pombe
gatatggcttacacttctgactgta

SEQ ID NO: 96175 - DNA, 25 bp, S. pombe
gatattcttcggatgcatggttgct

SEQ ID NO: 96176 - DNA, 25 bp, S. pombe
gatatcttgctgctccaattgtgat

SEQ ID NO: 96177 - DNA, 25 bp, S. pombe
gatatccttgtcagcggttttaact

SEQ ID NO: 96178 - DNA, 25 bp, S. pombe
gatatctttgctcctggttctttaa

SEQ ID NO: 96179 - DNA, 25 bp, S. pombe
gatagattacattatgcgcctgctg

SEQ ID NO: 96180 - DNA, 25 bp, S. pombe
gatatgactccaatgactcctgcag

SEQ ID NO: 96181 - DNA, 25 bp, S. pombe
gatatgataccaatgtccctgcaga

SEQ ID NO: 96182 - DNA, 25 bp, S. pombe
gatatgactcttgaaccccatgatg

SEQ ID NO: 96183 - DNA, 25 bp, S. pombe
gatatgtgcacattcattactctga

SEQ ID NO: 96184 - DNA, 25 bp, S. pombe
gatatggacatgtcttcagccgcac

SEQ ID NO: 96185 - DNA, 25 bp, S. pombe
gatatgaatgtgttgtcagcccaaa

SEQ ID NO: 96186 - DNA, 25 bp, S. pombe
gatatacgaatttccatcagcgacg

SEQ ID NO: 96187 - DNA, 25 bp, S. pombe
gattttaaatcgctacacccattat

SEQ ID NO: 96188 - DNA, 25 bp, S. pombe
gatttgatgttccacttcctcttag

SEQ ID NO: 96189 - DNA, 25 bp, S. pombe
gatttaataggtacaggccgtgcac

SEQ ID NO: 96190 - DNA, 25 bp, S. pombe
gatattcctaacgttcgtcctcaac

SEQ ID NO: 96191 - DNA, 25 bp, S. pombe
gatatttgcactgtttgtcggtaaa

SEQ ID NO: 96192 - DNA, 25 bp, S. pombe
gattatcatagtatctcccggtata

SEQ ID NO: 96193 - DNA, 25 bp, S. pombe
gatatcttctttgcgatccgaacta

SEQ ID NO: 96194 - DNA, 25 bp, S. pombe
gatataattttattgtctctcagag

SEQ ID NO: 96195 - DNA, 25 bp, S. pombe
gatattatctcaaactgtctacaca

SEQ ID NO: 96196 - DNA, 25 bp, S. pombe
gatattactcaagctgcatctctag

SEQ ID NO: 96197 - DNA, 25 bp, S. pombe
gatttcatcggtcctgatggtacct

SEQ ID NO: 96198 - DNA, 25 bp, S. pombe
gatatatcctactctagcgtcaact

SEQ ID NO: 96199 - DNA, 25 bp, S. pombe
gatatatcggtctctatttctggct

SEQ ID NO: 96200 - DNA, 25 bp, S. pombe
gatattccttctgcttttcaggaga

SEQ ID NO: 96201 - DNA, 25 bp, S. pombe
gatattactcctgcatttgtcaacg

SEQ ID NO: 96202 - DNA, 25 bp, S. pombe
gatattatcgccgactttgctcaag

SEQ ID NO: 96203 - DNA, 25 bp, S. pombe
gatttcctcccttatttatagcctt

SEQ ID NO: 96204 - DNA, 25 bp, S. pombe
gatttgaatttctctggcttgcact

SEQ ID NO: 96205 - DNA, 25 bp, S. pombe
gatttgaaatctctaatgtacgcat

SEQ ID NO: 96206 - DNA, 25 bp, S. pombe
gatattgcaagttttaaggcacaag

SEQ ID NO: 96207 - DNA, 25 bp, S. pombe
gatatcttcacttgttaactcgcaa

SEQ ID NO: 96208 - DNA, 25 bp, S. pombe
gatatgacccatccaatgacacgat

SEQ ID NO: 96209 - DNA, 25 bp, S. pombe
gatataccaaggactactcacaaga

SEQ ID NO: 96210 - DNA, 25 bp, S. pombe
gattttgaaaccactgatgccgact

SEQ ID NO: 96211 - DNA, 25 bp, S. pombe
gattactttttagtcgtctcgggat

SEQ ID NO: 96212 - DNA, 25 bp, S. pombe
gatattctttctccacgcgatacat

SEQ ID NO: 96213 - DNA, 25 bp, S. pombe
gatttgttacattttcgcccatcat

SEQ ID NO: 96214 - DNA, 25 bp, S. pombe
gattttccgcaaatggtatctacta

SEQ ID NO: 96215 - DNA, 25 bp, S. pombe
gatttcttcgcaatatggtcttagt

SEQ ID NO: 96216 - DNA, 25 bp, S. pombe
gatattgctgatccttttggtgtag

SEQ ID NO: 96217 - DNA, 25 bp, S. pombe
gatattgctatcattcctggtggtg

SEQ ID NO: 96218 - DNA, 25 bp, S. pombe
gatatgacttctcatcgtgttacga

SEQ ID NO: 96219 - DNA, 25 bp, S. pombe
gatatcttccacctaagcaagctgt

SEQ ID NO: 96220 - DNA, 25 bp, S. pombe
gatttgcggtacaacagccttctaa

SEQ ID NO: 96221 - DNA, 25 bp, S. pombe
gatttccgactgacaactttctaaa

SEQ ID NO: 96222 - DNA, 25 bp, S. pombe
gatattgtcgcgttgaaaactccca

SEQ ID NO: 96223 - DNA, 25 bp, S. pombe
gatatccaagcttccgacagactga

SEQ ID NO: 96224 - DNA, 25 bp, S. pombe
gatatcgatggtctcactacctttg

SEQ ID NO: 96225 - DNA, 25 bp, S. pombe
gatatacttggcttcttgacctttg

SEQ ID NO: 96226 - DNA, 25 bp, S. pombe
gatatcctatgattactcttcctat

SEQ ID NO: 96227 - DNA, 25 bp, S. pombe
gattattcacttttcaaccgggagt

SEQ ID NO: 96228 - DNA, 25 bp, S. pombe
gatttccactacttaacacaggttg

SEQ ID NO: 96229 - DNA, 25 bp, S. pombe
gatatatcttgtcatcctactatgg

SEQ ID NO: 96230 - DNA, 25 bp, S. pombe
gatattgtttttgcatccgacgtgg

SEQ ID NO: 96231 - DNA, 25 bp, S. pombe
gatttgtctaactcttcaacggctg

SEQ ID NO: 96232 - DNA, 25 bp, S. pombe
gatttttaagctcgattcaacgcgg

SEQ ID NO: 96233 - DNA, 25 bp, S. pombe
gatattttgggtcttctacctccaa

SEQ ID NO: 96234 - DNA, 25 bp, S. pombe
gatttaatagccagtgtccaccaac

SEQ ID NO: 96235 - DNA, 25 bp, S. pombe
gatttcaagggcctgagtcctacaa

SEQ ID NO: 96236 - DNA, 25 bp, S. pombe
gatatttgtcatgacgtcctttccg

SEQ ID NO: 96237 - DNA, 25 bp, S. pombe
gatattggcgattgcccattcgaac

SEQ ID NO: 96238 - DNA, 25 bp, S. pombe
gattgatgccgtttcgttggaagaa

SEQ ID NO: 96239 - DNA, 25 bp, S. pombe
gattatatccctcttgagcctttac

SEQ ID NO: 96240 - DNA, 25 bp, S. pombe
gatatttacgtcctagagagagctt

SEQ ID NO: 96241 - DNA, 25 bp, S. pombe
gatatttctgagtctctcatgcaaa

SEQ ID NO: 96242 - DNA, 25 bp, S. pombe
gatattgacgatttcgctgctatga

SEQ ID NO: 96243 - DNA, 25 bp, S. pombe
gatattgtctacgaggctgattgcc

SEQ ID NO: 96244 - DNA, 25 bp, S. pombe
gatattcatggacccgatgctttac

SEQ ID NO: 96245 - DNA, 25 bp, S. pombe
gatatactcattgatcctcttggta

SEQ ID NO: 96246 - DNA, 25 bp, S. pombe
gttatgccagctgacgatttgagta

SEQ ID NO: 96247 - DNA, 25 bp, S. pombe
gttacagcctgtgccatggtggtca

SEQ ID NO: 96248 - DNA, 25 bp, S. pombe
gatttcgatgacgacgcggtttttg

SEQ ID NO: 96249 - DNA, 25 bp, S. pombe
gatttccttaatgactctgtgcttg

SEQ ID NO: 96250 - DNA, 25 bp, S. pombe
gattactttactgacgcggatggga

SEQ ID NO: 96251 - DNA, 25 bp, S. pombe
gattactctgagacgaaggctgtac

SEQ ID NO: 96252 - DNA, 25 bp, S. pombe
gattgtttagacgaagtactcctcc

SEQ ID NO: 96253 - DNA, 25 bp, S. pombe
gattattatcaacaaccctgggtac

SEQ ID NO: 96254 - DNA, 25 bp, S. pombe
gatttgctccaatgccgttaagaat

SEQ ID NO: 96255 - DNA, 25 bp, S. pombe
gatattcctcaatcggatgccaatg

SEQ ID NO: 96256 - DNA, 25 bp, S. pombe
gatattcctgcatccgaagctgaca

SEQ ID NO: 96257 - DNA, 25 bp, S. pombe
gatatttctgcttcgcaaagcgatc

SEQ ID NO: 96258 - DNA, 25 bp, S. pombe
gattacgacctttaaacgatgccaa

SEQ ID NO: 96259 - DNA, 25 bp, S. pombe
gatttggcacattctagatggacga

SEQ ID NO: 96260 - DNA, 25 bp, S. pombe
gattcggcatcatcgcaatgttgaa

SEQ ID NO: 96261 - DNA, 25 bp, S. pombe
gatttaattcgcgatactcagaagg

SEQ ID NO: 96262 - DNA, 25 bp, S. pombe
gattcttgaacgcagattacgccgc

SEQ ID NO: 96263 - DNA, 25 bp, S. pombe
gattccgaatcgaagttacccgcca

SEQ ID NO: 96264 - DNA, 25 bp, S. pombe
gatatctagctcaactttcctttgg

SEQ ID NO: 96265 - DNA, 25 bp, S. pombe
gatatcacccggaaattgctgctat

SEQ ID NO: 96266 - DNA, 25 bp, S. pombe
gatatctttcggacagaactctcaa

SEQ ID NO: 96267 - DNA, 25 bp, S. pombe
gatatctaccagctgatgaacctag

SEQ ID NO: 96268 - DNA, 25 bp, S. pombe
gattgatccggcacttatgcgacca

SEQ ID NO: 96269 - DNA, 25 bp, S. pombe
gattttttgaacttatgcgacctgg

SEQ ID NO: 96270 - DNA, 25 bp, S. pombe
gatttttggaacttacccgtgcctg

SEQ ID NO: 96271 - DNA, 25 bp, S. pombe
gatattgcctgtaagttccctaacg

SEQ ID NO: 96272 - DNA, 25 bp, S. pombe
gatattcccaatgtcacgcatgtta

SEQ ID NO: 96273 - DNA, 25 bp, S. pombe
gatatatttcgctctttctgtcagc

SEQ ID NO: 96274 - DNA, 25 bp, S. pombe
gatttatcgcaagcttataccgggc

SEQ ID NO: 96275 - DNA, 25 bp, S. pombe
gattttgctgaagatggtaccgaac

SEQ ID NO: 96276 - DNA, 25 bp, S. pombe
gatttcgccaaaacaattgctcctt

SEQ ID NO: 96277 - DNA, 25 bp, S. pombe
gatattagcttcttttcttcccatt

SEQ ID NO: 96278 - DNA, 25 bp, S. pombe
gatataagatttattctgatcctga

SEQ ID NO: 96279 - DNA, 25 bp, S. pombe
gttgatattccccaacaacacgcta

SEQ ID NO: 96280 - DNA, 25 bp, S. pombe
gatttgaatctctcaaggaccgcaa

SEQ ID NO: 96281 - DNA, 25 bp, S. pombe
gattcgcaagattccaggtatcccc

SEQ ID NO: 96282 - DNA, 25 bp, S. pombe
gatattaaatttgtctccctcgtcc

SEQ ID NO: 96283 - DNA, 25 bp, S. pombe
gatattattttttcctcctcttcta

SEQ ID NO: 96284 - DNA, 25 bp, S. pombe
gatattcattttaccgtccacctaa

SEQ ID NO: 96285 - DNA, 25 bp, S. pombe
gatattacttctcaagggcttcaaa

SEQ ID NO: 96286 - DNA, 25 bp, S. pombe
gatttggacatttcggttcactgga

SEQ ID NO: 96287 - DNA, 25 bp, S. pombe
gatttgctacttacgtttacttcat

SEQ ID NO: 96288 - DNA, 25 bp, S. pombe
gatttgctggcgattgatttggatt

SEQ ID NO: 96289 - DNA, 25 bp, S. pombe
gatattccggtggtcaaatctcatg

SEQ ID NO: 96290 - DNA, 25 bp, S. pombe
gatattccttgtgtgaaactagctg

SEQ ID NO: 96291 - DNA, 25 bp, S. pombe
gattaccctatgtacgaatttctca

SEQ ID NO: 96292 - DNA, 25 bp, S. pombe
gattaccagcttcatctatggatta

SEQ ID NO: 96293 - DNA, 25 bp, S. pombe
gatttgcaaccacttcaagctgaag

SEQ ID NO: 96294 - DNA, 25 bp, S. pombe
gattactacgttgaatcccttgcaa

SEQ ID NO: 96295 - DNA, 25 bp, S. pombe
gattctgatgaccagtctgaacacg

SEQ ID NO: 96296 - DNA, 25 bp, S. pombe
gattggctcggttttaactcagttc

SEQ ID NO: 96297 - DNA, 25 bp, S. pombe
gatttggccgttgaaactcgcattc

SEQ ID NO: 96298 - DNA, 25 bp, S. pombe
gatttcggatttctgttagctcaac

SEQ ID NO: 96299 - DNA, 25 bp, S. pombe
gatattgcgccatttgattttttga

SEQ ID NO: 96300 - DNA, 25 bp, S. pombe
gatattcccgtttttatcgtcactt

SEQ ID NO: 96301 - DNA, 25 bp, S. pombe
gatattttcttttacttcgtcacgt

SEQ ID NO: 96302 - DNA, 25 bp, S. pombe
gatttccaggatagttctactcaga

SEQ ID NO: 96303 - DNA, 25 bp, S. pombe
gatttccaagatttgagctcctcag

SEQ ID NO: 96304 - DNA, 25 bp, S. pombe
gatttcctaacactttctgcaacaa

SEQ ID NO: 96305 - DNA, 25 bp, S. pombe
gatttgatatcacactattcgctaa

SEQ ID NO: 96306 - DNA, 25 bp, S. pombe
gatattgaaccaactactgcactaa

SEQ ID NO: 96307 - DNA, 25 bp, S. pombe
gatatttagccagtcttggatataa

SEQ ID NO: 96308 - DNA, 25 bp, S. pombe
gatttgattgcctatcttagccgct

SEQ ID NO: 96309 - DNA, 25 bp, S. pombe
gatattgtggcaaagcttcctccca

SEQ ID NO: 96310 - DNA, 25 bp, S. pombe
gattttttcgcttcaattcccttga

SEQ ID NO: 96311 - DNA, 25 bp, S. pombe
gttttgtgttttgccagacccacca

SEQ ID NO: 96312 - DNA, 25 bp, S. pombe
gatttgtctgaagcctctgtttata

SEQ ID NO: 96313 - DNA, 25 bp, S. pombe
gattattatgattacccgcgttatt

SEQ ID NO: 96314 - DNA, 25 bp, S. pombe
gatttgcttccaaagttggcccatc

SEQ ID NO: 96315 - DNA, 25 bp, S. pombe
gatttggcaaattaccctgttcttc

SEQ ID NO: 96316 - DNA, 25 bp, S. pombe
gatttggattattacgagtctctcg

SEQ ID NO: 96317 - DNA, 25 bp, S. pombe
gatttgcgttactctagtgccaagt

SEQ ID NO: 96318 - DNA, 25 bp, S. pombe
gatttcttccaatcttatgcagaag

SEQ ID NO: 96319 - DNA, 25 bp, S. pombe
gattttctgctattcctttacatgg

SEQ ID NO: 96320 - DNA, 25 bp, S. pombe
gattttcccgatgcagctgtacaag

SEQ ID NO: 96321 - DNA, 25 bp, S. pombe
gattattttactctttgggctgcga

SEQ ID NO: 96322 - DNA, 25 bp, S. pombe
gattttgaagttttgtccgccttgg

SEQ ID NO: 96323 - DNA, 25 bp, S. pombe
gatatttactatccaggttgcccgg

SEQ ID NO: 96324 - DNA, 25 bp, S. pombe
gatttctttacttgggattgcctaa

SEQ ID NO: 96325 - DNA, 25 bp, S. pombe
gatttgtgcacttcgaatgcggtca

SEQ ID NO: 96326 - DNA, 25 bp, S. pombe
gattttgcagtcgtatatcgccgaa

SEQ ID NO: 96327 - DNA, 25 bp, S. pombe
gatttctcgtccatcatcgaggaag

SEQ ID NO: 96328 - DNA, 25 bp, S. pombe
gatattgccgcatttatcaaacgag

SEQ ID NO: 96329 - DNA, 25 bp, S. pombe
gatttgctctctgaatgggacttta

SEQ ID NO: 96330 - DNA, 25 bp, S. pombe
gatttgcacactgattccttttata

SEQ ID NO: 96331 - DNA, 25 bp, S. pombe
gattcttcaaaggtcccagttaagt

SEQ ID NO: 96332 - DNA, 25 bp, S. pombe
gattctaacgcatatcacccaggga

SEQ ID NO: 96333 - DNA, 25 bp, S. pombe
gatttggacttgacttactctcgta

SEQ ID NO: 96334 - DNA, 25 bp, S. pombe
gattctgggttcattactccgtttt

SEQ ID NO: 96335 - DNA, 25 bp, S. pombe
gatttgttactcgagtcatctctaa

SEQ ID NO: 96336 - DNA, 25 bp, S. pombe
gatttctcacctgttcaatctcaaa

SEQ ID NO: 96337 - DNA, 25 bp, S. pombe
gatttcttacttgtcagcttttcat

SEQ ID NO: 96338 - DNA, 25 bp, S. pombe
gattttaccttctccattattcaca

SEQ ID NO: 96339 - DNA, 25 bp, S. pombe
gatttttacatcacctagtttacaa

SEQ ID NO: 96340 - DNA, 25 bp, S. pombe
gatttttaccttatatcccacccat

SEQ ID NO: 96341 - DNA, 25 bp, S. pombe
gattcttctgataccgggagattcc

SEQ ID NO: 96342 - DNA, 25 bp, S. pombe
gattctttagatgctgtcgaggtcg

SEQ ID NO: 96343 - DNA, 25 bp, S. pombe
gatattgtcatccatgtacccaaag

SEQ ID NO: 96344 - DNA, 25 bp, S. pombe
gatttagctgatacactttcgagtg

SEQ ID NO: 96345 - DNA, 25 bp, S. pombe
gattttattcgacacccggagaacg

SEQ ID NO: 96346 - DNA, 25 bp, S. pombe
gattttgtacagtccactcctaaga

SEQ ID NO: 96347 - DNA, 25 bp, S. pombe
gattcttatacgtggctagtggtcc

SEQ ID NO: 96348 - DNA, 25 bp, S. pombe
gatttatctttgtctccggtttaca

SEQ ID NO: 96349 - DNA, 25 bp, S. pombe
gattttttccttagctggacttcca

SEQ ID NO: 96350 - DNA, 25 bp, S. pombe
gattttggtgccttttatttgctac

SEQ ID NO: 96351 - DNA, 25 bp, S. pombe
gattttgggtttgaggctgcgtaca

SEQ ID NO: 96352 - DNA, 25 bp, S. pombe
gattatctggttgaccactcggtat

SEQ ID NO: 96353 - DNA, 25 bp, S. pombe
gattcttatggatcggtgccggaca

SEQ ID NO: 96354 - DNA, 25 bp, S. pombe
gattccttggaaaaccctaagcagt

SEQ ID NO: 96355 - DNA, 25 bp, S. pombe
gttgacgaggagtccattcccaaag

SEQ ID NO: 96356 - DNA, 25 bp, S. pombe
gatttccgagcctaagccgttgaag

SEQ ID NO: 96357 - DNA, 25 bp, S. pombe
gattaaatcccaaagtaatgaaaga

SEQ ID NO: 96358 - DNA, 25 bp, S. pombe
gattaagttcgcagaaaagcagaaa

SEQ ID NO: 96359 - DNA, 25 bp, S. pombe
gatttgagttctctcacaaccagta

SEQ ID NO: 96360 - DNA, 25 bp, S. pombe
gatttcttcaatcggtcaagccagt

SEQ ID NO: 96361 - DNA, 25 bp, S. pombe
gatttcaatcgtttgttggccacgt

SEQ ID NO: 96362 - DNA, 25 bp, S. pombe
gatttgcaacctttatcagcgcaag

SEQ ID NO: 96363 - DNA, 25 bp, S. pombe
gatttcacaccgtcaatagccaatg

SEQ ID NO: 96364 - DNA, 25 bp, S. pombe
gatttcatcaacgtcaactcgcaag

SEQ ID NO: 96365 - DNA, 25 bp, S. pombe
gattttcacagcttccatcgtggta

SEQ ID NO: 96366 - DNA, 25 bp, S. pombe
gatttggctgagtatcttgttcgta

SEQ ID NO: 96367 - DNA, 25 bp, S. pombe
gatttgtgcagttcgctttgaagct

SEQ ID NO: 96368 - DNA, 25 bp, S. pombe
gatttccgcattggctttattgaga

SEQ ID NO: 96369 - DNA, 25 bp, S. pombe
gatttgtacgttcctttctgccata

SEQ ID NO: 96370 - DNA, 25 bp, S. pombe
gatttctgactttgagctttctatt

SEQ ID NO: 96371 - DNA, 25 bp, S. pombe
gatttctcgctaagtgctttctata

SEQ ID NO: 96372 - DNA, 25 bp, S. pombe
gatttgggcattactactgtcttca

SEQ ID NO: 96373 - DNA, 25 bp, S. pombe
gatttggccaatattgccctcgatt

SEQ ID NO: 96374 - DNA, 25 bp, S. pombe
gatttaaatgcctctcaagccgaag

SEQ ID NO: 96375 - DNA, 25 bp, S. pombe
gatttctcattggtcatcctataaa

SEQ ID NO: 96376 - DNA, 25 bp, S. pombe
gatttggacctcgagagtgctctga

SEQ ID NO: 96377 - DNA, 25 bp, S. pombe
gattacttgccggtgcagcatcaat

SEQ ID NO: 96378 - DNA, 25 bp, S. pombe
gatttccaagttactgcacacgtat

SEQ ID NO: 96379 - DNA, 25 bp, S. pombe
gattactaagtacctgccacaagct

SEQ ID NO: 96380 - DNA, 25 bp, S. pombe
gatttactacagaccttgatccacc

SEQ ID NO: 96381 - DNA, 25 bp, S. pombe
gatttacaaggaccgctatgccaca

SEQ ID NO: 96382 - DNA, 25 bp, S. pombe
gatttacttgatcccatgcgtgatt

SEQ ID NO: 96383 - DNA, 25 bp, S. pombe
gatttgccattgatgttcgtctctc

SEQ ID NO: 96384 - DNA, 25 bp, S. pombe
gattttcttttgaacgtcctcttca

SEQ ID NO: 96385 - DNA, 25 bp, S. pombe
gattatctgccagttcgttatgcaa

SEQ ID NO: 96386 - DNA, 25 bp, S. pombe
gattatgtacttcgatggccaaaag

SEQ ID NO: 96387 - DNA, 25 bp, S. pombe
gattttactgatccaggcgcaacgt

SEQ ID NO: 96388 - DNA, 25 bp, S. pombe
gatttgctggttatctactgcgaat

SEQ ID NO: 96389 - DNA, 25 bp, S. pombe
gatttgtgtgttgctctacaactac

SEQ ID NO: 96390 - DNA, 25 bp, S. pombe
gattcttcggttaccaacacttctt

SEQ ID NO: 96391 - DNA, 25 bp, S. pombe
gattaatccgctactatccgaaaga

SEQ ID NO: 96392 - DNA, 25 bp, S. pombe
gattttatcgttaatgaccaccagg

SEQ ID NO: 96393 - DNA, 25 bp, S. pombe
gattttcctttgaatgatgcccacc

SEQ ID NO: 96394 - DNA, 25 bp, S. pombe
gatttatcctacttatctgccgatt

SEQ ID NO: 96395 - DNA, 25 bp, S. pombe
gatttatccataacttctgccacag

SEQ ID NO: 96396 - DNA, 25 bp, S. pombe
gatttcatcactttgtagctcacag

SEQ ID NO: 96397 - DNA, 25 bp, S. pombe
gatttgacgctatacatccagaatg

SEQ ID NO: 96398 - DNA, 25 bp, S. pombe
gatttcattggtttatcctgtgcaa

SEQ ID NO: 96399 - DNA, 25 bp, S. pombe
gattttcgactcttctccttcaatt

SEQ ID NO: 96400 - DNA, 25 bp, S. pombe
gattcccaaatttcaacctttgcga

SEQ ID NO: 96401 - DNA, 25 bp, S. pombe
gattccaaaaatccaacgccatttg

SEQ ID NO: 96402 - DNA, 25 bp, S. pombe
gatttgactctgtacgctgatgaaa

SEQ ID NO: 96403 - DNA, 25 bp, S. pombe
gatttatctcgtggtcagcatggaa

SEQ ID NO: 96404 - DNA, 25 bp, S. pombe
gatttaccagtaccacatttgacac

SEQ ID NO: 96405 - DNA, 25 bp, S. pombe
gatttcaccgttcatcacttacaaa

SEQ ID NO: 96406 - DNA, 25 bp, S. pombe
gttcgcgaacttcacgtgtatggca

SEQ ID NO: 96407 - DNA, 25 bp, S. pombe
gatttcgaatccctttcatgccaac

SEQ ID NO: 96408 - DNA, 25 bp, S. pombe
gatttcgaatacctcacttctactg

SEQ ID NO: 96409 - DNA, 25 bp, S. pombe
gattttttgtttccatgttacgcct

SEQ ID NO: 96410 - DNA, 25 bp, S. pombe
gatttgcttttatctaatttcgcca

SEQ ID NO: 96411 - DNA, 25 bp, S. pombe
gattttgtcctccattaatcttggc

SEQ ID NO: 96412 - DNA, 25 bp, S. pombe
gatttagatccttcttccactattc

SEQ ID NO: 96413 - DNA, 25 bp, S. pombe
gattaacgcatctctatcgcttcat

SEQ ID NO: 96414 - DNA, 25 bp, S. pombe
gattacagttcaactatccttcctc

SEQ ID NO: 96415 - DNA, 25 bp, S. pombe
gatttcgttcaaatgattcttgcca

SEQ ID NO: 96416 - DNA, 25 bp, S. pombe
gatttagttcacaagcgttgtcccc

SEQ ID NO: 96417 - DNA, 25 bp, S. pombe
gatttaatccctttattgcttaccg

SEQ ID NO: 96418 - DNA, 25 bp, S. pombe
gatttctccctctattttgcataaa

SEQ ID NO: 96419 - DNA, 25 bp, S. pombe
gattcgctactccacttttagtaac

SEQ ID NO: 96420 - DNA, 25 bp, S. pombe
gatttctaccatccgttgcaatgac

SEQ ID NO: 96421 - DNA, 25 bp, S. pombe
gattcttacctccatgtttgtacct

SEQ ID NO: 96422 - DNA, 25 bp, S. pombe
gattatgttcgtggtgttttcccgg

SEQ ID NO: 96423 - DNA, 25 bp, S. pombe
gatttatcaccttcttatgggagca

SEQ ID NO: 96424 - DNA, 25 bp, S. pombe
gattattttcccctcaatgtttgtt

SEQ ID NO: 96425 - DNA, 25 bp, S. pombe
gatttcgtttggacgatatccacag

SEQ ID NO: 96426 - DNA, 25 bp, S. pombe
gatttcattcccaacagtttgcaag

SEQ ID NO: 96427 - DNA, 25 bp, S. pombe
gattacaagttttcctctgacgcgg

SEQ ID NO: 96428 - DNA, 25 bp, S. pombe
gattaaactataagcctggcccatg

SEQ ID NO: 96429 - DNA, 25 bp, S. pombe
gatttatccgataagcctgaggctc

SEQ ID NO: 96430 - DNA, 25 bp, S. pombe
gatttatgctggtgatcctgtcttg

SEQ ID NO: 96431 - DNA, 25 bp, S. pombe
gatttatcgcttttatttgttccaa

SEQ ID NO: 96432 - DNA, 25 bp, S. pombe
gattgatttgaagccgaatggtcga

SEQ ID NO: 96433 - DNA, 25 bp, S. pombe
gattatccgaaacctgaagtgtctg

SEQ ID NO: 96434 - DNA, 25 bp, S. pombe
gatttcttcgaacctgaattaccgg

SEQ ID NO: 96435 - DNA, 25 bp, S. pombe
gattattgggtccacattccgaggc

SEQ ID NO: 96436 - DNA, 25 bp, S. pombe
gattttgtaccatctgtctcggaaa

SEQ ID NO: 96437 - DNA, 25 bp, S. pombe
gatttcgttcctttacctggtcaag

SEQ ID NO: 96438 - DNA, 25 bp, S. pombe
gatttccctctttgtactgaaggtc

SEQ ID NO: 96439 - DNA, 25 bp, S. pombe
gattatttccgctgtattaaggcta

SEQ ID NO: 96440 - DNA, 25 bp, S. pombe
gatttttcacctgttctgcaaggca

SEQ ID NO: 96441 - DNA, 25 bp, S. pombe
gattctttaactcatgtcttacagc

SEQ ID NO: 96442 - DNA, 25 bp, S. pombe
gattcgctagcaaagctggcagatt

SEQ ID NO: 96443 - DNA, 25 bp, S. pombe
gattctgctacatccagtaatgttt

SEQ ID NO: 96444 - DNA, 25 bp, S. pombe
gattcagttgatgtcgattcggatg

SEQ ID NO: 96445 - DNA, 25 bp, S. pombe
gattcgtcttttgtatcgcctaata

SEQ ID NO: 96446 - DNA, 25 bp, S. pombe
gattcgtcccttgtggagacactat

SEQ ID NO: 96447 - DNA, 25 bp, S. pombe
gatttactgaacgttgcacacctta

SEQ ID NO: 96448 - DNA, 25 bp, S. pombe
gatttattactcgtggaaccattga

SEQ ID NO: 96449 - DNA, 25 bp, S. pombe
gatttctctattactggaacctcta

SEQ ID NO: 96450 - DNA, 25 bp, S. pombe
gattttgcatttccatcgatcacct

SEQ ID NO: 96451 - DNA, 25 bp, S. pombe
gattacaatgatcgtcctcgtcgtc

SEQ ID NO: 96452 - DNA, 25 bp, S. pombe
gatttagatgtacccagtgcattta

SEQ ID NO: 96453 - DNA, 25 bp, S. pombe
gatttacctgtatttgctgatgctg

SEQ ID NO: 96454 - DNA, 25 bp, S. pombe
gattatcacttttatctgctgggca

SEQ ID NO: 96455 - DNA, 25 bp, S. pombe
gattatacatgctcattgcacggag

SEQ ID NO: 96456 - DNA, 25 bp, S. pombe
gattcagcaggttcattcgagccac

SEQ ID NO: 96457 - DNA, 25 bp, S. pombe
gattatggcattatccacgactctg

SEQ ID NO: 96458 - DNA, 25 bp, S. pombe
gattacatttcattcgacgagcctt

SEQ ID NO: 96459 - DNA, 25 bp, S. pombe
gattacatattgtgcgccgagctat

SEQ ID NO: 96460 - DNA, 25 bp, S. pombe
gattatcttccaagcgtgatgactt

SEQ ID NO: 96461 - DNA, 25 bp, S. pombe
gatttttcatatgcccaacttgtcg

SEQ ID NO: 96462 - DNA, 25 bp, S. pombe
gattttcattatgcaacaccttttg

SEQ ID NO: 96463 - DNA, 25 bp, S. pombe
gattttctgttctcagacacttcgc

SEQ ID NO: 96464 - DNA, 25 bp, S. pombe
gattcattatttgaggaggccccaa

SEQ ID NO: 96465 - DNA, 25 bp, S. pombe
gatttcatttcccaagttcaggtag

SEQ ID NO: 96466 - DNA, 25 bp, S. pombe
gatttttcgcccagtcttttgagaa

SEQ ID NO: 96467 - DNA, 25 bp, S. pombe
gattttacgaaccaagtctgctcaa

SEQ ID NO: 96468 - DNA, 25 bp, S. pombe
gattcttcggtcaaggcactttcaa

SEQ ID NO: 96469 - DNA, 25 bp, S. pombe
gattttctaccagagacccatcaag

SEQ ID NO: 96470 - DNA, 25 bp, S. pombe
gatttattacccaaacctatgcaaa

SEQ ID NO: 96471 - DNA, 25 bp, S. pombe
gattatcgttatacttgcccaaccg

SEQ ID NO: 96472 - DNA, 25 bp, S. pombe
gattacccgcgttattccgagagga

SEQ ID NO: 96473 - DNA, 25 bp, S. pombe
gatttagacaccgaggcgtcacctg

SEQ ID NO: 96474 - DNA, 25 bp, S. pombe
gatttatccacatccattttgtttg

SEQ ID NO: 96475 - DNA, 25 bp, S. pombe
gattttccatggttcaactattgct

SEQ ID NO: 96476 - DNA, 25 bp, S. pombe
gattaactgggattgtccctgtctt

SEQ ID NO: 96477 - DNA, 25 bp, S. pombe
gattaaaggctcgtatccatcaatt

SEQ ID NO: 96478 - DNA, 25 bp, S. pombe
gattcgcttggttatgatcggctcg

SEQ ID NO: 96479 - DNA, 25 bp, S. pombe
gattttcggttgttatgccatctgc

SEQ ID NO: 96480 - DNA, 25 bp, S. pombe
gatttatgcagctggtaagcctcaa

SEQ ID NO: 96481 - DNA, 25 bp, S. pombe
gatttacatgctcagtactcagcca

SEQ ID NO: 96482 - DNA, 25 bp, S. pombe
gattatttgggcatcgtcgtcatga

SEQ ID NO: 96483 - DNA, 25 bp, S. pombe
gatttttctgtcaatcctcgtgtag

SEQ ID NO: 96484 - DNA, 25 bp, S. pombe
gattttcagcaagagctttcccttt

SEQ ID NO: 96485 - DNA, 25 bp, S. pombe
gattttaccaattctttccacagct

SEQ ID NO: 96486 - DNA, 25 bp, S. pombe
gattttaccatttgctacactcata

SEQ ID NO: 96487 - DNA, 25 bp, S. pombe
gattttcatctttcttgcctgtcat

SEQ ID NO: 96488 - DNA, 25 bp, S. pombe
gattctcaatcaatttccatttgca

SEQ ID NO: 96489 - DNA, 25 bp, S. pombe
gattactgatgctaaacctcttgct

SEQ ID NO: 96490 - DNA, 25 bp, S. pombe
gattcactgcatcaagtactcttgg

SEQ ID NO: 96491 - DNA, 25 bp, S. pombe
gattcaatccggttacttctctgag

SEQ ID NO: 96492 - DNA, 25 bp, S. pombe
gtacaatggaggctccgtccgtagc

SEQ ID NO: 96493 - DNA, 25 bp, S. pombe
gttgtgaaccttaccgagggtacag

SEQ ID NO: 96494 - DNA, 25 bp, S. pombe
gattgctaacctcaacagatttaac

SEQ ID NO: 96495 - DNA, 25 bp, S. pombe
gattgaaaactctaacatgcctgta

SEQ ID NO: 96496 - DNA, 25 bp, S. pombe
gattagggattctccatccttcgaa

SEQ ID NO: 96497 - DNA, 25 bp, S. pombe
gatttatttgtaccctccattcgaa

SEQ ID NO: 96498 - DNA, 25 bp, S. pombe
gatttattttacgttcctctcacct

SEQ ID NO: 96499 - DNA, 25 bp, S. pombe
gatttattcatctctctgctggatt

SEQ ID NO: 96500 - DNA, 25 bp, S. pombe
gattttcgtccattccttgtagtaa

SEQ ID NO: 96501 - DNA, 25 bp, S. pombe
gattatcgagcagaatcgtcgcaaa

SEQ ID NO: 96502 - DNA, 25 bp, S. pombe
gattatgcgacgtcattgcctaatg

SEQ ID NO: 96503 - DNA, 25 bp, S. pombe
gattacgctggctagttgacggatt

SEQ ID NO: 96504 - DNA, 25 bp, S. pombe
gttggccttgatcctgataacctgg

SEQ ID NO: 96505 - DNA, 25 bp, S. pombe
gattgcccagtatcgaaggcttgct

SEQ ID NO: 96506 - DNA, 25 bp, S. pombe
gattaccactaaggatgtcgcattt

SEQ ID NO: 96507 - DNA, 25 bp, S. pombe
gattatactcattcacgtacgttgg

SEQ ID NO: 96508 - DNA, 25 bp, S. pombe
gattagcaaatctctgtcggttgtg

SEQ ID NO: 96509 - DNA, 25 bp, S. pombe
gattcgcccgtcctgaagaggatga

SEQ ID NO: 96510 - DNA, 25 bp, S. pombe
gattcggcaagtgctgcaactacta

SEQ ID NO: 96511 - DNA, 25 bp, S. pombe
gattcgaccagtttgcagactttgc

SEQ ID NO: 96512 - DNA, 25 bp, S. pombe
gattcgatcgcgcttaactgtggaa

SEQ ID NO: 96513 - DNA, 25 bp, S. pombe
gattttctaactactacggtgatga

SEQ ID NO: 96514 - DNA, 25 bp, S. pombe
gattgtgcctacattatccggatta

SEQ ID NO: 96515 - DNA, 25 bp, S. pombe
gattgctagctctcgtaaagtggta

SEQ ID NO: 96516 - DNA, 25 bp, S. pombe
gattcttccttcgtgtacttcgaaa

SEQ ID NO: 96517 - DNA, 25 bp, S. pombe
gattccccacttatccttggaagat

SEQ ID NO: 96518 - DNA, 25 bp, S. pombe
gattacaccatgttttcctacgaag

SEQ ID NO: 96519 - DNA, 25 bp, S. pombe
gattaccttttcgatccacggaatg

SEQ ID NO: 96520 - DNA, 25 bp, S. pombe
gattatccttttaagccacctgcaa

SEQ ID NO: 96521 - DNA, 25 bp, S. pombe
gattactatgattttggaacctgga

SEQ ID NO: 96522 - DNA, 25 bp, S. pombe
gattcaatcaaagcagttcccaaag

SEQ ID NO: 96523 - DNA, 25 bp, S. pombe
gattacccgtgagttgtctctacaa

SEQ ID NO: 96524 - DNA, 25 bp, S. pombe
gattcccgggccatgttcataacaa

SEQ ID NO: 96525 - DNA, 25 bp, S. pombe
gattgtgcgggctgtctggaattaa

SEQ ID NO: 96526 - DNA, 25 bp, S. pombe
gattctggccaggtgatgtcgcaag

SEQ ID NO: 96527 - DNA, 25 bp, S. pombe
gattcattgaactgggactctgtcg

SEQ ID NO: 96528 - DNA, 25 bp, S. pombe
gattctctggacttacaatctctcc

SEQ ID NO: 96529 - DNA, 25 bp, S. pombe
gatttatttacccacagaccagctt

SEQ ID NO: 96530 - DNA, 25 bp, S. pombe
gattcatatattccccaagatccca

SEQ ID NO: 96531 - DNA, 25 bp, S. pombe
gattttgtcggtcatctgcagtaat

SEQ ID NO: 96532 - DNA, 25 bp, S. pombe
gatttttagattgcatcgctatatt

SEQ ID NO: 96533 - DNA, 25 bp, S. pombe
gattgttagaatcagcagccggcca

SEQ ID NO: 96534 - DNA, 25 bp, S. pombe
gatttttgcaatcatgtcacgcgtg

SEQ ID NO: 96535 - DNA, 25 bp, S. pombe
gattttgctgtagatgccactggcg

SEQ ID NO: 96536 - DNA, 25 bp, S. pombe
gatttttgtaaatcgcatgcgcata

SEQ ID NO: 96537 - DNA, 25 bp, S. pombe
gattttttgactttggcagcggtta

SEQ ID NO: 96538 - DNA, 25 bp, S. pombe
gattacacatttacggttccagcct

SEQ ID NO: 96539 - DNA, 25 bp, S. pombe
gattttctcttgaaggactgccgta

SEQ ID NO: 96540 - DNA, 25 bp, S. pombe
gattattctatctgaggctggtcct

SEQ ID NO: 96541 - DNA, 25 bp, S. pombe
gattttaacattcgtcgtgtccaac

SEQ ID NO: 96542 - DNA, 25 bp, S. pombe
gattttggatatctcgctatcgaag

SEQ ID NO: 96543 - DNA, 25 bp, S. pombe
gttcccactttcacgtaatggtagc

SEQ ID NO: 96544 - DNA, 25 bp, S. pombe
gttcccctttcaaacttggcgatag

SEQ ID NO: 96545 - DNA, 25 bp, S. pombe
gttccaggctttaatactcttcgtg

SEQ ID NO: 96546 - DNA, 25 bp, S. pombe
gattcctctttactatggtttcttt

SEQ ID NO: 96547 - DNA, 25 bp, S. pombe
gattattgcccttttgtttctgatt

SEQ ID NO: 96548 - DNA, 25 bp, S. pombe
gattactcctggtatcgctttggat

SEQ ID NO: 96549 - DNA, 25 bp, S. pombe
gattttattcagctcgactcatggt

SEQ ID NO: 96550 - DNA, 25 bp, S. pombe
gattttattacttccacacttgatg

SEQ ID NO: 96551 - DNA, 25 bp, S. pombe
gattttcttattccccattttgttg

SEQ ID NO: 96552 - DNA, 25 bp, S. pombe
gattattgtattcggctccttatca

SEQ ID NO: 96553 - DNA, 25 bp, S. pombe
gattatttggtatgctctcttcctt

SEQ ID NO: 96554 - DNA, 25 bp, S. pombe
gattttgtgcgcaaagtttcgccat

SEQ ID NO: 96555 - DNA, 25 bp, S. pombe
gattcctaaattatccccaaaaatg

SEQ ID NO: 96556 - DNA, 25 bp, S. pombe
gttcgaattcacgttaccttgtctc

SEQ ID NO: 96557 - DNA, 25 bp, S. pombe
gttgcaaataccgttgtttctcctg

SEQ ID NO: 96558 - DNA, 25 bp, S. pombe
gattgaaaatccactaccttcctac

SEQ ID NO: 96559 - DNA, 25 bp, S. pombe
gattctatcccgattattcctgatt

SEQ ID NO: 96560 - DNA, 25 bp, S. pombe
gattttactggtgctgattacttta

SEQ ID NO: 96561 - DNA, 25 bp, S. pombe
gattttgactctttccataactttg

SEQ ID NO: 96562 - DNA, 25 bp, S. pombe
gattttgcacgtcatctctgatact

SEQ ID NO: 96563 - DNA, 25 bp, S. pombe
gattcggatggtcttctatttgttg

SEQ ID NO: 96564 - DNA, 25 bp, S. pombe
gattttgctacttgacacctatttt

SEQ ID NO: 96565 - DNA, 25 bp, S. pombe
gattattctcctagtccattgatta

SEQ ID NO: 96566 - DNA, 25 bp, S. pombe
gattttctgccttgatccatttcga

SEQ ID NO: 96567 - DNA, 25 bp, S. pombe
gattctactgttcgtctatccaaga

SEQ ID NO: 96568 - DNA, 25 bp, S. pombe
gattcttcttgtggtaatcgaacac

SEQ ID NO: 96569 - DNA, 25 bp, S. pombe
gattcttggcaaccggtcaaccagt

SEQ ID NO: 96570 - DNA, 25 bp, S. pombe
gattcactactgtctgtcctggaag

SEQ ID NO: 96571 - DNA, 25 bp, S. pombe
gattattgccaacgactaccagcga

SEQ ID NO: 96572 - DNA, 25 bp, S. pombe
gattatgtgatcagccatcttccgg

SEQ ID NO: 96573 - DNA, 25 bp, S. pombe
gattcagttgtttttgttaccagtc

SEQ ID NO: 96574 - DNA, 25 bp, S. pombe
gattcgcttttagtagatcccgtga

SEQ ID NO: 96575 - DNA, 25 bp, S. pombe
gattctatttcgcaacgttggcaaa

SEQ ID NO: 96576 - DNA, 25 bp, S. pombe
gttggtaccgttgcccatgagtgca

SEQ ID NO: 96577 - DNA, 25 bp, S. pombe
gttgaccccgttgtagtgatggtat

SEQ ID NO: 96578 - DNA, 25 bp, S. pombe
gattcatctgttgaccgtggatccc

SEQ ID NO: 96579 - DNA, 25 bp, S. pombe
gattcatctggcaacactcatagca

SEQ ID NO: 96580 - DNA, 25 bp, S. pombe
gattcctgaggatccgtgtagttta

SEQ ID NO: 96581 - DNA, 25 bp, S. pombe
gttgtgctaggttccctgaagggat

SEQ ID NO: 96582 - DNA, 25 bp, S. pombe
gattatgaaactcgcatccatcaaa

SEQ ID NO: 96583 - DNA, 25 bp, S. pombe
gattacatttccatatccgcttctt

SEQ ID NO: 96584 - DNA, 25 bp, S. pombe
gattattcttgcctttaagctcagt

SEQ ID NO: 96585 - DNA, 25 bp, S. pombe
gattagtccatcattgtcaagccac

SEQ ID NO: 96586 - DNA, 25 bp, S. pombe
gattatgtcgtcgttgatgctgacc

SEQ ID NO: 96587 - DNA, 25 bp, S. pombe
gattttgcagagctcctcattggta

SEQ ID NO: 96588 - DNA, 25 bp, S. pombe
gattcttgcatgctgtctgtccgag

SEQ ID NO: 96589 - DNA, 25 bp, S. pombe
gattattacagactcttccgatcct

SEQ ID NO: 96590 - DNA, 25 bp, S. pombe
gattattccctattcagcggattta

SEQ ID NO: 96591 - DNA, 25 bp, S. pombe
gattatgctgttactctcggtcatt

SEQ ID NO: 96592 - DNA, 25 bp, S. pombe
gattcacttatactctgggttgctg

SEQ ID NO: 96593 - DNA, 25 bp, S. pombe
gattcactatcggttccattgcatt

SEQ ID NO: 96594 - DNA, 25 bp, S. pombe
gattgccatcatcggattgtttgct

SEQ ID NO: 96595 - DNA, 25 bp, S. pombe
gattcgctatccgtcatttacttga

SEQ ID NO: 96596 - DNA, 25 bp, S. pombe
gattaggaccttatgatccctcgtt

SEQ ID NO: 96597 - DNA, 25 bp, S. pombe
gattagggcctaatcttacccctgt

SEQ ID NO: 96598 - DNA, 25 bp, S. pombe
gattcttatttctacctggaggacg

SEQ ID NO: 96599 - DNA, 25 bp, S. pombe
gattctcccacgctggtcataagag

SEQ ID NO: 96600 - DNA, 25 bp, S. pombe
gattaccccggaactgagaacatga

SEQ ID NO: 96601 - DNA, 25 bp, S. pombe
gattatacccgcatctctgaaaata

SEQ ID NO: 96602 - DNA, 25 bp, S. pombe
gattagatcccgagcgtgttaacat

SEQ ID NO: 96603 - DNA, 25 bp, S. pombe
gattaatcaccaagctgcgatgttg

SEQ ID NO: 96604 - DNA, 25 bp, S. pombe
gattatgcaacttacttttcagctg

SEQ ID NO: 96605 - DNA, 25 bp, S. pombe
gattcatcaatcttccgatttcggt

SEQ ID NO: 96606 - DNA, 25 bp, S. pombe
gattcacctgacagttggtcggatt

SEQ ID NO: 96607 - DNA, 25 bp, S. pombe
gattcacattacttgttggtcgcaa

SEQ ID NO: 96608 - DNA, 25 bp, S. pombe
gattcactatcgtggcatgtcccaa

SEQ ID NO: 96609 - DNA, 25 bp, S. pombe
gattaccatcgatttcattcgccga

SEQ ID NO: 96610 - DNA, 25 bp, S. pombe
gattaccatccagtgattgttccaa

SEQ ID NO: 96611 - DNA, 25 bp, S. pombe
gattcaccgatttgcaacttgtctg

SEQ ID NO: 96612 - DNA, 25 bp, S. pombe
gattagacgatatgcctgctcatgt

SEQ ID NO: 96613 - DNA, 25 bp, S. pombe
gattatgccttgttgccagtgacac

SEQ ID NO: 96614 - DNA, 25 bp, S. pombe
gattcgtatcatttgtcggacctcc

SEQ ID NO: 96615 - DNA, 25 bp, S. pombe
gattcttatgcttttgtttcctcaa

SEQ ID NO: 96616 - DNA, 25 bp, S. pombe
gattattatctttcagtgtcaccca

SEQ ID NO: 96617 - DNA, 25 bp, S. pombe
gattcgaattgctcaagatccctca

SEQ ID NO: 96618 - DNA, 25 bp, S. pombe
gattatgctatgtttggttcgtgta

SEQ ID NO: 96619 - DNA, 25 bp, S. pombe
gattacaatgctatggtacctgtga

SEQ ID NO: 96620 - DNA, 25 bp, S. pombe
gattacagtgttactccagaggagt

SEQ ID NO: 96621 - DNA, 25 bp, S. pombe
gattgatagcgttttgtcagcgtga

SEQ ID NO: 96622 - DNA, 25 bp, S. pombe
gattctgccgttaaagctcaacctc

SEQ ID NO: 96623 - DNA, 25 bp, S. pombe
gattgctaacatcatgcttgccgtc

SEQ ID NO: 96624 - DNA, 25 bp, S. pombe
gattgccaacatttgcattctctcg

SEQ ID NO: 96625 - DNA, 25 bp, S. pombe
gattcaccaatttacttttacgaca

SEQ ID NO: 96626 - DNA, 25 bp, S. pombe
gattgaacgcgcaaaaccccaagat

SEQ ID NO: 96627 - DNA, 25 bp, S. pombe
gattaatccgtctaccctaatgatg

SEQ ID NO: 96628 - DNA, 25 bp, S. pombe
gattatatggcatccacgcccgatt

SEQ ID NO: 96629 - DNA, 25 bp, S. pombe
gttacgatgtcccaaaggatttttg

SEQ ID NO: 96630 - DNA, 25 bp, S. pombe
gattaagcaatccaaacaagttttc

SEQ ID NO: 96631 - DNA, 25 bp, S. pombe
gattgcacaagccagatgactataa

SEQ ID NO: 96632 - DNA, 25 bp, S. pombe
gattcaatgcgccatcagatccata

SEQ ID NO: 96633 - DNA, 25 bp, S. pombe
gattagatgccgtttccagaagtac

SEQ ID NO: 96634 - DNA, 25 bp, S. pombe
gattatgatcgtcgttctcctaaac

SEQ ID NO: 96635 - DNA, 25 bp, S. pombe
gattcagctagggttctggcttcaa

SEQ ID NO: 96636 - DNA, 25 bp, S. pombe
gattatgctagggttactggacaaa

SEQ ID NO: 96637 - DNA, 25 bp, S. pombe
gattgccaggcgtgaaaattaccaa

SEQ ID NO: 96638 - DNA, 25 bp, S. pombe
gattctcagttaccaagtgtccgtc

SEQ ID NO: 96639 - DNA, 25 bp, S. pombe
gattcggttaaaatggacttgctca

SEQ ID NO: 96640 - DNA, 25 bp, S. pombe
gattgggtttgtgtttctactcaac

SEQ ID NO: 96641 - DNA, 25 bp, S. pombe
gattggtgtttaattttaattgata

SEQ ID NO: 96642 - DNA, 25 bp, S. pombe
gattgggacatgctctggtaattac

SEQ ID NO: 96643 - DNA, 25 bp, S. pombe
gattctagcttttttgaccgtcaca

SEQ ID NO: 96644 - DNA, 25 bp, S. pombe
gattctcattcgtgctttgtattcc

SEQ ID NO: 96645 - DNA, 25 bp, S. pombe
gattcacttctggacttttcaacaa

SEQ ID NO: 96646 - DNA, 25 bp, S. pombe
gattacaatccatatcgtcgtccca

SEQ ID NO: 96647 - DNA, 25 bp, S. pombe
gattagatcccaagtattccatccc

SEQ ID NO: 96648 - DNA, 25 bp, S. pombe
gattatgtcaacttggcttcgacag

SEQ ID NO: 96649 - DNA, 25 bp, S. pombe
gattggacaccgcagctttgaatgt

SEQ ID NO: 96650 - DNA, 25 bp, S. pombe
gattacctgcgccaacattttgtta

SEQ ID NO: 96651 - DNA, 25 bp, S. pombe
gattcacttatcacatttaccattg

SEQ ID NO: 96652 - DNA, 25 bp, S. pombe
gattagtacttcttctcttcaaaca

SEQ ID NO: 96653 - DNA, 25 bp, S. pombe
gattccaagtcgacggttactgctt

SEQ ID NO: 96654 - DNA, 25 bp, S. pombe
gattgccaagttcagtctaccgagt

SEQ ID NO: 96655 - DNA, 25 bp, S. pombe
gattgccgcggtaattttgttggtt

SEQ ID NO: 96656 - DNA, 25 bp, S. pombe
gattcacccaaatatgtacctcctt

SEQ ID NO: 96657 - DNA, 25 bp, S. pombe
gattcaaccgacttgcttacattta

SEQ ID NO: 96658 - DNA, 25 bp, S. pombe
gattacagaggaacagcgacaagat

SEQ ID NO: 96659 - DNA, 25 bp, S. pombe
gattacacgattcacatgcacaaga

SEQ ID NO: 96660 - DNA, 25 bp, S. pombe
gattacgtctgggaactccagcttg

SEQ ID NO: 96661 - DNA, 25 bp, S. pombe
gattgatcgtcctgtaccgactaaa

SEQ ID NO: 96662 - DNA, 25 bp, S. pombe
gattagcttcccataaggacccaga

SEQ ID NO: 96663 - DNA, 25 bp, S. pombe
gattctggtgtcatacgtctaggta

SEQ ID NO: 96664 - DNA, 25 bp, S. pombe
gattgtctcgtcctggtaccaactt

SEQ ID NO: 96665 - DNA, 25 bp, S. pombe
gattctttacttactcgagcgagag

SEQ ID NO: 96666 - DNA, 25 bp, S. pombe
gttgcatgtcattcactgtcacgta

SEQ ID NO: 96667 - DNA, 25 bp, S. pombe
gattgatgccattggtgctaccgcc

SEQ ID NO: 96668 - DNA, 25 bp, S. pombe
gattcctatcagcatatggcgccaa

SEQ ID NO: 96669 - DNA, 25 bp, S. pombe
gattcttcatgttcagccggaggag

SEQ ID NO: 96670 - DNA, 25 bp, S. pombe
gattactatgctcgcccgaatggag

SEQ ID NO: 96671 - DNA, 25 bp, S. pombe
gttgcttgcgcaaatcctgaagatg

SEQ ID NO: 96672 - DNA, 25 bp, S. pombe
gattgctatggtgatcctacggtaa

SEQ ID NO: 96673 - DNA, 25 bp, S. pombe
gattcgggtgtttcgattgtctcta

SEQ ID NO: 96674 - DNA, 25 bp, S. pombe
gattaccattgaacagcgacctccg

SEQ ID NO: 96675 - DNA, 25 bp, S. pombe
gattcccattgagctagatcctcat

SEQ ID NO: 96676 - DNA, 25 bp, S. pombe
gattaccattggatctgctctgtat

SEQ ID NO: 96677 - DNA, 25 bp, S. pombe
gattctcgtggtgacattgcttact

SEQ ID NO: 96678 - DNA, 25 bp, S. pombe
gattacgtttctattgctggactta

SEQ ID NO: 96679 - DNA, 25 bp, S. pombe
gattacgtccttatgcatttgttca

SEQ ID NO: 96680 - DNA, 25 bp, S. pombe
gattccgacacttcacgatttggta

SEQ ID NO: 96681 - DNA, 25 bp, S. pombe
gattgaagatactcacgttgctcgt

SEQ ID NO: 96682 - DNA, 25 bp, S. pombe
gattggatgctgtatacgcctcaca

SEQ ID NO: 96683 - DNA, 25 bp, S. pombe
gattcaatgtgttttgccgattcga

SEQ ID NO: 96684 - DNA, 25 bp, S. pombe
gattcaactcactttgcttactgcg

SEQ ID NO: 96685 - DNA, 25 bp, S. pombe
gattcatacgacactgctctactat

SEQ ID NO: 96686 - DNA, 25 bp, S. pombe
gattactcagagatcgctgctacta

SEQ ID NO: 96687 - DNA, 25 bp, S. pombe
gattacgcgacaaagcatggactaa

SEQ ID NO: 96688 - DNA, 25 bp, S. pombe
gttgtttggcctaaaggtgttgctt

SEQ ID NO: 96689 - DNA, 25 bp, S. pombe
gttgtctgtaccgtaactggttctt

SEQ ID NO: 96690 - DNA, 25 bp, S. pombe
gttggctcgccaagaacgtagtcaa

SEQ ID NO: 96691 - DNA, 25 bp, S. pombe
gttctaataaacacttcacctacgg

SEQ ID NO: 96692 - DNA, 25 bp, S. pombe
gattcctcggattcataaccatcag

SEQ ID NO: 96693 - DNA, 25 bp, S. pombe
gattacatgcatcttatcggcaaca

SEQ ID NO: 96694 - DNA, 25 bp, S. pombe
gattcacctgcttatatcggattac

SEQ ID NO: 96695 - DNA, 25 bp, S. pombe
gattcatcctcttctgattgatttc

SEQ ID NO: 96696 - DNA, 25 bp, S. pombe
gattcaccaaagttcatttcagata

SEQ ID NO: 96697 - DNA, 25 bp, S. pombe
gattgcactggaaatgtcactgtca

SEQ ID NO: 96698 - DNA, 25 bp, S. pombe
gattcgggcaaattctacctctaat

SEQ ID NO: 96699 - DNA, 25 bp, S. pombe
gattcaaggccttttcaggatccaa

SEQ ID NO: 96700 - DNA, 25 bp, S. pombe
gattcaaacttcatgtcacctgctc

SEQ ID NO: 96701 - DNA, 25 bp, S. pombe
gattcggaattcattgacgcctgcc

SEQ ID NO: 96702 - DNA, 25 bp, S. pombe
gttgttgattggaggcatttccgaa

SEQ ID NO: 96703 - DNA, 25 bp, S. pombe
gttggctgatttccctgattttaga

SEQ ID NO: 96704 - DNA, 25 bp, S. pombe
gattgttgttctcgcctttttctac

SEQ ID NO: 96705 - DNA, 25 bp, S. pombe
gattctgattctgaacttttgtgcg

SEQ ID NO: 96706 - DNA, 25 bp, S. pombe
gattcctctgatggcaagtggtctt

SEQ ID NO: 96707 - DNA, 25 bp, S. pombe
gattcagagctcagaaatgcctttg

SEQ ID NO: 96708 - DNA, 25 bp, S. pombe
gattcaaaccattcaagtgcttctg

SEQ ID NO: 96709 - DNA, 25 bp, S. pombe
gattccaatccttatggtcgtctgg

SEQ ID NO: 96710 - DNA, 25 bp, S. pombe
gattcgaatccttatggcacatgct

SEQ ID NO: 96711 - DNA, 25 bp, S. pombe
gattctttgttaatacccactcgta

SEQ ID NO: 96712 - DNA, 25 bp, S. pombe
gattctacttccaaattctcactac

SEQ ID NO: 96713 - DNA, 25 bp, S. pombe
gattcatcttctatttccaacaaca

SEQ ID NO: 96714 - DNA, 25 bp, S. pombe
gttgtcattcttgttccaggaacgc

SEQ ID NO: 96715 - DNA, 25 bp, S. pombe
gttgttacattcattcccgaacgtc

SEQ ID NO: 96716 - DNA, 25 bp, S. pombe
gttgttacaaatactgcccgagccc

SEQ ID NO: 96717 - DNA, 25 bp, S. pombe
gttgttgcgaaaactgtccgacctc

SEQ ID NO: 96718 - DNA, 25 bp, S. pombe
gattggtcaaaaagccccgacttca

SEQ ID NO: 96719 - DNA, 25 bp, S. pombe
gattctatctgcaagtggactcaca

SEQ ID NO: 96720 - DNA, 25 bp, S. pombe
gattcttctgaattgcaggtcccta

SEQ ID NO: 96721 - DNA, 25 bp, S. pombe
gattcctctgaattggcatttcgtt

SEQ ID NO: 96722 - DNA, 25 bp, S. pombe
gattctcgtgatcaagctactgcta

SEQ ID NO: 96723 - DNA, 25 bp, S. pombe
gattcatctgtgttcattccactta

SEQ ID NO: 96724 - DNA, 25 bp, S. pombe
gattgacccatcctttaataccgag

SEQ ID NO: 96725 - DNA, 25 bp, S. pombe
gttgaagacgaatcccatgccatta

SEQ ID NO: 96726 - DNA, 25 bp, S. pombe
gattaagcaggtatcctccacatat

SEQ ID NO: 96727 - DNA, 25 bp, S. pombe
gattcaacaacttcttaccaacggc

SEQ ID NO: 96728 - DNA, 25 bp, S. pombe
gattcacaagttttaaccgacgaga

SEQ ID NO: 96729 - DNA, 25 bp, S. pombe
gattcaattcgtttatcccttcgga

SEQ ID NO: 96730 - DNA, 25 bp, S. pombe
gattgtccgggtgatctatgatgaa

SEQ ID NO: 96731 - DNA, 25 bp, S. pombe
gattggacggctcttctaaaattag

SEQ ID NO: 96732 - DNA, 25 bp, S. pombe
gttggagagccttttgacgaaattt

SEQ ID NO: 96733 - DNA, 25 bp, S. pombe
gattgggagcgcgttcagtcgaaat

SEQ ID NO: 96734 - DNA, 25 bp, S. pombe
gattgacaccaatgctctaagttta

SEQ ID NO: 96735 - DNA, 25 bp, S. pombe
gttgatccagaagcttacacagtta

SEQ ID NO: 96736 - DNA, 25 bp, S. pombe
gttgcatcaaattcggtaacctgaa

SEQ ID NO: 96737 - DNA, 25 bp, S. pombe
gattgcgcagaatctttctcagtct

SEQ ID NO: 96738 - DNA, 25 bp, S. pombe
gattcgcgaagtttgtgatcagctt

SEQ ID NO: 96739 - DNA, 25 bp, S. pombe
gattctgaactgaccatagattctt

SEQ ID NO: 96740 - DNA, 25 bp, S. pombe
gattctcgaacaactatgggtgcat

SEQ ID NO: 96741 - DNA, 25 bp, S. pombe
gattcgtgcatttttccaagtgggt

SEQ ID NO: 96742 - DNA, 25 bp, S. pombe
gattctctcttcgtctgcaaaatga

SEQ ID NO: 96743 - DNA, 25 bp, S. pombe
gattctcgatttatgtacagggtct

SEQ ID NO: 96744 - DNA, 25 bp, S. pombe
gattccttgatgcttgttactgcgt

SEQ ID NO: 96745 - DNA, 25 bp, S. pombe
gttccatcgatggtttcagcatcca

SEQ ID NO: 96746 - DNA, 25 bp, S. pombe
gattcatcgtgctatatttggatcc

SEQ ID NO: 96747 - DNA, 25 bp, S. pombe
gattgaaggctttcctagtccgtaa

SEQ ID NO: 96748 - DNA, 25 bp, S. pombe
gattgtaagttgtcttttcccgaag

SEQ ID NO: 96749 - DNA, 25 bp, S. pombe
gattgtggtacggatccccttatat

SEQ ID NO: 96750 - DNA, 25 bp, S. pombe
gattcatcggactttgatctttcag

SEQ ID NO: 96751 - DNA, 25 bp, S. pombe
gattcatcggattttgtctggacaa

SEQ ID NO: 96752 - DNA, 25 bp, S. pombe
gattctcatgtaaggccgacaacgt

SEQ ID NO: 96753 - DNA, 25 bp, S. pombe
gattcactgtattggctcaaacggt

SEQ ID NO: 96754 - DNA, 25 bp, S. pombe
gttgtccgaagatccttgctttatt

SEQ ID NO: 96755 - DNA, 25 bp, S. pombe
gattgctcataaagactgcccagtg

SEQ ID NO: 96756 - DNA, 25 bp, S. pombe
gattcttcggaaaccagcttggctt

SEQ ID NO: 96757 - DNA, 25 bp, S. pombe
gattctcttaagtaccgtgatgcta

SEQ ID NO: 96758 - DNA, 25 bp, S. pombe
gattgctgccaaggaacgggcacta

SEQ ID NO: 96759 - DNA, 25 bp, S. pombe
gattgctcccatggatggttctgag

SEQ ID NO: 96760 - DNA, 25 bp, S. pombe
gattctccattggttctgtctagaa

SEQ ID NO: 96761 - DNA, 25 bp, S. pombe
gttcccaaggtcttcatccatgaat

SEQ ID NO: 96762 - DNA, 25 bp, S. pombe
gattcccaagtttttcggagctgct

SEQ ID NO: 96763 - DNA, 25 bp, S. pombe
gttgacgcgtttttatcggatgctt

SEQ ID NO: 96764 - DNA, 25 bp, S. pombe
gattgtttccgtaatagcagcgact

SEQ ID NO: 96765 - DNA, 25 bp, S. pombe
gttgcttcttcgaggaattcatccc

SEQ ID NO: 96766 - DNA, 25 bp, S. pombe
gattcgtctatcagaagccattgca

SEQ ID NO: 96767 - DNA, 25 bp, S. pombe
gattcccagttaaacgcttcatctg

SEQ ID NO: 96768 - DNA, 25 bp, S. pombe
gattctacttttgcccatattgctg

SEQ ID NO: 96769 - DNA, 25 bp, S. pombe
gattctctcaattcttcctcaaata

SEQ ID NO: 96770 - DNA, 25 bp, S. pombe
gattcccaaggatcgcatcaaacca

SEQ ID NO: 96771 - DNA, 25 bp, S. pombe
gattcgccagagaaactcctacagc

SEQ ID NO: 96772 - DNA, 25 bp, S. pombe
gattccttgtttgtgtggtgctcca

SEQ ID NO: 96773 - DNA, 25 bp, S. pombe
gattcgtctatcaattcgttctact

SEQ ID NO: 96774 - DNA, 25 bp, S. pombe
gattcctattgcaatgggcttcttc

SEQ ID NO: 96775 - DNA, 25 bp, S. pombe
gattctatattgatgggcgcttcca

SEQ ID NO: 96776 - DNA, 25 bp, S. pombe
gattctgattctttggcggattccg

SEQ ID NO: 96777 - DNA, 25 bp, S. pombe
gattcgcatttgttgcagtctttgc

SEQ ID NO: 96778 - DNA, 25 bp, S. pombe
gattcgatgtcgttagctctttgaa

SEQ ID NO: 96779 - DNA, 25 bp, S. pombe
gattcattacagtccgtgcatattc

SEQ ID NO: 96780 - DNA, 25 bp, S. pombe
gattcttcacagtctttctttgttg

SEQ ID NO: 96781 - DNA, 25 bp, S. pombe
gattccattagtcattcctcatctt

SEQ ID NO: 96782 - DNA, 25 bp, S. pombe
gattcgatgcaaacgattcctcatg

SEQ ID NO: 96783 - DNA, 25 bp, S. pombe
gattctgttaagctgtctccagttc

SEQ ID NO: 96784 - DNA, 25 bp, S. pombe
gattctgaagattctcgtaccatta

SEQ ID NO: 96785 - DNA, 25 bp, S. pombe
gattcttgtcctatgcatatctgca

SEQ ID NO: 96786 - DNA, 25 bp, S. pombe
gattgcttgatcgttttcatggact

SEQ ID NO: 96787 - DNA, 25 bp, S. pombe
gattgctatctcttgtttccagact

SEQ ID NO: 96788 - DNA, 25 bp, S. pombe
gattgcctcattctttgacaacttt

SEQ ID NO: 96789 - DNA, 25 bp, S. pombe
gattgccttagcgttagatcgagcg

SEQ ID NO: 96790 - DNA, 25 bp, S. pombe
gattcctgtagtgccagacgatgct

SEQ ID NO: 96791 - DNA, 25 bp, S. pombe
gattcctctactatcgacgatcaag

SEQ ID NO: 96792 - DNA, 25 bp, S. pombe
gattctttcactctagacaaggctg

SEQ ID NO: 96793 - DNA, 25 bp, S. pombe
gattctttcagatctaatacactcg

SEQ ID NO: 96794 - DNA, 25 bp, S. pombe
gattcctatccagaaggtcctttag

SEQ ID NO: 96795 - DNA, 25 bp, S. pombe
gattgcctacatgaaagcggtgtcc

SEQ ID NO: 96796 - DNA, 25 bp, S. pombe
gattcctacgagtcatgtgggttcc

SEQ ID NO: 96797 - DNA, 25 bp, S. pombe
gattcgccaagatttgcttccacga

SEQ ID NO: 96798 - DNA, 25 bp, S. pombe
gattcgaaagcaactctcattaaga

SEQ ID NO: 96799 - DNA, 25 bp, S. pombe
gattcgtgttcgtttagcctacata

SEQ ID NO: 96800 - DNA, 25 bp, S. pombe
gttggtcgccaggtctccaaaaaat

SEQ ID NO: 96801 - DNA, 25 bp, S. pombe
gttggcccaaaactactcagaaaat

SEQ ID NO: 96802 - DNA, 25 bp, S. pombe
gattggcccaaattctaagcgaaga

SEQ ID NO: 96803 - DNA, 25 bp, S. pombe
gattgcctaacaacccacttgaaat

SEQ ID NO: 96804 - DNA, 25 bp, S. pombe
gttggtactccagcgcacattaaag

SEQ ID NO: 96805 - DNA, 25 bp, S. pombe
gttgagcaagtcacccacttacaag

SEQ ID NO: 96806 - DNA, 25 bp, S. pombe
gttggaatgctaccgcgcttctaga

SEQ ID NO: 96807 - DNA, 25 bp, S. pombe
gattctatcacgaagcgcaggttaa

SEQ ID NO: 96808 - DNA, 25 bp, S. pombe
gattctatgccaaggagcgctttac

SEQ ID NO: 96809 - DNA, 25 bp, S. pombe
gattgagcaccctagaggctcttga

SEQ ID NO: 96810 - DNA, 25 bp, S. pombe
gattgacgatcctgaattctgtgaa

SEQ ID NO: 96811 - DNA, 25 bp, S. pombe
gattgagcgccctgaaattggtgtc

SEQ ID NO: 96812 - DNA, 25 bp, S. pombe
gttgtggctctcgtaaatacctttg

SEQ ID NO: 96813 - DNA, 25 bp, S. pombe
gattgcatcgttgttactatttatt

SEQ ID NO: 96814 - DNA, 25 bp, S. pombe
gattgttttgaggttgccatgcata

SEQ ID NO: 96815 - DNA, 25 bp, S. pombe
gattgcgccgtttagtgcttcaaaa

SEQ ID NO: 96816 - DNA, 25 bp, S. pombe
gattgcgccgtcaatttatccaaat

SEQ ID NO: 96817 - DNA, 25 bp, S. pombe
gattgcctgcaagagattcactaac

SEQ ID NO: 96818 - DNA, 25 bp, S. pombe
gttgtatcaacacttgcgtcgtgca

SEQ ID NO: 96819 - DNA, 25 bp, S. pombe
gattgctatcaagttccttttgcgg

SEQ ID NO: 96820 - DNA, 25 bp, S. pombe
gttgctttaatttcaccttggttag

SEQ ID NO: 96821 - DNA, 25 bp, S. pombe
gttgtttgtcaacgtcgctttagta

SEQ ID NO: 96822 - DNA, 25 bp, S. pombe
gttgttcgtgaacatcctgatttgt

SEQ ID NO: 96823 - DNA, 25 bp, S. pombe
gattccttgtgatgttcctgttcct

SEQ ID NO: 96824 - DNA, 25 bp, S. pombe
gattccttgcttggcttatcattgg

SEQ ID NO: 96825 - DNA, 25 bp, S. pombe
gattcgctactggtgctttatcata

SEQ ID NO: 96826 - DNA, 25 bp, S. pombe
gattccgtctttgatttcagctttg

SEQ ID NO: 96827 - DNA, 25 bp, S. pombe
gattgcccttttgattgtcagtgtt

SEQ ID NO: 96828 - DNA, 25 bp, S. pombe
gattgcaccagctgctgaggttgga

SEQ ID NO: 96829 - DNA, 25 bp, S. pombe
gattgctctgactctaatgttggat

SEQ ID NO: 96830 - DNA, 25 bp, S. pombe
gattcctccgaccagatttgtgaag

SEQ ID NO: 96831 - DNA, 25 bp, S. pombe
gattcgtccagctacaattggtcaa

SEQ ID NO: 96832 - DNA, 25 bp, S. pombe
gattctgcatccataactacaccaa

SEQ ID NO: 96833 - DNA, 25 bp, S. pombe
gattctgctaacgatctcttgaaaa

SEQ ID NO: 96834 - DNA, 25 bp, S. pombe
gattctcgaagcaattcttgcctaa

SEQ ID NO: 96835 - DNA, 25 bp, S. pombe
gattgctcgattttctcattcatta

SEQ ID NO: 96836 - DNA, 25 bp, S. pombe
gattgcagcattcgtttcatgtctt

SEQ ID NO: 96837 - DNA, 25 bp, S. pombe
gattgctattgggatactcatgatt

SEQ ID NO: 96838 - DNA, 25 bp, S. pombe
gattccgatactgattcttccacat

SEQ ID NO: 96839 - DNA, 25 bp, S. pombe
gattgccgaacaacttcttcaaagt

SEQ ID NO: 96840 - DNA, 25 bp, S. pombe
gttgaaccctactttggagccatgt

SEQ ID NO: 96841 - DNA, 25 bp, S. pombe
gttgataccctactttgggcaattg

SEQ ID NO: 96842 - DNA, 25 bp, S. pombe
gattctcctcctcatgaattcgaaa

SEQ ID NO: 96843 - DNA, 25 bp, S. pombe
gattctcctgttaaagttcgtcaag

SEQ ID NO: 96844 - DNA, 25 bp, S. pombe
gattcgcagtttatagttggccaca

SEQ ID NO: 96845 - DNA, 25 bp, S. pombe
gattcggttattttgattgctccac

SEQ ID NO: 96846 - DNA, 25 bp, S. pombe
gattctccatataatgtaccacctg

SEQ ID NO: 96847 - DNA, 25 bp, S. pombe
gattctccagatatgcctgaagccg

SEQ ID NO: 96848 - DNA, 25 bp, S. pombe
gattgctgcaattgaggtccattat

SEQ ID NO: 96849 - DNA, 25 bp, S. pombe
gattctgctgtatggattcttgacc

SEQ ID NO: 96850 - DNA, 25 bp, S. pombe
gattgctgcgaatggaacttgtcac

SEQ ID NO: 96851 - DNA, 25 bp, S. pombe
gattgtgccattctaacatcgtccg

SEQ ID NO: 96852 - DNA, 25 bp, S. pombe
gttgtgccattcttaagtcttctcg

SEQ ID NO: 96853 - DNA, 25 bp, S. pombe
gattgcgcaagagttcccagagctt

SEQ ID NO: 96854 - DNA, 25 bp, S. pombe
gattgctcatgatctttctagcgct

SEQ ID NO: 96855 - DNA, 25 bp, S. pombe
gattctgattctaacctgctacatt

SEQ ID NO: 96856 - DNA, 25 bp, S. pombe
gattgcgcattctctggattacctg

SEQ ID NO: 96857 - DNA, 25 bp, S. pombe
gattgcttggtctttcaactgctat

SEQ ID NO: 96858 - DNA, 25 bp, S. pombe
gattgcatacgatgatgcctcagga

SEQ ID NO: 96859 - DNA, 25 bp, S. pombe
gattctgcacagttgacttcggaac

SEQ ID NO: 96860 - DNA, 25 bp, S. pombe
gattcgactcattcccaaatcgtat

SEQ ID NO: 96861 - DNA, 25 bp, S. pombe
gattggatccttggctatctttttc

SEQ ID NO: 96862 - DNA, 25 bp, S. pombe
gattgaatgccatactgtgtccatg

SEQ ID NO: 96863 - DNA, 25 bp, S. pombe
gattgatatccgcttttctagtagt

SEQ ID NO: 96864 - DNA, 25 bp, S. pombe
gattcctccgaaacttctactagat

SEQ ID NO: 96865 - DNA, 25 bp, S. pombe
gttggagacctcaaatcccattgga

SEQ ID NO: 96866 - DNA, 25 bp, S. pombe
gttggaaactcaagtcccattctgc

SEQ ID NO: 96867 - DNA, 25 bp, S. pombe
gttagtaaccaacccagtttgctca

SEQ ID NO: 96868 - DNA, 25 bp, S. pombe
gattggatggacatacccgtttcaa

SEQ ID NO: 96869 - DNA, 25 bp, S. pombe
gattgagtgtgccatcgacaccgat

SEQ ID NO: 96870 - DNA, 25 bp, S. pombe
gattgaattcattccaccggacgga

SEQ ID NO: 96871 - DNA, 25 bp, S. pombe
gttaagctagtgtccactggacttg

SEQ ID NO: 96872 - DNA, 25 bp, S. pombe
gtttagggcttcacgttccatggac

SEQ ID NO: 96873 - DNA, 25 bp, S. pombe
gattcgagcggaaatgcctgtttct

SEQ ID NO: 96874 - DNA, 25 bp, S. pombe
gattgtgtaggacatgccgttacca

SEQ ID NO: 96875 - DNA, 25 bp, S. pombe
gattgtatcaatgcttccctttgga

SEQ ID NO: 96876 - DNA, 25 bp, S. pombe
gattggatggaagcactctggatta

SEQ ID NO: 96877 - DNA, 25 bp, S. pombe
gattcggattcagactcggactcct

SEQ ID NO: 96878 - DNA, 25 bp, S. pombe
gattgagtactcagctcagccggta

SEQ ID NO: 96879 - DNA, 25 bp, S. pombe
gattgaatcaccaggcggcatcatt

SEQ ID NO: 96880 - DNA, 25 bp, S. pombe
gattgtttgcttactggcggcagca

SEQ ID NO: 96881 - DNA, 25 bp, S. pombe
gattgtgttcatccattacttaccg

SEQ ID NO: 96882 - DNA, 25 bp, S. pombe
gattgcattacctcattttaccggc

SEQ ID NO: 96883 - DNA, 25 bp, S. pombe
gattgcaaaccggtatgcgtcacgc

SEQ ID NO: 96884 - DNA, 25 bp, S. pombe
gattgctaatcctgatttgcccgca

SEQ ID NO: 96885 - DNA, 25 bp, S. pombe
gattgagcgtctatgtttacaccta

SEQ ID NO: 96886 - DNA, 25 bp, S. pombe
gttaggcggctatttgggctactca

SEQ ID NO: 96887 - DNA, 25 bp, S. pombe
gttgtaacgcaacgccaaaccagag

SEQ ID NO: 96888 - DNA, 25 bp, S. pombe
gttccaacccaatcttattgctatt

SEQ ID NO: 96889 - DNA, 25 bp, S. pombe
gattccaatgtcgtacctttctttt

SEQ ID NO: 96890 - DNA, 25 bp, S. pombe
gattgccggattctgtgtcatttac

SEQ ID NO: 96891 - DNA, 25 bp, S. pombe
gattgcccgtatcgagtttttaata

SEQ ID NO: 96892 - DNA, 25 bp, S. pombe
gattgcggcgttcggtttctaacaa

SEQ ID NO: 96893 - DNA, 25 bp, S. pombe
gattgctggatacacgactcatctt

SEQ ID NO: 96894 - DNA, 25 bp, S. pombe
gttgctgatgcatggacgacgataa

SEQ ID NO: 96895 - DNA, 25 bp, S. pombe
gattgattacctcccatcgtataaa

SEQ ID NO: 96896 - DNA, 25 bp, S. pombe
gattgatctccatgaactttataat

SEQ ID NO: 96897 - DNA, 25 bp, S. pombe
gattgaccgcatgctcagtatgtct

SEQ ID NO: 96898 - DNA, 25 bp, S. pombe
gattgtgccgatcctaaagtcttta

SEQ ID NO: 96899 - DNA, 25 bp, S. pombe
gattgtgtataagccaccgtctagt

SEQ ID NO: 96900 - DNA, 25 bp, S. pombe
gttgcgatttatttgcggacgatgc

SEQ ID NO: 96901 - DNA, 25 bp, S. pombe
gattggcgtttcctacgatcacgaa

SEQ ID NO: 96902 - DNA, 25 bp, S. pombe
gattggtattcccttcgataacatt

SEQ ID NO: 96903 - DNA, 25 bp, S. pombe
gattgcagtcatcccctatgggata

SEQ ID NO: 96904 - DNA, 25 bp, S. pombe
gattgactcatcatattcagcagaa

SEQ ID NO: 96905 - DNA, 25 bp, S. pombe
gttgtctcatgacgctgtcgcagaa

SEQ ID NO: 96906 - DNA, 25 bp, S. pombe
gttgtgcagcagacacctgagctta

SEQ ID NO: 96907 - DNA, 25 bp, S. pombe
gattcctgataacgttgctcttcaa

SEQ ID NO: 96908 - DNA, 25 bp, S. pombe
gattcctgatgatcaattgcccaaa

SEQ ID NO: 96909 - DNA, 25 bp, S. pombe
gattcccgataatgtcctcaaagct

SEQ ID NO: 96910 - DNA, 25 bp, S. pombe
gattccaagcatcatttcccgaagc

SEQ ID NO: 96911 - DNA, 25 bp, S. pombe
gattcctacattatatccagcgatg

SEQ ID NO: 96912 - DNA, 25 bp, S. pombe
gttgttacaaacgacatgcgcatcg

SEQ ID NO: 96913 - DNA, 25 bp, S. pombe
gttgttgaccaacgtcgtctcaaag

SEQ ID NO: 96914 - DNA, 25 bp, S. pombe
gattgacctttgtgatgcggttaca

SEQ ID NO: 96915 - DNA, 25 bp, S. pombe
gttgaactgttttgcgtctttagaa

SEQ ID NO: 96916 - DNA, 25 bp, S. pombe
gattggtcactgtttcgttcttaaa

SEQ ID NO: 96917 - DNA, 25 bp, S. pombe
gattgggatgctttggtttcgttaa

SEQ ID NO: 96918 - DNA, 25 bp, S. pombe
gattgccttgtctcgtttatcttga

SEQ ID NO: 96919 - DNA, 25 bp, S. pombe
gattcctgttgatgagcttttcttt

SEQ ID NO: 96920 - DNA, 25 bp, S. pombe
gattccttttctatgttccattctc

SEQ ID NO: 96921 - DNA, 25 bp, S. pombe
gattccttctcctattgttttgcag

SEQ ID NO: 96922 - DNA, 25 bp, S. pombe
gttggtactactttgtttggctatc

SEQ ID NO: 96923 - DNA, 25 bp, S. pombe
gttggaccacctccatatgttaggc

SEQ ID NO: 96924 - DNA, 25 bp, S. pombe
gttggacgccaacaatttacctgaa

SEQ ID NO: 96925 - DNA, 25 bp, S. pombe
gttcgatctgtctctcaaagtagcg

SEQ ID NO: 96926 - DNA, 25 bp, S. pombe
gattgttgtcaagtctccaagaggg

SEQ ID NO: 96927 - DNA, 25 bp, S. pombe
gattgggtaccacactgattcatga

SEQ ID NO: 96928 - DNA, 25 bp, S. pombe
gttggcgtacaataccatcctgaat

SEQ ID NO: 96929 - DNA, 25 bp, S. pombe
gttgtcagtaaacaggtcgcgcaga

SEQ ID NO: 96930 - DNA, 25 bp, S. pombe
gttgtcttacaacaagcgcgtgtac

SEQ ID NO: 96931 - DNA, 25 bp, S. pombe
gttgacctccaacacagactgttaa

SEQ ID NO: 96932 - DNA, 25 bp, S. pombe
gttggctcccaaaacaagcctagta

SEQ ID NO: 96933 - DNA, 25 bp, S. pombe
gttgctgcccctttaagagatgcta

SEQ ID NO: 96934 - DNA, 25 bp, S. pombe
gttgatcaacactccaagcaagcga

SEQ ID NO: 96935 - DNA, 25 bp, S. pombe
gtcatcgaaaactccgtaggcgttg

SEQ ID NO: 96936 - DNA, 25 bp, S. pombe
gtccctagcaactccgtatacgaag

SEQ ID NO: 96937 - DNA, 25 bp, S. pombe
gttgcacagtgatcctaaccaagct

SEQ ID NO: 96938 - DNA, 25 bp, S. pombe
gattgatcgtattcctaacgccgta

SEQ ID NO: 96939 - DNA, 25 bp, S. pombe
gattgatcctagacttgttcgcttg

SEQ ID NO: 96940 - DNA, 25 bp, S. pombe
gttgtcccggatgtattacgagttc

SEQ ID NO: 96941 - DNA, 25 bp, S. pombe
gttggcccatatgatgcaaggtcct

SEQ ID NO: 96942 - DNA, 25 bp, S. pombe
gttgagcaacgttcagtcgttcgtc

SEQ ID NO: 96943 - DNA, 25 bp, S. pombe
gattgacctctgctaaagtctcttc

SEQ ID NO: 96944 - DNA, 25 bp, S. pombe
gttgaagctttcactgactacgctc

SEQ ID NO: 96945 - DNA, 25 bp, S. pombe
gttgaagcctgcgtttagtatcgac

SEQ ID NO: 96946 - DNA, 25 bp, S. pombe
gattgccttttccttatgtcacaaa

SEQ ID NO: 96947 - DNA, 25 bp, S. pombe
gattgatttacccagctttacagaa

SEQ ID NO: 96948 - DNA, 25 bp, S. pombe
gttgattttagctctctttcgaatg

SEQ ID NO: 96949 - DNA, 25 bp, S. pombe
gattgtttatccaacgtgtcttaca

SEQ ID NO: 96950 - DNA, 25 bp, S. pombe
gattggtggatccattcttgcttct

SEQ ID NO: 96951 - DNA, 25 bp, S. pombe
gattgcgcttgctattttagttgta

SEQ ID NO: 96952 - DNA, 25 bp, S. pombe
gttgagcgactctttgggtttgccc

SEQ ID NO: 96953 - DNA, 25 bp, S. pombe
gttgtgactctttggtatcgtgctc

SEQ ID NO: 96954 - DNA, 25 bp, S. pombe
gattgtgtcattttcgataccgctc

SEQ ID NO: 96955 - DNA, 25 bp, S. pombe
gattgttcctcgaaaaccagcgact

SEQ ID NO: 96956 - DNA, 25 bp, S. pombe
gattgttcctgcatcaacgagcgat

SEQ ID NO: 96957 - DNA, 25 bp, S. pombe
gtatcttacattttgcaaacttggt

SEQ ID NO: 96958 - DNA, 25 bp, S. pombe
gttgttgacaccagcaaactcgttt

SEQ ID NO: 96959 - DNA, 25 bp, S. pombe
gattgttccccacaagacttttgtt

SEQ ID NO: 96960 - DNA, 25 bp, S. pombe
gttggtctaccgaagtcattttcta

SEQ ID NO: 96961 - DNA, 25 bp, S. pombe
gttgttgtcgtcttgaccctaatta

SEQ ID NO: 96962 - DNA, 25 bp, S. pombe
gttgaagcatggaaccgtctaattc

SEQ ID NO: 96963 - DNA, 25 bp, S. pombe
gattgtttatgcaagctcaacgaga

SEQ ID NO: 96964 - DNA, 25 bp, S. pombe
gttgtcgaacctactaatgctgccg

SEQ ID NO: 96965 - DNA, 25 bp, S. pombe
gttgtacaccacttgctaatctagc

SEQ ID NO: 96966 - DNA, 25 bp, S. pombe
gattgcaacaaactaaagtgtactt

SEQ ID NO: 96967 - DNA, 25 bp, S. pombe
gttgaacaaacttcttggtcacgtt

SEQ ID NO: 96968 - DNA, 25 bp, S. pombe
gattggataggcgtcaccgtctttg

SEQ ID NO: 96969 - DNA, 25 bp, S. pombe
gattggaatgttttctcccttcaaa

SEQ ID NO: 96970 - DNA, 25 bp, S. pombe
gttgtcctttgtcgtcctaaaaatg

SEQ ID NO: 96971 - DNA, 25 bp, S. pombe
gttgcttttagtcagcctagtgaaa

SEQ ID NO: 96972 - DNA, 25 bp, S. pombe
gttgttcctgttacagcatcggcta

SEQ ID NO: 96973 - DNA, 25 bp, S. pombe
gttcggtcaaagtggcattcctgga

SEQ ID NO: 96974 - DNA, 25 bp, S. pombe
gttggcctactgatggtccttctta

SEQ ID NO: 96975 - DNA, 25 bp, S. pombe
gttggaatactatgcgatgctttct

SEQ ID NO: 96976 - DNA, 25 bp, S. pombe
gttggccacgtttgcaatgcatttc

SEQ ID NO: 96977 - DNA, 25 bp, S. pombe
gttgggcactgcttataagtcatct

SEQ ID NO: 96978 - DNA, 25 bp, S. pombe
gattgtcccatttcagaggtcccaa

SEQ ID NO: 96979 - DNA, 25 bp, S. pombe
gattggcgcctataagtatctcgaa

SEQ ID NO: 96980 - DNA, 25 bp, S. pombe
gattggctcgtaaaaccttgggatt

SEQ ID NO: 96981 - DNA, 25 bp, S. pombe
gttggctcttactacatacctgggt

SEQ ID NO: 96982 - DNA, 25 bp, S. pombe
gttggatttcctagaaccatcaatt

SEQ ID NO: 96983 - DNA, 25 bp, S. pombe
gttggccaagttgattgtcggtttt

SEQ ID NO: 96984 - DNA, 25 bp, S. pombe
gttggcgacagaattccttcgtcta

SEQ ID NO: 96985 - DNA, 25 bp, S. pombe
gttggaacagaacgcctccgtatca

SEQ ID NO: 96986 - DNA, 25 bp, S. pombe
gttggtgatggatttactcgccgcc

SEQ ID NO: 96987 - DNA, 25 bp, S. pombe
gttgaaaccatcatcgagactcctg

SEQ ID NO: 96988 - DNA, 25 bp, S. pombe
gttgtaacgctgtctgttggtcacc

SEQ ID NO: 96989 - DNA, 25 bp, S. pombe
gttggaagctgccttttcgtactag

SEQ ID NO: 96990 - DNA, 25 bp, S. pombe
gttggagtgtccatgcaccttctaa

SEQ ID NO: 96991 - DNA, 25 bp, S. pombe
gttgtggtctccttatggaatccga

SEQ ID NO: 96992 - DNA, 25 bp, S. pombe
gattgtcgttcttttgtaggcactg

SEQ ID NO: 96993 - DNA, 25 bp, S. pombe
gattgatctattgacctgtacgctc

SEQ ID NO: 96994 - DNA, 25 bp, S. pombe
gattgattcatatcacgctttgcga

SEQ ID NO: 96995 - DNA, 25 bp, S. pombe
gattgcaattcttaccgagcattat

SEQ ID NO: 96996 - DNA, 25 bp, S. pombe
gattggtgtctgtactcatcttggt

SEQ ID NO: 96997 - DNA, 25 bp, S. pombe
gattggcctctatctatgagcgatg

SEQ ID NO: 96998 - DNA, 25 bp, S. pombe
gattgtgccttattccgcggagagc

SEQ ID NO: 96999 - DNA, 25 bp, S. pombe
gttgatgccgcttgtatcgcagtaa

SEQ ID NO: 97000 - DNA, 25 bp, S. pombe
gttgatgccagtgttgcgacgcaga

SEQ ID NO: 97001 - DNA, 25 bp, S. pombe
gattgttcattttccggattgttgt

SEQ ID NO: 97002 - DNA, 25 bp, S. pombe
gttcggctgccaaagtatcggtact

SEQ ID NO: 97003 - DNA, 25 bp, S. pombe
gttcgcgcttgggagtaccgtcaga

SEQ ID NO: 97004 - DNA, 25 bp, S. pombe
gttgggttggtcttatccttgcgat

SEQ ID NO: 97005 - DNA, 25 bp, S. pombe
gttggtgttcgcgtaattctaattc

SEQ ID NO: 97006 - DNA, 25 bp, S. pombe
gttggtgtgtccgtagattttctcc

SEQ ID NO: 97007 - DNA, 25 bp, S. pombe
gttggtcgtgtccatcgtttgttac

SEQ ID NO: 97008 - DNA, 25 bp, S. pombe
gttggtttacgatgcacttgctgtc

SEQ ID NO: 97009 - DNA, 25 bp, S. pombe
gttcgattaaaagcgcagtctccaa

SEQ ID NO: 97010 - DNA, 25 bp, S. pombe
gattgtttaaatcctccactcgcaa

SEQ ID NO: 97011 - DNA, 25 bp, S. pombe
gattgtttggtcttctagtgcctac

SEQ ID NO: 97012 - DNA, 25 bp, S. pombe
gattgttgttctcttattgcagcta

SEQ ID NO: 97013 - DNA, 25 bp, S. pombe
gttctacgtacagtggtgttccaat

SEQ ID NO: 97014 - DNA, 25 bp, S. pombe
gttgctacagcacctaaatcttggg

SEQ ID NO: 97015 - DNA, 25 bp, S. pombe
gattgtgaaacgctcgatccttggc

SEQ ID NO: 97016 - DNA, 25 bp, S. pombe
gtagtcttgaagtcggtcctatcgt

SEQ ID NO: 97017 - DNA, 25 bp, S. pombe
ggaggtggatactggcttttcgtta

SEQ ID NO: 97018 - DNA, 25 bp, S. pombe
ggagggcgaattcttctaactggaa

SEQ ID NO: 97019 - DNA, 25 bp, S. pombe
gttgtttgatgcttttactaacgga

SEQ ID NO: 97020 - DNA, 25 bp, S. pombe
gttgatcctgattttttgtttacca

SEQ ID NO: 97021 - DNA, 25 bp, S. pombe
gattgtcatgttcgccatcatttct

SEQ ID NO: 97022 - DNA, 25 bp, S. pombe
gttggtgaagtccttagcgcaatta

SEQ ID NO: 97023 - DNA, 25 bp, S. pombe
gttgatcccaggcttgcagaacatt

SEQ ID NO: 97024 - DNA, 25 bp, S. pombe
gttgatcccagcgttcacaaatggt

SEQ ID NO: 97025 - DNA, 25 bp, S. pombe
gttgattgccgctaccaagaaggtt

SEQ ID NO: 97026 - DNA, 25 bp, S. pombe
gttgttgccgattcaaccaactcta

SEQ ID NO: 97027 - DNA, 25 bp, S. pombe
gattgatcctttttgtgacaaccta

SEQ ID NO: 97028 - DNA, 25 bp, S. pombe
gattggttcatacagggccaacgat

SEQ ID NO: 97029 - DNA, 25 bp, S. pombe
gtccctcccgaaaggaaactgctgt

SEQ ID NO: 97030 - DNA, 25 bp, S. pombe
gttgctccgcctaaagcaaatccgt

SEQ ID NO: 97031 - DNA, 25 bp, S. pombe
gttgcacctctagcatgtgaaacac

SEQ ID NO: 97032 - DNA, 25 bp, S. pombe
gttgaccctcagacgttggaacaaa

SEQ ID NO: 97033 - DNA, 25 bp, S. pombe
gattggccgccatgtgttttacaaa

SEQ ID NO: 97034 - DNA, 25 bp, S. pombe
gattggtgccctactggtttcaaaa

SEQ ID NO: 97035 - DNA, 25 bp, S. pombe
gttgttagacgaaagtgcccacgat

SEQ ID NO: 97036 - DNA, 25 bp, S. pombe
gattgttaacgattacgcttgccga

SEQ ID NO: 97037 - DNA, 25 bp, S. pombe
gttgcttaacaagtaccgtcctgag

SEQ ID NO: 97038 - DNA, 25 bp, S. pombe
gttttctaatttttcgtccgatgat

SEQ ID NO: 97039 - DNA, 25 bp, S. pombe
gttggtactccaattgtcactgata

SEQ ID NO: 97040 - DNA, 25 bp, S. pombe
gttggtacacttttctacgcatcag

SEQ ID NO: 97041 - DNA, 25 bp, S. pombe
gttggctcgtcgtctccgtggcgaa

SEQ ID NO: 97042 - DNA, 25 bp, S. pombe
gttggctcgtcgtctccgtggcgaa

SEQ ID NO: 97043 - DNA, 25 bp, S. pombe
gttggctgcgttttgccgtgataaa

SEQ ID NO: 97044 - DNA, 25 bp, S. pombe
gattggcccgtattgatgctctctt

SEQ ID NO: 97045 - DNA, 25 bp, S. pombe
gttgtcaccaatacgtatcctatca

SEQ ID NO: 97046 - DNA, 25 bp, S. pombe
gattgtcaagatttcacgctccaga

SEQ ID NO: 97047 - DNA, 25 bp, S. pombe
gttggagatccttacatctacgatt

SEQ ID NO: 97048 - DNA, 25 bp, S. pombe
gttggctccatcgtttatagttttg

SEQ ID NO: 97049 - DNA, 25 bp, S. pombe
gttgagtttgttttgcctccagaaa

SEQ ID NO: 97050 - DNA, 25 bp, S. pombe
gattggcgtctgtttatgcctgaaa

SEQ ID NO: 97051 - DNA, 25 bp, S. pombe
gattggctgccttaaatgccgcaaa

SEQ ID NO: 97052 - DNA, 25 bp, S. pombe
gttgattcgacttttgacctgtttg

SEQ ID NO: 97053 - DNA, 25 bp, S. pombe
gttgtcgaagctatggcaccggtgt

SEQ ID NO: 97054 - DNA, 25 bp, S. pombe
gttgttaacatcaagccccaggttg

SEQ ID NO: 97055 - DNA, 25 bp, S. pombe
gttgtgtcacgttcgaattcatttt

SEQ ID NO: 97056 - DNA, 25 bp, S. pombe
gttggtcacagtacgggacatttga

SEQ ID NO: 97057 - DNA, 25 bp, S. pombe
gttggactcgtgacaagctacttta

SEQ ID NO: 97058 - DNA, 25 bp, S. pombe
gattggaatgttcactggtccttca

SEQ ID NO: 97059 - DNA, 25 bp, S. pombe
gattgtgacattatattcgttcttg

SEQ ID NO: 97060 - DNA, 25 bp, S. pombe
gattggacatgtatacttcttcgtt

SEQ ID NO: 97061 - DNA, 25 bp, S. pombe
gttgtcttttaccttcagtcacttt

SEQ ID NO: 97062 - DNA, 25 bp, S. pombe
gttgttttccatttctagatactga

SEQ ID NO: 97063 - DNA, 25 bp, S. pombe
gttgatttctgcttccttagacgat

SEQ ID NO: 97064 - DNA, 25 bp, S. pombe
gttgatctctccttggctaatgtta

SEQ ID NO: 97065 - DNA, 25 bp, S. pombe
gttgcagctcagaccggtacagatc

SEQ ID NO: 97066 - DNA, 25 bp, S. pombe
gttgcatctggagctcttcaaacat

SEQ ID NO: 97067 - DNA, 25 bp, S. pombe
gttgctcaaatgcttcgaatcgtcg

SEQ ID NO: 97068 - DNA, 25 bp, S. pombe
gttgtcaaggttgccaactctcgca

SEQ ID NO: 97069 - DNA, 25 bp, S. pombe
gttatgttggattcgggtcttcctt

SEQ ID NO: 97070 - DNA, 25 bp, S. pombe
gttctatttgactctggtgttcgtt

SEQ ID NO: 97071 - DNA, 25 bp, S. pombe
gttgctcttaactcggatgtggctc

SEQ ID NO: 97072 - DNA, 25 bp, S. pombe
gttggccaacgtcaatatgaagctt

SEQ ID NO: 97073 - DNA, 25 bp, S. pombe
gttggcgcaacaaagcttatctatt

SEQ ID NO: 97074 - DNA, 25 bp, S. pombe
gttgtctctcggtttttgcacaaac

SEQ ID NO: 97075 - DNA, 25 bp, S. pombe
gttgattcctcagctagtcgtttag

SEQ ID NO: 97076 - DNA, 25 bp, S. pombe
gttgaaattcacgatggtccttata

SEQ ID NO: 97077 - DNA, 25 bp, S. pombe
gttggcagaacttccatcagttggt

SEQ ID NO: 97078 - DNA, 25 bp, S. pombe
gttggcgcaaacacatctcttggta

SEQ ID NO: 97079 - DNA, 25 bp, S. pombe
gttgattgcatttttagcgctcatc

SEQ ID NO: 97080 - DNA, 25 bp, S. pombe
gttgattcatgttaccaggctcttt

SEQ ID NO: 97081 - DNA, 25 bp, S. pombe
gttgttgacttatctgatcctcttg

SEQ ID NO: 97082 - DNA, 25 bp, S. pombe
gttgtctacatttagtacaccgtga

SEQ ID NO: 97083 - DNA, 25 bp, S. pombe
gttgagtcccgaattgacagcctcg

SEQ ID NO: 97084 - DNA, 25 bp, S. pombe
gttggacgccgaattgtcacatctt

SEQ ID NO: 97085 - DNA, 25 bp, S. pombe
gttgttccaaaatcaccactaagtt

SEQ ID NO: 97086 - DNA, 25 bp, S. pombe
gttgatctcttaaatcccagtcatg

SEQ ID NO: 97087 - DNA, 25 bp, S. pombe
gttatgacaggctctatcgcggacg

SEQ ID NO: 97088 - DNA, 25 bp, S. pombe
gttggcaatggcactactgaggtat

SEQ ID NO: 97089 - DNA, 25 bp, S. pombe
gttgaaaacgcatcatatggcaatt

SEQ ID NO: 97090 - DNA, 25 bp, S. pombe
gttggacacccatgatattactcgt

SEQ ID NO: 97091 - DNA, 25 bp, S. pombe
gttgcgtgcccatctacaagattgg

SEQ ID NO: 97092 - DNA, 25 bp, S. pombe
gttggccgatagcaattcagaaccc

SEQ ID NO: 97093 - DNA, 25 bp, S. pombe
gttcgtcgcgagcaaaaacttccag

SEQ ID NO: 97094 - DNA, 25 bp, S. pombe
tgttgccggcaacacgaaacttcgg

SEQ ID NO: 97095 - DNA, 25 bp, S. pombe
gttgaatgccaaccatccagatcat

SEQ ID NO: 97096 - DNA, 25 bp, S. pombe
gttgctgatcaaaccaccgatatcg

SEQ ID NO: 97097 - DNA, 25 bp, S. pombe
gttggactatgcaggccaggacgcc

SEQ ID NO: 97098 - DNA, 25 bp, S. pombe
gttcgctgaagccaaaatcgttcct

SEQ ID NO: 97099 - DNA, 25 bp, S. pombe
gttgccgaggcgaagaagctcttct

SEQ ID NO: 97100 - DNA, 25 bp, S. pombe
gttggctgaggacttgaactctgat

SEQ ID NO: 97101 - DNA, 25 bp, S. pombe
gattggcttgctactgatttgtgga

SEQ ID NO: 97102 - DNA, 25 bp, S. pombe
gttggcattgctcccattaatggat

SEQ ID NO: 97103 - DNA, 25 bp, S. pombe
gttgtggatctgttaatcgcgttac

SEQ ID NO: 97104 - DNA, 25 bp, S. pombe
gttgggcgcggtaatcacagtgcta

SEQ ID NO: 97105 - DNA, 25 bp, S. pombe
gttggactggtgtgctcttgaataa

SEQ ID NO: 97106 - DNA, 25 bp, S. pombe
gttgtttgttcatcctgtggttcaa

SEQ ID NO: 97107 - DNA, 25 bp, S. pombe
gttggtttgatcaccattggcgcca

SEQ ID NO: 97108 - DNA, 25 bp, S. pombe
gttggattttatctgagggcctcaa

SEQ ID NO: 97109 - DNA, 25 bp, S. pombe
gttggatgtcacttctctagagagt

SEQ ID NO: 97110 - DNA, 25 bp, S. pombe
gttgtttctcaacgctgtgaagatg

SEQ ID NO: 97111 - DNA, 25 bp, S. pombe
gttttcctcccggttcaatgactgg

SEQ ID NO: 97112 - DNA, 25 bp, S. pombe
gttgttccctaaacctcaaagtgag

SEQ ID NO: 97113 - DNA, 25 bp, S. pombe
gttgttccttacgaccttgaagacg

SEQ ID NO: 97114 - DNA, 25 bp, S. pombe
gttggatcctgttaagcgttacgac

SEQ ID NO: 97115 - DNA, 25 bp, S. pombe
gttggcttcccttacaaaatccgag

SEQ ID NO: 97116 - DNA, 25 bp, S. pombe
gttccttctaattcaccaactcgaa

SEQ ID NO: 97117 - DNA, 25 bp, S. pombe
gttgtcatcactaacggatttccca

SEQ ID NO: 97118 - DNA, 25 bp, S. pombe
gttgtatactcttcgtttacatcaa

SEQ ID NO: 97119 - DNA, 25 bp, S. pombe
gttgtgctcatttatctgtttcgga

SEQ ID NO: 97120 - DNA, 25 bp, S. pombe
gttgggctgttgatgcattacgtat

SEQ ID NO: 97121 - DNA, 25 bp, S. pombe
gttgggctgtatatgcttttccata

SEQ ID NO: 97122 - DNA, 25 bp, S. pombe
gttggtggtgatcagcttgtttcta

SEQ ID NO: 97123 - DNA, 25 bp, S. pombe
gttggtggttacattgcagcttcta

SEQ ID NO: 97124 - DNA, 25 bp, S. pombe
gttggagttttcattggctctgcca

SEQ ID NO: 97125 - DNA, 25 bp, S. pombe
ggatccaacaagcactcgtactaat

SEQ ID NO: 97126 - DNA, 25 bp, S. pombe
gttcctttagcttcactttttgtgg

SEQ ID NO: 97127 - DNA, 25 bp, S. pombe
gttgccaggttcttttcttaactat

SEQ ID NO: 97128 - DNA, 25 bp, S. pombe
gttgctatgcaatcctccttatata

SEQ ID NO: 97129 - DNA, 25 bp, S. pombe
gttgtatcagagtatcgcctgcaaa

SEQ ID NO: 97130 - DNA, 25 bp, S. pombe
gttgattacagctaccccgaagatt

SEQ ID NO: 97131 - DNA, 25 bp, S. pombe
gttgatgttagtcttcccaagtttg

SEQ ID NO: 97132 - DNA, 25 bp, S. pombe
gttgtcacatcttgcatatcgtgca

SEQ ID NO: 97133 - DNA, 25 bp, S. pombe
gttggcacattgtcgtcatatgcac

SEQ ID NO: 97134 - DNA, 25 bp, S. pombe
gttgcaacaagcatcgtctgtccag

SEQ ID NO: 97135 - DNA, 25 bp, S. pombe
gttgatgagcactctaaggctgaac

SEQ ID NO: 97136 - DNA, 25 bp, S. pombe
gttgcaggccactaacatgacttat

SEQ ID NO: 97137 - DNA, 25 bp, S. pombe
gttggacttctggtatgatcattca

SEQ ID NO: 97138 - DNA, 25 bp, S. pombe
gttggcatccttattcatcttacac

SEQ ID NO: 97139 - DNA, 25 bp, S. pombe
gttggcactgcttctgttcaaaaca

SEQ ID NO: 97140 - DNA, 25 bp, S. pombe
gttggcatgccttttgacgataata

SEQ ID NO: 97141 - DNA, 25 bp, S. pombe
gttggtgctcaatttatggttcata

SEQ ID NO: 97142 - DNA, 25 bp, S. pombe
gttggtctgaacttcgtaagcgagt

SEQ ID NO: 97143 - DNA, 25 bp, S. pombe
gttctcagaatcgtccaaaagtcaa

SEQ ID NO: 97144 - DNA, 25 bp, S. pombe
gttgtccaacattttcattgtccaa

SEQ ID NO: 97145 - DNA, 25 bp, S. pombe
gttgcattctcgaaaggccattcaa

SEQ ID NO: 97146 - DNA, 25 bp, S. pombe
gttgtgtcctgaacactggcatgta

SEQ ID NO: 97147 - DNA, 25 bp, S. pombe
gttgtgatcgtgtttatccatgtga

SEQ ID NO: 97148 - DNA, 25 bp, S. pombe
gttgaacgtcatatgcctggcttaa

SEQ ID NO: 97149 - DNA, 25 bp, S. pombe
gttgataactgcaagtgctcttctt

SEQ ID NO: 97150 - DNA, 25 bp, S. pombe
gttgtaactcatagcgtctaccttc

SEQ ID NO: 97151 - DNA, 25 bp, S. pombe
gttggaattgctagctgtcaccctt

SEQ ID NO: 97152 - DNA, 25 bp, S. pombe
gttggtttcatgaagtcacctcttc

SEQ ID NO: 97153 - DNA, 25 bp, S. pombe
gttgtttctactaattcaccagttg

SEQ ID NO: 97154 - DNA, 25 bp, S. pombe
gttgatgaaccttgtacttgacgat

SEQ ID NO: 97155 - DNA, 25 bp, S. pombe
gttcaagcaccaaagtttctcgctc

SEQ ID NO: 97156 - DNA, 25 bp, S. pombe
gttcatttagacgttaagccttcca

SEQ ID NO: 97157 - DNA, 25 bp, S. pombe
gttcgcttagatgttttgacctcct

SEQ ID NO: 97158 - DNA, 25 bp, S. pombe
gttgcttaaatggacgttacctatc

SEQ ID NO: 97159 - DNA, 25 bp, S. pombe
gttgtctaagagtgcctactctgct

SEQ ID NO: 97160 - DNA, 25 bp, S. pombe
gttgtcataaatcggctctggtctc

SEQ ID NO: 97161 - DNA, 25 bp, S. pombe
gttgtccaaatggatgctctcgtcc

SEQ ID NO: 97162 - DNA, 25 bp, S. pombe
gttgatcctaatgttcttgctgccg

SEQ ID NO: 97163 - DNA, 25 bp, S. pombe
gttttgcttgacacggatactgatc

SEQ ID NO: 97164 - DNA, 25 bp, S. pombe
gttggtgcttctacttggaacgatc

SEQ ID NO: 97165 - DNA, 25 bp, S. pombe
gttcgtttagaaaggtcagccatcg

SEQ ID NO: 97166 - DNA, 25 bp, S. pombe
gttcactgttcagcaggcgtaggac

SEQ ID NO: 97167 - DNA, 25 bp, S. pombe
gttacggtaccgaagttggcatcag

SEQ ID NO: 97168 - DNA, 25 bp, S. pombe
gttgctgctaattccgtcagttcag

SEQ ID NO: 97169 - DNA, 25 bp, S. pombe
gttggtcaatctcttctgttgcaga

SEQ ID NO: 97170 - DNA, 25 bp, S. pombe
gttggatccaacttgtcagtggctt

SEQ ID NO: 97171 - DNA, 25 bp, S. pombe
gttggatctctttgttcaggcttat

SEQ ID NO: 97172 - DNA, 25 bp, S. pombe
gttgattgccttttacgactttgtc

SEQ ID NO: 97173 - DNA, 25 bp, S. pombe
gttggtttagctctacacgttgttc

SEQ ID NO: 97174 - DNA, 25 bp, S. pombe
gttggtgctcttaacaaacttccct

SEQ ID NO: 97175 - DNA, 25 bp, S. pombe
gttgaggagctttacttacttcgta

SEQ ID NO: 97176 - DNA, 25 bp, S. pombe
gttgacaactggtcctaagcttgtt

SEQ ID NO: 97177 - DNA, 25 bp, S. pombe
gttgaaactttccaagcgcttcttg

SEQ ID NO: 97178 - DNA, 25 bp, S. pombe
gttgaaactttacgctcttctcttc

SEQ ID NO: 97179 - DNA, 25 bp, S. pombe
gttgaaacttcacctggttcttgtg

SEQ ID NO: 97180 - DNA, 25 bp, S. pombe
gttgaaagtcattctacgtacattt

SEQ ID NO: 97181 - DNA, 25 bp, S. pombe
gttgactggtgtcctactggattca

SEQ ID NO: 97182 - DNA, 25 bp, S. pombe
tgttcgtgtccgttcccgtgaagga

SEQ ID NO: 97183 - DNA, 25 bp, S. pombe
gttgcgctttatttccgcagttagg

SEQ ID NO: 97184 - DNA, 25 bp, S. pombe
gtctcagctgatgtactcgagcgat

SEQ ID NO: 97185 - DNA, 25 bp, S. pombe
gttgcagctggtgcttcgagaatca

SEQ ID NO: 97186 - DNA, 25 bp, S. pombe
gttgcagtcgatataccagcggatg

SEQ ID NO: 97187 - DNA, 25 bp, S. pombe
gttgtgcctgataattctgctaaag

SEQ ID NO: 97188 - DNA, 25 bp, S. pombe
gttgacgagtcaattcatcttgtag

SEQ ID NO: 97189 - DNA, 25 bp, S. pombe
gttgctcgagcctttcaatcattat

SEQ ID NO: 97190 - DNA, 25 bp, S. pombe
gttgataggctctttactcatctcc

SEQ ID NO: 97191 - DNA, 25 bp, S. pombe
gttacaaccctagtcgtggtgcttt

SEQ ID NO: 97192 - DNA, 25 bp, S. pombe
gttccaaaagctagcggcgcgactg

SEQ ID NO: 97193 - DNA, 25 bp, S. pombe
gttgcaaaatacacgcgtcgccatg

SEQ ID NO: 97194 - DNA, 25 bp, S. pombe
gttgattaatacacgcactctgtgg

SEQ ID NO: 97195 - DNA, 25 bp, S. pombe
gttgtttcatttccccatcatagga

SEQ ID NO: 97196 - DNA, 25 bp, S. pombe
gttggtcatctttcttccactaaga

SEQ ID NO: 97197 - DNA, 25 bp, S. pombe
gttggtcttattgctgctcgtagaa

SEQ ID NO: 97198 - DNA, 25 bp, S. pombe
gttggtctctttactggcgaataca

SEQ ID NO: 97199 - DNA, 25 bp, S. pombe
gttggtgatcctttcgccgaagata

SEQ ID NO: 97200 - DNA, 25 bp, S. pombe
gttggtctcctgttcaatctgttga

SEQ ID NO: 97201 - DNA, 25 bp, S. pombe
gtagcgtcactagcggtcagagcgt

SEQ ID NO: 97202 - DNA, 25 bp, S. pombe
gttgctgaaccttcaacagctcagt

SEQ ID NO: 97203 - DNA, 25 bp, S. pombe
gttgtgaacactgacggcacgctta

SEQ ID NO: 97204 - DNA, 25 bp, S. pombe
gttgtggtcaaacatgccgctcttt

SEQ ID NO: 97205 - DNA, 25 bp, S. pombe
gttgtcgatagttgtactgccttgt

SEQ ID NO: 97206 - DNA, 25 bp, S. pombe
gttgatcgtctcgtcaatggaccta

SEQ ID NO: 97207 - DNA, 25 bp, S. pombe
gtatgataccttgaaacccgtcgtt

SEQ ID NO: 97208 - DNA, 25 bp, S. pombe
gtattggcactagaaactcgggatt

SEQ ID NO: 97209 - DNA, 25 bp, S. pombe
gttgagatctctaaaccttctgaag

SEQ ID NO: 97210 - DNA, 25 bp, S. pombe
gttgtgtttgcaaactcttctcgca

SEQ ID NO: 97211 - DNA, 25 bp, S. pombe
gttgcttttgcagatcttcgaggaa

SEQ ID NO: 97212 - DNA, 25 bp, S. pombe
gttgcgctatatgtgtttgggatgt

SEQ ID NO: 97213 - DNA, 25 bp, S. pombe
gttcgacgaaactccaattgttctt

SEQ ID NO: 97214 - DNA, 25 bp, S. pombe
gttccggatgctacagatgctgcca

SEQ ID NO: 97215 - DNA, 25 bp, S. pombe
gttgaaggtgttcttgctatccgca

SEQ ID NO: 97216 - DNA, 25 bp, S. pombe
gttgacgaggttttctcaacccagc

SEQ ID NO: 97217 - DNA, 25 bp, S. pombe
gttgttttgtttctgatcccaatca

SEQ ID NO: 97218 - DNA, 25 bp, S. pombe
gttgttccgtattccgtctacaaat

SEQ ID NO: 97219 - DNA, 25 bp, S. pombe
gttgatgaccctaattctcttaaag

SEQ ID NO: 97220 - DNA, 25 bp, S. pombe
gttgtgaccttttgcatccttatta

SEQ ID NO: 97221 - DNA, 25 bp, S. pombe
gttgtgctttctctgtttatatttt

SEQ ID NO: 97222 - DNA, 25 bp, S. pombe
gttgtcatttcatcttttgtcgttg

SEQ ID NO: 97223 - DNA, 25 bp, S. pombe
gttctgaatttactaggcgcatcgt

SEQ ID NO: 97224 - DNA, 25 bp, S. pombe
gtctgcattgcattgatcggtgtct

SEQ ID NO: 97225 - DNA, 25 bp, S. pombe
gttgatagaatgaccgagcttgcgt

SEQ ID NO: 97226 - DNA, 25 bp, S. pombe
gttgcaagaattccagtcgctgctt

SEQ ID NO: 97227 - DNA, 25 bp, S. pombe
gttcatgaactaccagtcggcattg

SEQ ID NO: 97228 - DNA, 25 bp, S. pombe
gttgaccttactgaatctgcgtttg

SEQ ID NO: 97229 - DNA, 25 bp, S. pombe
gttgtcttttattgatgctcgggaa

SEQ ID NO: 97230 - DNA, 25 bp, S. pombe
gttgtgtttcaagggctcgatcgac

SEQ ID NO: 97231 - DNA, 25 bp, S. pombe
gtttcaactaccattttgggcgcca

SEQ ID NO: 97232 - DNA, 25 bp, S. pombe
gttccttgcgtacaatctattgctc

SEQ ID NO: 97233 - DNA, 25 bp, S. pombe
gttgtcgtcgtatgattcttactca

SEQ ID NO: 97234 - DNA, 25 bp, S. pombe
gttgtcgacttgtacatacttcctc

SEQ ID NO: 97235 - DNA, 25 bp, S. pombe
gttgttggctttctagtgtcgatat

SEQ ID NO: 97236 - DNA, 25 bp, S. pombe
gttgtaggcatgtccgaacgtctta

SEQ ID NO: 97237 - DNA, 25 bp, S. pombe
gttcgttctaccagaatttcggact

SEQ ID NO: 97238 - DNA, 25 bp, S. pombe
gttcgtttatggagaatcgtcgctc

SEQ ID NO: 97239 - DNA, 25 bp, S. pombe
gttcctaccgcatcagagaccgaaa

SEQ ID NO: 97240 - DNA, 25 bp, S. pombe
gttccgtactgcctataacgctgta

SEQ ID NO: 97241 - DNA, 25 bp, S. pombe
gttgaacgtcaaagcaatctctata

SEQ ID NO: 97242 - DNA, 25 bp, S. pombe
gttgtcgtcaactctcgtggtgaaa

SEQ ID NO: 97243 - DNA, 25 bp, S. pombe
gtcgtggtagactctcgtccagaat

SEQ ID NO: 97244 - DNA, 25 bp, S. pombe
gttgagttggactgtcgcccagaac

SEQ ID NO: 97245 - DNA, 25 bp, S. pombe
gttgtctacgtttgtttgctctagt

SEQ ID NO: 97246 - DNA, 25 bp, S. pombe
gttgtcgtccgaagttgtcactagt

SEQ ID NO: 97247 - DNA, 25 bp, S. pombe
gttgccgcccgaggtttggacattc

SEQ ID NO: 97248 - DNA, 25 bp, S. pombe
gttgccacactaacgtttctactaa

SEQ ID NO: 97249 - DNA, 25 bp, S. pombe
gttgctgccacttacgatgtgacat

SEQ ID NO: 97250 - DNA, 25 bp, S. pombe
gttgcgtcaaattcggtaatgtgaa

SEQ ID NO: 97251 - DNA, 25 bp, S. pombe
gttgctctacaactacgaattctgc

SEQ ID NO: 97252 - DNA, 25 bp, S. pombe
gttgtcaacaatcacgagctcagca

SEQ ID NO: 97253 - DNA, 25 bp, S. pombe
gttgtcaacaaccataatcgccatg

SEQ ID NO: 97254 - DNA, 25 bp, S. pombe
gttgcatataatccagtcgacccat

SEQ ID NO: 97255 - DNA, 25 bp, S. pombe
gttcatttacgaagcggcatgcctt

SEQ ID NO: 97256 - DNA, 25 bp, S. pombe
gtaaccggaaagcttgccttgcaga

SEQ ID NO: 97257 - DNA, 25 bp, S. pombe
gtggccctaagtgtagtaacctcaa

SEQ ID NO: 97258 - DNA, 25 bp, S. pombe
gttgctcgtaaggttcgtacttcta

SEQ ID NO: 97259 - DNA, 25 bp, S. pombe
gttgccgctaatcgttttttcgcta

SEQ ID NO: 97260 - DNA, 25 bp, S. pombe
gttctcgctaattctttttgggttg

SEQ ID NO: 97261 - DNA, 25 bp, S. pombe
gttgctcgtccaccaattttgggat

SEQ ID NO: 97262 - DNA, 25 bp, S. pombe
gttgattcagagcttggtcgccgta

SEQ ID NO: 97263 - DNA, 25 bp, S. pombe
gttgttcatggctattaatcgtcgt

SEQ ID NO: 97264 - DNA, 25 bp, S. pombe
gttgcgtcggtaactctagtggctc

SEQ ID NO: 97265 - DNA, 25 bp, S. pombe
gttctcctggttacttgcatatggc

SEQ ID NO: 97266 - DNA, 25 bp, S. pombe
gtataccggttaccaataccaagca

SEQ ID NO: 97267 - DNA, 25 bp, S. pombe
gttgcgccttcttagaccttacgaa

SEQ ID NO: 97268 - DNA, 25 bp, S. pombe
gttgcgcaatttcaggcctaacagc

SEQ ID NO: 97269 - DNA, 25 bp, S. pombe
gttgctactcaagatactgatgtct

SEQ ID NO: 97270 - DNA, 25 bp, S. pombe
gttgcaatccaacatgtctcatttg

SEQ ID NO: 97271 - DNA, 25 bp, S. pombe
gttgatcagcctaaagtctctactt

SEQ ID NO: 97272 - DNA, 25 bp, S. pombe
gttgcagcggctaacgatcttttat

SEQ ID NO: 97273 - DNA, 25 bp, S. pombe
gttgccgaaaaccatgctcattgcc

SEQ ID NO: 97274 - DNA, 25 bp, S. pombe
gttcctaaggatcatctctggctca

SEQ ID NO: 97275 - DNA, 25 bp, S. pombe
gttcctcaagatgtgaatccccagt

SEQ ID NO: 97276 - DNA, 25 bp, S. pombe
gttgctcatgcatgtcttgtttcac

SEQ ID NO: 97277 - DNA, 25 bp, S. pombe
gttgctactaccatattttcttcag

SEQ ID NO: 97278 - DNA, 25 bp, S. pombe
gttgttaacgccatcatgtctctta

SEQ ID NO: 97279 - DNA, 25 bp, S. pombe
gttctgggtctatctggtgggcaaa

SEQ ID NO: 97280 - DNA, 25 bp, S. pombe
gttgctggtgctgacaagtttgccg

SEQ ID NO: 97281 - DNA, 25 bp, S. pombe
gtcgcttacttggaagtccttggca

SEQ ID NO: 97282 - DNA, 25 bp, S. pombe
gttgaaggtgctctcaatctctcaa

SEQ ID NO: 97283 - DNA, 25 bp, S. pombe
gttgatccctcgtttgatagcatgg

SEQ ID NO: 97284 - DNA, 25 bp, S. pombe
gttgttcccatgttttttgtttgca

SEQ ID NO: 97285 - DNA, 25 bp, S. pombe
gttgtttctctattgtccttttaca

SEQ ID NO: 97286 - DNA, 25 bp, S. pombe
gttgtttctgtcttgatttccggaa

SEQ ID NO: 97287 - DNA, 25 bp, S. pombe
gttgttgtaactaatgctcctgaaa

SEQ ID NO: 97288 - DNA, 25 bp, S. pombe
gttccgcttcctaatgacgctgaaa

SEQ ID NO: 97289 - DNA, 25 bp, S. pombe
gttcctcttcttcaaccagtagtga

SEQ ID NO: 97290 - DNA, 25 bp, S. pombe
gggccaatctggaaggttagttcaa

SEQ ID NO: 97291 - DNA, 25 bp, S. pombe
gttgcttacggtaccttagttcaag

SEQ ID NO: 97292 - DNA, 25 bp, S. pombe
gttgcccaccaacaatgaactggag

SEQ ID NO: 97293 - DNA, 25 bp, S. pombe
gttgctaacggagactcactgtcaa

SEQ ID NO: 97294 - DNA, 25 bp, S. pombe
gttgttcttgtatttatccttccaa

SEQ ID NO: 97295 - DNA, 25 bp, S. pombe
gttgttcatgttttttcctttcagc

SEQ ID NO: 97296 - DNA, 25 bp, S. pombe
gttgctttaccatcattcaaacttt

SEQ ID NO: 97297 - DNA, 25 bp, S. pombe
gtttcgtgctggctttaaacgcttt

SEQ ID NO: 97298 - DNA, 25 bp, S. pombe
gtctcgtcacccactaaagcaaata

SEQ ID NO: 97299 - DNA, 25 bp, S. pombe
gttccggtactcacaacatgtacaa

SEQ ID NO: 97300 - DNA, 25 bp, S. pombe
gttatcggtggtcacaaggctgcac

SEQ ID NO: 97301 - DNA, 25 bp, S. pombe
gttgccgtgttctctttggtataac

SEQ ID NO: 97302 - DNA, 25 bp, S. pombe
gttgttgtattctctcaatggcttg

SEQ ID NO: 97303 - DNA, 25 bp, S. pombe
gttgcttccttcattgttcaaatct

SEQ ID NO: 97304 - DNA, 25 bp, S. pombe
gttgcatggccagttcagtatgact

SEQ ID NO: 97305 - DNA, 25 bp, S. pombe
gttgcagtaacttccttcatttctc

SEQ ID NO: 97306 - DNA, 25 bp, S. pombe
gttgcccaagctattcaagctgtct

SEQ ID NO: 97307 - DNA, 25 bp, S. pombe
gttccgctgaaaacattgggcctaa

SEQ ID NO: 97308 - DNA, 25 bp, S. pombe
gttgccgttgtgttggacccgaagc

SEQ ID NO: 97309 - DNA, 25 bp, S. pombe
gttgcccgtgtctggacttatgaaa

SEQ ID NO: 97310 - DNA, 25 bp, S. pombe
gttgttgcttactttgcttttcgca

SEQ ID NO: 97311 - DNA, 25 bp, S. pombe
gttgctgacttaagtgtttctgttc

SEQ ID NO: 97312 - DNA, 25 bp, S. pombe
gttgaacttcaactttctcttaaag

SEQ ID NO: 97313 - DNA, 25 bp, S. pombe
gttgaatttagacgctttccttgaa

SEQ ID NO: 97314 - DNA, 25 bp, S. pombe
gttgcaattttgcttgtaccattac

SEQ ID NO: 97315 - DNA, 25 bp, S. pombe
gttgcaaagttcgttgacacctctc

SEQ ID NO: 97316 - DNA, 25 bp, S. pombe
gttccgagtttttgtcacctatttg

SEQ ID NO: 97317 - DNA, 25 bp, S. pombe
gttctcaggatctctaatttcgtta

SEQ ID NO: 97318 - DNA, 25 bp, S. pombe
gttcgcacgatgaggtacttcgttt

SEQ ID NO: 97319 - DNA, 25 bp, S. pombe
gttgagcaatgcacgcgaacttcgt

SEQ ID NO: 97320 - DNA, 25 bp, S. pombe
gttgaatctcatgcgcgaatccggt

SEQ ID NO: 97321 - DNA, 25 bp, S. pombe
gttgcatcatcgtgttgaggctgtt

SEQ ID NO: 97322 - DNA, 25 bp, S. pombe
gttgctgatcctagtactactgtca

SEQ ID NO: 97323 - DNA, 25 bp, S. pombe
gttgctccatcatttgttattccac

SEQ ID NO: 97324 - DNA, 25 bp, S. pombe
gttgctgctcaatttcttgatgaac

SEQ ID NO: 97325 - DNA, 25 bp, S. pombe
gttgctccagatatctttacacttt

SEQ ID NO: 97326 - DNA, 25 bp, S. pombe
gttgctcgcaataagttacactcta

SEQ ID NO: 97327 - DNA, 25 bp, S. pombe
gttgatgaacaagatcgctacgcat

SEQ ID NO: 97328 - DNA, 25 bp, S. pombe
gttgatttatctgcacctaactcgg

SEQ ID NO: 97329 - DNA, 25 bp, S. pombe
gttcaggaacattcttgcggaggaa

SEQ ID NO: 97330 - DNA, 25 bp, S. pombe
gttcgcgaccatgcctgggttaaat

SEQ ID NO: 97331 - DNA, 25 bp, S. pombe
ggtgcaattgccgactatggtaatc

SEQ ID NO: 97332 - DNA, 25 bp, S. pombe
gttgaacgcgccaaatgagctatat

SEQ ID NO: 97333 - DNA, 25 bp, S. pombe
gttgacacccgttagcattattgcc

SEQ ID NO: 97334 - DNA, 25 bp, S. pombe
gttgcagccctcgaaaattgcatga

SEQ ID NO: 97335 - DNA, 25 bp, S. pombe
gttgcgacacaagacttagacgttc

SEQ ID NO: 97336 - DNA, 25 bp, S. pombe
gttctcacgatactactattacctc

SEQ ID NO: 97337 - DNA, 25 bp, S. pombe
gtatcattcaaagcactctttcctc

SEQ ID NO: 97338 - DNA, 25 bp, S. pombe
gttcttgagaagcaccttatcccta

SEQ ID NO: 97339 - DNA, 25 bp, S. pombe
gttccaagtttacgtatgtcgccct

SEQ ID NO: 97340 - DNA, 25 bp, S. pombe
gttctatcgttcgtgaggttgctgg

SEQ ID NO: 97341 - DNA, 25 bp, S. pombe
gttcgtgtattgctatggttgccct

SEQ ID NO: 97342 - DNA, 25 bp, S. pombe
gttgcagcatttggcaggtactcca

SEQ ID NO: 97343 - DNA, 25 bp, S. pombe
gttgcatgttatgagcgcattccaa

SEQ ID NO: 97344 - DNA, 25 bp, S. pombe
gttgcagctttaaccaatccgattt

SEQ ID NO: 97345 - DNA, 25 bp, S. pombe
gttgagtacgatcctagcaccgggc

SEQ ID NO: 97346 - DNA, 25 bp, S. pombe
gttgcagaacgtactaatccagggc

SEQ ID NO: 97347 - DNA, 25 bp, S. pombe
gttcgcattcgctctgtcattaaag

SEQ ID NO: 97348 - DNA, 25 bp, S. pombe
gttccttgcgattttttggacggca

SEQ ID NO: 97349 - DNA, 25 bp, S. pombe
gttcctttgtattcgaaggcgccaa

SEQ ID NO: 97350 - DNA, 25 bp, S. pombe
gttcgtgtcgttttagaggcttctt

SEQ ID NO: 97351 - DNA, 25 bp, S. pombe
gttctacgtgaataccatgctgact

SEQ ID NO: 97352 - DNA, 25 bp, S. pombe
gttgcgcttgtcctgagaccaaaca

SEQ ID NO: 97353 - DNA, 25 bp, S. pombe
gttgcttgttatcagtgtcgaccaa

SEQ ID NO: 97354 - DNA, 25 bp, S. pombe
gttccttttctagtgtctaccacaa

SEQ ID NO: 97355 - DNA, 25 bp, S. pombe
gttcctttcatcaagttggtcgacg

SEQ ID NO: 97356 - DNA, 25 bp, S. pombe
gttcctcctcgcaagtatcttgaga

SEQ ID NO: 97357 - DNA, 25 bp, S. pombe
gttgcttcattttctggatcgcttg

SEQ ID NO: 97358 - DNA, 25 bp, S. pombe
gttgcaaatgttcctgactcgtatt

SEQ ID NO: 97359 - DNA, 25 bp, S. pombe
gttgcaatgattccacaagctcttt

SEQ ID NO: 97360 - DNA, 25 bp, S. pombe
gttgcagatattaaacccgtttcag

SEQ ID NO: 97361 - DNA, 25 bp, S. pombe
gttgactacattgaccgtgctctta

SEQ ID NO: 97362 - DNA, 25 bp, S. pombe
gttgagaagctttatcctgatccta

SEQ ID NO: 97363 - DNA, 25 bp, S. pombe
gttgaaccagtttctcaacctcaac

SEQ ID NO: 97364 - DNA, 25 bp, S. pombe
gttgacatcaacacgcatttattaa

SEQ ID NO: 97365 - DNA, 25 bp, S. pombe
gttgacatctggacacggttattta

SEQ ID NO: 97366 - DNA, 25 bp, S. pombe
gttcctccgagtcgtgctacattaa

SEQ ID NO: 97367 - DNA, 25 bp, S. pombe
gttcccaaacttccggacaacagag

SEQ ID NO: 97368 - DNA, 25 bp, S. pombe
gttgaagttcccctatctaatttat

SEQ ID NO: 97369 - DNA, 25 bp, S. pombe
gttgaaaagccgaaggctcccattt

SEQ ID NO: 97370 - DNA, 25 bp, S. pombe
gttccatttgtttgtggcagccgta

SEQ ID NO: 97371 - DNA, 25 bp, S. pombe
gttcctttgcttggaggtgttacaa

SEQ ID NO: 97372 - DNA, 25 bp, S. pombe
gttcctgttgttaagcgtgatgagt

SEQ ID NO: 97373 - DNA, 25 bp, S. pombe
gttcctttgtgaaacttctggctac

SEQ ID NO: 97374 - DNA, 25 bp, S. pombe
gttcgcgtatggaattcttctctgc

SEQ ID NO: 97375 - DNA, 25 bp, S. pombe
gttcggcaatggaagctgctgcatt

SEQ ID NO: 97376 - DNA, 25 bp, S. pombe
gttcctccgttgcagcatatatcaa

SEQ ID NO: 97377 - DNA, 25 bp, S. pombe
gttgctcctcggttattcattcaaa

SEQ ID NO: 97378 - DNA, 25 bp, S. pombe
gttgcagagtctaccttatgagtca

SEQ ID NO: 97379 - DNA, 25 bp, S. pombe
gttgcagcaggtattgttgcccaaa

SEQ ID NO: 97380 - DNA, 25 bp, S. pombe
gttgctgcaagtattgttcaccacg

SEQ ID NO: 97381 - DNA, 25 bp, S. pombe
gttctatagcgcttggattactgac

SEQ ID NO: 97382 - DNA, 25 bp, S. pombe
gttgcagtccgctgttgtatgggaa

SEQ ID NO: 97383 - DNA, 25 bp, S. pombe
gttcctgtacccgtgttggatgaat

SEQ ID NO: 97384 - DNA, 25 bp, S. pombe
gttcctttctccagcacaggataat

SEQ ID NO: 97385 - DNA, 25 bp, S. pombe
gttccgttgcccaacactagttata

SEQ ID NO: 97386 - DNA, 25 bp, S. pombe
gttcctgttgtcaagcgtgacgaat

SEQ ID NO: 97387 - DNA, 25 bp, S. pombe
gttgctttgatcattcgaggcccaa

SEQ ID NO: 97388 - DNA, 25 bp, S. pombe
gttcttttactgcatctgatccatt

SEQ ID NO: 97389 - DNA, 25 bp, S. pombe
gttcttattactcgacggacaccta

SEQ ID NO: 97390 - DNA, 25 bp, S. pombe
ggttttgtacgacaaggagcctgat

SEQ ID NO: 97391 - DNA, 25 bp, S. pombe
gttcatgttgtacaaatgggccctt

SEQ ID NO: 97392 - DNA, 25 bp, S. pombe
gttctcattcttccaaatggccaac

SEQ ID NO: 97393 - DNA, 25 bp, S. pombe
gttcgacaccgagcattctgagata

SEQ ID NO: 97394 - DNA, 25 bp, S. pombe
gttccaagccatattgaagcaccct

SEQ ID NO: 97395 - DNA, 25 bp, S. pombe
gtttgactacttctaagaccactgc

SEQ ID NO: 97396 - DNA, 25 bp, S. pombe
gttccctcattggtttaagctttct

SEQ ID NO: 97397 - DNA, 25 bp, S. pombe
gttgctcaaactaattcttccgctt

SEQ ID NO: 97398 - DNA, 25 bp, S. pombe
gttctggaaacgtttctgcagcgca

SEQ ID NO: 97399 - DNA, 25 bp, S. pombe
gttctatggaagctcttgacgcgga

SEQ ID NO: 97400 - DNA, 25 bp, S. pombe
gttccatgctgaagcgctttgacga

SEQ ID NO: 97401 - DNA, 25 bp, S. pombe
gttctccgggatgtcaagagtcgcc

SEQ ID NO: 97402 - DNA, 25 bp, S. pombe
gttcctgacttcaacaagatgtacg

SEQ ID NO: 97403 - DNA, 25 bp, S. pombe
gttccttctactttcatattgcatc

SEQ ID NO: 97404 - DNA, 25 bp, S. pombe
gttgcctattatcgcttcatttgac

SEQ ID NO: 97405 - DNA, 25 bp, S. pombe
gttgcttatcttgcttctgttgatc

SEQ ID NO: 97406 - DNA, 25 bp, S. pombe
gttgcttctctaactttgtttgtga

SEQ ID NO: 97407 - DNA, 25 bp, S. pombe
gttgctctccctacttgtggtttag

SEQ ID NO: 97408 - DNA, 25 bp, S. pombe
gttcctccttattcttatgcgttat

SEQ ID NO: 97409 - DNA, 25 bp, S. pombe
gttccagacctattctttcgtttga

SEQ ID NO: 97410 - DNA, 25 bp, S. pombe
gttccagcagtttctttatcgttta

SEQ ID NO: 97411 - DNA, 25 bp, S. pombe
gttgccgtgttccagtatgatagtg

SEQ ID NO: 97412 - DNA, 25 bp, S. pombe
gttgcattttttgatcgtcatcgac

SEQ ID NO: 97413 - DNA, 25 bp, S. pombe
gttcttgaatttttcggtcatgccg

SEQ ID NO: 97414 - DNA, 25 bp, S. pombe
gttcgcgaatttgtgcttttggaga

SEQ ID NO: 97415 - DNA, 25 bp, S. pombe
gttcgaaatccatttattcctttgg

SEQ ID NO: 97416 - DNA, 25 bp, S. pombe
gttcgcaaataactctatgccctct

SEQ ID NO: 97417 - DNA, 25 bp, S. pombe
gttcaggtgctgacattgccaaggc

SEQ ID NO: 97418 - DNA, 25 bp, S. pombe
gttgctgcgtctaattctgctagag

SEQ ID NO: 97419 - DNA, 25 bp, S. pombe
gttgcgcgattcttctcgcaatgaa

SEQ ID NO: 97420 - DNA, 25 bp, S. pombe
gttcaggatcaatttgagctccaaa

SEQ ID NO: 97421 - DNA, 25 bp, S. pombe
gttgccagtcaatatacccagatga

SEQ ID NO: 97422 - DNA, 25 bp, S. pombe
gttgctttgcatatttctcacatga

SEQ ID NO: 97423 - DNA, 25 bp, S. pombe
gttcgtgctgctattcgtaatcaag

SEQ ID NO: 97424 - DNA, 25 bp, S. pombe
gttcgtctcgccatcaactgataaa

SEQ ID NO: 97425 - DNA, 25 bp, S. pombe
gttcgtcatacccaattcgatgtaa

SEQ ID NO: 97426 - DNA, 25 bp, S. pombe
gttgcgcggcagtctttggaagtaa

SEQ ID NO: 97427 - DNA, 25 bp, S. pombe
gttcgagatagttttggcaagcaat

SEQ ID NO: 97428 - DNA, 25 bp, S. pombe
gttcctgaagtctctgagctcgaga

SEQ ID NO: 97429 - DNA, 25 bp, S. pombe
gttccttcatgttcacaacctgatg

SEQ ID NO: 97430 - DNA, 25 bp, S. pombe
gttccttaatacaatagtgtgcatt

SEQ ID NO: 97431 - DNA, 25 bp, S. pombe
gttcctataaaaacagctgtgcgat

SEQ ID NO: 97432 - DNA, 25 bp, S. pombe
gttctgtgacaaaaagctcttctaa

SEQ ID NO: 97433 - DNA, 25 bp, S. pombe
gttagaaaaccctgacgagcgcaat

SEQ ID NO: 97434 - DNA, 25 bp, S. pombe
gttcttctggtatctaatgcctcaa

SEQ ID NO: 97435 - DNA, 25 bp, S. pombe
gttgcttccatatttagtggcctcc

SEQ ID NO: 97436 - DNA, 25 bp, S. pombe
gttcctcctgatgcacgggatctta

SEQ ID NO: 97437 - DNA, 25 bp, S. pombe
gttgctctaattccatggtctagtc

SEQ ID NO: 97438 - DNA, 25 bp, S. pombe
gttgcgctaatgctatttctatgat

SEQ ID NO: 97439 - DNA, 25 bp, S. pombe
gttgccataatcctttgcttcaagc

SEQ ID NO: 97440 - DNA, 25 bp, S. pombe
gttgcttagatcctcattttctcca

SEQ ID NO: 97441 - DNA, 25 bp, S. pombe
gttgctgttgttgatctatgttcca

SEQ ID NO: 97442 - DNA, 25 bp, S. pombe
gttcgatccatatatgctccttttt

SEQ ID NO: 97443 - DNA, 25 bp, S. pombe
gttcgcaccattcgattttttctgg

SEQ ID NO: 97444 - DNA, 25 bp, S. pombe
gttgcgaaaagccttccgtatctta

SEQ ID NO: 97445 - DNA, 25 bp, S. pombe
gttcggcaaatgcatctcctgctac

SEQ ID NO: 97446 - DNA, 25 bp, S. pombe
gttctagcaatagctgggctgccat

SEQ ID NO: 97447 - DNA, 25 bp, S. pombe
gttccaccatcaaggcctagtgcta

SEQ ID NO: 97448 - DNA, 25 bp, S. pombe
gttcctctgtacatcatttagcaaa

SEQ ID NO: 97449 - DNA, 25 bp, S. pombe
gttgctcgttttttcgtagcatcaa

SEQ ID NO: 97450 - DNA, 25 bp, S. pombe
gttcgttaccgctctaagtgtgctg

SEQ ID NO: 97451 - DNA, 25 bp, S. pombe
gtgaacgcgtacttgctaagggttt

SEQ ID NO: 97452 - DNA, 25 bp, S. pombe
gttccggcggcttaaaacacattgg

SEQ ID NO: 97453 - DNA, 25 bp, S. pombe
gttcgcggctggaaaaagacacgtt

SEQ ID NO: 97454 - DNA, 25 bp, S. pombe
gttaggcgcttaaatgaacctcctt

SEQ ID NO: 97455 - DNA, 25 bp, S. pombe
gttgctggagctgttgttactttaa

SEQ ID NO: 97456 - DNA, 25 bp, S. pombe
gttgctgaagcgattcttggtttac

SEQ ID NO: 97457 - DNA, 25 bp, S. pombe
gttgctggtcagatttatcggtcta

SEQ ID NO: 97458 - DNA, 25 bp, S. pombe
gttcgtcttcactctttttactata

SEQ ID NO: 97459 - DNA, 25 bp, S. pombe
gggtcttccgcaatgaaaccgttga

SEQ ID NO: 97460 - DNA, 25 bp, S. pombe
gttccacttctaagttcactcgtta

SEQ ID NO: 97461 - DNA, 25 bp, S. pombe
gttcctgttcctgtatttgagtttc

SEQ ID NO: 97462 - DNA, 25 bp, S. pombe
gttcctgagaccaccattctgaatt

SEQ ID NO: 97463 - DNA, 25 bp, S. pombe
gttgcgctcaatgtcataccgttga

SEQ ID NO: 97464 - DNA, 25 bp, S. pombe
gttgcgctacgacatatcctttgga

SEQ ID NO: 97465 - DNA, 25 bp, S. pombe
gttcggtcgaaattccatgcttggt

SEQ ID NO: 97466 - DNA, 25 bp, S. pombe
gttccttataatcgacctgcaattt

SEQ ID NO: 97467 - DNA, 25 bp, S. pombe
gttccgatgataacgccgatgcttt

SEQ ID NO: 97468 - DNA, 25 bp, S. pombe
gttccatttcagtcacgcaggttta

SEQ ID NO: 97469 - DNA, 25 bp, S. pombe
gttgccgttcaacagattgagccaa

SEQ ID NO: 97470 - DNA, 25 bp, S. pombe
gttccgttagatctgtgcaagccat

SEQ ID NO: 97471 - DNA, 25 bp, S. pombe
gtttcctcgggctcttatattacaa

SEQ ID NO: 97472 - DNA, 25 bp, S. pombe
gttccacgcagagagctttttgaca

SEQ ID NO: 97473 - DNA, 25 bp, S. pombe
gttctttctcggcttaatccattga

SEQ ID NO: 97474 - DNA, 25 bp, S. pombe
gttctcctcaaaaaagtcactggtt

SEQ ID NO: 97475 - DNA, 25 bp, S. pombe
gttcctatagccttaagccctgtct

SEQ ID NO: 97476 - DNA, 25 bp, S. pombe
gttccctaagctgggttaattcaat

SEQ ID NO: 97477 - DNA, 25 bp, S. pombe
gttgccgcaatactcggtgatattt

SEQ ID NO: 97478 - DNA, 25 bp, S. pombe
gttgcccttactcatgattattctt

SEQ ID NO: 97479 - DNA, 25 bp, S. pombe
gttgccactaacgattgtctatact

SEQ ID NO: 97480 - DNA, 25 bp, S. pombe
gttgcccataattttgtgctctacg

SEQ ID NO: 97481 - DNA, 25 bp, S. pombe
gttcgcagcggtaaagtcctagagt

SEQ ID NO: 97482 - DNA, 25 bp, S. pombe
gttccactgtgcatgttactgtctg

SEQ ID NO: 97483 - DNA, 25 bp, S. pombe
gggacgttccggataacatgcgaac

SEQ ID NO: 97484 - DNA, 25 bp, S. pombe
gttaactttcggactcaacagcaaa

SEQ ID NO: 97485 - DNA, 25 bp, S. pombe
gttaactttgtgaccgaaaccatcg

SEQ ID NO: 97486 - DNA, 25 bp, S. pombe
gttctttctttcaagcccagtttat

SEQ ID NO: 97487 - DNA, 25 bp, S. pombe
gtactaccatggcaagactggtgtt

SEQ ID NO: 97488 - DNA, 25 bp, S. pombe
gttctccatcaggtttttcgtaacg

SEQ ID NO: 97489 - DNA, 25 bp, S. pombe
gttccgaagcatatgtttcctcatt

SEQ ID NO: 97490 - DNA, 25 bp, S. pombe
gttccagtgagctctttgtcagcaa

SEQ ID NO: 97491 - DNA, 25 bp, S. pombe
gttccttacatccattcatgtcgta

SEQ ID NO: 97492 - DNA, 25 bp, S. pombe
gttctttcccaaacagtcgctgaat

SEQ ID NO: 97493 - DNA, 25 bp, S. pombe
gttctttccgtcaattggtctgcaa

SEQ ID NO: 97494 - DNA, 25 bp, S. pombe
gttcttctgctgttaattgcgtcgc

SEQ ID NO: 97495 - DNA, 25 bp, S. pombe
gttctcgatatttacagggctatgg

SEQ ID NO: 97496 - DNA, 25 bp, S. pombe
ggtccaggtggctcaggatatccta

SEQ ID NO: 97497 - DNA, 25 bp, S. pombe
gttaccttcctcagtttcgaaattg

SEQ ID NO: 97498 - DNA, 25 bp, S. pombe
gttatttttcagagtttggaccaca

SEQ ID NO: 97499 - DNA, 25 bp, S. pombe
gttcaattctttctttggtgaccag

SEQ ID NO: 97500 - DNA, 25 bp, S. pombe
gttccggtgatggtagctcgcaaaa

SEQ ID NO: 97501 - DNA, 25 bp, S. pombe
gttcctggtcgtttgtatgtgtgta

SEQ ID NO: 97502 - DNA, 25 bp, S. pombe
gttcttttgctcttcatttacttac

SEQ ID NO: 97503 - DNA, 25 bp, S. pombe
gttcgctgtcctttccaattttaga

SEQ ID NO: 97504 - DNA, 25 bp, S. pombe
gttcgcgattatttgcaacatgtgt

SEQ ID NO: 97505 - DNA, 25 bp, S. pombe
gttgcctgctattttaatcggtcct

SEQ ID NO: 97506 - DNA, 25 bp, S. pombe
gttcctaatttttcatcgctatact

SEQ ID NO: 97507 - DNA, 25 bp, S. pombe
gttgccatctttattgccttgtcag

SEQ ID NO: 97508 - DNA, 25 bp, S. pombe
gttccttgcttgtaggcgcatttat

SEQ ID NO: 97509 - DNA, 25 bp, S. pombe
gttgccatcaccaaaactttcacag

SEQ ID NO: 97510 - DNA, 25 bp, S. pombe
gttctgtacctgcttttattgatca

SEQ ID NO: 97511 - DNA, 25 bp, S. pombe
gttccttcctacgtgtgttattgat

SEQ ID NO: 97512 - DNA, 25 bp, S. pombe
gttccttcactaacttgacgactga

SEQ ID NO: 97513 - DNA, 25 bp, S. pombe
gttcctctctttagttgtcaatcgt

SEQ ID NO: 97514 - DNA, 25 bp, S. pombe
gtagccccttacagtgaacactcga

SEQ ID NO: 97515 - DNA, 25 bp, S. pombe
gttctcgagatgcaaatggaccttc

SEQ ID NO: 97516 - DNA, 25 bp, S. pombe
gttctcgaatacatcagtgaccttg

SEQ ID NO: 97517 - DNA, 25 bp, S. pombe
gttcgaacatccattgtgaggctat

SEQ ID NO: 97518 - DNA, 25 bp, S. pombe
gtatgccctaacttggctgttatgt

SEQ ID NO: 97519 - DNA, 25 bp, S. pombe
gttcaccctgatactggtatttcca

SEQ ID NO: 97520 - DNA, 25 bp, S. pombe
gttcagcccttcgtggtgttcgttt

SEQ ID NO: 97521 - DNA, 25 bp, S. pombe
gttgccagagactatcatccattgt

SEQ ID NO: 97522 - DNA, 25 bp, S. pombe
gttcgatcgattgctgcttttgcat

SEQ ID NO: 97523 - DNA, 25 bp, S. pombe
gttcaaacggattctaatgctgctg

SEQ ID NO: 97524 - DNA, 25 bp, S. pombe
gttcgaagaacctactgagcctacg

SEQ ID NO: 97525 - DNA, 25 bp, S. pombe
gttcgctcagaaagtatctacccct

SEQ ID NO: 97526 - DNA, 25 bp, S. pombe
gttcacggagattctggacggctac

SEQ ID NO: 97527 - DNA, 25 bp, S. pombe
gttcacgggagttggatttcatcac

SEQ ID NO: 97528 - DNA, 25 bp, S. pombe
gttcagtgggtttgagtctgctcca

SEQ ID NO: 97529 - DNA, 25 bp, S. pombe
gttcgtattaactagtgctgctcca

SEQ ID NO: 97530 - DNA, 25 bp, S. pombe
gttctgatgattctccttttttgga

SEQ ID NO: 97531 - DNA, 25 bp, S. pombe
gttcgaaatcagaccatcctttatg

SEQ ID NO: 97532 - DNA, 25 bp, S. pombe
gttccatctataatgcctccttaat

SEQ ID NO: 97533 - DNA, 25 bp, S. pombe
gttaacgtatgtgctcccggaacaa

SEQ ID NO: 97534 - DNA, 25 bp, S. pombe
gttcccagttgtaatagatgccctt

SEQ ID NO: 97535 - DNA, 25 bp, S. pombe
gttcgccttttaaacttcagtgtga

SEQ ID NO: 97536 - DNA, 25 bp, S. pombe
gttcgttattaagacgtcctgctaa

SEQ ID NO: 97537 - DNA, 25 bp, S. pombe
gttcgttgtatttgtagccccagta

SEQ ID NO: 97538 - DNA, 25 bp, S. pombe
gttccatttatcatgctgttgccga

SEQ ID NO: 97539 - DNA, 25 bp, S. pombe
gttcatgacgtttgtgctgttgctt

SEQ ID NO: 97540 - DNA, 25 bp, S. pombe
gttctgatctgttgactcgtggtat

SEQ ID NO: 97541 - DNA, 25 bp, S. pombe
gttcttctcaagttcctggctatat

SEQ ID NO: 97542 - DNA, 25 bp, S. pombe
gttcctagtgtttcatactcccaaa

SEQ ID NO: 97543 - DNA, 25 bp, S. pombe
gttccttgttatttacctccatact

SEQ ID NO: 97544 - DNA, 25 bp, S. pombe
gtttacgctgctatactttctttag

SEQ ID NO: 97545 - DNA, 25 bp, S. pombe
gttcctactctggttggtgcagaac

SEQ ID NO: 97546 - DNA, 25 bp, S. pombe
gttacgcccgctacggagacaagaa

SEQ ID NO: 97547 - DNA, 25 bp, S. pombe
gtctaccctcgacaaggccaaggaa

SEQ ID NO: 97548 - DNA, 25 bp, S. pombe
gttcccttcgccataatcaaattgt

SEQ ID NO: 97549 - DNA, 25 bp, S. pombe
gttctccgacccaaagttattgcgt

SEQ ID NO: 97550 - DNA, 25 bp, S. pombe
gttctccacatacacaaatttcttt

SEQ ID NO: 97551 - DNA, 25 bp, S. pombe
gttcctacaacttcacacgtttcat

SEQ ID NO: 97552 - DNA, 25 bp, S. pombe
gttcgatactactcgggacaccatg

SEQ ID NO: 97553 - DNA, 25 bp, S. pombe
gttcctactattatggcttacgcag

SEQ ID NO: 97554 - DNA, 25 bp, S. pombe
gttctatttttctttgcttatggca

SEQ ID NO: 97555 - DNA, 25 bp, S. pombe
gttcatttctggtgtcttgtgcaag

SEQ ID NO: 97556 - DNA, 25 bp, S. pombe
gttcttctcggtaacttctcaagca

SEQ ID NO: 97557 - DNA, 25 bp, S. pombe
gttcagttcaatcgcctatctggaa

SEQ ID NO: 97558 - DNA, 25 bp, S. pombe
gttactgcatcaaagccacttggga

SEQ ID NO: 97559 - DNA, 25 bp, S. pombe
gttactgtaaagaccccgtggctat

SEQ ID NO: 97560 - DNA, 25 bp, S. pombe
gttaatgaatcataccgccggagct

SEQ ID NO: 97561 - DNA, 25 bp, S. pombe
gttctcttcaacattccagacggta

SEQ ID NO: 97562 - DNA, 25 bp, S. pombe
gttaactcggttgctcaaacgtttg

SEQ ID NO: 97563 - DNA, 25 bp, S. pombe
gttaaccgtgaacatcttcctgttg

SEQ ID NO: 97564 - DNA, 25 bp, S. pombe
gttacccggacatacagatcttatt

SEQ ID NO: 97565 - DNA, 25 bp, S. pombe
gtaaaggtgcctttccagatgagga

SEQ ID NO: 97566 - DNA, 25 bp, S. pombe
gttaagcgtgcacatgtccagaaga

SEQ ID NO: 97567 - DNA, 25 bp, S. pombe
gtatcaagccttgtaccatagaaag

SEQ ID NO: 97568 - DNA, 25 bp, S. pombe
gttctggtcctcgtatccaagagaa

SEQ ID NO: 97569 - DNA, 25 bp, S. pombe
gttcgtgaggccgatgtctatcatc

SEQ ID NO: 97570 - DNA, 25 bp, S. pombe
gttagtagtcctcaatatgctcaag

SEQ ID NO: 97571 - DNA, 25 bp, S. pombe
gttcgtggttccatacatccggaat

SEQ ID NO: 97572 - DNA, 25 bp, S. pombe
gtttctggtagtgtcgaagcctcat

SEQ ID NO: 97573 - DNA, 25 bp, S. pombe
gtttctcggaaaatcgaagcggcta

SEQ ID NO: 97574 - DNA, 25 bp, S. pombe
gttccgagcgtttggccaagtacaa

SEQ ID NO: 97575 - DNA, 25 bp, S. pombe
gttcctgacgctttggttggtacat

SEQ ID NO: 97576 - DNA, 25 bp, S. pombe
gttcaatccattcatgtgccttggg

SEQ ID NO: 97577 - DNA, 25 bp, S. pombe
gttcagctaactgctagtcttggta

SEQ ID NO: 97578 - DNA, 25 bp, S. pombe
gttcccatattttagctgcttcgat

SEQ ID NO: 97579 - DNA, 25 bp, S. pombe
gttcccttatgaagttttgctcgat

SEQ ID NO: 97580 - DNA, 25 bp, S. pombe
gttcaccactcatattcttttgctg

SEQ ID NO: 97581 - DNA, 25 bp, S. pombe
gttcgctatccttttcttatgtcta

SEQ ID NO: 97582 - DNA, 25 bp, S. pombe
gttcattcctcctgatggcgaattt

SEQ ID NO: 97583 - DNA, 25 bp, S. pombe
gttatacatcggctggacccattgc

SEQ ID NO: 97584 - DNA, 25 bp, S. pombe
gttaatagtgagaacgtcccaatcg

SEQ ID NO: 97585 - DNA, 25 bp, S. pombe
gttcgagccaacagtacctatttat

SEQ ID NO: 97586 - DNA, 25 bp, S. pombe
gtgtaggcgcaattttaccttttct

SEQ ID NO: 97587 - DNA, 25 bp, S. pombe
gttcaatagaagacgactcacccta

SEQ ID NO: 97588 - DNA, 25 bp, S. pombe
gttaacaattacgaagctaccactt

SEQ ID NO: 97589 - DNA, 25 bp, S. pombe
gttaaagtttcgagcccaaggtgtg

SEQ ID NO: 97590 - DNA, 25 bp, S. pombe
gttcagtttttgtcttccctaatat

SEQ ID NO: 97591 - DNA, 25 bp, S. pombe
gttcaacttgtggacttttccgagt

SEQ ID NO: 97592 - DNA, 25 bp, S. pombe
gttctagtgcgggacatgtttccaa

SEQ ID NO: 97593 - DNA, 25 bp, S. pombe
gttccgttcccatttgaatcacgag

SEQ ID NO: 97594 - DNA, 25 bp, S. pombe
gttttattcctgtattcaatccggt

SEQ ID NO: 97595 - DNA, 25 bp, S. pombe
gttctcatattcctgttggcatacc

SEQ ID NO: 97596 - DNA, 25 bp, S. pombe
gttcttcattgactggtgacggcgt

SEQ ID NO: 97597 - DNA, 25 bp, S. pombe
gttctccttggtggattgcggagca

SEQ ID NO: 97598 - DNA, 25 bp, S. pombe
gttacttcccctaaggatgcatttg

SEQ ID NO: 97599 - DNA, 25 bp, S. pombe
gttcgccttctacttttacacaatt

SEQ ID NO: 97600 - DNA, 25 bp, S. pombe
gttccgtcattcctcttgataacat

SEQ ID NO: 97601 - DNA, 25 bp, S. pombe
gttcgcggcaatcctttaacgatga

SEQ ID NO: 97602 - DNA, 25 bp, S. pombe
gttcgcctcataactttgactggat

SEQ ID NO: 97603 - DNA, 25 bp, S. pombe
gttcccgcaacctatgtgacagaat

SEQ ID NO: 97604 - DNA, 25 bp, S. pombe
gttctgactgggacaacacgcctat

SEQ ID NO: 97605 - DNA, 25 bp, S. pombe
gttaattcctcgctcttcaatttta

SEQ ID NO: 97606 - DNA, 25 bp, S. pombe
gttcaattcttttcgcttctacttt

SEQ ID NO: 97607 - DNA, 25 bp, S. pombe
gttcgttcttttcgatttactcctg

SEQ ID NO: 97608 - DNA, 25 bp, S. pombe
gttcgcttctttgcaattaccattc

SEQ ID NO: 97609 - DNA, 25 bp, S. pombe
gttctaatcaataccttctaccttc

SEQ ID NO: 97610 - DNA, 25 bp, S. pombe
ggaacactttctatattacggttgt

SEQ ID NO: 97611 - DNA, 25 bp, S. pombe
gttctccagggatgtcactagctct

SEQ ID NO: 97612 - DNA, 25 bp, S. pombe
gttcatgacacactcggtacaagat

SEQ ID NO: 97613 - DNA, 25 bp, S. pombe
gttcccttagagagctgaagcctga

SEQ ID NO: 97614 - DNA, 25 bp, S. pombe
gttcacaacttcctactacttttga

SEQ ID NO: 97615 - DNA, 25 bp, S. pombe
gttctaatttgctttcttcttctct

SEQ ID NO: 97616 - DNA, 25 bp, S. pombe
gttcgaatttctattgctgctcctg

SEQ ID NO: 97617 - DNA, 25 bp, S. pombe
gttcgtaaccatggttgcttccagt

SEQ ID NO: 97618 - DNA, 25 bp, S. pombe
gttcgatgcgacgttattgccaaag

SEQ ID NO: 97619 - DNA, 25 bp, S. pombe
gttcgctggcaggatcaatgttaca

SEQ ID NO: 97620 - DNA, 25 bp, S. pombe
gttatcccgttgcaaattgttgagc

SEQ ID NO: 97621 - DNA, 25 bp, S. pombe
gttcatcctattacccaaaagttgt

SEQ ID NO: 97622 - DNA, 25 bp, S. pombe
gttcacaaagcaaccgtcgcgaatc

SEQ ID NO: 97623 - DNA, 25 bp, S. pombe
gttcaccaactctcctatagtaagg

SEQ ID NO: 97624 - DNA, 25 bp, S. pombe
gttaacaatgctccccatgatgtgt

SEQ ID NO: 97625 - DNA, 25 bp, S. pombe
gttaaccggcttgcaatatgtccaa

SEQ ID NO: 97626 - DNA, 25 bp, S. pombe
gttaatccggccatatttgatgaag

SEQ ID NO: 97627 - DNA, 25 bp, S. pombe
gttcgtgctcttttatcactttcac

SEQ ID NO: 97628 - DNA, 25 bp, S. pombe
gttcaggctgtttctattgatccca

SEQ ID NO: 97629 - DNA, 25 bp, S. pombe
gtttaaatcttaccggatccactag

SEQ ID NO: 97630 - DNA, 25 bp, S. pombe
gttcaaaagtttacctaccagctag

SEQ ID NO: 97631 - DNA, 25 bp, S. pombe
gttcaacaaattcttctatccgccg

SEQ ID NO: 97632 - DNA, 25 bp, S. pombe
gtaaatgcaaacgtttccacacccg

SEQ ID NO: 97633 - DNA, 25 bp, S. pombe
gttcacccaatattatcgacagcct

SEQ ID NO: 97634 - DNA, 25 bp, S. pombe
gttaccgccgtaattgatgagggac

SEQ ID NO: 97635 - DNA, 25 bp, S. pombe
gttaccgtcgtcttattgcaatgag

SEQ ID NO: 97636 - DNA, 25 bp, S. pombe
gttagtggacttatgcttgcaaatc

SEQ ID NO: 97637 - DNA, 25 bp, S. pombe
gttcagtcgctgttatctcaataca

SEQ ID NO: 97638 - DNA, 25 bp, S. pombe
gttcttcacatgatcatctcacttc

SEQ ID NO: 97639 - DNA, 25 bp, S. pombe
gttctcgctatttccaattcatcat

SEQ ID NO: 97640 - DNA, 25 bp, S. pombe
gttatgatcctcaacgccgagaacg

SEQ ID NO: 97641 - DNA, 25 bp, S. pombe
gttcatggattaaccctggcacaca

SEQ ID NO: 97642 - DNA, 25 bp, S. pombe
gttatctgcccttggtggatgggat

SEQ ID NO: 97643 - DNA, 25 bp, S. pombe
gttaatgcaccgacatacgcacgag

SEQ ID NO: 97644 - DNA, 25 bp, S. pombe
gtacttcggcacctatcgatatgga

SEQ ID NO: 97645 - DNA, 25 bp, S. pombe
gttctactcgcttagatgcttctga

SEQ ID NO: 97646 - DNA, 25 bp, S. pombe
gttcgatctcaagacacacgttcac

SEQ ID NO: 97647 - DNA, 25 bp, S. pombe
gttcttctgaacttgagcctttact

SEQ ID NO: 97648 - DNA, 25 bp, S. pombe
gttcatattgcaccattaccttctt

SEQ ID NO: 97649 - DNA, 25 bp, S. pombe
gttcattgtccagtttgctttctat

SEQ ID NO: 97650 - DNA, 25 bp, S. pombe
gttcttgacaacttttttctactgt

SEQ ID NO: 97651 - DNA, 25 bp, S. pombe
gttcgtgaagatgatattctcgtct

SEQ ID NO: 97652 - DNA, 25 bp, S. pombe
gttcgtcaaatcgagacactcactg

SEQ ID NO: 97653 - DNA, 25 bp, S. pombe
gttcgtcaagatcaagttcactgtt

SEQ ID NO: 97654 - DNA, 25 bp, S. pombe
gttcggcaaatgaatcgcttcctgt

SEQ ID NO: 97655 - DNA, 25 bp, S. pombe
gttcggcctctaagatgattcctgt

SEQ ID NO: 97656 - DNA, 25 bp, S. pombe
gttctggcctcttttaatgcatcta

SEQ ID NO: 97657 - DNA, 25 bp, S. pombe
gttcgtgcctttttgattgaggaac

SEQ ID NO: 97658 - DNA, 25 bp, S. pombe
gtataaaggcaatctcgcttcccag

SEQ ID NO: 97659 - DNA, 25 bp, S. pombe
gttaaggtgaatgcccttccagaag

SEQ ID NO: 97660 - DNA, 25 bp, S. pombe
gttcttgccgaaaataagcgccttc

SEQ ID NO: 97661 - DNA, 25 bp, S. pombe
gttttggctgaactcaaggcgcttg

SEQ ID NO: 97662 - DNA, 25 bp, S. pombe
gttcttggtcaacatttgggccctg

SEQ ID NO: 97663 - DNA, 25 bp, S. pombe
gggttcgtcatacactttggtcttg

SEQ ID NO: 97664 - DNA, 25 bp, S. pombe
gttcttcggatagaattcgcgtttt

SEQ ID NO: 97665 - DNA, 25 bp, S. pombe
gttcgtctggaataatcgctctttc

SEQ ID NO: 97666 - DNA, 25 bp, S. pombe
gttcagttggcctttcagctattaa

SEQ ID NO: 97667 - DNA, 25 bp, S. pombe
ttgccgggtcccagtattgacaaac

SEQ ID NO: 97668 - DNA, 25 bp, S. pombe
gttcgggtgcacttcttcgataaaa

SEQ ID NO: 97669 - DNA, 25 bp, S. pombe
gttcttggtgattctgctgtcgaaa

SEQ ID NO: 97670 - DNA, 25 bp, S. pombe
gttcattcactaactcttcagacta

SEQ ID NO: 97671 - DNA, 25 bp, S. pombe
gttcattcacttgttatccatcgat

SEQ ID NO: 97672 - DNA, 25 bp, S. pombe
gttcattcctcgcttcctaatgaaa

SEQ ID NO: 97673 - DNA, 25 bp, S. pombe
gttcgtgcccgagttgagctaaaca

SEQ ID NO: 97674 - DNA, 25 bp, S. pombe
gttcatggctttggtagaggctcaa

SEQ ID NO: 97675 - DNA, 25 bp, S. pombe
gttagtctataccagccgtgcatta

SEQ ID NO: 97676 - DNA, 25 bp, S. pombe
gttaatcttacacctatgtcagtta

SEQ ID NO: 97677 - DNA, 25 bp, S. pombe
gttaatctatactcttgcaccaaaa

SEQ ID NO: 97678 - DNA, 25 bp, S. pombe
gttatcgttgatgttccccaaagga

SEQ ID NO: 97679 - DNA, 25 bp, S. pombe
gttagcgtttcagacccaaaagtga

SEQ ID NO: 97680 - DNA, 25 bp, S. pombe
gtctactttgccagaaatcggtgtg

SEQ ID NO: 97681 - DNA, 25 bp, S. pombe
gttcagttttcatacaccacagttt

SEQ ID NO: 97682 - DNA, 25 bp, S. pombe
gttcaatcctgttacgaaacgtggt

SEQ ID NO: 97683 - DNA, 25 bp, S. pombe
gttactgcctgattacgaacaacgg

SEQ ID NO: 97684 - DNA, 25 bp, S. pombe
gtataccattgctttcggaattcga

SEQ ID NO: 97685 - DNA, 25 bp, S. pombe
gttctttctgtctcttctgatatga

SEQ ID NO: 97686 - DNA, 25 bp, S. pombe
gttaaggccgttacttgacaactat

SEQ ID NO: 97687 - DNA, 25 bp, S. pombe
gttctaagcacgttattcatcctgg

SEQ ID NO: 97688 - DNA, 25 bp, S. pombe
gtattctcgacgcaaccacggttta

SEQ ID NO: 97689 - DNA, 25 bp, S. pombe
gttcaccgatttaggctcagcaagg

SEQ ID NO: 97690 - DNA, 25 bp, S. pombe
gttctcgctttaagtgctactacgc

SEQ ID NO: 97691 - DNA, 25 bp, S. pombe
gtatgccttttacagtcgtaccagc

SEQ ID NO: 97692 - DNA, 25 bp, S. pombe
gttacatttctactgggttgcacca

SEQ ID NO: 97693 - DNA, 25 bp, S. pombe
gttacctattgagcctttttcgtca

SEQ ID NO: 97694 - DNA, 25 bp, S. pombe
gttcacgtttacctttcaacactgt

SEQ ID NO: 97695 - DNA, 25 bp, S. pombe
gttacggcggtgtttcttacggctg

SEQ ID NO: 97696 - DNA, 25 bp, S. pombe
gttactagcaaatctgtttcaaggg

SEQ ID NO: 97697 - DNA, 25 bp, S. pombe
gttactgtcaacaagtttcctatgg

SEQ ID NO: 97698 - DNA, 25 bp, S. pombe
gttaccgacacttggatttctatgg

SEQ ID NO: 97699 - DNA, 25 bp, S. pombe
gttaccgtcgttgatttctatgcag

SEQ ID NO: 97700 - DNA, 25 bp, S. pombe
gttactttgatgtccgttctgtcga

SEQ ID NO: 97701 - DNA, 25 bp, S. pombe
gttactgttgaagaggtccctgacg

SEQ ID NO: 97702 - DNA, 25 bp, S. pombe
gttctttcgaaaagcaatccccaag

SEQ ID NO: 97703 - DNA, 25 bp, S. pombe
ggtctaattcgcgacgggcaatttc

SEQ ID NO: 97704 - DNA, 25 bp, S. pombe
gttcaaccattcaacggctcttatg

SEQ ID NO: 97705 - DNA, 25 bp, S. pombe
gttaactttcatggcggaatccctg

SEQ ID NO: 97706 - DNA, 25 bp, S. pombe
gttagtctttactacgagtcccgat

SEQ ID NO: 97707 - DNA, 25 bp, S. pombe
gttaattggcctcgtctagtactac

SEQ ID NO: 97708 - DNA, 25 bp, S. pombe
gttagtcggccttttagaatgctta

SEQ ID NO: 97709 - DNA, 25 bp, S. pombe
gttatccttgggtgttgaggctcta

SEQ ID NO: 97710 - DNA, 25 bp, S. pombe
gttctttggtccttttagcctctag

SEQ ID NO: 97711 - DNA, 25 bp, S. pombe
gttctccaaagcgtatggctactga

SEQ ID NO: 97712 - DNA, 25 bp, S. pombe
gttctccacaccgttctataatgaa

SEQ ID NO: 97713 - DNA, 25 bp, S. pombe
gttcatcaacccgtatttcttgcaa

SEQ ID NO: 97714 - DNA, 25 bp, S. pombe
gttaaacctcagcatgcagtcatta

SEQ ID NO: 97715 - DNA, 25 bp, S. pombe
gttcaaaaccgtcacctcttactat

SEQ ID NO: 97716 - DNA, 25 bp, S. pombe
gtatcaagaacctccatcctttaac

SEQ ID NO: 97717 - DNA, 25 bp, S. pombe
gttctcgctccttcaaactatttga

SEQ ID NO: 97718 - DNA, 25 bp, S. pombe
gttcttgccgtttcaacattcttga

SEQ ID NO: 97719 - DNA, 25 bp, S. pombe
gttctcatcatgatttcgttccttt

SEQ ID NO: 97720 - DNA, 25 bp, S. pombe
gtatgactaccacaaattccgttcc

SEQ ID NO: 97721 - DNA, 25 bp, S. pombe
ggtaccaccggtttgggcaaatctg

SEQ ID NO: 97722 - DNA, 25 bp, S. pombe
gttactcccgttttagagccaaatg

SEQ ID NO: 97723 - DNA, 25 bp, S. pombe
gttaaatttcttcgtggactacaca

SEQ ID NO: 97724 - DNA, 25 bp, S. pombe
gttaaattcttcctctaagtccaag

SEQ ID NO: 97725 - DNA, 25 bp, S. pombe
gttctttgtctcctctgtattacat

SEQ ID NO: 97726 - DNA, 25 bp, S. pombe
gttcattccctcataatcatgtaca

SEQ ID NO: 97727 - DNA, 25 bp, S. pombe
gttaagccacttttacatgtcatca

SEQ ID NO: 97728 - DNA, 25 bp, S. pombe
gttagagccctttaaataccatcat

SEQ ID NO: 97729 - DNA, 25 bp, S. pombe
gttacattccgtcgtgatcctaata

SEQ ID NO: 97730 - DNA, 25 bp, S. pombe
gttcatcttcctacggacttttcag

SEQ ID NO: 97731 - DNA, 25 bp, S. pombe
gttaattctaagcatcctggctcgg

SEQ ID NO: 97732 - DNA, 25 bp, S. pombe
gttagaccactcttctgctgaaaag

SEQ ID NO: 97733 - DNA, 25 bp, S. pombe
gtataccaactgcttcgaaaacccg

SEQ ID NO: 97734 - DNA, 25 bp, S. pombe
gttaagaggcgtgctcgtttatcct

SEQ ID NO: 97735 - DNA, 25 bp, S. pombe
gttactcacgagttattgattgatc

SEQ ID NO: 97736 - DNA, 25 bp, S. pombe
gttcagtgaaccaagcttagtgcct

SEQ ID NO: 97737 - DNA, 25 bp, S. pombe
gttcagtacctcgatttcagcgatc

SEQ ID NO: 97738 - DNA, 25 bp, S. pombe
gttaaacctcaaggtagccgtgcta

SEQ ID NO: 97739 - DNA, 25 bp, S. pombe
gttttccctgcacgcgtacgtggta

SEQ ID NO: 97740 - DNA, 25 bp, S. pombe
gttcttttctggttcgtcgaagtga

SEQ ID NO: 97741 - DNA, 25 bp, S. pombe
gttctttaattgttgcttcaccagt

SEQ ID NO: 97742 - DNA, 25 bp, S. pombe
gttcattctttaatacttcctccag

SEQ ID NO: 97743 - DNA, 25 bp, S. pombe
gttcttgctcttttaaggcgtatca

SEQ ID NO: 97744 - DNA, 25 bp, S. pombe
gttcttgagcatttctaaggccgtt

SEQ ID NO: 97745 - DNA, 25 bp, S. pombe
gttaccgaagttcgcgagtcttctt

SEQ ID NO: 97746 - DNA, 25 bp, S. pombe
gttcaacaacttgaccagttggctg

SEQ ID NO: 97747 - DNA, 25 bp, S. pombe
gttcacactaatttcaccaacggct

SEQ ID NO: 97748 - DNA, 25 bp, S. pombe
gttcagccaacatgtgctcttacag

SEQ ID NO: 97749 - DNA, 25 bp, S. pombe
gttcagcatggttattgcgacgcaa

SEQ ID NO: 97750 - DNA, 25 bp, S. pombe
gttcatcgtgctatatgtgaccata

SEQ ID NO: 97751 - DNA, 25 bp, S. pombe
gttcacgattctttgttaagcgcat

SEQ ID NO: 97752 - DNA, 25 bp, S. pombe
gttcaagcttcgttgttccaagtac

SEQ ID NO: 97753 - DNA, 25 bp, S. pombe
gttcaagcttcgttgctccagatat

SEQ ID NO: 97754 - DNA, 25 bp, S. pombe
gttcacaaatccttgcttcgcataa

SEQ ID NO: 97755 - DNA, 25 bp, S. pombe
gttcaacctgccttttcatgtgaag

SEQ ID NO: 97756 - DNA, 25 bp, S. pombe
gttcataccagcttatgctacctga

SEQ ID NO: 97757 - DNA, 25 bp, S. pombe
gttcatacactggttcaatcacaga

SEQ ID NO: 97758 - DNA, 25 bp, S. pombe
gttctatacatcctatcactactgg

SEQ ID NO: 97759 - DNA, 25 bp, S. pombe
gttcttatatcatccactatctcgc

SEQ ID NO: 97760 - DNA, 25 bp, S. pombe
gttcattctattgcaattactcctg

SEQ ID NO: 97761 - DNA, 25 bp, S. pombe
gttcagtctaatgaattcaccgaat

SEQ ID NO: 97762 - DNA, 25 bp, S. pombe
gttcaatccatggttcagagtctat

SEQ ID NO: 97763 - DNA, 25 bp, S. pombe
gttcatatgcctgtcttggatgctc

SEQ ID NO: 97764 - DNA, 25 bp, S. pombe
gttcatcattgaattcaccgcgtca

SEQ ID NO: 97765 - DNA, 25 bp, S. pombe
gttcaaatcatgagccaccgcaaga

SEQ ID NO: 97766 - DNA, 25 bp, S. pombe
gttagcaagggcaaccgcaccaaat

SEQ ID NO: 97767 - DNA, 25 bp, S. pombe
gttacaggcgatcttcggcgagatt

SEQ ID NO: 97768 - DNA, 25 bp, S. pombe
gttacagtctgttcttcgggaatgc

SEQ ID NO: 97769 - DNA, 25 bp, S. pombe
gttcacagtctttttctgcgtagga

SEQ ID NO: 97770 - DNA, 25 bp, S. pombe
gttagcgctaattcttcacgtagga

SEQ ID NO: 97771 - DNA, 25 bp, S. pombe
gttagcgcgcaaggcttccgtcgtg

SEQ ID NO: 97772 - DNA, 25 bp, S. pombe
gttaatcatttacctccttttcctg

SEQ ID NO: 97773 - DNA, 25 bp, S. pombe
gttaatgctgaaacactccttgatt

SEQ ID NO: 97774 - DNA, 25 bp, S. pombe
gttacttttggatactctctcgaaa

SEQ ID NO: 97775 - DNA, 25 bp, S. pombe
gttatcagtttatccaaccctaagt

SEQ ID NO: 97776 - DNA, 25 bp, S. pombe
gttactgtccatatcaaaccgctga

SEQ ID NO: 97777 - DNA, 25 bp, S. pombe
gttaatgacttctctgaacctttgc

SEQ ID NO: 97778 - DNA, 25 bp, S. pombe
gttcaatactcttttcaacccgatt

SEQ ID NO: 97779 - DNA, 25 bp, S. pombe
gttaaaagcggcctctcaaatcctc

SEQ ID NO: 97780 - DNA, 25 bp, S. pombe
gttagaaagatctagtccgccgcct

SEQ ID NO: 97781 - DNA, 25 bp, S. pombe
gttaccaccggctagcaacaatcga

SEQ ID NO: 97782 - DNA, 25 bp, S. pombe
ttttaagcctggtaaagcgacgaag

SEQ ID NO: 97783 - DNA, 25 bp, S. pombe
gtattcctaccgataaaactagtgg

SEQ ID NO: 97784 - DNA, 25 bp, S. pombe
gttatcccgccgctaagacccgtag

SEQ ID NO: 97785 - DNA, 25 bp, S. pombe
gttatcccgccgctaagacccgtag

SEQ ID NO: 97786 - DNA, 25 bp, S. pombe
gttactaatcctatccaacaagctg

SEQ ID NO: 97787 - DNA, 25 bp, S. pombe
gttacaacctcgtttcgtttatgca

SEQ ID NO: 97788 - DNA, 25 bp, S. pombe
gttaaacacagcacctagtcgtaca

SEQ ID NO: 97789 - DNA, 25 bp, S. pombe
gttcaattgttgaattcatttggac

SEQ ID NO: 97790 - DNA, 25 bp, S. pombe
gttcagattacttttctcatcccat

SEQ ID NO: 97791 - DNA, 25 bp, S. pombe
gttcattcacctctttatgtccgaa

SEQ ID NO: 97792 - DNA, 25 bp, S. pombe
gttcatttttgtctcgatggctcga

SEQ ID NO: 97793 - DNA, 25 bp, S. pombe
gttaaaaaagccaaccagcagtatg

SEQ ID NO: 97794 - DNA, 25 bp, S. pombe
gttcatgaagtatgcgacctctcag

SEQ ID NO: 97795 - DNA, 25 bp, S. pombe
gttcagtcagtatcgtcacatgcta

SEQ ID NO: 97796 - DNA, 25 bp, S. pombe
gttcactatgtctcttctcagtata

SEQ ID NO: 97797 - DNA, 25 bp, S. pombe
gttcatgctctcaattctcttacaa

SEQ ID NO: 97798 - DNA, 25 bp, S. pombe
gttcatcccagtagtcttcatatgc

SEQ ID NO: 97799 - DNA, 25 bp, S. pombe
gttacggctgaggaaacttctacta

SEQ ID NO: 97800 - DNA, 25 bp, S. pombe
gttaaggcttcgtaccaaatggata

SEQ ID NO: 97801 - DNA, 25 bp, S. pombe
gttacaggatcccattcaagcagac

SEQ ID NO: 97802 - DNA, 25 bp, S. pombe
gttttgctagcgacattcttcagac

SEQ ID NO: 97803 - DNA, 25 bp, S. pombe
gttcatctctacctgtatcttcaaa

SEQ ID NO: 97804 - DNA, 25 bp, S. pombe
gttcattgactactcttcatctttc

SEQ ID NO: 97805 - DNA, 25 bp, S. pombe
gttactgccttggaatcagccgatg

SEQ ID NO: 97806 - DNA, 25 bp, S. pombe
gttactccctataacgcacaggtag

SEQ ID NO: 97807 - DNA, 25 bp, S. pombe
gttacggtttggatgctggcgtcac

SEQ ID NO: 97808 - DNA, 25 bp, S. pombe
gttcaatggttttggcgagctgttc

SEQ ID NO: 97809 - DNA, 25 bp, S. pombe
gttcacagagtataccttcacgata

SEQ ID NO: 97810 - DNA, 25 bp, S. pombe
gttacgaagacaatccgtcaccaaa

SEQ ID NO: 97811 - DNA, 25 bp, S. pombe
gttacttgcgaatacgtcagccaaa

SEQ ID NO: 97812 - DNA, 25 bp, S. pombe
gttacttcgtgattctttcgctaat

SEQ ID NO: 97813 - DNA, 25 bp, S. pombe
gttagcaggaacatttgtagaataa

SEQ ID NO: 97814 - DNA, 25 bp, S. pombe
gttagttcagctacgtaccaagccg

SEQ ID NO: 97815 - DNA, 25 bp, S. pombe
gtttgaacgttcttgactcaactcg

SEQ ID NO: 97816 - DNA, 25 bp, S. pombe
gttcaacctatacctgctcaaacta

SEQ ID NO: 97817 - DNA, 25 bp, S. pombe
gttaacactaactcgtcattctcag

SEQ ID NO: 97818 - DNA, 25 bp, S. pombe
gttaaattatactgtcctcggtgtg

SEQ ID NO: 97819 - DNA, 25 bp, S. pombe
gttaatgacttctcttcgtcggaaa

SEQ ID NO: 97820 - DNA, 25 bp, S. pombe
gttagagactcgcaattttcgcaga

SEQ ID NO: 97821 - DNA, 25 bp, S. pombe
gttaagcctcgttttctcaacaaag

SEQ ID NO: 97822 - DNA, 25 bp, S. pombe
gttagagccggtgccttaaaggaca

SEQ ID NO: 97823 - DNA, 25 bp, S. pombe
gttcatgtgattgctacggcatcca

SEQ ID NO: 97824 - DNA, 25 bp, S. pombe
gttaatgctggcaatgtgcgcacta

SEQ ID NO: 97825 - DNA, 25 bp, S. pombe
gttactgttgattctgctgcagcca

SEQ ID NO: 97826 - DNA, 25 bp, S. pombe
gttacagtcttcaagctcgttcagc

SEQ ID NO: 97827 - DNA, 25 bp, S. pombe
gttaaggcttcaatactatcgctat

SEQ ID NO: 97828 - DNA, 25 bp, S. pombe
gttacagactccaaaaccagctgat

SEQ ID NO: 97829 - DNA, 25 bp, S. pombe
gttaatgtaagcacaacggccatgt

SEQ ID NO: 97830 - DNA, 25 bp, S. pombe
gttaatttcaccatcagcggtcatg

SEQ ID NO: 97831 - DNA, 25 bp, S. pombe
gtttaagtcctcacatggcagtgct

SEQ ID NO: 97832 - DNA, 25 bp, S. pombe
gttaaagtcttcagttagcgctaat

SEQ ID NO: 97833 - DNA, 25 bp, S. pombe
gttaaacagctttggtatcacctcc

SEQ ID NO: 97834 - DNA, 25 bp, S. pombe
gttcaaaaccatatgttgctcccga

SEQ ID NO: 97835 - DNA, 25 bp, S. pombe
gttaaaacttgcatccattgtaata

SEQ ID NO: 97836 - DNA, 25 bp, S. pombe
gttaaagctgctttcccagttgaaa

SEQ ID NO: 97837 - DNA, 25 bp, S. pombe
gttaaggagctataccctgagcaaa

SEQ ID NO: 97838 - DNA, 25 bp, S. pombe
gttagtgagagttgtcccgaagtta

SEQ ID NO: 97839 - DNA, 25 bp, S. pombe
gttattatgcgtatccgtgaaccca

SEQ ID NO: 97840 - DNA, 25 bp, S. pombe
gttactcatcttttcgttgaatcgt

SEQ ID NO: 97841 - DNA, 25 bp, S. pombe
tgaaacccgcctctttaataatctt

SEQ ID NO: 97842 - DNA, 25 bp, S. pombe
tgaaccaaccaacaaatacagaagt

SEQ ID NO: 97843 - DNA, 25 bp, S. pombe
gttcagaaagccaagcgatctcgcc

SEQ ID NO: 97844 - DNA, 25 bp, S. pombe
gttcagcacaaccaaaatccactac

SEQ ID NO: 97845 - DNA, 25 bp, S. pombe
gttagacatgcagcaatcacccagt

SEQ ID NO: 97846 - DNA, 25 bp, S. pombe
gttagactcgatggtgatgcgcaca

SEQ ID NO: 97847 - DNA, 25 bp, S. pombe
gttatgctcctcgtggtgaatacag

SEQ ID NO: 97848 - DNA, 25 bp, S. pombe
gttagctacctttggcaatacatca

SEQ ID NO: 97849 - DNA, 25 bp, S. pombe
gttagccctactcaaatgcatccat

SEQ ID NO: 97850 - DNA, 25 bp, S. pombe
gttagagcttccagtgtacgcaatg

SEQ ID NO: 97851 - DNA, 25 bp, S. pombe
gttaggtagccgtgtcttgcaatac

SEQ ID NO: 97852 - DNA, 25 bp, S. pombe
gttagtggacctcttgcattgcaaa

SEQ ID NO: 97853 - DNA, 25 bp, S. pombe
gttataccagccgaagcattttcat

SEQ ID NO: 97854 - DNA, 25 bp, S. pombe
gttaccgctgttgaaaagaccactg

SEQ ID NO: 97855 - DNA, 25 bp, S. pombe
gttactcctttgcaattagaccctt

SEQ ID NO: 97856 - DNA, 25 bp, S. pombe
gttcaacgttattatccgatcagca

SEQ ID NO: 97857 - DNA, 25 bp, S. pombe
gttaaacttgtttccgatcgcataa

SEQ ID NO: 97858 - DNA, 25 bp, S. pombe
gttacactacgatacaatgcataag

SEQ ID NO: 97859 - DNA, 25 bp, S. pombe
gttcacgtccaaaagctgctcctaa

SEQ ID NO: 97860 - DNA, 25 bp, S. pombe
gttaaactcaccagctgcatgcact

SEQ ID NO: 97861 - DNA, 25 bp, S. pombe
gttaaaccacctcgcattgagttgg

SEQ ID NO: 97862 - DNA, 25 bp, S. pombe
gttaaacttcttccatctttatggc

SEQ ID NO: 97863 - DNA, 25 bp, S. pombe
gttcaacctcacatttctttcatca

SEQ ID NO: 97864 - DNA, 25 bp, S. pombe
gttttagatcagtctcacctttcac

SEQ ID NO: 97865 - DNA, 25 bp, S. pombe
gttttggatgctgcccagtattact

SEQ ID NO: 97866 - DNA, 25 bp, S. pombe
gttcacaaccatcacgacaattctg

SEQ ID NO: 97867 - DNA, 25 bp, S. pombe
gttaatccaacaaaggctccatcca

SEQ ID NO: 97868 - DNA, 25 bp, S. pombe
gttcacttaacaatagcacaccctt

SEQ ID NO: 97869 - DNA, 25 bp, S. pombe
gttacaatgtttccatcgcttcaag

SEQ ID NO: 97870 - DNA, 25 bp, S. pombe
gttacaatcttcctccagcaataat

SEQ ID NO: 97871 - DNA, 25 bp, S. pombe
gttaacgatttctacgggtggtgat

SEQ ID NO: 97872 - DNA, 25 bp, S. pombe
gttacacctttcaacgtggtttcag

SEQ ID NO: 97873 - DNA, 25 bp, S. pombe
gttaatgcttttcatcgggtatcct

SEQ ID NO: 97874 - DNA, 25 bp, S. pombe
gttatgcttttaccagacgactaca

SEQ ID NO: 97875 - DNA, 25 bp, S. pombe
gttaatgatccggaacttgctcaaa

SEQ ID NO: 97876 - DNA, 25 bp, S. pombe
gttaagacagcttccacttctagtg

SEQ ID NO: 97877 - DNA, 25 bp, S. pombe
gttttgtaacactccgactatgatt

SEQ ID NO: 97878 - DNA, 25 bp, S. pombe
gttttctaacactcctaagcgactt

SEQ ID NO: 97879 - DNA, 25 bp, S. pombe
gttttccaaagctcctcaaggtaca

SEQ ID NO: 97880 - DNA, 25 bp, S. pombe
gttttagatacctcttcgcttgtaa

SEQ ID NO: 97881 - DNA, 25 bp, S. pombe
gttaaggacatcttccctatcttgt

SEQ ID NO: 97882 - DNA, 25 bp, S. pombe
gttaaggacatctccttggttgatt

SEQ ID NO: 97883 - DNA, 25 bp, S. pombe
gttaccagctctaacactactgttg

SEQ ID NO: 97884 - DNA, 25 bp, S. pombe
gttactcgccttacacatcagtgga

SEQ ID NO: 97885 - DNA, 25 bp, S. pombe
gttagactccttaattcgagagcag

SEQ ID NO: 97886 - DNA, 25 bp, S. pombe
gttacaccggtcattcgtaatgctg

SEQ ID NO: 97887 - DNA, 25 bp, S. pombe
gttaccctttccgatgcttattcaa

SEQ ID NO: 97888 - DNA, 25 bp, S. pombe
gttaacactggcaacaagccttctg

SEQ ID NO: 97889 - DNA, 25 bp, S. pombe
gttaacactggcaacaagccttctg

SEQ ID NO: 97890 - DNA, 25 bp, S. pombe
gttatcaacgagtccaaccgtcttg

SEQ ID NO: 97891 - DNA, 25 bp, S. pombe
gttacaactctctgcaactagtgtt

SEQ ID NO: 97892 - DNA, 25 bp, S. pombe
gttactggtgcaaactctttggctt

SEQ ID NO: 97893 - DNA, 25 bp, S. pombe
gttaatcgccaaaactcactctgtt

SEQ ID NO: 97894 - DNA, 25 bp, S. pombe
gttagttagcttggaccttgccagc

SEQ ID NO: 97895 - DNA, 25 bp, S. pombe
gtctaggtcgcggtggaattccaaa

SEQ ID NO: 97896 - DNA, 25 bp, S. pombe
gtttagctcctcgtggaaataccaa

SEQ ID NO: 97897 - DNA, 25 bp, S. pombe
gtttaggtcctttcataatcacatc

SEQ ID NO: 97898 - DNA, 25 bp, S. pombe
gttttggttccgttgcaatccattt

SEQ ID NO: 97899 - DNA, 25 bp, S. pombe
gttttcccacttggatggcatgaca

SEQ ID NO: 97900 - DNA, 25 bp, S. pombe
gttatatcaacagtgcggcggcatc

SEQ ID NO: 97901 - DNA, 25 bp, S. pombe
gtcattgtcgatggagctactgcat

SEQ ID NO: 97902 - DNA, 25 bp, S. pombe
gttaggtgatgacgctactgctgaa

SEQ ID NO: 97903 - DNA, 25 bp, S. pombe
gttatgcgcattggccttctggaaa

SEQ ID NO: 97904 - DNA, 25 bp, S. pombe
gttagcgcttcctcagcggtttata

SEQ ID NO: 97905 - DNA, 25 bp, S. pombe
gttaggttccatggaccgtctgaaa

SEQ ID NO: 97906 - DNA, 25 bp, S. pombe
gttaatcgctcaagaggctgttcta

SEQ ID NO: 97907 - DNA, 25 bp, S. pombe
gttaaccatccattcgttgagcagt

SEQ ID NO: 97908 - DNA, 25 bp, S. pombe
gttagacatcctcatcgcttgaaga

SEQ ID NO: 97909 - DNA, 25 bp, S. pombe
gttaccctatcctttccagaattgg

SEQ ID NO: 97910 - DNA, 25 bp, S. pombe
gttactacaacgtacatgctggact

SEQ ID NO: 97911 - DNA, 25 bp, S. pombe
gttacttgaatcttaccgtgctctc

SEQ ID NO: 97912 - DNA, 25 bp, S. pombe
gttagcttggtatcaaatgcaccta

SEQ ID NO: 97913 - DNA, 25 bp, S. pombe
gttacttccgtatatcgcacctgat

SEQ ID NO: 97914 - DNA, 25 bp, S. pombe
gttacgactttagcggatatcctgt

SEQ ID NO: 97915 - DNA, 25 bp, S. pombe
gttatcgtcgtgaagcagggtccca

SEQ ID NO: 97916 - DNA, 25 bp, S. pombe
gttactctgccaatcctttgctaaa

SEQ ID NO: 97917 - DNA, 25 bp, S. pombe
gttacattgcccgtgcttgcaaaga

SEQ ID NO: 97918 - DNA, 25 bp, S. pombe
gttaaagccaccttgtcaacgaata

SEQ ID NO: 97919 - DNA, 25 bp, S. pombe
gtctgaaaccccttactcaggtgga

SEQ ID NO: 97920 - DNA, 25 bp, S. pombe
gttaacaacttgaatgccgctcagg

SEQ ID NO: 97921 - DNA, 25 bp, S. pombe
gttacttcaaatgcaacctctcgag

SEQ ID NO: 97922 - DNA, 25 bp, S. pombe
gttatttttgtctgaccctgaccaa

SEQ ID NO: 97923 - DNA, 25 bp, S. pombe
gttactttcaatggcgacgttgcag

SEQ ID NO: 97924 - DNA, 25 bp, S. pombe
gttaactatcaatcacacgggctca

SEQ ID NO: 97925 - DNA, 25 bp, S. pombe
gttacgttctgaatgtcatcgggac

SEQ ID NO: 97926 - DNA, 25 bp, S. pombe
gttacagcgtctattgatcccgaat

SEQ ID NO: 97927 - DNA, 25 bp, S. pombe
gttaccgatctcaaattccgcggtg

SEQ ID NO: 97928 - DNA, 25 bp, S. pombe
gttagcctccatcgatgaatctttt

SEQ ID NO: 97929 - DNA, 25 bp, S. pombe
gttacgttggttattctgctattct

SEQ ID NO: 97930 - DNA, 25 bp, S. pombe
gttttacgtaacttgggtcgcacag

SEQ ID NO: 97931 - DNA, 25 bp, S. pombe
gttttactttccttcgagtgtgcaa

SEQ ID NO: 97932 - DNA, 25 bp, S. pombe
gtatttaatggtccgtgcgtttctc

SEQ ID NO: 97933 - DNA, 25 bp, S. pombe
gtttgctaatttccggaattgcttc

SEQ ID NO: 97934 - DNA, 25 bp, S. pombe
gttatcgaatatctgcacaccatgt

SEQ ID NO: 97935 - DNA, 25 bp, S. pombe
gttacagatactttcagacctttag

SEQ ID NO: 97936 - DNA, 25 bp, S. pombe
gttaagttctcacaaaatggccgct

SEQ ID NO: 97937 - DNA, 25 bp, S. pombe
gttactggtcccatcacatatttca

SEQ ID NO: 97938 - DNA, 25 bp, S. pombe
gttacgtactccatctgttttgaca

SEQ ID NO: 97939 - DNA, 25 bp, S. pombe
gttacactcgtcagctttcgtttac

SEQ ID NO: 97940 - DNA, 25 bp, S. pombe
gttacatctgttttctttcttttat

SEQ ID NO: 97941 - DNA, 25 bp, S. pombe
gttaccgctactacaattgctttta

SEQ ID NO: 97942 - DNA, 25 bp, S. pombe
gttacgccgttatcaagcttgtata

SEQ ID NO: 97943 - DNA, 25 bp, S. pombe
gttattgaaccatttgagcgctcag

SEQ ID NO: 97944 - DNA, 25 bp, S. pombe
gttagtgagaacttgggcgccgcca

SEQ ID NO: 97945 - DNA, 25 bp, S. pombe
gttatagtatatatggacccgcgaa

SEQ ID NO: 97946 - DNA, 25 bp, S. pombe
gttatgaatttgacggtgcctccaa

SEQ ID NO: 97947 - DNA, 25 bp, S. pombe
gttaaatgtgatcctcgtgccggtc

SEQ ID NO: 97948 - DNA, 25 bp, S. pombe
gttatgaacgatcaagccactgttt

SEQ ID NO: 97949 - DNA, 25 bp, S. pombe
gttacgacgactcaaattcttcaca

SEQ ID NO: 97950 - DNA, 25 bp, S. pombe
gttagaagatggacgtactttgtct

SEQ ID NO: 97951 - DNA, 25 bp, S. pombe
gtttacattcttcaaatcgttttat

SEQ ID NO: 97952 - DNA, 25 bp, S. pombe
gtataaaatcgtccaattccgccca

SEQ ID NO: 97953 - DNA, 25 bp, S. pombe
gttacaattcgctcaaagggatcta

SEQ ID NO: 97954 - DNA, 25 bp, S. pombe
gttacaacggtgctgcagctggtaa

SEQ ID NO: 97955 - DNA, 25 bp, S. pombe
gttaacaattcatcttcaggtcaca

SEQ ID NO: 97956 - DNA, 25 bp, S. pombe
gtttgactccttccggaaacattgg

SEQ ID NO: 97957 - DNA, 25 bp, S. pombe
gtttattccccgcagaaatcaacca

SEQ ID NO: 97958 - DNA, 25 bp, S. pombe
gttattcctttacacatccctattg

SEQ ID NO: 97959 - DNA, 25 bp, S. pombe
gttaccatgactggttttgcccaaa

SEQ ID NO: 97960 - DNA, 25 bp, S. pombe
gttatcgatagttgcttcaagccgc

SEQ ID NO: 97961 - DNA, 25 bp, S. pombe
gttacgtactcaattcaatgtccat

SEQ ID NO: 97962 - DNA, 25 bp, S. pombe
gttagtattcatatgccagcaccat

SEQ ID NO: 97963 - DNA, 25 bp, S. pombe
gttacatatttcatccttcgcatgc

SEQ ID NO: 97964 - DNA, 25 bp, S. pombe
gttatacaatgtcgctactactaat

SEQ ID NO: 97965 - DNA, 25 bp, S. pombe
gtttcatcaggccatggtgactcgg

SEQ ID NO: 97966 - DNA, 25 bp, S. pombe
gttatgctaggcagtgctgtcacta

SEQ ID NO: 97967 - DNA, 25 bp, S. pombe
gttagctatgactctacgcacttta

SEQ ID NO: 97968 - DNA, 25 bp, S. pombe
tgataaacgggagcctcgtctttaa

SEQ ID NO: 97969 - DNA, 25 bp, S. pombe
gtttttgtgtggattcaaccgataa

SEQ ID NO: 97970 - DNA, 25 bp, S. pombe
gttttccttttgagtcactacacaa

SEQ ID NO: 97971 - DNA, 25 bp, S. pombe
gttttcctcattcaggtcccaaaat

SEQ ID NO: 97972 - DNA, 25 bp, S. pombe
gttacctcatctatgtcgagtcttt

SEQ ID NO: 97973 - DNA, 25 bp, S. pombe
gttacttactgttgcacctacttta

SEQ ID NO: 97974 - DNA, 25 bp, S. pombe
gttacttttgtgatcatttgctgca

SEQ ID NO: 97975 - DNA, 25 bp, S. pombe
gttacggttatggatatcctgccaa

SEQ ID NO: 97976 - DNA, 25 bp, S. pombe
gttacagtgttgttgaactccccga

SEQ ID NO: 97977 - DNA, 25 bp, S. pombe
gttactatggagacgctttcagcgc

SEQ ID NO: 97978 - DNA, 25 bp, S. pombe
gttatccatccactatgcttgtgaa

SEQ ID NO: 97979 - DNA, 25 bp, S. pombe
gttactgccactgatgattttgatg

SEQ ID NO: 97980 - DNA, 25 bp, S. pombe
gttactatcatcgttggaaaggcaa

SEQ ID NO: 97981 - DNA, 25 bp, S. pombe
gttatgttcactccaccaaaggttc

SEQ ID NO: 97982 - DNA, 25 bp, S. pombe
gttatcatctaaccagagacgctct

SEQ ID NO: 97983 - DNA, 25 bp, S. pombe
gttatccattcaccgtagcagctat

SEQ ID NO: 97984 - DNA, 25 bp, S. pombe
gttactcttgagactgccgatgcaa

SEQ ID NO: 97985 - DNA, 25 bp, S. pombe
gttatcacttcttgatcccactgat

SEQ ID NO: 97986 - DNA, 25 bp, S. pombe
gtttgggccgccttaaccattatca

SEQ ID NO: 97987 - DNA, 25 bp, S. pombe
gttacgacgattactttcatgttat

SEQ ID NO: 97988 - DNA, 25 bp, S. pombe
gttacgtggcaaggcagactcattt

SEQ ID NO: 97989 - DNA, 25 bp, S. pombe
gttacttggcaacatatctctcgtt

SEQ ID NO: 97990 - DNA, 25 bp, S. pombe
gttacatagtcctgaacttcgcgct

SEQ ID NO: 97991 - DNA, 25 bp, S. pombe
gttacgcttttttgagacttcctcg

SEQ ID NO: 97992 - DNA, 25 bp, S. pombe
gttacgttatcttaagtctctatcg

SEQ ID NO: 97993 - DNA, 25 bp, S. pombe
gttacagtcttcaaatggtcctata

SEQ ID NO: 97994 - DNA, 25 bp, S. pombe
gttactttcaaaggttcccgatgat

SEQ ID NO: 97995 - DNA, 25 bp, S. pombe
gttactaaacaaggtctcgccgcta

SEQ ID NO: 97996 - DNA, 25 bp, S. pombe
gttagaaacacatcttgcctatccc

SEQ ID NO: 97997 - DNA, 25 bp, S. pombe
gttagaacgcagtccattggcaact

SEQ ID NO: 97998 - DNA, 25 bp, S. pombe
gttagcaacgatctcatctggcaag

SEQ ID NO: 97999 - DNA, 25 bp, S. pombe
gttatggacgactttcggcaagctc

SEQ ID NO: 98000 - DNA, 25 bp, S. pombe
gtattgcggaatttgaaggtaaagt

SEQ ID NO: 98001 - DNA, 25 bp, S. pombe
gtttttattacgatggacacctctg

SEQ ID NO: 98002 - DNA, 25 bp, S. pombe
gttttcgcaatagacaagaactttg

SEQ ID NO: 98003 - DNA, 25 bp, S. pombe
gtttcgccattagacaaaatcgtat

SEQ ID NO: 98004 - DNA, 25 bp, S. pombe
gtcagtctggaaaggacccaacgtg

SEQ ID NO: 98005 - DNA, 25 bp, S. pombe
gttattggcaacgtacccaagcgtt

SEQ ID NO: 98006 - DNA, 25 bp, S. pombe
gttattgacaacatacgctccggaa

SEQ ID NO: 98007 - DNA, 25 bp, S. pombe
gtttagtacgtgctccttttggaat

SEQ ID NO: 98008 - DNA, 25 bp, S. pombe
gtttcgacttggctcctgtagagga

SEQ ID NO: 98009 - DNA, 25 bp, S. pombe
gttttagtagcgtccgctgccaaaa

SEQ ID NO: 98010 - DNA, 25 bp, S. pombe
gtttatctgttgcaatccgcggaag

SEQ ID NO: 98011 - DNA, 25 bp, S. pombe
gttttcttcgagagcaatgccggtg

SEQ ID NO: 98012 - DNA, 25 bp, S. pombe
gtttactacggtattgctgcggcta

SEQ ID NO: 98013 - DNA, 25 bp, S. pombe
gtttaaacggcctttcactgcgtag

SEQ ID NO: 98014 - DNA, 25 bp, S. pombe
gttattcttcgacttatctaccttc

SEQ ID NO: 98015 - DNA, 25 bp, S. pombe
gttttaactcatctttactttccag

SEQ ID NO: 98016 - DNA, 25 bp, S. pombe
gttatgcgtcgcgacaagactttga

SEQ ID NO: 98017 - DNA, 25 bp, S. pombe
gttatgctcgcacagaagtccttga

SEQ ID NO: 98018 - DNA, 25 bp, S. pombe
gttagcgacttcttcgagtgagcat

SEQ ID NO: 98019 - DNA, 25 bp, S. pombe
gttaggttggcaatctggttcctct

SEQ ID NO: 98020 - DNA, 25 bp, S. pombe
gttactgaacctgttgaccctgaat

SEQ ID NO: 98021 - DNA, 25 bp, S. pombe
gtttttacccaacactccatatttg

SEQ ID NO: 98022 - DNA, 25 bp, S. pombe
gttttaaccctattactattgcttg

SEQ ID NO: 98023 - DNA, 25 bp, S. pombe
gttttagatgcctcttttaatgttg

SEQ ID NO: 98024 - DNA, 25 bp, S. pombe
gttattagatgaccctttacctcct

SEQ ID NO: 98025 - DNA, 25 bp, S. pombe
gttttgccatatcttttacttcctt

SEQ ID NO: 98026 - DNA, 25 bp, S. pombe
gttattgcgtttgtctttctttcat

SEQ ID NO: 98027 - DNA, 25 bp, S. pombe
gttattggttctcttatcagctatg

SEQ ID NO: 98028 - DNA, 25 bp, S. pombe
gttatccactttcatcgacatgctt

SEQ ID NO: 98029 - DNA, 25 bp, S. pombe
gttactactgtttcacccggataag

SEQ ID NO: 98030 - DNA, 25 bp, S. pombe
gttatcatccttttcttcacggtaa

SEQ ID NO: 98031 - DNA, 25 bp, S. pombe
gttatgcccatttcttatcacagta

SEQ ID NO: 98032 - DNA, 25 bp, S. pombe
gttatgcctggcttcttctagagaa

SEQ ID NO: 98033 - DNA, 25 bp, S. pombe
gttatgtctctcgtcgtgctgaaga

SEQ ID NO: 98034 - DNA, 25 bp, S. pombe
gttatagctgctacttctctcaaag

SEQ ID NO: 98035 - DNA, 25 bp, S. pombe
gttactggtgaagcatctgaacaat

SEQ ID NO: 98036 - DNA, 25 bp, S. pombe
gttactgcgttaaatcctcacatcg

SEQ ID NO: 98037 - DNA, 25 bp, S. pombe
gttactcccattaatcctactaatc

SEQ ID NO: 98038 - DNA, 25 bp, S. pombe
gttactcctattatgtctcctaagc

SEQ ID NO: 98039 - DNA, 25 bp, S. pombe
gttagtgcactgcttgtttgcctaa

SEQ ID NO: 98040 - DNA, 25 bp, S. pombe
gttagccattgcactgtttcgtaaa

SEQ ID NO: 98041 - DNA, 25 bp, S. pombe
gttagacatcgaggcagtttcaaaa

SEQ ID NO: 98042 - DNA, 25 bp, S. pombe
gttttcgcattccattaccaactta

SEQ ID NO: 98043 - DNA, 25 bp, S. pombe
gttataccaacgttcattcagccgg

SEQ ID NO: 98044 - DNA, 25 bp, S. pombe
gttatcaccaaatcttttgcccgta

SEQ ID NO: 98045 - DNA, 25 bp, S. pombe
gtttaatccatccaaagaagtcggt

SEQ ID NO: 98046 - DNA, 25 bp, S. pombe
gtttaaaagttgagccatcgggagg

SEQ ID NO: 98047 - DNA, 25 bp, S. pombe
gtttacctacaaaaatgcgcggcga

SEQ ID NO: 98048 - DNA, 25 bp, S. pombe
gttatacgagcacaccgtactgcaa

SEQ ID NO: 98049 - DNA, 25 bp, S. pombe
gttagtcgagcagttcaccttgaaa

SEQ ID NO: 98050 - DNA, 25 bp, S. pombe
gttattgatgctggcgattccgaca

SEQ ID NO: 98051 - DNA, 25 bp, S. pombe
gttattcctcatatggccaagcaag

SEQ ID NO: 98052 - DNA, 25 bp, S. pombe
gttagaaccgtttcaacctctgcaa

SEQ ID NO: 98053 - DNA, 25 bp, S. pombe
gttatgatacccttcaaaccttgct

SEQ ID NO: 98054 - DNA, 25 bp, S. pombe
gtttttagtccgagtatgtcgtcag

SEQ ID NO: 98055 - DNA, 25 bp, S. pombe
gttatttcccttgttgatgtcttaa

SEQ ID NO: 98056 - DNA, 25 bp, S. pombe
gttatttacgctctttaggccatga

SEQ ID NO: 98057 - DNA, 25 bp, S. pombe
gttattgtaggtccgtatacgctca

SEQ ID NO: 98058 - DNA, 25 bp, S. pombe
gtaatcggaggttcgttcaacatca

SEQ ID NO: 98059 - DNA, 25 bp, S. pombe
gtattagacctgatggccggcgatt

SEQ ID NO: 98060 - DNA, 25 bp, S. pombe
gttattcatgcatgttccgggtgtt

SEQ ID NO: 98061 - DNA, 25 bp, S. pombe
gttatctctacaaagtctgctgggt

SEQ ID NO: 98062 - DNA, 25 bp, S. pombe
gttacctaacatgtcttggccttta

SEQ ID NO: 98063 - DNA, 25 bp, S. pombe
gtatacctcaaagcgtatggccctt

SEQ ID NO: 98064 - DNA, 25 bp, S. pombe
gttagtaccctgatttcttcaatac

SEQ ID NO: 98065 - DNA, 25 bp, S. pombe
gttagttacatgcaaatccgcgata

SEQ ID NO: 98066 - DNA, 25 bp, S. pombe
gttagttcaatggaaagcaccagtt

SEQ ID NO: 98067 - DNA, 25 bp, S. pombe
gttagtcttttggagcaacttgcta

SEQ ID NO: 98068 - DNA, 25 bp, S. pombe
gttatgcgttaccagcttgatctct

SEQ ID NO: 98069 - DNA, 25 bp, S. pombe
gttatgcagttgcaacgtacctcaa

SEQ ID NO: 98070 - DNA, 25 bp, S. pombe
gttatattctgggtcgtgatcctaa

SEQ ID NO: 98071 - DNA, 25 bp, S. pombe
gttagtggaggcgtcgaatcctata

SEQ ID NO: 98072 - DNA, 25 bp, S. pombe
gttttggcagcggtgtgaatccctc

SEQ ID NO: 98073 - DNA, 25 bp, S. pombe
gttattgtcccacctaattttcatc

SEQ ID NO: 98074 - DNA, 25 bp, S. pombe
gttatttctcctatcgtctttggta

SEQ ID NO: 98075 - DNA, 25 bp, S. pombe
gttagttatactatggctctcttcc

SEQ ID NO: 98076 - DNA, 25 bp, S. pombe
gttattcattacttgttgtctgatg

SEQ ID NO: 98077 - DNA, 25 bp, S. pombe
gttatccatagttgggctgttcctt

SEQ ID NO: 98078 - DNA, 25 bp, S. pombe
gttatgatcttgaccaaccttccaa

SEQ ID NO: 98079 - DNA, 25 bp, S. pombe
gtttaccgtccccactatggaatat

SEQ ID NO: 98080 - DNA, 25 bp, S. pombe
gtttcagccgtcgacaagtctggta

SEQ ID NO: 98081 - DNA, 25 bp, S. pombe
gtttcaacctactgatgactgtgct

SEQ ID NO: 98082 - DNA, 25 bp, S. pombe
gttattacctgatagctactgcatg

SEQ ID NO: 98083 - DNA, 25 bp, S. pombe
gtttggtccaaaaaagcctctgaat

SEQ ID NO: 98084 - DNA, 25 bp, S. pombe
gttattatcggttacttcctgttct

SEQ ID NO: 98085 - DNA, 25 bp, S. pombe
gttattcgttgctatcttcgtctta

SEQ ID NO: 98086 - DNA, 25 bp, S. pombe
gttagccttatctcttcaagcgatt

SEQ ID NO: 98087 - DNA, 25 bp, S. pombe
gttacctatcattacttcccttatt

SEQ ID NO: 98088 - DNA, 25 bp, S. pombe
gttatgcttggctttcgatacgttt

SEQ ID NO: 98089 - DNA, 25 bp, S. pombe
gtttctaggatcaaagaacgggttg

SEQ ID NO: 98090 - DNA, 25 bp, S. pombe
gttttgtatcacatagctgccaagt

SEQ ID NO: 98091 - DNA, 25 bp, S. pombe
gttttgaggaatctccatctcttga

SEQ ID NO: 98092 - DNA, 25 bp, S. pombe
gttttgacttactttactcctgaat

SEQ ID NO: 98093 - DNA, 25 bp, S. pombe
gttatcctttattatgtttcactga

SEQ ID NO: 98094 - DNA, 25 bp, S. pombe
gttatcgggcatctagtcattacaa

SEQ ID NO: 98095 - DNA, 25 bp, S. pombe
gtttgcaagcctcttagcattgaca

SEQ ID NO: 98096 - DNA, 25 bp, S. pombe
gtttgatcgattctgctaaccccag

SEQ ID NO: 98097 - DNA, 25 bp, S. pombe
gttttcgcctgaactcaacgcaaaa

SEQ ID NO: 98098 - DNA, 25 bp, S. pombe
gttattccacgcttagacgacattt

SEQ ID NO: 98099 - DNA, 25 bp, S. pombe
gttttccaacgattactgcactcta

SEQ ID NO: 98100 - DNA, 25 bp, S. pombe
gttttacattaagggcactcggcgc

SEQ ID NO: 98101 - DNA, 25 bp, S. pombe
gtttttacaacaggccaagcttggc

SEQ ID NO: 98102 - DNA, 25 bp, S. pombe
gttatgttcctggttctacgtacag

SEQ ID NO: 98103 - DNA, 25 bp, S. pombe
gtttcttcctcctctgtcgtcaacg

SEQ ID NO: 98104 - DNA, 25 bp, S. pombe
gtttcttcctcctctgtcgtcaacg

SEQ ID NO: 98105 - DNA, 25 bp, S. pombe
gtggttttgattcttaccttgccaa

SEQ ID NO: 98106 - DNA, 25 bp, S. pombe
ggtttgcttactatcggtacccgat

SEQ ID NO: 98107 - DNA, 25 bp, S. pombe
gttattaccgtgcacctgagattat

SEQ ID NO: 98108 - DNA, 25 bp, S. pombe
gttttaatcctacccataactgcat

SEQ ID NO: 98109 - DNA, 25 bp, S. pombe
gtttcttggacttactctatttgct

SEQ ID NO: 98110 - DNA, 25 bp, S. pombe
gttttctgctgattctacctactta

SEQ ID NO: 98111 - DNA, 25 bp, S. pombe
gttatttcagcttgaccgtttacaa

SEQ ID NO: 98112 - DNA, 25 bp, S. pombe
gtttctaacggctacatgtctatgg

SEQ ID NO: 98113 - DNA, 25 bp, S. pombe
gtttaccaaattgcctctttctaca

SEQ ID NO: 98114 - DNA, 25 bp, S. pombe
gtcgttttaggtgactctaccctca

SEQ ID NO: 98115 - DNA, 25 bp, S. pombe
gtttcatttgtatgtcacgtcccga

SEQ ID NO: 98116 - DNA, 25 bp, S. pombe
gttatgttttatctcaatctcccga

SEQ ID NO: 98117 - DNA, 25 bp, S. pombe
gttttgcttttgtacaaccatcgcg

SEQ ID NO: 98118 - DNA, 25 bp, S. pombe
gtttactttggccaaactgcctgga

SEQ ID NO: 98119 - DNA, 25 bp, S. pombe
gtttagctctatcgctgcaattgct

SEQ ID NO: 98120 - DNA, 25 bp, S. pombe
gtattgattctaccgctgatgcagc

SEQ ID NO: 98121 - DNA, 25 bp, S. pombe
gtttatttaccgtatgctgccaagc

SEQ ID NO: 98122 - DNA, 25 bp, S. pombe
gtttatgttacacctttgccggtat

SEQ ID NO: 98123 - DNA, 25 bp, S. pombe
gttttgggaaacctgctgggcttat

SEQ ID NO: 98124 - DNA, 25 bp, S. pombe
gttttgtcgcaagaacctgactgga

SEQ ID NO: 98125 - DNA, 25 bp, S. pombe
gttagtgtacaagtcgttcctcaaa

SEQ ID NO: 98126 - DNA, 25 bp, S. pombe
gtttttaccagctgttctccaaaga

SEQ ID NO: 98127 - DNA, 25 bp, S. pombe
gttttcgcgacccattgagttcaaa

SEQ ID NO: 98128 - DNA, 25 bp, S. pombe
gttttggtacctttgacttcaagct

SEQ ID NO: 98129 - DNA, 25 bp, S. pombe
gttttacccgaagtcaatgtgcctc

SEQ ID NO: 98130 - DNA, 25 bp, S. pombe
gttttgaagcacactatcccgaatg

SEQ ID NO: 98131 - DNA, 25 bp, S. pombe
gtttggaacactcgcgatgacactg

SEQ ID NO: 98132 - DNA, 25 bp, S. pombe
gttatgtgtctacctttgctgccta

SEQ ID NO: 98133 - DNA, 25 bp, S. pombe
gttatgctgatttccttcgtgctta

SEQ ID NO: 98134 - DNA, 25 bp, S. pombe
gttttgattcttcggtactctgtta

SEQ ID NO: 98135 - DNA, 25 bp, S. pombe
gtataagctctgcaaggtcaagcgt

SEQ ID NO: 98136 - DNA, 25 bp, S. pombe
gtcacacagcttgaaaaacgcgttt

SEQ ID NO: 98137 - DNA, 25 bp, S. pombe
gtcttgactgtccaaaagggcgtct

SEQ ID NO: 98138 - DNA, 25 bp, S. pombe
gtttgtctgctataaagggccatct

SEQ ID NO: 98139 - DNA, 25 bp, S. pombe
gttatacgactaattccgcaggcat

SEQ ID NO: 98140 - DNA, 25 bp, S. pombe
gttatgttttgatcctgccaagcga

SEQ ID NO: 98141 - DNA, 25 bp, S. pombe
gtttttcatgtgtacaaccgatcgg

SEQ ID NO: 98142 - DNA, 25 bp, S. pombe
gtttctattttgctactggtcttca

SEQ ID NO: 98143 - DNA, 25 bp, S. pombe
gtttttagtctcatatgggcctact

SEQ ID NO: 98144 - DNA, 25 bp, S. pombe
gttattttgtgcaccaatggccaga

SEQ ID NO: 98145 - DNA, 25 bp, S. pombe
gttttataccggaaagacagcgcaa

SEQ ID NO: 98146 - DNA, 25 bp, S. pombe
gtttgaattcacctacggacaccaa

SEQ ID NO: 98147 - DNA, 25 bp, S. pombe
gttattggctatttccggtatctca

SEQ ID NO: 98148 - DNA, 25 bp, S. pombe
gttatttcgtataccgttgatctgg

SEQ ID NO: 98149 - DNA, 25 bp, S. pombe
gttatttctgattaccttcgacttg

SEQ ID NO: 98150 - DNA, 25 bp, S. pombe
gttataccctgctaccttgaaattt

SEQ ID NO: 98151 - DNA, 25 bp, S. pombe
gtttatcccggagctggaagactct

SEQ ID NO: 98152 - DNA, 25 bp, S. pombe
gttattaccctcattcgaaagctag

SEQ ID NO: 98153 - DNA, 25 bp, S. pombe
gtataccaccgtgtactccaagcaa

SEQ ID NO: 98154 - DNA, 25 bp, S. pombe
gtttccaactcgtaatcgtcgacag

SEQ ID NO: 98155 - DNA, 25 bp, S. pombe
gttatacacaccagaacttgccgac

SEQ ID NO: 98156 - DNA, 25 bp, S. pombe
gttattataccgacacagccgatgc

SEQ ID NO: 98157 - DNA, 25 bp, S. pombe
gtttatgtccttatgtacggccatt

SEQ ID NO: 98158 - DNA, 25 bp, S. pombe
gttttgttcggtatgacggtcgcat

SEQ ID NO: 98159 - DNA, 25 bp, S. pombe
gttatctttttcagtcatcttggag

SEQ ID NO: 98160 - DNA, 25 bp, S. pombe
gttatcctattaaagtccgtgctgt

SEQ ID NO: 98161 - DNA, 25 bp, S. pombe
gtttctggtaatcaagccttgcctg

SEQ ID NO: 98162 - DNA, 25 bp, S. pombe
gttttggaccatataccatggttgg

SEQ ID NO: 98163 - DNA, 25 bp, S. pombe
gttttgtaccatggtccttgggatt

SEQ ID NO: 98164 - DNA, 25 bp, S. pombe
gtttctgtgatgctggacccggatt

SEQ ID NO: 98165 - DNA, 25 bp, S. pombe
gttttagaactaggctccggatgtg

SEQ ID NO: 98166 - DNA, 25 bp, S. pombe
gttttagactcttatgcccaaagtt

SEQ ID NO: 98167 - DNA, 25 bp, S. pombe
gttttccagtatagtcccgaagact

SEQ ID NO: 98168 - DNA, 25 bp, S. pombe
gttatacatttttaccaccctgatt

SEQ ID NO: 98169 - DNA, 25 bp, S. pombe
gttttattttttcagcccagtgctt

SEQ ID NO: 98170 - DNA, 25 bp, S. pombe
gttttcaggatgatctaagcccgtt

SEQ ID NO: 98171 - DNA, 25 bp, S. pombe
gttttccgatgagtctacagatgcc

SEQ ID NO: 98172 - DNA, 25 bp, S. pombe
gttttgtctttctcagcacctgaat

SEQ ID NO: 98173 - DNA, 25 bp, S. pombe
gttatatgaattacccagagctttt

SEQ ID NO: 98174 - DNA, 25 bp, S. pombe
gttatctgaaacacgacgcaaattt

SEQ ID NO: 98175 - DNA, 25 bp, S. pombe
gtttagcagaacctcgacgcagtat

SEQ ID NO: 98176 - DNA, 25 bp, S. pombe
gtttatgcaaaaccccttggagatt

SEQ ID NO: 98177 - DNA, 25 bp, S. pombe
gttatatcttaacggctcagggttt

SEQ ID NO: 98178 - DNA, 25 bp, S. pombe
gttatatcttcaaaacctaggcttt

SEQ ID NO: 98179 - DNA, 25 bp, S. pombe
gttatactctcagcttcgtttgatg

SEQ ID NO: 98180 - DNA, 25 bp, S. pombe
gttttgcctcatagtgtttttgcta

SEQ ID NO: 98181 - DNA, 25 bp, S. pombe
gtttatcctatgcaccggcttaaaa

SEQ ID NO: 98182 - DNA, 25 bp, S. pombe
gttttcctactacctcagcttataa

SEQ ID NO: 98183 - DNA, 25 bp, S. pombe
gttttccgtctcaacgtcttaatga

SEQ ID NO: 98184 - DNA, 25 bp, S. pombe
gttatccctcctttagtcttaatga

SEQ ID NO: 98185 - DNA, 25 bp, S. pombe
gtttcacttaaacgaattctccaag

SEQ ID NO: 98186 - DNA, 25 bp, S. pombe
gtttaatacggtctgctcgtcatca

SEQ ID NO: 98187 - DNA, 25 bp, S. pombe
gttatgacccaccagttcagtgtga

SEQ ID NO: 98188 - DNA, 25 bp, S. pombe
gtttgtaccgattggatttccctga

SEQ ID NO: 98189 - DNA, 25 bp, S. pombe
gttttagacgaacatgttgtgcctg

SEQ ID NO: 98190 - DNA, 25 bp, S. pombe
gttttccacgacatagatctggcca

SEQ ID NO: 98191 - DNA, 25 bp, S. pombe
gttttgcctttaaccttcgtcaatg

SEQ ID NO: 98192 - DNA, 25 bp, S. pombe
gttttctcttatttagttcgtcctg

SEQ ID NO: 98193 - DNA, 25 bp, S. pombe
gtttcgaatctatcaagtaccccta

SEQ ID NO: 98194 - DNA, 25 bp, S. pombe
gtttacggtggattgcctgtgcaag

SEQ ID NO: 98195 - DNA, 25 bp, S. pombe
gtttagggctgctcctttaattgca

SEQ ID NO: 98196 - DNA, 25 bp, S. pombe
gttttgaacgttgagatccctttgg

SEQ ID NO: 98197 - DNA, 25 bp, S. pombe
gttatcttgaacctttctctcatgt

SEQ ID NO: 98198 - DNA, 25 bp, S. pombe
gttatatacacccttcttgacgaga

SEQ ID NO: 98199 - DNA, 25 bp, S. pombe
gtttaatcctcactctttttgcaac

SEQ ID NO: 98200 - DNA, 25 bp, S. pombe
gttatcattctttgttctcttctca

SEQ ID NO: 98201 - DNA, 25 bp, S. pombe
gttatcacagagtatccacttcgcg

SEQ ID NO: 98202 - DNA, 25 bp, S. pombe
gtttatcgccatgagttacaaagct

SEQ ID NO: 98203 - DNA, 25 bp, S. pombe
gttttagctgctacttctagccaac

SEQ ID NO: 98204 - DNA, 25 bp, S. pombe
gtttgcaaacagtccaatctctacc

SEQ ID NO: 98205 - DNA, 25 bp, S. pombe
gtttgacaacgccaagaccgatcgg

SEQ ID NO: 98206 - DNA, 25 bp, S. pombe
gtttatgagaaactggccgccgaag

SEQ ID NO: 98207 - DNA, 25 bp, S. pombe
gtttaagcgtatcattcgtttcttg

SEQ ID NO: 98208 - DNA, 25 bp, S. pombe
gtttatggctgcatcaattcccttt

SEQ ID NO: 98209 - DNA, 25 bp, S. pombe
gttttggcagttttcttcggcataa

SEQ ID NO: 98210 - DNA, 25 bp, S. pombe
gtttctgtgcgtttaaatcgaccaa

SEQ ID NO: 98211 - DNA, 25 bp, S. pombe
gttttcttgattgtaacttccacat

SEQ ID NO: 98212 - DNA, 25 bp, S. pombe
gttttacctttaagcactatcccag

SEQ ID NO: 98213 - DNA, 25 bp, S. pombe
gttttgcgacttgattcgttctcta

SEQ ID NO: 98214 - DNA, 25 bp, S. pombe
gttttgcgagttgattccttttcca

SEQ ID NO: 98215 - DNA, 25 bp, S. pombe
gttttatcacttatccttacttcca

SEQ ID NO: 98216 - DNA, 25 bp, S. pombe
gtttttactatccattttacgcacg

SEQ ID NO: 98217 - DNA, 25 bp, S. pombe
gtttttagtgctcattcattaccaa

SEQ ID NO: 98218 - DNA, 25 bp, S. pombe
gtctaccgaggtgtgtactcccaaa

SEQ ID NO: 98219 - DNA, 25 bp, S. pombe
gtttcagggttgtttactctcgcga

SEQ ID NO: 98220 - DNA, 25 bp, S. pombe
gtttgcgctcaaacgctagtttact

SEQ ID NO: 98221 - DNA, 25 bp, S. pombe
gtttgcgattagtcctagtgctgct

SEQ ID NO: 98222 - DNA, 25 bp, S. pombe
gtttcatgcgacacagtgcgttgca

SEQ ID NO: 98223 - DNA, 25 bp, S. pombe
gtttcctggctaaatcctggcatat

SEQ ID NO: 98224 - DNA, 25 bp, S. pombe
gtttcctgcctaaacctaagacagt

SEQ ID NO: 98225 - DNA, 25 bp, S. pombe
gtttcccaatcactgttgaaggcag

SEQ ID NO: 98226 - DNA, 25 bp, S. pombe
gttttacatcgctactcacaacgtg

SEQ ID NO: 98227 - DNA, 25 bp, S. pombe
gttattacctgcaacgtcaacatgt

SEQ ID NO: 98228 - DNA, 25 bp, S. pombe
ggtcttctcctgttagttacgacga

SEQ ID NO: 98229 - DNA, 25 bp, S. pombe
ggattactactagagcttcttacga

SEQ ID NO: 98230 - DNA, 25 bp, S. pombe
gtttacatctcaacgtccttggaac

SEQ ID NO: 98231 - DNA, 25 bp, S. pombe
gttttgctgtcaatagcccttgtca

SEQ ID NO: 98232 - DNA, 25 bp, S. pombe
gttatattattatctggccgggcat

SEQ ID NO: 98233 - DNA, 25 bp, S. pombe
gttttctgctttacaagccgttcag

SEQ ID NO: 98234 - DNA, 25 bp, S. pombe
gttttgtcagtaatcgatgctcgta

SEQ ID NO: 98235 - DNA, 25 bp, S. pombe
gttttggattggcatcatcacaaca

SEQ ID NO: 98236 - DNA, 25 bp, S. pombe
gtttaagcacggctagagcagctat

SEQ ID NO: 98237 - DNA, 25 bp, S. pombe
gtttggccattaaccatacggagat

SEQ ID NO: 98238 - DNA, 25 bp, S. pombe
ttaatcggccctcaaactttcaaag

SEQ ID NO: 98239 - DNA, 25 bp, S. pombe
gtttttgcccttgagaacgccaagt

SEQ ID NO: 98240 - DNA, 25 bp, S. pombe
gtttgtagatttttctttgccgact

SEQ ID NO: 98241 - DNA, 25 bp, S. pombe
gtttaaattctgttctgtcaccgct

SEQ ID NO: 98242 - DNA, 25 bp, S. pombe
gtttaaaacttgatgtccctctgcc

SEQ ID NO: 98243 - DNA, 25 bp, S. pombe
gttttacatcctaagtaccacctga

SEQ ID NO: 98244 - DNA, 25 bp, S. pombe
gtttcttctactccagtttaccata

SEQ ID NO: 98245 - DNA, 25 bp, S. pombe
gtttacatcaaatccggcgatctaa

SEQ ID NO: 98246 - DNA, 25 bp, S. pombe
gtgctcccgttaccgagaggtgata

SEQ ID NO: 98247 - DNA, 25 bp, S. pombe
gtttttcggcaaagacactctagct

SEQ ID NO: 98248 - DNA, 25 bp, S. pombe
gtttacaacaatttggtccgcgcca

SEQ ID NO: 98249 - DNA, 25 bp, S. pombe
gttattgcaagcgtttggctcctac

SEQ ID NO: 98250 - DNA, 25 bp, S. pombe
gttttataggcttcgcttgcatcaa

SEQ ID NO: 98251 - DNA, 25 bp, S. pombe
gtttatcgctacttgtgttgtgcta

SEQ ID NO: 98252 - DNA, 25 bp, S. pombe
gttttggccaacatgcttagcgaat

SEQ ID NO: 98253 - DNA, 25 bp, S. pombe
gttattgctaccactgctcttaagt

SEQ ID NO: 98254 - DNA, 25 bp, S. pombe
gtttcagctaccactgttgaagcag

SEQ ID NO: 98255 - DNA, 25 bp, S. pombe
gttttccatggacttatttctgctt

SEQ ID NO: 98256 - DNA, 25 bp, S. pombe
gttttccaggaaatcatcgcttaag

SEQ ID NO: 98257 - DNA, 25 bp, S. pombe
gtcctttgggacacatattttttca

SEQ ID NO: 98258 - DNA, 25 bp, S. pombe
gggtttggaagctctaactctgtta

SEQ ID NO: 98259 - DNA, 25 bp, S. pombe
gtttgcccagtacgttcaacaagaa

SEQ ID NO: 98260 - DNA, 25 bp, S. pombe
gtattgccggccaagttccaaaata

SEQ ID NO: 98261 - DNA, 25 bp, S. pombe
gttttcgctcatcctgaagctggaa

SEQ ID NO: 98262 - DNA, 25 bp, S. pombe
gtttatcgtgcttctctagcggaaa

SEQ ID NO: 98263 - DNA, 25 bp, S. pombe
gttttggtcctgcttgttcaagaca

SEQ ID NO: 98264 - DNA, 25 bp, S. pombe
gttttgattcctgttcttggcaata

SEQ ID NO: 98265 - DNA, 25 bp, S. pombe
gttattcaaccatttttcgtctatt

SEQ ID NO: 98266 - DNA, 25 bp, S. pombe
gtttaccaacggattcactcaaatt

SEQ ID NO: 98267 - DNA, 25 bp, S. pombe
gttttcgtcagggtttagctcaaat

SEQ ID NO: 98268 - DNA, 25 bp, S. pombe
gttttttatgctattgcttctcccg

SEQ ID NO: 98269 - DNA, 25 bp, S. pombe
gtttcccatgttaaatctttcgagt

SEQ ID NO: 98270 - DNA, 25 bp, S. pombe
gttttctcatcgttcctgatatgct

SEQ ID NO: 98271 - DNA, 25 bp, S. pombe
gttttcgatattccatctgcagcaa

SEQ ID NO: 98272 - DNA, 25 bp, S. pombe
gttttcgatgattctactcctgacc

SEQ ID NO: 98273 - DNA, 25 bp, S. pombe
gttttcttcactatctcatacactc

SEQ ID NO: 98274 - DNA, 25 bp, S. pombe
gttattgcgctttcttatccaacga

SEQ ID NO: 98275 - DNA, 25 bp, S. pombe
gttttgctgttttgtactctcctga

SEQ ID NO: 98276 - DNA, 25 bp, S. pombe
gttttctgtcctgttgtgcatttat

SEQ ID NO: 98277 - DNA, 25 bp, S. pombe
gttttgcgtcgctacattgtcgaat

SEQ ID NO: 98278 - DNA, 25 bp, S. pombe
gttttgcagctcaagtacctgatca

SEQ ID NO: 98279 - DNA, 25 bp, S. pombe
gttttgctatgtacagttcgctcca

SEQ ID NO: 98280 - DNA, 25 bp, S. pombe
gtttatctcaatcctttggcacgcg

SEQ ID NO: 98281 - DNA, 25 bp, S. pombe
gtttaatcaaggtcaatggagcccc

SEQ ID NO: 98282 - DNA, 25 bp, S. pombe
gtttccataagatcaaggccgccca

SEQ ID NO: 98283 - DNA, 25 bp, S. pombe
gttttcacgtagtagtggtcctgga

SEQ ID NO: 98284 - DNA, 25 bp, S. pombe
gtttaactccgttgacttcttgaat

SEQ ID NO: 98285 - DNA, 25 bp, S. pombe
gtttaccaacatacttcttccatag

SEQ ID NO: 98286 - DNA, 25 bp, S. pombe
gtttaccaagctatacgtcgctctt

SEQ ID NO: 98287 - DNA, 25 bp, S. pombe
gtttaccaatccagaagatccctct

SEQ ID NO: 98288 - DNA, 25 bp, S. pombe
gtttgtccacttatttgaagaccta

SEQ ID NO: 98289 - DNA, 25 bp, S. pombe
gtttgagcgcctaactaatgaaagc

SEQ ID NO: 98290 - DNA, 25 bp, S. pombe
gtttttcctcgattacagcaaatgg

SEQ ID NO: 98291 - DNA, 25 bp, S. pombe
gtttttccggtatcgatatctcgtt

SEQ ID NO: 98292 - DNA, 25 bp, S. pombe
gtttattctcgtcaacgtgatgctg

SEQ ID NO: 98293 - DNA, 25 bp, S. pombe
gttttctctttttacgctgacatgc

SEQ ID NO: 98294 - DNA, 25 bp, S. pombe
gttttctttccttatcgcttcatga

SEQ ID NO: 98295 - DNA, 25 bp, S. pombe
gtttgtcatttgcagccttttctac

SEQ ID NO: 98296 - DNA, 25 bp, S. pombe
gttttttactgattttgcagccaag

SEQ ID NO: 98297 - DNA, 25 bp, S. pombe
gttttgtccatctctttcagacgaa

SEQ ID NO: 98298 - DNA, 25 bp, S. pombe
gttttctctgatttacttggtccta

SEQ ID NO: 98299 - DNA, 25 bp, S. pombe
gttttccccgctaaagagacactgc

SEQ ID NO: 98300 - DNA, 25 bp, S. pombe
gtttttcttcccagttgcgctttat

SEQ ID NO: 98301 - DNA, 25 bp, S. pombe
gtttattgtccaagggtgtcgcttt

SEQ ID NO: 98302 - DNA, 25 bp, S. pombe
gtttcccgtgaaggttccagcaaga

SEQ ID NO: 98303 - DNA, 25 bp, S. pombe
gttttcggcctctactatttacagt

SEQ ID NO: 98304 - DNA, 25 bp, S. pombe
ggtctcgtaaagctcgacggatatc

SEQ ID NO: 98305 - DNA, 25 bp, S. pombe
gtttactcgaacattacttcagttt

SEQ ID NO: 98306 - DNA, 25 bp, S. pombe
gtttatcatagcacacttgaatcta

SEQ ID NO: 98307 - DNA, 25 bp, S. pombe
gtttgtcattactcaggatccggat

SEQ ID NO: 98308 - DNA, 25 bp, S. pombe
gtttttgctaccacagatactctcg

SEQ ID NO: 98309 - DNA, 25 bp, S. pombe
gtttgctattcatatcgttaccctt

SEQ ID NO: 98310 - DNA, 25 bp, S. pombe
gttttccaggataccagtgcaactt

SEQ ID NO: 98311 - DNA, 25 bp, S. pombe
gttttccacaagtcgaattatctct

SEQ ID NO: 98312 - DNA, 25 bp, S. pombe
gttttcttctcttagtgttcttgca

SEQ ID NO: 98313 - DNA, 25 bp, S. pombe
gtttgtcgattcacggtttatgcat

SEQ ID NO: 98314 - DNA, 25 bp, S. pombe
gttttccactcaggcggtatttcga

SEQ ID NO: 98315 - DNA, 25 bp, S. pombe
gtttgtccactttaggtcatgtact

SEQ ID NO: 98316 - DNA, 25 bp, S. pombe
gtttatcgccgtaagcattcatgtg

SEQ ID NO: 98317 - DNA, 25 bp, S. pombe
gttttcagccaagtcagcgtcagga

SEQ ID NO: 98318 - DNA, 25 bp, S. pombe
gtttctactaaggacactcgtgctg

SEQ ID NO: 98319 - DNA, 25 bp, S. pombe
gttttcagtatataccgcttgtggc

SEQ ID NO: 98320 - DNA, 25 bp, S. pombe
gttttatcgaatccccagcttggaa

SEQ ID NO: 98321 - DNA, 25 bp, S. pombe
gtttattcgataccgctggtcagga

SEQ ID NO: 98322 - DNA, 25 bp, S. pombe
gtttttcaaacttctcctgaggagg

SEQ ID NO: 98323 - DNA, 25 bp, S. pombe
gtttggtaagcacagccacgtgtat

SEQ ID NO: 98324 - DNA, 25 bp, S. pombe
gtttttcaatgacacagccagcttt

SEQ ID NO: 98325 - DNA, 25 bp, S. pombe
gttttttgactatcctactatccct

SEQ ID NO: 98326 - DNA, 25 bp, S. pombe
gtttatttaccatctgcgacttcac

SEQ ID NO: 98327 - DNA, 25 bp, S. pombe
gttttttatcactctagcacctact

SEQ ID NO: 98328 - DNA, 25 bp, S. pombe
gtttcaaaatccgttagccttatct

SEQ ID NO: 98329 - DNA, 25 bp, S. pombe
gtttctaaatattcgggctgcagta

SEQ ID NO: 98330 - DNA, 25 bp, S. pombe
gttttcaacattggcaagactgtga

SEQ ID NO: 98331 - DNA, 25 bp, S. pombe
gtttctattcaccagcaatcacaac

SEQ ID NO: 98332 - DNA, 25 bp, S. pombe
gttttactacgaccactgatgacta

SEQ ID NO: 98333 - DNA, 25 bp, S. pombe
gttttatcgttgaccatattggcca

SEQ ID NO: 98334 - DNA, 25 bp, S. pombe
gttttcatcgtttcagacattccca

SEQ ID NO: 98335 - DNA, 25 bp, S. pombe
gtttacctgatgaaaagcccgatct

SEQ ID NO: 98336 - DNA, 25 bp, S. pombe
gtttattaatgatgaagcctccaat

SEQ ID NO: 98337 - DNA, 25 bp, S. pombe
gtttttgagccaactatcgctggac

SEQ ID NO: 98338 - DNA, 25 bp, S. pombe
gtttcttgtcctctgcagaagtcaa

SEQ ID NO: 98339 - DNA, 25 bp, S. pombe
gtttccgcactaaaggcaatggccc

SEQ ID NO: 98340 - DNA, 25 bp, S. pombe
gtttattacgcttccaatcttgata

SEQ ID NO: 98341 - DNA, 25 bp, S. pombe
gtttccttttgttcatggtcaaccg

SEQ ID NO: 98342 - DNA, 25 bp, S. pombe
gtttcccttatacgccacttgaaag

SEQ ID NO: 98343 - DNA, 25 bp, S. pombe
gtttcacctagtcaccggagcaaag

SEQ ID NO: 98344 - DNA, 25 bp, S. pombe
gttttcattcgaacaccacggtatc

SEQ ID NO: 98345 - DNA, 25 bp, S. pombe
gttttttcgttaatccaggctcagc

SEQ ID NO: 98346 - DNA, 25 bp, S. pombe
gttttttctgctcaactacagtcaa

SEQ ID NO: 98347 - DNA, 25 bp, S. pombe
gtttttcgtcatcaactggagtgaa

SEQ ID NO: 98348 - DNA, 25 bp, S. pombe
gtttcttctacatctatacttgcaa

SEQ ID NO: 98349 - DNA, 25 bp, S. pombe
gtttggccttgaagacgacgttgta

SEQ ID NO: 98350 - DNA, 25 bp, S. pombe
gtttgccccaaatcgtctttatgat

SEQ ID NO: 98351 - DNA, 25 bp, S. pombe
gtattctttaaatccttgccttctg

SEQ ID NO: 98352 - DNA, 25 bp, S. pombe
gtttctcttacagacatttcctctt

SEQ ID NO: 98353 - DNA, 25 bp, S. pombe
gtttctattaccgattttcttcttg

SEQ ID NO: 98354 - DNA, 25 bp, S. pombe
gtttatatctatgctgttcgtcttc

SEQ ID NO: 98355 - DNA, 25 bp, S. pombe
gtttctcttagtccatctactgttc

SEQ ID NO: 98356 - DNA, 25 bp, S. pombe
gttttcatctttcaagacttccgcc

SEQ ID NO: 98357 - DNA, 25 bp, S. pombe
gtttttgaatgaacctactcccaat

SEQ ID NO: 98358 - DNA, 25 bp, S. pombe
gtttcttgaaggttgctactgccat

SEQ ID NO: 98359 - DNA, 25 bp, S. pombe
gtttttgaagccattctcaaccagt

SEQ ID NO: 98360 - DNA, 25 bp, S. pombe
gtttttcgctatgatgcacctccaa

SEQ ID NO: 98361 - DNA, 25 bp, S. pombe
gtttattctccaccattgatttcgg

SEQ ID NO: 98362 - DNA, 25 bp, S. pombe
gtttttgaatcactttgtgccatga

SEQ ID NO: 98363 - DNA, 25 bp, S. pombe
gttttattcatcttttgcgctgcta

SEQ ID NO: 98364 - DNA, 25 bp, S. pombe
gttttatttccttgtcagcatgctt

SEQ ID NO: 98365 - DNA, 25 bp, S. pombe
gtttggcgtcgttgggataatctta

SEQ ID NO: 98366 - DNA, 25 bp, S. pombe
gtttggcgcggaacgctatcaaatt

SEQ ID NO: 98367 - DNA, 25 bp, S. pombe
gtttcagcggaagatgtcactaatt

SEQ ID NO: 98368 - DNA, 25 bp, S. pombe
gtttctgttgactttgcaagcactt

SEQ ID NO: 98369 - DNA, 25 bp, S. pombe
gtattcaccttacctcgcaataatc

SEQ ID NO: 98370 - DNA, 25 bp, S. pombe
gtttaccatctaattcaccagttcg

SEQ ID NO: 98371 - DNA, 25 bp, S. pombe
gtttaggctctaatccatccagtgg

SEQ ID NO: 98372 - DNA, 25 bp, S. pombe
gtttcgtatgtgcatctactgttga

SEQ ID NO: 98373 - DNA, 25 bp, S. pombe
gtttcaccagtgcttacggatcttc

SEQ ID NO: 98374 - DNA, 25 bp, S. pombe
gtttcatccaggtcattaggcgtgt

SEQ ID NO: 98375 - DNA, 25 bp, S. pombe
gtttttactccaccacaatgcgaaa

SEQ ID NO: 98376 - DNA, 25 bp, S. pombe
gtttttcctctctatcttatgcaga

SEQ ID NO: 98377 - DNA, 25 bp, S. pombe
gtttatatctccatttggatcccag

SEQ ID NO: 98378 - DNA, 25 bp, S. pombe
gtttttcacacaatttggcttccaa

SEQ ID NO: 98379 - DNA, 25 bp, S. pombe
gtttgagcagcaacaaccgactacc

SEQ ID NO: 98380 - DNA, 25 bp, S. pombe
gtatagaccgactccgaaatctgct

SEQ ID NO: 98381 - DNA, 25 bp, S. pombe
gtaagtcggctctttctgaaacgga

SEQ ID NO: 98382 - DNA, 25 bp, S. pombe
gtttgaacccattaaagtgccagca

SEQ ID NO: 98383 - DNA, 25 bp, S. pombe
gtttaaacacattccaactgagtgt

SEQ ID NO: 98384 - DNA, 25 bp, S. pombe
gtttaaacacattccaactgagtgt

SEQ ID NO: 98385 - DNA, 25 bp, S. pombe
gtttattaccttgcataccacagtg

SEQ ID NO: 98386 - DNA, 25 bp, S. pombe
gtttattcaccaaattctccaaggc

SEQ ID NO: 98387 - DNA, 25 bp, S. pombe
gtttcgcttttaattcgcttgcatt

SEQ ID NO: 98388 - DNA, 25 bp, S. pombe
gtatccttactcacaactttctata

SEQ ID NO: 98389 - DNA, 25 bp, S. pombe
gtttttatgctcaccgtatttattt

SEQ ID NO: 98390 - DNA, 25 bp, S. pombe
gtttttgatttgttgcgcgactatt

SEQ ID NO: 98391 - DNA, 25 bp, S. pombe
gtttgtctatttactccgacggttg

SEQ ID NO: 98392 - DNA, 25 bp, S. pombe
gtttattagtttcccgacgagatat

SEQ ID NO: 98393 - DNA, 25 bp, S. pombe
gtttccgtggccttcaaaagctaat

SEQ ID NO: 98394 - DNA, 25 bp, S. pombe
gtttactgttttaccagcacctttg

SEQ ID NO: 98395 - DNA, 25 bp, S. pombe
gtttcatcttttgaggacacctttg

SEQ ID NO: 98396 - DNA, 25 bp, S. pombe
gtttatgctcattacctgctttcaa

SEQ ID NO: 98397 - DNA, 25 bp, S. pombe
gtttctgatatgtgcgctggtttaa

SEQ ID NO: 98398 - DNA, 25 bp, S. pombe
gtttatcttgctacacctatggtgt

SEQ ID NO: 98399 - DNA, 25 bp, S. pombe
gtttccaagatccacctagtatgtt

SEQ ID NO: 98400 - DNA, 25 bp, S. pombe
gtttccagaatgtcaccatcgattt

SEQ ID NO: 98401 - DNA, 25 bp, S. pombe
gtttcagaagtcaacgcctctttag

SEQ ID NO: 98402 - DNA, 25 bp, S. pombe
gtttatgccattacacctcttttag

SEQ ID NO: 98403 - DNA, 25 bp, S. pombe
gtttactaatgtcttgccgcttgat

SEQ ID NO: 98404 - DNA, 25 bp, S. pombe
gtttatcacgatgttcaggaccatt

SEQ ID NO: 98405 - DNA, 25 bp, S. pombe
gtttcagccggtgatgaggagcctt

SEQ ID NO: 98406 - DNA, 25 bp, S. pombe
tatttcagtccgttggtttcttggg

SEQ ID NO: 98407 - DNA, 25 bp, S. pombe
gtttcctctcgatagttatttggcg

SEQ ID NO: 98408 - DNA, 25 bp, S. pombe
gtttacccgatccttatatttgctt

SEQ ID NO: 98409 - DNA, 25 bp, S. pombe
gtttacccacgactctcaaattatt

SEQ ID NO: 98410 - DNA, 25 bp, S. pombe
gtttcccctgcgaattccaataatg

SEQ ID NO: 98411 - DNA, 25 bp, S. pombe
gtttccgtcgctatttgcaagcacg

SEQ ID NO: 98412 - DNA, 25 bp, S. pombe
gtttctcagtcctctttaaaagcaa

SEQ ID NO: 98413 - DNA, 25 bp, S. pombe
gtttccaacggcagctagttcagcg

SEQ ID NO: 98414 - DNA, 25 bp, S. pombe
gtttgtatagtgttttctcctactt

SEQ ID NO: 98415 - DNA, 25 bp, S. pombe
gtttcatcagcataaggacagcgat

SEQ ID NO: 98416 - DNA, 25 bp, S. pombe
gtttgcacgggcagcagacgctgat

SEQ ID NO: 98417 - DNA, 25 bp, S. pombe
gtttgatccaccagctaggttggaa

SEQ ID NO: 98418 - DNA, 25 bp, S. pombe
gtttgtctactctcttgactatgcc

SEQ ID NO: 98419 - DNA, 25 bp, S. pombe
gtttgtatactgttctatgaggtta

SEQ ID NO: 98420 - DNA, 25 bp, S. pombe
gtttgcttcctgctgatagtggtag

SEQ ID NO: 98421 - DNA, 25 bp, S. pombe
gtattgcttccttaaagtgggtcca

SEQ ID NO: 98422 - DNA, 25 bp, S. pombe
gtttttgttacagaccggtgctcta

SEQ ID NO: 98423 - DNA, 25 bp, S. pombe
gtttgcaaatcacacgtctaccgac

SEQ ID NO: 98424 - DNA, 25 bp, S. pombe
gtttgcaagaagtacgcccgtcaga

SEQ ID NO: 98425 - DNA, 25 bp, S. pombe
gtttactgaagattcctcacaggca

SEQ ID NO: 98426 - DNA, 25 bp, S. pombe
gtttaggaacaattcgccaggcgaa

SEQ ID NO: 98427 - DNA, 25 bp, S. pombe
gtaataaaccttctcaatctccttg

SEQ ID NO: 98428 - DNA, 25 bp, S. pombe
gtaaatgaagtttcgcctacctttg

SEQ ID NO: 98429 - DNA, 25 bp, S. pombe
gtataatactggtgcgcttctcctt

SEQ ID NO: 98430 - DNA, 25 bp, S. pombe
gtttgcaaagggatctgttcgtatt

SEQ ID NO: 98431 - DNA, 25 bp, S. pombe
gtttaaatcaacttcccacatcatc

SEQ ID NO: 98432 - DNA, 25 bp, S. pombe
gtttaatgaaacctcggctgcctat

SEQ ID NO: 98433 - DNA, 25 bp, S. pombe
gtttcaaatgtcaacggtcctcagt

SEQ ID NO: 98434 - DNA, 25 bp, S. pombe
gtttaacacattgatggcacattgc

SEQ ID NO: 98435 - DNA, 25 bp, S. pombe
gtattatgcatacaccatcggttcg

SEQ ID NO: 98436 - DNA, 25 bp, S. pombe
gtatactgctaatcgacactggact

SEQ ID NO: 98437 - DNA, 25 bp, S. pombe
gtttccctggatgatctcgaggagc

SEQ ID NO: 98438 - DNA, 25 bp, S. pombe
gtttctcttaaacttcgaggtgcat

SEQ ID NO: 98439 - DNA, 25 bp, S. pombe
gtttcaccttcaagtatcgacccaa

SEQ ID NO: 98440 - DNA, 25 bp, S. pombe
gtttctccaggtactatagccaaag

SEQ ID NO: 98441 - DNA, 25 bp, S. pombe
gtttgtcgtttctcaagttgctgca

SEQ ID NO: 98442 - DNA, 25 bp, S. pombe
gtttatccttctgagcaatttgcca

SEQ ID NO: 98443 - DNA, 25 bp, S. pombe
gtttatgcagctgaaaggttctcca

SEQ ID NO: 98444 - DNA, 25 bp, S. pombe
gtattgcaattgcttacggttgtct

SEQ ID NO: 98445 - DNA, 25 bp, S. pombe
gtttctcaacgtcttatttcgccaa

SEQ ID NO: 98446 - DNA, 25 bp, S. pombe
gtttcccggtttgatttatcgcatg

SEQ ID NO: 98447 - DNA, 25 bp, S. pombe
gtttctccaggtgccatgattgtca

SEQ ID NO: 98448 - DNA, 25 bp, S. pombe
gtttcactatgtccgctgcaaacat

SEQ ID NO: 98449 - DNA, 25 bp, S. pombe
gtttcacctctcaagtcactaatgg

SEQ ID NO: 98450 - DNA, 25 bp, S. pombe
gtttccgatgcccaaccaaatgatt

SEQ ID NO: 98451 - DNA, 25 bp, S. pombe
gtttgacgacccatctaagagactg

SEQ ID NO: 98452 - DNA, 25 bp, S. pombe
gtttgccaaactccttcgtgaagat

SEQ ID NO: 98453 - DNA, 25 bp, S. pombe
gtatctggatgtactccttcggtat

SEQ ID NO: 98454 - DNA, 25 bp, S. pombe
gtattacttccttcagtgcaatcta

SEQ ID NO: 98455 - DNA, 25 bp, S. pombe
gtttcactgaccatattgtatcgag

SEQ ID NO: 98456 - DNA, 25 bp, S. pombe
gtttactggctactgactctattac

SEQ ID NO: 98457 - DNA, 25 bp, S. pombe
gtttgtctcgacagatccaaggaaa

SEQ ID NO: 98458 - DNA, 25 bp, S. pombe
gtatttagttccttgggctgaccaa

SEQ ID NO: 98459 - DNA, 25 bp, S. pombe
gtttcatcgtcttttgggcgtccga

SEQ ID NO: 98460 - DNA, 25 bp, S. pombe
gtttctcctgctttcgatgggctag

SEQ ID NO: 98461 - DNA, 25 bp, S. pombe
gtttcaaatgtcttcgcatcctgta

SEQ ID NO: 98462 - DNA, 25 bp, S. pombe
gtattactggaagttctccaactga

SEQ ID NO: 98463 - DNA, 25 bp, S. pombe
gtttcagacttgtatactgcagcaa

SEQ ID NO: 98464 - DNA, 25 bp, S. pombe
gtttgcgcatcgattggtggctgaa

SEQ ID NO: 98465 - DNA, 25 bp, S. pombe
gtttgctgcagctttttcgaggaaa

SEQ ID NO: 98466 - DNA, 25 bp, S. pombe
gtttctggttccgaagattctgcat

SEQ ID NO: 98467 - DNA, 25 bp, S. pombe
gtattcggtcctcaacatttcttag

SEQ ID NO: 98468 - DNA, 25 bp, S. pombe
gtagtccagtcccaaaagttcctga

SEQ ID NO: 98469 - DNA, 25 bp, S. pombe
gtagatcttgtcacatgaaacttca

SEQ ID NO: 98470 - DNA, 25 bp, S. pombe
gtatgtgcttgtcgctcatggaatc

SEQ ID NO: 98471 - DNA, 25 bp, S. pombe
gtttcttggcttttgaattccattg

SEQ ID NO: 98472 - DNA, 25 bp, S. pombe
gtttcacattttccattatgcgcca

SEQ ID NO: 98473 - DNA, 25 bp, S. pombe
gtgttatacttctctttggtcattg

SEQ ID NO: 98474 - DNA, 25 bp, S. pombe
gtttaacagctctctttgactcttg

SEQ ID NO: 98475 - DNA, 25 bp, S. pombe
gtttgtacccgaccttaattctgag

SEQ ID NO: 98476 - DNA, 25 bp, S. pombe
gtatagttcctcgagtcttatggtt

SEQ ID NO: 98477 - DNA, 25 bp, S. pombe
gtagttcccttacttatggactcag

SEQ ID NO: 98478 - DNA, 25 bp, S. pombe
gtttcttccttattttagtgcacaa

SEQ ID NO: 98479 - DNA, 25 bp, S. pombe
gtttctccctttgtattgctgatca

SEQ ID NO: 98480 - DNA, 25 bp, S. pombe
gtttgctcgttcatgttctgtagga

SEQ ID NO: 98481 - DNA, 25 bp, S. pombe
gtttcactcttgagcattgctgctt

SEQ ID NO: 98482 - DNA, 25 bp, S. pombe
gtttactctgtgtcatcatcttcat

SEQ ID NO: 98483 - DNA, 25 bp, S. pombe
gtttcacccgcatcatttattactt

SEQ ID NO: 98484 - DNA, 25 bp, S. pombe
gtttcagcccgataaacagtcgttt

SEQ ID NO: 98485 - DNA, 25 bp, S. pombe
gtattccgccgttgagaaagctcgt

SEQ ID NO: 98486 - DNA, 25 bp, S. pombe
gtttcacctgaaagtattcgccgaa

SEQ ID NO: 98487 - DNA, 25 bp, S. pombe
gtttcctagaacttattcctggcat

SEQ ID NO: 98488 - DNA, 25 bp, S. pombe
gtttctaatagcactgcttctcaag

SEQ ID NO: 98489 - DNA, 25 bp, S. pombe
gtttctgtgctaaacgcgtcactat

SEQ ID NO: 98490 - DNA, 25 bp, S. pombe
gtttcttcccaaactggagctattt

SEQ ID NO: 98491 - DNA, 25 bp, S. pombe
gtttcaccgctgcatcatggaaata

SEQ ID NO: 98492 - DNA, 25 bp, S. pombe
gtttgcagcactcgctttggaacaa

SEQ ID NO: 98493 - DNA, 25 bp, S. pombe
gtttcgtcgcgacagctttacgaat

SEQ ID NO: 98494 - DNA, 25 bp, S. pombe
gtttccggtgagacacttaacgaat

SEQ ID NO: 98495 - DNA, 25 bp, S. pombe
gtttccgggtattccaattatggca

SEQ ID NO: 98496 - DNA, 25 bp, S. pombe
gtatttgccaggacccgttgaacca

SEQ ID NO: 98497 - DNA, 25 bp, S. pombe
gtttcccaggaaccgcttacagcaa

SEQ ID NO: 98498 - DNA, 25 bp, S. pombe
gtttcgccttattttgttcacagca

SEQ ID NO: 98499 - DNA, 25 bp, S. pombe
gtttgtatacccaatttcaccgatt

SEQ ID NO: 98500 - DNA, 25 bp, S. pombe
tattactttcatccttttaccgtgc

SEQ ID NO: 98501 - DNA, 25 bp, S. pombe
gtttctttgcatccagtttacggga

SEQ ID NO: 98502 - DNA, 25 bp, S. pombe
gtattcgtctcaacgttacacggta

SEQ ID NO: 98503 - DNA, 25 bp, S. pombe
gtttgcgagcttgatttggttttta

SEQ ID NO: 98504 - DNA, 25 bp, S. pombe
gtttgcgactcggatttttgttttg

SEQ ID NO: 98505 - DNA, 25 bp, S. pombe
gtttcgtctccacttaatgttgtct

SEQ ID NO: 98506 - DNA, 25 bp, S. pombe
gtttggtcgcttcaagatgttgctt

SEQ ID NO: 98507 - DNA, 25 bp, S. pombe
gtttgtggccacatcggtcatgaaa

SEQ ID NO: 98508 - DNA, 25 bp, S. pombe
gtattagctgcctccgagtcaacat

SEQ ID NO: 98509 - DNA, 25 bp, S. pombe
gtttgactgccaaccagcatgtcat

SEQ ID NO: 98510 - DNA, 25 bp, S. pombe
gtttctgtcgcagcaagtgccataa

SEQ ID NO: 98511 - DNA, 25 bp, S. pombe
gtttcacgaattacggctgtctcag

SEQ ID NO: 98512 - DNA, 25 bp, S. pombe
gtttctctggtattgaggtcctcga

SEQ ID NO: 98513 - DNA, 25 bp, S. pombe
gtttcgtgagttagaggagccctta

SEQ ID NO: 98514 - DNA, 25 bp, S. pombe
gtttctgctactggtcatgatggtc

SEQ ID NO: 98515 - DNA, 25 bp, S. pombe
gtttcagtcactggatctgttgcca

SEQ ID NO: 98516 - DNA, 25 bp, S. pombe
gtattcagtgtacctcgacggacgg

SEQ ID NO: 98517 - DNA, 25 bp, S. pombe
gtttccttgagcgttgcacggacga

SEQ ID NO: 98518 - DNA, 25 bp, S. pombe
gtttctcctcagtttcaacagatcg

SEQ ID NO: 98519 - DNA, 25 bp, S. pombe
gtttgtacctctttggcttttgaag

SEQ ID NO: 98520 - DNA, 25 bp, S. pombe
gtagttactactttttggctagagg

SEQ ID NO: 98521 - DNA, 25 bp, S. pombe
gtttgcagagaaacatacctccatt

SEQ ID NO: 98522 - DNA, 25 bp, S. pombe
gtttggaaccgatcgtagtctgatt

SEQ ID NO: 98523 - DNA, 25 bp, S. pombe
gtttggaagacctggattgcttttc

SEQ ID NO: 98524 - DNA, 25 bp, S. pombe
gtttggccatgcaacttgtaagtca

SEQ ID NO: 98525 - DNA, 25 bp, S. pombe
gtttggctcgttttttcgtcagcag

SEQ ID NO: 98526 - DNA, 25 bp, S. pombe
gtttggatcttgctcacatgtacct

SEQ ID NO: 98527 - DNA, 25 bp, S. pombe
gtttctgtcattcctactttattgc

SEQ ID NO: 98528 - DNA, 25 bp, S. pombe
gtttcatgtctttctacggattcca

SEQ ID NO: 98529 - DNA, 25 bp, S. pombe
gtttcagctcttttactttgcacca

SEQ ID NO: 98530 - DNA, 25 bp, S. pombe
gtttgtcacttttttgtcttcttct

SEQ ID NO: 98531 - DNA, 25 bp, S. pombe
gtttgccctgatcgtattgtttgca

SEQ ID NO: 98532 - DNA, 25 bp, S. pombe
gtttcctctcacgaatttgcagtca

SEQ ID NO: 98533 - DNA, 25 bp, S. pombe
gtttcttctatcgacattgctgagc

SEQ ID NO: 98534 - DNA, 25 bp, S. pombe
gtttcatttgccaagttgctccata

SEQ ID NO: 98535 - DNA, 25 bp, S. pombe
gtttgctttgacattctgggatatt

SEQ ID NO: 98536 - DNA, 25 bp, S. pombe
gtatattcctgagctttcggttcca

SEQ ID NO: 98537 - DNA, 25 bp, S. pombe
gtatcctttgttgttcgtgattcca

SEQ ID NO: 98538 - DNA, 25 bp, S. pombe
gtatgcctactatgtttggtgctcc

SEQ ID NO: 98539 - DNA, 25 bp, S. pombe
gtatttaccacgtttgcaggtcctc

SEQ ID NO: 98540 - DNA, 25 bp, S. pombe
gtttcaggcgagttaccgtatgctt

SEQ ID NO: 98541 - DNA, 25 bp, S. pombe
gtttcgagggcaatttcgttgcaca

SEQ ID NO: 98542 - DNA, 25 bp, S. pombe
gtattcgtgggctttatcgtggtct

SEQ ID NO: 98543 - DNA, 25 bp, S. pombe
gtttgtaagccgactatcgcgccaa

SEQ ID NO: 98544 - DNA, 25 bp, S. pombe
gtatcaacctacatcaaactcagcg

SEQ ID NO: 98545 - DNA, 25 bp, S. pombe
gtatcaactaacagctctaatgcga

SEQ ID NO: 98546 - DNA, 25 bp, S. pombe
gtacaacaaagtcgctcagaggagt

SEQ ID NO: 98547 - DNA, 25 bp, S. pombe
gtattgctacgattccagagtggac

SEQ ID NO: 98548 - DNA, 25 bp, S. pombe
gtttgacccttccataactgacgaa

SEQ ID NO: 98549 - DNA, 25 bp, S. pombe
gtatttctcgctacctaaagtccaa

SEQ ID NO: 98550 - DNA, 25 bp, S. pombe
gtatttcttggatcctgaagtccga

SEQ ID NO: 98551 - DNA, 25 bp, S. pombe
gtatcttttggctcgtgaagtcctt

SEQ ID NO: 98552 - DNA, 25 bp, S. pombe
gtttcattcgcccatttgtattcat

SEQ ID NO: 98553 - DNA, 25 bp, S. pombe
gtagacttttgtattgttcctttgg

SEQ ID NO: 98554 - DNA, 25 bp, S. pombe
gtatgcccttgccaaagaatccttc

SEQ ID NO: 98555 - DNA, 25 bp, S. pombe
gtttcggcataactagaactgttcc

SEQ ID NO: 98556 - DNA, 25 bp, S. pombe
gtttccgacattttgaccattcatc

SEQ ID NO: 98557 - DNA, 25 bp, S. pombe
gtttctcaacacatcaggcatcttt

SEQ ID NO: 98558 - DNA, 25 bp, S. pombe
gtttgctcaccatatagtcacttgt

SEQ ID NO: 98559 - DNA, 25 bp, S. pombe
gtttctttcaagaagcgtgctcctc

SEQ ID NO: 98560 - DNA, 25 bp, S. pombe
gtttctttgcaggaattggctccga

SEQ ID NO: 98561 - DNA, 25 bp, S. pombe
gtttctatggcaaattctggtccta

SEQ ID NO: 98562 - DNA, 25 bp, S. pombe
gtattcttgcgatgttcaggccaca

SEQ ID NO: 98563 - DNA, 25 bp, S. pombe
gtactgcagcagcatggtatctctg

SEQ ID NO: 98564 - DNA, 25 bp, S. pombe
gtttgctgacaaattatctcgcgtt

SEQ ID NO: 98565 - DNA, 25 bp, S. pombe
gtttctacagtttctcatgcgcatg

SEQ ID NO: 98566 - DNA, 25 bp, S. pombe
gtttctataatgatgcactcgatgg

SEQ ID NO: 98567 - DNA, 25 bp, S. pombe
gtttctttgatcacaccagtcgtac

SEQ ID NO: 98568 - DNA, 25 bp, S. pombe
gtttctgccattcaacaaggttact

SEQ ID NO: 98569 - DNA, 25 bp, S. pombe
gtttctacgatttttgctctcacaa

SEQ ID NO: 98570 - DNA, 25 bp, S. pombe
gtttccaaattctgtatctcgcaat

SEQ ID NO: 98571 - DNA, 25 bp, S. pombe
gtttccactgagaacaacgagcctg

SEQ ID NO: 98572 - DNA, 25 bp, S. pombe
gtataccctgggaaagctcagccag

SEQ ID NO: 98573 - DNA, 25 bp, S. pombe
gtattacctttgagagtgcaccttt

SEQ ID NO: 98574 - DNA, 25 bp, S. pombe
gtatattcctgttttagacccgatt

SEQ ID NO: 98575 - DNA, 25 bp, S. pombe
gtcttaagttttatgccgcacgtat

SEQ ID NO: 98576 - DNA, 25 bp, S. pombe
gtttgaaggctttttgctagacgaa

SEQ ID NO: 98577 - DNA, 25 bp, S. pombe
gtttctgtcaattccattcctaaag

SEQ ID NO: 98578 - DNA, 25 bp, S. pombe
gtttctctctattcctttctagcaa

SEQ ID NO: 98579 - DNA, 25 bp, S. pombe
gtatgtccccttctcaaattggtgt

SEQ ID NO: 98580 - DNA, 25 bp, S. pombe
gtttctctcctgacgataaatattc

SEQ ID NO: 98581 - DNA, 25 bp, S. pombe
gtttgtgctattactccagacattg

SEQ ID NO: 98582 - DNA, 25 bp, S. pombe
gtttccggcagttgcgaactcaacc

SEQ ID NO: 98583 - DNA, 25 bp, S. pombe
gtattgtcgctccattactaactgc

SEQ ID NO: 98584 - DNA, 25 bp, S. pombe
gtttgtcattaaaatctcacgcgga

SEQ ID NO: 98585 - DNA, 25 bp, S. pombe
gtttcgcgctcaataatacctgatg

SEQ ID NO: 98586 - DNA, 25 bp, S. pombe
gtattctcgtcttaaatctgctgtg

SEQ ID NO: 98587 - DNA, 25 bp, S. pombe
gtttctggctctttggacatatatt

SEQ ID NO: 98588 - DNA, 25 bp, S. pombe
gtattctccttctttgatgcaaatg

SEQ ID NO: 98589 - DNA, 25 bp, S. pombe
gtatctttcttccttggcatttatg

SEQ ID NO: 98590 - DNA, 25 bp, S. pombe
gtatctgtttatgtaagctttggcg

SEQ ID NO: 98591 - DNA, 25 bp, S. pombe
gtattttttggtacacgcgtgctgc

SEQ ID NO: 98592 - DNA, 25 bp, S. pombe
gtttccttcatcaccgttatgtata

SEQ ID NO: 98593 - DNA, 25 bp, S. pombe
gtttccgacagcacctattatcgaa

SEQ ID NO: 98594 - DNA, 25 bp, S. pombe
gtataccacgtgttcgttgacgcta

SEQ ID NO: 98595 - DNA, 25 bp, S. pombe
gtattcgctgttggaattttcccat

SEQ ID NO: 98596 - DNA, 25 bp, S. pombe
gtttcgtctatggaatacgctccct

SEQ ID NO: 98597 - DNA, 25 bp, S. pombe
gtttccaatatggttactgctcccg

SEQ ID NO: 98598 - DNA, 25 bp, S. pombe
gtattatatcgtgtcaatccccaat

SEQ ID NO: 98599 - DNA, 25 bp, S. pombe
gtttgctatctgctaagttcccaat

SEQ ID NO: 98600 - DNA, 25 bp, S. pombe
gtattttctgctcaatggtacccat

SEQ ID NO: 98601 - DNA, 25 bp, S. pombe
gtttgtcacacccataatttacctg

SEQ ID NO: 98602 - DNA, 25 bp, S. pombe
gtttcccacccataatgaagcactt

SEQ ID NO: 98603 - DNA, 25 bp, S. pombe
gtttcccacacctttatatctagtt

SEQ ID NO: 98604 - DNA, 25 bp, S. pombe
gtttcggtacactgttgctcatcaa

SEQ ID NO: 98605 - DNA, 25 bp, S. pombe
gtttgctttgaacctgtactcatca

SEQ ID NO: 98606 - DNA, 25 bp, S. pombe
gtattcccgctgtaatgtacactca

SEQ ID NO: 98607 - DNA, 25 bp, S. pombe
gtttgccgatgacttttatccatat

SEQ ID NO: 98608 - DNA, 25 bp, S. pombe
gtttcctgaggttgcgcgaattcat

SEQ ID NO: 98609 - DNA, 25 bp, S. pombe
gtttcgcatttttgcccatatgtat

SEQ ID NO: 98610 - DNA, 25 bp, S. pombe
gtttgaagatgctcagaccggctat

SEQ ID NO: 98611 - DNA, 25 bp, S. pombe
gtttgatagcacgacatcccgagaa

SEQ ID NO: 98612 - DNA, 25 bp, S. pombe
gtttgatcgattggcatccttggat

SEQ ID NO: 98613 - DNA, 25 bp, S. pombe
gtttgcctgcataaagttctcgttc

SEQ ID NO: 98614 - DNA, 25 bp, S. pombe
gtttgccgctgaaagaatacgtgat

SEQ ID NO: 98615 - DNA, 25 bp, S. pombe
gtttgtctatttatcatcgtctaag

SEQ ID NO: 98616 - DNA, 25 bp, S. pombe
gtttgttcgattatctcaactgcga

SEQ ID NO: 98617 - DNA, 25 bp, S. pombe
gtttgtcacagtattggcggtcgca

SEQ ID NO: 98618 - DNA, 25 bp, S. pombe
gtttgctccgtcattacttggcgta

SEQ ID NO: 98619 - DNA, 25 bp, S. pombe
gtatcgttcgcagtttttgctcgcc

SEQ ID NO: 98620 - DNA, 25 bp, S. pombe
gtatagaattggcactttccccttt

SEQ ID NO: 98621 - DNA, 25 bp, S. pombe
gtaaaggagtggctctacgtcctcc

SEQ ID NO: 98622 - DNA, 25 bp, S. pombe
gtacagcgggtacggtcctttgtca

SEQ ID NO: 98623 - DNA, 25 bp, S. pombe
gtatcacaccgtaagggccgtgggt

SEQ ID NO: 98624 - DNA, 25 bp, S. pombe
gtactacggtccctaatgacagttt

SEQ ID NO: 98625 - DNA, 25 bp, S. pombe
gtattcgaaccccaagatctgtatg

SEQ ID NO: 98626 - DNA, 25 bp, S. pombe
gtagtcgtacctttcgaactgatga

SEQ ID NO: 98627 - DNA, 25 bp, S. pombe
gtgttttacgccttaagcctggacg

SEQ ID NO: 98628 - DNA, 25 bp, S. pombe
gtttgtttctactatgcttccttat

SEQ ID NO: 98629 - DNA, 25 bp, S. pombe
gtttgttaccattgacttcccaatt

SEQ ID NO: 98630 - DNA, 25 bp, S. pombe
gtattggtactttattcgtgcgcct

SEQ ID NO: 98631 - DNA, 25 bp, S. pombe
gtattattacttcgccttacgttgg

SEQ ID NO: 98632 - DNA, 25 bp, S. pombe
gtattttagctttcccgccgattcg

SEQ ID NO: 98633 - DNA, 25 bp, S. pombe
gtttgcattgctttaccgtgtagga

SEQ ID NO: 98634 - DNA, 25 bp, S. pombe
gtttgttctctctctcattaacgaa

SEQ ID NO: 98635 - DNA, 25 bp, S. pombe
gtttcctctcatgcttctgtaactt

SEQ ID NO: 98636 - DNA, 25 bp, S. pombe
gtataccgctctccttcaggaaatt

SEQ ID NO: 98637 - DNA, 25 bp, S. pombe
gtattattgttcctactaccgtaag

SEQ ID NO: 98638 - DNA, 25 bp, S. pombe
gtattatctatttccgtgacggtac

SEQ ID NO: 98639 - DNA, 25 bp, S. pombe
gtattttatctcctctaatcggtca

SEQ ID NO: 98640 - DNA, 25 bp, S. pombe
gtatctgtgtttctctaattgacca

SEQ ID NO: 98641 - DNA, 25 bp, S. pombe
gtatcataccgacttctacgttatt

SEQ ID NO: 98642 - DNA, 25 bp, S. pombe
gtattagcactgtttagacctcata

SEQ ID NO: 98643 - DNA, 25 bp, S. pombe
gtttgctagcactttggatcctata

SEQ ID NO: 98644 - DNA, 25 bp, S. pombe
gtattgcaggtctatgcattcccat

SEQ ID NO: 98645 - DNA, 25 bp, S. pombe
gtttgcattgccttatcattcttca

SEQ ID NO: 98646 - DNA, 25 bp, S. pombe
gtattgagcatccttgtttttattg

SEQ ID NO: 98647 - DNA, 25 bp, S. pombe
gtttgagccgctcgattcttgcatg

SEQ ID NO: 98648 - DNA, 25 bp, S. pombe
gtatagctcctcctttgaatgtggt

SEQ ID NO: 98649 - DNA, 25 bp, S. pombe
gtatatgcccatattaccattgttg

SEQ ID NO: 98650 - DNA, 25 bp, S. pombe
gtattattcctttcacgcttttgtt

SEQ ID NO: 98651 - DNA, 25 bp, S. pombe
gtatttagccacgttccttcaacca

SEQ ID NO: 98652 - DNA, 25 bp, S. pombe
gtatttaccactactccttattcac

SEQ ID NO: 98653 - DNA, 25 bp, S. pombe
gtatatcaaccgttttttcgcgtga

SEQ ID NO: 98654 - DNA, 25 bp, S. pombe
gtttgctgaccttgtcttatgggac

SEQ ID NO: 98655 - DNA, 25 bp, S. pombe
gtttgcgacaggttctttggcatca

SEQ ID NO: 98656 - DNA, 25 bp, S. pombe
gtttggcggcagtttactagcacaa

SEQ ID NO: 98657 - DNA, 25 bp, S. pombe
gtttggcctggctatgtacatggtc

SEQ ID NO: 98658 - DNA, 25 bp, S. pombe
gtttgtgccaactgtggtggtcatt

SEQ ID NO: 98659 - DNA, 25 bp, S. pombe
gtttgcgacaactgtgaaggtctct

SEQ ID NO: 98660 - DNA, 25 bp, S. pombe
gtttgcgtcctgatcaacgttatag

SEQ ID NO: 98661 - DNA, 25 bp, S. pombe
gtattttgaacgtttctgcccttga

SEQ ID NO: 98662 - DNA, 25 bp, S. pombe
gtattgattaaccagtttgccgctg

SEQ ID NO: 98663 - DNA, 25 bp, S. pombe
gtctgacgtcaatcacgcgatcggc

SEQ ID NO: 98664 - DNA, 25 bp, S. pombe
gtattcacaacttcattgtctttgt

SEQ ID NO: 98665 - DNA, 25 bp, S. pombe
ttttaaaccgtcatttggcacctca

SEQ ID NO: 98666 - DNA, 25 bp, S. pombe
tgatcttagtactgtctttgagcca

SEQ ID NO: 98667 - DNA, 25 bp, S. pombe
gtatcatagtcatgggcttttgcct

SEQ ID NO: 98668 - DNA, 25 bp, S. pombe
gtttggtcaatggtgctggtctcgc

SEQ ID NO: 98669 - DNA, 25 bp, S. pombe
gtttgtcacaatggcatggcagatt

SEQ ID NO: 98670 - DNA, 25 bp, S. pombe
gtttgatcaacaacggcacatccat

SEQ ID NO: 98671 - DNA, 25 bp, S. pombe
gtattaaagcaccttgccatcaccg

SEQ ID NO: 98672 - DNA, 25 bp, S. pombe
gtatggaaatcaacggcccaccgag

SEQ ID NO: 98673 - DNA, 25 bp, S. pombe
gtagaagtttatggcgccttatccc

SEQ ID NO: 98674 - DNA, 25 bp, S. pombe
gtatgaactggtacagccttcttga

SEQ ID NO: 98675 - DNA, 25 bp, S. pombe
gtattgcaccatttcgcggatttgt

SEQ ID NO: 98676 - DNA, 25 bp, S. pombe
gtttgcagcaattcctagtgtttct

SEQ ID NO: 98677 - DNA, 25 bp, S. pombe
gtttgcatctcaacgctagtctaac

SEQ ID NO: 98678 - DNA, 25 bp, S. pombe
gtttgcttgaaccttatgctcactc

SEQ ID NO: 98679 - DNA, 25 bp, S. pombe
gtatagtcttcacgtagtctcagct

SEQ ID NO: 98680 - DNA, 25 bp, S. pombe
gtataccctgcattggactagtgaa

SEQ ID NO: 98681 - DNA, 25 bp, S. pombe
gtatccctctagttgttggtggttc

SEQ ID NO: 98682 - DNA, 25 bp, S. pombe
gtatccctctgttcgtaaagtttgc

SEQ ID NO: 98683 - DNA, 25 bp, S. pombe
gtttgattctcaacaagccgcttat

SEQ ID NO: 98684 - DNA, 25 bp, S. pombe
gtttgactcaagcaagttctccaca

SEQ ID NO: 98685 - DNA, 25 bp, S. pombe
gtttgattgcttatggtgcctccca

SEQ ID NO: 98686 - DNA, 25 bp, S. pombe
gtttggatgtttgccttgctcgtaa

SEQ ID NO: 98687 - DNA, 25 bp, S. pombe
gtagggttattcgattttgcgtcaa

SEQ ID NO: 98688 - DNA, 25 bp, S. pombe
gtaaatttcaagttttcgtctcgag

SEQ ID NO: 98689 - DNA, 25 bp, S. pombe
gtataaccccagatttcgttcgtga

SEQ ID NO: 98690 - DNA, 25 bp, S. pombe
gtattcgtcgatgcggctttatata

SEQ ID NO: 98691 - DNA, 25 bp, S. pombe
gtttggagcgtttactattatcact

SEQ ID NO: 98692 - DNA, 25 bp, S. pombe
gtttggcatgagattcccattccac

SEQ ID NO: 98693 - DNA, 25 bp, S. pombe
gtttgattttgctactgactctgat

SEQ ID NO: 98694 - DNA, 25 bp, S. pombe
gtttgttttcctactctaaatccag

SEQ ID NO: 98695 - DNA, 25 bp, S. pombe
gtttgattttgtaacccgaaggcag

SEQ ID NO: 98696 - DNA, 25 bp, S. pombe
gtttgttgaatctttcccagaacca

SEQ ID NO: 98697 - DNA, 25 bp, S. pombe
gtcaaaaagccttacgtcctagaag

SEQ ID NO: 98698 - DNA, 25 bp, S. pombe
gtagaacgccttctcgtcaaaacag

SEQ ID NO: 98699 - DNA, 25 bp, S. pombe
gtttgttactgatatgctgcgacat

SEQ ID NO: 98700 - DNA, 25 bp, S. pombe
gtatcttttaagtctgggccgagca

SEQ ID NO: 98701 - DNA, 25 bp, S. pombe
gtatttcttctttctaccaaagccg

SEQ ID NO: 98702 - DNA, 25 bp, S. pombe
gtatttcctgaaaactccaaagcca

SEQ ID NO: 98703 - DNA, 25 bp, S. pombe
gtttgaaatgcatttgcgcggccat

SEQ ID NO: 98704 - DNA, 25 bp, S. pombe
gtttgagaatgcttcccagagttaa

SEQ ID NO: 98705 - DNA, 25 bp, S. pombe
gtattagcaagcctgaacatctcga

SEQ ID NO: 98706 - DNA, 25 bp, S. pombe
gtataacttcccgtgagcttcgtaa

SEQ ID NO: 98707 - DNA, 25 bp, S. pombe
gtattcactttctgtaatgccttta

SEQ ID NO: 98708 - DNA, 25 bp, S. pombe
gtattcttctacttgatggatccag

SEQ ID NO: 98709 - DNA, 25 bp, S. pombe
gtatcccaatcgtgctagagatcct

SEQ ID NO: 98710 - DNA, 25 bp, S. pombe
gtattgtacacaaagcgccttggct

SEQ ID NO: 98711 - DNA, 25 bp, S. pombe
gtttgtacacaaatcatgctgttgt

SEQ ID NO: 98712 - DNA, 25 bp, S. pombe
gtttgtgacacattttcctagttta

SEQ ID NO: 98713 - DNA, 25 bp, S. pombe
gtataagataattcaccggcttcta

SEQ ID NO: 98714 - DNA, 25 bp, S. pombe
gtataccatttttctatgatcggat

SEQ ID NO: 98715 - DNA, 25 bp, S. pombe
gtataccctttcagtcaatttctag

SEQ ID NO: 98716 - DNA, 25 bp, S. pombe
gtatccatttcctacagttcattcg

SEQ ID NO: 98717 - DNA, 25 bp, S. pombe
gtatctgccgaactggttcaggtcg

SEQ ID NO: 98718 - DNA, 25 bp, S. pombe
gtattgccgctgttgagtatatcgc

SEQ ID NO: 98719 - DNA, 25 bp, S. pombe
gtattccttcctactttcgagatga

SEQ ID NO: 98720 - DNA, 25 bp, S. pombe
gtattgcctactctcttttggaaga

SEQ ID NO: 98721 - DNA, 25 bp, S. pombe
gtattctcccttactatcttggaag

SEQ ID NO: 98722 - DNA, 25 bp, S. pombe
gtattctactcttcatgtgcctaaa

SEQ ID NO: 98723 - DNA, 25 bp, S. pombe
gtattcttgagcagcatgccgtgaa

SEQ ID NO: 98724 - DNA, 25 bp, S. pombe
gtttgatttctcatgccggaagtct

SEQ ID NO: 98725 - DNA, 25 bp, S. pombe
gtttgattctatttgcctggaaggc

SEQ ID NO: 98726 - DNA, 25 bp, S. pombe
gtttgatctcaggattgctgctgga

SEQ ID NO: 98727 - DNA, 25 bp, S. pombe
gtattgcttcggttgctgatgacaa

SEQ ID NO: 98728 - DNA, 25 bp, S. pombe
gtttggcatcggtcgttgctaagca

SEQ ID NO: 98729 - DNA, 25 bp, S. pombe
gtatcggtactgcttctatcattag

SEQ ID NO: 98730 - DNA, 25 bp, S. pombe
gtaggatcgtgtatgatgcccctct

SEQ ID NO: 98731 - DNA, 25 bp, S. pombe
gtaggatctatctttgtcgttattt

SEQ ID NO: 98732 - DNA, 25 bp, S. pombe
gtagttttcgttctcaacagtgcta

SEQ ID NO: 98733 - DNA, 25 bp, S. pombe
gtatgtttcactctacgcagaaggc

SEQ ID NO: 98734 - DNA, 25 bp, S. pombe
gtatatgaccctacaaggttacgat

SEQ ID NO: 98735 - DNA, 25 bp, S. pombe
gtatttcgaagatcatcctcctcag

SEQ ID NO: 98736 - DNA, 25 bp, S. pombe
gtatttggaatctaccctttagaag

SEQ ID NO: 98737 - DNA, 25 bp, S. pombe
gtatttgaatactctgccttgaagc

SEQ ID NO: 98738 - DNA, 25 bp, S. pombe
gtatttgacgaatcttcagcaccag

SEQ ID NO: 98739 - DNA, 25 bp, S. pombe
gtataggcccatttttgatcagctg

SEQ ID NO: 98740 - DNA, 25 bp, S. pombe
gtattggatccaacgcttcagctgt

SEQ ID NO: 98741 - DNA, 25 bp, S. pombe
gtttggcaaccagtcaggcacgaac

SEQ ID NO: 98742 - DNA, 25 bp, S. pombe
gtctagctaaacatgtagctaaaac

SEQ ID NO: 98743 - DNA, 25 bp, S. pombe
gtaggtatggtcctgtacgacaaat

SEQ ID NO: 98744 - DNA, 25 bp, S. pombe
gtcgtcaagctcgtcaaaccaaggc

SEQ ID NO: 98745 - DNA, 25 bp, S. pombe
gtattcaccatctcacaaccaaaaa

SEQ ID NO: 98746 - DNA, 25 bp, S. pombe
gtattcgtgacggactatccacaaa

SEQ ID NO: 98747 - DNA, 25 bp, S. pombe
gtatctatgcttctactactcttca

SEQ ID NO: 98748 - DNA, 25 bp, S. pombe
gtattcgtgagtatgctccaggcta

SEQ ID NO: 98749 - DNA, 25 bp, S. pombe
gtattcagtgcgtgaggctactcat

SEQ ID NO: 98750 - DNA, 25 bp, S. pombe
gtattggtgccactcatagttctcg

SEQ ID NO: 98751 - DNA, 25 bp, S. pombe
gtattctggttggttctcatgatca

SEQ ID NO: 98752 - DNA, 25 bp, S. pombe
gtatcttgttccgtaattcacctgc

SEQ ID NO: 98753 - DNA, 25 bp, S. pombe
gtattaccgtactcattatcatctt

SEQ ID NO: 98754 - DNA, 25 bp, S. pombe
gtatgttccgtccaagcgtatatct

SEQ ID NO: 98755 - DNA, 25 bp, S. pombe
gtatggtctatctgaaggctatcgt

SEQ ID NO: 98756 - DNA, 25 bp, S. pombe
gtttgggctgtcaacaacggtcaca

SEQ ID NO: 98757 - DNA, 25 bp, S. pombe
gtttgtgaattcaaccccgatgcga

SEQ ID NO: 98758 - DNA, 25 bp, S. pombe
gtatgtggcataccgtatatccttt

SEQ ID NO: 98759 - DNA, 25 bp, S. pombe
gtattggatacccagcagtctgttt

SEQ ID NO: 98760 - DNA, 25 bp, S. pombe
gtttggacaccaccgaatgattata

SEQ ID NO: 98761 - DNA, 25 bp, S. pombe
gtcagtaagccgtgccaatgaactt

SEQ ID NO: 98762 - DNA, 25 bp, S. pombe
gtagtggccgatacatctggaaact

SEQ ID NO: 98763 - DNA, 25 bp, S. pombe
gtatttcggctgctttatttttcat

SEQ ID NO: 98764 - DNA, 25 bp, S. pombe
gtatttcggctgctttatttttcat

SEQ ID NO: 98765 - DNA, 25 bp, S. pombe
gtattacggctctcttgtgctttac

SEQ ID NO: 98766 - DNA, 25 bp, S. pombe
gtatatacggttatctgggcttcag

SEQ ID NO: 98767 - DNA, 25 bp, S. pombe
gtatgaaagtgcctcttctaccgtc

SEQ ID NO: 98768 - DNA, 25 bp, S. pombe
gtatattgactgctgctactatcca

SEQ ID NO: 98769 - DNA, 25 bp, S. pombe
gtattgctaatccttcactatgtga

SEQ ID NO: 98770 - DNA, 25 bp, S. pombe
gtatactgaattcccactttttgcc

SEQ ID NO: 98771 - DNA, 25 bp, S. pombe
gtaagtaagcgagccagaccttccc

SEQ ID NO: 98772 - DNA, 25 bp, S. pombe
gtatttacctgcacacgacgttatc

SEQ ID NO: 98773 - DNA, 25 bp, S. pombe
gtattttaccatccccaggtgtata

SEQ ID NO: 98774 - DNA, 25 bp, S. pombe
gtattaaagatcaaccccttggcta

SEQ ID NO: 98775 - DNA, 25 bp, S. pombe
gtagaacatggtgatccacttcccc

SEQ ID NO: 98776 - DNA, 25 bp, S. pombe
gtatcatggcagatcgtccactggc

SEQ ID NO: 98777 - DNA, 25 bp, S. pombe
gtatcgactggtgttgcattggtaa

SEQ ID NO: 98778 - DNA, 25 bp, S. pombe
gtatctacgtctccgagcgtggtaa

SEQ ID NO: 98779 - DNA, 25 bp, S. pombe
gtatatctccattttccggttggat

SEQ ID NO: 98780 - DNA, 25 bp, S. pombe
gtatcagctcaataagcccgtcgac

SEQ ID NO: 98781 - DNA, 25 bp, S. pombe
gtattgctagcaaatatccacgtgc

SEQ ID NO: 98782 - DNA, 25 bp, S. pombe
gtatggacgttatagacttgctctt

SEQ ID NO: 98783 - DNA, 25 bp, S. pombe
gtatctttctttacgacgtgcggaa

SEQ ID NO: 98784 - DNA, 25 bp, S. pombe
gtataattatcaacgccctggcatc

SEQ ID NO: 98785 - DNA, 25 bp, S. pombe
gtatagcagcgaagacgcccttcat

SEQ ID NO: 98786 - DNA, 25 bp, S. pombe
gtatgcccaatggagcacgtttcat

SEQ ID NO: 98787 - DNA, 25 bp, S. pombe
gtatcccgtcaaggctggtatattt

SEQ ID NO: 98788 - DNA, 25 bp, S. pombe
gtattcgaactagctgttactattt

SEQ ID NO: 98789 - DNA, 25 bp, S. pombe
gtatcaaacgcttctttagctcctt

SEQ ID NO: 98790 - DNA, 25 bp, S. pombe
gtataattcgccttttgagcactat

SEQ ID NO: 98791 - DNA, 25 bp, S. pombe
gtattatctccctattcgctgaaca

SEQ ID NO: 98792 - DNA, 25 bp, S. pombe
gtattatcttgcaagtccgttccag

SEQ ID NO: 98793 - DNA, 25 bp, S. pombe
gtattactttgaccaaatggccatg

SEQ ID NO: 98794 - DNA, 25 bp, S. pombe
gtattccttggccaaatctggtcat

SEQ ID NO: 98795 - DNA, 25 bp, S. pombe
gtactaccacggatgaccaagcgca

SEQ ID NO: 98796 - DNA, 25 bp, S. pombe
gtattgcaaatcctgtagccacctt

SEQ ID NO: 98797 - DNA, 25 bp, S. pombe
gtattgacaaaatccctccgttaga

SEQ ID NO: 98798 - DNA, 25 bp, S. pombe
gtcgagcccgctgaagttaaacaag

SEQ ID NO: 98799 - DNA, 25 bp, S. pombe
gtctggcgacgtgaacctcaaacac

SEQ ID NO: 98800 - DNA, 25 bp, S. pombe
tttgatgttggatcgcactcgtgca

SEQ ID NO: 98801 - DNA, 25 bp, S. pombe
gtatgttttgactgactctgatcac

SEQ ID NO: 98802 - DNA, 25 bp, S. pombe
gtattttcacatgcgagatctccga

SEQ ID NO: 98803 - DNA, 25 bp, S. pombe
gtatctttagagtccgatcatcctg

SEQ ID NO: 98804 - DNA, 25 bp, S. pombe
gtatcagccgtttcaatgtgtccgc

SEQ ID NO: 98805 - DNA, 25 bp, S. pombe
gtatcaatcgttacttactccctac

SEQ ID NO: 98806 - DNA, 25 bp, S. pombe
gtatcttcagttgtttctgccatta

SEQ ID NO: 98807 - DNA, 25 bp, S. pombe
gtattcatgctatcgaacgcgcgtt

SEQ ID NO: 98808 - DNA, 25 bp, S. pombe
gtattgatccaaaaccagctgctct

SEQ ID NO: 98809 - DNA, 25 bp, S. pombe
gtattttaataatcgtcatctgcta

SEQ ID NO: 98810 - DNA, 25 bp, S. pombe
gtagatggtactttagatccggaaa

SEQ ID NO: 98811 - DNA, 25 bp, S. pombe
gtattacgagagattcccgccacaa

SEQ ID NO: 98812 - DNA, 25 bp, S. pombe
gtactgaggtaactactcttcctga

SEQ ID NO: 98813 - DNA, 25 bp, S. pombe
gtattcactctatcggttttttgtc

SEQ ID NO: 98814 - DNA, 25 bp, S. pombe
gtattcgctgtagtctagtttcttt

SEQ ID NO: 98815 - DNA, 25 bp, S. pombe
gtattgcctgtctctaatactcctt

SEQ ID NO: 98816 - DNA, 25 bp, S. pombe
gtatggccatcgtccgaagtcaagg

SEQ ID NO: 98817 - DNA, 25 bp, S. pombe
gtatcgcagacctccaagacatggt

SEQ ID NO: 98818 - DNA, 25 bp, S. pombe
gtatctcagccctcgaataatgcag

SEQ ID NO: 98819 - DNA, 25 bp, S. pombe
gtattcaaccaactgtatgaatgat

SEQ ID NO: 98820 - DNA, 25 bp, S. pombe
gtatttgctctgactactctacttc

SEQ ID NO: 98821 - DNA, 25 bp, S. pombe
gtattaccatagtcatcccatcttg

SEQ ID NO: 98822 - DNA, 25 bp, S. pombe
gtatttatcacgtaccaagagctgg

SEQ ID NO: 98823 - DNA, 25 bp, S. pombe
gtatctgggtgcttctgccaataaa

SEQ ID NO: 98824 - DNA, 25 bp, S. pombe
gtattactacgaccctaagcatgca

SEQ ID NO: 98825 - DNA, 25 bp, S. pombe
gtatatgtcgtgttccattcgatgg

SEQ ID NO: 98826 - DNA, 25 bp, S. pombe
gtatatgtctgtcatcaagccctgg

SEQ ID NO: 98827 - DNA, 25 bp, S. pombe
gtattattcttcattaccctgctaa

SEQ ID NO: 98828 - DNA, 25 bp, S. pombe
gtattacatttctcttttgcaagct

SEQ ID NO: 98829 - DNA, 25 bp, S. pombe
gtatttttgtgctctaacgctcagc

SEQ ID NO: 98830 - DNA, 25 bp, S. pombe
gtatgtcggtatttccaacctctga

SEQ ID NO: 98831 - DNA, 25 bp, S. pombe
gtattcgttgaattgccagaacctg

SEQ ID NO: 98832 - DNA, 25 bp, S. pombe
gtattcgtctaatttcagttggtga

SEQ ID NO: 98833 - DNA, 25 bp, S. pombe
gtattcttcataaatctccttggat

SEQ ID NO: 98834 - DNA, 25 bp, S. pombe
gtatatcttcggaatcttctgtgga

SEQ ID NO: 98835 - DNA, 25 bp, S. pombe
gtattactgtgtttagtgctcctaa

SEQ ID NO: 98836 - DNA, 25 bp, S. pombe
gtattcagtgcgaaccagtgctact

SEQ ID NO: 98837 - DNA, 25 bp, S. pombe
gtatcacaactagagtcgcagcgcc

SEQ ID NO: 98838 - DNA, 25 bp, S. pombe
gtatcatcgaccttgctagtgcaga

SEQ ID NO: 98839 - DNA, 25 bp, S. pombe
gtatcatgttatggctgctgcacct

SEQ ID NO: 98840 - DNA, 25 bp, S. pombe
gtatgcatgttttgcgtggtcatct

SEQ ID NO: 98841 - DNA, 25 bp, S. pombe
gtatcatgtatcttcggtgctatca

SEQ ID NO: 98842 - DNA, 25 bp, S. pombe
gtatcagtcagcttcgtgattcgat

SEQ ID NO: 98843 - DNA, 25 bp, S. pombe
gtataccccattcttcacaaatttg

SEQ ID NO: 98844 - DNA, 25 bp, S. pombe
gtatatcggccaatgacttctaagt

SEQ ID NO: 98845 - DNA, 25 bp, S. pombe
gtatatgagatgaaatcggctgtag

SEQ ID NO: 98846 - DNA, 25 bp, S. pombe
gtatatctgcatttctagccgcgta

SEQ ID NO: 98847 - DNA, 25 bp, S. pombe
gtatattcgttggtcatggtctaca

SEQ ID NO: 98848 - DNA, 25 bp, S. pombe
gtatttcgtgcgtttggacttgcaa

SEQ ID NO: 98849 - DNA, 25 bp, S. pombe
gtattagtggcgtttggtctcgaat

SEQ ID NO: 98850 - DNA, 25 bp, S. pombe
gtatgatgaggtcgatttccccaaa

SEQ ID NO: 98851 - DNA, 25 bp, S. pombe
gtatatgcaccacatttacctctag

SEQ ID NO: 98852 - DNA, 25 bp, S. pombe
gtatacacatcgactgggcttgctt

SEQ ID NO: 98853 - DNA, 25 bp, S. pombe
gtattcttgcaattttcgcatgtcg

SEQ ID NO: 98854 - DNA, 25 bp, S. pombe
gtatctgcctgataggtacattcgt

SEQ ID NO: 98855 - DNA, 25 bp, S. pombe
gtatctcctcattcaggtcctgctc

SEQ ID NO: 98856 - DNA, 25 bp, S. pombe
gtattcagcatcaagaagtcctctt

SEQ ID NO: 98857 - DNA, 25 bp, S. pombe
gtagtggcactacggtccctttgaa

SEQ ID NO: 98858 - DNA, 25 bp, S. pombe
gtagttcctagtatgccgtttgtga

SEQ ID NO: 98859 - DNA, 25 bp, S. pombe
gtatttcttacatttccgacgttga

SEQ ID NO: 98860 - DNA, 25 bp, S. pombe
gtacgtccgaaaaccgagatcgtga

SEQ ID NO: 98861 - DNA, 25 bp, S. pombe
gtaggatccaaattcaacgcgacga

SEQ ID NO: 98862 - DNA, 25 bp, S. pombe
gtatggaggctcttttttcggcagc

SEQ ID NO: 98863 - DNA, 25 bp, S. pombe
gtatcagaaatgtgcctcaccgtct

SEQ ID NO: 98864 - DNA, 25 bp, S. pombe
gtagaaagagccactcctatcacta

SEQ ID NO: 98865 - DNA, 25 bp, S. pombe
gtatgggcggtatggacttcagtca

SEQ ID NO: 98866 - DNA, 25 bp, S. pombe
gtatcagcgctggtacggatgctaa

SEQ ID NO: 98867 - DNA, 25 bp, S. pombe
gtatcctcggacagatccatgcgta

SEQ ID NO: 98868 - DNA, 25 bp, S. pombe
gtatttccaaccaagccatgcgtat

SEQ ID NO: 98869 - DNA, 25 bp, S. pombe
gtattttacctatctcatgggcata

SEQ ID NO: 98870 - DNA, 25 bp, S. pombe
gtatttatcttgacgtccgaccaaa

SEQ ID NO: 98871 - DNA, 25 bp, S. pombe
gtatttatcgataggtctcgccgaa

SEQ ID NO: 98872 - DNA, 25 bp, S. pombe
gtatttatcttgcatcgacctcgat

SEQ ID NO: 98873 - DNA, 25 bp, S. pombe
gtattttttgtacgatcgccgcata

SEQ ID NO: 98874 - DNA, 25 bp, S. pombe
gtatgttttttacctggcacactta

SEQ ID NO: 98875 - DNA, 25 bp, S. pombe
gtagtttgcttgcacctggaacact

SEQ ID NO: 98876 - DNA, 25 bp, S. pombe
gtatgattctttgttcgttgttgca

SEQ ID NO: 98877 - DNA, 25 bp, S. pombe
gtatttctgttggtactgtcttatc

SEQ ID NO: 98878 - DNA, 25 bp, S. pombe
gtattttgaatgtctctgctctcga

SEQ ID NO: 98879 - DNA, 25 bp, S. pombe
gtatttggctatgtctcccaatggt

SEQ ID NO: 98880 - DNA, 25 bp, S. pombe
gtatttgcttactgctaaacctgtt

SEQ ID NO: 98881 - DNA, 25 bp, S. pombe
gtattttgctgtttgtgacaacccg

SEQ ID NO: 98882 - DNA, 25 bp, S. pombe
gtatgcctctggacttggaaatctc

SEQ ID NO: 98883 - DNA, 25 bp, S. pombe
gtatgccgagaaactgcgaattgtt

SEQ ID NO: 98884 - DNA, 25 bp, S. pombe
gtatgcaataaaatgatcaacttgt

SEQ ID NO: 98885 - DNA, 25 bp, S. pombe
gtatgcatcggactagccatcactt

SEQ ID NO: 98886 - DNA, 25 bp, S. pombe
gtatgatcatcgcttggtccattac

SEQ ID NO: 98887 - DNA, 25 bp, S. pombe
gtatgtacgccctagtgcaattctc

SEQ ID NO: 98888 - DNA, 25 bp, S. pombe
gtagtacccatggacgtttctcctg

SEQ ID NO: 98889 - DNA, 25 bp, S. pombe
gtatggaccctggagacttttgcgc

SEQ ID NO: 98890 - DNA, 25 bp, S. pombe
gtatgccccgctttaatttgtgctg

SEQ ID NO: 98891 - DNA, 25 bp, S. pombe
gtatcctccgtttagtttggcatgc

SEQ ID NO: 98892 - DNA, 25 bp, S. pombe
gtatgatgctccgtttagtaccgac

SEQ ID NO: 98893 - DNA, 25 bp, S. pombe
gtatatggtcctcgacaatacgaag

SEQ ID NO: 98894 - DNA, 25 bp, S. pombe
gtatacgagcagactatccacacaa

SEQ ID NO: 98895 - DNA, 25 bp, S. pombe
gtatccatacccattctcaggaagc

SEQ ID NO: 98896 - DNA, 25 bp, S. pombe
gtatcttaccagcttttgtgaatct

SEQ ID NO: 98897 - DNA, 25 bp, S. pombe
gtatcttaacccttgttttgcggca

SEQ ID NO: 98898 - DNA, 25 bp, S. pombe
gtatgccgaaccttctgttttacga

SEQ ID NO: 98899 - DNA, 25 bp, S. pombe
gtatcgctgaagaaagccctttccc

SEQ ID NO: 98900 - DNA, 25 bp, S. pombe
gtatgttggtgcaaagccctttact

SEQ ID NO: 98901 - DNA, 25 bp, S. pombe
gtatcttcagcaggcgactatgtcg

SEQ ID NO: 98902 - DNA, 25 bp, S. pombe
gtatactgatcgtcatcttgcaaga

SEQ ID NO: 98903 - DNA, 25 bp, S. pombe
gtatccgtgatgacatgcttggcaa

SEQ ID NO: 98904 - DNA, 25 bp, S. pombe
gtatggctggcaatatcttcgctag

SEQ ID NO: 98905 - DNA, 25 bp, S. pombe
gtatatcggccattcccgatgatgt

SEQ ID NO: 98906 - DNA, 25 bp, S. pombe
gtatttgtcatctccagaacgtcaa

SEQ ID NO: 98907 - DNA, 25 bp, S. pombe
gtatgaacctgcttccagtacagtc

SEQ ID NO: 98908 - DNA, 25 bp, S. pombe
gtagctctcatagcagggtaccgga

SEQ ID NO: 98909 - DNA, 25 bp, S. pombe
gtatccaagtttcttattccttcat

SEQ ID NO: 98910 - DNA, 25 bp, S. pombe
gtatttggctatatcgttaactgct

SEQ ID NO: 98911 - DNA, 25 bp, S. pombe
gtatttcattgcttctgtggatcat

SEQ ID NO: 98912 - DNA, 25 bp, S. pombe
gtatcaccattgttcctttccaaat

SEQ ID NO: 98913 - DNA, 25 bp, S. pombe
gtatttattcttccctatatgccgt

SEQ ID NO: 98914 - DNA, 25 bp, S. pombe
gtataatttctaccgctttcagtat

SEQ ID NO: 98915 - DNA, 25 bp, S. pombe
gtatcaatatgacttctgcgtttca

SEQ ID NO: 98916 - DNA, 25 bp, S. pombe
gtgaaatgtcatctcgtcgtaacgc

SEQ ID NO: 98917 - DNA, 25 bp, S. pombe
gtatacttgcatatcgacgaaacct

SEQ ID NO: 98918 - DNA, 25 bp, S. pombe
gtatgcacggcattccactagcaaa

SEQ ID NO: 98919 - DNA, 25 bp, S. pombe
gtatcgatgtccaacaagtctcctt

SEQ ID NO: 98920 - DNA, 25 bp, S. pombe
gtatagatcccaacgattctctttc

SEQ ID NO: 98921 - DNA, 25 bp, S. pombe
gtatatttctaatcttcctcttcat

SEQ ID NO: 98922 - DNA, 25 bp, S. pombe
gtatggttaggattcttccggcttt

SEQ ID NO: 98923 - DNA, 25 bp, S. pombe
gtatcgttcaagattacccaccttt

SEQ ID NO: 98924 - DNA, 25 bp, S. pombe
gtatttcattgatgcgaagcgctct

SEQ ID NO: 98925 - DNA, 25 bp, S. pombe
gtatgctttcattctcaaggttgat

SEQ ID NO: 98926 - DNA, 25 bp, S. pombe
gtatcattctcacccgggttttggt

SEQ ID NO: 98927 - DNA, 25 bp, S. pombe
gtagagatggcttcgttggctccac

SEQ ID NO: 98928 - DNA, 25 bp, S. pombe
gtatgaatacttctcacctcttggg

SEQ ID NO: 98929 - DNA, 25 bp, S. pombe
gtagagttcattttgcatcactttg

SEQ ID NO: 98930 - DNA, 25 bp, S. pombe
gtatacgtcgatgcgccaatttgtt

SEQ ID NO: 98931 - DNA, 25 bp, S. pombe
gtatcacactctcaccaggttgtta

SEQ ID NO: 98932 - DNA, 25 bp, S. pombe
gtatgggacttctgcgtccatttga

SEQ ID NO: 98933 - DNA, 25 bp, S. pombe
gtatctagtatttctacctctggtt

SEQ ID NO: 98934 - DNA, 25 bp, S. pombe
gtataacttgttagctcgccatgcg

SEQ ID NO: 98935 - DNA, 25 bp, S. pombe
gtatagagttgttcttcatcctgaa

SEQ ID NO: 98936 - DNA, 25 bp, S. pombe
gtatgagttttactctcgtgctgcc

SEQ ID NO: 98937 - DNA, 25 bp, S. pombe
gtatggcttattctgccgtggaagc

SEQ ID NO: 98938 - DNA, 25 bp, S. pombe
gtaggcacaaattccacgcatcatg

SEQ ID NO: 98939 - DNA, 25 bp, S. pombe
gtaggaaatcgacctgatccacgaa

SEQ ID NO: 98940 - DNA, 25 bp, S. pombe
gtagtcgaacgaccaatcgccgata

SEQ ID NO: 98941 - DNA, 25 bp, S. pombe
gtagttacgctgttttccaggacaa

SEQ ID NO: 98942 - DNA, 25 bp, S. pombe
gtatcttatacattcggtgccgatg

SEQ ID NO: 98943 - DNA, 25 bp, S. pombe
gtatggtttatgtgccttttcttcc

SEQ ID NO: 98944 - DNA, 25 bp, S. pombe
gtatggattttgacctttttcaccg

SEQ ID NO: 98945 - DNA, 25 bp, S. pombe
gtatcgttgatttcgcacgtgcacg

SEQ ID NO: 98946 - DNA, 25 bp, S. pombe
gtatcagattctgtgaacggcaaaa

SEQ ID NO: 98947 - DNA, 25 bp, S. pombe
gtatgctactcaagctgcaaccgaa

SEQ ID NO: 98948 - DNA, 25 bp, S. pombe
gtatcttcaacattcccgaggacta

SEQ ID NO: 98949 - DNA, 25 bp, S. pombe
gtatatttaacacctgagtcatcag

SEQ ID NO: 98950 - DNA, 25 bp, S. pombe
gtatcacactcactggattggtcca

SEQ ID NO: 98951 - DNA, 25 bp, S. pombe
gtatactccaatctctggtccagag

SEQ ID NO: 98952 - DNA, 25 bp, S. pombe
gtatctcccgtttgattctacacaa

SEQ ID NO: 98953 - DNA, 25 bp, S. pombe
gtagttaacttgactcgcaatcccg

SEQ ID NO: 98954 - DNA, 25 bp, S. pombe
gtgtttacgaaccttctagtcctat

SEQ ID NO: 98955 - DNA, 25 bp, S. pombe
gtatgggaccaaccttcggtggtat

SEQ ID NO: 98956 - DNA, 25 bp, S. pombe
gtatgattcaactgccgggtgttat

SEQ ID NO: 98957 - DNA, 25 bp, S. pombe
gtatgtcgcaactcgttggtatcga

SEQ ID NO: 98958 - DNA, 25 bp, S. pombe
gtatgcggcgattgtcagttgcagt

SEQ ID NO: 98959 - DNA, 25 bp, S. pombe
gtatgatgccgttgtccttggcaaa

SEQ ID NO: 98960 - DNA, 25 bp, S. pombe
gtataccacttgtctcttctcaata

SEQ ID NO: 98961 - DNA, 25 bp, S. pombe
gtatacacctcatcttcttctattt

SEQ ID NO: 98962 - DNA, 25 bp, S. pombe
gtatcctgctgaagtttttcctgca

SEQ ID NO: 98963 - DNA, 25 bp, S. pombe
gtatcagccgatgcgttttctctaa

SEQ ID NO: 98964 - DNA, 25 bp, S. pombe
gtatcggaaccttgttgcttcgcaa

SEQ ID NO: 98965 - DNA, 25 bp, S. pombe
gtatcgatgcctttacttcttcgaa

SEQ ID NO: 98966 - DNA, 25 bp, S. pombe
gtatctgcagtcacccgttatagaa

SEQ ID NO: 98967 - DNA, 25 bp, S. pombe
gtatcgcttctcatcctgaaactag

SEQ ID NO: 98968 - DNA, 25 bp, S. pombe
gtatactgcgttatggcttacctcc

SEQ ID NO: 98969 - DNA, 25 bp, S. pombe
gtatcttgtcagtcgttgccaacga

SEQ ID NO: 98970 - DNA, 25 bp, S. pombe
gtatccgtatgccagtgccactgaa

SEQ ID NO: 98971 - DNA, 25 bp, S. pombe
gtatacgatatccagctatcctgca

SEQ ID NO: 98972 - DNA, 25 bp, S. pombe
gtatacactagcttgcgtgacgcat

SEQ ID NO: 98973 - DNA, 25 bp, S. pombe
gtatacagcgactggattgatgctt

SEQ ID NO: 98974 - DNA, 25 bp, S. pombe
gtagtgaggatcttgcttgcttttt

SEQ ID NO: 98975 - DNA, 25 bp, S. pombe
gtcgtcaaatctgtactcggttcta

SEQ ID NO: 98976 - DNA, 25 bp, S. pombe
gtatctgccaccttgtgaagtattt

SEQ ID NO: 98977 - DNA, 25 bp, S. pombe
gtatccctccggtggtgattatatg

SEQ ID NO: 98978 - DNA, 25 bp, S. pombe
gtatcacctcctctttctataatga

SEQ ID NO: 98979 - DNA, 25 bp, S. pombe
gtatggccaaaaagcttcccaggaa

SEQ ID NO: 98980 - DNA, 25 bp, S. pombe
gtatggctcaatacggttacgaggt

SEQ ID NO: 98981 - DNA, 25 bp, S. pombe
gtatcactagtgacctttttgacgc

SEQ ID NO: 98982 - DNA, 25 bp, S. pombe
gtatcgacacccagttgtttcatgt

SEQ ID NO: 98983 - DNA, 25 bp, S. pombe
gtatcgacgcctctaaggttgtcat

SEQ ID NO: 98984 - DNA, 25 bp, S. pombe
gtatgggacactgctcttgaaaaag

SEQ ID NO: 98985 - DNA, 25 bp, S. pombe
gtatggagccttttattcgtgcact

SEQ ID NO: 98986 - DNA, 25 bp, S. pombe
gtatcacttcgacctatcctagtag

SEQ ID NO: 98987 - DNA, 25 bp, S. pombe
gtatcgattcgatcttcactactat

SEQ ID NO: 98988 - DNA, 25 bp, S. pombe
gtatgcatcaacgacgcacttcggg

SEQ ID NO: 98989 - DNA, 25 bp, S. pombe
gtatgcagctatcagagacttctcc

SEQ ID NO: 98990 - DNA, 25 bp, S. pombe
gtatacttgcgaaatgcttcttgaa

SEQ ID NO: 98991 - DNA, 25 bp, S. pombe
gtatcagccaggtcaattcgctatt

SEQ ID NO: 98992 - DNA, 25 bp, S. pombe
gtatgcgtatggtctgttcctattg

SEQ ID NO: 98993 - DNA, 25 bp, S. pombe
gtatctgctaggctttcacaatatg

SEQ ID NO: 98994 - DNA, 25 bp, S. pombe
gtactctttggttgcatcaaattcg

SEQ ID NO: 98995 - DNA, 25 bp, S. pombe
gtagttttggctgatcgacctctaa

SEQ ID NO: 98996 - DNA, 25 bp, S. pombe
gtagttgctggaataccgaccatta

SEQ ID NO: 98997 - DNA, 25 bp, S. pombe
gtagtgatgctgctaatcgagactt

SEQ ID NO: 98998 - DNA, 25 bp, S. pombe
gtatcattttgtcctccattgcaag

SEQ ID NO: 98999 - DNA, 25 bp, S. pombe
gtatactttgtttccagtgccggtc

SEQ ID NO: 99000 - DNA, 25 bp, S. pombe
gtatgctttattgaaatccacgctg

SEQ ID NO: 99001 - DNA, 25 bp, S. pombe
gtatcttctttccaagttccactgt

SEQ ID NO: 99002 - DNA, 25 bp, S. pombe
gtatcttcaacccatatgtaaccga

SEQ ID NO: 99003 - DNA, 25 bp, S. pombe
gtatgcttcaacacactctacagag

SEQ ID NO: 99004 - DNA, 25 bp, S. pombe
gtatctccagttcacaccaaagctg

SEQ ID NO: 99005 - DNA, 25 bp, S. pombe
gtagtccagtcgacgtccaaagtta

SEQ ID NO: 99006 - DNA, 25 bp, S. pombe
gtagatcatgcgtcaaaattccaag

SEQ ID NO: 99007 - DNA, 25 bp, S. pombe
gtatcagcaatttactcaccgttgg

SEQ ID NO: 99008 - DNA, 25 bp, S. pombe
gtatcacagacttaacagacgtttt

SEQ ID NO: 99009 - DNA, 25 bp, S. pombe
gtatctcgagaaactccacgcttga

SEQ ID NO: 99010 - DNA, 25 bp, S. pombe
gtcatgaatccgagatgcgcaagca

SEQ ID NO: 99011 - DNA, 25 bp, S. pombe
gtagcaacagctctggcagcagcag

SEQ ID NO: 99012 - DNA, 25 bp, S. pombe
gtatgccccttttcaaacgaaattg

SEQ ID NO: 99013 - DNA, 25 bp, S. pombe
gtatgcctccggttaaaccacattt

SEQ ID NO: 99014 - DNA, 25 bp, S. pombe
gtatgttccgtggtaacatccctta

SEQ ID NO: 99015 - DNA, 25 bp, S. pombe
gtatgtactcggttacttcttcgtc

SEQ ID NO: 99016 - DNA, 25 bp, S. pombe
gtatgaactttctttcttcttcgtc

SEQ ID NO: 99017 - DNA, 25 bp, S. pombe
gtatcaaccgtcttatttctcttgg

SEQ ID NO: 99018 - DNA, 25 bp, S. pombe
gtatccaagttatgatcttccagat

SEQ ID NO: 99019 - DNA, 25 bp, S. pombe
gtacgttcaattgcacagactgatt

SEQ ID NO: 99020 - DNA, 25 bp, S. pombe
gtagtttctccttacaagcgcgctt

SEQ ID NO: 99021 - DNA, 25 bp, S. pombe
gtagtttctgccaaaattcgccaag

SEQ ID NO: 99022 - DNA, 25 bp, S. pombe
gtaggaatttcttacacctctgcct

SEQ ID NO: 99023 - DNA, 25 bp, S. pombe
gtaggtattttacgagccctcggtg

SEQ ID NO: 99024 - DNA, 25 bp, S. pombe
gtatcttatgtcttagctggtggtc

SEQ ID NO: 99025 - DNA, 25 bp, S. pombe
gtatccgaagatttcagatccaaag

SEQ ID NO: 99026 - DNA, 25 bp, S. pombe
gtagggctcatacttgaacaggctt

SEQ ID NO: 99027 - DNA, 25 bp, S. pombe
gtatcgagtatctttcagacggatg

SEQ ID NO: 99028 - DNA, 25 bp, S. pombe
gtatctagctactttgccaatgggt

SEQ ID NO: 99029 - DNA, 25 bp, S. pombe
gtatctactagtcatcctgatgcgc

SEQ ID NO: 99030 - DNA, 25 bp, S. pombe
gtatcgacatcttggatcctgctct

SEQ ID NO: 99031 - DNA, 25 bp, S. pombe
gtatcagactgctggattcacgcaa

SEQ ID NO: 99032 - DNA, 25 bp, S. pombe
gtatcgtcgtagtcaatgctttagt

SEQ ID NO: 99033 - DNA, 25 bp, S. pombe
gtatcgctcttattgcagctcttta

SEQ ID NO: 99034 - DNA, 25 bp, S. pombe
gtatcgagtcaaagttggctcccaa

SEQ ID NO: 99035 - DNA, 25 bp, S. pombe
gtatgccattaaaatcgttcccact

SEQ ID NO: 99036 - DNA, 25 bp, S. pombe
gtatcatctttaattcgtcttcccc

SEQ ID NO: 99037 - DNA, 25 bp, S. pombe
gtatctttgttcatcgcttttcact

SEQ ID NO: 99038 - DNA, 25 bp, S. pombe
gtatcttttgtgctcagtttgtatt

SEQ ID NO: 99039 - DNA, 25 bp, S. pombe
gtagtccttctcctagacgtgatag

SEQ ID NO: 99040 - DNA, 25 bp, S. pombe
gtagaaccacccagtctgctataaa

SEQ ID NO: 99041 - DNA, 25 bp, S. pombe
gtatgctgtgaaaatttacaacgtt

SEQ ID NO: 99042 - DNA, 25 bp, S. pombe
gtatgttccctaccgttgatagcag

SEQ ID NO: 99043 - DNA, 25 bp, S. pombe
gtatcttcgcctcaagttcaatggt

SEQ ID NO: 99044 - DNA, 25 bp, S. pombe
gtatcctttggcgaagcttcatgaa

SEQ ID NO: 99045 - DNA, 25 bp, S. pombe
gtatccaatgctggctcaaattctg

SEQ ID NO: 99046 - DNA, 25 bp, S. pombe
gtatcttcgattcagtggcttggta

SEQ ID NO: 99047 - DNA, 25 bp, S. pombe
gtatgattcagttgtcgatcccgct

SEQ ID NO: 99048 - DNA, 25 bp, S. pombe
gtatgtctgcattacctatgcgtcc

SEQ ID NO: 99049 - DNA, 25 bp, S. pombe
gtatgattcatatcttcctgcttta

SEQ ID NO: 99050 - DNA, 25 bp, S. pombe
gtagatttaacaactccctcatcac

SEQ ID NO: 99051 - DNA, 25 bp, S. pombe
gtagttattacgctccagtcaaatg

SEQ ID NO: 99052 - DNA, 25 bp, S. pombe
gtaggttcagatgacacacccgaag

SEQ ID NO: 99053 - DNA, 25 bp, S. pombe
gtaggtgctaaagcgatccccttag

SEQ ID NO: 99054 - DNA, 25 bp, S. pombe
gtagtcttaaagaaggcccacctca

SEQ ID NO: 99055 - DNA, 25 bp, S. pombe
gtaggactcaaaaagcgtgatcgca

SEQ ID NO: 99056 - DNA, 25 bp, S. pombe
gtatgtcacccaatatcaaaactat

SEQ ID NO: 99057 - DNA, 25 bp, S. pombe
gtagcacactactcagacgaaattc

SEQ ID NO: 99058 - DNA, 25 bp, S. pombe
gtagacaattcttcaatcgagcaat

SEQ ID NO: 99059 - DNA, 25 bp, S. pombe
gtgcatgaagccttggtcacgaaga

SEQ ID NO: 99060 - DNA, 25 bp, S. pombe
gtatgattgctcttcgtcaaggtga

SEQ ID NO: 99061 - DNA, 25 bp, S. pombe
gtatggctgcctctgttacaaagta

SEQ ID NO: 99062 - DNA, 25 bp, S. pombe
gtatgcttcctagtcatctcaatgc

SEQ ID NO: 99063 - DNA, 25 bp, S. pombe
gtaggctggctgaaccgcacattac

SEQ ID NO: 99064 - DNA, 25 bp, S. pombe
gtacgtgctgctagagatcctattg

SEQ ID NO: 99065 - DNA, 25 bp, S. pombe
gtactagatacgatcctacgcttcc

SEQ ID NO: 99066 - DNA, 25 bp, S. pombe
gtagaatctgatctcgtcacaattg

SEQ ID NO: 99067 - DNA, 25 bp, S. pombe
gtagattctgtacccgccgatgaga

SEQ ID NO: 99068 - DNA, 25 bp, S. pombe
gtggacttgtccgtggccaaggaaa

SEQ ID NO: 99069 - DNA, 25 bp, S. pombe
gtagactctaccaatgggcacgaaa

SEQ ID NO: 99070 - DNA, 25 bp, S. pombe
gtatgtatcttggtttgtcggtcca

SEQ ID NO: 99071 - DNA, 25 bp, S. pombe
gtatgacatttaccttttgcgtaca

SEQ ID NO: 99072 - DNA, 25 bp, S. pombe
gtatgtacattaccctttcgtagga

SEQ ID NO: 99073 - DNA, 25 bp, S. pombe
gtatggaacagacctctctacgtag

SEQ ID NO: 99074 - DNA, 25 bp, S. pombe
gtatggcagaaatgctccttggcaa

SEQ ID NO: 99075 - DNA, 25 bp, S. pombe
gtatctccagtcctgattttgtgaa

SEQ ID NO: 99076 - DNA, 25 bp, S. pombe
gtatgctccacttttggcttatgat

SEQ ID NO: 99077 - DNA, 25 bp, S. pombe
gtatgttgagtgttccgctttgacc

SEQ ID NO: 99078 - DNA, 25 bp, S. pombe
gtatctctcgagtattcagtgtgct

SEQ ID NO: 99079 - DNA, 25 bp, S. pombe
gtatctctcaggtcatcacgattta

SEQ ID NO: 99080 - DNA, 25 bp, S. pombe
gtatccatacgctatccgatttcgt

SEQ ID NO: 99081 - DNA, 25 bp, S. pombe
gtacctaacccaattgctgaagctt

SEQ ID NO: 99082 - DNA, 25 bp, S. pombe
gtatcgactcgttgctctgtatggc

SEQ ID NO: 99083 - DNA, 25 bp, S. pombe
gtatcgacttgttgtatccagctca

SEQ ID NO: 99084 - DNA, 25 bp, S. pombe
gtatgcagtcgtcttattctcttca

SEQ ID NO: 99085 - DNA, 25 bp, S. pombe
gtatgcaggttagttcttccatcca

SEQ ID NO: 99086 - DNA, 25 bp, S. pombe
gtatcgcaatatctctttcactgta

SEQ ID NO: 99087 - DNA, 25 bp, S. pombe
gtatcgactattgcatctgttattc

SEQ ID NO: 99088 - DNA, 25 bp, S. pombe
gtatccctgttttggttatctgcac

SEQ ID NO: 99089 - DNA, 25 bp, S. pombe
gtatccgttctttggttatcgacga

SEQ ID NO: 99090 - DNA, 25 bp, S. pombe
gtatcggttttcgtggtaaagctga

SEQ ID NO: 99091 - DNA, 25 bp, S. pombe
gtagcatttggagcaccacttctgc

SEQ ID NO: 99092 - DNA, 25 bp, S. pombe
gtagtttccagtgctatcgttgata

SEQ ID NO: 99093 - DNA, 25 bp, S. pombe
gtagtttactgtcgctctggtagaa

SEQ ID NO: 99094 - DNA, 25 bp, S. pombe
gtagttatactacgctctccagaaa

SEQ ID NO: 99095 - DNA, 25 bp, S. pombe
gtaccaaagttgctacaagctcttt

SEQ ID NO: 99096 - DNA, 25 bp, S. pombe
gtatcgccagttagcttacacagtg

SEQ ID NO: 99097 - DNA, 25 bp, S. pombe
gtatccgctgatcaacataaccctg

SEQ ID NO: 99098 - DNA, 25 bp, S. pombe
gtagatcgtacaccacaacaacctg

SEQ ID NO: 99099 - DNA, 25 bp, S. pombe
gtagatcctgataaacccaacgagt

SEQ ID NO: 99100 - DNA, 25 bp, S. pombe
gtatcccattattccattgatcgcg

SEQ ID NO: 99101 - DNA, 25 bp, S. pombe
gtatcccttacttcactttgtgtta

SEQ ID NO: 99102 - DNA, 25 bp, S. pombe
gtacggttctaatgcctacagtcat

SEQ ID NO: 99103 - DNA, 25 bp, S. pombe
gtagcttttcattataccggagtca

SEQ ID NO: 99104 - DNA, 25 bp, S. pombe
gtatgtatttacgtttgcctgtcaa

SEQ ID NO: 99105 - DNA, 25 bp, S. pombe
gtatgtgtgtcaacacctacgggct

SEQ ID NO: 99106 - DNA, 25 bp, S. pombe
gtatgatgtatcagcgctctgccga

SEQ ID NO: 99107 - DNA, 25 bp, S. pombe
gtatgcaatatcatcctcttggaca

SEQ ID NO: 99108 - DNA, 25 bp, S. pombe
gtatccctgcttctttgtggattaa

SEQ ID NO: 99109 - DNA, 25 bp, S. pombe
gtacgatcaattccagaaggccaca

SEQ ID NO: 99110 - DNA, 25 bp, S. pombe
gtagtgcactaccatccggtggtaa

SEQ ID NO: 99111 - DNA, 25 bp, S. pombe
gtatggacgacttcctcagcgaaag

SEQ ID NO: 99112 - DNA, 25 bp, S. pombe
gtatggatcagcttactagcctgaa

SEQ ID NO: 99113 - DNA, 25 bp, S. pombe
gtatgcttctaatgctaccatggat

SEQ ID NO: 99114 - DNA, 25 bp, S. pombe
gtatcgcctattcctatgccagaga

SEQ ID NO: 99115 - DNA, 25 bp, S. pombe
gtatccccactcgagagcgcaaaga

SEQ ID NO: 99116 - DNA, 25 bp, S. pombe
gtaggcctcggtcagcgactaaacg

SEQ ID NO: 99117 - DNA, 25 bp, S. pombe
gtaggtctctgttttggtcatcaaa

SEQ ID NO: 99118 - DNA, 25 bp, S. pombe
gtatgcgcccttgttcgtaaaatga

SEQ ID NO: 99119 - DNA, 25 bp, S. pombe
gtatggcttctaaacactctaaaaa

SEQ ID NO: 99120 - DNA, 25 bp, S. pombe
gtatggctttcaccttcttgaaggt

SEQ ID NO: 99121 - DNA, 25 bp, S. pombe
gtatggtcatgtccttaattcaaga

SEQ ID NO: 99122 - DNA, 25 bp, S. pombe
gtacaatggaaccttgcagcaagcg

SEQ ID NO: 99123 - DNA, 25 bp, S. pombe
gtagctcaagatttcaagggattcg

SEQ ID NO: 99124 - DNA, 25 bp, S. pombe
gtatgccaggatcactaggttttgc

SEQ ID NO: 99125 - DNA, 25 bp, S. pombe
gtatgcgacatctcaaacgcgttcg

SEQ ID NO: 99126 - DNA, 25 bp, S. pombe
gtatgctactcctaacattcttcaa

SEQ ID NO: 99127 - DNA, 25 bp, S. pombe
gtatgtcactgcattactgatccca

SEQ ID NO: 99128 - DNA, 25 bp, S. pombe
gtatgcatacccttatctggtgcga

SEQ ID NO: 99129 - DNA, 25 bp, S. pombe
gtatgtatactcttttgttgcagaa

SEQ ID NO: 99130 - DNA, 25 bp, S. pombe
gtagtagactattattgcgcgcaaa

SEQ ID NO: 99131 - DNA, 25 bp, S. pombe
gtatggtcaaccctcttactaataa

SEQ ID NO: 99132 - DNA, 25 bp, S. pombe
gtagcgctcgacgaatcaccggatt

SEQ ID NO: 99133 - DNA, 25 bp, S. pombe
gtagattcgagagcatctgccggtc

SEQ ID NO: 99134 - DNA, 25 bp, S. pombe
gtatgtctgctgatggcttatcgtt

SEQ ID NO: 99135 - DNA, 25 bp, S. pombe
gtatgcggactatgccttcatgtta

SEQ ID NO: 99136 - DNA, 25 bp, S. pombe
gtatggatgtcactagcactttgtt

SEQ ID NO: 99137 - DNA, 25 bp, S. pombe
gtatggttgctcaagccttgtctat

SEQ ID NO: 99138 - DNA, 25 bp, S. pombe
gtatgtgtattcaaccaactgtatg

SEQ ID NO: 99139 - DNA, 25 bp, S. pombe
gtatgtgccatcaaatatcagtagc

SEQ ID NO: 99140 - DNA, 25 bp, S. pombe
gtagatgatactcgtaccactctcc

SEQ ID NO: 99141 - DNA, 25 bp, S. pombe
gtacgctcacttctattgatacgtc

SEQ ID NO: 99142 - DNA, 25 bp, S. pombe
gtatgcccaatgcttacttgactga

SEQ ID NO: 99143 - DNA, 25 bp, S. pombe
gggttagatattccagccgttgact

SEQ ID NO: 99144 - DNA, 25 bp, S. pombe
ggagcttcctttcgaacgttggtag

SEQ ID NO: 99145 - DNA, 25 bp, S. pombe
gtaggcatttccaacgttgaacgtt

SEQ ID NO: 99146 - DNA, 25 bp, S. pombe
gtagcatatcggattatttccccaa

SEQ ID NO: 99147 - DNA, 25 bp, S. pombe
gtatgcttcgtggtcttggacccaa

SEQ ID NO: 99148 - DNA, 25 bp, S. pombe
gtatgatcgtcattttgcacttcaa

SEQ ID NO: 99149 - DNA, 25 bp, S. pombe
gtagtcgttattgtcttcattgccc

SEQ ID NO: 99150 - DNA, 25 bp, S. pombe
gtagtccttttgctgtatttcgtca

SEQ ID NO: 99151 - DNA, 25 bp, S. pombe
gtagtttacaagacgctttagctaa

SEQ ID NO: 99152 - DNA, 25 bp, S. pombe
gtactattagctgccggttacgaaa

SEQ ID NO: 99153 - DNA, 25 bp, S. pombe
gtatgcaagttaccgtagcttcctc

SEQ ID NO: 99154 - DNA, 25 bp, S. pombe
gtatgaagattaacggctcccttgc

SEQ ID NO: 99155 - DNA, 25 bp, S. pombe
gtatgcctgaattcgctcttaactt

SEQ ID NO: 99156 - DNA, 25 bp, S. pombe
gtatgccgagtgtaggttcaaatct

SEQ ID NO: 99157 - DNA, 25 bp, S. pombe
gtatgcctgatgacacagttggaga

SEQ ID NO: 99158 - DNA, 25 bp, S. pombe
gtatgagcccagcatcggagatttc

SEQ ID NO: 99159 - DNA, 25 bp, S. pombe
gtatggtcaggcgagcattccctca

SEQ ID NO: 99160 - DNA, 25 bp, S. pombe
gtatggtgcagttcaatccgttcaa

SEQ ID NO: 99161 - DNA, 25 bp, S. pombe
gtaggctatttatttccacatttgg

SEQ ID NO: 99162 - DNA, 25 bp, S. pombe
gtatgggatccgtattcgcattgtt

SEQ ID NO: 99163 - DNA, 25 bp, S. pombe
gtagaggtcctgaaccaacaattgt

SEQ ID NO: 99164 - DNA, 25 bp, S. pombe
gtatgggtctcttacattccaggat

SEQ ID NO: 99165 - DNA, 25 bp, S. pombe
gtagacgtttcaatccatgtggtgg

SEQ ID NO: 99166 - DNA, 25 bp, S. pombe
gtagtcgtcgacatcgtgatctgga

SEQ ID NO: 99167 - DNA, 25 bp, S. pombe
gtagctcctcaaatacatgggcgga

SEQ ID NO: 99168 - DNA, 25 bp, S. pombe
gtagtcctatgaacttgcagccggt

SEQ ID NO: 99169 - DNA, 25 bp, S. pombe
gtaggctctgtaggaaactctgaat

SEQ ID NO: 99170 - DNA, 25 bp, S. pombe
gtatgcatgtccctcgtgtaaaaat

SEQ ID NO: 99171 - DNA, 25 bp, S. pombe
gtgagcttacgacagtacttgacca

SEQ ID NO: 99172 - DNA, 25 bp, S. pombe
gtagctctacgcagttaagtgacca

SEQ ID NO: 99173 - DNA, 25 bp, S. pombe
gtaggctaactgaattaattgacga

SEQ ID NO: 99174 - DNA, 25 bp, S. pombe
gtagtctgcctcatcctatatttag

SEQ ID NO: 99175 - DNA, 25 bp, S. pombe
gtaggtgtctcttccatagattcaa

SEQ ID NO: 99176 - DNA, 25 bp, S. pombe
gtatgtcgccttgctaagtcacaga

SEQ ID NO: 99177 - DNA, 25 bp, S. pombe
gtgttccctttcgacttacaagaga

SEQ ID NO: 99178 - DNA, 25 bp, S. pombe
gtatggcgaatgcaaacgtcaaatg

SEQ ID NO: 99179 - DNA, 25 bp, S. pombe
gtagttcacaatcatccagccagaa

SEQ ID NO: 99180 - DNA, 25 bp, S. pombe
gtatggtctaatgcagccgcgagat

SEQ ID NO: 99181 - DNA, 25 bp, S. pombe
gtagccttcactgcttggaaaacca

SEQ ID NO: 99182 - DNA, 25 bp, S. pombe
gtagccttcatcatttgggtaccta

SEQ ID NO: 99183 - DNA, 25 bp, S. pombe
gtctcaatactcgatttagcgggat

SEQ ID NO: 99184 - DNA, 25 bp, S. pombe
gtagttgctacgacagtttgcccaa

SEQ ID NO: 99185 - DNA, 25 bp, S. pombe
gtagttcacattgctgttgtaccga

SEQ ID NO: 99186 - DNA, 25 bp, S. pombe
gtaggagactttttgctgaacacga

SEQ ID NO: 99187 - DNA, 25 bp, S. pombe
gtagtttccaactttgtacacgata

SEQ ID NO: 99188 - DNA, 25 bp, S. pombe
gtaggattcgcatatttttgaggat

SEQ ID NO: 99189 - DNA, 25 bp, S. pombe
gtatgtcaatattgccgttcgtgga

SEQ ID NO: 99190 - DNA, 25 bp, S. pombe
gtatgttcaagatgctgtccgtaga

SEQ ID NO: 99191 - DNA, 25 bp, S. pombe
gtatgttcatagaagcggtcgtacc

SEQ ID NO: 99192 - DNA, 25 bp, S. pombe
gtatgaaaatcttgcttcctctccg

SEQ ID NO: 99193 - DNA, 25 bp, S. pombe
gtagaccagacggttacctcacaaa

SEQ ID NO: 99194 - DNA, 25 bp, S. pombe
taacggtaccgtcactgctgctaat

SEQ ID NO: 99195 - DNA, 25 bp, S. pombe
gtacgcgtccttctcgtaaagagat

SEQ ID NO: 99196 - DNA, 25 bp, S. pombe
gtaggccttctctgcatttaaatga

SEQ ID NO: 99197 - DNA, 25 bp, S. pombe
gtaagcttggcagatcgtgtgaata

SEQ ID NO: 99198 - DNA, 25 bp, S. pombe
gtaggagccggatttgtcatgacat

SEQ ID NO: 99199 - DNA, 25 bp, S. pombe
gtagggttctcatatgcacagacat

SEQ ID NO: 99200 - DNA, 25 bp, S. pombe
gtagtgaatcttcctctgcaagtga

SEQ ID NO: 99201 - DNA, 25 bp, S. pombe
gtagtcagtatggtcgtcttcgaat

SEQ ID NO: 99202 - DNA, 25 bp, S. pombe
gtagctcacaagaccgatgcattat

SEQ ID NO: 99203 - DNA, 25 bp, S. pombe
gtagcacccaagttacactggaatt

SEQ ID NO: 99204 - DNA, 25 bp, S. pombe
gtcaacccaattaactcggaatctg

SEQ ID NO: 99205 - DNA, 25 bp, S. pombe
gtagcctcctttaaccctgaagtgt

SEQ ID NO: 99206 - DNA, 25 bp, S. pombe
gtaggccgttgtgtgctttgcaata

SEQ ID NO: 99207 - DNA, 25 bp, S. pombe
gtaggctaccgcagatgtttcaaat

SEQ ID NO: 99208 - DNA, 25 bp, S. pombe
gtaggcgactctctattggtgacac

SEQ ID NO: 99209 - DNA, 25 bp, S. pombe
gtacgaacccttggactttcattat

SEQ ID NO: 99210 - DNA, 25 bp, S. pombe
gtactggatccagcggagccacgtt

SEQ ID NO: 99211 - DNA, 25 bp, S. pombe
gtgagctcataccacaggaactgat

SEQ ID NO: 99212 - DNA, 25 bp, S. pombe
gtagcatggcctttcaatattcgat

SEQ ID NO: 99213 - DNA, 25 bp, S. pombe
gtacgcctgctgttgcaaatggttc

SEQ ID NO: 99214 - DNA, 25 bp, S. pombe
gtacctacggagatcactacttttc

SEQ ID NO: 99215 - DNA, 25 bp, S. pombe
gtagacactagggtagactctttac

SEQ ID NO: 99216 - DNA, 25 bp, S. pombe
gtactgtcgtccaagctgaaaagct

SEQ ID NO: 99217 - DNA, 25 bp, S. pombe
gtagcttcatgctttgggaacaatg

SEQ ID NO: 99218 - DNA, 25 bp, S. pombe
gtagtgatgctggtgctcgacccga

SEQ ID NO: 99219 - DNA, 25 bp, S. pombe
gtagtccagcttatgacctcgacga

SEQ ID NO: 99220 - DNA, 25 bp, S. pombe
gtacccagctcttaaactctatgac

SEQ ID NO: 99221 - DNA, 25 bp, S. pombe
gtaggtgacctctctaatgcattgt

SEQ ID NO: 99222 - DNA, 25 bp, S. pombe
gtagctaccggtcctttgacaaaca

SEQ ID NO: 99223 - DNA, 25 bp, S. pombe
gtagtgacggtgttcttgctgccaa

SEQ ID NO: 99224 - DNA, 25 bp, S. pombe
gtagtatctggtggtcttgtcttag

SEQ ID NO: 99225 - DNA, 25 bp, S. pombe
gtagcatgacactcgattctttttg

SEQ ID NO: 99226 - DNA, 25 bp, S. pombe
gtaggccagttacttgcttttgatg

SEQ ID NO: 99227 - DNA, 25 bp, S. pombe
gtagccaatttcatcgcttacgagg

SEQ ID NO: 99228 - DNA, 25 bp, S. pombe
gtagtagactctaaccttgcatctg

SEQ ID NO: 99229 - DNA, 25 bp, S. pombe
gtaggagacttagcgcgtgcattaa

SEQ ID NO: 99230 - DNA, 25 bp, S. pombe
gtaggtggacttcccagatctgaac

SEQ ID NO: 99231 - DNA, 25 bp, S. pombe
gtacgaagttatgctaaccgctcaa

SEQ ID NO: 99232 - DNA, 25 bp, S. pombe
gtaatgaagccttaccttcacactc

SEQ ID NO: 99233 - DNA, 25 bp, S. pombe
gtacggcacctaacactcaaactaa

SEQ ID NO: 99234 - DNA, 25 bp, S. pombe
gtaggcaccactgctttactggtga

SEQ ID NO: 99235 - DNA, 25 bp, S. pombe
gtacgcaatcctggttccattgtag

SEQ ID NO: 99236 - DNA, 25 bp, S. pombe
gtacctcctgcaatgcttgttggga

SEQ ID NO: 99237 - DNA, 25 bp, S. pombe
gtacccctcgtgattttgagacgtt

SEQ ID NO: 99238 - DNA, 25 bp, S. pombe
gtaccggtcgacatctttggcgcgt

SEQ ID NO: 99239 - DNA, 25 bp, S. pombe
gtaccaacggttattcctggcatca

SEQ ID NO: 99240 - DNA, 25 bp, S. pombe
gtagccaatttgtatcaccctcaaa

SEQ ID NO: 99241 - DNA, 25 bp, S. pombe
gtaccaccgtactaaagatgctaaa

SEQ ID NO: 99242 - DNA, 25 bp, S. pombe
gtagacgtcggtttctttggagtgt

SEQ ID NO: 99243 - DNA, 25 bp, S. pombe
gtaacgcttgtggtttgtatgcccg

SEQ ID NO: 99244 - DNA, 25 bp, S. pombe
gtagtcgtgattctttttcctcgaa

SEQ ID NO: 99245 - DNA, 25 bp, S. pombe
gtagcatgcttgacagttcgtccac

SEQ ID NO: 99246 - DNA, 25 bp, S. pombe
gtagcagctcagtcttactcagtgg

SEQ ID NO: 99247 - DNA, 25 bp, S. pombe
gtagaaccgaatacaccttgcttaa

SEQ ID NO: 99248 - DNA, 25 bp, S. pombe
gtactagccgcacgtgagggtttaa

SEQ ID NO: 99249 - DNA, 25 bp, S. pombe
gtacacgaacgataggtatcgatct

SEQ ID NO: 99250 - DNA, 25 bp, S. pombe
gtaccgtccatgtaactaatccttg

SEQ ID NO: 99251 - DNA, 25 bp, S. pombe
gtaccaaccgtacgctatagtgctt

SEQ ID NO: 99252 - DNA, 25 bp, S. pombe
gtactctgcttcgatcgattattgt

SEQ ID NO: 99253 - DNA, 25 bp, S. pombe
gtagcatcgatatctcctggatttg

SEQ ID NO: 99254 - DNA, 25 bp, S. pombe
gtagcttttactgctggttctatcc

SEQ ID NO: 99255 - DNA, 25 bp, S. pombe
gtagattcttactctccaagcatta

SEQ ID NO: 99256 - DNA, 25 bp, S. pombe
gtagattttactctcaatgacacat

SEQ ID NO: 99257 - DNA, 25 bp, S. pombe
gtagatttattgacacacccctgga

SEQ ID NO: 99258 - DNA, 25 bp, S. pombe
gtagagcctttgaccaatttcacag

SEQ ID NO: 99259 - DNA, 25 bp, S. pombe
gtagcaactgctgtcgcaattcata

SEQ ID NO: 99260 - DNA, 25 bp, S. pombe
gtagacacctttgggttcatcagaa

SEQ ID NO: 99261 - DNA, 25 bp, S. pombe
gtagacccttcattgtttacgattg

SEQ ID NO: 99262 - DNA, 25 bp, S. pombe
gtagttgccgtatgattgcttccaa

SEQ ID NO: 99263 - DNA, 25 bp, S. pombe
gtagcattccggcaattgtttcaga

SEQ ID NO: 99264 - DNA, 25 bp, S. pombe
gtagctttggctcaactaatttata

SEQ ID NO: 99265 - DNA, 25 bp, S. pombe
gtagaattggctcatatcgatatta

SEQ ID NO: 99266 - DNA, 25 bp, S. pombe
gtagatgccgccaagctgttgagaa

SEQ ID NO: 99267 - DNA, 25 bp, S. pombe
gtactgtactgaaagccaacatttt

SEQ ID NO: 99268 - DNA, 25 bp, S. pombe
tgtatggtttccctttacgctggac

SEQ ID NO: 99269 - DNA, 25 bp, S. pombe
gtagatgccatttgactcttaagtt

SEQ ID NO: 99270 - DNA, 25 bp, S. pombe
gtagctttatccatcttgcgtgatc

SEQ ID NO: 99271 - DNA, 25 bp, S. pombe
gtagtcactgactgttctgaaattg

SEQ ID NO: 99272 - DNA, 25 bp, S. pombe
gtagtgccagcatgtttcgtaatag

SEQ ID NO: 99273 - DNA, 25 bp, S. pombe
gtagtggaaatgctgctgcttcgtc

SEQ ID NO: 99274 - DNA, 25 bp, S. pombe
gtagctcatgtcaatcgtgtgttcg

SEQ ID NO: 99275 - DNA, 25 bp, S. pombe
gtagctcgccaaaatctgatgtcgt

SEQ ID NO: 99276 - DNA, 25 bp, S. pombe
gtagcctcataatcattggttcaga

SEQ ID NO: 99277 - DNA, 25 bp, S. pombe
gtagtttaaatcctgctgttgcacc

SEQ ID NO: 99278 - DNA, 25 bp, S. pombe
gtagtatcgagcgatccctttgcat

SEQ ID NO: 99279 - DNA, 25 bp, S. pombe
gtagtaccactacgcttgatgagga

SEQ ID NO: 99280 - DNA, 25 bp, S. pombe
gtagtgcccaccttgattctaatga

SEQ ID NO: 99281 - DNA, 25 bp, S. pombe
gtacctattgcctttgtcgacagat

SEQ ID NO: 99282 - DNA, 25 bp, S. pombe
gtacgccagctccatttgagtacga

SEQ ID NO: 99283 - DNA, 25 bp, S. pombe
gtacccacgcgagtgagtctcaagt

SEQ ID NO: 99284 - DNA, 25 bp, S. pombe
gtactctaccaagggcgttctaaag

SEQ ID NO: 99285 - DNA, 25 bp, S. pombe
gtcagccaagagagaaccttccggt

SEQ ID NO: 99286 - DNA, 25 bp, S. pombe
gtaccaataacgtcttccaccagtt

SEQ ID NO: 99287 - DNA, 25 bp, S. pombe
gtactgactctacctttcctaccgg

SEQ ID NO: 99288 - DNA, 25 bp, S. pombe
gtagcaactccaccattgtatcgaa

SEQ ID NO: 99289 - DNA, 25 bp, S. pombe
gtacgtgatcaagctttttatggat

SEQ ID NO: 99290 - DNA, 25 bp, S. pombe
gtagcggtcattgtcctttggatga

SEQ ID NO: 99291 - DNA, 25 bp, S. pombe
gtacgattggacgactactcaggtc

SEQ ID NO: 99292 - DNA, 25 bp, S. pombe
gtaccggtcttggtcaatttgcttt

SEQ ID NO: 99293 - DNA, 25 bp, S. pombe
gtacggctcgatttatcaaacacgc

SEQ ID NO: 99294 - DNA, 25 bp, S. pombe
gtactcggcgatttaccagacggat

SEQ ID NO: 99295 - DNA, 25 bp, S. pombe
gtactcggaagattgaccccttttg

SEQ ID NO: 99296 - DNA, 25 bp, S. pombe
gtacccctagatcaaactcgacaat

SEQ ID NO: 99297 - DNA, 25 bp, S. pombe
gtacgatcgtgaaagtgcctcttcc

SEQ ID NO: 99298 - DNA, 25 bp, S. pombe
gtacgaagatatgtctccctctact

SEQ ID NO: 99299 - DNA, 25 bp, S. pombe
gtaccgattatcaccttcttacata

SEQ ID NO: 99300 - DNA, 25 bp, S. pombe
gtagctggtccaattgttggtcgaa

SEQ ID NO: 99301 - DNA, 25 bp, S. pombe
gtagtagctgccgtgtgccatggtc

SEQ ID NO: 99302 - DNA, 25 bp, S. pombe
gtagaccggtgatttcagccagcat

SEQ ID NO: 99303 - DNA, 25 bp, S. pombe
gtagctccggtactatcgacaataa

SEQ ID NO: 99304 - DNA, 25 bp, S. pombe
gtagctcaggcactttgacgaagat

SEQ ID NO: 99305 - DNA, 25 bp, S. pombe
gtaccaggagattgttcgaccctct

SEQ ID NO: 99306 - DNA, 25 bp, S. pombe
gggactgttaacgaggctagactta

SEQ ID NO: 99307 - DNA, 25 bp, S. pombe
gtagattttatacagcccgagctaa

SEQ ID NO: 99308 - DNA, 25 bp, S. pombe
gtagaaagtattcctgccggagcat

SEQ ID NO: 99309 - DNA, 25 bp, S. pombe
gtacgcgtgagttgatccctgaatt

SEQ ID NO: 99310 - DNA, 25 bp, S. pombe
gtacgcgagcagcaatactgctatt

SEQ ID NO: 99311 - DNA, 25 bp, S. pombe
gtacgagagcacgacaagcgatcat

SEQ ID NO: 99312 - DNA, 25 bp, S. pombe
gtaccagctcgtaaattgtcacaat

SEQ ID NO: 99313 - DNA, 25 bp, S. pombe
gtagccctttaagtagtcgcacaag

SEQ ID NO: 99314 - DNA, 25 bp, S. pombe
gtaccacttctcacagtttgaccaa

SEQ ID NO: 99315 - DNA, 25 bp, S. pombe
gtacgtctattccattattgagcaa

SEQ ID NO: 99316 - DNA, 25 bp, S. pombe
gtacgcgcggtagctttttgaagtt

SEQ ID NO: 99317 - DNA, 25 bp, S. pombe
gtaatccgaaggcatctaacgacga

SEQ ID NO: 99318 - DNA, 25 bp, S. pombe
gtacctgctgagtggactaccgtaa

SEQ ID NO: 99319 - DNA, 25 bp, S. pombe
gtaccggaaatcttggtgccgtaat

SEQ ID NO: 99320 - DNA, 25 bp, S. pombe
gtaagggtacctatcatattcgtag

SEQ ID NO: 99321 - DNA, 25 bp, S. pombe
gtagcagtggttctcgtatcatttg

SEQ ID NO: 99322 - DNA, 25 bp, S. pombe
gtagcaccgtacatggctgagcatt

SEQ ID NO: 99323 - DNA, 25 bp, S. pombe
gtagcgaatctcaatctgtggtcat

SEQ ID NO: 99324 - DNA, 25 bp, S. pombe
gtagacttctattgtttgctcatca

SEQ ID NO: 99325 - DNA, 25 bp, S. pombe
gtaccttacattccagatgctgcat

SEQ ID NO: 99326 - DNA, 25 bp, S. pombe
gtacggataccattccaatgccatt

SEQ ID NO: 99327 - DNA, 25 bp, S. pombe
gtacgagcataggagtcatattcaa

SEQ ID NO: 99328 - DNA, 25 bp, S. pombe
gtactgtacagcgtcactacatgca

SEQ ID NO: 99329 - DNA, 25 bp, S. pombe
gtaccgcaagcttttcgacgaaatc

SEQ ID NO: 99330 - DNA, 25 bp, S. pombe
gtactggcaagtctccgattatggt

SEQ ID NO: 99331 - DNA, 25 bp, S. pombe
gtactcagccaagcacactcagaaa

SEQ ID NO: 99332 - DNA, 25 bp, S. pombe
gtaccagattctatggctcttcacg

SEQ ID NO: 99333 - DNA, 25 bp, S. pombe
gtacgatattcgctcttattcacgc

SEQ ID NO: 99334 - DNA, 25 bp, S. pombe
gtacattttcagagtttccaggcca

SEQ ID NO: 99335 - DNA, 25 bp, S. pombe
gtactttgccgtttattctaagcta

SEQ ID NO: 99336 - DNA, 25 bp, S. pombe
gtacttgtcgcgttcggacgaaatt

SEQ ID NO: 99337 - DNA, 25 bp, S. pombe
gtactcgtcgcgtgcttaattagtg

SEQ ID NO: 99338 - DNA, 25 bp, S. pombe
gtactcgttcatttcgtaaaggtga

SEQ ID NO: 99339 - DNA, 25 bp, S. pombe
ttactttactttggaacatttggtg

SEQ ID NO: 99340 - DNA, 25 bp, S. pombe
gtagctttctatatcgtcctttggg

SEQ ID NO: 99341 - DNA, 25 bp, S. pombe
gtacttattctttcgtcactttcta

SEQ ID NO: 99342 - DNA, 25 bp, S. pombe
gtagctcttttcttctttcttttat

SEQ ID NO: 99343 - DNA, 25 bp, S. pombe
gtaccatttcttcttttctatctaa

SEQ ID NO: 99344 - DNA, 25 bp, S. pombe
gtaccgtttatgtttattccagcaa

SEQ ID NO: 99345 - DNA, 25 bp, S. pombe
gtacgcgtgtttttgagcttactca

SEQ ID NO: 99346 - DNA, 25 bp, S. pombe
gtactctattagtaagtccttcgga

SEQ ID NO: 99347 - DNA, 25 bp, S. pombe
gtactcttggaatggttgatctcgt

SEQ ID NO: 99348 - DNA, 25 bp, S. pombe
gtacggtattcctgatattcggctt

SEQ ID NO: 99349 - DNA, 25 bp, S. pombe
gtaccagtgttcgtcatggtgctaa

SEQ ID NO: 99350 - DNA, 25 bp, S. pombe
gtactggctggctatatcatggcat

SEQ ID NO: 99351 - DNA, 25 bp, S. pombe
gtactgcgcatgtagatcctgaatc

SEQ ID NO: 99352 - DNA, 25 bp, S. pombe
gtactgaatgggtttcggcgattac

SEQ ID NO: 99353 - DNA, 25 bp, S. pombe
gtacgtcgtatgattcctctagttc

SEQ ID NO: 99354 - DNA, 25 bp, S. pombe
gtagccacttagatgacgctcttct

SEQ ID NO: 99355 - DNA, 25 bp, S. pombe
gtagccgtgctaaagtcatgctttt

SEQ ID NO: 99356 - DNA, 25 bp, S. pombe
gtcagcgggccagaaatctttgttt

SEQ ID NO: 99357 - DNA, 25 bp, S. pombe
gtagcctccaaccaacagattttta

SEQ ID NO: 99358 - DNA, 25 bp, S. pombe
gtactattcttacaatgccattttt

SEQ ID NO: 99359 - DNA, 25 bp, S. pombe
gtaccattctccattcacgagttta

SEQ ID NO: 99360 - DNA, 25 bp, S. pombe
ttaccttcgaccgaaccagttgaag

SEQ ID NO: 99361 - DNA, 25 bp, S. pombe
gtactcataatgacacatgcctcgg

SEQ ID NO: 99362 - DNA, 25 bp, S. pombe
gtaccaaatgcttcgctcaaaggat

SEQ ID NO: 99363 - DNA, 25 bp, S. pombe
gtagcgtctatctctctcaaaaatg

SEQ ID NO: 99364 - DNA, 25 bp, S. pombe
gtagcatttcatcttccattttgac

SEQ ID NO: 99365 - DNA, 25 bp, S. pombe
gtagcatttcgttccgttttgcaac

SEQ ID NO: 99366 - DNA, 25 bp, S. pombe
gtactttcgtttattgctggcagcc

SEQ ID NO: 99367 - DNA, 25 bp, S. pombe
gtactcctgatggtagggtcgttaa

SEQ ID NO: 99368 - DNA, 25 bp, S. pombe
gtacctcggtggactggttgttcaa

SEQ ID NO: 99369 - DNA, 25 bp, S. pombe
gtagcgttgttcgttacgtccatat

SEQ ID NO: 99370 - DNA, 25 bp, S. pombe
gtactgttggtggataccttccgca

SEQ ID NO: 99371 - DNA, 25 bp, S. pombe
gtactactaccactccttttaatat

SEQ ID NO: 99372 - DNA, 25 bp, S. pombe
gtactcctctttccctttaatgatt

SEQ ID NO: 99373 - DNA, 25 bp, S. pombe
gtactctatctttacactcggacga

SEQ ID NO: 99374 - DNA, 25 bp, S. pombe
gtgataccggtgttcccttgcaagg

SEQ ID NO: 99375 - DNA, 25 bp, S. pombe
gtagcagcagcagaaaacccacata

SEQ ID NO: 99376 - DNA, 25 bp, S. pombe
gtagcaagtctccaaatgatccgat

SEQ ID NO: 99377 - DNA, 25 bp, S. pombe
gtacatgtctcagcaaatatccgat

SEQ ID NO: 99378 - DNA, 25 bp, S. pombe
gtagcattcgccaaagcttagctga

SEQ ID NO: 99379 - DNA, 25 bp, S. pombe
gtacccctaatcacaccaatataaa

SEQ ID NO: 99380 - DNA, 25 bp, S. pombe
gtaccagtagagactgccccatatt

SEQ ID NO: 99381 - DNA, 25 bp, S. pombe
gtagcggatcagcttgccgtattat

SEQ ID NO: 99382 - DNA, 25 bp, S. pombe
gtagcggatcacctactcatgatat

SEQ ID NO: 99383 - DNA, 25 bp, S. pombe
gtagctcttcattatcttcatggcg

SEQ ID NO: 99384 - DNA, 25 bp, S. pombe
gtagcttggcaattattcttgggtt

SEQ ID NO: 99385 - DNA, 25 bp, S. pombe
gtagcggaaatgacgtctcaaccaa

SEQ ID NO: 99386 - DNA, 25 bp, S. pombe
gtcagcgacgaaaacctaactcaga

SEQ ID NO: 99387 - DNA, 25 bp, S. pombe
gtaccgattcccattttgtgctgaa

SEQ ID NO: 99388 - DNA, 25 bp, S. pombe
gtaccgtcactccttgtttattaat

SEQ ID NO: 99389 - DNA, 25 bp, S. pombe
gtacctcatccaagcaatcggtttg

SEQ ID NO: 99390 - DNA, 25 bp, S. pombe
gtagctcaaactatcatcgcgtctc

SEQ ID NO: 99391 - DNA, 25 bp, S. pombe
gtagcaccagaggtttaccagattg

SEQ ID NO: 99392 - DNA, 25 bp, S. pombe
gtacccgttgttcataccacaattg

SEQ ID NO: 99393 - DNA, 25 bp, S. pombe
gtacgcgagttgttaatggccaaat

SEQ ID NO: 99394 - DNA, 25 bp, S. pombe
gtacgccgtgtgttaatgtctgctc

SEQ ID NO: 99395 - DNA, 25 bp, S. pombe
gtaccgcttgtcgattatatctctc

SEQ ID NO: 99396 - DNA, 25 bp, S. pombe
gtactgcatggagatttactcatta

SEQ ID NO: 99397 - DNA, 25 bp, S. pombe
gtagctgcacgacatctttggcaat

SEQ ID NO: 99398 - DNA, 25 bp, S. pombe
gtagctcctgaaaatgttccagcgg

SEQ ID NO: 99399 - DNA, 25 bp, S. pombe
gtacctatgtcatgatttcagcgct

SEQ ID NO: 99400 - DNA, 25 bp, S. pombe
gtagctaggagctctgtctataagg

SEQ ID NO: 99401 - DNA, 25 bp, S. pombe
gtagctacctgcttctttatagaca

SEQ ID NO: 99402 - DNA, 25 bp, S. pombe
gtagctacctctctcaattatcaat

SEQ ID NO: 99403 - DNA, 25 bp, S. pombe
gtactaacttcacttgcatcgtcaa

SEQ ID NO: 99404 - DNA, 25 bp, S. pombe
gtaccattgctgatgacattgctga

SEQ ID NO: 99405 - DNA, 25 bp, S. pombe
gtaaacggtgaatctttggttcagg

SEQ ID NO: 99406 - DNA, 25 bp, S. pombe
gtaaaatggctttttttggctgtgt

SEQ ID NO: 99407 - DNA, 25 bp, S. pombe
gtaaatcgcgttgtttggccatgca

SEQ ID NO: 99408 - DNA, 25 bp, S. pombe
gtacacaatgcgatcgtttggccga

SEQ ID NO: 99409 - DNA, 25 bp, S. pombe
gtacgctatgcttccgaccaaaaga

SEQ ID NO: 99410 - DNA, 25 bp, S. pombe
gtacccgtcgtcaagcaaaagcaga

SEQ ID NO: 99411 - DNA, 25 bp, S. pombe
gtactacccattttgacacgttgaa

SEQ ID NO: 99412 - DNA, 25 bp, S. pombe
gtactttccaaatataacgttcacg

SEQ ID NO: 99413 - DNA, 25 bp, S. pombe
gtactttctggaggttcaacgttat

SEQ ID NO: 99414 - DNA, 25 bp, S. pombe
gtaccttctgaagtttcttatgatg

SEQ ID NO: 99415 - DNA, 25 bp, S. pombe
gtaatcgactgcaagcttcttcaac

SEQ ID NO: 99416 - DNA, 25 bp, S. pombe
gtactcgatcgctgcattgttgcaa

SEQ ID NO: 99417 - DNA, 25 bp, S. pombe
gtactggtctatcgcttattggaat

SEQ ID NO: 99418 - DNA, 25 bp, S. pombe
gtacggtttcgcttatcggaatgca

SEQ ID NO: 99419 - DNA, 25 bp, S. pombe
gtacgatccgctgcagttttaatga

SEQ ID NO: 99420 - DNA, 25 bp, S. pombe
gtacgatccttccattggtatttat

SEQ ID NO: 99421 - DNA, 25 bp, S. pombe
gtacttttccgatggttctgtatca

SEQ ID NO: 99422 - DNA, 25 bp, S. pombe
gtacgtttagctgttgcttctcaaa

SEQ ID NO: 99423 - DNA, 25 bp, S. pombe
gtacttcgtagttttgctctctatt

SEQ ID NO: 99424 - DNA, 25 bp, S. pombe
gtactctttcagtagaagcttctgt

SEQ ID NO: 99425 - DNA, 25 bp, S. pombe
gtactttttatggtagcggctgcta

SEQ ID NO: 99426 - DNA, 25 bp, S. pombe
gtactagttgttcctacttctgata

SEQ ID NO: 99427 - DNA, 25 bp, S. pombe
gtagccatcttagccattgttccta

SEQ ID NO: 99428 - DNA, 25 bp, S. pombe
gtctttgatttatctcgtcgtcgag

SEQ ID NO: 99429 - DNA, 25 bp, S. pombe
gtactttggttacataccgccagca

SEQ ID NO: 99430 - DNA, 25 bp, S. pombe
gtacttgcgtttttcgagttcaaag

SEQ ID NO: 99431 - DNA, 25 bp, S. pombe
gtacttttgtacttgactctctttg

SEQ ID NO: 99432 - DNA, 25 bp, S. pombe
gtaccctagtgataacggctttcct

SEQ ID NO: 99433 - DNA, 25 bp, S. pombe
gtacgtcggttaatacgcgctattc

SEQ ID NO: 99434 - DNA, 25 bp, S. pombe
gtacaaagttcacagacccgagtgt

SEQ ID NO: 99435 - DNA, 25 bp, S. pombe
gtacttactggttcgtggcatccaa

SEQ ID NO: 99436 - DNA, 25 bp, S. pombe
gtacttgcggcccagataatttgat

SEQ ID NO: 99437 - DNA, 25 bp, S. pombe
gtacccttcctttctgtcgtagata

SEQ ID NO: 99438 - DNA, 25 bp, S. pombe
gtacgatgacccttccgataataca

SEQ ID NO: 99439 - DNA, 25 bp, S. pombe
gtaccattactattccagccaagat

SEQ ID NO: 99440 - DNA, 25 bp, S. pombe
gtaaatatactcgagacgcccaagg

SEQ ID NO: 99441 - DNA, 25 bp, S. pombe
gtaaaattactgtcacacctcaaag

SEQ ID NO: 99442 - DNA, 25 bp, S. pombe
gtaacgaaattcctcctgaaccaga

SEQ ID NO: 99443 - DNA, 25 bp, S. pombe
gtaatccacaaatgtcttccacctt

SEQ ID NO: 99444 - DNA, 25 bp, S. pombe
gtaactctagtgacagcggaaacgt

SEQ ID NO: 99445 - DNA, 25 bp, S. pombe
gtaccccatatttgaaggaattcct

SEQ ID NO: 99446 - DNA, 25 bp, S. pombe
gtaccaacgtcctcaattgtttcta

SEQ ID NO: 99447 - DNA, 25 bp, S. pombe
gtaaaagcgtgtcttactgagatct

SEQ ID NO: 99448 - DNA, 25 bp, S. pombe
gtaccaagccctatttcagagtgat

SEQ ID NO: 99449 - DNA, 25 bp, S. pombe
gtacccgctacacttttcagcgtgg

SEQ ID NO: 99450 - DNA, 25 bp, S. pombe
gtaccggcttctgatttgcaggcat

SEQ ID NO: 99451 - DNA, 25 bp, S. pombe
gtaacttcacagagctttatccttt

SEQ ID NO: 99452 - DNA, 25 bp, S. pombe
gtacgactcctgatgttttctttgc

SEQ ID NO: 99453 - DNA, 25 bp, S. pombe
gtacgaccttcaatttcgtgctgtg

SEQ ID NO: 99454 - DNA, 25 bp, S. pombe
gtaaatcacgaacgaccagcttcac

SEQ ID NO: 99455 - DNA, 25 bp, S. pombe
gtaccttggagattatcccagcgaa

SEQ ID NO: 99456 - DNA, 25 bp, S. pombe
gtaccattggcgattccgagaaaat

SEQ ID NO: 99457 - DNA, 25 bp, S. pombe
gtaccatgggtaattctgcaaacac

SEQ ID NO: 99458 - DNA, 25 bp, S. pombe
gtaccattgtcattcatgccggtga

SEQ ID NO: 99459 - DNA, 25 bp, S. pombe
gtaacaattcatcagcgggtgtctc

SEQ ID NO: 99460 - DNA, 25 bp, S. pombe
gtactgcatccaaaagactttccgt

SEQ ID NO: 99461 - DNA, 25 bp, S. pombe
gtactatgcgcttcaagtctcttgc

SEQ ID NO: 99462 - DNA, 25 bp, S. pombe
gtacctcacatattagcgccattgg

SEQ ID NO: 99463 - DNA, 25 bp, S. pombe
gtacctaatatcaacgctcatctct

SEQ ID NO: 99464 - DNA, 25 bp, S. pombe
gtaccttctgacaaatctgctttct

SEQ ID NO: 99465 - DNA, 25 bp, S. pombe
gtacactccgcacaattacttcaag

SEQ ID NO: 99466 - DNA, 25 bp, S. pombe
gtacttccgctgtagttgactcata

SEQ ID NO: 99467 - DNA, 25 bp, S. pombe
gtactgcaacaatcgtgcttcgagg

SEQ ID NO: 99468 - DNA, 25 bp, S. pombe
gtaccatctattccagctgttccag

SEQ ID NO: 99469 - DNA, 25 bp, S. pombe
gtaacattcgctcggaaggcctcgt

SEQ ID NO: 99470 - DNA, 25 bp, S. pombe
gtaaacgccgtcaagctttaagaga

SEQ ID NO: 99471 - DNA, 25 bp, S. pombe
gtaaacgccgaaggactcaacgaga

SEQ ID NO: 99472 - DNA, 25 bp, S. pombe
gtcaaaccggcatcgttacaaagtg

SEQ ID NO: 99473 - DNA, 25 bp, S. pombe
gtaaatgcaaccacttttcgaatga

SEQ ID NO: 99474 - DNA, 25 bp, S. pombe
gtacataccacctacattgtttatt

SEQ ID NO: 99475 - DNA, 25 bp, S. pombe
gtaccattgctcgtcctcatggaaa

SEQ ID NO: 99476 - DNA, 25 bp, S. pombe
gtaaacgtcgttcctggacatgcaa

SEQ ID NO: 99477 - DNA, 25 bp, S. pombe
gtactactgagcttgtatcaaagac

SEQ ID NO: 99478 - DNA, 25 bp, S. pombe
gtacggaatgtcctgcacctaaatt

SEQ ID NO: 99479 - DNA, 25 bp, S. pombe
gtaccttttatcttgcctcgagaaa

SEQ ID NO: 99480 - DNA, 25 bp, S. pombe
gtacctttggtaacttcgctgacat

SEQ ID NO: 99481 - DNA, 25 bp, S. pombe
gtaccgcatcttttggatcctgata

SEQ ID NO: 99482 - DNA, 25 bp, S. pombe
gtacggcttctgtatatgatcctac

SEQ ID NO: 99483 - DNA, 25 bp, S. pombe
gtacccaactgatcgtgcaaaccgt

SEQ ID NO: 99484 - DNA, 25 bp, S. pombe
gtgacccaattaactacgttccgat

SEQ ID NO: 99485 - DNA, 25 bp, S. pombe
gtacggaggctcaactagcttttcg

SEQ ID NO: 99486 - DNA, 25 bp, S. pombe
gtactgaagccggtatgtttgcatt

SEQ ID NO: 99487 - DNA, 25 bp, S. pombe
gtactttccatgttctatttgctat

SEQ ID NO: 99488 - DNA, 25 bp, S. pombe
gtaccgtttgatatgattgctgcta

SEQ ID NO: 99489 - DNA, 25 bp, S. pombe
gtactcgtcattatcgtgctccaga

SEQ ID NO: 99490 - DNA, 25 bp, S. pombe
gtacgacctcatattttcaacaaag

SEQ ID NO: 99491 - DNA, 25 bp, S. pombe
gtaccgccctttagtatcacagata

SEQ ID NO: 99492 - DNA, 25 bp, S. pombe
gtacgatatcatacttttaaagatt

SEQ ID NO: 99493 - DNA, 25 bp, S. pombe
gtacgacgctagctcttcaaagaag

SEQ ID NO: 99494 - DNA, 25 bp, S. pombe
gtactgctattagggacattgccat

SEQ ID NO: 99495 - DNA, 25 bp, S. pombe
gtacgacagctctatcaactatctt

SEQ ID NO: 99496 - DNA, 25 bp, S. pombe
gtactgactccaccaacaaatgatg

SEQ ID NO: 99497 - DNA, 25 bp, S. pombe
gtacgcccaagttactaagatgctt

SEQ ID NO: 99498 - DNA, 25 bp, S. pombe
gtaccccattggtttactggcatta

SEQ ID NO: 99499 - DNA, 25 bp, S. pombe
gtactaccatatctctttgctgcga

SEQ ID NO: 99500 - DNA, 25 bp, S. pombe
gtacggtttgaacatctctcgtcaa

SEQ ID NO: 99501 - DNA, 25 bp, S. pombe
gtactgtgactgtaaccacttctga

SEQ ID NO: 99502 - DNA, 25 bp, S. pombe
gtacttacttcatcacttcttgcaa

SEQ ID NO: 99503 - DNA, 25 bp, S. pombe
gtacgtttctattacattcgctcaa

SEQ ID NO: 99504 - DNA, 25 bp, S. pombe
gtaaggagaccgctgttcctctatc

SEQ ID NO: 99505 - DNA, 25 bp, S. pombe
gtaacggaacacttttgacatgttt

SEQ ID NO: 99506 - DNA, 25 bp, S. pombe
gtgacgggagcagtggaaccaccat

SEQ ID NO: 99507 - DNA, 25 bp, S. pombe
gtacgtaacagttgagccctcacat

SEQ ID NO: 99508 - DNA, 25 bp, S. pombe
gtactcaacttgtcgataaccctga

SEQ ID NO: 99509 - DNA, 25 bp, S. pombe
gtaatggagttctcagatgcccctg

SEQ ID NO: 99510 - DNA, 25 bp, S. pombe
gtaacgcagaacttggactcccaaa

SEQ ID NO: 99511 - DNA, 25 bp, S. pombe
gtactcaagggcatgttgaatccga

SEQ ID NO: 99512 - DNA, 25 bp, S. pombe
gtacccactgtgaatgatcttttgc

SEQ ID NO: 99513 - DNA, 25 bp, S. pombe
gtacacacggccttcaagagtatgt

SEQ ID NO: 99514 - DNA, 25 bp, S. pombe
gtacgacgtgtcaatacatgcttta

SEQ ID NO: 99515 - DNA, 25 bp, S. pombe
gtactcaagaggatgcgcaacacta

SEQ ID NO: 99516 - DNA, 25 bp, S. pombe
gtacacgattacacctggactctta

SEQ ID NO: 99517 - DNA, 25 bp, S. pombe
gtaaggcatttcgaccggcaacaaa

SEQ ID NO: 99518 - DNA, 25 bp, S. pombe
gtaacgctggtcgtctactatttta

SEQ ID NO: 99519 - DNA, 25 bp, S. pombe
gtaagcgatcgtcatcttctacttc

SEQ ID NO: 99520 - DNA, 25 bp, S. pombe
gtacgcagccccaaagataatcaag

SEQ ID NO: 99521 - DNA, 25 bp, S. pombe
gtacaagtgactccacgtgagccta

SEQ ID NO: 99522 - DNA, 25 bp, S. pombe
gtacagtctctgtcaccggaggcaa

SEQ ID NO: 99523 - DNA, 25 bp, S. pombe
gtactgctgatgattcgacggataa

SEQ ID NO: 99524 - DNA, 25 bp, S. pombe
gtacattggctttggatcgtgctaa

SEQ ID NO: 99525 - DNA, 25 bp, S. pombe
gtaaggaggatgctctttcccacgt

SEQ ID NO: 99526 - DNA, 25 bp, S. pombe
tgttacggtgatctttttcgacgaa

SEQ ID NO: 99527 - DNA, 25 bp, S. pombe
gtctagtgctttgtaccttaaacga

SEQ ID NO: 99528 - DNA, 25 bp, S. pombe
gtaaggttaatgcaaggccgatatt

SEQ ID NO: 99529 - DNA, 25 bp, S. pombe
gtgactcgtaaaagtaggcccaatt

SEQ ID NO: 99530 - DNA, 25 bp, S. pombe
gtactttagaatatggtcctcgtta

SEQ ID NO: 99531 - DNA, 25 bp, S. pombe
gtacttgtataccttggttgtcgct

SEQ ID NO: 99532 - DNA, 25 bp, S. pombe
gtacttttcacgtgcattgttgctg

SEQ ID NO: 99533 - DNA, 25 bp, S. pombe
gtactattatggatggacgtcgctt

SEQ ID NO: 99534 - DNA, 25 bp, S. pombe
gtaacactggcggtgggcacagctt

SEQ ID NO: 99535 - DNA, 25 bp, S. pombe
gtaacactactgctgccaaggatga

SEQ ID NO: 99536 - DNA, 25 bp, S. pombe
gtaatgcctactcttacggtgcaaa

SEQ ID NO: 99537 - DNA, 25 bp, S. pombe
gtactcctatctctagtttctctga

SEQ ID NO: 99538 - DNA, 25 bp, S. pombe
gtactacttactcaattgcctgcaa

SEQ ID NO: 99539 - DNA, 25 bp, S. pombe
gtacgattcctctatgccaacatat

SEQ ID NO: 99540 - DNA, 25 bp, S. pombe
gtacattttcgctgtggacattcgt

SEQ ID NO: 99541 - DNA, 25 bp, S. pombe
gtaacttaatctcaggtacttcaag

SEQ ID NO: 99542 - DNA, 25 bp, S. pombe
gtaacttggacgaaaccctgacata

SEQ ID NO: 99543 - DNA, 25 bp, S. pombe
gtacacgtggtggtcaagcccaatt

SEQ ID NO: 99544 - DNA, 25 bp, S. pombe
gtactgcgaaattacaagcccataa

SEQ ID NO: 99545 - DNA, 25 bp, S. pombe
gtactctcaaaatccgtcacgatgg

SEQ ID NO: 99546 - DNA, 25 bp, S. pombe
gtacttcaaatacccgtgctggtgc

SEQ ID NO: 99547 - DNA, 25 bp, S. pombe
gtacgaactatatccggctatggtg

SEQ ID NO: 99548 - DNA, 25 bp, S. pombe
gtacgatccttaggccttaatggct

SEQ ID NO: 99549 - DNA, 25 bp, S. pombe
gtaattacctttgaacctggagaat

SEQ ID NO: 99550 - DNA, 25 bp, S. pombe
gtactatacacgtttattcacctga

SEQ ID NO: 99551 - DNA, 25 bp, S. pombe
gtactttccagctttatgacgacga

SEQ ID NO: 99552 - DNA, 25 bp, S. pombe
gtacttctcaacttttggccaagct

SEQ ID NO: 99553 - DNA, 25 bp, S. pombe
gtactctttatgctttcgctatggg

SEQ ID NO: 99554 - DNA, 25 bp, S. pombe
gtactcagattttcttaccattcgg

SEQ ID NO: 99555 - DNA, 25 bp, S. pombe
gtaatagttctactcctactgacca

SEQ ID NO: 99556 - DNA, 25 bp, S. pombe
gtactcttatgttctgcttattgcg

SEQ ID NO: 99557 - DNA, 25 bp, S. pombe
gtacgatcttgctttgcagtcattg

SEQ ID NO: 99558 - DNA, 25 bp, S. pombe
gtacggctaccgatgctgttacaaa

SEQ ID NO: 99559 - DNA, 25 bp, S. pombe
gtacgtggaatgactcaacttctcc

SEQ ID NO: 99560 - DNA, 25 bp, S. pombe
gtacgaggatatgtctccttccact

SEQ ID NO: 99561 - DNA, 25 bp, S. pombe
gtactagtacagtttccattccagg

SEQ ID NO: 99562 - DNA, 25 bp, S. pombe
gtaaacccaattagcgcttatcctt

SEQ ID NO: 99563 - DNA, 25 bp, S. pombe
gtacaaagccttggacgttacctat

SEQ ID NO: 99564 - DNA, 25 bp, S. pombe
gtcccaagttgtgaagtacccatat

SEQ ID NO: 99565 - DNA, 25 bp, S. pombe
gtgtccctgaacctttaattcgatt

SEQ ID NO: 99566 - DNA, 25 bp, S. pombe
gtacactgccagtattttctcttgt

SEQ ID NO: 99567 - DNA, 25 bp, S. pombe
gtactgcctgggatctttgcttgat

SEQ ID NO: 99568 - DNA, 25 bp, S. pombe
gtaatccgggatttgcttcgtaacg

SEQ ID NO: 99569 - DNA, 25 bp, S. pombe
gtaattggtggttcatcttctgttg

SEQ ID NO: 99570 - DNA, 25 bp, S. pombe
gtaacttgggtgaagctctgcgccg

SEQ ID NO: 99571 - DNA, 25 bp, S. pombe
gtacagcttggtcaattgcctatct

SEQ ID NO: 99572 - DNA, 25 bp, S. pombe
gtacgttgaccgcagatgacatttt

SEQ ID NO: 99573 - DNA, 25 bp, S. pombe
gtaacccattggaggacatttctat

SEQ ID NO: 99574 - DNA, 25 bp, S. pombe
ttacgctttccacaaatcagcttcg

SEQ ID NO: 99575 - DNA, 25 bp, S. pombe
gtacagcttgtcgaatttacggcca

SEQ ID NO: 99576 - DNA, 25 bp, S. pombe
gtaactgtgtttatgttggcaacct

SEQ ID NO: 99577 - DNA, 25 bp, S. pombe
tgtaaattccttgtttgagaacctt

SEQ ID NO: 99578 - DNA, 25 bp, S. pombe
gtactattgcggctgatttagctag

SEQ ID NO: 99579 - DNA, 25 bp, S. pombe
gtactgcctctgtggatgatgctat

SEQ ID NO: 99580 - DNA, 25 bp, S. pombe
gtactcaagtcaagatacccctact

SEQ ID NO: 99581 - DNA, 25 bp, S. pombe
tgtaaatagtcaaacagccctcccg

SEQ ID NO: 99582 - DNA, 25 bp, S. pombe
gtactcgccaataacttactatgtt

SEQ ID NO: 99583 - DNA, 25 bp, S. pombe
gtacttgcctataaccataaatttg

SEQ ID NO: 99584 - DNA, 25 bp, S. pombe
gtactgctcctaatgctccaaaaat

SEQ ID NO: 99585 - DNA, 25 bp, S. pombe
gtactgtttatgttgctacgaaaaa

SEQ ID NO: 99586 - DNA, 25 bp, S. pombe
gtacaccgtgattgtgctactgaaa

SEQ ID NO: 99587 - DNA, 25 bp, S. pombe
gtacatgccatgtttgtcatcgtaa

SEQ ID NO: 99588 - DNA, 25 bp, S. pombe
gtactatctctgtgttctgaactgg

SEQ ID NO: 99589 - DNA, 25 bp, S. pombe
gtacaaatcatgtcttttgaaggct

SEQ ID NO: 99590 - DNA, 25 bp, S. pombe
gtaaatttcggcgtcacagaagcta

SEQ ID NO: 99591 - DNA, 25 bp, S. pombe
gtacaaacttcattccttgacggaa

SEQ ID NO: 99592 - DNA, 25 bp, S. pombe
gtaaaggatctcgtacctgacctaa

SEQ ID NO: 99593 - DNA, 25 bp, S. pombe
gtaaccgtcctttttgcatgtctag

SEQ ID NO: 99594 - DNA, 25 bp, S. pombe
gtacactcaccttagcattggtttg

SEQ ID NO: 99595 - DNA, 25 bp, S. pombe
gtacacaaactgttgaccgttctaa

SEQ ID NO: 99596 - DNA, 25 bp, S. pombe
gtaaagcagctctctcttagtattt

SEQ ID NO: 99597 - DNA, 25 bp, S. pombe
gtacaaacttttttagcgattggtg

SEQ ID NO: 99598 - DNA, 25 bp, S. pombe
gtaaaagccttgattccagttgttg

SEQ ID NO: 99599 - DNA, 25 bp, S. pombe
gtacagggtttatatatttcttctt

SEQ ID NO: 99600 - DNA, 25 bp, S. pombe
gtacatgtgcagctttacttttatt

SEQ ID NO: 99601 - DNA, 25 bp, S. pombe
gtacatgtgcgggttcttctatata

SEQ ID NO: 99602 - DNA, 25 bp, S. pombe
gtacttggtactccttcatatcatg

SEQ ID NO: 99603 - DNA, 25 bp, S. pombe
gtactgttgttgaccttttgatcga

SEQ ID NO: 99604 - DNA, 25 bp, S. pombe
gtactgtttttcatggttatctcac

SEQ ID NO: 99605 - DNA, 25 bp, S. pombe
gtaatggcaactgactggatttccc

SEQ ID NO: 99606 - DNA, 25 bp, S. pombe
gtaaatggcctttctggatgtctcc

SEQ ID NO: 99607 - DNA, 25 bp, S. pombe
gtactgtaatctgtgttcctgttga

SEQ ID NO: 99608 - DNA, 25 bp, S. pombe
gtactattatccttttcctttcatc

SEQ ID NO: 99609 - DNA, 25 bp, S. pombe
gtactttggcacttcctaatgtcaa

SEQ ID NO: 99610 - DNA, 25 bp, S. pombe
gtactccagattcgattccaaacac

SEQ ID NO: 99611 - DNA, 25 bp, S. pombe
gtactcgctcgtcaatatctttgga

SEQ ID NO: 99612 - DNA, 25 bp, S. pombe
gtacttgtgcttcaatacgttggct

SEQ ID NO: 99613 - DNA, 25 bp, S. pombe
gtacttgtgcttcatacctttctgc

SEQ ID NO: 99614 - DNA, 25 bp, S. pombe
gtaacaggaactcgactcaccaatg

SEQ ID NO: 99615 - DNA, 25 bp, S. pombe
gtaaatacccacaagcctctgaaat

SEQ ID NO: 99616 - DNA, 25 bp, S. pombe
gtaacttccacatcatcaaaaggta

SEQ ID NO: 99617 - DNA, 25 bp, S. pombe
ttaatttccctcataaacgtgccgc

SEQ ID NO: 99618 - DNA, 25 bp, S. pombe
gtacaatcactatcaaatcgactcg

SEQ ID NO: 99619 - DNA, 25 bp, S. pombe
gtacttcttgtaaaatccctggtgt

SEQ ID NO: 99620 - DNA, 25 bp, S. pombe
gtccgttttacgctcaatctgggtc

SEQ ID NO: 99621 - DNA, 25 bp, S. pombe
gtaaagtgctatggttatgcccgat

SEQ ID NO: 99622 - DNA, 25 bp, S. pombe
gtaattgttgggttatctctgagta

SEQ ID NO: 99623 - DNA, 25 bp, S. pombe
gtacatggtggcctattttctgatg

SEQ ID NO: 99624 - DNA, 25 bp, S. pombe
gtacttgtccaccattgatgccatt

SEQ ID NO: 99625 - DNA, 25 bp, S. pombe
gtactctgctccgtataaggcttat

SEQ ID NO: 99626 - DNA, 25 bp, S. pombe
gtacactctccggaaaccatattga

SEQ ID NO: 99627 - DNA, 25 bp, S. pombe
gtacaatcgacggatgatactccta

SEQ ID NO: 99628 - DNA, 25 bp, S. pombe
gtacataccaatcaaagcgccttag

SEQ ID NO: 99629 - DNA, 25 bp, S. pombe
gtaaagctttcttcgcagcaattga

SEQ ID NO: 99630 - DNA, 25 bp, S. pombe
gtcaaccttctcaacgtaatggcgg

SEQ ID NO: 99631 - DNA, 25 bp, S. pombe
gtacacttttccctgtccttgtggg

SEQ ID NO: 99632 - DNA, 25 bp, S. pombe
gtacacttttaacgatccttgctgg

SEQ ID NO: 99633 - DNA, 25 bp, S. pombe
gtcttatgccttcaagagcctttgg

SEQ ID NO: 99634 - DNA, 25 bp, S. pombe
gtactcattttactcccgctaataa

SEQ ID NO: 99635 - DNA, 25 bp, S. pombe
gtcacttctgtacgatgcgcatttg

SEQ ID NO: 99636 - DNA, 25 bp, S. pombe
gtacttcttttgtccgttctatcgt

SEQ ID NO: 99637 - DNA, 25 bp, S. pombe
gtacattccgtatcgaaattccaag

SEQ ID NO: 99638 - DNA, 25 bp, S. pombe
gtacttccctcaagccaaattgcga

SEQ ID NO: 99639 - DNA, 25 bp, S. pombe
gtaacggccctctacaaattatggt

SEQ ID NO: 99640 - DNA, 25 bp, S. pombe
gtaagcaatcgataacaatgtctgt

SEQ ID NO: 99641 - DNA, 25 bp, S. pombe
gtaagcaacttgaagacggacgtac

SEQ ID NO: 99642 - DNA, 25 bp, S. pombe
gtaaacgtcctcacatggtctattg

SEQ ID NO: 99643 - DNA, 25 bp, S. pombe
gtcaaaatattctttcgtccttcgt

SEQ ID NO: 99644 - DNA, 25 bp, S. pombe
gtacaagtttccgtcgtatcgtatt

SEQ ID NO: 99645 - DNA, 25 bp, S. pombe
gtaacttctcctgccagttttgaaa

SEQ ID NO: 99646 - DNA, 25 bp, S. pombe
gtaaaaccaaagtcgctcagagtga

SEQ ID NO: 99647 - DNA, 25 bp, S. pombe
gtacaaaacaaagtcgccatcctca

SEQ ID NO: 99648 - DNA, 25 bp, S. pombe
gtaagcagctcaactttggaagtcc

SEQ ID NO: 99649 - DNA, 25 bp, S. pombe
gtaaaagctcctactgcaacagtcg

SEQ ID NO: 99650 - DNA, 25 bp, S. pombe
gtaagcacccttatccgaattgtga

SEQ ID NO: 99651 - DNA, 25 bp, S. pombe
gtaacggcttctaaggaattgacat

SEQ ID NO: 99652 - DNA, 25 bp, S. pombe
gtaacggcgtcaaagctgcttctta

SEQ ID NO: 99653 - DNA, 25 bp, S. pombe
gtaaaggcgcagaaagtcatcactt

SEQ ID NO: 99654 - DNA, 25 bp, S. pombe
gtaaatgagcgcgtgccaactcctg

SEQ ID NO: 99655 - DNA, 25 bp, S. pombe
gtaatgtgcaccttgtcgaccgata

SEQ ID NO: 99656 - DNA, 25 bp, S. pombe
gtaatgctacatcttggtctgcgta

SEQ ID NO: 99657 - DNA, 25 bp, S. pombe
gtaacgccgttctcgatggtgctga

SEQ ID NO: 99658 - DNA, 25 bp, S. pombe
gtaacagcattctcttccatatggg

SEQ ID NO: 99659 - DNA, 25 bp, S. pombe
gtaacattcccctcactatggatgt

SEQ ID NO: 99660 - DNA, 25 bp, S. pombe
gtcaacacgcgtgggtcacttaatt

SEQ ID NO: 99661 - DNA, 25 bp, S. pombe
gtaaatccggacgtagcctgctttg

SEQ ID NO: 99662 - DNA, 25 bp, S. pombe
gtaaacctcttactcatcgggttgc

SEQ ID NO: 99663 - DNA, 25 bp, S. pombe
gtaaatcctcctaaacctggtgatc

SEQ ID NO: 99664 - DNA, 25 bp, S. pombe
gtactttcactgctttgctttcgaa

SEQ ID NO: 99665 - DNA, 25 bp, S. pombe
gtacatttccatgtcttccattaaa

SEQ ID NO: 99666 - DNA, 25 bp, S. pombe
tgttaacttgcgtttcaccttgtga

SEQ ID NO: 99667 - DNA, 25 bp, S. pombe
gtaaggttggtgacacccttgctat

SEQ ID NO: 99668 - DNA, 25 bp, S. pombe
gtaagaacgactttgcgcctgttgt

SEQ ID NO: 99669 - DNA, 25 bp, S. pombe
gtaaaattctctaagccgaccaaag

SEQ ID NO: 99670 - DNA, 25 bp, S. pombe
gtaatttactctaaccataccagaa

SEQ ID NO: 99671 - DNA, 25 bp, S. pombe
gtacaagagatttgctcccaacgaa

SEQ ID NO: 99672 - DNA, 25 bp, S. pombe
gtacacttgatcagacctgcacagt

SEQ ID NO: 99673 - DNA, 25 bp, S. pombe
gtacagcttctgaattaactgaatc

SEQ ID NO: 99674 - DNA, 25 bp, S. pombe
gtcacatactcaaatcgggcttcac

SEQ ID NO: 99675 - DNA, 25 bp, S. pombe
gtaagccaacactcacgaatgcaac

SEQ ID NO: 99676 - DNA, 25 bp, S. pombe
gtaaaagctataccattgatcagta

SEQ ID NO: 99677 - DNA, 25 bp, S. pombe
gtctcaaattcatcgacttgccaaa

SEQ ID NO: 99678 - DNA, 25 bp, S. pombe
gtacatctttcagggtgttcgcgaa

SEQ ID NO: 99679 - DNA, 25 bp, S. pombe
gtaaaatcggtcctcagtgattccg

SEQ ID NO: 99680 - DNA, 25 bp, S. pombe
gtgaagcatctggagccgctagtgt

SEQ ID NO: 99681 - DNA, 25 bp, S. pombe
gtcaagctcataatggcccatctac

SEQ ID NO: 99682 - DNA, 25 bp, S. pombe
gtaaccgaatcttccttatgacaag

SEQ ID NO: 99683 - DNA, 25 bp, S. pombe
gtaacacaacttcccatttcaaatg

SEQ ID NO: 99684 - DNA, 25 bp, S. pombe
gtacatatactgactctccggaaat

SEQ ID NO: 99685 - DNA, 25 bp, S. pombe
gtacagtaggtcgtccagtatcaca

SEQ ID NO: 99686 - DNA, 25 bp, S. pombe
gtaaatccttcaacaaccaatcctt

SEQ ID NO: 99687 - DNA, 25 bp, S. pombe
gtaaatgcgcttctgtagccacatc

SEQ ID NO: 99688 - DNA, 25 bp, S. pombe
gtaaaattcttcgtgacaacattca

SEQ ID NO: 99689 - DNA, 25 bp, S. pombe
gtaaaattcttcgtgacaacattca

SEQ ID NO: 99690 - DNA, 25 bp, S. pombe
gtaaaattgaattcccacctccatc

SEQ ID NO: 99691 - DNA, 25 bp, S. pombe
gtaaaattattgtccaccgctggca

SEQ ID NO: 99692 - DNA, 25 bp, S. pombe
gtacaactccactgcttctgaaagc

SEQ ID NO: 99693 - DNA, 25 bp, S. pombe
gtaaattcagccgttttccattctt

SEQ ID NO: 99694 - DNA, 25 bp, S. pombe
gtacaattttgttctgggctctatg

SEQ ID NO: 99695 - DNA, 25 bp, S. pombe
gtacagttggttttgctgctccgga

SEQ ID NO: 99696 - DNA, 25 bp, S. pombe
gtacaagtacgtatgcagctcctga

SEQ ID NO: 99697 - DNA, 25 bp, S. pombe
gtaaagccgcttttagctctatcaa

SEQ ID NO: 99698 - DNA, 25 bp, S. pombe
gtaaaaccttttgcttctgctcaac

SEQ ID NO: 99699 - DNA, 25 bp, S. pombe
gtaagagccaatcttccaacgtgaa

SEQ ID NO: 99700 - DNA, 25 bp, S. pombe
gtaagagcgcttctctcgagggtaa

SEQ ID NO: 99701 - DNA, 25 bp, S. pombe
gtacagagcctctttgcgaaggagc

SEQ ID NO: 99702 - DNA, 25 bp, S. pombe
gtaagcatcttcctgattctgtcat

SEQ ID NO: 99703 - DNA, 25 bp, S. pombe
gtacaacaagcgacacctcatattc

SEQ ID NO: 99704 - DNA, 25 bp, S. pombe
gtaatgccagtttctacgcaactag

SEQ ID NO: 99705 - DNA, 25 bp, S. pombe
gtaacgcgttaattggcatggctaa

SEQ ID NO: 99706 - DNA, 25 bp, S. pombe
gtaagctcgttggattacttcgtga

SEQ ID NO: 99707 - DNA, 25 bp, S. pombe
gtaagcttctctccaaagactgtca

SEQ ID NO: 99708 - DNA, 25 bp, S. pombe
gtgtaattacttctgctgcgactaa

SEQ ID NO: 99709 - DNA, 25 bp, S. pombe
gtaaggtacttcgttgttctcattg

SEQ ID NO: 99710 - DNA, 25 bp, S. pombe
gtaagggctcatttctttgccctat

SEQ ID NO: 99711 - DNA, 25 bp, S. pombe
gtacagagtaattcacgtcaaccaa

SEQ ID NO: 99712 - DNA, 25 bp, S. pombe
gtacaaggaaatacattgcaagcca

SEQ ID NO: 99713 - DNA, 25 bp, S. pombe
gtaaagatgcagctgccttagccgc

SEQ ID NO: 99714 - DNA, 25 bp, S. pombe
gtctacaacatgtctggtaacccca

SEQ ID NO: 99715 - DNA, 25 bp, S. pombe
gtcttcagtctgtgtgcaataccca

SEQ ID NO: 99716 - DNA, 25 bp, S. pombe
gtaacgctggatcctaatgacccaa

SEQ ID NO: 99717 - DNA, 25 bp, S. pombe
gtaattcgttttaactggccagctt

SEQ ID NO: 99718 - DNA, 25 bp, S. pombe
gtacaatcgttagcttttcctgtta

SEQ ID NO: 99719 - DNA, 25 bp, S. pombe
gtacaatgcgtcaaatgcctttctt

SEQ ID NO: 99720 - DNA, 25 bp, S. pombe
gtaactgctctcgatatcctttctt

SEQ ID NO: 99721 - DNA, 25 bp, S. pombe
gtacaacctaattactgcatctctt

SEQ ID NO: 99722 - DNA, 25 bp, S. pombe
gtaaacgctttacttgcattgttca

SEQ ID NO: 99723 - DNA, 25 bp, S. pombe
gtaatacggatctactagaatcttt

SEQ ID NO: 99724 - DNA, 25 bp, S. pombe
gtcataatcggttactagttccatc

SEQ ID NO: 99725 - DNA, 25 bp, S. pombe
gtaagactggtgtacttgttctcat

SEQ ID NO: 99726 - DNA, 25 bp, S. pombe
gtaatgacccattcactttgaccat

SEQ ID NO: 99727 - DNA, 25 bp, S. pombe
gtaacgatccctcattgcagagtat

SEQ ID NO: 99728 - DNA, 25 bp, S. pombe
gtaagcgtcatggtaatctcggtta

SEQ ID NO: 99729 - DNA, 25 bp, S. pombe
gtaacctctttgtcgctgggttaga

SEQ ID NO: 99730 - DNA, 25 bp, S. pombe
gtaaccttttttgatcgctatgtga

SEQ ID NO: 99731 - DNA, 25 bp, S. pombe
gtaacctttctcagttgcatcttta

SEQ ID NO: 99732 - DNA, 25 bp, S. pombe
gtaacgtttcagatgttgagctctt

SEQ ID NO: 99733 - DNA, 25 bp, S. pombe
gtcagcatcacaatcgcaatcaagc

SEQ ID NO: 99734 - DNA, 25 bp, S. pombe
gtaactgccatgaaagattctatat

SEQ ID NO: 99735 - DNA, 25 bp, S. pombe
gtaaatgtctattctgcttctgatt

SEQ ID NO: 99736 - DNA, 25 bp, S. pombe
gtaaatgctttactcatactcatag

SEQ ID NO: 99737 - DNA, 25 bp, S. pombe
gtaaatcctagaccattctctcatg

SEQ ID NO: 99738 - DNA, 25 bp, S. pombe
gtaattacgatgctagttctccatt

SEQ ID NO: 99739 - DNA, 25 bp, S. pombe
gtaagctgcagcaccgtttttatgc

SEQ ID NO: 99740 - DNA, 25 bp, S. pombe
gtcaaaagcgcattagtcgtttcaa

SEQ ID NO: 99741 - DNA, 25 bp, S. pombe
gtacaacgagcttcttcgtattgaa

SEQ ID NO: 99742 - DNA, 25 bp, S. pombe
gtaaactggctcctattggcacgaa

SEQ ID NO: 99743 - DNA, 25 bp, S. pombe
gtgctttagacatatttggcggcgt

SEQ ID NO: 99744 - DNA, 25 bp, S. pombe
gtgctattagctataccagggtcgt

SEQ ID NO: 99745 - DNA, 25 bp, S. pombe
gtcttgcatcaaaggataccaattc

SEQ ID NO: 99746 - DNA, 25 bp, S. pombe
gtcgtcaataaggaaaactcttcca

SEQ ID NO: 99747 - DNA, 25 bp, S. pombe
gtcaccaaacgcagaagatccactc

SEQ ID NO: 99748 - DNA, 25 bp, S. pombe
gtaacttcactgagactgtcgagct

SEQ ID NO: 99749 - DNA, 25 bp, S. pombe
gtaatggtcctgagcgctttgagat

SEQ ID NO: 99750 - DNA, 25 bp, S. pombe
gtaagcgtactggtgactctgccga

SEQ ID NO: 99751 - DNA, 25 bp, S. pombe
gtaagcgtgttgctgacttccaaaa

SEQ ID NO: 99752 - DNA, 25 bp, S. pombe
gtaaggataagagggccgcctccga

SEQ ID NO: 99753 - DNA, 25 bp, S. pombe
gtaaattatacgcactcgcatctcg

SEQ ID NO: 99754 - DNA, 25 bp, S. pombe
gtacaattcatattccagctgccat

SEQ ID NO: 99755 - DNA, 25 bp, S. pombe
gtaatttcagaaccagctcctagag

SEQ ID NO: 99756 - DNA, 25 bp, S. pombe
gtaatagttgccagagtactcgaga

SEQ ID NO: 99757 - DNA, 25 bp, S. pombe
gtaatcttcaaacggacgcaccatc

SEQ ID NO: 99758 - DNA, 25 bp, S. pombe
gtaatttcacttggagacggctctt

SEQ ID NO: 99759 - DNA, 25 bp, S. pombe
gtaaaactcgtgctacagatgcttt

SEQ ID NO: 99760 - DNA, 25 bp, S. pombe
gtaatgtgactaatcccgacttcga

SEQ ID NO: 99761 - DNA, 25 bp, S. pombe
gtaacagccatttcccaggtattat

SEQ ID NO: 99762 - DNA, 25 bp, S. pombe
gtaaatgcaatttcaccaggttatg

SEQ ID NO: 99763 - DNA, 25 bp, S. pombe
gtaacgccaatgtcttcaggattca

SEQ ID NO: 99764 - DNA, 25 bp, S. pombe
gtaacgatccttggtctcactgaat

SEQ ID NO: 99765 - DNA, 25 bp, S. pombe
gtaaggctacgagtttcacgaatgt

SEQ ID NO: 99766 - DNA, 25 bp, S. pombe
gtgttatcaacttgtcggaaccaac

SEQ ID NO: 99767 - DNA, 25 bp, S. pombe
gtgctttaattgcttctgtacctag

SEQ ID NO: 99768 - DNA, 25 bp, S. pombe
gtctttttcccttatgaacctagag

SEQ ID NO: 99769 - DNA, 25 bp, S. pombe
gtcttttagcccttaagtgtcttgg

SEQ ID NO: 99770 - DNA, 25 bp, S. pombe
gtctttgtcccctcaggtatctaaa

SEQ ID NO: 99771 - DNA, 25 bp, S. pombe
gtccggcgatatttacccgatggca

SEQ ID NO: 99772 - DNA, 25 bp, S. pombe
gtaacactattacttcttcttggaa

SEQ ID NO: 99773 - DNA, 25 bp, S. pombe
gtcaacttggtatgcctactgtttt

SEQ ID NO: 99774 - DNA, 25 bp, S. pombe
gtctacgtgcagtatggcctacaat

SEQ ID NO: 99775 - DNA, 25 bp, S. pombe
gtaagaaccatagttgccttcgcat

SEQ ID NO: 99776 - DNA, 25 bp, S. pombe
gtctagaatactgttccttctcatg

SEQ ID NO: 99777 - DNA, 25 bp, S. pombe
gtcagcgaaccgaaaacaatacctt

SEQ ID NO: 99778 - DNA, 25 bp, S. pombe
ttccatcaaaggtaaagcaactact

SEQ ID NO: 99779 - DNA, 25 bp, S. pombe
gtaattcaagtcaatcccacatagg

SEQ ID NO: 99780 - DNA, 25 bp, S. pombe
gtaacctcggttgctcttggagact

SEQ ID NO: 99781 - DNA, 25 bp, S. pombe
gtaacctcgatgttgtctctgtaga

SEQ ID NO: 99782 - DNA, 25 bp, S. pombe
gtaaccttttaacttgtgctgtgca

SEQ ID NO: 99783 - DNA, 25 bp, S. pombe
gtaacactgttacaccatctactgc

SEQ ID NO: 99784 - DNA, 25 bp, S. pombe
gtaacatctagtccaaaatcttctg

SEQ ID NO: 99785 - DNA, 25 bp, S. pombe
gtcaggttattgcaagccacttctc

SEQ ID NO: 99786 - DNA, 25 bp, S. pombe
gtcactgttactcaagccgttattt

SEQ ID NO: 99787 - DNA, 25 bp, S. pombe
gtcgttctccagttagccgtaattg

SEQ ID NO: 99788 - DNA, 25 bp, S. pombe
ttcgcagcgtttgggacagggtttt

SEQ ID NO: 99789 - DNA, 25 bp, S. pombe
tcatcaaggttgacggaaaggttcg

SEQ ID NO: 99790 - DNA, 25 bp, S. pombe
gtaagtttatcctaccttggcgata

SEQ ID NO: 99791 - DNA, 25 bp, S. pombe
gtaatgttatacaaacctttggtag

SEQ ID NO: 99792 - DNA, 25 bp, S. pombe
gtaatgtatctacagcgcccattgg

SEQ ID NO: 99793 - DNA, 25 bp, S. pombe
gtcaatatcatttggagccgcagca

SEQ ID NO: 99794 - DNA, 25 bp, S. pombe
gtaatactatgcagcctttccaacg

SEQ ID NO: 99795 - DNA, 25 bp, S. pombe
gtaatgcattccgtattcttgtcga

SEQ ID NO: 99796 - DNA, 25 bp, S. pombe
gtaatgcacattcataccgctgtcg

SEQ ID NO: 99797 - DNA, 25 bp, S. pombe
gtaagcaactggtggatgcgtccaa

SEQ ID NO: 99798 - DNA, 25 bp, S. pombe
gtaaccgctgatgagggacctgtaa

SEQ ID NO: 99799 - DNA, 25 bp, S. pombe
gtaaaccttggatggattctgctaa

SEQ ID NO: 99800 - DNA, 25 bp, S. pombe
gtaaagcatgttcatctttccgcct

SEQ ID NO: 99801 - DNA, 25 bp, S. pombe
gtaagattacaattcctgctcccat

SEQ ID NO: 99802 - DNA, 25 bp, S. pombe
gtaatccaggctcgtatcgctaatt

SEQ ID NO: 99803 - DNA, 25 bp, S. pombe
gtcgcccttacgtagcggcagtaaa

SEQ ID NO: 99804 - DNA, 25 bp, S. pombe
gtcgtttcgaaatctaggtagccaa

SEQ ID NO: 99805 - DNA, 25 bp, S. pombe
tgttggtcgtactgcccaaggcaag

SEQ ID NO: 99806 - DNA, 25 bp, S. pombe
gtctcgttggaatgacccagctgct

SEQ ID NO: 99807 - DNA, 25 bp, S. pombe
gtaagggcatgcttcattttgatag

SEQ ID NO: 99808 - DNA, 25 bp, S. pombe
gtaactcacttacttctcgtaatcc

SEQ ID NO: 99809 - DNA, 25 bp, S. pombe
gtaagcatctttcttccgatattcc

SEQ ID NO: 99810 - DNA, 25 bp, S. pombe
gtaacaatgttcataccgctagtaa

SEQ ID NO: 99811 - DNA, 25 bp, S. pombe
gtcaatgcaggtgttcagtcagcta

SEQ ID NO: 99812 - DNA, 25 bp, S. pombe
gtaatgagcgtcatctttgcgccat

SEQ ID NO: 99813 - DNA, 25 bp, S. pombe
gtaaaaccagttttccagcactcaa

SEQ ID NO: 99814 - DNA, 25 bp, S. pombe
gtaaaaagagtaagcctcacctcca

SEQ ID NO: 99815 - DNA, 25 bp, S. pombe
gtaagaacaactggcgtttccctgg

SEQ ID NO: 99816 - DNA, 25 bp, S. pombe
gtcatcgtatactttgcgcgttagc

SEQ ID NO: 99817 - DNA, 25 bp, S. pombe
gtcatgttcttttcacttcgttacg

SEQ ID NO: 99818 - DNA, 25 bp, S. pombe
gtaactctgtttattccattgatgg

SEQ ID NO: 99819 - DNA, 25 bp, S. pombe
gtaacatctggtgttgctgccaatg

SEQ ID NO: 99820 - DNA, 25 bp, S. pombe
gtaatatgaccacccaggcttcaga

SEQ ID NO: 99821 - DNA, 25 bp, S. pombe
gtaatggaggcccttagcaccaatg

SEQ ID NO: 99822 - DNA, 25 bp, S. pombe
gtaagcaatcgaaattatagccaca

SEQ ID NO: 99823 - DNA, 25 bp, S. pombe
gtaatgcaacgactagctcttcact

SEQ ID NO: 99824 - DNA, 25 bp, S. pombe
gtcaacgacttcgtgccgtcgatga

SEQ ID NO: 99825 - DNA, 25 bp, S. pombe
gtaatttttcgactccagacggtgc

SEQ ID NO: 99826 - DNA, 25 bp, S. pombe
gtaaggctcctcgtaagcaacttgc

SEQ ID NO: 99827 - DNA, 25 bp, S. pombe
gtaatgtcaactttaatcaacgcga

SEQ ID NO: 99828 - DNA, 25 bp, S. pombe
gtaatgtcaacctcagtaaccgtta

SEQ ID NO: 99829 - DNA, 25 bp, S. pombe
gtcagaagaatcacacccgacttgg

SEQ ID NO: 99830 - DNA, 25 bp, S. pombe
gtctagtcaacaaatgcagctcacc

SEQ ID NO: 99831 - DNA, 25 bp, S. pombe
gtaattatgctctttcaattctaca

SEQ ID NO: 99832 - DNA, 25 bp, S. pombe
gtcaaagtcacgaatgccggcgcta

SEQ ID NO: 99833 - DNA, 25 bp, S. pombe
gtcaaatcattttcaccacgagtgt

SEQ ID NO: 99834 - DNA, 25 bp, S. pombe
gtgcaaaattcattccgaccgggtg

SEQ ID NO: 99835 - DNA, 25 bp, S. pombe
gtaagcctggaagcgaccgtgcaac

SEQ ID NO: 99836 - DNA, 25 bp, S. pombe
gtaagcctagtaacgatgccgcaaa

SEQ ID NO: 99837 - DNA, 25 bp, S. pombe
gtcatattttttgagcccaataccg

SEQ ID NO: 99838 - DNA, 25 bp, S. pombe
gtgctgattttttaaccaaggacgt

SEQ ID NO: 99839 - DNA, 25 bp, S. pombe
gtcaccttgaagtatcgcgctgtca

SEQ ID NO: 99840 - DNA, 25 bp, S. pombe
gtaagcacttcagcatcgaatgtca

SEQ ID NO: 99841 - DNA, 25 bp, S. pombe
gtcaagcctccattactaacgaact

SEQ ID NO: 99842 - DNA, 25 bp, S. pombe
gtaatgcttcaattagctaaccgtg

SEQ ID NO: 99843 - DNA, 25 bp, S. pombe
gtaacttcggagtctaccaggagaa

SEQ ID NO: 99844 - DNA, 25 bp, S. pombe
gtaaccgtattgactctatcgaggc

SEQ ID NO: 99845 - DNA, 25 bp, S. pombe
gtcaagcgagattcctactatcaag

SEQ ID NO: 99846 - DNA, 25 bp, S. pombe
gtcaagcctagtaacacttcagcct

SEQ ID NO: 99847 - DNA, 25 bp, S. pombe
gtaatcttatacctccattggtcca

SEQ ID NO: 99848 - DNA, 25 bp, S. pombe
gtaactgtgtcatcttcttggtcaa

SEQ ID NO: 99849 - DNA, 25 bp, S. pombe
gtaagcgtgttgttgtcctcagtca

SEQ ID NO: 99850 - DNA, 25 bp, S. pombe
tgatcaaggtcaacggtgcccctct

SEQ ID NO: 99851 - DNA, 25 bp, S. pombe
tgatagggaaatgcgtcctcctttc

SEQ ID NO: 99852 - DNA, 25 bp, S. pombe
gtaatcttcaacgagtccatatctg

SEQ ID NO: 99853 - DNA, 25 bp, S. pombe
gtaataactcaacctcgcaacctag

SEQ ID NO: 99854 - DNA, 25 bp, S. pombe
gtcaaccgtgccaaggacaagcaat

SEQ ID NO: 99855 - DNA, 25 bp, S. pombe
gtaaccgtcctagcaactctattat

SEQ ID NO: 99856 - DNA, 25 bp, S. pombe
gtaatggcctattgactgtcacctt

SEQ ID NO: 99857 - DNA, 25 bp, S. pombe
gtaatcggcttatgcttcctatgtc

SEQ ID NO: 99858 - DNA, 25 bp, S. pombe
gtcaccggccagtttaccattgaga

SEQ ID NO: 99859 - DNA, 25 bp, S. pombe
gtaatccgccagtggacactcataa

SEQ ID NO: 99860 - DNA, 25 bp, S. pombe
gtaaccgcatcttctgatcatgttg

SEQ ID NO: 99861 - DNA, 25 bp, S. pombe
gtaaccgcatcattactcatcgtga

SEQ ID NO: 99862 - DNA, 25 bp, S. pombe
gtaatcgatccaaccaatgctcatg

SEQ ID NO: 99863 - DNA, 25 bp, S. pombe
gtaaccatccaaccacattgtggtg

SEQ ID NO: 99864 - DNA, 25 bp, S. pombe
gtaaccccacagttcaatctgagat

SEQ ID NO: 99865 - DNA, 25 bp, S. pombe
gtgacacacaaagggtacattgact

SEQ ID NO: 99866 - DNA, 25 bp, S. pombe
gtcaaccggaatctaccatgtctag

SEQ ID NO: 99867 - DNA, 25 bp, S. pombe
gtaacctctaaaatatccgcttcag

SEQ ID NO: 99868 - DNA, 25 bp, S. pombe
gtcatccgggaatacctgctatttt

SEQ ID NO: 99869 - DNA, 25 bp, S. pombe
gtcaacgctggcaacaagcctgctg

SEQ ID NO: 99870 - DNA, 25 bp, S. pombe
gtcaacgctggcaacaagcctgctg

SEQ ID NO: 99871 - DNA, 25 bp, S. pombe
gtaacgctggttacatgcaccgtac

SEQ ID NO: 99872 - DNA, 25 bp, S. pombe
gtaagtgcttttttcacaattttca

SEQ ID NO: 99873 - DNA, 25 bp, S. pombe
gtcaattcccttttacttagtgcca

SEQ ID NO: 99874 - DNA, 25 bp, S. pombe
gtcactgttactgcttcttcggaaa

SEQ ID NO: 99875 - DNA, 25 bp, S. pombe
gtaagcttagattctctcactcttg

SEQ ID NO: 99876 - DNA, 25 bp, S. pombe
gtcgcctctttaagggtaaccgcag

SEQ ID NO: 99877 - DNA, 25 bp, S. pombe
gtctacagtgttaatcccaaccttt

SEQ ID NO: 99878 - DNA, 25 bp, S. pombe
gtcagaaagtctcagcgcagcaagc

SEQ ID NO: 99879 - DNA, 25 bp, S. pombe
gtcaccgagacttatgctagccatg

SEQ ID NO: 99880 - DNA, 25 bp, S. pombe
gtcagggcactaacgtttcccaaag

SEQ ID NO: 99881 - DNA, 25 bp, S. pombe
gtaagctcatgctccaggcattaga

SEQ ID NO: 99882 - DNA, 25 bp, S. pombe
gtaacctatgctacgaatgtatcga

SEQ ID NO: 99883 - DNA, 25 bp, S. pombe
gtcacacctacatcaacatttgcga

SEQ ID NO: 99884 - DNA, 25 bp, S. pombe
gtcaatgcctacaacaacaatccta

SEQ ID NO: 99885 - DNA, 25 bp, S. pombe
gtaagcgtgctatccatatgatcaa

SEQ ID NO: 99886 - DNA, 25 bp, S. pombe
gtgcaagcggtatccagttcaagta

SEQ ID NO: 99887 - DNA, 25 bp, S. pombe
gtcaacggtacttgccttacagtga

SEQ ID NO: 99888 - DNA, 25 bp, S. pombe
gtaagactgttacatctttggatgt

SEQ ID NO: 99889 - DNA, 25 bp, S. pombe
gtaagttttcacgtgcattctgcga

SEQ ID NO: 99890 - DNA, 25 bp, S. pombe
gtcaaatactatttcctggccgaac

SEQ ID NO: 99891 - DNA, 25 bp, S. pombe
gtcaagaacttgatcgcattgtcaa

SEQ ID NO: 99892 - DNA, 25 bp, S. pombe
gtcaagtgattttgcccatttccga

SEQ ID NO: 99893 - DNA, 25 bp, S. pombe
gtaagcttgttagccatgtctgctc

SEQ ID NO: 99894 - DNA, 25 bp, S. pombe
gtcaatccgtggctacttggcaaat

SEQ ID NO: 99895 - DNA, 25 bp, S. pombe
gtaatactggcgatccttgggaata

SEQ ID NO: 99896 - DNA, 25 bp, S. pombe
gtcaattcgctctactcgtgaggag

SEQ ID NO: 99897 - DNA, 25 bp, S. pombe
gtcaatggcgactaccgattatcaa

SEQ ID NO: 99898 - DNA, 25 bp, S. pombe
gtcatcaagctattcttcgttgtat

SEQ ID NO: 99899 - DNA, 25 bp, S. pombe
gtcaatcaggcattattccttggat

SEQ ID NO: 99900 - DNA, 25 bp, S. pombe
gtaatggacctttttctggattttg

SEQ ID NO: 99901 - DNA, 25 bp, S. pombe
gtcgaggtcgctaccgaacattaca

SEQ ID NO: 99902 - DNA, 25 bp, S. pombe
gtctggttccttattggctttcaat

SEQ ID NO: 99903 - DNA, 25 bp, S. pombe
gtcaatttcgttcggtggctttaat

SEQ ID NO: 99904 - DNA, 25 bp, S. pombe
gtctttcttctacaaatctcgttcg

SEQ ID NO: 99905 - DNA, 25 bp, S. pombe
gtctaattacagctctttcggcacc

SEQ ID NO: 99906 - DNA, 25 bp, S. pombe
gtctcagttacgttcaattacctcc

SEQ ID NO: 99907 - DNA, 25 bp, S. pombe
gtcaagctaacaccgattctgctgc

SEQ ID NO: 99908 - DNA, 25 bp, S. pombe
gtcaagcttcaatactgtgtctcat

SEQ ID NO: 99909 - DNA, 25 bp, S. pombe
gtcaagtatccatccgtggtcgtat

SEQ ID NO: 99910 - DNA, 25 bp, S. pombe
gtcaagtctctatccgtggccgtat

SEQ ID NO: 99911 - DNA, 25 bp, S. pombe
gtcaagtctcttaaggtcggtgctc

SEQ ID NO: 99912 - DNA, 25 bp, S. pombe
gtaagtattttaagccctgtgttat

SEQ ID NO: 99913 - DNA, 25 bp, S. pombe
gtccggaatcttctatccttactaa

SEQ ID NO: 99914 - DNA, 25 bp, S. pombe
gtaagggacttgatgctgctgcgaa

SEQ ID NO: 99915 - DNA, 25 bp, S. pombe
gtcaagaccggtactcacaaggaat

SEQ ID NO: 99916 - DNA, 25 bp, S. pombe
gtcagacgaagcttatgcagcattt

SEQ ID NO: 99917 - DNA, 25 bp, S. pombe
gtcaatcgtacagtcatgccatcta

SEQ ID NO: 99918 - DNA, 25 bp, S. pombe
gtcaatgcttctaatacccatcgtt

SEQ ID NO: 99919 - DNA, 25 bp, S. pombe
gtcaattcactcgtctcttatgttc

SEQ ID NO: 99920 - DNA, 25 bp, S. pombe
gtcaagctcgtctcttggtacgata

SEQ ID NO: 99921 - DNA, 25 bp, S. pombe
gtcaagctttccctcaattggtatt

SEQ ID NO: 99922 - DNA, 25 bp, S. pombe
gtaagtctgttcctgaatggcgttt

SEQ ID NO: 99923 - DNA, 25 bp, S. pombe
gtccgttttcctagagggttgctat

SEQ ID NO: 99924 - DNA, 25 bp, S. pombe
gtcggttctgtcgttggtatttaca

SEQ ID NO: 99925 - DNA, 25 bp, S. pombe
gtcggcatattctcggactgtcgaa

SEQ ID NO: 99926 - DNA, 25 bp, S. pombe
gtcagaagcttctccaagttaccaa

SEQ ID NO: 99927 - DNA, 25 bp, S. pombe
gtaatgattgcctccaacgtactag

SEQ ID NO: 99928 - DNA, 25 bp, S. pombe
gtcaatgtcgacacgaaaaactaat

SEQ ID NO: 99929 - DNA, 25 bp, S. pombe
gtcactccgactttaaaactccagt

SEQ ID NO: 99930 - DNA, 25 bp, S. pombe
gtaatattgccactgcttgaacccc

SEQ ID NO: 99931 - DNA, 25 bp, S. pombe
gtaatatttggcttttacgctgccc

SEQ ID NO: 99932 - DNA, 25 bp, S. pombe
gtcagatcttctgcactttacgaca

SEQ ID NO: 99933 - DNA, 25 bp, S. pombe
gtcaagatcctgctctttacggatt

SEQ ID NO: 99934 - DNA, 25 bp, S. pombe
gtaatcgtggcttctcaacaggcta

SEQ ID NO: 99935 - DNA, 25 bp, S. pombe
gtaattgatccttcttccaagctag

SEQ ID NO: 99936 - DNA, 25 bp, S. pombe
gtaattctcgccattcaaactctga

SEQ ID NO: 99937 - DNA, 25 bp, S. pombe
gtcaattcattcttttcaacctctc

SEQ ID NO: 99938 - DNA, 25 bp, S. pombe
gtaattctttttgattgctccttca

SEQ ID NO: 99939 - DNA, 25 bp, S. pombe
gtaattcttcatacattttctcccc

SEQ ID NO: 99940 - DNA, 25 bp, S. pombe
gtcaacacctgtcataattttttcc

SEQ ID NO: 99941 - DNA, 25 bp, S. pombe
gtccgagccgctcataagtttaata

SEQ ID NO: 99942 - DNA, 25 bp, S. pombe
gtcacaggcctcgatgttggttgaa

SEQ ID NO: 99943 - DNA, 25 bp, S. pombe
gtcccgttgcttttgtataatcctg

SEQ ID NO: 99944 - DNA, 25 bp, S. pombe
gtcagccgattttcaatggtacacg

SEQ ID NO: 99945 - DNA, 25 bp, S. pombe
gtcagcctgcttttgtaggtaccgt

SEQ ID NO: 99946 - DNA, 25 bp, S. pombe
gtcatgcttgttgctgtaggtgcca

SEQ ID NO: 99947 - DNA, 25 bp, S. pombe
gtcagcactgtcgttgagtattact

SEQ ID NO: 99948 - DNA, 25 bp, S. pombe
gtcaagctcttgaacaggccgtcaa

SEQ ID NO: 99949 - DNA, 25 bp, S. pombe
gtaatacaaatgaccctcctcatgt

SEQ ID NO: 99950 - DNA, 25 bp, S. pombe
gtcaaaaactggcttcatcctttca

SEQ ID NO: 99951 - DNA, 25 bp, S. pombe
gtcaacactgaattggtttctctta

SEQ ID NO: 99952 - DNA, 25 bp, S. pombe
gtcaatcttcccagtgatctttatg

SEQ ID NO: 99953 - DNA, 25 bp, S. pombe
gtaatcctcccacttggatgttaga

SEQ ID NO: 99954 - DNA, 25 bp, S. pombe
gtcattcaaaactctttccgaactt

SEQ ID NO: 99955 - DNA, 25 bp, S. pombe
gtcttaaaatccatgcttccggtca

SEQ ID NO: 99956 - DNA, 25 bp, S. pombe
gtcttgttaattattctcgctcgtc

SEQ ID NO: 99957 - DNA, 25 bp, S. pombe
gtgttttaaataaccattggctagc

SEQ ID NO: 99958 - DNA, 25 bp, S. pombe
gtgttttaaataaccattggctagc

SEQ ID NO: 99959 - DNA, 25 bp, S. pombe
gtcttttaatagtagccctggccgc

SEQ ID NO: 99960 - DNA, 25 bp, S. pombe
gtctttttacaattcgatcctgccc

SEQ ID NO: 99961 - DNA, 25 bp, S. pombe
gtctttggacgtctttggattctac

SEQ ID NO: 99962 - DNA, 25 bp, S. pombe
gtgggttccgttttgagaagtctcg

SEQ ID NO: 99963 - DNA, 25 bp, S. pombe
gtcggttcacgtactcggaaatctt

SEQ ID NO: 99964 - DNA, 25 bp, S. pombe
gtcggttgccggattgcttacaatg

SEQ ID NO: 99965 - DNA, 25 bp, S. pombe
gtcgcgttacggtttccagaaagat

SEQ ID NO: 99966 - DNA, 25 bp, S. pombe
gtcacggaacgtgtctccaaattca

SEQ ID NO: 99967 - DNA, 25 bp, S. pombe
gtccggatcaaatggtagctcttta

SEQ ID NO: 99968 - DNA, 25 bp, S. pombe
gtcatcggataactctttgcgtctt

SEQ ID NO: 99969 - DNA, 25 bp, S. pombe
gtcaaggtaacaaggctgccactgt

SEQ ID NO: 99970 - DNA, 25 bp, S. pombe
gtcaagagatcagtgtattcgctat

SEQ ID NO: 99971 - DNA, 25 bp, S. pombe
gtcagtaatcgtaatatgcccacag

SEQ ID NO: 99972 - DNA, 25 bp, S. pombe
gtcaaatctttgttaccaccactgg

SEQ ID NO: 99973 - DNA, 25 bp, S. pombe
gtaattctcgtggtattcggactca

SEQ ID NO: 99974 - DNA, 25 bp, S. pombe
gtcaatgtccgtttgttcgaatctg

SEQ ID NO: 99975 - DNA, 25 bp, S. pombe
gtcactaccgtactttcagcattat

SEQ ID NO: 99976 - DNA, 25 bp, S. pombe
gtctgccgccagagaggaaagccat

SEQ ID NO: 99977 - DNA, 25 bp, S. pombe
tgtcctggacctgggtactggtaat

SEQ ID NO: 99978 - DNA, 25 bp, S. pombe
gtcaagtgcatatgttgatactatt

SEQ ID NO: 99979 - DNA, 25 bp, S. pombe
gtcagctggcgaagttgtgcatcct

SEQ ID NO: 99980 - DNA, 25 bp, S. pombe
gtaatcctgagattcttgtcctatg

SEQ ID NO: 99981 - DNA, 25 bp, S. pombe
gtcaacactgtgcacttgtcgatag

SEQ ID NO: 99982 - DNA, 25 bp, S. pombe
gtcaattcaacatctgcttacttag

SEQ ID NO: 99983 - DNA, 25 bp, S. pombe
gtcaatctttcatcgtttgcattta

SEQ ID NO: 99984 - DNA, 25 bp, S. pombe
gtcagtcaagacagagagtcccatt

SEQ ID NO: 99985 - DNA, 25 bp, S. pombe
gtcttctcaaacctggaactttctg

SEQ ID NO: 99986 - DNA, 25 bp, S. pombe
gtctttggaatttcgcgaagctgtt

SEQ ID NO: 99987 - DNA, 25 bp, S. pombe
gtcttttggatctcatcggtggtta

SEQ ID NO: 99988 - DNA, 25 bp, S. pombe
gtctcttgccctgatcaaaggttca

SEQ ID NO: 99989 - DNA, 25 bp, S. pombe
gtcttcgactgcaaatactgcggca

SEQ ID NO: 99990 - DNA, 25 bp, S. pombe
gtcatgtcgatataggatctgcagg

SEQ ID NO: 99991 - DNA, 25 bp, S. pombe
gtcagtcttgcatatcgcctagtgg

SEQ ID NO: 99992 - DNA, 25 bp, S. pombe
gtcagcagcttgttatggccggtca

SEQ ID NO: 99993 - DNA, 25 bp, S. pombe
gtcagttgtgatactagaaccagct

SEQ ID NO: 99994 - DNA, 25 bp, S. pombe
gtgcagttgctaaggcgacccatgg

SEQ ID NO: 99995 - DNA, 25 bp, S. pombe
gtctattaatcgtgacccagtctca

SEQ ID NO: 99996 - DNA, 25 bp, S. pombe
gtcaaaaatccatttccgcagttcc

SEQ ID NO: 99997 - DNA, 25 bp, S. pombe
gtcaggacacccgatttcaaattct

SEQ ID NO: 99998 - DNA, 25 bp, S. pombe
gtcatatcaactgccatggacaagt

SEQ ID NO: 99999 - DNA, 25 bp, S. pombe
gtcacaccacagttgttatgcgcaa

SEQ ID NO: 100000 - DNA, 25 bp, S. pombe
gtgcattgtacgctgttcaactggt

SEQ ID NO: 100001 - DNA, 25 bp, S. pombe
gtcaaacgatcttatgtcccaacat

SEQ ID NO: 100002 - DNA, 25 bp, S. pombe
gtcaacacgacttttagccctgcaa

SEQ ID NO: 100003 - DNA, 25 bp, S. pombe
gtcaacccacattttactcttagaa

SEQ ID NO: 100004 - DNA, 25 bp, S. pombe
gtcaaagatttttattctcctcgaa

SEQ ID NO: 100005 - DNA, 25 bp, S. pombe
gtcacaaactttgatagccgctcct

SEQ ID NO: 100006 - DNA, 25 bp, S. pombe
gtctttgtttgctctccaagctaaa

SEQ ID NO: 100007 - DNA, 25 bp, S. pombe
gtcaattttccattacctatgctaa

SEQ ID NO: 100008 - DNA, 25 bp, S. pombe
gtcaatatttcagttgctcctatag

SEQ ID NO: 100009 - DNA, 25 bp, S. pombe
gtcaatgagcttgttggccgtatta

SEQ ID NO: 100010 - DNA, 25 bp, S. pombe
gtcaggcgtaaacacacatgcttcc

SEQ ID NO: 100011 - DNA, 25 bp, S. pombe
gtcagcgcgtaaataaggctattcc

SEQ ID NO: 100012 - DNA, 25 bp, S. pombe
gtcaccgtaacatgtggctctacaa

SEQ ID NO: 100013 - DNA, 25 bp, S. pombe
gtcaattagtatacctcctccgaaa

SEQ ID NO: 100014 - DNA, 25 bp, S. pombe
gtcagcaaacaatcctcttccagaa

SEQ ID NO: 100015 - DNA, 25 bp, S. pombe
gtcaaaattgacgttcttccagcag

SEQ ID NO: 100016 - DNA, 25 bp, S. pombe
gtcataaatctaattcgttccggtt

SEQ ID NO: 100017 - DNA, 25 bp, S. pombe
gtcactgatgggatttatgcttacg

SEQ ID NO: 100018 - DNA, 25 bp, S. pombe
gtctgaccgcttcaagcgtgttgga

SEQ ID NO: 100019 - DNA, 25 bp, S. pombe
gtcaatcccattaatagcgagtccg

SEQ ID NO: 100020 - DNA, 25 bp, S. pombe
gtcaatactttgttggctggtgtcc

SEQ ID NO: 100021 - DNA, 25 bp, S. pombe
gtcaaacttctgtttctagtctgga

SEQ ID NO: 100022 - DNA, 25 bp, S. pombe
gtcaatctgcttatggccaatctaa

SEQ ID NO: 100023 - DNA, 25 bp, S. pombe
gtcaactgtctattctggcgaccaa

SEQ ID NO: 100024 - DNA, 25 bp, S. pombe
gtcaatgatacaccctccgaagaaa

SEQ ID NO: 100025 - DNA, 25 bp, S. pombe
gtcattttcttgatgcctacagtcc

SEQ ID NO: 100026 - DNA, 25 bp, S. pombe
gtcacgaaaccacgccttgatgaat

SEQ ID NO: 100027 - DNA, 25 bp, S. pombe
gtcctgtacatgtagccgcaatcaa

SEQ ID NO: 100028 - DNA, 25 bp, S. pombe
gtcaactcctaccaaacttgtcgag

SEQ ID NO: 100029 - DNA, 25 bp, S. pombe
gtcaacttcaactaaatcttctcgg

SEQ ID NO: 100030 - DNA, 25 bp, S. pombe
gtcaactttccattaatgtgcctcc

SEQ ID NO: 100031 - DNA, 25 bp, S. pombe
gtcagcagttttgtttggactccac

SEQ ID NO: 100032 - DNA, 25 bp, S. pombe
gtcagcgtagtcctcatgcttataa

SEQ ID NO: 100033 - DNA, 25 bp, S. pombe
gtcttacaatccattttcggctttt

SEQ ID NO: 100034 - DNA, 25 bp, S. pombe
gtctgaaagtcctagagtttgggtt

SEQ ID NO: 100035 - DNA, 25 bp, S. pombe
gtcatgaaacagtacttggagtgca

SEQ ID NO: 100036 - DNA, 25 bp, S. pombe
gtcttggacacatcttcgagtaacg

SEQ ID NO: 100037 - DNA, 25 bp, S. pombe
gtcttcctttcactttaatgcactt

SEQ ID NO: 100038 - DNA, 25 bp, S. pombe
gtcttccatgtccatcttaaagcca

SEQ ID NO: 100039 - DNA, 25 bp, S. pombe
gtcaaccctcttcttcggatgataa

SEQ ID NO: 100040 - DNA, 25 bp, S. pombe
gtcaacctcttttcttgcttggaaa

SEQ ID NO: 100041 - DNA, 25 bp, S. pombe
gtcacttgttgactacgtagacaga

SEQ ID NO: 100042 - DNA, 25 bp, S. pombe
gtcacttttggatgcagatcgatca

SEQ ID NO: 100043 - DNA, 25 bp, S. pombe
gtcaatcatttccacgagcatcaat

SEQ ID NO: 100044 - DNA, 25 bp, S. pombe
gtcaatgatcttaccgagcaagcaa

SEQ ID NO: 100045 - DNA, 25 bp, S. pombe
gtcaaacttgacttctgctgcaatg

SEQ ID NO: 100046 - DNA, 25 bp, S. pombe
gtcactgaccaatttttgagccgta

SEQ ID NO: 100047 - DNA, 25 bp, S. pombe
gtcactgcggaatatttggaagcat

SEQ ID NO: 100048 - DNA, 25 bp, S. pombe
gtcagctcagtgaagcttatccaga

SEQ ID NO: 100049 - DNA, 25 bp, S. pombe
gtcaaaattgatactcgcaggcgag

SEQ ID NO: 100050 - DNA, 25 bp, S. pombe
gtcagaatttgttcatcagcgacaa

SEQ ID NO: 100051 - DNA, 25 bp, S. pombe
gtcaaatttctgtctacttgcatgt

SEQ ID NO: 100052 - DNA, 25 bp, S. pombe
gtcaccatttttagatctgcagagt

SEQ ID NO: 100053 - DNA, 25 bp, S. pombe
gtcatcatactcgatccattttgga

SEQ ID NO: 100054 - DNA, 25 bp, S. pombe
gtctctggtcgtttactagttggtt

SEQ ID NO: 100055 - DNA, 25 bp, S. pombe
gtctcatgggtggtatcaacggtct

SEQ ID NO: 100056 - DNA, 25 bp, S. pombe
gtcgtaccagcacttatggcagact

SEQ ID NO: 100057 - DNA, 25 bp, S. pombe
gtcaagtcgttactactctcgaata

SEQ ID NO: 100058 - DNA, 25 bp, S. pombe
gtgaaccgttaattcccgacaatca

SEQ ID NO: 100059 - DNA, 25 bp, S. pombe
gtcttcgcggctatttgaccaaata

SEQ ID NO: 100060 - DNA, 25 bp, S. pombe
gtcttcctcgtgaatttgaccaaaa

SEQ ID NO: 100061 - DNA, 25 bp, S. pombe
gtctaaacatacacgttccctgaaa

SEQ ID NO: 100062 - DNA, 25 bp, S. pombe
gtcacattggttggtctgttccttc

SEQ ID NO: 100063 - DNA, 25 bp, S. pombe
gtcacatctttcttgtcccatttaa

SEQ ID NO: 100064 - DNA, 25 bp, S. pombe
gtcacagttcacttgggccggtaaa

SEQ ID NO: 100065 - DNA, 25 bp, S. pombe
gtcacgtctctttctggaagttcaa

SEQ ID NO: 100066 - DNA, 25 bp, S. pombe
gtctactctatttgcggattctgat

SEQ ID NO: 100067 - DNA, 25 bp, S. pombe
gtcccttatgcatggagcagcactg

SEQ ID NO: 100068 - DNA, 25 bp, S. pombe
gtcaccttgatgatcgggcttctta

SEQ ID NO: 100069 - DNA, 25 bp, S. pombe
gtcaccaaagttacagagccttcta

SEQ ID NO: 100070 - DNA, 25 bp, S. pombe
gtcaacgcgcaatacaaggcattct

SEQ ID NO: 100071 - DNA, 25 bp, S. pombe
gtcttcccgaaggtgagctcggtaa

SEQ ID NO: 100072 - DNA, 25 bp, S. pombe
gtcttcaactaatcattcccagtca

SEQ ID NO: 100073 - DNA, 25 bp, S. pombe
gtcttgaaaaattactcccctatgg

SEQ ID NO: 100074 - DNA, 25 bp, S. pombe
gtctacaaagacaaactccgccgtt

SEQ ID NO: 100075 - DNA, 25 bp, S. pombe
gtctactaacatccaattacgcctt

SEQ ID NO: 100076 - DNA, 25 bp, S. pombe
gtcaactaacgtatctttgccatat

SEQ ID NO: 100077 - DNA, 25 bp, S. pombe
gtcaactgagtggtcgtctaacaat

SEQ ID NO: 100078 - DNA, 25 bp, S. pombe
gtcacctataagctacatccaacat

SEQ ID NO: 100079 - DNA, 25 bp, S. pombe
gtcaagcgtgctcatgtccaaaaga

SEQ ID NO: 100080 - DNA, 25 bp, S. pombe
gtcaagccatggatcgagctcatcg

SEQ ID NO: 100081 - DNA, 25 bp, S. pombe
gtcaaatgattgctcctgcttctgt

SEQ ID NO: 100082 - DNA, 25 bp, S. pombe
gtcagcagtcttattccatttacag

SEQ ID NO: 100083 - DNA, 25 bp, S. pombe
gtcagcttttaattccattgcaaca

SEQ ID NO: 100084 - DNA, 25 bp, S. pombe
gtcactgttgttttggctataatta

SEQ ID NO: 100085 - DNA, 25 bp, S. pombe
gtcatatcagcgttttgctactctt

SEQ ID NO: 100086 - DNA, 25 bp, S. pombe
gtcattcaacaacacggtttgccgg

SEQ ID NO: 100087 - DNA, 25 bp, S. pombe
gtcattctacaagccgtatcacatc

SEQ ID NO: 100088 - DNA, 25 bp, S. pombe
gtcatggtccaaacagcctgataac

SEQ ID NO: 100089 - DNA, 25 bp, S. pombe
gtcagtcaaaacaccacacatctat

SEQ ID NO: 100090 - DNA, 25 bp, S. pombe
gtcattccaattacttgccaacaat

SEQ ID NO: 100091 - DNA, 25 bp, S. pombe
gtcttcgtttccatcatgcctaata

SEQ ID NO: 100092 - DNA, 25 bp, S. pombe
gtctttacgcttttgacctacaagg

SEQ ID NO: 100093 - DNA, 25 bp, S. pombe
gtctatttcgtcgactgaactacgg

SEQ ID NO: 100094 - DNA, 25 bp, S. pombe
gtcttcttctgtcccgaaaatcgtt

SEQ ID NO: 100095 - DNA, 25 bp, S. pombe
gtcaacttgctgcttctgctaatga

SEQ ID NO: 100096 - DNA, 25 bp, S. pombe
gtcaacattgacactctgcgaaact

SEQ ID NO: 100097 - DNA, 25 bp, S. pombe
gtcagccaaagcattcgagaatcag

SEQ ID NO: 100098 - DNA, 25 bp, S. pombe
gtcagccaacatgtcaggcgaattg

SEQ ID NO: 100099 - DNA, 25 bp, S. pombe
gtcagcttcttccttcgtaaggata

SEQ ID NO: 100100 - DNA, 25 bp, S. pombe
gtcacccaaaccatatcgcatgtta

SEQ ID NO: 100101 - DNA, 25 bp, S. pombe
gtcaccccaactacatacgcaaatg

SEQ ID NO: 100102 - DNA, 25 bp, S. pombe
gtcatccccaattttatccagtatt

SEQ ID NO: 100103 - DNA, 25 bp, S. pombe
gtcacacccaaatcaatccattagg

SEQ ID NO: 100104 - DNA, 25 bp, S. pombe
gtcactggtggtctatgacctttta

SEQ ID NO: 100105 - DNA, 25 bp, S. pombe
gtcattgggctctttacaaacttgt

SEQ ID NO: 100106 - DNA, 25 bp, S. pombe
gtcattaattctgtcaccttgtata

SEQ ID NO: 100107 - DNA, 25 bp, S. pombe
gtcaccattaattctgatgatcctg

SEQ ID NO: 100108 - DNA, 25 bp, S. pombe
gtcaaacttttcaatgccactgctg

SEQ ID NO: 100109 - DNA, 25 bp, S. pombe
gtcacgtccttataccatcgatttt

SEQ ID NO: 100110 - DNA, 25 bp, S. pombe
gtcggacggaacatgctcttcaaga

SEQ ID NO: 100111 - DNA, 25 bp, S. pombe
gtcatacgttggcagtcgcttatca

SEQ ID NO: 100112 - DNA, 25 bp, S. pombe
gtcatccttgctttaggtttcttag

SEQ ID NO: 100113 - DNA, 25 bp, S. pombe
gtcagcagcctcacaaagattttta

SEQ ID NO: 100114 - DNA, 25 bp, S. pombe
gtcagccccttcaaatcatttcaat

SEQ ID NO: 100115 - DNA, 25 bp, S. pombe
gtcagtcccgaatccatgttatgtt

SEQ ID NO: 100116 - DNA, 25 bp, S. pombe
gtgctaagcgccatcgtaagatcct

SEQ ID NO: 100117 - DNA, 25 bp, S. pombe
gtcactgcctttattgctggtatta

SEQ ID NO: 100118 - DNA, 25 bp, S. pombe
gtcatcagcatcattctttctggtc

SEQ ID NO: 100119 - DNA, 25 bp, S. pombe
gtcaccatggtcgttttttatgcac

SEQ ID NO: 100120 - DNA, 25 bp, S. pombe
gtcatgccttcggttttttaagcaa

SEQ ID NO: 100121 - DNA, 25 bp, S. pombe
gtcagctctctttttcttttaccag

SEQ ID NO: 100122 - DNA, 25 bp, S. pombe
gtgcagtccccactttaggtaaata

SEQ ID NO: 100123 - DNA, 25 bp, S. pombe
gtcgttccttttcagagtactcaaa

SEQ ID NO: 100124 - DNA, 25 bp, S. pombe
gtcttatccgttttccgagattaca

SEQ ID NO: 100125 - DNA, 25 bp, S. pombe
tcgcccgccggttctgaaggaattt

SEQ ID NO: 100126 - DNA, 25 bp, S. pombe
tggaatatgcgagaccccggaggat

SEQ ID NO: 100127 - DNA, 25 bp, S. pombe
tgctaacgcgacaacccacggaggg

SEQ ID NO: 100128 - DNA, 25 bp, S. pombe
tgctttcgcgcaaaacgatcgtggg

SEQ ID NO: 100129 - DNA, 25 bp, S. pombe
gtcagtgatgcagaagtccgtcgtt

SEQ ID NO: 100130 - DNA, 25 bp, S. pombe
gtcgggcagcacagttctagcgtta

SEQ ID NO: 100131 - DNA, 25 bp, S. pombe
gtcagaaacctacctagattcgcgt

SEQ ID NO: 100132 - DNA, 25 bp, S. pombe
gtcgcttatcgtgttttttctggag

SEQ ID NO: 100133 - DNA, 25 bp, S. pombe
gtctttatgggttcgctttttgtga

SEQ ID NO: 100134 - DNA, 25 bp, S. pombe
gtcttttgcattcttgcctttggaa

SEQ ID NO: 100135 - DNA, 25 bp, S. pombe
gtctttcattatcttccattcttta

SEQ ID NO: 100136 - DNA, 25 bp, S. pombe
gtcttgagcgttattccatccttaa

SEQ ID NO: 100137 - DNA, 25 bp, S. pombe
gtctttgcaggtcataactcgctaa

SEQ ID NO: 100138 - DNA, 25 bp, S. pombe
gtctctttgactggtattgcgtttg

SEQ ID NO: 100139 - DNA, 25 bp, S. pombe
gtcttgttactcctagaactcttca

SEQ ID NO: 100140 - DNA, 25 bp, S. pombe
gtcacgctgcagtcaagtgttctta

SEQ ID NO: 100141 - DNA, 25 bp, S. pombe
gtcaggcactccctattgcaaatta

SEQ ID NO: 100142 - DNA, 25 bp, S. pombe
gtcttctgacaccattgataacgta

SEQ ID NO: 100143 - DNA, 25 bp, S. pombe
gtcatggcaagtagctcctagaggt

SEQ ID NO: 100144 - DNA, 25 bp, S. pombe
gtcacgggttccatggattctacta

SEQ ID NO: 100145 - DNA, 25 bp, S. pombe
gtcacgccgttgtcgctggtgtcga

SEQ ID NO: 100146 - DNA, 25 bp, S. pombe
gtcaggaacttgcttatcgtctttt

SEQ ID NO: 100147 - DNA, 25 bp, S. pombe
gtcaggaacttgctcttgccaatat

SEQ ID NO: 100148 - DNA, 25 bp, S. pombe
gtcaggaacttgctgttgctcaagc

SEQ ID NO: 100149 - DNA, 25 bp, S. pombe
gtcatgtcagacttttgtggtgtac

SEQ ID NO: 100150 - DNA, 25 bp, S. pombe
gtcatgtgtcactttgcttggagtt

SEQ ID NO: 100151 - DNA, 25 bp, S. pombe
gtcatatcatatttcgcttggcgtt

SEQ ID NO: 100152 - DNA, 25 bp, S. pombe
gtcgttttacgctcaaagcagctga

SEQ ID NO: 100153 - DNA, 25 bp, S. pombe
gtcgtccgtccgtcttaaatcaaga

SEQ ID NO: 100154 - DNA, 25 bp, S. pombe
gtcttcgtggcggtatgcaaatttt

SEQ ID NO: 100155 - DNA, 25 bp, S. pombe
gtcacgtccgtctgtctgaaagaat

SEQ ID NO: 100156 - DNA, 25 bp, S. pombe
ggtcgacgagtatcctaaggcttca

SEQ ID NO: 100157 - DNA, 25 bp, S. pombe
ggtatggtagtatccctggtcttaa

SEQ ID NO: 100158 - DNA, 25 bp, S. pombe
ggcttggaagtacatccgagtcgta

SEQ ID NO: 100159 - DNA, 25 bp, S. pombe
tgttttgaagtaccatcccattgtg

SEQ ID NO: 100160 - DNA, 25 bp, S. pombe
tgacggcgaggttccaactgatttg

SEQ ID NO: 100161 - DNA, 25 bp, S. pombe
gtcagcggattttcaaactttcaaa

SEQ ID NO: 100162 - DNA, 25 bp, S. pombe
gtcagctcgtggtcaaattgccttt

SEQ ID NO: 100163 - DNA, 25 bp, S. pombe
gtcattccggaatagtgcactttct

SEQ ID NO: 100164 - DNA, 25 bp, S. pombe
gtctaccgacactgtatcgtttcat

SEQ ID NO: 100165 - DNA, 25 bp, S. pombe
gtcttgcacatatctcgtttacttc

SEQ ID NO: 100166 - DNA, 25 bp, S. pombe
gtcgtgccactactggtaaactgtt

SEQ ID NO: 100167 - DNA, 25 bp, S. pombe
gtcggacctcctttagatacatttc

SEQ ID NO: 100168 - DNA, 25 bp, S. pombe
gtcaggcttctggtatatatagtca

SEQ ID NO: 100169 - DNA, 25 bp, S. pombe
gtcaccatgctacttttatctcaaa

SEQ ID NO: 100170 - DNA, 25 bp, S. pombe
gtcaccttcagcatccgatattgaa

SEQ ID NO: 100171 - DNA, 25 bp, S. pombe
gtcaggttatgcagcgcgtagtcaa

SEQ ID NO: 100172 - DNA, 25 bp, S. pombe
gtctgtattgattgacgtcccatta

SEQ ID NO: 100173 - DNA, 25 bp, S. pombe
gtcttctaccaacggcactcttgaa

SEQ ID NO: 100174 - DNA, 25 bp, S. pombe
gtctctcatacttcaagagccttcg

SEQ ID NO: 100175 - DNA, 25 bp, S. pombe
gtcatccaattcgaagtttaggctt

SEQ ID NO: 100176 - DNA, 25 bp, S. pombe
gtcttccacctgttgaatcactggt

SEQ ID NO: 100177 - DNA, 25 bp, S. pombe
gtcattctaacgtatggtcaggcga

SEQ ID NO: 100178 - DNA, 25 bp, S. pombe
gtcatttagatttcgtgtcctgttc

SEQ ID NO: 100179 - DNA, 25 bp, S. pombe
gtgaaaaggcttctgctactgcttc

SEQ ID NO: 100180 - DNA, 25 bp, S. pombe
gtgcaaaaagttatgatacctccta

SEQ ID NO: 100181 - DNA, 25 bp, S. pombe
gtctacaacacagaaggtccagttt

SEQ ID NO: 100182 - DNA, 25 bp, S. pombe
gtctaaaacagttctggtccgtcaa

SEQ ID NO: 100183 - DNA, 25 bp, S. pombe
gtctttcgtcgaaccggatatggaa

SEQ ID NO: 100184 - DNA, 25 bp, S. pombe
gtctcttgagactgttcggaatctt

SEQ ID NO: 100185 - DNA, 25 bp, S. pombe
gtgctgtctacctgttagaaagcca

SEQ ID NO: 100186 - DNA, 25 bp, S. pombe
gtcattcatcgcctggttgggagaa

SEQ ID NO: 100187 - DNA, 25 bp, S. pombe
gtcttgctgcctctgttttaaaatg

SEQ ID NO: 100188 - DNA, 25 bp, S. pombe
gtcttgggatggtctatttaggaaa

SEQ ID NO: 100189 - DNA, 25 bp, S. pombe
gtctctgtgtattaagttgcttcat

SEQ ID NO: 100190 - DNA, 25 bp, S. pombe
gtcttagtatcccattagctctctt

SEQ ID NO: 100191 - DNA, 25 bp, S. pombe
gtcttggtccctaatgatgctgcat

SEQ ID NO: 100192 - DNA, 25 bp, S. pombe
gtcttggcgagcactattgcagcat

SEQ ID NO: 100193 - DNA, 25 bp, S. pombe
gtctatggttgccagctgtgtgaca

SEQ ID NO: 100194 - DNA, 25 bp, S. pombe
gtcattggtgatagcgctgtcgaaa

SEQ ID NO: 100195 - DNA, 25 bp, S. pombe
gtcatcccaggctaccgtgaaaagt

SEQ ID NO: 100196 - DNA, 25 bp, S. pombe
gtctcaccggtcacatcgaccgagt

SEQ ID NO: 100197 - DNA, 25 bp, S. pombe
gtcttcatctttctcacgacaaagt

SEQ ID NO: 100198 - DNA, 25 bp, S. pombe
gtcatttcggtcctatcaacacaat

SEQ ID NO: 100199 - DNA, 25 bp, S. pombe
gtcgatcttggcttggttggaatta

SEQ ID NO: 100200 - DNA, 25 bp, S. pombe
gtctgatctacgctggaaagcaaat

SEQ ID NO: 100201 - DNA, 25 bp, S. pombe
gtctgtcgcgcgcaggtattgaaat

SEQ ID NO: 100202 - DNA, 25 bp, S. pombe
gtcattggcgagactggcaagagtt

SEQ ID NO: 100203 - DNA, 25 bp, S. pombe
gtctctcgtgcatatggacctgtct

SEQ ID NO: 100204 - DNA, 25 bp, S. pombe
gtcatgcctggattgatgcttgcgt

SEQ ID NO: 100205 - DNA, 25 bp, S. pombe
gtcagtgagatgcttcttggtcaaa

SEQ ID NO: 100206 - DNA, 25 bp, S. pombe
gtcattacaggactctttgttaaaa

SEQ ID NO: 100207 - DNA, 25 bp, S. pombe
gtcagttaacagacattctttccaa

SEQ ID NO: 100208 - DNA, 25 bp, S. pombe
gtcagttttctgttagttacgctaa

SEQ ID NO: 100209 - DNA, 25 bp, S. pombe
gtcatttttcgactgggaagcagct

SEQ ID NO: 100210 - DNA, 25 bp, S. pombe
gtctatcattactgtcgttcactct

SEQ ID NO: 100211 - DNA, 25 bp, S. pombe
gtcttcttcttgttaactcttgtgt

SEQ ID NO: 100212 - DNA, 25 bp, S. pombe
gtctactccaatgctaacttcgatt

SEQ ID NO: 100213 - DNA, 25 bp, S. pombe
gtctttcagacatgcataacttcgt

SEQ ID NO: 100214 - DNA, 25 bp, S. pombe
gtctttgaatgctcagattcctcgt

SEQ ID NO: 100215 - DNA, 25 bp, S. pombe
gtgtttatcctaccagaacggctag

SEQ ID NO: 100216 - DNA, 25 bp, S. pombe
gtcagttgagccaaccaagcgtcaa

SEQ ID NO: 100217 - DNA, 25 bp, S. pombe
gtcatcatcgaaaagcgcgctacat

SEQ ID NO: 100218 - DNA, 25 bp, S. pombe
gtctttatgatgacagcgctgctaa

SEQ ID NO: 100219 - DNA, 25 bp, S. pombe
gtcataaatcatcctcgtcttctaa

SEQ ID NO: 100220 - DNA, 25 bp, S. pombe
gtcagtgctaatgctttcccagtaa

SEQ ID NO: 100221 - DNA, 25 bp, S. pombe
ggcaggaaaaccacccagttacatt

SEQ ID NO: 100222 - DNA, 25 bp, S. pombe
gtcttcctgagtgctatattcgtgg

SEQ ID NO: 100223 - DNA, 25 bp, S. pombe
gtctatgattgactcagcctacacc

SEQ ID NO: 100224 - DNA, 25 bp, S. pombe
gtcatttccagctaattacccatat

SEQ ID NO: 100225 - DNA, 25 bp, S. pombe
gtcttcccgttatttttgcttgtga

SEQ ID NO: 100226 - DNA, 25 bp, S. pombe
gtcgacgttcctgtaaaggctgcta

SEQ ID NO: 100227 - DNA, 25 bp, S. pombe
gtcgttgattccgttgacaaggctt

SEQ ID NO: 100228 - DNA, 25 bp, S. pombe
gtcgttttcgcgaattggagcatgc

SEQ ID NO: 100229 - DNA, 25 bp, S. pombe
gtcttttccgcgaacctgaatgttt

SEQ ID NO: 100230 - DNA, 25 bp, S. pombe
gtctccaccactcacatagttagag

SEQ ID NO: 100231 - DNA, 25 bp, S. pombe
gtccaacggaggtgtttgctcaact

SEQ ID NO: 100232 - DNA, 25 bp, S. pombe
gtctagcgagttggaatcctcttca

SEQ ID NO: 100233 - DNA, 25 bp, S. pombe
gtcttggtctcttattcttctgaag

SEQ ID NO: 100234 - DNA, 25 bp, S. pombe
gtctttggtcattttgtttgccgct

SEQ ID NO: 100235 - DNA, 25 bp, S. pombe
gtcatttgctatacactttttcttc

SEQ ID NO: 100236 - DNA, 25 bp, S. pombe
gtctttgctacacttttgctttcta

SEQ ID NO: 100237 - DNA, 25 bp, S. pombe
gtctttctgcaccttttgtactaaa

SEQ ID NO: 100238 - DNA, 25 bp, S. pombe
gtcattttcacacgatcctaacaca

SEQ ID NO: 100239 - DNA, 25 bp, S. pombe
gtcatctattaacgctcttattcga

SEQ ID NO: 100240 - DNA, 25 bp, S. pombe
gtctctagtaattgccctggtgtta

SEQ ID NO: 100241 - DNA, 25 bp, S. pombe
gtcatcgtcatcttccaactaatgt

SEQ ID NO: 100242 - DNA, 25 bp, S. pombe
gtcatcctctactactttgaagacg

SEQ ID NO: 100243 - DNA, 25 bp, S. pombe
gtcatctccgtatcttctgaagaag

SEQ ID NO: 100244 - DNA, 25 bp, S. pombe
gtcattgcgcgttagattgtgaact

SEQ ID NO: 100245 - DNA, 25 bp, S. pombe
gtcatatgcttcattctgcaacagt

SEQ ID NO: 100246 - DNA, 25 bp, S. pombe
gtctcgcaggaattgatgccccaga

SEQ ID NO: 100247 - DNA, 25 bp, S. pombe
gtctctgacatttgtgacgccaata

SEQ ID NO: 100248 - DNA, 25 bp, S. pombe
gtctctagtgacctgcagcgacaaa

SEQ ID NO: 100249 - DNA, 25 bp, S. pombe
gtcatgtcgtgatcgagcgcaacat

SEQ ID NO: 100250 - DNA, 25 bp, S. pombe
gtcatttactccaactcaagtcatt

SEQ ID NO: 100251 - DNA, 25 bp, S. pombe
gtctgtcataacctacgttggcaat

SEQ ID NO: 100252 - DNA, 25 bp, S. pombe
gtcttcaaagttccaatgctccagt

SEQ ID NO: 100253 - DNA, 25 bp, S. pombe
gtctctacgatatcaatggaacact

SEQ ID NO: 100254 - DNA, 25 bp, S. pombe
gtcgggttaaacttgacttgtgcaa

SEQ ID NO: 100255 - DNA, 25 bp, S. pombe
gtcatttctaactttcactgtctat

SEQ ID NO: 100256 - DNA, 25 bp, S. pombe
gtctttcaatcctttatcatctgct

SEQ ID NO: 100257 - DNA, 25 bp, S. pombe
gtcttgaagaccatgccgctatact

SEQ ID NO: 100258 - DNA, 25 bp, S. pombe
gtcttaagaattcccgtatacctag

SEQ ID NO: 100259 - DNA, 25 bp, S. pombe
gtctttcaagacatgcctgcagtag

SEQ ID NO: 100260 - DNA, 25 bp, S. pombe
gtcttggcagcatctttggaggaaa

SEQ ID NO: 100261 - DNA, 25 bp, S. pombe
gtcttgctgcctgcttatggtggaa

SEQ ID NO: 100262 - DNA, 25 bp, S. pombe
gtctttctgctcttttccatgagaa

SEQ ID NO: 100263 - DNA, 25 bp, S. pombe
gtcattctattgttgagtcgccatt

SEQ ID NO: 100264 - DNA, 25 bp, S. pombe
gtcattcttatggaacgccagcgtt

SEQ ID NO: 100265 - DNA, 25 bp, S. pombe
gtcatctctttgtaaaacgcgtttg

SEQ ID NO: 100266 - DNA, 25 bp, S. pombe
gtctattgccgatcacagcatggaa

SEQ ID NO: 100267 - DNA, 25 bp, S. pombe
gtccattcctgattgctgagctaat

SEQ ID NO: 100268 - DNA, 25 bp, S. pombe
gtgccatgatttctacattgaaggt

SEQ ID NO: 100269 - DNA, 25 bp, S. pombe
gtctgaacaaagctcgccatactta

SEQ ID NO: 100270 - DNA, 25 bp, S. pombe
gtctaacgaggaattcttactgtat

SEQ ID NO: 100271 - DNA, 25 bp, S. pombe
gtctcgccatggttagctttttagc

SEQ ID NO: 100272 - DNA, 25 bp, S. pombe
gtcgatcctggattggcacctggaa

SEQ ID NO: 100273 - DNA, 25 bp, S. pombe
gtcttcctgtatagacactatcgag

SEQ ID NO: 100274 - DNA, 25 bp, S. pombe
gtcttcttgcattagccctgatgga

SEQ ID NO: 100275 - DNA, 25 bp, S. pombe
gtctctatccctactgatgtacaag

SEQ ID NO: 100276 - DNA, 25 bp, S. pombe
gtccatccctatccttggattagtg

SEQ ID NO: 100277 - DNA, 25 bp, S. pombe
gtctactcaacctcttttacaaact

SEQ ID NO: 100278 - DNA, 25 bp, S. pombe
gtctacttacccgatttcttagagg

SEQ ID NO: 100279 - DNA, 25 bp, S. pombe
gtctactctcatacagtttccttaa

SEQ ID NO: 100280 - DNA, 25 bp, S. pombe
gtcatactttacttcagttctcgca

SEQ ID NO: 100281 - DNA, 25 bp, S. pombe
gtctcggttacaacaaattgcgcag

SEQ ID NO: 100282 - DNA, 25 bp, S. pombe
gtcggtggcaggaccaagattccat

SEQ ID NO: 100283 - DNA, 25 bp, S. pombe
gtctttatggacttcgtgatgcact

SEQ ID NO: 100284 - DNA, 25 bp, S. pombe
gtcttcaatgggtttgtccagcttt

SEQ ID NO: 100285 - DNA, 25 bp, S. pombe
gtctatatgtcagattcgcaacttt

SEQ ID NO: 100286 - DNA, 25 bp, S. pombe
gtctattccaagcagtcgattctca

SEQ ID NO: 100287 - DNA, 25 bp, S. pombe
gtcttttccagatgtcgatcctaac

SEQ ID NO: 100288 - DNA, 25 bp, S. pombe
gtcggatttggattggcttgccatt

SEQ ID NO: 100289 - DNA, 25 bp, S. pombe
gtctctttcgaactggttgccctga

SEQ ID NO: 100290 - DNA, 25 bp, S. pombe
gtctctttcacgtgcttcgaacgat

SEQ ID NO: 100291 - DNA, 25 bp, S. pombe
gtctttactttctttgggcacaatc

SEQ ID NO: 100292 - DNA, 25 bp, S. pombe
gtctttacattatactcgggcacat

SEQ ID NO: 100293 - DNA, 25 bp, S. pombe
gtcgctgccagaggtctagatatac

SEQ ID NO: 100294 - DNA, 25 bp, S. pombe
gtgcgcatgccggtcattatgtagc

SEQ ID NO: 100295 - DNA, 25 bp, S. pombe
gtcgattctggatttggtcagccaa

SEQ ID NO: 100296 - DNA, 25 bp, S. pombe
gtgctgcctctggtactaagtatag

SEQ ID NO: 100297 - DNA, 25 bp, S. pombe
gtctatcgcgttgcctattacatgg

SEQ ID NO: 100298 - DNA, 25 bp, S. pombe
gtctagccgttcttgctttaagtga

SEQ ID NO: 100299 - DNA, 25 bp, S. pombe
gtcattgctctgaacgattttctag

SEQ ID NO: 100300 - DNA, 25 bp, S. pombe
gtcttcctctactactcgtcgataa

SEQ ID NO: 100301 - DNA, 25 bp, S. pombe
gtctcccctactgtttcggattata

SEQ ID NO: 100302 - DNA, 25 bp, S. pombe
gtctcttctagctcaccttgatgaa

SEQ ID NO: 100303 - DNA, 25 bp, S. pombe
gtctctgctcgtaagcgtgttgaaa

SEQ ID NO: 100304 - DNA, 25 bp, S. pombe
gtctcgtcgtgatattcttggcgaa

SEQ ID NO: 100305 - DNA, 25 bp, S. pombe
gtccgacgaggatttcagtaagcac

SEQ ID NO: 100306 - DNA, 25 bp, S. pombe
gtctgcgtcggtatcacaggaagca

SEQ ID NO: 100307 - DNA, 25 bp, S. pombe
gtctcgtctgacactcaagcaacaa

SEQ ID NO: 100308 - DNA, 25 bp, S. pombe
gtgcggacggctactagtcaatcaa

SEQ ID NO: 100309 - DNA, 25 bp, S. pombe
gtcgagacatgggtgccgataccaa

SEQ ID NO: 100310 - DNA, 25 bp, S. pombe
gtctacttcctctaatattccatat

SEQ ID NO: 100311 - DNA, 25 bp, S. pombe
gtcggtcccaaagactcagtgttac

SEQ ID NO: 100312 - DNA, 25 bp, S. pombe
gtcggatgccgtaacgttcagtttt

SEQ ID NO: 100313 - DNA, 25 bp, S. pombe
gtcggtaaatccacattcactttct

SEQ ID NO: 100314 - DNA, 25 bp, S. pombe
gtccgtattttcttcttactttctg

SEQ ID NO: 100315 - DNA, 25 bp, S. pombe
gtccatgctcttttattcgtttttc

SEQ ID NO: 100316 - DNA, 25 bp, S. pombe
gtcttctctatgttcgtcgttttgt

SEQ ID NO: 100317 - DNA, 25 bp, S. pombe
gtcttctctatgttcgtcgttttgt

SEQ ID NO: 100318 - DNA, 25 bp, S. pombe
gtcattgccatgattgctgtcgctt

SEQ ID NO: 100319 - DNA, 25 bp, S. pombe
gtcattcagctggttgctcttgtaa

SEQ ID NO: 100320 - DNA, 25 bp, S. pombe
gtcttactgtgttcgtcgctgaaaa

SEQ ID NO: 100321 - DNA, 25 bp, S. pombe
gtcttattcagttagtcctacctct

SEQ ID NO: 100322 - DNA, 25 bp, S. pombe
gtcttctttgaagtcggattcccat

SEQ ID NO: 100323 - DNA, 25 bp, S. pombe
gtcttgcctctaattatcgttatgc

SEQ ID NO: 100324 - DNA, 25 bp, S. pombe
gtcttgcccatcgtggtcgtttaga

SEQ ID NO: 100325 - DNA, 25 bp, S. pombe
gtcgctctcaatctcctgaattaag

SEQ ID NO: 100326 - DNA, 25 bp, S. pombe
gtgcagcttccggtactaagtacag

SEQ ID NO: 100327 - DNA, 25 bp, S. pombe
gtcgtgatgctgcttccatgaaatc

SEQ ID NO: 100328 - DNA, 25 bp, S. pombe
gtcggtatgtttctgatcgatcaat

SEQ ID NO: 100329 - DNA, 25 bp, S. pombe
gtcccttggttctcatcaatggtgt

SEQ ID NO: 100330 - DNA, 25 bp, S. pombe
gtccccgtgtggttatccagtatta

SEQ ID NO: 100331 - DNA, 25 bp, S. pombe
gtctctttgcttactggtttatcaa

SEQ ID NO: 100332 - DNA, 25 bp, S. pombe
gtcgacttgttttccaaaccatcac

SEQ ID NO: 100333 - DNA, 25 bp, S. pombe
ggccgttgtccgtgaaacctatgaa

SEQ ID NO: 100334 - DNA, 25 bp, S. pombe
ttcgaaacccctctaccaataaatg

SEQ ID NO: 100335 - DNA, 25 bp, S. pombe
gtcgaaacctcgcttatccgataaa

SEQ ID NO: 100336 - DNA, 25 bp, S. pombe
gtctatcaacccctttatcacaaga

SEQ ID NO: 100337 - DNA, 25 bp, S. pombe
gtctcccaattttctcaactgtgaa

SEQ ID NO: 100338 - DNA, 25 bp, S. pombe
gtctacagacgacgtgattgctcat

SEQ ID NO: 100339 - DNA, 25 bp, S. pombe
gtctacgactacttgcaatctcagt

SEQ ID NO: 100340 - DNA, 25 bp, S. pombe
gtcggcaggctctatggaatctcag

SEQ ID NO: 100341 - DNA, 25 bp, S. pombe
tatcggcaccgagggacattctggt

SEQ ID NO: 100342 - DNA, 25 bp, S. pombe
gtctccactcgggtattatcggatt

SEQ ID NO: 100343 - DNA, 25 bp, S. pombe
gtcgtcctcggtgaagaagcctata

SEQ ID NO: 100344 - DNA, 25 bp, S. pombe
gtcttttccactgatagtagccctt

SEQ ID NO: 100345 - DNA, 25 bp, S. pombe
gtcgttaacactggcaacaagcctt

SEQ ID NO: 100346 - DNA, 25 bp, S. pombe
gtcggaaacttgaccacgtgccaaa

SEQ ID NO: 100347 - DNA, 25 bp, S. pombe
gtcttagacaatctacacgtgccca

SEQ ID NO: 100348 - DNA, 25 bp, S. pombe
gtccgacctgcaagaagagccgcat

SEQ ID NO: 100349 - DNA, 25 bp, S. pombe
gtctacttcatttacttcttacacc

SEQ ID NO: 100350 - DNA, 25 bp, S. pombe
gtctcagctcttccttatattggta

SEQ ID NO: 100351 - DNA, 25 bp, S. pombe
gtctcttctgcatcttcaaattctt

SEQ ID NO: 100352 - DNA, 25 bp, S. pombe
gtcggtgcctattcatcttcaaaag

SEQ ID NO: 100353 - DNA, 25 bp, S. pombe
gtcgggcctttagcacaatatgcgt

SEQ ID NO: 100354 - DNA, 25 bp, S. pombe
gtcggccaggtttgtggtgtcacca

SEQ ID NO: 100355 - DNA, 25 bp, S. pombe
gtcgtcgtgtgctaagatggtctca

SEQ ID NO: 100356 - DNA, 25 bp, S. pombe
gtcgtttgtcgaccatggctatatt

SEQ ID NO: 100357 - DNA, 25 bp, S. pombe
gtctacgaccagaagcacgctttat

SEQ ID NO: 100358 - DNA, 25 bp, S. pombe
gtcgcgccgcagaggagcttttgta

SEQ ID NO: 100359 - DNA, 25 bp, S. pombe
gtctgcccatggaaacggtttctca

SEQ ID NO: 100360 - DNA, 25 bp, S. pombe
gtctgatcccgcaagaaagtctttt

SEQ ID NO: 100361 - DNA, 25 bp, S. pombe
gtctgaaagcggacctaagtcttct

SEQ ID NO: 100362 - DNA, 25 bp, S. pombe
gtctaacatggcctcttctattgaa

SEQ ID NO: 100363 - DNA, 25 bp, S. pombe
gtctcgcagtcgactctttttataa

SEQ ID NO: 100364 - DNA, 25 bp, S. pombe
gtcgacccatatcaatttgcgtccg

SEQ ID NO: 100365 - DNA, 25 bp, S. pombe
gtcgacgcaaaccattacctaacaa

SEQ ID NO: 100366 - DNA, 25 bp, S. pombe
gtcgccgagtcagttttggtactaa

SEQ ID NO: 100367 - DNA, 25 bp, S. pombe
gtcctggttcctctgtaaataattg

SEQ ID NO: 100368 - DNA, 25 bp, S. pombe
gtccggcgttcatcgatacaatatt

SEQ ID NO: 100369 - DNA, 25 bp, S. pombe
gtctcgtaactttccttcaaatcat

SEQ ID NO: 100370 - DNA, 25 bp, S. pombe
gtctcgggatttgggttcttcatat

SEQ ID NO: 100371 - DNA, 25 bp, S. pombe
gtcgttgagacgtgcattagcttct

SEQ ID NO: 100372 - DNA, 25 bp, S. pombe
gtcggtaagagttgccttcttctac

SEQ ID NO: 100373 - DNA, 25 bp, S. pombe
gtctcattcatgtttttctgcgcat

SEQ ID NO: 100374 - DNA, 25 bp, S. pombe
gtcgggcctttccaatgttgacgga

SEQ ID NO: 100375 - DNA, 25 bp, S. pombe
gtcgatttcctaaccttcaaagcga

SEQ ID NO: 100376 - DNA, 25 bp, S. pombe
gtcgttcctcaaaattccctagaat

SEQ ID NO: 100377 - DNA, 25 bp, S. pombe
gtctttccactgatgatcctttaca

SEQ ID NO: 100378 - DNA, 25 bp, S. pombe
gtctttgaatgcgtctcccttataa

SEQ ID NO: 100379 - DNA, 25 bp, S. pombe
gtctgttgcataccgcttatctata

SEQ ID NO: 100380 - DNA, 25 bp, S. pombe
gtctgaagttcacgataccccacat

SEQ ID NO: 100381 - DNA, 25 bp, S. pombe
gtctgatacataccaattcgcctac

SEQ ID NO: 100382 - DNA, 25 bp, S. pombe
gtccgaagcttcattggctcatgac

SEQ ID NO: 100383 - DNA, 25 bp, S. pombe
gtctcgatacttagtcacccatgat

SEQ ID NO: 100384 - DNA, 25 bp, S. pombe
gtcgacgtattaagatcttccatgg

SEQ ID NO: 100385 - DNA, 25 bp, S. pombe
gtcgaccccgaagtcttgcatgagg

SEQ ID NO: 100386 - DNA, 25 bp, S. pombe
gtctacccaatgtcagcttttggtt

SEQ ID NO: 100387 - DNA, 25 bp, S. pombe
gtctggcctattctttctatgtttc

SEQ ID NO: 100388 - DNA, 25 bp, S. pombe
gtctgagttaattcgtcctatacct

SEQ ID NO: 100389 - DNA, 25 bp, S. pombe
gtctcgttaagtgatgcttttcctg

SEQ ID NO: 100390 - DNA, 25 bp, S. pombe
gtctcgatccgtcgctttatatgac

SEQ ID NO: 100391 - DNA, 25 bp, S. pombe
gtcgctgaatctcgagtcactttag

SEQ ID NO: 100392 - DNA, 25 bp, S. pombe
gtccgaactgcgacaatcattttgt

SEQ ID NO: 100393 - DNA, 25 bp, S. pombe
gtcgtgtcgcttttacataccagga

SEQ ID NO: 100394 - DNA, 25 bp, S. pombe
gtcctgcctgtctgttcaaaagggt

SEQ ID NO: 100395 - DNA, 25 bp, S. pombe
ggtccgttcggcatgaatggttgtt

SEQ ID NO: 100396 - DNA, 25 bp, S. pombe
gtcgtcgtttgtctgataggctttt

SEQ ID NO: 100397 - DNA, 25 bp, S. pombe
gtctctttcgtttgacgatgcttct

SEQ ID NO: 100398 - DNA, 25 bp, S. pombe
gtctcttcactaatgccacaggttg

SEQ ID NO: 100399 - DNA, 25 bp, S. pombe
gtctctccacatttgcactaggatt

SEQ ID NO: 100400 - DNA, 25 bp, S. pombe
gtctcactggcatccactatgacat

SEQ ID NO: 100401 - DNA, 25 bp, S. pombe
gtctcagaagcatctcaaatatgtt

SEQ ID NO: 100402 - DNA, 25 bp, S. pombe
gtcctggttattcacgttctagtat

SEQ ID NO: 100403 - DNA, 25 bp, S. pombe
gtccggttttccaagagttcattat

SEQ ID NO: 100404 - DNA, 25 bp, S. pombe
gtctctttattgaacggctcggcat

SEQ ID NO: 100405 - DNA, 25 bp, S. pombe
gtcgatcaaattcttcgcgctggaa

SEQ ID NO: 100406 - DNA, 25 bp, S. pombe
gtggaacactttttgcgggtggaat

SEQ ID NO: 100407 - DNA, 25 bp, S. pombe
gtcgaaccataatttctgcacggga

SEQ ID NO: 100408 - DNA, 25 bp, S. pombe
gtcggcacgaagtacttttatggtt

SEQ ID NO: 100409 - DNA, 25 bp, S. pombe
gtctcaccgccgctcaaaaattgaa

SEQ ID NO: 100410 - DNA, 25 bp, S. pombe
gtctcactcttgatttccaaaccaa

SEQ ID NO: 100411 - DNA, 25 bp, S. pombe
gtctacctcgacattccagaatcaa

SEQ ID NO: 100412 - DNA, 25 bp, S. pombe
gtctgtgggcactaccaattgactg

SEQ ID NO: 100413 - DNA, 25 bp, S. pombe
gtcgtattggactcaagcctttgat

SEQ ID NO: 100414 - DNA, 25 bp, S. pombe
gggctactagtgtgcttggttttat

SEQ ID NO: 100415 - DNA, 25 bp, S. pombe
gtcgctacttcagctaactggtttt

SEQ ID NO: 100416 - DNA, 25 bp, S. pombe
gtcgtcaatttccaacagtgtgttt

SEQ ID NO: 100417 - DNA, 25 bp, S. pombe
gtcgacttcacacgcaaatgggctg

SEQ ID NO: 100418 - DNA, 25 bp, S. pombe
gtcgagtatctcgtcaatatggtcg

SEQ ID NO: 100419 - DNA, 25 bp, S. pombe
gtctcttcgtctagtgttaccaatt

SEQ ID NO: 100420 - DNA, 25 bp, S. pombe
gtcggctcaatctgtgttacccaaa

SEQ ID NO: 100421 - DNA, 25 bp, S. pombe
gtctgttttacgcacatcagctaat

SEQ ID NO: 100422 - DNA, 25 bp, S. pombe
gtctgatgttttgcaaatcatgtaa

SEQ ID NO: 100423 - DNA, 25 bp, S. pombe
gtctcatcatgtttcaaatgccaca

SEQ ID NO: 100424 - DNA, 25 bp, S. pombe
gtctctcttgatgagaatggcagca

SEQ ID NO: 100425 - DNA, 25 bp, S. pombe
gtctgctcatcctgaaattcaacat

SEQ ID NO: 100426 - DNA, 25 bp, S. pombe
gtcgaacgacttctggacagccaat

SEQ ID NO: 100427 - DNA, 25 bp, S. pombe
gtcgatgacattcctttggcaacca

SEQ ID NO: 100428 - DNA, 25 bp, S. pombe
gtctacaatgctttgttggcaacga

SEQ ID NO: 100429 - DNA, 25 bp, S. pombe
gtctgcgtatggtgtctatgctgag

SEQ ID NO: 100430 - DNA, 25 bp, S. pombe
gtctcgttcgtattctagctgcaat

SEQ ID NO: 100431 - DNA, 25 bp, S. pombe
gtccgactagcgctttacataaatt

SEQ ID NO: 100432 - DNA, 25 bp, S. pombe
gtccatgctaccagggctaaacgat

SEQ ID NO: 100433 - DNA, 25 bp, S. pombe
gtcgtgcccttggtgaagttgtcaa

SEQ ID NO: 100434 - DNA, 25 bp, S. pombe
gtcgtctccttcctaatcaattaca

SEQ ID NO: 100435 - DNA, 25 bp, S. pombe
gtctgttccttccatgttagttgag

SEQ ID NO: 100436 - DNA, 25 bp, S. pombe
gtctctgttgtaatgtttgtgtatc

SEQ ID NO: 100437 - DNA, 25 bp, S. pombe
gtgctggaggtgctgttactattct

SEQ ID NO: 100438 - DNA, 25 bp, S. pombe
gtcgcaactggttttgctggtgcca

SEQ ID NO: 100439 - DNA, 25 bp, S. pombe
gtcgaagctttgttcgaggcctttt

SEQ ID NO: 100440 - DNA, 25 bp, S. pombe
gtctccttggacagtatcctgatgt

SEQ ID NO: 100441 - DNA, 25 bp, S. pombe
gtctactttaatggctgctcacatg

SEQ ID NO: 100442 - DNA, 25 bp, S. pombe
gtctccctatttggcttactgaatt

SEQ ID NO: 100443 - DNA, 25 bp, S. pombe
gtctccgctcaactgggtcaatata

SEQ ID NO: 100444 - DNA, 25 bp, S. pombe
gtcgatagcatgtcaatctctagat

SEQ ID NO: 100445 - DNA, 25 bp, S. pombe
gtcgatatcgatgatcccaagcagt

SEQ ID NO: 100446 - DNA, 25 bp, S. pombe
gtccttttccttgggatatgccgaa

SEQ ID NO: 100447 - DNA, 25 bp, S. pombe
gtcgatgttatcgttgccgttgaca

SEQ ID NO: 100448 - DNA, 25 bp, S. pombe
gtcgatttgtccatagcgatgctcc

SEQ ID NO: 100449 - DNA, 25 bp, S. pombe
gtcgtcattactgatcgtctccatg

SEQ ID NO: 100450 - DNA, 25 bp, S. pombe
gtcctatgatgatgcctggttccgt

SEQ ID NO: 100451 - DNA, 25 bp, S. pombe
gtctggcagaactaaattttcggca

SEQ ID NO: 100452 - DNA, 25 bp, S. pombe
gtcggctaactacactaatcgcgtt

SEQ ID NO: 100453 - DNA, 25 bp, S. pombe
gtcgtgctttccacaaataccgtgt

SEQ ID NO: 100454 - DNA, 25 bp, S. pombe
gtgccggtcctcttcaaaaagtggt

SEQ ID NO: 100455 - DNA, 25 bp, S. pombe
gtcgtttccatcttctaccaattga

SEQ ID NO: 100456 - DNA, 25 bp, S. pombe
gtctgataaccatcgatgccgagca

SEQ ID NO: 100457 - DNA, 25 bp, S. pombe
gtctaacccttccatcaataattca

SEQ ID NO: 100458 - DNA, 25 bp, S. pombe
gtctcacataccataccgaaattca

SEQ ID NO: 100459 - DNA, 25 bp, S. pombe
gtccacagagtcacccaatacaaga

SEQ ID NO: 100460 - DNA, 25 bp, S. pombe
gtcctggccgtttagatcgaaaaat

SEQ ID NO: 100461 - DNA, 25 bp, S. pombe
gtcctgcgtcgagcaatgttgaaca

SEQ ID NO: 100462 - DNA, 25 bp, S. pombe
gtccgcgacttttatgctcttaatt

SEQ ID NO: 100463 - DNA, 25 bp, S. pombe
gtctcagcccttgttatttatgatt

SEQ ID NO: 100464 - DNA, 25 bp, S. pombe
gtctccctataacttactttcattc

SEQ ID NO: 100465 - DNA, 25 bp, S. pombe
gtctgcaactgaaagtattcccgat

SEQ ID NO: 100466 - DNA, 25 bp, S. pombe
gtcgaataatcccacatgctacatt

SEQ ID NO: 100467 - DNA, 25 bp, S. pombe
gtcgcaactctacctctgaagattt

SEQ ID NO: 100468 - DNA, 25 bp, S. pombe
gtctccgactgttggtactatagct

SEQ ID NO: 100469 - DNA, 25 bp, S. pombe
gtctctggacgtttgctttttgcta

SEQ ID NO: 100470 - DNA, 25 bp, S. pombe
gtctgggcaggtttcttctttgaaa

SEQ ID NO: 100471 - DNA, 25 bp, S. pombe
gtcgcaaaacgcacaatggaatctc

SEQ ID NO: 100472 - DNA, 25 bp, S. pombe
gtccgagacacgattggtacttaca

SEQ ID NO: 100473 - DNA, 25 bp, S. pombe
gtctcgtaatctttccacagtcaat

SEQ ID NO: 100474 - DNA, 25 bp, S. pombe
gtctcttaatgctgctcctaataca

SEQ ID NO: 100475 - DNA, 25 bp, S. pombe
gtcccggtgatactttaatccctat

SEQ ID NO: 100476 - DNA, 25 bp, S. pombe
tgcccgagggtaccattatttccaa

SEQ ID NO: 100477 - DNA, 25 bp, S. pombe
gtctccgaatactttcatttgctga

SEQ ID NO: 100478 - DNA, 25 bp, S. pombe
gtctgtcgttcaggtactatctacc

SEQ ID NO: 100479 - DNA, 25 bp, S. pombe
gtcgttgcattctctttatgctaca

SEQ ID NO: 100480 - DNA, 25 bp, S. pombe
gtctgtccttgactctgaattgcaa

SEQ ID NO: 100481 - DNA, 25 bp, S. pombe
gtcgcttctggaggcgctgataaag

SEQ ID NO: 100482 - DNA, 25 bp, S. pombe
gtcgctcactgcaaggtcggtaagg

SEQ ID NO: 100483 - DNA, 25 bp, S. pombe
gtccagctagaagacgcgatcgtta

SEQ ID NO: 100484 - DNA, 25 bp, S. pombe
gtctctcctcaattgtccgatagaa

SEQ ID NO: 100485 - DNA, 25 bp, S. pombe
gtctgccatgagtgctgctgatgac

SEQ ID NO: 100486 - DNA, 25 bp, S. pombe
gtctcctgatgatgtctcaaggctt

SEQ ID NO: 100487 - DNA, 25 bp, S. pombe
gtgctacgtgggatacagtctctgc

SEQ ID NO: 100488 - DNA, 25 bp, S. pombe
gtccgtgctgttctaaaacgcgatt

SEQ ID NO: 100489 - DNA, 25 bp, S. pombe
gtccgtggtggttacaaagctgcca

SEQ ID NO: 100490 - DNA, 25 bp, S. pombe
gtctcgtcgcggttacacaatcgaa

SEQ ID NO: 100491 - DNA, 25 bp, S. pombe
gtctctcatcctggtgaaccttcga

SEQ ID NO: 100492 - DNA, 25 bp, S. pombe
gtctgccttgctaaactctggaaat

SEQ ID NO: 100493 - DNA, 25 bp, S. pombe
gtctctcaaggaacacgctggtata

SEQ ID NO: 100494 - DNA, 25 bp, S. pombe
gtctctatgaggttgctcgtttcaa

SEQ ID NO: 100495 - DNA, 25 bp, S. pombe
gtctcctagtatctcagtcactcaa

SEQ ID NO: 100496 - DNA, 25 bp, S. pombe
gtctctcaagtggttctctatgcta

SEQ ID NO: 100497 - DNA, 25 bp, S. pombe
gtcgctctagacgttctttgtattc

SEQ ID NO: 100498 - DNA, 25 bp, S. pombe
gtctgctcaacagttttatggtgat

SEQ ID NO: 100499 - DNA, 25 bp, S. pombe
gtctgctacacttttatgggatcct

SEQ ID NO: 100500 - DNA, 25 bp, S. pombe
gtcgcgaatctggtgttcacgcaga

SEQ ID NO: 100501 - DNA, 25 bp, S. pombe
gtcgcgcatattcagctaaccgatg

SEQ ID NO: 100502 - DNA, 25 bp, S. pombe
gtcgcctttccacaagactgcgtaa

SEQ ID NO: 100503 - DNA, 25 bp, S. pombe
gtctccgagcccattagtgcagaag

SEQ ID NO: 100504 - DNA, 25 bp, S. pombe
gtccctgaatcctcaaggtgcttta

SEQ ID NO: 100505 - DNA, 25 bp, S. pombe
gtcccaagactttaactcctgtata

SEQ ID NO: 100506 - DNA, 25 bp, S. pombe
gtcgcttgaaggacctcagcaacat

SEQ ID NO: 100507 - DNA, 25 bp, S. pombe
gtcgtgcagactattcggaatcaga

SEQ ID NO: 100508 - DNA, 25 bp, S. pombe
gtcgtctcgacaattcctgcagata

SEQ ID NO: 100509 - DNA, 25 bp, S. pombe
gtctgcgttacacttcctgatgata

SEQ ID NO: 100510 - DNA, 25 bp, S. pombe
gtctgcgtacccatgactggtgaac

SEQ ID NO: 100511 - DNA, 25 bp, S. pombe
gtctgcctatgctgtatttttatca

SEQ ID NO: 100512 - DNA, 25 bp, S. pombe
gtctcctgctgatgttcctaataat

SEQ ID NO: 100513 - DNA, 25 bp, S. pombe
gtctccttcttatcactttgtttaa

SEQ ID NO: 100514 - DNA, 25 bp, S. pombe
gtcgtcctctgataccatttttaga

SEQ ID NO: 100515 - DNA, 25 bp, S. pombe
gtccactcctaagccatttaattcg

SEQ ID NO: 100516 - DNA, 25 bp, S. pombe
gtcgaaaggtccctgttacgcatac

SEQ ID NO: 100517 - DNA, 25 bp, S. pombe
gtctcgacagcccttctattaggaa

SEQ ID NO: 100518 - DNA, 25 bp, S. pombe
gtgcctcccagttacttttggaaag

SEQ ID NO: 100519 - DNA, 25 bp, S. pombe
gtcccattacttgtccttggtgaag

SEQ ID NO: 100520 - DNA, 25 bp, S. pombe
gtcccttcaccggaccatatgaaaa

SEQ ID NO: 100521 - DNA, 25 bp, S. pombe
gtctgccacttctatttttgtatcg

SEQ ID NO: 100522 - DNA, 25 bp, S. pombe
gtcggctctttacttattgctcata

SEQ ID NO: 100523 - DNA, 25 bp, S. pombe
gtcgcggtcgctttttacaaaggct

SEQ ID NO: 100524 - DNA, 25 bp, S. pombe
gtcctttccgtccttgaaaagcatt

SEQ ID NO: 100525 - DNA, 25 bp, S. pombe
gtcgcttactgtccggaaaagcatt

SEQ ID NO: 100526 - DNA, 25 bp, S. pombe
gtctgcctttaatgcaagtgcctca

SEQ ID NO: 100527 - DNA, 25 bp, S. pombe
gtccttggacgccataattgcttca

SEQ ID NO: 100528 - DNA, 25 bp, S. pombe
gtcgctctttggcatgacatcagtt

SEQ ID NO: 100529 - DNA, 25 bp, S. pombe
gtctgctctttatttacatctgctt

SEQ ID NO: 100530 - DNA, 25 bp, S. pombe
gtcccgtcaagttgatgcatctgca

SEQ ID NO: 100531 - DNA, 25 bp, S. pombe
gtcctgaatgggtagatgcgctcat

SEQ ID NO: 100532 - DNA, 25 bp, S. pombe
gtgccaactgatccattgccaaatt

SEQ ID NO: 100533 - DNA, 25 bp, S. pombe
gtccatactttgtcgcacaacttgg

SEQ ID NO: 100534 - DNA, 25 bp, S. pombe
gtctccacattttcgtatcactagt

SEQ ID NO: 100535 - DNA, 25 bp, S. pombe
gtcgattcattttttccatccaatt

SEQ ID NO: 100536 - DNA, 25 bp, S. pombe
gtcgttacttaaaggtgccacatac

SEQ ID NO: 100537 - DNA, 25 bp, S. pombe
gtcggttctacaaagttggcagcgt

SEQ ID NO: 100538 - DNA, 25 bp, S. pombe
gtcgcttttactgaattggcaccgc

SEQ ID NO: 100539 - DNA, 25 bp, S. pombe
gtcccttccatgattgatttccgca

SEQ ID NO: 100540 - DNA, 25 bp, S. pombe
gtcgcgcttttgagttttccacatt

SEQ ID NO: 100541 - DNA, 25 bp, S. pombe
gtcggatcgtttcttttgacacacc

SEQ ID NO: 100542 - DNA, 25 bp, S. pombe
gtcgttcccttagttcttgatcaaa

SEQ ID NO: 100543 - DNA, 25 bp, S. pombe
gtcgttacgctaacattgtttgcaa

SEQ ID NO: 100544 - DNA, 25 bp, S. pombe
gtcggtcctgtaactggaatgttta

SEQ ID NO: 100545 - DNA, 25 bp, S. pombe
gtctgcgtctgttagagggaattct

SEQ ID NO: 100546 - DNA, 25 bp, S. pombe
gtcggtctttttcgtcaaatgctga

SEQ ID NO: 100547 - DNA, 25 bp, S. pombe
gtcccctttttgattcttggcaata

SEQ ID NO: 100548 - DNA, 25 bp, S. pombe
gtctgaccctttatgttctatccaa

SEQ ID NO: 100549 - DNA, 25 bp, S. pombe
gtcgacactttgcatatgtttacca

SEQ ID NO: 100550 - DNA, 25 bp, S. pombe
gtcgaattggcttgggatgctcccg

SEQ ID NO: 100551 - DNA, 25 bp, S. pombe
gtcgcaatcgcgataggactatccg

SEQ ID NO: 100552 - DNA, 25 bp, S. pombe
gtcgactgcgtttcggattacacaa

SEQ ID NO: 100553 - DNA, 25 bp, S. pombe
gtcgacgtggtcttggtatacatta

SEQ ID NO: 100554 - DNA, 25 bp, S. pombe
gtcggccattactttttatcactag

SEQ ID NO: 100555 - DNA, 25 bp, S. pombe
gtctgctctcattaaagtttgtaaa

SEQ ID NO: 100556 - DNA, 25 bp, S. pombe
gtctgcttgtcttactgtttggaac

SEQ ID NO: 100557 - DNA, 25 bp, S. pombe
gtctgcgtctcatttcgttgaggaa

SEQ ID NO: 100558 - DNA, 25 bp, S. pombe
gtctggtgctctatcaatggcggta

SEQ ID NO: 100559 - DNA, 25 bp, S. pombe
gtcgccatgttccacgttggattag

SEQ ID NO: 100560 - DNA, 25 bp, S. pombe
gtcctagtcttatgtcgcgctatag

SEQ ID NO: 100561 - DNA, 25 bp, S. pombe
gtcccatatcttttcctgtaatcag

SEQ ID NO: 100562 - DNA, 25 bp, S. pombe
gtcggattgttagtgcctgccaaga

SEQ ID NO: 100563 - DNA, 25 bp, S. pombe
gtcggattgctacgttactaggcca

SEQ ID NO: 100564 - DNA, 25 bp, S. pombe
gtcggagcattttgacatgcctaaa

SEQ ID NO: 100565 - DNA, 25 bp, S. pombe
gtcggcgattcttccatgtatacga

SEQ ID NO: 100566 - DNA, 25 bp, S. pombe
gtcggcgtcgacaactgctgaacaa

SEQ ID NO: 100567 - DNA, 25 bp, S. pombe
gtcgagcgccaggaattcttagcaa

SEQ ID NO: 100568 - DNA, 25 bp, S. pombe
gtcgatgcgtcgaaatatcctcata

SEQ ID NO: 100569 - DNA, 25 bp, S. pombe
gtcctcgtcgtctaattgtcgaatt

SEQ ID NO: 100570 - DNA, 25 bp, S. pombe
gtcgccattcgtggaaattccgtta

SEQ ID NO: 100571 - DNA, 25 bp, S. pombe
gtcgccattcgtattttcgtactag

SEQ ID NO: 100572 - DNA, 25 bp, S. pombe
gtcctacggttcgaggtacagctat

SEQ ID NO: 100573 - DNA, 25 bp, S. pombe
gtctgcaactcctcaagctattaat

SEQ ID NO: 100574 - DNA, 25 bp, S. pombe
gtcggaatttcctagctttatcgaa

SEQ ID NO: 100575 - DNA, 25 bp, S. pombe
gtcgggtcggctgtttgtcaaatag

SEQ ID NO: 100576 - DNA, 25 bp, S. pombe
gtcggttctcgtgctttatatcata

SEQ ID NO: 100577 - DNA, 25 bp, S. pombe
gtcgttcctcgcacagatgtaatca

SEQ ID NO: 100578 - DNA, 25 bp, S. pombe
gtcgttcatcctccactatttatga

SEQ ID NO: 100579 - DNA, 25 bp, S. pombe
gtcgcattgctcaccaatttgtgga

SEQ ID NO: 100580 - DNA, 25 bp, S. pombe
gtccccgttctacttatagcgaaca

SEQ ID NO: 100581 - DNA, 25 bp, S. pombe
gtccttagtggtggtaatccgcgaa

SEQ ID NO: 100582 - DNA, 25 bp, S. pombe
gtcctcttgtttacgagtccggata

SEQ ID NO: 100583 - DNA, 25 bp, S. pombe
gtcgcctttcttccgaagtaggatg

SEQ ID NO: 100584 - DNA, 25 bp, S. pombe
gtgtccaacccgctgaaagcgatgt

SEQ ID NO: 100585 - DNA, 25 bp, S. pombe
gtcctcctaatatctatcaacgtct

SEQ ID NO: 100586 - DNA, 25 bp, S. pombe
gtcctggtcgtctcgataagctgat

SEQ ID NO: 100587 - DNA, 25 bp, S. pombe
gtccgcaggagttccgattcctaaa

SEQ ID NO: 100588 - DNA, 25 bp, S. pombe
gtcccgggatgcagagttagacatt

SEQ ID NO: 100589 - DNA, 25 bp, S. pombe
gtcctgcaaggtcaactgttactat

SEQ ID NO: 100590 - DNA, 25 bp, S. pombe
gtcgatggcggttatacttgtcttt

SEQ ID NO: 100591 - DNA, 25 bp, S. pombe
gtcggtcgtgttcatcgtttgttgc

SEQ ID NO: 100592 - DNA, 25 bp, S. pombe
gtcggtcgtattctcgatttctaca

SEQ ID NO: 100593 - DNA, 25 bp, S. pombe
gtcgtacggattctcgtttcaacaa

SEQ ID NO: 100594 - DNA, 25 bp, S. pombe
gtcgttctaattcttttagccctat

SEQ ID NO: 100595 - DNA, 25 bp, S. pombe
gtcgttctaaatcttcttctctttc

SEQ ID NO: 100596 - DNA, 25 bp, S. pombe
gtcgtatctgaagctactcgtctta

SEQ ID NO: 100597 - DNA, 25 bp, S. pombe
gtctggcaaacaaaagatcgcttct

SEQ ID NO: 100598 - DNA, 25 bp, S. pombe
gtctggacaccttgatcgaagttta

SEQ ID NO: 100599 - DNA, 25 bp, S. pombe
gtccagacatgcaatcgacggatct

SEQ ID NO: 100600 - DNA, 25 bp, S. pombe
gtcccgactgattcaacgttgactg

SEQ ID NO: 100601 - DNA, 25 bp, S. pombe
gtccgctttttccaggtgcatgaat

SEQ ID NO: 100602 - DNA, 25 bp, S. pombe
gtcgcgcgtatcatgaaatcggcac

SEQ ID NO: 100603 - DNA, 25 bp, S. pombe
gtcgcccttttattctcaggcatga

SEQ ID NO: 100604 - DNA, 25 bp, S. pombe
gtcggtgttttatccacatgctggc

SEQ ID NO: 100605 - DNA, 25 bp, S. pombe
gtcggtgtggttatagcagcgttca

SEQ ID NO: 100606 - DNA, 25 bp, S. pombe
gtcgaggtgttttctatgtctgtac

SEQ ID NO: 100607 - DNA, 25 bp, S. pombe
gtcgactgttggaatttttggcatc

SEQ ID NO: 100608 - DNA, 25 bp, S. pombe
gtcgacagacgattcaccttataaa

SEQ ID NO: 100609 - DNA, 25 bp, S. pombe
gtcgttctttcagctttgtatctaa

SEQ ID NO: 100610 - DNA, 25 bp, S. pombe
gtcgtttgtcatggactgtccttta

SEQ ID NO: 100611 - DNA, 25 bp, S. pombe
gtcgtatagttttaccgcagctgct

SEQ ID NO: 100612 - DNA, 25 bp, S. pombe
gtgttgaaaagtcatcggtccctaa

SEQ ID NO: 100613 - DNA, 25 bp, S. pombe
gtcgttggtgactttgattcgttaa

SEQ ID NO: 100614 - DNA, 25 bp, S. pombe
gtcgtccgtgacattcttggtaaat

SEQ ID NO: 100615 - DNA, 25 bp, S. pombe
gtgcgcaccacttgctgaatttgga

SEQ ID NO: 100616 - DNA, 25 bp, S. pombe
gtcgcggaacctcttgatttggtga

SEQ ID NO: 100617 - DNA, 25 bp, S. pombe
gtcgaggagaccagtaagctttatg

SEQ ID NO: 100618 - DNA, 25 bp, S. pombe
gtccaggaccctgaacaatgttcat

SEQ ID NO: 100619 - DNA, 25 bp, S. pombe
gtccgctaacgggagagtctatgtc

SEQ ID NO: 100620 - DNA, 25 bp, S. pombe
tgtcaaaggttgtagcccctggttc

SEQ ID NO: 100621 - DNA, 25 bp, S. pombe
gtcgaaagttgctagcgctgctgga

SEQ ID NO: 100622 - DNA, 25 bp, S. pombe
gtcgcatcgatttctattgcttgca

SEQ ID NO: 100623 - DNA, 25 bp, S. pombe
gtcgcaggtgctacgtctattgaag

SEQ ID NO: 100624 - DNA, 25 bp, S. pombe
gtcgtggtattcctcttggtcaagc

SEQ ID NO: 100625 - DNA, 25 bp, S. pombe
gtcgtggttccgcatgtgttgaaac

SEQ ID NO: 100626 - DNA, 25 bp, S. pombe
gtcctaagtctttctctactgaagc

SEQ ID NO: 100627 - DNA, 25 bp, S. pombe
gtccccagtttcctgatacattagt

SEQ ID NO: 100628 - DNA, 25 bp, S. pombe
gtcgaagcagtttcctctacattaa

SEQ ID NO: 100629 - DNA, 25 bp, S. pombe
gtcgcacagttttgcaactttcgca

SEQ ID NO: 100630 - DNA, 25 bp, S. pombe
gtcggtcctttatcatttcgcaaga

SEQ ID NO: 100631 - DNA, 25 bp, S. pombe
gtcgttcttttctcagctttgacta

SEQ ID NO: 100632 - DNA, 25 bp, S. pombe
gtcgttgcttataccaccaagtgta

SEQ ID NO: 100633 - DNA, 25 bp, S. pombe
gtcgaagtatccaagcccgaagtat

SEQ ID NO: 100634 - DNA, 25 bp, S. pombe
gtcgaagttcccttacgcaacattc

SEQ ID NO: 100635 - DNA, 25 bp, S. pombe
gtcgcggtattcaacttgttcacat

SEQ ID NO: 100636 - DNA, 25 bp, S. pombe
gtcgggcgattggaatattacagtt

SEQ ID NO: 100637 - DNA, 25 bp, S. pombe
gtgcggtgctcttggtttaaattta

SEQ ID NO: 100638 - DNA, 25 bp, S. pombe
gtcgtgttacgagcgttgttgcagt

SEQ ID NO: 100639 - DNA, 25 bp, S. pombe
gtcgctgattactactctgtgtttg

SEQ ID NO: 100640 - DNA, 25 bp, S. pombe
gtcgtcaacgctggcaacaagcctg

SEQ ID NO: 100641 - DNA, 25 bp, S. pombe
gtcgtcaacgctggcaacaagcctg

SEQ ID NO: 100642 - DNA, 25 bp, S. pombe
gtcgtcgtcttgcatacaacactcg

SEQ ID NO: 100643 - DNA, 25 bp, S. pombe
gtcgtcgtctcggtttaatccgcaa

SEQ ID NO: 100644 - DNA, 25 bp, S. pombe
gtggatgcgttatgccgaagccttg

SEQ ID NO: 100645 - DNA, 25 bp, S. pombe
gtccgcgagaaccattcaaacttgt

SEQ ID NO: 100646 - DNA, 25 bp, S. pombe
gtgtcggttaatcctcgaagactcg

SEQ ID NO: 100647 - DNA, 25 bp, S. pombe
gtgccttattgggactgcggaaatt

SEQ ID NO: 100648 - DNA, 25 bp, S. pombe
gtcgagttttgtactcctgaacttt

SEQ ID NO: 100649 - DNA, 25 bp, S. pombe
gtccgttccggtagcatctatcaaa

SEQ ID NO: 100650 - DNA, 25 bp, S. pombe
gtcgaagctttgaaatccctaggta

SEQ ID NO: 100651 - DNA, 25 bp, S. pombe
gtccaacttggtatcaacggctgtt

SEQ ID NO: 100652 - DNA, 25 bp, S. pombe
gtcgcacagacgaagttttccctat

SEQ ID NO: 100653 - DNA, 25 bp, S. pombe
gtgcctacccgggatacaatacgac

SEQ ID NO: 100654 - DNA, 25 bp, S. pombe
gtcgacctccttgtactactaagaa

SEQ ID NO: 100655 - DNA, 25 bp, S. pombe
gtcgtttccgtggtactatttcaat

SEQ ID NO: 100656 - DNA, 25 bp, S. pombe
gtcgtttctgcctgtttactatatt

SEQ ID NO: 100657 - DNA, 25 bp, S. pombe
gtcgttctcacttcggttacattta

SEQ ID NO: 100658 - DNA, 25 bp, S. pombe
gtccccagcaattcgatgttttagt

SEQ ID NO: 100659 - DNA, 25 bp, S. pombe
gtcgtgccggacctaattatcaaga

SEQ ID NO: 100660 - DNA, 25 bp, S. pombe
gtcctgcactttggcttactgatta

SEQ ID NO: 100661 - DNA, 25 bp, S. pombe
gtcgatccactattgaaggtctcaa

SEQ ID NO: 100662 - DNA, 25 bp, S. pombe
gtcgataatcactatggcggtcttg

SEQ ID NO: 100663 - DNA, 25 bp, S. pombe
gtgcgagatgcttgaaccgggaaat

SEQ ID NO: 100664 - DNA, 25 bp, S. pombe
gtccacctgccaaacgcgtaaatta

SEQ ID NO: 100665 - DNA, 25 bp, S. pombe
gtccgtgcattaaagcctgttgaat

SEQ ID NO: 100666 - DNA, 25 bp, S. pombe
gtcgcatcaatgttcataccgcaga

SEQ ID NO: 100667 - DNA, 25 bp, S. pombe
gtcgctgagccattagagtctcgca

SEQ ID NO: 100668 - DNA, 25 bp, S. pombe
gtcgctgacggcaaggtctgcaagt

SEQ ID NO: 100669 - DNA, 25 bp, S. pombe
tgatctaatgccagacagtccggta

SEQ ID NO: 100670 - DNA, 25 bp, S. pombe
gtccagcatcaaaaaagcccgtatt

SEQ ID NO: 100671 - DNA, 25 bp, S. pombe
gtcgtattcatccttcatgaccagg

SEQ ID NO: 100672 - DNA, 25 bp, S. pombe
gtcgagttgcttttcatccaagtgg

SEQ ID NO: 100673 - DNA, 25 bp, S. pombe
gtccagtggttctcaactaggcagt

SEQ ID NO: 100674 - DNA, 25 bp, S. pombe
gtcgcattccattcaactacaaaag

SEQ ID NO: 100675 - DNA, 25 bp, S. pombe
gtcgcctcaaattacccagcaaaga

SEQ ID NO: 100676 - DNA, 25 bp, S. pombe
gtcccgactacatctctgcagaaaa

SEQ ID NO: 100677 - DNA, 25 bp, S. pombe
gtcccaggcgactttccaatcagaa

SEQ ID NO: 100678 - DNA, 25 bp, S. pombe
gtcctcgtggtactctcaagcaaaa

SEQ ID NO: 100679 - DNA, 25 bp, S. pombe
gtgcgagtagaacacttaccacctg

SEQ ID NO: 100680 - DNA, 25 bp, S. pombe
gtcgatgagacctttgctaacaacc

SEQ ID NO: 100681 - DNA, 25 bp, S. pombe
gtcgaggacacatggctaggctata

SEQ ID NO: 100682 - DNA, 25 bp, S. pombe
gtcgaaggctcacgaagaggctcaa

SEQ ID NO: 100683 - DNA, 25 bp, S. pombe
gtcgtttatgtcgttgatggctaat

SEQ ID NO: 100684 - DNA, 25 bp, S. pombe
gtgcgtttgctggacttgatactac

SEQ ID NO: 100685 - DNA, 25 bp, S. pombe
tcctaccgactctacccgtagaaag

SEQ ID NO: 100686 - DNA, 25 bp, S. pombe
gtcccattgaatactggccattgga

SEQ ID NO: 100687 - DNA, 25 bp, S. pombe
gtcgccgtgatctcaccaaggaata

SEQ ID NO: 100688 - DNA, 25 bp, S. pombe
gtcgacagttccctctgattacaat

SEQ ID NO: 100689 - DNA, 25 bp, S. pombe
gtcgaccgatacctaattcacagaa

SEQ ID NO: 100690 - DNA, 25 bp, S. pombe
gtgctctccggtgtaactcaagaca

SEQ ID NO: 100691 - DNA, 25 bp, S. pombe
gtcctcttgagtgtgctaccgagac

SEQ ID NO: 100692 - DNA, 25 bp, S. pombe
gtcccattagtgctgtccgtatgag

SEQ ID NO: 100693 - DNA, 25 bp, S. pombe
gtcctgcactttctgagcgcaatga

SEQ ID NO: 100694 - DNA, 25 bp, S. pombe
gtgcccagtcttgctggtggtaaaa

SEQ ID NO: 100695 - DNA, 25 bp, S. pombe
gtcccgctggtgtctttgagtttga

SEQ ID NO: 100696 - DNA, 25 bp, S. pombe
gtcgcaaagtcaccggtcactgtta

SEQ ID NO: 100697 - DNA, 25 bp, S. pombe
gtcgatgaagtctaatcctgatctg

SEQ ID NO: 100698 - DNA, 25 bp, S. pombe
gtcgatgcatgtaatagccctattc

SEQ ID NO: 100699 - DNA, 25 bp, S. pombe
gtcgctttttagctatgatgcctca

SEQ ID NO: 100700 - DNA, 25 bp, S. pombe
gtcgctcttattctgctcatgatat

SEQ ID NO: 100701 - DNA, 25 bp, S. pombe
gtcgataatcttcatgctgccattt

SEQ ID NO: 100702 - DNA, 25 bp, S. pombe
gtcgccgtattcgtgaggctactga

SEQ ID NO: 100703 - DNA, 25 bp, S. pombe
gtcctctttatcgagaactgccatg

SEQ ID NO: 100704 - DNA, 25 bp, S. pombe
gtgccattcgttgattcggctcatg

SEQ ID NO: 100705 - DNA, 25 bp, S. pombe
gtgccattcgtgaagaagcccttgc

SEQ ID NO: 100706 - DNA, 25 bp, S. pombe
gtccttgagtgcgaaatccttgtct

SEQ ID NO: 100707 - DNA, 25 bp, S. pombe
gtcgctggtgccgataagtttgccg

SEQ ID NO: 100708 - DNA, 25 bp, S. pombe
gtccgcggtgctaatggctttggaa

SEQ ID NO: 100709 - DNA, 25 bp, S. pombe
gtccaggtggctgcgaactatctga

SEQ ID NO: 100710 - DNA, 25 bp, S. pombe
gtgctctttttctttacgaaatggg

SEQ ID NO: 100711 - DNA, 25 bp, S. pombe
gtccttttacagcttcctgaaactg

SEQ ID NO: 100712 - DNA, 25 bp, S. pombe
gtcccatttccgttactgctgaaga

SEQ ID NO: 100713 - DNA, 25 bp, S. pombe
gtgcctggtctacagattcacgatt

SEQ ID NO: 100714 - DNA, 25 bp, S. pombe
gtccgtttcatctaatttctcagtt

SEQ ID NO: 100715 - DNA, 25 bp, S. pombe
gtcgccttagcattagctccaaaat

SEQ ID NO: 100716 - DNA, 25 bp, S. pombe
gtcgacattgatccaagcgccaaat

SEQ ID NO: 100717 - DNA, 25 bp, S. pombe
gtcgagcacgctgacgcacgaaaaa

SEQ ID NO: 100718 - DNA, 25 bp, S. pombe
gtccgggttatatctgcgtttacag

SEQ ID NO: 100719 - DNA, 25 bp, S. pombe
gtgctcgatcaatataccggtagtt

SEQ ID NO: 100720 - DNA, 25 bp, S. pombe
gtgctcgtaaggtacaacgtttctt

SEQ ID NO: 100721 - DNA, 25 bp, S. pombe
gtccgtcaacgatactcagtcaatc

SEQ ID NO: 100722 - DNA, 25 bp, S. pombe
gggaaaacttcgtgctatcggcgtt

SEQ ID NO: 100723 - DNA, 25 bp, S. pombe
ggtgataagggctatgcccctgctc

SEQ ID NO: 100724 - DNA, 25 bp, S. pombe
gtgccaaaaattctcgctcctataa

SEQ ID NO: 100725 - DNA, 25 bp, S. pombe
gtgccatcgaacatacattacccag

SEQ ID NO: 100726 - DNA, 25 bp, S. pombe
gtcgctcagtgggatgaacgctaca

SEQ ID NO: 100727 - DNA, 25 bp, S. pombe
gtcgcattgcgtgcacaacagctaa

SEQ ID NO: 100728 - DNA, 25 bp, S. pombe
gtcgctatcatgcaactacattcaa

SEQ ID NO: 100729 - DNA, 25 bp, S. pombe
gtccttctgctgtccttttagataa

SEQ ID NO: 100730 - DNA, 25 bp, S. pombe
gtcgcaagcgttttctttccagaat

SEQ ID NO: 100731 - DNA, 25 bp, S. pombe
gtcgcgtccaatctctagagcgtga

SEQ ID NO: 100732 - DNA, 25 bp, S. pombe
gtgccgatcgtctagttggtcaagt

SEQ ID NO: 100733 - DNA, 25 bp, S. pombe
gtgctcccgactcttggacaaattg

SEQ ID NO: 100734 - DNA, 25 bp, S. pombe
gtgctctccggtctgctgaaagaag

SEQ ID NO: 100735 - DNA, 25 bp, S. pombe
gtgctcttgaggcttggaacatgaa

SEQ ID NO: 100736 - DNA, 25 bp, S. pombe
gtcctcctcgtgaacaatggtcata

SEQ ID NO: 100737 - DNA, 25 bp, S. pombe
gtgctcgttcgggatataaggctag

SEQ ID NO: 100738 - DNA, 25 bp, S. pombe
gtcgaatttcaagcaatcctctacc

SEQ ID NO: 100739 - DNA, 25 bp, S. pombe
gtcgaattcatggatgacacatccc

SEQ ID NO: 100740 - DNA, 25 bp, S. pombe
gtcgaacaacaatacgctcaacaag

SEQ ID NO: 100741 - DNA, 25 bp, S. pombe
gtcgaacactatgaaactctgcaca

SEQ ID NO: 100742 - DNA, 25 bp, S. pombe
ggatttactaattttcgtcgccgca

SEQ ID NO: 100743 - DNA, 25 bp, S. pombe
ggtcttacttttatcctcaggattc

SEQ ID NO: 100744 - DNA, 25 bp, S. pombe
gtcccatccgttaattcgatcattg

SEQ ID NO: 100745 - DNA, 25 bp, S. pombe
gtccaacggtattactcatctcttg

SEQ ID NO: 100746 - DNA, 25 bp, S. pombe
gtccgccatcgctacaaggaatatt

SEQ ID NO: 100747 - DNA, 25 bp, S. pombe
gtccgcgtcccatgagtaattattg

SEQ ID NO: 100748 - DNA, 25 bp, S. pombe
gtcctgggcctgtcagcgtaatcaa

SEQ ID NO: 100749 - DNA, 25 bp, S. pombe
gtccgctctcggtttgagcaagaga

SEQ ID NO: 100750 - DNA, 25 bp, S. pombe
gtcctctgcagctgcgttagcaaaa

SEQ ID NO: 100751 - DNA, 25 bp, S. pombe
gtcgctcgaaacttatcattactgt

SEQ ID NO: 100752 - DNA, 25 bp, S. pombe
gtgctgcccaatttattacggcggt

SEQ ID NO: 100753 - DNA, 25 bp, S. pombe
gtccatcgaagctcttacagcagtt

SEQ ID NO: 100754 - DNA, 25 bp, S. pombe
gtgccggatacaccttcggacaaga

SEQ ID NO: 100755 - DNA, 25 bp, S. pombe
gtccgtgccatctgcatttggatac

SEQ ID NO: 100756 - DNA, 25 bp, S. pombe
gtcgcaggcacattcagttttcaac

SEQ ID NO: 100757 - DNA, 25 bp, S. pombe
gtcgaacaagcagttcatctccatc

SEQ ID NO: 100758 - DNA, 25 bp, S. pombe
gtcgcaatcaaatcatctccatcat

SEQ ID NO: 100759 - DNA, 25 bp, S. pombe
gtcgcatctgtatataccttttccg

SEQ ID NO: 100760 - DNA, 25 bp, S. pombe
gtccccatctggtgagaaagtttcc

SEQ ID NO: 100761 - DNA, 25 bp, S. pombe
gtcctttgagcaagaccgttcgttt

SEQ ID NO: 100762 - DNA, 25 bp, S. pombe
gtcgctttacatccgtttttgcaaa

SEQ ID NO: 100763 - DNA, 25 bp, S. pombe
gtcctgctacgttgcgaattgtgca

SEQ ID NO: 100764 - DNA, 25 bp, S. pombe
gtccgctctcgtttaacattcaagg

SEQ ID NO: 100765 - DNA, 25 bp, S. pombe
gtcgccgtcgattttagcattcaag

SEQ ID NO: 100766 - DNA, 25 bp, S. pombe
gtgcccttcaggatttattaaacgc

SEQ ID NO: 100767 - DNA, 25 bp, S. pombe
gtccgttgggctactatgattctaa

SEQ ID NO: 100768 - DNA, 25 bp, S. pombe
gtcccattctgcaaagccgcttatg

SEQ ID NO: 100769 - DNA, 25 bp, S. pombe
gtgccactctacaaaccagctaatg

SEQ ID NO: 100770 - DNA, 25 bp, S. pombe
gtcgcaatgcatatgaacgcgctta

SEQ ID NO: 100771 - DNA, 25 bp, S. pombe
gtccgatatgatcgcacccaatata

SEQ ID NO: 100772 - DNA, 25 bp, S. pombe
gtcctttgtcagtccacatagcata

SEQ ID NO: 100773 - DNA, 25 bp, S. pombe
gtcctttgccaagtatctcagacaa

SEQ ID NO: 100774 - DNA, 25 bp, S. pombe
gtcctcgtgacaacaatcgcaacaa

SEQ ID NO: 100775 - DNA, 25 bp, S. pombe
gtcgctgtctcttcaataccgagtt

SEQ ID NO: 100776 - DNA, 25 bp, S. pombe
gtcgccgacaatactatacgcacaa

SEQ ID NO: 100777 - DNA, 25 bp, S. pombe
gtccattattcaatgctctttcgcg

SEQ ID NO: 100778 - DNA, 25 bp, S. pombe
gtcctgtattgtttctttgctctaa

SEQ ID NO: 100779 - DNA, 25 bp, S. pombe
gtccgttgttgctggattctgtaca

SEQ ID NO: 100780 - DNA, 25 bp, S. pombe
gtccgtctttcctacatacttgata

SEQ ID NO: 100781 - DNA, 25 bp, S. pombe
gtccttatcttggtcgtacactatg

SEQ ID NO: 100782 - DNA, 25 bp, S. pombe
gtgcccttttgttggtcaagtatcc

SEQ ID NO: 100783 - DNA, 25 bp, S. pombe
gtcgccgtttgtgcgtatggaacca

SEQ ID NO: 100784 - DNA, 25 bp, S. pombe
gtgctgccgctcagggtgatattga

SEQ ID NO: 100785 - DNA, 25 bp, S. pombe
ggtgcccatgctcgtgaagactatc

SEQ ID NO: 100786 - DNA, 25 bp, S. pombe
gtccttcacagacttacttcaagct

SEQ ID NO: 100787 - DNA, 25 bp, S. pombe
gtcccctatagacgtggatgctcat

SEQ ID NO: 100788 - DNA, 25 bp, S. pombe
gtcctcgctatattggtgaacttaa

SEQ ID NO: 100789 - DNA, 25 bp, S. pombe
gtcctcgtgctatagattttgtgaa

SEQ ID NO: 100790 - DNA, 25 bp, S. pombe
gtccctcatctattaattgcctgta

SEQ ID NO: 100791 - DNA, 25 bp, S. pombe
gtgctgcctgttggtgaaatgcctg

SEQ ID NO: 100792 - DNA, 25 bp, S. pombe
gtccgttgtgatgaatatgctgctg

SEQ ID NO: 100793 - DNA, 25 bp, S. pombe
gtgccgttggaagtatagctcaggt

SEQ ID NO: 100794 - DNA, 25 bp, S. pombe
gtgccgttcctgttcacagtagaga

SEQ ID NO: 100795 - DNA, 25 bp, S. pombe
gtgccatctgtgctggtcgattagt

SEQ ID NO: 100796 - DNA, 25 bp, S. pombe
gtggatcgtcgacatctactagtag

SEQ ID NO: 100797 - DNA, 25 bp, S. pombe
gtccaaggtctgctcattactttta

SEQ ID NO: 100798 - DNA, 25 bp, S. pombe
gtccctggtatgctttctgttttaa

SEQ ID NO: 100799 - DNA, 25 bp, S. pombe
gtgactcttggtactttagcgtttc

SEQ ID NO: 100800 - DNA, 25 bp, S. pombe
gtgctcctcaggtaaactagttggc

SEQ ID NO: 100801 - DNA, 25 bp, S. pombe
gtccgtcgttatgaagcttatgccc

SEQ ID NO: 100802 - DNA, 25 bp, S. pombe
gtcgcgtctctttggaaggagtttc

SEQ ID NO: 100803 - DNA, 25 bp, S. pombe
gtccgagccttgtccaatatgtcaa

SEQ ID NO: 100804 - DNA, 25 bp, S. pombe
gtcccgcaacaaagcaatttttctg

SEQ ID NO: 100805 - DNA, 25 bp, S. pombe
gtcccgctcaaaccattcttgaaaa

SEQ ID NO: 100806 - DNA, 25 bp, S. pombe
gtgctctcagtatcgattccatggc

SEQ ID NO: 100807 - DNA, 25 bp, S. pombe
gtgcaaccaattcgagctttactac

SEQ ID NO: 100808 - DNA, 25 bp, S. pombe
gtgcatgcaccgtattactgtttta

SEQ ID NO: 100809 - DNA, 25 bp, S. pombe
gtgcagcagcaccaatggatccaat

SEQ ID NO: 100810 - DNA, 25 bp, S. pombe
gtgaagaagcagcagccgaaccctc

SEQ ID NO: 100811 - DNA, 25 bp, S. pombe
gtgacgcgggaattcaaacctctga

SEQ ID NO: 100812 - DNA, 25 bp, S. pombe
gtgccacttattccaatagtccgag

SEQ ID NO: 100813 - DNA, 25 bp, S. pombe
gtcctgcgccaatgactgattattg

SEQ ID NO: 100814 - DNA, 25 bp, S. pombe
gtccggagcaacttcgtattcaata

SEQ ID NO: 100815 - DNA, 25 bp, S. pombe
gtccgccaggagctcgtaacaaaat

SEQ ID NO: 100816 - DNA, 25 bp, S. pombe
ggtttgccggcacacacgaaaaata

SEQ ID NO: 100817 - DNA, 25 bp, S. pombe
gggcaatactaaaatctccccttat

SEQ ID NO: 100818 - DNA, 25 bp, S. pombe
gtccggttttatcgcgccgtatata

SEQ ID NO: 100819 - DNA, 25 bp, S. pombe
gtccagcaatctttaggcgggttat

SEQ ID NO: 100820 - DNA, 25 bp, S. pombe
gtgcaacttttgaggcggaaatttc

SEQ ID NO: 100821 - DNA, 25 bp, S. pombe
ggtacctttggacgctggaacgctt

SEQ ID NO: 100822 - DNA, 25 bp, S. pombe
gtgcgatctgcaactattttaccta

SEQ ID NO: 100823 - DNA, 25 bp, S. pombe
gtgcgttgcattcatttcaaccata

SEQ ID NO: 100824 - DNA, 25 bp, S. pombe
gtgccttgattactttagcctgcta

SEQ ID NO: 100825 - DNA, 25 bp, S. pombe
gtgccattgagtttttacttcgaca

SEQ ID NO: 100826 - DNA, 25 bp, S. pombe
gtgcgcagctggtattttgggttta

SEQ ID NO: 100827 - DNA, 25 bp, S. pombe
gtccaggagtccaatatcatgttgt

SEQ ID NO: 100828 - DNA, 25 bp, S. pombe
gtcctgctgacgattcttattttac

SEQ ID NO: 100829 - DNA, 25 bp, S. pombe
gtgcgatcgcgaaacattcttttta

SEQ ID NO: 100830 - DNA, 25 bp, S. pombe
gtgcgactggtatcgccattgttta

SEQ ID NO: 100831 - DNA, 25 bp, S. pombe
gtccactggctattaggctttttga

SEQ ID NO: 100832 - DNA, 25 bp, S. pombe
gtcctcctgtattgatggttcctta

SEQ ID NO: 100833 - DNA, 25 bp, S. pombe
gtgcgccagatttacaagcttcctt

SEQ ID NO: 100834 - DNA, 25 bp, S. pombe
gtgctggtcaacttatccttcgtaa

SEQ ID NO: 100835 - DNA, 25 bp, S. pombe
gtgctggagcaggtcctacttggaa

SEQ ID NO: 100836 - DNA, 25 bp, S. pombe
gtcctcgcattgacttcggagagcg

SEQ ID NO: 100837 - DNA, 25 bp, S. pombe
gtgccaaatgacctcaagtgatgct

SEQ ID NO: 100838 - DNA, 25 bp, S. pombe
gtgccgctcttccacaagttggcaa

SEQ ID NO: 100839 - DNA, 25 bp, S. pombe
gtgctgaagcagctgaagccaagtt

SEQ ID NO: 100840 - DNA, 25 bp, S. pombe
gtgcgcgacatggtatatgctcttg

SEQ ID NO: 100841 - DNA, 25 bp, S. pombe
gtcctgaatgcttgggctcttgtaa

SEQ ID NO: 100842 - DNA, 25 bp, S. pombe
gtccggtcttgcttgcatctttaaa

SEQ ID NO: 100843 - DNA, 25 bp, S. pombe
gtccgtatcgctgtgacttatgcaa

SEQ ID NO: 100844 - DNA, 25 bp, S. pombe
gtgccattgatgctatccctttgaa

SEQ ID NO: 100845 - DNA, 25 bp, S. pombe
gtgccattggcaagctcgttttaag

SEQ ID NO: 100846 - DNA, 25 bp, S. pombe
gtgcaagaattttcactttcgcccc

SEQ ID NO: 100847 - DNA, 25 bp, S. pombe
tgtcgaaaataatctggttgctccc

SEQ ID NO: 100848 - DNA, 25 bp, S. pombe
tctaaacgtcttccaggtatcccag

SEQ ID NO: 100849 - DNA, 25 bp, S. pombe
gtgaattcaaactcagccagccttt

SEQ ID NO: 100850 - DNA, 25 bp, S. pombe
gtcctcgtatccatactgctaagta

SEQ ID NO: 100851 - DNA, 25 bp, S. pombe
gtcctcgtacaaatagcttcatcat

SEQ ID NO: 100852 - DNA, 25 bp, S. pombe
gtccgtcaatagtaagatctcttct

SEQ ID NO: 100853 - DNA, 25 bp, S. pombe
gtgcgcgtagaagaaactcgatttc

SEQ ID NO: 100854 - DNA, 25 bp, S. pombe
tgtcggcggcacaaatactacgttg

SEQ ID NO: 100855 - DNA, 25 bp, S. pombe
gtgctaagtcactacttgcagaact

SEQ ID NO: 100856 - DNA, 25 bp, S. pombe
gtccacgttggctagcgctcagaaa

SEQ ID NO: 100857 - DNA, 25 bp, S. pombe
gtgaccgattgcgagagcccagtag

SEQ ID NO: 100858 - DNA, 25 bp, S. pombe
ggaaggtagtagtcccacttgtgcc

SEQ ID NO: 100859 - DNA, 25 bp, S. pombe
gtgaatcgtcctcttcaagttcaat

SEQ ID NO: 100860 - DNA, 25 bp, S. pombe
gtccgtacataatttacccatcaag

SEQ ID NO: 100861 - DNA, 25 bp, S. pombe
gtgcctttttatttctggtaccata

SEQ ID NO: 100862 - DNA, 25 bp, S. pombe
gtccacaaatgtgtcatctccggaa

SEQ ID NO: 100863 - DNA, 25 bp, S. pombe
gtccactggactgtcattcctaaat

SEQ ID NO: 100864 - DNA, 25 bp, S. pombe
gtccaagtctactgttcactcaata

SEQ ID NO: 100865 - DNA, 25 bp, S. pombe
gtccaacccatcaacttacgaagaa

SEQ ID NO: 100866 - DNA, 25 bp, S. pombe
tgtcgattcgtctccggtaacagaa

SEQ ID NO: 100867 - DNA, 25 bp, S. pombe
gtccttctcctactctgggtaagaa

SEQ ID NO: 100868 - DNA, 25 bp, S. pombe
gtcctcctccaagtctaaatcaaaa

SEQ ID NO: 100869 - DNA, 25 bp, S. pombe
gtcctcctccatcttcaaattataa

SEQ ID NO: 100870 - DNA, 25 bp, S. pombe
gtcctctctactcctgtggaattaa

SEQ ID NO: 100871 - DNA, 25 bp, S. pombe
gtcctcttcactgttttatttgcac

SEQ ID NO: 100872 - DNA, 25 bp, S. pombe
gtcctttcatttggattcttcgctt

SEQ ID NO: 100873 - DNA, 25 bp, S. pombe
gtccttacaccaaattcttcactta

SEQ ID NO: 100874 - DNA, 25 bp, S. pombe
gtgcctatacccctggttataaatt

SEQ ID NO: 100875 - DNA, 25 bp, S. pombe
gtcctatacctcctgttttagatat

SEQ ID NO: 100876 - DNA, 25 bp, S. pombe
gtgcttggagtcaggttgttcgtaa

SEQ ID NO: 100877 - DNA, 25 bp, S. pombe
gtgctctgtatgtgggttttcttta

SEQ ID NO: 100878 - DNA, 25 bp, S. pombe
gtcctatcgtctgttattcttcttt

SEQ ID NO: 100879 - DNA, 25 bp, S. pombe
tactaagccaagcaagcaagcccgc

SEQ ID NO: 100880 - DNA, 25 bp, S. pombe
tatgttagccaacctgaaagtcccc

SEQ ID NO: 100881 - DNA, 25 bp, S. pombe
gtcctaccgagtttggatcttgcaa

SEQ ID NO: 100882 - DNA, 25 bp, S. pombe
gtgctcaaacgaattctggtatcca

SEQ ID NO: 100883 - DNA, 25 bp, S. pombe
gtgccatataggtcacttgggccaa

SEQ ID NO: 100884 - DNA, 25 bp, S. pombe
gtgctgcaacggtaagggctgcaaa

SEQ ID NO: 100885 - DNA, 25 bp, S. pombe
gtgccaacgattctcctatacggga

SEQ ID NO: 100886 - DNA, 25 bp, S. pombe
gtccaagtgtgtgcacctaacggat

SEQ ID NO: 100887 - DNA, 25 bp, S. pombe
gtccatcacatactcattctacaaa

SEQ ID NO: 100888 - DNA, 25 bp, S. pombe
gtgagcctagtccagtgttacgatt

SEQ ID NO: 100889 - DNA, 25 bp, S. pombe
gtgcagatgaacctatgagtacctt

SEQ ID NO: 100890 - DNA, 25 bp, S. pombe
gtgctgatgaatcccatggtaccgg

SEQ ID NO: 100891 - DNA, 25 bp, S. pombe
gtgcgaacagcttctggaacacagt

SEQ ID NO: 100892 - DNA, 25 bp, S. pombe
gtgccaaccatttccaccaaataat

SEQ ID NO: 100893 - DNA, 25 bp, S. pombe
tgtcctaatagatgtacccactcct

SEQ ID NO: 100894 - DNA, 25 bp, S. pombe
gtcctattcatgtttaccaagcttt

SEQ ID NO: 100895 - DNA, 25 bp, S. pombe
gtccaaatcttttagcactactgct

SEQ ID NO: 100896 - DNA, 25 bp, S. pombe
gggcgaggacgagctcactataatg

SEQ ID NO: 100897 - DNA, 25 bp, S. pombe
gggccaacttaggtcatgcttatcg

SEQ ID NO: 100898 - DNA, 25 bp, S. pombe
gtgccgttcccatgaagatctggat

SEQ ID NO: 100899 - DNA, 25 bp, S. pombe
gtgccttcatcagcagtgacagatt

SEQ ID NO: 100900 - DNA, 25 bp, S. pombe
gtgccagtactcttggaggtgtcaa

SEQ ID NO: 100901 - DNA, 25 bp, S. pombe
gtccagttattcttccgtgtatcaa

SEQ ID NO: 100902 - DNA, 25 bp, S. pombe
gtccagcttattgtccttcttaatt

SEQ ID NO: 100903 - DNA, 25 bp, S. pombe
gtccagttaatcttcaccatcttta

SEQ ID NO: 100904 - DNA, 25 bp, S. pombe
gtccagttcaaacgaccatgttgca

SEQ ID NO: 100905 - DNA, 25 bp, S. pombe
gtgcccaaaagacctgccaaatcat

SEQ ID NO: 100906 - DNA, 25 bp, S. pombe
gtgccgtcaaaggtgttcgtcgcaa

SEQ ID NO: 100907 - DNA, 25 bp, S. pombe
gtgcctgtcacatggcgtgtcaaaa

SEQ ID NO: 100908 - DNA, 25 bp, S. pombe
gtccatcaacattccatttaccgaa

SEQ ID NO: 100909 - DNA, 25 bp, S. pombe
gtgaacccatgatcttgtacccaga

SEQ ID NO: 100910 - DNA, 25 bp, S. pombe
gtgaatgccgtgtttgttacccctt

SEQ ID NO: 100911 - DNA, 25 bp, S. pombe
gtccaccgtcgttgagtaaaccatt

SEQ ID NO: 100912 - DNA, 25 bp, S. pombe
gtgccaagcgtcaccgtaagatcct

SEQ ID NO: 100913 - DNA, 25 bp, S. pombe
gtgccaagcgtcaccgtaagatcct

SEQ ID NO: 100914 - DNA, 25 bp, S. pombe
gtgctaagcgtcaccgtaaaattct

SEQ ID NO: 100915 - DNA, 25 bp, S. pombe
gtgagcgtgcattccaaaagcaacc

SEQ ID NO: 100916 - DNA, 25 bp, S. pombe
gtgctgccttacgagtattctgaac

SEQ ID NO: 100917 - DNA, 25 bp, S. pombe
gtgctcaggttcaagattacacatt

SEQ ID NO: 100918 - DNA, 25 bp, S. pombe
gtgccttagatccacatgcttatgt

SEQ ID NO: 100919 - DNA, 25 bp, S. pombe
gtccaggttggaggctttgttcaag

SEQ ID NO: 100920 - DNA, 25 bp, S. pombe
gtccagttatgctgccttttgtaga

SEQ ID NO: 100921 - DNA, 25 bp, S. pombe
gtgctcgtattcttcctgtaatagg

SEQ ID NO: 100922 - DNA, 25 bp, S. pombe
gtgctcgtctacttttgtcgtggta

SEQ ID NO: 100923 - DNA, 25 bp, S. pombe
gtgccgtttgctatttgccttataa

SEQ ID NO: 100924 - DNA, 25 bp, S. pombe
gtgccgttcccatttatcgtaacaa

SEQ ID NO: 100925 - DNA, 25 bp, S. pombe
gtgccaattgctcttctacgaaaac

SEQ ID NO: 100926 - DNA, 25 bp, S. pombe
gtgccgacagtggttctcagttaca

SEQ ID NO: 100927 - DNA, 25 bp, S. pombe
gtgctcgccgtggtcgtgaatttga

SEQ ID NO: 100928 - DNA, 25 bp, S. pombe
gtgctgtcactctgatcgttattat

SEQ ID NO: 100929 - DNA, 25 bp, S. pombe
gtgcaggctttatcagttaatccgt

SEQ ID NO: 100930 - DNA, 25 bp, S. pombe
gtgctcctttgctacatttggtcgg

SEQ ID NO: 100931 - DNA, 25 bp, S. pombe
gtgctcttcttgcaaatgtgcttcg

SEQ ID NO: 100932 - DNA, 25 bp, S. pombe
gtgccgctaaaatcattgctactgt

SEQ ID NO: 100933 - DNA, 25 bp, S. pombe
gggctcaaggaatcatttacgttaa

SEQ ID NO: 100934 - DNA, 25 bp, S. pombe
gtgcgtcaagaacagtctgcttcta

SEQ ID NO: 100935 - DNA, 25 bp, S. pombe
gtgcgtacacaaaacatcatgcgtc

SEQ ID NO: 100936 - DNA, 25 bp, S. pombe
gtgctctagctccattcatcaatga

SEQ ID NO: 100937 - DNA, 25 bp, S. pombe
gtgcccgcctttatacattaattca

SEQ ID NO: 100938 - DNA, 25 bp, S. pombe
gtgctttggacaccaatggcccatt

SEQ ID NO: 100939 - DNA, 25 bp, S. pombe
gtgatttggaccgtattgcctactc

SEQ ID NO: 100940 - DNA, 25 bp, S. pombe
gtgctaccaggttattgacagggat

SEQ ID NO: 100941 - DNA, 25 bp, S. pombe
gtgctaccacactatgctgagaatg

SEQ ID NO: 100942 - DNA, 25 bp, S. pombe
gtccaatctctctcaaaaccatagt

SEQ ID NO: 100943 - DNA, 25 bp, S. pombe
gtgcaaatttgcgacgacaacgaga

SEQ ID NO: 100944 - DNA, 25 bp, S. pombe
tggccactgagtacaccttcgaggg

SEQ ID NO: 100945 - DNA, 25 bp, S. pombe
gtgcgatgtcactattcctaaagag

SEQ ID NO: 100946 - DNA, 25 bp, S. pombe
gtgcggataccatctctactaaggc

SEQ ID NO: 100947 - DNA, 25 bp, S. pombe
gtgcctgttattgagccacactata

SEQ ID NO: 100948 - DNA, 25 bp, S. pombe
gtgcctttcacggagctatatggta

SEQ ID NO: 100949 - DNA, 25 bp, S. pombe
gtgaacattcccaagacccgtaaga

SEQ ID NO: 100950 - DNA, 25 bp, S. pombe
gtgcctattttgcaaccacgaaaaa

SEQ ID NO: 100951 - DNA, 25 bp, S. pombe
gtgcaaactcacaataccccattat

SEQ ID NO: 100952 - DNA, 25 bp, S. pombe
gtgaaagcaacttacccttgactga

SEQ ID NO: 100953 - DNA, 25 bp, S. pombe
gggaaacctacacatcgtctaatca

SEQ ID NO: 100954 - DNA, 25 bp, S. pombe
gtgaaacccaaaccacgtcaacaat

SEQ ID NO: 100955 - DNA, 25 bp, S. pombe
ggtcaaatctcaaacccctaaagtg

SEQ ID NO: 100956 - DNA, 25 bp, S. pombe
ggtcaaatctcaaacccctaaagtg

SEQ ID NO: 100957 - DNA, 25 bp, S. pombe
gtgcgctaacgctcttcttttgaag

SEQ ID NO: 100958 - DNA, 25 bp, S. pombe
gtgcctcttctgttttcaattctca

SEQ ID NO: 100959 - DNA, 25 bp, S. pombe
gtgccatcatcccattcttaatgta

SEQ ID NO: 100960 - DNA, 25 bp, S. pombe
gtgcctctctgccaatttggactag

SEQ ID NO: 100961 - DNA, 25 bp, S. pombe
gtgctgcacattcaatccgatattc

SEQ ID NO: 100962 - DNA, 25 bp, S. pombe
gtgcgactattttgcgagatattcc

SEQ ID NO: 100963 - DNA, 25 bp, S. pombe
gtgcccgcacaccattgtattatag

SEQ ID NO: 100964 - DNA, 25 bp, S. pombe
gtgcccgcaatattgatgatgcttt

SEQ ID NO: 100965 - DNA, 25 bp, S. pombe
gtgctatccattatgcatcacctgc

SEQ ID NO: 100966 - DNA, 25 bp, S. pombe
gtgcttgctaccagtgcaactgcaa

SEQ ID NO: 100967 - DNA, 25 bp, S. pombe
gtgctatgcccaacattaactgctg

SEQ ID NO: 100968 - DNA, 25 bp, S. pombe
gtgctttaactaatccttctacgga

SEQ ID NO: 100969 - DNA, 25 bp, S. pombe
gtgccctagacagctttttggtcaa

SEQ ID NO: 100970 - DNA, 25 bp, S. pombe
gtgccgcattacgacacttcatgat

SEQ ID NO: 100971 - DNA, 25 bp, S. pombe
gtgcaccattgacatatcctgctgg

SEQ ID NO: 100972 - DNA, 25 bp, S. pombe
gtgcctccaataataaccaacgtgt

SEQ ID NO: 100973 - DNA, 25 bp, S. pombe
gtgctcattacttaacgacgcgtat

SEQ ID NO: 100974 - DNA, 25 bp, S. pombe
gtgcaagcacttatgtttccaacga

SEQ ID NO: 100975 - DNA, 25 bp, S. pombe
gtgcgagcttcagatttttccaaaa

SEQ ID NO: 100976 - DNA, 25 bp, S. pombe
gtgctagtgttcgattcagtaccct

SEQ ID NO: 100977 - DNA, 25 bp, S. pombe
gtgccatttggcattccatcaaagg

SEQ ID NO: 100978 - DNA, 25 bp, S. pombe
gtgcataggcatatcgtcaattcag

SEQ ID NO: 100979 - DNA, 25 bp, S. pombe
gtgcattgcaatttctctgttggat

SEQ ID NO: 100980 - DNA, 25 bp, S. pombe
gtgctgtgtggagttcatacatctt

SEQ ID NO: 100981 - DNA, 25 bp, S. pombe
gtgcctgtggattttcagctcgtaa

SEQ ID NO: 100982 - DNA, 25 bp, S. pombe
gtgcgcctttactcttcgtataaac

SEQ ID NO: 100983 - DNA, 25 bp, S. pombe
gtgaagtttgttttacgctcgtata

SEQ ID NO: 100984 - DNA, 25 bp, S. pombe
gtgatttttgttttaggcggtcctg

SEQ ID NO: 100985 - DNA, 25 bp, S. pombe
gtgtttattgtgagctaccgttaag

SEQ ID NO: 100986 - DNA, 25 bp, S. pombe
gtgactttttgtaaaccggctcaag

SEQ ID NO: 100987 - DNA, 25 bp, S. pombe
gtgcccttttctcatttcagtatat

SEQ ID NO: 100988 - DNA, 25 bp, S. pombe
gtgcctcttcctctgaattttgata

SEQ ID NO: 100989 - DNA, 25 bp, S. pombe
gtgctcttaccatatacctattgtt

SEQ ID NO: 100990 - DNA, 25 bp, S. pombe
gtgcctgaactaattctcggtttgc

SEQ ID NO: 100991 - DNA, 25 bp, S. pombe
gtgcctcagctggtttgtctgaaga

SEQ ID NO: 100992 - DNA, 25 bp, S. pombe
gtgaagctgttgctcgcattacaaa

SEQ ID NO: 100993 - DNA, 25 bp, S. pombe
gtgacccatctgttgaaatgccact

SEQ ID NO: 100994 - DNA, 25 bp, S. pombe
gtgaactatctgtcgaacaaatcat

SEQ ID NO: 100995 - DNA, 25 bp, S. pombe
gtgcaagctatccaaaaggcctctc

SEQ ID NO: 100996 - DNA, 25 bp, S. pombe
gtgatacgaggtgcttaactcccgt

SEQ ID NO: 100997 - DNA, 25 bp, S. pombe
gtgcttctaaggtttacaccaccga

SEQ ID NO: 100998 - DNA, 25 bp, S. pombe
gtgctcctaaggtttcagacacgca

SEQ ID NO: 100999 - DNA, 25 bp, S. pombe
gtgccgaaagcttctatgagaccgt

SEQ ID NO: 101000 - DNA, 25 bp, S. pombe
gtgctggagctgatactttacgtaa

SEQ ID NO: 101001 - DNA, 25 bp, S. pombe
gtgccggtgatatctctatggccta

SEQ ID NO: 101002 - DNA, 25 bp, S. pombe
gtgagcctatttttatggatccttg

SEQ ID NO: 101003 - DNA, 25 bp, S. pombe
gtgcatattttgattccctgggtgt

SEQ ID NO: 101004 - DNA, 25 bp, S. pombe
gtgcctttgagcattgcatcctgga

SEQ ID NO: 101005 - DNA, 25 bp, S. pombe
gtgccttatcctatgactgctgaga

SEQ ID NO: 101006 - DNA, 25 bp, S. pombe
gtgcccgacttgctgaagctgaagt

SEQ ID NO: 101007 - DNA, 25 bp, S. pombe
gtgcccgagcttactcaacaaatgt

SEQ ID NO: 101008 - DNA, 25 bp, S. pombe
gtgcccaactccctatgaaggatac

SEQ ID NO: 101009 - DNA, 25 bp, S. pombe
gtgctggtcataatcaaacgcctaa

SEQ ID NO: 101010 - DNA, 25 bp, S. pombe
gtgcggttcttcctatattctacag

SEQ ID NO: 101011 - DNA, 25 bp, S. pombe
gtgactcgtaattattttggacctc

SEQ ID NO: 101012 - DNA, 25 bp, S. pombe
gtgctcgttttagcttttcctctaa

SEQ ID NO: 101013 - DNA, 25 bp, S. pombe
gtgacgttgttagctgatttccctc

SEQ ID NO: 101014 - DNA, 25 bp, S. pombe
ggacgttcttacatgcaatggccgc

SEQ ID NO: 101015 - DNA, 25 bp, S. pombe
gtgccgctcctgaagcaacttatag

SEQ ID NO: 101016 - DNA, 25 bp, S. pombe
gtgcctctcatatcaaatcattcca

SEQ ID NO: 101017 - DNA, 25 bp, S. pombe
gtgcaccagctatcgtatttcctaa

SEQ ID NO: 101018 - DNA, 25 bp, S. pombe
gtgcaagccttagccattcgtaaat

SEQ ID NO: 101019 - DNA, 25 bp, S. pombe
gtgcatcgaaaaccttgactgtaaa

SEQ ID NO: 101020 - DNA, 25 bp, S. pombe
gtgtccaaattcctgtcgttgcaaa

SEQ ID NO: 101021 - DNA, 25 bp, S. pombe
gtgctctacgttgatgcttgttgga

SEQ ID NO: 101022 - DNA, 25 bp, S. pombe
gtgctgctcgtgaaaatgcttttac

SEQ ID NO: 101023 - DNA, 25 bp, S. pombe
gtgcgaagcctaaagctgctcttag

SEQ ID NO: 101024 - DNA, 25 bp, S. pombe
gtgagactggtaagagctggatttc

SEQ ID NO: 101025 - DNA, 25 bp, S. pombe
gtgaagcctttcatcaaggtcatca

SEQ ID NO: 101026 - DNA, 25 bp, S. pombe
gtgaagatgctgttggtccgtgccc

SEQ ID NO: 101027 - DNA, 25 bp, S. pombe
gtgaaatatacgatgtcggcccaga

SEQ ID NO: 101028 - DNA, 25 bp, S. pombe
gtgctactaacgagtggttccgcat

SEQ ID NO: 101029 - DNA, 25 bp, S. pombe
gggagccaagcctgtggattccgaa

SEQ ID NO: 101030 - DNA, 25 bp, S. pombe
gtgaatcggtccaaagccatgcaat

SEQ ID NO: 101031 - DNA, 25 bp, S. pombe
gtgcttctacttaaatctctactcc

SEQ ID NO: 101032 - DNA, 25 bp, S. pombe
gtgcttcccaaatcagtcaacgaat

SEQ ID NO: 101033 - DNA, 25 bp, S. pombe
gtgcttatcacgcagccagtcaaaa

SEQ ID NO: 101034 - DNA, 25 bp, S. pombe
gtgccgctatccgtcattttaagaa

SEQ ID NO: 101035 - DNA, 25 bp, S. pombe
gtgctcttcagtttatggcttacga

SEQ ID NO: 101036 - DNA, 25 bp, S. pombe
gtgctgcccgtattcaagctcggga

SEQ ID NO: 101037 - DNA, 25 bp, S. pombe
gtgctcaacgtattcatgatcccga

SEQ ID NO: 101038 - DNA, 25 bp, S. pombe
gtgcttaatggattaccactgctga

SEQ ID NO: 101039 - DNA, 25 bp, S. pombe
gtggattgtcgacccacaacacaag

SEQ ID NO: 101040 - DNA, 25 bp, S. pombe
tgtaaacgtgactttgggagctccg

SEQ ID NO: 101041 - DNA, 25 bp, S. pombe
tccacaacctactttcgacgattta

SEQ ID NO: 101042 - DNA, 25 bp, S. pombe
gtgcaagacctttgaaccgtgtcat

SEQ ID NO: 101043 - DNA, 25 bp, S. pombe
gtgaagctcgtttacaaaggtcttt

SEQ ID NO: 101044 - DNA, 25 bp, S. pombe
gtggtccggtgctaggaagtcctat

SEQ ID NO: 101045 - DNA, 25 bp, S. pombe
ggagaacgttggcttccggtacact

SEQ ID NO: 101046 - DNA, 25 bp, S. pombe
gtgaatggaacaccgttcctggcca

SEQ ID NO: 101047 - DNA, 25 bp, S. pombe
gtgcaattggaccttgtaccttaca

SEQ ID NO: 101048 - DNA, 25 bp, S. pombe
gtgctagttgcattccattgacagt

SEQ ID NO: 101049 - DNA, 25 bp, S. pombe
gtgctggctcacgatttgatgctta

SEQ ID NO: 101050 - DNA, 25 bp, S. pombe
gtgccgcatcgcaatattgtcaatg

SEQ ID NO: 101051 - DNA, 25 bp, S. pombe
gtgcgtgccagcaatgcacttgcaa

SEQ ID NO: 101052 - DNA, 25 bp, S. pombe
gtgaatgctgccaatgccttggtta

SEQ ID NO: 101053 - DNA, 25 bp, S. pombe
gtgaaaccatccaagttttttccat

SEQ ID NO: 101054 - DNA, 25 bp, S. pombe
gtgataacactccacgggtttacca

SEQ ID NO: 101055 - DNA, 25 bp, S. pombe
gtgcgagggctcttttatagtatca

SEQ ID NO: 101056 - DNA, 25 bp, S. pombe
gtgaattccatctatttacaaacaa

SEQ ID NO: 101057 - DNA, 25 bp, S. pombe
gtgctgcccatcgtcttatggaaga

SEQ ID NO: 101058 - DNA, 25 bp, S. pombe
gtgctccttgcagatctgagaggct

SEQ ID NO: 101059 - DNA, 25 bp, S. pombe
gtgcccttcagtccaaaactttgta

SEQ ID NO: 101060 - DNA, 25 bp, S. pombe
gtgctcgcaatttaaagaagtctca

SEQ ID NO: 101061 - DNA, 25 bp, S. pombe
gtgctcgcgctgtaaaagatcgtat

SEQ ID NO: 101062 - DNA, 25 bp, S. pombe
gtgcccctagaagagcagctgctat

SEQ ID NO: 101063 - DNA, 25 bp, S. pombe
gtgcaacttaaaggatctgcgcttt

SEQ ID NO: 101064 - DNA, 25 bp, S. pombe
gtgctaatttgtacgcctgcagtat

SEQ ID NO: 101065 - DNA, 25 bp, S. pombe
gtgcgatcaatactatccttccatt

SEQ ID NO: 101066 - DNA, 25 bp, S. pombe
gtgcgcgtggcctacgacatattaa

SEQ ID NO: 101067 - DNA, 25 bp, S. pombe
gtgctggctgctgaactttttaatg

SEQ ID NO: 101068 - DNA, 25 bp, S. pombe
gtgctgcggatggagccccttttat

SEQ ID NO: 101069 - DNA, 25 bp, S. pombe
gtgctgagcaaatatcctgttgttc

SEQ ID NO: 101070 - DNA, 25 bp, S. pombe
gtgataaatttttccgtcttcctga

SEQ ID NO: 101071 - DNA, 25 bp, S. pombe
gtgaacaactacacgtgtccgagac

SEQ ID NO: 101072 - DNA, 25 bp, S. pombe
gtgacaacctacaagctttatcaat

SEQ ID NO: 101073 - DNA, 25 bp, S. pombe
gtgctacccaccttttatgaagaag

SEQ ID NO: 101074 - DNA, 25 bp, S. pombe
gtgcttcgctcctctttaaagaaag

SEQ ID NO: 101075 - DNA, 25 bp, S. pombe
gtgctctgttccctttttattcaaa

SEQ ID NO: 101076 - DNA, 25 bp, S. pombe
gtgcggccttaccaagcttagaaaa

SEQ ID NO: 101077 - DNA, 25 bp, S. pombe
gtgagacgactacagaggttaccat

SEQ ID NO: 101078 - DNA, 25 bp, S. pombe
gtgatggcccacgaaagtttacaat

SEQ ID NO: 101079 - DNA, 25 bp, S. pombe
gtgcaatcaccgacgatgaggtaat

SEQ ID NO: 101080 - DNA, 25 bp, S. pombe
gtgctggcagccattggagaaacat

SEQ ID NO: 101081 - DNA, 25 bp, S. pombe
gtgctcgcgcctttgacatgaaaat

SEQ ID NO: 101082 - DNA, 25 bp, S. pombe
gtgcttctgcccatattaaatgcat

SEQ ID NO: 101083 - DNA, 25 bp, S. pombe
gtgctccacctatatttgcttgcat

SEQ ID NO: 101084 - DNA, 25 bp, S. pombe
gtgctccacctgaaactgctggtat

SEQ ID NO: 101085 - DNA, 25 bp, S. pombe
gtgaatcccatgaaattgccagtat

SEQ ID NO: 101086 - DNA, 25 bp, S. pombe
gtgaacctctttcagctagtaatgc

SEQ ID NO: 101087 - DNA, 25 bp, S. pombe
gtgctatcctttcaccgacaaagat

SEQ ID NO: 101088 - DNA, 25 bp, S. pombe
gtgcgtcgtctcaaacgtaaaagaa

SEQ ID NO: 101089 - DNA, 25 bp, S. pombe
gtgctttgtaaaccactgaccggaa

SEQ ID NO: 101090 - DNA, 25 bp, S. pombe
gtgctctagttgaaccatctgtcga

SEQ ID NO: 101091 - DNA, 25 bp, S. pombe
gtgctggattctcaactgctatcaa

SEQ ID NO: 101092 - DNA, 25 bp, S. pombe
gtgcggtcacaatttggatccttat

SEQ ID NO: 101093 - DNA, 25 bp, S. pombe
gtgcatgtccaactttgacacctgt

SEQ ID NO: 101094 - DNA, 25 bp, S. pombe
gtgttccaagtttccagccttatgt

SEQ ID NO: 101095 - DNA, 25 bp, S. pombe
gtgaacataacctctcaacggcgat

SEQ ID NO: 101096 - DNA, 25 bp, S. pombe
gtgaacctcgccttattattgttac

SEQ ID NO: 101097 - DNA, 25 bp, S. pombe
gtgagaaccgccatgttactgttga

SEQ ID NO: 101098 - DNA, 25 bp, S. pombe
gtgcgtacgcagtcaatctcgagaa

SEQ ID NO: 101099 - DNA, 25 bp, S. pombe
gtgctgatcctggtaatcctggaca

SEQ ID NO: 101100 - DNA, 25 bp, S. pombe
gtgctattcagcatcttgccggaat

SEQ ID NO: 101101 - DNA, 25 bp, S. pombe
gtgctgttcctctagatgggcgagt

SEQ ID NO: 101102 - DNA, 25 bp, S. pombe
gtggttccgctgagggttatgttat

SEQ ID NO: 101103 - DNA, 25 bp, S. pombe
gtgcgttccaagattcgcttcattt

SEQ ID NO: 101104 - DNA, 25 bp, S. pombe
gtgttctggctactttaccaatgtt

SEQ ID NO: 101105 - DNA, 25 bp, S. pombe
gtgctatttccgattacgctaatgt

SEQ ID NO: 101106 - DNA, 25 bp, S. pombe
gtgctttgcccgcattgtttaagat

SEQ ID NO: 101107 - DNA, 25 bp, S. pombe
gtgcatcttctccatgtgttatctt

SEQ ID NO: 101108 - DNA, 25 bp, S. pombe
gtgcaggtctcgacgtgtttttgaa

SEQ ID NO: 101109 - DNA, 25 bp, S. pombe
taattaccggaggacgtacacaacg

SEQ ID NO: 101110 - DNA, 25 bp, S. pombe
ggtcattacgggttgggtcacacat

SEQ ID NO: 101111 - DNA, 25 bp, S. pombe
gtgaaattgcagatgctcgtgctaa

SEQ ID NO: 101112 - DNA, 25 bp, S. pombe
gtgaaatgtgttgcctcgaacgtga

SEQ ID NO: 101113 - DNA, 25 bp, S. pombe
gtgctatgaagcgtgatcctgctaa

SEQ ID NO: 101114 - DNA, 25 bp, S. pombe
gtgcatcatgagtcacgatcctaat

SEQ ID NO: 101115 - DNA, 25 bp, S. pombe
gtgctcgtattcctcaaatcatcaa

SEQ ID NO: 101116 - DNA, 25 bp, S. pombe
gtgcaacgttgcctgaatatcaaat

SEQ ID NO: 101117 - DNA, 25 bp, S. pombe
gtgctgcacgttttggcattcaaca

SEQ ID NO: 101118 - DNA, 25 bp, S. pombe
gtgacacctgtcttggagcctaatg

SEQ ID NO: 101119 - DNA, 25 bp, S. pombe
gtgctaatgcagtttttaccggtga

SEQ ID NO: 101120 - DNA, 25 bp, S. pombe
gtgcatcaaacgttggaaccgctgt

SEQ ID NO: 101121 - DNA, 25 bp, S. pombe
gtgaaacacaaccttcgactgacga

SEQ ID NO: 101122 - DNA, 25 bp, S. pombe
gtgaagactttgtcccctgtaaaca

SEQ ID NO: 101123 - DNA, 25 bp, S. pombe
gtgcatgggctattgttccctggaa

SEQ ID NO: 101124 - DNA, 25 bp, S. pombe
gtgcatgttatgaaactctccggta

SEQ ID NO: 101125 - DNA, 25 bp, S. pombe
gtgctattttaactctcctcttata

SEQ ID NO: 101126 - DNA, 25 bp, S. pombe
gtgaacttcaacattaccgctctta

SEQ ID NO: 101127 - DNA, 25 bp, S. pombe
gtgtcgattatagttaccccgtggg

SEQ ID NO: 101128 - DNA, 25 bp, S. pombe
gtgtccttgatttcaaacctcgtgg

SEQ ID NO: 101129 - DNA, 25 bp, S. pombe
gtgcttggactgtaactaccgctgc

SEQ ID NO: 101130 - DNA, 25 bp, S. pombe
gtgaagctagctaccgaagacatag

SEQ ID NO: 101131 - DNA, 25 bp, S. pombe
gtgaattacttcctgatggttctaa

SEQ ID NO: 101132 - DNA, 25 bp, S. pombe
gtgaagtctcttttgggattatctc

SEQ ID NO: 101133 - DNA, 25 bp, S. pombe
ggatcaccttcgtggaatctaccag

SEQ ID NO: 101134 - DNA, 25 bp, S. pombe
gtgagccttcttgtaaatgcgtcta

SEQ ID NO: 101135 - DNA, 25 bp, S. pombe
gtgacgttcgtgataagcttgccat

SEQ ID NO: 101136 - DNA, 25 bp, S. pombe
gtgagtttcaaagtcgcagcggatt

SEQ ID NO: 101137 - DNA, 25 bp, S. pombe
gtgcttttcgtcctgagattgttat

SEQ ID NO: 101138 - DNA, 25 bp, S. pombe
gtgctgaagtagtcctttatctcaa

SEQ ID NO: 101139 - DNA, 25 bp, S. pombe
gtgcatcaatgctagaccgtctact

SEQ ID NO: 101140 - DNA, 25 bp, S. pombe
gtgctaccgataacgttacttgcta

SEQ ID NO: 101141 - DNA, 25 bp, S. pombe
gtgctttcgtggattcttcactata

SEQ ID NO: 101142 - DNA, 25 bp, S. pombe
gtgctctacgggttgtcttacttac

SEQ ID NO: 101143 - DNA, 25 bp, S. pombe
gtgcttacaagcgtcttctctatgt

SEQ ID NO: 101144 - DNA, 25 bp, S. pombe
gtgcttacaagcgtcttctctatgt

SEQ ID NO: 101145 - DNA, 25 bp, S. pombe
gtgcaagctgaattcgaacccaatg

SEQ ID NO: 101146 - DNA, 25 bp, S. pombe
gtgacagcgaacctgaactcgaaga

SEQ ID NO: 101147 - DNA, 25 bp, S. pombe
gtgaatgtgttgctacgctcgacaa

SEQ ID NO: 101148 - DNA, 25 bp, S. pombe
gtgagaatgcaatcccttcgaatct

SEQ ID NO: 101149 - DNA, 25 bp, S. pombe
gtgaatcttatgtcagctctaaata

SEQ ID NO: 101150 - DNA, 25 bp, S. pombe
gtgatgccgaagaaccatctccagg

SEQ ID NO: 101151 - DNA, 25 bp, S. pombe
gtgcattgtcaaagcctcttggatt

SEQ ID NO: 101152 - DNA, 25 bp, S. pombe
gtgcagtgtcaattgattctcgaac

SEQ ID NO: 101153 - DNA, 25 bp, S. pombe
gtgagtttatttcctttgttactgg

SEQ ID NO: 101154 - DNA, 25 bp, S. pombe
gtgggttgcagtacctaatcttact

SEQ ID NO: 101155 - DNA, 25 bp, S. pombe
gtgatacagcatctccggaaaccat

SEQ ID NO: 101156 - DNA, 25 bp, S. pombe
gtgctaatccttaccttttgtacca

SEQ ID NO: 101157 - DNA, 25 bp, S. pombe
gtgctatcaaggctcgtgatcgctt

SEQ ID NO: 101158 - DNA, 25 bp, S. pombe
gtgcattgacaggtgctctttacaa

SEQ ID NO: 101159 - DNA, 25 bp, S. pombe
gtgcattgacaatccagttgctcaa

SEQ ID NO: 101160 - DNA, 25 bp, S. pombe
gtgatgatgaaacctcctcgtccaa

SEQ ID NO: 101161 - DNA, 25 bp, S. pombe
gtgagagataacgtccaatgggcca

SEQ ID NO: 101162 - DNA, 25 bp, S. pombe
gtgagctccatactcttcgtcaaaa

SEQ ID NO: 101163 - DNA, 25 bp, S. pombe
gtgatgcttacagggtgggctacaa

SEQ ID NO: 101164 - DNA, 25 bp, S. pombe
gtgatgtaactctgaacgctgccgt

SEQ ID NO: 101165 - DNA, 25 bp, S. pombe
gtgcattatcttggcgacaacttgt

SEQ ID NO: 101166 - DNA, 25 bp, S. pombe
gtgcttttctttcctatattatcgt

SEQ ID NO: 101167 - DNA, 25 bp, S. pombe
gtggcgtcctactgtcaatttggat

SEQ ID NO: 101168 - DNA, 25 bp, S. pombe
gtgaattgcccaataccacttctgt

SEQ ID NO: 101169 - DNA, 25 bp, S. pombe
gtgatttcccaatgcaacaatgccc

SEQ ID NO: 101170 - DNA, 25 bp, S. pombe
gtgtacatggatccaaacgcacccg

SEQ ID NO: 101171 - DNA, 25 bp, S. pombe
gtgctaccaactgccgcaagaagaa

SEQ ID NO: 101172 - DNA, 25 bp, S. pombe
gtgctacagcaatttccgggaatcc

SEQ ID NO: 101173 - DNA, 25 bp, S. pombe
gtgtgaaaacttaaggacgatccaa

SEQ ID NO: 101174 - DNA, 25 bp, S. pombe
gtgtaaaacttgcaaatcccctgat

SEQ ID NO: 101175 - DNA, 25 bp, S. pombe
gtgtatacaacgcagaatacctccg

SEQ ID NO: 101176 - DNA, 25 bp, S. pombe
gtgctaaacgcttacaataccgaag

SEQ ID NO: 101177 - DNA, 25 bp, S. pombe
gtgaagcgaactgtccttctggaaa

SEQ ID NO: 101178 - DNA, 25 bp, S. pombe
gtgctattctcgcaaaggcatggaa

SEQ ID NO: 101179 - DNA, 25 bp, S. pombe
gtgaatctcgtgagtatctccagaa

SEQ ID NO: 101180 - DNA, 25 bp, S. pombe
gtgaaccttgttttgctcttgaact

SEQ ID NO: 101181 - DNA, 25 bp, S. pombe
gtgaacttcgtcaagctactgctgg

SEQ ID NO: 101182 - DNA, 25 bp, S. pombe
gtgaatcgtctcatcgtccagatag

SEQ ID NO: 101183 - DNA, 25 bp, S. pombe
gtgattccccaaagcagcctgaagt

SEQ ID NO: 101184 - DNA, 25 bp, S. pombe
gtgctaccccaaatgacttatctat

SEQ ID NO: 101185 - DNA, 25 bp, S. pombe
gtgcattagaagtttgtgccctaca

SEQ ID NO: 101186 - DNA, 25 bp, S. pombe
gtgaaccggaatcctgaggcatttc

SEQ ID NO: 101187 - DNA, 25 bp, S. pombe
gtgacgatgtcaccgcaatcttaga

SEQ ID NO: 101188 - DNA, 25 bp, S. pombe
gtgaatatgcttcctgatacccatg

SEQ ID NO: 101189 - DNA, 25 bp, S. pombe
gtgttattttgacgaccctagatgg

SEQ ID NO: 101190 - DNA, 25 bp, S. pombe
gtgttctcaatagtagacccgatct

SEQ ID NO: 101191 - DNA, 25 bp, S. pombe
gtgttgctaaacctaagccttctaa

SEQ ID NO: 101192 - DNA, 25 bp, S. pombe
gtgacacccacatgaagttgcttga

SEQ ID NO: 101193 - DNA, 25 bp, S. pombe
gtgaagccacaacgaaccactttag

SEQ ID NO: 101194 - DNA, 25 bp, S. pombe
gtgaaagccaaacatcctctggtaa

SEQ ID NO: 101195 - DNA, 25 bp, S. pombe
gtgagatagccaaatcgacttgcat

SEQ ID NO: 101196 - DNA, 25 bp, S. pombe
gtgcaccaagttttgctgcttatgc

SEQ ID NO: 101197 - DNA, 25 bp, S. pombe
gtgcacctaatgtttctgctgtaga

SEQ ID NO: 101198 - DNA, 25 bp, S. pombe
gtgaacccaatttctgctgaagagt

SEQ ID NO: 101199 - DNA, 25 bp, S. pombe
gtgcaacgtgcgaacatacttatcc

SEQ ID NO: 101200 - DNA, 25 bp, S. pombe
gtgaacgctgtggactgagtttacc

SEQ ID NO: 101201 - DNA, 25 bp, S. pombe
gtgatatcgttggtgtcagtcctcc

SEQ ID NO: 101202 - DNA, 25 bp, S. pombe
gtgaaggctactatcagatccctga

SEQ ID NO: 101203 - DNA, 25 bp, S. pombe
gtgcaattcctatttggctttcgaa

SEQ ID NO: 101204 - DNA, 25 bp, S. pombe
gtgctttcctatatttgctgctcaa

SEQ ID NO: 101205 - DNA, 25 bp, S. pombe
gtgtttgcccattgtatcctggaga

SEQ ID NO: 101206 - DNA, 25 bp, S. pombe
gtgcttgccctcgtgtataatggaa

SEQ ID NO: 101207 - DNA, 25 bp, S. pombe
gtgattgtccatgcgttgtatttcc

SEQ ID NO: 101208 - DNA, 25 bp, S. pombe
gtggaaaacctgactttggcgtgcc

SEQ ID NO: 101209 - DNA, 25 bp, S. pombe
gtgaagcttatacccttttctgatg

SEQ ID NO: 101210 - DNA, 25 bp, S. pombe
gtgaactcgcttttgactcagtgtc

SEQ ID NO: 101211 - DNA, 25 bp, S. pombe
gtgaatccctctttgactgtgagta

SEQ ID NO: 101212 - DNA, 25 bp, S. pombe
gtgaagcaccttcgaattcttctgg

SEQ ID NO: 101213 - DNA, 25 bp, S. pombe
gtgagctttgtgctggatttcctaa

SEQ ID NO: 101214 - DNA, 25 bp, S. pombe
gtgttaggtgaacttccccatcaaa

SEQ ID NO: 101215 - DNA, 25 bp, S. pombe
gtgcaagcaagattcgttctcagaa

SEQ ID NO: 101216 - DNA, 25 bp, S. pombe
gtgcaatttccttatatcggtcgat

SEQ ID NO: 101217 - DNA, 25 bp, S. pombe
gtgcttatgctcgttatgccggtgc

SEQ ID NO: 101218 - DNA, 25 bp, S. pombe
gtggtagtgcaattgcctcgtcatc

SEQ ID NO: 101219 - DNA, 25 bp, S. pombe
gtgaatttccttggcactgaacctt

SEQ ID NO: 101220 - DNA, 25 bp, S. pombe
gtgaatttgagcttaccgaggccat

SEQ ID NO: 101221 - DNA, 25 bp, S. pombe
gtgaatttgcacctaccagaaaagc

SEQ ID NO: 101222 - DNA, 25 bp, S. pombe
gtgcatcctttacaccagctaaatt

SEQ ID NO: 101223 - DNA, 25 bp, S. pombe
gtgcatttgccatctcagctagata

SEQ ID NO: 101224 - DNA, 25 bp, S. pombe
gtgcattgcgatgtccagcttaata

SEQ ID NO: 101225 - DNA, 25 bp, S. pombe
gtgaatgctggaatctacctatatt

SEQ ID NO: 101226 - DNA, 25 bp, S. pombe
gtggtcgtgcaactcaatcaactga

SEQ ID NO: 101227 - DNA, 25 bp, S. pombe
gtgacacctcgagttaccttttggg

SEQ ID NO: 101228 - DNA, 25 bp, S. pombe
gtgacaactcgtgattcgcttatag

SEQ ID NO: 101229 - DNA, 25 bp, S. pombe
gtgaaacatttggacggcactttac

SEQ ID NO: 101230 - DNA, 25 bp, S. pombe
tccaacaattttcacggcggctcaa

SEQ ID NO: 101231 - DNA, 25 bp, S. pombe
tccaaggtggttttcggcggctaag

SEQ ID NO: 101232 - DNA, 25 bp, S. pombe
tcactcgcggtcgttttgccggtaa

SEQ ID NO: 101233 - DNA, 25 bp, S. pombe
gtgcattcggcttaattggtgtttt

SEQ ID NO: 101234 - DNA, 25 bp, S. pombe
gtgcattcgtattcacaatctgttt

SEQ ID NO: 101235 - DNA, 25 bp, S. pombe
gtgcacttgtcctattcatcgtatt

SEQ ID NO: 101236 - DNA, 25 bp, S. pombe
gtgactcaggaaacgcaacttcttt

SEQ ID NO: 101237 - DNA, 25 bp, S. pombe
gtgaagtttgccaagacctctccta

SEQ ID NO: 101238 - DNA, 25 bp, S. pombe
gtgaatgttctgttcgaccttagta

SEQ ID NO: 101239 - DNA, 25 bp, S. pombe
gtgacatatatcgttctactcttga

SEQ ID NO: 101240 - DNA, 25 bp, S. pombe
gtgagtgggctaatttgtactccaa

SEQ ID NO: 101241 - DNA, 25 bp, S. pombe
gtgactatggtaactggtctcctct

SEQ ID NO: 101242 - DNA, 25 bp, S. pombe
gtgacgttaactttggtgccatcca

SEQ ID NO: 101243 - DNA, 25 bp, S. pombe
gtgacttattacattggtggaccag

SEQ ID NO: 101244 - DNA, 25 bp, S. pombe
gtgaagcatttcctatttctgacta

SEQ ID NO: 101245 - DNA, 25 bp, S. pombe
gtgactcaagcccttttgtgaattc

SEQ ID NO: 101246 - DNA, 25 bp, S. pombe
gtgcactcgagctttcttattactt

SEQ ID NO: 101247 - DNA, 25 bp, S. pombe
gtgagcccatctatttatcatgtgt

SEQ ID NO: 101248 - DNA, 25 bp, S. pombe
gtgagcccaactttttgatgcgtgc

SEQ ID NO: 101249 - DNA, 25 bp, S. pombe
gtgggtctattatttctatcatgtc

SEQ ID NO: 101250 - DNA, 25 bp, S. pombe
gtggagcctttggaacttcattact

SEQ ID NO: 101251 - DNA, 25 bp, S. pombe
gggaatctagttcggacactgctta

SEQ ID NO: 101252 - DNA, 25 bp, S. pombe
gtgaacgtatttccgaagcccatga

SEQ ID NO: 101253 - DNA, 25 bp, S. pombe
gtgaaggtgttctatctactcctcg

SEQ ID NO: 101254 - DNA, 25 bp, S. pombe
gtgacagttgttgactacttgcttt

SEQ ID NO: 101255 - DNA, 25 bp, S. pombe
gtgatgcagacattacacctttatc

SEQ ID NO: 101256 - DNA, 25 bp, S. pombe
gtgaatcagagatcccctttagcat

SEQ ID NO: 101257 - DNA, 25 bp, S. pombe
gtgaatctgacatacttctcttaga

SEQ ID NO: 101258 - DNA, 25 bp, S. pombe
gtgatctgggtacagcgtctgcata

SEQ ID NO: 101259 - DNA, 25 bp, S. pombe
gtgaagagcttaccagcgccatcaa

SEQ ID NO: 101260 - DNA, 25 bp, S. pombe
gtgcaatcttgtatcgaggagcttc

SEQ ID NO: 101261 - DNA, 25 bp, S. pombe
gtgacctgtctcgagtgatcatgat

SEQ ID NO: 101262 - DNA, 25 bp, S. pombe
gtgagtcgattttatcgtgctccag

SEQ ID NO: 101263 - DNA, 25 bp, S. pombe
gtgagatcgctaaaaggtttcctaa

SEQ ID NO: 101264 - DNA, 25 bp, S. pombe
gtgaagcagcttcccaatggagaac

SEQ ID NO: 101265 - DNA, 25 bp, S. pombe
ggtatcgacgtatcgcaagtcaact

SEQ ID NO: 101266 - DNA, 25 bp, S. pombe
gtgatcctactttatctaccaatcg

SEQ ID NO: 101267 - DNA, 25 bp, S. pombe
gtgatcgtagtgacatcccgacaat

SEQ ID NO: 101268 - DNA, 25 bp, S. pombe
gtgatgcgaggttcatcccatggaa

SEQ ID NO: 101269 - DNA, 25 bp, S. pombe
gtgaataatcaaaaacagtgtgccg

SEQ ID NO: 101270 - DNA, 25 bp, S. pombe
gtgaatcctctaaatacagtccccg

SEQ ID NO: 101271 - DNA, 25 bp, S. pombe
gtgcaatcaccatctacaatgtcca

SEQ ID NO: 101272 - DNA, 25 bp, S. pombe
gtgaaacacaaccattagctccgtt

SEQ ID NO: 101273 - DNA, 25 bp, S. pombe
gtgaacgttatcttcccaagttgat

SEQ ID NO: 101274 - DNA, 25 bp, S. pombe
gtgaacatgttttccacactcagtg

SEQ ID NO: 101275 - DNA, 25 bp, S. pombe
gtgaccaaactactgctaccgaaac

SEQ ID NO: 101276 - DNA, 25 bp, S. pombe
gtgaccattgacgattttcctgaag

SEQ ID NO: 101277 - DNA, 25 bp, S. pombe
gtgacacttgatggagattcttctt

SEQ ID NO: 101278 - DNA, 25 bp, S. pombe
gtgaagttgctggatttgctcctta

SEQ ID NO: 101279 - DNA, 25 bp, S. pombe
gtgactattgatgttcctcaggaac

SEQ ID NO: 101280 - DNA, 25 bp, S. pombe
gtgaccatctaagtcgtgccattgg

SEQ ID NO: 101281 - DNA, 25 bp, S. pombe
gtgacacgcgttttcatgatgaatt

SEQ ID NO: 101282 - DNA, 25 bp, S. pombe
gtgacttctccgacgaacctgaaag

SEQ ID NO: 101283 - DNA, 25 bp, S. pombe
gtgactatgtccctcaaacatctgg

SEQ ID NO: 101284 - DNA, 25 bp, S. pombe
gtgaagctacctcaagatctcgatg

SEQ ID NO: 101285 - DNA, 25 bp, S. pombe
gtgaagcacacatggtcgatcttgt

SEQ ID NO: 101286 - DNA, 25 bp, S. pombe
gtgagacacgcaagacccatgttgt

SEQ ID NO: 101287 - DNA, 25 bp, S. pombe
gtgaagcaggcacaccatcatggta

SEQ ID NO: 101288 - DNA, 25 bp, S. pombe
gtgtagagcgctatcctgatgggac

SEQ ID NO: 101289 - DNA, 25 bp, S. pombe
gtgatcatatttgcttgctggccga

SEQ ID NO: 101290 - DNA, 25 bp, S. pombe
gtgtctgtttgggatgctcgtcaac

SEQ ID NO: 101291 - DNA, 25 bp, S. pombe
gtgtcagtgttgctttggctcacaa

SEQ ID NO: 101292 - DNA, 25 bp, S. pombe
gtgtacagcgattctatcatggatc

SEQ ID NO: 101293 - DNA, 25 bp, S. pombe
gtgtacttgacaaatcaggaccttc

SEQ ID NO: 101294 - DNA, 25 bp, S. pombe
gtgtacttaattgacgagccttctg

SEQ ID NO: 101295 - DNA, 25 bp, S. pombe
gtgtcacctggtctccagatggtaa

SEQ ID NO: 101296 - DNA, 25 bp, S. pombe
gtgaaagtgtgtaccatctgcatga

SEQ ID NO: 101297 - DNA, 25 bp, S. pombe
gtgaaagattcgacactgcttccgc

SEQ ID NO: 101298 - DNA, 25 bp, S. pombe
gtgattgtgagttacctgttcggtc

SEQ ID NO: 101299 - DNA, 25 bp, S. pombe
gtgacttgactgactaccttatgaa

SEQ ID NO: 101300 - DNA, 25 bp, S. pombe
gtgttcaaactgtcctttatcattc

SEQ ID NO: 101301 - DNA, 25 bp, S. pombe
gtgatctattaacagcaccgctcga

SEQ ID NO: 101302 - DNA, 25 bp, S. pombe
gtgactcacccgtctattgataaga

SEQ ID NO: 101303 - DNA, 25 bp, S. pombe
gtgagctcctttacaagcgtggttt

SEQ ID NO: 101304 - DNA, 25 bp, S. pombe
tgaaggccttacacggtatcaagtt

SEQ ID NO: 101305 - DNA, 25 bp, S. pombe
tgttggtactaaacggtacgatgtt

SEQ ID NO: 101306 - DNA, 25 bp, S. pombe
gtgatttacttgtcgcaggtgctac

SEQ ID NO: 101307 - DNA, 25 bp, S. pombe
gtgtctctcctaacgggacgtataa

SEQ ID NO: 101308 - DNA, 25 bp, S. pombe
ggttcatcgcagctttaagaacgga

SEQ ID NO: 101309 - DNA, 25 bp, S. pombe
ggtacttcggctcttagtagctcat

SEQ ID NO: 101310 - DNA, 25 bp, S. pombe
gtgtcgtcggtgctttgagtactac

SEQ ID NO: 101311 - DNA, 25 bp, S. pombe
taccccgtctggtttgaaactggca

SEQ ID NO: 101312 - DNA, 25 bp, S. pombe
gtgaccgtcctcacttgatgaagtt

SEQ ID NO: 101313 - DNA, 25 bp, S. pombe
gtgttcgtttcagcattcgtattaa

SEQ ID NO: 101314 - DNA, 25 bp, S. pombe
gtgatgttttgtgcaatcccggcga

SEQ ID NO: 101315 - DNA, 25 bp, S. pombe
gtgatggtttgaaacctcgcctcat

SEQ ID NO: 101316 - DNA, 25 bp, S. pombe
gtggatttacaacaggccctcaagg

SEQ ID NO: 101317 - DNA, 25 bp, S. pombe
gtgagttctgaacagtcgcctacac

SEQ ID NO: 101318 - DNA, 25 bp, S. pombe
gtgttaaaagcaattctccctcctc

SEQ ID NO: 101319 - DNA, 25 bp, S. pombe
gtgtttctcgacaagttttgcgccg

SEQ ID NO: 101320 - DNA, 25 bp, S. pombe
gtgttccgctgatgcccaaaagaaa

SEQ ID NO: 101321 - DNA, 25 bp, S. pombe
gtgttggccgtactgctcaaggtaa

SEQ ID NO: 101322 - DNA, 25 bp, S. pombe
gtgtttggcgctttggaggttatca

SEQ ID NO: 101323 - DNA, 25 bp, S. pombe
gtgttgctccctttagaggttttgt

SEQ ID NO: 101324 - DNA, 25 bp, S. pombe
gtgttgtcccacttaaggctataaa

SEQ ID NO: 101325 - DNA, 25 bp, S. pombe
gtgtttccgacttgttggccaagat

SEQ ID NO: 101326 - DNA, 25 bp, S. pombe
gtgttcagtcgagttgttcctaaat

SEQ ID NO: 101327 - DNA, 25 bp, S. pombe
gtgtagcttccgttggtttagattc

SEQ ID NO: 101328 - DNA, 25 bp, S. pombe
gtgttccctattattcattacctga

SEQ ID NO: 101329 - DNA, 25 bp, S. pombe
gtgttcgtttttcttcttctcattc

SEQ ID NO: 101330 - DNA, 25 bp, S. pombe
ggtgctccaacgagtgttttagcca

SEQ ID NO: 101331 - DNA, 25 bp, S. pombe
gtgagcccgttaacgtttctggcaa

SEQ ID NO: 101332 - DNA, 25 bp, S. pombe
gtgtctacgacttacgattttgggt

SEQ ID NO: 101333 - DNA, 25 bp, S. pombe
gtgatgtacgtgatcaagcttttta

SEQ ID NO: 101334 - DNA, 25 bp, S. pombe
tctggctaggctcggaaaactttta

SEQ ID NO: 101335 - DNA, 25 bp, S. pombe
gtgacaccaatcttgctgctcataa

SEQ ID NO: 101336 - DNA, 25 bp, S. pombe
gtgacactgctactgttgccaagaa

SEQ ID NO: 101337 - DNA, 25 bp, S. pombe
gtgacaacagatcgcttgccaatga

SEQ ID NO: 101338 - DNA, 25 bp, S. pombe
gtgacatatcagcaattccatggat

SEQ ID NO: 101339 - DNA, 25 bp, S. pombe
gtgactgatgacaagattcgcaaca

SEQ ID NO: 101340 - DNA, 25 bp, S. pombe
gtgatgatgatgctcagcctctgaa

SEQ ID NO: 101341 - DNA, 25 bp, S. pombe
gtgagacgaccatctgcattcatac

SEQ ID NO: 101342 - DNA, 25 bp, S. pombe
gtgttttgtatgttggccgacttcc

SEQ ID NO: 101343 - DNA, 25 bp, S. pombe
gtgtcgtttatgttatcaccgcaga

SEQ ID NO: 101344 - DNA, 25 bp, S. pombe
gtgtgaagtctatgtctcccgatga

SEQ ID NO: 101345 - DNA, 25 bp, S. pombe
gtgatcaagtgatacctctctcagt

SEQ ID NO: 101346 - DNA, 25 bp, S. pombe
gtgatctcgtaaactctgctgctaa

SEQ ID NO: 101347 - DNA, 25 bp, S. pombe
gtgacttgatcgaattcgctgctgc

SEQ ID NO: 101348 - DNA, 25 bp, S. pombe
gtgtcatggatcaagctgttcgcga

SEQ ID NO: 101349 - DNA, 25 bp, S. pombe
gtgatatggatcaacctgcttccct

SEQ ID NO: 101350 - DNA, 25 bp, S. pombe
gtgaccttgctattgacattcccat

SEQ ID NO: 101351 - DNA, 25 bp, S. pombe
gtgactgccaccacttcaaatatct

SEQ ID NO: 101352 - DNA, 25 bp, S. pombe
gtgtctctaacatcttcaactacta

SEQ ID NO: 101353 - DNA, 25 bp, S. pombe
gtgtatgtatttccgagttcctttc

SEQ ID NO: 101354 - DNA, 25 bp, S. pombe
gtgtcgcttttacagattccttttc

SEQ ID NO: 101355 - DNA, 25 bp, S. pombe
gtgttagatttacccgttcattcaa

SEQ ID NO: 101356 - DNA, 25 bp, S. pombe
gtgttcgtttcggtcagtctattat

SEQ ID NO: 101357 - DNA, 25 bp, S. pombe
gtgacacttttcttctcagtcttaa

SEQ ID NO: 101358 - DNA, 25 bp, S. pombe
gtgtcatggtcaccgaggactgttt

SEQ ID NO: 101359 - DNA, 25 bp, S. pombe
gtggattaatcatcgtatgtctcat

SEQ ID NO: 101360 - DNA, 25 bp, S. pombe
gtgtgggaaacctttgactcgcaaa

SEQ ID NO: 101361 - DNA, 25 bp, S. pombe
ggatcggtgtcaaattcccaacctt

SEQ ID NO: 101362 - DNA, 25 bp, S. pombe
gtgttgatggcttacgtccaaccat

SEQ ID NO: 101363 - DNA, 25 bp, S. pombe
gtgtgagcaaagcatctcttctgag

SEQ ID NO: 101364 - DNA, 25 bp, S. pombe
gtgatagctaacgatgcccatcttc

SEQ ID NO: 101365 - DNA, 25 bp, S. pombe
gtgatagccagcaacaacctttcgt

SEQ ID NO: 101366 - DNA, 25 bp, S. pombe
gtgagtgcatcgaacaacgctattt

SEQ ID NO: 101367 - DNA, 25 bp, S. pombe
gtgatgcactcgacgaactacgtga

SEQ ID NO: 101368 - DNA, 25 bp, S. pombe
gggccgtcagcttttagaagtaact

SEQ ID NO: 101369 - DNA, 25 bp, S. pombe
gggccagttgtggttcagccagtat

SEQ ID NO: 101370 - DNA, 25 bp, S. pombe
gtgacgaagaccttgcagccgagtt

SEQ ID NO: 101371 - DNA, 25 bp, S. pombe
gtgaccataatgtcgtctccaagtt

SEQ ID NO: 101372 - DNA, 25 bp, S. pombe
gtgtccgcacttccagaaaactttt

SEQ ID NO: 101373 - DNA, 25 bp, S. pombe
gtgtcgactataaaggaatcctcag

SEQ ID NO: 101374 - DNA, 25 bp, S. pombe
gtgtcagagtccactgcggagttta

SEQ ID NO: 101375 - DNA, 25 bp, S. pombe
gtgatgctgatgaccaactcttgtt

SEQ ID NO: 101376 - DNA, 25 bp, S. pombe
gtgaggactctgttgctttacaaac

SEQ ID NO: 101377 - DNA, 25 bp, S. pombe
gtgaggctcttactcgttacattaa

SEQ ID NO: 101378 - DNA, 25 bp, S. pombe
gtgttggctacgaaagctgctttat

SEQ ID NO: 101379 - DNA, 25 bp, S. pombe
gtgagtccatcaagccttggcttaa

SEQ ID NO: 101380 - DNA, 25 bp, S. pombe
gtgactatacaaatgcttctcctcc

SEQ ID NO: 101381 - DNA, 25 bp, S. pombe
gtgataatatctgttcctccatcct

SEQ ID NO: 101382 - DNA, 25 bp, S. pombe
gtgataattcgcgatacctctcttt

SEQ ID NO: 101383 - DNA, 25 bp, S. pombe
gtgatactctcatacaattctcttg

SEQ ID NO: 101384 - DNA, 25 bp, S. pombe
gtgatatgcgtttccaagctcttat

SEQ ID NO: 101385 - DNA, 25 bp, S. pombe
gtgtatggcctaatcagtcttctca

SEQ ID NO: 101386 - DNA, 25 bp, S. pombe
gtgtatgacttgatcgattctttgc

SEQ ID NO: 101387 - DNA, 25 bp, S. pombe
gtgacttatctacttctgctttcag

SEQ ID NO: 101388 - DNA, 25 bp, S. pombe
gtgaccgatgtaatatcttctctgg

SEQ ID NO: 101389 - DNA, 25 bp, S. pombe
gtgtcatctatgagtggtcccttca

SEQ ID NO: 101390 - DNA, 25 bp, S. pombe
ggtactaatggatggcccttacggc

SEQ ID NO: 101391 - DNA, 25 bp, S. pombe
tgttcgtcaacgtaaggcctggcgc

SEQ ID NO: 101392 - DNA, 25 bp, S. pombe
ggtcgatcaattgaagtctcccgga

SEQ ID NO: 101393 - DNA, 25 bp, S. pombe
ggtcgatgaagttacaatcccttgt

SEQ ID NO: 101394 - DNA, 25 bp, S. pombe
ggtcagaactaattggccccgaagc

SEQ ID NO: 101395 - DNA, 25 bp, S. pombe
gtgagcgaacaacttggaccggatt

SEQ ID NO: 101396 - DNA, 25 bp, S. pombe
gtgacgataccacttcttacgatga

SEQ ID NO: 101397 - DNA, 25 bp, S. pombe
gtgatgcatcttggactaacgtgga

SEQ ID NO: 101398 - DNA, 25 bp, S. pombe
gtgatgattctgacttagacgatga

SEQ ID NO: 101399 - DNA, 25 bp, S. pombe
gtggtgtatggcgtcttgagcacat

SEQ ID NO: 101400 - DNA, 25 bp, S. pombe
gtgatgtgtcaatttcttggcaagc

SEQ ID NO: 101401 - DNA, 25 bp, S. pombe
gtgaccaactctggatgtctcgttt

SEQ ID NO: 101402 - DNA, 25 bp, S. pombe
gtgacgatcgtgctatttacattga

SEQ ID NO: 101403 - DNA, 25 bp, S. pombe
gtgttccaaagttcgtgtgtatatt

SEQ ID NO: 101404 - DNA, 25 bp, S. pombe
gtgtcaaccaagctcttgctcttat

SEQ ID NO: 101405 - DNA, 25 bp, S. pombe
gtgtcaccgcaattacttgtcagtt

SEQ ID NO: 101406 - DNA, 25 bp, S. pombe
gtgatgatcgtgagtaccaccgtag

SEQ ID NO: 101407 - DNA, 25 bp, S. pombe
gtgtactctgtataccagcacggag

SEQ ID NO: 101408 - DNA, 25 bp, S. pombe
gtgtgagtctgtatacgagcccaat

SEQ ID NO: 101409 - DNA, 25 bp, S. pombe
gtgtgagctctgtaaaggcggcttt

SEQ ID NO: 101410 - DNA, 25 bp, S. pombe
gtggactcgaaatttcggcgtctaa

SEQ ID NO: 101411 - DNA, 25 bp, S. pombe
gtgaggacaccactaaggctgttta

SEQ ID NO: 101412 - DNA, 25 bp, S. pombe
gtgatgaaaccgaaagcctctttaa

SEQ ID NO: 101413 - DNA, 25 bp, S. pombe
gtgagaataccgaactggctgctat

SEQ ID NO: 101414 - DNA, 25 bp, S. pombe
gtgagatttgccttcgttgcgctaa

SEQ ID NO: 101415 - DNA, 25 bp, S. pombe
gtgttatctctaaggttgcagcatt

SEQ ID NO: 101416 - DNA, 25 bp, S. pombe
gtgtatgatacttatgtccgtccta

SEQ ID NO: 101417 - DNA, 25 bp, S. pombe
gtgtacatcaactgctgtcgtttca

SEQ ID NO: 101418 - DNA, 25 bp, S. pombe
gtgatatcccaggtgttcgtttcaa

SEQ ID NO: 101419 - DNA, 25 bp, S. pombe
gtgatatcccagacggtaaaccatt

SEQ ID NO: 101420 - DNA, 25 bp, S. pombe
gtgagtcatttgctttaccctgcat

SEQ ID NO: 101421 - DNA, 25 bp, S. pombe
gtgatactttccattatgccggcat

SEQ ID NO: 101422 - DNA, 25 bp, S. pombe
gtgtatggtttatcgtgtggctccc

SEQ ID NO: 101423 - DNA, 25 bp, S. pombe
gtgtcttgttattttcgttgtcgct

SEQ ID NO: 101424 - DNA, 25 bp, S. pombe
gtgtttattctattgccttttcgcc

SEQ ID NO: 101425 - DNA, 25 bp, S. pombe
gtgtatttcctgattcgcatggttc

SEQ ID NO: 101426 - DNA, 25 bp, S. pombe
gtgtatttacgatttggcgcgctga

SEQ ID NO: 101427 - DNA, 25 bp, S. pombe
gtgtattatcactcttgacctcgac

SEQ ID NO: 101428 - DNA, 25 bp, S. pombe
gtgttatatccacatcttcactgcc

SEQ ID NO: 101429 - DNA, 25 bp, S. pombe
gtgtctgctaactaatttcattccg

SEQ ID NO: 101430 - DNA, 25 bp, S. pombe
gtgttgtcgaaccatttagtcgtgt

SEQ ID NO: 101431 - DNA, 25 bp, S. pombe
gtgtagttagacgttttagccatgg

SEQ ID NO: 101432 - DNA, 25 bp, S. pombe
gtgttcgcgcaagactttatgttgt

SEQ ID NO: 101433 - DNA, 25 bp, S. pombe
gtgttctggactgcacgtgtgaatt

SEQ ID NO: 101434 - DNA, 25 bp, S. pombe
gtgtatgctgatgaccttgaggaat

SEQ ID NO: 101435 - DNA, 25 bp, S. pombe
gtggatttgaccctacatggacctc

SEQ ID NO: 101436 - DNA, 25 bp, S. pombe
gtgtactttctgctaatgcgacgct

SEQ ID NO: 101437 - DNA, 25 bp, S. pombe
gtgaggctgctcatggtactgtaca

SEQ ID NO: 101438 - DNA, 25 bp, S. pombe
gtgagcgcgctttggaattgttccg

SEQ ID NO: 101439 - DNA, 25 bp, S. pombe
gtgatgccccgagatattatcctgc

SEQ ID NO: 101440 - DNA, 25 bp, S. pombe
gtgagtacttgcatttcattcccaa

SEQ ID NO: 101441 - DNA, 25 bp, S. pombe
gtgagtacaatccttcttctacgaa

SEQ ID NO: 101442 - DNA, 25 bp, S. pombe
gtgattgatgactttttccgactta

SEQ ID NO: 101443 - DNA, 25 bp, S. pombe
gtgatatgcaactctgtattcgtct

SEQ ID NO: 101444 - DNA, 25 bp, S. pombe
gtgtcgttctcgtcaccaagggtga

SEQ ID NO: 101445 - DNA, 25 bp, S. pombe
gtgttgttgccgaacctcaattgac

SEQ ID NO: 101446 - DNA, 25 bp, S. pombe
gtgagacaggatattcccatccctc

SEQ ID NO: 101447 - DNA, 25 bp, S. pombe
gtgttcaagatttcaccagctccaa

SEQ ID NO: 101448 - DNA, 25 bp, S. pombe
gtgattgcggatatactcgatctat

SEQ ID NO: 101449 - DNA, 25 bp, S. pombe
gtgattgctgactttctcgctgaaa

SEQ ID NO: 101450 - DNA, 25 bp, S. pombe
gtgatcatctgtattgctgcactga

SEQ ID NO: 101451 - DNA, 25 bp, S. pombe
gtgatgccactcgagcttatgaaca

SEQ ID NO: 101452 - DNA, 25 bp, S. pombe
gtgagtatctttccacaccaaactt

SEQ ID NO: 101453 - DNA, 25 bp, S. pombe
gtgaggatccgtcatccgaaagtgt

SEQ ID NO: 101454 - DNA, 25 bp, S. pombe
ggcaagcgctttgaaccaacgtaaa

SEQ ID NO: 101455 - DNA, 25 bp, S. pombe
tgcccagggtggtgttgtacctaat

SEQ ID NO: 101456 - DNA, 25 bp, S. pombe
gtgggtactgcttggtttacttcca

SEQ ID NO: 101457 - DNA, 25 bp, S. pombe
gtgtactaccattggcctttgcaat

SEQ ID NO: 101458 - DNA, 25 bp, S. pombe
gtgtcctgtctttaactattctcgt

SEQ ID NO: 101459 - DNA, 25 bp, S. pombe
gtgtcaggccgtgagatcatcatta

SEQ ID NO: 101460 - DNA, 25 bp, S. pombe
gtgattcatcatctaactcgtctga

SEQ ID NO: 101461 - DNA, 25 bp, S. pombe
gtgagattccaatgactgatgtgat

SEQ ID NO: 101462 - DNA, 25 bp, S. pombe
gtgatttccttcaagtgttgcgcat

SEQ ID NO: 101463 - DNA, 25 bp, S. pombe
gtgattggcgttatgttcatcctgg

SEQ ID NO: 101464 - DNA, 25 bp, S. pombe
gtgattctaatgctttgcggctcag

SEQ ID NO: 101465 - DNA, 25 bp, S. pombe
gtgatcctccgcaagaaatggctga

SEQ ID NO: 101466 - DNA, 25 bp, S. pombe
gtgatctcttcagctatgtttgcaa

SEQ ID NO: 101467 - DNA, 25 bp, S. pombe
gtgatgcgattcaactttttgcgaa

SEQ ID NO: 101468 - DNA, 25 bp, S. pombe
gtgagtttctctggtatctttgata

SEQ ID NO: 101469 - DNA, 25 bp, S. pombe
gtgagtgtactcgtgcagactttga

SEQ ID NO: 101470 - DNA, 25 bp, S. pombe
gtgttgccgctctcaaaattctcaa

SEQ ID NO: 101471 - DNA, 25 bp, S. pombe
gtgtaccctgatttacaattccaat

SEQ ID NO: 101472 - DNA, 25 bp, S. pombe
gtgtttttacacgaactctgtcata

SEQ ID NO: 101473 - DNA, 25 bp, S. pombe
gtgattacttcttttgccagtgttg

SEQ ID NO: 101474 - DNA, 25 bp, S. pombe
gtgatcgacatgttattgctgccaa

SEQ ID NO: 101475 - DNA, 25 bp, S. pombe
gtgattgccaggaatatcgccatat

SEQ ID NO: 101476 - DNA, 25 bp, S. pombe
gtgatgtatattctccagtgtctgg

SEQ ID NO: 101477 - DNA, 25 bp, S. pombe
gtgtcctgtatgtcgtgatggtgtc

SEQ ID NO: 101478 - DNA, 25 bp, S. pombe
gtggccgtatcttgaccggtaccgt

SEQ ID NO: 101479 - DNA, 25 bp, S. pombe
gtggtcgtattctgactggtactgt

SEQ ID NO: 101480 - DNA, 25 bp, S. pombe
gtgttcactctccacaacgattaat

SEQ ID NO: 101481 - DNA, 25 bp, S. pombe
gtgttcaagcacaactacgggcagt

SEQ ID NO: 101482 - DNA, 25 bp, S. pombe
gtgatccgagtgctttcgctgaata

SEQ ID NO: 101483 - DNA, 25 bp, S. pombe
gtgtcaccggaagtctgcatttaac

SEQ ID NO: 101484 - DNA, 25 bp, S. pombe
gtgttcgacgaattctatcttcgag

SEQ ID NO: 101485 - DNA, 25 bp, S. pombe
gtgatttaggtttccatgctggcga

SEQ ID NO: 101486 - DNA, 25 bp, S. pombe
gtgttcttagtcatcctcatgggaa

SEQ ID NO: 101487 - DNA, 25 bp, S. pombe
gtgttcttcaatttggctcaagtga

SEQ ID NO: 101488 - DNA, 25 bp, S. pombe
gtgtttctcaattgattgtccggct

SEQ ID NO: 101489 - DNA, 25 bp, S. pombe
gtgtttccatttacaggctcgaaga

SEQ ID NO: 101490 - DNA, 25 bp, S. pombe
gtgtttccacttaatgtcatacgta

SEQ ID NO: 101491 - DNA, 25 bp, S. pombe
gtgttgtccactgagctgaatactt

SEQ ID NO: 101492 - DNA, 25 bp, S. pombe
gtgataccagtacttcaggagccat

SEQ ID NO: 101493 - DNA, 25 bp, S. pombe
gtggtttcaatgctacagggctctt

SEQ ID NO: 101494 - DNA, 25 bp, S. pombe
gtgatatggttcttgctaccgtcaa

SEQ ID NO: 101495 - DNA, 25 bp, S. pombe
gtgatagccttcaaccgggtgatat

SEQ ID NO: 101496 - DNA, 25 bp, S. pombe
gtgtacgctacaaccgcgatggcaa

SEQ ID NO: 101497 - DNA, 25 bp, S. pombe
gtgtctatgacattgctggtgtagc

SEQ ID NO: 101498 - DNA, 25 bp, S. pombe
gtgtcgatgactttgccgtcgaata

SEQ ID NO: 101499 - DNA, 25 bp, S. pombe
gtgttatgttatagctcctgcgcaa

SEQ ID NO: 101500 - DNA, 25 bp, S. pombe
gtgattcattgaaaccgatcctgga

SEQ ID NO: 101501 - DNA, 25 bp, S. pombe
gtgataccgatagccgacattcagg

SEQ ID NO: 101502 - DNA, 25 bp, S. pombe
gtgtcgtcgccgtatggaactgcag

SEQ ID NO: 101503 - DNA, 25 bp, S. pombe
gtgatactagcccttatgagcttgt

SEQ ID NO: 101504 - DNA, 25 bp, S. pombe
gtgtcaccacactaaacaggaccca

SEQ ID NO: 101505 - DNA, 25 bp, S. pombe
gtgttgctttgaaccttacagaggc

SEQ ID NO: 101506 - DNA, 25 bp, S. pombe
gtgtcagccctttctttatacgatg

SEQ ID NO: 101507 - DNA, 25 bp, S. pombe
gtgtggccctcaattgacgaacgtc

SEQ ID NO: 101508 - DNA, 25 bp, S. pombe
gtgtgtgggcatgcattgagctaca

SEQ ID NO: 101509 - DNA, 25 bp, S. pombe
gtgttgatcacgttgctagctacaa

SEQ ID NO: 101510 - DNA, 25 bp, S. pombe
gtgtccatacgatttcagatcctgt

SEQ ID NO: 101511 - DNA, 25 bp, S. pombe
gtgatcacactttacagacgaatag

SEQ ID NO: 101512 - DNA, 25 bp, S. pombe
gtgtatcgtgtcaacagtgcgcaat

SEQ ID NO: 101513 - DNA, 25 bp, S. pombe
gtgatcaattacgatcttcctgcaa

SEQ ID NO: 101514 - DNA, 25 bp, S. pombe
gtgttcttgagccatccatgtctaa

SEQ ID NO: 101515 - DNA, 25 bp, S. pombe
gtgtctcgatccttagctgtcaaaa

SEQ ID NO: 101516 - DNA, 25 bp, S. pombe
gtgttagctaccagctatgactcta

SEQ ID NO: 101517 - DNA, 25 bp, S. pombe
gtgtagtcactattcatgatccgtt

SEQ ID NO: 101518 - DNA, 25 bp, S. pombe
gtgttgacactaatcgactcgttat

SEQ ID NO: 101519 - DNA, 25 bp, S. pombe
gtgtctttgccaaatgacctcttat

SEQ ID NO: 101520 - DNA, 25 bp, S. pombe
gtgttttagcacttgcatcgtttga

SEQ ID NO: 101521 - DNA, 25 bp, S. pombe
gtgtagaatcccctgcacatttaaa

SEQ ID NO: 101522 - DNA, 25 bp, S. pombe
gtgtttgcacctcggtttatgctaa

SEQ ID NO: 101523 - DNA, 25 bp, S. pombe
gtgtcttcttcttgtccattcattt

SEQ ID NO: 101524 - DNA, 25 bp, S. pombe
gtgttgttcttactcacattgtcat

SEQ ID NO: 101525 - DNA, 25 bp, S. pombe
gtgttcttcgaacattagctcataa

SEQ ID NO: 101526 - DNA, 25 bp, S. pombe
gtgggtacacggctcgtcaattgaa

SEQ ID NO: 101527 - DNA, 25 bp, S. pombe
gtgtgatttcagagcgtcgtcgacg

SEQ ID NO: 101528 - DNA, 25 bp, S. pombe
gtgtgatttgctttggtcagaccct

SEQ ID NO: 101529 - DNA, 25 bp, S. pombe
gtgtttatcgtttgggatccacccg

SEQ ID NO: 101530 - DNA, 25 bp, S. pombe
gtgttatacgttcgatagacctcca

SEQ ID NO: 101531 - DNA, 25 bp, S. pombe
gtgttaactctgctgacattgcttt

SEQ ID NO: 101532 - DNA, 25 bp, S. pombe
gtgttgaccgtcttgttatgttttt

SEQ ID NO: 101533 - DNA, 25 bp, S. pombe
gtgttactcagtcctttcgtattga

SEQ ID NO: 101534 - DNA, 25 bp, S. pombe
gtgttactgtgtcctttcaatgctc

SEQ ID NO: 101535 - DNA, 25 bp, S. pombe
gtgttcgctcgactgtttcagatat

SEQ ID NO: 101536 - DNA, 25 bp, S. pombe
gtgttgctactttgtcttatttcca

SEQ ID NO: 101537 - DNA, 25 bp, S. pombe
gtgtttgtcgttgtgcatatgttcc

SEQ ID NO: 101538 - DNA, 25 bp, S. pombe
gtgtttgtgttgaagttgctgcccc

SEQ ID NO: 101539 - DNA, 25 bp, S. pombe
gtgattattttgactggtaccctca

SEQ ID NO: 101540 - DNA, 25 bp, S. pombe
gtggtttgtgatcctgttgccctaa

SEQ ID NO: 101541 - DNA, 25 bp, S. pombe
gtgttttcatttacttcccttcata

SEQ ID NO: 101542 - DNA, 25 bp, S. pombe
gtgtttctcattttctagccattaa

SEQ ID NO: 101543 - DNA, 25 bp, S. pombe
gtgatttcagtactcatctttcatt

SEQ ID NO: 101544 - DNA, 25 bp, S. pombe
gtggcagctactactaggcctgata

SEQ ID NO: 101545 - DNA, 25 bp, S. pombe
gtgtcaataactccttcactacagc

SEQ ID NO: 101546 - DNA, 25 bp, S. pombe
gtgtaaatgctacgacctctatgag

SEQ ID NO: 101547 - DNA, 25 bp, S. pombe
gtgttcttatgcttatcgatcgtga

SEQ ID NO: 101548 - DNA, 25 bp, S. pombe
gtgtttctcagtgcaggacctttat

SEQ ID NO: 101549 - DNA, 25 bp, S. pombe
gtggtattcgcgaggcttccaaggc

SEQ ID NO: 101550 - DNA, 25 bp, S. pombe
gggaccttggtgttttctgacggat

SEQ ID NO: 101551 - DNA, 25 bp, S. pombe
gtgtaccttttcttggcctaaaatg

SEQ ID NO: 101552 - DNA, 25 bp, S. pombe
gtgtagcacttaccctttctaaaat

SEQ ID NO: 101553 - DNA, 25 bp, S. pombe
gtgttatttcgtgcattcctaaact

SEQ ID NO: 101554 - DNA, 25 bp, S. pombe
gtgttcttccttttcctatttatca

SEQ ID NO: 101555 - DNA, 25 bp, S. pombe
gggtccccattgtggttgttggcaa

SEQ ID NO: 101556 - DNA, 25 bp, S. pombe
gtggtcttgttgagaacgttccccg

SEQ ID NO: 101557 - DNA, 25 bp, S. pombe
gtgtgtgagggctttaactgtttct

SEQ ID NO: 101558 - DNA, 25 bp, S. pombe
gtgttcgcggaatcaacgttaccaa

SEQ ID NO: 101559 - DNA, 25 bp, S. pombe
gtgtgcgtgcttgggaataccgtca

SEQ ID NO: 101560 - DNA, 25 bp, S. pombe
gtgtcagctgcttcagagcaaccag

SEQ ID NO: 101561 - DNA, 25 bp, S. pombe
gtgtggtttcagttagcaagtcata

SEQ ID NO: 101562 - DNA, 25 bp, S. pombe
gtgtttcacgagactctccaaggta

SEQ ID NO: 101563 - DNA, 25 bp, S. pombe
gggcgcgctccaaaggtatgcaagt

SEQ ID NO: 101564 - DNA, 25 bp, S. pombe
gggcctgtgtgaacgctttgaagct

SEQ ID NO: 101565 - DNA, 25 bp, S. pombe
ggagctacttaagcctttcggtgat

SEQ ID NO: 101566 - DNA, 25 bp, S. pombe
gtgtttactacatttggctgaccgt

SEQ ID NO: 101567 - DNA, 25 bp, S. pombe
gtgttgtttcaaattatccccagtt

SEQ ID NO: 101568 - DNA, 25 bp, S. pombe
gtgtcgatttacgttcccttgatat

SEQ ID NO: 101569 - DNA, 25 bp, S. pombe
gtgttcttcaatatctttgcggtgc

SEQ ID NO: 101570 - DNA, 25 bp, S. pombe
gggccattcatggattcaattgggt

SEQ ID NO: 101571 - DNA, 25 bp, S. pombe
gtgttgcagaagcatgaacttccta

SEQ ID NO: 101572 - DNA, 25 bp, S. pombe
gtgttgcagcttacaatacttcctt

SEQ ID NO: 101573 - DNA, 25 bp, S. pombe
gtgttcctgttattgatggccattt

SEQ ID NO: 101574 - DNA, 25 bp, S. pombe
gtgttcctgaattatatgcttgcat

SEQ ID NO: 101575 - DNA, 25 bp, S. pombe
gtgttgcttatgatattcgtcgctt

SEQ ID NO: 101576 - DNA, 25 bp, S. pombe
gtggccttatgcatatacctgcgac

SEQ ID NO: 101577 - DNA, 25 bp, S. pombe
gggctattctgatcaaccatcgggc

SEQ ID NO: 101578 - DNA, 25 bp, S. pombe
gtgtccataaatctagcttctccag

SEQ ID NO: 101579 - DNA, 25 bp, S. pombe
gtgtatcaagctgtaggttccgact

SEQ ID NO: 101580 - DNA, 25 bp, S. pombe
gtgtaattatctctcaaaggcgttt

SEQ ID NO: 101581 - DNA, 25 bp, S. pombe
ggtgaaattattcccgacggttgct

SEQ ID NO: 101582 - DNA, 25 bp, S. pombe
gtgtattcttttgggttgtgactat

SEQ ID NO: 101583 - DNA, 25 bp, S. pombe
gtgtccttgattgcaggtttccaaa

SEQ ID NO: 101584 - DNA, 25 bp, S. pombe
gtggtcatcttgcttctgtaaattc

SEQ ID NO: 101585 - DNA, 25 bp, S. pombe
gtgtgtacatgcagtctcagttcaa

SEQ ID NO: 101586 - DNA, 25 bp, S. pombe
gtgggagactaacgtccgactctaa

SEQ ID NO: 101587 - DNA, 25 bp, S. pombe
gtgggacaactatatcagcgactat

SEQ ID NO: 101588 - DNA, 25 bp, S. pombe
gtgggtgaacttgatcgcgcgaata

SEQ ID NO: 101589 - DNA, 25 bp, S. pombe
gggaatacaatagattggcgaaatc

SEQ ID NO: 101590 - DNA, 25 bp, S. pombe
gtgttctggtgctatattttggtct

SEQ ID NO: 101591 - DNA, 25 bp, S. pombe
gtgtttatgcccatttatgctgttg

SEQ ID NO: 101592 - DNA, 25 bp, S. pombe
gtgttctcatgccttttcatttttt

SEQ ID NO: 101593 - DNA, 25 bp, S. pombe
gtgtcattggcacatactattcccg

SEQ ID NO: 101594 - DNA, 25 bp, S. pombe
gtggacgtggtctttatactcgcga

SEQ ID NO: 101595 - DNA, 25 bp, S. pombe
gtggatgcgacaaaaccgtacctta

SEQ ID NO: 101596 - DNA, 25 bp, S. pombe
gggcgttcatggtccttggatccgt

SEQ ID NO: 101597 - DNA, 25 bp, S. pombe
gggcgttagtccgaaaatctcgtat

SEQ ID NO: 101598 - DNA, 25 bp, S. pombe
gtgggcgtacacaggatcaatctta

SEQ ID NO: 101599 - DNA, 25 bp, S. pombe
gtgggacccgaattatctgaactta

SEQ ID NO: 101600 - DNA, 25 bp, S. pombe
gtgggaccacgagactttattgcta

SEQ ID NO: 101601 - DNA, 25 bp, S. pombe
gtgggaatcttgtggcttctatatc

SEQ ID NO: 101602 - DNA, 25 bp, S. pombe
gtggttatcccgctgccaagactcg

SEQ ID NO: 101603 - DNA, 25 bp, S. pombe
gtggtgttcattcaggtgcagctac

SEQ ID NO: 101604 - DNA, 25 bp, S. pombe
gtggtggctgatactacattgcgta

SEQ ID NO: 101605 - DNA, 25 bp, S. pombe
gtgggctcttcacatatcggtatgc

SEQ ID NO: 101606 - DNA, 25 bp, S. pombe
gtgggccattcaaagggttcataaa

SEQ ID NO: 101607 - DNA, 25 bp, S. pombe
gtgtcgacaaccgtttgctatttca

SEQ ID NO: 101608 - DNA, 25 bp, S. pombe
gtgtcaaccaacgatatactccttc

SEQ ID NO: 101609 - DNA, 25 bp, S. pombe
gtgtacctggcgatatttctcattt

SEQ ID NO: 101610 - DNA, 25 bp, S. pombe
gtgtatcctgtcactcatgttacta

SEQ ID NO: 101611 - DNA, 25 bp, S. pombe
gtgttttcttacgttcatcatctaa

SEQ ID NO: 101612 - DNA, 25 bp, S. pombe
gtgtttacagtgaccttctggctaa

SEQ ID NO: 101613 - DNA, 25 bp, S. pombe
gtgtattcacaagctctttcttcaa

SEQ ID NO: 101614 - DNA, 25 bp, S. pombe
gtgtattcaaaaattcttcagcgca

SEQ ID NO: 101615 - DNA, 25 bp, S. pombe
gtgtcatatcactgcaacgtttgag

SEQ ID NO: 101616 - DNA, 25 bp, S. pombe
gtgtattcaaccaactgtatgaatg

SEQ ID NO: 101617 - DNA, 25 bp, S. pombe
gtgtcttcatacttactattggtgt

SEQ ID NO: 101618 - DNA, 25 bp, S. pombe
gtgtcactaccgaagtcaagtctgt

SEQ ID NO: 101619 - DNA, 25 bp, S. pombe
gtgtactgaatgctggccaagctct

SEQ ID NO: 101620 - DNA, 25 bp, S. pombe
gtgtcaacatatttaccgcaatttt

SEQ ID NO: 101621 - DNA, 25 bp, S. pombe
gtgtctaattcatcgcccaatgttc

SEQ ID NO: 101622 - DNA, 25 bp, S. pombe
gtgtctgtcaaccaagtcgaaggct

SEQ ID NO: 101623 - DNA, 25 bp, S. pombe
gtgtttcaagtactcgatctcctgt

SEQ ID NO: 101624 - DNA, 25 bp, S. pombe
gtgggattcaagtggattactgcaa

SEQ ID NO: 101625 - DNA, 25 bp, S. pombe
gtggtgctacttttgctacgactcc

SEQ ID NO: 101626 - DNA, 25 bp, S. pombe
gtgtttcatttttatcgccacctca

SEQ ID NO: 101627 - DNA, 25 bp, S. pombe
gtgtgattcatgttgctgttcctca

SEQ ID NO: 101628 - DNA, 25 bp, S. pombe
gtgtggcatctactcaattggttca

SEQ ID NO: 101629 - DNA, 25 bp, S. pombe
gtgtggacagcaatcatattcgttc

SEQ ID NO: 101630 - DNA, 25 bp, S. pombe
gtggagagcgcggatctttgcccat

SEQ ID NO: 101631 - DNA, 25 bp, S. pombe
gtggtgagccggtttttgcaaaagc

SEQ ID NO: 101632 - DNA, 25 bp, S. pombe
gtgtgcagacgctcaacaatggttc

SEQ ID NO: 101633 - DNA, 25 bp, S. pombe
gtggtcgctgctgttgaaatggcta

SEQ ID NO: 101634 - DNA, 25 bp, S. pombe
gggacatttacttgacttaccagat

SEQ ID NO: 101635 - DNA, 25 bp, S. pombe
ggagtccgatatccgacgtgtttac

SEQ ID NO: 101636 - DNA, 25 bp, S. pombe
gtggtgggtccctacattgaagatg

SEQ ID NO: 101637 - DNA, 25 bp, S. pombe
gtggtgctaccgtcattggatttaa

SEQ ID NO: 101638 - DNA, 25 bp, S. pombe
gtggaacatccttcgtgtggagcac

SEQ ID NO: 101639 - DNA, 25 bp, S. pombe
gtgtcgatcttgaacctggtatgga

SEQ ID NO: 101640 - DNA, 25 bp, S. pombe
gtgtcccttccgatattgttcatat

SEQ ID NO: 101641 - DNA, 25 bp, S. pombe
gtgtcaccttccaatttttgtgcat

SEQ ID NO: 101642 - DNA, 25 bp, S. pombe
gtgtgaccttctccttattcgtgga

SEQ ID NO: 101643 - DNA, 25 bp, S. pombe
gtgtctcatgtcttcacaagctgga

SEQ ID NO: 101644 - DNA, 25 bp, S. pombe
gtgtgtcatgacttatacctttgga

SEQ ID NO: 101645 - DNA, 25 bp, S. pombe
gtggtatctttttgacagctatcgg

SEQ ID NO: 101646 - DNA, 25 bp, S. pombe
gtgtggtcactgcaagaatctcgct

SEQ ID NO: 101647 - DNA, 25 bp, S. pombe
gtgtggtccgacaaagatcttcatc

SEQ ID NO: 101648 - DNA, 25 bp, S. pombe
gtgggtgatggttctaaattctctg

SEQ ID NO: 101649 - DNA, 25 bp, S. pombe
gtggactttcaccaagcatcagcag

SEQ ID NO: 101650 - DNA, 25 bp, S. pombe
gtgtagcccaacgattgctgcaaca

SEQ ID NO: 101651 - DNA, 25 bp, S. pombe
gtggaccaggtactaatttcccatt

SEQ ID NO: 101652 - DNA, 25 bp, S. pombe
gtggtgaacctgctaatttccttga

SEQ ID NO: 101653 - DNA, 25 bp, S. pombe
gtggtggttctgctaattacttaaa

SEQ ID NO: 101654 - DNA, 25 bp, S. pombe
gtgggactaacttcgatgctgattc

SEQ ID NO: 101655 - DNA, 25 bp, S. pombe
gtgggatttacttggctagtcatct

SEQ ID NO: 101656 - DNA, 25 bp, S. pombe
gtgtgggccaaaatgcccgctatta

SEQ ID NO: 101657 - DNA, 25 bp, S. pombe
gtggttctactgcacctagtgtgaa

SEQ ID NO: 101658 - DNA, 25 bp, S. pombe
gtggatttcatattaccccttgcaa

SEQ ID NO: 101659 - DNA, 25 bp, S. pombe
gtgggcaaaatgctccaatttctgt

SEQ ID NO: 101660 - DNA, 25 bp, S. pombe
gtggtccacttgttcgtagtagcta

SEQ ID NO: 101661 - DNA, 25 bp, S. pombe
gtggcagggcttaccgcagatgcaa

SEQ ID NO: 101662 - DNA, 25 bp, S. pombe
gggcaacgatcgtgaattccgtcaa

SEQ ID NO: 101663 - DNA, 25 bp, S. pombe
gtggcaacgttgcatggttcacctt

SEQ ID NO: 101664 - DNA, 25 bp, S. pombe
ggtaattcctccaccaagaagtatg

SEQ ID NO: 101665 - DNA, 25 bp, S. pombe
ggtaacccctgtctatgaaagcttc

SEQ ID NO: 101666 - DNA, 25 bp, S. pombe
tggtaacccgtatgtagacccttca

SEQ ID NO: 101667 - DNA, 25 bp, S. pombe
gtggaccaacactctaagcaagcta

SEQ ID NO: 101668 - DNA, 25 bp, S. pombe
gtgggtcacattctattaaacctga

SEQ ID NO: 101669 - DNA, 25 bp, S. pombe
gtgtggtacctcttatttcagactc

SEQ ID NO: 101670 - DNA, 25 bp, S. pombe
gtgtgccgctattattattttccta

SEQ ID NO: 101671 - DNA, 25 bp, S. pombe
gtgtggtgctcgctatgacattcaa

SEQ ID NO: 101672 - DNA, 25 bp, S. pombe
gtgggagacaggaaatttcgcaatt

SEQ ID NO: 101673 - DNA, 25 bp, S. pombe
gtgggatgaccctagcggcaaatta

SEQ ID NO: 101674 - DNA, 25 bp, S. pombe
gggttaaccaagatgctacttacaa

SEQ ID NO: 101675 - DNA, 25 bp, S. pombe
gtggttatactccatttgctcgacc

SEQ ID NO: 101676 - DNA, 25 bp, S. pombe
gtggaacaaccgtctgcttcaaaga

SEQ ID NO: 101677 - DNA, 25 bp, S. pombe
gtgggaccttcgttctctgaaaagt

SEQ ID NO: 101678 - DNA, 25 bp, S. pombe
gtgtcccgagtgcatcctgataaac

SEQ ID NO: 101679 - DNA, 25 bp, S. pombe
gtgtcacccactttcctgaaaatat

SEQ ID NO: 101680 - DNA, 25 bp, S. pombe
gtggatgacgaacttcctgaaacat

SEQ ID NO: 101681 - DNA, 25 bp, S. pombe
gtgtcatgatcgaatctcaccttaa

SEQ ID NO: 101682 - DNA, 25 bp, S. pombe
gtgtcaccatcgttgttatgcttca

SEQ ID NO: 101683 - DNA, 25 bp, S. pombe
gtgtgggcatcgtgttatgtacaaa

SEQ ID NO: 101684 - DNA, 25 bp, S. pombe
gtgtctctaccactttctcaagaag

SEQ ID NO: 101685 - DNA, 25 bp, S. pombe
gtggaacagtccctacgcagtatat

SEQ ID NO: 101686 - DNA, 25 bp, S. pombe
gtggtattcgatgtcctgctataat

SEQ ID NO: 101687 - DNA, 25 bp, S. pombe
gtggtaattccgactgctggttata

SEQ ID NO: 101688 - DNA, 25 bp, S. pombe
gtggtgtcattggtattgccgtcta

SEQ ID NO: 101689 - DNA, 25 bp, S. pombe
gtggaattacttgcacacgatttct

SEQ ID NO: 101690 - DNA, 25 bp, S. pombe
gtggttcatttagcgcaggaggtcc

SEQ ID NO: 101691 - DNA, 25 bp, S. pombe
gtggattcaatttgcttccaaggta

SEQ ID NO: 101692 - DNA, 25 bp, S. pombe
gtggactcaaatccgctggcgatag

SEQ ID NO: 101693 - DNA, 25 bp, S. pombe
gtggtgccaaacgtgctactgctat

SEQ ID NO: 101694 - DNA, 25 bp, S. pombe
gtggactcagaacacaactgccata

SEQ ID NO: 101695 - DNA, 25 bp, S. pombe
gtggcttcagaagagtcacctgctc

SEQ ID NO: 101696 - DNA, 25 bp, S. pombe
gtggtgtctacaacagaacctgcat

SEQ ID NO: 101697 - DNA, 25 bp, S. pombe
gtgtcgttgctctttatgactctgt

SEQ ID NO: 101698 - DNA, 25 bp, S. pombe
gtgtcttctctaatttatctgctaa

SEQ ID NO: 101699 - DNA, 25 bp, S. pombe
gtgtcctcgcagaattctttgccaa

SEQ ID NO: 101700 - DNA, 25 bp, S. pombe
gtggttccaaaacgcgagctttcga

SEQ ID NO: 101701 - DNA, 25 bp, S. pombe
gtggctctcccggtaagattaactt

SEQ ID NO: 101702 - DNA, 25 bp, S. pombe
gtggacctggtatcacggagtcaga

SEQ ID NO: 101703 - DNA, 25 bp, S. pombe
gtggccgtgttttcaacttgtagat

SEQ ID NO: 101704 - DNA, 25 bp, S. pombe
gggcccgtgcaacattctgaaattg

SEQ ID NO: 101705 - DNA, 25 bp, S. pombe
gggcgcctggcacgaattttcaaag

SEQ ID NO: 101706 - DNA, 25 bp, S. pombe
gtgtgcaattctccgatactcacgt

SEQ ID NO: 101707 - DNA, 25 bp, S. pombe
gtgtggcattcgcacattacacgta

SEQ ID NO: 101708 - DNA, 25 bp, S. pombe
gtgggaatcgtgatttctcgtgcaa

SEQ ID NO: 101709 - DNA, 25 bp, S. pombe
gtgggcctgctggttttcctgtaaa

SEQ ID NO: 101710 - DNA, 25 bp, S. pombe
gtggccaggcctatgtaccttaatt

SEQ ID NO: 101711 - DNA, 25 bp, S. pombe
gtggtaccactatgtatcccggtat

SEQ ID NO: 101712 - DNA, 25 bp, S. pombe
gtggtagccgtattgtcaccgctgt

SEQ ID NO: 101713 - DNA, 25 bp, S. pombe
gtggttctattttgactggcgttct

SEQ ID NO: 101714 - DNA, 25 bp, S. pombe
gtgtccgctataaccgtgatggcaa

SEQ ID NO: 101715 - DNA, 25 bp, S. pombe
gggccaaccctcattgagtgcaata

SEQ ID NO: 101716 - DNA, 25 bp, S. pombe
gtgtggatataccatcgttggctaa

SEQ ID NO: 101717 - DNA, 25 bp, S. pombe
gtgtgcgaacacaatcagctgatgg

SEQ ID NO: 101718 - DNA, 25 bp, S. pombe
gtggctacttcatcagctatgcgta

SEQ ID NO: 101719 - DNA, 25 bp, S. pombe
gtgtgctgcttgtcaaagtacttat

SEQ ID NO: 101720 - DNA, 25 bp, S. pombe
gtggtgttgctcaagcgtacgctac

SEQ ID NO: 101721 - DNA, 25 bp, S. pombe
gtggccctgagctatccaaagctga

SEQ ID NO: 101722 - DNA, 25 bp, S. pombe
gtgtgcccgttaagtgctcataata

SEQ ID NO: 101723 - DNA, 25 bp, S. pombe
gtggctccgttgacgacatcaatat

SEQ ID NO: 101724 - DNA, 25 bp, S. pombe
gtggctcctgactcaaatatatata

SEQ ID NO: 101725 - DNA, 25 bp, S. pombe
gtggaattcctatgcgtgtttgtca

SEQ ID NO: 101726 - DNA, 25 bp, S. pombe
ggtcctttaagcatgttagtcgcga

SEQ ID NO: 101727 - DNA, 25 bp, S. pombe
ggtccctccaagctttagtgacgat

SEQ ID NO: 101728 - DNA, 25 bp, S. pombe
gtgtgatcccgcttggttaaaggtt

SEQ ID NO: 101729 - DNA, 25 bp, S. pombe
gtgtgtctcaccgatcatttcataa

SEQ ID NO: 101730 - DNA, 25 bp, S. pombe
gtggtccactcgaaaaacagatcaa

SEQ ID NO: 101731 - DNA, 25 bp, S. pombe
gtggcagcatgtatcaagttgcaat

SEQ ID NO: 101732 - DNA, 25 bp, S. pombe
gtgtgagcgctattcatagacccaa

SEQ ID NO: 101733 - DNA, 25 bp, S. pombe
gtggacgatgtatttgaagctgcta

SEQ ID NO: 101734 - DNA, 25 bp, S. pombe
gtggtgcagctgaaaaaatctctac

SEQ ID NO: 101735 - DNA, 25 bp, S. pombe
gtggacattgacgaagttcctgact

SEQ ID NO: 101736 - DNA, 25 bp, S. pombe
gtggcttgaacctttaccagatcgt

SEQ ID NO: 101737 - DNA, 25 bp, S. pombe
gtggctgctgaaccatacgaatcaa

SEQ ID NO: 101738 - DNA, 25 bp, S. pombe
gtggccgatccaaacgagaacaata

SEQ ID NO: 101739 - DNA, 25 bp, S. pombe
gtgtgcgagcaaattccagatcatt

SEQ ID NO: 101740 - DNA, 25 bp, S. pombe
gtgtgtgtgcaaaccgcatctatgt

SEQ ID NO: 101741 - DNA, 25 bp, S. pombe
gtgtgcttcagcatgccgcaatttc

SEQ ID NO: 101742 - DNA, 25 bp, S. pombe
gtgtgcataaatacccatacttaga

SEQ ID NO: 101743 - DNA, 25 bp, S. pombe
gtggctatcagttttaccctttaat

SEQ ID NO: 101744 - DNA, 25 bp, S. pombe
gggctcttacggtcttaccaattat

SEQ ID NO: 101745 - DNA, 25 bp, S. pombe
gggcgcattgcgagctttaaaagct

SEQ ID NO: 101746 - DNA, 25 bp, S. pombe
gtgggatcacgaacttttctcaatc

SEQ ID NO: 101747 - DNA, 25 bp, S. pombe
gtggtgcaacgttgtgtttctcatt

SEQ ID NO: 101748 - DNA, 25 bp, S. pombe
gtggtgctgctggaggaaaaactta

SEQ ID NO: 101749 - DNA, 25 bp, S. pombe
gtgtgtgcacgagggtctttacagt

SEQ ID NO: 101750 - DNA, 25 bp, S. pombe
gggaaggcaggatcgtatttataaa

SEQ ID NO: 101751 - DNA, 25 bp, S. pombe
gtgtgttatgattgtacttcccaaa

SEQ ID NO: 101752 - DNA, 25 bp, S. pombe
gtgtgattcgtgaacctttgcatta

SEQ ID NO: 101753 - DNA, 25 bp, S. pombe
gtggattgctgtaggcctttggcta

SEQ ID NO: 101754 - DNA, 25 bp, S. pombe
gtggttctgctgatttcttgcgtaa

SEQ ID NO: 101755 - DNA, 25 bp, S. pombe
gtggtctatgtttgttactctgaaa

SEQ ID NO: 101756 - DNA, 25 bp, S. pombe
gtggttcattgttagctccatggaa

SEQ ID NO: 101757 - DNA, 25 bp, S. pombe
gtgggctagtgaattctttcaccaa

SEQ ID NO: 101758 - DNA, 25 bp, S. pombe
gtggtgggtgcttacttgtcacaaa

SEQ ID NO: 101759 - DNA, 25 bp, S. pombe
gtggtcctgcagctgaagcagccaa

SEQ ID NO: 101760 - DNA, 25 bp, S. pombe
gtggtgcttttgacggtcgttcaaa

SEQ ID NO: 101761 - DNA, 25 bp, S. pombe
gtggcttgttcttcgtttcccgaat

SEQ ID NO: 101762 - DNA, 25 bp, S. pombe
gtggtgttccggaagcttatttgca

SEQ ID NO: 101763 - DNA, 25 bp, S. pombe
gtggtgcttctcttgaactcttgga

SEQ ID NO: 101764 - DNA, 25 bp, S. pombe
gtggtgctatcggtaatctcatcat

SEQ ID NO: 101765 - DNA, 25 bp, S. pombe
gtggcggatccaaaatctgcatttc

SEQ ID NO: 101766 - DNA, 25 bp, S. pombe
gggcctcggctacagaagaaactaa

SEQ ID NO: 101767 - DNA, 25 bp, S. pombe
gggcctcgagaacaagtatacttag

SEQ ID NO: 101768 - DNA, 25 bp, S. pombe
gtggaagccatagtacgctacagtt

SEQ ID NO: 101769 - DNA, 25 bp, S. pombe
gtgggccatgttccggtatcctaaa

SEQ ID NO: 101770 - DNA, 25 bp, S. pombe
gtggagctttgcacggtatactcaa

SEQ ID NO: 101771 - DNA, 25 bp, S. pombe
gtggactgttcgtcatcacaaatcg

SEQ ID NO: 101772 - DNA, 25 bp, S. pombe
ggaaatttcgtctcaaattccttct

SEQ ID NO: 101773 - DNA, 25 bp, S. pombe
ggaaatagttcctggtttctcccat

SEQ ID NO: 101774 - DNA, 25 bp, S. pombe
gggcgaacgtattactcgtgtcatc

SEQ ID NO: 101775 - DNA, 25 bp, S. pombe
gtggttacatgtttactcgcattcg

SEQ ID NO: 101776 - DNA, 25 bp, S. pombe
gggcttatgcgtttagttgcttgtt

SEQ ID NO: 101777 - DNA, 25 bp, S. pombe
gtggccttcttggtagttttggtca

SEQ ID NO: 101778 - DNA, 25 bp, S. pombe
gtggctctttcacaactgattctgg

SEQ ID NO: 101779 - DNA, 25 bp, S. pombe
gtggtccttcagaaactgcctcaaa

SEQ ID NO: 101780 - DNA, 25 bp, S. pombe
gtggtacttcccattgtccatgaag

SEQ ID NO: 101781 - DNA, 25 bp, S. pombe
gtggaactagttattgctcaaaagg

SEQ ID NO: 101782 - DNA, 25 bp, S. pombe
gtgggatcctcctgttgctcaaaat

SEQ ID NO: 101783 - DNA, 25 bp, S. pombe
gtgggtactcaatggaacgtctttc

SEQ ID NO: 101784 - DNA, 25 bp, S. pombe
gtggagtattcttcaaaccgttatt

SEQ ID NO: 101785 - DNA, 25 bp, S. pombe
ggtgcaattcctcaattacctaacc

SEQ ID NO: 101786 - DNA, 25 bp, S. pombe
gggctttgggccacctgaagcataa

SEQ ID NO: 101787 - DNA, 25 bp, S. pombe
gtggcgtccatcaggattttgacct

SEQ ID NO: 101788 - DNA, 25 bp, S. pombe
gggccgcgtactttctgaaacggag

SEQ ID NO: 101789 - DNA, 25 bp, S. pombe
gtggccgacgatgatgctgtagata

SEQ ID NO: 101790 - DNA, 25 bp, S. pombe
gggcattaatgaattctctaaggca

SEQ ID NO: 101791 - DNA, 25 bp, S. pombe
gtggactaattgaccttacagagca

SEQ ID NO: 101792 - DNA, 25 bp, S. pombe
gtggccaagagatagtctacgcttt

SEQ ID NO: 101793 - DNA, 25 bp, S. pombe
gtggaaatgcatcatgttagacaga

SEQ ID NO: 101794 - DNA, 25 bp, S. pombe
gtgggatgccctggattaaatcaat

SEQ ID NO: 101795 - DNA, 25 bp, S. pombe
gtggtagcccttatgtagccagcaa

SEQ ID NO: 101796 - DNA, 25 bp, S. pombe
gtggaaacatttacctcgccagtat

SEQ ID NO: 101797 - DNA, 25 bp, S. pombe
gtggacacaattctcctcatactaa

SEQ ID NO: 101798 - DNA, 25 bp, S. pombe
gtggcagtggttacagcgcttaaaa

SEQ ID NO: 101799 - DNA, 25 bp, S. pombe
gtggtgatcctgtaccgattgacat

SEQ ID NO: 101800 - DNA, 25 bp, S. pombe
gtggtgatccattccctggaacaaa

SEQ ID NO: 101801 - DNA, 25 bp, S. pombe
gtgggtctatacactgctcaacaac

SEQ ID NO: 101802 - DNA, 25 bp, S. pombe
gggctggtgagatcctaattcgaca

SEQ ID NO: 101803 - DNA, 25 bp, S. pombe
gtggtggtactttaggttcatcaat

SEQ ID NO: 101804 - DNA, 25 bp, S. pombe
gtggatggaccgttagtttgcaaga

SEQ ID NO: 101805 - DNA, 25 bp, S. pombe
gtggtttacaattcggatatgcctt

SEQ ID NO: 101806 - DNA, 25 bp, S. pombe
gtggtattaaccttattggcgctaa

SEQ ID NO: 101807 - DNA, 25 bp, S. pombe
gtggttgccttcgtttgagtgatat

SEQ ID NO: 101808 - DNA, 25 bp, S. pombe
gtggatcatttcctttctgggatga

SEQ ID NO: 101809 - DNA, 25 bp, S. pombe
gtggtccttcttatgctgtaagact

SEQ ID NO: 101810 - DNA, 25 bp, S. pombe
ggtcagccttcttttggtaagtttg

SEQ ID NO: 101811 - DNA, 25 bp, S. pombe
gggctgctccacttttggtaggtaa

SEQ ID NO: 101812 - DNA, 25 bp, S. pombe
gtggcatatgcacgacttattccag

SEQ ID NO: 101813 - DNA, 25 bp, S. pombe
gggaagcagctgtcatgtcattcta

SEQ ID NO: 101814 - DNA, 25 bp, S. pombe
gtggatgctgactcatggatgcttc

SEQ ID NO: 101815 - DNA, 25 bp, S. pombe
gtggtgcttcatccattgttatcga

SEQ ID NO: 101816 - DNA, 25 bp, S. pombe
gtggtctcactccaaattcatggtc

SEQ ID NO: 101817 - DNA, 25 bp, S. pombe
gtggtgctcaagttttacgaatctc

SEQ ID NO: 101818 - DNA, 25 bp, S. pombe
gtggtccacatttactcgagtttca

SEQ ID NO: 101819 - DNA, 25 bp, S. pombe
gtggtctcaattgcactccaaattc

SEQ ID NO: 101820 - DNA, 25 bp, S. pombe
gtggttatatcatcgcccagcaata

SEQ ID NO: 101821 - DNA, 25 bp, S. pombe
gtggtgctcaaattgctgccatcat

SEQ ID NO: 101822 - DNA, 25 bp, S. pombe
gtggcccaagtcaaacatattccga

SEQ ID NO: 101823 - DNA, 25 bp, S. pombe
gtggtccttgttgtcaatacagcga

SEQ ID NO: 101824 - DNA, 25 bp, S. pombe
gtggtcgatatgttactactagcag

SEQ ID NO: 101825 - DNA, 25 bp, S. pombe
gtggtcgacattttgcatcctggca

SEQ ID NO: 101826 - DNA, 25 bp, S. pombe
gtggcttacaagttcatggctggat

SEQ ID NO: 101827 - DNA, 25 bp, S. pombe
gtggtattactactcctggtcaaat

SEQ ID NO: 101828 - DNA, 25 bp, S. pombe
gtggcttcaagcttttttctcgtga

SEQ ID NO: 101829 - DNA, 25 bp, S. pombe
gtggtactacattatatttcgctta

SEQ ID NO: 101830 - DNA, 25 bp, S. pombe
gtggatgtctacacttcgtcagcat

SEQ ID NO: 101831 - DNA, 25 bp, S. pombe
gtggagtctgttgctctcaaagcta

SEQ ID NO: 101832 - DNA, 25 bp, S. pombe
gggctgctagatcgtccaaagttcc

SEQ ID NO: 101833 - DNA, 25 bp, S. pombe
gggcagctatgcaagcactcgaagt

SEQ ID NO: 101834 - DNA, 25 bp, S. pombe
gggaacctttgaaacgacgctggca

SEQ ID NO: 101835 - DNA, 25 bp, S. pombe
gggccgcctccgaatctgaaaagaa

SEQ ID NO: 101836 - DNA, 25 bp, S. pombe
gggccgcctcgatttctgaaaagaa

SEQ ID NO: 101837 - DNA, 25 bp, S. pombe
gtggcgccaatcgtgttcgcaagaa

SEQ ID NO: 101838 - DNA, 25 bp, S. pombe
gggcccagcattggagctaagagaa

SEQ ID NO: 101839 - DNA, 25 bp, S. pombe
gtggccacaggtttcattttataca

SEQ ID NO: 101840 - DNA, 25 bp, S. pombe
gtggtctcgcaacaatctcttcata

SEQ ID NO: 101841 - DNA, 25 bp, S. pombe
gtggatgctctttgcgatatcgaac

SEQ ID NO: 101842 - DNA, 25 bp, S. pombe
gtggccgtgaatactttgagagcaa

SEQ ID NO: 101843 - DNA, 25 bp, S. pombe
gtggccgtgaatatttggagactct

SEQ ID NO: 101844 - DNA, 25 bp, S. pombe
gggctccaggtcatactaggattta

SEQ ID NO: 101845 - DNA, 25 bp, S. pombe
gggccgcactttagaagttcgccta

SEQ ID NO: 101846 - DNA, 25 bp, S. pombe
gtggacccgtacaaagcatggcgtt

SEQ ID NO: 101847 - DNA, 25 bp, S. pombe
gtggaccccgatttggtacgtatat

SEQ ID NO: 101848 - DNA, 25 bp, S. pombe
gtggaccctcgatacattaagcttt

SEQ ID NO: 101849 - DNA, 25 bp, S. pombe
ggtggtgtcgtacaagtcaactttt

SEQ ID NO: 101850 - DNA, 25 bp, S. pombe
gtggcgctcgacaagctgttgcaaa

SEQ ID NO: 101851 - DNA, 25 bp, S. pombe
gtggcccgataaagttgagaagctc

SEQ ID NO: 101852 - DNA, 25 bp, S. pombe
gggcctggtccacgtggattcttaa

SEQ ID NO: 101853 - DNA, 25 bp, S. pombe
gggccagccttatccaattatggat

SEQ ID NO: 101854 - DNA, 25 bp, S. pombe
ggatgataaaccctcgactaccgat

SEQ ID NO: 101855 - DNA, 25 bp, S. pombe
gtggattattgcttacgttgtttca

SEQ ID NO: 101856 - DNA, 25 bp, S. pombe
gtggtaactatgatgctctctttat

SEQ ID NO: 101857 - DNA, 25 bp, S. pombe
gtggcctccaatccagttaactatg

SEQ ID NO: 101858 - DNA, 25 bp, S. pombe
gtggtattctatcctttcaacctgt

SEQ ID NO: 101859 - DNA, 25 bp, S. pombe
gtggaatatcttccttcccaagatt

SEQ ID NO: 101860 - DNA, 25 bp, S. pombe
gggcaattgcttacaccaccaaatg

SEQ ID NO: 101861 - DNA, 25 bp, S. pombe
ggaacaaccgtgaacaaccctagtg

SEQ ID NO: 101862 - DNA, 25 bp, S. pombe
gtggattctccctcaaatacagatt

SEQ ID NO: 101863 - DNA, 25 bp, S. pombe
gggattagtcgatcaacaggaactc

SEQ ID NO: 101864 - DNA, 25 bp, S. pombe
ggtgaagcctttagttccggacatt

SEQ ID NO: 101865 - DNA, 25 bp, S. pombe
gggacaagatatccggccaacaccg

SEQ ID NO: 101866 - DNA, 25 bp, S. pombe
gtggctccatcattagtcgcttttg

SEQ ID NO: 101867 - DNA, 25 bp, S. pombe
gtggttattgccgatgccattaatg

SEQ ID NO: 101868 - DNA, 25 bp, S. pombe
gtggaggtttcatttgttacgacaa

SEQ ID NO: 101869 - DNA, 25 bp, S. pombe
gtggttatgcccaagctgttcagaa

SEQ ID NO: 101870 - DNA, 25 bp, S. pombe
gtggattctgcatcaactgctttaa

SEQ ID NO: 101871 - DNA, 25 bp, S. pombe
gtggcattctcagactatcattctc

SEQ ID NO: 101872 - DNA, 25 bp, S. pombe
gtggttcacacattcgttttctcat

SEQ ID NO: 101873 - DNA, 25 bp, S. pombe
gtggattccgaacttactgagctgg

SEQ ID NO: 101874 - DNA, 25 bp, S. pombe
gtggaacacgcattcattgactttg

SEQ ID NO: 101875 - DNA, 25 bp, S. pombe
gtggactttctcctagtattcagca

SEQ ID NO: 101876 - DNA, 25 bp, S. pombe
gtggatacgtattcccttatgaccc

SEQ ID NO: 101877 - DNA, 25 bp, S. pombe
ggtgaagtcgtacccttagaccagc

SEQ ID NO: 101878 - DNA, 25 bp, S. pombe
gtggaaagcagtcaccttcagcatc

SEQ ID NO: 101879 - DNA, 25 bp, S. pombe
gtggattacacagtcatcctcaaag

SEQ ID NO: 101880 - DNA, 25 bp, S. pombe
gtggcttacttcatgagcatcgcta

SEQ ID NO: 101881 - DNA, 25 bp, S. pombe
gtggcttcaagttcatcctgttctc

SEQ ID NO: 101882 - DNA, 25 bp, S. pombe
gtggaaccgccaaacatgattgaat

SEQ ID NO: 101883 - DNA, 25 bp, S. pombe
gtggaaccacgattctaatgtcatt

SEQ ID NO: 101884 - DNA, 25 bp, S. pombe
gtggaacttgccgttatggctctaa

SEQ ID NO: 101885 - DNA, 25 bp, S. pombe
gtggatctcattctttacattcaaa

SEQ ID NO: 101886 - DNA, 25 bp, S. pombe
gtggatttaattacttctgatgcta

SEQ ID NO: 101887 - DNA, 25 bp, S. pombe
gggcaatccagttgttattaaggct

SEQ ID NO: 101888 - DNA, 25 bp, S. pombe
gtggaatgcctgtcgccttaaaggc

SEQ ID NO: 101889 - DNA, 25 bp, S. pombe
gggcttgacttgctcttcaataagc

SEQ ID NO: 101890 - DNA, 25 bp, S. pombe
gggctgccgacatggttactcaaac

SEQ ID NO: 101891 - DNA, 25 bp, S. pombe
gtggcaccctgaattatggtcatta

SEQ ID NO: 101892 - DNA, 25 bp, S. pombe
gtggatctcgttggcaatgacgcta

SEQ ID NO: 101893 - DNA, 25 bp, S. pombe
gggccccatatatgcagtacgactc

SEQ ID NO: 101894 - DNA, 25 bp, S. pombe
gggccttggagcaattacgttactt

SEQ ID NO: 101895 - DNA, 25 bp, S. pombe
gggccttggattgtagcgtttgttt

SEQ ID NO: 101896 - DNA, 25 bp, S. pombe
gggaacaggttattcaccctcgaat

SEQ ID NO: 101897 - DNA, 25 bp, S. pombe
gtggctaacttgtggactcgtgcgt

SEQ ID NO: 101898 - DNA, 25 bp, S. pombe
gtggatcgacttttggacctttgta

SEQ ID NO: 101899 - DNA, 25 bp, S. pombe
gtggagcacccaaatttttacgtca

SEQ ID NO: 101900 - DNA, 25 bp, S. pombe
gggctcttggtgcttgtacgactcc

SEQ ID NO: 101901 - DNA, 25 bp, S. pombe
gggccttgggtatttctcaatcatc

SEQ ID NO: 101902 - DNA, 25 bp, S. pombe
gggaactgggttatccaacatataa

SEQ ID NO: 101903 - DNA, 25 bp, S. pombe
gggccgcaattttttcatcgcagtt

SEQ ID NO: 101904 - DNA, 25 bp, S. pombe
gtggcttgctaaaacttcttcgtta

SEQ ID NO: 101905 - DNA, 25 bp, S. pombe
gggctacagaaggtcttcgtcgatt

SEQ ID NO: 101906 - DNA, 25 bp, S. pombe
gggctcaagctatggaatccctgat

SEQ ID NO: 101907 - DNA, 25 bp, S. pombe
gggccactagtttagatccgagact

SEQ ID NO: 101908 - DNA, 25 bp, S. pombe
gtggccgctggatatgcaacgagtt

SEQ ID NO: 101909 - DNA, 25 bp, S. pombe
gggacctactatcattaagcaagct

SEQ ID NO: 101910 - DNA, 25 bp, S. pombe
gggccaatgctcctattatacaaac

SEQ ID NO: 101911 - DNA, 25 bp, S. pombe
gtggccacagtcgacattgatccaa

SEQ ID NO: 101912 - DNA, 25 bp, S. pombe
gtggcacacttatgcaatgcaccat

SEQ ID NO: 101913 - DNA, 25 bp, S. pombe
gtggagacacgtacgaatgctgctt

SEQ ID NO: 101914 - DNA, 25 bp, S. pombe
gggcgatctgcgtcttgcaatggaa

SEQ ID NO: 101915 - DNA, 25 bp, S. pombe
ggtgcccgtgtcgaacgtattttag

SEQ ID NO: 101916 - DNA, 25 bp, S. pombe
gggcctcaatggaaacgttcatatt

SEQ ID NO: 101917 - DNA, 25 bp, S. pombe
gtggcaccccaatgtcgatatgagt

SEQ ID NO: 101918 - DNA, 25 bp, S. pombe
gggctcatcacctatcaatcgatta

SEQ ID NO: 101919 - DNA, 25 bp, S. pombe
gggctgaatctgagactgctcttca

SEQ ID NO: 101920 - DNA, 25 bp, S. pombe
gggctaccaggcgaatatcttcaaa

SEQ ID NO: 101921 - DNA, 25 bp, S. pombe
gggagacaaagctgcattgctagat

SEQ ID NO: 101922 - DNA, 25 bp, S. pombe
gggcagaaatcatcgatgcgcatga

SEQ ID NO: 101923 - DNA, 25 bp, S. pombe
gtggaatcaatactcgctcctgaaa

SEQ ID NO: 101924 - DNA, 25 bp, S. pombe
gtggaatcatatgcttgcactgtgc

SEQ ID NO: 101925 - DNA, 25 bp, S. pombe
gtggactcacttacgattttgttgg

SEQ ID NO: 101926 - DNA, 25 bp, S. pombe
gtggcactgctgttttgtttattta

SEQ ID NO: 101927 - DNA, 25 bp, S. pombe
gggctcgatgatttgattgaccttt

SEQ ID NO: 101928 - DNA, 25 bp, S. pombe
gtggctcgaggcttgtatgactaca

SEQ ID NO: 101929 - DNA, 25 bp, S. pombe
gtggcgtcgacatcatgtctcaaag

SEQ ID NO: 101930 - DNA, 25 bp, S. pombe
gtggcttgatcatgacgcgttggtc

SEQ ID NO: 101931 - DNA, 25 bp, S. pombe
gggcataattgttcaactggtgact

SEQ ID NO: 101932 - DNA, 25 bp, S. pombe
gtggaagcgctttcaacgtctatta

SEQ ID NO: 101933 - DNA, 25 bp, S. pombe
ggaactggtttctcctttgtatgga

SEQ ID NO: 101934 - DNA, 25 bp, S. pombe
ggatacatttccagtcgttttagtg

SEQ ID NO: 101935 - DNA, 25 bp, S. pombe
gggaactcgagcacttcaaattagt

SEQ ID NO: 101936 - DNA, 25 bp, S. pombe
gggcagtcaactgaatgctatcatt

SEQ ID NO: 101937 - DNA, 25 bp, S. pombe
gggctttacgttaatgacatgactc

SEQ ID NO: 101938 - DNA, 25 bp, S. pombe
gggctcttacttgtaaatcaccagg

SEQ ID NO: 101939 - DNA, 25 bp, S. pombe
gtggcttctccggttacagagcaaa

SEQ ID NO: 101940 - DNA, 25 bp, S. pombe
gggcttacctcttctaatggctaca

SEQ ID NO: 101941 - DNA, 25 bp, S. pombe
gggcttacttcgatactggccgaaa

SEQ ID NO: 101942 - DNA, 25 bp, S. pombe
gggaattcttccatctaagtccaaa

SEQ ID NO: 101943 - DNA, 25 bp, S. pombe
gggccagtatcgtttttgaggctat

SEQ ID NO: 101944 - DNA, 25 bp, S. pombe
tcggtcgaacgttgtttatcctggt

SEQ ID NO: 101945 - DNA, 25 bp, S. pombe
gggactacatcgatttttacgctga

SEQ ID NO: 101946 - DNA, 25 bp, S. pombe
gtggaattactccaattcgtgctat

SEQ ID NO: 101947 - DNA, 25 bp, S. pombe
gtggaatttctttcgggacaagcaa

SEQ ID NO: 101948 - DNA, 25 bp, S. pombe
gggcgttcacatcggaccagacaga

SEQ ID NO: 101949 - DNA, 25 bp, S. pombe
gggcgtattcttcgtgccaagcgac

SEQ ID NO: 101950 - DNA, 25 bp, S. pombe
gtggcaaatatggttctcgtccttc

SEQ ID NO: 101951 - DNA, 25 bp, S. pombe
gtggcacctggattttcccaattaa

SEQ ID NO: 101952 - DNA, 25 bp, S. pombe
gggctatggctatatgttgctctaa

SEQ ID NO: 101953 - DNA, 25 bp, S. pombe
gtggctattgccaacgttttacaaa

SEQ ID NO: 101954 - DNA, 25 bp, S. pombe
gggctagtgcccagtcatggtatca

SEQ ID NO: 101955 - DNA, 25 bp, S. pombe
gggcaggttcttcagtttattcatc

SEQ ID NO: 101956 - DNA, 25 bp, S. pombe
gggcctttttgaacttgtacatctc

SEQ ID NO: 101957 - DNA, 25 bp, S. pombe
gggctttgtctggtcactttgaaag

SEQ ID NO: 101958 - DNA, 25 bp, S. pombe
gggcccattctgtactgcatggaga

SEQ ID NO: 101959 - DNA, 25 bp, S. pombe
gggccacatcgaatatcgctgggtc

SEQ ID NO: 101960 - DNA, 25 bp, S. pombe
ggtacccttacagccaagacatcag

SEQ ID NO: 101961 - DNA, 25 bp, S. pombe
gggactaccaccactacaggattaa

SEQ ID NO: 101962 - DNA, 25 bp, S. pombe
gggacaccagtccaacgtttattgt

SEQ ID NO: 101963 - DNA, 25 bp, S. pombe
ggcgacaaatccaccgttttaattg

SEQ ID NO: 101964 - DNA, 25 bp, S. pombe
gggcactgtgcaacagtttctcaat

SEQ ID NO: 101965 - DNA, 25 bp, S. pombe
gggagcgtcagtcttcactaattga

SEQ ID NO: 101966 - DNA, 25 bp, S. pombe
gtggccttcgtgatggttactatat

SEQ ID NO: 101967 - DNA, 25 bp, S. pombe
gtggccttttgactggtcgcattaa

SEQ ID NO: 101968 - DNA, 25 bp, S. pombe
gggagcccataagtgcgcctaaaaa

SEQ ID NO: 101969 - DNA, 25 bp, S. pombe
gtggccatcacaaaccggtagaagg

SEQ ID NO: 101970 - DNA, 25 bp, S. pombe
gtggccataatattcccgcattaga

SEQ ID NO: 101971 - DNA, 25 bp, S. pombe
gggctctgaatatccacaactacaa

SEQ ID NO: 101972 - DNA, 25 bp, S. pombe
ggcgtcctttgaacgatcaaccgga

SEQ ID NO: 101973 - DNA, 25 bp, S. pombe
gggaatctcgtgaaaactctacttg

SEQ ID NO: 101974 - DNA, 25 bp, S. pombe
ggagaacttgagaacgcccgaactg

SEQ ID NO: 101975 - DNA, 25 bp, S. pombe
gggaatgtcagaaacacccgattat

SEQ ID NO: 101976 - DNA, 25 bp, S. pombe
gggattctatacacggactttactc

SEQ ID NO: 101977 - DNA, 25 bp, S. pombe
gggagactttttctggccttacgca

SEQ ID NO: 101978 - DNA, 25 bp, S. pombe
gggcttttgattccatcatgcactc

SEQ ID NO: 101979 - DNA, 25 bp, S. pombe
gggcattatgtattcgtcaacacct

SEQ ID NO: 101980 - DNA, 25 bp, S. pombe
gggcccgaatcagttagagctatgt

SEQ ID NO: 101981 - DNA, 25 bp, S. pombe
gggctgaagataaactttactccaa

SEQ ID NO: 101982 - DNA, 25 bp, S. pombe
gggagaagatggcactttcaccctt

SEQ ID NO: 101983 - DNA, 25 bp, S. pombe
gggccaatgatgttacacttcaact

SEQ ID NO: 101984 - DNA, 25 bp, S. pombe
ttggcgaccactttaaagacaagac

SEQ ID NO: 101985 - DNA, 25 bp, S. pombe
gggtaacaccttcaagcacaaacgt

SEQ ID NO: 101986 - DNA, 25 bp, S. pombe
gggaaaactgttacgatggagccat

SEQ ID NO: 101987 - DNA, 25 bp, S. pombe
gggcatacctgcaaatgtcgatcgt

SEQ ID NO: 101988 - DNA, 25 bp, S. pombe
gggcgcatttactcctaatgcatct

SEQ ID NO: 101989 - DNA, 25 bp, S. pombe
gggctcactgctgaagcgaatgatt

SEQ ID NO: 101990 - DNA, 25 bp, S. pombe
ggcgtaggacgcactggtactttta

SEQ ID NO: 101991 - DNA, 25 bp, S. pombe
gggctactcagctattttgtttgga

SEQ ID NO: 101992 - DNA, 25 bp, S. pombe
gggctttaagttccaattctgtcaa

SEQ ID NO: 101993 - DNA, 25 bp, S. pombe
gggctatcctagctaataatgtaaa

SEQ ID NO: 101994 - DNA, 25 bp, S. pombe
gggctgcacttcagtctactcaaaa

SEQ ID NO: 101995 - DNA, 25 bp, S. pombe
gggctagcaataacgaactgtcttc

SEQ ID NO: 101996 - DNA, 25 bp, S. pombe
gggatgtccgaatttcgcttacctt

SEQ ID NO: 101997 - DNA, 25 bp, S. pombe
gggcatttcgatatttggacacagt

SEQ ID NO: 101998 - DNA, 25 bp, S. pombe
gggcctacctcacgaattttctata

SEQ ID NO: 101999 - DNA, 25 bp, S. pombe
gggactaaaccttttctactatgat

SEQ ID NO: 102000 - DNA, 25 bp, S. pombe
gggttaaaaccttactcatgcttgt

SEQ ID NO: 102001 - DNA, 25 bp, S. pombe
gggaaacgaaaatacatctgtcagt

SEQ ID NO: 102002 - DNA, 25 bp, S. pombe
gtggccttggctatattgatctgtt

SEQ ID NO: 102003 - DNA, 25 bp, S. pombe
gggcgccattgcaactttattgatc

SEQ ID NO: 102004 - DNA, 25 bp, S. pombe
gggccatgtatttgcatcccagcgt

SEQ ID NO: 102005 - DNA, 25 bp, S. pombe
gggcgtgttgtatccattctgttaa

SEQ ID NO: 102006 - DNA, 25 bp, S. pombe
gggctctgaatttgttgatacgcta

SEQ ID NO: 102007 - DNA, 25 bp, S. pombe
gggcatcagcggaatctatgtcgtt

SEQ ID NO: 102008 - DNA, 25 bp, S. pombe
gggaattaccagagactcacgacac

SEQ ID NO: 102009 - DNA, 25 bp, S. pombe
gggcaactactttgttcctcatgag

SEQ ID NO: 102010 - DNA, 25 bp, S. pombe
gggcaaaacactaatattcgcgacg

SEQ ID NO: 102011 - DNA, 25 bp, S. pombe
gggcagagacttgatcattaccgtt

SEQ ID NO: 102012 - DNA, 25 bp, S. pombe
gggccattctctccttacaatgatt

SEQ ID NO: 102013 - DNA, 25 bp, S. pombe
gggtgagagtacactacctccatat

SEQ ID NO: 102014 - DNA, 25 bp, S. pombe
gggctcgtcttactttacgcgatag

SEQ ID NO: 102015 - DNA, 25 bp, S. pombe
gggctctgtccattctttaaaaagg

SEQ ID NO: 102016 - DNA, 25 bp, S. pombe
gggccttcctttcttgaatggagtt

SEQ ID NO: 102017 - DNA, 25 bp, S. pombe
gggaatccgtcaaacaacactagtg

SEQ ID NO: 102018 - DNA, 25 bp, S. pombe
gggcctccaggaaatcaccgtagaa

SEQ ID NO: 102019 - DNA, 25 bp, S. pombe
gggcgacaaccttccgatgagataa

SEQ ID NO: 102020 - DNA, 25 bp, S. pombe
gggatgctgcttactatgctatgaa

SEQ ID NO: 102021 - DNA, 25 bp, S. pombe
gggaccgacattgccaagccaagtt

SEQ ID NO: 102022 - DNA, 25 bp, S. pombe
gggccgcgatattgtccgtgaaatg

SEQ ID NO: 102023 - DNA, 25 bp, S. pombe
gggccagcgttatgccgttaatcat

SEQ ID NO: 102024 - DNA, 25 bp, S. pombe
gggcccagagtctccacttaattat

SEQ ID NO: 102025 - DNA, 25 bp, S. pombe
gggaccacgattgcctatataagta

SEQ ID NO: 102026 - DNA, 25 bp, S. pombe
gggctcacccttgcaatattgattg

SEQ ID NO: 102027 - DNA, 25 bp, S. pombe
gggcttcctcgtgaattttttactg

SEQ ID NO: 102028 - DNA, 25 bp, S. pombe
ggtggactcttataccttttctata

SEQ ID NO: 102029 - DNA, 25 bp, S. pombe
ggtgaagtccgtccaaaatcgtttg

SEQ ID NO: 102030 - DNA, 25 bp, S. pombe
gggcattacccgttgaagattttat

SEQ ID NO: 102031 - DNA, 25 bp, S. pombe
gggcgactcgtactgtcaactatat

SEQ ID NO: 102032 - DNA, 25 bp, S. pombe
gggcgccgattgtatagtccatgat

SEQ ID NO: 102033 - DNA, 25 bp, S. pombe
ggagccgacggttctcgtaatgtat

SEQ ID NO: 102034 - DNA, 25 bp, S. pombe
gggagctttactttacgagacctga

SEQ ID NO: 102035 - DNA, 25 bp, S. pombe
gggcactcttgatactaagaccttg

SEQ ID NO: 102036 - DNA, 25 bp, S. pombe
gggagtcaaacttctttctcgacaa

SEQ ID NO: 102037 - DNA, 25 bp, S. pombe
gggtagatactgacttttcgtacaa

SEQ ID NO: 102038 - DNA, 25 bp, S. pombe
gggtgaattgcgctatgttttaact

SEQ ID NO: 102039 - DNA, 25 bp, S. pombe
gggcgcattttcctatatgtcttca

SEQ ID NO: 102040 - DNA, 25 bp, S. pombe
ggcggtcagaagtcactttgtgctt

SEQ ID NO: 102041 - DNA, 25 bp, S. pombe
gggaatctctcgttgcagtggcagc

SEQ ID NO: 102042 - DNA, 25 bp, S. pombe
gggaaccacctgcaaatctttggag

SEQ ID NO: 102043 - DNA, 25 bp, S. pombe
gggaactccagcagctaagcgactt

SEQ ID NO: 102044 - DNA, 25 bp, S. pombe
gggcatacccgaccttgacgagtta

SEQ ID NO: 102045 - DNA, 25 bp, S. pombe
gggcaatgcccgtatcttacgagta

SEQ ID NO: 102046 - DNA, 25 bp, S. pombe
gggaattactcgtgcttatttcaat

SEQ ID NO: 102047 - DNA, 25 bp, S. pombe
gggaaactccgctagctatagttaa

SEQ ID NO: 102048 - DNA, 25 bp, S. pombe
gggaattttcactgccaggtgtcat

SEQ ID NO: 102049 - DNA, 25 bp, S. pombe
gggctgttgcaactatggctttcat

SEQ ID NO: 102050 - DNA, 25 bp, S. pombe
gggctcagataacgtcccattatat

SEQ ID NO: 102051 - DNA, 25 bp, S. pombe
gggcttttacttcttatgtgagggc

SEQ ID NO: 102052 - DNA, 25 bp, S. pombe
gggaagccttattattttgcctttg

SEQ ID NO: 102053 - DNA, 25 bp, S. pombe
gggacagccctgaacttaatcatga

SEQ ID NO: 102054 - DNA, 25 bp, S. pombe
gggagcaacctgtactacatgagat

SEQ ID NO: 102055 - DNA, 25 bp, S. pombe
gggaaagccataccgactctattaa

SEQ ID NO: 102056 - DNA, 25 bp, S. pombe
gggcaacgccaaccgtgtgaatcta

SEQ ID NO: 102057 - DNA, 25 bp, S. pombe
gggaatgtcatctttgctgttgaat

SEQ ID NO: 102058 - DNA, 25 bp, S. pombe
gggctaatgcacttgacttgcgcaa

SEQ ID NO: 102059 - DNA, 25 bp, S. pombe
gggcgaacagtctacatctgctgaa

SEQ ID NO: 102060 - DNA, 25 bp, S. pombe
gggcatcaagagtcatattcaggaa

SEQ ID NO: 102061 - DNA, 25 bp, S. pombe
gggaatccagctgttcgaaaccgtg

SEQ ID NO: 102062 - DNA, 25 bp, S. pombe
gggaagccgtccttagcaaaacaat

SEQ ID NO: 102063 - DNA, 25 bp, S. pombe
gggagacttccttaacgacgatgat

SEQ ID NO: 102064 - DNA, 25 bp, S. pombe
gggctttgaatcctgacgacttcga

SEQ ID NO: 102065 - DNA, 25 bp, S. pombe
gggctatcgaatttgacttctccaa

SEQ ID NO: 102066 - DNA, 25 bp, S. pombe
gggcgatcgatttgtacatcctgga

SEQ ID NO: 102067 - DNA, 25 bp, S. pombe
gggcgactttcgtgctactggattc

SEQ ID NO: 102068 - DNA, 25 bp, S. pombe
gggaagctattcgtaaccgtaatcg

SEQ ID NO: 102069 - DNA, 25 bp, S. pombe
gggcaactttcattgatccaccaaa

SEQ ID NO: 102070 - DNA, 25 bp, S. pombe
gggcatacctctattgcctatgata

SEQ ID NO: 102071 - DNA, 25 bp, S. pombe
gggctgctcccaatcttgagattaa

SEQ ID NO: 102072 - DNA, 25 bp, S. pombe
gggcattctatcattatcattgggt

SEQ ID NO: 102073 - DNA, 25 bp, S. pombe
gggcttttgattcccattgaaggca

SEQ ID NO: 102074 - DNA, 25 bp, S. pombe
gggcttattattacttccgggatct

SEQ ID NO: 102075 - DNA, 25 bp, S. pombe
gggaaccaaaattactccaagtgct

SEQ ID NO: 102076 - DNA, 25 bp, S. pombe
gggaacccatagatttctcgagtct

SEQ ID NO: 102077 - DNA, 25 bp, S. pombe
gggaacccgtgaaagcctgttgcag

SEQ ID NO: 102078 - DNA, 25 bp, S. pombe
ggtgaacgtactcttactaaggaca

SEQ ID NO: 102079 - DNA, 25 bp, S. pombe
gggaatgctttgtcgttgcaccaaa

SEQ ID NO: 102080 - DNA, 25 bp, S. pombe
gggacatttgatgccttgagcgaaa

SEQ ID NO: 102081 - DNA, 25 bp, S. pombe
gggtttcattcgtaaaagccactag

SEQ ID NO: 102082 - DNA, 25 bp, S. pombe
gggctcctcagtctagagaacaaat

SEQ ID NO: 102083 - DNA, 25 bp, S. pombe
gggcgtcggtatataaccgcacgat

SEQ ID NO: 102084 - DNA, 25 bp, S. pombe
gggcagtcttggattacaccggtac

SEQ ID NO: 102085 - DNA, 25 bp, S. pombe
ggagaatgtagcctttcaaccccta

SEQ ID NO: 102086 - DNA, 25 bp, S. pombe
ggaacaatgacgcttaacccttatc

SEQ ID NO: 102087 - DNA, 25 bp, S. pombe
ggaagaaacgcgtgagacgccttaa

SEQ ID NO: 102088 - DNA, 25 bp, S. pombe
gggcagttaggtttcattcatcatt

SEQ ID NO: 102089 - DNA, 25 bp, S. pombe
gggcttctttatcgactgtcaaatt

SEQ ID NO: 102090 - DNA, 25 bp, S. pombe
ggaggtccctttgaacagcatgttt

SEQ ID NO: 102091 - DNA, 25 bp, S. pombe
gggcttggcgctcactataatagtt

SEQ ID NO: 102092 - DNA, 25 bp, S. pombe
gggacaccatcagcgaaccaaagtt

SEQ ID NO: 102093 - DNA, 25 bp, S. pombe
gggaatcatcattgccgatacgaaa

SEQ ID NO: 102094 - DNA, 25 bp, S. pombe
gggaaaccgaattttgcatgcaact

SEQ ID NO: 102095 - DNA, 25 bp, S. pombe
gggcaataccgcttaaccaaatgta

SEQ ID NO: 102096 - DNA, 25 bp, S. pombe
gggaaaccgctttatcaaaactatg

SEQ ID NO: 102097 - DNA, 25 bp, S. pombe
gggatatacggtatgtgcgcgacat

SEQ ID NO: 102098 - DNA, 25 bp, S. pombe
gggaactgcaatctgaagccgattt

SEQ ID NO: 102099 - DNA, 25 bp, S. pombe
gggcatccctcaatcgatataggct

SEQ ID NO: 102100 - DNA, 25 bp, S. pombe
gggatgcactctcctctgaaagcga

SEQ ID NO: 102101 - DNA, 25 bp, S. pombe
gggaacttctgacaacacggcagag

SEQ ID NO: 102102 - DNA, 25 bp, S. pombe
gggatcgtccttatactcgagagcg

SEQ ID NO: 102103 - DNA, 25 bp, S. pombe
gggcatttcgacactgtgattgaca

SEQ ID NO: 102104 - DNA, 25 bp, S. pombe
gggcttttgcctgctatattacatt

SEQ ID NO: 102105 - DNA, 25 bp, S. pombe
gggctttcttccatagttcattatc

SEQ ID NO: 102106 - DNA, 25 bp, S. pombe
gggcttctatgatcctttctggtac

SEQ ID NO: 102107 - DNA, 25 bp, S. pombe
gggcatcttcagaacttttccgatt

SEQ ID NO: 102108 - DNA, 25 bp, S. pombe
gggcagcatctacaagttaccattt

SEQ ID NO: 102109 - DNA, 25 bp, S. pombe
gggcttcattgtcgctaatatcttg

SEQ ID NO: 102110 - DNA, 25 bp, S. pombe
gggcattcattttcatacgagacta

SEQ ID NO: 102111 - DNA, 25 bp, S. pombe
gggacaagcaactgtgcacgacctt

SEQ ID NO: 102112 - DNA, 25 bp, S. pombe
gggagtccatttgatgtctactttc

SEQ ID NO: 102113 - DNA, 25 bp, S. pombe
gggagttcgtctatttcacttacat

SEQ ID NO: 102114 - DNA, 25 bp, S. pombe
gggctcttggatctctttatttata

SEQ ID NO: 102115 - DNA, 25 bp, S. pombe
gggctgctaaatctatcattgttaa

SEQ ID NO: 102116 - DNA, 25 bp, S. pombe
gggaatgatagacagccttgcacaa

SEQ ID NO: 102117 - DNA, 25 bp, S. pombe
gggcaaaagtacttctgcgcacctt

SEQ ID NO: 102118 - DNA, 25 bp, S. pombe
gggaacgtgcactacctattgaatt

SEQ ID NO: 102119 - DNA, 25 bp, S. pombe
gggaagttcgtactgttgagcttat

SEQ ID NO: 102120 - DNA, 25 bp, S. pombe
gggaatgttcctgatgttagtcttt

SEQ ID NO: 102121 - DNA, 25 bp, S. pombe
gggactattactgtctgttggaatt

SEQ ID NO: 102122 - DNA, 25 bp, S. pombe
gggactctactaggaatcttatcga

SEQ ID NO: 102123 - DNA, 25 bp, S. pombe
gggacttaaagacctcactcttgca

SEQ ID NO: 102124 - DNA, 25 bp, S. pombe
gggcttagagaaatttcacgtctga

SEQ ID NO: 102125 - DNA, 25 bp, S. pombe
gggctctttacattttctgatccta

SEQ ID NO: 102126 - DNA, 25 bp, S. pombe
gggcactttccttacttggattcaa

SEQ ID NO: 102127 - DNA, 25 bp, S. pombe
gggcttacttactcgtgcaattcaa

SEQ ID NO: 102128 - DNA, 25 bp, S. pombe
gggctttttatttctggcgtgtcaa

SEQ ID NO: 102129 - DNA, 25 bp, S. pombe
gggctacgtgttaatctggatttca

SEQ ID NO: 102130 - DNA, 25 bp, S. pombe
gggctcaactgctataccttatgtt

SEQ ID NO: 102131 - DNA, 25 bp, S. pombe
gggctatgatatttcctttcttata

SEQ ID NO: 102132 - DNA, 25 bp, S. pombe
gggcattgatatcttctttttcgag

SEQ ID NO: 102133 - DNA, 25 bp, S. pombe
gggcaatgttctttttctttgcgaa

SEQ ID NO: 102134 - DNA, 25 bp, S. pombe
gggaatgtttccttgtctattaata

SEQ ID NO: 102135 - DNA, 25 bp, S. pombe
gggcaaaatgcctagttctgtgaaa

SEQ ID NO: 102136 - DNA, 25 bp, S. pombe
gggtagcagtcttggtgtccctgaa

SEQ ID NO: 102137 - DNA, 25 bp, S. pombe
gggcttcgacgaatttatgaacatt

SEQ ID NO: 102138 - DNA, 25 bp, S. pombe
gggcttctccccaaagtgaggtcat

SEQ ID NO: 102139 - DNA, 25 bp, S. pombe
gggttctccttattgggaagccaag

SEQ ID NO: 102140 - DNA, 25 bp, S. pombe
gggcatgtatccaagattcacttct

SEQ ID NO: 102141 - DNA, 25 bp, S. pombe
gggcagatcagcgaaagtccttgta

SEQ ID NO: 102142 - DNA, 25 bp, S. pombe
gggactactgcattggtaccgctag

SEQ ID NO: 102143 - DNA, 25 bp, S. pombe
gggaaattattaatagccgccattt

SEQ ID NO: 102144 - DNA, 25 bp, S. pombe
gggacattgattattcagccatgcc

SEQ ID NO: 102145 - DNA, 25 bp, S. pombe
gggagaaatcccatttgcattatga

SEQ ID NO: 102146 - DNA, 25 bp, S. pombe
gggcttttggcgttttgatgtatca

SEQ ID NO: 102147 - DNA, 25 bp, S. pombe
gggaattcaagcttcagcctctggg

SEQ ID NO: 102148 - DNA, 25 bp, S. pombe
gggcaaatccgtcgctagcaattaa

SEQ ID NO: 102149 - DNA, 25 bp, S. pombe
gggcaccatcatataccatgcagat

SEQ ID NO: 102150 - DNA, 25 bp, S. pombe
gggcacccattgaacatgatggcaa

SEQ ID NO: 102151 - DNA, 25 bp, S. pombe
gggaggtgagtctcttatttccttt

SEQ ID NO: 102152 - DNA, 25 bp, S. pombe
gggagttgttgatacccctatgcaa

SEQ ID NO: 102153 - DNA, 25 bp, S. pombe
gggaatcaattttcacaccaggtgt

SEQ ID NO: 102154 - DNA, 25 bp, S. pombe
gggacgaaatgcttcaatactctta

SEQ ID NO: 102155 - DNA, 25 bp, S. pombe
gggcacgtatttggaagacttgtaa

SEQ ID NO: 102156 - DNA, 25 bp, S. pombe
gggcatcatttttcgaagctggtta

SEQ ID NO: 102157 - DNA, 25 bp, S. pombe
gggacctggcaaactcttggtacag

SEQ ID NO: 102158 - DNA, 25 bp, S. pombe
gggacaatatctacgatcctctgca

SEQ ID NO: 102159 - DNA, 25 bp, S. pombe
gggaaatcattctctaattctcagc

SEQ ID NO: 102160 - DNA, 25 bp, S. pombe
gggaactactccaatcaagtcttct

SEQ ID NO: 102161 - DNA, 25 bp, S. pombe
gggacagtccttcgagatattttac

SEQ ID NO: 102162 - DNA, 25 bp, S. pombe
ggtgccatcttggaaggcgatactt

SEQ ID NO: 102163 - DNA, 25 bp, S. pombe
gggcagagtctgtacttcgacaata

SEQ ID NO: 102164 - DNA, 25 bp, S. pombe
gggtattgctgagcccaatggagaa

SEQ ID NO: 102165 - DNA, 25 bp, S. pombe
gggtacttgcagaggctattcgccg

SEQ ID NO: 102166 - DNA, 25 bp, S. pombe
gggtcacattggatggtccgtgcca

SEQ ID NO: 102167 - DNA, 25 bp, S. pombe
gggtcaagctggatggttcaacttt

SEQ ID NO: 102168 - DNA, 25 bp, S. pombe
gggactctcgatcgctttgtcaaag

SEQ ID NO: 102169 - DNA, 25 bp, S. pombe
gggcacttgtgttatcttatcaacg

SEQ ID NO: 102170 - DNA, 25 bp, S. pombe
gggatacagttcattggcagcacaa

SEQ ID NO: 102171 - DNA, 25 bp, S. pombe
gggactgataaagctgtgcctcaaa

SEQ ID NO: 102172 - DNA, 25 bp, S. pombe
gggaatgattgattttgccctcaaa

SEQ ID NO: 102173 - DNA, 25 bp, S. pombe
gggaaaatcatgtcttcttctgaga

SEQ ID NO: 102174 - DNA, 25 bp, S. pombe
gggaagaactcaatctctacagaat

SEQ ID NO: 102175 - DNA, 25 bp, S. pombe
gggcaaaagccaagtcattcctatg

SEQ ID NO: 102176 - DNA, 25 bp, S. pombe
gggcaacctgtcattgattcctcgg

SEQ ID NO: 102177 - DNA, 25 bp, S. pombe
gggcaatttccatttggtccgatgc

SEQ ID NO: 102178 - DNA, 25 bp, S. pombe
gggcaattacaattccagttgcagt

SEQ ID NO: 102179 - DNA, 25 bp, S. pombe
gggcaattctcgtatccgattatct

SEQ ID NO: 102180 - DNA, 25 bp, S. pombe
gggtatttcgcatttcgattccaaa

SEQ ID NO: 102181 - DNA, 25 bp, S. pombe
tggcgttgaagacccggacgtttat

SEQ ID NO: 102182 - DNA, 25 bp, S. pombe
gggattacacttccgggacttctat

SEQ ID NO: 102183 - DNA, 25 bp, S. pombe
gggacatggatcaactacgtgcttt

SEQ ID NO: 102184 - DNA, 25 bp, S. pombe
gggcaactcattatgcagacattta

SEQ ID NO: 102185 - DNA, 25 bp, S. pombe
gggatcctagatttgcttcattgta

SEQ ID NO: 102186 - DNA, 25 bp, S. pombe
gggattcaagattatgccagtcgta

SEQ ID NO: 102187 - DNA, 25 bp, S. pombe
ggagcatccaaaattacgtccctct

SEQ ID NO: 102188 - DNA, 25 bp, S. pombe
ggcgacttaataatacttcctcctg

SEQ ID NO: 102189 - DNA, 25 bp, S. pombe
gggcacccgaagaatttgttcacat

SEQ ID NO: 102190 - DNA, 25 bp, S. pombe
gggaaccatgcgtactattaactca

SEQ ID NO: 102191 - DNA, 25 bp, S. pombe
gggacagcaatatcgtactcctgaa

SEQ ID NO: 102192 - DNA, 25 bp, S. pombe
gggaccagcagaccgtactttaatt

SEQ ID NO: 102193 - DNA, 25 bp, S. pombe
ggtgaaccgaacatacttggaagct

SEQ ID NO: 102194 - DNA, 25 bp, S. pombe
gggaagccgattgttcttacagatg

SEQ ID NO: 102195 - DNA, 25 bp, S. pombe
ggtgaagtcctttctggttacgata

SEQ ID NO: 102196 - DNA, 25 bp, S. pombe
gggcaaccattgtattgttttcaag

SEQ ID NO: 102197 - DNA, 25 bp, S. pombe
gggagatcccaacgctgaacacagt

SEQ ID NO: 102198 - DNA, 25 bp, S. pombe
gggatgcgacacatactaaggctaa

SEQ ID NO: 102199 - DNA, 25 bp, S. pombe
gggactgcaccttccattatgggaa

SEQ ID NO: 102200 - DNA, 25 bp, S. pombe
gggaccacatgctacgatttggaaa

SEQ ID NO: 102201 - DNA, 25 bp, S. pombe
gggacatcgttactgacttggaata

SEQ ID NO: 102202 - DNA, 25 bp, S. pombe
gggaatgcgttactcagcctggatt

SEQ ID NO: 102203 - DNA, 25 bp, S. pombe
gggagcggtgaactcacctgctata

SEQ ID NO: 102204 - DNA, 25 bp, S. pombe
gggacatcaccaaaccagtacagta

SEQ ID NO: 102205 - DNA, 25 bp, S. pombe
gggagctactcaaaaatgtctgcgt

SEQ ID NO: 102206 - DNA, 25 bp, S. pombe
gggagtgcgctcatcaagttcatcg

SEQ ID NO: 102207 - DNA, 25 bp, S. pombe
gggaggtgctctgcaatttcttaaa

SEQ ID NO: 102208 - DNA, 25 bp, S. pombe
gggattttgatactcttagccattt

SEQ ID NO: 102209 - DNA, 25 bp, S. pombe
gggacacgtgccctatgttacgaaa

SEQ ID NO: 102210 - DNA, 25 bp, S. pombe
gggacaggctgcaacttttcctaaa

SEQ ID NO: 102211 - DNA, 25 bp, S. pombe
gggaacaactggtacacatgcaatc

SEQ ID NO: 102212 - DNA, 25 bp, S. pombe
gggcaaaattatctccaagcgtatt

SEQ ID NO: 102213 - DNA, 25 bp, S. pombe
gggaaattcttcttaatcgtgctaa

SEQ ID NO: 102214 - DNA, 25 bp, S. pombe
gggttattcagcacgccgccgtatt

SEQ ID NO: 102215 - DNA, 25 bp, S. pombe
gggtcttgataatcccagccgtcaa

SEQ ID NO: 102216 - DNA, 25 bp, S. pombe
gggactttcaaagctcgcacgtata

SEQ ID NO: 102217 - DNA, 25 bp, S. pombe
gggactgttcatggccttaacgtac

SEQ ID NO: 102218 - DNA, 25 bp, S. pombe
gggactcttacattttaatgcgcta

SEQ ID NO: 102219 - DNA, 25 bp, S. pombe
tgtggatcccagtttcttcaagtta

SEQ ID NO: 102220 - DNA, 25 bp, S. pombe
gggatacctgttttacacacataca

SEQ ID NO: 102221 - DNA, 25 bp, S. pombe
gggaatcgctggcaataccgcatat

SEQ ID NO: 102222 - DNA, 25 bp, S. pombe
gggcaatcgccggataacacttgat

SEQ ID NO: 102223 - DNA, 25 bp, S. pombe
gggagcttactcataatacttcatt

SEQ ID NO: 102224 - DNA, 25 bp, S. pombe
gggaatcacacaaaaataccgcttt

SEQ ID NO: 102225 - DNA, 25 bp, S. pombe
gggcaatctccacatctagaaaatg

SEQ ID NO: 102226 - DNA, 25 bp, S. pombe
gggtatcaacgtcagctgaagagtt

SEQ ID NO: 102227 - DNA, 25 bp, S. pombe
gggtcccggtgctcaagctgctctt

SEQ ID NO: 102228 - DNA, 25 bp, S. pombe
gggatcatcgtcttagtaaatgacc

SEQ ID NO: 102229 - DNA, 25 bp, S. pombe
gggactcgtacttgaaagctgcaaa

SEQ ID NO: 102230 - DNA, 25 bp, S. pombe
gggaccagctactacaacactaatt

SEQ ID NO: 102231 - DNA, 25 bp, S. pombe
ggtgaccgtacgttagaggacttga

SEQ ID NO: 102232 - DNA, 25 bp, S. pombe
gggagcgcgattcagctattagcaa

SEQ ID NO: 102233 - DNA, 25 bp, S. pombe
gggaggacgtttcagattatgtttt

SEQ ID NO: 102234 - DNA, 25 bp, S. pombe
gggaagctattcagcctggatttac

SEQ ID NO: 102235 - DNA, 25 bp, S. pombe
ggatgaagcatcttctaccggcgat

SEQ ID NO: 102236 - DNA, 25 bp, S. pombe
gggagctgatgcacaagccgacgat

SEQ ID NO: 102237 - DNA, 25 bp, S. pombe
gggtcttatgctgcccaaggtgttt

SEQ ID NO: 102238 - DNA, 25 bp, S. pombe
gggtatgaagccattgccaaccttt

SEQ ID NO: 102239 - DNA, 25 bp, S. pombe
gggaaatccttcagcaggctatctt

SEQ ID NO: 102240 - DNA, 25 bp, S. pombe
gggacacttgttggattcgatgatt

SEQ ID NO: 102241 - DNA, 25 bp, S. pombe
gggaactagcaaggcctcaaatcat

SEQ ID NO: 102242 - DNA, 25 bp, S. pombe
gggaacgacatcacttgctaatcat

SEQ ID NO: 102243 - DNA, 25 bp, S. pombe
gggaaatcattcaatctaccattat

SEQ ID NO: 102244 - DNA, 25 bp, S. pombe
gggatgtcgccttattgaaccaaaa

SEQ ID NO: 102245 - DNA, 25 bp, S. pombe
gggagctccgttaccacaacaaaag

SEQ ID NO: 102246 - DNA, 25 bp, S. pombe
gggaactgggatttcgtttacgcat

SEQ ID NO: 102247 - DNA, 25 bp, S. pombe
gggaacttgtaatcatgcatttcac

SEQ ID NO: 102248 - DNA, 25 bp, S. pombe
gggatcatgatacacagtttgcttt

SEQ ID NO: 102249 - DNA, 25 bp, S. pombe
gggaatgctgcatcctcttggagga

SEQ ID NO: 102250 - DNA, 25 bp, S. pombe
gggaaatcacatagtcacagttcgt

SEQ ID NO: 102251 - DNA, 25 bp, S. pombe
gggacacgttaccatcatttctgat

SEQ ID NO: 102252 - DNA, 25 bp, S. pombe
gggacgcacctacaagttcatattc

SEQ ID NO: 102253 - DNA, 25 bp, S. pombe
gggtatttagtcaagcccaaagagt

SEQ ID NO: 102254 - DNA, 25 bp, S. pombe
gggacaccgaaaatgccactcaatg

SEQ ID NO: 102255 - DNA, 25 bp, S. pombe
ggttacccaaattgtcaccatttct

SEQ ID NO: 102256 - DNA, 25 bp, S. pombe
gggaccgcatatatggctttctcca

SEQ ID NO: 102257 - DNA, 25 bp, S. pombe
gggatacatctctagagtcttcgtt

SEQ ID NO: 102258 - DNA, 25 bp, S. pombe
gggaacatcgagcaattactgtcta

SEQ ID NO: 102259 - DNA, 25 bp, S. pombe
gggagccatcgtattctatggtact

SEQ ID NO: 102260 - DNA, 25 bp, S. pombe
gggagatctctcattttcctatgga

SEQ ID NO: 102261 - DNA, 25 bp, S. pombe
gggacatctctctttattttcttgc

SEQ ID NO: 102262 - DNA, 25 bp, S. pombe
gggaggtcttgtttccatttggata

SEQ ID NO: 102263 - DNA, 25 bp, S. pombe
gggaggtccacttaacatgtttgaa

SEQ ID NO: 102264 - DNA, 25 bp, S. pombe
gggacatgacattcctcgaaaattt

SEQ ID NO: 102265 - DNA, 25 bp, S. pombe
gggtaacgccgagcacgattggctt

SEQ ID NO: 102266 - DNA, 25 bp, S. pombe
gggtaaatgcggtgccatcttggct

SEQ ID NO: 102267 - DNA, 25 bp, S. pombe
gggttctgatgtcgatgcaacttta

SEQ ID NO: 102268 - DNA, 25 bp, S. pombe
gggttttggcttgttactcatctaa

SEQ ID NO: 102269 - DNA, 25 bp, S. pombe
gggatttcttcaaatgccttgtact

SEQ ID NO: 102270 - DNA, 25 bp, S. pombe
gggagatcgcttatcaccaagtcag

SEQ ID NO: 102271 - DNA, 25 bp, S. pombe
gggaaatgcttactcgccatataac

SEQ ID NO: 102272 - DNA, 25 bp, S. pombe
gggatatgcattccatcttcttaca

SEQ ID NO: 102273 - DNA, 25 bp, S. pombe
gggatactgtacatttttcaaggct

SEQ ID NO: 102274 - DNA, 25 bp, S. pombe
gggtttggtcttcgtattaatctgt

SEQ ID NO: 102275 - DNA, 25 bp, S. pombe
ggttagtaaatctctcagttggctt

SEQ ID NO: 102276 - DNA, 25 bp, S. pombe
gggacattgccataaaatttctcga

SEQ ID NO: 102277 - DNA, 25 bp, S. pombe
gggacttccacctaataagcttctg

SEQ ID NO: 102278 - DNA, 25 bp, S. pombe
gggaaatcccaattacacatgcttg

SEQ ID NO: 102279 - DNA, 25 bp, S. pombe
gggaaactctcgaagacatctttag

SEQ ID NO: 102280 - DNA, 25 bp, S. pombe
gggaaagtcctgttgatacttttat

SEQ ID NO: 102281 - DNA, 25 bp, S. pombe
gggaccggtcatattcatacgttcg

SEQ ID NO: 102282 - DNA, 25 bp, S. pombe
gggaccgctttaatgaatcgatttt

SEQ ID NO: 102283 - DNA, 25 bp, S. pombe
gggaacttctctaagcaacgcattt

SEQ ID NO: 102284 - DNA, 25 bp, S. pombe
gggtttccgatgctactcgtgaagc

SEQ ID NO: 102285 - DNA, 25 bp, S. pombe
gggtgctccggtcaacctggaaaat

SEQ ID NO: 102286 - DNA, 25 bp, S. pombe
gggtcttctggtgaacattcgcatc

SEQ ID NO: 102287 - DNA, 25 bp, S. pombe
gggagattacgacttggcaatgaca

SEQ ID NO: 102288 - DNA, 25 bp, S. pombe
gggacattcaactccgcattcaaaa

SEQ ID NO: 102289 - DNA, 25 bp, S. pombe
gggactttctgcgatactagagtta

SEQ ID NO: 102290 - DNA, 25 bp, S. pombe
gggtttcccggcatagaggttcaat

SEQ ID NO: 102291 - DNA, 25 bp, S. pombe
gggatttaccccacagatagttctt

SEQ ID NO: 102292 - DNA, 25 bp, S. pombe
gggttcacaccgcatatgcacgaag

SEQ ID NO: 102293 - DNA, 25 bp, S. pombe
ggtgttttcgtttatccaggcatgg

SEQ ID NO: 102294 - DNA, 25 bp, S. pombe
gggactttcttttatcgatcacatc

SEQ ID NO: 102295 - DNA, 25 bp, S. pombe
gggactgaatcctaacttggcaaag

SEQ ID NO: 102296 - DNA, 25 bp, S. pombe
gggattgcctttggccaaggactac

SEQ ID NO: 102297 - DNA, 25 bp, S. pombe
gggatctcttcgtacatacctggac

SEQ ID NO: 102298 - DNA, 25 bp, S. pombe
gggacattcaagttcatcattctgg

SEQ ID NO: 102299 - DNA, 25 bp, S. pombe
gggagctggtactgctttagctgca

SEQ ID NO: 102300 - DNA, 25 bp, S. pombe
gggatcttgctctacgcatttactg

SEQ ID NO: 102301 - DNA, 25 bp, S. pombe
gggattcttctgttgctattattgt

SEQ ID NO: 102302 - DNA, 25 bp, S. pombe
gggttcctcttaaatggcattggcc

SEQ ID NO: 102303 - DNA, 25 bp, S. pombe
gggtttctcttacaccgaagccaat

SEQ ID NO: 102304 - DNA, 25 bp, S. pombe
gggttatcttctcaaccgtttagca

SEQ ID NO: 102305 - DNA, 25 bp, S. pombe
gggttttatcacacgccggtgctag

SEQ ID NO: 102306 - DNA, 25 bp, S. pombe
gggataattttgtctcaatgcttga

SEQ ID NO: 102307 - DNA, 25 bp, S. pombe
gggattaattgctagtcaaccttct

SEQ ID NO: 102308 - DNA, 25 bp, S. pombe
gggataacggcacccatcatacgag

SEQ ID NO: 102309 - DNA, 25 bp, S. pombe
gggatttcgtcctgttactttctca

SEQ ID NO: 102310 - DNA, 25 bp, S. pombe
ggtcttaaattctcaagcttaccta

SEQ ID NO: 102311 - DNA, 25 bp, S. pombe
gggatgtttctcctgtttcacacag

SEQ ID NO: 102312 - DNA, 25 bp, S. pombe
gggagttgcaatgcgtctccaacgt

SEQ ID NO: 102313 - DNA, 25 bp, S. pombe
gggagttgttgtttctaagcgttat

SEQ ID NO: 102314 - DNA, 25 bp, S. pombe
gggatcttatccgtcgtttgaaaca

SEQ ID NO: 102315 - DNA, 25 bp, S. pombe
gggatttttgccctttgatgaaaat

SEQ ID NO: 102316 - DNA, 25 bp, S. pombe
gggatttcccacctgttgagtatga

SEQ ID NO: 102317 - DNA, 25 bp, S. pombe
gggagttccaacgttatggtcatta

SEQ ID NO: 102318 - DNA, 25 bp, S. pombe
gggagcaaccaacggtacttcatta

SEQ ID NO: 102319 - DNA, 25 bp, S. pombe
gggtggcccaaagttcgatatcgtg

SEQ ID NO: 102320 - DNA, 25 bp, S. pombe
ggcgtacgacaatattcgattcctg

SEQ ID NO: 102321 - DNA, 25 bp, S. pombe
gggttaattcttccagtgtttctga

SEQ ID NO: 102322 - DNA, 25 bp, S. pombe
gggttcaccatgatggcccatttga

SEQ ID NO: 102323 - DNA, 25 bp, S. pombe
gggtaatactacttccacttgtaag

SEQ ID NO: 102324 - DNA, 25 bp, S. pombe
gggttgtttaccatcattcgtgata

SEQ ID NO: 102325 - DNA, 25 bp, S. pombe
gggatttttattaatcgtaggatca

SEQ ID NO: 102326 - DNA, 25 bp, S. pombe
gggacttcttcttctgacgttaaag

SEQ ID NO: 102327 - DNA, 25 bp, S. pombe
gggactcttcctttgttgatgatac

SEQ ID NO: 102328 - DNA, 25 bp, S. pombe
gggagtgttcgtgttacatccacat

SEQ ID NO: 102329 - DNA, 25 bp, S. pombe
gggactggtacttttatatcacttt

SEQ ID NO: 102330 - DNA, 25 bp, S. pombe
gggtatggtcgtaagctcatgctcc

SEQ ID NO: 102331 - DNA, 25 bp, S. pombe
gggacgtcttcattgactggagaat

SEQ ID NO: 102332 - DNA, 25 bp, S. pombe
gggtccatcactactattaatttta

SEQ ID NO: 102333 - DNA, 25 bp, S. pombe
ggtggcgatggctctttaattatgg

SEQ ID NO: 102334 - DNA, 25 bp, S. pombe
gggatagactcttacagcaaaactc

SEQ ID NO: 102335 - DNA, 25 bp, S. pombe
gggagagacttagatcagattcaca

SEQ ID NO: 102336 - DNA, 25 bp, S. pombe
gggtaaaaccattgcttccacctcg

SEQ ID NO: 102337 - DNA, 25 bp, S. pombe
tgaggttaaaccaccttccactact

SEQ ID NO: 102338 - DNA, 25 bp, S. pombe
gggactgcaatatgtcgatccaagt

SEQ ID NO: 102339 - DNA, 25 bp, S. pombe
gggattacagtacccatcagtatcg

SEQ ID NO: 102340 - DNA, 25 bp, S. pombe
gggattgctctcaacataaatgaat

SEQ ID NO: 102341 - DNA, 25 bp, S. pombe
gggttgtttccagtgatgcctatac

SEQ ID NO: 102342 - DNA, 25 bp, S. pombe
gggattttttcaatcgcctgtcagc

SEQ ID NO: 102343 - DNA, 25 bp, S. pombe
gggagctctctttaacggtcaggac

SEQ ID NO: 102344 - DNA, 25 bp, S. pombe
gggatctttacatcacagttcgtta

SEQ ID NO: 102345 - DNA, 25 bp, S. pombe
gggagctttcctgaagaaggcgaaa

SEQ ID NO: 102346 - DNA, 25 bp, S. pombe
gggtattacccatctacggtgatat

SEQ ID NO: 102347 - DNA, 25 bp, S. pombe
ggtggtggattcattccggctagaa

SEQ ID NO: 102348 - DNA, 25 bp, S. pombe
gggagacaaatttatactagcatat

SEQ ID NO: 102349 - DNA, 25 bp, S. pombe
gggagcagctccatatatcgtgtct

SEQ ID NO: 102350 - DNA, 25 bp, S. pombe
gggtggccgatgatactgttcataa

SEQ ID NO: 102351 - DNA, 25 bp, S. pombe
gggatatgctattgccagcgcattt

SEQ ID NO: 102352 - DNA, 25 bp, S. pombe
ggtgtaattgttctcggtaatccaa

SEQ ID NO: 102353 - DNA, 25 bp, S. pombe
gggtacatacttctttgggtatcct

SEQ ID NO: 102354 - DNA, 25 bp, S. pombe
ggcatttccgttcgccgagtttaat

SEQ ID NO: 102355 - DNA, 25 bp, S. pombe
gggtttgacgttgcaggctatttac

SEQ ID NO: 102356 - DNA, 25 bp, S. pombe
ggtgtttaacttgctttctttcatc

SEQ ID NO: 102357 - DNA, 25 bp, S. pombe
gggtgccgtaatctttattttgcca

SEQ ID NO: 102358 - DNA, 25 bp, S. pombe
gggttactactttctacaaatgatg

SEQ ID NO: 102359 - DNA, 25 bp, S. pombe
gggattcttcgcaaatataggacca

SEQ ID NO: 102360 - DNA, 25 bp, S. pombe
gggatacctcagttgttccagaact

SEQ ID NO: 102361 - DNA, 25 bp, S. pombe
gggatccctggcagtgtctcaaaat

SEQ ID NO: 102362 - DNA, 25 bp, S. pombe
tggacccggaggctgctcgaaaatt

SEQ ID NO: 102363 - DNA, 25 bp, S. pombe
ggaaccggatggctttacaacttcg

SEQ ID NO: 102364 - DNA, 25 bp, S. pombe
gggatccggatatctttcacaactt

SEQ ID NO: 102365 - DNA, 25 bp, S. pombe
gggataacgctgaactttacttgga

SEQ ID NO: 102366 - DNA, 25 bp, S. pombe
gggtcacaatgtctttatttctgga

SEQ ID NO: 102367 - DNA, 25 bp, S. pombe
gggtatacagtcatgcttttccttg

SEQ ID NO: 102368 - DNA, 25 bp, S. pombe
gggattccctcaggagttctcaatt

SEQ ID NO: 102369 - DNA, 25 bp, S. pombe
gggtacacctggcagtaacaatgtt

SEQ ID NO: 102370 - DNA, 25 bp, S. pombe
gggtattgcctacagctacaacagt

SEQ ID NO: 102371 - DNA, 25 bp, S. pombe
gggatactacgttcagcaggccaat

SEQ ID NO: 102372 - DNA, 25 bp, S. pombe
gggtactacactttacgctgcaata

SEQ ID NO: 102373 - DNA, 25 bp, S. pombe
gggtatgaaccttctatggctgaaa

SEQ ID NO: 102374 - DNA, 25 bp, S. pombe
ggaaagccagatccggaagctcgtt

SEQ ID NO: 102375 - DNA, 25 bp, S. pombe
gggtatctcctacacaaggcaggaa

SEQ ID NO: 102376 - DNA, 25 bp, S. pombe
gggatccaacttatcaagcttactt

SEQ ID NO: 102377 - DNA, 25 bp, S. pombe
gggttcgacactatggatgcctatt

SEQ ID NO: 102378 - DNA, 25 bp, S. pombe
gggttcgtcaacatcgtgagcatat

SEQ ID NO: 102379 - DNA, 25 bp, S. pombe
gggttacaaggacattttcgctcta

SEQ ID NO: 102380 - DNA, 25 bp, S. pombe
gggtttcaagcgcaatgggtccttc

SEQ ID NO: 102381 - DNA, 25 bp, S. pombe
ggtgtcctttccatttatgaccaag

SEQ ID NO: 102382 - DNA, 25 bp, S. pombe
gggttcttgcataattttagcctaa

SEQ ID NO: 102383 - DNA, 25 bp, S. pombe
gggatcatcaagttggtctttcata

SEQ ID NO: 102384 - DNA, 25 bp, S. pombe
gggatcgctctcatgaatttctata

SEQ ID NO: 102385 - DNA, 25 bp, S. pombe
gggatgccatctcgtatattacaaa

SEQ ID NO: 102386 - DNA, 25 bp, S. pombe
ggtgatgctacttcggaccttagta

SEQ ID NO: 102387 - DNA, 25 bp, S. pombe
gggagtcatccatcaaagtgtcata

SEQ ID NO: 102388 - DNA, 25 bp, S. pombe
gggttgctgcacttaagacttctat

SEQ ID NO: 102389 - DNA, 25 bp, S. pombe
gggatatttctcctacatattctaa

SEQ ID NO: 102390 - DNA, 25 bp, S. pombe
gggagatctttgctcatgcatttat

SEQ ID NO: 102391 - DNA, 25 bp, S. pombe
gggattccaagttatcactgtcctt

SEQ ID NO: 102392 - DNA, 25 bp, S. pombe
gggattccatatgtaactctagctg

SEQ ID NO: 102393 - DNA, 25 bp, S. pombe
gggttatttcgttttgccgatgcaa

SEQ ID NO: 102394 - DNA, 25 bp, S. pombe
gggtagttcgcgttttgcctgaaca

SEQ ID NO: 102395 - DNA, 25 bp, S. pombe
gggtagctacttgatcaatgcctcc

SEQ ID NO: 102396 - DNA, 25 bp, S. pombe
gggtatctcattggcttaaccttat

SEQ ID NO: 102397 - DNA, 25 bp, S. pombe
gggtagtcatttgctatacactttt

SEQ ID NO: 102398 - DNA, 25 bp, S. pombe
gggattatctttgttctgcagcatt

SEQ ID NO: 102399 - DNA, 25 bp, S. pombe
gggattcatttgtccttgccaatgt

SEQ ID NO: 102400 - DNA, 25 bp, S. pombe
gggatccatttatcactgcaggtgg

SEQ ID NO: 102401 - DNA, 25 bp, S. pombe
ggtgtcacaaactcaaccggttaat

SEQ ID NO: 102402 - DNA, 25 bp, S. pombe
gggttacactaaatttatggctatt

SEQ ID NO: 102403 - DNA, 25 bp, S. pombe
gggtctcaggtatcatgccaagctt

SEQ ID NO: 102404 - DNA, 25 bp, S. pombe
gggtgttgcggaattgccatacatt

SEQ ID NO: 102405 - DNA, 25 bp, S. pombe
gggatttacgcaataggcagcattt

SEQ ID NO: 102406 - DNA, 25 bp, S. pombe
gggttattcgtgcaggtatcattac

SEQ ID NO: 102407 - DNA, 25 bp, S. pombe
gggttcaacgtccaggtgtactcaa

SEQ ID NO: 102408 - DNA, 25 bp, S. pombe
gggttcgacctatgtatgtatctca

SEQ ID NO: 102409 - DNA, 25 bp, S. pombe
ggtccgcacatacaagtagcttctt

SEQ ID NO: 102410 - DNA, 25 bp, S. pombe
ggtacccattggaaaagcgactttg

SEQ ID NO: 102411 - DNA, 25 bp, S. pombe
gggtgcatcagtatgaacatcctag

SEQ ID NO: 102412 - DNA, 25 bp, S. pombe
ggtggaagccctcacgattttgaaa

SEQ ID NO: 102413 - DNA, 25 bp, S. pombe
ggtggtaaatttgcttcaagaaact

SEQ ID NO: 102414 - DNA, 25 bp, S. pombe
ggtcctaaggaacccaaatcatcat

SEQ ID NO: 102415 - DNA, 25 bp, S. pombe
gggtgcaattgtatcctatggtata

SEQ ID NO: 102416 - DNA, 25 bp, S. pombe
gggtatgcaccctgcaattagacat

SEQ ID NO: 102417 - DNA, 25 bp, S. pombe
gggtcattccaagaactttccactt

SEQ ID NO: 102418 - DNA, 25 bp, S. pombe
gggttccttcaaaaagcgtctcatt

SEQ ID NO: 102419 - DNA, 25 bp, S. pombe
gggtacagtaacacacacaatcttt

SEQ ID NO: 102420 - DNA, 25 bp, S. pombe
gggatccgcagttcgcatggctgaa

SEQ ID NO: 102421 - DNA, 25 bp, S. pombe
gggtcgcgagattcctacataacga

SEQ ID NO: 102422 - DNA, 25 bp, S. pombe
gggatcgctagcattcatcttaaaa

SEQ ID NO: 102423 - DNA, 25 bp, S. pombe
gggtctgaagctacattttccagca

SEQ ID NO: 102424 - DNA, 25 bp, S. pombe
gggttctcgtcgtgcgtcagaaaaa

SEQ ID NO: 102425 - DNA, 25 bp, S. pombe
gggtatatggtgatcccctagaata

SEQ ID NO: 102426 - DNA, 25 bp, S. pombe
gggtagtaggtgtcccacttactca

SEQ ID NO: 102427 - DNA, 25 bp, S. pombe
gggttgaaaacatctctctttgccc

SEQ ID NO: 102428 - DNA, 25 bp, S. pombe
gggattaaaccattctgctgctttg

SEQ ID NO: 102429 - DNA, 25 bp, S. pombe
gggatctttccactgcttgatttaa

SEQ ID NO: 102430 - DNA, 25 bp, S. pombe
gggatttccgtctattgaactcata

SEQ ID NO: 102431 - DNA, 25 bp, S. pombe
gggatcgttctcaaattgctaccat

SEQ ID NO: 102432 - DNA, 25 bp, S. pombe
gggtcacttccacatatcaatcgat

SEQ ID NO: 102433 - DNA, 25 bp, S. pombe
ggtgtacccaagtccagatatatgc

SEQ ID NO: 102434 - DNA, 25 bp, S. pombe
gggtatccacaaatgaggtttcctc

SEQ ID NO: 102435 - DNA, 25 bp, S. pombe
gggtgagccaaacaatgcttctccc

SEQ ID NO: 102436 - DNA, 25 bp, S. pombe
ggtgaagctaaacaacgtgcccaag

SEQ ID NO: 102437 - DNA, 25 bp, S. pombe
gggattcacaataaggttgctcgta

SEQ ID NO: 102438 - DNA, 25 bp, S. pombe
gggtctcatcgaaaagccatccgaa

SEQ ID NO: 102439 - DNA, 25 bp, S. pombe
gggtttcatgcaaaagtcccgcaac

SEQ ID NO: 102440 - DNA, 25 bp, S. pombe
ggtgaatcctgataaaacctcaaga

SEQ ID NO: 102441 - DNA, 25 bp, S. pombe
gggtaaagttcacggatctctcgct

SEQ ID NO: 102442 - DNA, 25 bp, S. pombe
gggattgtcctgaaggctactgcat

SEQ ID NO: 102443 - DNA, 25 bp, S. pombe
gggtatgcctgctgatgtgtactta

SEQ ID NO: 102444 - DNA, 25 bp, S. pombe
gggatattccagcttgcaactttaa

SEQ ID NO: 102445 - DNA, 25 bp, S. pombe
gggtttatagttaagccatatccag

SEQ ID NO: 102446 - DNA, 25 bp, S. pombe
gggattattagtaccgacgttgata

SEQ ID NO: 102447 - DNA, 25 bp, S. pombe
ggacccgttcttgccgtcattaaat

SEQ ID NO: 102448 - DNA, 25 bp, S. pombe
ggacccaaactcactcgtcggaagt

SEQ ID NO: 102449 - DNA, 25 bp, S. pombe
gggtcccatatctggtaactggcta

SEQ ID NO: 102450 - DNA, 25 bp, S. pombe
gggttggcctgttatgacttcatac

SEQ ID NO: 102451 - DNA, 25 bp, S. pombe
gggttgtcctgttgagcgcatacaa

SEQ ID NO: 102452 - DNA, 25 bp, S. pombe
gggttgtttgcttatccatgctcaa

SEQ ID NO: 102453 - DNA, 25 bp, S. pombe
gggtacttcagcttgtgttacagct

SEQ ID NO: 102454 - DNA, 25 bp, S. pombe
gggttccttgcacatttacttagca

SEQ ID NO: 102455 - DNA, 25 bp, S. pombe
ggaggtctttcaggtgtcccttacg

SEQ ID NO: 102456 - DNA, 25 bp, S. pombe
ggtggttttcacttgaccgtcagtc

SEQ ID NO: 102457 - DNA, 25 bp, S. pombe
ggtcggtacgactgccttgggattt

SEQ ID NO: 102458 - DNA, 25 bp, S. pombe
ggtgtccttacttctgacagtcttc

SEQ ID NO: 102459 - DNA, 25 bp, S. pombe
ggtgatccttcacagtgggactttg

SEQ ID NO: 102460 - DNA, 25 bp, S. pombe
gggtagcattcactattcgtttttg

SEQ ID NO: 102461 - DNA, 25 bp, S. pombe
gggtatcctcatattcgatcttctt

SEQ ID NO: 102462 - DNA, 25 bp, S. pombe
gggtactgctttgggtgatcctcac

SEQ ID NO: 102463 - DNA, 25 bp, S. pombe
gggtgactatgcgtctggtaccaac

SEQ ID NO: 102464 - DNA, 25 bp, S. pombe
gggtccactgcaatatttaccatgg

SEQ ID NO: 102465 - DNA, 25 bp, S. pombe
gggtgctactaatcgaccagctgac

SEQ ID NO: 102466 - DNA, 25 bp, S. pombe
gggtagctccattgaattatttgca

SEQ ID NO: 102467 - DNA, 25 bp, S. pombe
ggtggttacgatcacgtccaggata

SEQ ID NO: 102468 - DNA, 25 bp, S. pombe
ggtggttatgcagcattgcgctcat

SEQ ID NO: 102469 - DNA, 25 bp, S. pombe
gggtatgttccctgttgatcaattc

SEQ ID NO: 102470 - DNA, 25 bp, S. pombe
gggtttccatattattcacaagcaa

SEQ ID NO: 102471 - DNA, 25 bp, S. pombe
gggtatttgccttttcaatctcagt

SEQ ID NO: 102472 - DNA, 25 bp, S. pombe
gggttacccgtgttcaaatcattca

SEQ ID NO: 102473 - DNA, 25 bp, S. pombe
gggttcgccctgaattaatgatttc

SEQ ID NO: 102474 - DNA, 25 bp, S. pombe
gggtagctccagtaactcgagtgct

SEQ ID NO: 102475 - DNA, 25 bp, S. pombe
gggtggatcctttaatgcttttcct

SEQ ID NO: 102476 - DNA, 25 bp, S. pombe
gggttgatgctccaaactcgtataa

SEQ ID NO: 102477 - DNA, 25 bp, S. pombe
gggtcgtccaggataggctgcttaa

SEQ ID NO: 102478 - DNA, 25 bp, S. pombe
gggtcctcagcatcaatacgacatt

SEQ ID NO: 102479 - DNA, 25 bp, S. pombe
gggtcgtcatgcacaattcaaattg

SEQ ID NO: 102480 - DNA, 25 bp, S. pombe
gggtctcgtgtcagccaatatattt

SEQ ID NO: 102481 - DNA, 25 bp, S. pombe
gggttccgatttcccaatattcgag

SEQ ID NO: 102482 - DNA, 25 bp, S. pombe
ggtcttcgttaactaatgcggctcc

SEQ ID NO: 102483 - DNA, 25 bp, S. pombe
gggttcgttatatattcctgtaatt

SEQ ID NO: 102484 - DNA, 25 bp, S. pombe
gggttcacgtataccattcttgttt

SEQ ID NO: 102485 - DNA, 25 bp, S. pombe
gggtatcaccgaatgcaagtcttat

SEQ ID NO: 102486 - DNA, 25 bp, S. pombe
gggtgtcttcgcagacggatgcaat

SEQ ID NO: 102487 - DNA, 25 bp, S. pombe
gggtgtttcaagcactatgtcagca

SEQ ID NO: 102488 - DNA, 25 bp, S. pombe
ggtggctatcttttggacatggctc

SEQ ID NO: 102489 - DNA, 25 bp, S. pombe
gggtgaactttttaatgctgccaag

SEQ ID NO: 102490 - DNA, 25 bp, S. pombe
gggttttgttatgatgtccatcctc

SEQ ID NO: 102491 - DNA, 25 bp, S. pombe
ggtggtcttgtttacaaccatcctc

SEQ ID NO: 102492 - DNA, 25 bp, S. pombe
gggtgatattcctgactacttctta

SEQ ID NO: 102493 - DNA, 25 bp, S. pombe
gggtcaacttggtattacttcgcaa

SEQ ID NO: 102494 - DNA, 25 bp, S. pombe
gggtcttgtaggtgccaatatcgaa

SEQ ID NO: 102495 - DNA, 25 bp, S. pombe
gggttctacctcatcagcataattc

SEQ ID NO: 102496 - DNA, 25 bp, S. pombe
gggtctgtacccgaacatcaataat

SEQ ID NO: 102497 - DNA, 25 bp, S. pombe
gggtgttttccctaatcgtgagatt

SEQ ID NO: 102498 - DNA, 25 bp, S. pombe
gggttatttacctcatctttatcaa

SEQ ID NO: 102499 - DNA, 25 bp, S. pombe
gggtttatgtttgctactgcttcca

SEQ ID NO: 102500 - DNA, 25 bp, S. pombe
gggtcttaaagttggccgcactgtt

SEQ ID NO: 102501 - DNA, 25 bp, S. pombe
gggtcgcataaatcccaatcgctgg

SEQ ID NO: 102502 - DNA, 25 bp, S. pombe
gggtcaatccaggtcgagtcgaaat

SEQ ID NO: 102503 - DNA, 25 bp, S. pombe
gggtccattagcctctgaatccaat

SEQ ID NO: 102504 - DNA, 25 bp, S. pombe
gggtctcattggttatatcatcaaa

SEQ ID NO: 102505 - DNA, 25 bp, S. pombe
gggtgtttccattttagagcgttct

SEQ ID NO: 102506 - DNA, 25 bp, S. pombe
gggtctcggaaatttgtgctcttac

SEQ ID NO: 102507 - DNA, 25 bp, S. pombe
gggtctttgactttttctattgagg

SEQ ID NO: 102508 - DNA, 25 bp, S. pombe
gggtattatggctcgttctttggaa

SEQ ID NO: 102509 - DNA, 25 bp, S. pombe
gggtgtaacggcttctatttgtcaa

SEQ ID NO: 102510 - DNA, 25 bp, S. pombe
gggtatacacacgtttttgttgcaa

SEQ ID NO: 102511 - DNA, 25 bp, S. pombe
gggttacaatccgtactctttgcaa

SEQ ID NO: 102512 - DNA, 25 bp, S. pombe
gggttctcaaccgaactctgtggag

SEQ ID NO: 102513 - DNA, 25 bp, S. pombe
ggtcttctcgttcgaaccgaggatt

SEQ ID NO: 102514 - DNA, 25 bp, S. pombe
gggtttccgttcaactctggagcat

SEQ ID NO: 102515 - DNA, 25 bp, S. pombe
gggtacctgtattactggattctgt

SEQ ID NO: 102516 - DNA, 25 bp, S. pombe
gggttcattctttgactcggtcaga

SEQ ID NO: 102517 - DNA, 25 bp, S. pombe
gggtacaatcagcttctcttaatgc

SEQ ID NO: 102518 - DNA, 25 bp, S. pombe
gggtacaatctatttcacctactct

SEQ ID NO: 102519 - DNA, 25 bp, S. pombe
gggtacaattattctcagcgattct

SEQ ID NO: 102520 - DNA, 25 bp, S. pombe
gggtattcttgtactgtccatttac

SEQ ID NO: 102521 - DNA, 25 bp, S. pombe
gggtcttttgacaagatccattgac

SEQ ID NO: 102522 - DNA, 25 bp, S. pombe
gggtattacagctttcacctacaaa

SEQ ID NO: 102523 - DNA, 25 bp, S. pombe
gggtcagtggtgtcaagtcatttca

SEQ ID NO: 102524 - DNA, 25 bp, S. pombe
gggtcaggctgtccagattattcta

SEQ ID NO: 102525 - DNA, 25 bp, S. pombe
gggtatacttggactctcatgatct

SEQ ID NO: 102526 - DNA, 25 bp, S. pombe
gggtttctctcaatatgctcgtgat

SEQ ID NO: 102527 - DNA, 25 bp, S. pombe
gggtcaacttcatctattccaaatt

SEQ ID NO: 102528 - DNA, 25 bp, S. pombe
gggtctattcaattagctcgggtaa

SEQ ID NO: 102529 - DNA, 25 bp, S. pombe
ggtcctagaaattactcatcgttcg

SEQ ID NO: 102530 - DNA, 25 bp, S. pombe
ggtcccgtagagcatgtccgtattc

SEQ ID NO: 102531 - DNA, 25 bp, S. pombe
ggtgctactgtatggagtcccttaa

SEQ ID NO: 102532 - DNA, 25 bp, S. pombe
ggtgagatgcccgagggtaccatta

SEQ ID NO: 102533 - DNA, 25 bp, S. pombe
ggagggacaccgagccaaacctggt

SEQ ID NO: 102534 - DNA, 25 bp, S. pombe
gggtgcttatccttcaaatgattct

SEQ ID NO: 102535 - DNA, 25 bp, S. pombe
ggtgatgctagacctgtccgagctt

SEQ ID NO: 102536 - DNA, 25 bp, S. pombe
gggtgctcagcaacgcttgaagcat

SEQ ID NO: 102537 - DNA, 25 bp, S. pombe
gggtatattaccctatgttgtcttt

SEQ ID NO: 102538 - DNA, 25 bp, S. pombe
gggtctttacaacaatgctgccgat

SEQ ID NO: 102539 - DNA, 25 bp, S. pombe
gggtctttaacgactagtctcgcag

SEQ ID NO: 102540 - DNA, 25 bp, S. pombe
ggtcgtttagcctcaacggtagcta

SEQ ID NO: 102541 - DNA, 25 bp, S. pombe
ggtggacctaccaatggcgtcttga

SEQ ID NO: 102542 - DNA, 25 bp, S. pombe
gggtgccaagagtctttgcattcca

SEQ ID NO: 102543 - DNA, 25 bp, S. pombe
gggtacattatgacttccaatccct

SEQ ID NO: 102544 - DNA, 25 bp, S. pombe
gggtgtctcatatggtcggattcga

SEQ ID NO: 102545 - DNA, 25 bp, S. pombe
gggtgtatcatctgaccgtttcgat

SEQ ID NO: 102546 - DNA, 25 bp, S. pombe
ggtgttgctaccatcgattatatcg

SEQ ID NO: 102547 - DNA, 25 bp, S. pombe
gggtgatgtttactcgtttgccgaa

SEQ ID NO: 102548 - DNA, 25 bp, S. pombe
gggtatcgtttttctcctgaagaag

SEQ ID NO: 102549 - DNA, 25 bp, S. pombe
gggtcttatgttttcatttgcgcag

SEQ ID NO: 102550 - DNA, 25 bp, S. pombe
ggtgtttccaactacggtgtgaagc

SEQ ID NO: 102551 - DNA, 25 bp, S. pombe
gggtcggattgattccttggtctcc

SEQ ID NO: 102552 - DNA, 25 bp, S. pombe
ggtgtcggtaatgcgtttaccacca

SEQ ID NO: 102553 - DNA, 25 bp, S. pombe
gggtcccatttacttattcacactg

SEQ ID NO: 102554 - DNA, 25 bp, S. pombe
ggcgtaagcttagtcccaaggttga

SEQ ID NO: 102555 - DNA, 25 bp, S. pombe
gggtgtcactgaacccgaaggtgaa

SEQ ID NO: 102556 - DNA, 25 bp, S. pombe
gggtcccgttagttcttatattcat

SEQ ID NO: 102557 - DNA, 25 bp, S. pombe
gggtcctccggaatgttgtatatgt

SEQ ID NO: 102558 - DNA, 25 bp, S. pombe
gggtcacatccttggcagttatgta

SEQ ID NO: 102559 - DNA, 25 bp, S. pombe
gggtactggatatcgcttcagcaaa

SEQ ID NO: 102560 - DNA, 25 bp, S. pombe
gggtgttcctgttatatctgttgca

SEQ ID NO: 102561 - DNA, 25 bp, S. pombe
gggtactcctgattatatcgctcca

SEQ ID NO: 102562 - DNA, 25 bp, S. pombe
ggtggacgtcttggaacagcagtaa

SEQ ID NO: 102563 - DNA, 25 bp, S. pombe
ggtgatcgacctgaacttgctggta

SEQ ID NO: 102564 - DNA, 25 bp, S. pombe
ggtgtttctcatgtgttgcaggata

SEQ ID NO: 102565 - DNA, 25 bp, S. pombe
ggtgagattaatgtccccattcctc

SEQ ID NO: 102566 - DNA, 25 bp, S. pombe
ggtggtgaacatcataccctagcct

SEQ ID NO: 102567 - DNA, 25 bp, S. pombe
gggtacatgtttaatcccatcaacg

SEQ ID NO: 102568 - DNA, 25 bp, S. pombe
ggtgtatctggcattgttccaaccc

SEQ ID NO: 102569 - DNA, 25 bp, S. pombe
gggtagtggtcagcaactctatttt

SEQ ID NO: 102570 - DNA, 25 bp, S. pombe
gggtgtctggtcttatcaacgttaa

SEQ ID NO: 102571 - DNA, 25 bp, S. pombe
ggtgtgccttgtttcatcgaagtta

SEQ ID NO: 102572 - DNA, 25 bp, S. pombe
gggtcgccataaacgtgacaacttt

SEQ ID NO: 102573 - DNA, 25 bp, S. pombe
ggtctcccattgtatcgatgtcaac

SEQ ID NO: 102574 - DNA, 25 bp, S. pombe
ggatcacgttgaccaaacaagccaa

SEQ ID NO: 102575 - DNA, 25 bp, S. pombe
ggtggtccgaggtcatgcctttcat

SEQ ID NO: 102576 - DNA, 25 bp, S. pombe
ggtggtactgcactttactacatcg

SEQ ID NO: 102577 - DNA, 25 bp, S. pombe
ggtggatcatcccatagctactata

SEQ ID NO: 102578 - DNA, 25 bp, S. pombe
ggtgccaagcccgtagacaatacat

SEQ ID NO: 102579 - DNA, 25 bp, S. pombe
ggtggaacccgtactctggatatca

SEQ ID NO: 102580 - DNA, 25 bp, S. pombe
gggtcataacgttggagcagctaac

SEQ ID NO: 102581 - DNA, 25 bp, S. pombe
tgggtagaacgctgggacgaacaaa

SEQ ID NO: 102582 - DNA, 25 bp, S. pombe
ggtggaaccctgcaattgaagaaca

SEQ ID NO: 102583 - DNA, 25 bp, S. pombe
gggtaactctcttttggcatttatg

SEQ ID NO: 102584 - DNA, 25 bp, S. pombe
gggtaatctccatcatgctggcgat

SEQ ID NO: 102585 - DNA, 25 bp, S. pombe
ggtggacattgctattattgggatc

SEQ ID NO: 102586 - DNA, 25 bp, S. pombe
ggtgaaatctggcttcgtggtccct

SEQ ID NO: 102587 - DNA, 25 bp, S. pombe
ggtggacctggcattcgagttcatc

SEQ ID NO: 102588 - DNA, 25 bp, S. pombe
gggtaaaaatggtcctgcctgtctg

SEQ ID NO: 102589 - DNA, 25 bp, S. pombe
ggtggagaccctcttcaaggtattt

SEQ ID NO: 102590 - DNA, 25 bp, S. pombe
gggtgccacatgtctttcaaaactt

SEQ ID NO: 102591 - DNA, 25 bp, S. pombe
gggtctatatgctttctaacttctt

SEQ ID NO: 102592 - DNA, 25 bp, S. pombe
ggtgtctaaattgaagcgccccatc

SEQ ID NO: 102593 - DNA, 25 bp, S. pombe
ggtgcatttaactcgactttggctc

SEQ ID NO: 102594 - DNA, 25 bp, S. pombe
ggatttttaccgcacttacttcgag

SEQ ID NO: 102595 - DNA, 25 bp, S. pombe
gggtgtgacacctgacattcaatct

SEQ ID NO: 102596 - DNA, 25 bp, S. pombe
ggtcgtcaagtgttgggttcagctt

SEQ ID NO: 102597 - DNA, 25 bp, S. pombe
gggtgttactatgcaacttcctata

SEQ ID NO: 102598 - DNA, 25 bp, S. pombe
ggtgtactgatattccacgcactca

SEQ ID NO: 102599 - DNA, 25 bp, S. pombe
gggtgcatattatttcaagcgtcag

SEQ ID NO: 102600 - DNA, 25 bp, S. pombe
gggtgcaactttgcaagcgcctcat

SEQ ID NO: 102601 - DNA, 25 bp, S. pombe
ggtctatacgtagcaattccgtttg

SEQ ID NO: 102602 - DNA, 25 bp, S. pombe
ggtggtaccaatgcgtctttatgct

SEQ ID NO: 102603 - DNA, 25 bp, S. pombe
ggtggctagatcaggatgctcttat

SEQ ID NO: 102604 - DNA, 25 bp, S. pombe
ggtggtaatgtactgacctctcaaa

SEQ ID NO: 102605 - DNA, 25 bp, S. pombe
ggagcggaagtactacctgccttaa

SEQ ID NO: 102606 - DNA, 25 bp, S. pombe
ggtggtatttactctgtccttaaca

SEQ ID NO: 102607 - DNA, 25 bp, S. pombe
ggaggtgattttgccgttcgtagaa

SEQ ID NO: 102608 - DNA, 25 bp, S. pombe
ggtgttcaaacaaactgccattcaa

SEQ ID NO: 102609 - DNA, 25 bp, S. pombe
ggattttacaagcacctgtacggtt

SEQ ID NO: 102610 - DNA, 25 bp, S. pombe
ggttgattaccatgatcctaacgtg

SEQ ID NO: 102611 - DNA, 25 bp, S. pombe
ggtggacccctacatgatgcagaat

SEQ ID NO: 102612 - DNA, 25 bp, S. pombe
ggtgttcatcaacccaagttcactg

SEQ ID NO: 102613 - DNA, 25 bp, S. pombe
ggtgtcatctgaactagcatcgtat

SEQ ID NO: 102614 - DNA, 25 bp, S. pombe
ggtggtctttctccatcgttaagtc

SEQ ID NO: 102615 - DNA, 25 bp, S. pombe
ggccggatttccattattcgcagtg

SEQ ID NO: 102616 - DNA, 25 bp, S. pombe
ggtagggctctaactatatccgaaa

SEQ ID NO: 102617 - DNA, 25 bp, S. pombe
gggtccacaggtcctattagcgaac

SEQ ID NO: 102618 - DNA, 25 bp, S. pombe
gggtcctaattatgccattcgttga

SEQ ID NO: 102619 - DNA, 25 bp, S. pombe
gggtgggttcttctcagcaagccaa

SEQ ID NO: 102620 - DNA, 25 bp, S. pombe
ggtgttgttaccattttctcatttt

SEQ ID NO: 102621 - DNA, 25 bp, S. pombe
ggtgacttgagcgattttaaccaaa

SEQ ID NO: 102622 - DNA, 25 bp, S. pombe
gggtcgttatatagctcctcatctt

SEQ ID NO: 102623 - DNA, 25 bp, S. pombe
ggtggcgtatttgcgagctgacaat

SEQ ID NO: 102624 - DNA, 25 bp, S. pombe
ggtgcaattatttacggcgctagac

SEQ ID NO: 102625 - DNA, 25 bp, S. pombe
ggtgtccctacgaaagccatttata

SEQ ID NO: 102626 - DNA, 25 bp, S. pombe
ggtctccagaaagctttggtgccac

SEQ ID NO: 102627 - DNA, 25 bp, S. pombe
ggtgctacctttgcaattactcagg

SEQ ID NO: 102628 - DNA, 25 bp, S. pombe
ggtgattattcttcaagtcccgcta

SEQ ID NO: 102629 - DNA, 25 bp, S. pombe
ggtgtcatccaaaaagtggaccaac

SEQ ID NO: 102630 - DNA, 25 bp, S. pombe
ggtggcactcttaataccgaccaaa

SEQ ID NO: 102631 - DNA, 25 bp, S. pombe
ggtgttgaagtgaaggatatctctt

SEQ ID NO: 102632 - DNA, 25 bp, S. pombe
ggtgttcacgttagacaacttgctc

SEQ ID NO: 102633 - DNA, 25 bp, S. pombe
ggtgcatatccgatagagcctttat

SEQ ID NO: 102634 - DNA, 25 bp, S. pombe
ggtggctctcagcagacgtattgaa

SEQ ID NO: 102635 - DNA, 25 bp, S. pombe
ggtggtaaaatgtcttcctctgccg

SEQ ID NO: 102636 - DNA, 25 bp, S. pombe
ggtggtaatattcttgcccattcga

SEQ ID NO: 102637 - DNA, 25 bp, S. pombe
ggtgttaagacactccctaatggta

SEQ ID NO: 102638 - DNA, 25 bp, S. pombe
ggtggacaaatcatcgctgcgtaga

SEQ ID NO: 102639 - DNA, 25 bp, S. pombe
ggtggcagcaatactttacaacaga

SEQ ID NO: 102640 - DNA, 25 bp, S. pombe
ggtgatttcactcgcggtaacggta

SEQ ID NO: 102641 - DNA, 25 bp, S. pombe
gggtgacgtccatgttcaatgcgat

SEQ ID NO: 102642 - DNA, 25 bp, S. pombe
ggtgggcttaccttatgcaataatt

SEQ ID NO: 102643 - DNA, 25 bp, S. pombe
gggtgatgcctgttttatttatgta

SEQ ID NO: 102644 - DNA, 25 bp, S. pombe
gggtgagcacttcgacttttgacaa

SEQ ID NO: 102645 - DNA, 25 bp, S. pombe
ggtgtaatctattgctctggccaaa

SEQ ID NO: 102646 - DNA, 25 bp, S. pombe
gggtgcgctttttacggaaattcat

SEQ ID NO: 102647 - DNA, 25 bp, S. pombe
ggtggctcttttttggaccaattat

SEQ ID NO: 102648 - DNA, 25 bp, S. pombe
gggtgatgctccagtacattctata

SEQ ID NO: 102649 - DNA, 25 bp, S. pombe
gggtgcccagtgttaaagcattcta

SEQ ID NO: 102650 - DNA, 25 bp, S. pombe
ggtgaatactctgtggaactccaaa

SEQ ID NO: 102651 - DNA, 25 bp, S. pombe
ggtgaagccgctgctgaagaacaga

SEQ ID NO: 102652 - DNA, 25 bp, S. pombe
ggtgtcacacctgtattggctaagt

SEQ ID NO: 102653 - DNA, 25 bp, S. pombe
ggtggtatcttctattcctttggaa

SEQ ID NO: 102654 - DNA, 25 bp, S. pombe
gggtgccgtttgtatacatttgcga

SEQ ID NO: 102655 - DNA, 25 bp, S. pombe
gggtggcctttgtaattttatgcat

SEQ ID NO: 102656 - DNA, 25 bp, S. pombe
ggtggtattcattcttcaatctctc

SEQ ID NO: 102657 - DNA, 25 bp, S. pombe
ggtggtttcatctttattagccaaa

SEQ ID NO: 102658 - DNA, 25 bp, S. pombe
ggtggtattgccaactttacctcac

SEQ ID NO: 102659 - DNA, 25 bp, S. pombe
ggtggtgtccttacttctgacagtc

SEQ ID NO: 102660 - DNA, 25 bp, S. pombe
ggtggttccttatgtcatccagata

SEQ ID NO: 102661 - DNA, 25 bp, S. pombe
ggtggcattcgcttaagctattcca

SEQ ID NO: 102662 - DNA, 25 bp, S. pombe
ggtggatctgcggtacatctcacta

SEQ ID NO: 102663 - DNA, 25 bp, S. pombe
ggtggtatctgttacactctcagca

SEQ ID NO: 102664 - DNA, 25 bp, S. pombe
ggtgattatagttccacttccaatg

SEQ ID NO: 102665 - DNA, 25 bp, S. pombe
ggtgaatccccaaaaccagatgacg

SEQ ID NO: 102666 - DNA, 25 bp, S. pombe
ggtattcccgttacacatcgtggag

SEQ ID NO: 102667 - DNA, 25 bp, S. pombe
ggtgcacaaggtcaatttcctggta

SEQ ID NO: 102668 - DNA, 25 bp, S. pombe
ggtgatctttcctacactgatagca

SEQ ID NO: 102669 - DNA, 25 bp, S. pombe
ggtgacttttcttaatgtacaattg

SEQ ID NO: 102670 - DNA, 25 bp, S. pombe
ggtgacctcggtcctatatatggtt

SEQ ID NO: 102671 - DNA, 25 bp, S. pombe
ggtgattggtctttttatgcttcgt

SEQ ID NO: 102672 - DNA, 25 bp, S. pombe
ggtgttggttattatatgactcgcc

SEQ ID NO: 102673 - DNA, 25 bp, S. pombe
ggtgttgcagctgatatgattacta

SEQ ID NO: 102674 - DNA, 25 bp, S. pombe
ggtgttcatgtcgagtcagctagct

SEQ ID NO: 102675 - DNA, 25 bp, S. pombe
ggtgttgcaacaggctatgcttctt

SEQ ID NO: 102676 - DNA, 25 bp, S. pombe
ggtgttagtctcttggttgcaggaa

SEQ ID NO: 102677 - DNA, 25 bp, S. pombe
gggtgtatgctcgtctagttggaaa

SEQ ID NO: 102678 - DNA, 25 bp, S. pombe
ggtggtgttatttctcacgatccca

SEQ ID NO: 102679 - DNA, 25 bp, S. pombe
ggtgggattcttctaccagtatcac

SEQ ID NO: 102680 - DNA, 25 bp, S. pombe
ggtggttgtttgtacaccaatccaa

SEQ ID NO: 102681 - DNA, 25 bp, S. pombe
ggtgctaagttgataccgcttctca

SEQ ID NO: 102682 - DNA, 25 bp, S. pombe
ggtggtattcccttgcacgaattaa

SEQ ID NO: 102683 - DNA, 25 bp, S. pombe
ggtggtgttcaatagccttcattca

SEQ ID NO: 102684 - DNA, 25 bp, S. pombe
ggtggtgatcatttaactcttcttc

SEQ ID NO: 102685 - DNA, 25 bp, S. pombe
ggtggtatatttcctcttttgacat

SEQ ID NO: 102686 - DNA, 25 bp, S. pombe
ggtggctctttacccaattgtaagc

SEQ ID NO: 102687 - DNA, 25 bp, S. pombe
ggtggtctttcaccagacttgaatt

SEQ ID NO: 102688 - DNA, 25 bp, S. pombe
ggtgtttcaatcagtcattctagct

SEQ ID NO: 102689 - DNA, 25 bp, S. pombe
ggtgcatgcgtagtatccgacgata

SEQ ID NO: 102690 - DNA, 25 bp, S. pombe
ggtgtgtttgctaccatgccaagac

SEQ ID NO: 102691 - DNA, 25 bp, S. pombe
gggtgatttgccagattacgacagt

SEQ ID NO: 102692 - DNA, 25 bp, S. pombe
ggtggttattatccttatgccgaag

SEQ ID NO: 102693 - DNA, 25 bp, S. pombe
ggtggatctaagtgttgccgcaata

SEQ ID NO: 102694 - DNA, 25 bp, S. pombe
ggtggtctaaattcaggtgcctttg

SEQ ID NO: 102695 - DNA, 25 bp, S. pombe
ggtgatgtctcaagtgcagtatctc

SEQ ID NO: 102696 - DNA, 25 bp, S. pombe
ggtgtgctcaagttaaagtcgttaa

SEQ ID NO: 102697 - DNA, 25 bp, S. pombe
ggtggatccgctgcaaacttcatta

SEQ ID NO: 102698 - DNA, 25 bp, S. pombe
ggtgattctaatagacccggcatta

SEQ ID NO: 102699 - DNA, 25 bp, S. pombe
gggtggtacatttatgctcggtcaa

SEQ ID NO: 102700 - DNA, 25 bp, S. pombe
ggtgtcgctatgaatcctgttgatc

SEQ ID NO: 102701 - DNA, 25 bp, S. pombe
ggtgcctttgttgcgttaccttcaa

SEQ ID NO: 102702 - DNA, 25 bp, S. pombe
ggtctcgtatttccgattacttcta

SEQ ID NO: 102703 - DNA, 25 bp, S. pombe
ggtgtattaatgctggatcctaaca

SEQ ID NO: 102704 - DNA, 25 bp, S. pombe
ggtctattcctttgaagcccattca

SEQ ID NO: 102705 - DNA, 25 bp, S. pombe
ggtcctgtttccgaatgggcttcaa

SEQ ID NO: 102706 - DNA, 25 bp, S. pombe
ggtccgataacctgtggtcttcaac

SEQ ID NO: 102707 - DNA, 25 bp, S. pombe
ggtgttattgatcgactcatgcctt

SEQ ID NO: 102708 - DNA, 25 bp, S. pombe
ggtgtacttcattcatctatgccta

SEQ ID NO: 102709 - DNA, 25 bp, S. pombe
ggtggaccagcattgatattggcta

SEQ ID NO: 102710 - DNA, 25 bp, S. pombe
ggtgcaaaagccctgatcgtggtct

SEQ ID NO: 102711 - DNA, 25 bp, S. pombe
ggatagccaatgtcggtctgtagcg

SEQ ID NO: 102712 - DNA, 25 bp, S. pombe
ggtgcacttcacgattctaaggttt

SEQ ID NO: 102713 - DNA, 25 bp, S. pombe
ggtgaaataccataaccgtaatttg

SEQ ID NO: 102714 - DNA, 25 bp, S. pombe
ggtgtgaattcccagattccttgaa

SEQ ID NO: 102715 - DNA, 25 bp, S. pombe
ggtgtaattgccatgtctcgcgaaa

SEQ ID NO: 102716 - DNA, 25 bp, S. pombe
ggtggacagagcttcatgcccgaat

SEQ ID NO: 102717 - DNA, 25 bp, S. pombe
ggtgctcaatggctcatctacgatt

SEQ ID NO: 102718 - DNA, 25 bp, S. pombe
ggtcgagcatggttacaactattct

SEQ ID NO: 102719 - DNA, 25 bp, S. pombe
ggtcaccatggacggtttgcaatgt

SEQ ID NO: 102720 - DNA, 25 bp, S. pombe
ggtaccacgtaggacttcatttagt

SEQ ID NO: 102721 - DNA, 25 bp, S. pombe
ggtggaactttcgatcatttacatg

SEQ ID NO: 102722 - DNA, 25 bp, S. pombe
ggtctgatagctatgcacgaggatt

SEQ ID NO: 102723 - DNA, 25 bp, S. pombe
ggtcgtcatcgttgcattggtgagc

SEQ ID NO: 102724 - DNA, 25 bp, S. pombe
ggtcgtgacgccgatgagatagatc

SEQ ID NO: 102725 - DNA, 25 bp, S. pombe
ggtgaagcagctcccaagaagtctt

SEQ ID NO: 102726 - DNA, 25 bp, S. pombe
ggtgccgctttccaagaagacttgt

SEQ ID NO: 102727 - DNA, 25 bp, S. pombe
ggtgatggtatttctggtgcagcaa

SEQ ID NO: 102728 - DNA, 25 bp, S. pombe
ggtgtgtgctatccattttcatatg

SEQ ID NO: 102729 - DNA, 25 bp, S. pombe
ggtgtggagcgtctatctgatttta

SEQ ID NO: 102730 - DNA, 25 bp, S. pombe
ggtgtcgacttagcactagtctcta

SEQ ID NO: 102731 - DNA, 25 bp, S. pombe
ggtcatggtattacacctggtgtca

SEQ ID NO: 102732 - DNA, 25 bp, S. pombe
ggtcgtatcataaagccaggagctc

SEQ ID NO: 102733 - DNA, 25 bp, S. pombe
ggtggtattccctgatttggtgttt

SEQ ID NO: 102734 - DNA, 25 bp, S. pombe
ggtaattctaccaatgccgatgctg

SEQ ID NO: 102735 - DNA, 25 bp, S. pombe
ggtgagcaactttactgttactgtc

SEQ ID NO: 102736 - DNA, 25 bp, S. pombe
ggtggatactactcaataactactc

SEQ ID NO: 102737 - DNA, 25 bp, S. pombe
ggtggatatgcttccccaaatgcaa

SEQ ID NO: 102738 - DNA, 25 bp, S. pombe
ggtgattatttaccccagactctat

SEQ ID NO: 102739 - DNA, 25 bp, S. pombe
ggtgatatgttttggcccttcctac

SEQ ID NO: 102740 - DNA, 25 bp, S. pombe
ggcccaggattcacgtttggcaatt

SEQ ID NO: 102741 - DNA, 25 bp, S. pombe
ggtgctcgaatatcctttttcaatt

SEQ ID NO: 102742 - DNA, 25 bp, S. pombe
ggtgatagtaaatcttccattcaaa

SEQ ID NO: 102743 - DNA, 25 bp, S. pombe
ggtgtgacggacaacgattcttcaa

SEQ ID NO: 102744 - DNA, 25 bp, S. pombe
ggtgtgaggttatacattctgaaac

SEQ ID NO: 102745 - DNA, 25 bp, S. pombe
ggtgacttggctatacttctgagaa

SEQ ID NO: 102746 - DNA, 25 bp, S. pombe
ggtgtctcgcctatagctggtagaa

SEQ ID NO: 102747 - DNA, 25 bp, S. pombe
ggtgtaccacattgcttctgggtat

SEQ ID NO: 102748 - DNA, 25 bp, S. pombe
ggtgtcaccatcactatcgtgtgga

SEQ ID NO: 102749 - DNA, 25 bp, S. pombe
ggagatcaaaaagtcgccgcggcct

SEQ ID NO: 102750 - DNA, 25 bp, S. pombe
ggtgtcagtaaagcaggcccagcaa

SEQ ID NO: 102751 - DNA, 25 bp, S. pombe
ggtctcgtgaaaagcgtgttagcca

SEQ ID NO: 102752 - DNA, 25 bp, S. pombe
tgctgtgggtaaccgtttttggcaa

SEQ ID NO: 102753 - DNA, 25 bp, S. pombe
ggtcgaccgacccttactgaagaag

SEQ ID NO: 102754 - DNA, 25 bp, S. pombe
ggtgctaggcgtccagttcaaacaa

SEQ ID NO: 102755 - DNA, 25 bp, S. pombe
ggtgctcaactaacccagacggtga

SEQ ID NO: 102756 - DNA, 25 bp, S. pombe
ggtgatttcatgcatatgccctttg

SEQ ID NO: 102757 - DNA, 25 bp, S. pombe
ggtgatttcacgcatgccattttag

SEQ ID NO: 102758 - DNA, 25 bp, S. pombe
ggtgtcattccaggtgccaattttg

SEQ ID NO: 102759 - DNA, 25 bp, S. pombe
ggtgtcacatctttttacccatatg

SEQ ID NO: 102760 - DNA, 25 bp, S. pombe
ggtgctcatgccataggtcatattc

SEQ ID NO: 102761 - DNA, 25 bp, S. pombe
ggtgatcggcacttagacaatctct

SEQ ID NO: 102762 - DNA, 25 bp, S. pombe
ggtgaagttccgacatctgcaaatc

SEQ ID NO: 102763 - DNA, 25 bp, S. pombe
ggttcatcgtagcttcaaaaatggt

SEQ ID NO: 102764 - DNA, 25 bp, S. pombe
ggtctacagcccctgcaaaaaatga

SEQ ID NO: 102765 - DNA, 25 bp, S. pombe
ggtcgaacagtcctcaaatctagta

SEQ ID NO: 102766 - DNA, 25 bp, S. pombe
ggtgctcgtggcctagatgatatca

SEQ ID NO: 102767 - DNA, 25 bp, S. pombe
ggtgccgtgccctatgaaaaagaac

SEQ ID NO: 102768 - DNA, 25 bp, S. pombe
ggtccgtgctctgtaccaagaagaa

SEQ ID NO: 102769 - DNA, 25 bp, S. pombe
ggtcctatttgccttgccaaacaaa

SEQ ID NO: 102770 - DNA, 25 bp, S. pombe
ggtgtagttgcttctcaaaaccaat

SEQ ID NO: 102771 - DNA, 25 bp, S. pombe
ggtgtcgttgaagtcgataacccaa

SEQ ID NO: 102772 - DNA, 25 bp, S. pombe
ggtgtccttgaacctatagccaaaa

SEQ ID NO: 102773 - DNA, 25 bp, S. pombe
ggtgacctggctcaattaacacggt

SEQ ID NO: 102774 - DNA, 25 bp, S. pombe
ggtcagcctggtcatcttaaagagt

SEQ ID NO: 102775 - DNA, 25 bp, S. pombe
ggtgatgtttgctttagtatgccaa

SEQ ID NO: 102776 - DNA, 25 bp, S. pombe
ggtgttcatcctacagctggtcaaa

SEQ ID NO: 102777 - DNA, 25 bp, S. pombe
ggtgcttctcacaaacatggcgaaa

SEQ ID NO: 102778 - DNA, 25 bp, S. pombe
ggtgcgacatgagttcatactgcat

SEQ ID NO: 102779 - DNA, 25 bp, S. pombe
ggtgaccaattgcatactcctgaag

SEQ ID NO: 102780 - DNA, 25 bp, S. pombe
ggtcacaactgggtttccggtcaag

SEQ ID NO: 102781 - DNA, 25 bp, S. pombe
ggctacaaccgtccagtttcgtaat

SEQ ID NO: 102782 - DNA, 25 bp, S. pombe
ggtcatttccctatatggttaacgc

SEQ ID NO: 102783 - DNA, 25 bp, S. pombe
ggtgctatatctcctgtacgtgaac

SEQ ID NO: 102784 - DNA, 25 bp, S. pombe
ggtgaaactccctctgtgattatca

SEQ ID NO: 102785 - DNA, 25 bp, S. pombe
ggtgtacgggataggctcacattta

SEQ ID NO: 102786 - DNA, 25 bp, S. pombe
ggttttgaccaagcgtcaacttcct

SEQ ID NO: 102787 - DNA, 25 bp, S. pombe
ggtataaaccaagcgtcgagccatc

SEQ ID NO: 102788 - DNA, 25 bp, S. pombe
ggtgccgttattcgaagcgcttata

SEQ ID NO: 102789 - DNA, 25 bp, S. pombe
ggtgcttatatatccactcgttgga

SEQ ID NO: 102790 - DNA, 25 bp, S. pombe
ggtcttctgtagtcaagggtagtac

SEQ ID NO: 102791 - DNA, 25 bp, S. pombe
ggtcctgggactacgatgcaatcaa

SEQ ID NO: 102792 - DNA, 25 bp, S. pombe
ggttcgcttcccagaaatactacaa

SEQ ID NO: 102793 - DNA, 25 bp, S. pombe
ggtctgccaataacgatttcgaact

SEQ ID NO: 102794 - DNA, 25 bp, S. pombe
ggtgcccgatctccgtgtaagcaaa

SEQ ID NO: 102795 - DNA, 25 bp, S. pombe
ggtgtaaaacccaatcttcgctatt

SEQ ID NO: 102796 - DNA, 25 bp, S. pombe
ggtgaaaagagtacaagcatattgt

SEQ ID NO: 102797 - DNA, 25 bp, S. pombe
ggtgaaaacgatcctagccttgctt

SEQ ID NO: 102798 - DNA, 25 bp, S. pombe
ggtgaaaccgatttgcagcttagac

SEQ ID NO: 102799 - DNA, 25 bp, S. pombe
ggtgtatactatattatgcccagat

SEQ ID NO: 102800 - DNA, 25 bp, S. pombe
ggttagtgggtatcacaccagcctg

SEQ ID NO: 102801 - DNA, 25 bp, S. pombe
ggtatttggcggcacccgttacact

SEQ ID NO: 102802 - DNA, 25 bp, S. pombe
ggttttgagcataggacctccttac

SEQ ID NO: 102803 - DNA, 25 bp, S. pombe
ggtgtattggccaaacctactcatg

SEQ ID NO: 102804 - DNA, 25 bp, S. pombe
ggtgacttaacatccactgacaagg

SEQ ID NO: 102805 - DNA, 25 bp, S. pombe
ggtcgtgtacccattgctgacgaat

SEQ ID NO: 102806 - DNA, 25 bp, S. pombe
ggtcgtgctagcttaaacacccgta

SEQ ID NO: 102807 - DNA, 25 bp, S. pombe
ggtgccaataatgcgactaggaaag

SEQ ID NO: 102808 - DNA, 25 bp, S. pombe
ggtcgtcctttacttgccatgatcg

SEQ ID NO: 102809 - DNA, 25 bp, S. pombe
ggtcccctatttatgtatgccctaa

SEQ ID NO: 102810 - DNA, 25 bp, S. pombe
ggtgcggaacttactttgccgataa

SEQ ID NO: 102811 - DNA, 25 bp, S. pombe
ggtcgtactctttctgattacaata

SEQ ID NO: 102812 - DNA, 25 bp, S. pombe
ggtgaacatccaatcctttactata

SEQ ID NO: 102813 - DNA, 25 bp, S. pombe
ggtgtttactcttcttcttgtatac

SEQ ID NO: 102814 - DNA, 25 bp, S. pombe
ggtgttgcttactgctataatgctc

SEQ ID NO: 102815 - DNA, 25 bp, S. pombe
ggtgcactattattgctgccgctaa

SEQ ID NO: 102816 - DNA, 25 bp, S. pombe
ggtgatcaattcttgtcagctggta

SEQ ID NO: 102817 - DNA, 25 bp, S. pombe
ggtgttggtcaattcattcttttca

SEQ ID NO: 102818 - DNA, 25 bp, S. pombe
ggtgttaataaatttagtcctcttg

SEQ ID NO: 102819 - DNA, 25 bp, S. pombe
ggtgaatttgatccatctgccattg

SEQ ID NO: 102820 - DNA, 25 bp, S. pombe
ggtgctgcttttcaaacgtatctag

SEQ ID NO: 102821 - DNA, 25 bp, S. pombe
ggtgccgatttactggtagtcgcaa

SEQ ID NO: 102822 - DNA, 25 bp, S. pombe
ggtgccagccgatttggtacccaaa

SEQ ID NO: 102823 - DNA, 25 bp, S. pombe
ggtgactcaagcttaagtcctcaag

SEQ ID NO: 102824 - DNA, 25 bp, S. pombe
ggtgttgcttcttatcctcttgata

SEQ ID NO: 102825 - DNA, 25 bp, S. pombe
ggtcgatcgacacattggtattgct

SEQ ID NO: 102826 - DNA, 25 bp, S. pombe
ggtgttccagtatccactattatga

SEQ ID NO: 102827 - DNA, 25 bp, S. pombe
ggtgttccttatgccattgtcaaga

SEQ ID NO: 102828 - DNA, 25 bp, S. pombe
ggtgctactcatattccggtaggca

SEQ ID NO: 102829 - DNA, 25 bp, S. pombe
ggtgatactcttgtttatcgcgact

SEQ ID NO: 102830 - DNA, 25 bp, S. pombe
ggtgatcaccggatttgtagcgaat

SEQ ID NO: 102831 - DNA, 25 bp, S. pombe
ggtttcggttatgttactttctctg

SEQ ID NO: 102832 - DNA, 25 bp, S. pombe
ggtctacggtttgtggttgctataa

SEQ ID NO: 102833 - DNA, 25 bp, S. pombe
ggtgcaggagcgtcttaccaaacaa

SEQ ID NO: 102834 - DNA, 25 bp, S. pombe
ggtgcagttgctccttttataacat

SEQ ID NO: 102835 - DNA, 25 bp, S. pombe
ggtgatgcacctccaatgtttatta

SEQ ID NO: 102836 - DNA, 25 bp, S. pombe
ggtgatgctctttctatatctgaat

SEQ ID NO: 102837 - DNA, 25 bp, S. pombe
ggccgtccggtatacgttgagcaac

SEQ ID NO: 102838 - DNA, 25 bp, S. pombe
ggtcgatttacattcggtgcaacca

SEQ ID NO: 102839 - DNA, 25 bp, S. pombe
ggtcgtttagatttgacgcagctaa

SEQ ID NO: 102840 - DNA, 25 bp, S. pombe
ggtactgttagctgaaatcccgaaa

SEQ ID NO: 102841 - DNA, 25 bp, S. pombe
ggtgcaatttctcgatctatacttt

SEQ ID NO: 102842 - DNA, 25 bp, S. pombe
ggtacactcaccgttgggtatttcg

SEQ ID NO: 102843 - DNA, 25 bp, S. pombe
ggtgcaggacgattcactcatcagt

SEQ ID NO: 102844 - DNA, 25 bp, S. pombe
ggtgaaaatcagtcccacagtgaaa

SEQ ID NO: 102845 - DNA, 25 bp, S. pombe
ggtgaaaatccttcgtcgtcaagtt

SEQ ID NO: 102846 - DNA, 25 bp, S. pombe
ggtgatcacgttatggtcatgtaca

SEQ ID NO: 102847 - DNA, 25 bp, S. pombe
ggtgatacgtctattgatcttcctg

SEQ ID NO: 102848 - DNA, 25 bp, S. pombe
ggtgaactgtctttgtgttccgcac

SEQ ID NO: 102849 - DNA, 25 bp, S. pombe
ggtgaacgtgttttattccgcccat

SEQ ID NO: 102850 - DNA, 25 bp, S. pombe
ggtaagccttttggagttgaactca

SEQ ID NO: 102851 - DNA, 25 bp, S. pombe
ggtgaacgccttagtgaatttagtc

SEQ ID NO: 102852 - DNA, 25 bp, S. pombe
ggtccgatatgcgacttgttatggt

SEQ ID NO: 102853 - DNA, 25 bp, S. pombe
ggtgagcttgttaatgttcttcgtc

SEQ ID NO: 102854 - DNA, 25 bp, S. pombe
ggtgatcccactaagttcattcgtt

SEQ ID NO: 102855 - DNA, 25 bp, S. pombe
ggtgatgtctcattcctgaaatttc

SEQ ID NO: 102856 - DNA, 25 bp, S. pombe
ggtgatgttgattctcgtaccattc

SEQ ID NO: 102857 - DNA, 25 bp, S. pombe
ggtgagagcacttattccagtcatt

SEQ ID NO: 102858 - DNA, 25 bp, S. pombe
ggtaaacctattccattctggcttt

SEQ ID NO: 102859 - DNA, 25 bp, S. pombe
ggtcgttgtcaaatactctactatg

SEQ ID NO: 102860 - DNA, 25 bp, S. pombe
ggtaatcccgttagtcaagccattg

SEQ ID NO: 102861 - DNA, 25 bp, S. pombe
ggtgagactattcctcaattgtctt

SEQ ID NO: 102862 - DNA, 25 bp, S. pombe
ggtgcacctattgtaactaatgtcg

SEQ ID NO: 102863 - DNA, 25 bp, S. pombe
ggtgaactgctttcatgcgaccaaa

SEQ ID NO: 102864 - DNA, 25 bp, S. pombe
ggtcatgccgataccaatatgcgtt

SEQ ID NO: 102865 - DNA, 25 bp, S. pombe
ggtcagtcaattgttaactcggttt

SEQ ID NO: 102866 - DNA, 25 bp, S. pombe
ggtgcagctcagttggttaatcata

SEQ ID NO: 102867 - DNA, 25 bp, S. pombe
ggtgcccatttgtattatgcatatg

SEQ ID NO: 102868 - DNA, 25 bp, S. pombe
ggtgccgtagaaacacttctgtgtt

SEQ ID NO: 102869 - DNA, 25 bp, S. pombe
ggtgctccttcaaacaattctcata

SEQ ID NO: 102870 - DNA, 25 bp, S. pombe
ggtaatattcggcttgcctatctcc

SEQ ID NO: 102871 - DNA, 25 bp, S. pombe
ggtgcccttagtatcccaatgatga

SEQ ID NO: 102872 - DNA, 25 bp, S. pombe
ggtccgtatatgtcagatcccaatt

SEQ ID NO: 102873 - DNA, 25 bp, S. pombe
ggtgcggtatcatttatcaattcat

SEQ ID NO: 102874 - DNA, 25 bp, S. pombe
ggtgctactgactttatcgattctt

SEQ ID NO: 102875 - DNA, 25 bp, S. pombe
ggtgaacctctcaagtcccaaattg

SEQ ID NO: 102876 - DNA, 25 bp, S. pombe
ggtaactttggcttcggtattcaag

SEQ ID NO: 102877 - DNA, 25 bp, S. pombe
ggtgcaaatttttcgtctggtcaac

SEQ ID NO: 102878 - DNA, 25 bp, S. pombe
ggtacattcgtatccttactaatga

SEQ ID NO: 102879 - DNA, 25 bp, S. pombe
ggtcagttggactcctgttatgtct

SEQ ID NO: 102880 - DNA, 25 bp, S. pombe
ggtctctaggccttaccattttaga

SEQ ID NO: 102881 - DNA, 25 bp, S. pombe
ggtccctgattatagcacgaataca

SEQ ID NO: 102882 - DNA, 25 bp, S. pombe
ggtgcttctgatgttattccgatac

SEQ ID NO: 102883 - DNA, 25 bp, S. pombe
ggtgctggctatcctatttacaaaa

SEQ ID NO: 102884 - DNA, 25 bp, S. pombe
ggtgcatgtttgctcttgatccaaa

SEQ ID NO: 102885 - DNA, 25 bp, S. pombe
ggtgctgatttgtcggtcatggatc

SEQ ID NO: 102886 - DNA, 25 bp, S. pombe
ggtctctccagtagatttggcccta

SEQ ID NO: 102887 - DNA, 25 bp, S. pombe
ggttccatcgttgaaggtcctcagg

SEQ ID NO: 102888 - DNA, 25 bp, S. pombe
ggtgctgctctattatcaacatcgg

SEQ ID NO: 102889 - DNA, 25 bp, S. pombe
ggtgccaccgtaaacgaagcagcta

SEQ ID NO: 102890 - DNA, 25 bp, S. pombe
ggtctacattagtatcagaaggcta

SEQ ID NO: 102891 - DNA, 25 bp, S. pombe
ggtcgatcatgttgacaagaaagct

SEQ ID NO: 102892 - DNA, 25 bp, S. pombe
ggtcgctctgctcacattgaaatca

SEQ ID NO: 102893 - DNA, 25 bp, S. pombe
ggtgcctttggatctgctattgcag

SEQ ID NO: 102894 - DNA, 25 bp, S. pombe
ggtgcctttaatacgctggatgcta

SEQ ID NO: 102895 - DNA, 25 bp, S. pombe
ggtgctttgaacaatgctgctgcca

SEQ ID NO: 102896 - DNA, 25 bp, S. pombe
ggtgcaaggaacaactgtcgccgtt

SEQ ID NO: 102897 - DNA, 25 bp, S. pombe
ggttatggtcctcgcagtatgatga

SEQ ID NO: 102898 - DNA, 25 bp, S. pombe
ggtcctggtcaaatacttgcatatc

SEQ ID NO: 102899 - DNA, 25 bp, S. pombe
ggtcctgtcacatatcacgattatc

SEQ ID NO: 102900 - DNA, 25 bp, S. pombe
ggtgctctaacttgttcgcaatatc

SEQ ID NO: 102901 - DNA, 25 bp, S. pombe
ggtcctcaagtttatttcgatccta

SEQ ID NO: 102902 - DNA, 25 bp, S. pombe
ggtcgctatcaacaaagtcgtcgct

SEQ ID NO: 102903 - DNA, 25 bp, S. pombe
ggtctcttagatgttccttttgtta

SEQ ID NO: 102904 - DNA, 25 bp, S. pombe
ggtcttctagattttggcttctcga

SEQ ID NO: 102905 - DNA, 25 bp, S. pombe
ggtcttcacagttcgtttagctgga

SEQ ID NO: 102906 - DNA, 25 bp, S. pombe
ggtcacgaacttggtcattggtaca

SEQ ID NO: 102907 - DNA, 25 bp, S. pombe
ggtcaccaacttgctgttcgaagta

SEQ ID NO: 102908 - DNA, 25 bp, S. pombe
ggtcccgactaactgattctgaacg

SEQ ID NO: 102909 - DNA, 25 bp, S. pombe
ggtgccaaactcttatgccttatat

SEQ ID NO: 102910 - DNA, 25 bp, S. pombe
ggtgccaacctcatgacaattcata

SEQ ID NO: 102911 - DNA, 25 bp, S. pombe
ggtcctcagtgattccgatttggat

SEQ ID NO: 102912 - DNA, 25 bp, S. pombe
ggtaaagatattccacttcgactaa

SEQ ID NO: 102913 - DNA, 25 bp, S. pombe
ggtccaggagaaatccttcgacgaa

SEQ ID NO: 102914 - DNA, 25 bp, S. pombe
ggtcttggcctcgataagcttggaa

SEQ ID NO: 102915 - DNA, 25 bp, S. pombe
ggtgcaccaggctcatacaatacgt

SEQ ID NO: 102916 - DNA, 25 bp, S. pombe
ggtgcagccgatgaaacacttcgat

SEQ ID NO: 102917 - DNA, 25 bp, S. pombe
ggtgcactatcaatcttcttggtaa

SEQ ID NO: 102918 - DNA, 25 bp, S. pombe
ggtgcacaatgcgtcttttgggaaa

SEQ ID NO: 102919 - DNA, 25 bp, S. pombe
ggtcgctgcttaatgcttattcaaa

SEQ ID NO: 102920 - DNA, 25 bp, S. pombe
ggtgcatgtggtttacaactctaca

SEQ ID NO: 102921 - DNA, 25 bp, S. pombe
ggtgcttctatatccatcttttttg

SEQ ID NO: 102922 - DNA, 25 bp, S. pombe
ggtcctgcttttatctagtccagta

SEQ ID NO: 102923 - DNA, 25 bp, S. pombe
ggtcctgctgaaatttctggtgcta

SEQ ID NO: 102924 - DNA, 25 bp, S. pombe
ggtcctcatagatctgccattgtta

SEQ ID NO: 102925 - DNA, 25 bp, S. pombe
ggtgcatccctattagctgtagcca

SEQ ID NO: 102926 - DNA, 25 bp, S. pombe
ggtgctctactattatctgttggcg

SEQ ID NO: 102927 - DNA, 25 bp, S. pombe
ggtcatatcactagatcccttgggt

SEQ ID NO: 102928 - DNA, 25 bp, S. pombe
ggtttactctccagcagcggcgttt

SEQ ID NO: 102929 - DNA, 25 bp, S. pombe
ggtcatatatttcctagttcgcgtc

SEQ ID NO: 102930 - DNA, 25 bp, S. pombe
ggtgcctatattcgatcttatcctg

SEQ ID NO: 102931 - DNA, 25 bp, S. pombe
ggatttaaagcgcttatgccttctt

SEQ ID NO: 102932 - DNA, 25 bp, S. pombe
ggtctcaaatcggtttatgcccttc

SEQ ID NO: 102933 - DNA, 25 bp, S. pombe
ggtgcttcctatggtggttacatga

SEQ ID NO: 102934 - DNA, 25 bp, S. pombe
ggtccacgcttgctggttttcaaat

SEQ ID NO: 102935 - DNA, 25 bp, S. pombe
ggtctggaattggtctgttcttcaa

SEQ ID NO: 102936 - DNA, 25 bp, S. pombe
ggtcggttatttcagctgctacaga

SEQ ID NO: 102937 - DNA, 25 bp, S. pombe
ggtcccaggtgttccacttatatat

SEQ ID NO: 102938 - DNA, 25 bp, S. pombe
ggtcgatttctctatgccttgtgaa

SEQ ID NO: 102939 - DNA, 25 bp, S. pombe
ggttgatgacacacctcggcctgga

SEQ ID NO: 102940 - DNA, 25 bp, S. pombe
ggtactgtaacctgtgtgatccgta

SEQ ID NO: 102941 - DNA, 25 bp, S. pombe
ggtctagctaaacatgtagctaaaa

SEQ ID NO: 102942 - DNA, 25 bp, S. pombe
ggtgctattgtttctaacgccaaga

SEQ ID NO: 102943 - DNA, 25 bp, S. pombe
ggtcttgctaactttaactgcctgg

SEQ ID NO: 102944 - DNA, 25 bp, S. pombe
ggctctagtgaaccttcaagtcctg

SEQ ID NO: 102945 - DNA, 25 bp, S. pombe
ggtcgaggccaacacattgatgtct

SEQ ID NO: 102946 - DNA, 25 bp, S. pombe
ggtcaagcgcgatgaacttactctt

SEQ ID NO: 102947 - DNA, 25 bp, S. pombe
ggtcatactcgaaaagccgttctta

SEQ ID NO: 102948 - DNA, 25 bp, S. pombe
ggtctctgctttacgtgggtcaaga

SEQ ID NO: 102949 - DNA, 25 bp, S. pombe
ggtctcagctaatcctttactatgt

SEQ ID NO: 102950 - DNA, 25 bp, S. pombe
ggtctcgattactgctctatgatga

SEQ ID NO: 102951 - DNA, 25 bp, S. pombe
ggtcctattacctatgctatgcaaa

SEQ ID NO: 102952 - DNA, 25 bp, S. pombe
ggtcctttaaggataccacataatg

SEQ ID NO: 102953 - DNA, 25 bp, S. pombe
ggtcgtttagaagttgtccatctga

SEQ ID NO: 102954 - DNA, 25 bp, S. pombe
ggtcattaccgtatgttcatgcatt

SEQ ID NO: 102955 - DNA, 25 bp, S. pombe
ggtctggccgagttttatcatgctg

SEQ ID NO: 102956 - DNA, 25 bp, S. pombe
ggtgctgtcccttattattatgaat

SEQ ID NO: 102957 - DNA, 25 bp, S. pombe
ggtcacgagcctgatttgattagac

SEQ ID NO: 102958 - DNA, 25 bp, S. pombe
ggtgcctgggttattcattgccata

SEQ ID NO: 102959 - DNA, 25 bp, S. pombe
ggtccccggttatcgtgaactggat

SEQ ID NO: 102960 - DNA, 25 bp, S. pombe
ggtcgcctatttttatccagaaacg

SEQ ID NO: 102961 - DNA, 25 bp, S. pombe
ggtagcctatcttcaattccgaaag

SEQ ID NO: 102962 - DNA, 25 bp, S. pombe
ggtcagactattcaagctcaggcaa

SEQ ID NO: 102963 - DNA, 25 bp, S. pombe
ggtagaagttactagctcggcaact

SEQ ID NO: 102964 - DNA, 25 bp, S. pombe
ggtaagagtgttcccatcgtcaagg

SEQ ID NO: 102965 - DNA, 25 bp, S. pombe
ggtcaatatatgctccgcggctata

SEQ ID NO: 102966 - DNA, 25 bp, S. pombe
ggtaatatgcatcctacttggctag

SEQ ID NO: 102967 - DNA, 25 bp, S. pombe
ggtaatccggcctagtgtgaacttg

SEQ ID NO: 102968 - DNA, 25 bp, S. pombe
ggtcaaacggccgatggtcaacaag

SEQ ID NO: 102969 - DNA, 25 bp, S. pombe
ggtaaacattgctgacatgctccaa

SEQ ID NO: 102970 - DNA, 25 bp, S. pombe
ggtactactgccagaatgctcgaaa

SEQ ID NO: 102971 - DNA, 25 bp, S. pombe
ggttccagcgccatgaagagccaaa

SEQ ID NO: 102972 - DNA, 25 bp, S. pombe
ggtcctttagctacgattcctgaaa

SEQ ID NO: 102973 - DNA, 25 bp, S. pombe
ggtacaaaatttcatcccggagata

SEQ ID NO: 102974 - DNA, 25 bp, S. pombe
tggtcgtgcccctaaaatccaaggt

SEQ ID NO: 102975 - DNA, 25 bp, S. pombe
ggtttctcactctcgtatcaagggt

SEQ ID NO: 102976 - DNA, 25 bp, S. pombe
ggttgaaactgctcgtttggagaat

SEQ ID NO: 102977 - DNA, 25 bp, S. pombe
ggtgccaacattgctggtttcttga

SEQ ID NO: 102978 - DNA, 25 bp, S. pombe
ggtctactatgtctatttccgcaag

SEQ ID NO: 102979 - DNA, 25 bp, S. pombe
ggtacttggtaccttgcgagagcaa

SEQ ID NO: 102980 - DNA, 25 bp, S. pombe
ggtacttgtgatttttgtgggacgt

SEQ ID NO: 102981 - DNA, 25 bp, S. pombe
ggtcctcatgtatgtttgggccagc

SEQ ID NO: 102982 - DNA, 25 bp, S. pombe
ggtcgtagtaattatcgcggtggct

SEQ ID NO: 102983 - DNA, 25 bp, S. pombe
ggtcgtcagtaaatcaccgtgaggt

SEQ ID NO: 102984 - DNA, 25 bp, S. pombe
ggtcatcaagtacctgcagcagatt

SEQ ID NO: 102985 - DNA, 25 bp, S. pombe
ggtatcagagctcgcacccgttaca

SEQ ID NO: 102986 - DNA, 25 bp, S. pombe
ggtagacaacgccatccttcgatgg

SEQ ID NO: 102987 - DNA, 25 bp, S. pombe
ggtccaatacctactgttcaacagg

SEQ ID NO: 102988 - DNA, 25 bp, S. pombe
ggtcctaaagctgccagagtacttt

SEQ ID NO: 102989 - DNA, 25 bp, S. pombe
ggtcatgttactattgcccagggtg

SEQ ID NO: 102990 - DNA, 25 bp, S. pombe
ggtcgtataaacttcacctatgggt

SEQ ID NO: 102991 - DNA, 25 bp, S. pombe
ggtcctacattacttccattcatga

SEQ ID NO: 102992 - DNA, 25 bp, S. pombe
ggtcctactcttttgagcgcagtga

SEQ ID NO: 102993 - DNA, 25 bp, S. pombe
ggtccgaatttattaccagcgatta

SEQ ID NO: 102994 - DNA, 25 bp, S. pombe
ggtatgttctctagcaaacccgtta

SEQ ID NO: 102995 - DNA, 25 bp, S. pombe
ggtatgatcctaaaaacccaatctt

SEQ ID NO: 102996 - DNA, 25 bp, S. pombe
ggtaaacgaggccaagtcacttttg

SEQ ID NO: 102997 - DNA, 25 bp, S. pombe
ggtaaatacgtccaacgccgctatt

SEQ ID NO: 102998 - DNA, 25 bp, S. pombe
ggtaaagctcgtgaagcccttgaat

SEQ ID NO: 102999 - DNA, 25 bp, S. pombe
ggtaccgctcctttagtcaaattag

SEQ ID NO: 103000 - DNA, 25 bp, S. pombe
ggtccccgtcttgtgagacaattat

SEQ ID NO: 103001 - DNA, 25 bp, S. pombe
ggtcgtccccaattaggaggtgctt

SEQ ID NO: 103002 - DNA, 25 bp, S. pombe
ggtcctgacctttctatctatgatt

SEQ ID NO: 103003 - DNA, 25 bp, S. pombe
ggtcgctctaatccttatgcacgaa

SEQ ID NO: 103004 - DNA, 25 bp, S. pombe
ggtccatcttccaattcattagtga

SEQ ID NO: 103005 - DNA, 25 bp, S. pombe
ggtctcacccctatcatatttgtaa

SEQ ID NO: 103006 - DNA, 25 bp, S. pombe
ggtctatgttcccactgtttttgaa

SEQ ID NO: 103007 - DNA, 25 bp, S. pombe
ggtcttttctgccaatcgtctatat

SEQ ID NO: 103008 - DNA, 25 bp, S. pombe
ggtcctttctgctgatggtcttaga

SEQ ID NO: 103009 - DNA, 25 bp, S. pombe
ggtcctaacactaatggttctcagt

SEQ ID NO: 103010 - DNA, 25 bp, S. pombe
ggtctcaaactaaatagctctgcta

SEQ ID NO: 103011 - DNA, 25 bp, S. pombe
ggtcaattaattactgcttccaaac

SEQ ID NO: 103012 - DNA, 25 bp, S. pombe
ggtcagacataatctccgtccgaaa

SEQ ID NO: 103013 - DNA, 25 bp, S. pombe
ggtccatcggattcggtgtacgcag

SEQ ID NO: 103014 - DNA, 25 bp, S. pombe
ggtcccgttcatcgtttaatgcatg

SEQ ID NO: 103015 - DNA, 25 bp, S. pombe
ggtccctgcttcttatcttaattga

SEQ ID NO: 103016 - DNA, 25 bp, S. pombe
ggtcgatatgtcttgagctttttac

SEQ ID NO: 103017 - DNA, 25 bp, S. pombe
ggtcgcatcgattttgttcttgata

SEQ ID NO: 103018 - DNA, 25 bp, S. pombe
ggtatttaccctgagaagcgtgaca

SEQ ID NO: 103019 - DNA, 25 bp, S. pombe
ggtcgcatcttattccacggagaaa

SEQ ID NO: 103020 - DNA, 25 bp, S. pombe
ggtccttctaatcatagtgagtcaa

SEQ ID NO: 103021 - DNA, 25 bp, S. pombe
ggtaccatatcccaaaaatctcctt

SEQ ID NO: 103022 - DNA, 25 bp, S. pombe
ggtactatcatctccaacgttgagg

SEQ ID NO: 103023 - DNA, 25 bp, S. pombe
ggtacttctaaaccatcaggtccga

SEQ ID NO: 103024 - DNA, 25 bp, S. pombe
ggtacccgtactttgaacatcagtg

SEQ ID NO: 103025 - DNA, 25 bp, S. pombe
ggtacaccggatcaacttccagtag

SEQ ID NO: 103026 - DNA, 25 bp, S. pombe
ggtccgtaaccttagtggctgcata

SEQ ID NO: 103027 - DNA, 25 bp, S. pombe
ggatctggtacatctacttggtcta

SEQ ID NO: 103028 - DNA, 25 bp, S. pombe
ggtcggattaattcctcttttggag

SEQ ID NO: 103029 - DNA, 25 bp, S. pombe
ggtctgaagtaattcgtgctcttag

SEQ ID NO: 103030 - DNA, 25 bp, S. pombe
ggtcgaatgccaatacctgcacagt

SEQ ID NO: 103031 - DNA, 25 bp, S. pombe
ggtttcattgaaagccggcagcgtg

SEQ ID NO: 103032 - DNA, 25 bp, S. pombe
ggtcacccattacttcgtggagatg

SEQ ID NO: 103033 - DNA, 25 bp, S. pombe
ggtcacaacctcaagctgcgatggg

SEQ ID NO: 103034 - DNA, 25 bp, S. pombe
ggtctaaactcgttgccagtggcca

SEQ ID NO: 103035 - DNA, 25 bp, S. pombe
ggtctcctcgatggttgatctcgaa

SEQ ID NO: 103036 - DNA, 25 bp, S. pombe
ggtctacttgtattcttgcatagtt

SEQ ID NO: 103037 - DNA, 25 bp, S. pombe
ggtcataccgctttcctaagttaga

SEQ ID NO: 103038 - DNA, 25 bp, S. pombe
ggtcgattatttgtcgcagatttaa

SEQ ID NO: 103039 - DNA, 25 bp, S. pombe
ggtcaggtaagtgtccatctagtga

SEQ ID NO: 103040 - DNA, 25 bp, S. pombe
ggtcgctttgttatctcatgctaga

SEQ ID NO: 103041 - DNA, 25 bp, S. pombe
ggtcactcctgtatgtcctgaagaa

SEQ ID NO: 103042 - DNA, 25 bp, S. pombe
ggtcacctccatcaactaaagcata

SEQ ID NO: 103043 - DNA, 25 bp, S. pombe
ggtcaagtcattgccgtgtatgtaa

SEQ ID NO: 103044 - DNA, 25 bp, S. pombe
ggtccgcattgtggtacgtatctac

SEQ ID NO: 103045 - DNA, 25 bp, S. pombe
ggtccgcatctggtgtatattttgt

SEQ ID NO: 103046 - DNA, 25 bp, S. pombe
ggtcccttggtattcttatctttga

SEQ ID NO: 103047 - DNA, 25 bp, S. pombe
ggtcagcactttatccttcaattta

SEQ ID NO: 103048 - DNA, 25 bp, S. pombe
ggtcgacttagtactccattgttta

SEQ ID NO: 103049 - DNA, 25 bp, S. pombe
ggtcgtcccatacttgttgagttaa

SEQ ID NO: 103050 - DNA, 25 bp, S. pombe
ggtcagtatccagccttagggttag

SEQ ID NO: 103051 - DNA, 25 bp, S. pombe
ggtcaaattcgtttgtccacttatt

SEQ ID NO: 103052 - DNA, 25 bp, S. pombe
ggtaagagacgacctgtccatcttt

SEQ ID NO: 103053 - DNA, 25 bp, S. pombe
ggtaattgacgcctttcgattgatt

SEQ ID NO: 103054 - DNA, 25 bp, S. pombe
ggttacatagccctggacggtactt

SEQ ID NO: 103055 - DNA, 25 bp, S. pombe
ggtatgaaactcactacggtatttt

SEQ ID NO: 103056 - DNA, 25 bp, S. pombe
ggtatgacaaggatgcaacgctgga

SEQ ID NO: 103057 - DNA, 25 bp, S. pombe
ggatgaggaagtccccgtagaccca

SEQ ID NO: 103058 - DNA, 25 bp, S. pombe
ggtaagaaggccactgctacaccta

SEQ ID NO: 103059 - DNA, 25 bp, S. pombe
ggtcaagagcgctgctttctaccaa

SEQ ID NO: 103060 - DNA, 25 bp, S. pombe
ggtaacccttggttcatttgcacaa

SEQ ID NO: 103061 - DNA, 25 bp, S. pombe
tttaaaccatctattctgggccgcc

SEQ ID NO: 103062 - DNA, 25 bp, S. pombe
tctttataacttctttgggtccgca

SEQ ID NO: 103063 - DNA, 25 bp, S. pombe
ggattcatacctgcatttactggag

SEQ ID NO: 103064 - DNA, 25 bp, S. pombe
ggtagctcaaaactccaaacttgtg

SEQ ID NO: 103065 - DNA, 25 bp, S. pombe
ggtcgtggaaaatctactgctctta

SEQ ID NO: 103066 - DNA, 25 bp, S. pombe
ggtcgggtcataagttagtctcttc

SEQ ID NO: 103067 - DNA, 25 bp, S. pombe
ggtcgtggtattaactcttccttcg

SEQ ID NO: 103068 - DNA, 25 bp, S. pombe
ggtcaggtttatagatcatcccctt

SEQ ID NO: 103069 - DNA, 25 bp, S. pombe
ggtcgtgctcctaataatcctactt

SEQ ID NO: 103070 - DNA, 25 bp, S. pombe
ggtcattccattgaagaacccgatg

SEQ ID NO: 103071 - DNA, 25 bp, S. pombe
ggtaactgcattgaagtggcccgat

SEQ ID NO: 103072 - DNA, 25 bp, S. pombe
ggaaacattgatgctacggcccgtt

SEQ ID NO: 103073 - DNA, 25 bp, S. pombe
ggtaaactccatgctgaccttgaag

SEQ ID NO: 103074 - DNA, 25 bp, S. pombe
ggtcgttctcttgggaagcgtctac

SEQ ID NO: 103075 - DNA, 25 bp, S. pombe
ggtaatgcccttggtcatacgattt

SEQ ID NO: 103076 - DNA, 25 bp, S. pombe
ggtcaatgctcagctcttcgaataa

SEQ ID NO: 103077 - DNA, 25 bp, S. pombe
ggtagcatttgtttggatatccttc

SEQ ID NO: 103078 - DNA, 25 bp, S. pombe
ggtagtatgctgtgtcgaatctccc

SEQ ID NO: 103079 - DNA, 25 bp, S. pombe
ggtacatagcattttcagagcatct

SEQ ID NO: 103080 - DNA, 25 bp, S. pombe
ggtcattctgctgatcttacatctg

SEQ ID NO: 103081 - DNA, 25 bp, S. pombe
ggtcaactcatttttactgctgcta

SEQ ID NO: 103082 - DNA, 25 bp, S. pombe
ggtcatcaactttgactttcctcaa

SEQ ID NO: 103083 - DNA, 25 bp, S. pombe
ggtcatgcgcctaaagtgttttcca

SEQ ID NO: 103084 - DNA, 25 bp, S. pombe
ggtcttgccaaaacatttcttccta

SEQ ID NO: 103085 - DNA, 25 bp, S. pombe
ggtactccacatgactttgttttga

SEQ ID NO: 103086 - DNA, 25 bp, S. pombe
ggtaacgccatatcgttgtttcaag

SEQ ID NO: 103087 - DNA, 25 bp, S. pombe
ggtctaccgctatcgttttacattg

SEQ ID NO: 103088 - DNA, 25 bp, S. pombe
ggtctctcgactttcgttattacaa

SEQ ID NO: 103089 - DNA, 25 bp, S. pombe
ggtcttctgacgttaacttttctag

SEQ ID NO: 103090 - DNA, 25 bp, S. pombe
ggtcttattgggaaacctgtccttg

SEQ ID NO: 103091 - DNA, 25 bp, S. pombe
ggtcttattggtcatcatctcgatc

SEQ ID NO: 103092 - DNA, 25 bp, S. pombe
ggtctattatcattgtattcgcagt

SEQ ID NO: 103093 - DNA, 25 bp, S. pombe
ggtctcctatttaatcatcgatctt

SEQ ID NO: 103094 - DNA, 25 bp, S. pombe
ggtctttgcgtctattcagagttga

SEQ ID NO: 103095 - DNA, 25 bp, S. pombe
ggtaccagtatcttggtgaacttag

SEQ ID NO: 103096 - DNA, 25 bp, S. pombe
ggtaacttatgttcagggctcattt

SEQ ID NO: 103097 - DNA, 25 bp, S. pombe
ggtcaacttaagtctggtgctcctt

SEQ ID NO: 103098 - DNA, 25 bp, S. pombe
ggtactataactgcccatcatcttt

SEQ ID NO: 103099 - DNA, 25 bp, S. pombe
ggtagtgaagattcccgcgagccaa

SEQ ID NO: 103100 - DNA, 25 bp, S. pombe
ggttttcgaaccctcatacaaagca

SEQ ID NO: 103101 - DNA, 25 bp, S. pombe
ggtctttccaacttcaacgatacaa

SEQ ID NO: 103102 - DNA, 25 bp, S. pombe
ggtcttcaccaagctccattatatg

SEQ ID NO: 103103 - DNA, 25 bp, S. pombe
ggtctatcgccaattctaatgtcat

SEQ ID NO: 103104 - DNA, 25 bp, S. pombe
ggatccaccaacatctcagcgaatg

SEQ ID NO: 103105 - DNA, 25 bp, S. pombe
ggtctccattccttgaacatacata

SEQ ID NO: 103106 - DNA, 25 bp, S. pombe
ggtctttctcctagtattgatacac

SEQ ID NO: 103107 - DNA, 25 bp, S. pombe
ggtctcttgtttttatgagtcctcc

SEQ ID NO: 103108 - DNA, 25 bp, S. pombe
ggtctattgtttacgtgttctcttc

SEQ ID NO: 103109 - DNA, 25 bp, S. pombe
ggtcatatgttgacactccctacat

SEQ ID NO: 103110 - DNA, 25 bp, S. pombe
ggtctcaactttccaactgcagagg

SEQ ID NO: 103111 - DNA, 25 bp, S. pombe
ggatccaaatccagcttcacaagcg

SEQ ID NO: 103112 - DNA, 25 bp, S. pombe
ggatcccgataatcttgacaccgta

SEQ ID NO: 103113 - DNA, 25 bp, S. pombe
ggtacctctggaattgactacttta

SEQ ID NO: 103114 - DNA, 25 bp, S. pombe
ggtacccattggcagatctactctt

SEQ ID NO: 103115 - DNA, 25 bp, S. pombe
ggtcttgttctttctcagtcagata

SEQ ID NO: 103116 - DNA, 25 bp, S. pombe
ggttcggcccttcgtgaaagtgatc

SEQ ID NO: 103117 - DNA, 25 bp, S. pombe
ggtcttgacgcatttgggatcgaaa

SEQ ID NO: 103118 - DNA, 25 bp, S. pombe
ggtctctgatcgttcgtcctaaaaa

SEQ ID NO: 103119 - DNA, 25 bp, S. pombe
ggttctgggttgcttcttaatgtaa

SEQ ID NO: 103120 - DNA, 25 bp, S. pombe
ggattctcaagttcgggttgccctg

SEQ ID NO: 103121 - DNA, 25 bp, S. pombe
ggtatctcaacttttgggatccctg

SEQ ID NO: 103122 - DNA, 25 bp, S. pombe
ggtactcaaatagctatggcccgcc

SEQ ID NO: 103123 - DNA, 25 bp, S. pombe
ggtacttcaacagttaaggcctctt

SEQ ID NO: 103124 - DNA, 25 bp, S. pombe
ggtctttccaacttcttcacttggg

SEQ ID NO: 103125 - DNA, 25 bp, S. pombe
ggtcttaaagaattcctcctcggtg

SEQ ID NO: 103126 - DNA, 25 bp, S. pombe
ggtcattatgaccactatgccgcca

SEQ ID NO: 103127 - DNA, 25 bp, S. pombe
ggtaatgatggctctatccgcacaa

SEQ ID NO: 103128 - DNA, 25 bp, S. pombe
ggtcactggatgaacgattctcgaa

SEQ ID NO: 103129 - DNA, 25 bp, S. pombe
ggttcatctgaaactccagttccat

SEQ ID NO: 103130 - DNA, 25 bp, S. pombe
ggtacacctactaatccagttcatt

SEQ ID NO: 103131 - DNA, 25 bp, S. pombe
ggtatcatccaacgtttgccttgaa

SEQ ID NO: 103132 - DNA, 25 bp, S. pombe
ggtaccaagcgttttgattctgaaa

SEQ ID NO: 103133 - DNA, 25 bp, S. pombe
ggtaccgtcgaagctattcgtcaag

SEQ ID NO: 103134 - DNA, 25 bp, S. pombe
ggtacggtccgaagcaatcttgatc

SEQ ID NO: 103135 - DNA, 25 bp, S. pombe
ggtatccgacgttgcaatttcacaa

SEQ ID NO: 103136 - DNA, 25 bp, S. pombe
ggtcaaggtatgctttctcaacgcc

SEQ ID NO: 103137 - DNA, 25 bp, S. pombe
ggtcatctctggttaattccgcagt

SEQ ID NO: 103138 - DNA, 25 bp, S. pombe
ggtttcgcctttgctgaatttgtta

SEQ ID NO: 103139 - DNA, 25 bp, S. pombe
ggtcttgactacatgtttgccgctt

SEQ ID NO: 103140 - DNA, 25 bp, S. pombe
ggatgcgaataagctcctcttggct

SEQ ID NO: 103141 - DNA, 25 bp, S. pombe
ggtaacatttgcaagctttctcttc

SEQ ID NO: 103142 - DNA, 25 bp, S. pombe
ggtcaaatctcgtgtgtatcttatc

SEQ ID NO: 103143 - DNA, 25 bp, S. pombe
ggtcaaatctctgctggttactctc

SEQ ID NO: 103144 - DNA, 25 bp, S. pombe
ggataaacctaatggtcctccaaag

SEQ ID NO: 103145 - DNA, 25 bp, S. pombe
ggtaacgagaagctcgccactgttc

SEQ ID NO: 103146 - DNA, 25 bp, S. pombe
ggtcaaatttagctaccgcgtctat

SEQ ID NO: 103147 - DNA, 25 bp, S. pombe
ggtcatggcttttgttaccaatgca

SEQ ID NO: 103148 - DNA, 25 bp, S. pombe
ggtcatgccttttgttctaattgta

SEQ ID NO: 103149 - DNA, 25 bp, S. pombe
ggtcatgttgttggttctagcgctc

SEQ ID NO: 103150 - DNA, 25 bp, S. pombe
ggtcttggattcttcttatgtgtca

SEQ ID NO: 103151 - DNA, 25 bp, S. pombe
ggtcttttgatttctgtttgccaag

SEQ ID NO: 103152 - DNA, 25 bp, S. pombe
ggtagttctgcctatcgatgtagac

SEQ ID NO: 103153 - DNA, 25 bp, S. pombe
ggtagtcatgaacagcttatggcta

SEQ ID NO: 103154 - DNA, 25 bp, S. pombe
ggtcacgttaccattgctcaaggtg

SEQ ID NO: 103155 - DNA, 25 bp, S. pombe
ggtagcgtccaagtatcatctcgag

SEQ ID NO: 103156 - DNA, 25 bp, S. pombe
ggtatcatgtcccacaacgaagctc

SEQ ID NO: 103157 - DNA, 25 bp, S. pombe
ggtactttgaacaatgggcttccaa

SEQ ID NO: 103158 - DNA, 25 bp, S. pombe
ggtcaaggtcttggtcagcacaatc

SEQ ID NO: 103159 - DNA, 25 bp, S. pombe
ggtaacttcattgctgcctacatca

SEQ ID NO: 103160 - DNA, 25 bp, S. pombe
ggtcaatcttttatgttgcaccaaa

SEQ ID NO: 103161 - DNA, 25 bp, S. pombe
ggtatcttgcattagccactgaggc

SEQ ID NO: 103162 - DNA, 25 bp, S. pombe
ggtcatttcatttccagcaacgttc

SEQ ID NO: 103163 - DNA, 25 bp, S. pombe
ggtagaatctctcctacaggcaagt

SEQ ID NO: 103164 - DNA, 25 bp, S. pombe
ggtaatcaatcatccacaaagtcat

SEQ ID NO: 103165 - DNA, 25 bp, S. pombe
ggtcagataacattccgactctact

SEQ ID NO: 103166 - DNA, 25 bp, S. pombe
ggtagtaaaagcgtgtcttactgag

SEQ ID NO: 103167 - DNA, 25 bp, S. pombe
ggtaataaaacggacttggctgata

SEQ ID NO: 103168 - DNA, 25 bp, S. pombe
ggtactttatcacagtcatgtccat

SEQ ID NO: 103169 - DNA, 25 bp, S. pombe
ggtactgacgtatttactcccttag

SEQ ID NO: 103170 - DNA, 25 bp, S. pombe
ggtatgcgacgatgttatatccaca

SEQ ID NO: 103171 - DNA, 25 bp, S. pombe
ggtcagcaatttcaagcattcatgt

SEQ ID NO: 103172 - DNA, 25 bp, S. pombe
ggtcaacatcctgctatgattcgta

SEQ ID NO: 103173 - DNA, 25 bp, S. pombe
ggtcacggtcgtattggcaagcaca

SEQ ID NO: 103174 - DNA, 25 bp, S. pombe
ggtcaaatgtcgcattcagctcgcg

SEQ ID NO: 103175 - DNA, 25 bp, S. pombe
ggtaaatatcgccttcatgatcgct

SEQ ID NO: 103176 - DNA, 25 bp, S. pombe
ggtaactctggacttcatatggcta

SEQ ID NO: 103177 - DNA, 25 bp, S. pombe
ggtaatccggagtcgtgcattggca

SEQ ID NO: 103178 - DNA, 25 bp, S. pombe
ggtaacacgcataatcctttccaat

SEQ ID NO: 103179 - DNA, 25 bp, S. pombe
ggtcaagccgtcaatgcctttattt

SEQ ID NO: 103180 - DNA, 25 bp, S. pombe
ggttctccgtatctttggactagat

SEQ ID NO: 103181 - DNA, 25 bp, S. pombe
ggttctttactagcccgccaacaga

SEQ ID NO: 103182 - DNA, 25 bp, S. pombe
ggtatttctgaaagtcgcgccaaac

SEQ ID NO: 103183 - DNA, 25 bp, S. pombe
ggtcagttcccaagatacctcgaaa

SEQ ID NO: 103184 - DNA, 25 bp, S. pombe
ggtatcaagcagctgatcctagcaa

SEQ ID NO: 103185 - DNA, 25 bp, S. pombe
ggtatctctgacgatatctctgatg

SEQ ID NO: 103186 - DNA, 25 bp, S. pombe
ggtaacttggctccatctgtaacag

SEQ ID NO: 103187 - DNA, 25 bp, S. pombe
ggttcaccggcgtctgcgataagca

SEQ ID NO: 103188 - DNA, 25 bp, S. pombe
ggtcaaattgtcgtcgagcacctgg

SEQ ID NO: 103189 - DNA, 25 bp, S. pombe
ggttctcaaggtcaatgcccgatgg

SEQ ID NO: 103190 - DNA, 25 bp, S. pombe
ggttcttacgacgagatcggtgctt

SEQ ID NO: 103191 - DNA, 25 bp, S. pombe
ggtttgggccaaaatttatcgcgat

SEQ ID NO: 103192 - DNA, 25 bp, S. pombe
tggtatttgccctaagtcttacggt

SEQ ID NO: 103193 - DNA, 25 bp, S. pombe
ggccttatcccagagtttacgaata

SEQ ID NO: 103194 - DNA, 25 bp, S. pombe
ggtttacctagcaatttaagcgact

SEQ ID NO: 103195 - DNA, 25 bp, S. pombe
ggtcaacccagactttacattcgtt

SEQ ID NO: 103196 - DNA, 25 bp, S. pombe
ggtaagcctgtttttatccgtcatc

SEQ ID NO: 103197 - DNA, 25 bp, S. pombe
ggtcaactttctcattttctcttga

SEQ ID NO: 103198 - DNA, 25 bp, S. pombe
ggtacactttgtctctctttaatat

SEQ ID NO: 103199 - DNA, 25 bp, S. pombe
ggttttgtctttggtcgttactgat

SEQ ID NO: 103200 - DNA, 25 bp, S. pombe
ggactactgctcattattttggacg

SEQ ID NO: 103201 - DNA, 25 bp, S. pombe
ggttagactttctcaagctttggaa

SEQ ID NO: 103202 - DNA, 25 bp, S. pombe
ggtataagcccatctcacagtagtg

SEQ ID NO: 103203 - DNA, 25 bp, S. pombe
ggtcaatcacttgagccacttgagc

SEQ ID NO: 103204 - DNA, 25 bp, S. pombe
ggtaagccattattcgctgctgcat

SEQ ID NO: 103205 - DNA, 25 bp, S. pombe
ggtacaaattgcattggctgattca

SEQ ID NO: 103206 - DNA, 25 bp, S. pombe
ggtaatacagacgtcgctgctttca

SEQ ID NO: 103207 - DNA, 25 bp, S. pombe
ggtaatgaacgccttgatcctaaaa

SEQ ID NO: 103208 - DNA, 25 bp, S. pombe
ggtaccaaatccgtcaccaagtatt

SEQ ID NO: 103209 - DNA, 25 bp, S. pombe
ggtacggatatttcccatcaaagtt

SEQ ID NO: 103210 - DNA, 25 bp, S. pombe
ggtagttgataattccccttggtat

SEQ ID NO: 103211 - DNA, 25 bp, S. pombe
ggtacgctactgttaacttatcttg

SEQ ID NO: 103212 - DNA, 25 bp, S. pombe
ggtcaagttcatttgcgactatttc

SEQ ID NO: 103213 - DNA, 25 bp, S. pombe
ggtaagcttatcttggccgaattct

SEQ ID NO: 103214 - DNA, 25 bp, S. pombe
ggtaggtctacatcccaaattgcat

SEQ ID NO: 103215 - DNA, 25 bp, S. pombe
ggtaaggctcttcaccaatttattt

SEQ ID NO: 103216 - DNA, 25 bp, S. pombe
ggtcaagaccctgcccaaaatgttg

SEQ ID NO: 103217 - DNA, 25 bp, S. pombe
ggtttgcttccttcaatcaagttac

SEQ ID NO: 103218 - DNA, 25 bp, S. pombe
ggtaattttcgccattattctccct

SEQ ID NO: 103219 - DNA, 25 bp, S. pombe
ggtactaatacccattgattctaat

SEQ ID NO: 103220 - DNA, 25 bp, S. pombe
ggtaatcaacaactcaggtctccgt

SEQ ID NO: 103221 - DNA, 25 bp, S. pombe
ggtagacagtgaccctaggatttta

SEQ ID NO: 103222 - DNA, 25 bp, S. pombe
ggtactttgttgttctcagtgtgac

SEQ ID NO: 103223 - DNA, 25 bp, S. pombe
ggtactttgttgcttcaattcctgt

SEQ ID NO: 103224 - DNA, 25 bp, S. pombe
ggttgtttcccatcgaatcgtttca

SEQ ID NO: 103225 - DNA, 25 bp, S. pombe
ggtacaatgctaaacttgccagatt

SEQ ID NO: 103226 - DNA, 25 bp, S. pombe
ggtagagactttactctccagtctt

SEQ ID NO: 103227 - DNA, 25 bp, S. pombe
ggctaggagtttaccaatcttttgg

SEQ ID NO: 103228 - DNA, 25 bp, S. pombe
ggtagcacaattacaaactcttgga

SEQ ID NO: 103229 - DNA, 25 bp, S. pombe
ggtacttcaccagtcaatgttctaa

SEQ ID NO: 103230 - DNA, 25 bp, S. pombe
ggtagtgtcggcatctttttcatca

SEQ ID NO: 103231 - DNA, 25 bp, S. pombe
ggtacttccagcaatctttgttcta

SEQ ID NO: 103232 - DNA, 25 bp, S. pombe
ggtacccatcacaacttggctgtta

SEQ ID NO: 103233 - DNA, 25 bp, S. pombe
ggagtctctggaacgaaacctttca

SEQ ID NO: 103234 - DNA, 25 bp, S. pombe
ggagtccggaactgattcacttgaa

SEQ ID NO: 103235 - DNA, 25 bp, S. pombe
ggatctccccgatggttgcaaatga

SEQ ID NO: 103236 - DNA, 25 bp, S. pombe
ggattcacccgtcaacgaatatgga

SEQ ID NO: 103237 - DNA, 25 bp, S. pombe
ggttacctgtgagcaacgtttctga

SEQ ID NO: 103238 - DNA, 25 bp, S. pombe
ggttaccgatatcaagctcttttta

SEQ ID NO: 103239 - DNA, 25 bp, S. pombe
ggtatccttataaagcaccctctat

SEQ ID NO: 103240 - DNA, 25 bp, S. pombe
ggtactgttgataacacccctgttg

SEQ ID NO: 103241 - DNA, 25 bp, S. pombe
ggtacaaattatcgttcccctcatg

SEQ ID NO: 103242 - DNA, 25 bp, S. pombe
ggtaacaacattcgctatcttcaca

SEQ ID NO: 103243 - DNA, 25 bp, S. pombe
ggtacttttgtagtctccatgcgtc

SEQ ID NO: 103244 - DNA, 25 bp, S. pombe
ggtagctgttttgccggtcagtgca

SEQ ID NO: 103245 - DNA, 25 bp, S. pombe
ggtaaactgtccaagccatttcaac

SEQ ID NO: 103246 - DNA, 25 bp, S. pombe
ggataacaactcatctccggacgaa

SEQ ID NO: 103247 - DNA, 25 bp, S. pombe
ggtaccgactctatccttggtatga

SEQ ID NO: 103248 - DNA, 25 bp, S. pombe
ggtaaatttcccttgcatccaaaca

SEQ ID NO: 103249 - DNA, 25 bp, S. pombe
ggtagaatttcttcctgccttagaa

SEQ ID NO: 103250 - DNA, 25 bp, S. pombe
ggtaaacctgtttcttggtctcaat

SEQ ID NO: 103251 - DNA, 25 bp, S. pombe
ggtactaccgttgttagtcgcacag

SEQ ID NO: 103252 - DNA, 25 bp, S. pombe
ggtaaattcttatctgcaatgcacg

SEQ ID NO: 103253 - DNA, 25 bp, S. pombe
ggtacaattttatctgcttcccttc

SEQ ID NO: 103254 - DNA, 25 bp, S. pombe
ggttttaagtgaacttgctgcgctt

SEQ ID NO: 103255 - DNA, 25 bp, S. pombe
ggtttacgatgctgccaaggctcac

SEQ ID NO: 103256 - DNA, 25 bp, S. pombe
ggtacgctcagattctacacagcat

SEQ ID NO: 103257 - DNA, 25 bp, S. pombe
ggtagtaccacgctgaaacaacata

SEQ ID NO: 103258 - DNA, 25 bp, S. pombe
ggtagatgatgcactttctcgaaaa

SEQ ID NO: 103259 - DNA, 25 bp, S. pombe
ggtattggtccacttcttaccaaag

SEQ ID NO: 103260 - DNA, 25 bp, S. pombe
ggtactaagcttttgaacgccagca

SEQ ID NO: 103261 - DNA, 25 bp, S. pombe
ggtattgtccctttggaagccatgc

SEQ ID NO: 103262 - DNA, 25 bp, S. pombe
ggtatttccggtaaaggcgctgcag

SEQ ID NO: 103263 - DNA, 25 bp, S. pombe
ggtttacccgttgtggttgcaatca

SEQ ID NO: 103264 - DNA, 25 bp, S. pombe
ggttatacctaatgcgatgcgtcgc

SEQ ID NO: 103265 - DNA, 25 bp, S. pombe
ggttatgacctcaagacttagcccc

SEQ ID NO: 103266 - DNA, 25 bp, S. pombe
ggtatttgccagtatgctaaacctt

SEQ ID NO: 103267 - DNA, 25 bp, S. pombe
ggtatgcttgcaggtttaattccgt

SEQ ID NO: 103268 - DNA, 25 bp, S. pombe
ggatatcctgccctttataatggtc

SEQ ID NO: 103269 - DNA, 25 bp, S. pombe
ggtatagccaatgttctagccaaaa

SEQ ID NO: 103270 - DNA, 25 bp, S. pombe
ggtatcagatgcttcttgacgtcaa

SEQ ID NO: 103271 - DNA, 25 bp, S. pombe
ggttcagtgctgtggacattgtcac

SEQ ID NO: 103272 - DNA, 25 bp, S. pombe
ggttttgctagcttgcaaggctgca

SEQ ID NO: 103273 - DNA, 25 bp, S. pombe
ggtaccactttcatcagctctacaa

SEQ ID NO: 103274 - DNA, 25 bp, S. pombe
ggtaccacatgaatttcgtccacgg

SEQ ID NO: 103275 - DNA, 25 bp, S. pombe
ggtactccaatgtatatggccccgg

SEQ ID NO: 103276 - DNA, 25 bp, S. pombe
ggtactcgaatggtgtgagcatcac

SEQ ID NO: 103277 - DNA, 25 bp, S. pombe
ggtacatctcactacacacgataaa

SEQ ID NO: 103278 - DNA, 25 bp, S. pombe
ggtactatagcttatcccatcgaca

SEQ ID NO: 103279 - DNA, 25 bp, S. pombe
ggtacattgcatgttggcatccaat

SEQ ID NO: 103280 - DNA, 25 bp, S. pombe
ggtagcatccatgattcgatcctgt

SEQ ID NO: 103281 - DNA, 25 bp, S. pombe
ggtactgcacttcatctttatctat

SEQ ID NO: 103282 - DNA, 25 bp, S. pombe
ggattcttttatatttactacgccg

SEQ ID NO: 103283 - DNA, 25 bp, S. pombe
ggtttcttgtttcttatccctcaag

SEQ ID NO: 103284 - DNA, 25 bp, S. pombe
ggttacgacgctattactcctaagg

SEQ ID NO: 103285 - DNA, 25 bp, S. pombe
ggttttattactgtgagccgtactt

SEQ ID NO: 103286 - DNA, 25 bp, S. pombe
ggttttacaacgcagtccggttatg

SEQ ID NO: 103287 - DNA, 25 bp, S. pombe
ggttttatcgagatcatccttggga

SEQ ID NO: 103288 - DNA, 25 bp, S. pombe
ggtatttctgaagctctgacttggg

SEQ ID NO: 103289 - DNA, 25 bp, S. pombe
ggtactggtgatggtgtgcccttca

SEQ ID NO: 103290 - DNA, 25 bp, S. pombe
ggttttgcctgatctgtaactacat

SEQ ID NO: 103291 - DNA, 25 bp, S. pombe
ggtactgtcttatctgttttccata

SEQ ID NO: 103292 - DNA, 25 bp, S. pombe
ggattattatgaaaccctcccttct

SEQ ID NO: 103293 - DNA, 25 bp, S. pombe
tccatttataactttcctcctttct

SEQ ID NO: 103294 - DNA, 25 bp, S. pombe
tcctattttaaaacctatgcttcct

SEQ ID NO: 103295 - DNA, 25 bp, S. pombe
ggtatctttagacccgcaagttctt

SEQ ID NO: 103296 - DNA, 25 bp, S. pombe
ggttgcttgagtgccaatgccgtta

SEQ ID NO: 103297 - DNA, 25 bp, S. pombe
ggttgcttatggacctaacttcaaa

SEQ ID NO: 103298 - DNA, 25 bp, S. pombe
ggtttccgtactgccttgttgaaca

SEQ ID NO: 103299 - DNA, 25 bp, S. pombe
ggtagatcggtctccattagataca

SEQ ID NO: 103300 - DNA, 25 bp, S. pombe
ggtttcctcaacagctggcatgcaa

SEQ ID NO: 103301 - DNA, 25 bp, S. pombe
ggtatttcaccaaacgcagcagacg

SEQ ID NO: 103302 - DNA, 25 bp, S. pombe
ggttccagccttcggaaatccaagt

SEQ ID NO: 103303 - DNA, 25 bp, S. pombe
ggttcacattcaacggtttccaatc

SEQ ID NO: 103304 - DNA, 25 bp, S. pombe
ggttccttcaccgttggtcgataga

SEQ ID NO: 103305 - DNA, 25 bp, S. pombe
ggttaattccttatggttatgctac

SEQ ID NO: 103306 - DNA, 25 bp, S. pombe
ggagtactttttctggtgttgctta

SEQ ID NO: 103307 - DNA, 25 bp, S. pombe
ggagttccttttaacattgcttctt

SEQ ID NO: 103308 - DNA, 25 bp, S. pombe
ggaacttttcttccaaagctggcct

SEQ ID NO: 103309 - DNA, 25 bp, S. pombe
ggatccgtttcccaaaaatgtctct

SEQ ID NO: 103310 - DNA, 25 bp, S. pombe
ggttccttccaccaatcatagaggg

SEQ ID NO: 103311 - DNA, 25 bp, S. pombe
ggtatccgacctgctattaacgttg

SEQ ID NO: 103312 - DNA, 25 bp, S. pombe
ggtacgccaatcactatttccagtg

SEQ ID NO: 103313 - DNA, 25 bp, S. pombe
ggtacctcggaagctaatcaatctg

SEQ ID NO: 103314 - DNA, 25 bp, S. pombe
ggtaccctcataggccaaaccattt

SEQ ID NO: 103315 - DNA, 25 bp, S. pombe
ggttatacaacacggtcactcacgc

SEQ ID NO: 103316 - DNA, 25 bp, S. pombe
ggtatttattcctaggctacttcat

SEQ ID NO: 103317 - DNA, 25 bp, S. pombe
ggtatgtgtattcaaccaactgtat

SEQ ID NO: 103318 - DNA, 25 bp, S. pombe
ggtttgactgcacatttactacgag

SEQ ID NO: 103319 - DNA, 25 bp, S. pombe
ggtatccggcaatgatcaacaagtt

SEQ ID NO: 103320 - DNA, 25 bp, S. pombe
ggtaccaggatcaaagcttcaagtt

SEQ ID NO: 103321 - DNA, 25 bp, S. pombe
ggatcccacaggtacaggtcgaggt

SEQ ID NO: 103322 - DNA, 25 bp, S. pombe
ggttctaccgtatggtcgaggctta

SEQ ID NO: 103323 - DNA, 25 bp, S. pombe
ggttatacacgatgctggtcgcacc

SEQ ID NO: 103324 - DNA, 25 bp, S. pombe
ggttcaaagcgctagtgacccagcc

SEQ ID NO: 103325 - DNA, 25 bp, S. pombe
ggtttgatatgcctggtgacccaga

SEQ ID NO: 103326 - DNA, 25 bp, S. pombe
ggtatttactatgatggccccacgt

SEQ ID NO: 103327 - DNA, 25 bp, S. pombe
ggtttatagtggtatgggccccgat

SEQ ID NO: 103328 - DNA, 25 bp, S. pombe
ggtttaacgcagctgaggccctcaa

SEQ ID NO: 103329 - DNA, 25 bp, S. pombe
ggtatttacaccaaagctggcctcc

SEQ ID NO: 103330 - DNA, 25 bp, S. pombe
ggtttcacaaacactcaagccgagg

SEQ ID NO: 103331 - DNA, 25 bp, S. pombe
ggtttccaactcaacttgtcaaagg

SEQ ID NO: 103332 - DNA, 25 bp, S. pombe
ggtttcattgtcctcgttgtaaagc

SEQ ID NO: 103333 - DNA, 25 bp, S. pombe
ggtatcataatgtccgctgttcgta

SEQ ID NO: 103334 - DNA, 25 bp, S. pombe
ggtttaaaccatcttcgtattcatt

SEQ ID NO: 103335 - DNA, 25 bp, S. pombe
ggatcttaaacctcttgggatacaa

SEQ ID NO: 103336 - DNA, 25 bp, S. pombe
ggttttcaatactcatcgttgcatc

SEQ ID NO: 103337 - DNA, 25 bp, S. pombe
ggttattctaaatgcaggtgtcctt

SEQ ID NO: 103338 - DNA, 25 bp, S. pombe
ggaattttgaaatctgttgaccagt

SEQ ID NO: 103339 - DNA, 25 bp, S. pombe
tgtcacttttatttcacgtctaccg

SEQ ID NO: 103340 - DNA, 25 bp, S. pombe
tgtactgtcgaattacctttacctt

SEQ ID NO: 103341 - DNA, 25 bp, S. pombe
ggttgtcaaattacgccttacttat

SEQ ID NO: 103342 - DNA, 25 bp, S. pombe
ggtttcaataagaccgctgtcccta

SEQ ID NO: 103343 - DNA, 25 bp, S. pombe
ggtttaaacgccaacatatctcctg

SEQ ID NO: 103344 - DNA, 25 bp, S. pombe
ggtatctacaacttcaacttctctg

SEQ ID NO: 103345 - DNA, 25 bp, S. pombe
ggtatcgcaaccttgcaagccttaa

SEQ ID NO: 103346 - DNA, 25 bp, S. pombe
ggtatccccgccgatggatttagaa

SEQ ID NO: 103347 - DNA, 25 bp, S. pombe
ggtacctccaaatgtattgtatcga

SEQ ID NO: 103348 - DNA, 25 bp, S. pombe
ggtactgtgccatggaatctttcta

SEQ ID NO: 103349 - DNA, 25 bp, S. pombe
ggtatctggagcttgcaaacgttca

SEQ ID NO: 103350 - DNA, 25 bp, S. pombe
ggtatctcgatctgagacctgttat

SEQ ID NO: 103351 - DNA, 25 bp, S. pombe
ggtatccttttgtacctgctaatac

SEQ ID NO: 103352 - DNA, 25 bp, S. pombe
ggtaccattattagatcttgcgcaa

SEQ ID NO: 103353 - DNA, 25 bp, S. pombe
ggttttgatgatccattctttaagg

SEQ ID NO: 103354 - DNA, 25 bp, S. pombe
ggtagcatcaaagttgtccccaatt

SEQ ID NO: 103355 - DNA, 25 bp, S. pombe
ggatgacaagaagctcttccccact

SEQ ID NO: 103356 - DNA, 25 bp, S. pombe
ggtatcaagctagcgttcccattta

SEQ ID NO: 103357 - DNA, 25 bp, S. pombe
ggtatcaatcttgcgtgtgctaata

SEQ ID NO: 103358 - DNA, 25 bp, S. pombe
ggtttagctgctggtgtacacacta

SEQ ID NO: 103359 - DNA, 25 bp, S. pombe
ggtattgtcgattagtctttcagga

SEQ ID NO: 103360 - DNA, 25 bp, S. pombe
ggtttgacgtttatgctcacggcaa

SEQ ID NO: 103361 - DNA, 25 bp, S. pombe
ggttgaacgttgcattgactcgagc

SEQ ID NO: 103362 - DNA, 25 bp, S. pombe
ggttgggtttgcgatagactctcct

SEQ ID NO: 103363 - DNA, 25 bp, S. pombe
ggttgatcgtgaaggtcgacctctc

SEQ ID NO: 103364 - DNA, 25 bp, S. pombe
ggttgcattggaactttccgggcac

SEQ ID NO: 103365 - DNA, 25 bp, S. pombe
ggtatccattatctcttttgatcca

SEQ ID NO: 103366 - DNA, 25 bp, S. pombe
ggtttgatggtgcagcttcttcaca

SEQ ID NO: 103367 - DNA, 25 bp, S. pombe
ggtatttctcaaccatggactcaat

SEQ ID NO: 103368 - DNA, 25 bp, S. pombe
ggtagattcttatcatggctcatac

SEQ ID NO: 103369 - DNA, 25 bp, S. pombe
ggtagtcaacttccattttcaaatc

SEQ ID NO: 103370 - DNA, 25 bp, S. pombe
ggtatatacattcctaggtccgaaa

SEQ ID NO: 103371 - DNA, 25 bp, S. pombe
ggtttctgtatgacagcggcgcatc

SEQ ID NO: 103372 - DNA, 25 bp, S. pombe
ggttcaggaagtccgttcaacgtca

SEQ ID NO: 103373 - DNA, 25 bp, S. pombe
ggtatttatgtcactagcaaagcaa

SEQ ID NO: 103374 - DNA, 25 bp, S. pombe
ggttcgtttacaacatgcaagtcca

SEQ ID NO: 103375 - DNA, 25 bp, S. pombe
ggtatctcctgacacattgttgaca

SEQ ID NO: 103376 - DNA, 25 bp, S. pombe
ggttatttcttgctttttgcttcac

SEQ ID NO: 103377 - DNA, 25 bp, S. pombe
ggttgactatttgttagctcgctta

SEQ ID NO: 103378 - DNA, 25 bp, S. pombe
ggtaggatgtttattcgccattcta

SEQ ID NO: 103379 - DNA, 25 bp, S. pombe
ggtatggctatttatcaatctcccc

SEQ ID NO: 103380 - DNA, 25 bp, S. pombe
ggtagaattcttcccataccatcgg

SEQ ID NO: 103381 - DNA, 25 bp, S. pombe
ggataaattgcctccaaccgatacc

SEQ ID NO: 103382 - DNA, 25 bp, S. pombe
ggtatcacccgaagcgattcaattt

SEQ ID NO: 103383 - DNA, 25 bp, S. pombe
ggtatcacctggaaccattttcact

SEQ ID NO: 103384 - DNA, 25 bp, S. pombe
ggttgcagtacctaatcttacttta

SEQ ID NO: 103385 - DNA, 25 bp, S. pombe
ggttgaacttatttacgaatctcca

SEQ ID NO: 103386 - DNA, 25 bp, S. pombe
ggttgaagccgtttgacgttgtcat

SEQ ID NO: 103387 - DNA, 25 bp, S. pombe
ggttaaaatctgttgtcgatcccaa

SEQ ID NO: 103388 - DNA, 25 bp, S. pombe
ggttgtcacaagcttattctcctag

SEQ ID NO: 103389 - DNA, 25 bp, S. pombe
ggtttaccgtgactatctcatggct

SEQ ID NO: 103390 - DNA, 25 bp, S. pombe
ggtattatttgctacgctctactaa

SEQ ID NO: 103391 - DNA, 25 bp, S. pombe
ggtattactcctatgcttcaaatca

SEQ ID NO: 103392 - DNA, 25 bp, S. pombe
ggtattgctactactggctttattc

SEQ ID NO: 103393 - DNA, 25 bp, S. pombe
ggttctgccattgttgacgttatca

SEQ ID NO: 103394 - DNA, 25 bp, S. pombe
ggatttcctaagtttcgtaccaatg

SEQ ID NO: 103395 - DNA, 25 bp, S. pombe
ggtttagccaatcttcgtatcctag

SEQ ID NO: 103396 - DNA, 25 bp, S. pombe
ggtattcccggtggatacagccaaa

SEQ ID NO: 103397 - DNA, 25 bp, S. pombe
ggtatgatcctcgttggcgattcaa

SEQ ID NO: 103398 - DNA, 25 bp, S. pombe
tggtatgtccatgatgagcgccttc

SEQ ID NO: 103399 - DNA, 25 bp, S. pombe
ggtattactgtctatctgctcattg

SEQ ID NO: 103400 - DNA, 25 bp, S. pombe
ggtatatcacgtcctttcatggtat

SEQ ID NO: 103401 - DNA, 25 bp, S. pombe
ggtttccatgcccttgtaggtaatg

SEQ ID NO: 103402 - DNA, 25 bp, S. pombe
ggtttgagctattgggttctactga

SEQ ID NO: 103403 - DNA, 25 bp, S. pombe
ggtttgcatggacctgttacccata

SEQ ID NO: 103404 - DNA, 25 bp, S. pombe
ggtatgccaagtagccattctcaat

SEQ ID NO: 103405 - DNA, 25 bp, S. pombe
ggtatctccatgatgctcttaatca

SEQ ID NO: 103406 - DNA, 25 bp, S. pombe
ggtatgccaatgactcctgaaacac

SEQ ID NO: 103407 - DNA, 25 bp, S. pombe
ggtatctccagatggaagagtcaca

SEQ ID NO: 103408 - DNA, 25 bp, S. pombe
ggtattccacatttcaacaactgat

SEQ ID NO: 103409 - DNA, 25 bp, S. pombe
ggtattaacttaactgccgctgata

SEQ ID NO: 103410 - DNA, 25 bp, S. pombe
ggttataactttagatctgccagct

SEQ ID NO: 103411 - DNA, 25 bp, S. pombe
ggttctacctaaatcatccgactca

SEQ ID NO: 103412 - DNA, 25 bp, S. pombe
ggtatccccattttgagtgttgcga

SEQ ID NO: 103413 - DNA, 25 bp, S. pombe
ggtagtaccgacatattatcgccat

SEQ ID NO: 103414 - DNA, 25 bp, S. pombe
ggtagtacctggtgatccactggat

SEQ ID NO: 103415 - DNA, 25 bp, S. pombe
ggtatgctagccaagtaattccttt

SEQ ID NO: 103416 - DNA, 25 bp, S. pombe
ggttgccctcgtgttataaatcttg

SEQ ID NO: 103417 - DNA, 25 bp, S. pombe
ggatgttcggtctggccaattactt

SEQ ID NO: 103418 - DNA, 25 bp, S. pombe
ggattactgggctgtgaaatatcga

SEQ ID NO: 103419 - DNA, 25 bp, S. pombe
ggtatgacgggctcgacttcagaat

SEQ ID NO: 103420 - DNA, 25 bp, S. pombe
ggtataggtgcttcgttcttaacat

SEQ ID NO: 103421 - DNA, 25 bp, S. pombe
ggtattggtgattatgcccgttccc

SEQ ID NO: 103422 - DNA, 25 bp, S. pombe
ggttagctgttaaacgtggccacaa

SEQ ID NO: 103423 - DNA, 25 bp, S. pombe
ggttggatgccaaataccccagtgc

SEQ ID NO: 103424 - DNA, 25 bp, S. pombe
ggtatgtggcatgaaactcctcctc

SEQ ID NO: 103425 - DNA, 25 bp, S. pombe
ggtatgtctgtacatccaccagtca

SEQ ID NO: 103426 - DNA, 25 bp, S. pombe
ggataattcaacacgttcgacttgg

SEQ ID NO: 103427 - DNA, 25 bp, S. pombe
ggttactaccttcgtatcgttgatc

SEQ ID NO: 103428 - DNA, 25 bp, S. pombe
ggttcctgaacagcgaatgctttca

SEQ ID NO: 103429 - DNA, 25 bp, S. pombe
tggttcggaatctcaaagtgttgcc

SEQ ID NO: 103430 - DNA, 25 bp, S. pombe
ggttcgtaatcgttcaaagcttcca

SEQ ID NO: 103431 - DNA, 25 bp, S. pombe
ggttctgtgcaagctgttacgtttc

SEQ ID NO: 103432 - DNA, 25 bp, S. pombe
ggtatgctgatgaaccgcttagcga

SEQ ID NO: 103433 - DNA, 25 bp, S. pombe
ggtatgatttacgaacgctgcaaag

SEQ ID NO: 103434 - DNA, 25 bp, S. pombe
ggttctattacctcagtccaagctg

SEQ ID NO: 103435 - DNA, 25 bp, S. pombe
ggttctaatgcccaaagttccagtg

SEQ ID NO: 103436 - DNA, 25 bp, S. pombe
ggattggatcctcaagtaaccttgg

SEQ ID NO: 103437 - DNA, 25 bp, S. pombe
ggttggtcgtttaagcaatcctatg

SEQ ID NO: 103438 - DNA, 25 bp, S. pombe
ggttttattgcatttccaacttcgg

SEQ ID NO: 103439 - DNA, 25 bp, S. pombe
ggatttttactgaccaaccttctgg

SEQ ID NO: 103440 - DNA, 25 bp, S. pombe
ggatttggtactgcggcccgtatat

SEQ ID NO: 103441 - DNA, 25 bp, S. pombe
ggttgctgacctgaagaaacttgaa

SEQ ID NO: 103442 - DNA, 25 bp, S. pombe
ggtattcccgaagacattctcaatc

SEQ ID NO: 103443 - DNA, 25 bp, S. pombe
ggtattcccaatttacattctgttc

SEQ ID NO: 103444 - DNA, 25 bp, S. pombe
ggtataccacaacctgatcgtgttt

SEQ ID NO: 103445 - DNA, 25 bp, S. pombe
ggtttctcaacaatcttccatggtt

SEQ ID NO: 103446 - DNA, 25 bp, S. pombe
ggtttcctagcaatgtcttcagtgt

SEQ ID NO: 103447 - DNA, 25 bp, S. pombe
ggtttgctctactttctttttatgg

SEQ ID NO: 103448 - DNA, 25 bp, S. pombe
ggtttacgtcggattcttcgatcag

SEQ ID NO: 103449 - DNA, 25 bp, S. pombe
ggtttggaccgcgattactttgaag

SEQ ID NO: 103450 - DNA, 25 bp, S. pombe
ggtttgcagcccgaaatagtctatg

SEQ ID NO: 103451 - DNA, 25 bp, S. pombe
ggtatcatgtcccataatgaggctc

SEQ ID NO: 103452 - DNA, 25 bp, S. pombe
ggtatcgtagacattatctccctaa

SEQ ID NO: 103453 - DNA, 25 bp, S. pombe
ggtatttacactacttctacacaaa

SEQ ID NO: 103454 - DNA, 25 bp, S. pombe
ggtattcaacgctctctctatgaaa

SEQ ID NO: 103455 - DNA, 25 bp, S. pombe
ggtatctcaaacttcttctcatggg

SEQ ID NO: 103456 - DNA, 25 bp, S. pombe
ggtataccagattgaccttatgaac

SEQ ID NO: 103457 - DNA, 25 bp, S. pombe
ggttgaccatgaccctttatgaact

SEQ ID NO: 103458 - DNA, 25 bp, S. pombe
ggttcctacttcctatggtattcat

SEQ ID NO: 103459 - DNA, 25 bp, S. pombe
ggttttgcaggtgtttgtgcctcaa

SEQ ID NO: 103460 - DNA, 25 bp, S. pombe
ggttttcgtgatattcatcgtccaa

SEQ ID NO: 103461 - DNA, 25 bp, S. pombe
ggtttctctgatattattccttcac

SEQ ID NO: 103462 - DNA, 25 bp, S. pombe
ggtattcctgtcgtattttctactg

SEQ ID NO: 103463 - DNA, 25 bp, S. pombe
ggtttgttttcaagttctctccatc

SEQ ID NO: 103464 - DNA, 25 bp, S. pombe
ggttttgttgtcatttcccgattca

SEQ ID NO: 103465 - DNA, 25 bp, S. pombe
ggtttgattttagcttcgtcgactc

SEQ ID NO: 103466 - DNA, 25 bp, S. pombe
ggtattgagttgagccttcgtgatt

SEQ ID NO: 103467 - DNA, 25 bp, S. pombe
ggtttaatagcattcgcagttctga

SEQ ID NO: 103468 - DNA, 25 bp, S. pombe
ggtattccatgccaatcaagtcatt

SEQ ID NO: 103469 - DNA, 25 bp, S. pombe
ggtattccatctacatatcagtctg

SEQ ID NO: 103470 - DNA, 25 bp, S. pombe
ggtattataactccttgattcctga

SEQ ID NO: 103471 - DNA, 25 bp, S. pombe
ggatcccaacagacctattttacgc

SEQ ID NO: 103472 - DNA, 25 bp, S. pombe
ggattggccgacttaacggtgcaca

SEQ ID NO: 103473 - DNA, 25 bp, S. pombe
ggattactccttcaaatattcgcaa

SEQ ID NO: 103474 - DNA, 25 bp, S. pombe
ggttcaactcaacaattgcatccga

SEQ ID NO: 103475 - DNA, 25 bp, S. pombe
ggtatataccaccacctgcgaatag

SEQ ID NO: 103476 - DNA, 25 bp, S. pombe
ggtttcagtcaatagagcagcgatt

SEQ ID NO: 103477 - DNA, 25 bp, S. pombe
ggttaaatatggcttcttccgctat

SEQ ID NO: 103478 - DNA, 25 bp, S. pombe
ggttctcaaattcgttcattccgtg

SEQ ID NO: 103479 - DNA, 25 bp, S. pombe
ggtttaatttactgctccaagattg

SEQ ID NO: 103480 - DNA, 25 bp, S. pombe
ggttattatttccaagtccaagatg

SEQ ID NO: 103481 - DNA, 25 bp, S. pombe
ggttggttctgttgttggtatctac

SEQ ID NO: 103482 - DNA, 25 bp, S. pombe
ggttggtatgcttcagatgttgtct

SEQ ID NO: 103483 - DNA, 25 bp, S. pombe
ggttcactgtgcttgctatggattt

SEQ ID NO: 103484 - DNA, 25 bp, S. pombe
ggtttcttgattatggatactcgga

SEQ ID NO: 103485 - DNA, 25 bp, S. pombe
ggttccgattttacgcttgctacta

SEQ ID NO: 103486 - DNA, 25 bp, S. pombe
ggttacgttatatcgcctgcagaag

SEQ ID NO: 103487 - DNA, 25 bp, S. pombe
ggtattttgttctacttcacactct

SEQ ID NO: 103488 - DNA, 25 bp, S. pombe
ggttttattgtccactctacagttc

SEQ ID NO: 103489 - DNA, 25 bp, S. pombe
ggttacctatcctattccagcaaat

SEQ ID NO: 103490 - DNA, 25 bp, S. pombe
ggtattttttctcccgtgattgcaa

SEQ ID NO: 103491 - DNA, 25 bp, S. pombe
ggtttcttgtttcctctagttcaag

SEQ ID NO: 103492 - DNA, 25 bp, S. pombe
ggttgtcgtttcctaagactcttga

SEQ ID NO: 103493 - DNA, 25 bp, S. pombe
ggttctagttctgcattaagccgtt

SEQ ID NO: 103494 - DNA, 25 bp, S. pombe
ggattctaattctcttaagccctcc

SEQ ID NO: 103495 - DNA, 25 bp, S. pombe
ggttactagatgtcattctgcaaat

SEQ ID NO: 103496 - DNA, 25 bp, S. pombe
ggtttcaagatgtgtcgcaggtgca

SEQ ID NO: 103497 - DNA, 25 bp, S. pombe
ggttatgcccgattacaagacatgt

SEQ ID NO: 103498 - DNA, 25 bp, S. pombe
ggttgttcacagttttctaaggcga

SEQ ID NO: 103499 - DNA, 25 bp, S. pombe
ggttttatagcacttctctacgcgt

SEQ ID NO: 103500 - DNA, 25 bp, S. pombe
ggtattggcataccttgtctccatg

SEQ ID NO: 103501 - DNA, 25 bp, S. pombe
ggtttgccatgatttttgccaatgt

SEQ ID NO: 103502 - DNA, 25 bp, S. pombe
ggtttatgcattcgagttcgcctcg

SEQ ID NO: 103503 - DNA, 25 bp, S. pombe
ggtttatcatcacggtacttctgcg

SEQ ID NO: 103504 - DNA, 25 bp, S. pombe
ggttttgctatttctccatttcaat

SEQ ID NO: 103505 - DNA, 25 bp, S. pombe
ggtttctacttgaatcctggtttgc

SEQ ID NO: 103506 - DNA, 25 bp, S. pombe
ggttatgctacctattcctggtact

SEQ ID NO: 103507 - DNA, 25 bp, S. pombe
ggtattaacgctatcaaggccgctt

SEQ ID NO: 103508 - DNA, 25 bp, S. pombe
ggtttatcacgcttaccaggatcgt

SEQ ID NO: 103509 - DNA, 25 bp, S. pombe
ggtttgctagcgttatccatgtttt

SEQ ID NO: 103510 - DNA, 25 bp, S. pombe
ggtttgcgacgcttttatttatcta

SEQ ID NO: 103511 - DNA, 25 bp, S. pombe
ggtattctacatcctattctctaaa

SEQ ID NO: 103512 - DNA, 25 bp, S. pombe
ggttatgctagacttcatcgctcta

SEQ ID NO: 103513 - DNA, 25 bp, S. pombe
ggtttgctcagctttcgagcttata

SEQ ID NO: 103514 - DNA, 25 bp, S. pombe
ggtattcgattatttggctctctta

SEQ ID NO: 103515 - DNA, 25 bp, S. pombe
ggtattcgcaatgtatcccagttga

SEQ ID NO: 103516 - DNA, 25 bp, S. pombe
ggtattcgagctcgtatctcacaat

SEQ ID NO: 103517 - DNA, 25 bp, S. pombe
ggttttgtccacctcatacatgaat

SEQ ID NO: 103518 - DNA, 25 bp, S. pombe
ggttatttggatcccagctcaacac

SEQ ID NO: 103519 - DNA, 25 bp, S. pombe
ggtttggaccaaattgctcaggaaa

SEQ ID NO: 103520 - DNA, 25 bp, S. pombe
ggtttcagaattctatcgttcgcag

SEQ ID NO: 103521 - DNA, 25 bp, S. pombe
ggttctcgatttattggccttcagt

SEQ ID NO: 103522 - DNA, 25 bp, S. pombe
ggatgcatccacttttgttggacgt

SEQ ID NO: 103523 - DNA, 25 bp, S. pombe
ggttttgcttcactgtgttaccgaa

SEQ ID NO: 103524 - DNA, 25 bp, S. pombe
ggttgatcgaagactttttagccaa

SEQ ID NO: 103525 - DNA, 25 bp, S. pombe
ggttttcttggcatgtactactact

SEQ ID NO: 103526 - DNA, 25 bp, S. pombe
ggttttcatcggctaatcaatttct

SEQ ID NO: 103527 - DNA, 25 bp, S. pombe
ggtttgccagggatgataatatatt

SEQ ID NO: 103528 - DNA, 25 bp, S. pombe
ggtttgttccatctgttgctggtga

SEQ ID NO: 103529 - DNA, 25 bp, S. pombe
ggttgtgttcacagtgcacctttaa

SEQ ID NO: 103530 - DNA, 25 bp, S. pombe
ggtttttgctggatgacaccacaat

SEQ ID NO: 103531 - DNA, 25 bp, S. pombe
ggttttatcattttgctagccacga

SEQ ID NO: 103532 - DNA, 25 bp, S. pombe
ggttcttaatttttcgcctgcgaag

SEQ ID NO: 103533 - DNA, 25 bp, S. pombe
ggttcttccaaacttgttagcgaat

SEQ ID NO: 103534 - DNA, 25 bp, S. pombe
ggttgttccaaagcgctctattata

SEQ ID NO: 103535 - DNA, 25 bp, S. pombe
ggttttggaacagctctctggtcaa

SEQ ID NO: 103536 - DNA, 25 bp, S. pombe
ggttctcgaaaagccttctgtcagc

SEQ ID NO: 103537 - DNA, 25 bp, S. pombe
ggttttcagaataagcaggccgtcc

SEQ ID NO: 103538 - DNA, 25 bp, S. pombe
ggtttttggatgagcatgcgccttc

SEQ ID NO: 103539 - DNA, 25 bp, S. pombe
ggtttcttttcgtatcactgtgttt

SEQ ID NO: 103540 - DNA, 25 bp, S. pombe
ggtttccttatttgctgtcttttat

SEQ ID NO: 103541 - DNA, 25 bp, S. pombe
ggttacagcgacatccattcaaatg

SEQ ID NO: 103542 - DNA, 25 bp, S. pombe
ggtttctcacgtacttcaccaaagg

SEQ ID NO: 103543 - DNA, 25 bp, S. pombe
ggtttcccgtacatgcatacatcaa

SEQ ID NO: 103544 - DNA, 25 bp, S. pombe
ggatttcctcgtgcatggactcaaa

SEQ ID NO: 103545 - DNA, 25 bp, S. pombe
ggttgttcgtgttcccaaacaagat

SEQ ID NO: 103546 - DNA, 25 bp, S. pombe
ggttgtatctttcttttggtcatta

SEQ ID NO: 103547 - DNA, 25 bp, S. pombe
ggtttcgctttctgaattggtctta

SEQ ID NO: 103548 - DNA, 25 bp, S. pombe
ggttccactttcctaaatgtcctat

SEQ ID NO: 103549 - DNA, 25 bp, S. pombe
ggttccaccacagcaatatcggttg

SEQ ID NO: 103550 - DNA, 25 bp, S. pombe
tgtgtccccgttctattcaaaattt

SEQ ID NO: 103551 - DNA, 25 bp, S. pombe
ggatccctcgtttgttttagatttg

SEQ ID NO: 103552 - DNA, 25 bp, S. pombe
ggattaccttcacaacccaatagta

SEQ ID NO: 103553 - DNA, 25 bp, S. pombe
ggttgaggttaccattgcccagtaa

SEQ ID NO: 103554 - DNA, 25 bp, S. pombe
ggtttacacttacttgcagtctcga

SEQ ID NO: 103555 - DNA, 25 bp, S. pombe
ggttcaattaactctgcaatatgca

SEQ ID NO: 103556 - DNA, 25 bp, S. pombe
ggtttctgcacccaaatcgcagtat

SEQ ID NO: 103557 - DNA, 25 bp, S. pombe
ggtttctcaatacagatccactctt

SEQ ID NO: 103558 - DNA, 25 bp, S. pombe
ggattttggacacctatctaccatt

SEQ ID NO: 103559 - DNA, 25 bp, S. pombe
ggttatcgagaacctctcttgtgtt

SEQ ID NO: 103560 - DNA, 25 bp, S. pombe
ggatttccttgacgccgttcaaaag

SEQ ID NO: 103561 - DNA, 25 bp, S. pombe
ggttttaccatatcgagtgtatcgt

SEQ ID NO: 103562 - DNA, 25 bp, S. pombe
ggttcgcttcaaatcccgatattta

SEQ ID NO: 103563 - DNA, 25 bp, S. pombe
ggttctttcagatcttcgtgagtct

SEQ ID NO: 103564 - DNA, 25 bp, S. pombe
ggattttatcgatctcctggaccat

SEQ ID NO: 103565 - DNA, 25 bp, S. pombe
ggattttaccttcagagtcacgctt

SEQ ID NO: 103566 - DNA, 25 bp, S. pombe
ggatttctacgttgtcatggaccgc

SEQ ID NO: 103567 - DNA, 25 bp, S. pombe
ggatacaaactacttctgctgattc

SEQ ID NO: 103568 - DNA, 25 bp, S. pombe
ggaccagtactttatctgtgactca

SEQ ID NO: 103569 - DNA, 25 bp, S. pombe
ggatccagaactactaaagcgtcag

SEQ ID NO: 103570 - DNA, 25 bp, S. pombe
ggatcacgacctgcaatagggccaa

SEQ ID NO: 103571 - DNA, 25 bp, S. pombe
ggttcaatcggctacattgggcaaa

SEQ ID NO: 103572 - DNA, 25 bp, S. pombe
ggttaccgccttcaatagtactgga

SEQ ID NO: 103573 - DNA, 25 bp, S. pombe
ggattccccgtgtacaatagttttg

SEQ ID NO: 103574 - DNA, 25 bp, S. pombe
ggttcacccttctactaatgttagt

SEQ ID NO: 103575 - DNA, 25 bp, S. pombe
ggatatccatgcctttactcaggtt

SEQ ID NO: 103576 - DNA, 25 bp, S. pombe
ggttccttctgctaatgttggtgat

SEQ ID NO: 103577 - DNA, 25 bp, S. pombe
ggttcggctgctcaatctattacat

SEQ ID NO: 103578 - DNA, 25 bp, S. pombe
ggttcagtctgctccagttcaaaga

SEQ ID NO: 103579 - DNA, 25 bp, S. pombe
ggttagttaccgtcattcaccatga

SEQ ID NO: 103580 - DNA, 25 bp, S. pombe
ggttaagtactcttcttcatccgaa

SEQ ID NO: 103581 - DNA, 25 bp, S. pombe
ggttaggacctactttgcacaacat

SEQ ID NO: 103582 - DNA, 25 bp, S. pombe
ggttaatcacttggtttgcacacga

SEQ ID NO: 103583 - DNA, 25 bp, S. pombe
ggttaagattgaagacgctcctcgt

SEQ ID NO: 103584 - DNA, 25 bp, S. pombe
ggttgaaagccaaatcctcccagat

SEQ ID NO: 103585 - DNA, 25 bp, S. pombe
ggttgagacaccaaagcccgaagct

SEQ ID NO: 103586 - DNA, 25 bp, S. pombe
ggttatatcatcatagtcactggag

SEQ ID NO: 103587 - DNA, 25 bp, S. pombe
ggttattatcttacatccatcgtgg

SEQ ID NO: 103588 - DNA, 25 bp, S. pombe
ggttatttgaacaatcctgctgcga

SEQ ID NO: 103589 - DNA, 25 bp, S. pombe
ggtttatcgtattatctctctcctc

SEQ ID NO: 103590 - DNA, 25 bp, S. pombe
ggttagattgtcttattcttcaaat

SEQ ID NO: 103591 - DNA, 25 bp, S. pombe
ggatctaggtactgtttgtttgcac

SEQ ID NO: 103592 - DNA, 25 bp, S. pombe
ggattacatcaaaacgtcggttcac

SEQ ID NO: 103593 - DNA, 25 bp, S. pombe
ggattacaagacattcctcgtccac

SEQ ID NO: 103594 - DNA, 25 bp, S. pombe
ggattccaaacgttccttgataccg

SEQ ID NO: 103595 - DNA, 25 bp, S. pombe
ggttacaagtgatgcgttctccaca

SEQ ID NO: 103596 - DNA, 25 bp, S. pombe
ggattttttaactgcactcaaactt

SEQ ID NO: 103597 - DNA, 25 bp, S. pombe
ggctaactttatggaccgccaaaga

SEQ ID NO: 103598 - DNA, 25 bp, S. pombe
ggatcacgtatttggagccccgaaa

SEQ ID NO: 103599 - DNA, 25 bp, S. pombe
ggttgcgtcaaattcggtaatgtga

SEQ ID NO: 103600 - DNA, 25 bp, S. pombe
ggttttcaaattgcaccagatgtga

SEQ ID NO: 103601 - DNA, 25 bp, S. pombe
ggtttattttcatcccacatcagat

SEQ ID NO: 103602 - DNA, 25 bp, S. pombe
ggttacgtatctgcagtcaccatct

SEQ ID NO: 103603 - DNA, 25 bp, S. pombe
ggttccctatttatatgcccattaa

SEQ ID NO: 103604 - DNA, 25 bp, S. pombe
ggttcctacggaacatgagcctgtt

SEQ ID NO: 103605 - DNA, 25 bp, S. pombe
ggttagctattcgtaacaccctctc

SEQ ID NO: 103606 - DNA, 25 bp, S. pombe
ggatacattttctgatgggccctca

SEQ ID NO: 103607 - DNA, 25 bp, S. pombe
ggttattattcttctggtgctccag

SEQ ID NO: 103608 - DNA, 25 bp, S. pombe
ggttacaaagttcctcatccattaa

SEQ ID NO: 103609 - DNA, 25 bp, S. pombe
ggatcaagaccgcaacattttggat

SEQ ID NO: 103610 - DNA, 25 bp, S. pombe
ggttaatcgcactagagacttttat

SEQ ID NO: 103611 - DNA, 25 bp, S. pombe
ggttcaatcacagaaaccattgtaa

SEQ ID NO: 103612 - DNA, 25 bp, S. pombe
ggttagacatggacaaactcatcat

SEQ ID NO: 103613 - DNA, 25 bp, S. pombe
ggcgacctcaggatgctgagcgtca

SEQ ID NO: 103614 - DNA, 25 bp, S. pombe
ggttcctttgtttgagcagtgcacg

SEQ ID NO: 103615 - DNA, 25 bp, S. pombe
ggttctttctctttggctgagatat

SEQ ID NO: 103616 - DNA, 25 bp, S. pombe
ggttttgatcctttggcatctctaa

SEQ ID NO: 103617 - DNA, 25 bp, S. pombe
ggttataatccttatggccctatta

SEQ ID NO: 103618 - DNA, 25 bp, S. pombe
ggttgaactacgttgagcctcatac

SEQ ID NO: 103619 - DNA, 25 bp, S. pombe
ggattggatctaacagggcttctat

SEQ ID NO: 103620 - DNA, 25 bp, S. pombe
ggagttatctcgacgtggtactttt

SEQ ID NO: 103621 - DNA, 25 bp, S. pombe
ggagggattcagcaagttactttct

SEQ ID NO: 103622 - DNA, 25 bp, S. pombe
ggagggtaggaacatgtactctttt

SEQ ID NO: 103623 - DNA, 25 bp, S. pombe
ggaggattacgatcgtttacgccct

SEQ ID NO: 103624 - DNA, 25 bp, S. pombe
ggatacttactcaagcgccttaagc

SEQ ID NO: 103625 - DNA, 25 bp, S. pombe
ggttatgctactactgctcaattaa

SEQ ID NO: 103626 - DNA, 25 bp, S. pombe
ggttatggcccaagctaatgtttct

SEQ ID NO: 103627 - DNA, 25 bp, S. pombe
ggatttccccgtcaagttaaagatg

SEQ ID NO: 103628 - DNA, 25 bp, S. pombe
ggttacgctgtggatgcatctactc

SEQ ID NO: 103629 - DNA, 25 bp, S. pombe
ggttatcctccattttactctgaga

SEQ ID NO: 103630 - DNA, 25 bp, S. pombe
ggattgcgtttcacaagtttctttc

SEQ ID NO: 103631 - DNA, 25 bp, S. pombe
ggttcgagtctactagcttttcttt

SEQ ID NO: 103632 - DNA, 25 bp, S. pombe
ggttaacattactgagcttcctgat

SEQ ID NO: 103633 - DNA, 25 bp, S. pombe
ggttctgaggagataccgaatccat

SEQ ID NO: 103634 - DNA, 25 bp, S. pombe
ggttttggatactcttgacacactt

SEQ ID NO: 103635 - DNA, 25 bp, S. pombe
ggttccgaagcaatcctaacgatcc

SEQ ID NO: 103636 - DNA, 25 bp, S. pombe
ggatggttcttactcaaggtcgatt

SEQ ID NO: 103637 - DNA, 25 bp, S. pombe
ggttacggcgtttctcaagctgaat

SEQ ID NO: 103638 - DNA, 25 bp, S. pombe
ggttctgctgagtttttattttctt

SEQ ID NO: 103639 - DNA, 25 bp, S. pombe
ggttccttacatgtgtgtcattgca

SEQ ID NO: 103640 - DNA, 25 bp, S. pombe
ggttccttacatgtgtgtcattgca

SEQ ID NO: 103641 - DNA, 25 bp, S. pombe
ggttccttatatgtgtgtaattgct

SEQ ID NO: 103642 - DNA, 25 bp, S. pombe
ggattatgccaacggtactaccact

SEQ ID NO: 103643 - DNA, 25 bp, S. pombe
ggattgacgctcacgctgacattaa

SEQ ID NO: 103644 - DNA, 25 bp, S. pombe
ggattacgttcttgatgcctattac

SEQ ID NO: 103645 - DNA, 25 bp, S. pombe
ggataacgttctttctttcgatatt

SEQ ID NO: 103646 - DNA, 25 bp, S. pombe
ggagctgaagctttagctaccgcct

SEQ ID NO: 103647 - DNA, 25 bp, S. pombe
ggttacaacaagcttcgacgatcag

SEQ ID NO: 103648 - DNA, 25 bp, S. pombe
ggttagcaagctttttcacatcgta

SEQ ID NO: 103649 - DNA, 25 bp, S. pombe
ggttcactactattattacaggcat

SEQ ID NO: 103650 - DNA, 25 bp, S. pombe
ggttacatctcctatggtgtcacaa

SEQ ID NO: 103651 - DNA, 25 bp, S. pombe
ggttactattgccatgctcttgaga

SEQ ID NO: 103652 - DNA, 25 bp, S. pombe
ggttgcaatactcccttaatcaaat

SEQ ID NO: 103653 - DNA, 25 bp, S. pombe
ggattcgtggaatattgcccctttt

SEQ ID NO: 103654 - DNA, 25 bp, S. pombe
ggattggttgaatgtccccgtcatc

SEQ ID NO: 103655 - DNA, 25 bp, S. pombe
ggttgtcttatatttccgcacctaa

SEQ ID NO: 103656 - DNA, 25 bp, S. pombe
ggttgtcttagatccgtcatttaat

SEQ ID NO: 103657 - DNA, 25 bp, S. pombe
ggcttttataaaggatgtttcccag

SEQ ID NO: 103658 - DNA, 25 bp, S. pombe
ggaattacccaagatacatcccctt

SEQ ID NO: 103659 - DNA, 25 bp, S. pombe
ggaagtacccaacaattgccaacct

SEQ ID NO: 103660 - DNA, 25 bp, S. pombe
ggatggatacccttaatattcctta

SEQ ID NO: 103661 - DNA, 25 bp, S. pombe
ggattaagctcctcaaattgttcac

SEQ ID NO: 103662 - DNA, 25 bp, S. pombe
ggttctgcccctagtaatattgctt

SEQ ID NO: 103663 - DNA, 25 bp, S. pombe
ggttccacctgtttattatgcgcat

SEQ ID NO: 103664 - DNA, 25 bp, S. pombe
ggattgttttacagctatcgatcta

SEQ ID NO: 103665 - DNA, 25 bp, S. pombe
ggacggatttcccatttttgcttat

SEQ ID NO: 103666 - DNA, 25 bp, S. pombe
ggattggtgcgttcgattttatcga

SEQ ID NO: 103667 - DNA, 25 bp, S. pombe
ggattcatttccattgccaaccgat

SEQ ID NO: 103668 - DNA, 25 bp, S. pombe
ggttctttgtgcacaatgcttccac

SEQ ID NO: 103669 - DNA, 25 bp, S. pombe
ggttctctattgcttttgtatactg

SEQ ID NO: 103670 - DNA, 25 bp, S. pombe
ggttcatccggtgttagtcatgtca

SEQ ID NO: 103671 - DNA, 25 bp, S. pombe
ggattcggcgttgctatagatttaa

SEQ ID NO: 103672 - DNA, 25 bp, S. pombe
ggattcggcgtttaatttactgcaa

SEQ ID NO: 103673 - DNA, 25 bp, S. pombe
ggttcagtaatttctattctttcat

SEQ ID NO: 103674 - DNA, 25 bp, S. pombe
ggttccctatgtttatttacgctat

SEQ ID NO: 103675 - DNA, 25 bp, S. pombe
ggatactactaggttctttacactt

SEQ ID NO: 103676 - DNA, 25 bp, S. pombe
ggatttttaggcttcctcaacagca

SEQ ID NO: 103677 - DNA, 25 bp, S. pombe
ggttaatttggcatcttccaggaat

SEQ ID NO: 103678 - DNA, 25 bp, S. pombe
ggattttcttcgtgatgcatgggat

SEQ ID NO: 103679 - DNA, 25 bp, S. pombe
ggatatcttttcttcggtttgagtt

SEQ ID NO: 103680 - DNA, 25 bp, S. pombe
ggattttctttaccgtattcgctgt

SEQ ID NO: 103681 - DNA, 25 bp, S. pombe
ggatttattttaccagccttatgct

SEQ ID NO: 103682 - DNA, 25 bp, S. pombe
ggattccctgttacatcatttgcgt

SEQ ID NO: 103683 - DNA, 25 bp, S. pombe
ggttggcatcagaaaaccctgcaga

SEQ ID NO: 103684 - DNA, 25 bp, S. pombe
ggttgcgctctcaagcaaaactaga

SEQ ID NO: 103685 - DNA, 25 bp, S. pombe
ggttgtctccccaaattctagaata

SEQ ID NO: 103686 - DNA, 25 bp, S. pombe
ggttgatgccctgtatactataaat

SEQ ID NO: 103687 - DNA, 25 bp, S. pombe
ggttggaccagcttcgactgtaatg

SEQ ID NO: 103688 - DNA, 25 bp, S. pombe
ggttggatccagcatcttcgaaatc

SEQ ID NO: 103689 - DNA, 25 bp, S. pombe
ggttgctcagattactactctggca

SEQ ID NO: 103690 - DNA, 25 bp, S. pombe
ggttgaagaatttggcgccgccatg

SEQ ID NO: 103691 - DNA, 25 bp, S. pombe
ggttaatgatttatcccagcctgat

SEQ ID NO: 103692 - DNA, 25 bp, S. pombe
ggttcttcgtcatgatatccctaat

SEQ ID NO: 103693 - DNA, 25 bp, S. pombe
ggttgtgcttaatagagtgcgctca

SEQ ID NO: 103694 - DNA, 25 bp, S. pombe
ggatcatggcagtatctgtctcgat

SEQ ID NO: 103695 - DNA, 25 bp, S. pombe
ggttctgcccaacttgctgataagg

SEQ ID NO: 103696 - DNA, 25 bp, S. pombe
ggttctcaacatttctttgggtgaa

SEQ ID NO: 103697 - DNA, 25 bp, S. pombe
ggataccaatcggtcgtgtactttt

SEQ ID NO: 103698 - DNA, 25 bp, S. pombe
ggatcgatttccacaagggctgcta

SEQ ID NO: 103699 - DNA, 25 bp, S. pombe
ggttgaaagtcagtctctcgaagat

SEQ ID NO: 103700 - DNA, 25 bp, S. pombe
ggctttcaattcgtctaagtttact

SEQ ID NO: 103701 - DNA, 25 bp, S. pombe
ggattttaccctttgcatattatga

SEQ ID NO: 103702 - DNA, 25 bp, S. pombe
ggttcttcactcctttgagattcta

SEQ ID NO: 103703 - DNA, 25 bp, S. pombe
ggttgcagcatctcgtgttacatat

SEQ ID NO: 103704 - DNA, 25 bp, S. pombe
ggttgagccttccatgtatactagt

SEQ ID NO: 103705 - DNA, 25 bp, S. pombe
ggttgcgacttcactcaatgcaatt

SEQ ID NO: 103706 - DNA, 25 bp, S. pombe
ggttcagtccaattttgcttgctgt

SEQ ID NO: 103707 - DNA, 25 bp, S. pombe
ggattgtaaacgtgctcatcgctcc

SEQ ID NO: 103708 - DNA, 25 bp, S. pombe
ggttgtgaactattcttgctcttca

SEQ ID NO: 103709 - DNA, 25 bp, S. pombe
ggttctacagtattctagggctcaa

SEQ ID NO: 103710 - DNA, 25 bp, S. pombe
ggttcttccttttagtgcctacact

SEQ ID NO: 103711 - DNA, 25 bp, S. pombe
ggttctatccttcgtgagtgttccc

SEQ ID NO: 103712 - DNA, 25 bp, S. pombe
ggttgttcaattcgtacctgataga

SEQ ID NO: 103713 - DNA, 25 bp, S. pombe
ggattgttaattctcatcacggatg

SEQ ID NO: 103714 - DNA, 25 bp, S. pombe
ggattgttctcaggttgcaacgaca

SEQ ID NO: 103715 - DNA, 25 bp, S. pombe
ggttcatccctgcttgtgatcgata

SEQ ID NO: 103716 - DNA, 25 bp, S. pombe
ggatcgcttcgagatatctttggaa

SEQ ID NO: 103717 - DNA, 25 bp, S. pombe
ggattgttagttccactcttgtaca

SEQ ID NO: 103718 - DNA, 25 bp, S. pombe
ggatttacgaagtggctcgccaatt

SEQ ID NO: 103719 - DNA, 25 bp, S. pombe
ggatgaaagccgagagactaccact

SEQ ID NO: 103720 - DNA, 25 bp, S. pombe
ggataccccaattaagtcgccgtcg

SEQ ID NO: 103721 - DNA, 25 bp, S. pombe
ggttccaaaagtcgtactctgcttc

SEQ ID NO: 103722 - DNA, 25 bp, S. pombe
ggttctggaaagcagtcgcatctgt

SEQ ID NO: 103723 - DNA, 25 bp, S. pombe
ggttgctactgatgttgcttctaga

SEQ ID NO: 103724 - DNA, 25 bp, S. pombe
ggatactggttgtttggcatttcac

SEQ ID NO: 103725 - DNA, 25 bp, S. pombe
ggttgctggatttttgatgctttca

SEQ ID NO: 103726 - DNA, 25 bp, S. pombe
ggcaccttgtttgtttgctggtcga

SEQ ID NO: 103727 - DNA, 25 bp, S. pombe
ggatctttgtttatatttggccgta

SEQ ID NO: 103728 - DNA, 25 bp, S. pombe
ggttccgttctattctacttcgaag

SEQ ID NO: 103729 - DNA, 25 bp, S. pombe
ggttctgatccgttttcaacattca

SEQ ID NO: 103730 - DNA, 25 bp, S. pombe
ggttgcttatccaattgctctattt

SEQ ID NO: 103731 - DNA, 25 bp, S. pombe
ggttcctgttgctcacatttttgaa

SEQ ID NO: 103732 - DNA, 25 bp, S. pombe
ggatacttcgctacggacatgcctg

SEQ ID NO: 103733 - DNA, 25 bp, S. pombe
ggataggccgctcacagaacctgaa

SEQ ID NO: 103734 - DNA, 25 bp, S. pombe
ggatatccgtgcttacgaacgtgaa

SEQ ID NO: 103735 - DNA, 25 bp, S. pombe
ggattttaaccacttgacctggtct

SEQ ID NO: 103736 - DNA, 25 bp, S. pombe
ggattcctctaaacccaaaggcact

SEQ ID NO: 103737 - DNA, 25 bp, S. pombe
ggattgcaccttaacgtcaacacga

SEQ ID NO: 103738 - DNA, 25 bp, S. pombe
ggatttcgtggaccgctacaaacgt

SEQ ID NO: 103739 - DNA, 25 bp, S. pombe
ggattcccggaaagcctcgaatggt

SEQ ID NO: 103740 - DNA, 25 bp, S. pombe
ggttctgcacttgtcaaacttgttg

SEQ ID NO: 103741 - DNA, 25 bp, S. pombe
ggattcgtaggttcatttctcagag

SEQ ID NO: 103742 - DNA, 25 bp, S. pombe
ggattggctaggctcaatttcaaag

SEQ ID NO: 103743 - DNA, 25 bp, S. pombe
ggttggacttgtatatactctttac

SEQ ID NO: 103744 - DNA, 25 bp, S. pombe
ggttgttgcgagatatccagtccat

SEQ ID NO: 103745 - DNA, 25 bp, S. pombe
ggatgagtcccgtatgaagcttgat

SEQ ID NO: 103746 - DNA, 25 bp, S. pombe
ggatactgtgtctttgcacgttgtt

SEQ ID NO: 103747 - DNA, 25 bp, S. pombe
ggatatttgaccaccgtcatggatt

SEQ ID NO: 103748 - DNA, 25 bp, S. pombe
ggatattcagtcaaaccgtcttgtt

SEQ ID NO: 103749 - DNA, 25 bp, S. pombe
ggattcggtcaattcaacgctagtt

SEQ ID NO: 103750 - DNA, 25 bp, S. pombe
ggatttagtcaattgggcctacatt

SEQ ID NO: 103751 - DNA, 25 bp, S. pombe
ggttccgcatactattgaagccgtt

SEQ ID NO: 103752 - DNA, 25 bp, S. pombe
ggattccgaacgcttattgatgcta

SEQ ID NO: 103753 - DNA, 25 bp, S. pombe
ggagaccgatgctgggtttgactct

SEQ ID NO: 103754 - DNA, 25 bp, S. pombe
ggatgcacaggttcgggatttagct

SEQ ID NO: 103755 - DNA, 25 bp, S. pombe
ggatcagcgacttcggtatctccag

SEQ ID NO: 103756 - DNA, 25 bp, S. pombe
ggattcactgtttacgtccttgatg

SEQ ID NO: 103757 - DNA, 25 bp, S. pombe
ggttgcacctgcttatgattttgct

SEQ ID NO: 103758 - DNA, 25 bp, S. pombe
ggatttacctttattattgcccata

SEQ ID NO: 103759 - DNA, 25 bp, S. pombe
ggattcttcctatgttccattttca

SEQ ID NO: 103760 - DNA, 25 bp, S. pombe
ggattcattccgagtaggtacttca

SEQ ID NO: 103761 - DNA, 25 bp, S. pombe
ggattcgtcacgaccggaaatttca

SEQ ID NO: 103762 - DNA, 25 bp, S. pombe
ggattcgaccctcgtggtaacatta

SEQ ID NO: 103763 - DNA, 25 bp, S. pombe
ggatagccctacagcctcgaaaaag

SEQ ID NO: 103764 - DNA, 25 bp, S. pombe
ggaacccgaagatctccacttaatt

SEQ ID NO: 103765 - DNA, 25 bp, S. pombe
ggattgcccgacgtagtcgactata

SEQ ID NO: 103766 - DNA, 25 bp, S. pombe
ggttgctccaacgtctgttaatcat

SEQ ID NO: 103767 - DNA, 25 bp, S. pombe
ggattgcccacatatgcacatgtta

SEQ ID NO: 103768 - DNA, 25 bp, S. pombe
ggattggatcgctactgcacattta

SEQ ID NO: 103769 - DNA, 25 bp, S. pombe
ggattggactccttgccatgtatat

SEQ ID NO: 103770 - DNA, 25 bp, S. pombe
ggatactttgaatccttcgtccaaa

SEQ ID NO: 103771 - DNA, 25 bp, S. pombe
ggatcttcaaattctttggaccgga

SEQ ID NO: 103772 - DNA, 25 bp, S. pombe
ggttgcattaatcctttggtctctt

SEQ ID NO: 103773 - DNA, 25 bp, S. pombe
ggaatcgtgacaatatgaggagctc

SEQ ID NO: 103774 - DNA, 25 bp, S. pombe
ggatactgccgcaaatggtctacca

SEQ ID NO: 103775 - DNA, 25 bp, S. pombe
ggattcgatcacacgaccaatctta

SEQ ID NO: 103776 - DNA, 25 bp, S. pombe
ggatctagctctttggaccaatcgt

SEQ ID NO: 103777 - DNA, 25 bp, S. pombe
ggatatccttcgtgaccaatggtct

SEQ ID NO: 103778 - DNA, 25 bp, S. pombe
ggatttcgtgcgttatcttgatgga

SEQ ID NO: 103779 - DNA, 25 bp, S. pombe
ggattctcgcggctatcttaagacc

SEQ ID NO: 103780 - DNA, 25 bp, S. pombe
ggattctgaaggctccattaataca

SEQ ID NO: 103781 - DNA, 25 bp, S. pombe
ggatactgattacccgattgacacc

SEQ ID NO: 103782 - DNA, 25 bp, S. pombe
ggattgattataccggttcaccctt

SEQ ID NO: 103783 - DNA, 25 bp, S. pombe
ggatattacctctattgatgcccta

SEQ ID NO: 103784 - DNA, 25 bp, S. pombe
ggattctggtatagtaagcgccgaa

SEQ ID NO: 103785 - DNA, 25 bp, S. pombe
ggatttggctataatctacccacca

SEQ ID NO: 103786 - DNA, 25 bp, S. pombe
ggagttcctgaatgtcaggcccaat

SEQ ID NO: 103787 - DNA, 25 bp, S. pombe
ggattatcctaatggctggagccct

SEQ ID NO: 103788 - DNA, 25 bp, S. pombe
ggatatcctacaaaggccgacctta

SEQ ID NO: 103789 - DNA, 25 bp, S. pombe
ggatcgattaccatcaacctctgtt

SEQ ID NO: 103790 - DNA, 25 bp, S. pombe
ggatcatattcgtggatatcagcta

SEQ ID NO: 103791 - DNA, 25 bp, S. pombe
ggattcattgctcacgatttgtaca

SEQ ID NO: 103792 - DNA, 25 bp, S. pombe
ggattcagatcgcatcttagtctta

SEQ ID NO: 103793 - DNA, 25 bp, S. pombe
ggattgaatcccaaacttgctgaat

SEQ ID NO: 103794 - DNA, 25 bp, S. pombe
ggttggctactggaagtcgcatcaa

SEQ ID NO: 103795 - DNA, 25 bp, S. pombe
ggattgtgttaccaaatctcttcat

SEQ ID NO: 103796 - DNA, 25 bp, S. pombe
ggatttgtacctcttttcatttata

SEQ ID NO: 103797 - DNA, 25 bp, S. pombe
ggatatcttagctaccttattctgt

SEQ ID NO: 103798 - DNA, 25 bp, S. pombe
ggatcactcatagtaacgtttcgaa

SEQ ID NO: 103799 - DNA, 25 bp, S. pombe
ggatccttgaagacacgttagctgg

SEQ ID NO: 103800 - DNA, 25 bp, S. pombe
ggatatgctggctattgacgttaca

SEQ ID NO: 103801 - DNA, 25 bp, S. pombe
ggcattgggtgctgacgttgaaatt

SEQ ID NO: 103802 - DNA, 25 bp, S. pombe
ggattcagctttcttgggcaaggcc

SEQ ID NO: 103803 - DNA, 25 bp, S. pombe
ggatattgctttcttactggaccct

SEQ ID NO: 103804 - DNA, 25 bp, S. pombe
ggattctctttgcttaaggctcata

SEQ ID NO: 103805 - DNA, 25 bp, S. pombe
ggattcttttgaggcacacgtgttt

SEQ ID NO: 103806 - DNA, 25 bp, S. pombe
ggatttgtattaatgcagcccgtga

SEQ ID NO: 103807 - DNA, 25 bp, S. pombe
ggattcacaccatggttcaaactta

SEQ ID NO: 103808 - DNA, 25 bp, S. pombe
ggattccttgatggattcttccttc

SEQ ID NO: 103809 - DNA, 25 bp, S. pombe
ggattccatattcgctattttcttc

SEQ ID NO: 103810 - DNA, 25 bp, S. pombe
ggagcaacactatcgagcggttact

SEQ ID NO: 103811 - DNA, 25 bp, S. pombe
ggataccctttcagatatcggtcaa

SEQ ID NO: 103812 - DNA, 25 bp, S. pombe
ggatgcggacttttttaatggactt

SEQ ID NO: 103813 - DNA, 25 bp, S. pombe
ggattggatctgcattttacactac

SEQ ID NO: 103814 - DNA, 25 bp, S. pombe
ggattcgtccaatgctctttataga

SEQ ID NO: 103815 - DNA, 25 bp, S. pombe
ggattcagtcaaacctattgtcaaa

SEQ ID NO: 103816 - DNA, 25 bp, S. pombe
ggttgggcacatggctccatctaaa

SEQ ID NO: 103817 - DNA, 25 bp, S. pombe
ggatccggatcgtatattgtctctt

SEQ ID NO: 103818 - DNA, 25 bp, S. pombe
ggatccctctcgcatgttttattgg

SEQ ID NO: 103819 - DNA, 25 bp, S. pombe
ggattatgatcgcttgcgtccttta

SEQ ID NO: 103820 - DNA, 25 bp, S. pombe
ggatgcttctagctgatgcagattc

SEQ ID NO: 103821 - DNA, 25 bp, S. pombe
ggattgcttgcacaactgatactgt

SEQ ID NO: 103822 - DNA, 25 bp, S. pombe
ggattaactgacaagcctacactat

SEQ ID NO: 103823 - DNA, 25 bp, S. pombe
ggaggcttacttgctggtaaccctt

SEQ ID NO: 103824 - DNA, 25 bp, S. pombe
ggatgtgccaacaagctgctgagga

SEQ ID NO: 103825 - DNA, 25 bp, S. pombe
ggaaatgctggacctctggagaatt

SEQ ID NO: 103826 - DNA, 25 bp, S. pombe
ggatagatctggttcttgcaagaaa

SEQ ID NO: 103827 - DNA, 25 bp, S. pombe
ggatttgcaggattcacttgttcag

SEQ ID NO: 103828 - DNA, 25 bp, S. pombe
ggatttgtctctccatttaatgttt

SEQ ID NO: 103829 - DNA, 25 bp, S. pombe
ggatcgttctcgcatcattcagagt

SEQ ID NO: 103830 - DNA, 25 bp, S. pombe
ggattccaccagtttgagcatactt

SEQ ID NO: 103831 - DNA, 25 bp, S. pombe
ggattctccagctggtggcattcat

SEQ ID NO: 103832 - DNA, 25 bp, S. pombe
ggatttgcgctgtccgtaatgatta

SEQ ID NO: 103833 - DNA, 25 bp, S. pombe
ggattctccgcccagttatatatgg

SEQ ID NO: 103834 - DNA, 25 bp, S. pombe
ggattcttctcctaatgagtttttg

SEQ ID NO: 103835 - DNA, 25 bp, S. pombe
ggattccgatccaatacgttcttta

SEQ ID NO: 103836 - DNA, 25 bp, S. pombe
ggattccgtgctggcaagcctactt

SEQ ID NO: 103837 - DNA, 25 bp, S. pombe
ggattctgagacttgaaccttcggt

SEQ ID NO: 103838 - DNA, 25 bp, S. pombe
ggatgtgtagaagagcaccttcgac

SEQ ID NO: 103839 - DNA, 25 bp, S. pombe
ggttgtaatccttcaagccatcgac

SEQ ID NO: 103840 - DNA, 25 bp, S. pombe
ggttgtcaagcctttctaagccagt

SEQ ID NO: 103841 - DNA, 25 bp, S. pombe
ggatttccaccaatttgaagccgtt

SEQ ID NO: 103842 - DNA, 25 bp, S. pombe
ggatggacttaacctcgcaaactgt

SEQ ID NO: 103843 - DNA, 25 bp, S. pombe
ggatttttattgagcccgatactac

SEQ ID NO: 103844 - DNA, 25 bp, S. pombe
ggatcctatgttcgcgaacctgaac

SEQ ID NO: 103845 - DNA, 25 bp, S. pombe
ggatggacatttcctaagcctaaat

SEQ ID NO: 103846 - DNA, 25 bp, S. pombe
ggattggcgaatcctcaagcctaca

SEQ ID NO: 103847 - DNA, 25 bp, S. pombe
ggattactgttgattcagcacttca

SEQ ID NO: 103848 - DNA, 25 bp, S. pombe
ggatatcgttatgtgcttctgccca

SEQ ID NO: 103849 - DNA, 25 bp, S. pombe
ggatattcgtgaaagtcgctctcaa

SEQ ID NO: 103850 - DNA, 25 bp, S. pombe
ggattaattggtactgctgctgcta

SEQ ID NO: 103851 - DNA, 25 bp, S. pombe
ggttgtcgagtatgctttacatcct

SEQ ID NO: 103852 - DNA, 25 bp, S. pombe
ggattgccgttatgctatctatgat

SEQ ID NO: 103853 - DNA, 25 bp, S. pombe
ggattgcccgataagttgccattga

SEQ ID NO: 103854 - DNA, 25 bp, S. pombe
ggatcatccactttttctaacaacg

SEQ ID NO: 103855 - DNA, 25 bp, S. pombe
ggataccaacattctgggaatcgaa

SEQ ID NO: 103856 - DNA, 25 bp, S. pombe
ggatcccttgcagctgggttcagat

SEQ ID NO: 103857 - DNA, 25 bp, S. pombe
ggattcgtggacctgctgtttgcaa

SEQ ID NO: 103858 - DNA, 25 bp, S. pombe
ggattatttcctttatgtctagcag

SEQ ID NO: 103859 - DNA, 25 bp, S. pombe
ggatttatttctttcgtcaacccat

SEQ ID NO: 103860 - DNA, 25 bp, S. pombe
ggattctgatcatttttcggcaaca

SEQ ID NO: 103861 - DNA, 25 bp, S. pombe
ggattcttacagttgctacacatta

SEQ ID NO: 103862 - DNA, 25 bp, S. pombe
ggatcagatattcattttcgctatt

SEQ ID NO: 103863 - DNA, 25 bp, S. pombe
ggatatgcaattcttgttctcaaat

SEQ ID NO: 103864 - DNA, 25 bp, S. pombe
ggatttctacaatttctcttgcacg

SEQ ID NO: 103865 - DNA, 25 bp, S. pombe
ggattatctagcaaaccgcaaactg

SEQ ID NO: 103866 - DNA, 25 bp, S. pombe
ggattgcaagactacgctcccagaa

SEQ ID NO: 103867 - DNA, 25 bp, S. pombe
ggattgtatgactacttccgcacaa

SEQ ID NO: 103868 - DNA, 25 bp, S. pombe
ggattctatcatccgttcagaagca

SEQ ID NO: 103869 - DNA, 25 bp, S. pombe
ggattccatattcggcttcaagcac

SEQ ID NO: 103870 - DNA, 25 bp, S. pombe
ggatgcaggcactatgtcaacaatg

SEQ ID NO: 103871 - DNA, 25 bp, S. pombe
ggagggaatctcgaactagttacag

SEQ ID NO: 103872 - DNA, 25 bp, S. pombe
ggatttattgtcattcctgatctaa

SEQ ID NO: 103873 - DNA, 25 bp, S. pombe
ggattggttcgtaccagtatctcaa

SEQ ID NO: 103874 - DNA, 25 bp, S. pombe
ggatcaatggtcaccggtttataca

SEQ ID NO: 103875 - DNA, 25 bp, S. pombe
ggataggtcccaacatgtctttgat

SEQ ID NO: 103876 - DNA, 25 bp, S. pombe
ggatcaggcttccaatattatttga

SEQ ID NO: 103877 - DNA, 25 bp, S. pombe
ggatcattcccctaaaaattgaccg

SEQ ID NO: 103878 - DNA, 25 bp, S. pombe
ggatcgtcggcctgaaattgtgaac

SEQ ID NO: 103879 - DNA, 25 bp, S. pombe
ggatttgcaatccttagctcaacac

SEQ ID NO: 103880 - DNA, 25 bp, S. pombe
ggattgctcgatcatttgctgaaca

SEQ ID NO: 103881 - DNA, 25 bp, S. pombe
ggattgcttgcatattttgacccat

SEQ ID NO: 103882 - DNA, 25 bp, S. pombe
ggatagccgctatttgggacccttc

SEQ ID NO: 103883 - DNA, 25 bp, S. pombe
ggattcgacttactctaaggatcaa

SEQ ID NO: 103884 - DNA, 25 bp, S. pombe
ggattcgccttaacagaagctacag

SEQ ID NO: 103885 - DNA, 25 bp, S. pombe
ggattcttctgttgaaactctacaa

SEQ ID NO: 103886 - DNA, 25 bp, S. pombe
ggatttattctattcaaagacatca

SEQ ID NO: 103887 - DNA, 25 bp, S. pombe
ggattttctgagtttcacctctacg

SEQ ID NO: 103888 - DNA, 25 bp, S. pombe
ggatttttggtcacatcacttgtca

SEQ ID NO: 103889 - DNA, 25 bp, S. pombe
ggattttcatatcccagaccgagct

SEQ ID NO: 103890 - DNA, 25 bp, S. pombe
ggactcccttcctcatatagaaatg

SEQ ID NO: 103891 - DNA, 25 bp, S. pombe
ggatatgttactctactgccaatga

SEQ ID NO: 103892 - DNA, 25 bp, S. pombe
ggatttggccagcatctgatattga

SEQ ID NO: 103893 - DNA, 25 bp, S. pombe
ggattatctccggaagttcgcacat

SEQ ID NO: 103894 - DNA, 25 bp, S. pombe
ggaggtattgctttcgtagccctgc

SEQ ID NO: 103895 - DNA, 25 bp, S. pombe
ggaggtatgttttctggacgttcag

SEQ ID NO: 103896 - DNA, 25 bp, S. pombe
ggatgccgacagtgtctctgaagtt

SEQ ID NO: 103897 - DNA, 25 bp, S. pombe
ggattcgccagaaacattatcttca

SEQ ID NO: 103898 - DNA, 25 bp, S. pombe
ggatttcgcaatctgatcttgaaca

SEQ ID NO: 103899 - DNA, 25 bp, S. pombe
ggatttgactgatgcttacgacaca

SEQ ID NO: 103900 - DNA, 25 bp, S. pombe
ggatttagcatctgctcttcgtaaa

SEQ ID NO: 103901 - DNA, 25 bp, S. pombe
ggattccctctttttgctgtgcaaa

SEQ ID NO: 103902 - DNA, 25 bp, S. pombe
ggatgtaaccttcggcatgcatgga

SEQ ID NO: 103903 - DNA, 25 bp, S. pombe
ggattagtcacaaactcgatcgcta

SEQ ID NO: 103904 - DNA, 25 bp, S. pombe
ggattcaatgaatggccccgcttat

SEQ ID NO: 103905 - DNA, 25 bp, S. pombe
ggatttatgaagcaactccctaatt

SEQ ID NO: 103906 - DNA, 25 bp, S. pombe
ggaatttggcgttacccaggctcgc

SEQ ID NO: 103907 - DNA, 25 bp, S. pombe
ggatctgcgctttttatggtagtag

SEQ ID NO: 103908 - DNA, 25 bp, S. pombe
ggatgctgaatttactgatggatca

SEQ ID NO: 103909 - DNA, 25 bp, S. pombe
ggatgctcaaccagctatacggttt

SEQ ID NO: 103910 - DNA, 25 bp, S. pombe
ggattcacaatccatcgagtgtttg

SEQ ID NO: 103911 - DNA, 25 bp, S. pombe
ggatcctacacttcggtatttcatt

SEQ ID NO: 103912 - DNA, 25 bp, S. pombe
ggatcgcaactcaagtggtcttttg

SEQ ID NO: 103913 - DNA, 25 bp, S. pombe
ggatcgcaactctatggaaacgtta

SEQ ID NO: 103914 - DNA, 25 bp, S. pombe
ggatcgcaacatttggcaagccaag

SEQ ID NO: 103915 - DNA, 25 bp, S. pombe
ggatcattcaattcttcacgcacaa

SEQ ID NO: 103916 - DNA, 25 bp, S. pombe
ggattatcaatcttgctctcgcaaa

SEQ ID NO: 103917 - DNA, 25 bp, S. pombe
ggattcacaccctacgtatatctaa

SEQ ID NO: 103918 - DNA, 25 bp, S. pombe
ggattctaccaattcgttcttgcta

SEQ ID NO: 103919 - DNA, 25 bp, S. pombe
ggatttactgtcttcgttggtcata

SEQ ID NO: 103920 - DNA, 25 bp, S. pombe
ggatttttccttttcgcgagtgata

SEQ ID NO: 103921 - DNA, 25 bp, S. pombe
ggagttactccgtctaaagttcttg

SEQ ID NO: 103922 - DNA, 25 bp, S. pombe
ggataagcgtcctactgatactatt

SEQ ID NO: 103923 - DNA, 25 bp, S. pombe
ggatattccttctgtgcaactagta

SEQ ID NO: 103924 - DNA, 25 bp, S. pombe
ggatcttcggcctctcaaaaatatg

SEQ ID NO: 103925 - DNA, 25 bp, S. pombe
ggagctagcgtacacatccatgctt

SEQ ID NO: 103926 - DNA, 25 bp, S. pombe
ggattattcagctattgaccccact

SEQ ID NO: 103927 - DNA, 25 bp, S. pombe
ggattttccatagacaacgcacgtg

SEQ ID NO: 103928 - DNA, 25 bp, S. pombe
ggattttagtcagccaactacgtga

SEQ ID NO: 103929 - DNA, 25 bp, S. pombe
ggatttgtaaaacccgcatctggca

SEQ ID NO: 103930 - DNA, 25 bp, S. pombe
ggattaccattgactatacctttca

SEQ ID NO: 103931 - DNA, 25 bp, S. pombe
ggatacatcatcgaagctttcttca

SEQ ID NO: 103932 - DNA, 25 bp, S. pombe
ggatgacattaccagctttcctaat

SEQ ID NO: 103933 - DNA, 25 bp, S. pombe
ggatgctgttaacgttcgcacgaat

SEQ ID NO: 103934 - DNA, 25 bp, S. pombe
ggatcgtattctggttcaacgtatc

SEQ ID NO: 103935 - DNA, 25 bp, S. pombe
ggattattcctcgtatctgacggat

SEQ ID NO: 103936 - DNA, 25 bp, S. pombe
ggatattatccgtctgtcgtgagca

SEQ ID NO: 103937 - DNA, 25 bp, S. pombe
ggatattgtcacatcgtctgcttat

SEQ ID NO: 103938 - DNA, 25 bp, S. pombe
ggattattcacgtagatgctgttgt

SEQ ID NO: 103939 - DNA, 25 bp, S. pombe
ggatttctcacttttgctttttcat

SEQ ID NO: 103940 - DNA, 25 bp, S. pombe
ggatgctttgtacgacgctttgcta

SEQ ID NO: 103941 - DNA, 25 bp, S. pombe
ggattttgtactcactgcttcatca

SEQ ID NO: 103942 - DNA, 25 bp, S. pombe
ggatcgatgttgcatgaacgacctt

SEQ ID NO: 103943 - DNA, 25 bp, S. pombe
ggatcgatttggtcaaaccagcgtt

SEQ ID NO: 103944 - DNA, 25 bp, S. pombe
ggatatattgccgttaaaccgctat

SEQ ID NO: 103945 - DNA, 25 bp, S. pombe
ggatatgctcattcaggacaaacga

SEQ ID NO: 103946 - DNA, 25 bp, S. pombe
ggatttaccacttctgacgacgtta

SEQ ID NO: 103947 - DNA, 25 bp, S. pombe
ggatcctaaacattggaccacttct

SEQ ID NO: 103948 - DNA, 25 bp, S. pombe
ggatccggatcctagcgtgcaagaa

SEQ ID NO: 103949 - DNA, 25 bp, S. pombe
ggatacggagtctacttgctagcct

SEQ ID NO: 103950 - DNA, 25 bp, S. pombe
ggacgacgaggatctagcttctttt

SEQ ID NO: 103951 - DNA, 25 bp, S. pombe
tgtccgtcgaggtttgggctaccaa

SEQ ID NO: 103952 - DNA, 25 bp, S. pombe
tggccctcgttgtggtttaggcgaa

SEQ ID NO: 103953 - DNA, 25 bp, S. pombe
tgttccctttttctacaaccagtat

SEQ ID NO: 103954 - DNA, 25 bp, S. pombe
ggatacgctttcaaacatacaggca

SEQ ID NO: 103955 - DNA, 25 bp, S. pombe
ggatattttctccttctacaggcat

SEQ ID NO: 103956 - DNA, 25 bp, S. pombe
ggatatttattccaccgagcagcct

SEQ ID NO: 103957 - DNA, 25 bp, S. pombe
ggatttttctgagccttccaaagtt

SEQ ID NO: 103958 - DNA, 25 bp, S. pombe
ggattttccggtcgctctaacaagc

SEQ ID NO: 103959 - DNA, 25 bp, S. pombe
ggatatttcaactggcctacgaact

SEQ ID NO: 103960 - DNA, 25 bp, S. pombe
ggatgcatttgctacagcggataca

SEQ ID NO: 103961 - DNA, 25 bp, S. pombe
ggatccactgatcctgttgcagagc

SEQ ID NO: 103962 - DNA, 25 bp, S. pombe
ggataacccagctgcttacagtcaa

SEQ ID NO: 103963 - DNA, 25 bp, S. pombe
ggattttcaatagcccatcccaata

SEQ ID NO: 103964 - DNA, 25 bp, S. pombe
ggatgcttcagctggacatgccaca

SEQ ID NO: 103965 - DNA, 25 bp, S. pombe
ggatttcagcggtatgctcaatcaa

SEQ ID NO: 103966 - DNA, 25 bp, S. pombe
ggatggctatattcagtctacctct

SEQ ID NO: 103967 - DNA, 25 bp, S. pombe
ggatcgtgcactacgtatagcgttt

SEQ ID NO: 103968 - DNA, 25 bp, S. pombe
ggatctcctgcattcgtaacgttag

SEQ ID NO: 103969 - DNA, 25 bp, S. pombe
ggatttgccaggtttaggtcaacat

SEQ ID NO: 103970 - DNA, 25 bp, S. pombe
ggatttctccgttttcagatatttg

SEQ ID NO: 103971 - DNA, 25 bp, S. pombe
ggatttccggttttcagtcattgtc

SEQ ID NO: 103972 - DNA, 25 bp, S. pombe
ggatgatttgtctcatgagcgttac

SEQ ID NO: 103973 - DNA, 25 bp, S. pombe
ggatattgcttctcaaattgctcaa

SEQ ID NO: 103974 - DNA, 25 bp, S. pombe
ggatttctgtcattctcgtggtata

SEQ ID NO: 103975 - DNA, 25 bp, S. pombe
ggactcggtatcaactatatgggag

SEQ ID NO: 103976 - DNA, 25 bp, S. pombe
ggatcacatccagaaaacgtcttta

SEQ ID NO: 103977 - DNA, 25 bp, S. pombe
ggatcaaatccaaaaatagcttcta

SEQ ID NO: 103978 - DNA, 25 bp, S. pombe
ggatacgtgcactgatgaatactgt

SEQ ID NO: 103979 - DNA, 25 bp, S. pombe
ggatatccctgaatctttgaatcat

SEQ ID NO: 103980 - DNA, 25 bp, S. pombe
ggatttgcctgttattcgagaattc

SEQ ID NO: 103981 - DNA, 25 bp, S. pombe
ggatttcctttagtcagatgccaac

SEQ ID NO: 103982 - DNA, 25 bp, S. pombe
ggatttcctttatttgctgttcaaa

SEQ ID NO: 103983 - DNA, 25 bp, S. pombe
ggatttacgatctttccaatggtca

SEQ ID NO: 103984 - DNA, 25 bp, S. pombe
ggatctgtacaaaccccaatttcaa

SEQ ID NO: 103985 - DNA, 25 bp, S. pombe
ggatattgagaactctcccaacgat

SEQ ID NO: 103986 - DNA, 25 bp, S. pombe
ggatacagccgttgccaaatggcaa

SEQ ID NO: 103987 - DNA, 25 bp, S. pombe
ggatagcctcgttggacctgttcaa

SEQ ID NO: 103988 - DNA, 25 bp, S. pombe
ggagtatcctgatccttccaaatct

SEQ ID NO: 103989 - DNA, 25 bp, S. pombe
ggatctctcaccgttagcaattatt

SEQ ID NO: 103990 - DNA, 25 bp, S. pombe
ggatctgtccatcattctaacgaaa

SEQ ID NO: 103991 - DNA, 25 bp, S. pombe
ggatgcgtatttaacgaatgctgaa

SEQ ID NO: 103992 - DNA, 25 bp, S. pombe
ggatctgtttcaagccgtacttact

SEQ ID NO: 103993 - DNA, 25 bp, S. pombe
ggatacttgtattccgtaccatttc

SEQ ID NO: 103994 - DNA, 25 bp, S. pombe
ggatattcagtttcacctggataga

SEQ ID NO: 103995 - DNA, 25 bp, S. pombe
ggatatacacttacacctgaggaaa

SEQ ID NO: 103996 - DNA, 25 bp, S. pombe
ggatcacttgcactattgcgcgaac

SEQ ID NO: 103997 - DNA, 25 bp, S. pombe
ggatatgcatcccatttggcgtaca

SEQ ID NO: 103998 - DNA, 25 bp, S. pombe
ggatatctcagtaattgctccaata

SEQ ID NO: 103999 - DNA, 25 bp, S. pombe
ggatctgctcagatgaagtcccaat

SEQ ID NO: 104000 - DNA, 25 bp, S. pombe
ggatccatttagatgatattgcaat

SEQ ID NO: 104001 - DNA, 25 bp, S. pombe
ggatcccaaatcagtgcttccggaa

SEQ ID NO: 104002 - DNA, 25 bp, S. pombe
ggaggcaattccgatttgaacaaac

SEQ ID NO: 104003 - DNA, 25 bp, S. pombe
ggatagaaccttttgataccactga

SEQ ID NO: 104004 - DNA, 25 bp, S. pombe
ggatctgatactgttttaccacttg

SEQ ID NO: 104005 - DNA, 25 bp, S. pombe
ggatgtggccatcaaacttttccca

SEQ ID NO: 104006 - DNA, 25 bp, S. pombe
ggatcatcttaaatttggccgcagt

SEQ ID NO: 104007 - DNA, 25 bp, S. pombe
ggatccttcattattgttgctacgt

SEQ ID NO: 104008 - DNA, 25 bp, S. pombe
ggatcctccagcagtggttgtagaa

SEQ ID NO: 104009 - DNA, 25 bp, S. pombe
ggatcttgcacactaccattttaga

SEQ ID NO: 104010 - DNA, 25 bp, S. pombe
ggatagaattgctccatttgctcag

SEQ ID NO: 104011 - DNA, 25 bp, S. pombe
ggatagaacatctcgatctgctcga

SEQ ID NO: 104012 - DNA, 25 bp, S. pombe
ggatgtcaactgttcagtcgtctga

SEQ ID NO: 104013 - DNA, 25 bp, S. pombe
ggatgctcaacgttttaccatacca

SEQ ID NO: 104014 - DNA, 25 bp, S. pombe
ggatagatacccatgtcactgcacc

SEQ ID NO: 104015 - DNA, 25 bp, S. pombe
ggataacatcacattagccgactat

SEQ ID NO: 104016 - DNA, 25 bp, S. pombe
ggatacactccagtagaccgtgcaa

SEQ ID NO: 104017 - DNA, 25 bp, S. pombe
ggatatgattcttctcaaccagtta

SEQ ID NO: 104018 - DNA, 25 bp, S. pombe
ggatcttttcgcatgattttacgtg

SEQ ID NO: 104019 - DNA, 25 bp, S. pombe
ggaggtttaatctttactttcatgg

SEQ ID NO: 104020 - DNA, 25 bp, S. pombe
ggatcttttttgtgttatttcgtgc

SEQ ID NO: 104021 - DNA, 25 bp, S. pombe
ggatcactttttgccttacttagct

SEQ ID NO: 104022 - DNA, 25 bp, S. pombe
ggatatatgacctccatgttcaaaa

SEQ ID NO: 104023 - DNA, 25 bp, S. pombe
ggatagaccctgttgctatggacaa

SEQ ID NO: 104024 - DNA, 25 bp, S. pombe
ggatgctatctccagagcctaggaa

SEQ ID NO: 104025 - DNA, 25 bp, S. pombe
ggatctatctcttcagccaaggtga

SEQ ID NO: 104026 - DNA, 25 bp, S. pombe
ggatctttcatttcctgcagtgatg

SEQ ID NO: 104027 - DNA, 25 bp, S. pombe
ggatctcattataatcacgcagtcg

SEQ ID NO: 104028 - DNA, 25 bp, S. pombe
ggatctcttatagcagtttcgcgct

SEQ ID NO: 104029 - DNA, 25 bp, S. pombe
ggatgtattgcggaatttgaaggta

SEQ ID NO: 104030 - DNA, 25 bp, S. pombe
ggatcttctattgctaattcccctt

SEQ ID NO: 104031 - DNA, 25 bp, S. pombe
ggatccctcattgaaaatctaccgt

SEQ ID NO: 104032 - DNA, 25 bp, S. pombe
ggatgcccttgttctacggattagc

SEQ ID NO: 104033 - DNA, 25 bp, S. pombe
ggatctccctgttcatggcatgatg

SEQ ID NO: 104034 - DNA, 25 bp, S. pombe
ggatctcgaagttcattcacattga

SEQ ID NO: 104035 - DNA, 25 bp, S. pombe
ggatgaacctatttctcacgaacag

SEQ ID NO: 104036 - DNA, 25 bp, S. pombe
ggatccctcgatcatgataaacaag

SEQ ID NO: 104037 - DNA, 25 bp, S. pombe
ggatccagttatcctgtcgcaacaa

SEQ ID NO: 104038 - DNA, 25 bp, S. pombe
ggatgtctcgttctttacagcttaa

SEQ ID NO: 104039 - DNA, 25 bp, S. pombe
ggatgatgtttcctttggccatgtt

SEQ ID NO: 104040 - DNA, 25 bp, S. pombe
ggatatgtcaaacgctgccaaggaa

SEQ ID NO: 104041 - DNA, 25 bp, S. pombe
ggatcgtgagcttacctcagaggaa

SEQ ID NO: 104042 - DNA, 25 bp, S. pombe
ggatagatacttggttgtgcattat

SEQ ID NO: 104043 - DNA, 25 bp, S. pombe
ggaggaacatcaatgccgtgcactt

SEQ ID NO: 104044 - DNA, 25 bp, S. pombe
ggctgtgaccataaacggacttttt

SEQ ID NO: 104045 - DNA, 25 bp, S. pombe
ggagtcgcaatttatctgcctacca

SEQ ID NO: 104046 - DNA, 25 bp, S. pombe
ggatgcctgctgttatcaatgtcat

SEQ ID NO: 104047 - DNA, 25 bp, S. pombe
ggatcagcattggactcatgggtaa

SEQ ID NO: 104048 - DNA, 25 bp, S. pombe
ggatcatctttgtctcatgtagctc

SEQ ID NO: 104049 - DNA, 25 bp, S. pombe
ggatctgtcgtgtctgctgtcaagc

SEQ ID NO: 104050 - DNA, 25 bp, S. pombe
ggatgatccatcttgcgttcaatta

SEQ ID NO: 104051 - DNA, 25 bp, S. pombe
ggagctcaagctactgttcatgatt

SEQ ID NO: 104052 - DNA, 25 bp, S. pombe
ggatgtctgagctattcttctgatt

SEQ ID NO: 104053 - DNA, 25 bp, S. pombe
ggatgatctgactctctgtaatgtt

SEQ ID NO: 104054 - DNA, 25 bp, S. pombe
ggagttgactcttcgacatttattg

SEQ ID NO: 104055 - DNA, 25 bp, S. pombe
ggatgcttcgtctacaacctgaatt

SEQ ID NO: 104056 - DNA, 25 bp, S. pombe
ggatgctgccagatacaacttcgaa

SEQ ID NO: 104057 - DNA, 25 bp, S. pombe
ggatacttttcagctttctaagaca

SEQ ID NO: 104058 - DNA, 25 bp, S. pombe
ggataatccgcatatcattgctatg

SEQ ID NO: 104059 - DNA, 25 bp, S. pombe
ggataatcctgcctatctttcattt

SEQ ID NO: 104060 - DNA, 25 bp, S. pombe
ggatactccaggcacttttattgtt

SEQ ID NO: 104061 - DNA, 25 bp, S. pombe
ggaagtctcgggtcggaatcgttat

SEQ ID NO: 104062 - DNA, 25 bp, S. pombe
ggcgactcggaagccgaacgtttca

SEQ ID NO: 104063 - DNA, 25 bp, S. pombe
ggagaccggatagcccaacttattt

SEQ ID NO: 104064 - DNA, 25 bp, S. pombe
ggagaccgtgatttacttcgtaata

SEQ ID NO: 104065 - DNA, 25 bp, S. pombe
ggatctattgttttagctcgcgtca

SEQ ID NO: 104066 - DNA, 25 bp, S. pombe
ggatctagttctggaagctcctcgg

SEQ ID NO: 104067 - DNA, 25 bp, S. pombe
ggatgaagctttgatgcgtcccggt

SEQ ID NO: 104068 - DNA, 25 bp, S. pombe
ggagttggatatactgctcctccac

SEQ ID NO: 104069 - DNA, 25 bp, S. pombe
ggagttgcagtgatcgatcgcttca

SEQ ID NO: 104070 - DNA, 25 bp, S. pombe
ggagatctcattgtgatactgttca

SEQ ID NO: 104071 - DNA, 25 bp, S. pombe
ggatcatgtattcttcagctgtcga

SEQ ID NO: 104072 - DNA, 25 bp, S. pombe
ggaggcactttctgcgattgcacac

SEQ ID NO: 104073 - DNA, 25 bp, S. pombe
ggatgagctcgaccaactttgcgat

SEQ ID NO: 104074 - DNA, 25 bp, S. pombe
ggatgacatcggactgactttgcaa

SEQ ID NO: 104075 - DNA, 25 bp, S. pombe
ggagtcgtacgcctgtcgaataata

SEQ ID NO: 104076 - DNA, 25 bp, S. pombe
ggaggcgttgcatcgagttctgaaa

SEQ ID NO: 104077 - DNA, 25 bp, S. pombe
ggatcctttcttcgatcttctgaag

SEQ ID NO: 104078 - DNA, 25 bp, S. pombe
ggatctctttctttgtcttctaaca

SEQ ID NO: 104079 - DNA, 25 bp, S. pombe
ggatcgttatctggctttgcattta

SEQ ID NO: 104080 - DNA, 25 bp, S. pombe
ggatctgcattttaccattcttgga

SEQ ID NO: 104081 - DNA, 25 bp, S. pombe
ggatcgttcatgttctcattcttag

SEQ ID NO: 104082 - DNA, 25 bp, S. pombe
ggatcaaactcgtcggtgcagacat

SEQ ID NO: 104083 - DNA, 25 bp, S. pombe
ggatcgcttcagtattttcgacgca

SEQ ID NO: 104084 - DNA, 25 bp, S. pombe
ggaggttatgtgtccttcgatacaa

SEQ ID NO: 104085 - DNA, 25 bp, S. pombe
ggatgttttgcgctcttggattaaa

SEQ ID NO: 104086 - DNA, 25 bp, S. pombe
ggatcccattttacaatctgtgagg

SEQ ID NO: 104087 - DNA, 25 bp, S. pombe
ggatgcttgcgagtcttttactgat

SEQ ID NO: 104088 - DNA, 25 bp, S. pombe
ggatcttccggtttaactgattctg

SEQ ID NO: 104089 - DNA, 25 bp, S. pombe
ggacttccgcgtttcgaatatcaca

SEQ ID NO: 104090 - DNA, 25 bp, S. pombe
ggatgtaccctggtttgtttccgat

SEQ ID NO: 104091 - DNA, 25 bp, S. pombe
ggagatacccgactttgtcctcaat

SEQ ID NO: 104092 - DNA, 25 bp, S. pombe
ggatggctttcattattcgttggaa

SEQ ID NO: 104093 - DNA, 25 bp, S. pombe
ggaggtacttttatgattgccaaca

SEQ ID NO: 104094 - DNA, 25 bp, S. pombe
ggaggtggctccaaaacttttgcaa

SEQ ID NO: 104095 - DNA, 25 bp, S. pombe
ggaggtgttcctgaagtcttgcctt

SEQ ID NO: 104096 - DNA, 25 bp, S. pombe
ggaggcgtcgcttcattagaattgc

SEQ ID NO: 104097 - DNA, 25 bp, S. pombe
ggatggcgcacgtattcgaaactca

SEQ ID NO: 104098 - DNA, 25 bp, S. pombe
ggatgtccatcgttatcaactttac

SEQ ID NO: 104099 - DNA, 25 bp, S. pombe
ggagtccgcgactctggctttaaac

SEQ ID NO: 104100 - DNA, 25 bp, S. pombe
ggatgcaaacatctccaaagcttta

SEQ ID NO: 104101 - DNA, 25 bp, S. pombe
ggatctattccttcttatattgctc

SEQ ID NO: 104102 - DNA, 25 bp, S. pombe
ggatctttcgtctgataagcttggt

SEQ ID NO: 104103 - DNA, 25 bp, S. pombe
ggagttattgggatgcacctacata

SEQ ID NO: 104104 - DNA, 25 bp, S. pombe
ggagttactaggcacaccaacagaa

SEQ ID NO: 104105 - DNA, 25 bp, S. pombe
ggagaaccaattttgcctttaactg

SEQ ID NO: 104106 - DNA, 25 bp, S. pombe
ggagaagccgtttttcttcgtgcct

SEQ ID NO: 104107 - DNA, 25 bp, S. pombe
ggatgaagctttcttcgccgagaac

SEQ ID NO: 104108 - DNA, 25 bp, S. pombe
ggatgttgcttcctatatcagccaa

SEQ ID NO: 104109 - DNA, 25 bp, S. pombe
ggagatgcagttacaatacagccat

SEQ ID NO: 104110 - DNA, 25 bp, S. pombe
ggacgcattattcacactagctcgt

SEQ ID NO: 104111 - DNA, 25 bp, S. pombe
ggatggattgttaaagctcaccgat

SEQ ID NO: 104112 - DNA, 25 bp, S. pombe
ggagtacttgcttttctgtcagttt

SEQ ID NO: 104113 - DNA, 25 bp, S. pombe
ggatggaactgcactttttcatttt

SEQ ID NO: 104114 - DNA, 25 bp, S. pombe
ggatggacctgctccaattttattt

SEQ ID NO: 104115 - DNA, 25 bp, S. pombe
ggatccacgctctcgaatgttaata

SEQ ID NO: 104116 - DNA, 25 bp, S. pombe
ggatccatccaagcgattcctgaaa

SEQ ID NO: 104117 - DNA, 25 bp, S. pombe
ggagcttaagcctgtttgcaatgaa

SEQ ID NO: 104118 - DNA, 25 bp, S. pombe
ggaggccaagcccattactgaagaa

SEQ ID NO: 104119 - DNA, 25 bp, S. pombe
ggatgggaatcgctttctgaacata

SEQ ID NO: 104120 - DNA, 25 bp, S. pombe
ggcaggttactacacattaccactg

SEQ ID NO: 104121 - DNA, 25 bp, S. pombe
ggatggctacagacaacgctcagaa

SEQ ID NO: 104122 - DNA, 25 bp, S. pombe
ggatgtctactataccgatgaggtg

SEQ ID NO: 104123 - DNA, 25 bp, S. pombe
ggagtcacataaagccacgtcggat

SEQ ID NO: 104124 - DNA, 25 bp, S. pombe
ggatgacagccaaagaccccacgaa

SEQ ID NO: 104125 - DNA, 25 bp, S. pombe
ggatggatgcacttagtccctacaa

SEQ ID NO: 104126 - DNA, 25 bp, S. pombe
ggaagatgtccagcgtactagcccc

SEQ ID NO: 104127 - DNA, 25 bp, S. pombe
ggatgaaattccctacacaagttta

SEQ ID NO: 104128 - DNA, 25 bp, S. pombe
ggatggactgtctgtaacctgttta

SEQ ID NO: 104129 - DNA, 25 bp, S. pombe
ggaggtgcatggactgtcaccactg

SEQ ID NO: 104130 - DNA, 25 bp, S. pombe
ggagtgatgatggtctttgcgtcta

SEQ ID NO: 104131 - DNA, 25 bp, S. pombe
ggatgtatatacagccccgcagaag

SEQ ID NO: 104132 - DNA, 25 bp, S. pombe
ggagtcacatggatcaaccgcgcaa

SEQ ID NO: 104133 - DNA, 25 bp, S. pombe
ggagtacttttggatcaccatgcag

SEQ ID NO: 104134 - DNA, 25 bp, S. pombe
ggatccatcgattgttgcatttgtt

SEQ ID NO: 104135 - DNA, 25 bp, S. pombe
ggatctcaagatgtctgcaactttt

SEQ ID NO: 104136 - DNA, 25 bp, S. pombe
ggatccaccgagtcagcaactattt

SEQ ID NO: 104137 - DNA, 25 bp, S. pombe
ggatccatcattagcaccaattctt

SEQ ID NO: 104138 - DNA, 25 bp, S. pombe
ggatcgcatcctaggtagtgtttca

SEQ ID NO: 104139 - DNA, 25 bp, S. pombe
ggatcctcttgctcatgggtcttat

SEQ ID NO: 104140 - DNA, 25 bp, S. pombe
ggatctctttgcaaagcaggcctta

SEQ ID NO: 104141 - DNA, 25 bp, S. pombe
ggagatgtccaaacggcagcctgcg

SEQ ID NO: 104142 - DNA, 25 bp, S. pombe
ggaggattacgttgtctatttgact

SEQ ID NO: 104143 - DNA, 25 bp, S. pombe
ggagactaacgccattcttatcgag

SEQ ID NO: 104144 - DNA, 25 bp, S. pombe
ggagtcaatcgtcttcttgtaggaa

SEQ ID NO: 104145 - DNA, 25 bp, S. pombe
ggatgtgaaccctatttctgtatta

SEQ ID NO: 104146 - DNA, 25 bp, S. pombe
ggatgttactcccatccccactgat

SEQ ID NO: 104147 - DNA, 25 bp, S. pombe
ggatgttacaccacccgaatttgtc

SEQ ID NO: 104148 - DNA, 25 bp, S. pombe
ggagtaacttgcagcctaggtttat

SEQ ID NO: 104149 - DNA, 25 bp, S. pombe
ggagaatggcttaccctcatacaat

SEQ ID NO: 104150 - DNA, 25 bp, S. pombe
ggagttccgctcttccaagaataga

SEQ ID NO: 104151 - DNA, 25 bp, S. pombe
ggagtctcaggacgcaccaagatta

SEQ ID NO: 104152 - DNA, 25 bp, S. pombe
ggaggaaggatacgccacctactca

SEQ ID NO: 104153 - DNA, 25 bp, S. pombe
ggatgtatatcctttacccaacgaa

SEQ ID NO: 104154 - DNA, 25 bp, S. pombe
ggatcctactggtatcacttgtatt

SEQ ID NO: 104155 - DNA, 25 bp, S. pombe
ggatcctaccgattatacgtttctt

SEQ ID NO: 104156 - DNA, 25 bp, S. pombe
ggaggatacttcgagtaacgacatt

SEQ ID NO: 104157 - DNA, 25 bp, S. pombe
ggaggaacttccttaatacctggat

SEQ ID NO: 104158 - DNA, 25 bp, S. pombe
ggatgtaactctttattggtaccag

SEQ ID NO: 104159 - DNA, 25 bp, S. pombe
ggatggacctgcttatcagcttgta

SEQ ID NO: 104160 - DNA, 25 bp, S. pombe
ggatgagactcgtatgaagctcgat

SEQ ID NO: 104161 - DNA, 25 bp, S. pombe
ggatgatagctctaaccgtcgttct

SEQ ID NO: 104162 - DNA, 25 bp, S. pombe
ggatgactttggtacagctgctatt

SEQ ID NO: 104163 - DNA, 25 bp, S. pombe
ggatgtttccctaaaatcgcaaagc

SEQ ID NO: 104164 - DNA, 25 bp, S. pombe
ggatgtctaccgaatcaaacgcaag

SEQ ID NO: 104165 - DNA, 25 bp, S. pombe
ggatggtattactccctacatgatc

SEQ ID NO: 104166 - DNA, 25 bp, S. pombe
ggatgagctatcttctaaccaaaac

SEQ ID NO: 104167 - DNA, 25 bp, S. pombe
ggagcagctagatgtcaggccagac

SEQ ID NO: 104168 - DNA, 25 bp, S. pombe
ggatccagcgcagtatatgcttctg

SEQ ID NO: 104169 - DNA, 25 bp, S. pombe
ggatgccggcgtagttttctcaaaa

SEQ ID NO: 104170 - DNA, 25 bp, S. pombe
ggccgttgagaaggttgcccctggt

SEQ ID NO: 104171 - DNA, 25 bp, S. pombe
ggagcgttaaggatggtccccagat

SEQ ID NO: 104172 - DNA, 25 bp, S. pombe
ggctccttacggaatgggcccaaga

SEQ ID NO: 104173 - DNA, 25 bp, S. pombe
ggaggccaacgactcttactacaga

SEQ ID NO: 104174 - DNA, 25 bp, S. pombe
tggccaggaacgtttccgtaccatt

SEQ ID NO: 104175 - DNA, 25 bp, S. pombe
tgtggtcaaacggtttcttacccat

SEQ ID NO: 104176 - DNA, 25 bp, S. pombe
ggatgaccctttatacggattgtaa

SEQ ID NO: 104177 - DNA, 25 bp, S. pombe
ggatccccttatatcgaactcggaa

SEQ ID NO: 104178 - DNA, 25 bp, S. pombe
tccagcgtttttccttatacttctt

SEQ ID NO: 104179 - DNA, 25 bp, S. pombe
ggcactttttgtccttaacgataat

SEQ ID NO: 104180 - DNA, 25 bp, S. pombe
ggatgtcttcaaatcgagcactact

SEQ ID NO: 104181 - DNA, 25 bp, S. pombe
ggatgcttgctcgtccaaaatttag

SEQ ID NO: 104182 - DNA, 25 bp, S. pombe
ggatgttccctttcatgctatttgc

SEQ ID NO: 104183 - DNA, 25 bp, S. pombe
ggagtcttatgccatgtacaagctt

SEQ ID NO: 104184 - DNA, 25 bp, S. pombe
ggatgagcccatactactaattgtt

SEQ ID NO: 104185 - DNA, 25 bp, S. pombe
ggatgagccaactacaaatctcgat

SEQ ID NO: 104186 - DNA, 25 bp, S. pombe
ggatgttatatctcatattccagta

SEQ ID NO: 104187 - DNA, 25 bp, S. pombe
ggatgcgtcgtagtatatcataaca

SEQ ID NO: 104188 - DNA, 25 bp, S. pombe
ggagagtttcctgaacttgctaaat

SEQ ID NO: 104189 - DNA, 25 bp, S. pombe
ggagacgttcttgacacttttaaat

SEQ ID NO: 104190 - DNA, 25 bp, S. pombe
ggatcctacttctaaacctggtcaa

SEQ ID NO: 104191 - DNA, 25 bp, S. pombe
ggaccccggattttgatggcaacga

SEQ ID NO: 104192 - DNA, 25 bp, S. pombe
tgtaccttcggatcattgggcccaa

SEQ ID NO: 104193 - DNA, 25 bp, S. pombe
ttccgttcggaaaatgagccctcac

SEQ ID NO: 104194 - DNA, 25 bp, S. pombe
tatcatccctaaagaagtttccttg

SEQ ID NO: 104195 - DNA, 25 bp, S. pombe
ggaccttgtatctacggttcctatt

SEQ ID NO: 104196 - DNA, 25 bp, S. pombe
ggacgtttgatgcagacttattcta

SEQ ID NO: 104197 - DNA, 25 bp, S. pombe
ggagggatttatcggcgtcttctac

SEQ ID NO: 104198 - DNA, 25 bp, S. pombe
ggatgaggattatcttccctctctg

SEQ ID NO: 104199 - DNA, 25 bp, S. pombe
ggatgctcgttatcatagcccttta

SEQ ID NO: 104200 - DNA, 25 bp, S. pombe
ggactccattcctcgtataaaagat

SEQ ID NO: 104201 - DNA, 25 bp, S. pombe
ggacccaatactgcccataagaacg

SEQ ID NO: 104202 - DNA, 25 bp, S. pombe
ggacccaagtcctctgctaagtttg

SEQ ID NO: 104203 - DNA, 25 bp, S. pombe
ggaacggcccttggtgctaactttg

SEQ ID NO: 104204 - DNA, 25 bp, S. pombe
ggaggatccctctaaattattcgct

SEQ ID NO: 104205 - DNA, 25 bp, S. pombe
ggatggacgcctttaatgatctcta

SEQ ID NO: 104206 - DNA, 25 bp, S. pombe
ggatgctgatccttactactttaat

SEQ ID NO: 104207 - DNA, 25 bp, S. pombe
ggatgcctccgaagattcaatcaat

SEQ ID NO: 104208 - DNA, 25 bp, S. pombe
ggatgacctcgatgagccatatctt

SEQ ID NO: 104209 - DNA, 25 bp, S. pombe
ggatgtttcccaggttcaacagaaa

SEQ ID NO: 104210 - DNA, 25 bp, S. pombe
ggaggttccagacgctgattttcta

SEQ ID NO: 104211 - DNA, 25 bp, S. pombe
ggatgctttagtagccagtggaaaa

SEQ ID NO: 104212 - DNA, 25 bp, S. pombe
ggagatacttcatgcatcacatccc

SEQ ID NO: 104213 - DNA, 25 bp, S. pombe
ggagatatattctgcgctcttcatt

SEQ ID NO: 104214 - DNA, 25 bp, S. pombe
ggatggcacgttgatcaagcaattt

SEQ ID NO: 104215 - DNA, 25 bp, S. pombe
ggatggccctcatacaacaattgtt

SEQ ID NO: 104216 - DNA, 25 bp, S. pombe
ggaggctcctatggcaacgacaata

SEQ ID NO: 104217 - DNA, 25 bp, S. pombe
ggaggcacctgaaataccccatgag

SEQ ID NO: 104218 - DNA, 25 bp, S. pombe
ggagtcctccccaaaatcaaaatga

SEQ ID NO: 104219 - DNA, 25 bp, S. pombe
ggagtcctttcaccaaatactgagc

SEQ ID NO: 104220 - DNA, 25 bp, S. pombe
ggagtcctgctttacaaattcgaac

SEQ ID NO: 104221 - DNA, 25 bp, S. pombe
ggagcccaatagtgattccacgaat

SEQ ID NO: 104222 - DNA, 25 bp, S. pombe
ggagtccatgatgcacttacacagt

SEQ ID NO: 104223 - DNA, 25 bp, S. pombe
ggatgacaattctccaagacaacga

SEQ ID NO: 104224 - DNA, 25 bp, S. pombe
ggatgcagaaccattatctgtggaa

SEQ ID NO: 104225 - DNA, 25 bp, S. pombe
ggatgctagcgatagcgacgacagt

SEQ ID NO: 104226 - DNA, 25 bp, S. pombe
ggagtcagcatttaatccggatact

SEQ ID NO: 104227 - DNA, 25 bp, S. pombe
ggatgatcgcgctttcgagacggac

SEQ ID NO: 104228 - DNA, 25 bp, S. pombe
ggatgctcgagcttacttacttgac

SEQ ID NO: 104229 - DNA, 25 bp, S. pombe
ggaggtggtgtccttacttctgaca

SEQ ID NO: 104230 - DNA, 25 bp, S. pombe
ggaggcggtagacttaatcaccaaa

SEQ ID NO: 104231 - DNA, 25 bp, S. pombe
ggaggttcttggtgcatttgccaat

SEQ ID NO: 104232 - DNA, 25 bp, S. pombe
ggatggataccgttcctacttgcag

SEQ ID NO: 104233 - DNA, 25 bp, S. pombe
ggaggaatccgcgtcaataagccat

SEQ ID NO: 104234 - DNA, 25 bp, S. pombe
ggaatgaatctcctaaaaaacccat

SEQ ID NO: 104235 - DNA, 25 bp, S. pombe
ggagggtctttgcaatcacaaccaa

SEQ ID NO: 104236 - DNA, 25 bp, S. pombe
ggaggcttcgattttgaacctagac

SEQ ID NO: 104237 - DNA, 25 bp, S. pombe
ggaggcttcctctttattctataga

SEQ ID NO: 104238 - DNA, 25 bp, S. pombe
ggaggccctgtcagattatctcaaa

SEQ ID NO: 104239 - DNA, 25 bp, S. pombe
ggagcttaccgacattggatcaacc

SEQ ID NO: 104240 - DNA, 25 bp, S. pombe
ggagcattagccaaacccggaacca

SEQ ID NO: 104241 - DNA, 25 bp, S. pombe
ggagatccatacaactggtccgtta

SEQ ID NO: 104242 - DNA, 25 bp, S. pombe
ggatgttctcacgatctatgaccaa

SEQ ID NO: 104243 - DNA, 25 bp, S. pombe
ggaggtatcgtgacattgggcaatt

SEQ ID NO: 104244 - DNA, 25 bp, S. pombe
ggaggttccatctatttgagcaaat

SEQ ID NO: 104245 - DNA, 25 bp, S. pombe
ggaggcgttcaatgcatataccaat

SEQ ID NO: 104246 - DNA, 25 bp, S. pombe
ggagttttccaagccagagcagctt

SEQ ID NO: 104247 - DNA, 25 bp, S. pombe
ggaggtcttccatctctagtagtat

SEQ ID NO: 104248 - DNA, 25 bp, S. pombe
ggagtttcctccttctaatattgat

SEQ ID NO: 104249 - DNA, 25 bp, S. pombe
ggaggtaacttctttcatacttaat

SEQ ID NO: 104250 - DNA, 25 bp, S. pombe
ggagatgtcactgccacattttggc

SEQ ID NO: 104251 - DNA, 25 bp, S. pombe
ggaggctttatccacagagccgtca

SEQ ID NO: 104252 - DNA, 25 bp, S. pombe
ggagtaatcctgtttttgctgaaaa

SEQ ID NO: 104253 - DNA, 25 bp, S. pombe
ggaggcaccctgtttttagaacaag

SEQ ID NO: 104254 - DNA, 25 bp, S. pombe
ggagttgtcactccctttaaaatag

SEQ ID NO: 104255 - DNA, 25 bp, S. pombe
ggagttttcactatttataccaagg

SEQ ID NO: 104256 - DNA, 25 bp, S. pombe
ggatgtttacttcgtattgaaccaa

SEQ ID NO: 104257 - DNA, 25 bp, S. pombe
ggatgtctttgcaggatttgatctt

SEQ ID NO: 104258 - DNA, 25 bp, S. pombe
ggatgatctcatttcttattctttg

SEQ ID NO: 104259 - DNA, 25 bp, S. pombe
ggaggagctgcctttaacagaatct

SEQ ID NO: 104260 - DNA, 25 bp, S. pombe
ggagcaccgccttttgaggacatgt

SEQ ID NO: 104261 - DNA, 25 bp, S. pombe
ggagccctccaagttgaaccttgaa

SEQ ID NO: 104262 - DNA, 25 bp, S. pombe
ggcgttcccgaacaaactgataatt

SEQ ID NO: 104263 - DNA, 25 bp, S. pombe
ggatgtctcctgcaacagactttgt

SEQ ID NO: 104264 - DNA, 25 bp, S. pombe
ggagattctctggacgaacccattc

SEQ ID NO: 104265 - DNA, 25 bp, S. pombe
ggagattctcttggaaagcccttcc

SEQ ID NO: 104266 - DNA, 25 bp, S. pombe
ggagatacactcttggatagacctt

SEQ ID NO: 104267 - DNA, 25 bp, S. pombe
ggaggaattgctttctgaccataat

SEQ ID NO: 104268 - DNA, 25 bp, S. pombe
ggaggatcagtctgtcttgccaaat

SEQ ID NO: 104269 - DNA, 25 bp, S. pombe
ggagtcaagctcacattggcaaggt

SEQ ID NO: 104270 - DNA, 25 bp, S. pombe
ggaggatgaccacattgcccaaatt

SEQ ID NO: 104271 - DNA, 25 bp, S. pombe
ggaggaggacctttcaactgaattt

SEQ ID NO: 104272 - DNA, 25 bp, S. pombe
ggagtcccctctgtacaaggatcaa

SEQ ID NO: 104273 - DNA, 25 bp, S. pombe
ggagtattcgttgtaccgtgatcac

SEQ ID NO: 104274 - DNA, 25 bp, S. pombe
ggagttgccgttaaatccactgaca

SEQ ID NO: 104275 - DNA, 25 bp, S. pombe
ggaggtccgccaattttaatgacat

SEQ ID NO: 104276 - DNA, 25 bp, S. pombe
ggaggctccagctactgctaaaata

SEQ ID NO: 104277 - DNA, 25 bp, S. pombe
ggacgtactattctgtgtcatcgga

SEQ ID NO: 104278 - DNA, 25 bp, S. pombe
ggatggtagctttggttctctagta

SEQ ID NO: 104279 - DNA, 25 bp, S. pombe
ggatggtagcattcttgttctccgc

SEQ ID NO: 104280 - DNA, 25 bp, S. pombe
ggagtcgttttccaatttgtactga

SEQ ID NO: 104281 - DNA, 25 bp, S. pombe
ggagatcgatttactcagtttttcg

SEQ ID NO: 104282 - DNA, 25 bp, S. pombe
ggaggcttattatagttttctgctg

SEQ ID NO: 104283 - DNA, 25 bp, S. pombe
ggaggccttgtaaagcgcactgtta

SEQ ID NO: 104284 - DNA, 25 bp, S. pombe
ggacctatccaacatttctcttaat

SEQ ID NO: 104285 - DNA, 25 bp, S. pombe
ggaccatcatgagagccttttcatt

SEQ ID NO: 104286 - DNA, 25 bp, S. pombe
ggaggtcattacttctttacttgct

SEQ ID NO: 104287 - DNA, 25 bp, S. pombe
ggagagctcttatagccttcttatg

SEQ ID NO: 104288 - DNA, 25 bp, S. pombe
ggagtctttattagcgtccaatatt

SEQ ID NO: 104289 - DNA, 25 bp, S. pombe
ggaggagttcgtccaaacacatact

SEQ ID NO: 104290 - DNA, 25 bp, S. pombe
ggaggcaattcgtcgcatacacaat

SEQ ID NO: 104291 - DNA, 25 bp, S. pombe
ggagagcacgtccatcgtttacaaa

SEQ ID NO: 104292 - DNA, 25 bp, S. pombe
ggaggtcagatgcatcccttcaaaa

SEQ ID NO: 104293 - DNA, 25 bp, S. pombe
ggaggcgctgcaatttggcttacta

SEQ ID NO: 104294 - DNA, 25 bp, S. pombe
ggacgccttatgctggcatcgatat

SEQ ID NO: 104295 - DNA, 25 bp, S. pombe
ggaggtcttacgagcattgaatttt

SEQ ID NO: 104296 - DNA, 25 bp, S. pombe
ggagcttttcggattagaagttgca

SEQ ID NO: 104297 - DNA, 25 bp, S. pombe
ggagtatttcgtccttacgactcac

SEQ ID NO: 104298 - DNA, 25 bp, S. pombe
ggatgtcaattcgtagcttaccctg

SEQ ID NO: 104299 - DNA, 25 bp, S. pombe
ggagttttagacttgctaccacatg

SEQ ID NO: 104300 - DNA, 25 bp, S. pombe
ggagattcatgctaaggttacacaa

SEQ ID NO: 104301 - DNA, 25 bp, S. pombe
ggagtttgactacgtatccaaagca

SEQ ID NO: 104302 - DNA, 25 bp, S. pombe
ggagctttaaacattgctctccctc

SEQ ID NO: 104303 - DNA, 25 bp, S. pombe
ggagtctccacaacaatttgtcctc

SEQ ID NO: 104304 - DNA, 25 bp, S. pombe
ggagggcgatacttttgatgctttc

SEQ ID NO: 104305 - DNA, 25 bp, S. pombe
ggacgttctcgagacggcggtctac

SEQ ID NO: 104306 - DNA, 25 bp, S. pombe
ggaggattatcaccttttcaggcta

SEQ ID NO: 104307 - DNA, 25 bp, S. pombe
ggacctctatcaccattttacgtaa

SEQ ID NO: 104308 - DNA, 25 bp, S. pombe
ggagcctaattctagtggtcttaag

SEQ ID NO: 104309 - DNA, 25 bp, S. pombe
ggagactcacaaacagcaggctgga

SEQ ID NO: 104310 - DNA, 25 bp, S. pombe
ggagaataatataccggctgtcaaa

SEQ ID NO: 104311 - DNA, 25 bp, S. pombe
ggcagtttcaaacctcggtctagta

SEQ ID NO: 104312 - DNA, 25 bp, S. pombe
ggagtttcaaaattcagtgttacag

SEQ ID NO: 104313 - DNA, 25 bp, S. pombe
ggagcttctttttatgcacggaggc

SEQ ID NO: 104314 - DNA, 25 bp, S. pombe
ggagcagctcctgtgatatacggaa

SEQ ID NO: 104315 - DNA, 25 bp, S. pombe
ggagcagcctcttcgaagatctcga

SEQ ID NO: 104316 - DNA, 25 bp, S. pombe
ggagcgatcgcttcagaatcactat

SEQ ID NO: 104317 - DNA, 25 bp, S. pombe
ggagatatcgcctttctcaggtgaa

SEQ ID NO: 104318 - DNA, 25 bp, S. pombe
ggagtacatccgctttttgacaaat

SEQ ID NO: 104319 - DNA, 25 bp, S. pombe
ggagagcacccgtaatacttagaag

SEQ ID NO: 104320 - DNA, 25 bp, S. pombe
ggaggtcactcttcctaattctaaa

SEQ ID NO: 104321 - DNA, 25 bp, S. pombe
ggaggtatctatccctttttacgat

SEQ ID NO: 104322 - DNA, 25 bp, S. pombe
ggagttgcttcaattatcgtttcaa

SEQ ID NO: 104323 - DNA, 25 bp, S. pombe
ggagggtgctctatcttattgtaac

SEQ ID NO: 104324 - DNA, 25 bp, S. pombe
ggaggtgctctggttctatatttac

SEQ ID NO: 104325 - DNA, 25 bp, S. pombe
ggagaatatcgagtcacgtccttat

SEQ ID NO: 104326 - DNA, 25 bp, S. pombe
ggagtatctcaaatcacttctggta

SEQ ID NO: 104327 - DNA, 25 bp, S. pombe
ggaggcattcaattcactttttatt

SEQ ID NO: 104328 - DNA, 25 bp, S. pombe
ggagcacagctacttcaaatttttg

SEQ ID NO: 104329 - DNA, 25 bp, S. pombe
ggagcaacactcacaatttttctgg

SEQ ID NO: 104330 - DNA, 25 bp, S. pombe
ggagccacccatacaatcaattaca

SEQ ID NO: 104331 - DNA, 25 bp, S. pombe
ggagaatttgccttgaccctaaaat

SEQ ID NO: 104332 - DNA, 25 bp, S. pombe
ggactattatttttgcctaacggct

SEQ ID NO: 104333 - DNA, 25 bp, S. pombe
ggagctgtcatatacgccttaagga

SEQ ID NO: 104334 - DNA, 25 bp, S. pombe
ggagcttgtaatgccctacttggag

SEQ ID NO: 104335 - DNA, 25 bp, S. pombe
ggactagctattttccttattggag

SEQ ID NO: 104336 - DNA, 25 bp, S. pombe
ggagtagttttgtttgcctcggatt

SEQ ID NO: 104337 - DNA, 25 bp, S. pombe
ggaggaatattttttcttcgcgatt

SEQ ID NO: 104338 - DNA, 25 bp, S. pombe
ggagacttacatagcacttctgcaa

SEQ ID NO: 104339 - DNA, 25 bp, S. pombe
ggaggttgacatagagtttcccaaa

SEQ ID NO: 104340 - DNA, 25 bp, S. pombe
ggaggactctattcctgttgctcaa

SEQ ID NO: 104341 - DNA, 25 bp, S. pombe
ggaggattgctctatcactatcgta

SEQ ID NO: 104342 - DNA, 25 bp, S. pombe
ggaggaattcgactatctgctagaa

SEQ ID NO: 104343 - DNA, 25 bp, S. pombe
ggcagctaagcgttccagagcggta

SEQ ID NO: 104344 - DNA, 25 bp, S. pombe
ggagtgaaaccgacattgccagaaa

SEQ ID NO: 104345 - DNA, 25 bp, S. pombe
ggaggagattgtgcttcgcaactaa

SEQ ID NO: 104346 - DNA, 25 bp, S. pombe
ggagacccagtatcccaaatggcta

SEQ ID NO: 104347 - DNA, 25 bp, S. pombe
ggaggtcccaagtctcaaatcagga

SEQ ID NO: 104348 - DNA, 25 bp, S. pombe
ggaggtgcaccaacatctaattctg

SEQ ID NO: 104349 - DNA, 25 bp, S. pombe
ggaggatccatcatctagccaattt

SEQ ID NO: 104350 - DNA, 25 bp, S. pombe
ggagtgtctttgtccaatacttttg

SEQ ID NO: 104351 - DNA, 25 bp, S. pombe
ggagatgtcactaattgcccactga

SEQ ID NO: 104352 - DNA, 25 bp, S. pombe
ggagcacgccgctaagatgcatgaa

SEQ ID NO: 104353 - DNA, 25 bp, S. pombe
ggagcttaaagatggcccttcacgt

SEQ ID NO: 104354 - DNA, 25 bp, S. pombe
ggagcttcaatatgggcccttgttg

SEQ ID NO: 104355 - DNA, 25 bp, S. pombe
ggcagcgtcataacaggcggttttt

SEQ ID NO: 104356 - DNA, 25 bp, S. pombe
ggacgatctgcaactaccgattttg

SEQ ID NO: 104357 - DNA, 25 bp, S. pombe
ggaggatctgcaaactttcatttag

SEQ ID NO: 104358 - DNA, 25 bp, S. pombe
ggaggtgttgccagttgttctgaaa

SEQ ID NO: 104359 - DNA, 25 bp, S. pombe
ggagtacctcagcttttctttatac

SEQ ID NO: 104360 - DNA, 25 bp, S. pombe
ggagttacaccatctttttgtcatg

SEQ ID NO: 104361 - DNA, 25 bp, S. pombe
tggaggaaccgcactttgtttttcg

SEQ ID NO: 104362 - DNA, 25 bp, S. pombe
ggagatgccccgaaattttgatttt

SEQ ID NO: 104363 - DNA, 25 bp, S. pombe
ggagacgcccattcatgaaaaccag

SEQ ID NO: 104364 - DNA, 25 bp, S. pombe
ggcaaggccagtatcagaacccaaa

SEQ ID NO: 104365 - DNA, 25 bp, S. pombe
ggaggtcgcggcaatcattactgat

SEQ ID NO: 104366 - DNA, 25 bp, S. pombe
ggagcgtcacgttcaaaatgcattt

SEQ ID NO: 104367 - DNA, 25 bp, S. pombe
ggagtatccgtccttaatgattgta

SEQ ID NO: 104368 - DNA, 25 bp, S. pombe
ggagtactacattttcaatatcttt

SEQ ID NO: 104369 - DNA, 25 bp, S. pombe
ggacttttggccctaattattctgt

SEQ ID NO: 104370 - DNA, 25 bp, S. pombe
ggagcttttacctataacttacgat

SEQ ID NO: 104371 - DNA, 25 bp, S. pombe
ggagatttcgaatactggccccatg

SEQ ID NO: 104372 - DNA, 25 bp, S. pombe
ggaaagcgtgccaagaacagtaact

SEQ ID NO: 104373 - DNA, 25 bp, S. pombe
ggaaacagtgtccatgcagacgtaa

SEQ ID NO: 104374 - DNA, 25 bp, S. pombe
ggagttctttcatcagagggtcgaa

SEQ ID NO: 104375 - DNA, 25 bp, S. pombe
ggagacgtctatacagcatcggctg

SEQ ID NO: 104376 - DNA, 25 bp, S. pombe
ggagatcgagtcctttgtctgatga

SEQ ID NO: 104377 - DNA, 25 bp, S. pombe
ggagcatcgaactcgtatcttgcaa

SEQ ID NO: 104378 - DNA, 25 bp, S. pombe
ggcaccagcaaatagtacatcgtca

SEQ ID NO: 104379 - DNA, 25 bp, S. pombe
ggagtcatgccttcaactgatacgt

SEQ ID NO: 104380 - DNA, 25 bp, S. pombe
ggagttggacctggcaaacgcgcat

SEQ ID NO: 104381 - DNA, 25 bp, S. pombe
ggagggtgcccttgacaacatcgta

SEQ ID NO: 104382 - DNA, 25 bp, S. pombe
ggaggtatttcttcaactacttcag

SEQ ID NO: 104383 - DNA, 25 bp, S. pombe
ggagggtttgcttggacacctgtca

SEQ ID NO: 104384 - DNA, 25 bp, S. pombe
ggaccgttcatcaaggaccattaac

SEQ ID NO: 104385 - DNA, 25 bp, S. pombe
ggacctgttccaatgggccttatta

SEQ ID NO: 104386 - DNA, 25 bp, S. pombe
ggagcttggctgatattcactttga

SEQ ID NO: 104387 - DNA, 25 bp, S. pombe
ggagccggcgtttctcatgaattaa

SEQ ID NO: 104388 - DNA, 25 bp, S. pombe
ggagccgtgaaatcagggacatcaa

SEQ ID NO: 104389 - DNA, 25 bp, S. pombe
ggagctcgtaatggacctgcaggcc

SEQ ID NO: 104390 - DNA, 25 bp, S. pombe
tggagttgcaaaggacgtacccgaa

SEQ ID NO: 104391 - DNA, 25 bp, S. pombe
ggagctatcagacgcttctgctgaa

SEQ ID NO: 104392 - DNA, 25 bp, S. pombe
ggccaaattattgccgtaccgtcac

SEQ ID NO: 104393 - DNA, 25 bp, S. pombe
ggactaagcgttggccgtactacca

SEQ ID NO: 104394 - DNA, 25 bp, S. pombe
ggactgtacggaggtttgactgcac

SEQ ID NO: 104395 - DNA, 25 bp, S. pombe
ggagtttcacgcattggcaattcta

SEQ ID NO: 104396 - DNA, 25 bp, S. pombe
ggaaaagttcaccagctatgttcgt

SEQ ID NO: 104397 - DNA, 25 bp, S. pombe
ggagtattccttgacatggcttaca

SEQ ID NO: 104398 - DNA, 25 bp, S. pombe
ggagtgcattatccctaaatggtac

SEQ ID NO: 104399 - DNA, 25 bp, S. pombe
ggactttagtcctttctggtattgg

SEQ ID NO: 104400 - DNA, 25 bp, S. pombe
ggagctgttgagtcttttctactgt

SEQ ID NO: 104401 - DNA, 25 bp, S. pombe
ggagtggctctagtttatcatctaa

SEQ ID NO: 104402 - DNA, 25 bp, S. pombe
ggagggcctcttcatgatcccaata

SEQ ID NO: 104403 - DNA, 25 bp, S. pombe
ggactaactactcaatactcgttcg

SEQ ID NO: 104404 - DNA, 25 bp, S. pombe
ggcaattacccgtggtacttctgta

SEQ ID NO: 104405 - DNA, 25 bp, S. pombe
ggccatgttcgtgttttacttttca

SEQ ID NO: 104406 - DNA, 25 bp, S. pombe
ggcggcttcggtttatatgttttct

SEQ ID NO: 104407 - DNA, 25 bp, S. pombe
ggagctgcaatattcttatactgtt

SEQ ID NO: 104408 - DNA, 25 bp, S. pombe
ggagtaatctttctcactctgattt

SEQ ID NO: 104409 - DNA, 25 bp, S. pombe
ggagtgcttcttattctttgtttac

SEQ ID NO: 104410 - DNA, 25 bp, S. pombe
ggagtattattacccacaatctctt

SEQ ID NO: 104411 - DNA, 25 bp, S. pombe
ggagacttgattagatccatccagt

SEQ ID NO: 104412 - DNA, 25 bp, S. pombe
ggagactgacacaagccgctatatg

SEQ ID NO: 104413 - DNA, 25 bp, S. pombe
ggacccgaccggaaatatgtattag

SEQ ID NO: 104414 - DNA, 25 bp, S. pombe
ggacccgaaattgttgattccttgt

SEQ ID NO: 104415 - DNA, 25 bp, S. pombe
ggaccgcaggacgtttatgttcctt

SEQ ID NO: 104416 - DNA, 25 bp, S. pombe
ggacctcgcgttctatgtatgtgac

SEQ ID NO: 104417 - DNA, 25 bp, S. pombe
ggacctcatgcctttaaatctgttc

SEQ ID NO: 104418 - DNA, 25 bp, S. pombe
ggagtcattccatttacttcaattc

SEQ ID NO: 104419 - DNA, 25 bp, S. pombe
ggagtctctacaacttctacgattc

SEQ ID NO: 104420 - DNA, 25 bp, S. pombe
ggcaccacttgttcctcaaagaaag

SEQ ID NO: 104421 - DNA, 25 bp, S. pombe
ggactcctggagtgcttcaaaaagc

SEQ ID NO: 104422 - DNA, 25 bp, S. pombe
ggaccactcccttggtacatgaaaa

SEQ ID NO: 104423 - DNA, 25 bp, S. pombe
ggacgaggctcgatttttcatataa

SEQ ID NO: 104424 - DNA, 25 bp, S. pombe
ggagctattgcttgttattttcttt

SEQ ID NO: 104425 - DNA, 25 bp, S. pombe
ggagaatcctgtattttcgcgtatt

SEQ ID NO: 104426 - DNA, 25 bp, S. pombe
ggagacatcctttacttgatcctta

SEQ ID NO: 104427 - DNA, 25 bp, S. pombe
ggagatatttttgcttatgccatta

SEQ ID NO: 104428 - DNA, 25 bp, S. pombe
ggagttgttaatgccactgctggac

SEQ ID NO: 104429 - DNA, 25 bp, S. pombe
ggagtttctcgtgcctatcgaagag

SEQ ID NO: 104430 - DNA, 25 bp, S. pombe
ggagaaatccaccactgtgcaagaa

SEQ ID NO: 104431 - DNA, 25 bp, S. pombe
ggagaaatgcccgacttctctgaag

SEQ ID NO: 104432 - DNA, 25 bp, S. pombe
ggagacattccaacaaccttgtgag

SEQ ID NO: 104433 - DNA, 25 bp, S. pombe
tggaaactggccgaaactttggtat

SEQ ID NO: 104434 - DNA, 25 bp, S. pombe
ggaccaaggcagtcaagcacttttt

SEQ ID NO: 104435 - DNA, 25 bp, S. pombe
ggagcgtactaatgcaaaccgaact

SEQ ID NO: 104436 - DNA, 25 bp, S. pombe
ggagcttcaaaatcaaatcggtact

SEQ ID NO: 104437 - DNA, 25 bp, S. pombe
ggagcttgcaagaattcactgacag

SEQ ID NO: 104438 - DNA, 25 bp, S. pombe
ggagccgcagcaaggttctgacaaa

SEQ ID NO: 104439 - DNA, 25 bp, S. pombe
ggagccggcggatttgatgcacaat

SEQ ID NO: 104440 - DNA, 25 bp, S. pombe
ggagcccagggttcagcagcaatat

SEQ ID NO: 104441 - DNA, 25 bp, S. pombe
ggacgacactctccattgaggaaaa

SEQ ID NO: 104442 - DNA, 25 bp, S. pombe
ggacgtcctaatgaaaacacacccg

SEQ ID NO: 104443 - DNA, 25 bp, S. pombe
ggctcgtgttaagaaggctctacca

SEQ ID NO: 104444 - DNA, 25 bp, S. pombe
ggagacactacacttcatggacgtt

SEQ ID NO: 104445 - DNA, 25 bp, S. pombe
ggagaacctactgcagagacttttg

SEQ ID NO: 104446 - DNA, 25 bp, S. pombe
ggagaacattctgccggaattccct

SEQ ID NO: 104447 - DNA, 25 bp, S. pombe
tggaactacggtgcttttcctcaaa

SEQ ID NO: 104448 - DNA, 25 bp, S. pombe
ggaactaagattcttcccgctgaaa

SEQ ID NO: 104449 - DNA, 25 bp, S. pombe
ggacgctctttttgaaactatacca

SEQ ID NO: 104450 - DNA, 25 bp, S. pombe
ggacgttcactcaccggataattca

SEQ ID NO: 104451 - DNA, 25 bp, S. pombe
ggaatgattcctataccgtttttat

SEQ ID NO: 104452 - DNA, 25 bp, S. pombe
ggagaatcagcatcactcatttcaa

SEQ ID NO: 104453 - DNA, 25 bp, S. pombe
ggagagggctctattgctacaatta

SEQ ID NO: 104454 - DNA, 25 bp, S. pombe
ggagacgttgctattgatacacaga

SEQ ID NO: 104455 - DNA, 25 bp, S. pombe
ggactactttgggtgatccaactat

SEQ ID NO: 104456 - DNA, 25 bp, S. pombe
ggacctcttctcaaagctcattaat

SEQ ID NO: 104457 - DNA, 25 bp, S. pombe
ggaccaatctattgatccgagctat

SEQ ID NO: 104458 - DNA, 25 bp, S. pombe
ggaaatgccgaattcacgtacctta

SEQ ID NO: 104459 - DNA, 25 bp, S. pombe
ggacattggccgatatggtacctaa

SEQ ID NO: 104460 - DNA, 25 bp, S. pombe
ggagaaggcagctctgcttcagttt

SEQ ID NO: 104461 - DNA, 25 bp, S. pombe
ggagattgcacgctattctatgtat

SEQ ID NO: 104462 - DNA, 25 bp, S. pombe
ggagatatgcaccttgaccaatgtc

SEQ ID NO: 104463 - DNA, 25 bp, S. pombe
ggaatatccgctcacgatcgtgcat

SEQ ID NO: 104464 - DNA, 25 bp, S. pombe
ggagcagaaggtttcgcattcgaat

SEQ ID NO: 104465 - DNA, 25 bp, S. pombe
ggagcaatcctcttttttggaacaa

SEQ ID NO: 104466 - DNA, 25 bp, S. pombe
ggagatgcatttattcgtggaaaca

SEQ ID NO: 104467 - DNA, 25 bp, S. pombe
ggagatgtctttgctctttgtaaaa

SEQ ID NO: 104468 - DNA, 25 bp, S. pombe
ggagatctcctttgcttgaacttag

SEQ ID NO: 104469 - DNA, 25 bp, S. pombe
ggagaacgttctgtatctactataa

SEQ ID NO: 104470 - DNA, 25 bp, S. pombe
ggagcaccgcttcaaattctttcat

SEQ ID NO: 104471 - DNA, 25 bp, S. pombe
ggagacgatgatttttctgttcaat

SEQ ID NO: 104472 - DNA, 25 bp, S. pombe
ggcaggaattccatacgtgtcaata

SEQ ID NO: 104473 - DNA, 25 bp, S. pombe
ggacctcggattctgtaaagctcaa

SEQ ID NO: 104474 - DNA, 25 bp, S. pombe
ggagccactgatttcattaacccta

SEQ ID NO: 104475 - DNA, 25 bp, S. pombe
ggagctatgtccttcatcgaaacac

SEQ ID NO: 104476 - DNA, 25 bp, S. pombe
ggacttggtgctggtcaacaatccc

SEQ ID NO: 104477 - DNA, 25 bp, S. pombe
ggacctgacagtgatcaacttccta

SEQ ID NO: 104478 - DNA, 25 bp, S. pombe
ggagactgaaaccacaacctcatct

SEQ ID NO: 104479 - DNA, 25 bp, S. pombe
ggactttgtcttaaagcctcaacga

SEQ ID NO: 104480 - DNA, 25 bp, S. pombe
ggagcgtcgtttacagacccaagtt

SEQ ID NO: 104481 - DNA, 25 bp, S. pombe
ggagctcacgattataccccagcaa

SEQ ID NO: 104482 - DNA, 25 bp, S. pombe
ggagcatgagctagactcttctctt

SEQ ID NO: 104483 - DNA, 25 bp, S. pombe
ggagataccagtccttttcttgatt

SEQ ID NO: 104484 - DNA, 25 bp, S. pombe
ggagaaccgttctatttcagtgagt

SEQ ID NO: 104485 - DNA, 25 bp, S. pombe
ggagacctctcatttactgtatcga

SEQ ID NO: 104486 - DNA, 25 bp, S. pombe
ggagctgtcaaattcttatggtttt

SEQ ID NO: 104487 - DNA, 25 bp, S. pombe
ggacatcttcaatggctaggactat

SEQ ID NO: 104488 - DNA, 25 bp, S. pombe
ggactctggatatcgctgggactta

SEQ ID NO: 104489 - DNA, 25 bp, S. pombe
ggagcttccaaacgaattgctactt

SEQ ID NO: 104490 - DNA, 25 bp, S. pombe
ggagctctacaatgatgaatctgcc

SEQ ID NO: 104491 - DNA, 25 bp, S. pombe
ggagctttatattgctgaacttctc

SEQ ID NO: 104492 - DNA, 25 bp, S. pombe
ggacgttgtttatgatcttcggata

SEQ ID NO: 104493 - DNA, 25 bp, S. pombe
ggaccctggttatagctttgaaaat

SEQ ID NO: 104494 - DNA, 25 bp, S. pombe
ggaccagttgttgcaatttcgaaat

SEQ ID NO: 104495 - DNA, 25 bp, S. pombe
ggacccattcggctcaatgtttata

SEQ ID NO: 104496 - DNA, 25 bp, S. pombe
ggagctggtcaatatcgtggttata

SEQ ID NO: 104497 - DNA, 25 bp, S. pombe
ggagctttgaattcaccttcttata

SEQ ID NO: 104498 - DNA, 25 bp, S. pombe
ggactattgagtgcagccgactttc

SEQ ID NO: 104499 - DNA, 25 bp, S. pombe
ggcctacattttctcatgggttttg

SEQ ID NO: 104500 - DNA, 25 bp, S. pombe
ggactttcctagcttctggttatta

SEQ ID NO: 104501 - DNA, 25 bp, S. pombe
ggacagttcctctagtggtggattt

SEQ ID NO: 104502 - DNA, 25 bp, S. pombe
ggacagctggaagcccaaggttttt

SEQ ID NO: 104503 - DNA, 25 bp, S. pombe
ggagctgaaggagttatcctctcta

SEQ ID NO: 104504 - DNA, 25 bp, S. pombe
ggagcgaatgtcactgtcacatctt

SEQ ID NO: 104505 - DNA, 25 bp, S. pombe
ggagagactgtcgatttcacatttt

SEQ ID NO: 104506 - DNA, 25 bp, S. pombe
ggagaacttccattcttcagtaaga

SEQ ID NO: 104507 - DNA, 25 bp, S. pombe
ggagaatttctcctctgttattcag

SEQ ID NO: 104508 - DNA, 25 bp, S. pombe
ggagccttgattcgttgtgtaccaa

SEQ ID NO: 104509 - DNA, 25 bp, S. pombe
ggacacacgtatgagcctgaagact

SEQ ID NO: 104510 - DNA, 25 bp, S. pombe
ggagcctctacgaactataatgcct

SEQ ID NO: 104511 - DNA, 25 bp, S. pombe
ggagacgtaccaagttgaacatcta

SEQ ID NO: 104512 - DNA, 25 bp, S. pombe
ggagctatatgaccctttattccca

SEQ ID NO: 104513 - DNA, 25 bp, S. pombe
ggagcttatgaaacatttaccagac

SEQ ID NO: 104514 - DNA, 25 bp, S. pombe
ggagcatttcacattttcgagcaat

SEQ ID NO: 104515 - DNA, 25 bp, S. pombe
ggacgagtcccatttgacgacgttt

SEQ ID NO: 104516 - DNA, 25 bp, S. pombe
ggagcgtggacctacttctaagtta

SEQ ID NO: 104517 - DNA, 25 bp, S. pombe
ggcacttggccctattttaattgat

SEQ ID NO: 104518 - DNA, 25 bp, S. pombe
ggacgtggcattgatctttctttgt

SEQ ID NO: 104519 - DNA, 25 bp, S. pombe
ggacgcattgcttacagtttctttg

SEQ ID NO: 104520 - DNA, 25 bp, S. pombe
ggacgttttacagtctctcgttgac

SEQ ID NO: 104521 - DNA, 25 bp, S. pombe
ggacgcttggtctctcggaatagtt

SEQ ID NO: 104522 - DNA, 25 bp, S. pombe
ggagccaagtttgctgctgtggata

SEQ ID NO: 104523 - DNA, 25 bp, S. pombe
ggagcattgcacgttactgttgtaa

SEQ ID NO: 104524 - DNA, 25 bp, S. pombe
ggagcttacaattatctggtcaata

SEQ ID NO: 104525 - DNA, 25 bp, S. pombe
ggagcttaaacactcggttatgaca

SEQ ID NO: 104526 - DNA, 25 bp, S. pombe
ggagccatctactactgaggatttg

SEQ ID NO: 104527 - DNA, 25 bp, S. pombe
ggagcctccatattctggcatacat

SEQ ID NO: 104528 - DNA, 25 bp, S. pombe
ggagaatccaatttgctgctttgag

SEQ ID NO: 104529 - DNA, 25 bp, S. pombe
ggagacactatcaacgccaagcttg

SEQ ID NO: 104530 - DNA, 25 bp, S. pombe
ggagaacactgatgccatgccatac

SEQ ID NO: 104531 - DNA, 25 bp, S. pombe
ggagaacctcaaatcatcgaactag

SEQ ID NO: 104532 - DNA, 25 bp, S. pombe
ggagaatgcaacaccattaagtatg

SEQ ID NO: 104533 - DNA, 25 bp, S. pombe
ggcatgaagaccactcccgaagagg

SEQ ID NO: 104534 - DNA, 25 bp, S. pombe
ggagaaaccattcccactaaggctg

SEQ ID NO: 104535 - DNA, 25 bp, S. pombe
ggagcagtatctcatgttcctgact

SEQ ID NO: 104536 - DNA, 25 bp, S. pombe
ggagcagttgctgacactactgaat

SEQ ID NO: 104537 - DNA, 25 bp, S. pombe
ggagcttatcgatcctactttagaa

SEQ ID NO: 104538 - DNA, 25 bp, S. pombe
ggagctcctcgatctctttaaagat

SEQ ID NO: 104539 - DNA, 25 bp, S. pombe
ggagcacatgcccaatcttttaagc

SEQ ID NO: 104540 - DNA, 25 bp, S. pombe
ggagcactaagcacattcattattg

SEQ ID NO: 104541 - DNA, 25 bp, S. pombe
ggagccatctttccattatttgctg

SEQ ID NO: 104542 - DNA, 25 bp, S. pombe
ggagcaatctttggcattattcttt

SEQ ID NO: 104543 - DNA, 25 bp, S. pombe
ggagcaacctttatctagctttact

SEQ ID NO: 104544 - DNA, 25 bp, S. pombe
ggagcaagctgcctttatatcactt

SEQ ID NO: 104545 - DNA, 25 bp, S. pombe
ggaactacgttcaacttttcacttg

SEQ ID NO: 104546 - DNA, 25 bp, S. pombe
ggagaatccgatttccttttcacaa

SEQ ID NO: 104547 - DNA, 25 bp, S. pombe
ggacgaatctgcttgtgtacttact

SEQ ID NO: 104548 - DNA, 25 bp, S. pombe
ggacatacacatctgtttggaactt

SEQ ID NO: 104549 - DNA, 25 bp, S. pombe
ggagctgcgcttatggaagttacca

SEQ ID NO: 104550 - DNA, 25 bp, S. pombe
ggagcggtaccatctttatttcagt

SEQ ID NO: 104551 - DNA, 25 bp, S. pombe
ggacgaatcaactgctttccatcta

SEQ ID NO: 104552 - DNA, 25 bp, S. pombe
ggagcgtctacatcaattctgccaa

SEQ ID NO: 104553 - DNA, 25 bp, S. pombe
ggagctgtttatgctaccgcagcaa

SEQ ID NO: 104554 - DNA, 25 bp, S. pombe
ggagcaaattcacgacccaagtcaa

SEQ ID NO: 104555 - DNA, 25 bp, S. pombe
tgggagacttcggactagcaactag

SEQ ID NO: 104556 - DNA, 25 bp, S. pombe
ggagaatctcctgcttttacaaatg

SEQ ID NO: 104557 - DNA, 25 bp, S. pombe
ggagcaattctcaacgatctttcaa

SEQ ID NO: 104558 - DNA, 25 bp, S. pombe
ggagctatcaacgaccaacaaccat

SEQ ID NO: 104559 - DNA, 25 bp, S. pombe
ggactatcagatccccaaattcata

SEQ ID NO: 104560 - DNA, 25 bp, S. pombe
ggagcttcctgatcctaatcatcaa

SEQ ID NO: 104561 - DNA, 25 bp, S. pombe
ggacgctcaatgtttctatgttcaa

SEQ ID NO: 104562 - DNA, 25 bp, S. pombe
ggagcgccaaatatctgtgcaagta

SEQ ID NO: 104563 - DNA, 25 bp, S. pombe
ggagcattgcgaataatttcaagac

SEQ ID NO: 104564 - DNA, 25 bp, S. pombe
ggacgacctgatttactagactaca

SEQ ID NO: 104565 - DNA, 25 bp, S. pombe
ggagcaaatcccatgaatatcactt

SEQ ID NO: 104566 - DNA, 25 bp, S. pombe
ggagcaagtccaagcagccgtctct

SEQ ID NO: 104567 - DNA, 25 bp, S. pombe
ggagctcagcctttaaaacatgtta

SEQ ID NO: 104568 - DNA, 25 bp, S. pombe
ggagcgagcgcttattcaagaaatt

SEQ ID NO: 104569 - DNA, 25 bp, S. pombe
ggagccgttatacctgaacactttg

SEQ ID NO: 104570 - DNA, 25 bp, S. pombe
ggagcaccattctatacgaacactt

SEQ ID NO: 104571 - DNA, 25 bp, S. pombe
ggacctatccagaaatgcagccact

SEQ ID NO: 104572 - DNA, 25 bp, S. pombe
ggacctgcatcatgaaggccatcat

SEQ ID NO: 104573 - DNA, 25 bp, S. pombe
ggacgtgatcgctatggccaatgct

SEQ ID NO: 104574 - DNA, 25 bp, S. pombe
ggagcattgaatcatggcgctacta

SEQ ID NO: 104575 - DNA, 25 bp, S. pombe
ggagcttaatgcctgatgctgacaa

SEQ ID NO: 104576 - DNA, 25 bp, S. pombe
ggagctctagctcatagcagtcgat

SEQ ID NO: 104577 - DNA, 25 bp, S. pombe
ggagcttccatctggagctgatcaa

SEQ ID NO: 104578 - DNA, 25 bp, S. pombe
ggagcttacactgttgcagctgcta

SEQ ID NO: 104579 - DNA, 25 bp, S. pombe
ggagcgttcacttcttgactattta

SEQ ID NO: 104580 - DNA, 25 bp, S. pombe
ggaccaaacgcctgatgacatctca

SEQ ID NO: 104581 - DNA, 25 bp, S. pombe
ggacccgattccaatggatctcagt

SEQ ID NO: 104582 - DNA, 25 bp, S. pombe
ggagcagtagatcctcttactttgg

SEQ ID NO: 104583 - DNA, 25 bp, S. pombe
ggacgctgatatccttttgtttgga

SEQ ID NO: 104584 - DNA, 25 bp, S. pombe
ggacctaatggctcatttctttaca

SEQ ID NO: 104585 - DNA, 25 bp, S. pombe
ggaccacaacatcttttttctatca

SEQ ID NO: 104586 - DNA, 25 bp, S. pombe
ggacctctcaacttctttgtttata

SEQ ID NO: 104587 - DNA, 25 bp, S. pombe
ggagctctctctgctttatttggtc

SEQ ID NO: 104588 - DNA, 25 bp, S. pombe
ggaccacgtcttacaattggcgttg

SEQ ID NO: 104589 - DNA, 25 bp, S. pombe
ggacaagccgcttacaaaccgtatt

SEQ ID NO: 104590 - DNA, 25 bp, S. pombe
ggaaagcacctcaagccaaacctat

SEQ ID NO: 104591 - DNA, 25 bp, S. pombe
ggaaactttgattacagactgtcgg

SEQ ID NO: 104592 - DNA, 25 bp, S. pombe
ggaaatcctggctttatgactgagt

SEQ ID NO: 104593 - DNA, 25 bp, S. pombe
ggacgtgatcttcttaacatggcta

SEQ ID NO: 104594 - DNA, 25 bp, S. pombe
ggacgaatcttatttaccactgtta

SEQ ID NO: 104595 - DNA, 25 bp, S. pombe
ggaccattgtgtgctgaacccgttc

SEQ ID NO: 104596 - DNA, 25 bp, S. pombe
ggaaatcgcgtttatatcccggcac

SEQ ID NO: 104597 - DNA, 25 bp, S. pombe
ggaatttgatttatacccaccctcg

SEQ ID NO: 104598 - DNA, 25 bp, S. pombe
ggaattataggtgctacccatcccc

SEQ ID NO: 104599 - DNA, 25 bp, S. pombe
ggacctgctatacggcaacttgcta

SEQ ID NO: 104600 - DNA, 25 bp, S. pombe
ggacttgtgcaactacagactggac

SEQ ID NO: 104601 - DNA, 25 bp, S. pombe
ggacaatgcgtcaaccagctgtggg

SEQ ID NO: 104602 - DNA, 25 bp, S. pombe
ggactcatgccgaggttgacgctaa

SEQ ID NO: 104603 - DNA, 25 bp, S. pombe
ggacggtttcgaagtcaccactatg

SEQ ID NO: 104604 - DNA, 25 bp, S. pombe
ggaagaacactttggcgcagcaccg

SEQ ID NO: 104605 - DNA, 25 bp, S. pombe
tggacctaattgaggctagccctgc

SEQ ID NO: 104606 - DNA, 25 bp, S. pombe
ggactttatcgcatggtcagtgcat

SEQ ID NO: 104607 - DNA, 25 bp, S. pombe
ggaccttatagcatgttcactcaat

SEQ ID NO: 104608 - DNA, 25 bp, S. pombe
ggacctttgatgactttgcagcttt

SEQ ID NO: 104609 - DNA, 25 bp, S. pombe
ggacgcgccgatattatgagttgtt

SEQ ID NO: 104610 - DNA, 25 bp, S. pombe
ggaccaaatcatttctttcgctgag

SEQ ID NO: 104611 - DNA, 25 bp, S. pombe
ggaagagaaacctgtacccgagcct

SEQ ID NO: 104612 - DNA, 25 bp, S. pombe
ggaaaatcagggtcgtcgtgccccg

SEQ ID NO: 104613 - DNA, 25 bp, S. pombe
ggaaattggtgttgctacgatcccc

SEQ ID NO: 104614 - DNA, 25 bp, S. pombe
ggaaactttttctctgctacctctt

SEQ ID NO: 104615 - DNA, 25 bp, S. pombe
ggacgaatctgttcctgtgcctgtt

SEQ ID NO: 104616 - DNA, 25 bp, S. pombe
ggacgaatcagttccttttgatgat

SEQ ID NO: 104617 - DNA, 25 bp, S. pombe
ggagccattggcattttctttgctt

SEQ ID NO: 104618 - DNA, 25 bp, S. pombe
ggaaccagcgtatttataggacttt

SEQ ID NO: 104619 - DNA, 25 bp, S. pombe
ggacatccttcgaacgtatggtcta

SEQ ID NO: 104620 - DNA, 25 bp, S. pombe
ggacatgccactctatttgattttc

SEQ ID NO: 104621 - DNA, 25 bp, S. pombe
ggacgcatcttttcgataattacat

SEQ ID NO: 104622 - DNA, 25 bp, S. pombe
ggacgcagctactcgaatcattaaa

SEQ ID NO: 104623 - DNA, 25 bp, S. pombe
ggacatgcattatcgctgcaactgt

SEQ ID NO: 104624 - DNA, 25 bp, S. pombe
ggactctcatatggcagcttactat

SEQ ID NO: 104625 - DNA, 25 bp, S. pombe
ggacgcagcatcaagtgttacacat

SEQ ID NO: 104626 - DNA, 25 bp, S. pombe
ggacagagcccgaattcaactttga

SEQ ID NO: 104627 - DNA, 25 bp, S. pombe
ggcacacttttggaattactcactt

SEQ ID NO: 104628 - DNA, 25 bp, S. pombe
ggacgaaagtcgcttacccattctt

SEQ ID NO: 104629 - DNA, 25 bp, S. pombe
tggacgaaaccacgcgtcttggtta

SEQ ID NO: 104630 - DNA, 25 bp, S. pombe
ggacaggagtcctcgattttttatg

SEQ ID NO: 104631 - DNA, 25 bp, S. pombe
ggagcgcgagcatacactacagcaa

SEQ ID NO: 104632 - DNA, 25 bp, S. pombe
ggacttgtcataccgatactcatac

SEQ ID NO: 104633 - DNA, 25 bp, S. pombe
ggacgtttacatacccaactatggt

SEQ ID NO: 104634 - DNA, 25 bp, S. pombe
ggacacgaatctttacgacatgctt

SEQ ID NO: 104635 - DNA, 25 bp, S. pombe
ggacaatgaaatgcctgctgctgct

SEQ ID NO: 104636 - DNA, 25 bp, S. pombe
ggacatgttagcaggaccatttttg

SEQ ID NO: 104637 - DNA, 25 bp, S. pombe
ggagccagtctattttgctttcatt

SEQ ID NO: 104638 - DNA, 25 bp, S. pombe
ggaccagcagcttttactatccatt

SEQ ID NO: 104639 - DNA, 25 bp, S. pombe
ggacccagagtattctgagctgttt

SEQ ID NO: 104640 - DNA, 25 bp, S. pombe
ggacctcgtgatgttttgctattct

SEQ ID NO: 104641 - DNA, 25 bp, S. pombe
ggacctcgtatcgtgtttcatattc

SEQ ID NO: 104642 - DNA, 25 bp, S. pombe
ggaccactagactttcaccgttaat

SEQ ID NO: 104643 - DNA, 25 bp, S. pombe
ggacctctggtttcatccaaatcga

SEQ ID NO: 104644 - DNA, 25 bp, S. pombe
ggacaccatggtcgattcggacacg

SEQ ID NO: 104645 - DNA, 25 bp, S. pombe
ggaaccttgagtctggagaacttct

SEQ ID NO: 104646 - DNA, 25 bp, S. pombe
ggacatctcttccttttagaactta

SEQ ID NO: 104647 - DNA, 25 bp, S. pombe
ggacggagccgcagttagaacctat

SEQ ID NO: 104648 - DNA, 25 bp, S. pombe
ggacctggcctgattgatagaacct

SEQ ID NO: 104649 - DNA, 25 bp, S. pombe
ggacctatccatgtgttcaaagctt

SEQ ID NO: 104650 - DNA, 25 bp, S. pombe
ggaccttgctcatcttgtcaaaaat

SEQ ID NO: 104651 - DNA, 25 bp, S. pombe
ggaccattgctatcggaagccacaa

SEQ ID NO: 104652 - DNA, 25 bp, S. pombe
ggagccttcaccaaagtctcgtaaa

SEQ ID NO: 104653 - DNA, 25 bp, S. pombe
ggaccttgattcctagtctcgcgaa

SEQ ID NO: 104654 - DNA, 25 bp, S. pombe
ggacgtttatccgactcgtggacat

SEQ ID NO: 104655 - DNA, 25 bp, S. pombe
ggacatttccgtgctacatttgaag

SEQ ID NO: 104656 - DNA, 25 bp, S. pombe
ggacgatatacttttcttaatgaac

SEQ ID NO: 104657 - DNA, 25 bp, S. pombe
tgggataaacatgcaaccttaaggc

SEQ ID NO: 104658 - DNA, 25 bp, S. pombe
tcggaaaataccatcctttgcatcc

SEQ ID NO: 104659 - DNA, 25 bp, S. pombe
taaaaaatactcacgcccttcttct

SEQ ID NO: 104660 - DNA, 25 bp, S. pombe
ggaaagtatacgaacctcctcgcta

SEQ ID NO: 104661 - DNA, 25 bp, S. pombe
ggacactaacgagaagcctgcgaag

SEQ ID NO: 104662 - DNA, 25 bp, S. pombe
ggacctggaatgacaaacttggata

SEQ ID NO: 104663 - DNA, 25 bp, S. pombe
ggaccgctatgtggatatcgctgat

SEQ ID NO: 104664 - DNA, 25 bp, S. pombe
ggactctgcaatacaatgtctcgat

SEQ ID NO: 104665 - DNA, 25 bp, S. pombe
ggaccaacatgcaagggtatcatat

SEQ ID NO: 104666 - DNA, 25 bp, S. pombe
ggacctactactggagattatctaa

SEQ ID NO: 104667 - DNA, 25 bp, S. pombe
ggaccatacgctaggcaattctctt

SEQ ID NO: 104668 - DNA, 25 bp, S. pombe
ggacactacctacggatagtcctac

SEQ ID NO: 104669 - DNA, 25 bp, S. pombe
ggacgtacacgatgcaattgatttc

SEQ ID NO: 104670 - DNA, 25 bp, S. pombe
ggacgtactctttcagattacaaca

SEQ ID NO: 104671 - DNA, 25 bp, S. pombe
ggacggacctagcatccttgaagac

SEQ ID NO: 104672 - DNA, 25 bp, S. pombe
ggacgcaataaataccctcatgaat

SEQ ID NO: 104673 - DNA, 25 bp, S. pombe
ggaccttctgaaacaccttatgatt

SEQ ID NO: 104674 - DNA, 25 bp, S. pombe
ggaccttcaagcatacggtgatctt

SEQ ID NO: 104675 - DNA, 25 bp, S. pombe
ggaaaattacccttcgtatctgcca

SEQ ID NO: 104676 - DNA, 25 bp, S. pombe
ggcaaacattcctgggtaactcgct

SEQ ID NO: 104677 - DNA, 25 bp, S. pombe
ggaacttgagtacaggaatcccaat

SEQ ID NO: 104678 - DNA, 25 bp, S. pombe
ggacacgggtctaaaagtcaccatt

SEQ ID NO: 104679 - DNA, 25 bp, S. pombe
ggaccgtggttgatattgtcgcgtt

SEQ ID NO: 104680 - DNA, 25 bp, S. pombe
ggaacttggtttgcttctccagaat

SEQ ID NO: 104681 - DNA, 25 bp, S. pombe
ggactttaattccagctttaatctt

SEQ ID NO: 104682 - DNA, 25 bp, S. pombe
ggactccaagttccgtttgattctt

SEQ ID NO: 104683 - DNA, 25 bp, S. pombe
ggacaacaagtattgctgctgctca

SEQ ID NO: 104684 - DNA, 25 bp, S. pombe
ggactttttgctcctactcaacata

SEQ ID NO: 104685 - DNA, 25 bp, S. pombe
ggacgctttgactcatgctgttgaa

SEQ ID NO: 104686 - DNA, 25 bp, S. pombe
ggacgagttcccttcatttgtcaaa

SEQ ID NO: 104687 - DNA, 25 bp, S. pombe
ggactgtttccctcaaattatgtag

SEQ ID NO: 104688 - DNA, 25 bp, S. pombe
ggacttttacgctaccaattcatta

SEQ ID NO: 104689 - DNA, 25 bp, S. pombe
ggacatttgtaccatatgcgaactc

SEQ ID NO: 104690 - DNA, 25 bp, S. pombe
ggaaagcccaatgtccaacatcagc

SEQ ID NO: 104691 - DNA, 25 bp, S. pombe
ggaaaatcgaaagaagacgctgctt

SEQ ID NO: 104692 - DNA, 25 bp, S. pombe
ggacaaaacggcatcgtcgcttctg

SEQ ID NO: 104693 - DNA, 25 bp, S. pombe
ggaaatggccgatgctgtagcacgt

SEQ ID NO: 104694 - DNA, 25 bp, S. pombe
ggaccctactttacctagatcagac

SEQ ID NO: 104695 - DNA, 25 bp, S. pombe
ggaccccattgcattctttgaagaa

SEQ ID NO: 104696 - DNA, 25 bp, S. pombe
ggactcgtcttgatccttattacaa

SEQ ID NO: 104697 - DNA, 25 bp, S. pombe
ggactcctcgtttccttgaggctaa

SEQ ID NO: 104698 - DNA, 25 bp, S. pombe
ggacgccttgtttccttgaaagata

SEQ ID NO: 104699 - DNA, 25 bp, S. pombe
ggaattgcctttctatttttcatgg

SEQ ID NO: 104700 - DNA, 25 bp, S. pombe
ggactagccattgtttctataattg

SEQ ID NO: 104701 - DNA, 25 bp, S. pombe
ggaaaggcttcgtagtctgtcttaa

SEQ ID NO: 104702 - DNA, 25 bp, S. pombe
ggacaccgttcgagatttctttcaa

SEQ ID NO: 104703 - DNA, 25 bp, S. pombe
ggaccgcgatatgtttcttttctaa

SEQ ID NO: 104704 - DNA, 25 bp, S. pombe
ggaccgctcaaggtatccagatttt

SEQ ID NO: 104705 - DNA, 25 bp, S. pombe
ggacgccattaattatccgtttgga

SEQ ID NO: 104706 - DNA, 25 bp, S. pombe
ggacgttctgaggaaccccattgga

SEQ ID NO: 104707 - DNA, 25 bp, S. pombe
ggacacattgtgcttccaagctcct

SEQ ID NO: 104708 - DNA, 25 bp, S. pombe
ggacgcgatttttgcgatatctagc

SEQ ID NO: 104709 - DNA, 25 bp, S. pombe
ggacgagatgtttcactgttatact

SEQ ID NO: 104710 - DNA, 25 bp, S. pombe
ggacatattggtgcttaccttgtgt

SEQ ID NO: 104711 - DNA, 25 bp, S. pombe
ggacaaagtgcataccaatcctgtg

SEQ ID NO: 104712 - DNA, 25 bp, S. pombe
ggacgcatagtctttgctcaacgat

SEQ ID NO: 104713 - DNA, 25 bp, S. pombe
ggacagatagttttgcaagccgaca

SEQ ID NO: 104714 - DNA, 25 bp, S. pombe
ggacgattttgcttctccaggaata

SEQ ID NO: 104715 - DNA, 25 bp, S. pombe
ggactttaatgcttcagccagccaa

SEQ ID NO: 104716 - DNA, 25 bp, S. pombe
ggacagcatccttatgcatcacgag

SEQ ID NO: 104717 - DNA, 25 bp, S. pombe
ggacatgagctgtatattcactggt

SEQ ID NO: 104718 - DNA, 25 bp, S. pombe
ggacatgtctggtcattcagctacg

SEQ ID NO: 104719 - DNA, 25 bp, S. pombe
ggacgacttgatccaacgtagtgat

SEQ ID NO: 104720 - DNA, 25 bp, S. pombe
ggacgacttgttgtctgctcaatat

SEQ ID NO: 104721 - DNA, 25 bp, S. pombe
ggactacattgagtttcttcagcat

SEQ ID NO: 104722 - DNA, 25 bp, S. pombe
ggacatccattacttttcttatgaa

SEQ ID NO: 104723 - DNA, 25 bp, S. pombe
ggacgccattactttgactttaatc

SEQ ID NO: 104724 - DNA, 25 bp, S. pombe
ggcattgtgggataccgcaggtcaa

SEQ ID NO: 104725 - DNA, 25 bp, S. pombe
ggactgggccgcatgaatatcatat

SEQ ID NO: 104726 - DNA, 25 bp, S. pombe
ggacataattcttccgtttactcta

SEQ ID NO: 104727 - DNA, 25 bp, S. pombe
ggaaaagtctgtgttatttgccgca

SEQ ID NO: 104728 - DNA, 25 bp, S. pombe
ggaaaacccttattcaactgccaag

SEQ ID NO: 104729 - DNA, 25 bp, S. pombe
ggaaactgcaggatgtccaacccag

SEQ ID NO: 104730 - DNA, 25 bp, S. pombe
ggacttcaacttatatgtctcctga

SEQ ID NO: 104731 - DNA, 25 bp, S. pombe
ggacttgcacaatcttctatggtta

SEQ ID NO: 104732 - DNA, 25 bp, S. pombe
ggacttgctaaacgtctcatggttc

SEQ ID NO: 104733 - DNA, 25 bp, S. pombe
ggactattgcaataccgcagtggaa

SEQ ID NO: 104734 - DNA, 25 bp, S. pombe
ggaaatagtgacaccctcggcatac

SEQ ID NO: 104735 - DNA, 25 bp, S. pombe
ggacaatgttctcctactgtagcaa

SEQ ID NO: 104736 - DNA, 25 bp, S. pombe
ggactttctacgttttctgatactt

SEQ ID NO: 104737 - DNA, 25 bp, S. pombe
ggacttttccgtatccataagcttc

SEQ ID NO: 104738 - DNA, 25 bp, S. pombe
ggacatcgtccggaactttagtaga

SEQ ID NO: 104739 - DNA, 25 bp, S. pombe
ggaaaacccacgtcgacttgtatga

SEQ ID NO: 104740 - DNA, 25 bp, S. pombe
ggaaactccgacgtcgagtgtttat

SEQ ID NO: 104741 - DNA, 25 bp, S. pombe
ggacagattttctcaggttgttaca

SEQ ID NO: 104742 - DNA, 25 bp, S. pombe
ggacaaattacaagcctaccaacta

SEQ ID NO: 104743 - DNA, 25 bp, S. pombe
ggaaattcccgtggtatgccaactt

SEQ ID NO: 104744 - DNA, 25 bp, S. pombe
ggaaactcactgctgaagagcgcaa

SEQ ID NO: 104745 - DNA, 25 bp, S. pombe
ggacaacgcttctaaatttgcctat

SEQ ID NO: 104746 - DNA, 25 bp, S. pombe
ggaaacgccgtaaatctccacttga

SEQ ID NO: 104747 - DNA, 25 bp, S. pombe
ggaaatccccgaatatatccctcgt

SEQ ID NO: 104748 - DNA, 25 bp, S. pombe
ggacaatctccggagttgtgctttc

SEQ ID NO: 104749 - DNA, 25 bp, S. pombe
ggactgttttataccgtcgtatgca

SEQ ID NO: 104750 - DNA, 25 bp, S. pombe
ggactgtcctttaccgtcgtatgca

SEQ ID NO: 104751 - DNA, 25 bp, S. pombe
ggacgtcccattacacgtttatgtt

SEQ ID NO: 104752 - DNA, 25 bp, S. pombe
ggacgactctagtgcagctggtcta

SEQ ID NO: 104753 - DNA, 25 bp, S. pombe
ggactgcacacttcaagagcttatt

SEQ ID NO: 104754 - DNA, 25 bp, S. pombe
ggacttctgaattgacccattgcaa

SEQ ID NO: 104755 - DNA, 25 bp, S. pombe
ggacttcagagtggagcgcttttga

SEQ ID NO: 104756 - DNA, 25 bp, S. pombe
ggaagtcagtatcatacggcgtgaa

SEQ ID NO: 104757 - DNA, 25 bp, S. pombe
ggaaactttaccgtgagcgtgcaaa

SEQ ID NO: 104758 - DNA, 25 bp, S. pombe
ggaaactgacagatccgagaccgtt

SEQ ID NO: 104759 - DNA, 25 bp, S. pombe
ggaaaaccacttacatgttaccgca

SEQ ID NO: 104760 - DNA, 25 bp, S. pombe
ggaaaacccatgcaagtaaccgaat

SEQ ID NO: 104761 - DNA, 25 bp, S. pombe
ggaagattcgcctcgaaaacgccaa

SEQ ID NO: 104762 - DNA, 25 bp, S. pombe
ggacaattgcccatccaaaacgtag

SEQ ID NO: 104763 - DNA, 25 bp, S. pombe
ggacatcttgcgaaccctatagctt

SEQ ID NO: 104764 - DNA, 25 bp, S. pombe
ggacagtctcttttctttataggca

SEQ ID NO: 104765 - DNA, 25 bp, S. pombe
ggacgtgcctgtgctttacatatta

SEQ ID NO: 104766 - DNA, 25 bp, S. pombe
ggaagttttcctttagatcattttg

SEQ ID NO: 104767 - DNA, 25 bp, S. pombe
ggaagccaatttgtaccacctgcaa

SEQ ID NO: 104768 - DNA, 25 bp, S. pombe
ggacttctagtcctgcatggaactt

SEQ ID NO: 104769 - DNA, 25 bp, S. pombe
ggactatccgtcaactggaagctca

SEQ ID NO: 104770 - DNA, 25 bp, S. pombe
ggactcacctctttaactgtgcata

SEQ ID NO: 104771 - DNA, 25 bp, S. pombe
ggacggtagcgaatctatcggttca

SEQ ID NO: 104772 - DNA, 25 bp, S. pombe
ggactgagataacgtcttctactaa

SEQ ID NO: 104773 - DNA, 25 bp, S. pombe
ggactgcgtcaagcgattctctgaa

SEQ ID NO: 104774 - DNA, 25 bp, S. pombe
ggacatgcttactgttgatctttca

SEQ ID NO: 104775 - DNA, 25 bp, S. pombe
ggactctttgggaatgatgcacttc

SEQ ID NO: 104776 - DNA, 25 bp, S. pombe
ggaaacattcgtgggcaggcagctt

SEQ ID NO: 104777 - DNA, 25 bp, S. pombe
ggaacttgccatgctcgacgaaaat

SEQ ID NO: 104778 - DNA, 25 bp, S. pombe
ggaaacagaggctttattgaatgaa

SEQ ID NO: 104779 - DNA, 25 bp, S. pombe
ggactctacatatttggcatgcgaa

SEQ ID NO: 104780 - DNA, 25 bp, S. pombe
ggactttatggccttggagagcaaa

SEQ ID NO: 104781 - DNA, 25 bp, S. pombe
ggactttgatccgtttgaggcacaa

SEQ ID NO: 104782 - DNA, 25 bp, S. pombe
ggacaagccttgtttcaaacccatg

SEQ ID NO: 104783 - DNA, 25 bp, S. pombe
ggacatcctcttattcaaacccatt

SEQ ID NO: 104784 - DNA, 25 bp, S. pombe
ggactttatcttacagaacgcgttt

SEQ ID NO: 104785 - DNA, 25 bp, S. pombe
ggacaaagctatttcccattcattt

SEQ ID NO: 104786 - DNA, 25 bp, S. pombe
ggacaaagatatgctaccttttcta

SEQ ID NO: 104787 - DNA, 25 bp, S. pombe
ggacaagcattagctcgtttgcgtt

SEQ ID NO: 104788 - DNA, 25 bp, S. pombe
ggaaacacgcggactccttggagaa

SEQ ID NO: 104789 - DNA, 25 bp, S. pombe
ggaaatgctagtacccaacactcaa

SEQ ID NO: 104790 - DNA, 25 bp, S. pombe
ggaaatgtgaagaactccctcccat

SEQ ID NO: 104791 - DNA, 25 bp, S. pombe
ggacacttcaagagtctattccatt

SEQ ID NO: 104792 - DNA, 25 bp, S. pombe
ggacattgacactatcgatgccctt

SEQ ID NO: 104793 - DNA, 25 bp, S. pombe
ggactatgacccagcagcagcgttt

SEQ ID NO: 104794 - DNA, 25 bp, S. pombe
ggacatactacgtatcatccgcatc

SEQ ID NO: 104795 - DNA, 25 bp, S. pombe
ggactcactatggaattcacgctca

SEQ ID NO: 104796 - DNA, 25 bp, S. pombe
ggactcgtcagctcttgcaatgtag

SEQ ID NO: 104797 - DNA, 25 bp, S. pombe
ggacattgctcgtatcttgactgtt

SEQ ID NO: 104798 - DNA, 25 bp, S. pombe
ggaaatgtcggacctcgtcaaatta

SEQ ID NO: 104799 - DNA, 25 bp, S. pombe
ggaaactggaatctcctctaaataa

SEQ ID NO: 104800 - DNA, 25 bp, S. pombe
ggacagatcgaatcttggccacaaa

SEQ ID NO: 104801 - DNA, 25 bp, S. pombe
ggacaaaattgtcttcgcacggcca

SEQ ID NO: 104802 - DNA, 25 bp, S. pombe
ggaaaactaccgtgcttgatgtgat

SEQ ID NO: 104803 - DNA, 25 bp, S. pombe
ggaaaaatccatctatcgatcgtgt

SEQ ID NO: 104804 - DNA, 25 bp, S. pombe
ggaaaaatcattctgccgccatgga

SEQ ID NO: 104805 - DNA, 25 bp, S. pombe
ggaaaggtcatgtagtcacccttat

SEQ ID NO: 104806 - DNA, 25 bp, S. pombe
ggacaagtttcacactctgactgag

SEQ ID NO: 104807 - DNA, 25 bp, S. pombe
ggaaacgagtatcaaccctcaaata

SEQ ID NO: 104808 - DNA, 25 bp, S. pombe
ggaaatttgtccaacccagaccaag

SEQ ID NO: 104809 - DNA, 25 bp, S. pombe
ggaaacttggccaaacatcttcaga

SEQ ID NO: 104810 - DNA, 25 bp, S. pombe
ggaaatctgtgactctacgacttta

SEQ ID NO: 104811 - DNA, 25 bp, S. pombe
ggacaacgtgcctttcaaacattaa

SEQ ID NO: 104812 - DNA, 25 bp, S. pombe
ggacagtcatctacaggattacctt

SEQ ID NO: 104813 - DNA, 25 bp, S. pombe
ggaagtagcactcagaaccctcatt

SEQ ID NO: 104814 - DNA, 25 bp, S. pombe
ggaaatacctggaaatccgctccca

SEQ ID NO: 104815 - DNA, 25 bp, S. pombe
ggaaaacaattcatccgagccccag

SEQ ID NO: 104816 - DNA, 25 bp, S. pombe
ggaaaacgattcatgcttgcccaac

SEQ ID NO: 104817 - DNA, 25 bp, S. pombe
ggaaaaagtggctcctgactcaaat

SEQ ID NO: 104818 - DNA, 25 bp, S. pombe
ggaaaatttggcgtctctaaactat

SEQ ID NO: 104819 - DNA, 25 bp, S. pombe
ggaaatgcatcacggagctctttac

SEQ ID NO: 104820 - DNA, 25 bp, S. pombe
ggacacgcgatcagatgttgtttca

SEQ ID NO: 104821 - DNA, 25 bp, S. pombe
ggaaagtgattctacagccccagag

SEQ ID NO: 104822 - DNA, 25 bp, S. pombe
ggaaatgctttggaccgatccacaa

SEQ ID NO: 104823 - DNA, 25 bp, S. pombe
ggaaaatttaatatctcagctacag

SEQ ID NO: 104824 - DNA, 25 bp, S. pombe
ggaaaatgatttagtcgctgcccga

SEQ ID NO: 104825 - DNA, 25 bp, S. pombe
ggacaaatggttagcttctgccctc

SEQ ID NO: 104826 - DNA, 25 bp, S. pombe
ggaactatcctagtgtttcacgtgt

SEQ ID NO: 104827 - DNA, 25 bp, S. pombe
ggaacattaactcctttgaccaatt

SEQ ID NO: 104828 - DNA, 25 bp, S. pombe
ggcagcccgaacttttctggaaaca

SEQ ID NO: 104829 - DNA, 25 bp, S. pombe
ggaacggttcagctacctataacta

SEQ ID NO: 104830 - DNA, 25 bp, S. pombe
ggaaacttgtacaccgatagctaaa

SEQ ID NO: 104831 - DNA, 25 bp, S. pombe
ggaaactatatgatcctcgtgcagt

SEQ ID NO: 104832 - DNA, 25 bp, S. pombe
ggacatactcctcaattccatggta

SEQ ID NO: 104833 - DNA, 25 bp, S. pombe
ggacaactacgttcgaagctgcgca

SEQ ID NO: 104834 - DNA, 25 bp, S. pombe
ggacacaatcatttccttgggactg

SEQ ID NO: 104835 - DNA, 25 bp, S. pombe
ggaacagattctctcgctggtgatc

SEQ ID NO: 104836 - DNA, 25 bp, S. pombe
ggaaaatgttattcgtgatgctgtc

SEQ ID NO: 104837 - DNA, 25 bp, S. pombe
ggaaaatgttattcgtgatgctgtc

SEQ ID NO: 104838 - DNA, 25 bp, S. pombe
ggacactgtggttttggatgctgat

SEQ ID NO: 104839 - DNA, 25 bp, S. pombe
ggacatgcacctaacgttacatcag

SEQ ID NO: 104840 - DNA, 25 bp, S. pombe
ggacaaacagcattggcttacgcca

SEQ ID NO: 104841 - DNA, 25 bp, S. pombe
ggacaacacgattttcaacactgca

SEQ ID NO: 104842 - DNA, 25 bp, S. pombe
ggaagatcgccttttaactctgcag

SEQ ID NO: 104843 - DNA, 25 bp, S. pombe
tccaacgtcttacttaacttcctgt

SEQ ID NO: 104844 - DNA, 25 bp, S. pombe
ggacacgtatctcgtttacttggta

SEQ ID NO: 104845 - DNA, 25 bp, S. pombe
ggacattaatccttctttattcgat

SEQ ID NO: 104846 - DNA, 25 bp, S. pombe
ggaactagcactcctcgaatggctg

SEQ ID NO: 104847 - DNA, 25 bp, S. pombe
ggacaagagcacctctcaagaggct

SEQ ID NO: 104848 - DNA, 25 bp, S. pombe
ggacagcgtcattcgtgtcgatcaa

SEQ ID NO: 104849 - DNA, 25 bp, S. pombe
ggaacccgttgaactgctcattgat

SEQ ID NO: 104850 - DNA, 25 bp, S. pombe
ggcagccaaggcaatttccgacgtt

SEQ ID NO: 104851 - DNA, 25 bp, S. pombe
ggaacaagtgtttacgcggcctcta

SEQ ID NO: 104852 - DNA, 25 bp, S. pombe
ggaaatgttaattgcggcttgccgc

SEQ ID NO: 104853 - DNA, 25 bp, S. pombe
ggacatttcaaaactcccgtatgag

SEQ ID NO: 104854 - DNA, 25 bp, S. pombe
ggaagaccaaaaatcccgaatctga

SEQ ID NO: 104855 - DNA, 25 bp, S. pombe
ggacaccaattctagcggttgcttc

SEQ ID NO: 104856 - DNA, 25 bp, S. pombe
ggacaactggacttggactatgcat

SEQ ID NO: 104857 - DNA, 25 bp, S. pombe
ggacaaccttctcgtgatgctagat

SEQ ID NO: 104858 - DNA, 25 bp, S. pombe
ggaaccttgttcatggcttaatact

SEQ ID NO: 104859 - DNA, 25 bp, S. pombe
ggacacatgcagtttcttactgtag

SEQ ID NO: 104860 - DNA, 25 bp, S. pombe
ggaaattgcttcttacctgtcaact

SEQ ID NO: 104861 - DNA, 25 bp, S. pombe
ggaaattctccaccatcctttgatt

SEQ ID NO: 104862 - DNA, 25 bp, S. pombe
ggaatctttcccgtcaattatgtgc

SEQ ID NO: 104863 - DNA, 25 bp, S. pombe
ggaacttctcatcccttaatggacg

SEQ ID NO: 104864 - DNA, 25 bp, S. pombe
ggaacgtccacttgctgtattagaa

SEQ ID NO: 104865 - DNA, 25 bp, S. pombe
ggaatcgacgcctgttgttacaaaa

SEQ ID NO: 104866 - DNA, 25 bp, S. pombe
ggaaacagtatcctctcacttgata

SEQ ID NO: 104867 - DNA, 25 bp, S. pombe
ggaagtaattcctgccattgcatac

SEQ ID NO: 104868 - DNA, 25 bp, S. pombe
ggaacgtaacaaatcctttgcattt

SEQ ID NO: 104869 - DNA, 25 bp, S. pombe
ggaactcgaaaaacgcttggctact

SEQ ID NO: 104870 - DNA, 25 bp, S. pombe
ggaaccgcaatttacgctttttgct

SEQ ID NO: 104871 - DNA, 25 bp, S. pombe
ggacacctgtcatacatttgctgca

SEQ ID NO: 104872 - DNA, 25 bp, S. pombe
ggacacactctgtgagatgtgctta

SEQ ID NO: 104873 - DNA, 25 bp, S. pombe
ggaacagtgtattcagtatcttcat

SEQ ID NO: 104874 - DNA, 25 bp, S. pombe
ggaaaggtattcatatctcattaaa

SEQ ID NO: 104875 - DNA, 25 bp, S. pombe
ggaaacgtggaattgcggcttctca

SEQ ID NO: 104876 - DNA, 25 bp, S. pombe
ggaaaccgaaagtcatggcatgcct

SEQ ID NO: 104877 - DNA, 25 bp, S. pombe
ggaattcgcgattagtgcatctgat

SEQ ID NO: 104878 - DNA, 25 bp, S. pombe
ggacatgctgtccataacgatctca

SEQ ID NO: 104879 - DNA, 25 bp, S. pombe
ggacatgctcatttatcacaactaa

SEQ ID NO: 104880 - DNA, 25 bp, S. pombe
ggacatgtcaaatccgccgatagaa

SEQ ID NO: 104881 - DNA, 25 bp, S. pombe
ggaaagaccattgctgcctatacat

SEQ ID NO: 104882 - DNA, 25 bp, S. pombe
ggaaagctcgcattactactctatc

SEQ ID NO: 104883 - DNA, 25 bp, S. pombe
ggaaagtcgctgaaggctcctacca

SEQ ID NO: 104884 - DNA, 25 bp, S. pombe
ggaaacgtacagtgcacttcacaac

SEQ ID NO: 104885 - DNA, 25 bp, S. pombe
ggaatacttatgttacatccccaac

SEQ ID NO: 104886 - DNA, 25 bp, S. pombe
ggaaacttaggtactggctctcaga

SEQ ID NO: 104887 - DNA, 25 bp, S. pombe
ggaaatgcctcaaatagtaccacga

SEQ ID NO: 104888 - DNA, 25 bp, S. pombe
ggaaaattcttctgctagatcacta

SEQ ID NO: 104889 - DNA, 25 bp, S. pombe
ggaaatttgtttgccgatcgctatt

SEQ ID NO: 104890 - DNA, 25 bp, S. pombe
ggaacattgtttctcgaacctatat

SEQ ID NO: 104891 - DNA, 25 bp, S. pombe
ggaaattctttttggatgctcctaa

SEQ ID NO: 104892 - DNA, 25 bp, S. pombe
ggaaattctttatcgttacttgcaa

SEQ ID NO: 104893 - DNA, 25 bp, S. pombe
ggaaatttgttatgctttgcccgat

SEQ ID NO: 104894 - DNA, 25 bp, S. pombe
ggaaaattgcctttgcttcctttct

SEQ ID NO: 104895 - DNA, 25 bp, S. pombe
ggcaagggtcatcgtttcaacaact

SEQ ID NO: 104896 - DNA, 25 bp, S. pombe
ggaacgcccagtgtatcaaagtctt

SEQ ID NO: 104897 - DNA, 25 bp, S. pombe
ggaaacccagtcttacaaatggatt

SEQ ID NO: 104898 - DNA, 25 bp, S. pombe
ggaaatactattgtgcactgctctg

SEQ ID NO: 104899 - DNA, 25 bp, S. pombe
ggaaatttctgctaccatccgtaac

SEQ ID NO: 104900 - DNA, 25 bp, S. pombe
ggaaattcttcaagccgagcgctac

SEQ ID NO: 104901 - DNA, 25 bp, S. pombe
ggaaattctctattcatcgatcgca

SEQ ID NO: 104902 - DNA, 25 bp, S. pombe
ggaagttttcagtctcgtctgcaat

SEQ ID NO: 104903 - DNA, 25 bp, S. pombe
ggaaggaatcaagcacgtctctagt

SEQ ID NO: 104904 - DNA, 25 bp, S. pombe
ggaaggagacgtcccattcatcttt

SEQ ID NO: 104905 - DNA, 25 bp, S. pombe
ggaaattccctgaaggcgcatttat

SEQ ID NO: 104906 - DNA, 25 bp, S. pombe
ggaaatccccagtgcagatgacttt

SEQ ID NO: 104907 - DNA, 25 bp, S. pombe
ggaataccatccgttagcatacctt

SEQ ID NO: 104908 - DNA, 25 bp, S. pombe
ggaaacaagctccagttcaagcccg

SEQ ID NO: 104909 - DNA, 25 bp, S. pombe
ggaactcatcaattcgtttataccg

SEQ ID NO: 104910 - DNA, 25 bp, S. pombe
ggaaccagcaagtcgtgcttattct

SEQ ID NO: 104911 - DNA, 25 bp, S. pombe
ggcagctcgagaggaaggttcatct

SEQ ID NO: 104912 - DNA, 25 bp, S. pombe
ggaacctggattaatcggaataagc

SEQ ID NO: 104913 - DNA, 25 bp, S. pombe
ggcatacgaggatttacgacgcaaa

SEQ ID NO: 104914 - DNA, 25 bp, S. pombe
ggaatctggcagtttcgatgaacta

SEQ ID NO: 104915 - DNA, 25 bp, S. pombe
ggaaccttgttctgcatgggatatt

SEQ ID NO: 104916 - DNA, 25 bp, S. pombe
ggaaagcctgttttgaccactaatg

SEQ ID NO: 104917 - DNA, 25 bp, S. pombe
ggaagcacggtcattaccctatttg

SEQ ID NO: 104918 - DNA, 25 bp, S. pombe
ggaacacgtccttgatgtttttcat

SEQ ID NO: 104919 - DNA, 25 bp, S. pombe
ggacacttcttccatttgcttttgg

SEQ ID NO: 104920 - DNA, 25 bp, S. pombe
ggaaaaatatcacccagctggcctc

SEQ ID NO: 104921 - DNA, 25 bp, S. pombe
ggaaacaatcgcaaggcactcggtt

SEQ ID NO: 104922 - DNA, 25 bp, S. pombe
ggacaaaatcctacgctggctgaga

SEQ ID NO: 104923 - DNA, 25 bp, S. pombe
ggaaatattcctagcgcttgtagaa

SEQ ID NO: 104924 - DNA, 25 bp, S. pombe
ggaaatttcctgaagctctgaactc

SEQ ID NO: 104925 - DNA, 25 bp, S. pombe
ggaacacttacgatgattgctactc

SEQ ID NO: 104926 - DNA, 25 bp, S. pombe
ggaaacatcgccatccaggcaattt

SEQ ID NO: 104927 - DNA, 25 bp, S. pombe
ggaaacctcttgtcattgagcaaat

SEQ ID NO: 104928 - DNA, 25 bp, S. pombe
ggaatacccatgactattgacacgt

SEQ ID NO: 104929 - DNA, 25 bp, S. pombe
ggaaatgaacattgctaccccacat

SEQ ID NO: 104930 - DNA, 25 bp, S. pombe
ggaaataccattcgactggctcctt

SEQ ID NO: 104931 - DNA, 25 bp, S. pombe
ggaaatccgcttccacaagtggttc

SEQ ID NO: 104932 - DNA, 25 bp, S. pombe
ggaatctccattcgcaaaaacggca

SEQ ID NO: 104933 - DNA, 25 bp, S. pombe
ggaattgctggacgaaaccacgcgt

SEQ ID NO: 104934 - DNA, 25 bp, S. pombe
ggcaaaattactttcactccaggag

SEQ ID NO: 104935 - DNA, 25 bp, S. pombe
ggacaagagcgaaatccctccaggt

SEQ ID NO: 104936 - DNA, 25 bp, S. pombe
ggacaagtcgaacaactcacaggtt

SEQ ID NO: 104937 - DNA, 25 bp, S. pombe
ggaacgggccactaacaatctggtt

SEQ ID NO: 104938 - DNA, 25 bp, S. pombe
ggaacttgccagacacaacaacgtt

SEQ ID NO: 104939 - DNA, 25 bp, S. pombe
ggaagcttcgtgacctacaagagca

SEQ ID NO: 104940 - DNA, 25 bp, S. pombe
ggcggtagcgctggtgaaatatcaa

SEQ ID NO: 104941 - DNA, 25 bp, S. pombe
ggaaagttgccctctatcaatgaaa

SEQ ID NO: 104942 - DNA, 25 bp, S. pombe
ggaatgtttccctcctgaatacaaa

SEQ ID NO: 104943 - DNA, 25 bp, S. pombe
ggaaatttcccatttctatgttcca

SEQ ID NO: 104944 - DNA, 25 bp, S. pombe
ggaaattcctcctattgctattaaa

SEQ ID NO: 104945 - DNA, 25 bp, S. pombe
ggaaacacaccttttgcatttcacc

SEQ ID NO: 104946 - DNA, 25 bp, S. pombe
ggaaatgctaactgccaatttgttt

SEQ ID NO: 104947 - DNA, 25 bp, S. pombe
ggaactcgtagaagcttacgctaat

SEQ ID NO: 104948 - DNA, 25 bp, S. pombe
ggaaccaaagctacttggcctctat

SEQ ID NO: 104949 - DNA, 25 bp, S. pombe
ggaaacacagtcgacttgccgttac

SEQ ID NO: 104950 - DNA, 25 bp, S. pombe
ggaactctacccttggatcttggag

SEQ ID NO: 104951 - DNA, 25 bp, S. pombe
ggaacgcctttttgattcggttgat

SEQ ID NO: 104952 - DNA, 25 bp, S. pombe
ggaaatcacttaattgtcgcggttg

SEQ ID NO: 104953 - DNA, 25 bp, S. pombe
ggaaatgacgctatatccgtggata

SEQ ID NO: 104954 - DNA, 25 bp, S. pombe
ggaaatgatccacgagtgccctaga

SEQ ID NO: 104955 - DNA, 25 bp, S. pombe
ggaagctcttcaacatttataccag

SEQ ID NO: 104956 - DNA, 25 bp, S. pombe
ggaaatgttcgtttaccatcaagta

SEQ ID NO: 104957 - DNA, 25 bp, S. pombe
ggaaatttccaatactcttagtcgg

SEQ ID NO: 104958 - DNA, 25 bp, S. pombe
ggaacagcttcgcaatcctgaggat

SEQ ID NO: 104959 - DNA, 25 bp, S. pombe
ggaacagctactacaacttgaggaa

SEQ ID NO: 104960 - DNA, 25 bp, S. pombe
ggaaatgcccaagttgattgctgaa

SEQ ID NO: 104961 - DNA, 25 bp, S. pombe
ggaaagcctcaaacttcatcgtgaa

SEQ ID NO: 104962 - DNA, 25 bp, S. pombe
ggaaatcctctatcaagtgcctttg

SEQ ID NO: 104963 - DNA, 25 bp, S. pombe
ggaaatctcttatgggtctcttata

SEQ ID NO: 104964 - DNA, 25 bp, S. pombe
ggaacgttcgtagagaccataacca

SEQ ID NO: 104965 - DNA, 25 bp, S. pombe
ggaaagccatccacttctgaatctt

SEQ ID NO: 104966 - DNA, 25 bp, S. pombe
ggaaatcgcacctggtctcaagctt

SEQ ID NO: 104967 - DNA, 25 bp, S. pombe
ggaactattggctggttgccctaat

SEQ ID NO: 104968 - DNA, 25 bp, S. pombe
ggaacttcaatctaagctttctgag

SEQ ID NO: 104969 - DNA, 25 bp, S. pombe
ggaaaagacgctgccttagctcaaa

SEQ ID NO: 104970 - DNA, 25 bp, S. pombe
ggaaatcgactctccttattcagct

SEQ ID NO: 104971 - DNA, 25 bp, S. pombe
ggaaatgtcctaaccatagcgatca

SEQ ID NO: 104972 - DNA, 25 bp, S. pombe
ggcaaaatacttctaacatgcaggg

SEQ ID NO: 104973 - DNA, 25 bp, S. pombe
ggaacacaccttctacatatgggca

SEQ ID NO: 104974 - DNA, 25 bp, S. pombe
ggaaatcgcttcagcttcaaacacc

SEQ ID NO: 104975 - DNA, 25 bp, S. pombe
ggaattggcaacctgttccaaccca

SEQ ID NO: 104976 - DNA, 25 bp, S. pombe
ggaattgctatcgagtctgaaactg

SEQ ID NO: 104977 - DNA, 25 bp, S. pombe
ggaactctacccttgaaactgcaaa

SEQ ID NO: 104978 - DNA, 25 bp, S. pombe
ggaacctacggctgatgacaatcta

SEQ ID NO: 104979 - DNA, 25 bp, S. pombe
ggcggttacaccttggagaactatt

SEQ ID NO: 104980 - DNA, 25 bp, S. pombe
ggccgttaccctatagaactcatta

SEQ ID NO: 104981 - DNA, 25 bp, S. pombe
ggcgaatccccgaaaaaagctgctt

SEQ ID NO: 104982 - DNA, 25 bp, S. pombe
ggaaatccacccaaaccaattggct

SEQ ID NO: 104983 - DNA, 25 bp, S. pombe
ggaaaccaccgcgaacttgatattg

SEQ ID NO: 104984 - DNA, 25 bp, S. pombe
ggaagtaccaccgaagttgctcagc

SEQ ID NO: 104985 - DNA, 25 bp, S. pombe
ggaaaatctcccgatagtttcgata

SEQ ID NO: 104986 - DNA, 25 bp, S. pombe
ggaaaatgtcccgtactagtagcaa

SEQ ID NO: 104987 - DNA, 25 bp, S. pombe
ggaacttttaccaagctggctataa

SEQ ID NO: 104988 - DNA, 25 bp, S. pombe
ggcaattctaaaccgctaatgcaag

SEQ ID NO: 104989 - DNA, 25 bp, S. pombe
ggaacgcctactatggacgattttt

SEQ ID NO: 104990 - DNA, 25 bp, S. pombe
ggaaagcgtcctatgcaaatttatt

SEQ ID NO: 104991 - DNA, 25 bp, S. pombe
ggaattggtcttgaacgtctcgcaa

SEQ ID NO: 104992 - DNA, 25 bp, S. pombe
ggaagtttgtcgtgagctcgttcaa

SEQ ID NO: 104993 - DNA, 25 bp, S. pombe
ggaaagcatttcacgaagctcttga

SEQ ID NO: 104994 - DNA, 25 bp, S. pombe
ggaacagcttgtaactgaacttctt

SEQ ID NO: 104995 - DNA, 25 bp, S. pombe
ggaactgtttatttgcaagccggtg

SEQ ID NO: 104996 - DNA, 25 bp, S. pombe
ggaacttgctgtattaggcgctaat

SEQ ID NO: 104997 - DNA, 25 bp, S. pombe
ggaagtcgactttctaaggctattt

SEQ ID NO: 104998 - DNA, 25 bp, S. pombe
ggaagctcgcctgacgaagttttat

SEQ ID NO: 104999 - DNA, 25 bp, S. pombe
taacttctcagggacgtcgtttttg

SEQ ID NO: 105000 - DNA, 25 bp, S. pombe
ggctttatagctggtcgtcgatttc

SEQ ID NO: 105001 - DNA, 25 bp, S. pombe
ggaacgtgatgctgttatcggtcat

SEQ ID NO: 105002 - DNA, 25 bp, S. pombe
ggcacccctgtaggagacgctgtaa

SEQ ID NO: 105003 - DNA, 25 bp, S. pombe
ggaagacttggtatctagcatcgat

SEQ ID NO: 105004 - DNA, 25 bp, S. pombe
ggaaccttggaaatttatctgactt

SEQ ID NO: 105005 - DNA, 25 bp, S. pombe
ggaactcttctgataacattgctga

SEQ ID NO: 105006 - DNA, 25 bp, S. pombe
ggaacagctgtcaagcccaaactta

SEQ ID NO: 105007 - DNA, 25 bp, S. pombe
ggaagaatcccaagtttagcagaag

SEQ ID NO: 105008 - DNA, 25 bp, S. pombe
ggaagctttgcctgttgaacgaaga

SEQ ID NO: 105009 - DNA, 25 bp, S. pombe
ggaacagattccttagcacaagcaa

SEQ ID NO: 105010 - DNA, 25 bp, S. pombe
ggaaactcagacttatactcccgtt

SEQ ID NO: 105011 - DNA, 25 bp, S. pombe
ggaacctgaagctgaacccaagtct

SEQ ID NO: 105012 - DNA, 25 bp, S. pombe
ggaatcctgcaacgagttcaccgat

SEQ ID NO: 105013 - DNA, 25 bp, S. pombe
ggaactcgagaattccctatcgata

SEQ ID NO: 105014 - DNA, 25 bp, S. pombe
ggaacagttagatcagcctcacgaa

SEQ ID NO: 105015 - DNA, 25 bp, S. pombe
ggaaacatgtcaatccagctctcct

SEQ ID NO: 105016 - DNA, 25 bp, S. pombe
ggaaagcctgctgccgctgttgctg

SEQ ID NO: 105017 - DNA, 25 bp, S. pombe
ggaaagcctgctgccgctgttgctg

SEQ ID NO: 105018 - DNA, 25 bp, S. pombe
ggaacaactgctggtactgtcctaa

SEQ ID NO: 105019 - DNA, 25 bp, S. pombe
ggaacaacttggtcagcagatactt

SEQ ID NO: 105020 - DNA, 25 bp, S. pombe
ggaaaacttgattcgagaggcccaa

SEQ ID NO: 105021 - DNA, 25 bp, S. pombe
ggaaccgtcgattcttacgcgtgaa

SEQ ID NO: 105022 - DNA, 25 bp, S. pombe
ggaaaccactctttatacgctggaa

SEQ ID NO: 105023 - DNA, 25 bp, S. pombe
ggaacatccacagcattcaactggt

SEQ ID NO: 105024 - DNA, 25 bp, S. pombe
ggaacaaactcttctacgtcgacat

SEQ ID NO: 105025 - DNA, 25 bp, S. pombe
ggaaaaccatttacgatctgcaaaa

SEQ ID NO: 105026 - DNA, 25 bp, S. pombe
ggaaaatttgcacccgactctaaag

SEQ ID NO: 105027 - DNA, 25 bp, S. pombe
ggaagcaccccgctgtagacaaaat

SEQ ID NO: 105028 - DNA, 25 bp, S. pombe
ggaagatgttgctcgttgcccaagc

SEQ ID NO: 105029 - DNA, 25 bp, S. pombe
ggaacagtctgttcgtgcaccacca

SEQ ID NO: 105030 - DNA, 25 bp, S. pombe
ggaagactctttgttcgtggagaca

SEQ ID NO: 105031 - DNA, 25 bp, S. pombe
ggaacagcatctcgttttcgtagac

SEQ ID NO: 105032 - DNA, 25 bp, S. pombe
ggaacataccagttattcgtcaagt

SEQ ID NO: 105033 - DNA, 25 bp, S. pombe
ggaaaagccatgtcttcacctgaag

SEQ ID NO: 105034 - DNA, 25 bp, S. pombe
ggaaggctccttgcgagtatacaag

SEQ ID NO: 105035 - DNA, 25 bp, S. pombe
ggaaacctctttcactaacagatgc

SEQ ID NO: 105036 - DNA, 25 bp, S. pombe
ggaaaaacttgtcgactgcagccct

SEQ ID NO: 105037 - DNA, 25 bp, S. pombe
ggaaacatagcttctcgacctgtta

SEQ ID NO: 105038 - DNA, 25 bp, S. pombe
ggaatggattcctgttacgattaaa

SEQ ID NO: 105039 - DNA, 25 bp, S. pombe
ggaagtggatacagcaactcctccc

SEQ ID NO: 105040 - DNA, 25 bp, S. pombe
ggaacttgatcattaccgcgcaatc

SEQ ID NO: 105041 - DNA, 25 bp, S. pombe
ggaaaaccgcaaagctattcatcaa

SEQ ID NO: 105042 - DNA, 25 bp, S. pombe
ggaagaatcctaccctaactcaagt

SEQ ID NO: 105043 - DNA, 25 bp, S. pombe
ggaacagtactatctctgcatgact

SEQ ID NO: 105044 - DNA, 25 bp, S. pombe
ggaatggctcgattcatgcgatata

SEQ ID NO: 105045 - DNA, 25 bp, S. pombe
ggaagacactatcgcatgcatacat

SEQ ID NO: 105046 - DNA, 25 bp, S. pombe
ggaagcaatgcttctgcatctgcgt

SEQ ID NO: 105047 - DNA, 25 bp, S. pombe
ggaacaattacatctcagtcccaat

SEQ ID NO: 105048 - DNA, 25 bp, S. pombe
ggaagttgaatcgaccccaggatat

SEQ ID NO: 105049 - DNA, 25 bp, S. pombe
ggaacttgctaacaccgatcatgaa

SEQ ID NO: 105050 - DNA, 25 bp, S. pombe
ggaaaattcgtcttcgtctaaagca

SEQ ID NO: 105051 - DNA, 25 bp, S. pombe
ggaacacttggttctcgttcgagaa

SEQ ID NO: 105052 - DNA, 25 bp, S. pombe
ggaaaatgggtctacgtatcgtgga

SEQ ID NO: 105053 - DNA, 25 bp, S. pombe
ggaacttgcaagacattcggtcgga

SEQ ID NO: 105054 - DNA, 25 bp, S. pombe
ggaagccgagcagttgagccgtaaa

SEQ ID NO: 105055 - DNA, 25 bp, S. pombe
ggaactactttatctcctgttgcag

SEQ ID NO: 105056 - DNA, 25 bp, S. pombe
ggaactgacatttacgttgcttagt

SEQ ID NO: 105057 - DNA, 25 bp, S. pombe
ggaacttatccattcgttaccagct

SEQ ID NO: 105058 - DNA, 25 bp, S. pombe
ggaacgtgatgcaccgtcaaaattc

SEQ ID NO: 105059 - DNA, 25 bp, S. pombe
ggcaacgtgctatggattccgaaac

SEQ ID NO: 105060 - DNA, 25 bp, S. pombe
ggaacaccgaacaaactcatgagct

SEQ ID NO: 105061 - DNA, 25 bp, S. pombe
ggaagcatccgagcagcaatcctta

SEQ ID NO: 105062 - DNA, 25 bp, S. pombe
ggaagtccttcgtcaacgtattagt

SEQ ID NO: 105063 - DNA, 25 bp, S. pombe
ggaatacagtctcttcagcttggct

SEQ ID NO: 105064 - DNA, 25 bp, S. pombe
ggaaaagtcccgatgcagatggcat

SEQ ID NO: 105065 - DNA, 25 bp, S. pombe
ggaaaaaccacttctgcacatggaa

SEQ ID NO: 105066 - DNA, 25 bp, S. pombe
ggaaaaagcttctgctcctgagcga

SEQ ID NO: 105067 - DNA, 25 bp, S. pombe
ggaagcaaactgtacctactactga

SEQ ID NO: 105068 - DNA, 25 bp, S. pombe
ggaagcctacgttcgttctgactgg

SEQ ID NO: 105069 - DNA, 25 bp, S. pombe
ggaacaagcttgatttactgatgat

SEQ ID NO: 105070 - DNA, 25 bp, S. pombe
ggaatctcatgttgcgaattgtcta

SEQ ID NO: 105071 - DNA, 25 bp, S. pombe
ggaacaagttgctcagtcgcatcaa

SEQ ID NO: 105072 - DNA, 25 bp, S. pombe
ggaactagattatatgagccacatt

SEQ ID NO: 105073 - DNA, 25 bp, S. pombe
ggaacaaattccctcatacgcagat

SEQ ID NO: 105074 - DNA, 25 bp, S. pombe
ggaattactgcttcgatgtacactg

SEQ ID NO: 105075 - DNA, 25 bp, S. pombe
ggaaaactgcattggctgccacgat

SEQ ID NO: 105076 - DNA, 25 bp, S. pombe
ggaaaatggcatcgcagctcaacta

SEQ ID NO: 105077 - DNA, 25 bp, S. pombe
ggaatcgctactaaattgactcaag

SEQ ID NO: 105078 - DNA, 25 bp, S. pombe
tggaaaaacggcattacagtcagat

SEQ ID NO: 105079 - DNA, 25 bp, S. pombe
ggaatcaatgcaccgtctgttttaa

SEQ ID NO: 105080 - DNA, 25 bp, S. pombe
ggcacaagaacacgaggcacatatg

SEQ ID NO: 105081 - DNA, 25 bp, S. pombe
ggcaaagatcattctacgctcctta

SEQ ID NO: 105082 - DNA, 25 bp, S. pombe
ggcacaaaatattcccttcctaagc

SEQ ID NO: 105083 - DNA, 25 bp, S. pombe
ggaagacaatatctctttgccaagt

SEQ ID NO: 105084 - DNA, 25 bp, S. pombe
ggaacaactttttggcggagctttg

SEQ ID NO: 105085 - DNA, 25 bp, S. pombe
ggaactattcatttacagctgtcgt

SEQ ID NO: 105086 - DNA, 25 bp, S. pombe
ggaacgcgcggatttgcttgccaaa

SEQ ID NO: 105087 - DNA, 25 bp, S. pombe
ggaacaacaaattccctctactgtt

SEQ ID NO: 105088 - DNA, 25 bp, S. pombe
ggaacaagcctacgcagagtgctat

SEQ ID NO: 105089 - DNA, 25 bp, S. pombe
ggaacagcagctaccacaattttaa

SEQ ID NO: 105090 - DNA, 25 bp, S. pombe
ggaactctccccattttgataacag

SEQ ID NO: 105091 - DNA, 25 bp, S. pombe
ggaagccactgcaatctgaagggat

SEQ ID NO: 105092 - DNA, 25 bp, S. pombe
ggaactgcacgattctatactggag

SEQ ID NO: 105093 - DNA, 25 bp, S. pombe
ggcaagccaaggtctcatacgtaga

SEQ ID NO: 105094 - DNA, 25 bp, S. pombe
ggaaccaaagcttattcgtctgcat

SEQ ID NO: 105095 - DNA, 25 bp, S. pombe
ggcaactatcgagcccttatcagat

SEQ ID NO: 105096 - DNA, 25 bp, S. pombe
ggaacattcatcaacgccagcaagc

SEQ ID NO: 105097 - DNA, 25 bp, S. pombe
ggaacattgcatgaagctccttcta

SEQ ID NO: 105098 - DNA, 25 bp, S. pombe
ggaacatgtcttcaccaatcttcaa

SEQ ID NO: 105099 - DNA, 25 bp, S. pombe
ggaactctttgtgccaatgtctttg

SEQ ID NO: 105100 - DNA, 25 bp, S. pombe
ggaactgatcctctattgcgttata

SEQ ID NO: 105101 - DNA, 25 bp, S. pombe
ggaagctactcatatgtgcatggtt

SEQ ID NO: 105102 - DNA, 25 bp, S. pombe
ggaagctacttactgtcttatttag

SEQ ID NO: 105103 - DNA, 25 bp, S. pombe
ggaagattaacgctgcactttcaga

SEQ ID NO: 105104 - DNA, 25 bp, S. pombe
ggaacatcaaactctcacttatcaa

SEQ ID NO: 105105 - DNA, 25 bp, S. pombe
ggaatctaagcctcaacttactgga

SEQ ID NO: 105106 - DNA, 25 bp, S. pombe
ggaacttagttaccagctcgcatag

SEQ ID NO: 105107 - DNA, 25 bp, S. pombe
ggaactctattttccagcctaatgg

SEQ ID NO: 105108 - DNA, 25 bp, S. pombe
ggaactcttgcaactagtacggctt

SEQ ID NO: 105109 - DNA, 25 bp, S. pombe
ggaactgcttatgccactttgcgtg

SEQ ID NO: 105110 - DNA, 25 bp, S. pombe
ggaactcattagtccatttcttgag

SEQ ID NO: 105111 - DNA, 25 bp, S. pombe
ggaaccaccaagttcatcgctatac

SEQ ID NO: 105112 - DNA, 25 bp, S. pombe
ggaacacccagacgtatgcactgat

SEQ ID NO: 105113 - DNA, 25 bp, S. pombe
ggaagcacaggccatcgatcgtatt

SEQ ID NO: 105114 - DNA, 25 bp, S. pombe
ggaagcccgaattgcagcggcactt

SEQ ID NO: 105115 - DNA, 25 bp, S. pombe
ggaatggttcctttgtgtcatagtt

SEQ ID NO: 105116 - DNA, 25 bp, S. pombe
ggaagaatgctagcggtgctccttt

SEQ ID NO: 105117 - DNA, 25 bp, S. pombe
ggaagtcgtggctctttgtcaggaa

SEQ ID NO: 105118 - DNA, 25 bp, S. pombe
ggaagtcgttcgagctttcactcaa

SEQ ID NO: 105119 - DNA, 25 bp, S. pombe
ggaaccatttcgtactttgaatcat

SEQ ID NO: 105120 - DNA, 25 bp, S. pombe
ggaacctttgcgtattgtgcgtcaa

SEQ ID NO: 105121 - DNA, 25 bp, S. pombe
ggaaggtcttggtatgcttggtcaa

SEQ ID NO: 105122 - DNA, 25 bp, S. pombe
ggaagctgatttcttttggtctgaa

SEQ ID NO: 105123 - DNA, 25 bp, S. pombe
ggaagcttattccattcattttcaa

SEQ ID NO: 105124 - DNA, 25 bp, S. pombe
ggaagtttggcgacagtgttctcaa

SEQ ID NO: 105125 - DNA, 25 bp, S. pombe
ggaatgatttgtgccggtaccctta

SEQ ID NO: 105126 - DNA, 25 bp, S. pombe
ggaatacttggttcttcaacaactt

SEQ ID NO: 105127 - DNA, 25 bp, S. pombe
ggaatacttatctcctgaagcaccc

SEQ ID NO: 105128 - DNA, 25 bp, S. pombe
ggaagccttgatgaccagaacctat

SEQ ID NO: 105129 - DNA, 25 bp, S. pombe
ggaagctacgtaccaaggcaacatt

SEQ ID NO: 105130 - DNA, 25 bp, S. pombe
ggaagctattcgaaacgccaacatt

SEQ ID NO: 105131 - DNA, 25 bp, S. pombe
ggaactttcctatttgcaagactat

SEQ ID NO: 105132 - DNA, 25 bp, S. pombe
ggaactttctctaatagcacccatg

SEQ ID NO: 105133 - DNA, 25 bp, S. pombe
ggaacttcttcttattcccatcatg

SEQ ID NO: 105134 - DNA, 25 bp, S. pombe
ggaagtttctgtttctcgaagtcat

SEQ ID NO: 105135 - DNA, 25 bp, S. pombe
ggaagttatattctctccaagcata

SEQ ID NO: 105136 - DNA, 25 bp, S. pombe
ggaacttcaattctgccacaaaggt

SEQ ID NO: 105137 - DNA, 25 bp, S. pombe
ggaagctgatcctgatgatcctaac

SEQ ID NO: 105138 - DNA, 25 bp, S. pombe
ggaactgcattgctgatatccccag

SEQ ID NO: 105139 - DNA, 25 bp, S. pombe
ggaacttcagcgtcaagctccagag

SEQ ID NO: 105140 - DNA, 25 bp, S. pombe
ggaagttcatcgtgagctatcgcat

SEQ ID NO: 105141 - DNA, 25 bp, S. pombe
ggaagttcaatcatgccaggcaaag

SEQ ID NO: 105142 - DNA, 25 bp, S. pombe
ggaatttcctgtccatggtatggga

SEQ ID NO: 105143 - DNA, 25 bp, S. pombe
ggaagttgtccattctgttcgtaaa

SEQ ID NO: 105144 - DNA, 25 bp, S. pombe
ggaatttacgatcctcttctagaag

SEQ ID NO: 105145 - DNA, 25 bp, S. pombe
ggaaccagattgtgctttaccagcg

SEQ ID NO: 105146 - DNA, 25 bp, S. pombe
ggaacgctgctctcgtaaacatgtc

SEQ ID NO: 105147 - DNA, 25 bp, S. pombe
ggaactgtgacagcgtttgacatta

SEQ ID NO: 105148 - DNA, 25 bp, S. pombe
ggaactctcgaacccatgtgcaaaa

SEQ ID NO: 105149 - DNA, 25 bp, S. pombe
ggaacgccagtaacggttgaatcat

SEQ ID NO: 105150 - DNA, 25 bp, S. pombe
ggaagttgagtcttctgacaccatt

SEQ ID NO: 105151 - DNA, 25 bp, S. pombe
ggaagatgaaccttctgaccttcat

SEQ ID NO: 105152 - DNA, 25 bp, S. pombe
ggaacgctggtggacaattattaac

SEQ ID NO: 105153 - DNA, 25 bp, S. pombe
ggaacgctcgttacatgatgctatt

SEQ ID NO: 105154 - DNA, 25 bp, S. pombe
ggaagcttggttacactgattacta

SEQ ID NO: 105155 - DNA, 25 bp, S. pombe
ggaatcttgagatcccaactgacta

SEQ ID NO: 105156 - DNA, 25 bp, S. pombe
ggaactgtgaattctccattggcac

SEQ ID NO: 105157 - DNA, 25 bp, S. pombe
ggaagcttcttcttgcatgcataag

SEQ ID NO: 105158 - DNA, 25 bp, S. pombe
ggcggcttttaatgttaacgctcct

SEQ ID NO: 105159 - DNA, 25 bp, S. pombe
tggaagccgtccagttaaacttagt

SEQ ID NO: 105160 - DNA, 25 bp, S. pombe
ggaagccgctctgatatttcaattt

SEQ ID NO: 105161 - DNA, 25 bp, S. pombe
ggaagccactccattttattattac

SEQ ID NO: 105162 - DNA, 25 bp, S. pombe
ggaattgcgactctaggatggacta

SEQ ID NO: 105163 - DNA, 25 bp, S. pombe
ggaattccaagatctcggcgagcca

SEQ ID NO: 105164 - DNA, 25 bp, S. pombe
ggaattgctcaactcattcgtcaac

SEQ ID NO: 105165 - DNA, 25 bp, S. pombe
ggcactacgatacccaaggcaagga

SEQ ID NO: 105166 - DNA, 25 bp, S. pombe
ggaacgttgatctctcgacagtgga

SEQ ID NO: 105167 - DNA, 25 bp, S. pombe
ggaagctttgatatgccgacacagg

SEQ ID NO: 105168 - DNA, 25 bp, S. pombe
ggaatcattgtgctactccaacgat

SEQ ID NO: 105169 - DNA, 25 bp, S. pombe
ggaatgctcccctctagtgaaaaat

SEQ ID NO: 105170 - DNA, 25 bp, S. pombe
ggaactactcctagaattgcccaat

SEQ ID NO: 105171 - DNA, 25 bp, S. pombe
ggaacggtcctccaattgacaaatc

SEQ ID NO: 105172 - DNA, 25 bp, S. pombe
ggaacggtcgtcttcatataacaac

SEQ ID NO: 105173 - DNA, 25 bp, S. pombe
ggaagttccgtctcatttgaaacca

SEQ ID NO: 105174 - DNA, 25 bp, S. pombe
ggaatgcttcctcaaatttaccaaa

SEQ ID NO: 105175 - DNA, 25 bp, S. pombe
ggaatttcctcacagaactacatca

SEQ ID NO: 105176 - DNA, 25 bp, S. pombe
ggaagtcctaatacaattcgtcaat

SEQ ID NO: 105177 - DNA, 25 bp, S. pombe
ggaactccacaaatcacatacgctt

SEQ ID NO: 105178 - DNA, 25 bp, S. pombe
ggaatccattactggtgcctacgac

SEQ ID NO: 105179 - DNA, 25 bp, S. pombe
ggaacgttgactttgaaccatctat

SEQ ID NO: 105180 - DNA, 25 bp, S. pombe
ggaacgcttgatattctccatggtt

SEQ ID NO: 105181 - DNA, 25 bp, S. pombe
ggaactgctttgtttcacagggctg

SEQ ID NO: 105182 - DNA, 25 bp, S. pombe
ggccctttatgacttagcggagctg

SEQ ID NO: 105183 - DNA, 25 bp, S. pombe
ggcaacttccaacttactggcattg

SEQ ID NO: 105184 - DNA, 25 bp, S. pombe
ggcaagggacaacgtctcggttcta

SEQ ID NO: 105185 - DNA, 25 bp, S. pombe
ggcaacggcgatgaaccattttcta

SEQ ID NO: 105186 - DNA, 25 bp, S. pombe
ggaagcaatcaaaataccagtcaat

SEQ ID NO: 105187 - DNA, 25 bp, S. pombe
ggcaaagcctactggttagcgatgt

SEQ ID NO: 105188 - DNA, 25 bp, S. pombe
ggcaggaacctagtaattcttcagt

SEQ ID NO: 105189 - DNA, 25 bp, S. pombe
ggaagtgtcaccaatacaagtagca

SEQ ID NO: 105190 - DNA, 25 bp, S. pombe
ggaagtgaccatgctttcatctgga

SEQ ID NO: 105191 - DNA, 25 bp, S. pombe
ggaagcttgctcaaaggccaccaat

SEQ ID NO: 105192 - DNA, 25 bp, S. pombe
tggaagctttactcgtcctcaagga

SEQ ID NO: 105193 - DNA, 25 bp, S. pombe
ggaaggatttgacggctcctcaaaa

SEQ ID NO: 105194 - DNA, 25 bp, S. pombe
ggaagacagcttactaccgaaaatt

SEQ ID NO: 105195 - DNA, 25 bp, S. pombe
ggaacccttctagtggccgataata

SEQ ID NO: 105196 - DNA, 25 bp, S. pombe
ggcaactccttcgactggtaaacaa

SEQ ID NO: 105197 - DNA, 25 bp, S. pombe
ggaatcacaattactttctcttaac

SEQ ID NO: 105198 - DNA, 25 bp, S. pombe
ggaatcacctacaccgtctaagaaa

SEQ ID NO: 105199 - DNA, 25 bp, S. pombe
ggaatccatggctatgtactcgttt

SEQ ID NO: 105200 - DNA, 25 bp, S. pombe
ggaatcctccatagcaactttacgt

SEQ ID NO: 105201 - DNA, 25 bp, S. pombe
ggaacctgtctgtggaattgctcaa

SEQ ID NO: 105202 - DNA, 25 bp, S. pombe
ggaagccgctcgtatcgaaagccaa

SEQ ID NO: 105203 - DNA, 25 bp, S. pombe
ggaagtcccgcatattaacttattg

SEQ ID NO: 105204 - DNA, 25 bp, S. pombe
ggaagcgccgcatcaaacaacttga

SEQ ID NO: 105205 - DNA, 25 bp, S. pombe
ggcaatggaggaacaaccccttgtt

SEQ ID NO: 105206 - DNA, 25 bp, S. pombe
ggaattttatcacctacgcgctgaa

SEQ ID NO: 105207 - DNA, 25 bp, S. pombe
ggaatctctcgtttccaaagatctg

SEQ ID NO: 105208 - DNA, 25 bp, S. pombe
ggaatggcatcatcgtcgtcaacaa

SEQ ID NO: 105209 - DNA, 25 bp, S. pombe
ggaagcttcaacttcagtgtcaaaa

SEQ ID NO: 105210 - DNA, 25 bp, S. pombe
ggaattcgctctttagcaactgcaa

SEQ ID NO: 105211 - DNA, 25 bp, S. pombe
ggcaatagcagtcttaaacccatat

SEQ ID NO: 105212 - DNA, 25 bp, S. pombe
ggaattcagtaccttaagcctcctg

SEQ ID NO: 105213 - DNA, 25 bp, S. pombe
ggcaatttgtagattaagttcgcag

SEQ ID NO: 105214 - DNA, 25 bp, S. pombe
ggaaccatcttgagaacctttgcaa

SEQ ID NO: 105215 - DNA, 25 bp, S. pombe
ggaatcttctttatactcgaggcga

SEQ ID NO: 105216 - DNA, 25 bp, S. pombe
ggaatttgtttcattcagccctcta

SEQ ID NO: 105217 - DNA, 25 bp, S. pombe
ggaatagtctttgttagctcttgta

SEQ ID NO: 105218 - DNA, 25 bp, S. pombe
ggcattgaactagtgaaccccttac

SEQ ID NO: 105219 - DNA, 25 bp, S. pombe
ggcactaatttttcaccgagctgtt

SEQ ID NO: 105220 - DNA, 25 bp, S. pombe
ggcttactcaggttgcgacgtgtca

SEQ ID NO: 105221 - DNA, 25 bp, S. pombe
ggcaaaattgttatccagttgaatg

SEQ ID NO: 105222 - DNA, 25 bp, S. pombe
ggaagctattcaaccgacgatgtat

SEQ ID NO: 105223 - DNA, 25 bp, S. pombe
ggaaggctcgccaattgacagcttt

SEQ ID NO: 105224 - DNA, 25 bp, S. pombe
ggaagcatgcttgcaattgccactt

SEQ ID NO: 105225 - DNA, 25 bp, S. pombe
ggcagcctttaatcgatattgcatc

SEQ ID NO: 105226 - DNA, 25 bp, S. pombe
ggcacgatcaagttcctaggcaggt

SEQ ID NO: 105227 - DNA, 25 bp, S. pombe
ggcaagttgacaattactaaggcat

SEQ ID NO: 105228 - DNA, 25 bp, S. pombe
ggaattttgcacgtcgtcagcaggc

SEQ ID NO: 105229 - DNA, 25 bp, S. pombe
ggaattccggtactgaacaagtcgt

SEQ ID NO: 105230 - DNA, 25 bp, S. pombe
ggaagtttcttctactgttgttcaa

SEQ ID NO: 105231 - DNA, 25 bp, S. pombe
ggaaggtctccctatctatttagag

SEQ ID NO: 105232 - DNA, 25 bp, S. pombe
ggaagtgccatcgaacagtttttga

SEQ ID NO: 105233 - DNA, 25 bp, S. pombe
ggcaaaccctgcaaatgaaaagtca

SEQ ID NO: 105234 - DNA, 25 bp, S. pombe
ggaagtcaccaccaaatttatgcgt

SEQ ID NO: 105235 - DNA, 25 bp, S. pombe
ggcaagtaccttcattctgtaggct

SEQ ID NO: 105236 - DNA, 25 bp, S. pombe
ggcatacaaagcctttacctggcgt

SEQ ID NO: 105237 - DNA, 25 bp, S. pombe
ggaagcctaagtctacaactgaatg

SEQ ID NO: 105238 - DNA, 25 bp, S. pombe
ggaagcttactgctgaagaacgcaa

SEQ ID NO: 105239 - DNA, 25 bp, S. pombe
ggaagtttctgacgaagcacccaaa

SEQ ID NO: 105240 - DNA, 25 bp, S. pombe
ggaagcgtgtttttaggctcattga

SEQ ID NO: 105241 - DNA, 25 bp, S. pombe
ggaagctggctgaacactatgaaca

SEQ ID NO: 105242 - DNA, 25 bp, S. pombe
ggaagcatattgcacttgcctctca

SEQ ID NO: 105243 - DNA, 25 bp, S. pombe
ggaagcaacttcgttgatcctcaag

SEQ ID NO: 105244 - DNA, 25 bp, S. pombe
ggaattggccgagcagcacttataa

SEQ ID NO: 105245 - DNA, 25 bp, S. pombe
ggaagatcctttagctcctattcgc

SEQ ID NO: 105246 - DNA, 25 bp, S. pombe
ggcaagagtcctatcgttgtcgatg

SEQ ID NO: 105247 - DNA, 25 bp, S. pombe
ggcaatgcctactttgagttgtact

SEQ ID NO: 105248 - DNA, 25 bp, S. pombe
ggaataccattcgtggttctggcct

SEQ ID NO: 105249 - DNA, 25 bp, S. pombe
ggaatacttgctattgtacgccaat

SEQ ID NO: 105250 - DNA, 25 bp, S. pombe
ggaattgcgttcatttactgcctga

SEQ ID NO: 105251 - DNA, 25 bp, S. pombe
ggaagcttcccaatttgcatcgatt

SEQ ID NO: 105252 - DNA, 25 bp, S. pombe
ggaagttcaacaatccatctcggag

SEQ ID NO: 105253 - DNA, 25 bp, S. pombe
ggaagcataccaaatccgtgatata

SEQ ID NO: 105254 - DNA, 25 bp, S. pombe
ggaagcaacctcagctattgacaat

SEQ ID NO: 105255 - DNA, 25 bp, S. pombe
ggaagattcccttgatcctgaagat

SEQ ID NO: 105256 - DNA, 25 bp, S. pombe
ggcaaagctgccctcgtagaaaacg

SEQ ID NO: 105257 - DNA, 25 bp, S. pombe
ggcacgacgccaagctctaggaaag

SEQ ID NO: 105258 - DNA, 25 bp, S. pombe
ggcaacatcgccagcttggtaaagc

SEQ ID NO: 105259 - DNA, 25 bp, S. pombe
ggaatcattctcacactagtacaag

SEQ ID NO: 105260 - DNA, 25 bp, S. pombe
ggaagatatctttgcctcgtgacca

SEQ ID NO: 105261 - DNA, 25 bp, S. pombe
ggaatttatagacctcgatgccctt

SEQ ID NO: 105262 - DNA, 25 bp, S. pombe
ggaatattaagtccatctgcctcct

SEQ ID NO: 105263 - DNA, 25 bp, S. pombe
ggaatttaagtaccccatgctaagt

SEQ ID NO: 105264 - DNA, 25 bp, S. pombe
ggcaagttgctcaataaccttcgta

SEQ ID NO: 105265 - DNA, 25 bp, S. pombe
ggaatgcgcgatctcatagccttca

SEQ ID NO: 105266 - DNA, 25 bp, S. pombe
ggaatgccaatttacaaccttcata

SEQ ID NO: 105267 - DNA, 25 bp, S. pombe
ggcaagcgttaactcctttcaagaa

SEQ ID NO: 105268 - DNA, 25 bp, S. pombe
ggcaacctggaaacgcttcaacgat

SEQ ID NO: 105269 - DNA, 25 bp, S. pombe
ggcaactccaaagccattgaagcaa

SEQ ID NO: 105270 - DNA, 25 bp, S. pombe
ggaattgccatttaccttagaacaa

SEQ ID NO: 105271 - DNA, 25 bp, S. pombe
ggaatggacatttcaccttcgatgc

SEQ ID NO: 105272 - DNA, 25 bp, S. pombe
ggaagtgcctattcatccaggttat

SEQ ID NO: 105273 - DNA, 25 bp, S. pombe
ggaagtagctatcagcggtcttgat

SEQ ID NO: 105274 - DNA, 25 bp, S. pombe
ggaatcatgtgttctgactcaacga

SEQ ID NO: 105275 - DNA, 25 bp, S. pombe
ggaatcaggcattctccgcacgaga

SEQ ID NO: 105276 - DNA, 25 bp, S. pombe
ggaatcatacacttcgaatgccaga

SEQ ID NO: 105277 - DNA, 25 bp, S. pombe
ggcagactctactcgagatggcact

SEQ ID NO: 105278 - DNA, 25 bp, S. pombe
ggcagaactggctatcgtgatgatc

SEQ ID NO: 105279 - DNA, 25 bp, S. pombe
ggaatccgttcctgacaaatcgtta

SEQ ID NO: 105280 - DNA, 25 bp, S. pombe
ggaatccgcatttgggacaactttt

SEQ ID NO: 105281 - DNA, 25 bp, S. pombe
ggaatccgttaggtcacaatatgta

SEQ ID NO: 105282 - DNA, 25 bp, S. pombe
ggaatcctgaaactgccacacaatg

SEQ ID NO: 105283 - DNA, 25 bp, S. pombe
ggcaagaatgccatcgacaacaata

SEQ ID NO: 105284 - DNA, 25 bp, S. pombe
ggaatatctaccgagccaactacag

SEQ ID NO: 105285 - DNA, 25 bp, S. pombe
ggaatctctaccatcattacccgat

SEQ ID NO: 105286 - DNA, 25 bp, S. pombe
ggaatttacgctacttgaaccagat

SEQ ID NO: 105287 - DNA, 25 bp, S. pombe
ggaatttaacgcttgtctctacatg

SEQ ID NO: 105288 - DNA, 25 bp, S. pombe
tggacaaggaacctgaccctaactt

SEQ ID NO: 105289 - DNA, 25 bp, S. pombe
tgagtaaggaatgtcccctttcttt

SEQ ID NO: 105290 - DNA, 25 bp, S. pombe
ggaagatcgaatatcccctttcact

SEQ ID NO: 105291 - DNA, 25 bp, S. pombe
ggcgttcagttttctccaagcggag

SEQ ID NO: 105292 - DNA, 25 bp, S. pombe
ggaatcctttattggccagggcaag

SEQ ID NO: 105293 - DNA, 25 bp, S. pombe
ggaatttcctttgatccaatgcctc

SEQ ID NO: 105294 - DNA, 25 bp, S. pombe
ggaatttcgtattttctcggctgtt

SEQ ID NO: 105295 - DNA, 25 bp, S. pombe
ggaatttgaaaatgtcgcgtctctt

SEQ ID NO: 105296 - DNA, 25 bp, S. pombe
ggaaggccttatatcagctgcgaaa

SEQ ID NO: 105297 - DNA, 25 bp, S. pombe
ggcacagaaatcctaccgtcgaaga

SEQ ID NO: 105298 - DNA, 25 bp, S. pombe
ggcaagaaagccaccctacacaatc

SEQ ID NO: 105299 - DNA, 25 bp, S. pombe
ggcacgaagcggttcatcagttact

SEQ ID NO: 105300 - DNA, 25 bp, S. pombe
ggcacgtcagtgattacagcttcag

SEQ ID NO: 105301 - DNA, 25 bp, S. pombe
ggcaaacgtgcccaagagcttcaag

SEQ ID NO: 105302 - DNA, 25 bp, S. pombe
tgcctaaccgaccaatatacctaaa

SEQ ID NO: 105303 - DNA, 25 bp, S. pombe
ggaatatccgggtttatgccaacaa

SEQ ID NO: 105304 - DNA, 25 bp, S. pombe
ggaattatgcattcagcctggcaag

SEQ ID NO: 105305 - DNA, 25 bp, S. pombe
ggaagtagcattagccgctgctgaa

SEQ ID NO: 105306 - DNA, 25 bp, S. pombe
ggaatgcctgctatgccaatgatga

SEQ ID NO: 105307 - DNA, 25 bp, S. pombe
ggaatgctagctactgtcaaatatt

SEQ ID NO: 105308 - DNA, 25 bp, S. pombe
ggcaccttggcctaagactgattca

SEQ ID NO: 105309 - DNA, 25 bp, S. pombe
ggcaccaagcccgaagatttattag

SEQ ID NO: 105310 - DNA, 25 bp, S. pombe
ggaattcactttactctcgaactat

SEQ ID NO: 105311 - DNA, 25 bp, S. pombe
ggaatgtacttgtgcttgctgctac

SEQ ID NO: 105312 - DNA, 25 bp, S. pombe
ggaagtcctcatgtgttgtgccaaa

SEQ ID NO: 105313 - DNA, 25 bp, S. pombe
ggcaatccttcctttgtggagcaag

SEQ ID NO: 105314 - DNA, 25 bp, S. pombe
ggcaatactctcacggtgcatagaa

SEQ ID NO: 105315 - DNA, 25 bp, S. pombe
ggaatatccacgtcggttaagcaat

SEQ ID NO: 105316 - DNA, 25 bp, S. pombe
ggcacattctcagcacggcttaata

SEQ ID NO: 105317 - DNA, 25 bp, S. pombe
ggcaattccagagtcgcctgttgaa

SEQ ID NO: 105318 - DNA, 25 bp, S. pombe
ggaatgtccaggtgcactcataaga

SEQ ID NO: 105319 - DNA, 25 bp, S. pombe
ggaattctcggatcatagccaagat

SEQ ID NO: 105320 - DNA, 25 bp, S. pombe
ggaaggcttacagcatctccatgaa

SEQ ID NO: 105321 - DNA, 25 bp, S. pombe
ggaatacttcactcatgctactgac

SEQ ID NO: 105322 - DNA, 25 bp, S. pombe
ggaatgcagcaaatcgtattacgga

SEQ ID NO: 105323 - DNA, 25 bp, S. pombe
ggaatccttctccattttcagatga

SEQ ID NO: 105324 - DNA, 25 bp, S. pombe
ggcacatcgtcaagcgcttttaaga

SEQ ID NO: 105325 - DNA, 25 bp, S. pombe
ggaatgcgccaatttctctgaaaga

SEQ ID NO: 105326 - DNA, 25 bp, S. pombe
ggaatagccgatactgctgctgaaa

SEQ ID NO: 105327 - DNA, 25 bp, S. pombe
ggaatctgccaaatgtgtatcttat

SEQ ID NO: 105328 - DNA, 25 bp, S. pombe
ggaatctcgattttctcgtcttgaa

SEQ ID NO: 105329 - DNA, 25 bp, S. pombe
ggaatcttatatttcggccattggc

SEQ ID NO: 105330 - DNA, 25 bp, S. pombe
ggaatcgacgatttactccattgcc

SEQ ID NO: 105331 - DNA, 25 bp, S. pombe
ggcaagcagcaggtttactcaatta

SEQ ID NO: 105332 - DNA, 25 bp, S. pombe
ggaattgatttctttgcctctcgtg

SEQ ID NO: 105333 - DNA, 25 bp, S. pombe
ggaatatgatttcgcgttcctctcg

SEQ ID NO: 105334 - DNA, 25 bp, S. pombe
ggaatataatcgtcctgtcgctcca

SEQ ID NO: 105335 - DNA, 25 bp, S. pombe
ggaatattcgatatcgctggtccga

SEQ ID NO: 105336 - DNA, 25 bp, S. pombe
ggaattgtctatggaacttggttta

SEQ ID NO: 105337 - DNA, 25 bp, S. pombe
ggaattgttacacttttgctctttt

SEQ ID NO: 105338 - DNA, 25 bp, S. pombe
ggaatcttcttcattggacgcatct

SEQ ID NO: 105339 - DNA, 25 bp, S. pombe
ggaattttctgttcgtatcacactc

SEQ ID NO: 105340 - DNA, 25 bp, S. pombe
ggaattattttgtccttgaatgcca

SEQ ID NO: 105341 - DNA, 25 bp, S. pombe
ggcagcatcagtcggtgtccctttt

SEQ ID NO: 105342 - DNA, 25 bp, S. pombe
ggcaattgatttggctgctcaggaa

SEQ ID NO: 105343 - DNA, 25 bp, S. pombe
ggcacatgtttccttacgtaaccaa

SEQ ID NO: 105344 - DNA, 25 bp, S. pombe
ggaattgatctgtttatcccaccac

SEQ ID NO: 105345 - DNA, 25 bp, S. pombe
ggaatcttctgttatacctccaatt

SEQ ID NO: 105346 - DNA, 25 bp, S. pombe
ggaatgactgtttttgctgctcaaa

SEQ ID NO: 105347 - DNA, 25 bp, S. pombe
ggaatacgttcagtcacctacattt

SEQ ID NO: 105348 - DNA, 25 bp, S. pombe
ggcgacaagttgttaccatccattg

SEQ ID NO: 105349 - DNA, 25 bp, S. pombe
ggcgcttccactataaacgaccaaa

SEQ ID NO: 105350 - DNA, 25 bp, S. pombe
ttgtgttaacctgctcggccttaaa

SEQ ID NO: 105351 - DNA, 25 bp, S. pombe
tggtagaatggtccccaggcttcag

SEQ ID NO: 105352 - DNA, 25 bp, S. pombe
ggaatttactcagccagtgcgtcag

SEQ ID NO: 105353 - DNA, 25 bp, S. pombe
ggcaatttatcctttcattcttcag

SEQ ID NO: 105354 - DNA, 25 bp, S. pombe
ggcaagttgctatgtcatcggtcaa

SEQ ID NO: 105355 - DNA, 25 bp, S. pombe
ggaattaataataccacctgaagaa

SEQ ID NO: 105356 - DNA, 25 bp, S. pombe
ggaatacaatcctcttaccagctag

SEQ ID NO: 105357 - DNA, 25 bp, S. pombe
ggcactacgtccaatgtattcaaag

SEQ ID NO: 105358 - DNA, 25 bp, S. pombe
ggaatcacgagctaacatgttcaaa

SEQ ID NO: 105359 - DNA, 25 bp, S. pombe
tggaccgctagttgatgcattacag

SEQ ID NO: 105360 - DNA, 25 bp, S. pombe
ggcgccagcttgatgatttaggtaa

SEQ ID NO: 105361 - DNA, 25 bp, S. pombe
ggcaagccgttaccatgttttcatc

SEQ ID NO: 105362 - DNA, 25 bp, S. pombe
ggcaatgaacgctcacttacactac

SEQ ID NO: 105363 - DNA, 25 bp, S. pombe
ggaatattctgctgacttagcgtca

SEQ ID NO: 105364 - DNA, 25 bp, S. pombe
ggaattcccttctaacatttcttca

SEQ ID NO: 105365 - DNA, 25 bp, S. pombe
ggcaatttccatatccacttgttgt

SEQ ID NO: 105366 - DNA, 25 bp, S. pombe
ggaatttggcttaacacctgttgag

SEQ ID NO: 105367 - DNA, 25 bp, S. pombe
ggctcctttaggcaaaatgtctccc

SEQ ID NO: 105368 - DNA, 25 bp, S. pombe
tgggaccttctcttttagaaccttg

SEQ ID NO: 105369 - DNA, 25 bp, S. pombe
ggaattgcttagacaatgcggtcaa

SEQ ID NO: 105370 - DNA, 25 bp, S. pombe
ggcgcagtcggtaccgtggctataa

SEQ ID NO: 105371 - DNA, 25 bp, S. pombe
ggaattgctaattaccggtctacag

SEQ ID NO: 105372 - DNA, 25 bp, S. pombe
ggaataccctttacgtgttgcttat

SEQ ID NO: 105373 - DNA, 25 bp, S. pombe
ggcactgaacctttggtgggtctta

SEQ ID NO: 105374 - DNA, 25 bp, S. pombe
ggcaagtctcagtttttcgaaggaa

SEQ ID NO: 105375 - DNA, 25 bp, S. pombe
ggcaggttggtcttttaccagctaa

SEQ ID NO: 105376 - DNA, 25 bp, S. pombe
ggcatccgtcgatcatctggtattt

SEQ ID NO: 105377 - DNA, 25 bp, S. pombe
ggcacctgcttatactggacataca

SEQ ID NO: 105378 - DNA, 25 bp, S. pombe
ggcagccattgttccagtagtgatc

SEQ ID NO: 105379 - DNA, 25 bp, S. pombe
ggcgctgcagctccattgaaggata

SEQ ID NO: 105380 - DNA, 25 bp, S. pombe
ggaattgtgcatcctgtgacagttg

SEQ ID NO: 105381 - DNA, 25 bp, S. pombe
ggaatctgatgcctctgaacatgta

SEQ ID NO: 105382 - DNA, 25 bp, S. pombe
ggaattgcgtgcgtagccatgtcat

SEQ ID NO: 105383 - DNA, 25 bp, S. pombe
ggaattgtcatcgtcaacactgcac

SEQ ID NO: 105384 - DNA, 25 bp, S. pombe
ggaatttcacctgatcctgatttat

SEQ ID NO: 105385 - DNA, 25 bp, S. pombe
ggaattatgcccagaatcgattgga

SEQ ID NO: 105386 - DNA, 25 bp, S. pombe
ggcacatgaagaactaccaccggtt

SEQ ID NO: 105387 - DNA, 25 bp, S. pombe
tggatccgtttgctggtactggtca

SEQ ID NO: 105388 - DNA, 25 bp, S. pombe
ggcaacgtatatcatttatccctca

SEQ ID NO: 105389 - DNA, 25 bp, S. pombe
ggcaatcctaatatttcccatctaa

SEQ ID NO: 105390 - DNA, 25 bp, S. pombe
ggcattcatggttatctggtcaggt

SEQ ID NO: 105391 - DNA, 25 bp, S. pombe
ggctcggaccaatttacaatatcct

SEQ ID NO: 105392 - DNA, 25 bp, S. pombe
ggcttgcatacctcagtcgataatt

SEQ ID NO: 105393 - DNA, 25 bp, S. pombe
ggcagggacaattcatggtgtacat

SEQ ID NO: 105394 - DNA, 25 bp, S. pombe
ggcggcgccgtattggcagatatca

SEQ ID NO: 105395 - DNA, 25 bp, S. pombe
ggcacccgcgttttagcaacaatgg

SEQ ID NO: 105396 - DNA, 25 bp, S. pombe
ggaattgcaggccactttacaggaa

SEQ ID NO: 105397 - DNA, 25 bp, S. pombe
ggaatacgatcaatcacgcccgaaa

SEQ ID NO: 105398 - DNA, 25 bp, S. pombe
ggaatactacttggcgctgtcggaa

SEQ ID NO: 105399 - DNA, 25 bp, S. pombe
ggcagattttctatccgacacgatg

SEQ ID NO: 105400 - DNA, 25 bp, S. pombe
ggcagaattacaaccctaccgatgt

SEQ ID NO: 105401 - DNA, 25 bp, S. pombe
ggcaatcaacaatcccaaccagaat

SEQ ID NO: 105402 - DNA, 25 bp, S. pombe
ggcaatatcaaatacccactcctat

SEQ ID NO: 105403 - DNA, 25 bp, S. pombe
ggaatcatcaaaccttgagcgttct

SEQ ID NO: 105404 - DNA, 25 bp, S. pombe
ggaatacaaacctcctgatttttag

SEQ ID NO: 105405 - DNA, 25 bp, S. pombe
ggaatacacacagcagcaccttgtt

SEQ ID NO: 105406 - DNA, 25 bp, S. pombe
ggcattatacaaaccgtcttcttgg

SEQ ID NO: 105407 - DNA, 25 bp, S. pombe
ggcattaactactcgtttctttgaa

SEQ ID NO: 105408 - DNA, 25 bp, S. pombe
ggcttccctactattatgttcttta

SEQ ID NO: 105409 - DNA, 25 bp, S. pombe
tgggtacccgtattaatgttcgttg

SEQ ID NO: 105410 - DNA, 25 bp, S. pombe
ggcagtcgacatggaaaacgttttc

SEQ ID NO: 105411 - DNA, 25 bp, S. pombe
ggcagaccactttacaggctttaca

SEQ ID NO: 105412 - DNA, 25 bp, S. pombe
ggaataccgttctactgttcattgc

SEQ ID NO: 105413 - DNA, 25 bp, S. pombe
ggaattcctattgctgctattttgg

SEQ ID NO: 105414 - DNA, 25 bp, S. pombe
ggaatttcttcttcctcagttatag

SEQ ID NO: 105415 - DNA, 25 bp, S. pombe
ggaattcattctttgctcactttat

SEQ ID NO: 105416 - DNA, 25 bp, S. pombe
ggcagtctatcctcttacatgatac

SEQ ID NO: 105417 - DNA, 25 bp, S. pombe
ggcgatctaatcttaaacaaggcac

SEQ ID NO: 105418 - DNA, 25 bp, S. pombe
ggcaagctccatcttataaaccact

SEQ ID NO: 105419 - DNA, 25 bp, S. pombe
ggcaacattcttatattccctcatt

SEQ ID NO: 105420 - DNA, 25 bp, S. pombe
ggcaaatcctctatttacgttcatt

SEQ ID NO: 105421 - DNA, 25 bp, S. pombe
ggcattcaacaacctttagcgtcaa

SEQ ID NO: 105422 - DNA, 25 bp, S. pombe
ggctctcaaatactttttggccgtc

SEQ ID NO: 105423 - DNA, 25 bp, S. pombe
ggctgatgctgaaacactccgatat

SEQ ID NO: 105424 - DNA, 25 bp, S. pombe
ggcattggcggatcttaattctgtg

SEQ ID NO: 105425 - DNA, 25 bp, S. pombe
ggcattggataaacttggccttcaa

SEQ ID NO: 105426 - DNA, 25 bp, S. pombe
ggcagacttcgcactactcaagtat

SEQ ID NO: 105427 - DNA, 25 bp, S. pombe
ggaattctcgatctcattcaagtat

SEQ ID NO: 105428 - DNA, 25 bp, S. pombe
ggaattgccatacctcgatcgaaat

SEQ ID NO: 105429 - DNA, 25 bp, S. pombe
ggcagcaatggtgttggtcaattca

SEQ ID NO: 105430 - DNA, 25 bp, S. pombe
ggcaagggtacttctgctcaatact

SEQ ID NO: 105431 - DNA, 25 bp, S. pombe
ggcaaatcctaaacgatcctgttat

SEQ ID NO: 105432 - DNA, 25 bp, S. pombe
tggagaacccgttatcctcaaactt

SEQ ID NO: 105433 - DNA, 25 bp, S. pombe
ggctaactccgtttcttcctcctct

SEQ ID NO: 105434 - DNA, 25 bp, S. pombe
ggctaacactgtttcttcctccgtc

SEQ ID NO: 105435 - DNA, 25 bp, S. pombe
ggctaacactgtttcttcctccgtc

SEQ ID NO: 105436 - DNA, 25 bp, S. pombe
ggctttccgtaacattcctggtgtt

SEQ ID NO: 105437 - DNA, 25 bp, S. pombe
ggctcgcgaagttatcaaccgtgtt

SEQ ID NO: 105438 - DNA, 25 bp, S. pombe
ggcactggagtttatcaatcccgca

SEQ ID NO: 105439 - DNA, 25 bp, S. pombe
ggcactgttggtgatcaaactcgcc

SEQ ID NO: 105440 - DNA, 25 bp, S. pombe
ggcgaactttgcttggacattctgc

SEQ ID NO: 105441 - DNA, 25 bp, S. pombe
ggcagacccgtgatgtgcacattta

SEQ ID NO: 105442 - DNA, 25 bp, S. pombe
ggcaatggctcatcaatcactggac

SEQ ID NO: 105443 - DNA, 25 bp, S. pombe
ggcaattgccacattagctgcagtt

SEQ ID NO: 105444 - DNA, 25 bp, S. pombe
ggcaattggtgctattactggctta

SEQ ID NO: 105445 - DNA, 25 bp, S. pombe
ggcaaatggtattcccagctttacg

SEQ ID NO: 105446 - DNA, 25 bp, S. pombe
ggcagcccgtagaagacagctcatt

SEQ ID NO: 105447 - DNA, 25 bp, S. pombe
ggcaagcaattcacccaagattcgt

SEQ ID NO: 105448 - DNA, 25 bp, S. pombe
ggcaccatcgcgtatgtcgaattca

SEQ ID NO: 105449 - DNA, 25 bp, S. pombe
ggcagccacgagttgctacatgaat

SEQ ID NO: 105450 - DNA, 25 bp, S. pombe
ggcaaagtctgctgataaggaatga

SEQ ID NO: 105451 - DNA, 25 bp, S. pombe
ggcaatagccatctctccaaatgat

SEQ ID NO: 105452 - DNA, 25 bp, S. pombe
ggcaaagccgtgatgcacctagata

SEQ ID NO: 105453 - DNA, 25 bp, S. pombe
ggcaactctttgcagatcatttctt

SEQ ID NO: 105454 - DNA, 25 bp, S. pombe
ggcaactcacttcgttatgtcgagc

SEQ ID NO: 105455 - DNA, 25 bp, S. pombe
ggcaggattccttggtatgattctt

SEQ ID NO: 105456 - DNA, 25 bp, S. pombe
ggcaggttccattactatcaagtgt

SEQ ID NO: 105457 - DNA, 25 bp, S. pombe
ggctgggtgtcttagattcggtaca

SEQ ID NO: 105458 - DNA, 25 bp, S. pombe
ggcttggtgctttttgactttggca

SEQ ID NO: 105459 - DNA, 25 bp, S. pombe
ggaattaacgctacatctatctggt

SEQ ID NO: 105460 - DNA, 25 bp, S. pombe
ggaattcagggccagatctcagctt

SEQ ID NO: 105461 - DNA, 25 bp, S. pombe
ggaattccatgtccaccaagtttgg

SEQ ID NO: 105462 - DNA, 25 bp, S. pombe
ggaattgcacttactgctactctgg

SEQ ID NO: 105463 - DNA, 25 bp, S. pombe
ggcgtgaactttgtgtctctgatga

SEQ ID NO: 105464 - DNA, 25 bp, S. pombe
ggcagtgcaaatgtggttccgctaa

SEQ ID NO: 105465 - DNA, 25 bp, S. pombe
ggcaccataggcatagtaccaccaa

SEQ ID NO: 105466 - DNA, 25 bp, S. pombe
ggctggttatacatggcctaagaat

SEQ ID NO: 105467 - DNA, 25 bp, S. pombe
ggcatacaaggacctgactctttca

SEQ ID NO: 105468 - DNA, 25 bp, S. pombe
ggcatttactcgctatattgtatga

SEQ ID NO: 105469 - DNA, 25 bp, S. pombe
ggcactatattccatgtcaatcctg

SEQ ID NO: 105470 - DNA, 25 bp, S. pombe
ggcacttcatttcgatacacagcta

SEQ ID NO: 105471 - DNA, 25 bp, S. pombe
ggcaattctcttcgctatgtcatta

SEQ ID NO: 105472 - DNA, 25 bp, S. pombe
ggcaatgtctcttccatttgtacat

SEQ ID NO: 105473 - DNA, 25 bp, S. pombe
ggcagcatcaaacttttcaacaagt

SEQ ID NO: 105474 - DNA, 25 bp, S. pombe
ggcaagaccgctgttgacgatggaa

SEQ ID NO: 105475 - DNA, 25 bp, S. pombe
ggcaattatattttctctagtcaga

SEQ ID NO: 105476 - DNA, 25 bp, S. pombe
ggcaattatgcattttcttcgccat

SEQ ID NO: 105477 - DNA, 25 bp, S. pombe
ggcagattctctgtttacatcgcat

SEQ ID NO: 105478 - DNA, 25 bp, S. pombe
ggcagcagattctacagacgcagta

SEQ ID NO: 105479 - DNA, 25 bp, S. pombe
ggcaagcttgctgtcatcgttgaca

SEQ ID NO: 105480 - DNA, 25 bp, S. pombe
ggcattgccgctttatcgtacaaga

SEQ ID NO: 105481 - DNA, 25 bp, S. pombe
tggaatgatggcgacctgtgtttaa

SEQ ID NO: 105482 - DNA, 25 bp, S. pombe
ggcaatatgttgcactcatgaaacg

SEQ ID NO: 105483 - DNA, 25 bp, S. pombe
ggcaatcagcattctactcgagttc

SEQ ID NO: 105484 - DNA, 25 bp, S. pombe
ggcaatcgtattttccagttttgat

SEQ ID NO: 105485 - DNA, 25 bp, S. pombe
ggcaacgtgtaagccagtcttctat

SEQ ID NO: 105486 - DNA, 25 bp, S. pombe
ggcaccgttagctactcgatttttg

SEQ ID NO: 105487 - DNA, 25 bp, S. pombe
tggctttccgaaaatcctgagtatg

SEQ ID NO: 105488 - DNA, 25 bp, S. pombe
ggcagtagcgctcgtatcatagctt

SEQ ID NO: 105489 - DNA, 25 bp, S. pombe
ggcactcgcgacgtagctgaaatta

SEQ ID NO: 105490 - DNA, 25 bp, S. pombe
ggcaagactcatctatatccgtaaa

SEQ ID NO: 105491 - DNA, 25 bp, S. pombe
ggcatccgctgctgttgaacgaaaa

SEQ ID NO: 105492 - DNA, 25 bp, S. pombe
ggcacttgcctggttgggatgaaaa

SEQ ID NO: 105493 - DNA, 25 bp, S. pombe
ggcaagcgagccattttccaaattc

SEQ ID NO: 105494 - DNA, 25 bp, S. pombe
ggcattcggagcatttttcgactct

SEQ ID NO: 105495 - DNA, 25 bp, S. pombe
ggcatttggtcaagttcttcgtcga

SEQ ID NO: 105496 - DNA, 25 bp, S. pombe
ggcattatggacagcttcggcagac

SEQ ID NO: 105497 - DNA, 25 bp, S. pombe
ggcatcggaatctagactttctgat

SEQ ID NO: 105498 - DNA, 25 bp, S. pombe
ggctaacgtatctccgatccaaaat

SEQ ID NO: 105499 - DNA, 25 bp, S. pombe
ggcatattccaacacgctgcgtata

SEQ ID NO: 105500 - DNA, 25 bp, S. pombe
ggcttatctaagcacggctacaatg

SEQ ID NO: 105501 - DNA, 25 bp, S. pombe
ggcattcttaagtactggccacgaa

SEQ ID NO: 105502 - DNA, 25 bp, S. pombe
ggcaatgatgagtcccaccgaatct

SEQ ID NO: 105503 - DNA, 25 bp, S. pombe
ggctagctagcatgtcctggaatct

SEQ ID NO: 105504 - DNA, 25 bp, S. pombe
ggcagacatggcaatcttcagttca

SEQ ID NO: 105505 - DNA, 25 bp, S. pombe
ggcagagtgcattcgtcggattcat

SEQ ID NO: 105506 - DNA, 25 bp, S. pombe
ggcagatcatgctctacggattcat

SEQ ID NO: 105507 - DNA, 25 bp, S. pombe
ggcattgccatcgttcagttgcaaa

SEQ ID NO: 105508 - DNA, 25 bp, S. pombe
ggcattcctggaatcatccatgcaa

SEQ ID NO: 105509 - DNA, 25 bp, S. pombe
ggcattattaatccactccatgtag

SEQ ID NO: 105510 - DNA, 25 bp, S. pombe
ggctatttacacagatcccaaaact

SEQ ID NO: 105511 - DNA, 25 bp, S. pombe
ggctatttacaagggcgcaccacag

SEQ ID NO: 105512 - DNA, 25 bp, S. pombe
ggcacgaatgtctttcagcttatta

SEQ ID NO: 105513 - DNA, 25 bp, S. pombe
tggccttcagtacagtgcctttaag

SEQ ID NO: 105514 - DNA, 25 bp, S. pombe
ggcgttaaattactcctgtctatgg

SEQ ID NO: 105515 - DNA, 25 bp, S. pombe
ggcgtatttcttttcctacaaggct

SEQ ID NO: 105516 - DNA, 25 bp, S. pombe
ggcagtattttaccccataagagca

SEQ ID NO: 105517 - DNA, 25 bp, S. pombe
ggcaccttctgctattcaatacagc

SEQ ID NO: 105518 - DNA, 25 bp, S. pombe
ggccggtcatggatttacagctgcg

SEQ ID NO: 105519 - DNA, 25 bp, S. pombe
ggctcgtttggtaaacagcgctcgt

SEQ ID NO: 105520 - DNA, 25 bp, S. pombe
ggcttctatcggaaatatcacggct

SEQ ID NO: 105521 - DNA, 25 bp, S. pombe
ggcactttttgcgttggctgataaa

SEQ ID NO: 105522 - DNA, 25 bp, S. pombe
ggcctgaacaagaccgatctcaacg

SEQ ID NO: 105523 - DNA, 25 bp, S. pombe
ggcacaaaccgccactgatggtgaa

SEQ ID NO: 105524 - DNA, 25 bp, S. pombe
ggctaaacgctctaccatgatgggt

SEQ ID NO: 105525 - DNA, 25 bp, S. pombe
ggcagagtacatttgtcctatcatt

SEQ ID NO: 105526 - DNA, 25 bp, S. pombe
ggcaaagaaactccccatgattatt

SEQ ID NO: 105527 - DNA, 25 bp, S. pombe
ggctaaacagtatcccagatgcttt

SEQ ID NO: 105528 - DNA, 25 bp, S. pombe
ggcatactaagctttcccaattttg

SEQ ID NO: 105529 - DNA, 25 bp, S. pombe
ggcaactcactcttgtaaaggcttt

SEQ ID NO: 105530 - DNA, 25 bp, S. pombe
ggcatcaaccctgaacgtgtttatt

SEQ ID NO: 105531 - DNA, 25 bp, S. pombe
ggctgcagcaaccacacaagggatt

SEQ ID NO: 105532 - DNA, 25 bp, S. pombe
ggcagcagagacacatcaagagttt

SEQ ID NO: 105533 - DNA, 25 bp, S. pombe
ggcaacaaagtgtggtcacgtctat

SEQ ID NO: 105534 - DNA, 25 bp, S. pombe
ggcctatcaggacattggacactct

SEQ ID NO: 105535 - DNA, 25 bp, S. pombe
ggcttatgcagccatctttgggagt

SEQ ID NO: 105536 - DNA, 25 bp, S. pombe
ggcactgaccagtcgcttttgaagt

SEQ ID NO: 105537 - DNA, 25 bp, S. pombe
ggcttactagcaattcttcagggat

SEQ ID NO: 105538 - DNA, 25 bp, S. pombe
ggcttacatccaagacttgccaggt

SEQ ID NO: 105539 - DNA, 25 bp, S. pombe
ggcgtacaacagaagtggccttgct

SEQ ID NO: 105540 - DNA, 25 bp, S. pombe
ggcatggatattcacaacacgcgtt

SEQ ID NO: 105541 - DNA, 25 bp, S. pombe
ggcattgagctttcgcaacaacttc

SEQ ID NO: 105542 - DNA, 25 bp, S. pombe
ggcagcaagatttcctctttctata

SEQ ID NO: 105543 - DNA, 25 bp, S. pombe
ggcacaagcattttatcattcgtta

SEQ ID NO: 105544 - DNA, 25 bp, S. pombe
ggcagatcctgtttctattgagtat

SEQ ID NO: 105545 - DNA, 25 bp, S. pombe
ggctgcttctttatgaccgatggac

SEQ ID NO: 105546 - DNA, 25 bp, S. pombe
ggcatgcattgctattttacgtatc

SEQ ID NO: 105547 - DNA, 25 bp, S. pombe
ggcatattgccgtattcacagtgtc

SEQ ID NO: 105548 - DNA, 25 bp, S. pombe
ggcaaatgcacaggtccaacttcat

SEQ ID NO: 105549 - DNA, 25 bp, S. pombe
ggcatcttgtatcaacgctactact

SEQ ID NO: 105550 - DNA, 25 bp, S. pombe
ggcagtgctttattggttactcccg

SEQ ID NO: 105551 - DNA, 25 bp, S. pombe
ggcaggtctctatggatcttttcta

SEQ ID NO: 105552 - DNA, 25 bp, S. pombe
ggcatgttttgctgtatttttcttc

SEQ ID NO: 105553 - DNA, 25 bp, S. pombe
ggcatttttccggagagctgtttag

SEQ ID NO: 105554 - DNA, 25 bp, S. pombe
ggcttcttttcttggacttgtagga

SEQ ID NO: 105555 - DNA, 25 bp, S. pombe
ggcttcttacgatacaactttggat

SEQ ID NO: 105556 - DNA, 25 bp, S. pombe
ggctctttacttacaaacattggcg

SEQ ID NO: 105557 - DNA, 25 bp, S. pombe
ggcatttgctgatgttccgagttac

SEQ ID NO: 105558 - DNA, 25 bp, S. pombe
ggcatagagttttgcttcaggcaga

SEQ ID NO: 105559 - DNA, 25 bp, S. pombe
ggcacaattttacatcctcagcaag

SEQ ID NO: 105560 - DNA, 25 bp, S. pombe
ggcattgattttgtttccacactgg

SEQ ID NO: 105561 - DNA, 25 bp, S. pombe
tggcttgcaagttcctatccaaacg

SEQ ID NO: 105562 - DNA, 25 bp, S. pombe
ggcatggctggttcagttgctcaaa

SEQ ID NO: 105563 - DNA, 25 bp, S. pombe
ggcaggaaaagctacgcctacgcct

SEQ ID NO: 105564 - DNA, 25 bp, S. pombe
ggcgtaccagacacaaatgagactc

SEQ ID NO: 105565 - DNA, 25 bp, S. pombe
ggcttacgggtttttgcttcttcat

SEQ ID NO: 105566 - DNA, 25 bp, S. pombe
ggcttattccagttccttttatgtt

SEQ ID NO: 105567 - DNA, 25 bp, S. pombe
ggctttttagttcttcttgcaggta

SEQ ID NO: 105568 - DNA, 25 bp, S. pombe
ggctctttgtacttgccaatctcta

SEQ ID NO: 105569 - DNA, 25 bp, S. pombe
ggctctgttggagttattgtctcta

SEQ ID NO: 105570 - DNA, 25 bp, S. pombe
ggctttgatgccagaattgttccac

SEQ ID NO: 105571 - DNA, 25 bp, S. pombe
ggctttagccattgacttgttggac

SEQ ID NO: 105572 - DNA, 25 bp, S. pombe
ggcacttcccgaaaacgccaagatt

SEQ ID NO: 105573 - DNA, 25 bp, S. pombe
tggatttccctaacattacccaggt

SEQ ID NO: 105574 - DNA, 25 bp, S. pombe
ggctaattgcccttttacggattgc

SEQ ID NO: 105575 - DNA, 25 bp, S. pombe
ggcattcgatgctactccagattat

SEQ ID NO: 105576 - DNA, 25 bp, S. pombe
ggcagccaacgctttactatctgat

SEQ ID NO: 105577 - DNA, 25 bp, S. pombe
ggcagcccacgaatggactgtcgat

SEQ ID NO: 105578 - DNA, 25 bp, S. pombe
ggcacccatcgatttcacagttata

SEQ ID NO: 105579 - DNA, 25 bp, S. pombe
ggcatgggccgcattagttttaata

SEQ ID NO: 105580 - DNA, 25 bp, S. pombe
ggcagttgtgcgatttttcaaaccg

SEQ ID NO: 105581 - DNA, 25 bp, S. pombe
ggcatcatccgtatagcagacctag

SEQ ID NO: 105582 - DNA, 25 bp, S. pombe
ggcttgctcaaaacgtaccattgtt

SEQ ID NO: 105583 - DNA, 25 bp, S. pombe
ggctaacagaatccttatctcaatg

SEQ ID NO: 105584 - DNA, 25 bp, S. pombe
ggcgtagcaacgtcaaaccagaaat

SEQ ID NO: 105585 - DNA, 25 bp, S. pombe
ggcgttctacttgataccgcagtat

SEQ ID NO: 105586 - DNA, 25 bp, S. pombe
ggctattctacgtacaaccgatcga

SEQ ID NO: 105587 - DNA, 25 bp, S. pombe
ggctcaatctacagaaactcgtcta

SEQ ID NO: 105588 - DNA, 25 bp, S. pombe
ggcttctacagtcttccattttatt

SEQ ID NO: 105589 - DNA, 25 bp, S. pombe
ggcagtcgcccttatatttttgttg

SEQ ID NO: 105590 - DNA, 25 bp, S. pombe
ggcagggcctattctattttgttta

SEQ ID NO: 105591 - DNA, 25 bp, S. pombe
ggcagcatctctttacgaaggattt

SEQ ID NO: 105592 - DNA, 25 bp, S. pombe
ggcgagggattaccaatgcgtttct

SEQ ID NO: 105593 - DNA, 25 bp, S. pombe
tggaacttttcaagaggtttcaaag

SEQ ID NO: 105594 - DNA, 25 bp, S. pombe
ggcttacatttttatgggcccaatt

SEQ ID NO: 105595 - DNA, 25 bp, S. pombe
ggctcttccttatctggtggtcaaa

SEQ ID NO: 105596 - DNA, 25 bp, S. pombe
ggcattcattgtcattctacttctg

SEQ ID NO: 105597 - DNA, 25 bp, S. pombe
ggcacatcatttatgttctcactgt

SEQ ID NO: 105598 - DNA, 25 bp, S. pombe
ggcactagtcataccattctctgtg

SEQ ID NO: 105599 - DNA, 25 bp, S. pombe
ggcagctagagctaacttcacttga

SEQ ID NO: 105600 - DNA, 25 bp, S. pombe
ggcatgtccgccgaagaatctgatg

SEQ ID NO: 105601 - DNA, 25 bp, S. pombe
ggcattccgatcgagcagatttcac

SEQ ID NO: 105602 - DNA, 25 bp, S. pombe
ggcatgtaggtgtactcagcttcaa

SEQ ID NO: 105603 - DNA, 25 bp, S. pombe
ggcttcagcggatgctagctttgac

SEQ ID NO: 105604 - DNA, 25 bp, S. pombe
ggcagtgcgccttatgaccatattt

SEQ ID NO: 105605 - DNA, 25 bp, S. pombe
ggctactcctagtgaaattgtggca

SEQ ID NO: 105606 - DNA, 25 bp, S. pombe
ggctaccgtcatactgcagaaggat

SEQ ID NO: 105607 - DNA, 25 bp, S. pombe
ggctatgctttaccatcactagcgt

SEQ ID NO: 105608 - DNA, 25 bp, S. pombe
ggctttttcgtcatctagtatttct

SEQ ID NO: 105609 - DNA, 25 bp, S. pombe
ggcttcgttggaatctttttgctaa

SEQ ID NO: 105610 - DNA, 25 bp, S. pombe
ggcatatggttcctacacttattca

SEQ ID NO: 105611 - DNA, 25 bp, S. pombe
ggcatatcgtttcgcaattttacaa

SEQ ID NO: 105612 - DNA, 25 bp, S. pombe
ggctactgcatctggtaccttaaaa

SEQ ID NO: 105613 - DNA, 25 bp, S. pombe
ggcaccgccaaagttaccttttgag

SEQ ID NO: 105614 - DNA, 25 bp, S. pombe
ggcctccccagagacaacttttaag

SEQ ID NO: 105615 - DNA, 25 bp, S. pombe
ggccccactagtcccaaaatttatg

SEQ ID NO: 105616 - DNA, 25 bp, S. pombe
ggccgtagctaccacttggaattta

SEQ ID NO: 105617 - DNA, 25 bp, S. pombe
ggcttgccgctcgaataatgttgac

SEQ ID NO: 105618 - DNA, 25 bp, S. pombe
ggcatcgcctgctcttaaattgacg

SEQ ID NO: 105619 - DNA, 25 bp, S. pombe
ggcacccatgatgcttattactcac

SEQ ID NO: 105620 - DNA, 25 bp, S. pombe
ggcaccgcatatgttgattttgtca

SEQ ID NO: 105621 - DNA, 25 bp, S. pombe
ggctgcttctgctgctatcaaattt

SEQ ID NO: 105622 - DNA, 25 bp, S. pombe
tgcgcttattgcgatgccttaattg

SEQ ID NO: 105623 - DNA, 25 bp, S. pombe
ggcattagtgcagccattcaattag

SEQ ID NO: 105624 - DNA, 25 bp, S. pombe
ggcttccaagcccttgatgacttaa

SEQ ID NO: 105625 - DNA, 25 bp, S. pombe
ggcatatccaacacttgatcagaaa

SEQ ID NO: 105626 - DNA, 25 bp, S. pombe
ggctagcaaagcaatcctggaagaa

SEQ ID NO: 105627 - DNA, 25 bp, S. pombe
ggcttctttgtttcctaaccagcaa

SEQ ID NO: 105628 - DNA, 25 bp, S. pombe
ggcttaaaacctgacacttcatcgt

SEQ ID NO: 105629 - DNA, 25 bp, S. pombe
ggctatcaacacacggcagtttgtc

SEQ ID NO: 105630 - DNA, 25 bp, S. pombe
ggcttcatctaagaacgtcccatta

SEQ ID NO: 105631 - DNA, 25 bp, S. pombe
ggcattccaacaaaacgacccattg

SEQ ID NO: 105632 - DNA, 25 bp, S. pombe
ggcttcgaagcagaaacacatcctt

SEQ ID NO: 105633 - DNA, 25 bp, S. pombe
ggcgttgaagttaaggacatctcct

SEQ ID NO: 105634 - DNA, 25 bp, S. pombe
ggcgtctctcttgatgagaatggca

SEQ ID NO: 105635 - DNA, 25 bp, S. pombe
ggcagtaccttcttcagcaagctat

SEQ ID NO: 105636 - DNA, 25 bp, S. pombe
ggcagtagccattcatctagtatta

SEQ ID NO: 105637 - DNA, 25 bp, S. pombe
ggcattctccattttcagtcattac

SEQ ID NO: 105638 - DNA, 25 bp, S. pombe
ggctacattcgccttagaagctggt

SEQ ID NO: 105639 - DNA, 25 bp, S. pombe
ggctatttcctgtttggtgcggata

SEQ ID NO: 105640 - DNA, 25 bp, S. pombe
ggcagctgacaaacatcttccaaaa

SEQ ID NO: 105641 - DNA, 25 bp, S. pombe
ggcttcgcaacgctatatctcaatt

SEQ ID NO: 105642 - DNA, 25 bp, S. pombe
ggcatcagcgatttagttactcctt

SEQ ID NO: 105643 - DNA, 25 bp, S. pombe
ggctcaggttatatctaccctcaaa

SEQ ID NO: 105644 - DNA, 25 bp, S. pombe
ggctggcgtggtatccaaacttatt

SEQ ID NO: 105645 - DNA, 25 bp, S. pombe
ggctatgcgtccacacaatgaactt

SEQ ID NO: 105646 - DNA, 25 bp, S. pombe
ggcatattcccaacaaggtactcat

SEQ ID NO: 105647 - DNA, 25 bp, S. pombe
ggcttcccaaactaacttatgcact

SEQ ID NO: 105648 - DNA, 25 bp, S. pombe
ggcaggaaatgccttgcttcaacaa

SEQ ID NO: 105649 - DNA, 25 bp, S. pombe
ggcaggtataccatcttaaagcagg

SEQ ID NO: 105650 - DNA, 25 bp, S. pombe
ggcattttggccgtcttcaatatgg

SEQ ID NO: 105651 - DNA, 25 bp, S. pombe
ggctttgtggccattcgagacatta

SEQ ID NO: 105652 - DNA, 25 bp, S. pombe
ggctttttccagatacaccttacaa

SEQ ID NO: 105653 - DNA, 25 bp, S. pombe
ggcttttctgtctctaccagtaaaa

SEQ ID NO: 105654 - DNA, 25 bp, S. pombe
ggctatgacttttcctttaggtaca

SEQ ID NO: 105655 - DNA, 25 bp, S. pombe
ggctatagcatttacctttccggta

SEQ ID NO: 105656 - DNA, 25 bp, S. pombe
ggctttttgaatgaataccgagtat

SEQ ID NO: 105657 - DNA, 25 bp, S. pombe
ggctcctgaattacctaaaccgttg

SEQ ID NO: 105658 - DNA, 25 bp, S. pombe
ggctcttaacgcattaactgcactt

SEQ ID NO: 105659 - DNA, 25 bp, S. pombe
ggctattaacgcgactattacctct

SEQ ID NO: 105660 - DNA, 25 bp, S. pombe
ggctttcgaggctataacccgtaca

SEQ ID NO: 105661 - DNA, 25 bp, S. pombe
ggcagacctgcaacttataatccga

SEQ ID NO: 105662 - DNA, 25 bp, S. pombe
ggcgagtacaacgttcttgtcggaa

SEQ ID NO: 105663 - DNA, 25 bp, S. pombe
tggtggtggcagatctaccggcttc

SEQ ID NO: 105664 - DNA, 25 bp, S. pombe
ggcagatgatggctttaccgtctac

SEQ ID NO: 105665 - DNA, 25 bp, S. pombe
ggcgattccgaattatccgtgcata

SEQ ID NO: 105666 - DNA, 25 bp, S. pombe
ggcgtgggtatgtgaactctcttga

SEQ ID NO: 105667 - DNA, 25 bp, S. pombe
ggcttcaagttctaccatcgattta

SEQ ID NO: 105668 - DNA, 25 bp, S. pombe
ggcttgctggttctcaacaatttca

SEQ ID NO: 105669 - DNA, 25 bp, S. pombe
ggcggtcgtatcgttaatatctatc

SEQ ID NO: 105670 - DNA, 25 bp, S. pombe
ggcatgggcggatgtcaacttctac

SEQ ID NO: 105671 - DNA, 25 bp, S. pombe
ggctcgaacgtgcatgtaagtctaa

SEQ ID NO: 105672 - DNA, 25 bp, S. pombe
ggctctgaacagttggatgaaccta

SEQ ID NO: 105673 - DNA, 25 bp, S. pombe
ggcttacacagctgcaaggaaccaa

SEQ ID NO: 105674 - DNA, 25 bp, S. pombe
ggctgttagctcgtcacggaagcaa

SEQ ID NO: 105675 - DNA, 25 bp, S. pombe
ggctttcctggtcatcgtaggcaaa

SEQ ID NO: 105676 - DNA, 25 bp, S. pombe
ggcttctcgtttgatcgttcatgaa

SEQ ID NO: 105677 - DNA, 25 bp, S. pombe
ggctatccaagctatgttcaagtta

SEQ ID NO: 105678 - DNA, 25 bp, S. pombe
tggaaggtttggcttactcccacgg

SEQ ID NO: 105679 - DNA, 25 bp, S. pombe
tgaagtggttggaggtactacccct

SEQ ID NO: 105680 - DNA, 25 bp, S. pombe
tatcgggtgtggaaagtcccatttc

SEQ ID NO: 105681 - DNA, 25 bp, S. pombe
ggcgtgttcaatctgagcatccatg

SEQ ID NO: 105682 - DNA, 25 bp, S. pombe
ggcggtgtcattactactcaagctg

SEQ ID NO: 105683 - DNA, 25 bp, S. pombe
ggctgttatgatggctttagcccca

SEQ ID NO: 105684 - DNA, 25 bp, S. pombe
ggcagtgatgattcttcctctgaag

SEQ ID NO: 105685 - DNA, 25 bp, S. pombe
ggcattgtgcattttcctatacttc

SEQ ID NO: 105686 - DNA, 25 bp, S. pombe
ggctaatgatgcttttaacgtcgat

SEQ ID NO: 105687 - DNA, 25 bp, S. pombe
ggcttcagtgcctcaaattgctaat

SEQ ID NO: 105688 - DNA, 25 bp, S. pombe
tggccccgtcactttcgagaaagat

SEQ ID NO: 105689 - DNA, 25 bp, S. pombe
ggctactatggatcaatacgttctt

SEQ ID NO: 105690 - DNA, 25 bp, S. pombe
ggcataccaaccgtgggaactagtt

SEQ ID NO: 105691 - DNA, 25 bp, S. pombe
ggctacgaaccaaattcacctacta

SEQ ID NO: 105692 - DNA, 25 bp, S. pombe
ggctttatccatcttagtgctttaa

SEQ ID NO: 105693 - DNA, 25 bp, S. pombe
ggcttctgtacattttatcttccga

SEQ ID NO: 105694 - DNA, 25 bp, S. pombe
ggcatctagggctttttcattactg

SEQ ID NO: 105695 - DNA, 25 bp, S. pombe
ggcatctgatgcctgcttttgatga

SEQ ID NO: 105696 - DNA, 25 bp, S. pombe
ggcattgctgcctatgtgattatga

SEQ ID NO: 105697 - DNA, 25 bp, S. pombe
ggctacactacttatcgtgggtctt

SEQ ID NO: 105698 - DNA, 25 bp, S. pombe
ggctagcgcggatcataccagggat

SEQ ID NO: 105699 - DNA, 25 bp, S. pombe
ggctcggcttttctatctggttgaa

SEQ ID NO: 105700 - DNA, 25 bp, S. pombe
ggcatccaatttccactgtacgaat

SEQ ID NO: 105701 - DNA, 25 bp, S. pombe
ggctcgtcttgatgccgaactcaag

SEQ ID NO: 105702 - DNA, 25 bp, S. pombe
ggctccggtaactagtgatatccca

SEQ ID NO: 105703 - DNA, 25 bp, S. pombe
tgacccgactacgttcattttttgg

SEQ ID NO: 105704 - DNA, 25 bp, S. pombe
tccctcgtttacactttttcatggt

SEQ ID NO: 105705 - DNA, 25 bp, S. pombe
tccgtcgttaacactggcaacaagc

SEQ ID NO: 105706 - DNA, 25 bp, S. pombe
ggcccaggtaactctagtcaaccga

SEQ ID NO: 105707 - DNA, 25 bp, S. pombe
tgccacccaaaagaccgttgacggt

SEQ ID NO: 105708 - DNA, 25 bp, S. pombe
tggcctacccaagaattttacgagt

SEQ ID NO: 105709 - DNA, 25 bp, S. pombe
ggcgctaccgcggttactattaaag

SEQ ID NO: 105710 - DNA, 25 bp, S. pombe
ggcttcctgcccctgtaataaaggg

SEQ ID NO: 105711 - DNA, 25 bp, S. pombe
ggctatcatagcgattgcacccgaa

SEQ ID NO: 105712 - DNA, 25 bp, S. pombe
ggctgcatcaaatttgcgtgccatg

SEQ ID NO: 105713 - DNA, 25 bp, S. pombe
ggcatcaatcgtgctggctatgtta

SEQ ID NO: 105714 - DNA, 25 bp, S. pombe
ggctattcccctcgaggatgaaagc

SEQ ID NO: 105715 - DNA, 25 bp, S. pombe
ggcatcaaacggcaactattcaatt

SEQ ID NO: 105716 - DNA, 25 bp, S. pombe
ggctaaggcgggtatctctaatttt

SEQ ID NO: 105717 - DNA, 25 bp, S. pombe
tgtccaaggccaccttttactttga

SEQ ID NO: 105718 - DNA, 25 bp, S. pombe
tctgcggatacctttttacctttga

SEQ ID NO: 105719 - DNA, 25 bp, S. pombe
tgctctcgaacctcgttatttggga

SEQ ID NO: 105720 - DNA, 25 bp, S. pombe
ggctcttcggctagatggtactatg

SEQ ID NO: 105721 - DNA, 25 bp, S. pombe
ggcttgatccagtggttgtctcaaa

SEQ ID NO: 105722 - DNA, 25 bp, S. pombe
ggcttgcttgacctttgatgaacta

SEQ ID NO: 105723 - DNA, 25 bp, S. pombe
ggctgctgctataagttgcgcatca

SEQ ID NO: 105724 - DNA, 25 bp, S. pombe
ggctgagcaatatcttgcgctgcaa

SEQ ID NO: 105725 - DNA, 25 bp, S. pombe
ggcttaacatgtttaatcctattga

SEQ ID NO: 105726 - DNA, 25 bp, S. pombe
ggcttccagatttatctatccttta

SEQ ID NO: 105727 - DNA, 25 bp, S. pombe
ggctgcggaacatttgcgatctacg

SEQ ID NO: 105728 - DNA, 25 bp, S. pombe
ggcttgtcaatccttggattctcgc

SEQ ID NO: 105729 - DNA, 25 bp, S. pombe
ggctaggccttcagcatatagatca

SEQ ID NO: 105730 - DNA, 25 bp, S. pombe
ggcattgaattgagtcccttggcta

SEQ ID NO: 105731 - DNA, 25 bp, S. pombe
tggctggacatttcaacccttggaa

SEQ ID NO: 105732 - DNA, 25 bp, S. pombe
ggcattgattgcttttacatttcac

SEQ ID NO: 105733 - DNA, 25 bp, S. pombe
ggctcatgaaaatcgatccctggct

SEQ ID NO: 105734 - DNA, 25 bp, S. pombe
ggctagcactaaccattcttgtctt

SEQ ID NO: 105735 - DNA, 25 bp, S. pombe
ggcttattcatactcttattgtctg

SEQ ID NO: 105736 - DNA, 25 bp, S. pombe
ggctcctccatactttatatttcac

SEQ ID NO: 105737 - DNA, 25 bp, S. pombe
ggcttctcgatactttattgaccat

SEQ ID NO: 105738 - DNA, 25 bp, S. pombe
ggcttacaagattacgcttacccct

SEQ ID NO: 105739 - DNA, 25 bp, S. pombe
tggctggaattatcaacgtaccctt

SEQ ID NO: 105740 - DNA, 25 bp, S. pombe
tggcattcaattcaaccgtgagccc

SEQ ID NO: 105741 - DNA, 25 bp, S. pombe
tgtttcaattgccaatgattgtaga

SEQ ID NO: 105742 - DNA, 25 bp, S. pombe
ggcttcttgcgcgatcaattcaatt

SEQ ID NO: 105743 - DNA, 25 bp, S. pombe
ggctcctaggcctttgttgtacata

SEQ ID NO: 105744 - DNA, 25 bp, S. pombe
ggctagcccggctgtaggaaatcaa

SEQ ID NO: 105745 - DNA, 25 bp, S. pombe
ggctgaacgcggtgtcatccaaaaa

SEQ ID NO: 105746 - DNA, 25 bp, S. pombe
ggctagtgccaatgcgtattatatt

SEQ ID NO: 105747 - DNA, 25 bp, S. pombe
ggcatattgtctatccttgtcatca

SEQ ID NO: 105748 - DNA, 25 bp, S. pombe
ggctcaattttgcagatgtcagatc

SEQ ID NO: 105749 - DNA, 25 bp, S. pombe
ggctcttcgatctgctttatttgca

SEQ ID NO: 105750 - DNA, 25 bp, S. pombe
ggctcttcgataagtcatctcactg

SEQ ID NO: 105751 - DNA, 25 bp, S. pombe
ggctaatgttttgacttctactgca

SEQ ID NO: 105752 - DNA, 25 bp, S. pombe
ggcgctgctcagataccgagtgtca

SEQ ID NO: 105753 - DNA, 25 bp, S. pombe
ggctcttcaatcttagcaagcgcac

SEQ ID NO: 105754 - DNA, 25 bp, S. pombe
ggcggaactgcatattttactctta

SEQ ID NO: 105755 - DNA, 25 bp, S. pombe
ggcggatccgtacttattggtctat

SEQ ID NO: 105756 - DNA, 25 bp, S. pombe
ggcttgtctgcattggtcttcaaaa

SEQ ID NO: 105757 - DNA, 25 bp, S. pombe
ggctattctattcgagatattgaag

SEQ ID NO: 105758 - DNA, 25 bp, S. pombe
tggaccctctaatacatccgatggt

SEQ ID NO: 105759 - DNA, 25 bp, S. pombe
ggcttacttagattcacttcgttgg

SEQ ID NO: 105760 - DNA, 25 bp, S. pombe
ggctccagttaattcacattctttt

SEQ ID NO: 105761 - DNA, 25 bp, S. pombe
ggcgctttaatccaaattcgtcgtc

SEQ ID NO: 105762 - DNA, 25 bp, S. pombe
ggcgttttactatcttgccttgata

SEQ ID NO: 105763 - DNA, 25 bp, S. pombe
ggcttcttcgctcaaaccaagatac

SEQ ID NO: 105764 - DNA, 25 bp, S. pombe
ggctttttatcatgcatcacctaga

SEQ ID NO: 105765 - DNA, 25 bp, S. pombe
ggctgatgtatttttcaccctcgaa

SEQ ID NO: 105766 - DNA, 25 bp, S. pombe
ggcttgaatacagctccataccgaa

SEQ ID NO: 105767 - DNA, 25 bp, S. pombe
ggctctagctattcctacttggtta

SEQ ID NO: 105768 - DNA, 25 bp, S. pombe
ggcttactttcctatctgtatttca

SEQ ID NO: 105769 - DNA, 25 bp, S. pombe
ggcctttttccttcgaattgcaatt

SEQ ID NO: 105770 - DNA, 25 bp, S. pombe
ggctgctttatttcttcgtttcaaa

SEQ ID NO: 105771 - DNA, 25 bp, S. pombe
ggctttattctctcgttatatgcaa

SEQ ID NO: 105772 - DNA, 25 bp, S. pombe
ggctttattccgtgctttgaagaca

SEQ ID NO: 105773 - DNA, 25 bp, S. pombe
ggctagtattcctgcctttacggaa

SEQ ID NO: 105774 - DNA, 25 bp, S. pombe
ggcgagtttcaatcttcttacgtgc

SEQ ID NO: 105775 - DNA, 25 bp, S. pombe
ggctaacttagatctatttccttgt

SEQ ID NO: 105776 - DNA, 25 bp, S. pombe
ggctacgacgatttctatttccttg

SEQ ID NO: 105777 - DNA, 25 bp, S. pombe
ggctgctcaaggtggtatttcttct

SEQ ID NO: 105778 - DNA, 25 bp, S. pombe
ggctctccgtatcgaggactttttg

SEQ ID NO: 105779 - DNA, 25 bp, S. pombe
ggcttcctgtcctcaaatgaatgct

SEQ ID NO: 105780 - DNA, 25 bp, S. pombe
ggcttcgctttgatctatgactcta

SEQ ID NO: 105781 - DNA, 25 bp, S. pombe
ggctcaagagcctcggcagatgaat

SEQ ID NO: 105782 - DNA, 25 bp, S. pombe
ggctcactggcagaagtatcccaat

SEQ ID NO: 105783 - DNA, 25 bp, S. pombe
ggcttgctttgtgggagatcgactc

SEQ ID NO: 105784 - DNA, 25 bp, S. pombe
ggctccttttcttgaagcgaacaga

SEQ ID NO: 105785 - DNA, 25 bp, S. pombe
ggctgcgctgttgacgaatgctcca

SEQ ID NO: 105786 - DNA, 25 bp, S. pombe
ggctgcgtgttacatgcaatgctat

SEQ ID NO: 105787 - DNA, 25 bp, S. pombe
tgggttacctgacaatgcttctcta

SEQ ID NO: 105788 - DNA, 25 bp, S. pombe
tgggtggaccgaaccataccttata

SEQ ID NO: 105789 - DNA, 25 bp, S. pombe
ggctggtaacgatcctgcaatttca

SEQ ID NO: 105790 - DNA, 25 bp, S. pombe
ggcgttcatcaacccaaacatttgt

SEQ ID NO: 105791 - DNA, 25 bp, S. pombe
ggcgttattgtagcgtccacttgtc

SEQ ID NO: 105792 - DNA, 25 bp, S. pombe
ggcttcttggaagcgattcctgtaa

SEQ ID NO: 105793 - DNA, 25 bp, S. pombe
ggctactcgggttcagatatttcta

SEQ ID NO: 105794 - DNA, 25 bp, S. pombe
ggctttttcatgtccggattctata

SEQ ID NO: 105795 - DNA, 25 bp, S. pombe
ggctttttcttaggaggtgcgcata

SEQ ID NO: 105796 - DNA, 25 bp, S. pombe
ggcttttctcaaggctactgtggaa

SEQ ID NO: 105797 - DNA, 25 bp, S. pombe
ggcttttttgacatccctgtagaca

SEQ ID NO: 105798 - DNA, 25 bp, S. pombe
ggccatattattacgtaccttagga

SEQ ID NO: 105799 - DNA, 25 bp, S. pombe
ggccataaatcttgggtcaccgatg

SEQ ID NO: 105800 - DNA, 25 bp, S. pombe
ggctgcaaatgcttcgagatctaca

SEQ ID NO: 105801 - DNA, 25 bp, S. pombe
ggcttcgatgatatctcgtattcaa

SEQ ID NO: 105802 - DNA, 25 bp, S. pombe
ggcttcttctcttggtttttatgta

SEQ ID NO: 105803 - DNA, 25 bp, S. pombe
ggctcttctagctggatatggttca

SEQ ID NO: 105804 - DNA, 25 bp, S. pombe
ggctctcctagcgaagctggtttaa

SEQ ID NO: 105805 - DNA, 25 bp, S. pombe
tggtcccggtacttggtttagcaag

SEQ ID NO: 105806 - DNA, 25 bp, S. pombe
ggcttctctgcttactttctattaa

SEQ ID NO: 105807 - DNA, 25 bp, S. pombe
ggctttgcagttggtggcacctcaa

SEQ ID NO: 105808 - DNA, 25 bp, S. pombe
ggctttagtggatataccagttcat

SEQ ID NO: 105809 - DNA, 25 bp, S. pombe
ggctctcatttatccaaccagttat

SEQ ID NO: 105810 - DNA, 25 bp, S. pombe
ggcttcttcaaaacttctacgcaaa

SEQ ID NO: 105811 - DNA, 25 bp, S. pombe
ggctctcttaatcttttcaatgcaa

SEQ ID NO: 105812 - DNA, 25 bp, S. pombe
ggcgcgtaggttaatttcgcattac

SEQ ID NO: 105813 - DNA, 25 bp, S. pombe
ggccctagcattttacttgttactg

SEQ ID NO: 105814 - DNA, 25 bp, S. pombe
tgatacctggtttacttcgttacga

SEQ ID NO: 105815 - DNA, 25 bp, S. pombe
ggctttggtcgcaatgaacgctcca

SEQ ID NO: 105816 - DNA, 25 bp, S. pombe
tggcagttgttgtcgaccctattca

SEQ ID NO: 105817 - DNA, 25 bp, S. pombe
ggctgtagtcttccaatcttattca

SEQ ID NO: 105818 - DNA, 25 bp, S. pombe
ggctttgtatttcctgttccaaaag

SEQ ID NO: 105819 - DNA, 25 bp, S. pombe
ggctcagtcctatcgtttgcaaaat

SEQ ID NO: 105820 - DNA, 25 bp, S. pombe
ggctattcctaaattacctccaaag

SEQ ID NO: 105821 - DNA, 25 bp, S. pombe
ggctcccactgtttctgacacttga

SEQ ID NO: 105822 - DNA, 25 bp, S. pombe
ggctgacgatattgacttacttgaa

SEQ ID NO: 105823 - DNA, 25 bp, S. pombe
ggctgctcgcaaagctattactgct

SEQ ID NO: 105824 - DNA, 25 bp, S. pombe
ggcgatacagttaatcctgccgacc

SEQ ID NO: 105825 - DNA, 25 bp, S. pombe
ggcttatcgtgctttgactttgaca

SEQ ID NO: 105826 - DNA, 25 bp, S. pombe
ggcttatgcatttattcctgtttca

SEQ ID NO: 105827 - DNA, 25 bp, S. pombe
ggctatcatcattctttttgcattt

SEQ ID NO: 105828 - DNA, 25 bp, S. pombe
ggctcagctatttattcagctcttt

SEQ ID NO: 105829 - DNA, 25 bp, S. pombe
ggccagtacctttagtgttggtcta

SEQ ID NO: 105830 - DNA, 25 bp, S. pombe
tggccgttacttaacagttgccgct

SEQ ID NO: 105831 - DNA, 25 bp, S. pombe
ggcctagctcgtcaaaatcttcata

SEQ ID NO: 105832 - DNA, 25 bp, S. pombe
ggctatcatttccacaatcgttgag

SEQ ID NO: 105833 - DNA, 25 bp, S. pombe
ggctacctcatggatcattctttga

SEQ ID NO: 105834 - DNA, 25 bp, S. pombe
ggctggttctggacttctttagtat

SEQ ID NO: 105835 - DNA, 25 bp, S. pombe
ggcgatttatgaggcactttacgag

SEQ ID NO: 105836 - DNA, 25 bp, S. pombe
ggctgccacacaaaaatgtccggtg

SEQ ID NO: 105837 - DNA, 25 bp, S. pombe
ggctcctgccttgaattatcagtct

SEQ ID NO: 105838 - DNA, 25 bp, S. pombe
ggctgcatttgatatttctccctta

SEQ ID NO: 105839 - DNA, 25 bp, S. pombe
ggccaacgctagtgattctactgtt

SEQ ID NO: 105840 - DNA, 25 bp, S. pombe
ggctaaactccttgatctccaagtt

SEQ ID NO: 105841 - DNA, 25 bp, S. pombe
ggctacgatgctgcttataccattt

SEQ ID NO: 105842 - DNA, 25 bp, S. pombe
ggctatactctcttggataccattt

SEQ ID NO: 105843 - DNA, 25 bp, S. pombe
ggctcaagtacccattattcctatt

SEQ ID NO: 105844 - DNA, 25 bp, S. pombe
ggctaagttgcccaatatgttgctt

SEQ ID NO: 105845 - DNA, 25 bp, S. pombe
ggcgtagctatcacattcctattta

SEQ ID NO: 105846 - DNA, 25 bp, S. pombe
ggcgatgaccatgttgtcgttgact

SEQ ID NO: 105847 - DNA, 25 bp, S. pombe
ggctgcacccatggttagtggtatt

SEQ ID NO: 105848 - DNA, 25 bp, S. pombe
tggtggaaaggactccccttccgct

SEQ ID NO: 105849 - DNA, 25 bp, S. pombe
tggtggaaagaactccccttctgcc

SEQ ID NO: 105850 - DNA, 25 bp, S. pombe
tgaggaaaacgtacccagtccgagt

SEQ ID NO: 105851 - DNA, 25 bp, S. pombe
tggcaaaaacgttaaactccgctat

SEQ ID NO: 105852 - DNA, 25 bp, S. pombe
ggcgaataggtgttattaccccata

SEQ ID NO: 105853 - DNA, 25 bp, S. pombe
ggcgatgttagtcaagttgtccaag

SEQ ID NO: 105854 - DNA, 25 bp, S. pombe
ggccatttcagagctcgatagtctt

SEQ ID NO: 105855 - DNA, 25 bp, S. pombe
ggctcacctgaaaaaccactttctg

SEQ ID NO: 105856 - DNA, 25 bp, S. pombe
ggctccaatggtatatccacttctt

SEQ ID NO: 105857 - DNA, 25 bp, S. pombe
ggctcgcatagaggaaatccctttt

SEQ ID NO: 105858 - DNA, 25 bp, S. pombe
ggctcgaatgcctaatgattgtcgt

SEQ ID NO: 105859 - DNA, 25 bp, S. pombe
ggctccacagcacatagtcagttga

SEQ ID NO: 105860 - DNA, 25 bp, S. pombe
ggctgatttgctttgtacgtatgga

SEQ ID NO: 105861 - DNA, 25 bp, S. pombe
ggctgcattttacgttcggcttaca

SEQ ID NO: 105862 - DNA, 25 bp, S. pombe
ggcgattttatgcttacagttcctt

SEQ ID NO: 105863 - DNA, 25 bp, S. pombe
ggctggtcctcgctttgagatgaaa

SEQ ID NO: 105864 - DNA, 25 bp, S. pombe
ggctctgctatttgtgctatggaaa

SEQ ID NO: 105865 - DNA, 25 bp, S. pombe
ggctcgccctagtcctaatagaata

SEQ ID NO: 105866 - DNA, 25 bp, S. pombe
ggctccttctcttctattgtcgaag

SEQ ID NO: 105867 - DNA, 25 bp, S. pombe
ggctcgttttgatatttccacagaa

SEQ ID NO: 105868 - DNA, 25 bp, S. pombe
ggcggctctaatggtttcagtttat

SEQ ID NO: 105869 - DNA, 25 bp, S. pombe
ggcggtcaacacatacctgcataag

SEQ ID NO: 105870 - DNA, 25 bp, S. pombe
ggctgtgttcaattccccaataagg

SEQ ID NO: 105871 - DNA, 25 bp, S. pombe
ggctcttcgcaacatccttgaaaag

SEQ ID NO: 105872 - DNA, 25 bp, S. pombe
ggctcttcgtactttttaacaacag

SEQ ID NO: 105873 - DNA, 25 bp, S. pombe
ggcggtagcgttttttgagagcaat

SEQ ID NO: 105874 - DNA, 25 bp, S. pombe
ggctgttgggttttatctcgatgaa

SEQ ID NO: 105875 - DNA, 25 bp, S. pombe
ggcctttgaggattctatacgctac

SEQ ID NO: 105876 - DNA, 25 bp, S. pombe
ggctgaaattcccatgcatattcga

SEQ ID NO: 105877 - DNA, 25 bp, S. pombe
ggctaaagctcaggatgccaccgct

SEQ ID NO: 105878 - DNA, 25 bp, S. pombe
ggctaccagctctcgcaaacgttag

SEQ ID NO: 105879 - DNA, 25 bp, S. pombe
ggctcactagatatccaaatccgta

SEQ ID NO: 105880 - DNA, 25 bp, S. pombe
ggctcactatatttcctttacttca

SEQ ID NO: 105881 - DNA, 25 bp, S. pombe
ggctcatccaatttactgtgttcct

SEQ ID NO: 105882 - DNA, 25 bp, S. pombe
ggctccagcgacaagacaattccat

SEQ ID NO: 105883 - DNA, 25 bp, S. pombe
ggcgaagccctacgagctgtaattt

SEQ ID NO: 105884 - DNA, 25 bp, S. pombe
ggccaatgctggacctaacacaaat

SEQ ID NO: 105885 - DNA, 25 bp, S. pombe
ggcggtttgacctttcgtgaagcaa

SEQ ID NO: 105886 - DNA, 25 bp, S. pombe
ggcggtttgactttccgtgaggcaa

SEQ ID NO: 105887 - DNA, 25 bp, S. pombe
ggcggtgccactaaaactcctagta

SEQ ID NO: 105888 - DNA, 25 bp, S. pombe
tggaccgtcatttaaaccctcagaa

SEQ ID NO: 105889 - DNA, 25 bp, S. pombe
tgtcccttttacaaccgcttatttg

SEQ ID NO: 105890 - DNA, 25 bp, S. pombe
tgaccctgagttgcaagaccttttc

SEQ ID NO: 105891 - DNA, 25 bp, S. pombe
ggccgggtagtggaagcttcaattt

SEQ ID NO: 105892 - DNA, 25 bp, S. pombe
ggcgagcaagctcctggaatcattc

SEQ ID NO: 105893 - DNA, 25 bp, S. pombe
ggcgatgcctcaagtcctataagaa

SEQ ID NO: 105894 - DNA, 25 bp, S. pombe
ggctgatcatgatgcgtacctcaca

SEQ ID NO: 105895 - DNA, 25 bp, S. pombe
ggctgcattggacctatcaccaaaa

SEQ ID NO: 105896 - DNA, 25 bp, S. pombe
ggctcatattattttatccttactg

SEQ ID NO: 105897 - DNA, 25 bp, S. pombe
ggccataaaaggtattccctcgctt

SEQ ID NO: 105898 - DNA, 25 bp, S. pombe
tggagcaaagcaagactcgtccctt

SEQ ID NO: 105899 - DNA, 25 bp, S. pombe
ggcggtcgaggaagcaatccaccat

SEQ ID NO: 105900 - DNA, 25 bp, S. pombe
ggcggtgtaaatccatatccatcct

SEQ ID NO: 105901 - DNA, 25 bp, S. pombe
ggctgagagtcaatggcacctgtgc

SEQ ID NO: 105902 - DNA, 25 bp, S. pombe
ggcgtgagccattgcatgacattat

SEQ ID NO: 105903 - DNA, 25 bp, S. pombe
ggcgtatgcattcactatcactgta

SEQ ID NO: 105904 - DNA, 25 bp, S. pombe
ggcgctagtggctacatgcatttat

SEQ ID NO: 105905 - DNA, 25 bp, S. pombe
ggctctatattccatcatgctctta

SEQ ID NO: 105906 - DNA, 25 bp, S. pombe
ggctcattgatctttctactggtaa

SEQ ID NO: 105907 - DNA, 25 bp, S. pombe
ggctcacggtctatgacggctggat

SEQ ID NO: 105908 - DNA, 25 bp, S. pombe
tggcattgactctgaaggattccga

SEQ ID NO: 105909 - DNA, 25 bp, S. pombe
tggaactcttcctcttagtgcacaa

SEQ ID NO: 105910 - DNA, 25 bp, S. pombe
tggaaatttaccttgggccacctca

SEQ ID NO: 105911 - DNA, 25 bp, S. pombe
tggtacgttacctgtgctaagtgcc

SEQ ID NO: 105912 - DNA, 25 bp, S. pombe
tgaaaacgtacctctctaatcgtcc

SEQ ID NO: 105913 - DNA, 25 bp, S. pombe
ggctgttctcctcaaacatgtttca

SEQ ID NO: 105914 - DNA, 25 bp, S. pombe
ggcgtctactctcaaagcctttata

SEQ ID NO: 105915 - DNA, 25 bp, S. pombe
ggctgcatcgaccttaattcggtat

SEQ ID NO: 105916 - DNA, 25 bp, S. pombe
ggctcgtgaagctcgttggtaatta

SEQ ID NO: 105917 - DNA, 25 bp, S. pombe
ggccggcaacaccaatacgaggata

SEQ ID NO: 105918 - DNA, 25 bp, S. pombe
ggctcgatgagtttatgtacggatt

SEQ ID NO: 105919 - DNA, 25 bp, S. pombe
ggcgactgtttttctagctcaatta

SEQ ID NO: 105920 - DNA, 25 bp, S. pombe
ggcgttgttgcgttttgggatatac

SEQ ID NO: 105921 - DNA, 25 bp, S. pombe
ggcgatttccgtctctaagaatcca

SEQ ID NO: 105922 - DNA, 25 bp, S. pombe
ggcccttgcgctggtattgaaatgg

SEQ ID NO: 105923 - DNA, 25 bp, S. pombe
ggctcacttgctgctccagaaataa

SEQ ID NO: 105924 - DNA, 25 bp, S. pombe
ggctcgcgtgctcatatggtgaaca

SEQ ID NO: 105925 - DNA, 25 bp, S. pombe
ggccgacatgatttggtgcattcca

SEQ ID NO: 105926 - DNA, 25 bp, S. pombe
ggctgcgccaaacggtcttacaaaa

SEQ ID NO: 105927 - DNA, 25 bp, S. pombe
ggccgaagcaattttttacaagatc

SEQ ID NO: 105928 - DNA, 25 bp, S. pombe
ggctctcaactctactattgtgacg

SEQ ID NO: 105929 - DNA, 25 bp, S. pombe
ggcgctaatatctcgcagttggcga

SEQ ID NO: 105930 - DNA, 25 bp, S. pombe
ggcgccgtaccacagatgcagaagc

SEQ ID NO: 105931 - DNA, 25 bp, S. pombe
tggcgctcaggaaaaaacggagtct

SEQ ID NO: 105932 - DNA, 25 bp, S. pombe
ggctgacctggttgcagagcattta

SEQ ID NO: 105933 - DNA, 25 bp, S. pombe
ggctcatcctgccagcatcaagaaa

SEQ ID NO: 105934 - DNA, 25 bp, S. pombe
ggccattttggctaagtcctagaca

SEQ ID NO: 105935 - DNA, 25 bp, S. pombe
ggctgcagtgcctttatcgtttaag

SEQ ID NO: 105936 - DNA, 25 bp, S. pombe
ggctgcgcatccatacatttttaac

SEQ ID NO: 105937 - DNA, 25 bp, S. pombe
ggctgacagcactttctttttcaaa

SEQ ID NO: 105938 - DNA, 25 bp, S. pombe
ggctgaaccattgtactttagaata

SEQ ID NO: 105939 - DNA, 25 bp, S. pombe
ggcgatttacgagccaattggtctc

SEQ ID NO: 105940 - DNA, 25 bp, S. pombe
ggcgtatctacgtaccaaatgcttc

SEQ ID NO: 105941 - DNA, 25 bp, S. pombe
ggctgcggtgtcaaactgctagata

SEQ ID NO: 105942 - DNA, 25 bp, S. pombe
ggctgagcgattagcattctctaaa

SEQ ID NO: 105943 - DNA, 25 bp, S. pombe
ggctgacattgtacttcttgtttcc

SEQ ID NO: 105944 - DNA, 25 bp, S. pombe
ggcgacaacgcttatttacttccag

SEQ ID NO: 105945 - DNA, 25 bp, S. pombe
ggcgaaacttacgtatcatcttttg

SEQ ID NO: 105946 - DNA, 25 bp, S. pombe
ggcgacaaatcgtcctgatactcta

SEQ ID NO: 105947 - DNA, 25 bp, S. pombe
ggcggaacatcgtttatctttggac

SEQ ID NO: 105948 - DNA, 25 bp, S. pombe
ggccaagtctttttcattaccaatg

SEQ ID NO: 105949 - DNA, 25 bp, S. pombe
ggccgatttacaactgaagccgaaa

SEQ ID NO: 105950 - DNA, 25 bp, S. pombe
ggccccattcctatcgattggatgc

SEQ ID NO: 105951 - DNA, 25 bp, S. pombe
tgggcccttgacaccaattggagga

SEQ ID NO: 105952 - DNA, 25 bp, S. pombe
tgaaaccggagttccttattggaat

SEQ ID NO: 105953 - DNA, 25 bp, S. pombe
ggctgaacttggcagattacttcta

SEQ ID NO: 105954 - DNA, 25 bp, S. pombe
tggccggttcgtacttcatttgaag

SEQ ID NO: 105955 - DNA, 25 bp, S. pombe
ggcgcgtggcttgttgttttaagac

SEQ ID NO: 105956 - DNA, 25 bp, S. pombe
ggccgtccgatctttattcattaag

SEQ ID NO: 105957 - DNA, 25 bp, S. pombe
ggctggtcacgttgctgctttaaaa

SEQ ID NO: 105958 - DNA, 25 bp, S. pombe
ggctgttgcttttgctcattatgaa

SEQ ID NO: 105959 - DNA, 25 bp, S. pombe
ggcgtgatcttgtccgtgtttgtga

SEQ ID NO: 105960 - DNA, 25 bp, S. pombe
ggcggtcttgacgagtatcttgtaa

SEQ ID NO: 105961 - DNA, 25 bp, S. pombe
ggcccaagaaacttaccagcagctt

SEQ ID NO: 105962 - DNA, 25 bp, S. pombe
ggccgcgaatatattacttagctca

SEQ ID NO: 105963 - DNA, 25 bp, S. pombe
ggctgccctgggagcttatgaagat

SEQ ID NO: 105964 - DNA, 25 bp, S. pombe
ggctccacaggtgtctattgcaaat

SEQ ID NO: 105965 - DNA, 25 bp, S. pombe
ggcgatacaccttccaaacgagaac

SEQ ID NO: 105966 - DNA, 25 bp, S. pombe
tgggaagatcctgacgaccgcaaag

SEQ ID NO: 105967 - DNA, 25 bp, S. pombe
tgggaagtcttccagcaaaggctta

SEQ ID NO: 105968 - DNA, 25 bp, S. pombe
ggctgggaagatgctcgctatttta

SEQ ID NO: 105969 - DNA, 25 bp, S. pombe
ggcgtcagagtatcaagggttccaa

SEQ ID NO: 105970 - DNA, 25 bp, S. pombe
ggcggcattattttactggaaccaa

SEQ ID NO: 105971 - DNA, 25 bp, S. pombe
ggcggactttcacagattcaaccat

SEQ ID NO: 105972 - DNA, 25 bp, S. pombe
ggcgaacttctccaaactcaaatta

SEQ ID NO: 105973 - DNA, 25 bp, S. pombe
ggcgattcttcccaaacaactttgt

SEQ ID NO: 105974 - DNA, 25 bp, S. pombe
ggctgcttcatacccaaagtacgtt

SEQ ID NO: 105975 - DNA, 25 bp, S. pombe
ggccgtagaccaggaaatgttgttc

SEQ ID NO: 105976 - DNA, 25 bp, S. pombe
ggcgcgctgaatatactcactttaa

SEQ ID NO: 105977 - DNA, 25 bp, S. pombe
ggcgtttggaatgcctctactacat

SEQ ID NO: 105978 - DNA, 25 bp, S. pombe
ggcgcttagcatttctgggtagctt

SEQ ID NO: 105979 - DNA, 25 bp, S. pombe
ggctgttcgctcaatgctgtatgat

SEQ ID NO: 105980 - DNA, 25 bp, S. pombe
ggctggatcccatttcattgtaaaa

SEQ ID NO: 105981 - DNA, 25 bp, S. pombe
ggcgagtccatttccattgtaacgg

SEQ ID NO: 105982 - DNA, 25 bp, S. pombe
ggccgtgcttataagcgtcttttat

SEQ ID NO: 105983 - DNA, 25 bp, S. pombe
ggccgtgcttataagcgtcttttat

SEQ ID NO: 105984 - DNA, 25 bp, S. pombe
ggctgctcatgataaatttgcgtat

SEQ ID NO: 105985 - DNA, 25 bp, S. pombe
ggctgctaataaatctcttcgttct

SEQ ID NO: 105986 - DNA, 25 bp, S. pombe
ggctgccctgccgaaaacgaaaagt

SEQ ID NO: 105987 - DNA, 25 bp, S. pombe
ggctgcctggtgcaacatgactgaa

SEQ ID NO: 105988 - DNA, 25 bp, S. pombe
ggctgagtcactcaagcatactcaa

SEQ ID NO: 105989 - DNA, 25 bp, S. pombe
ggcgcgtactccctcaagattagaa

SEQ ID NO: 105990 - DNA, 25 bp, S. pombe
ggccaaagcttccaacagtatgatt

SEQ ID NO: 105991 - DNA, 25 bp, S. pombe
ggctgatataatgctttgccctatg

SEQ ID NO: 105992 - DNA, 25 bp, S. pombe
ggctggatattcatttcgccaaggt

SEQ ID NO: 105993 - DNA, 25 bp, S. pombe
ggcgacttctctaggtataccactt

SEQ ID NO: 105994 - DNA, 25 bp, S. pombe
ggcgctttgtcttggattttggtat

SEQ ID NO: 105995 - DNA, 25 bp, S. pombe
ggcgtttgttcatcaagaatttcga

SEQ ID NO: 105996 - DNA, 25 bp, S. pombe
ggcgtatgccatttcacgaggctta

SEQ ID NO: 105997 - DNA, 25 bp, S. pombe
ggcgtccatttttaatgcgctatga

SEQ ID NO: 105998 - DNA, 25 bp, S. pombe
ggccctggtgagtggatctgcattc

SEQ ID NO: 105999 - DNA, 25 bp, S. pombe
ggccctgatttctcgatggattcca

SEQ ID NO: 106000 - DNA, 25 bp, S. pombe
ggcgagcttgtttatcatcatggat

SEQ ID NO: 106001 - DNA, 25 bp, S. pombe
tggcgccgttcttatgacattgctc

SEQ ID NO: 106002 - DNA, 25 bp, S. pombe
ggcgctcgatttaagtcatacccaa

SEQ ID NO: 106003 - DNA, 25 bp, S. pombe
tggcggcgtcttggagttcactcga

SEQ ID NO: 106004 - DNA, 25 bp, S. pombe
ggctgtggatcctttgatggacatt

SEQ ID NO: 106005 - DNA, 25 bp, S. pombe
ggcggattccgatgatgagatcttt

SEQ ID NO: 106006 - DNA, 25 bp, S. pombe
tggcggtatccttcgtggtaattta

SEQ ID NO: 106007 - DNA, 25 bp, S. pombe
tgggccttggactggttatctatta

SEQ ID NO: 106008 - DNA, 25 bp, S. pombe
tggctcgttggcgtgggaaatcttc

SEQ ID NO: 106009 - DNA, 25 bp, S. pombe
ggccacaccttttggagacttgcat

SEQ ID NO: 106010 - DNA, 25 bp, S. pombe
tggccgcacctatttgggacttaaa

SEQ ID NO: 106011 - DNA, 25 bp, S. pombe
ggccctcttattcgctggagtgaaa

SEQ ID NO: 106012 - DNA, 25 bp, S. pombe
ggccgcagtttgtctcctaaaaaat

SEQ ID NO: 106013 - DNA, 25 bp, S. pombe
ggcgccgctttcaattgtcgcaaag

SEQ ID NO: 106014 - DNA, 25 bp, S. pombe
ggctgttggtatacttcttcgcaat

SEQ ID NO: 106015 - DNA, 25 bp, S. pombe
ggcggcttattcttcattattcttt

SEQ ID NO: 106016 - DNA, 25 bp, S. pombe
ggctggttcattcatcatgtttcat

SEQ ID NO: 106017 - DNA, 25 bp, S. pombe
tggccccatcgaccaattgttggag

SEQ ID NO: 106018 - DNA, 25 bp, S. pombe
ggcgtccttggacattcatttatat

SEQ ID NO: 106019 - DNA, 25 bp, S. pombe
ggccttcaacgttattgttgtcgtc

SEQ ID NO: 106020 - DNA, 25 bp, S. pombe
ggcgttcaacgcatgcaggaaatgt

SEQ ID NO: 106021 - DNA, 25 bp, S. pombe
ggcggtcattacacagcatttgcta

SEQ ID NO: 106022 - DNA, 25 bp, S. pombe
ggctggtctttcttacagtggtata

SEQ ID NO: 106023 - DNA, 25 bp, S. pombe
ggcgggctaaagttactcagcgatt

SEQ ID NO: 106024 - DNA, 25 bp, S. pombe
ggcggtgatactttctcaaacgatt

SEQ ID NO: 106025 - DNA, 25 bp, S. pombe
ggccccttgattatttcccatatat

SEQ ID NO: 106026 - DNA, 25 bp, S. pombe
ggccttattgttgctcttttactta

SEQ ID NO: 106027 - DNA, 25 bp, S. pombe
tggccctttatgcaaccggttagta

SEQ ID NO: 106028 - DNA, 25 bp, S. pombe
tggcccgattttgcaccaagtcaag

SEQ ID NO: 106029 - DNA, 25 bp, S. pombe
ggcccttgtttatctacatggtcaa

SEQ ID NO: 106030 - DNA, 25 bp, S. pombe
ggcctatttacatgctatcgaacct

SEQ ID NO: 106031 - DNA, 25 bp, S. pombe
ggcgtttctaaagaagaccttctca

SEQ ID NO: 106032 - DNA, 25 bp, S. pombe
tggcggcaaagggttatcacgactg

SEQ ID NO: 106033 - DNA, 25 bp, S. pombe
ggcccgcaaggctattgatgatttt

SEQ ID NO: 106034 - DNA, 25 bp, S. pombe
ggcccgaactctttgtatttctact

SEQ ID NO: 106035 - DNA, 25 bp, S. pombe
ggcgtcgtcgctattttcaattaat

SEQ ID NO: 106036 - DNA, 25 bp, S. pombe
ggcgtagcagcagtagatttgtcaa

SEQ ID NO: 106037 - DNA, 25 bp, S. pombe
ggcggatctcagttcagatttgcgt

SEQ ID NO: 106038 - DNA, 25 bp, S. pombe
ggcgcgactacattcaacctggtga

SEQ ID NO: 106039 - DNA, 25 bp, S. pombe
ggcggacagaagtgcgcctgtatac

SEQ ID NO: 106040 - DNA, 25 bp, S. pombe
ggccggtaatgctgctcgtgataac

SEQ ID NO: 106041 - DNA, 25 bp, S. pombe
ggcccgatacagttgctgctgttga

SEQ ID NO: 106042 - DNA, 25 bp, S. pombe
tgtccccttttttgacttagactcg

SEQ ID NO: 106043 - DNA, 25 bp, S. pombe
tggccaagcctaccaactacgagga

SEQ ID NO: 106044 - DNA, 25 bp, S. pombe
ggcctgagactactgctgacttgaa

SEQ ID NO: 106045 - DNA, 25 bp, S. pombe
ggcccaactatcatattgtaccttt

SEQ ID NO: 106046 - DNA, 25 bp, S. pombe
tggccccaaagtccctacagtatga

SEQ ID NO: 106047 - DNA, 25 bp, S. pombe
ggcgcatccccgatatagtgaagag

SEQ ID NO: 106048 - DNA, 25 bp, S. pombe
ggccctggctccaaacgtggtggaa

SEQ ID NO: 106049 - DNA, 25 bp, S. pombe
tggcctctggcggtaatgacaacgt

SEQ ID NO: 106050 - DNA, 25 bp, S. pombe
ggccttgattcaggtgttcccgtca

SEQ ID NO: 106051 - DNA, 25 bp, S. pombe
ggcctattgtcgctttcgtggatga

SEQ ID NO: 106052 - DNA, 25 bp, S. pombe
ggccgacttcctcatggattttatg

SEQ ID NO: 106053 - DNA, 25 bp, S. pombe
ggccaggttccccattatatttggt

SEQ ID NO: 106054 - DNA, 25 bp, S. pombe
ggccgtattcccaattctatttttg

SEQ ID NO: 106055 - DNA, 25 bp, S. pombe
ggcccggcactggaatttctatatt

SEQ ID NO: 106056 - DNA, 25 bp, S. pombe
ggcccaggtgcggaaactctattac

SEQ ID NO: 106057 - DNA, 25 bp, S. pombe
tggcttaacccaacaaattctcgac

SEQ ID NO: 106058 - DNA, 25 bp, S. pombe
tggaaagcaacctacgggtgcctac

SEQ ID NO: 106059 - DNA, 25 bp, S. pombe
tccgacaaattctctgacgatccta

SEQ ID NO: 106060 - DNA, 25 bp, S. pombe
tggccgtaagttgcgtcgtcgtcaa

SEQ ID NO: 106061 - DNA, 25 bp, S. pombe
ggcctgtaaggcattggttcgtcaa

SEQ ID NO: 106062 - DNA, 25 bp, S. pombe
ggccggaaggacgactattaccaat

SEQ ID NO: 106063 - DNA, 25 bp, S. pombe
ggccgcgaagcctcttgtagaattt

SEQ ID NO: 106064 - DNA, 25 bp, S. pombe
ggccgaatccaaacgcatgttagca

SEQ ID NO: 106065 - DNA, 25 bp, S. pombe
tggccaaccggttcacaattgctga

SEQ ID NO: 106066 - DNA, 25 bp, S. pombe
ggcgatgaaacctctcctgaaggaa

SEQ ID NO: 106067 - DNA, 25 bp, S. pombe
ggcgttatctcgtttgcctaagatg

SEQ ID NO: 106068 - DNA, 25 bp, S. pombe
ggcgtcttctgctgttgactacata

SEQ ID NO: 106069 - DNA, 25 bp, S. pombe
tgtgcgcgctaaccatggaccaaat

SEQ ID NO: 106070 - DNA, 25 bp, S. pombe
ggcgcgactgaattgcagctatgct

SEQ ID NO: 106071 - DNA, 25 bp, S. pombe
ggccgctggcttttctgaagaacaa

SEQ ID NO: 106072 - DNA, 25 bp, S. pombe
ggcgtcgctaatgccaatgagctta

SEQ ID NO: 106073 - DNA, 25 bp, S. pombe
ggcgttgctcaacctactggaaatg

SEQ ID NO: 106074 - DNA, 25 bp, S. pombe
ggcgacattcaacttcacgcaaaat

SEQ ID NO: 106075 - DNA, 25 bp, S. pombe
ggcgatgattatttccactgcaaga

SEQ ID NO: 106076 - DNA, 25 bp, S. pombe
ggccattgtgattcccgtaaaactt

SEQ ID NO: 106077 - DNA, 25 bp, S. pombe
ggccttccttctctgaaaaatctac

SEQ ID NO: 106078 - DNA, 25 bp, S. pombe
ggcctcccctttggatgaaaacatc

SEQ ID NO: 106079 - DNA, 25 bp, S. pombe
tgcgtcttaccggtcgtcatgaaac

SEQ ID NO: 106080 - DNA, 25 bp, S. pombe
tggctctttcgggacttcaaagaca

SEQ ID NO: 106081 - DNA, 25 bp, S. pombe
ggccttgcgcgctcgtaatgaagaa

SEQ ID NO: 106082 - DNA, 25 bp, S. pombe
ggccgtgcaccaacgtatcgaatag

SEQ ID NO: 106083 - DNA, 25 bp, S. pombe
ggccctcctccaatggcattgatta

SEQ ID NO: 106084 - DNA, 25 bp, S. pombe
tggcaaaagtccctcgcaattttaa

SEQ ID NO: 106085 - DNA, 25 bp, S. pombe
ggcgagaagaccacctatgctatta

SEQ ID NO: 106086 - DNA, 25 bp, S. pombe
ggcgaagcaaatttccagtcactta

SEQ ID NO: 106087 - DNA, 25 bp, S. pombe
ggcgtttattcccaacattcacatt

SEQ ID NO: 106088 - DNA, 25 bp, S. pombe
ggcgattcttatatcacagttcaca

SEQ ID NO: 106089 - DNA, 25 bp, S. pombe
ggccaggcctattgtgaacttcata

SEQ ID NO: 106090 - DNA, 25 bp, S. pombe
ggccagacgtcttgagaagcattct

SEQ ID NO: 106091 - DNA, 25 bp, S. pombe
ggcgtcacctgtcgtaagcacaata

SEQ ID NO: 106092 - DNA, 25 bp, S. pombe
ggccgctactaaatccgaagctgaa

SEQ ID NO: 106093 - DNA, 25 bp, S. pombe
ggccgtctttattcccaatgtgaag

SEQ ID NO: 106094 - DNA, 25 bp, S. pombe
ggccgtaggattccccgatgtacaa

SEQ ID NO: 106095 - DNA, 25 bp, S. pombe
ggccaatctcatagtcataacccga

SEQ ID NO: 106096 - DNA, 25 bp, S. pombe
ggccacttctacaatgaacgcctag

SEQ ID NO: 106097 - DNA, 25 bp, S. pombe
tggcaactttacaaatacccggatt

SEQ ID NO: 106098 - DNA, 25 bp, S. pombe
tggactcaatggctaactccgtttc

SEQ ID NO: 106099 - DNA, 25 bp, S. pombe
ggcgacgaaaatgcaacatctactt

SEQ ID NO: 106100 - DNA, 25 bp, S. pombe
ggccttgtaatcaacccttactatt

SEQ ID NO: 106101 - DNA, 25 bp, S. pombe
tggccttttgggttacattcctgga

SEQ ID NO: 106102 - DNA, 25 bp, S. pombe
tggttattccggatacgtcgcaggc

SEQ ID NO: 106103 - DNA, 25 bp, S. pombe
tggacctcgccgttttatggttcga

SEQ ID NO: 106104 - DNA, 25 bp, S. pombe
ggcgaaggtgccattttatactcta

SEQ ID NO: 106105 - DNA, 25 bp, S. pombe
ggcgaagttggcatttcctattcaa

SEQ ID NO: 106106 - DNA, 25 bp, S. pombe
ggcgaaaagagttcacatcctgttt

SEQ ID NO: 106107 - DNA, 25 bp, S. pombe
tggcctagagtgttaccggtttgta

SEQ ID NO: 106108 - DNA, 25 bp, S. pombe
ggcgctagacatttcactcgaggat

SEQ ID NO: 106109 - DNA, 25 bp, S. pombe
ggccaagcatcatttgaccgatcga

SEQ ID NO: 106110 - DNA, 25 bp, S. pombe
tggcatgccagatttgagcgcactt

SEQ ID NO: 106111 - DNA, 25 bp, S. pombe
tggcagccaaatcacagtttacgtt

SEQ ID NO: 106112 - DNA, 25 bp, S. pombe
tggccgctgatctgatcgttaacgt

SEQ ID NO: 106113 - DNA, 25 bp, S. pombe
tggccgctggaggatcgctttgtca

SEQ ID NO: 106114 - DNA, 25 bp, S. pombe
tggcgtgtgcagacatatgcttgtt

SEQ ID NO: 106115 - DNA, 25 bp, S. pombe
tgtacgagtttacgctgaggccagc

SEQ ID NO: 106116 - DNA, 25 bp, S. pombe
tggacacgtttcagctggtcacggt

SEQ ID NO: 106117 - DNA, 25 bp, S. pombe
tggaaatacattcgtccttaccctc

SEQ ID NO: 106118 - DNA, 25 bp, S. pombe
tgggaaacttcctcttattccgtat

SEQ ID NO: 106119 - DNA, 25 bp, S. pombe
tggtaagtatgtcctggcttttccg

SEQ ID NO: 106120 - DNA, 25 bp, S. pombe
tgttaacgaccccaaggttgctgtt

SEQ ID NO: 106121 - DNA, 25 bp, S. pombe
tacgttcgtcgtgcaagggtttttg

SEQ ID NO: 106122 - DNA, 25 bp, S. pombe
ggccgttgtcaatctatggttctac

SEQ ID NO: 106123 - DNA, 25 bp, S. pombe
ggccgttctaaagatgatgctccta

SEQ ID NO: 106124 - DNA, 25 bp, S. pombe
ggcctcaaagatatgctatttcccg

SEQ ID NO: 106125 - DNA, 25 bp, S. pombe
ggcccatgaagtttgccatttagct

SEQ ID NO: 106126 - DNA, 25 bp, S. pombe
ggcccgaactactttgtggagcatt

SEQ ID NO: 106127 - DNA, 25 bp, S. pombe
tggccccaaccctcattgggatgat

SEQ ID NO: 106128 - DNA, 25 bp, S. pombe
ggcgcatatactcattggcctattg

SEQ ID NO: 106129 - DNA, 25 bp, S. pombe
ggcgaatacactactggcgctagta

SEQ ID NO: 106130 - DNA, 25 bp, S. pombe
tggcccaatattctttcaccgttaa

SEQ ID NO: 106131 - DNA, 25 bp, S. pombe
ggccgcgatcttctttagacagtaa

SEQ ID NO: 106132 - DNA, 25 bp, S. pombe
ggcctgcttctttaaccagtgagga

SEQ ID NO: 106133 - DNA, 25 bp, S. pombe
ggcgccttcttctagttcagataac

SEQ ID NO: 106134 - DNA, 25 bp, S. pombe
ggccacacatcattttcatttgctg

SEQ ID NO: 106135 - DNA, 25 bp, S. pombe
ggccagaattcagttttgttgcttt

SEQ ID NO: 106136 - DNA, 25 bp, S. pombe
ggcgcaacagccaaatcttttatta

SEQ ID NO: 106137 - DNA, 25 bp, S. pombe
ggccgaagactcgattcgctctaaa

SEQ ID NO: 106138 - DNA, 25 bp, S. pombe
ggccagcctataatattccagaaat

SEQ ID NO: 106139 - DNA, 25 bp, S. pombe
tggcggcgctatcaaggctgcatat

SEQ ID NO: 106140 - DNA, 25 bp, S. pombe
tggcgctcctgaaatacgtgctacg

SEQ ID NO: 106141 - DNA, 25 bp, S. pombe
tgtacgaagttcaaaggcccagatt

SEQ ID NO: 106142 - DNA, 25 bp, S. pombe
tgttggcaggctgataagtcccaga

SEQ ID NO: 106143 - DNA, 25 bp, S. pombe
tggcatcagccggtcgatattacga

SEQ ID NO: 106144 - DNA, 25 bp, S. pombe
tggacagtctggtgctgttcacgct

SEQ ID NO: 106145 - DNA, 25 bp, S. pombe
tggagacgttgctcagtcaccatgc

SEQ ID NO: 106146 - DNA, 25 bp, S. pombe
ggccacacaaatcgcatctcagaat

SEQ ID NO: 106147 - DNA, 25 bp, S. pombe
ggcgagacagattgctgactccaat

SEQ ID NO: 106148 - DNA, 25 bp, S. pombe
ggcgaattcatcttgacccatcgaa

SEQ ID NO: 106149 - DNA, 25 bp, S. pombe
ggcgaattcgtgacacccatggaaa

SEQ ID NO: 106150 - DNA, 25 bp, S. pombe
tggcgcctttctctttgttaacaaa

SEQ ID NO: 106151 - DNA, 25 bp, S. pombe
ggcgaatgttctaatttcccgacct

SEQ ID NO: 106152 - DNA, 25 bp, S. pombe
ggcgaatcaagcttgtcctttaaaa

SEQ ID NO: 106153 - DNA, 25 bp, S. pombe
tggaacaacaaccactcttgtctac

SEQ ID NO: 106154 - DNA, 25 bp, S. pombe
ggcgctttacaaactagtgtgcttc

SEQ ID NO: 106155 - DNA, 25 bp, S. pombe
ggcgactttgccaatgccattaagg

SEQ ID NO: 106156 - DNA, 25 bp, S. pombe
ggcccttgttcatcctgatattgag

SEQ ID NO: 106157 - DNA, 25 bp, S. pombe
tggctcacttttgggctttattgca

SEQ ID NO: 106158 - DNA, 25 bp, S. pombe
tggccgtaggccagttgtttatttt

SEQ ID NO: 106159 - DNA, 25 bp, S. pombe
ggccttgagcccgagtttactaagt

SEQ ID NO: 106160 - DNA, 25 bp, S. pombe
ggccatcgaggacgttttttcaatt

SEQ ID NO: 106161 - DNA, 25 bp, S. pombe
ttctcccaaactgttcgccaaaaat

SEQ ID NO: 106162 - DNA, 25 bp, S. pombe
ggccgcttaactattatatactcga

SEQ ID NO: 106163 - DNA, 25 bp, S. pombe
tggacccggattcttttattgttct

SEQ ID NO: 106164 - DNA, 25 bp, S. pombe
ggccacctcagatcgcaatttattg

SEQ ID NO: 106165 - DNA, 25 bp, S. pombe
tggcgacctcagtatgtggaatcaa

SEQ ID NO: 106166 - DNA, 25 bp, S. pombe
tggctgacaacgctgacgatctttt

SEQ ID NO: 106167 - DNA, 25 bp, S. pombe
tggcgatgcctttttccaagtttcc

SEQ ID NO: 106168 - DNA, 25 bp, S. pombe
tggctgctcgttttgttccagatta

SEQ ID NO: 106169 - DNA, 25 bp, S. pombe
tgtgcagtcggccaagtattatctt

SEQ ID NO: 106170 - DNA, 25 bp, S. pombe
tggcccaatgactgtttccagttca

SEQ ID NO: 106171 - DNA, 25 bp, S. pombe
tggcaacatatgtcaggcctgtcat

SEQ ID NO: 106172 - DNA, 25 bp, S. pombe
tggaccatattaacgtacttcaaca

SEQ ID NO: 106173 - DNA, 25 bp, S. pombe
tggaccatatattgaccgtttaact

SEQ ID NO: 106174 - DNA, 25 bp, S. pombe
tggaccactaggtacgtgttcttcc

SEQ ID NO: 106175 - DNA, 25 bp, S. pombe
tggacaaacgttcgcatggaccttc

SEQ ID NO: 106176 - DNA, 25 bp, S. pombe
tggccacaaagctgccttgagcaat

SEQ ID NO: 106177 - DNA, 25 bp, S. pombe
ggccatcaaagtttctcagcaagct

SEQ ID NO: 106178 - DNA, 25 bp, S. pombe
ggcctgcattcagcttctatgatga

SEQ ID NO: 106179 - DNA, 25 bp, S. pombe
ggcctcttctgcttgggccaagaaa

SEQ ID NO: 106180 - DNA, 25 bp, S. pombe
tggaagatgacctagctcctatcgt

SEQ ID NO: 106181 - DNA, 25 bp, S. pombe
tggaaagcggtcgaacagtctcttc

SEQ ID NO: 106182 - DNA, 25 bp, S. pombe
tggcgcgatcggagaacttctgatt

SEQ ID NO: 106183 - DNA, 25 bp, S. pombe
ggccttcatgctctccaaataactt

SEQ ID NO: 106184 - DNA, 25 bp, S. pombe
ggcccaatctgccttacagaaactc

SEQ ID NO: 106185 - DNA, 25 bp, S. pombe
ggccgatatgcctttagaacgagtt

SEQ ID NO: 106186 - DNA, 25 bp, S. pombe
tggccgctctactttacgaaatgtt

SEQ ID NO: 106187 - DNA, 25 bp, S. pombe
ggcgcttcctctcattcagaagaaa

SEQ ID NO: 106188 - DNA, 25 bp, S. pombe
tggccccatgtctggtgcagaaatt

SEQ ID NO: 106189 - DNA, 25 bp, S. pombe
tggccctatggctggtgaattgatt

SEQ ID NO: 106190 - DNA, 25 bp, S. pombe
tggcgatcttagcaggttgcaacct

SEQ ID NO: 106191 - DNA, 25 bp, S. pombe
ggccacatttatcttggatctcctg

SEQ ID NO: 106192 - DNA, 25 bp, S. pombe
ggccgattgttagcggtgcttcaac

SEQ ID NO: 106193 - DNA, 25 bp, S. pombe
tggcctttgcttacgggattcataa

SEQ ID NO: 106194 - DNA, 25 bp, S. pombe
ggcctttcgcgatggattttgtcaa

SEQ ID NO: 106195 - DNA, 25 bp, S. pombe
ggccttctccgttgtatgtcaagtt

SEQ ID NO: 106196 - DNA, 25 bp, S. pombe
ggccccgtttgctcatctaaaaatg

SEQ ID NO: 106197 - DNA, 25 bp, S. pombe
ggcctccgtttaaaccaatatgaag

SEQ ID NO: 106198 - DNA, 25 bp, S. pombe
ggcctcaacctctaatacaatctat

SEQ ID NO: 106199 - DNA, 25 bp, S. pombe
tggcaaaccttgtcgtcgttgggaa

SEQ ID NO: 106200 - DNA, 25 bp, S. pombe
tgggtacttttgctcgttatggaca

SEQ ID NO: 106201 - DNA, 25 bp, S. pombe
ttggacctaattctcgatcggacag

SEQ ID NO: 106202 - DNA, 25 bp, S. pombe
tggaaccaaattctggctcccaagt

SEQ ID NO: 106203 - DNA, 25 bp, S. pombe
tggatagtttcctttaccggcgaca

SEQ ID NO: 106204 - DNA, 25 bp, S. pombe
tggctattattgatcgtctgcaccg

SEQ ID NO: 106205 - DNA, 25 bp, S. pombe
tggcgcgttatgaggacgatcctga

SEQ ID NO: 106206 - DNA, 25 bp, S. pombe
ggccttcatattcgtgcatcttttg

SEQ ID NO: 106207 - DNA, 25 bp, S. pombe
ggcctctctcatcaatgatcttttg

SEQ ID NO: 106208 - DNA, 25 bp, S. pombe
tggcccgcagctgaaagagactatg

SEQ ID NO: 106209 - DNA, 25 bp, S. pombe
tggcgccgccatgcttcgaggaatg

SEQ ID NO: 106210 - DNA, 25 bp, S. pombe
tggcctcaattcactagcgcaagta

SEQ ID NO: 106211 - DNA, 25 bp, S. pombe
ggccctgttggcgatgatttattcc

SEQ ID NO: 106212 - DNA, 25 bp, S. pombe
tggcccagcatttttgagtcaatac

SEQ ID NO: 106213 - DNA, 25 bp, S. pombe
tggcgccaaatatatgagtcttcat

SEQ ID NO: 106214 - DNA, 25 bp, S. pombe
tggctcagaatcatcttcacctatt

SEQ ID NO: 106215 - DNA, 25 bp, S. pombe
tggccgatacttctgatccttttaa

SEQ ID NO: 106216 - DNA, 25 bp, S. pombe
tggctgtttctttattgtccgttta

SEQ ID NO: 106217 - DNA, 25 bp, S. pombe
tggcttttccttgcgaacgtatttt

SEQ ID NO: 106218 - DNA, 25 bp, S. pombe
tggctcatcctcaaaccgaaagttt

SEQ ID NO: 106219 - DNA, 25 bp, S. pombe
tggccccaaccatcttgttgttgaa

SEQ ID NO: 106220 - DNA, 25 bp, S. pombe
ggccgataccgctacgttggaacaa

SEQ ID NO: 106221 - DNA, 25 bp, S. pombe
ggccgatgacgctcctcttgaaaaa

SEQ ID NO: 106222 - DNA, 25 bp, S. pombe
ggccgagcgtggtgtcattcaaaaa

SEQ ID NO: 106223 - DNA, 25 bp, S. pombe
tggccctggctttgttcttgaaaaa

SEQ ID NO: 106224 - DNA, 25 bp, S. pombe
ggccatatttttgcttctactgcta

SEQ ID NO: 106225 - DNA, 25 bp, S. pombe
ggccgttctgttactgcttacattc

SEQ ID NO: 106226 - DNA, 25 bp, S. pombe
ggccattttcatcacgctttatatt

SEQ ID NO: 106227 - DNA, 25 bp, S. pombe
ggccatgtgtttaacagtgttctca

SEQ ID NO: 106228 - DNA, 25 bp, S. pombe
ggccatcgtcgtgccttttctaaat

SEQ ID NO: 106229 - DNA, 25 bp, S. pombe
ggccattcatcaagctttgttccaa

SEQ ID NO: 106230 - DNA, 25 bp, S. pombe
tggcagtataccctttattcctttt

SEQ ID NO: 106231 - DNA, 25 bp, S. pombe
tggcgttgtcggaattaagcccaaa

SEQ ID NO: 106232 - DNA, 25 bp, S. pombe
tggccttttaggacaattgcgtcaa

SEQ ID NO: 106233 - DNA, 25 bp, S. pombe
ggccatggaagaacttgctcgcgtc

SEQ ID NO: 106234 - DNA, 25 bp, S. pombe
tggcgccaaaaaggttgtcccctct

SEQ ID NO: 106235 - DNA, 25 bp, S. pombe
tgtccccagaagtgttgattccttt

SEQ ID NO: 106236 - DNA, 25 bp, S. pombe
ggcctatcctttcattgttgcaata

SEQ ID NO: 106237 - DNA, 25 bp, S. pombe
tggttccttttcatccaaacgaagt

SEQ ID NO: 106238 - DNA, 25 bp, S. pombe
tggattccattcaaattctaaccgg

SEQ ID NO: 106239 - DNA, 25 bp, S. pombe
tggcttttgttcttggcaaacctgc

SEQ ID NO: 106240 - DNA, 25 bp, S. pombe
tggattccagtcatggtgtaccctt

SEQ ID NO: 106241 - DNA, 25 bp, S. pombe
tggtgggataatgttttttctgctc

SEQ ID NO: 106242 - DNA, 25 bp, S. pombe
tggagtcgcgattttttcgttcttc

SEQ ID NO: 106243 - DNA, 25 bp, S. pombe
tggccctggcagaagtgttccttta

SEQ ID NO: 106244 - DNA, 25 bp, S. pombe
tggcacttgtccactgttccaatta

SEQ ID NO: 106245 - DNA, 25 bp, S. pombe
tgtcttggaggctttgcttgtcaac

SEQ ID NO: 106246 - DNA, 25 bp, S. pombe
tggcttggatatctcgaactcactc

SEQ ID NO: 106247 - DNA, 25 bp, S. pombe
ggcctcttataagcacttgtgtgaa

SEQ ID NO: 106248 - DNA, 25 bp, S. pombe
tggcgcgctgtttctctagagctaa

SEQ ID NO: 106249 - DNA, 25 bp, S. pombe
tgtgccctctttccaacttaaaact

SEQ ID NO: 106250 - DNA, 25 bp, S. pombe
tggcccgcttaaaacctcagaaaat

SEQ ID NO: 106251 - DNA, 25 bp, S. pombe
ggcctgtccgtttacgatgcagtaa

SEQ ID NO: 106252 - DNA, 25 bp, S. pombe
ggccttccatgaatctaacagcgtt

SEQ ID NO: 106253 - DNA, 25 bp, S. pombe
ggccattggctggtctacaagattt

SEQ ID NO: 106254 - DNA, 25 bp, S. pombe
tggcacatcatcatattggacagga

SEQ ID NO: 106255 - DNA, 25 bp, S. pombe
ggccatgtcaatcccttttattaat

SEQ ID NO: 106256 - DNA, 25 bp, S. pombe
ggccggcaagacctttgctgattaa

SEQ ID NO: 106257 - DNA, 25 bp, S. pombe
tggctgatccaccagagattcttat

SEQ ID NO: 106258 - DNA, 25 bp, S. pombe
tggaatcccgcgttgataagaaaat

SEQ ID NO: 106259 - DNA, 25 bp, S. pombe
tggccattccattttgacgacgagt

SEQ ID NO: 106260 - DNA, 25 bp, S. pombe
tggccaacagagagtaatattcgct

SEQ ID NO: 106261 - DNA, 25 bp, S. pombe
tggctcaacaagatttatccccttc

SEQ ID NO: 106262 - DNA, 25 bp, S. pombe
ggccatgacccgtttgtcagatatg

SEQ ID NO: 106263 - DNA, 25 bp, S. pombe
ggccaatcgcttcgcttgagaaatg

SEQ ID NO: 106264 - DNA, 25 bp, S. pombe
ggccagacagtacgcgagcagcaat

SEQ ID NO: 106265 - DNA, 25 bp, S. pombe
ggccagacagtacgcgagcagcaat

SEQ ID NO: 106266 - DNA, 25 bp, S. pombe
ggccattggcatactcacattgatt

SEQ ID NO: 106267 - DNA, 25 bp, S. pombe
ggccttgcgtcctcttgtaaatcga

SEQ ID NO: 106268 - DNA, 25 bp, S. pombe
ggccttcgatctggtattgctaata

SEQ ID NO: 106269 - DNA, 25 bp, S. pombe
ggccttctgttgctaccaatatatg

SEQ ID NO: 106270 - DNA, 25 bp, S. pombe
tggccgtcgtatctcacaacaaggt

SEQ ID NO: 106271 - DNA, 25 bp, S. pombe
tggccgctcgtggatttaacattga

SEQ ID NO: 106272 - DNA, 25 bp, S. pombe
tggtccaagggcgtcaaaactaata

SEQ ID NO: 106273 - DNA, 25 bp, S. pombe
tggacggtctcctgaaattctacta

SEQ ID NO: 106274 - DNA, 25 bp, S. pombe
tggcacggcccttaaattacttttg

SEQ ID NO: 106275 - DNA, 25 bp, S. pombe
tgatcgggctactgaaagcttttca

SEQ ID NO: 106276 - DNA, 25 bp, S. pombe
tggaaacggtagttcaccctgttct

SEQ ID NO: 106277 - DNA, 25 bp, S. pombe
tggttaacaccggtccctggaatga

SEQ ID NO: 106278 - DNA, 25 bp, S. pombe
ggcctgaaattgttggtcctgaaaa

SEQ ID NO: 106279 - DNA, 25 bp, S. pombe
ggccatctgatgatttgcgcaatta

SEQ ID NO: 106280 - DNA, 25 bp, S. pombe
tggaaggcaaccaatcctgctaata

SEQ ID NO: 106281 - DNA, 25 bp, S. pombe
ggcctatcaagcaaatcctgtacaa

SEQ ID NO: 106282 - DNA, 25 bp, S. pombe
tggtctttgtgacacgtttcatcct

SEQ ID NO: 106283 - DNA, 25 bp, S. pombe
tggccaggcagttgaccgcgttgaa

SEQ ID NO: 106284 - DNA, 25 bp, S. pombe
tggcgacggtcaaagcgtgcttcaa

SEQ ID NO: 106285 - DNA, 25 bp, S. pombe
ggcctggagtctacaatctgcttgt

SEQ ID NO: 106286 - DNA, 25 bp, S. pombe
tggaatcatcacttgacagactcaa

SEQ ID NO: 106287 - DNA, 25 bp, S. pombe
tggagcctggagttgtcaatgcatt

SEQ ID NO: 106288 - DNA, 25 bp, S. pombe
tggccgttcagttgcacaagctatc

SEQ ID NO: 106289 - DNA, 25 bp, S. pombe
ggccttcttatgctgctcaatatag

SEQ ID NO: 106290 - DNA, 25 bp, S. pombe
tggctctttttggtgctgctaaaca

SEQ ID NO: 106291 - DNA, 25 bp, S. pombe
ggcctatgctttcttatgttgctac

SEQ ID NO: 106292 - DNA, 25 bp, S. pombe
tggcctattcttgttgtctattatc

SEQ ID NO: 106293 - DNA, 25 bp, S. pombe
tggcttttttccctactaattggtg

SEQ ID NO: 106294 - DNA, 25 bp, S. pombe
tggctttttacttacgaatacaccg

SEQ ID NO: 106295 - DNA, 25 bp, S. pombe
tggtttccgttctggaaagcctgct

SEQ ID NO: 106296 - DNA, 25 bp, S. pombe
tggtttccgttctggaaagcctgct

SEQ ID NO: 106297 - DNA, 25 bp, S. pombe
tggatttcgggctctcgggaaccta

SEQ ID NO: 106298 - DNA, 25 bp, S. pombe
tggttctggccttgcttacggattt

SEQ ID NO: 106299 - DNA, 25 bp, S. pombe
tggattcgtcgctagtgaaggcact

SEQ ID NO: 106300 - DNA, 25 bp, S. pombe
tggattcgtctttggaaaccgtctt

SEQ ID NO: 106301 - DNA, 25 bp, S. pombe
tggatccgatgctcaaactcaaggt

SEQ ID NO: 106302 - DNA, 25 bp, S. pombe
tggatcgcttcaccaaacgacgagt

SEQ ID NO: 106303 - DNA, 25 bp, S. pombe
tggcagaaaccaccgaactggaaaa

SEQ ID NO: 106304 - DNA, 25 bp, S. pombe
tggagaaattcctgaccttgtcgaa

SEQ ID NO: 106305 - DNA, 25 bp, S. pombe
tggaaatcattcctcaatgccattt

SEQ ID NO: 106306 - DNA, 25 bp, S. pombe
tggcagttctgtgtggcaaacccat

SEQ ID NO: 106307 - DNA, 25 bp, S. pombe
tggagcattcaagcctgcgacaaat

SEQ ID NO: 106308 - DNA, 25 bp, S. pombe
tggacgtgatatttcttccctttaa

SEQ ID NO: 106309 - DNA, 25 bp, S. pombe
tggaccaaatctgctttcggacttc

SEQ ID NO: 106310 - DNA, 25 bp, S. pombe
tggccctcaaacatttccgaattct

SEQ ID NO: 106311 - DNA, 25 bp, S. pombe
tggctatctttgttaccacccagat

SEQ ID NO: 106312 - DNA, 25 bp, S. pombe
tggcgctctttcataacacctggat

SEQ ID NO: 106313 - DNA, 25 bp, S. pombe
tggcgcatttacttcaaactctttc

SEQ ID NO: 106314 - DNA, 25 bp, S. pombe
tggtattgctagttcgaacccttcg

SEQ ID NO: 106315 - DNA, 25 bp, S. pombe
tggacatcgtttgcgtgtactcttc

SEQ ID NO: 106316 - DNA, 25 bp, S. pombe
tggcgaaagatccaactctggctaa

SEQ ID NO: 106317 - DNA, 25 bp, S. pombe
tggcgtcttgacttacaccgtacag

SEQ ID NO: 106318 - DNA, 25 bp, S. pombe
tggctatcttaaaacccgctacaac

SEQ ID NO: 106319 - DNA, 25 bp, S. pombe
tggcctctaaattggtcacgttgaa

SEQ ID NO: 106320 - DNA, 25 bp, S. pombe
tggcgcatctcctaaggacacgttt

SEQ ID NO: 106321 - DNA, 25 bp, S. pombe
tggactccatcaacgttggttcgga

SEQ ID NO: 106322 - DNA, 25 bp, S. pombe
tggacacccgatgtttatgttcccg

SEQ ID NO: 106323 - DNA, 25 bp, S. pombe
tgctaaatccggctcccttaaaaga

SEQ ID NO: 106324 - DNA, 25 bp, S. pombe
tggccgacacaatcatcaacactta

SEQ ID NO: 106325 - DNA, 25 bp, S. pombe
tggctagctgcatatccctttgata

SEQ ID NO: 106326 - DNA, 25 bp, S. pombe
tggcgctatgaacgtcctctcgata

SEQ ID NO: 106327 - DNA, 25 bp, S. pombe
tggacgagacatcatcctcttatac

SEQ ID NO: 106328 - DNA, 25 bp, S. pombe
ggccagccagcgaatctttttgaac

SEQ ID NO: 106329 - DNA, 25 bp, S. pombe
ggccaatggtacttttactgcttgt

SEQ ID NO: 106330 - DNA, 25 bp, S. pombe
ggccacgtttctattattgctgact

SEQ ID NO: 106331 - DNA, 25 bp, S. pombe
tggtacttttataggctttgggctt

SEQ ID NO: 106332 - DNA, 25 bp, S. pombe
tggctagccttcctttgtgtattca

SEQ ID NO: 106333 - DNA, 25 bp, S. pombe
tggccaagcttggacttctgagtct

SEQ ID NO: 106334 - DNA, 25 bp, S. pombe
tggcaaagttgctcgtgcaggtctc

SEQ ID NO: 106335 - DNA, 25 bp, S. pombe
tggaaaggccttgtcgtcagtccta

SEQ ID NO: 106336 - DNA, 25 bp, S. pombe
tggaaaacgtcctagcttttggtga

SEQ ID NO: 106337 - DNA, 25 bp, S. pombe
tggttcctggacataatggccctat

SEQ ID NO: 106338 - DNA, 25 bp, S. pombe
tgattcacacgtgggtacggacttt

SEQ ID NO: 106339 - DNA, 25 bp, S. pombe
tactaaactaggaggaattttcgag

SEQ ID NO: 106340 - DNA, 25 bp, S. pombe
tattaacacttgctcgttttttcgg

SEQ ID NO: 106341 - DNA, 25 bp, S. pombe
tggtaaaccggtttctcttcattcg

SEQ ID NO: 106342 - DNA, 25 bp, S. pombe
tggcttttccgttctacaatttgtt

SEQ ID NO: 106343 - DNA, 25 bp, S. pombe
tggactttggtatgtctcagccctt

SEQ ID NO: 106344 - DNA, 25 bp, S. pombe
tgtagtttcgactgattaccctgat

SEQ ID NO: 106345 - DNA, 25 bp, S. pombe
tgttgttcccaaggttacggtcact

SEQ ID NO: 106346 - DNA, 25 bp, S. pombe
tggttatcgggcctgttacatggta

SEQ ID NO: 106347 - DNA, 25 bp, S. pombe
tggcctgacaactcttttaatgcta

SEQ ID NO: 106348 - DNA, 25 bp, S. pombe
tgtgaaaaatttagctcccaaggat

SEQ ID NO: 106349 - DNA, 25 bp, S. pombe
tgtaaaatccttacctgctacggct

SEQ ID NO: 106350 - DNA, 25 bp, S. pombe
tgtagacgtctcgtacggtggcgac

SEQ ID NO: 106351 - DNA, 25 bp, S. pombe
tgggcacgattctcaaggatgggtt

SEQ ID NO: 106352 - DNA, 25 bp, S. pombe
tggaactattgcatccggagggctt

SEQ ID NO: 106353 - DNA, 25 bp, S. pombe
tggccaaacactaacatttcctgct

SEQ ID NO: 106354 - DNA, 25 bp, S. pombe
ggccagcaaaccaatctctttgagg

SEQ ID NO: 106355 - DNA, 25 bp, S. pombe
tggacaaaaataatcggccccttca

SEQ ID NO: 106356 - DNA, 25 bp, S. pombe
tggtgcgacgggactgtttaccgaa

SEQ ID NO: 106357 - DNA, 25 bp, S. pombe
tggcatagacgtttcccaagacatg

SEQ ID NO: 106358 - DNA, 25 bp, S. pombe
tggaagactgcgtatcctcagcaac

SEQ ID NO: 106359 - DNA, 25 bp, S. pombe
tggtcgtgctgctgatgccgtagat

SEQ ID NO: 106360 - DNA, 25 bp, S. pombe
tggacgatgctattgatactgctca

SEQ ID NO: 106361 - DNA, 25 bp, S. pombe
tggatgcagcctctatgcccaaaac

SEQ ID NO: 106362 - DNA, 25 bp, S. pombe
tggcatgtccgctgaccaaataagt

SEQ ID NO: 106363 - DNA, 25 bp, S. pombe
tggctcctacttacgaaactcttgg

SEQ ID NO: 106364 - DNA, 25 bp, S. pombe
ggccaatcctcctcaagactttgaa

SEQ ID NO: 106365 - DNA, 25 bp, S. pombe
tggcgaggccctatatggattaata

SEQ ID NO: 106366 - DNA, 25 bp, S. pombe
tggcggttccgcttatttgtgaaaa

SEQ ID NO: 106367 - DNA, 25 bp, S. pombe
tggaagatccgacacttagtggact

SEQ ID NO: 106368 - DNA, 25 bp, S. pombe
tggaattcaacagtccttcaacgtt

SEQ ID NO: 106369 - DNA, 25 bp, S. pombe
tggttatattcctcgtaagcgtgta

SEQ ID NO: 106370 - DNA, 25 bp, S. pombe
tggactttctaccttttactggcaa

SEQ ID NO: 106371 - DNA, 25 bp, S. pombe
tggacgattttactctttcactcac

SEQ ID NO: 106372 - DNA, 25 bp, S. pombe
tggaattggaccctttggcttactc

SEQ ID NO: 106373 - DNA, 25 bp, S. pombe
tggagtgattgcagccgtttgccat

SEQ ID NO: 106374 - DNA, 25 bp, S. pombe
tggctgtggtgctgacgttattatc

SEQ ID NO: 106375 - DNA, 25 bp, S. pombe
tgggcgctctagtttttatgtacag

SEQ ID NO: 106376 - DNA, 25 bp, S. pombe
tggacccctgtttctactaattcta

SEQ ID NO: 106377 - DNA, 25 bp, S. pombe
tggaacctggatcttgctctacaga

SEQ ID NO: 106378 - DNA, 25 bp, S. pombe
tggcacctagtgttattgagtctca

SEQ ID NO: 106379 - DNA, 25 bp, S. pombe
tggctgctcttgtcgttatggatgc

SEQ ID NO: 106380 - DNA, 25 bp, S. pombe
tggatgtcgctcgtaaagtcaccat

SEQ ID NO: 106381 - DNA, 25 bp, S. pombe
tggacgaatacatgttgctcccacc

SEQ ID NO: 106382 - DNA, 25 bp, S. pombe
tggaaaaagcattgggcccggcact

SEQ ID NO: 106383 - DNA, 25 bp, S. pombe
tggaactacacaagagcctgccggc

SEQ ID NO: 106384 - DNA, 25 bp, S. pombe
tggcgactacgacgatacgttactt

SEQ ID NO: 106385 - DNA, 25 bp, S. pombe
tggcaaggacggcaaagttcaatgt

SEQ ID NO: 106386 - DNA, 25 bp, S. pombe
tggaaccctgcccaagatttgcaag

SEQ ID NO: 106387 - DNA, 25 bp, S. pombe
tggaaaccccagagcttgtgtggaa

SEQ ID NO: 106388 - DNA, 25 bp, S. pombe
tggactaacggttcagacgacgaat

SEQ ID NO: 106389 - DNA, 25 bp, S. pombe
tggacataatccaccgtcggcgaga

SEQ ID NO: 106390 - DNA, 25 bp, S. pombe
tggaacggcttcctatccaattagg

SEQ ID NO: 106391 - DNA, 25 bp, S. pombe
tggcgttccaccctcaagaaacaag

SEQ ID NO: 106392 - DNA, 25 bp, S. pombe
tggccgaccctaatctcactgaata

SEQ ID NO: 106393 - DNA, 25 bp, S. pombe
tggcttacctcgtctatcatctaaa

SEQ ID NO: 106394 - DNA, 25 bp, S. pombe
tggcttgcaccttgattacgcatgc

SEQ ID NO: 106395 - DNA, 25 bp, S. pombe
tgtatgctgcgctcgaagatcgtgc

SEQ ID NO: 106396 - DNA, 25 bp, S. pombe
tggttgccgaggctcaactttccaa

SEQ ID NO: 106397 - DNA, 25 bp, S. pombe
tggcgttcggtttacctttctgaat

SEQ ID NO: 106398 - DNA, 25 bp, S. pombe
tggcgattcctgcttatacgtttga

SEQ ID NO: 106399 - DNA, 25 bp, S. pombe
tgggtctaagctatgattcgttcga

SEQ ID NO: 106400 - DNA, 25 bp, S. pombe
tggcctctatatattcattggtgtg

SEQ ID NO: 106401 - DNA, 25 bp, S. pombe
tggcagctacaaatcttccgtggtg

SEQ ID NO: 106402 - DNA, 25 bp, S. pombe
tggcgctctgcataattccgtggat

SEQ ID NO: 106403 - DNA, 25 bp, S. pombe
tggcgtctcattatacggtgcgatc

SEQ ID NO: 106404 - DNA, 25 bp, S. pombe
tggttctacacaagtcgatttccgc

SEQ ID NO: 106405 - DNA, 25 bp, S. pombe
tggagtgcacccaattactgttaca

SEQ ID NO: 106406 - DNA, 25 bp, S. pombe
tggagtcacccaagtccgtgtcgaa

SEQ ID NO: 106407 - DNA, 25 bp, S. pombe
tggcctcaatccaggttctatgaac

SEQ ID NO: 106408 - DNA, 25 bp, S. pombe
tggcggtactggtcactacaagctt

SEQ ID NO: 106409 - DNA, 25 bp, S. pombe
tggcgagtccagcagaatcaaagtc

SEQ ID NO: 106410 - DNA, 25 bp, S. pombe
tggcgaatccagcaccatgaaattg

SEQ ID NO: 106411 - DNA, 25 bp, S. pombe
tggtaacattgtttcgccgcaacta

SEQ ID NO: 106412 - DNA, 25 bp, S. pombe
tcgtttgactttttagagccctcgt

SEQ ID NO: 106413 - DNA, 25 bp, S. pombe
tggttgcttcgattcaagggctttc

SEQ ID NO: 106414 - DNA, 25 bp, S. pombe
tggctcctctcacgccaaaggaatt

SEQ ID NO: 106415 - DNA, 25 bp, S. pombe
tggcgctgacgctgatgaagacaca

SEQ ID NO: 106416 - DNA, 25 bp, S. pombe
tggctccactgggatctcgacagta

SEQ ID NO: 106417 - DNA, 25 bp, S. pombe
tggctcgtcttaacccttatgctaa

SEQ ID NO: 106418 - DNA, 25 bp, S. pombe
tggtagatgccacttgaccctcaaa

SEQ ID NO: 106419 - DNA, 25 bp, S. pombe
tggacaagttcttatgctgccgcac

SEQ ID NO: 106420 - DNA, 25 bp, S. pombe
tggtaatggctcttcgtcttaacga

SEQ ID NO: 106421 - DNA, 25 bp, S. pombe
tggacatggcgtcttgcatcgctta

SEQ ID NO: 106422 - DNA, 25 bp, S. pombe
tggaattacttttctgcctcctgaa

SEQ ID NO: 106423 - DNA, 25 bp, S. pombe
tggttgctgtcgcttctgaagatgc

SEQ ID NO: 106424 - DNA, 25 bp, S. pombe
tggattgaacgctgctcgcaaactt

SEQ ID NO: 106425 - DNA, 25 bp, S. pombe
tggattgaatcccagagccgagatt

SEQ ID NO: 106426 - DNA, 25 bp, S. pombe
tgggtcattcatcggctcaattacg

SEQ ID NO: 106427 - DNA, 25 bp, S. pombe
tggacatgccgagcctatccaaaag

SEQ ID NO: 106428 - DNA, 25 bp, S. pombe
tggagcaacagaccgcatttttaag

SEQ ID NO: 106429 - DNA, 25 bp, S. pombe
tggcccataagcctgtatctcctga

SEQ ID NO: 106430 - DNA, 25 bp, S. pombe
tggaccacattcatttcacctgtat

SEQ ID NO: 106431 - DNA, 25 bp, S. pombe
tggcccatctttacttcagcggtaa

SEQ ID NO: 106432 - DNA, 25 bp, S. pombe
tggctgctggttacgctataggagt

SEQ ID NO: 106433 - DNA, 25 bp, S. pombe
tcgtactttacctgaaactgtccgt

SEQ ID NO: 106434 - DNA, 25 bp, S. pombe
tggaccaaattcgtcactttttaca

SEQ ID NO: 106435 - DNA, 25 bp, S. pombe
tggtccgtcaactagccgaaatata

SEQ ID NO: 106436 - DNA, 25 bp, S. pombe
tggcaactgtcgatcctactgagaa

SEQ ID NO: 106437 - DNA, 25 bp, S. pombe
tggctttgtttgctcagtttgtcta

SEQ ID NO: 106438 - DNA, 25 bp, S. pombe
tggcttccatttcgtcctttacaag

SEQ ID NO: 106439 - DNA, 25 bp, S. pombe
tggcaaatcgttttacttctagtga

SEQ ID NO: 106440 - DNA, 25 bp, S. pombe
tgtgcttgataaccgtacttccatt

SEQ ID NO: 106441 - DNA, 25 bp, S. pombe
tggcatttaactctgacggcacaat

SEQ ID NO: 106442 - DNA, 25 bp, S. pombe
tggatttgacgtttttacagacagt

SEQ ID NO: 106443 - DNA, 25 bp, S. pombe
tggacccattcccaatgtcgaatat

SEQ ID NO: 106444 - DNA, 25 bp, S. pombe
tggctgctttggacgctgagcttga

SEQ ID NO: 106445 - DNA, 25 bp, S. pombe
tggctgcttattttatctctctcga

SEQ ID NO: 106446 - DNA, 25 bp, S. pombe
tggctgctttcatttctatctttaa

SEQ ID NO: 106447 - DNA, 25 bp, S. pombe
tggcaaccaagcttccatctttgaa

SEQ ID NO: 106448 - DNA, 25 bp, S. pombe
tggcaagcctacttccgctgctact

SEQ ID NO: 106449 - DNA, 25 bp, S. pombe
tggaaactacactggctcatggctt

SEQ ID NO: 106450 - DNA, 25 bp, S. pombe
tgggtcgaacttttgatccgcgttt

SEQ ID NO: 106451 - DNA, 25 bp, S. pombe
tggaagcgaatcttcaagctccctg

SEQ ID NO: 106452 - DNA, 25 bp, S. pombe
tggagtggccgatcaatttcttgtg

SEQ ID NO: 106453 - DNA, 25 bp, S. pombe
tggctctccctttttcttggttaag

SEQ ID NO: 106454 - DNA, 25 bp, S. pombe
tggcgatatcaattgcgtgctataa

SEQ ID NO: 106455 - DNA, 25 bp, S. pombe
tggttgtaattgtgattgccccttc

SEQ ID NO: 106456 - DNA, 25 bp, S. pombe
tggttgttacgaaactcctggctta

SEQ ID NO: 106457 - DNA, 25 bp, S. pombe
tggcatcccctcttacttcctaaat

SEQ ID NO: 106458 - DNA, 25 bp, S. pombe
tgtcttcccgaatctgtccaaagaa

SEQ ID NO: 106459 - DNA, 25 bp, S. pombe
tgttttcggcaagctcttcaagacg

SEQ ID NO: 106460 - DNA, 25 bp, S. pombe
tggctgttgattctgccgttaccaa

SEQ ID NO: 106461 - DNA, 25 bp, S. pombe
tggctctgtttttcgaggcttacaa

SEQ ID NO: 106462 - DNA, 25 bp, S. pombe
tggcttgctttatccaaatgcttga

SEQ ID NO: 106463 - DNA, 25 bp, S. pombe
tggttccattgattccaggatgctc

SEQ ID NO: 106464 - DNA, 25 bp, S. pombe
tggctgacagactatcccatactga

SEQ ID NO: 106465 - DNA, 25 bp, S. pombe
tggcttagcttctccaatctatact

SEQ ID NO: 106466 - DNA, 25 bp, S. pombe
tggcttattctcagcgcaatcaaca

SEQ ID NO: 106467 - DNA, 25 bp, S. pombe
tggctcttggtttgaacactcatcc

SEQ ID NO: 106468 - DNA, 25 bp, S. pombe
tggctctacagcatattcactttcc

SEQ ID NO: 106469 - DNA, 25 bp, S. pombe
tggctctcaacgattcaaatgtccc

SEQ ID NO: 106470 - DNA, 25 bp, S. pombe
tgtttcaggcggttacgatggcact

SEQ ID NO: 106471 - DNA, 25 bp, S. pombe
tggtctcagccgcagtcaagattac

SEQ ID NO: 106472 - DNA, 25 bp, S. pombe
tggcagctggacttcaacggtaact

SEQ ID NO: 106473 - DNA, 25 bp, S. pombe
tggaggcggcccaactggacagtct

SEQ ID NO: 106474 - DNA, 25 bp, S. pombe
tggatggctccagaagtcgttacta

SEQ ID NO: 106475 - DNA, 25 bp, S. pombe
tggagtctccgacagaattttcaga

SEQ ID NO: 106476 - DNA, 25 bp, S. pombe
tggttcgccaacttctatttttaat

SEQ ID NO: 106477 - DNA, 25 bp, S. pombe
tggtgatgcccatgatcttgatcgt

SEQ ID NO: 106478 - DNA, 25 bp, S. pombe
tggcagctctcctgtatggttgcta

SEQ ID NO: 106479 - DNA, 25 bp, S. pombe
tggagtcttccatttgtgggcgaaa

SEQ ID NO: 106480 - DNA, 25 bp, S. pombe
tggaatatcccagttgtacgacatt

SEQ ID NO: 106481 - DNA, 25 bp, S. pombe
tggaatcccgaatacaagccttttg

SEQ ID NO: 106482 - DNA, 25 bp, S. pombe
tggtctcgccgtttagatcgtatat

SEQ ID NO: 106483 - DNA, 25 bp, S. pombe
tggatgcaggcgttccagcggaaaa

SEQ ID NO: 106484 - DNA, 25 bp, S. pombe
tggtcggcgctgttttggtattttc

SEQ ID NO: 106485 - DNA, 25 bp, S. pombe
tggtggtgccttctctggtaaagac

SEQ ID NO: 106486 - DNA, 25 bp, S. pombe
tggaggattttgttcgcgtcatgac

SEQ ID NO: 106487 - DNA, 25 bp, S. pombe
tggcagtattgcagtttctcgagac

SEQ ID NO: 106488 - DNA, 25 bp, S. pombe
tggcagttctgctatggcttacaag

SEQ ID NO: 106489 - DNA, 25 bp, S. pombe
tggttgtcgctgacgccaagaaggc

SEQ ID NO: 106490 - DNA, 25 bp, S. pombe
tggcactcagtataaatcaaacaac

SEQ ID NO: 106491 - DNA, 25 bp, S. pombe
tggcaccaccactgtgatcgatgat

SEQ ID NO: 106492 - DNA, 25 bp, S. pombe
tggaatccaactttgcagctccaaa

SEQ ID NO: 106493 - DNA, 25 bp, S. pombe
tggaatactactggtgccgcccaaa

SEQ ID NO: 106494 - DNA, 25 bp, S. pombe
tggaaaagtctcgtacccgaccaag

SEQ ID NO: 106495 - DNA, 25 bp, S. pombe
tggagaaatgttttgccgccggatc

SEQ ID NO: 106496 - DNA, 25 bp, S. pombe
tgtgggcggttgtacacgaacgata

SEQ ID NO: 106497 - DNA, 25 bp, S. pombe
tgggatcgagctttgggactaccta

SEQ ID NO: 106498 - DNA, 25 bp, S. pombe
tggattccaagccaccgatgaaaac

SEQ ID NO: 106499 - DNA, 25 bp, S. pombe
tggtctcgcaatggccactatggat

SEQ ID NO: 106500 - DNA, 25 bp, S. pombe
tggctcttgcctggacactgaaaaa

SEQ ID NO: 106501 - DNA, 25 bp, S. pombe
tggtattgctgctgacctttccaag

SEQ ID NO: 106502 - DNA, 25 bp, S. pombe
tggaagagccacaccgagtatcgca

SEQ ID NO: 106503 - DNA, 25 bp, S. pombe
tggcttgctcaacacggaattcgtt

SEQ ID NO: 106504 - DNA, 25 bp, S. pombe
tggctattcacaccgtctagattgt

SEQ ID NO: 106505 - DNA, 25 bp, S. pombe
tggacattgatacgccatcccagaa

SEQ ID NO: 106506 - DNA, 25 bp, S. pombe
tggactttggctcgcatccaagaag

SEQ ID NO: 106507 - DNA, 25 bp, S. pombe
tggaacgattacctacaacgccatc

SEQ ID NO: 106508 - DNA, 25 bp, S. pombe
tggacctagtttaactgttcccatt

SEQ ID NO: 106509 - DNA, 25 bp, S. pombe
tggaccttggttatagtgacacttt

SEQ ID NO: 106510 - DNA, 25 bp, S. pombe
tggacgccattacccttgtgatgga

SEQ ID NO: 106511 - DNA, 25 bp, S. pombe
tggacttattcgcatctgggatttg

SEQ ID NO: 106512 - DNA, 25 bp, S. pombe
tggcacttttcgcatctgggatgtc

SEQ ID NO: 106513 - DNA, 25 bp, S. pombe
tggctttattgcgttctatgggaca

SEQ ID NO: 106514 - DNA, 25 bp, S. pombe
tggcttgtttgcgtgatctttgtaa

SEQ ID NO: 106515 - DNA, 25 bp, S. pombe
tggcttatgcgatatctattcacaa

SEQ ID NO: 106516 - DNA, 25 bp, S. pombe
tggcttctcaattgaccattccgaa

SEQ ID NO: 106517 - DNA, 25 bp, S. pombe
tggcttcaaaatttccatccgctct

SEQ ID NO: 106518 - DNA, 25 bp, S. pombe
tggtgactcggtaccaaaccgttat

SEQ ID NO: 106519 - DNA, 25 bp, S. pombe
tggattttggcgagcatggcaccgt

SEQ ID NO: 106520 - DNA, 25 bp, S. pombe
tggtggccgtgtggaaccttcagac

SEQ ID NO: 106521 - DNA, 25 bp, S. pombe
tggtcctggaggtcaaaatgtcaac

SEQ ID NO: 106522 - DNA, 25 bp, S. pombe
tgggattgtgcccatctccaattca

SEQ ID NO: 106523 - DNA, 25 bp, S. pombe
tggtattgatgccaaacccattccc

SEQ ID NO: 106524 - DNA, 25 bp, S. pombe
tggttggatcacaacaccactgctg

SEQ ID NO: 106525 - DNA, 25 bp, S. pombe
tgtgcgcaaatacgagcccaagctg

SEQ ID NO: 106526 - DNA, 25 bp, S. pombe
tggaacaccaatcatgcgagcactt

SEQ ID NO: 106527 - DNA, 25 bp, S. pombe
tggataaactggaacatgctactgt

SEQ ID NO: 106528 - DNA, 25 bp, S. pombe
tggtggaattcctagcgacgcgttt

SEQ ID NO: 106529 - DNA, 25 bp, S. pombe
tgggaaatattcgaggccgcggttt

SEQ ID NO: 106530 - DNA, 25 bp, S. pombe
tcgacaaaaatgttggcctgggttt

SEQ ID NO: 106531 - DNA, 25 bp, S. pombe
tggaatctcaaactcccaagctggt

SEQ ID NO: 106532 - DNA, 25 bp, S. pombe
tggttgcacgtacacagagctggct

SEQ ID NO: 106533 - DNA, 25 bp, S. pombe
tggtttggctatcacaagcctgctg

SEQ ID NO: 106534 - DNA, 25 bp, S. pombe
tgtcttaaatttgttcgtccgtcgc

SEQ ID NO: 106535 - DNA, 25 bp, S. pombe
tggtaaattttccattcgcaccgtc

SEQ ID NO: 106536 - DNA, 25 bp, S. pombe
tggcataaaatcaagccccgctatt

SEQ ID NO: 106537 - DNA, 25 bp, S. pombe
tggaaaaatcgatcgcgctgctatc

SEQ ID NO: 106538 - DNA, 25 bp, S. pombe
tggaacgatcacgaagtcaagcctt

SEQ ID NO: 106539 - DNA, 25 bp, S. pombe
tggaatatccgatgctgtcgcccaa

SEQ ID NO: 106540 - DNA, 25 bp, S. pombe
tggaatcctaaaacccttcgcgaag

SEQ ID NO: 106541 - DNA, 25 bp, S. pombe
tggaattcgaagaacccaatcgtaa

SEQ ID NO: 106542 - DNA, 25 bp, S. pombe
tggaagtcacgatcccgtaaaccgt

SEQ ID NO: 106543 - DNA, 25 bp, S. pombe
tggaatgtacgatcccgataccacg

SEQ ID NO: 106544 - DNA, 25 bp, S. pombe
tggaggtactctaccgctatccata

SEQ ID NO: 106545 - DNA, 25 bp, S. pombe
tggagttagcttccgcgaatctgat

SEQ ID NO: 106546 - DNA, 25 bp, S. pombe
tggaaatttagatctcccatccctt

SEQ ID NO: 106547 - DNA, 25 bp, S. pombe
tggaaagcttaatgctccggtcctt

SEQ ID NO: 106548 - DNA, 25 bp, S. pombe
tgtatacttttgaaaccggccgatt

SEQ ID NO: 106549 - DNA, 25 bp, S. pombe
tggttggcacaagttcatatcgatg

SEQ ID NO: 106550 - DNA, 25 bp, S. pombe
tggttatatcgcttcaatcattggt

SEQ ID NO: 106551 - DNA, 25 bp, S. pombe
tggatcttgtaacacctcactttgt

SEQ ID NO: 106552 - DNA, 25 bp, S. pombe
tggttctactagttttggttcagct

SEQ ID NO: 106553 - DNA, 25 bp, S. pombe
tggttgacacatgggctcctgaagc

SEQ ID NO: 106554 - DNA, 25 bp, S. pombe
tggtatatccatccatgtcgtacgc

SEQ ID NO: 106555 - DNA, 25 bp, S. pombe
tggatcagtcacgaattacacctct

SEQ ID NO: 106556 - DNA, 25 bp, S. pombe
tggtctttgacaaactacctccaac

SEQ ID NO: 106557 - DNA, 25 bp, S. pombe
tgggtcttgacaatgagccttctcc

SEQ ID NO: 106558 - DNA, 25 bp, S. pombe
tgggtcttgaacagttatctcgtcc

SEQ ID NO: 106559 - DNA, 25 bp, S. pombe
tggacgctactactgtgttatctcg

SEQ ID NO: 106560 - DNA, 25 bp, S. pombe
tggactcgcccaaatatttcttgct

SEQ ID NO: 106561 - DNA, 25 bp, S. pombe
tggagaccattttctttttggcttt

SEQ ID NO: 106562 - DNA, 25 bp, S. pombe
tgggtaactacacgttttccattat

SEQ ID NO: 106563 - DNA, 25 bp, S. pombe
tggttaactactccttttacagctt

SEQ ID NO: 106564 - DNA, 25 bp, S. pombe
tgtgtttacaccacttgcggacgat

SEQ ID NO: 106565 - DNA, 25 bp, S. pombe
tgtgattttttgttcggcaggacgt

SEQ ID NO: 106566 - DNA, 25 bp, S. pombe
tggttttacttcttcatgggactga

SEQ ID NO: 106567 - DNA, 25 bp, S. pombe
tggttgttcccgacaatttccaaca

SEQ ID NO: 106568 - DNA, 25 bp, S. pombe
tggtgaacccaataaacttcccaag

SEQ ID NO: 106569 - DNA, 25 bp, S. pombe
tgctttacaatttcctaactgccgc

SEQ ID NO: 106570 - DNA, 25 bp, S. pombe
tggtctaatttctcttcacccaaaa

SEQ ID NO: 106571 - DNA, 25 bp, S. pombe
tgagcccaagtttcttcctacttta

SEQ ID NO: 106572 - DNA, 25 bp, S. pombe
tgggtacaaatctgtggccttctcc

SEQ ID NO: 106573 - DNA, 25 bp, S. pombe
tggtcaagtttgtgtctgccctaac

SEQ ID NO: 106574 - DNA, 25 bp, S. pombe
tggatgaacttttgcctactccttc

SEQ ID NO: 106575 - DNA, 25 bp, S. pombe
tggtggccctattcgtcaacgctat

SEQ ID NO: 106576 - DNA, 25 bp, S. pombe
tggaggaatgtctcgtcagcctcta

SEQ ID NO: 106577 - DNA, 25 bp, S. pombe
tggagcaagtcgtttacgccagctg

SEQ ID NO: 106578 - DNA, 25 bp, S. pombe
tggatatgccacaattcccctcaaa

SEQ ID NO: 106579 - DNA, 25 bp, S. pombe
tggtctcgtcaagccttactacaag

SEQ ID NO: 106580 - DNA, 25 bp, S. pombe
tggatcatcattcaccgttagcgac

SEQ ID NO: 106581 - DNA, 25 bp, S. pombe
tggattgcattttccccaaaggctg

SEQ ID NO: 106582 - DNA, 25 bp, S. pombe
tggattgattcctcctaacagcact

SEQ ID NO: 106583 - DNA, 25 bp, S. pombe
tggattgcaatcctccgatcaacaa

SEQ ID NO: 106584 - DNA, 25 bp, S. pombe
tggaacacccagcaagagacagact

SEQ ID NO: 106585 - DNA, 25 bp, S. pombe
tggaaccctcatcctgaagacatga

SEQ ID NO: 106586 - DNA, 25 bp, S. pombe
tggagcctcccttaagttcaaatac

SEQ ID NO: 106587 - DNA, 25 bp, S. pombe
tggactgtcccgttacttagtgaaa

SEQ ID NO: 106588 - DNA, 25 bp, S. pombe
tggacttcttcgtggcactggtaaa

SEQ ID NO: 106589 - DNA, 25 bp, S. pombe
tggattttacttgggcacgctctga

SEQ ID NO: 106590 - DNA, 25 bp, S. pombe
tgtattgcttacttgggtatcccaa

SEQ ID NO: 106591 - DNA, 25 bp, S. pombe
tggatttcccggtgctcacggcatt

SEQ ID NO: 106592 - DNA, 25 bp, S. pombe
tggatattgctttggttggcctggc

SEQ ID NO: 106593 - DNA, 25 bp, S. pombe
tgtgtatgttattcgttacttggtg

SEQ ID NO: 106594 - DNA, 25 bp, S. pombe
tggttttttccctcattcttgtatt

SEQ ID NO: 106595 - DNA, 25 bp, S. pombe
tggatttcccttgtttcctggtgaa

SEQ ID NO: 106596 - DNA, 25 bp, S. pombe
tgaggttcccttttttaatggcgat

SEQ ID NO: 106597 - DNA, 25 bp, S. pombe
tggtgtcccttctgccaattacaaa

SEQ ID NO: 106598 - DNA, 25 bp, S. pombe
tggttccaatcctgcaagtgctaca

SEQ ID NO: 106599 - DNA, 25 bp, S. pombe
tggttttatccactacgcctttgaa

SEQ ID NO: 106600 - DNA, 25 bp, S. pombe
tggatcgtttgcctctattttttgg

SEQ ID NO: 106601 - DNA, 25 bp, S. pombe
tggagaatgcactcatgtcatgaaa

SEQ ID NO: 106602 - DNA, 25 bp, S. pombe
tggatgatatcactcgctggcttaa

SEQ ID NO: 106603 - DNA, 25 bp, S. pombe
tggatgaatgtacgtctgctttaga

SEQ ID NO: 106604 - DNA, 25 bp, S. pombe
tggacctctattgtcgcttggtaat

SEQ ID NO: 106605 - DNA, 25 bp, S. pombe
tgtgtgccactggtgctatttggac

SEQ ID NO: 106606 - DNA, 25 bp, S. pombe
tggagtgaccagttatgtgcgttat

SEQ ID NO: 106607 - DNA, 25 bp, S. pombe
tggatcctgaactatttgctcacct

SEQ ID NO: 106608 - DNA, 25 bp, S. pombe
tggataaatacatccgcgcacgctc

SEQ ID NO: 106609 - DNA, 25 bp, S. pombe
tggacctacgcatacatggcttgtt

SEQ ID NO: 106610 - DNA, 25 bp, S. pombe
tggaggccaccggacatgatgtttg

SEQ ID NO: 106611 - DNA, 25 bp, S. pombe
tggagacgcaccctgatagagtatc

SEQ ID NO: 106612 - DNA, 25 bp, S. pombe
tggacagtaactccctaactcatga

SEQ ID NO: 106613 - DNA, 25 bp, S. pombe
tggtattacacgcttcagactttcc

SEQ ID NO: 106614 - DNA, 25 bp, S. pombe
tggattttgccgcttcgtagatcac

SEQ ID NO: 106615 - DNA, 25 bp, S. pombe
tggagtttgctgctttagaccacag

SEQ ID NO: 106616 - DNA, 25 bp, S. pombe
tggagcgccccggtaaagatatcac

SEQ ID NO: 106617 - DNA, 25 bp, S. pombe
tggatgcttcccgtgatgaaaacat

SEQ ID NO: 106618 - DNA, 25 bp, S. pombe
tggttccctaatttccgattcttat

SEQ ID NO: 106619 - DNA, 25 bp, S. pombe
tggtttcaaacaagacgttaagctt

SEQ ID NO: 106620 - DNA, 25 bp, S. pombe
tggtttacagttttcctcgttgaga

SEQ ID NO: 106621 - DNA, 25 bp, S. pombe
tggatttagcgtttctcacactacc

SEQ ID NO: 106622 - DNA, 25 bp, S. pombe
tggtctcaagcgaggtatcctacct

SEQ ID NO: 106623 - DNA, 25 bp, S. pombe
tggatttttgcgttactggaccctt

SEQ ID NO: 106624 - DNA, 25 bp, S. pombe
tgagtttttccttagtggcttcctt

SEQ ID NO: 106625 - DNA, 25 bp, S. pombe
tggtcttcttccttcaaagttgcca

SEQ ID NO: 106626 - DNA, 25 bp, S. pombe
tggtgttccccaaattgaagtcacg

SEQ ID NO: 106627 - DNA, 25 bp, S. pombe
tggttgttacgctactggatcgcaa

SEQ ID NO: 106628 - DNA, 25 bp, S. pombe
tggtattcccaacgtaaccgatgaa

SEQ ID NO: 106629 - DNA, 25 bp, S. pombe
tggtattacagctccgaagcctgag

SEQ ID NO: 106630 - DNA, 25 bp, S. pombe
tggtctaactgtttcggatgccgaa

SEQ ID NO: 106631 - DNA, 25 bp, S. pombe
tggatcccaagttttttccagagga

SEQ ID NO: 106632 - DNA, 25 bp, S. pombe
tggtacccacggttatttcaaggca

SEQ ID NO: 106633 - DNA, 25 bp, S. pombe
tggtcaaacaccgtcctttaagcaa

SEQ ID NO: 106634 - DNA, 25 bp, S. pombe
tggacccattgattgcacgttcatg

SEQ ID NO: 106635 - DNA, 25 bp, S. pombe
tggattaccattcatgtcatgccgc

SEQ ID NO: 106636 - DNA, 25 bp, S. pombe
tggtagtgctcaatcctggtggtaa

SEQ ID NO: 106637 - DNA, 25 bp, S. pombe
tggattgcgttttcatgctcggtca

SEQ ID NO: 106638 - DNA, 25 bp, S. pombe
tggttcgttcagatgcagctttgca

SEQ ID NO: 106639 - DNA, 25 bp, S. pombe
tggagcatcgtcctgcaattttgcg

SEQ ID NO: 106640 - DNA, 25 bp, S. pombe
tggagccctcagcagattttagctt

SEQ ID NO: 106641 - DNA, 25 bp, S. pombe
tggtagtgttcttcccatgcaacaa

SEQ ID NO: 106642 - DNA, 25 bp, S. pombe
tggaggatcttatgcgccatgataa

SEQ ID NO: 106643 - DNA, 25 bp, S. pombe
tggtcctggtgctcaagctgccctt

SEQ ID NO: 106644 - DNA, 25 bp, S. pombe
tggtttctgctgacacattcgttcg

SEQ ID NO: 106645 - DNA, 25 bp, S. pombe
tggagacatgctttctacctttaag

SEQ ID NO: 106646 - DNA, 25 bp, S. pombe
tggagccctttctacgctgataaca

SEQ ID NO: 106647 - DNA, 25 bp, S. pombe
tggatggccattataccgcaaatat

SEQ ID NO: 106648 - DNA, 25 bp, S. pombe
tggagcgtcgcaaatcacggcaaga

SEQ ID NO: 106649 - DNA, 25 bp, S. pombe
tggaggccgctgtatcattagaaac

SEQ ID NO: 106650 - DNA, 25 bp, S. pombe
tgggattttcgggatttgacacaac

SEQ ID NO: 106651 - DNA, 25 bp, S. pombe
tgggtttagtatcggttccgcacca

SEQ ID NO: 106652 - DNA, 25 bp, S. pombe
tggtgtttcagttttgcgatccggc

SEQ ID NO: 106653 - DNA, 25 bp, S. pombe
tggttgtcgaccctgatgagagaaa

SEQ ID NO: 106654 - DNA, 25 bp, S. pombe
tggatggcctgcgtttttcgataat

SEQ ID NO: 106655 - DNA, 25 bp, S. pombe
tggatgctcctcgtgttttgattga

SEQ ID NO: 106656 - DNA, 25 bp, S. pombe
tggatccccatttgtttgcactatt

SEQ ID NO: 106657 - DNA, 25 bp, S. pombe
tggacgctgttctgctcaattcgaa

SEQ ID NO: 106658 - DNA, 25 bp, S. pombe
tggatgttttggatggccgtctcaa

SEQ ID NO: 106659 - DNA, 25 bp, S. pombe
tggacccataccgaacgcatttgaa

SEQ ID NO: 106660 - DNA, 25 bp, S. pombe
tgggtgctactatcgtcattactga

SEQ ID NO: 106661 - DNA, 25 bp, S. pombe
tggacccacagcgattcatacaaag

SEQ ID NO: 106662 - DNA, 25 bp, S. pombe
tggtgccaacagttcatctaccagg

SEQ ID NO: 106663 - DNA, 25 bp, S. pombe
tggtcacaaggctgcacttcataac

SEQ ID NO: 106664 - DNA, 25 bp, S. pombe
tggatgttattctctctgtttgtaa

SEQ ID NO: 106665 - DNA, 25 bp, S. pombe
tggatttattttctttgctctgaca

SEQ ID NO: 106666 - DNA, 25 bp, S. pombe
tggtttttacagcttctcttgcaaa

SEQ ID NO: 106667 - DNA, 25 bp, S. pombe
tggaggtggcttccctattaaactt

SEQ ID NO: 106668 - DNA, 25 bp, S. pombe
tggatttcctccatctgcttataat

SEQ ID NO: 106669 - DNA, 25 bp, S. pombe
tggatgctatccaacgatctcgtca

SEQ ID NO: 106670 - DNA, 25 bp, S. pombe
tggtaactcacgactacactggttc

SEQ ID NO: 106671 - DNA, 25 bp, S. pombe
tggtaatgtatctgctcacaccggt

SEQ ID NO: 106672 - DNA, 25 bp, S. pombe
tggtttgcaacacgctcttcaagat

SEQ ID NO: 106673 - DNA, 25 bp, S. pombe
tggtttacatacctcgctacgataa

SEQ ID NO: 106674 - DNA, 25 bp, S. pombe
tggattgctacatgcggtttcgaat

SEQ ID NO: 106675 - DNA, 25 bp, S. pombe
tgaccgctactttggcacttgctag

SEQ ID NO: 106676 - DNA, 25 bp, S. pombe
tggttatacacattggcccttagac

SEQ ID NO: 106677 - DNA, 25 bp, S. pombe
tggagtcactgaaacgcctttatgg

SEQ ID NO: 106678 - DNA, 25 bp, S. pombe
tggtggccttactgatgactttttg

SEQ ID NO: 106679 - DNA, 25 bp, S. pombe
tggtggagctagtccttcttttgaa

SEQ ID NO: 106680 - DNA, 25 bp, S. pombe
tgtggctactgcttctataaccggt

SEQ ID NO: 106681 - DNA, 25 bp, S. pombe
tggagcatgtttcgttcaacccatt

SEQ ID NO: 106682 - DNA, 25 bp, S. pombe
tggagcatctggtttcgaagccgat

SEQ ID NO: 106683 - DNA, 25 bp, S. pombe
tggagatggccgcaaaggacaactt

SEQ ID NO: 106684 - DNA, 25 bp, S. pombe
tgttacgaagaaatcctacggcaat

SEQ ID NO: 106685 - DNA, 25 bp, S. pombe
tgttacctactcaccttcgaaatag

SEQ ID NO: 106686 - DNA, 25 bp, S. pombe
tggttttatctatccttcacgtaag

SEQ ID NO: 106687 - DNA, 25 bp, S. pombe
tggttatattttcgctgcctgtaat

SEQ ID NO: 106688 - DNA, 25 bp, S. pombe
tggtgccactgcgacagctgagaat

SEQ ID NO: 106689 - DNA, 25 bp, S. pombe
tggatcgacgtcttcagagcactga

SEQ ID NO: 106690 - DNA, 25 bp, S. pombe
tggatctgcttttattactcctgct

SEQ ID NO: 106691 - DNA, 25 bp, S. pombe
tggatccgatggttgcttcattttc

SEQ ID NO: 106692 - DNA, 25 bp, S. pombe
tggtccactgagtcctgatcattta

SEQ ID NO: 106693 - DNA, 25 bp, S. pombe
tggtaccaggaaagtcatgttcaat

SEQ ID NO: 106694 - DNA, 25 bp, S. pombe
tggttcggactctaatgcttcatta

SEQ ID NO: 106695 - DNA, 25 bp, S. pombe
tggatctcgccatttttcaaaactg

SEQ ID NO: 106696 - DNA, 25 bp, S. pombe
tggtcgtcgcattctttcaaagtta

SEQ ID NO: 106697 - DNA, 25 bp, S. pombe
tggtcattcgcaagcccaatttgat

SEQ ID NO: 106698 - DNA, 25 bp, S. pombe
tgggacttcccactatatttaattt

SEQ ID NO: 106699 - DNA, 25 bp, S. pombe
tggtaccggcacctttagtagaatt

SEQ ID NO: 106700 - DNA, 25 bp, S. pombe
tgggaccgcgcaactttttatacaa

SEQ ID NO: 106701 - DNA, 25 bp, S. pombe
tgggcctgctctgttggtaaagtta

SEQ ID NO: 106702 - DNA, 25 bp, S. pombe
tgggctgatgtctctgatttaccgc

SEQ ID NO: 106703 - DNA, 25 bp, S. pombe
tgggtaccaccgaatgtgccatcgt

SEQ ID NO: 106704 - DNA, 25 bp, S. pombe
tggagtgaacccgtagctgactttc

SEQ ID NO: 106705 - DNA, 25 bp, S. pombe
tgggtgcaactataactggcctttt

SEQ ID NO: 106706 - DNA, 25 bp, S. pombe
tggatgcccagtagtttgtacaaac

SEQ ID NO: 106707 - DNA, 25 bp, S. pombe
tggaggccatgctatgctttcgaat

SEQ ID NO: 106708 - DNA, 25 bp, S. pombe
tgggcgccatattcttgcaaagctg

SEQ ID NO: 106709 - DNA, 25 bp, S. pombe
tggttgcacccatctatgcctttag

SEQ ID NO: 106710 - DNA, 25 bp, S. pombe
tggttgatccggttgtggctgttaa

SEQ ID NO: 106711 - DNA, 25 bp, S. pombe
tgggtgtttggagttccttcactac

SEQ ID NO: 106712 - DNA, 25 bp, S. pombe
tgggtttcgtcttccaccggagaag

SEQ ID NO: 106713 - DNA, 25 bp, S. pombe
tggtcggaacaagcaccgctatgtt

SEQ ID NO: 106714 - DNA, 25 bp, S. pombe
tggttcgtcgtcaattcctgaagtt

SEQ ID NO: 106715 - DNA, 25 bp, S. pombe
tggtactgtcgctcttcgtgagatt

SEQ ID NO: 106716 - DNA, 25 bp, S. pombe
tggtcgttggcaattccgtgagcat

SEQ ID NO: 106717 - DNA, 25 bp, S. pombe
tgggaacatgcctactatcctcaat

SEQ ID NO: 106718 - DNA, 25 bp, S. pombe
tgtggacacaccgatgctatctagc

SEQ ID NO: 106719 - DNA, 25 bp, S. pombe
tggttgcgtcaaattcggtaatgtg

SEQ ID NO: 106720 - DNA, 25 bp, S. pombe
tggtacacaatctatccgcggtagg

SEQ ID NO: 106721 - DNA, 25 bp, S. pombe
tggatggccagatggatcgtcccta

SEQ ID NO: 106722 - DNA, 25 bp, S. pombe
tggtattcaagcatgcgtgccacct

SEQ ID NO: 106723 - DNA, 25 bp, S. pombe
tggtcaaccgctacttcaattttaa

SEQ ID NO: 106724 - DNA, 25 bp, S. pombe
tggatgctcaatttgttgcctggaa

SEQ ID NO: 106725 - DNA, 25 bp, S. pombe
tggatccatcaattcttcctcaatc

SEQ ID NO: 106726 - DNA, 25 bp, S. pombe
tgggcgcataacattttcaagctta

SEQ ID NO: 106727 - DNA, 25 bp, S. pombe
tggtcgtgttggtcacattgctaga

SEQ ID NO: 106728 - DNA, 25 bp, S. pombe
tggtcgtgtttctcatttggatcaa

SEQ ID NO: 106729 - DNA, 25 bp, S. pombe
tggtcgagttgttgatcttcgccta

SEQ ID NO: 106730 - DNA, 25 bp, S. pombe
tgagtccaaggaacttacacgccgc

SEQ ID NO: 106731 - DNA, 25 bp, S. pombe
tgggtactagtgctgaacgctcttc

SEQ ID NO: 106732 - DNA, 25 bp, S. pombe
tggttaccagctaaaactctcgctc

SEQ ID NO: 106733 - DNA, 25 bp, S. pombe
tgggccgccatttgcaacaaaagtt

SEQ ID NO: 106734 - DNA, 25 bp, S. pombe
tggtcctctgccgtaaacaaagttc

SEQ ID NO: 106735 - DNA, 25 bp, S. pombe
tgtccattgacaccagataccgaac

SEQ ID NO: 106736 - DNA, 25 bp, S. pombe
tgtaaagatgactgattgcccacgt

SEQ ID NO: 106737 - DNA, 25 bp, S. pombe
tgttccaatggctgacgaaactgtc

SEQ ID NO: 106738 - DNA, 25 bp, S. pombe
tggtgaaaagagtacaagcatattg

SEQ ID NO: 106739 - DNA, 25 bp, S. pombe
tggtgaaaagagtacaagcatattg

SEQ ID NO: 106740 - DNA, 25 bp, S. pombe
tggtatccaggagcacattgacttg

SEQ ID NO: 106741 - DNA, 25 bp, S. pombe
tggtaccggatgtatcattgcttga

SEQ ID NO: 106742 - DNA, 25 bp, S. pombe
tggtatcttttggactttctgccta

SEQ ID NO: 106743 - DNA, 25 bp, S. pombe
tggattcttattttcttggcggcat

SEQ ID NO: 106744 - DNA, 25 bp, S. pombe
tggattcaattaaccttgtcaggat

SEQ ID NO: 106745 - DNA, 25 bp, S. pombe
tggtgtctcttgctaccaagcagtt

SEQ ID NO: 106746 - DNA, 25 bp, S. pombe
tggttcttcaatgccaacagcgaat

SEQ ID NO: 106747 - DNA, 25 bp, S. pombe
tggtccagtgtcgagaatttatctt

SEQ ID NO: 106748 - DNA, 25 bp, S. pombe
tgtcgctggtaccactggagctgat

SEQ ID NO: 106749 - DNA, 25 bp, S. pombe
tgtgctctaatttgcctagtgctgt

SEQ ID NO: 106750 - DNA, 25 bp, S. pombe
tgactatttccctttaactgcttta

SEQ ID NO: 106751 - DNA, 25 bp, S. pombe
tcttcagtccccttaaaggctttga

SEQ ID NO: 106752 - DNA, 25 bp, S. pombe
tggattatacgacttgcgctcgcga

SEQ ID NO: 106753 - DNA, 25 bp, S. pombe
tggattcaatctttctcctcaggaa

SEQ ID NO: 106754 - DNA, 25 bp, S. pombe
tggattacaccaatctcctaccaat

SEQ ID NO: 106755 - DNA, 25 bp, S. pombe
tggtatttttgcttttcatcctcct

SEQ ID NO: 106756 - DNA, 25 bp, S. pombe
tgggaatctggtgctgttaccctat

SEQ ID NO: 106757 - DNA, 25 bp, S. pombe
tgtggatggctgataaacccttata

SEQ ID NO: 106758 - DNA, 25 bp, S. pombe
tgggtaagggtcgtctgcctgatac

SEQ ID NO: 106759 - DNA, 25 bp, S. pombe
tgggtaagggacgtcttcctgagac

SEQ ID NO: 106760 - DNA, 25 bp, S. pombe
tggtggcatagcagacgtttcctaa

SEQ ID NO: 106761 - DNA, 25 bp, S. pombe
tgtggtcgtaacaagcatggccgtg

SEQ ID NO: 106762 - DNA, 25 bp, S. pombe
tggtcctcctgtttatcgtagtgga

SEQ ID NO: 106763 - DNA, 25 bp, S. pombe
tggattgccgtttttgagctcagta

SEQ ID NO: 106764 - DNA, 25 bp, S. pombe
tggttcgacctctttattcagatcc

SEQ ID NO: 106765 - DNA, 25 bp, S. pombe
tggttcaacacttttagctgctgcc

SEQ ID NO: 106766 - DNA, 25 bp, S. pombe
tgttgtcaacaattcgggtggccca

SEQ ID NO: 106767 - DNA, 25 bp, S. pombe
tggttactattttcagcgctcccaa

SEQ ID NO: 106768 - DNA, 25 bp, S. pombe
tggtttctacgttcgctctttaatt

SEQ ID NO: 106769 - DNA, 25 bp, S. pombe
tggtttgcgattcatttgtctgtcc

SEQ ID NO: 106770 - DNA, 25 bp, S. pombe
tggtgttccagtccatttatggcat

SEQ ID NO: 106771 - DNA, 25 bp, S. pombe
tggtcttctattccatcttggcaat

SEQ ID NO: 106772 - DNA, 25 bp, S. pombe
tgtgtattcaaccaactgtatgaat

SEQ ID NO: 106773 - DNA, 25 bp, S. pombe
tggtcattcccatttgtttgtcaat

SEQ ID NO: 106774 - DNA, 25 bp, S. pombe
tggtttcctcttatcaatcatcact

SEQ ID NO: 106775 - DNA, 25 bp, S. pombe
tggttcttccattcgtatcttcgat

SEQ ID NO: 106776 - DNA, 25 bp, S. pombe
tggtgaccctttgtactgtcgatta

SEQ ID NO: 106777 - DNA, 25 bp, S. pombe
tggtatcccttagcttcaggagcat

SEQ ID NO: 106778 - DNA, 25 bp, S. pombe
tggttcgcttttacttcagatggcc

SEQ ID NO: 106779 - DNA, 25 bp, S. pombe
tgggattcgactttctttgggtctt

SEQ ID NO: 106780 - DNA, 25 bp, S. pombe
tgtcgtaacgtttttgggcgctcta

SEQ ID NO: 106781 - DNA, 25 bp, S. pombe
tgggttgaccttttggagacgccta

SEQ ID NO: 106782 - DNA, 25 bp, S. pombe
tggtgtttacctttcctagagataa

SEQ ID NO: 106783 - DNA, 25 bp, S. pombe
tggttgctcccatgattcctaataa

SEQ ID NO: 106784 - DNA, 25 bp, S. pombe
tggtatcacctgaaatcgcttcccg

SEQ ID NO: 106785 - DNA, 25 bp, S. pombe
tggtaatttgattattgctgtcgcc

SEQ ID NO: 106786 - DNA, 25 bp, S. pombe
tggtcagccgtattttgccgatgca

SEQ ID NO: 106787 - DNA, 25 bp, S. pombe
tggtcaatcgtcaaggtcaagtcat

SEQ ID NO: 106788 - DNA, 25 bp, S. pombe
tggtgatgacaagccgttcgtatta

SEQ ID NO: 106789 - DNA, 25 bp, S. pombe
tggtgagtcataccctgttcgttac

SEQ ID NO: 106790 - DNA, 25 bp, S. pombe
tgggaacaacgcttgattgccgaac

SEQ ID NO: 106791 - DNA, 25 bp, S. pombe
tgtgaagccaaacccaagctcttgt

SEQ ID NO: 106792 - DNA, 25 bp, S. pombe
tgtacaagactgattccgaatgcgt

SEQ ID NO: 106793 - DNA, 25 bp, S. pombe
tgtcaagaagctatggcccatccgt

SEQ ID NO: 106794 - DNA, 25 bp, S. pombe
tgtgtatggcgcttggatcagtctt

SEQ ID NO: 106795 - DNA, 25 bp, S. pombe
tggtaacatcattcgtttctctcct

SEQ ID NO: 106796 - DNA, 25 bp, S. pombe
tggtgcttcctgtgtctgtgtattc

SEQ ID NO: 106797 - DNA, 25 bp, S. pombe
tgtcccttccgaaacggcagctgaa

SEQ ID NO: 106798 - DNA, 25 bp, S. pombe
tggtcctttggtcgacaagcctgaa

SEQ ID NO: 106799 - DNA, 25 bp, S. pombe
tggtccttctcgagtcaagcgtgct

SEQ ID NO: 106800 - DNA, 25 bp, S. pombe
tggtcactttcgacgtatgtgcgat

SEQ ID NO: 106801 - DNA, 25 bp, S. pombe
tgttcaaattttgtgcattgcgtta

SEQ ID NO: 106802 - DNA, 25 bp, S. pombe
tggtattttcttatgccagcgaata

SEQ ID NO: 106803 - DNA, 25 bp, S. pombe
tggttcaccatattcgttgcttcta

SEQ ID NO: 106804 - DNA, 25 bp, S. pombe
tggtcattcgcaaccgtcgtttaaa

SEQ ID NO: 106805 - DNA, 25 bp, S. pombe
tgtgtcgacaaagccaagttcgtat

SEQ ID NO: 106806 - DNA, 25 bp, S. pombe
tgggtcaatcccctttcaaaggtga

SEQ ID NO: 106807 - DNA, 25 bp, S. pombe
tgggattcccgtctacgtatcgaaa

SEQ ID NO: 106808 - DNA, 25 bp, S. pombe
tggtatttctccatttctttctaaa

SEQ ID NO: 106809 - DNA, 25 bp, S. pombe
tgggtactctccatattcttctagt

SEQ ID NO: 106810 - DNA, 25 bp, S. pombe
tggtagttctacaccttcaatgact

SEQ ID NO: 106811 - DNA, 25 bp, S. pombe
tgggtgttccatcatactctcaaac

SEQ ID NO: 106812 - DNA, 25 bp, S. pombe
tgggatggcccaattgttctcaaag

SEQ ID NO: 106813 - DNA, 25 bp, S. pombe
tgggattatctcttgtggacgcaaa

SEQ ID NO: 106814 - DNA, 25 bp, S. pombe
tgaaacgtattcaacgtggtcccgt

SEQ ID NO: 106815 - DNA, 25 bp, S. pombe
tgaaccagaaatcacgtttgcccca

SEQ ID NO: 106816 - DNA, 25 bp, S. pombe
tgtcagccaaaacgtagtaaccctt

SEQ ID NO: 106817 - DNA, 25 bp, S. pombe
tgtcgtcaaacactgcatctaaact

SEQ ID NO: 106818 - DNA, 25 bp, S. pombe
tgtccgactggaatgcaacgatttt

SEQ ID NO: 106819 - DNA, 25 bp, S. pombe
tgggcttgacatatgcggctgtacc

SEQ ID NO: 106820 - DNA, 25 bp, S. pombe
tggtcatcaaaagtcttcctccagc

SEQ ID NO: 106821 - DNA, 25 bp, S. pombe
tggtttaattcacttttcacgcctt

SEQ ID NO: 106822 - DNA, 25 bp, S. pombe
tggtcttctgaagaggctgctcgat

SEQ ID NO: 106823 - DNA, 25 bp, S. pombe
tgggcaatcacagcaaggcgtctct

SEQ ID NO: 106824 - DNA, 25 bp, S. pombe
tcggcaatcccgtcaaagtactgat

SEQ ID NO: 106825 - DNA, 25 bp, S. pombe
tggtttggacctacaacatcttgtt

SEQ ID NO: 106826 - DNA, 25 bp, S. pombe
tggtttcgaccggaagctgttattt

SEQ ID NO: 106827 - DNA, 25 bp, S. pombe
tgggttttcgttcggtgctaacaat

SEQ ID NO: 106828 - DNA, 25 bp, S. pombe
tggtgaagccccttacagttatcct

SEQ ID NO: 106829 - DNA, 25 bp, S. pombe
tggtggctgccaacagagtcggtac

SEQ ID NO: 106830 - DNA, 25 bp, S. pombe
tgctccaggacgaggaccatcgaaa

SEQ ID NO: 106831 - DNA, 25 bp, S. pombe
tggtattactgcaggtccatcgaat

SEQ ID NO: 106832 - DNA, 25 bp, S. pombe
tggtttcactcttgatgaccctagt

SEQ ID NO: 106833 - DNA, 25 bp, S. pombe
tggtgtgtatccttatgttcctacc

SEQ ID NO: 106834 - DNA, 25 bp, S. pombe
tgtgcgtgaacatgaaggctccgac

SEQ ID NO: 106835 - DNA, 25 bp, S. pombe
tggtggttcttgatcctatttcaaa

SEQ ID NO: 106836 - DNA, 25 bp, S. pombe
tggtcacttgttaacaccactttta

SEQ ID NO: 106837 - DNA, 25 bp, S. pombe
tggtctagcagatgatactcctttt

SEQ ID NO: 106838 - DNA, 25 bp, S. pombe
tggtcacatcaatcattctctcttt

SEQ ID NO: 106839 - DNA, 25 bp, S. pombe
tggtctctctttactggcatcagaa

SEQ ID NO: 106840 - DNA, 25 bp, S. pombe
tgaaccagttatttccgtcgttctc

SEQ ID NO: 106841 - DNA, 25 bp, S. pombe
tgggtaatttctacttctgccttgc

SEQ ID NO: 106842 - DNA, 25 bp, S. pombe
tgcgcttttgttaactttacgtcgt

SEQ ID NO: 106843 - DNA, 25 bp, S. pombe
tggtcctcgttaaacattatctgtt

SEQ ID NO: 106844 - DNA, 25 bp, S. pombe
tggtctccctgctgaaactgaaatt

SEQ ID NO: 106845 - DNA, 25 bp, S. pombe
tgtcctgacccttaattctaacttt

SEQ ID NO: 106846 - DNA, 25 bp, S. pombe
tcggtatttagccacgttccttcaa

SEQ ID NO: 106847 - DNA, 25 bp, S. pombe
tgggttttaccatgtatgcaataaa

SEQ ID NO: 106848 - DNA, 25 bp, S. pombe
tgggctctcgtgagcaacttgcaat

SEQ ID NO: 106849 - DNA, 25 bp, S. pombe
tcagggagcatggtcagatccgttt

SEQ ID NO: 106850 - DNA, 25 bp, S. pombe
tctgaagaggaagcccgttcttact

SEQ ID NO: 106851 - DNA, 25 bp, S. pombe
tgaggaacaagtccccaatggctcg

SEQ ID NO: 106852 - DNA, 25 bp, S. pombe
tgggcataacggaccctatactcag

SEQ ID NO: 106853 - DNA, 25 bp, S. pombe
tgggcactttgttcaaggacacgtt

SEQ ID NO: 106854 - DNA, 25 bp, S. pombe
tgaggcgttcgttcaagaggacaat

SEQ ID NO: 106855 - DNA, 25 bp, S. pombe
tgggactccccaaagtcacatatga

SEQ ID NO: 106856 - DNA, 25 bp, S. pombe
tgggcttccctcagattctattgaa

SEQ ID NO: 106857 - DNA, 25 bp, S. pombe
tggtgtattttgattgttttcgcaa

SEQ ID NO: 106858 - DNA, 25 bp, S. pombe
tggtggttcttcctgtcagagattc

SEQ ID NO: 106859 - DNA, 25 bp, S. pombe
tggtcatgctttccggtgagactac

SEQ ID NO: 106860 - DNA, 25 bp, S. pombe
tggtgctccaacatgtcgtggctat

SEQ ID NO: 106861 - DNA, 25 bp, S. pombe
tggtgcccgcacgttttggtaaaat

SEQ ID NO: 106862 - DNA, 25 bp, S. pombe
tggtgctacttctgtttctcagcaa

SEQ ID NO: 106863 - DNA, 25 bp, S. pombe
tggtgccgcaatcacttatcggatg

SEQ ID NO: 106864 - DNA, 25 bp, S. pombe
tggtgccactcatcagttactggat

SEQ ID NO: 106865 - DNA, 25 bp, S. pombe
tggtgcaactgctggcgctgatctc

SEQ ID NO: 106866 - DNA, 25 bp, S. pombe
tggtgattcatctggtgctggttta

SEQ ID NO: 106867 - DNA, 25 bp, S. pombe
tggtgctaagcgtcaccgtaaaatt

SEQ ID NO: 106868 - DNA, 25 bp, S. pombe
tggtgctaagcgtcaccgtaaaatt

SEQ ID NO: 106869 - DNA, 25 bp, S. pombe
tggtgccaagcgtcaccgtaagatc

SEQ ID NO: 106870 - DNA, 25 bp, S. pombe
tggtgccaagcgtcaccgtaagatc

SEQ ID NO: 106871 - DNA, 25 bp, S. pombe
tgggaccgagattctttctccctaa

SEQ ID NO: 106872 - DNA, 25 bp, S. pombe
tggtgttgcacttacattctctttc

SEQ ID NO: 106873 - DNA, 25 bp, S. pombe
tggtgactcctctgaattgactgca

SEQ ID NO: 106874 - DNA, 25 bp, S. pombe
tgtggtcgccctccgtaagaaatac

SEQ ID NO: 106875 - DNA, 25 bp, S. pombe
tgggtacaatcaggctcttcgggag

SEQ ID NO: 106876 - DNA, 25 bp, S. pombe
tgggctataacattggcattcggtt

SEQ ID NO: 106877 - DNA, 25 bp, S. pombe
tgggaactcctactgaacaatcatg

SEQ ID NO: 106878 - DNA, 25 bp, S. pombe
tggtggagaccttgctgaaaaactt

SEQ ID NO: 106879 - DNA, 25 bp, S. pombe
tggtgttccaaagttgtgcacgaaa

SEQ ID NO: 106880 - DNA, 25 bp, S. pombe
tggtgcccaaaacgtcttcgacaag

SEQ ID NO: 106881 - DNA, 25 bp, S. pombe
tgctaagcacttgtgggatgccggc

SEQ ID NO: 106882 - DNA, 25 bp, S. pombe
tgttcatggcttttgaggcaccgag

SEQ ID NO: 106883 - DNA, 25 bp, S. pombe
tgagttggctctttgggatacggct

SEQ ID NO: 106884 - DNA, 25 bp, S. pombe
tgatccggctcttattcgtccaggt

SEQ ID NO: 106885 - DNA, 25 bp, S. pombe
tgtcgtttcattgccttgctgggaa

SEQ ID NO: 106886 - DNA, 25 bp, S. pombe
tggtctcctgatggccaaactttgt

SEQ ID NO: 106887 - DNA, 25 bp, S. pombe
tgtgcatgctccttcgactagacaa

SEQ ID NO: 106888 - DNA, 25 bp, S. pombe
tgtgatctccgttgaaaagactggt

SEQ ID NO: 106889 - DNA, 25 bp, S. pombe
tgggccgagatggaagaacgcttta

SEQ ID NO: 106890 - DNA, 25 bp, S. pombe
tggtcccgtcgttgagcaagctaca

SEQ ID NO: 106891 - DNA, 25 bp, S. pombe
tgtactgaaggtttactgggccctt

SEQ ID NO: 106892 - DNA, 25 bp, S. pombe
tggtcgccgttatgccaacattgtt

SEQ ID NO: 106893 - DNA, 25 bp, S. pombe
tgggcgccgacaaccaaacatttta

SEQ ID NO: 106894 - DNA, 25 bp, S. pombe
tgggtgctaaaaaccccattcttga

SEQ ID NO: 106895 - DNA, 25 bp, S. pombe
tgggttttccattaggtctacttgt

SEQ ID NO: 106896 - DNA, 25 bp, S. pombe
tgggatattcctacaagttctacgg

SEQ ID NO: 106897 - DNA, 25 bp, S. pombe
ttgcgtcaaattcggtaatgtgaac

SEQ ID NO: 106898 - DNA, 25 bp, S. pombe
tgacgcttcaagctttgaggacccc

SEQ ID NO: 106899 - DNA, 25 bp, S. pombe
tgggagggccttttcaacaggctct

SEQ ID NO: 106900 - DNA, 25 bp, S. pombe
tgtcgggtcttattggttcttttat

SEQ ID NO: 106901 - DNA, 25 bp, S. pombe
tgtgggtgactttatggttcttatc

SEQ ID NO: 106902 - DNA, 25 bp, S. pombe
tgattttacattcaggcccgattcc

SEQ ID NO: 106903 - DNA, 25 bp, S. pombe
tggtgctatctgtggaggcgctata

SEQ ID NO: 106904 - DNA, 25 bp, S. pombe
tggtggatgtattgcggaatttgaa

SEQ ID NO: 106905 - DNA, 25 bp, S. pombe
tgggtgatgcgacgtcttttcatat

SEQ ID NO: 106906 - DNA, 25 bp, S. pombe
tgggcaggctgtttacttcaaagaa

SEQ ID NO: 106907 - DNA, 25 bp, S. pombe
tgtgcctatcttgtacctaacgaac

SEQ ID NO: 106908 - DNA, 25 bp, S. pombe
tgggctttttcatccacatgaggga

SEQ ID NO: 106909 - DNA, 25 bp, S. pombe
tggtgcttgccttttccaggagaaa

SEQ ID NO: 106910 - DNA, 25 bp, S. pombe
tggtcctccggctctatctgaaaaa

SEQ ID NO: 106911 - DNA, 25 bp, S. pombe
tggtcttgccgattctttcttaaaa

SEQ ID NO: 106912 - DNA, 25 bp, S. pombe
tggtgcctttcttcttttattatat

SEQ ID NO: 106913 - DNA, 25 bp, S. pombe
tgggctgttccttctttaggtataa

SEQ ID NO: 106914 - DNA, 25 bp, S. pombe
tgggcttcacctgctcttaaaatga

SEQ ID NO: 106915 - DNA, 25 bp, S. pombe
tgtccaacaactcactcagcaagtt

SEQ ID NO: 106916 - DNA, 25 bp, S. pombe
tggtcctaaagaactgtcacagctg

SEQ ID NO: 106917 - DNA, 25 bp, S. pombe
tgggcttacaagatggcacgcctaa

SEQ ID NO: 106918 - DNA, 25 bp, S. pombe
tggtgcttaccagcgtgatcgggaa

SEQ ID NO: 106919 - DNA, 25 bp, S. pombe
tggtgcttaccaaacattcgtcatg

SEQ ID NO: 106920 - DNA, 25 bp, S. pombe
tggtctgccccaaattactgttaca

SEQ ID NO: 106921 - DNA, 25 bp, S. pombe
tgggtcttccagttttaccattagt

SEQ ID NO: 106922 - DNA, 25 bp, S. pombe
tgggatttccggtcttccgataaat

SEQ ID NO: 106923 - DNA, 25 bp, S. pombe
tgggatgttcaaatcctcacccaca

SEQ ID NO: 106924 - DNA, 25 bp, S. pombe
tggtgattatcaaatccctcgaccc

SEQ ID NO: 106925 - DNA, 25 bp, S. pombe
tggtggttacatcgcctctattatt

SEQ ID NO: 106926 - DNA, 25 bp, S. pombe
tggtgatattaacgcctcttccaca

SEQ ID NO: 106927 - DNA, 25 bp, S. pombe
tggtccatttactctcatatgccga

SEQ ID NO: 106928 - DNA, 25 bp, S. pombe
tgggtcttacgttgctagagccaaa

SEQ ID NO: 106929 - DNA, 25 bp, S. pombe
tgggctcacgtcaagcatatcatga

SEQ ID NO: 106930 - DNA, 25 bp, S. pombe
tgggatctctgcctacataatgtat

SEQ ID NO: 106931 - DNA, 25 bp, S. pombe
tggtgcatccaactttgattacttg

SEQ ID NO: 106932 - DNA, 25 bp, S. pombe
tggtccactgcttgtacttacttga

SEQ ID NO: 106933 - DNA, 25 bp, S. pombe
tggtgttactcaagtccgtgtcgaa

SEQ ID NO: 106934 - DNA, 25 bp, S. pombe
tggtggtttcggtcgtcctcaataa

SEQ ID NO: 106935 - DNA, 25 bp, S. pombe
tgtttctcgtttctttggcaggtta

SEQ ID NO: 106936 - DNA, 25 bp, S. pombe
tgtacgtacttccttaccttagatc

SEQ ID NO: 106937 - DNA, 25 bp, S. pombe
tggtgcatcatattcccacgataat

SEQ ID NO: 106938 - DNA, 25 bp, S. pombe
tgggcttcttcaccacgtaattcga

SEQ ID NO: 106939 - DNA, 25 bp, S. pombe
tggtgcttctttaaccgaatctcca

SEQ ID NO: 106940 - DNA, 25 bp, S. pombe
tggtgttgttgttaacgttcctcaa

SEQ ID NO: 106941 - DNA, 25 bp, S. pombe
tggtgcaggtttttctttcggtgaa

SEQ ID NO: 106942 - DNA, 25 bp, S. pombe
tgtttgttttgctgttcctgacgaa

SEQ ID NO: 106943 - DNA, 25 bp, S. pombe
tgtttaatcggctgaaccctggaaa

SEQ ID NO: 106944 - DNA, 25 bp, S. pombe
tggtggattcggtcgccctgttgct

SEQ ID NO: 106945 - DNA, 25 bp, S. pombe
tgtggagtttgagtggccctttgcc

SEQ ID NO: 106946 - DNA, 25 bp, S. pombe
tttattgctgaaacagtaaaacctg

SEQ ID NO: 106947 - DNA, 25 bp, S. pombe
tggtgtgattgttttaaccacctct

SEQ ID NO: 106948 - DNA, 25 bp, S. pombe
tgctggttcgcgttgataaactccc

SEQ ID NO: 106949 - DNA, 25 bp, S. pombe
tgggcattcaagtcgaacgcctatg

SEQ ID NO: 106950 - DNA, 25 bp, S. pombe
tgggaacaagttacacgcacaattt

SEQ ID NO: 106951 - DNA, 25 bp, S. pombe
tggtgatcccaacagcagccggtat

SEQ ID NO: 106952 - DNA, 25 bp, S. pombe
tgggacttttagatgccgcagatta

SEQ ID NO: 106953 - DNA, 25 bp, S. pombe
tgtgttgcataccttcaatccctaa

SEQ ID NO: 106954 - DNA, 25 bp, S. pombe
tgtgctgctcatccgtataatcata

SEQ ID NO: 106955 - DNA, 25 bp, S. pombe
tgtgactctggctctaacaacattc

SEQ ID NO: 106956 - DNA, 25 bp, S. pombe
tgatgcatcctatactggtaccggt

SEQ ID NO: 106957 - DNA, 25 bp, S. pombe
tgagcaggctcattcattagtacga

SEQ ID NO: 106958 - DNA, 25 bp, S. pombe
tgggatgtcttcactgttttccgca

SEQ ID NO: 106959 - DNA, 25 bp, S. pombe
tgggcttccctacttgttttgccaa

SEQ ID NO: 106960 - DNA, 25 bp, S. pombe
tgtccctacaatcctatgtgttggt

SEQ ID NO: 106961 - DNA, 25 bp, S. pombe
tgtcccaatcaacctagtatccaac

SEQ ID NO: 106962 - DNA, 25 bp, S. pombe
tgaccatttcgacgcggatttcaat

SEQ ID NO: 106963 - DNA, 25 bp, S. pombe
tgacacgtttgtccggtactggatc

SEQ ID NO: 106964 - DNA, 25 bp, S. pombe
tgtcaaggtccttcgaaacgcgatc

SEQ ID NO: 106965 - DNA, 25 bp, S. pombe
tgtccggaccctaaaaactgtgatt

SEQ ID NO: 106966 - DNA, 25 bp, S. pombe
tgtctccaaccctaaacgacttttg

SEQ ID NO: 106967 - DNA, 25 bp, S. pombe
tttatcgaccactggaaggaccttt

SEQ ID NO: 106968 - DNA, 25 bp, S. pombe
tgtcttctactttcgagcaagctgc

SEQ ID NO: 106969 - DNA, 25 bp, S. pombe
tgtcgtcagcaattgtcggaactaa

SEQ ID NO: 106970 - DNA, 25 bp, S. pombe
tggtgttcaacatcttatccttaag

SEQ ID NO: 106971 - DNA, 25 bp, S. pombe
tgggattcaaagtttcttcctgact

SEQ ID NO: 106972 - DNA, 25 bp, S. pombe
tgggacggtttgcatttccatccta

SEQ ID NO: 106973 - DNA, 25 bp, S. pombe
tgggtgagttttccattacctacaa

SEQ ID NO: 106974 - DNA, 25 bp, S. pombe
tggtgttgctttatgtacccagaca

SEQ ID NO: 106975 - DNA, 25 bp, S. pombe
tggtgttttatcatcttggctcaaa

SEQ ID NO: 106976 - DNA, 25 bp, S. pombe
tggtgtcgttgagctcattgcctaa

SEQ ID NO: 106977 - DNA, 25 bp, S. pombe
tgtgggtattactcaggctgtacga

SEQ ID NO: 106978 - DNA, 25 bp, S. pombe
tgtaaatcggactcgcactgctgaa

SEQ ID NO: 106979 - DNA, 25 bp, S. pombe
tgtagccaatttttcaacggatgtt

SEQ ID NO: 106980 - DNA, 25 bp, S. pombe
tgtcatctacctcactaactaaatc

SEQ ID NO: 106981 - DNA, 25 bp, S. pombe
tgatcctaccttcacggtcgaatat

SEQ ID NO: 106982 - DNA, 25 bp, S. pombe
tgtcgtacgttctccgtcggaaata

SEQ ID NO: 106983 - DNA, 25 bp, S. pombe
tgggaaaatggcacctttactacaa

SEQ ID NO: 106984 - DNA, 25 bp, S. pombe
tgggattgagacctacctttttcca

SEQ ID NO: 106985 - DNA, 25 bp, S. pombe
tgggaccaagtttcgcttatttccg

SEQ ID NO: 106986 - DNA, 25 bp, S. pombe
tggtgatgccaagtagtccgcccat

SEQ ID NO: 106987 - DNA, 25 bp, S. pombe
tggtgtgtattaactgccgatgctt

SEQ ID NO: 106988 - DNA, 25 bp, S. pombe
tgggctctacacaattcgatgatct

SEQ ID NO: 106989 - DNA, 25 bp, S. pombe
tggtgtacatgccatttccactcag

SEQ ID NO: 106990 - DNA, 25 bp, S. pombe
tgtgtctcatgtgctattcacgctc

SEQ ID NO: 106991 - DNA, 25 bp, S. pombe
tggtgatcctaccttccgtaaaagt

SEQ ID NO: 106992 - DNA, 25 bp, S. pombe
tgggtcctactgtttctttgaatac

SEQ ID NO: 106993 - DNA, 25 bp, S. pombe
tgggccgttctcttatcagttataa

SEQ ID NO: 106994 - DNA, 25 bp, S. pombe
tgggcgcagttttttcccattacaa

SEQ ID NO: 106995 - DNA, 25 bp, S. pombe
tgggctatgtttcttccaaacgaac

SEQ ID NO: 106996 - DNA, 25 bp, S. pombe
tgggcttccttacttgccaaacaaa

SEQ ID NO: 106997 - DNA, 25 bp, S. pombe
ttcggttcttacttccaaaagcagg

SEQ ID NO: 106998 - DNA, 25 bp, S. pombe
tgtcggatcaccaagaatgaattta

SEQ ID NO: 106999 - DNA, 25 bp, S. pombe
tgtgtcccctgatatatctactcat

SEQ ID NO: 107000 - DNA, 25 bp, S. pombe
tgggtcaatctatttatgccgcctc

SEQ ID NO: 107001 - DNA, 25 bp, S. pombe
tgtggtcatattttttgctggtcat

SEQ ID NO: 107002 - DNA, 25 bp, S. pombe
tgatccttattgcattcttcccatt

SEQ ID NO: 107003 - DNA, 25 bp, S. pombe
tgtcggtgctactaactttgttttc

SEQ ID NO: 107004 - DNA, 25 bp, S. pombe
tgtcgcgacgacttagttttgaatc

SEQ ID NO: 107005 - DNA, 25 bp, S. pombe
tgttcgacaacacaatctcccaatt

SEQ ID NO: 107006 - DNA, 25 bp, S. pombe
tttccaggactcaaattctccgtca

SEQ ID NO: 107007 - DNA, 25 bp, S. pombe
tgtccaagacgtagaagccacctgt

SEQ ID NO: 107008 - DNA, 25 bp, S. pombe
tgtccgagcacgatcaacacgttgg

SEQ ID NO: 107009 - DNA, 25 bp, S. pombe
tgtacttcaaatggccgtctcggac

SEQ ID NO: 107010 - DNA, 25 bp, S. pombe
tgtcacaattaatccttctcgtcaa

SEQ ID NO: 107011 - DNA, 25 bp, S. pombe
tgatttaccccaatggacttcgtct

SEQ ID NO: 107012 - DNA, 25 bp, S. pombe
tgtagttccccaagatagtaccctt

SEQ ID NO: 107013 - DNA, 25 bp, S. pombe
tgtgccacaactgttttccgaaacg

SEQ ID NO: 107014 - DNA, 25 bp, S. pombe
tgtccatcggctctgtaattcgcaa

SEQ ID NO: 107015 - DNA, 25 bp, S. pombe
tgtcgccgattcttcagacgtcgtt

SEQ ID NO: 107016 - DNA, 25 bp, S. pombe
tgccctcgattctcaaccaaattac

SEQ ID NO: 107017 - DNA, 25 bp, S. pombe
tgtgacctaatagcacttgggcttt

SEQ ID NO: 107018 - DNA, 25 bp, S. pombe
tgtgattcccaagtacgtgcgttat

SEQ ID NO: 107019 - DNA, 25 bp, S. pombe
tttaaccaagtcagctattgtccaa

SEQ ID NO: 107020 - DNA, 25 bp, S. pombe
ttttatttaacatatttggtggagc

SEQ ID NO: 107021 - DNA, 25 bp, S. pombe
tgttttagtcaaccgagttcgtgga

SEQ ID NO: 107022 - DNA, 25 bp, S. pombe
tgtactcaaaaacccagtgtctctg

SEQ ID NO: 107023 - DNA, 25 bp, S. pombe
tgtaagagcaaacaaggcaagcctt

SEQ ID NO: 107024 - DNA, 25 bp, S. pombe
tgtcgttacagctttttcatcggaa

SEQ ID NO: 107025 - DNA, 25 bp, S. pombe
tttgtttaccgtttcatagctactg

SEQ ID NO: 107026 - DNA, 25 bp, S. pombe
tgttgtgcctatccttaaaactact

SEQ ID NO: 107027 - DNA, 25 bp, S. pombe
tgacagtcctcggtttcaaactagc

SEQ ID NO: 107028 - DNA, 25 bp, S. pombe
tgggtccttgcaatccttaaatacg

SEQ ID NO: 107029 - DNA, 25 bp, S. pombe
tgtcttcactcccactggtgttaaa

SEQ ID NO: 107030 - DNA, 25 bp, S. pombe
tactatgctgaatgacgggtctaca

SEQ ID NO: 107031 - DNA, 25 bp, S. pombe
tgatcaactgaaagacggcgtcccc

SEQ ID NO: 107032 - DNA, 25 bp, S. pombe
tgcaaattaaatcccgttacccaag

SEQ ID NO: 107033 - DNA, 25 bp, S. pombe
tgatgagggaaagcgtgtttatact

SEQ ID NO: 107034 - DNA, 25 bp, S. pombe
tgatttggaagagccttggtcgact

SEQ ID NO: 107035 - DNA, 25 bp, S. pombe
tgattttggacacttttggcgctgg

SEQ ID NO: 107036 - DNA, 25 bp, S. pombe
tgtcctttggacaatcgtgaatggg

SEQ ID NO: 107037 - DNA, 25 bp, S. pombe
ttcacgttggtttaattgttcggca

SEQ ID NO: 107038 - DNA, 25 bp, S. pombe
tcaccgttggttggaatttgcccca

SEQ ID NO: 107039 - DNA, 25 bp, S. pombe
tcagccggtagtcagagatttacga

SEQ ID NO: 107040 - DNA, 25 bp, S. pombe
tgaccgctgaagtcttggaacttgc

SEQ ID NO: 107041 - DNA, 25 bp, S. pombe
tgtggcctgaagacttggataccgt

SEQ ID NO: 107042 - DNA, 25 bp, S. pombe
tgtgtcaataagtcttgcctaccct

SEQ ID NO: 107043 - DNA, 25 bp, S. pombe
tgagttttacgccaagatcgcccgt

SEQ ID NO: 107044 - DNA, 25 bp, S. pombe
tgctcgtttaccaaagtctgtcgtt

SEQ ID NO: 107045 - DNA, 25 bp, S. pombe
tgtttaagatccagcaacgtgcaaa

SEQ ID NO: 107046 - DNA, 25 bp, S. pombe
tcctttgttttcgaagtgcccacta

SEQ ID NO: 107047 - DNA, 25 bp, S. pombe
tgtcattttacgacgaaatcgagtt

SEQ ID NO: 107048 - DNA, 25 bp, S. pombe
tgttgttccagatagtaccttccgc

SEQ ID NO: 107049 - DNA, 25 bp, S. pombe
tgttgttcacgacatgaccggtttc

SEQ ID NO: 107050 - DNA, 25 bp, S. pombe
tgtggtcgactacggaaagctttca

SEQ ID NO: 107051 - DNA, 25 bp, S. pombe
tgggtagactcaactgacatttcag

SEQ ID NO: 107052 - DNA, 25 bp, S. pombe
tgtggtagatgccacttgaccctca

SEQ ID NO: 107053 - DNA, 25 bp, S. pombe
tgtggtagatgccatttgactctta

SEQ ID NO: 107054 - DNA, 25 bp, S. pombe
tgggaagtgttcctcatcatccata

SEQ ID NO: 107055 - DNA, 25 bp, S. pombe
tgggatttcccaacaatcgagtttg

SEQ ID NO: 107056 - DNA, 25 bp, S. pombe
tgggcatgttctttacctcaagttt

SEQ ID NO: 107057 - DNA, 25 bp, S. pombe
tgggttatctccaatgtctcaaggg

SEQ ID NO: 107058 - DNA, 25 bp, S. pombe
tgcttttacttacactacttcctct

SEQ ID NO: 107059 - DNA, 25 bp, S. pombe
tgccttttctttcccgactatttca

SEQ ID NO: 107060 - DNA, 25 bp, S. pombe
tgtctacggttttcactacttcttt

SEQ ID NO: 107061 - DNA, 25 bp, S. pombe
tgttaccctttctctacgtgaattt

SEQ ID NO: 107062 - DNA, 25 bp, S. pombe
tgtcaatcaacaaacctccggtggc

SEQ ID NO: 107063 - DNA, 25 bp, S. pombe
tgggctaccggttctacattagtac

SEQ ID NO: 107064 - DNA, 25 bp, S. pombe
tgggccatcgggttctcaagtcaaa

SEQ ID NO: 107065 - DNA, 25 bp, S. pombe
taattactggtggacttggttccct

SEQ ID NO: 107066 - DNA, 25 bp, S. pombe
taattcctttggatcgtttcctgcc

SEQ ID NO: 107067 - DNA, 25 bp, S. pombe
tgagtaccttttatcgttgtaccaa

SEQ ID NO: 107068 - DNA, 25 bp, S. pombe
tgtggaggattcatcccggcttgaa

SEQ ID NO: 107069 - DNA, 25 bp, S. pombe
tgtcgggtacatggacagctatcca

SEQ ID NO: 107070 - DNA, 25 bp, S. pombe
tgtggccaaatttaccgatatccct

SEQ ID NO: 107071 - DNA, 25 bp, S. pombe
tgtataccgctttaaccatgtcttc

SEQ ID NO: 107072 - DNA, 25 bp, S. pombe
tgtacaagcgcttcaaaacctcttc

SEQ ID NO: 107073 - DNA, 25 bp, S. pombe
tgttaatcctaagcaacgccctagc

SEQ ID NO: 107074 - DNA, 25 bp, S. pombe
tgtacaatccaaccgaacgacgttc

SEQ ID NO: 107075 - DNA, 25 bp, S. pombe
tgtctcgtggaaatcagcgtgatgt

SEQ ID NO: 107076 - DNA, 25 bp, S. pombe
tgtagtgaactttgtggtgtacttc

SEQ ID NO: 107077 - DNA, 25 bp, S. pombe
tgtgctcgattgtctaaccgtacta

SEQ ID NO: 107078 - DNA, 25 bp, S. pombe
tgtcacgttgacaaatccttgcctg

SEQ ID NO: 107079 - DNA, 25 bp, S. pombe
tgtgacgatcgtaaccctggacatg

SEQ ID NO: 107080 - DNA, 25 bp, S. pombe
tgggctgatctcatagctcgtaatc

SEQ ID NO: 107081 - DNA, 25 bp, S. pombe
tgggccgcttgtaaagacttcctag

SEQ ID NO: 107082 - DNA, 25 bp, S. pombe
tgggccctggtcatcgaattgttac

SEQ ID NO: 107083 - DNA, 25 bp, S. pombe
tgtctcccggtcttaagcatcttta

SEQ ID NO: 107084 - DNA, 25 bp, S. pombe
tgtgcattcgcagattgtggattta

SEQ ID NO: 107085 - DNA, 25 bp, S. pombe
tgtgccttatgtttttgttcctagc

SEQ ID NO: 107086 - DNA, 25 bp, S. pombe
tgtactcggtgtttgtgacatgact

SEQ ID NO: 107087 - DNA, 25 bp, S. pombe
tgtgcactctgccttgggtaagatc

SEQ ID NO: 107088 - DNA, 25 bp, S. pombe
tgtgctcccactccagaggatgaat

SEQ ID NO: 107089 - DNA, 25 bp, S. pombe
tgtatgccgtgcacttgctgatgaa

SEQ ID NO: 107090 - DNA, 25 bp, S. pombe
tgtgtccatggttcgcgcggtagaa

SEQ ID NO: 107091 - DNA, 25 bp, S. pombe
tgggcgtcgctagtgccggatataa

SEQ ID NO: 107092 - DNA, 25 bp, S. pombe
tgggatatccagacgatcgagcttt

SEQ ID NO: 107093 - DNA, 25 bp, S. pombe
tgggcatccatcacttcaagcattt

SEQ ID NO: 107094 - DNA, 25 bp, S. pombe
tgggactatttcttgcagcacgttt

SEQ ID NO: 107095 - DNA, 25 bp, S. pombe
tgtggaatgacaatcccatctctgc

SEQ ID NO: 107096 - DNA, 25 bp, S. pombe
tgggcaattcaatcatcagctgtgg

SEQ ID NO: 107097 - DNA, 25 bp, S. pombe
tgggccactattttcgctaaagctc

SEQ ID NO: 107098 - DNA, 25 bp, S. pombe
tgggatcatctgacaacctttctgt

SEQ ID NO: 107099 - DNA, 25 bp, S. pombe
tgtcgagcagaggaacgttatagtc

SEQ ID NO: 107100 - DNA, 25 bp, S. pombe
tgtgctggtatgattcttctgtcga

SEQ ID NO: 107101 - DNA, 25 bp, S. pombe
tgtgcaacgagctctttcttcagta

SEQ ID NO: 107102 - DNA, 25 bp, S. pombe
tgtattacaccgtcccgaagttgga

SEQ ID NO: 107103 - DNA, 25 bp, S. pombe
tgtttcaaccgattcagtaagtctg

SEQ ID NO: 107104 - DNA, 25 bp, S. pombe
tgtcgtcaacgctggcaacaagcct

SEQ ID NO: 107105 - DNA, 25 bp, S. pombe
tgtcgtcaacgctggcaacaagcct

SEQ ID NO: 107106 - DNA, 25 bp, S. pombe
tgtgtgttccatgtgctcaaagcaa

SEQ ID NO: 107107 - DNA, 25 bp, S. pombe
tgtgcatgcgtctcggttccaaaag

SEQ ID NO: 107108 - DNA, 25 bp, S. pombe
tgttcgttccccttgtaagaagacg

SEQ ID NO: 107109 - DNA, 25 bp, S. pombe
tgtcactgtctctccggatggaaaa

SEQ ID NO: 107110 - DNA, 25 bp, S. pombe
tgtccctattcccaaggcgatggag

SEQ ID NO: 107111 - DNA, 25 bp, S. pombe
tgttcctttacctacacgtggacga

SEQ ID NO: 107112 - DNA, 25 bp, S. pombe
tgttcctcttagtaaacgattaaag

SEQ ID NO: 107113 - DNA, 25 bp, S. pombe
tgtcatcacttctcaaaggcacatg

SEQ ID NO: 107114 - DNA, 25 bp, S. pombe
tgtctactgctctgaagggtcggat

SEQ ID NO: 107115 - DNA, 25 bp, S. pombe
tgtatgggccattgctcaggacatc

SEQ ID NO: 107116 - DNA, 25 bp, S. pombe
tgtcagtgctgggtctcctaataaa

SEQ ID NO: 107117 - DNA, 25 bp, S. pombe
tgtcgtgtgtacgttctagtgaaca

SEQ ID NO: 107118 - DNA, 25 bp, S. pombe
tgtcgcacgttcgtatctcagatca

SEQ ID NO: 107119 - DNA, 25 bp, S. pombe
tgggctcttctaactcacaaacaaa

SEQ ID NO: 107120 - DNA, 25 bp, S. pombe
tgggctttttacaaccttctgtcaa

SEQ ID NO: 107121 - DNA, 25 bp, S. pombe
tgggctatattttctttcttcgcat

SEQ ID NO: 107122 - DNA, 25 bp, S. pombe
tgtggctgctgtttatccttattaa

SEQ ID NO: 107123 - DNA, 25 bp, S. pombe
tgtctatcacgcgttggcattgggt

SEQ ID NO: 107124 - DNA, 25 bp, S. pombe
tgatccaccgtctttgattgctaga

SEQ ID NO: 107125 - DNA, 25 bp, S. pombe
tgtgaatccgactttgttgctcaaa

SEQ ID NO: 107126 - DNA, 25 bp, S. pombe
tgtctcgggacatttggcttataga

SEQ ID NO: 107127 - DNA, 25 bp, S. pombe
tgagttttacgtatccattttccct

SEQ ID NO: 107128 - DNA, 25 bp, S. pombe
tgggcgttatctattcgttggttac

SEQ ID NO: 107129 - DNA, 25 bp, S. pombe
tgtggagttatttctcctcgtttta

SEQ ID NO: 107130 - DNA, 25 bp, S. pombe
tgttggttattctggatcctcttct

SEQ ID NO: 107131 - DNA, 25 bp, S. pombe
tgtcaatttgtcagaagctcggcct

SEQ ID NO: 107132 - DNA, 25 bp, S. pombe
tgtgattcattgtgggcagctcgtc

SEQ ID NO: 107133 - DNA, 25 bp, S. pombe
tgggctctatgggtgctatctcttc

SEQ ID NO: 107134 - DNA, 25 bp, S. pombe
tgggcctatatgtatctgcttgcta

SEQ ID NO: 107135 - DNA, 25 bp, S. pombe
tgggccattatgtaccatgttgcgg

SEQ ID NO: 107136 - DNA, 25 bp, S. pombe
tgtggcattttttcgtttccccgtg

SEQ ID NO: 107137 - DNA, 25 bp, S. pombe
tgctggttttggacgtggtgcccct

SEQ ID NO: 107138 - DNA, 25 bp, S. pombe
tgtgttttctgagtttggcgagcca

SEQ ID NO: 107139 - DNA, 25 bp, S. pombe
tgtgctttactcaacttctcggtcg

SEQ ID NO: 107140 - DNA, 25 bp, S. pombe
tgtgctgttattacttttcaaggcg

SEQ ID NO: 107141 - DNA, 25 bp, S. pombe
tgtgcacattatcatcttctttcgg

SEQ ID NO: 107142 - DNA, 25 bp, S. pombe
tgggctttgactatgctccagaaat

SEQ ID NO: 107143 - DNA, 25 bp, S. pombe
tgggcattggcatttagccctaatg

SEQ ID NO: 107144 - DNA, 25 bp, S. pombe
tgggcgctggcgttttattagatat

SEQ ID NO: 107145 - DNA, 25 bp, S. pombe
tgtggccgcacatctactacttttg

SEQ ID NO: 107146 - DNA, 25 bp, S. pombe
tacctcgaaggtccccttgaatgga

SEQ ID NO: 107147 - DNA, 25 bp, S. pombe
ttccggaaattccttcgtaagtgag

SEQ ID NO: 107148 - DNA, 25 bp, S. pombe
tgttcaagccactattagccagtcc

SEQ ID NO: 107149 - DNA, 25 bp, S. pombe
tgggctgaacaaatcatcaaccttg

SEQ ID NO: 107150 - DNA, 25 bp, S. pombe
tgaggctgccaaacaacgaatggac

SEQ ID NO: 107151 - DNA, 25 bp, S. pombe
tgtccttaatcatatctggcatact

SEQ ID NO: 107152 - DNA, 25 bp, S. pombe
tgtcgtttacgaggccagcatccaa

SEQ ID NO: 107153 - DNA, 25 bp, S. pombe
tgtgtttaacgaggccaccgctgat

SEQ ID NO: 107154 - DNA, 25 bp, S. pombe
tgtgttttccaaagccaccgctgaa

SEQ ID NO: 107155 - DNA, 25 bp, S. pombe
tgttttcaccagaggcacgagacaa

SEQ ID NO: 107156 - DNA, 25 bp, S. pombe
tgtccgtgaacaatggctgcgccaa

SEQ ID NO: 107157 - DNA, 25 bp, S. pombe
tgtgacagctgtttcttctacatcc

SEQ ID NO: 107158 - DNA, 25 bp, S. pombe
tgtctcaattgcatctccttcaact

SEQ ID NO: 107159 - DNA, 25 bp, S. pombe
tgatgatctcgatactacgggccct

SEQ ID NO: 107160 - DNA, 25 bp, S. pombe
tgatatgtccaatgtacgtacccaa

SEQ ID NO: 107161 - DNA, 25 bp, S. pombe
tgtttaggcgttccatatacccatc

SEQ ID NO: 107162 - DNA, 25 bp, S. pombe
tgtttgtcggaccaatatgccctat

SEQ ID NO: 107163 - DNA, 25 bp, S. pombe
tgtttctctggctgatgctgatgca

SEQ ID NO: 107164 - DNA, 25 bp, S. pombe
tgtcgactgggctgtgtgtcacaaa

SEQ ID NO: 107165 - DNA, 25 bp, S. pombe
tgtccctgcagataatggctactat

SEQ ID NO: 107166 - DNA, 25 bp, S. pombe
tttgccatcaggagttcaacttcag

SEQ ID NO: 107167 - DNA, 25 bp, S. pombe
tgttcaacgttccttcaaattcacc

SEQ ID NO: 107168 - DNA, 25 bp, S. pombe
tgttcaacgtcccttaaggccagat

SEQ ID NO: 107169 - DNA, 25 bp, S. pombe
tttcgttcgttctgtttggcaggat

SEQ ID NO: 107170 - DNA, 25 bp, S. pombe
tttctaacccttcatttacgcgata

SEQ ID NO: 107171 - DNA, 25 bp, S. pombe
tgtcggaatccgtacttttagatga

SEQ ID NO: 107172 - DNA, 25 bp, S. pombe
tgtcgttccttactctattcattag

SEQ ID NO: 107173 - DNA, 25 bp, S. pombe
tgtcgcttccgaacatttggttaag

SEQ ID NO: 107174 - DNA, 25 bp, S. pombe
tgtctacgactcaaagtaccccagt

SEQ ID NO: 107175 - DNA, 25 bp, S. pombe
tgtaccatgggttgcggtccactca

SEQ ID NO: 107176 - DNA, 25 bp, S. pombe
tgtatccaagcaagccaaaacccgc

SEQ ID NO: 107177 - DNA, 25 bp, S. pombe
tgtagaggcatctccaaaacctcct

SEQ ID NO: 107178 - DNA, 25 bp, S. pombe
tgttgtttatcccaagttcgaaaag

SEQ ID NO: 107179 - DNA, 25 bp, S. pombe
tgtctcagtgttaatccttcggttc

SEQ ID NO: 107180 - DNA, 25 bp, S. pombe
tgtcagcagtggaaacgtttaaatc

SEQ ID NO: 107181 - DNA, 25 bp, S. pombe
tgttagcttgtaccagttctgttct

SEQ ID NO: 107182 - DNA, 25 bp, S. pombe
tgtgctcgcattcggccattagtga

SEQ ID NO: 107183 - DNA, 25 bp, S. pombe
tgtcgcttacgcaaaagatcctcgc

SEQ ID NO: 107184 - DNA, 25 bp, S. pombe
tgtgccatattctattgcttctaaa

SEQ ID NO: 107185 - DNA, 25 bp, S. pombe
tgtctttgtcattggcttcacacgt

SEQ ID NO: 107186 - DNA, 25 bp, S. pombe
tgtcgttgctctttcttccaagtaa

SEQ ID NO: 107187 - DNA, 25 bp, S. pombe
tgtctttccaaactagcctttcaat

SEQ ID NO: 107188 - DNA, 25 bp, S. pombe
tgttactaccagaaatccaactccc

SEQ ID NO: 107189 - DNA, 25 bp, S. pombe
tgttgaactggtatcccctgattta

SEQ ID NO: 107190 - DNA, 25 bp, S. pombe
tgtgtctcaagttcagcgtcatcat

SEQ ID NO: 107191 - DNA, 25 bp, S. pombe
tgtagcgatcatgctcttttcggca

SEQ ID NO: 107192 - DNA, 25 bp, S. pombe
tgtagccgcttcgtttgtcattcaa

SEQ ID NO: 107193 - DNA, 25 bp, S. pombe
tgtagttctcccttctgcgttaaat

SEQ ID NO: 107194 - DNA, 25 bp, S. pombe
tgtcacctgctcacaagcgtgttaa

SEQ ID NO: 107195 - DNA, 25 bp, S. pombe
tgtagtagagcttcctagtgaatct

SEQ ID NO: 107196 - DNA, 25 bp, S. pombe
tgtagtagactacgcggtccgcatt

SEQ ID NO: 107197 - DNA, 25 bp, S. pombe
tgtgaattgcctttgcgaatccttt

SEQ ID NO: 107198 - DNA, 25 bp, S. pombe
tgtaactttcttcatgacctcaatg

SEQ ID NO: 107199 - DNA, 25 bp, S. pombe
tgtaccttccttacagtccgcaatg

SEQ ID NO: 107200 - DNA, 25 bp, S. pombe
tgtcctttccttaggtgacgtttgt

SEQ ID NO: 107201 - DNA, 25 bp, S. pombe
tgtctttacctttttcaagttctgt

SEQ ID NO: 107202 - DNA, 25 bp, S. pombe
tgtcctctcagaaagttggcagtat

SEQ ID NO: 107203 - DNA, 25 bp, S. pombe
tgtcacccaaagatatcactcgttt

SEQ ID NO: 107204 - DNA, 25 bp, S. pombe
tgattcccaagttattaccgtttat

SEQ ID NO: 107205 - DNA, 25 bp, S. pombe
tgatcgtcccgatttatacggtcct

SEQ ID NO: 107206 - DNA, 25 bp, S. pombe
tgtttctaggccatcccaatctgat

SEQ ID NO: 107207 - DNA, 25 bp, S. pombe
tgtttctaaccttcacgacatgcgt

SEQ ID NO: 107208 - DNA, 25 bp, S. pombe
tgtgtttgactccttcaagcgctag

SEQ ID NO: 107209 - DNA, 25 bp, S. pombe
tgtgtctttctaatggcaatgccga

SEQ ID NO: 107210 - DNA, 25 bp, S. pombe
tgtacgcttactcatttctcggatt

SEQ ID NO: 107211 - DNA, 25 bp, S. pombe
tgtgacctcttttatttctgctttg

SEQ ID NO: 107212 - DNA, 25 bp, S. pombe
tgtgcattccctttcattatcgttg

SEQ ID NO: 107213 - DNA, 25 bp, S. pombe
tgtcattgcccttttattctcactt

SEQ ID NO: 107214 - DNA, 25 bp, S. pombe
tgatggtaccatcattcctttttag

SEQ ID NO: 107215 - DNA, 25 bp, S. pombe
tgttcaacaaatttccttttgaagg

SEQ ID NO: 107216 - DNA, 25 bp, S. pombe
tgataaaaatccttctaatttcggg

SEQ ID NO: 107217 - DNA, 25 bp, S. pombe
tgtaaaaactgctttctctttcgaa

SEQ ID NO: 107218 - DNA, 25 bp, S. pombe
tgtgcacgcttctaatacccgtaaa

SEQ ID NO: 107219 - DNA, 25 bp, S. pombe
tgtagctgcttcttttctcctttaa

SEQ ID NO: 107220 - DNA, 25 bp, S. pombe
tgtgagcaattagttcgtcgcgttt

SEQ ID NO: 107221 - DNA, 25 bp, S. pombe
tgtgatccaattgtcgctccagcta

SEQ ID NO: 107222 - DNA, 25 bp, S. pombe
tgtgattgcattctttgctgtcgct

SEQ ID NO: 107223 - DNA, 25 bp, S. pombe
tgtgattttgctttttgctccttct

SEQ ID NO: 107224 - DNA, 25 bp, S. pombe
tgagcactttgatcccgagaactac

SEQ ID NO: 107225 - DNA, 25 bp, S. pombe
tgcagtttgaactccgtgaagtaca

SEQ ID NO: 107226 - DNA, 25 bp, S. pombe
tgtccctgtgtattggttactcaag

SEQ ID NO: 107227 - DNA, 25 bp, S. pombe
tgtcgctcctttagtgtatcctgaa

SEQ ID NO: 107228 - DNA, 25 bp, S. pombe
tgtgcctccttctttgtaccataaa

SEQ ID NO: 107229 - DNA, 25 bp, S. pombe
tgctacgaattgttgatgctatcta

SEQ ID NO: 107230 - DNA, 25 bp, S. pombe
tgtgacaactgtcttgctcatccaa

SEQ ID NO: 107231 - DNA, 25 bp, S. pombe
tgtcaaagcattccttgcctgcaga

SEQ ID NO: 107232 - DNA, 25 bp, S. pombe
tgtccgactcttatcttgcagatgt

SEQ ID NO: 107233 - DNA, 25 bp, S. pombe
tgtcctgttcgtctgtgacaggtga

SEQ ID NO: 107234 - DNA, 25 bp, S. pombe
tgtccattccatcgtcgtggcattg

SEQ ID NO: 107235 - DNA, 25 bp, S. pombe
tgtccttcctgcatatcgttggatt

SEQ ID NO: 107236 - DNA, 25 bp, S. pombe
tgtcgtattggcactcgttttgttc

SEQ ID NO: 107237 - DNA, 25 bp, S. pombe
tgtcgaccggtttcgtcttctgtta

SEQ ID NO: 107238 - DNA, 25 bp, S. pombe
tgtcaatcaaccactacgcatatgt

SEQ ID NO: 107239 - DNA, 25 bp, S. pombe
tgtctacagactaccgcattcaatt

SEQ ID NO: 107240 - DNA, 25 bp, S. pombe
tgtactccttgaccagcttgagcag

SEQ ID NO: 107241 - DNA, 25 bp, S. pombe
tgtatatttgctcatccgacaccag

SEQ ID NO: 107242 - DNA, 25 bp, S. pombe
tgtcaatgtcgggtcattcgccgga

SEQ ID NO: 107243 - DNA, 25 bp, S. pombe
tgtactacagctggcacaatcttgg

SEQ ID NO: 107244 - DNA, 25 bp, S. pombe
tgtccttgctcttgccattattaaa

SEQ ID NO: 107245 - DNA, 25 bp, S. pombe
tgtacatcctccacaaacaagttct

SEQ ID NO: 107246 - DNA, 25 bp, S. pombe
tgtactccaagaatactccttcacg

SEQ ID NO: 107247 - DNA, 25 bp, S. pombe
tgtcatatcgccaaagtgccttgtt

SEQ ID NO: 107248 - DNA, 25 bp, S. pombe
tgtttcaggaaaccagcttgcattt

SEQ ID NO: 107249 - DNA, 25 bp, S. pombe
tgattctcggactggaagggcccat

SEQ ID NO: 107250 - DNA, 25 bp, S. pombe
tgttaaaactgggagcggtgcgtct

SEQ ID NO: 107251 - DNA, 25 bp, S. pombe
tgtctgagctaaggccttgggtgca

SEQ ID NO: 107252 - DNA, 25 bp, S. pombe
tgttggacacatattgtactcgcca

SEQ ID NO: 107253 - DNA, 25 bp, S. pombe
tgtatggtagctatgttggccgata

SEQ ID NO: 107254 - DNA, 25 bp, S. pombe
tgtcgttaccagatactccaagagt

SEQ ID NO: 107255 - DNA, 25 bp, S. pombe
tgtagtcttgctatggctttgccaa

SEQ ID NO: 107256 - DNA, 25 bp, S. pombe
tgtcaacttctctatgcgttcaact

SEQ ID NO: 107257 - DNA, 25 bp, S. pombe
tgtcatacctttccgatcgtcttga

SEQ ID NO: 107258 - DNA, 25 bp, S. pombe
tgtatcatctactcctgtttgctga

SEQ ID NO: 107259 - DNA, 25 bp, S. pombe
tgtaggctaccaccatgttattgag

SEQ ID NO: 107260 - DNA, 25 bp, S. pombe
tgttactaccgttgctgtttcagcc

SEQ ID NO: 107261 - DNA, 25 bp, S. pombe
tgttcttaacccctgctttcagact

SEQ ID NO: 107262 - DNA, 25 bp, S. pombe
tgttgtataacttttcttgctccct

SEQ ID NO: 107263 - DNA, 25 bp, S. pombe
tgtctatcctgtgcctcttttaaag

SEQ ID NO: 107264 - DNA, 25 bp, S. pombe
tgtccattatttaccttcctactac

SEQ ID NO: 107265 - DNA, 25 bp, S. pombe
ttaaagggtcagttattccagctac

SEQ ID NO: 107266 - DNA, 25 bp, S. pombe
tgtatgaagtccatgtcccagagcc

SEQ ID NO: 107267 - DNA, 25 bp, S. pombe
tgttccttacgtttgctggtacagt

SEQ ID NO: 107268 - DNA, 25 bp, S. pombe
tgttctctgtttctttggtaatgtc

SEQ ID NO: 107269 - DNA, 25 bp, S. pombe
tgttttttgacaatcgacgccgcga

SEQ ID NO: 107270 - DNA, 25 bp, S. pombe
tgttttactgtatgtgtcgccgcga

SEQ ID NO: 107271 - DNA, 25 bp, S. pombe
tgagtttactgtaggcgctgacgcc

SEQ ID NO: 107272 - DNA, 25 bp, S. pombe
tgttacataatgtttcccacccata

SEQ ID NO: 107273 - DNA, 25 bp, S. pombe
tgtaaatctctcacccagcaaaaac

SEQ ID NO: 107274 - DNA, 25 bp, S. pombe
tgtaatttcaattcacccaggactt

SEQ ID NO: 107275 - DNA, 25 bp, S. pombe
tgtagtttctattcaccctggagta

SEQ ID NO: 107276 - DNA, 25 bp, S. pombe
tgtcgtgtcttctaactccaatggt

SEQ ID NO: 107277 - DNA, 25 bp, S. pombe
tgatcgtttacgtcctctaagttac

SEQ ID NO: 107278 - DNA, 25 bp, S. pombe
tgttggtcgcgggacacctgaagac

SEQ ID NO: 107279 - DNA, 25 bp, S. pombe
tgtaagcaaagactaacccgcctca

SEQ ID NO: 107280 - DNA, 25 bp, S. pombe
tgtagaaacaacatcacctccgtct

SEQ ID NO: 107281 - DNA, 25 bp, S. pombe
tgtttcaacgatttcaggccttttg

SEQ ID NO: 107282 - DNA, 25 bp, S. pombe
tgttactacgtaatcgtcctttcct

SEQ ID NO: 107283 - DNA, 25 bp, S. pombe
tgtcgatttttattcccgcttaccg

SEQ ID NO: 107284 - DNA, 25 bp, S. pombe
tgtagatgacttaagtgccgctctt

SEQ ID NO: 107285 - DNA, 25 bp, S. pombe
tgtcgatgaatattgcaccgcggtt

SEQ ID NO: 107286 - DNA, 25 bp, S. pombe
tgtctatgacattaagggccgtttc

SEQ ID NO: 107287 - DNA, 25 bp, S. pombe
tgtttgacatctactgttccgcaag

SEQ ID NO: 107288 - DNA, 25 bp, S. pombe
tgtattgcacttgtaccacagcttg

SEQ ID NO: 107289 - DNA, 25 bp, S. pombe
tgtcattgatttcttccaacgtcgc

SEQ ID NO: 107290 - DNA, 25 bp, S. pombe
tgttgagttgtctttcgaagcctgc

SEQ ID NO: 107291 - DNA, 25 bp, S. pombe
tgtcctttgttgacctctagagtga

SEQ ID NO: 107292 - DNA, 25 bp, S. pombe
tgtcctactttgaacttgctgccta

SEQ ID NO: 107293 - DNA, 25 bp, S. pombe
tgtttagaaggattccgcgctctat

SEQ ID NO: 107294 - DNA, 25 bp, S. pombe
tgtcatataaacctttcgcgccaat

SEQ ID NO: 107295 - DNA, 25 bp, S. pombe
tgtcataactaacttgcgggcattt

SEQ ID NO: 107296 - DNA, 25 bp, S. pombe
tgtagaccttacaacgggccgttat

SEQ ID NO: 107297 - DNA, 25 bp, S. pombe
tgtagactctaaccactgggccgaa

SEQ ID NO: 107298 - DNA, 25 bp, S. pombe
tgttactgcggtccctgaaattgaa

SEQ ID NO: 107299 - DNA, 25 bp, S. pombe
tgttcctcggcccactagtaagaaa

SEQ ID NO: 107300 - DNA, 25 bp, S. pombe
tgttttgctggctcctacaacagaa

SEQ ID NO: 107301 - DNA, 25 bp, S. pombe
tgttccctgactacagccaaacagt

SEQ ID NO: 107302 - DNA, 25 bp, S. pombe
tgtcttctctggttcgtcccaaaga

SEQ ID NO: 107303 - DNA, 25 bp, S. pombe
tgtcttgtcgagtgcttcagctaaa

SEQ ID NO: 107304 - DNA, 25 bp, S. pombe
tgtcgaggcttatcttgtctctctc

SEQ ID NO: 107305 - DNA, 25 bp, S. pombe
tgtcaattctcactctgcaactttt

SEQ ID NO: 107306 - DNA, 25 bp, S. pombe
tgtcaactcgactcaccatttgtta

SEQ ID NO: 107307 - DNA, 25 bp, S. pombe
tgttgagtcaacaaacccatccgtt

SEQ ID NO: 107308 - DNA, 25 bp, S. pombe
tgtttcctccaactgcaagcaaatg

SEQ ID NO: 107309 - DNA, 25 bp, S. pombe
tgtctttgcatctccaacgtacatg

SEQ ID NO: 107310 - DNA, 25 bp, S. pombe
tgtcgccattgatccatcatttaaa

SEQ ID NO: 107311 - DNA, 25 bp, S. pombe
tgaggccatggaacccggtaattta

SEQ ID NO: 107312 - DNA, 25 bp, S. pombe
tgtcgatgctcaattccggttactt

SEQ ID NO: 107313 - DNA, 25 bp, S. pombe
tgtctgggcttgtggtgttatctat

SEQ ID NO: 107314 - DNA, 25 bp, S. pombe
tgtctcgactgcacttttaattgat

SEQ ID NO: 107315 - DNA, 25 bp, S. pombe
tgtacagcaacacatcccttggatt

SEQ ID NO: 107316 - DNA, 25 bp, S. pombe
tgtacatcaacttatgccctttcgt

SEQ ID NO: 107317 - DNA, 25 bp, S. pombe
tgtctcatcaagctggccgagtagt

SEQ ID NO: 107318 - DNA, 25 bp, S. pombe
tgtttgcctgtacgtcggttttgaa

SEQ ID NO: 107319 - DNA, 25 bp, S. pombe
tgttctccgtacaggacctattcaa

SEQ ID NO: 107320 - DNA, 25 bp, S. pombe
tgttctctcgttctaatcctttcaa

SEQ ID NO: 107321 - DNA, 25 bp, S. pombe
tgtttctcgaggtttatggtctatc

SEQ ID NO: 107322 - DNA, 25 bp, S. pombe
tgtcttacgctgcttttggttcaaa

SEQ ID NO: 107323 - DNA, 25 bp, S. pombe
tgtctatctaatgtgtctctccagt

SEQ ID NO: 107324 - DNA, 25 bp, S. pombe
tgtcacatctcctatttctcaaagt

SEQ ID NO: 107325 - DNA, 25 bp, S. pombe
tgtcaatatccagttgctatccagg

SEQ ID NO: 107326 - DNA, 25 bp, S. pombe
tgtacctcctacaactagcttgaat

SEQ ID NO: 107327 - DNA, 25 bp, S. pombe
tgtacatctccctttgtcaattcaa

SEQ ID NO: 107328 - DNA, 25 bp, S. pombe
tgtacttccccatggccaaaagatg

SEQ ID NO: 107329 - DNA, 25 bp, S. pombe
tgtagaagccaacgatatgaaaata

SEQ ID NO: 107330 - DNA, 25 bp, S. pombe
tgtcaattgttccagcatcaacgct

SEQ ID NO: 107331 - DNA, 25 bp, S. pombe
tgttgatcaccctcatggtggtggt

SEQ ID NO: 107332 - DNA, 25 bp, S. pombe
tgttgctaccattacacctgagggc

SEQ ID NO: 107333 - DNA, 25 bp, S. pombe
tgttgtccaacaatgctcgtcagca

SEQ ID NO: 107334 - DNA, 25 bp, S. pombe
tgtcagtttcaaagcagcatgtagt

SEQ ID NO: 107335 - DNA, 25 bp, S. pombe
tgtctcctgctaacaatacttctgg

SEQ ID NO: 107336 - DNA, 25 bp, S. pombe
tgagtacgtcaactttttccgcgaa

SEQ ID NO: 107337 - DNA, 25 bp, S. pombe
tgactactatcgttaccttgctgag

SEQ ID NO: 107338 - DNA, 25 bp, S. pombe
tgttactggctacaatgcacttaat

SEQ ID NO: 107339 - DNA, 25 bp, S. pombe
tgtataattctactaccccttgcat

SEQ ID NO: 107340 - DNA, 25 bp, S. pombe
tgttcgcgacactgctaatgagttc

SEQ ID NO: 107341 - DNA, 25 bp, S. pombe
tgtttgtacatctgcgtcacgtcaa

SEQ ID NO: 107342 - DNA, 25 bp, S. pombe
tgttcttacttctttcggtcacaga

SEQ ID NO: 107343 - DNA, 25 bp, S. pombe
tgttcttgtttctataccggagcga

SEQ ID NO: 107344 - DNA, 25 bp, S. pombe
tgtctcttcttgcttaccaaaacgt

SEQ ID NO: 107345 - DNA, 25 bp, S. pombe
tgtctcttgctctctttctcaaaaa

SEQ ID NO: 107346 - DNA, 25 bp, S. pombe
tgtctcatcttatttttcctggcaa

SEQ ID NO: 107347 - DNA, 25 bp, S. pombe
tgtctgcatctgaacttgctaccag

SEQ ID NO: 107348 - DNA, 25 bp, S. pombe
tgtctgtctgtacatgaacatgcca

SEQ ID NO: 107349 - DNA, 25 bp, S. pombe
tgtaacccagcccaagcgtgagaaa

SEQ ID NO: 107350 - DNA, 25 bp, S. pombe
tgtaacaccagcacctcttgagaaa

SEQ ID NO: 107351 - DNA, 25 bp, S. pombe
tgtaatctcctgatcctttgtaaag

SEQ ID NO: 107352 - DNA, 25 bp, S. pombe
tgtttggctcgcaatccttttacaa

SEQ ID NO: 107353 - DNA, 25 bp, S. pombe
tgtcttagcctcattctctttgaaa

SEQ ID NO: 107354 - DNA, 25 bp, S. pombe
tgtcatgctgtttctaccttacgaa

SEQ ID NO: 107355 - DNA, 25 bp, S. pombe
tgtcagatgctttgatcccaccata

SEQ ID NO: 107356 - DNA, 25 bp, S. pombe
tgtatgatcttctttctcactgcat

SEQ ID NO: 107357 - DNA, 25 bp, S. pombe
tgtctgcttttaactactgctccaa

SEQ ID NO: 107358 - DNA, 25 bp, S. pombe
tgtctcattttttctgaccctcaaa

SEQ ID NO: 107359 - DNA, 25 bp, S. pombe
tgttcccgtggttcaatacatgtac

SEQ ID NO: 107360 - DNA, 25 bp, S. pombe
tgttcctaaagttcgcatgccattg

SEQ ID NO: 107361 - DNA, 25 bp, S. pombe
tgatcttgtcaaggtttccgttgcc

SEQ ID NO: 107362 - DNA, 25 bp, S. pombe
tgttttgttgtgctatctctggtat

SEQ ID NO: 107363 - DNA, 25 bp, S. pombe
tgattgttctgatgcgtaccgagtt

SEQ ID NO: 107364 - DNA, 25 bp, S. pombe
tgatagttgtgttcgtcgtcgtttc

SEQ ID NO: 107365 - DNA, 25 bp, S. pombe
tgtaattatacatgagcgccctcca

SEQ ID NO: 107366 - DNA, 25 bp, S. pombe
tgtctcaaatactagctatgctccc

SEQ ID NO: 107367 - DNA, 25 bp, S. pombe
tgtagcatttcaagccgtttccaac

SEQ ID NO: 107368 - DNA, 25 bp, S. pombe
tgtaaatgtctcagctgttcccaac

SEQ ID NO: 107369 - DNA, 25 bp, S. pombe
tgtatttgttgcagcgggtcacgcc

SEQ ID NO: 107370 - DNA, 25 bp, S. pombe
tgatattgacccagcggttgaccgc

SEQ ID NO: 107371 - DNA, 25 bp, S. pombe
tgtttttatacactgctggagctga

SEQ ID NO: 107372 - DNA, 25 bp, S. pombe
tgttctaacaagtcccggcataggt

SEQ ID NO: 107373 - DNA, 25 bp, S. pombe
tgaatccaaaggtcgtttcttttgt

SEQ ID NO: 107374 - DNA, 25 bp, S. pombe
tgtcagacgtcagcaactttaattc

SEQ ID NO: 107375 - DNA, 25 bp, S. pombe
tgtaccgtcttcctctaattttcta

SEQ ID NO: 107376 - DNA, 25 bp, S. pombe
tgtcaataccaagctcattcttcct

SEQ ID NO: 107377 - DNA, 25 bp, S. pombe
tgtcataaaaagtgcatatctccta

SEQ ID NO: 107378 - DNA, 25 bp, S. pombe
tgtcataaaagccacggatctccct

SEQ ID NO: 107379 - DNA, 25 bp, S. pombe
tgatcttcaaaccattccaggctag

SEQ ID NO: 107380 - DNA, 25 bp, S. pombe
tgtttgctaacgcacgggctaaaag

SEQ ID NO: 107381 - DNA, 25 bp, S. pombe
tgagtcgttacctgcaagtctaaaa

SEQ ID NO: 107382 - DNA, 25 bp, S. pombe
tgaggctttccgtgaggatcctaac

SEQ ID NO: 107383 - DNA, 25 bp, S. pombe
tgtatatatggctgggcagttccca

SEQ ID NO: 107384 - DNA, 25 bp, S. pombe
tgtattggatgctctagcgttgccc

SEQ ID NO: 107385 - DNA, 25 bp, S. pombe
tgcttcatggagtttgcggttggct

SEQ ID NO: 107386 - DNA, 25 bp, S. pombe
tgttccttatgatctttttaccttt

SEQ ID NO: 107387 - DNA, 25 bp, S. pombe
tgttcacctgctttcttttttcagc

SEQ ID NO: 107388 - DNA, 25 bp, S. pombe
tgttcccaggtcgtttatttcaatt

SEQ ID NO: 107389 - DNA, 25 bp, S. pombe
tgtcttctccttgctattcatttaa

SEQ ID NO: 107390 - DNA, 25 bp, S. pombe
tgttatgtcagcttaccaccatttg

SEQ ID NO: 107391 - DNA, 25 bp, S. pombe
tgttatttacgattcctgctcctaa

SEQ ID NO: 107392 - DNA, 25 bp, S. pombe
tgtttcttcctgttaagcctctaga

SEQ ID NO: 107393 - DNA, 25 bp, S. pombe
tgttttctcctatatatcctcttgc

SEQ ID NO: 107394 - DNA, 25 bp, S. pombe
tgatttggctcgtaaagacccggaa

SEQ ID NO: 107395 - DNA, 25 bp, S. pombe
tgattcctctgactccgaaagtgaa

SEQ ID NO: 107396 - DNA, 25 bp, S. pombe
tgtcatctcactcatcacaggattt

SEQ ID NO: 107397 - DNA, 25 bp, S. pombe
tgtcatgaacagttatctcccgaaa

SEQ ID NO: 107398 - DNA, 25 bp, S. pombe
tgttaagttgccctctggcgccaaa

SEQ ID NO: 107399 - DNA, 25 bp, S. pombe
tgttaagcctgcgttgagtccaact

SEQ ID NO: 107400 - DNA, 25 bp, S. pombe
tcgtgcaggtcgtttcggtacaaaa

SEQ ID NO: 107401 - DNA, 25 bp, S. pombe
tgattttgcgagctttttgacgtga

SEQ ID NO: 107402 - DNA, 25 bp, S. pombe
tttgaatccgaagcgttttgcccca

SEQ ID NO: 107403 - DNA, 25 bp, S. pombe
tgttgaaccgtatggatttcctccc

SEQ ID NO: 107404 - DNA, 25 bp, S. pombe
tgttacccttataaatgcctccttc

SEQ ID NO: 107405 - DNA, 25 bp, S. pombe
tgttgacgtttcagagactccctag

SEQ ID NO: 107406 - DNA, 25 bp, S. pombe
tgttaatattccagagcccgctaag

SEQ ID NO: 107407 - DNA, 25 bp, S. pombe
tgttcaatagtgttggacccagtcc

SEQ ID NO: 107408 - DNA, 25 bp, S. pombe
tgtatctattgctttgaaccctctg

SEQ ID NO: 107409 - DNA, 25 bp, S. pombe
tgtatgctaatttccaaccacctaa

SEQ ID NO: 107410 - DNA, 25 bp, S. pombe
tgttgctaatacatcatcacgccct

SEQ ID NO: 107411 - DNA, 25 bp, S. pombe
tgaatttacttttgccagtggctcg

SEQ ID NO: 107412 - DNA, 25 bp, S. pombe
tgttatcggttgtgtggcattcgcc

SEQ ID NO: 107413 - DNA, 25 bp, S. pombe
tgttgtcgtttaccaggcattctgt

SEQ ID NO: 107414 - DNA, 25 bp, S. pombe
tgttcccgatcttctagactacgag

SEQ ID NO: 107415 - DNA, 25 bp, S. pombe
tgttcgtcgttattcagccttgtac

SEQ ID NO: 107416 - DNA, 25 bp, S. pombe
tgtagatgtcgttacctttggtcaa

SEQ ID NO: 107417 - DNA, 25 bp, S. pombe
tgttgtatcctctcgtcctggtcaa

SEQ ID NO: 107418 - DNA, 25 bp, S. pombe
tgtacagattgtgccgagcgacagt

SEQ ID NO: 107419 - DNA, 25 bp, S. pombe
tgtttctttttcttcactcccatta

SEQ ID NO: 107420 - DNA, 25 bp, S. pombe
tgttactattttttctgctcccaat

SEQ ID NO: 107421 - DNA, 25 bp, S. pombe
tgttcaccgccttgctgttgaaaga

SEQ ID NO: 107422 - DNA, 25 bp, S. pombe
tgatccttctgctcttttaagcgaa

SEQ ID NO: 107423 - DNA, 25 bp, S. pombe
tgattcttcccggtgagttagccaa

SEQ ID NO: 107424 - DNA, 25 bp, S. pombe
tgatttttcgccgtttaagctctac

SEQ ID NO: 107425 - DNA, 25 bp, S. pombe
tgttttgtcccgtcttaacccatat

SEQ ID NO: 107426 - DNA, 25 bp, S. pombe
tgatttccctcctaaatttctcgat

SEQ ID NO: 107427 - DNA, 25 bp, S. pombe
tgatttacctccgaaacccatattc

SEQ ID NO: 107428 - DNA, 25 bp, S. pombe
tgatttacacgatacatcccctgat

SEQ ID NO: 107429 - DNA, 25 bp, S. pombe
tgtttcatctcgttatctcgcatac

SEQ ID NO: 107430 - DNA, 25 bp, S. pombe
tgaggctcaagctccggctatttag

SEQ ID NO: 107431 - DNA, 25 bp, S. pombe
tgtacgcccatcgatgataccaatt

SEQ ID NO: 107432 - DNA, 25 bp, S. pombe
tgtagcttccatcgctgaacaatat

SEQ ID NO: 107433 - DNA, 25 bp, S. pombe
tgtagcctcatcaagcgacaacttt

SEQ ID NO: 107434 - DNA, 25 bp, S. pombe
tgtatgttcatcactacgagccttc

SEQ ID NO: 107435 - DNA, 25 bp, S. pombe
tgtttagctctcctaaagcctgtac

SEQ ID NO: 107436 - DNA, 25 bp, S. pombe
tgtagattctatcacaccaccagtg

SEQ ID NO: 107437 - DNA, 25 bp, S. pombe
tgtagattcattcccgatcaactgg

SEQ ID NO: 107438 - DNA, 25 bp, S. pombe
ttacgacttaagctttacccgcatt

SEQ ID NO: 107439 - DNA, 25 bp, S. pombe
tgtttcgcgtcctgttcctatgaaa

SEQ ID NO: 107440 - DNA, 25 bp, S. pombe
tgttaatcgtatttcttccttggta

SEQ ID NO: 107441 - DNA, 25 bp, S. pombe
tgttaacgattcatatgccagcagt

SEQ ID NO: 107442 - DNA, 25 bp, S. pombe
tatcctcgtaaaattcctaaccctg

SEQ ID NO: 107443 - DNA, 25 bp, S. pombe
tgatcctcgtggctttggtaaccgt

SEQ ID NO: 107444 - DNA, 25 bp, S. pombe
tgttccttcttattcgggcgactct

SEQ ID NO: 107445 - DNA, 25 bp, S. pombe
tgtttctttgtcttcggtgttcgaa

SEQ ID NO: 107446 - DNA, 25 bp, S. pombe
tgtttctcaagtttctggtgttctg

SEQ ID NO: 107447 - DNA, 25 bp, S. pombe
tgttgttgaacttactcgtgcttgt

SEQ ID NO: 107448 - DNA, 25 bp, S. pombe
tgttatttacattcacgttgtgcta

SEQ ID NO: 107449 - DNA, 25 bp, S. pombe
tgattatccagtcatgtccgttcct

SEQ ID NO: 107450 - DNA, 25 bp, S. pombe
tgattaccgtgcttggttggtctca

SEQ ID NO: 107451 - DNA, 25 bp, S. pombe
tgttccacctgctgaatacgcttca

SEQ ID NO: 107452 - DNA, 25 bp, S. pombe
tgttacagcctctgaaacttctcca

SEQ ID NO: 107453 - DNA, 25 bp, S. pombe
tgttgaaaccggtacatcttcgcca

SEQ ID NO: 107454 - DNA, 25 bp, S. pombe
tgtacagttactacttccttgctgc

SEQ ID NO: 107455 - DNA, 25 bp, S. pombe
tgatcagactcgtattttccaccaa

SEQ ID NO: 107456 - DNA, 25 bp, S. pombe
tgataatcccttattgctggccaat

SEQ ID NO: 107457 - DNA, 25 bp, S. pombe
tgttgaacttctacttgctgagcgc

SEQ ID NO: 107458 - DNA, 25 bp, S. pombe
tgtttcactttcctatgcagagcac

SEQ ID NO: 107459 - DNA, 25 bp, S. pombe
tgtacccttttcaagctggcttcta

SEQ ID NO: 107460 - DNA, 25 bp, S. pombe
tgtaccgctattgctggcattgtat

SEQ ID NO: 107461 - DNA, 25 bp, S. pombe
tgtttggcatgatccctctgacgaa

SEQ ID NO: 107462 - DNA, 25 bp, S. pombe
tgtttcgagctcacgtgctaagcaa

SEQ ID NO: 107463 - DNA, 25 bp, S. pombe
tgtattcaaccaactgtatgaatga

SEQ ID NO: 107464 - DNA, 25 bp, S. pombe
tgtatcaacagtgaggacatgcctt

SEQ ID NO: 107465 - DNA, 25 bp, S. pombe
tgttaaacgctgttgctgtggcatc

SEQ ID NO: 107466 - DNA, 25 bp, S. pombe
tgttacaattgcaatggcctcggcg

SEQ ID NO: 107467 - DNA, 25 bp, S. pombe
tgtatcaatttttggccgccacgga

SEQ ID NO: 107468 - DNA, 25 bp, S. pombe
tgttaacgcagaagctgaactcagc

SEQ ID NO: 107469 - DNA, 25 bp, S. pombe
tgtatactttgatatgccgccttcg

SEQ ID NO: 107470 - DNA, 25 bp, S. pombe
tgtagtcctattgatgctcgaccct

SEQ ID NO: 107471 - DNA, 25 bp, S. pombe
tgtagtccttgtgcatcgtgtttca

SEQ ID NO: 107472 - DNA, 25 bp, S. pombe
tgtaccacattgtccatcggttgat

SEQ ID NO: 107473 - DNA, 25 bp, S. pombe
tgatttccgcagagattttcccttg

SEQ ID NO: 107474 - DNA, 25 bp, S. pombe
tgtttaccgacgatatgcttccttg

SEQ ID NO: 107475 - DNA, 25 bp, S. pombe
tgttaactcgtcactattgccttta

SEQ ID NO: 107476 - DNA, 25 bp, S. pombe
tgttattacgtttcctctccttcaa

SEQ ID NO: 107477 - DNA, 25 bp, S. pombe
tgttcccttgtttactttgtgtctt

SEQ ID NO: 107478 - DNA, 25 bp, S. pombe
tgttgtcgcctattttttgggtctt

SEQ ID NO: 107479 - DNA, 25 bp, S. pombe
tgatttactcgttccacaggtgggt

SEQ ID NO: 107480 - DNA, 25 bp, S. pombe
tgagtttttgatcccacttttggaa

SEQ ID NO: 107481 - DNA, 25 bp, S. pombe
tgcttgtttgtattccaatttggac

SEQ ID NO: 107482 - DNA, 25 bp, S. pombe
tgttcgcttgatgacctttgaggat

SEQ ID NO: 107483 - DNA, 25 bp, S. pombe
tgttgaatcagagcccgatcatcca

SEQ ID NO: 107484 - DNA, 25 bp, S. pombe
tgttagtagctcacagcctacgcat

SEQ ID NO: 107485 - DNA, 25 bp, S. pombe
tgttgaccacttttggcattctgct

SEQ ID NO: 107486 - DNA, 25 bp, S. pombe
tgttactaattctggcatgcctgat

SEQ ID NO: 107487 - DNA, 25 bp, S. pombe
tgatactggcgtccctttgcaaggt

SEQ ID NO: 107488 - DNA, 25 bp, S. pombe
tgaactgggccctatttcaatggca

SEQ ID NO: 107489 - DNA, 25 bp, S. pombe
tgacctgcggcccaatgatacattc

SEQ ID NO: 107490 - DNA, 25 bp, S. pombe
tgtattccaatttggacactcaagc

SEQ ID NO: 107491 - DNA, 25 bp, S. pombe
tgatcctagaaacccaaaggctgga

SEQ ID NO: 107492 - DNA, 25 bp, S. pombe
tgaggcattacctacgacagggtta

SEQ ID NO: 107493 - DNA, 25 bp, S. pombe
tgatgccgttcctgctgaaggtagt

SEQ ID NO: 107494 - DNA, 25 bp, S. pombe
tgactgcagcattcgaacctttaat

SEQ ID NO: 107495 - DNA, 25 bp, S. pombe
tgtttgttggtgctgatgctgccat

SEQ ID NO: 107496 - DNA, 25 bp, S. pombe
tgtatttatcctccttgcgtaagca

SEQ ID NO: 107497 - DNA, 25 bp, S. pombe
tgttcatttccatatcattcccaag

SEQ ID NO: 107498 - DNA, 25 bp, S. pombe
tgtatttctcaatcagcttcctcaa

SEQ ID NO: 107499 - DNA, 25 bp, S. pombe
tgttttcctatatcttgccatccaa

SEQ ID NO: 107500 - DNA, 25 bp, S. pombe
tgttgctgtcgtttacttccaaaaa

SEQ ID NO: 107501 - DNA, 25 bp, S. pombe
tgttcgccgtgacacctttgaaaag

SEQ ID NO: 107502 - DNA, 25 bp, S. pombe
tgatttatttttccccaagcaatgg

SEQ ID NO: 107503 - DNA, 25 bp, S. pombe
tgttttgatggagcccacaccaagg

SEQ ID NO: 107504 - DNA, 25 bp, S. pombe
tgttgtatgctaacatttgctggca

SEQ ID NO: 107505 - DNA, 25 bp, S. pombe
tgtttgcatgttacttttggccgaa

SEQ ID NO: 107506 - DNA, 25 bp, S. pombe
tgtttctttcacgtttggacctgat

SEQ ID NO: 107507 - DNA, 25 bp, S. pombe
tgcttttttacctttggaatcaaag

SEQ ID NO: 107508 - DNA, 25 bp, S. pombe
tgttttattatcgacctgggactta

SEQ ID NO: 107509 - DNA, 25 bp, S. pombe
tgttatgctaatttctgccttcgcc

SEQ ID NO: 107510 - DNA, 25 bp, S. pombe
tgtattacagttccttcacttctcg

SEQ ID NO: 107511 - DNA, 25 bp, S. pombe
tgtattacccttgttatctctgcag

SEQ ID NO: 107512 - DNA, 25 bp, S. pombe
tgtttgaccctgactattgcattag

SEQ ID NO: 107513 - DNA, 25 bp, S. pombe
tgttctgcagccgttagcacttcaa

SEQ ID NO: 107514 - DNA, 25 bp, S. pombe
tgatttatatgagcctctgcccgaa

SEQ ID NO: 107515 - DNA, 25 bp, S. pombe
tgatggatttcctctacccaaggat

SEQ ID NO: 107516 - DNA, 25 bp, S. pombe
tgatcgcttcgttttacccaagttg

SEQ ID NO: 107517 - DNA, 25 bp, S. pombe
tgatgcgtccctttcgatcaaagag

SEQ ID NO: 107518 - DNA, 25 bp, S. pombe
tgatgccgacccttctgatgaagag

SEQ ID NO: 107519 - DNA, 25 bp, S. pombe
tgttccatccaccattgagactgag

SEQ ID NO: 107520 - DNA, 25 bp, S. pombe
tgttagcacagaatcttcctcgcaa

SEQ ID NO: 107521 - DNA, 25 bp, S. pombe
tgttgcaatatcttcgatcctccaa

SEQ ID NO: 107522 - DNA, 25 bp, S. pombe
tgtatatatacatcgacctcactaa

SEQ ID NO: 107523 - DNA, 25 bp, S. pombe
tgtatctatttcaagccccgttcaa

SEQ ID NO: 107524 - DNA, 25 bp, S. pombe
tgttcacaatgcaatactccttttt

SEQ ID NO: 107525 - DNA, 25 bp, S. pombe
tgttttttcatttgctccatctgtc

SEQ ID NO: 107526 - DNA, 25 bp, S. pombe
tgttctttactttgcatgctacctc

SEQ ID NO: 107527 - DNA, 25 bp, S. pombe
tgtatattgtttgggctctgacgcc

SEQ ID NO: 107528 - DNA, 25 bp, S. pombe
tgtattctcttttaattgctggcga

SEQ ID NO: 107529 - DNA, 25 bp, S. pombe
tgttgcaactgatgtcgctgccaga

SEQ ID NO: 107530 - DNA, 25 bp, S. pombe
tgttgcatatggtgtcttacgacta

SEQ ID NO: 107531 - DNA, 25 bp, S. pombe
tgttctttgcgccattatcagtcat

SEQ ID NO: 107532 - DNA, 25 bp, S. pombe
tgttcattggtggatcgtgcagtac

SEQ ID NO: 107533 - DNA, 25 bp, S. pombe
tgtttcggatgttcaggcagccacg

SEQ ID NO: 107534 - DNA, 25 bp, S. pombe
tgttgttggataccttggctccaca

SEQ ID NO: 107535 - DNA, 25 bp, S. pombe
tgttgttgaatcacgttctcaccaa

SEQ ID NO: 107536 - DNA, 25 bp, S. pombe
tgttcaagcttaacgagtcgcctac

SEQ ID NO: 107537 - DNA, 25 bp, S. pombe
tgatttggcttctcgaattccttcg

SEQ ID NO: 107538 - DNA, 25 bp, S. pombe
tgttttctttccctattcactgata

SEQ ID NO: 107539 - DNA, 25 bp, S. pombe
tgttgttcgcaacttcagtgtgcaa

SEQ ID NO: 107540 - DNA, 25 bp, S. pombe
tgttgcttacaactcgcgtcatgaa

SEQ ID NO: 107541 - DNA, 25 bp, S. pombe
tgattacttccacctggtcagcaat

SEQ ID NO: 107542 - DNA, 25 bp, S. pombe
tgatcaagctctcagtccggaaatg

SEQ ID NO: 107543 - DNA, 25 bp, S. pombe
tgatgcttctggtcaatcggtgaaa

SEQ ID NO: 107544 - DNA, 25 bp, S. pombe
tgatcatcactgtcatcatcaccat

SEQ ID NO: 107545 - DNA, 25 bp, S. pombe
tgatctcacgacaacccaggaagct

SEQ ID NO: 107546 - DNA, 25 bp, S. pombe
tgagcgcaaggcagcggaagccaac

SEQ ID NO: 107547 - DNA, 25 bp, S. pombe
tgaagccactgaacctttacattcc

SEQ ID NO: 107548 - DNA, 25 bp, S. pombe
tgagatggaagaacctttcgtttac

SEQ ID NO: 107549 - DNA, 25 bp, S. pombe
tgagtggccaactcacttggtccat

SEQ ID NO: 107550 - DNA, 25 bp, S. pombe
tgttgagcccattggcacttactac

SEQ ID NO: 107551 - DNA, 25 bp, S. pombe
tgttccattatatgtcgctgcgggc

SEQ ID NO: 107552 - DNA, 25 bp, S. pombe
tgattgtttatatctcgaccgctgc

SEQ ID NO: 107553 - DNA, 25 bp, S. pombe
tgattgctctaaaacctggattcgc

SEQ ID NO: 107554 - DNA, 25 bp, S. pombe
tgttcccttaactgagatcgtcgac

SEQ ID NO: 107555 - DNA, 25 bp, S. pombe
tgttgtcgcttggacgtggtttcaa

SEQ ID NO: 107556 - DNA, 25 bp, S. pombe
tgtttccaatgcatttctgagtcaa

SEQ ID NO: 107557 - DNA, 25 bp, S. pombe
tgtttcttacatttgctctcgctat

SEQ ID NO: 107558 - DNA, 25 bp, S. pombe
tgtttatcatctgtctatccgcaac

SEQ ID NO: 107559 - DNA, 25 bp, S. pombe
tgatgatctacaccccaaagcaaac

SEQ ID NO: 107560 - DNA, 25 bp, S. pombe
tgacattccgcatgctaaactaacg

SEQ ID NO: 107561 - DNA, 25 bp, S. pombe
tcacaaccgaatgagcaaggacgct

SEQ ID NO: 107562 - DNA, 25 bp, S. pombe
tgattaccacttctgtaaccgctgt

SEQ ID NO: 107563 - DNA, 25 bp, S. pombe
tgatttactgttttcctcactaggc

SEQ ID NO: 107564 - DNA, 25 bp, S. pombe
tgataaaaacattccttccccgagt

SEQ ID NO: 107565 - DNA, 25 bp, S. pombe
tgataattacacaccaaccctcatt

SEQ ID NO: 107566 - DNA, 25 bp, S. pombe
tgaaaatcctcgtctcaagtcacag

SEQ ID NO: 107567 - DNA, 25 bp, S. pombe
tgatttcattgactctgctactcgc

SEQ ID NO: 107568 - DNA, 25 bp, S. pombe
tgagtgttgtgcttcactatgctcc

SEQ ID NO: 107569 - DNA, 25 bp, S. pombe
tgagtgaagttccatccatgatgca

SEQ ID NO: 107570 - DNA, 25 bp, S. pombe
tgcggagccatttgcatttgatgca

SEQ ID NO: 107571 - DNA, 25 bp, S. pombe
tgaggcccatgcgaaaatgcatctt

SEQ ID NO: 107572 - DNA, 25 bp, S. pombe
tgaggatcactaccaagacattcgt

SEQ ID NO: 107573 - DNA, 25 bp, S. pombe
tgaggtctgctgatgaaggttctac

SEQ ID NO: 107574 - DNA, 25 bp, S. pombe
tgatatttggttgctgactattcag

SEQ ID NO: 107575 - DNA, 25 bp, S. pombe
tgaagttggaagtcgccttgccgat

SEQ ID NO: 107576 - DNA, 25 bp, S. pombe
tgagtggtgctacttccgtatttat

SEQ ID NO: 107577 - DNA, 25 bp, S. pombe
tgttttatctcgacgctcttgttaa

SEQ ID NO: 107578 - DNA, 25 bp, S. pombe
tgttctttttgtggtcgttcaacta

SEQ ID NO: 107579 - DNA, 25 bp, S. pombe
tgttctgtatatttggatcgtcctc

SEQ ID NO: 107580 - DNA, 25 bp, S. pombe
tgttcgtgagcattgggatcctctt

SEQ ID NO: 107581 - DNA, 25 bp, S. pombe
tgttactgacattcgtgatccacct

SEQ ID NO: 107582 - DNA, 25 bp, S. pombe
tgttctcgacgatgctattgaagct

SEQ ID NO: 107583 - DNA, 25 bp, S. pombe
tgttatcgacagagctcttgaaagc

SEQ ID NO: 107584 - DNA, 25 bp, S. pombe
tgatactcccgtcatcattcaaaca

SEQ ID NO: 107585 - DNA, 25 bp, S. pombe
tgatcctgcgccttttaatatactc

SEQ ID NO: 107586 - DNA, 25 bp, S. pombe
tgattctctctaacagtgaagctgt

SEQ ID NO: 107587 - DNA, 25 bp, S. pombe
tgttgacgaagtcgctatcatcgcc

SEQ ID NO: 107588 - DNA, 25 bp, S. pombe
tgattaccatgattgccgtacgcaa

SEQ ID NO: 107589 - DNA, 25 bp, S. pombe
tgattaccatatgcccatccgagat

SEQ ID NO: 107590 - DNA, 25 bp, S. pombe
tgttccgatatcttcccttaatggt

SEQ ID NO: 107591 - DNA, 25 bp, S. pombe
tgttctcagtacttccctttgtgta

SEQ ID NO: 107592 - DNA, 25 bp, S. pombe
tgagtgatgcgtccagttctgattt

SEQ ID NO: 107593 - DNA, 25 bp, S. pombe
tgattattgcatccagctagctgat

SEQ ID NO: 107594 - DNA, 25 bp, S. pombe
tgatcttgcagaccgcagcctgata

SEQ ID NO: 107595 - DNA, 25 bp, S. pombe
tgttgtgccacatttcccggaaata

SEQ ID NO: 107596 - DNA, 25 bp, S. pombe
tgttgtccgtattccctctgcataa

SEQ ID NO: 107597 - DNA, 25 bp, S. pombe
tgttcacgctgctatctcgaagtct

SEQ ID NO: 107598 - DNA, 25 bp, S. pombe
tgttcacgtctatcgttgtgctgaa

SEQ ID NO: 107599 - DNA, 25 bp, S. pombe
tgttgccgattctcacttatctgaa

SEQ ID NO: 107600 - DNA, 25 bp, S. pombe
tgttaagaccgttcctctaagcact

SEQ ID NO: 107601 - DNA, 25 bp, S. pombe
tgttcaagactcgttgcgctcaatg

SEQ ID NO: 107602 - DNA, 25 bp, S. pombe
tgttcgtgctcgtttcacccataat

SEQ ID NO: 107603 - DNA, 25 bp, S. pombe
tgttcagtgaagctactctccttat

SEQ ID NO: 107604 - DNA, 25 bp, S. pombe
tgttgtgtgtatttccttctctatt

SEQ ID NO: 107605 - DNA, 25 bp, S. pombe
tgatggtcgtatttgcggcgttagc

SEQ ID NO: 107606 - DNA, 25 bp, S. pombe
tgaggttgtcatctccggtaagctc

SEQ ID NO: 107607 - DNA, 25 bp, S. pombe
tgaggtattgacacccgattcatcc

SEQ ID NO: 107608 - DNA, 25 bp, S. pombe
tgatttaagacttcaacctcctcca

SEQ ID NO: 107609 - DNA, 25 bp, S. pombe
tgatattaagacacgcacctcgcgt

SEQ ID NO: 107610 - DNA, 25 bp, S. pombe
tgattcaacaacaggcttcaccgtt

SEQ ID NO: 107611 - DNA, 25 bp, S. pombe
tgatattaatccgttttacccaaga

SEQ ID NO: 107612 - DNA, 25 bp, S. pombe
tgacaagagccgtccacgtaggttt

SEQ ID NO: 107613 - DNA, 25 bp, S. pombe
tgttctattacagtgctgccgctaa

SEQ ID NO: 107614 - DNA, 25 bp, S. pombe
tgttgaatgttcttagccgctatac

SEQ ID NO: 107615 - DNA, 25 bp, S. pombe
tgttgataatctttcccagcttcac

SEQ ID NO: 107616 - DNA, 25 bp, S. pombe
tgttgctcaatccaccaaagctgat

SEQ ID NO: 107617 - DNA, 25 bp, S. pombe
tgattggcaaagtggcagagcatga

SEQ ID NO: 107618 - DNA, 25 bp, S. pombe
tgaggccagacagtacgcgagcagc

SEQ ID NO: 107619 - DNA, 25 bp, S. pombe
tgataccagataccacgcggacttg

SEQ ID NO: 107620 - DNA, 25 bp, S. pombe
tgatcatacgggacaactctggctc

SEQ ID NO: 107621 - DNA, 25 bp, S. pombe
tgatgccacctttggccagctagga

SEQ ID NO: 107622 - DNA, 25 bp, S. pombe
tgatgcgattgctttggccagacgt

SEQ ID NO: 107623 - DNA, 25 bp, S. pombe
tgctgctggcatctggtgctgcaac

SEQ ID NO: 107624 - DNA, 25 bp, S. pombe
tgatctaccacatgccacaaatttg

SEQ ID NO: 107625 - DNA, 25 bp, S. pombe
tgttccgcctccaatcaaagatggt

SEQ ID NO: 107626 - DNA, 25 bp, S. pombe
tgatgagagtcaccggcgagaacct

SEQ ID NO: 107627 - DNA, 25 bp, S. pombe
tgatgcacttcagcgttggaacctt

SEQ ID NO: 107628 - DNA, 25 bp, S. pombe
tgattttacacggtgctggagcact

SEQ ID NO: 107629 - DNA, 25 bp, S. pombe
tgaggctgtcgctcgtgctgaagca

SEQ ID NO: 107630 - DNA, 25 bp, S. pombe
tgattgctgtcgcttgctctgtcat

SEQ ID NO: 107631 - DNA, 25 bp, S. pombe
tgttcattccattatgcgccatatt

SEQ ID NO: 107632 - DNA, 25 bp, S. pombe
tgttcatttgcacacatctacaccg

SEQ ID NO: 107633 - DNA, 25 bp, S. pombe
tgttccggtaccgttaccatctata

SEQ ID NO: 107634 - DNA, 25 bp, S. pombe
tgcaaccggtcctttctgaaattat

SEQ ID NO: 107635 - DNA, 25 bp, S. pombe
tgatattcctgtcccttctaattta

SEQ ID NO: 107636 - DNA, 25 bp, S. pombe
tgattatattcaccctaccacattt

SEQ ID NO: 107637 - DNA, 25 bp, S. pombe
tgatttcccatctgcaaccaattta

SEQ ID NO: 107638 - DNA, 25 bp, S. pombe
tgatccatctcctgacaacgaagct

SEQ ID NO: 107639 - DNA, 25 bp, S. pombe
tgatccatctcctgaaactgttcat

SEQ ID NO: 107640 - DNA, 25 bp, S. pombe
tgcagtatcatctccagaagtggct

SEQ ID NO: 107641 - DNA, 25 bp, S. pombe
tgatgatgcatctccgaagtacccg

SEQ ID NO: 107642 - DNA, 25 bp, S. pombe
tgcattagaaggacctgcgcctgct

SEQ ID NO: 107643 - DNA, 25 bp, S. pombe
tgatatgcaagatgatcccctcctt

SEQ ID NO: 107644 - DNA, 25 bp, S. pombe
tgttgacgaaacacctgctcttaca

SEQ ID NO: 107645 - DNA, 25 bp, S. pombe
tgttgacactaattctcctcctaaa

SEQ ID NO: 107646 - DNA, 25 bp, S. pombe
tgttgcagcgaagcggtcaccgaag

SEQ ID NO: 107647 - DNA, 25 bp, S. pombe
tgatacgtgccaaacctcctagaag

SEQ ID NO: 107648 - DNA, 25 bp, S. pombe
tgttcctcctaacttgcctagacag

SEQ ID NO: 107649 - DNA, 25 bp, S. pombe
tgttctccctgcaatttccgaaatt

SEQ ID NO: 107650 - DNA, 25 bp, S. pombe
tcagaacccttcactaaaacctatt

SEQ ID NO: 107651 - DNA, 25 bp, S. pombe
ttcaagtctcttgttttaacccaat

SEQ ID NO: 107652 - DNA, 25 bp, S. pombe
tgatcaattccctcttttaactaaa

SEQ ID NO: 107653 - DNA, 25 bp, S. pombe
tgattttcctcgcttttttcatgaa

SEQ ID NO: 107654 - DNA, 25 bp, S. pombe
tgaggtacctgtcgtttctttacaa

SEQ ID NO: 107655 - DNA, 25 bp, S. pombe
tgatgttatcccacgtgatgtccag

SEQ ID NO: 107656 - DNA, 25 bp, S. pombe
tgatgttatccctcgcgatgttcaa

SEQ ID NO: 107657 - DNA, 25 bp, S. pombe
tgatgttactcttagctcctttgga

SEQ ID NO: 107658 - DNA, 25 bp, S. pombe
tgagttagtctcgtgtagcatgctt

SEQ ID NO: 107659 - DNA, 25 bp, S. pombe
tgagacctgtcttggatgcaaagct

SEQ ID NO: 107660 - DNA, 25 bp, S. pombe
tgatatgcgcagtccatcgcaactt

SEQ ID NO: 107661 - DNA, 25 bp, S. pombe
tgatatcgatccttcttcatctagc

SEQ ID NO: 107662 - DNA, 25 bp, S. pombe
tgatacaacgcttgcagatccttgc

SEQ ID NO: 107663 - DNA, 25 bp, S. pombe
tgagatgtcgacagaggacgctctt

SEQ ID NO: 107664 - DNA, 25 bp, S. pombe
tgatgtgtccgctgagctaggctac

SEQ ID NO: 107665 - DNA, 25 bp, S. pombe
tgttgctcacgtaactagtcatccc

SEQ ID NO: 107666 - DNA, 25 bp, S. pombe
tgatccctcgttattggccttaaaa

SEQ ID NO: 107667 - DNA, 25 bp, S. pombe
tgttgcgccctgatttgattgttaa

SEQ ID NO: 107668 - DNA, 25 bp, S. pombe
tgattggatcctgtttgctttcttt

SEQ ID NO: 107669 - DNA, 25 bp, S. pombe
tgctaatgattgctccgtttggtga

SEQ ID NO: 107670 - DNA, 25 bp, S. pombe
tgattcacgttatcaagcctcccgt

SEQ ID NO: 107671 - DNA, 25 bp, S. pombe
tgttgacatgcttggtaatcctccc

SEQ ID NO: 107672 - DNA, 25 bp, S. pombe
tgatgtccgtcaattcgttattcgt

SEQ ID NO: 107673 - DNA, 25 bp, S. pombe
tgattatgcgcctttcttgcttaaa

SEQ ID NO: 107674 - DNA, 25 bp, S. pombe
tgattctgctcctggttttgacaag

SEQ ID NO: 107675 - DNA, 25 bp, S. pombe
tgatttagcatctgtatcttcccct

SEQ ID NO: 107676 - DNA, 25 bp, S. pombe
tgatgagtcccctgccaatatagat

SEQ ID NO: 107677 - DNA, 25 bp, S. pombe
tgaggcttctgctatggccgtgaaa

SEQ ID NO: 107678 - DNA, 25 bp, S. pombe
tgatgcgttcattaatgccattggg

SEQ ID NO: 107679 - DNA, 25 bp, S. pombe
tgaggagacgctacgccaattggca

SEQ ID NO: 107680 - DNA, 25 bp, S. pombe
tgaggctgcccgtagtctaatcaat

SEQ ID NO: 107681 - DNA, 25 bp, S. pombe
tgatgatgcttttgtcgcccaagac

SEQ ID NO: 107682 - DNA, 25 bp, S. pombe
tgatcctcatttccgcaagactttg

SEQ ID NO: 107683 - DNA, 25 bp, S. pombe
tgatcatgaatttcctcaggccctt

SEQ ID NO: 107684 - DNA, 25 bp, S. pombe
tgttgatgattctccggcacctgga

SEQ ID NO: 107685 - DNA, 25 bp, S. pombe
tgattgtgttgccttcgtaccgaaa

SEQ ID NO: 107686 - DNA, 25 bp, S. pombe
tgcttatggctccaaggtacccaag

SEQ ID NO: 107687 - DNA, 25 bp, S. pombe
tgatccgaattaattggccccagct

SEQ ID NO: 107688 - DNA, 25 bp, S. pombe
tgactatccttatctttctgtacct

SEQ ID NO: 107689 - DNA, 25 bp, S. pombe
tgagcctcagacatagtacccaact

SEQ ID NO: 107690 - DNA, 25 bp, S. pombe
tgagcgtctcaagaagattcaaact

SEQ ID NO: 107691 - DNA, 25 bp, S. pombe
tgatctaatgcttgcgattcttgaa

SEQ ID NO: 107692 - DNA, 25 bp, S. pombe
tgttgcctcgcttttcctatatttg

SEQ ID NO: 107693 - DNA, 25 bp, S. pombe
tgttggtaccttttttatgttgccg

SEQ ID NO: 107694 - DNA, 25 bp, S. pombe
tgttggcaacctttcattctatacc

SEQ ID NO: 107695 - DNA, 25 bp, S. pombe
tgaggctgctttccgtaacgtcaag

SEQ ID NO: 107696 - DNA, 25 bp, S. pombe
tctgggttttttcaagttctaggtg

SEQ ID NO: 107697 - DNA, 25 bp, S. pombe
tgacggttttttcacatcttttgga

SEQ ID NO: 107698 - DNA, 25 bp, S. pombe
tgacgacaattccttatacctttgg

SEQ ID NO: 107699 - DNA, 25 bp, S. pombe
tgatgctaaagtggctgtatcaact

SEQ ID NO: 107700 - DNA, 25 bp, S. pombe
tgatgctagcggtcctttcgaggat

SEQ ID NO: 107701 - DNA, 25 bp, S. pombe
tgataacggtcagtcttggcagaaa

SEQ ID NO: 107702 - DNA, 25 bp, S. pombe
tgatttgaccactgttcctactaaa

SEQ ID NO: 107703 - DNA, 25 bp, S. pombe
tgagtcctcatctaagttaatccag

SEQ ID NO: 107704 - DNA, 25 bp, S. pombe
taccgggaaagcaaactcaaggaat

SEQ ID NO: 107705 - DNA, 25 bp, S. pombe
tgacctgggaacttgaccccgatga

SEQ ID NO: 107706 - DNA, 25 bp, S. pombe
tgaaacacgagagccggttcgacct

SEQ ID NO: 107707 - DNA, 25 bp, S. pombe
tgatgagcccaagttccgtttcgac

SEQ ID NO: 107708 - DNA, 25 bp, S. pombe
tgatacccatattgtcattcctcac

SEQ ID NO: 107709 - DNA, 25 bp, S. pombe
tgatgatccaaatgacttccgtcca

SEQ ID NO: 107710 - DNA, 25 bp, S. pombe
tgagttacctaacatgccgtccaaa

SEQ ID NO: 107711 - DNA, 25 bp, S. pombe
tgagctccgttacaaccgatccaaa

SEQ ID NO: 107712 - DNA, 25 bp, S. pombe
tgatacgcgtttgcgacctgaccaa

SEQ ID NO: 107713 - DNA, 25 bp, S. pombe
tgataaataccccagtagcgtccgt

SEQ ID NO: 107714 - DNA, 25 bp, S. pombe
tgacctaaacccatatgcttttgat

SEQ ID NO: 107715 - DNA, 25 bp, S. pombe
tgctgacactaatgacgatatcgtt

SEQ ID NO: 107716 - DNA, 25 bp, S. pombe
tgctgaacaagccaagggtcgtttc

SEQ ID NO: 107717 - DNA, 25 bp, S. pombe
tgatccaaatgatatgtctcgcata

SEQ ID NO: 107718 - DNA, 25 bp, S. pombe
tgatcccattgttataccgtatacc

SEQ ID NO: 107719 - DNA, 25 bp, S. pombe
tgaccccggtgttaagactcgtcaa

SEQ ID NO: 107720 - DNA, 25 bp, S. pombe
tgacgctaagtcaaccgcaatcttt

SEQ ID NO: 107721 - DNA, 25 bp, S. pombe
tgaggcaacgtcgacttgatttttc

SEQ ID NO: 107722 - DNA, 25 bp, S. pombe
tgaggcagcccttacttttattctt

SEQ ID NO: 107723 - DNA, 25 bp, S. pombe
tgatggacctcgcaagtttactatt

SEQ ID NO: 107724 - DNA, 25 bp, S. pombe
tgacggttccatttcttttcgtgat

SEQ ID NO: 107725 - DNA, 25 bp, S. pombe
tccgttgccttaacatttcccgcat

SEQ ID NO: 107726 - DNA, 25 bp, S. pombe
tgttgttttgttgatcctgaccgtt

SEQ ID NO: 107727 - DNA, 25 bp, S. pombe
tgatggtttttctaactctccggtt

SEQ ID NO: 107728 - DNA, 25 bp, S. pombe
tgttgtcatgtcgttacagctcttc

SEQ ID NO: 107729 - DNA, 25 bp, S. pombe
tgctagacgagaatcccttttgggt

SEQ ID NO: 107730 - DNA, 25 bp, S. pombe
tgattggaagaaactcgctgcgaaa

SEQ ID NO: 107731 - DNA, 25 bp, S. pombe
tgttgtgcaacatactgaccttaat

SEQ ID NO: 107732 - DNA, 25 bp, S. pombe
tgatctggacactcagtaccttacg

SEQ ID NO: 107733 - DNA, 25 bp, S. pombe
tgacggttctttccaacttactggt

SEQ ID NO: 107734 - DNA, 25 bp, S. pombe
tgagctgtgggctttacaacttgag

SEQ ID NO: 107735 - DNA, 25 bp, S. pombe
tgatgctccttctcaagccaagaat

SEQ ID NO: 107736 - DNA, 25 bp, S. pombe
tgatgccctagccaaagccattaac

SEQ ID NO: 107737 - DNA, 25 bp, S. pombe
tgaggcctatgccaagatccgtgag

SEQ ID NO: 107738 - DNA, 25 bp, S. pombe
tgattgcctcaacatgtatcctcta

SEQ ID NO: 107739 - DNA, 25 bp, S. pombe
tgatgggtctcttgccttattgaac

SEQ ID NO: 107740 - DNA, 25 bp, S. pombe
tgatgggtacccctgatgttcattc

SEQ ID NO: 107741 - DNA, 25 bp, S. pombe
tgatgcgtaatcaacctcgtgccag

SEQ ID NO: 107742 - DNA, 25 bp, S. pombe
tgttgtaaaacaccggcagcatctg

SEQ ID NO: 107743 - DNA, 25 bp, S. pombe
tgattatgtagttcactcggcgact

SEQ ID NO: 107744 - DNA, 25 bp, S. pombe
tgagtgttggttgctgctaggacat

SEQ ID NO: 107745 - DNA, 25 bp, S. pombe
tgcacatattatcgctggccacaaa

SEQ ID NO: 107746 - DNA, 25 bp, S. pombe
tgacctcgacgactcgacagaaact

SEQ ID NO: 107747 - DNA, 25 bp, S. pombe
tgatcccgacacaatgcgccaaatg

SEQ ID NO: 107748 - DNA, 25 bp, S. pombe
tgaccgcagacgtgctctcaaggga

SEQ ID NO: 107749 - DNA, 25 bp, S. pombe
tgaccgcagacgtgcccttaaaggt

SEQ ID NO: 107750 - DNA, 25 bp, S. pombe
tgagctctcgaattggccctgtacg

SEQ ID NO: 107751 - DNA, 25 bp, S. pombe
tgagttgcgtagtcgtcatgctaac

SEQ ID NO: 107752 - DNA, 25 bp, S. pombe
tgatcgaactattgctcagctagaa

SEQ ID NO: 107753 - DNA, 25 bp, S. pombe
tgatgtcgtctttggtgtgtcaacc

SEQ ID NO: 107754 - DNA, 25 bp, S. pombe
tgcatatttcttgggttgtcgtcga

SEQ ID NO: 107755 - DNA, 25 bp, S. pombe
tgatttggttcgttctgctttgaga

SEQ ID NO: 107756 - DNA, 25 bp, S. pombe
tgactttatgattgctactcctaag

SEQ ID NO: 107757 - DNA, 25 bp, S. pombe
tgatttaatcattccccatcaccat

SEQ ID NO: 107758 - DNA, 25 bp, S. pombe
tgacgaagtgggtcgcacaccataa

SEQ ID NO: 107759 - DNA, 25 bp, S. pombe
tgatggacgtagtcggtctcccgat

SEQ ID NO: 107760 - DNA, 25 bp, S. pombe
tgatggtcaacatcggttccacttc

SEQ ID NO: 107761 - DNA, 25 bp, S. pombe
tgatagctcaaattcccttggactt

SEQ ID NO: 107762 - DNA, 25 bp, S. pombe
tgatcaatcttctgccttcttaggt

SEQ ID NO: 107763 - DNA, 25 bp, S. pombe
tgatcaatctgtctcctccaaatgg

SEQ ID NO: 107764 - DNA, 25 bp, S. pombe
tgaggcgacccttgatatgtttatg

SEQ ID NO: 107765 - DNA, 25 bp, S. pombe
tgatttacttgcttcttcacctgaa

SEQ ID NO: 107766 - DNA, 25 bp, S. pombe
tgatcttttaattggcagcccgtct

SEQ ID NO: 107767 - DNA, 25 bp, S. pombe
tgatcatgtcttttctatccaccag

SEQ ID NO: 107768 - DNA, 25 bp, S. pombe
tgaggtcatcgccagtttagagagt

SEQ ID NO: 107769 - DNA, 25 bp, S. pombe
tgatgacacattctcagcacttcgt

SEQ ID NO: 107770 - DNA, 25 bp, S. pombe
tgattcagcattttgcgttggcgct

SEQ ID NO: 107771 - DNA, 25 bp, S. pombe
tgatatacattttgccgcagcccga

SEQ ID NO: 107772 - DNA, 25 bp, S. pombe
tgatcaatttcttgtcgcccattat

SEQ ID NO: 107773 - DNA, 25 bp, S. pombe
tgatttttgccaacgctgtttcgat

SEQ ID NO: 107774 - DNA, 25 bp, S. pombe
tgatgttcttacagagtcctccaag

SEQ ID NO: 107775 - DNA, 25 bp, S. pombe
tgatgttgttacctcagtcttcagc

SEQ ID NO: 107776 - DNA, 25 bp, S. pombe
tgattagttcttccctggatcaaac

SEQ ID NO: 107777 - DNA, 25 bp, S. pombe
tgattatgttgcttcgggtgctcaa

SEQ ID NO: 107778 - DNA, 25 bp, S. pombe
tgatatcatattttcggcctctcta

SEQ ID NO: 107779 - DNA, 25 bp, S. pombe
tgatacaatttctgccttccataaa

SEQ ID NO: 107780 - DNA, 25 bp, S. pombe
tgacaagatttctcctttcgacacc

SEQ ID NO: 107781 - DNA, 25 bp, S. pombe
tgatcgcagtttctccatcgttgaa

SEQ ID NO: 107782 - DNA, 25 bp, S. pombe
tgagtaccaatctttccagcattct

SEQ ID NO: 107783 - DNA, 25 bp, S. pombe
tgatgtccaagcatttctcacttca

SEQ ID NO: 107784 - DNA, 25 bp, S. pombe
tgatatgtcatctgttcctcaaagt

SEQ ID NO: 107785 - DNA, 25 bp, S. pombe
tgaacttgcggtccctaaatctcaa

SEQ ID NO: 107786 - DNA, 25 bp, S. pombe
tgagaagcctgcaaccgtcaagact

SEQ ID NO: 107787 - DNA, 25 bp, S. pombe
tgatcaacctaaaccgcaaaccgtg

SEQ ID NO: 107788 - DNA, 25 bp, S. pombe
ttcaacttaccctcaaaccaattat

SEQ ID NO: 107789 - DNA, 25 bp, S. pombe
tcaaggttaccctcatcaaggctat

SEQ ID NO: 107790 - DNA, 25 bp, S. pombe
taagggtacgccatcaacagccatt

SEQ ID NO: 107791 - DNA, 25 bp, S. pombe
tgactgggtttggtgtacgtacgat

SEQ ID NO: 107792 - DNA, 25 bp, S. pombe
tgactggttctttggttcctcctaa

SEQ ID NO: 107793 - DNA, 25 bp, S. pombe
tgatcgccaaccttctttcaacaag

SEQ ID NO: 107794 - DNA, 25 bp, S. pombe
tgatgcccaatacgtcttcttagca

SEQ ID NO: 107795 - DNA, 25 bp, S. pombe
tgatctcgcacttcgctttggtgaa

SEQ ID NO: 107796 - DNA, 25 bp, S. pombe
tgacattgccaatgctcgtggagaa

SEQ ID NO: 107797 - DNA, 25 bp, S. pombe
tgatgccctcactatgccggagaaa

SEQ ID NO: 107798 - DNA, 25 bp, S. pombe
tgatcacactcatacttggcgaatt

SEQ ID NO: 107799 - DNA, 25 bp, S. pombe
tgatcccttggatgtgtgcgagata

SEQ ID NO: 107800 - DNA, 25 bp, S. pombe
tgatccttcattagtcacgccaagt

SEQ ID NO: 107801 - DNA, 25 bp, S. pombe
tgactcttattggacacacgcttgt

SEQ ID NO: 107802 - DNA, 25 bp, S. pombe
tgatcgatgcatctggcaaccctaa

SEQ ID NO: 107803 - DNA, 25 bp, S. pombe
tgatggtcatcagccaatccgatat

SEQ ID NO: 107804 - DNA, 25 bp, S. pombe
tgatagtccagagctgtcagccgat

SEQ ID NO: 107805 - DNA, 25 bp, S. pombe
tgatgctgaatacagtgccgccgct

SEQ ID NO: 107806 - DNA, 25 bp, S. pombe
tgatgcccagcaagatagcctccaa

SEQ ID NO: 107807 - DNA, 25 bp, S. pombe
tgatgagccactagaagccgctaat

SEQ ID NO: 107808 - DNA, 25 bp, S. pombe
tgatgcgctatctgaacttgctaca

SEQ ID NO: 107809 - DNA, 25 bp, S. pombe
tgatactctagatcctgccttgctt

SEQ ID NO: 107810 - DNA, 25 bp, S. pombe
tgatcccacgctcgatagagttcgt

SEQ ID NO: 107811 - DNA, 25 bp, S. pombe
tgataccgagcccatagagatttta

SEQ ID NO: 107812 - DNA, 25 bp, S. pombe
tgatgacttccaatgttaccgacga

SEQ ID NO: 107813 - DNA, 25 bp, S. pombe
tgatatttcagcctcatctaccgtt

SEQ ID NO: 107814 - DNA, 25 bp, S. pombe
tgagaactctcccagctatttacag

SEQ ID NO: 107815 - DNA, 25 bp, S. pombe
tgaaccctcgtactggacaacgtga

SEQ ID NO: 107816 - DNA, 25 bp, S. pombe
tgatcaagaagcctattcccctgaa

SEQ ID NO: 107817 - DNA, 25 bp, S. pombe
tgatcaaatccattattctcctaga

SEQ ID NO: 107818 - DNA, 25 bp, S. pombe
tgagggacctcttttcaacgaacag

SEQ ID NO: 107819 - DNA, 25 bp, S. pombe
tgagcggttggcacttctagagaat

SEQ ID NO: 107820 - DNA, 25 bp, S. pombe
tgagcgccctggttcatttgaagcc

SEQ ID NO: 107821 - DNA, 25 bp, S. pombe
tgatcttcctccttatacttcgaaa

SEQ ID NO: 107822 - DNA, 25 bp, S. pombe
tgatattcctgcacatgatacccga

SEQ ID NO: 107823 - DNA, 25 bp, S. pombe
tgagcctccagtactatgcgcaaag

SEQ ID NO: 107824 - DNA, 25 bp, S. pombe
tgatgctctgccttttatcgatggg

SEQ ID NO: 107825 - DNA, 25 bp, S. pombe
tgatgcgtgctttctatactgctgg

SEQ ID NO: 107826 - DNA, 25 bp, S. pombe
tgaagcttcggttggtatttggatt

SEQ ID NO: 107827 - DNA, 25 bp, S. pombe
tgatcacccggactttgccttgaaa

SEQ ID NO: 107828 - DNA, 25 bp, S. pombe
tgaacccttacttctacctttatat

SEQ ID NO: 107829 - DNA, 25 bp, S. pombe
tgatactttaattccttcgcttttg

SEQ ID NO: 107830 - DNA, 25 bp, S. pombe
tgataattttcaacacattctccgt

SEQ ID NO: 107831 - DNA, 25 bp, S. pombe
tgatggatctgctgagtggtctacc

SEQ ID NO: 107832 - DNA, 25 bp, S. pombe
tgatgcatacttgagatctatctac

SEQ ID NO: 107833 - DNA, 25 bp, S. pombe
tgatgcttctccaatggctatcgaa

SEQ ID NO: 107834 - DNA, 25 bp, S. pombe
tgatgtatatctctgcctatccaat

SEQ ID NO: 107835 - DNA, 25 bp, S. pombe
tgatcattcagggtgctttcgctac

SEQ ID NO: 107836 - DNA, 25 bp, S. pombe
tgatgcactctgtgtcgttcgtaat

SEQ ID NO: 107837 - DNA, 25 bp, S. pombe
tgatgcctcttctcagttcattgat

SEQ ID NO: 107838 - DNA, 25 bp, S. pombe
tgatatcgtgtctttttcagctcca

SEQ ID NO: 107839 - DNA, 25 bp, S. pombe
tgaagggtcggttttgcctcaagta

SEQ ID NO: 107840 - DNA, 25 bp, S. pombe
tgatacaggctagggcatccatcgc

SEQ ID NO: 107841 - DNA, 25 bp, S. pombe
tgataaaacatttcccgatagtgat

SEQ ID NO: 107842 - DNA, 25 bp, S. pombe
tgataatacgattgttggcgccggt

SEQ ID NO: 107843 - DNA, 25 bp, S. pombe
tgaccatcatcgtgctgaaagcgct

SEQ ID NO: 107844 - DNA, 25 bp, S. pombe
tgatcctattgcttctccgaaaatg

SEQ ID NO: 107845 - DNA, 25 bp, S. pombe
tgatctcgttgttcctcagcaagga

SEQ ID NO: 107846 - DNA, 25 bp, S. pombe
tgatctcgttcatgcccaaggtaaa

SEQ ID NO: 107847 - DNA, 25 bp, S. pombe
tgatgttttgctgatcggctctaaa

SEQ ID NO: 107848 - DNA, 25 bp, S. pombe
tgatgtattggctcatcgccagcta

SEQ ID NO: 107849 - DNA, 25 bp, S. pombe
tgataaggcactcctcctcaatgaa

SEQ ID NO: 107850 - DNA, 25 bp, S. pombe
tgatgacattactcgcttccttagg

SEQ ID NO: 107851 - DNA, 25 bp, S. pombe
tgaggcagcagaggagtctacccct

SEQ ID NO: 107852 - DNA, 25 bp, S. pombe
tgagctaacaaggtccattgcccgt

SEQ ID NO: 107853 - DNA, 25 bp, S. pombe
tgatgaaattcgttctcgtccagca

SEQ ID NO: 107854 - DNA, 25 bp, S. pombe
tgatgaacctccattactttctcag

SEQ ID NO: 107855 - DNA, 25 bp, S. pombe
tgataacactactgccacgttttgc

SEQ ID NO: 107856 - DNA, 25 bp, S. pombe
tgaggatcggcctgtagtcccttta

SEQ ID NO: 107857 - DNA, 25 bp, S. pombe
tgagttggcttctgtttctccttaa

SEQ ID NO: 107858 - DNA, 25 bp, S. pombe
tgagctttttactgctattgccaaa

SEQ ID NO: 107859 - DNA, 25 bp, S. pombe
tgacgcttgcccagttgttaaagat

SEQ ID NO: 107860 - DNA, 25 bp, S. pombe
tgacggccgcgggttgtatcaaaat

SEQ ID NO: 107861 - DNA, 25 bp, S. pombe
tgagggtcactccttcagaagaaaa

SEQ ID NO: 107862 - DNA, 25 bp, S. pombe
tgatgaccaggattccagcctgaat

SEQ ID NO: 107863 - DNA, 25 bp, S. pombe
tgcacaaatgtctaccgtcgagctt

SEQ ID NO: 107864 - DNA, 25 bp, S. pombe
tgagctgaccgaacctattttatct

SEQ ID NO: 107865 - DNA, 25 bp, S. pombe
tgatgatggcatggctgtccgattt

SEQ ID NO: 107866 - DNA, 25 bp, S. pombe
tgatcattcctattcgctgcttttc

SEQ ID NO: 107867 - DNA, 25 bp, S. pombe
tgaaattgccgaaagtccctcttct

SEQ ID NO: 107868 - DNA, 25 bp, S. pombe
tgaaattcctaaaactcctcctact

SEQ ID NO: 107869 - DNA, 25 bp, S. pombe
tgagaagtccatcaaccggcatact

SEQ ID NO: 107870 - DNA, 25 bp, S. pombe
tgatgaatgtcctgaatcgcctgct

SEQ ID NO: 107871 - DNA, 25 bp, S. pombe
tgagcttatgcttggacatcctctt

SEQ ID NO: 107872 - DNA, 25 bp, S. pombe
tgatgataatgctgccacgcacctt

SEQ ID NO: 107873 - DNA, 25 bp, S. pombe
tgatccccattccattcttgattta

SEQ ID NO: 107874 - DNA, 25 bp, S. pombe
tgatcctgtcttgtgctttattcaa

SEQ ID NO: 107875 - DNA, 25 bp, S. pombe
tgatgcattagctgttctttcccaa

SEQ ID NO: 107876 - DNA, 25 bp, S. pombe
tgatgctcttgatgttgctaaccgc

SEQ ID NO: 107877 - DNA, 25 bp, S. pombe
tgatgctcttatcgacactaaccac

SEQ ID NO: 107878 - DNA, 25 bp, S. pombe
tgatgctttcatcgaatctgcaaaa

SEQ ID NO: 107879 - DNA, 25 bp, S. pombe
tgatgcatcttctacagtcagccaa

SEQ ID NO: 107880 - DNA, 25 bp, S. pombe
tgactgtgacactggagccaatgct

SEQ ID NO: 107881 - DNA, 25 bp, S. pombe
tgagcctcttgttaagggtgccgtt

SEQ ID NO: 107882 - DNA, 25 bp, S. pombe
tgagcttcgtcttaagcgtaccgtt

SEQ ID NO: 107883 - DNA, 25 bp, S. pombe
tgcacttgcgaataaggcttacctt

SEQ ID NO: 107884 - DNA, 25 bp, S. pombe
tgacgtgccagattaccctttaaat

SEQ ID NO: 107885 - DNA, 25 bp, S. pombe
tgatgagtcaccctgatcctgaagt

SEQ ID NO: 107886 - DNA, 25 bp, S. pombe
tgatgaacactccaaggctgagctt

SEQ ID NO: 107887 - DNA, 25 bp, S. pombe
tgatgaccagcttcagtcgatactg

SEQ ID NO: 107888 - DNA, 25 bp, S. pombe
tgagttaaaacttgcatccattgta

SEQ ID NO: 107889 - DNA, 25 bp, S. pombe
tgagttaaaggcttgcttgacgaaa

SEQ ID NO: 107890 - DNA, 25 bp, S. pombe
tgactgtgccattgaagcttccggt

SEQ ID NO: 107891 - DNA, 25 bp, S. pombe
tgatcatcttcctactttattgcca

SEQ ID NO: 107892 - DNA, 25 bp, S. pombe
tgagtctctcgctaatgtttcccaa

SEQ ID NO: 107893 - DNA, 25 bp, S. pombe
tgagtcctcttttgatggcaccaca

SEQ ID NO: 107894 - DNA, 25 bp, S. pombe
tgagtatctcttctatggaccctgc

SEQ ID NO: 107895 - DNA, 25 bp, S. pombe
tgcgaattggtatccggttcctcca

SEQ ID NO: 107896 - DNA, 25 bp, S. pombe
tgaggaccttgttgtcgctttgcaa

SEQ ID NO: 107897 - DNA, 25 bp, S. pombe
tgatcgacacttttggcttttgcac

SEQ ID NO: 107898 - DNA, 25 bp, S. pombe
tgactggacgtctggcattcttaaa

SEQ ID NO: 107899 - DNA, 25 bp, S. pombe
tgagcgatacgaacggctatttaaa

SEQ ID NO: 107900 - DNA, 25 bp, S. pombe
tgatgatgatactaacggccttgaa

SEQ ID NO: 107901 - DNA, 25 bp, S. pombe
tgatgtacagaactcgagcgacgaa

SEQ ID NO: 107902 - DNA, 25 bp, S. pombe
tgacaagcaagccacttctcaggag

SEQ ID NO: 107903 - DNA, 25 bp, S. pombe
tgcagaatcggaagctgatgcccag

SEQ ID NO: 107904 - DNA, 25 bp, S. pombe
tgatgatcccagcattcatggccag

SEQ ID NO: 107905 - DNA, 25 bp, S. pombe
tgatgatacacacattcaccgcgta

SEQ ID NO: 107906 - DNA, 25 bp, S. pombe
tgatgattcttatttcccgcgtgaa

SEQ ID NO: 107907 - DNA, 25 bp, S. pombe
tgagcattgggatgtcgccggtaat

SEQ ID NO: 107908 - DNA, 25 bp, S. pombe
tcaagatcctgagcgttttaccact

SEQ ID NO: 107909 - DNA, 25 bp, S. pombe
tgaggacggctttttgtatatcacg

SEQ ID NO: 107910 - DNA, 25 bp, S. pombe
tgaggaaacgtcttcgcgattctct

SEQ ID NO: 107911 - DNA, 25 bp, S. pombe
tgatcggcaactgctttcagaggat

SEQ ID NO: 107912 - DNA, 25 bp, S. pombe
tgagggcatttactttatacttgaa

SEQ ID NO: 107913 - DNA, 25 bp, S. pombe
tgatgagccttatgttagtaccgaa

SEQ ID NO: 107914 - DNA, 25 bp, S. pombe
tgaacactagaattgatttactcga

SEQ ID NO: 107915 - DNA, 25 bp, S. pombe
tgacttctcgaatttttgacccgga

SEQ ID NO: 107916 - DNA, 25 bp, S. pombe
tgactacttattatttcccaccgat

SEQ ID NO: 107917 - DNA, 25 bp, S. pombe
tgacgccctcgatgtaaccaaagct

SEQ ID NO: 107918 - DNA, 25 bp, S. pombe
tgagcgccctcgtcttaacttaaaa

SEQ ID NO: 107919 - DNA, 25 bp, S. pombe
tgactcccgagttacgtggtaccta

SEQ ID NO: 107920 - DNA, 25 bp, S. pombe
tgatccgttatttacgttggaccaa

SEQ ID NO: 107921 - DNA, 25 bp, S. pombe
tgatgactttctttatcgcttggaa

SEQ ID NO: 107922 - DNA, 25 bp, S. pombe
tgatgtctcagttttccgtatggaa

SEQ ID NO: 107923 - DNA, 25 bp, S. pombe
tgagggcagtttgagcaaccgcttt

SEQ ID NO: 107924 - DNA, 25 bp, S. pombe
tgatgagggtcttcacaccgacttt

SEQ ID NO: 107925 - DNA, 25 bp, S. pombe
tgagaaatctcattcgccttacttc

SEQ ID NO: 107926 - DNA, 25 bp, S. pombe
tgatgaatcctcttctctttacgat

SEQ ID NO: 107927 - DNA, 25 bp, S. pombe
tgatgaacctcaagtcccgcaaaat

SEQ ID NO: 107928 - DNA, 25 bp, S. pombe
tgacagcccactctcgaagcgaaaa

SEQ ID NO: 107929 - DNA, 25 bp, S. pombe
tgacggaccagctgcgaagcgcaaa

SEQ ID NO: 107930 - DNA, 25 bp, S. pombe
tgagggattcacgtcgcttgatgat

SEQ ID NO: 107931 - DNA, 25 bp, S. pombe
tgagaccatgcatcaagccttagat

SEQ ID NO: 107932 - DNA, 25 bp, S. pombe
tgatgacatattttcccgggtggag

SEQ ID NO: 107933 - DNA, 25 bp, S. pombe
tgagttgatttctgctcgatcccaa

SEQ ID NO: 107934 - DNA, 25 bp, S. pombe
tgagtcatactttatccggccacaa

SEQ ID NO: 107935 - DNA, 25 bp, S. pombe
tgagtatactttacgacaccccgaa

SEQ ID NO: 107936 - DNA, 25 bp, S. pombe
tgagaaactgtactatgaacccggt

SEQ ID NO: 107937 - DNA, 25 bp, S. pombe
tgatgacattttacgcgttcttccc

SEQ ID NO: 107938 - DNA, 25 bp, S. pombe
tgatgaacgttttcgtcctatctcc

SEQ ID NO: 107939 - DNA, 25 bp, S. pombe
tgatgcttcgtcatttaggcctaaa

SEQ ID NO: 107940 - DNA, 25 bp, S. pombe
tgaccacatttctcttttcatctgt

SEQ ID NO: 107941 - DNA, 25 bp, S. pombe
tgatccaaatcctctacttgcagtg

SEQ ID NO: 107942 - DNA, 25 bp, S. pombe
tgatccaataccttctcctattatt

SEQ ID NO: 107943 - DNA, 25 bp, S. pombe
tgacccttcttcatttcaaaacctt

SEQ ID NO: 107944 - DNA, 25 bp, S. pombe
tgacccctttttcgaacaactgaca

SEQ ID NO: 107945 - DNA, 25 bp, S. pombe
tgagccccttggttggatacacact

SEQ ID NO: 107946 - DNA, 25 bp, S. pombe
tgatgagcgtttgttgactgtcccc

SEQ ID NO: 107947 - DNA, 25 bp, S. pombe
tgatgactatttgcttacccttgcc

SEQ ID NO: 107948 - DNA, 25 bp, S. pombe
tgagagccctattttgacctttact

SEQ ID NO: 107949 - DNA, 25 bp, S. pombe
tgaggcgttgtattgaacacggctt

SEQ ID NO: 107950 - DNA, 25 bp, S. pombe
tgagccgatttatgaccgcgaggtt

SEQ ID NO: 107951 - DNA, 25 bp, S. pombe
tgactgtattaatgcccaactggtt

SEQ ID NO: 107952 - DNA, 25 bp, S. pombe
tgagtgtatttctcttacctggtct

SEQ ID NO: 107953 - DNA, 25 bp, S. pombe
tgaactcgttactttcgcatcgggc

SEQ ID NO: 107954 - DNA, 25 bp, S. pombe
tgaaaagtttgatgtcgtcgacgaa

SEQ ID NO: 107955 - DNA, 25 bp, S. pombe
tgacaaacactccttctccggtaga

SEQ ID NO: 107956 - DNA, 25 bp, S. pombe
tgagagtctctatggttcaaccgat

SEQ ID NO: 107957 - DNA, 25 bp, S. pombe
tgaaaggccgatgtctacaccgtac

SEQ ID NO: 107958 - DNA, 25 bp, S. pombe
tgatggctagagctctttcccaagg

SEQ ID NO: 107959 - DNA, 25 bp, S. pombe
tgatgagctacgataccctactgga

SEQ ID NO: 107960 - DNA, 25 bp, S. pombe
tgacattggcggttacccatgtgaa

SEQ ID NO: 107961 - DNA, 25 bp, S. pombe
tgactctgacatcttggacgcttag

SEQ ID NO: 107962 - DNA, 25 bp, S. pombe
tgagacgccttaaacgtaaaagaag

SEQ ID NO: 107963 - DNA, 25 bp, S. pombe
tgaaccggctataccctaaacaacg

SEQ ID NO: 107964 - DNA, 25 bp, S. pombe
tgaaagggccctgactccaataaca

SEQ ID NO: 107965 - DNA, 25 bp, S. pombe
tgaacgacgactcaaactgtccttc

SEQ ID NO: 107966 - DNA, 25 bp, S. pombe
tcctcaaacgctacatactctggtg

SEQ ID NO: 107967 - DNA, 25 bp, S. pombe
tccaaaagccgtacgtcgcgaaagt

SEQ ID NO: 107968 - DNA, 25 bp, S. pombe
tgagcaatggcgatgttccgaacta

SEQ ID NO: 107969 - DNA, 25 bp, S. pombe
tgacgtgaaagctttgcctgaacca

SEQ ID NO: 107970 - DNA, 25 bp, S. pombe
tgactactgaccttcaaccgattga

SEQ ID NO: 107971 - DNA, 25 bp, S. pombe
tgactactatgcttcttcaccgtat

SEQ ID NO: 107972 - DNA, 25 bp, S. pombe
tgatgtctccttacaaaccttcatg

SEQ ID NO: 107973 - DNA, 25 bp, S. pombe
tgagtccccttatacacatatctgg

SEQ ID NO: 107974 - DNA, 25 bp, S. pombe
tgagaccctacaaaagcaattctct

SEQ ID NO: 107975 - DNA, 25 bp, S. pombe
tgagcccacccgcaaaacgatatgt

SEQ ID NO: 107976 - DNA, 25 bp, S. pombe
tgacaacccgtataaaccttctcag

SEQ ID NO: 107977 - DNA, 25 bp, S. pombe
tgaaagaccctatttattccgtttg

SEQ ID NO: 107978 - DNA, 25 bp, S. pombe
tgaactaccctcagaatcccgttta

SEQ ID NO: 107979 - DNA, 25 bp, S. pombe
tgaaggaccgtttgaccgtcatgat

SEQ ID NO: 107980 - DNA, 25 bp, S. pombe
tgaagggtcctgaagccatcgaatt

SEQ ID NO: 107981 - DNA, 25 bp, S. pombe
tgacggttcccttcatttaactgtt

SEQ ID NO: 107982 - DNA, 25 bp, S. pombe
tgacgttcttttgggttctcgagta

SEQ ID NO: 107983 - DNA, 25 bp, S. pombe
tgaggttgcttttcggttgcatcat

SEQ ID NO: 107984 - DNA, 25 bp, S. pombe
tgaggtttttcccacttccaataca

SEQ ID NO: 107985 - DNA, 25 bp, S. pombe
tgatggtgttttgcccttacaacaa

SEQ ID NO: 107986 - DNA, 25 bp, S. pombe
tgagcgacaaatccaggcagccttg

SEQ ID NO: 107987 - DNA, 25 bp, S. pombe
tgagatgatgtccacgaagcacgat

SEQ ID NO: 107988 - DNA, 25 bp, S. pombe
tgagatgctttctgctcgaccattg

SEQ ID NO: 107989 - DNA, 25 bp, S. pombe
tgatgatattatccccgaccgtaat

SEQ ID NO: 107990 - DNA, 25 bp, S. pombe
tgatgatcatccttctcatttcggt

SEQ ID NO: 107991 - DNA, 25 bp, S. pombe
tgatggcctatagcactgtgggtac

SEQ ID NO: 107992 - DNA, 25 bp, S. pombe
tgatgttaatgactttgcgacctac

SEQ ID NO: 107993 - DNA, 25 bp, S. pombe
tgagcttataatgcagtttcctgat

SEQ ID NO: 107994 - DNA, 25 bp, S. pombe
tgagcaatccaagcgtcttcagtta

SEQ ID NO: 107995 - DNA, 25 bp, S. pombe
tgagaatccaaacgctactacctac

SEQ ID NO: 107996 - DNA, 25 bp, S. pombe
tgaaaaatcaccctttgcccaactg

SEQ ID NO: 107997 - DNA, 25 bp, S. pombe
taaaagttggtataggcttcaagcc

SEQ ID NO: 107998 - DNA, 25 bp, S. pombe
taaaatggaggtgaaggccccggca

SEQ ID NO: 107999 - DNA, 25 bp, S. pombe
tgactacaggacttggcacggtgca

SEQ ID NO: 108000 - DNA, 25 bp, S. pombe
tgatgtgcttgatcctgcatttgca

SEQ ID NO: 108001 - DNA, 25 bp, S. pombe
tgatggcttcaaacgcttactccga

SEQ ID NO: 108002 - DNA, 25 bp, S. pombe
tgaacttactgctgacgaacctgga

SEQ ID NO: 108003 - DNA, 25 bp, S. pombe
tgacggtactccaattcgtgactac

SEQ ID NO: 108004 - DNA, 25 bp, S. pombe
tgcaggtgctcatagttccgacaac

SEQ ID NO: 108005 - DNA, 25 bp, S. pombe
tgagttgcacatcagggccgcacaa

SEQ ID NO: 108006 - DNA, 25 bp, S. pombe
tgagaatccattcgaggtccatgaa

SEQ ID NO: 108007 - DNA, 25 bp, S. pombe
tgatgtctatttatccacctggtct

SEQ ID NO: 108008 - DNA, 25 bp, S. pombe
tgaccgtgtcatccttttcgaggga

SEQ ID NO: 108009 - DNA, 25 bp, S. pombe
tgagcacggctcttcgtatttagat

SEQ ID NO: 108010 - DNA, 25 bp, S. pombe
tgagctttgctctctgaattccaag

SEQ ID NO: 108011 - DNA, 25 bp, S. pombe
tgaggttccatagttatcatcctat

SEQ ID NO: 108012 - DNA, 25 bp, S. pombe
tgaagctactcctattaccgtcaag

SEQ ID NO: 108013 - DNA, 25 bp, S. pombe
tgagtgcttcgatatctgctcgtat

SEQ ID NO: 108014 - DNA, 25 bp, S. pombe
tgagccagctcctattgcttctgaa

SEQ ID NO: 108015 - DNA, 25 bp, S. pombe
tgagcatctcgacatcatcatggga

SEQ ID NO: 108016 - DNA, 25 bp, S. pombe
tgagttctttcacgcagttcatcat

SEQ ID NO: 108017 - DNA, 25 bp, S. pombe
tgaggtccatcctttgcattttcat

SEQ ID NO: 108018 - DNA, 25 bp, S. pombe
tgatggatcctcgtattcttggtga

SEQ ID NO: 108019 - DNA, 25 bp, S. pombe
tgatgtgttgtccattcctttgtaa

SEQ ID NO: 108020 - DNA, 25 bp, S. pombe
tgagtcttttctaccttgctgctaa

SEQ ID NO: 108021 - DNA, 25 bp, S. pombe
tgagtttcttcctccattatcatgg

SEQ ID NO: 108022 - DNA, 25 bp, S. pombe
tgacggacttgcacgatttgtttac

SEQ ID NO: 108023 - DNA, 25 bp, S. pombe
tgacggcaattcatccgcttggtat

SEQ ID NO: 108024 - DNA, 25 bp, S. pombe
tgacgaggttactcctgtggcatat

SEQ ID NO: 108025 - DNA, 25 bp, S. pombe
tgacgagcgtattcaccgcagtgaa

SEQ ID NO: 108026 - DNA, 25 bp, S. pombe
tgaggatcgtcttcgtgccattgaa

SEQ ID NO: 108027 - DNA, 25 bp, S. pombe
tgagtcacgcgtccatttgcttgaa

SEQ ID NO: 108028 - DNA, 25 bp, S. pombe
tgagtggtcggcttcaggtgcacaa

SEQ ID NO: 108029 - DNA, 25 bp, S. pombe
tgaccccgagaggagcattgcattt

SEQ ID NO: 108030 - DNA, 25 bp, S. pombe
tgacgtgagcataccagcgcttgac

SEQ ID NO: 108031 - DNA, 25 bp, S. pombe
tgagcgggcactttgctgtatactt

SEQ ID NO: 108032 - DNA, 25 bp, S. pombe
tgagcatggtccttgtacttactct

SEQ ID NO: 108033 - DNA, 25 bp, S. pombe
tgagcatattcgttgttgccataat

SEQ ID NO: 108034 - DNA, 25 bp, S. pombe
tgaggttgctatcattgcttccaag

SEQ ID NO: 108035 - DNA, 25 bp, S. pombe
tgatggcgctaaactcgttcgcgat

SEQ ID NO: 108036 - DNA, 25 bp, S. pombe
tgagagcggcaaagtcgttcctggt

SEQ ID NO: 108037 - DNA, 25 bp, S. pombe
tcacgacaattactacggcagcctt

SEQ ID NO: 108038 - DNA, 25 bp, S. pombe
tgagcgattcacctttacaccaaag

SEQ ID NO: 108039 - DNA, 25 bp, S. pombe
tgacgatattcctaccaccaaagag

SEQ ID NO: 108040 - DNA, 25 bp, S. pombe
tgagttatatccaagagccacgttt

SEQ ID NO: 108041 - DNA, 25 bp, S. pombe
tgaggaaaaaattgcgcttcagcgc

SEQ ID NO: 108042 - DNA, 25 bp, S. pombe
tgaaagatcgagtgcggcttcccaa

SEQ ID NO: 108043 - DNA, 25 bp, S. pombe
tgaaacgagtcaaccgtcttcttcg

SEQ ID NO: 108044 - DNA, 25 bp, S. pombe
tgaggacttggaccctgttgatagt

SEQ ID NO: 108045 - DNA, 25 bp, S. pombe
tgacatatctgttactcctttacct

SEQ ID NO: 108046 - DNA, 25 bp, S. pombe
tgagaagttaaatgcgcgtgacgaa

SEQ ID NO: 108047 - DNA, 25 bp, S. pombe
tgagatcattgctctcttgaccgac

SEQ ID NO: 108048 - DNA, 25 bp, S. pombe
tgagatcgatctctttggctctgac

SEQ ID NO: 108049 - DNA, 25 bp, S. pombe
tgaaccccagtgaatcagtcgtcgt

SEQ ID NO: 108050 - DNA, 25 bp, S. pombe
tgaacaaccctctcgtgttttacgt

SEQ ID NO: 108051 - DNA, 25 bp, S. pombe
tgaaaacccttatggaatccctcct

SEQ ID NO: 108052 - DNA, 25 bp, S. pombe
tgaaattcgccgtattgcccgtcat

SEQ ID NO: 108053 - DNA, 25 bp, S. pombe
taatcacttatctttactccgggag

SEQ ID NO: 108054 - DNA, 25 bp, S. pombe
tgagcgagcgtttaagcactacaaa

SEQ ID NO: 108055 - DNA, 25 bp, S. pombe
tgagcagcctgagtcttcaatgcgt

SEQ ID NO: 108056 - DNA, 25 bp, S. pombe
tgagcgcttacttgaattcttcggt

SEQ ID NO: 108057 - DNA, 25 bp, S. pombe
tgagggtcgtcttattcttgccgat

SEQ ID NO: 108058 - DNA, 25 bp, S. pombe
tgagagtgcgcgatattcgttccca

SEQ ID NO: 108059 - DNA, 25 bp, S. pombe
tgaggtctcggttttggcgtcccaa

SEQ ID NO: 108060 - DNA, 25 bp, S. pombe
tgaaattggtgttttggatccccta

SEQ ID NO: 108061 - DNA, 25 bp, S. pombe
tgaacgggttactcaatcctttgac

SEQ ID NO: 108062 - DNA, 25 bp, S. pombe
tgacaacttaactcccagttcagaa

SEQ ID NO: 108063 - DNA, 25 bp, S. pombe
tgagaacatttcaacctcgtcgtct

SEQ ID NO: 108064 - DNA, 25 bp, S. pombe
tgaccatgttagcatcttctaccac

SEQ ID NO: 108065 - DNA, 25 bp, S. pombe
tgagttttgcggttactccatccca

SEQ ID NO: 108066 - DNA, 25 bp, S. pombe
tgactttgttagttactcccctcgt

SEQ ID NO: 108067 - DNA, 25 bp, S. pombe
tgacttctattgatggtttccccgt

SEQ ID NO: 108068 - DNA, 25 bp, S. pombe
tgaaattgctttaatgccgtcccct

SEQ ID NO: 108069 - DNA, 25 bp, S. pombe
tgaagaattgctcagggaccccttt

SEQ ID NO: 108070 - DNA, 25 bp, S. pombe
tgaaggttggattagcgacccctct

SEQ ID NO: 108071 - DNA, 25 bp, S. pombe
tgagatcgatatacccacgacacct

SEQ ID NO: 108072 - DNA, 25 bp, S. pombe
tgaaagtccagcgaattcccctaat

SEQ ID NO: 108073 - DNA, 25 bp, S. pombe
tgaaaacccgaagccacctaaagca

SEQ ID NO: 108074 - DNA, 25 bp, S. pombe
tgaaaaggccgcatccgaacgacaa

SEQ ID NO: 108075 - DNA, 25 bp, S. pombe
tgaaaattgcttgcgaggaactgaa

SEQ ID NO: 108076 - DNA, 25 bp, S. pombe
tgaccaaaatcttcaaggcatcttg

SEQ ID NO: 108077 - DNA, 25 bp, S. pombe
tgaccttgtatttcagttcagaaaa

SEQ ID NO: 108078 - DNA, 25 bp, S. pombe
tgagatggtactggctcttcaacac

SEQ ID NO: 108079 - DNA, 25 bp, S. pombe
tgagcaagttgctagatcctctccc

SEQ ID NO: 108080 - DNA, 25 bp, S. pombe
tgagagtgactctgatcctcgccaa

SEQ ID NO: 108081 - DNA, 25 bp, S. pombe
tgagagctactcttggtgctcttac

SEQ ID NO: 108082 - DNA, 25 bp, S. pombe
tgagaagacttccatcaccatcagt

SEQ ID NO: 108083 - DNA, 25 bp, S. pombe
tgcgcaaaatgctcgaactttcgcg

SEQ ID NO: 108084 - DNA, 25 bp, S. pombe
tgagcagtagcctcgaactttctgt

SEQ ID NO: 108085 - DNA, 25 bp, S. pombe
tgagcgtattgtgcctgacgtgcca

SEQ ID NO: 108086 - DNA, 25 bp, S. pombe
tgaactgcagcgtgtatcccagtct

SEQ ID NO: 108087 - DNA, 25 bp, S. pombe
tgaaaacgttttggcctcttataag

SEQ ID NO: 108088 - DNA, 25 bp, S. pombe
tgaaaactttttgcctactccagaa

SEQ ID NO: 108089 - DNA, 25 bp, S. pombe
tgaaaacgttttccctattgagcaa

SEQ ID NO: 108090 - DNA, 25 bp, S. pombe
tgaaaacgtagatccctttgtcgat

SEQ ID NO: 108091 - DNA, 25 bp, S. pombe
tgaagaagttcccatggttcgccat

SEQ ID NO: 108092 - DNA, 25 bp, S. pombe
tgagacccctgtcattgttcaaact

SEQ ID NO: 108093 - DNA, 25 bp, S. pombe
tgagcccctttctatttttgtcaat

SEQ ID NO: 108094 - DNA, 25 bp, S. pombe
tgaaggccatgtttcagaaagtgat

SEQ ID NO: 108095 - DNA, 25 bp, S. pombe
tgagactctgactttcccaaatgat

SEQ ID NO: 108096 - DNA, 25 bp, S. pombe
tgagaccaatatttccgcaacatcg

SEQ ID NO: 108097 - DNA, 25 bp, S. pombe
tgaactttccaagcaagaccgtttt

SEQ ID NO: 108098 - DNA, 25 bp, S. pombe
tgacctgatgacttcgcgagctgat

SEQ ID NO: 108099 - DNA, 25 bp, S. pombe
tgagcgtagctctgctgctgatgct

SEQ ID NO: 108100 - DNA, 25 bp, S. pombe
tgaaatttccttccgattatcctct

SEQ ID NO: 108101 - DNA, 25 bp, S. pombe
tgaagagcccgtcttgtatgttcgc

SEQ ID NO: 108102 - DNA, 25 bp, S. pombe
tgaaggtccgactttgttgtcttta

SEQ ID NO: 108103 - DNA, 25 bp, S. pombe
tgactcccataccttttactggatt

SEQ ID NO: 108104 - DNA, 25 bp, S. pombe
tgactcaagcatcgctctttcagag

SEQ ID NO: 108105 - DNA, 25 bp, S. pombe
tgaccaaccgcttgcttcagaggaa

SEQ ID NO: 108106 - DNA, 25 bp, S. pombe
tgagcttaccgaggccatcgaggat

SEQ ID NO: 108107 - DNA, 25 bp, S. pombe
tgagcttaccaaggccatcactgaa

SEQ ID NO: 108108 - DNA, 25 bp, S. pombe
tgacattagcagtaagcctccggca

SEQ ID NO: 108109 - DNA, 25 bp, S. pombe
tgactatgctaagctgcctcccaaa

SEQ ID NO: 108110 - DNA, 25 bp, S. pombe
tgactatgatttgcgtcctcatcac

SEQ ID NO: 108111 - DNA, 25 bp, S. pombe
tgaatgcggctcaatgggcgacttt

SEQ ID NO: 108112 - DNA, 25 bp, S. pombe
tgaatgcaactcaaggtcgtcccat

SEQ ID NO: 108113 - DNA, 25 bp, S. pombe
tgaattaaacaagtctcctaccgtt

SEQ ID NO: 108114 - DNA, 25 bp, S. pombe
tgaaatgcccaaaccacgtaccagt

SEQ ID NO: 108115 - DNA, 25 bp, S. pombe
tgaaaaccaagcacagccttccatt

SEQ ID NO: 108116 - DNA, 25 bp, S. pombe
tgaagaactcgacaacggctcctat

SEQ ID NO: 108117 - DNA, 25 bp, S. pombe
tgagactcccatcaaagtgaccaaa

SEQ ID NO: 108118 - DNA, 25 bp, S. pombe
tgagcctcccatgaaagtcaccaat

SEQ ID NO: 108119 - DNA, 25 bp, S. pombe
tgaccatccgctctgacagcaatta

SEQ ID NO: 108120 - DNA, 25 bp, S. pombe
tgaccagcccatcgtggaggttgaa

SEQ ID NO: 108121 - DNA, 25 bp, S. pombe
tgagcacgttgagaccacactcgat

SEQ ID NO: 108122 - DNA, 25 bp, S. pombe
tgagctcgctgaaaactgccctcga

SEQ ID NO: 108123 - DNA, 25 bp, S. pombe
tgactggtgcatacaaatcccctga

SEQ ID NO: 108124 - DNA, 25 bp, S. pombe
tgacttgggctctcatttgatcgat

SEQ ID NO: 108125 - DNA, 25 bp, S. pombe
tgaccggcactcaacagtctgacaa

SEQ ID NO: 108126 - DNA, 25 bp, S. pombe
tgaactacgatttttatcccgctca

SEQ ID NO: 108127 - DNA, 25 bp, S. pombe
tgaagaatcctccttggatccggat

SEQ ID NO: 108128 - DNA, 25 bp, S. pombe
tgaaggtaccacagggtcccatcaa

SEQ ID NO: 108129 - DNA, 25 bp, S. pombe
tgaacttctttatttagccccaaag

SEQ ID NO: 108130 - DNA, 25 bp, S. pombe
tgaagccctttgtgctgaatcccaa

SEQ ID NO: 108131 - DNA, 25 bp, S. pombe
tgacgaaccttggagctcttgagct

SEQ ID NO: 108132 - DNA, 25 bp, S. pombe
tgacaagactcatcatgcattccct

SEQ ID NO: 108133 - DNA, 25 bp, S. pombe
tgacctcaataacctcatcactgat

SEQ ID NO: 108134 - DNA, 25 bp, S. pombe
tgaaatgcctctcggtaagccttat

SEQ ID NO: 108135 - DNA, 25 bp, S. pombe
tgcaacttcaattttccctaaacgt

SEQ ID NO: 108136 - DNA, 25 bp, S. pombe
tgaaccgacttcatctgttgacgtg

SEQ ID NO: 108137 - DNA, 25 bp, S. pombe
tgaccgctaacgatcttacaccaaa

SEQ ID NO: 108138 - DNA, 25 bp, S. pombe
tgaacctattcaatctcggacccga

SEQ ID NO: 108139 - DNA, 25 bp, S. pombe
tgaacactcatatttggcgtcaccc

SEQ ID NO: 108140 - DNA, 25 bp, S. pombe
tgagcaacctgcttctttgaatggt

SEQ ID NO: 108141 - DNA, 25 bp, S. pombe
tgactaactcccaagctgaatgcgt

SEQ ID NO: 108142 - DNA, 25 bp, S. pombe
tgacgagcctaccaactatcttgat

SEQ ID NO: 108143 - DNA, 25 bp, S. pombe
tgacaaggtccttagctctctttaa

SEQ ID NO: 108144 - DNA, 25 bp, S. pombe
tgacaccttccttatccactaataa

SEQ ID NO: 108145 - DNA, 25 bp, S. pombe
tgagcaattggtttcacgccttcaa

SEQ ID NO: 108146 - DNA, 25 bp, S. pombe
tgagaaggttctcattgccgctcac

SEQ ID NO: 108147 - DNA, 25 bp, S. pombe
tgaacgagctttgcaaattccctaa

SEQ ID NO: 108148 - DNA, 25 bp, S. pombe
tgaatatgtcgtccctttacaaggc

SEQ ID NO: 108149 - DNA, 25 bp, S. pombe
tgaatgggctatcgcctttcaaatt

SEQ ID NO: 108150 - DNA, 25 bp, S. pombe
tgaaagcgcttgagcttccgacatt

SEQ ID NO: 108151 - DNA, 25 bp, S. pombe
tgaaaccacaatactgaccgaccta

SEQ ID NO: 108152 - DNA, 25 bp, S. pombe
tgaaaatagccgtgcctggtggttt

SEQ ID NO: 108153 - DNA, 25 bp, S. pombe
tgaacaatcacaaaccttaaccctc

SEQ ID NO: 108154 - DNA, 25 bp, S. pombe
tgaataactctcctaactccaagtc

SEQ ID NO: 108155 - DNA, 25 bp, S. pombe
tgaaactttggaaacagcgccggcc

SEQ ID NO: 108156 - DNA, 25 bp, S. pombe
tgaaactttagatagctggcgcgac

SEQ ID NO: 108157 - DNA, 25 bp, S. pombe
tgaacctttagagtacgcctcatcc

SEQ ID NO: 108158 - DNA, 25 bp, S. pombe
tgaacctttaacaatcgctactccg

SEQ ID NO: 108159 - DNA, 25 bp, S. pombe
tgacacctgtcaatactgttctcac

SEQ ID NO: 108160 - DNA, 25 bp, S. pombe
tgaacgttttgctcccaatgctaat

SEQ ID NO: 108161 - DNA, 25 bp, S. pombe
tgcaacgttttggaacctttggaca

SEQ ID NO: 108162 - DNA, 25 bp, S. pombe
tgaacagatttagtacaccttttgt

SEQ ID NO: 108163 - DNA, 25 bp, S. pombe
tgaaccagttgagatcccagatagt

SEQ ID NO: 108164 - DNA, 25 bp, S. pombe
tgaagccgccgttagcgcattataa

SEQ ID NO: 108165 - DNA, 25 bp, S. pombe
tgaaccgccgcgtgagaattacgtt

SEQ ID NO: 108166 - DNA, 25 bp, S. pombe
tgaaacttccgctgcttactacagt

SEQ ID NO: 108167 - DNA, 25 bp, S. pombe
tgaaaatcctcctgcatatcctaag

SEQ ID NO: 108168 - DNA, 25 bp, S. pombe
tgaaagctcggatccacaagggtat

SEQ ID NO: 108169 - DNA, 25 bp, S. pombe
tgaccactgttgatcctaagctcga

SEQ ID NO: 108170 - DNA, 25 bp, S. pombe
tgaaccatgttcgtttatcaccgcc

SEQ ID NO: 108171 - DNA, 25 bp, S. pombe
tgaaactggtcttttagccggcgaa

SEQ ID NO: 108172 - DNA, 25 bp, S. pombe
tgaaacacatcgcttttgccttgga

SEQ ID NO: 108173 - DNA, 25 bp, S. pombe
tgacaaaatcgtttctagccccaat

SEQ ID NO: 108174 - DNA, 25 bp, S. pombe
tgagccaagcatgtttcgatcccaa

SEQ ID NO: 108175 - DNA, 25 bp, S. pombe
tgagcgacgatgttctttctcccaa

SEQ ID NO: 108176 - DNA, 25 bp, S. pombe
tgacaacgagcttctattcagcctc

SEQ ID NO: 108177 - DNA, 25 bp, S. pombe
tgaaacgaacacattcaccccatac

SEQ ID NO: 108178 - DNA, 25 bp, S. pombe
tgaaaacggttttccaatcgcctgc

SEQ ID NO: 108179 - DNA, 25 bp, S. pombe
tgaaaacaaattctgccctgctggg

SEQ ID NO: 108180 - DNA, 25 bp, S. pombe
tgaactgatctcttccaacgacgga

SEQ ID NO: 108181 - DNA, 25 bp, S. pombe
tgaaatgcctttccccgaaaactgg

SEQ ID NO: 108182 - DNA, 25 bp, S. pombe
tgaagatttgttgcctcctaataag

SEQ ID NO: 108183 - DNA, 25 bp, S. pombe
tgaaagattcctcgcttggttgtgc

SEQ ID NO: 108184 - DNA, 25 bp, S. pombe
tgaaagttgctctcttacagctgcc

SEQ ID NO: 108185 - DNA, 25 bp, S. pombe
tgaacagttctcttgtcgatgccgc

SEQ ID NO: 108186 - DNA, 25 bp, S. pombe
tgaaaattccgtcgttcgtcagcta

SEQ ID NO: 108187 - DNA, 25 bp, S. pombe
tgaagtgaatccctctgttcgtatt

SEQ ID NO: 108188 - DNA, 25 bp, S. pombe
tgaaatgaggcccactgctattcca

SEQ ID NO: 108189 - DNA, 25 bp, S. pombe
tgaatctccaaaccctacagacatt

SEQ ID NO: 108190 - DNA, 25 bp, S. pombe
tgaccctaatataacaccgcatgat

SEQ ID NO: 108191 - DNA, 25 bp, S. pombe
tgaccttcgttctattgctctatgt

SEQ ID NO: 108192 - DNA, 25 bp, S. pombe
tgacacttccattaatttctctctc

SEQ ID NO: 108193 - DNA, 25 bp, S. pombe
tgacactcctcctttggttatctat

SEQ ID NO: 108194 - DNA, 25 bp, S. pombe
tgaaatcacctctgacaagctcttg

SEQ ID NO: 108195 - DNA, 25 bp, S. pombe
tgaagatactcctgaaaagcgcgtc

SEQ ID NO: 108196 - DNA, 25 bp, S. pombe
tgaaaacactcctcaattaccggct

SEQ ID NO: 108197 - DNA, 25 bp, S. pombe
tgaaaactcttctccaaactcgtgg

SEQ ID NO: 108198 - DNA, 25 bp, S. pombe
tgaaaatccttcagccgaacttcgt

SEQ ID NO: 108199 - DNA, 25 bp, S. pombe
tgaacaacaatctgcacctaactct

SEQ ID NO: 108200 - DNA, 25 bp, S. pombe
tgaaaaatcggaacctttgcaactt

SEQ ID NO: 108201 - DNA, 25 bp, S. pombe
tgaaaagcccgatcctttgttttct

SEQ ID NO: 108202 - DNA, 25 bp, S. pombe
tcgaaacctcgccaactgtttttca

SEQ ID NO: 108203 - DNA, 25 bp, S. pombe
tcggcatacaccagggcttttttaa

SEQ ID NO: 108204 - DNA, 25 bp, S. pombe
ttggatggcttttgggccctagtat

SEQ ID NO: 108205 - DNA, 25 bp, S. pombe
tgcttatacgcttcaagggcacgag

SEQ ID NO: 108206 - DNA, 25 bp, S. pombe
tatggaacgctatatggatgcttgg

SEQ ID NO: 108207 - DNA, 25 bp, S. pombe
tgacgttccttcagctgagcatgtt

SEQ ID NO: 108208 - DNA, 25 bp, S. pombe
tgacaagtgtgctcatcctgactat

SEQ ID NO: 108209 - DNA, 25 bp, S. pombe
tgacgatttaactgatcctgctcct

SEQ ID NO: 108210 - DNA, 25 bp, S. pombe
tgaagaaacaactgatgccctcgcc

SEQ ID NO: 108211 - DNA, 25 bp, S. pombe
tgaagaaactcttttcgcctacctc

SEQ ID NO: 108212 - DNA, 25 bp, S. pombe
tgactttaatgtatcccactatggg

SEQ ID NO: 108213 - DNA, 25 bp, S. pombe
tgaatcccaatagatttcgcccatc

SEQ ID NO: 108214 - DNA, 25 bp, S. pombe
ttcacaaaaacctggacggcttcct

SEQ ID NO: 108215 - DNA, 25 bp, S. pombe
tgcaacacacatgacgtttcttggg

SEQ ID NO: 108216 - DNA, 25 bp, S. pombe
tgaagcagagctaccgttggattct

SEQ ID NO: 108217 - DNA, 25 bp, S. pombe
tgaacaatttccctttgcatggtgt

SEQ ID NO: 108218 - DNA, 25 bp, S. pombe
tgactttactgtcggccacgaggga

SEQ ID NO: 108219 - DNA, 25 bp, S. pombe
tgaatttacccggatcagcgattga

SEQ ID NO: 108220 - DNA, 25 bp, S. pombe
tgacgttacctctgccggattaaag

SEQ ID NO: 108221 - DNA, 25 bp, S. pombe
tgaaatcgcggaatccgactcatga

SEQ ID NO: 108222 - DNA, 25 bp, S. pombe
tgacattctcaccaaactcggctat

SEQ ID NO: 108223 - DNA, 25 bp, S. pombe
tgaccccatcagttatcgtgtagag

SEQ ID NO: 108224 - DNA, 25 bp, S. pombe
tgactctcccgttactgatgcaaag

SEQ ID NO: 108225 - DNA, 25 bp, S. pombe
tgacgagtttgattgcttggcagtt

SEQ ID NO: 108226 - DNA, 25 bp, S. pombe
tgacgatgtttatctctccactgaa

SEQ ID NO: 108227 - DNA, 25 bp, S. pombe
tgaacgaaggattccaccacgtcta

SEQ ID NO: 108228 - DNA, 25 bp, S. pombe
tgaccgagaaaaccaggccgctgat

SEQ ID NO: 108229 - DNA, 25 bp, S. pombe
tgacacgcaacttttctatcgctga

SEQ ID NO: 108230 - DNA, 25 bp, S. pombe
tgacactgcatccttttctattcga

SEQ ID NO: 108231 - DNA, 25 bp, S. pombe
tgacactatggcattggctcctcaa

SEQ ID NO: 108232 - DNA, 25 bp, S. pombe
tgacacttgatcatgtttcgccttc

SEQ ID NO: 108233 - DNA, 25 bp, S. pombe
tgctgagtttctatgattcccgtac

SEQ ID NO: 108234 - DNA, 25 bp, S. pombe
tgaagtgtttcaaactcgccgtcgt

SEQ ID NO: 108235 - DNA, 25 bp, S. pombe
tgaatctcaagtaaccggccagtat

SEQ ID NO: 108236 - DNA, 25 bp, S. pombe
tgacttatgctcatttgtgccaaaa

SEQ ID NO: 108237 - DNA, 25 bp, S. pombe
tgactcgaccgtatatgaacagcaa

SEQ ID NO: 108238 - DNA, 25 bp, S. pombe
tgaagatctgttcagcattaaataa

SEQ ID NO: 108239 - DNA, 25 bp, S. pombe
tgaatctgcgttcagcttcgagtaa

SEQ ID NO: 108240 - DNA, 25 bp, S. pombe
tgacgccgctccttcaagtggtgaa

SEQ ID NO: 108241 - DNA, 25 bp, S. pombe
tgacgcgcttcctcaaatagatgaa

SEQ ID NO: 108242 - DNA, 25 bp, S. pombe
tgacttcctctctctcaaatgatag

SEQ ID NO: 108243 - DNA, 25 bp, S. pombe
tgacaagcttcccaaaggtgatgtt

SEQ ID NO: 108244 - DNA, 25 bp, S. pombe
tgaaggtctccctaatggctgggtc

SEQ ID NO: 108245 - DNA, 25 bp, S. pombe
tgactttgaccccaagcgctggaat

SEQ ID NO: 108246 - DNA, 25 bp, S. pombe
tgacagattcgtacgcaccttgaaa

SEQ ID NO: 108247 - DNA, 25 bp, S. pombe
tgaaggacgtcgacaatgctcccgt

SEQ ID NO: 108248 - DNA, 25 bp, S. pombe
tgaaatatctatcccgcactatcaa

SEQ ID NO: 108249 - DNA, 25 bp, S. pombe
tgcaaatccctaatcgcactactag

SEQ ID NO: 108250 - DNA, 25 bp, S. pombe
tgaaatgctccctcagcttaagggc

SEQ ID NO: 108251 - DNA, 25 bp, S. pombe
tgaagagtctcccaagcctgacgaa

SEQ ID NO: 108252 - DNA, 25 bp, S. pombe
tgaagcctttaccaaaactccaact

SEQ ID NO: 108253 - DNA, 25 bp, S. pombe
tgaacttgatgcgattaaccctaat

SEQ ID NO: 108254 - DNA, 25 bp, S. pombe
tgaaattgcattatcaccacctcca

SEQ ID NO: 108255 - DNA, 25 bp, S. pombe
tgaaattatttcttccagcaccaat

SEQ ID NO: 108256 - DNA, 25 bp, S. pombe
tgaaaactcaattccaagcccattg

SEQ ID NO: 108257 - DNA, 25 bp, S. pombe
tgaaaactgcattccactggtggct

SEQ ID NO: 108258 - DNA, 25 bp, S. pombe
tgaacaaccttctcggcagcagatt

SEQ ID NO: 108259 - DNA, 25 bp, S. pombe
tgaaaacatgtttgcctgcgagaat

SEQ ID NO: 108260 - DNA, 25 bp, S. pombe
tgaaatatgcagttgctcccggttt

SEQ ID NO: 108261 - DNA, 25 bp, S. pombe
tgaacgtactggttgcatgcattac

SEQ ID NO: 108262 - DNA, 25 bp, S. pombe
tgaaacaagtctccgactcttctga

SEQ ID NO: 108263 - DNA, 25 bp, S. pombe
tgaacgatagtcctcaaacttctga

SEQ ID NO: 108264 - DNA, 25 bp, S. pombe
tgaacgatggtgctagcgctcttgt

SEQ ID NO: 108265 - DNA, 25 bp, S. pombe
tgacacacctatctactgcattgag

SEQ ID NO: 108266 - DNA, 25 bp, S. pombe
tgactcactctgtagatcctgttga

SEQ ID NO: 108267 - DNA, 25 bp, S. pombe
tgactcgtctcaagcattgctggtg

SEQ ID NO: 108268 - DNA, 25 bp, S. pombe
tgacactgtcttagcatctggttct

SEQ ID NO: 108269 - DNA, 25 bp, S. pombe
tgaagctgtgttagttgcgcctgac

SEQ ID NO: 108270 - DNA, 25 bp, S. pombe
tgaaggtttattagaggccccgacg

SEQ ID NO: 108271 - DNA, 25 bp, S. pombe
tgaaggatttgtctttacccgtact

SEQ ID NO: 108272 - DNA, 25 bp, S. pombe
tgaagcgtgctgtcgacaacggcaa

SEQ ID NO: 108273 - DNA, 25 bp, S. pombe
tgaaattcgccgacaacgtgcatct

SEQ ID NO: 108274 - DNA, 25 bp, S. pombe
tgaacatagccttgtctggcgtcat

SEQ ID NO: 108275 - DNA, 25 bp, S. pombe
tgcaaaagcctcctcgaagacgtta

SEQ ID NO: 108276 - DNA, 25 bp, S. pombe
tgaaaagactactgataccgatgtt

SEQ ID NO: 108277 - DNA, 25 bp, S. pombe
tgaaagacctacctatcccgagtat

SEQ ID NO: 108278 - DNA, 25 bp, S. pombe
tgaaaccttctcagtgtacaccttt

SEQ ID NO: 108279 - DNA, 25 bp, S. pombe
tgaagaacctgtttctgaacccacc

SEQ ID NO: 108280 - DNA, 25 bp, S. pombe
tgaaaactcttaccttacccataca

SEQ ID NO: 108281 - DNA, 25 bp, S. pombe
tccggataagtaccttgtctccact

SEQ ID NO: 108282 - DNA, 25 bp, S. pombe
tgaaaccaattcttcctacggacta

SEQ ID NO: 108283 - DNA, 25 bp, S. pombe
tgaaactgttttgactggccccgat

SEQ ID NO: 108284 - DNA, 25 bp, S. pombe
tgaaagcttatttccacggcgcttc

SEQ ID NO: 108285 - DNA, 25 bp, S. pombe
tgaaggctactttttgcccgttaga

SEQ ID NO: 108286 - DNA, 25 bp, S. pombe
tgaaggtagcttatctcgtccattt

SEQ ID NO: 108287 - DNA, 25 bp, S. pombe
tgaagagtggtcaattccgtccctt

SEQ ID NO: 108288 - DNA, 25 bp, S. pombe
taatgagggcgcaaaccggcctgga

SEQ ID NO: 108289 - DNA, 25 bp, S. pombe
tgaaggtgcgagtcgaccaggccat

SEQ ID NO: 108290 - DNA, 25 bp, S. pombe
tgacattgtagaaactccctccacg

SEQ ID NO: 108291 - DNA, 25 bp, S. pombe
tgaaattaacaactccatctcccga

SEQ ID NO: 108292 - DNA, 25 bp, S. pombe
tgaagtaatacatccctctgtgccg

SEQ ID NO: 108293 - DNA, 25 bp, S. pombe
tgaagatcaatcaacaccccgacga

SEQ ID NO: 108294 - DNA, 25 bp, S. pombe
tgaaacttgaaagccgcgactggat

SEQ ID NO: 108295 - DNA, 25 bp, S. pombe
tgaatgatcttgtaatgcccgaaat

SEQ ID NO: 108296 - DNA, 25 bp, S. pombe
tgaaatgcctgttaacccaaatttt

SEQ ID NO: 108297 - DNA, 25 bp, S. pombe
tgaatatgcggtgaactcaatcctt

SEQ ID NO: 108298 - DNA, 25 bp, S. pombe
tgacaatggtgttttatccctccat

SEQ ID NO: 108299 - DNA, 25 bp, S. pombe
tgacattgttgctgttgacgcttcc

SEQ ID NO: 108300 - DNA, 25 bp, S. pombe
tgaataatttgctcaaccgcggcgg

SEQ ID NO: 108301 - DNA, 25 bp, S. pombe
tgacaatctttatcacgccggtgct

SEQ ID NO: 108302 - DNA, 25 bp, S. pombe
tgaaacttctgttatcccagcttct

SEQ ID NO: 108303 - DNA, 25 bp, S. pombe
tgaaagcttctttaaccagcctcgt

SEQ ID NO: 108304 - DNA, 25 bp, S. pombe
tgaagtttcatttacctcctatcct

SEQ ID NO: 108305 - DNA, 25 bp, S. pombe
tgacattcattcaccagcacttgta

SEQ ID NO: 108306 - DNA, 25 bp, S. pombe
tgaaaagtcttctacgtccaccact

SEQ ID NO: 108307 - DNA, 25 bp, S. pombe
tcatcaaacgttcaaacacccactg

SEQ ID NO: 108308 - DNA, 25 bp, S. pombe
tgaaaagccttctgaacagctccct

SEQ ID NO: 108309 - DNA, 25 bp, S. pombe
tgaagaagattttcccgcacttcct

SEQ ID NO: 108310 - DNA, 25 bp, S. pombe
tgaaaagtcttatccatctcttccc

SEQ ID NO: 108311 - DNA, 25 bp, S. pombe
tgaagtgtgatcctaacgccttttc

SEQ ID NO: 108312 - DNA, 25 bp, S. pombe
tgaagacaaccaccatattaattat

SEQ ID NO: 108313 - DNA, 25 bp, S. pombe
tgaaaggccacattgctcttgcaaa

SEQ ID NO: 108314 - DNA, 25 bp, S. pombe
tgacaacccaagatgctgctgctaa

SEQ ID NO: 108315 - DNA, 25 bp, S. pombe
tgaacgtgccacgaaactcagtgaa

SEQ ID NO: 108316 - DNA, 25 bp, S. pombe
tgaagtccaaggcaactctgcggct

SEQ ID NO: 108317 - DNA, 25 bp, S. pombe
tgcttatgaatatgcccacttcctc

SEQ ID NO: 108318 - DNA, 25 bp, S. pombe
tgaaatctttactgcgtttgacgaa

SEQ ID NO: 108319 - DNA, 25 bp, S. pombe
tgaattttccagtacgttctccgga

SEQ ID NO: 108320 - DNA, 25 bp, S. pombe
tgaagttcccactactagttccgta

SEQ ID NO: 108321 - DNA, 25 bp, S. pombe
tgaaatgtttccaacttttcgcgtt

SEQ ID NO: 108322 - DNA, 25 bp, S. pombe
tgaaaactccgaactttccgctgat

SEQ ID NO: 108323 - DNA, 25 bp, S. pombe
tgaaagccacttaacgttccgtgaa

SEQ ID NO: 108324 - DNA, 25 bp, S. pombe
tgcagccccacctttaagtgtgatt

SEQ ID NO: 108325 - DNA, 25 bp, S. pombe
tgaagccttacccagagaaccgtta

SEQ ID NO: 108326 - DNA, 25 bp, S. pombe
tgaagctgatcaagatgtcgacctt

SEQ ID NO: 108327 - DNA, 25 bp, S. pombe
tgaagagcaaatggcccagcgctat

SEQ ID NO: 108328 - DNA, 25 bp, S. pombe
tgaagactccactcgtattggtagt

SEQ ID NO: 108329 - DNA, 25 bp, S. pombe
tccaatccttcctgcaatttgtatg

SEQ ID NO: 108330 - DNA, 25 bp, S. pombe
tcctactactcctcagatttacatt

SEQ ID NO: 108331 - DNA, 25 bp, S. pombe
tgcataccctacaatctttacgaac

SEQ ID NO: 108332 - DNA, 25 bp, S. pombe
tcatccggcaactgtttaaggcatt

SEQ ID NO: 108333 - DNA, 25 bp, S. pombe
tgcccgagccctttttaaaatcgca

SEQ ID NO: 108334 - DNA, 25 bp, S. pombe
tgcacctcactgtggataacactct

SEQ ID NO: 108335 - DNA, 25 bp, S. pombe
tgaaatcagccagtacataacacct

SEQ ID NO: 108336 - DNA, 25 bp, S. pombe
tgaaatgccacctcatgtaaccaga

SEQ ID NO: 108337 - DNA, 25 bp, S. pombe
tgacaagtcctcttctgttaccaaa

SEQ ID NO: 108338 - DNA, 25 bp, S. pombe
tgacaagctcttgtctttaaccaag

SEQ ID NO: 108339 - DNA, 25 bp, S. pombe
tgacactagttcgatgactcaccct

SEQ ID NO: 108340 - DNA, 25 bp, S. pombe
tgaagctggcgttgatctgcgaaaa

SEQ ID NO: 108341 - DNA, 25 bp, S. pombe
tgaattcggatcctattgccatacc

SEQ ID NO: 108342 - DNA, 25 bp, S. pombe
tgaaatgactgcctgtctagccgtt

SEQ ID NO: 108343 - DNA, 25 bp, S. pombe
tgaatcagagcgtgctccaacgtct

SEQ ID NO: 108344 - DNA, 25 bp, S. pombe
tgaatgctgatgtaaggccaaccgc

SEQ ID NO: 108345 - DNA, 25 bp, S. pombe
tgaaatgcgcccaagacatccttat

SEQ ID NO: 108346 - DNA, 25 bp, S. pombe
tgaaatcggctctcaatcaattggg

SEQ ID NO: 108347 - DNA, 25 bp, S. pombe
tgaacaagttttccgccttggaggc

SEQ ID NO: 108348 - DNA, 25 bp, S. pombe
tgaacaattggcacttcctgacgac

SEQ ID NO: 108349 - DNA, 25 bp, S. pombe
tgaacttgtttccattctctctgaa

SEQ ID NO: 108350 - DNA, 25 bp, S. pombe
tgaagctattctcccaccttgtaaa

SEQ ID NO: 108351 - DNA, 25 bp, S. pombe
tgaagcaaatgcaccaccatgggaa

SEQ ID NO: 108352 - DNA, 25 bp, S. pombe
tgaagagcaacctcacactggtgaa

SEQ ID NO: 108353 - DNA, 25 bp, S. pombe
tgaagttcccattacttggcatgaa

SEQ ID NO: 108354 - DNA, 25 bp, S. pombe
tgaatcctactttgtctgactattg

SEQ ID NO: 108355 - DNA, 25 bp, S. pombe
tgaacccacaatttctcctcattta

SEQ ID NO: 108356 - DNA, 25 bp, S. pombe
tgaaggctctacctcgtcgtttaaa

SEQ ID NO: 108357 - DNA, 25 bp, S. pombe
tgaacactccccactcttttacaaa

SEQ ID NO: 108358 - DNA, 25 bp, S. pombe
tgaaacctcttcagctttcgctaaa

SEQ ID NO: 108359 - DNA, 25 bp, S. pombe
tgaaactataccctctcagtcatgc

SEQ ID NO: 108360 - DNA, 25 bp, S. pombe
tgaacgatctcttaacttgcctatg

SEQ ID NO: 108361 - DNA, 25 bp, S. pombe
tgaacgttgaacgacttcgccatat

SEQ ID NO: 108362 - DNA, 25 bp, S. pombe
tgaacttgttcagcacgcagaagat

SEQ ID NO: 108363 - DNA, 25 bp, S. pombe
tgaagctgcaaacccgagtctgaat

SEQ ID NO: 108364 - DNA, 25 bp, S. pombe
tgaaggcatcagatcaccgaccagt

SEQ ID NO: 108365 - DNA, 25 bp, S. pombe
tgaagcctgcacatctcgagagtcg

SEQ ID NO: 108366 - DNA, 25 bp, S. pombe
tgaaagctgctcatgctcgtgatgc

SEQ ID NO: 108367 - DNA, 25 bp, S. pombe
tgaacctgttacctccatatggaac

SEQ ID NO: 108368 - DNA, 25 bp, S. pombe
tgaagccttttcactgtttgatcgt

SEQ ID NO: 108369 - DNA, 25 bp, S. pombe
tgaacacatgatcgctccaggtttt

SEQ ID NO: 108370 - DNA, 25 bp, S. pombe
tgaactggacatgcctggttttcgg

SEQ ID NO: 108371 - DNA, 25 bp, S. pombe
tgaatactcatgctgttcgtgccaa

SEQ ID NO: 108372 - DNA, 25 bp, S. pombe
tgaaactcatgttccttggcatcga

SEQ ID NO: 108373 - DNA, 25 bp, S. pombe
tgaaacatctactcctcaagctatg

SEQ ID NO: 108374 - DNA, 25 bp, S. pombe
tgaaagctacaccaccatcagtttg

SEQ ID NO: 108375 - DNA, 25 bp, S. pombe
tgaagcacttctgactgttagcaca

SEQ ID NO: 108376 - DNA, 25 bp, S. pombe
tgaaccatggttgcctatcgcacaa

SEQ ID NO: 108377 - DNA, 25 bp, S. pombe
tgaaaagcttgtccctatcgctaaa

SEQ ID NO: 108378 - DNA, 25 bp, S. pombe
tgaaatgcgtatttgtcccaagact

SEQ ID NO: 108379 - DNA, 25 bp, S. pombe
tgaaccgctcattatgtgcccgagg

SEQ ID NO: 108380 - DNA, 25 bp, S. pombe
tgcaacaacgaatttgccggctgtt

SEQ ID NO: 108381 - DNA, 25 bp, S. pombe
tcaaaaaatgctcacccctgggaag

SEQ ID NO: 108382 - DNA, 25 bp, S. pombe
tgaaaaggcatcatctcctgacctg

SEQ ID NO: 108383 - DNA, 25 bp, S. pombe
tgaactttctctactacataccgga

SEQ ID NO: 108384 - DNA, 25 bp, S. pombe
tgaacttttctcctatcatttccag

SEQ ID NO: 108385 - DNA, 25 bp, S. pombe
tgaacaacttcccagcaatgcttta

SEQ ID NO: 108386 - DNA, 25 bp, S. pombe
tgaacatttgttgagagttggccaa

SEQ ID NO: 108387 - DNA, 25 bp, S. pombe
tgaatctactagtcacagctttccc

SEQ ID NO: 108388 - DNA, 25 bp, S. pombe
tgaagtcatgcctttatttccccaa

SEQ ID NO: 108389 - DNA, 25 bp, S. pombe
tgcatagacaccttaattcccatca

SEQ ID NO: 108390 - DNA, 25 bp, S. pombe
tgcaggttcctttatacccatcaga

SEQ ID NO: 108391 - DNA, 25 bp, S. pombe
tgcaggtagccgtgtctacgtgcaa

SEQ ID NO: 108392 - DNA, 25 bp, S. pombe
tgaagtactttcctctacggctgat

SEQ ID NO: 108393 - DNA, 25 bp, S. pombe
tgaaggacttatccgacctggttcg

SEQ ID NO: 108394 - DNA, 25 bp, S. pombe
tgaagacccgtggatggcctgagac

SEQ ID NO: 108395 - DNA, 25 bp, S. pombe
tgaagaagctcgtttggccgcaaaa

SEQ ID NO: 108396 - DNA, 25 bp, S. pombe
tgaacgagctcttttgggtctacaa

SEQ ID NO: 108397 - DNA, 25 bp, S. pombe
tgaatcgcgccatgttacgtgctaa

SEQ ID NO: 108398 - DNA, 25 bp, S. pombe
tgaatccgctagttctactcctaaa

SEQ ID NO: 108399 - DNA, 25 bp, S. pombe
tgcaatccctttttcaatcctagca

SEQ ID NO: 108400 - DNA, 25 bp, S. pombe
tgaattacgacatcacacctgcgga

SEQ ID NO: 108401 - DNA, 25 bp, S. pombe
tgaatgtctttcaagtcaccgggct

SEQ ID NO: 108402 - DNA, 25 bp, S. pombe
tgaattcgttattcccaagggctct

SEQ ID NO: 108403 - DNA, 25 bp, S. pombe
tgaattctaattacccaacgacttg

SEQ ID NO: 108404 - DNA, 25 bp, S. pombe
tgaattcttcttaccaaactccttt

SEQ ID NO: 108405 - DNA, 25 bp, S. pombe
tgcacattcttttcttcgaactcca

SEQ ID NO: 108406 - DNA, 25 bp, S. pombe
tgaatacgaccccttcaagattggt

SEQ ID NO: 108407 - DNA, 25 bp, S. pombe
tgaacgcgtcgcacttaatgaggga

SEQ ID NO: 108408 - DNA, 25 bp, S. pombe
tgcacaacccgtacgaacttcaaag

SEQ ID NO: 108409 - DNA, 25 bp, S. pombe
tgaatacccgtatgtcgcaaccaag

SEQ ID NO: 108410 - DNA, 25 bp, S. pombe
tgaactcaatcctttttcaacgagg

SEQ ID NO: 108411 - DNA, 25 bp, S. pombe
tgaaccgtatcactattcccgatga

SEQ ID NO: 108412 - DNA, 25 bp, S. pombe
tgaagatcagctagcccgtctatca

SEQ ID NO: 108413 - DNA, 25 bp, S. pombe
tgaacatcgacgtttgccatcgcat

SEQ ID NO: 108414 - DNA, 25 bp, S. pombe
tgaacctgctgcgtttgatctgaga

SEQ ID NO: 108415 - DNA, 25 bp, S. pombe
tgaattctgctcttgattcctgcaa

SEQ ID NO: 108416 - DNA, 25 bp, S. pombe
tgaaggtgtcttagccggcgaacta

SEQ ID NO: 108417 - DNA, 25 bp, S. pombe
tgaagatcttcctactcccgaaaga

SEQ ID NO: 108418 - DNA, 25 bp, S. pombe
tgaatggtttcatccccaacagaac

SEQ ID NO: 108419 - DNA, 25 bp, S. pombe
tgaagactaccactattcctgcatg

SEQ ID NO: 108420 - DNA, 25 bp, S. pombe
tgaagacattgttttccccactgag

SEQ ID NO: 108421 - DNA, 25 bp, S. pombe
tgaaaagcatgttactcacccctat

SEQ ID NO: 108422 - DNA, 25 bp, S. pombe
tgaagtcatcaatatctctcgccgc

SEQ ID NO: 108423 - DNA, 25 bp, S. pombe
tgaacgccgctcgtaagcttcgcaa

SEQ ID NO: 108424 - DNA, 25 bp, S. pombe
tgaaggctaatggtcttgctcccga

SEQ ID NO: 108425 - DNA, 25 bp, S. pombe
tgaatcttaatcgtgctatgtctcc

SEQ ID NO: 108426 - DNA, 25 bp, S. pombe
tgaatgtccagtttgctatgctcct

SEQ ID NO: 108427 - DNA, 25 bp, S. pombe
tgaaggctcttaatgctcgtcctat

SEQ ID NO: 108428 - DNA, 25 bp, S. pombe
tgaagtggcttcatgtcgtggtctt

SEQ ID NO: 108429 - DNA, 25 bp, S. pombe
tgaagtccttttactgggtctttgg

SEQ ID NO: 108430 - DNA, 25 bp, S. pombe
tgaagctatttccatttctgttgca

SEQ ID NO: 108431 - DNA, 25 bp, S. pombe
tgaagatactggtgcgtctgtcgct

SEQ ID NO: 108432 - DNA, 25 bp, S. pombe
tgaaaagagctttgcttttttacct

SEQ ID NO: 108433 - DNA, 25 bp, S. pombe
tgaagaatcctttgtggcgtcctac

SEQ ID NO: 108434 - DNA, 25 bp, S. pombe
tgaaggcaggccatggacataccaa

SEQ ID NO: 108435 - DNA, 25 bp, S. pombe
tgaaccaacctaactacgccaattt

SEQ ID NO: 108436 - DNA, 25 bp, S. pombe
tcgaaaccgctaaatttgccgatta

SEQ ID NO: 108437 - DNA, 25 bp, S. pombe
tgcgttactctccaaatttcctatt

SEQ ID NO: 108438 - DNA, 25 bp, S. pombe
tgcttctacccttacaagaccagtt

SEQ ID NO: 108439 - DNA, 25 bp, S. pombe
tgcgttcacgtttggtaccttacca

SEQ ID NO: 108440 - DNA, 25 bp, S. pombe
ttttccggtacctcttgtattatgg

SEQ ID NO: 108441 - DNA, 25 bp, S. pombe
tgctttgcctccattaactgacgtt

SEQ ID NO: 108442 - DNA, 25 bp, S. pombe
tgctatgagcatttttggaccagtc

SEQ ID NO: 108443 - DNA, 25 bp, S. pombe
tgctaaaacttttggctcttctctc

SEQ ID NO: 108444 - DNA, 25 bp, S. pombe
tgctgtagggcctgaatcggaacct

SEQ ID NO: 108445 - DNA, 25 bp, S. pombe
tgctgttgcttctgtcctgggacat

SEQ ID NO: 108446 - DNA, 25 bp, S. pombe
tgctatttccggcttggcgaattct

SEQ ID NO: 108447 - DNA, 25 bp, S. pombe
tgcttttataggcttcacgctgttc

SEQ ID NO: 108448 - DNA, 25 bp, S. pombe
tgcttctgctgatgctggttaccgc

SEQ ID NO: 108449 - DNA, 25 bp, S. pombe
tgctattgctaattttcgctctcgt

SEQ ID NO: 108450 - DNA, 25 bp, S. pombe
tgctggtggaaagatccttggcttc

SEQ ID NO: 108451 - DNA, 25 bp, S. pombe
tgcgggaaaggcatccttggcatta

SEQ ID NO: 108452 - DNA, 25 bp, S. pombe
tgcttacgaatgtccggattgccaa

SEQ ID NO: 108453 - DNA, 25 bp, S. pombe
tgcaaataatataccggaaccaatg

SEQ ID NO: 108454 - DNA, 25 bp, S. pombe
tgccgataaaaccttgactgccagt

SEQ ID NO: 108455 - DNA, 25 bp, S. pombe
tgcagaccatgctcatcggaaaaca

SEQ ID NO: 108456 - DNA, 25 bp, S. pombe
tgcatgtctcatggatcacgcttac

SEQ ID NO: 108457 - DNA, 25 bp, S. pombe
tgaactagccatgcgattatcactc

SEQ ID NO: 108458 - DNA, 25 bp, S. pombe
tgcaccaaaacctgtcactacattg

SEQ ID NO: 108459 - DNA, 25 bp, S. pombe
tcccttacgactctccgattacaaa

SEQ ID NO: 108460 - DNA, 25 bp, S. pombe
tccagttcgaccgttcaaaggcaaa

SEQ ID NO: 108461 - DNA, 25 bp, S. pombe
tcggtcctacccttgtaaagcaaag

SEQ ID NO: 108462 - DNA, 25 bp, S. pombe
tgctttcttcccatttaaccaatct

SEQ ID NO: 108463 - DNA, 25 bp, S. pombe
tcgtttggcgaaccgatctttacaa

SEQ ID NO: 108464 - DNA, 25 bp, S. pombe
tgcacagtggcttggaattctctca

SEQ ID NO: 108465 - DNA, 25 bp, S. pombe
tgcactattctacgctggcgactgt

SEQ ID NO: 108466 - DNA, 25 bp, S. pombe
tgctccactggtcgagtttcaagga

SEQ ID NO: 108467 - DNA, 25 bp, S. pombe
tgcatccgttggtactttagcgaca

SEQ ID NO: 108468 - DNA, 25 bp, S. pombe
tgcagccggtggaacctacgcaaga

SEQ ID NO: 108469 - DNA, 25 bp, S. pombe
tgaaccttgtgtgggcttgcatata

SEQ ID NO: 108470 - DNA, 25 bp, S. pombe
tgcagaggtttgtccagttgataca

SEQ ID NO: 108471 - DNA, 25 bp, S. pombe
tgctgacgacttccgatattatctg

SEQ ID NO: 108472 - DNA, 25 bp, S. pombe
tgctgaagacaaccccatagtgcgt

SEQ ID NO: 108473 - DNA, 25 bp, S. pombe
tgctatgcgtactgtcttcagacgt

SEQ ID NO: 108474 - DNA, 25 bp, S. pombe
tgcttctttaccaatgcgtacttcg

SEQ ID NO: 108475 - DNA, 25 bp, S. pombe
tgcgttattaccatgcgacttctaa

SEQ ID NO: 108476 - DNA, 25 bp, S. pombe
tgcatttacgctttggacagtctcc

SEQ ID NO: 108477 - DNA, 25 bp, S. pombe
tgcatttccgcctttgacagacgaa

SEQ ID NO: 108478 - DNA, 25 bp, S. pombe
tctccgtggacgttgattttgcagc

SEQ ID NO: 108479 - DNA, 25 bp, S. pombe
tcctcctcaacacaaagacacgtat

SEQ ID NO: 108480 - DNA, 25 bp, S. pombe
tcgatcaccgtcctaaagaccgtaa

SEQ ID NO: 108481 - DNA, 25 bp, S. pombe
tgcgttgtctacgaaatgggcggac

SEQ ID NO: 108482 - DNA, 25 bp, S. pombe
tgcgctggttacgaactgggatctt

SEQ ID NO: 108483 - DNA, 25 bp, S. pombe
tcctggatacattgacacccgacat

SEQ ID NO: 108484 - DNA, 25 bp, S. pombe
tgcacttaagcatgaaccctatcct

SEQ ID NO: 108485 - DNA, 25 bp, S. pombe
tgcacctaacatttacagtatacca

SEQ ID NO: 108486 - DNA, 25 bp, S. pombe
tgaacggcactgatgcatttcgata

SEQ ID NO: 108487 - DNA, 25 bp, S. pombe
tgaacagccgcaaagtccaaagatt

SEQ ID NO: 108488 - DNA, 25 bp, S. pombe
tgaaggctccaacaccaaagtactc

SEQ ID NO: 108489 - DNA, 25 bp, S. pombe
tgaaggccccagtactgcaaatgct

SEQ ID NO: 108490 - DNA, 25 bp, S. pombe
tgaagtcgtcactcaaaatccccaa

SEQ ID NO: 108491 - DNA, 25 bp, S. pombe
tcgacgcgtaaatatactccccata

SEQ ID NO: 108492 - DNA, 25 bp, S. pombe
tgaagccgagcttgccaaaacaaat

SEQ ID NO: 108493 - DNA, 25 bp, S. pombe
tgaagagccctctaccacaaagaaa

SEQ ID NO: 108494 - DNA, 25 bp, S. pombe
tgaagtttgcacgtctaccagagaa

SEQ ID NO: 108495 - DNA, 25 bp, S. pombe
tgaatatgtctcaaccacccatggt

SEQ ID NO: 108496 - DNA, 25 bp, S. pombe
tgaagagtccccatctacagagctt

SEQ ID NO: 108497 - DNA, 25 bp, S. pombe
tgaagcaactctcgctcttgaatat

SEQ ID NO: 108498 - DNA, 25 bp, S. pombe
tgaagctctcatttgctcccattgt

SEQ ID NO: 108499 - DNA, 25 bp, S. pombe
tgccgtgtcaatccaaccttgagga

SEQ ID NO: 108500 - DNA, 25 bp, S. pombe
tccttctactgacgaccttgtggaa

SEQ ID NO: 108501 - DNA, 25 bp, S. pombe
tcctttgccaacctactggtggtaa

SEQ ID NO: 108502 - DNA, 25 bp, S. pombe
tgcatttatgcctgttacggttata

SEQ ID NO: 108503 - DNA, 25 bp, S. pombe
tgcattttcacatgttgctcgtctg

SEQ ID NO: 108504 - DNA, 25 bp, S. pombe
tgcaagggttcctagtactgccata

SEQ ID NO: 108505 - DNA, 25 bp, S. pombe
tgcaaaattcatttcgcgctcgcaa

SEQ ID NO: 108506 - DNA, 25 bp, S. pombe
tgaagactacgatgccaaccattcc

SEQ ID NO: 108507 - DNA, 25 bp, S. pombe
tgaatcaccatcagcaaacatttct

SEQ ID NO: 108508 - DNA, 25 bp, S. pombe
tgaattacattcgactgctcatttc

SEQ ID NO: 108509 - DNA, 25 bp, S. pombe
tgaatttgatttcggaacgctctaa

SEQ ID NO: 108510 - DNA, 25 bp, S. pombe
tgaagattctcttcggcgccctaaa

SEQ ID NO: 108511 - DNA, 25 bp, S. pombe
tgaagcagcttgttcaaggccctcg

SEQ ID NO: 108512 - DNA, 25 bp, S. pombe
tgaagcgcagttcattcttgcaact

SEQ ID NO: 108513 - DNA, 25 bp, S. pombe
tcgtgaagacgctaccgactcggaa

SEQ ID NO: 108514 - DNA, 25 bp, S. pombe
tccttcaatttaccgatcccaaagt

SEQ ID NO: 108515 - DNA, 25 bp, S. pombe
tgcaacagctatcacaaacccattt

SEQ ID NO: 108516 - DNA, 25 bp, S. pombe
tgaacccggtaccaggtctgtagat

SEQ ID NO: 108517 - DNA, 25 bp, S. pombe
tgaagaccggttaatgacattggct

SEQ ID NO: 108518 - DNA, 25 bp, S. pombe
tgaagatagctctgaatccgactca

SEQ ID NO: 108519 - DNA, 25 bp, S. pombe
tgaagaaagtcaacgcgctccttgc

SEQ ID NO: 108520 - DNA, 25 bp, S. pombe
tgaatactagtcactcttctcttgc

SEQ ID NO: 108521 - DNA, 25 bp, S. pombe
tgaatgactattatccctcttggga

SEQ ID NO: 108522 - DNA, 25 bp, S. pombe
tgcagtagctttcaatcccgtaggt

SEQ ID NO: 108523 - DNA, 25 bp, S. pombe
tgcttatcttctcttgaccgttggt

SEQ ID NO: 108524 - DNA, 25 bp, S. pombe
tgctaattttacttgtccgattgac

SEQ ID NO: 108525 - DNA, 25 bp, S. pombe
tgcaatggtagttcgttccgtctat

SEQ ID NO: 108526 - DNA, 25 bp, S. pombe
tgcgatggctgtaacgaggctttta

SEQ ID NO: 108527 - DNA, 25 bp, S. pombe
tgctatcgttatggcttgtgtgtcc

SEQ ID NO: 108528 - DNA, 25 bp, S. pombe
taatgctgctgaagacgattcgtcc

SEQ ID NO: 108529 - DNA, 25 bp, S. pombe
tgaatgtggtcgtcaaatcctcgcc

SEQ ID NO: 108530 - DNA, 25 bp, S. pombe
tgcaattgattctttaacccctaat

SEQ ID NO: 108531 - DNA, 25 bp, S. pombe
tgcaacctatttctacttctttcaa

SEQ ID NO: 108532 - DNA, 25 bp, S. pombe
tgaagccgctcatgcagctggtggt

SEQ ID NO: 108533 - DNA, 25 bp, S. pombe
tgcaatgcccactatcatgctggat

SEQ ID NO: 108534 - DNA, 25 bp, S. pombe
tgaagccaagcaacatctcgatctc

SEQ ID NO: 108535 - DNA, 25 bp, S. pombe
tgaagctatacacatccgactacag

SEQ ID NO: 108536 - DNA, 25 bp, S. pombe
tgcagaactacagccaccagagaat

SEQ ID NO: 108537 - DNA, 25 bp, S. pombe
tcgaaatacttccaaatcaccctta

SEQ ID NO: 108538 - DNA, 25 bp, S. pombe
tgaatcttacaaggcccagctactt

SEQ ID NO: 108539 - DNA, 25 bp, S. pombe
tgaatttgacaacgcccttattttt

SEQ ID NO: 108540 - DNA, 25 bp, S. pombe
tgaatgtcgacaagccagttttact

SEQ ID NO: 108541 - DNA, 25 bp, S. pombe
tgaagccccaaccaaggatcaagat

SEQ ID NO: 108542 - DNA, 25 bp, S. pombe
tgaatgccgctaacttgacctacag

SEQ ID NO: 108543 - DNA, 25 bp, S. pombe
tgaatacgccaagtcattagctacg

SEQ ID NO: 108544 - DNA, 25 bp, S. pombe
tgcaatagctgcaattccacgactt

SEQ ID NO: 108545 - DNA, 25 bp, S. pombe
tgcattcaccaaatcatccaactag

SEQ ID NO: 108546 - DNA, 25 bp, S. pombe
tgcatactcagctacttcgaattcg

SEQ ID NO: 108547 - DNA, 25 bp, S. pombe
tgcaagaaccaatcgacagtccacc

SEQ ID NO: 108548 - DNA, 25 bp, S. pombe
tgcacggcccttgagtatggtctac

SEQ ID NO: 108549 - DNA, 25 bp, S. pombe
tgcatcgagccgcaaccatatggta

SEQ ID NO: 108550 - DNA, 25 bp, S. pombe
tgcacgagccgttgattatttctaa

SEQ ID NO: 108551 - DNA, 25 bp, S. pombe
tgaagtcactacgatttcctcaacc

SEQ ID NO: 108552 - DNA, 25 bp, S. pombe
tgaagtatctagttttggccaacat

SEQ ID NO: 108553 - DNA, 25 bp, S. pombe
tgctattcacggaaagcgtgtaact

SEQ ID NO: 108554 - DNA, 25 bp, S. pombe
tgaagtatctttcccttattatcct

SEQ ID NO: 108555 - DNA, 25 bp, S. pombe
tacgatattctttgggtccgtggtc

SEQ ID NO: 108556 - DNA, 25 bp, S. pombe
tacttgttttaacgtccttggcttg

SEQ ID NO: 108557 - DNA, 25 bp, S. pombe
taatagccgacgaagtgaccccttt

SEQ ID NO: 108558 - DNA, 25 bp, S. pombe
tgcttaccgcccgaaaatatttgta

SEQ ID NO: 108559 - DNA, 25 bp, S. pombe
tgccaagcgtcaccgtaagatcctt

SEQ ID NO: 108560 - DNA, 25 bp, S. pombe
tgccaagcgtcaccgtaagatcctt

SEQ ID NO: 108561 - DNA, 25 bp, S. pombe
tgctaagcgtcaccgtaaaattctt

SEQ ID NO: 108562 - DNA, 25 bp, S. pombe
tgctaagcgtcaccgtaaaattctt

SEQ ID NO: 108563 - DNA, 25 bp, S. pombe
tgctgaagcgaaaccggaaatttta

SEQ ID NO: 108564 - DNA, 25 bp, S. pombe
tgctcgtgccaagtccatgaaattt

SEQ ID NO: 108565 - DNA, 25 bp, S. pombe
tgcacagcagcaggattcgagactt

SEQ ID NO: 108566 - DNA, 25 bp, S. pombe
tgcttggttctatccccttaaaaag

SEQ ID NO: 108567 - DNA, 25 bp, S. pombe
ttttgcatacggcttattacactcg

SEQ ID NO: 108568 - DNA, 25 bp, S. pombe
tcttcgaacctgatccttaacttgt

SEQ ID NO: 108569 - DNA, 25 bp, S. pombe
tgctgccaagcagacttctgattca

SEQ ID NO: 108570 - DNA, 25 bp, S. pombe
tgcacccatggatcagttttcaaca

SEQ ID NO: 108571 - DNA, 25 bp, S. pombe
tgcacccatggttcttgattctcaa

SEQ ID NO: 108572 - DNA, 25 bp, S. pombe
tgcacatccaattcctgtttccaat

SEQ ID NO: 108573 - DNA, 25 bp, S. pombe
tcacctggttcgagtacacaatgga

SEQ ID NO: 108574 - DNA, 25 bp, S. pombe
tgcacctcgtgtcctagttgagcaa

SEQ ID NO: 108575 - DNA, 25 bp, S. pombe
tgcagtcttatgaattggcggaaac

SEQ ID NO: 108576 - DNA, 25 bp, S. pombe
tctcatggtcataatctcacaggat

SEQ ID NO: 108577 - DNA, 25 bp, S. pombe
tgcacaaagtgcgacctgaggtaat

SEQ ID NO: 108578 - DNA, 25 bp, S. pombe
tgcatttttgacatcgattcgctag

SEQ ID NO: 108579 - DNA, 25 bp, S. pombe
tgcatccttaaaacaatccgctctg

SEQ ID NO: 108580 - DNA, 25 bp, S. pombe
tgcagttatcccacaatccgtgaag

SEQ ID NO: 108581 - DNA, 25 bp, S. pombe
tgcattacatcccttatcacgttga

SEQ ID NO: 108582 - DNA, 25 bp, S. pombe
tctaataccgtttcgccagtggaag

SEQ ID NO: 108583 - DNA, 25 bp, S. pombe
tgcttctagggctgccgccgaagaa

SEQ ID NO: 108584 - DNA, 25 bp, S. pombe
tgctttgcaaagctggctgcctaag

SEQ ID NO: 108585 - DNA, 25 bp, S. pombe
tgctgtcggatctactttgcctaaa

SEQ ID NO: 108586 - DNA, 25 bp, S. pombe
tgcattgggcatactcttttttgaa

SEQ ID NO: 108587 - DNA, 25 bp, S. pombe
tcctggccttactcctattgaagag

SEQ ID NO: 108588 - DNA, 25 bp, S. pombe
tgctcttactgttaccgaggttggt

SEQ ID NO: 108589 - DNA, 25 bp, S. pombe
tgaattacagccaacgtgagcgtgt

SEQ ID NO: 108590 - DNA, 25 bp, S. pombe
tgaatcgccaactctggctgctgaa

SEQ ID NO: 108591 - DNA, 25 bp, S. pombe
tgcagtggacaatcatcacgggttt

SEQ ID NO: 108592 - DNA, 25 bp, S. pombe
tgctttgatagcgacttcctgttct

SEQ ID NO: 108593 - DNA, 25 bp, S. pombe
tgcattaccggcaattgttcgtgat

SEQ ID NO: 108594 - DNA, 25 bp, S. pombe
tgcttacctgatccacttagtgctg

SEQ ID NO: 108595 - DNA, 25 bp, S. pombe
tgcttccctgactgcttatgttgat

SEQ ID NO: 108596 - DNA, 25 bp, S. pombe
tgaagacttgcacgctttagcctat

SEQ ID NO: 108597 - DNA, 25 bp, S. pombe
tgaagagcttacctctgtcatccaa

SEQ ID NO: 108598 - DNA, 25 bp, S. pombe
tgaagagcttgtttctgattcccct

SEQ ID NO: 108599 - DNA, 25 bp, S. pombe
tgcaaggcatttcattgttcccatc

SEQ ID NO: 108600 - DNA, 25 bp, S. pombe
tcctcgtttcattagaactcactcc

SEQ ID NO: 108601 - DNA, 25 bp, S. pombe
tgcggctccggacaagcaaactggt

SEQ ID NO: 108602 - DNA, 25 bp, S. pombe
tgcggccaaggccaaagagcagcct

SEQ ID NO: 108603 - DNA, 25 bp, S. pombe
tgcactgcagcatcatgagcccaaa

SEQ ID NO: 108604 - DNA, 25 bp, S. pombe
tgcattcatatcgtcagccactgaa

SEQ ID NO: 108605 - DNA, 25 bp, S. pombe
tgcatatgcattgtcccgaaggctc

SEQ ID NO: 108606 - DNA, 25 bp, S. pombe
tgaagagcgtcgtcttgcgttcatc

SEQ ID NO: 108607 - DNA, 25 bp, S. pombe
tgaagggatcttatgctgctcctca

SEQ ID NO: 108608 - DNA, 25 bp, S. pombe
tgaagggacttgtcactcctactac

SEQ ID NO: 108609 - DNA, 25 bp, S. pombe
tgcaattcctcttacatctttttag

SEQ ID NO: 108610 - DNA, 25 bp, S. pombe
tgaatcctctacttttgcttttacg

SEQ ID NO: 108611 - DNA, 25 bp, S. pombe
tgaatttcttcttgctggtgtcatt

SEQ ID NO: 108612 - DNA, 25 bp, S. pombe
tgcaacatcaattataggaggtctt

SEQ ID NO: 108613 - DNA, 25 bp, S. pombe
tgcaagcgttgcctgtgggttataa

SEQ ID NO: 108614 - DNA, 25 bp, S. pombe
tgcaacttccgccagaggttcaaag

SEQ ID NO: 108615 - DNA, 25 bp, S. pombe
tgcagaagcatcacctaaatcgtat

SEQ ID NO: 108616 - DNA, 25 bp, S. pombe
tgctttctctgcgtccgaggaggag

SEQ ID NO: 108617 - DNA, 25 bp, S. pombe
tgctttactgctaatccgaatggaa

SEQ ID NO: 108618 - DNA, 25 bp, S. pombe
tgcaattgaaccatcggatctggaa

SEQ ID NO: 108619 - DNA, 25 bp, S. pombe
tgaatccattcttcaacctcagaaa

SEQ ID NO: 108620 - DNA, 25 bp, S. pombe
tgaatgtcttcatgcaacttcctga

SEQ ID NO: 108621 - DNA, 25 bp, S. pombe
tgaattacctgttgcatctgcctac

SEQ ID NO: 108622 - DNA, 25 bp, S. pombe
tgaatatacttctgtctgcccttgg

SEQ ID NO: 108623 - DNA, 25 bp, S. pombe
tgaatatactccaggcgtgccatgc

SEQ ID NO: 108624 - DNA, 25 bp, S. pombe
tgaatgctcctatttggcttgccga

SEQ ID NO: 108625 - DNA, 25 bp, S. pombe
tgaatctcctagagtcctgggtaat

SEQ ID NO: 108626 - DNA, 25 bp, S. pombe
tcgaccctggttttcatgggctaat

SEQ ID NO: 108627 - DNA, 25 bp, S. pombe
tcccggtgatttggtcgtcgtaagc

SEQ ID NO: 108628 - DNA, 25 bp, S. pombe
tgcagtcggcattatgtccctacaa

SEQ ID NO: 108629 - DNA, 25 bp, S. pombe
tgcacctttatcatcaactgtccaa

SEQ ID NO: 108630 - DNA, 25 bp, S. pombe
tgcacctcattactttggttccgag

SEQ ID NO: 108631 - DNA, 25 bp, S. pombe
tgcaggcacctaaaatgggattcgt

SEQ ID NO: 108632 - DNA, 25 bp, S. pombe
tgctcgaccttctcaggttgaagtt

SEQ ID NO: 108633 - DNA, 25 bp, S. pombe
tgctgaagcattccccacattggga

SEQ ID NO: 108634 - DNA, 25 bp, S. pombe
tgctattgttgagccagctggccaa

SEQ ID NO: 108635 - DNA, 25 bp, S. pombe
tgcgattacgagatgcacgagctca

SEQ ID NO: 108636 - DNA, 25 bp, S. pombe
tgcatgctgctatcaattcggtgcc

SEQ ID NO: 108637 - DNA, 25 bp, S. pombe
tgcggtcacgactaattccacgaga

SEQ ID NO: 108638 - DNA, 25 bp, S. pombe
tgcaggctacgatattcgcaccgaa

SEQ ID NO: 108639 - DNA, 25 bp, S. pombe
tgcggctactttgaggatcgtcgtc

SEQ ID NO: 108640 - DNA, 25 bp, S. pombe
tgcagagaggagcttttcttcccgc

SEQ ID NO: 108641 - DNA, 25 bp, S. pombe
tgcaataatgctcttctttaccctg

SEQ ID NO: 108642 - DNA, 25 bp, S. pombe
tgcgcatgttcccattttaaacctt

SEQ ID NO: 108643 - DNA, 25 bp, S. pombe
tgcttttgccgctttagtcctttaa

SEQ ID NO: 108644 - DNA, 25 bp, S. pombe
tgctattgaggcccttcgtcgttgt

SEQ ID NO: 108645 - DNA, 25 bp, S. pombe
tgcttttatgcgcacagctcaaatg

SEQ ID NO: 108646 - DNA, 25 bp, S. pombe
tgcttctactgctgccatggcaaat

SEQ ID NO: 108647 - DNA, 25 bp, S. pombe
tgcttactggcatgctactaacggc

SEQ ID NO: 108648 - DNA, 25 bp, S. pombe
tgctttctgcgagtctttgaacggt

SEQ ID NO: 108649 - DNA, 25 bp, S. pombe
tgctttcttcctgtttagctggatg

SEQ ID NO: 108650 - DNA, 25 bp, S. pombe
tgctttctttttctttgggcggaag

SEQ ID NO: 108651 - DNA, 25 bp, S. pombe
tgcttcgcttttactttctttggat

SEQ ID NO: 108652 - DNA, 25 bp, S. pombe
tgcggcccttggagaactttgcgat

SEQ ID NO: 108653 - DNA, 25 bp, S. pombe
tgctgacgcctctgaattttacgaa

SEQ ID NO: 108654 - DNA, 25 bp, S. pombe
tgcaatgtatgccatcggtcgtgat

SEQ ID NO: 108655 - DNA, 25 bp, S. pombe
tgctattggccttctgtgcaaagat

SEQ ID NO: 108656 - DNA, 25 bp, S. pombe
tgcagttggctcgtcgtctccgtgg

SEQ ID NO: 108657 - DNA, 25 bp, S. pombe
tgcaatatatcagcaattctcgaga

SEQ ID NO: 108658 - DNA, 25 bp, S. pombe
tgcaatttgctactggtacctccag

SEQ ID NO: 108659 - DNA, 25 bp, S. pombe
tgctttgtttaatacgccacgctac

SEQ ID NO: 108660 - DNA, 25 bp, S. pombe
tgcagtttatttttgttccgggaag

SEQ ID NO: 108661 - DNA, 25 bp, S. pombe
tgcttttagcttttgttcccgagga

SEQ ID NO: 108662 - DNA, 25 bp, S. pombe
tgctgttgaagcttacgtctctact

SEQ ID NO: 108663 - DNA, 25 bp, S. pombe
tgctgcacgtagagagcgtcttcgt

SEQ ID NO: 108664 - DNA, 25 bp, S. pombe
tgcacttgcagatattcccgaactt

SEQ ID NO: 108665 - DNA, 25 bp, S. pombe
tgctacacgttggtatctcactgtt

SEQ ID NO: 108666 - DNA, 25 bp, S. pombe
tgctgatcctttgactaccatgtag

SEQ ID NO: 108667 - DNA, 25 bp, S. pombe
tgcttccattttgctacgattactc

SEQ ID NO: 108668 - DNA, 25 bp, S. pombe
tctccttcattttcttctttaccag

SEQ ID NO: 108669 - DNA, 25 bp, S. pombe
tgctccgtcgtcttttgggtgtaaa

SEQ ID NO: 108670 - DNA, 25 bp, S. pombe
tgctacgttatgttttgggttcttc

SEQ ID NO: 108671 - DNA, 25 bp, S. pombe
tgctagaattctcgctttggtacct

SEQ ID NO: 108672 - DNA, 25 bp, S. pombe
tgcaagcaatttcacgcgttcatcg

SEQ ID NO: 108673 - DNA, 25 bp, S. pombe
tgcacgaattgagcacctttcacgt

SEQ ID NO: 108674 - DNA, 25 bp, S. pombe
tgccggtctacgttgtttggtattt

SEQ ID NO: 108675 - DNA, 25 bp, S. pombe
tgcactttccagcttttattctacg

SEQ ID NO: 108676 - DNA, 25 bp, S. pombe
tgctaaccgcattggtttcctttaa

SEQ ID NO: 108677 - DNA, 25 bp, S. pombe
tgcttgccaacaacgttgacagcaa

SEQ ID NO: 108678 - DNA, 25 bp, S. pombe
tgctgttgactatcctattcccgat

SEQ ID NO: 108679 - DNA, 25 bp, S. pombe
tgctggtactacttgtgattcccgt

SEQ ID NO: 108680 - DNA, 25 bp, S. pombe
tgctttccgtacagctttcttgcaa

SEQ ID NO: 108681 - DNA, 25 bp, S. pombe
tgcttctccactcttgcaatatgag

SEQ ID NO: 108682 - DNA, 25 bp, S. pombe
tgcttcgcaagcgttgatgcactag

SEQ ID NO: 108683 - DNA, 25 bp, S. pombe
tgctaagaccgtagcgccgagtgtt

SEQ ID NO: 108684 - DNA, 25 bp, S. pombe
tgctaatggcacttaccctggtcaa

SEQ ID NO: 108685 - DNA, 25 bp, S. pombe
tgctcggaaatatccatgtccatat

SEQ ID NO: 108686 - DNA, 25 bp, S. pombe
tgctcgaaaaacacgccctgaaatt

SEQ ID NO: 108687 - DNA, 25 bp, S. pombe
tgcaatagaactgtacgcgccggtc

SEQ ID NO: 108688 - DNA, 25 bp, S. pombe
tgctaaacttccagccgcaatattt

SEQ ID NO: 108689 - DNA, 25 bp, S. pombe
tccaggaattcctcccaatattgtt

SEQ ID NO: 108690 - DNA, 25 bp, S. pombe
tgcagctcacatccatcttattaat

SEQ ID NO: 108691 - DNA, 25 bp, S. pombe
tgcatccagcggttttcaatttgtt

SEQ ID NO: 108692 - DNA, 25 bp, S. pombe
tgcactcgcaggttgagcagctatt

SEQ ID NO: 108693 - DNA, 25 bp, S. pombe
tcctcttgatgcttacgctgatgat

SEQ ID NO: 108694 - DNA, 25 bp, S. pombe
tcctttgcggtgtcgtttaaaacag

SEQ ID NO: 108695 - DNA, 25 bp, S. pombe
tcgcttacggctcagtttcggaaaa

SEQ ID NO: 108696 - DNA, 25 bp, S. pombe
tccttaccctcctgttcagatagaa

SEQ ID NO: 108697 - DNA, 25 bp, S. pombe
tgcttttcctcctcttcaaaatgat

SEQ ID NO: 108698 - DNA, 25 bp, S. pombe
tgctggattccaggcagatcttacc

SEQ ID NO: 108699 - DNA, 25 bp, S. pombe
tgctcgtctcaaaaatctctcccaa

SEQ ID NO: 108700 - DNA, 25 bp, S. pombe
tgcagcgcgttggtgaatgccgcaa

SEQ ID NO: 108701 - DNA, 25 bp, S. pombe
tgctcctcgtatcgctaaacataca

SEQ ID NO: 108702 - DNA, 25 bp, S. pombe
tgcaactattatccccaaaacttcg

SEQ ID NO: 108703 - DNA, 25 bp, S. pombe
tgcaaattgcaaaccctctcatgat

SEQ ID NO: 108704 - DNA, 25 bp, S. pombe
tgcagcagtttcttacggtcattct

SEQ ID NO: 108705 - DNA, 25 bp, S. pombe
tgcagatcctctagctcacaagaag

SEQ ID NO: 108706 - DNA, 25 bp, S. pombe
tgcagcttcttctccaagcaatatc

SEQ ID NO: 108707 - DNA, 25 bp, S. pombe
tcttgcaaatgctggctacacctga

SEQ ID NO: 108708 - DNA, 25 bp, S. pombe
tgcttctttcaacgtccttgctgac

SEQ ID NO: 108709 - DNA, 25 bp, S. pombe
tgcatcaccttcatcttccagaaga

SEQ ID NO: 108710 - DNA, 25 bp, S. pombe
tgcactggccgaaacttgctaaagt

SEQ ID NO: 108711 - DNA, 25 bp, S. pombe
tgccttgcccaagcttaaattctac

SEQ ID NO: 108712 - DNA, 25 bp, S. pombe
tgcgcttcaaacctgcttataatcc

SEQ ID NO: 108713 - DNA, 25 bp, S. pombe
tgctgctgccaaacgtgctagaggt

SEQ ID NO: 108714 - DNA, 25 bp, S. pombe
tgcactgttggcatcacttctggat

SEQ ID NO: 108715 - DNA, 25 bp, S. pombe
tgcatttgttgcaagcgctttggat

SEQ ID NO: 108716 - DNA, 25 bp, S. pombe
tgcttctatcgcacctattaaggcc

SEQ ID NO: 108717 - DNA, 25 bp, S. pombe
tgcttcccggattcattgtaaatgc

SEQ ID NO: 108718 - DNA, 25 bp, S. pombe
tgctgtcccgtctcaagtcaaagac

SEQ ID NO: 108719 - DNA, 25 bp, S. pombe
tgctgtcgccggttatgttcctgga

SEQ ID NO: 108720 - DNA, 25 bp, S. pombe
tgctgcccctggtggtgacaatggt

SEQ ID NO: 108721 - DNA, 25 bp, S. pombe
tgcaagggcctttgaccaattggtt

SEQ ID NO: 108722 - DNA, 25 bp, S. pombe
tgcggttgagcaaggtcccttttta

SEQ ID NO: 108723 - DNA, 25 bp, S. pombe
tgctcccagagttgttaccaaacgt

SEQ ID NO: 108724 - DNA, 25 bp, S. pombe
tgcatttgcttcaaaaggcccgacc

SEQ ID NO: 108725 - DNA, 25 bp, S. pombe
tgctgttcctcaaaatggtaccgcc

SEQ ID NO: 108726 - DNA, 25 bp, S. pombe
tctttactccatctagataccgacg

SEQ ID NO: 108727 - DNA, 25 bp, S. pombe
tgcatccgtccttaaatgcggcaaa

SEQ ID NO: 108728 - DNA, 25 bp, S. pombe
tgcaccgtcgcttcgaaaggctgaa

SEQ ID NO: 108729 - DNA, 25 bp, S. pombe
tgcgccgtcccaagcataaggttaa

SEQ ID NO: 108730 - DNA, 25 bp, S. pombe
tgcgcgaatgcgtaagaaagtaatt

SEQ ID NO: 108731 - DNA, 25 bp, S. pombe
tgctgacagtcccaccaaagtaatt

SEQ ID NO: 108732 - DNA, 25 bp, S. pombe
tgctgactggtcatctcaagatcgt

SEQ ID NO: 108733 - DNA, 25 bp, S. pombe
tgcaagtgttagctccagatcgtga

SEQ ID NO: 108734 - DNA, 25 bp, S. pombe
tgcagcaatttattactccaccgtt

SEQ ID NO: 108735 - DNA, 25 bp, S. pombe
tgcaacttttaaatgcagaggagtt

SEQ ID NO: 108736 - DNA, 25 bp, S. pombe
tgcacactttatccgccgagagttc

SEQ ID NO: 108737 - DNA, 25 bp, S. pombe
tgctgagttcgctccttttgtaaag

SEQ ID NO: 108738 - DNA, 25 bp, S. pombe
tgcttcttcagatcttttgtgtcat

SEQ ID NO: 108739 - DNA, 25 bp, S. pombe
tgctgtcgtcgatctagtggagtct

SEQ ID NO: 108740 - DNA, 25 bp, S. pombe
tgcttcctttacttggcagagtaca

SEQ ID NO: 108741 - DNA, 25 bp, S. pombe
tgcttggtttaatttactgctccaa

SEQ ID NO: 108742 - DNA, 25 bp, S. pombe
tgcttcgtattaaacggtctgtaca

SEQ ID NO: 108743 - DNA, 25 bp, S. pombe
tgcgtcgggcttaacaatgctcgat

SEQ ID NO: 108744 - DNA, 25 bp, S. pombe
tgcagctcttcgtcttattttccat

SEQ ID NO: 108745 - DNA, 25 bp, S. pombe
tgcagcttttataccacacaatcca

SEQ ID NO: 108746 - DNA, 25 bp, S. pombe
tgcactcgataccaatcagcttttt

SEQ ID NO: 108747 - DNA, 25 bp, S. pombe
tgcactccacaccattacatatatt

SEQ ID NO: 108748 - DNA, 25 bp, S. pombe
tgcaccctgcagtagttttatgatt

SEQ ID NO: 108749 - DNA, 25 bp, S. pombe
tcctccgactgggtacttgttaaag

SEQ ID NO: 108750 - DNA, 25 bp, S. pombe
tgctcatagcgatgtacctgcgcat

SEQ ID NO: 108751 - DNA, 25 bp, S. pombe
tgctatcgccaaatcaacatctatg

SEQ ID NO: 108752 - DNA, 25 bp, S. pombe
tgctctcatcttggccgacgagggt

SEQ ID NO: 108753 - DNA, 25 bp, S. pombe
tgctgccatgattcgtaccaagggt

SEQ ID NO: 108754 - DNA, 25 bp, S. pombe
tgcatcgtgacgttaagcctcataa

SEQ ID NO: 108755 - DNA, 25 bp, S. pombe
tgctctgcaaactcggccttaaagt

SEQ ID NO: 108756 - DNA, 25 bp, S. pombe
tgcttcaagctcttcagcgactgaa

SEQ ID NO: 108757 - DNA, 25 bp, S. pombe
tgcttgccccgattgcgacataata

SEQ ID NO: 108758 - DNA, 25 bp, S. pombe
tgctgaggctactcgtacgcaaatt

SEQ ID NO: 108759 - DNA, 25 bp, S. pombe
tgctgtagtacctgaactgcacttc

SEQ ID NO: 108760 - DNA, 25 bp, S. pombe
tgctaaataccatcagtctgcatta

SEQ ID NO: 108761 - DNA, 25 bp, S. pombe
tgctacaaccgctcgttcaaaagtt

SEQ ID NO: 108762 - DNA, 25 bp, S. pombe
tgctagcaatgccaagttaccaccg

SEQ ID NO: 108763 - DNA, 25 bp, S. pombe
tgcagagtatgcgaggtgctaccag

SEQ ID NO: 108764 - DNA, 25 bp, S. pombe
tgcggatcatgaacaggcccttttg

SEQ ID NO: 108765 - DNA, 25 bp, S. pombe
tgctgtagatgttcagtcctctgca

SEQ ID NO: 108766 - DNA, 25 bp, S. pombe
tgctgctcagcttgaaattgcgcgt

SEQ ID NO: 108767 - DNA, 25 bp, S. pombe
tgcattgtctgtgtcgatggttcgt

SEQ ID NO: 108768 - DNA, 25 bp, S. pombe
tcttatgggtgttgtttccagcctt

SEQ ID NO: 108769 - DNA, 25 bp, S. pombe
tccttggtgatgagcctttaccttt

SEQ ID NO: 108770 - DNA, 25 bp, S. pombe
tgccggtggagttggtttacttctt

SEQ ID NO: 108771 - DNA, 25 bp, S. pombe
tcgcggtatatttaagttccttcta

SEQ ID NO: 108772 - DNA, 25 bp, S. pombe
tgcgttcgactgtagaacatgtcct

SEQ ID NO: 108773 - DNA, 25 bp, S. pombe
tgcggtaactataagcctgtcaata

SEQ ID NO: 108774 - DNA, 25 bp, S. pombe
tgcggctaacattgcataccattat

SEQ ID NO: 108775 - DNA, 25 bp, S. pombe
tgcgatgtaaatccaatcaatgcgg

SEQ ID NO: 108776 - DNA, 25 bp, S. pombe
tgcgaactaaactacgacgagactt

SEQ ID NO: 108777 - DNA, 25 bp, S. pombe
tgctcacaatgttatgctcttttta

SEQ ID NO: 108778 - DNA, 25 bp, S. pombe
tgctcacattatcacataccctagt

SEQ ID NO: 108779 - DNA, 25 bp, S. pombe
tgctcagaactgaagatggccctca

SEQ ID NO: 108780 - DNA, 25 bp, S. pombe
tgcttacgttagacacccatcatac

SEQ ID NO: 108781 - DNA, 25 bp, S. pombe
tgctacaccattaaacgctctcata

SEQ ID NO: 108782 - DNA, 25 bp, S. pombe
tgctaagcccaaggacgtcaacgtt

SEQ ID NO: 108783 - DNA, 25 bp, S. pombe
tcgtaagctacctttccaacgtttg

SEQ ID NO: 108784 - DNA, 25 bp, S. pombe
tgctgctacacaaagttcgcctgaa

SEQ ID NO: 108785 - DNA, 25 bp, S. pombe
tgcacccactactaagagctctttg

SEQ ID NO: 108786 - DNA, 25 bp, S. pombe
tgctcccgctactggtggtgttaag

SEQ ID NO: 108787 - DNA, 25 bp, S. pombe
tgcgggctttgacgttttgtctgaa

SEQ ID NO: 108788 - DNA, 25 bp, S. pombe
tgctacgtttggaattcttgcttac

SEQ ID NO: 108789 - DNA, 25 bp, S. pombe
tgcttgcgctttgtcgtctatcaaa

SEQ ID NO: 108790 - DNA, 25 bp, S. pombe
tgctagcaactggttctggaacttt

SEQ ID NO: 108791 - DNA, 25 bp, S. pombe
tgctgctgctacaatgagttgcgtt

SEQ ID NO: 108792 - DNA, 25 bp, S. pombe
tgctggtacaatgcgtggctacgtt

SEQ ID NO: 108793 - DNA, 25 bp, S. pombe
tgctgctttacacggttgtacgttt

SEQ ID NO: 108794 - DNA, 25 bp, S. pombe
tgctttgttacaagttgctcccttt

SEQ ID NO: 108795 - DNA, 25 bp, S. pombe
tcccggtgacacagttatattggct

SEQ ID NO: 108796 - DNA, 25 bp, S. pombe
tccgggaatcaagcgatctcacttt

SEQ ID NO: 108797 - DNA, 25 bp, S. pombe
tccggactttgaaacagcacccatt

SEQ ID NO: 108798 - DNA, 25 bp, S. pombe
tgcgcaaaccttgggaacagctttt

SEQ ID NO: 108799 - DNA, 25 bp, S. pombe
tgctcctcgtgccatcaaggaaatt

SEQ ID NO: 108800 - DNA, 25 bp, S. pombe
tgctcctttcactaagtctcaagtt

SEQ ID NO: 108801 - DNA, 25 bp, S. pombe
tgcggttttatatcgctgccatcat

SEQ ID NO: 108802 - DNA, 25 bp, S. pombe
tgcagggctttatactgctcctgta

SEQ ID NO: 108803 - DNA, 25 bp, S. pombe
tgcagcacggtttttcttccttatt

SEQ ID NO: 108804 - DNA, 25 bp, S. pombe
tgcagctcctgaacttttctcaaaa

SEQ ID NO: 108805 - DNA, 25 bp, S. pombe
tgcatgctataatccttcccaatat

SEQ ID NO: 108806 - DNA, 25 bp, S. pombe
tccaattgtgtacagcgaagtcgct

SEQ ID NO: 108807 - DNA, 25 bp, S. pombe
tcctgttttagtactgaagcctcga

SEQ ID NO: 108808 - DNA, 25 bp, S. pombe
tccgtctttgggattatcgccgaaa

SEQ ID NO: 108809 - DNA, 25 bp, S. pombe
tcgatttctctgatgtttacgcgga

SEQ ID NO: 108810 - DNA, 25 bp, S. pombe
tgcgaattcggcatcgtggaccaaa

SEQ ID NO: 108811 - DNA, 25 bp, S. pombe
tgctgaaccagttgttgtcgaccaa

SEQ ID NO: 108812 - DNA, 25 bp, S. pombe
tgctaacattgtttggcttcccgtt

SEQ ID NO: 108813 - DNA, 25 bp, S. pombe
tgctaccattgttatgtcggcaaag

SEQ ID NO: 108814 - DNA, 25 bp, S. pombe
tccacggcgatccatgtcggaaaat

SEQ ID NO: 108815 - DNA, 25 bp, S. pombe
tgccatccgtactgctgctgaggaa

SEQ ID NO: 108816 - DNA, 25 bp, S. pombe
tgctatcactgttcctgctgaagaa

SEQ ID NO: 108817 - DNA, 25 bp, S. pombe
tgctcttcgcgatgtctcatatcat

SEQ ID NO: 108818 - DNA, 25 bp, S. pombe
tgctctatctggtctgtcaaacttt

SEQ ID NO: 108819 - DNA, 25 bp, S. pombe
tgcgtctggcgctgtaatactttct

SEQ ID NO: 108820 - DNA, 25 bp, S. pombe
tgctcgtgagcttttgacccttgac

SEQ ID NO: 108821 - DNA, 25 bp, S. pombe
tgctttgcaatatgccgactccaat

SEQ ID NO: 108822 - DNA, 25 bp, S. pombe
tgctcttaatttctccgttttctac

SEQ ID NO: 108823 - DNA, 25 bp, S. pombe
tgcgactacaactcctacagattca

SEQ ID NO: 108824 - DNA, 25 bp, S. pombe
tgcttatcccattgtcttcgagaat

SEQ ID NO: 108825 - DNA, 25 bp, S. pombe
tgctttgcacaaaatttcgcggttt

SEQ ID NO: 108826 - DNA, 25 bp, S. pombe
tgctcttgccaaacatgatgccggg

SEQ ID NO: 108827 - DNA, 25 bp, S. pombe
tgcctactcatacttctaagactcg

SEQ ID NO: 108828 - DNA, 25 bp, S. pombe
tgcttatcatttctgcttacctagg

SEQ ID NO: 108829 - DNA, 25 bp, S. pombe
tgcttaatgctgtttcatccaccaa

SEQ ID NO: 108830 - DNA, 25 bp, S. pombe
tgctatttgcgtattgctatccata

SEQ ID NO: 108831 - DNA, 25 bp, S. pombe
tgccccattgagaaccgtagtgctg

SEQ ID NO: 108832 - DNA, 25 bp, S. pombe
tgctgtagactcctccacaaagaca

SEQ ID NO: 108833 - DNA, 25 bp, S. pombe
tgctcgcgctgctttccaaaagaag

SEQ ID NO: 108834 - DNA, 25 bp, S. pombe
tgctgggtgctttgtctttcagaca

SEQ ID NO: 108835 - DNA, 25 bp, S. pombe
tgctgatgaggcacgcaccttgaaa

SEQ ID NO: 108836 - DNA, 25 bp, S. pombe
tgctatgctgctacttaccttaaga

SEQ ID NO: 108837 - DNA, 25 bp, S. pombe
tgcttctttctcaacctacaaatgg

SEQ ID NO: 108838 - DNA, 25 bp, S. pombe
tgctctttctcctcttttcaaagga

SEQ ID NO: 108839 - DNA, 25 bp, S. pombe
tgctgtttccgctgatgtaccagaa

SEQ ID NO: 108840 - DNA, 25 bp, S. pombe
tgcttccatccctgagatgattctc

SEQ ID NO: 108841 - DNA, 25 bp, S. pombe
tgctccccaagacggtgatgattct

SEQ ID NO: 108842 - DNA, 25 bp, S. pombe
tgctaaccctattcccgtatttact

SEQ ID NO: 108843 - DNA, 25 bp, S. pombe
tgctgatagcccgattgaatttttt

SEQ ID NO: 108844 - DNA, 25 bp, S. pombe
tgctgatgctgctctcatgatgcaa

SEQ ID NO: 108845 - DNA, 25 bp, S. pombe
tgctgctgctcgtatctacaaggag

SEQ ID NO: 108846 - DNA, 25 bp, S. pombe
tgctcatgccatccataacggtatg

SEQ ID NO: 108847 - DNA, 25 bp, S. pombe
tgctacggagcaaggcgatgttgaa

SEQ ID NO: 108848 - DNA, 25 bp, S. pombe
tgcttctgaagctcacgctactgaa

SEQ ID NO: 108849 - DNA, 25 bp, S. pombe
tgcttcttttgagcgcattgtcgaa

SEQ ID NO: 108850 - DNA, 25 bp, S. pombe
tgcttctttagctcatctttctcaa

SEQ ID NO: 108851 - DNA, 25 bp, S. pombe
tgcttctgttcctgctctgattaaa

SEQ ID NO: 108852 - DNA, 25 bp, S. pombe
tgctaatagagcagctgccgagaaa

SEQ ID NO: 108853 - DNA, 25 bp, S. pombe
tccaaagttcggactatccaacgtg

SEQ ID NO: 108854 - DNA, 25 bp, S. pombe
tgctgtttctactcaacgcggcaaa

SEQ ID NO: 108855 - DNA, 25 bp, S. pombe
tagcgtggatccttcaaccgtaaag

SEQ ID NO: 108856 - DNA, 25 bp, S. pombe
tgcttgctcacattttggtcttctg

SEQ ID NO: 108857 - DNA, 25 bp, S. pombe
tgctcttcagcttgcagatactttg

SEQ ID NO: 108858 - DNA, 25 bp, S. pombe
tgctgccatgataggctatactgct

SEQ ID NO: 108859 - DNA, 25 bp, S. pombe
tgctgctttaagtcccaatgttgtg

SEQ ID NO: 108860 - DNA, 25 bp, S. pombe
tgctggtttagctacaattggtgtt

SEQ ID NO: 108861 - DNA, 25 bp, S. pombe
tgctggtaaaattcctctatctagt

SEQ ID NO: 108862 - DNA, 25 bp, S. pombe
tgctggtcaaattcccgtcgaagat

SEQ ID NO: 108863 - DNA, 25 bp, S. pombe
tgctgtgtccgatccaggtatgtgg

SEQ ID NO: 108864 - DNA, 25 bp, S. pombe
tcactaggtcggatgcacttgcaaa

SEQ ID NO: 108865 - DNA, 25 bp, S. pombe
tgctatacactttttcttcgcgcca

SEQ ID NO: 108866 - DNA, 25 bp, S. pombe
tgctcatctacttatttctattccc

SEQ ID NO: 108867 - DNA, 25 bp, S. pombe
tgctgttggtgctctgattgtttac

SEQ ID NO: 108868 - DNA, 25 bp, S. pombe
tgctttggagcgctttgtcattaat

SEQ ID NO: 108869 - DNA, 25 bp, S. pombe
tgcttccttgccatatatcttacga

SEQ ID NO: 108870 - DNA, 25 bp, S. pombe
tcgtctttcgcttttcgttagttat

SEQ ID NO: 108871 - DNA, 25 bp, S. pombe
tcgcttttacgtctttgctggtata

SEQ ID NO: 108872 - DNA, 25 bp, S. pombe
tgcccgtccagcgaatttacagttt

SEQ ID NO: 108873 - DNA, 25 bp, S. pombe
tgccctgatccactcacaggtataa

SEQ ID NO: 108874 - DNA, 25 bp, S. pombe
tgccgtatcaaaatccctcgttaga

SEQ ID NO: 108875 - DNA, 25 bp, S. pombe
tgctcctgctactaaacccatgaaa

SEQ ID NO: 108876 - DNA, 25 bp, S. pombe
tgctatcgttcgtctacaaagtggt

SEQ ID NO: 108877 - DNA, 25 bp, S. pombe
tcctccttcttggaacgaggcgtta

SEQ ID NO: 108878 - DNA, 25 bp, S. pombe
tgccactccatcttggacacgagat

SEQ ID NO: 108879 - DNA, 25 bp, S. pombe
tgctgcattcccttggtattacata

SEQ ID NO: 108880 - DNA, 25 bp, S. pombe
tgcgcatcgtcacttggtttcagga

SEQ ID NO: 108881 - DNA, 25 bp, S. pombe
tgctgcaccacttcgtgacattgaa

SEQ ID NO: 108882 - DNA, 25 bp, S. pombe
tgctcaccctacttatcgtcatata

SEQ ID NO: 108883 - DNA, 25 bp, S. pombe
tgctgttgccgctaatggtaccaag

SEQ ID NO: 108884 - DNA, 25 bp, S. pombe
tgcgtctatttgatattcccacttc

SEQ ID NO: 108885 - DNA, 25 bp, S. pombe
tgctatatttgttcaagtcccctct

SEQ ID NO: 108886 - DNA, 25 bp, S. pombe
tgctgcacccattgataaacttcgt

SEQ ID NO: 108887 - DNA, 25 bp, S. pombe
tgctactgctattgaggcccttcgt

SEQ ID NO: 108888 - DNA, 25 bp, S. pombe
tgctactgccattgaagcccttcgc

SEQ ID NO: 108889 - DNA, 25 bp, S. pombe
tgcttatcgttctttccaacagtct

SEQ ID NO: 108890 - DNA, 25 bp, S. pombe
tttacgttggtagaagcgctcttcc

SEQ ID NO: 108891 - DNA, 25 bp, S. pombe
tgctaccgtccgtcaatttgatatc

SEQ ID NO: 108892 - DNA, 25 bp, S. pombe
tgctactcgctccagattatcttta

SEQ ID NO: 108893 - DNA, 25 bp, S. pombe
tgccccagatcgacctagtttagtg

SEQ ID NO: 108894 - DNA, 25 bp, S. pombe
tacggtaaggcattttcagctttgg

SEQ ID NO: 108895 - DNA, 25 bp, S. pombe
tcacggtcccacaagtttgagttca

SEQ ID NO: 108896 - DNA, 25 bp, S. pombe
tgctagcaaagattcgtcaccattt

SEQ ID NO: 108897 - DNA, 25 bp, S. pombe
tgctcaaaagattgcgctccaccat

SEQ ID NO: 108898 - DNA, 25 bp, S. pombe
tgctatgcaagctcgtcctaataca

SEQ ID NO: 108899 - DNA, 25 bp, S. pombe
tgctaccagcattcctcttaaacag

SEQ ID NO: 108900 - DNA, 25 bp, S. pombe
tgctaaaccttctgcgaccaatgag

SEQ ID NO: 108901 - DNA, 25 bp, S. pombe
tgctaaataccctatggatcccatt

SEQ ID NO: 108902 - DNA, 25 bp, S. pombe
tgcgacatatacatgcttggaccaa

SEQ ID NO: 108903 - DNA, 25 bp, S. pombe
tgcgaatttcgtcgtggctatcaac

SEQ ID NO: 108904 - DNA, 25 bp, S. pombe
tgcgcctttgcgagtagagattaca

SEQ ID NO: 108905 - DNA, 25 bp, S. pombe
tgctcccggtttaactgctactgaa

SEQ ID NO: 108906 - DNA, 25 bp, S. pombe
tgccctgcgatgttctagccaaaag

SEQ ID NO: 108907 - DNA, 25 bp, S. pombe
tgctctgtacaccactacagtggaa

SEQ ID NO: 108908 - DNA, 25 bp, S. pombe
tgcgctatatgctctaacgttgctt

SEQ ID NO: 108909 - DNA, 25 bp, S. pombe
tcgggttcgcttacttttaatcgtg

SEQ ID NO: 108910 - DNA, 25 bp, S. pombe
tcgggttgccttacggccaaatgga

SEQ ID NO: 108911 - DNA, 25 bp, S. pombe
tcggtgaaactctcgatcctacagg

SEQ ID NO: 108912 - DNA, 25 bp, S. pombe
tgctgtagtcgagcaattgcatcct

SEQ ID NO: 108913 - DNA, 25 bp, S. pombe
tgctggagtctcacaacaatccggt

SEQ ID NO: 108914 - DNA, 25 bp, S. pombe
tgctgctgggatatcaagtcctcaa

SEQ ID NO: 108915 - DNA, 25 bp, S. pombe
tgctgcgaaatattgctagggatct

SEQ ID NO: 108916 - DNA, 25 bp, S. pombe
tgccaaacaaataccgtagctcctc

SEQ ID NO: 108917 - DNA, 25 bp, S. pombe
tgctcataacactcatccattagct

SEQ ID NO: 108918 - DNA, 25 bp, S. pombe
tgctgctcaatctccatcatttaat

SEQ ID NO: 108919 - DNA, 25 bp, S. pombe
tgctgctaatgcttctaccttgaac

SEQ ID NO: 108920 - DNA, 25 bp, S. pombe
tgctgctatgcctttacctgatgag

SEQ ID NO: 108921 - DNA, 25 bp, S. pombe
tgcctgcggatgactctactctgaa

SEQ ID NO: 108922 - DNA, 25 bp, S. pombe
tgcgctcggagttgcctcattaaaa

SEQ ID NO: 108923 - DNA, 25 bp, S. pombe
tgcctattgcaattccgatttacgg

SEQ ID NO: 108924 - DNA, 25 bp, S. pombe
tgccaatccaagtgcggttgccaag

SEQ ID NO: 108925 - DNA, 25 bp, S. pombe
tgctgtttgccaaaccctttcgaaa

SEQ ID NO: 108926 - DNA, 25 bp, S. pombe
tgctatttgctatccactcttatca

SEQ ID NO: 108927 - DNA, 25 bp, S. pombe
tgctcgtcctcatcatcaattatta

SEQ ID NO: 108928 - DNA, 25 bp, S. pombe
tgctcctcctcaacaagcttatgga

SEQ ID NO: 108929 - DNA, 25 bp, S. pombe
tgctcctcctgatacatcgttgaga

SEQ ID NO: 108930 - DNA, 25 bp, S. pombe
tgcgatcagcagtattcatagcgat

SEQ ID NO: 108931 - DNA, 25 bp, S. pombe
tgctgatcccgaatgctccgaaagt

SEQ ID NO: 108932 - DNA, 25 bp, S. pombe
tgctcctagtcgtgtgcaacaggct

SEQ ID NO: 108933 - DNA, 25 bp, S. pombe
tgccctttcgttggtcaagtctcta

SEQ ID NO: 108934 - DNA, 25 bp, S. pombe
tgcccttttcttctacgatatctat

SEQ ID NO: 108935 - DNA, 25 bp, S. pombe
tgctcgtttctctcctgacgataaa

SEQ ID NO: 108936 - DNA, 25 bp, S. pombe
tgcgtggtcgtgttcccatttatga

SEQ ID NO: 108937 - DNA, 25 bp, S. pombe
tgcgctgatcactcgaaacaatttg

SEQ ID NO: 108938 - DNA, 25 bp, S. pombe
tgctcaaacttcacaccaatctggt

SEQ ID NO: 108939 - DNA, 25 bp, S. pombe
tgctatttcatgtcgattccttgtt

SEQ ID NO: 108940 - DNA, 25 bp, S. pombe
tgctctccaattttctgatgctgtt

SEQ ID NO: 108941 - DNA, 25 bp, S. pombe
tgctctcgcaaagtgtactcctgaa

SEQ ID NO: 108942 - DNA, 25 bp, S. pombe
tgccgctgttgctgcctctgcttag

SEQ ID NO: 108943 - DNA, 25 bp, S. pombe
tgccgctgttgctgcctctgcttag

SEQ ID NO: 108944 - DNA, 25 bp, S. pombe
tgctcttgctactgccatatctaaa

SEQ ID NO: 108945 - DNA, 25 bp, S. pombe
tgctcccgagagttcaatagttgct

SEQ ID NO: 108946 - DNA, 25 bp, S. pombe
tgctcttcagcatgcaaccaagttt

SEQ ID NO: 108947 - DNA, 25 bp, S. pombe
tgccttgatttatgccctgttgtat

SEQ ID NO: 108948 - DNA, 25 bp, S. pombe
tgctccaatttacccattttgctag

SEQ ID NO: 108949 - DNA, 25 bp, S. pombe
tgctcagctttttgtcacttcttta

SEQ ID NO: 108950 - DNA, 25 bp, S. pombe
tgctactctttcttcacaacttgaa

SEQ ID NO: 108951 - DNA, 25 bp, S. pombe
tgcggccacctttatgttttgcttt

SEQ ID NO: 108952 - DNA, 25 bp, S. pombe
tgctcgtatcgccattcgtgatttg

SEQ ID NO: 108953 - DNA, 25 bp, S. pombe
tgcgagaatccgtatgccatcattg

SEQ ID NO: 108954 - DNA, 25 bp, S. pombe
tgcggccaatactttcctattttcg

SEQ ID NO: 108955 - DNA, 25 bp, S. pombe
tgccccttccagctattaatcaggt

SEQ ID NO: 108956 - DNA, 25 bp, S. pombe
tgcccgttccactatcgatgagttt

SEQ ID NO: 108957 - DNA, 25 bp, S. pombe
tccaagaatcggtggtggccatcat

SEQ ID NO: 108958 - DNA, 25 bp, S. pombe
tgcccgtcctgctggttcgagaaaa

SEQ ID NO: 108959 - DNA, 25 bp, S. pombe
tgccgctggtccttggttgaagtac

SEQ ID NO: 108960 - DNA, 25 bp, S. pombe
tgctgctgcgtttcgggatattcaa

SEQ ID NO: 108961 - DNA, 25 bp, S. pombe
tgcgtcaaattcggtaatgtgaact

SEQ ID NO: 108962 - DNA, 25 bp, S. pombe
tgcgtctttctcgaatgccaaatca

SEQ ID NO: 108963 - DNA, 25 bp, S. pombe
tgcgctcttttctctaaactttgga

SEQ ID NO: 108964 - DNA, 25 bp, S. pombe
tgcgcacttacgtgaccaggtcaat

SEQ ID NO: 108965 - DNA, 25 bp, S. pombe
tcgccagatactgtgcatccgggaa

SEQ ID NO: 108966 - DNA, 25 bp, S. pombe
tgcccctaatgtgctgatctggagt

SEQ ID NO: 108967 - DNA, 25 bp, S. pombe
tgcgtactgctcatatggacttgga

SEQ ID NO: 108968 - DNA, 25 bp, S. pombe
tctgctcgttgcactgctgaggaac

SEQ ID NO: 108969 - DNA, 25 bp, S. pombe
tgctcttttagacatggcttaccaa

SEQ ID NO: 108970 - DNA, 25 bp, S. pombe
tgcggtaggtaatttcaccggtctt

SEQ ID NO: 108971 - DNA, 25 bp, S. pombe
tcctttggctaaggttgcctttcgt

SEQ ID NO: 108972 - DNA, 25 bp, S. pombe
tcgttatgactctcgttccggtact

SEQ ID NO: 108973 - DNA, 25 bp, S. pombe
tctgctatatgtcaatcggctccga

SEQ ID NO: 108974 - DNA, 25 bp, S. pombe
tcgactgctgaaccacgaaccaaag

SEQ ID NO: 108975 - DNA, 25 bp, S. pombe
tgcggcgtaaacgagctattctaca

SEQ ID NO: 108976 - DNA, 25 bp, S. pombe
tgctgagcgccaagttacaaattac

SEQ ID NO: 108977 - DNA, 25 bp, S. pombe
tgctgagcacacacctgtacttaaa

SEQ ID NO: 108978 - DNA, 25 bp, S. pombe
tgcggtccagcaattgttcttctga

SEQ ID NO: 108979 - DNA, 25 bp, S. pombe
tcctcaaggtggatatcctgctcag

SEQ ID NO: 108980 - DNA, 25 bp, S. pombe
tgctgaattttgcacctccagaact

SEQ ID NO: 108981 - DNA, 25 bp, S. pombe
tgctcttctatttacgcatgccaga

SEQ ID NO: 108982 - DNA, 25 bp, S. pombe
tgctgtatgctactccagtggacaa

SEQ ID NO: 108983 - DNA, 25 bp, S. pombe
tgctgtcatctacgctatttgaacg

SEQ ID NO: 108984 - DNA, 25 bp, S. pombe
tgctgatatcttctggttgaccgtt

SEQ ID NO: 108985 - DNA, 25 bp, S. pombe
tgcgaatgcattcctgagttatcag

SEQ ID NO: 108986 - DNA, 25 bp, S. pombe
tgcgcgttagcatcatggtctttaa

SEQ ID NO: 108987 - DNA, 25 bp, S. pombe
tgctgctttatcacgttctcttaaa

SEQ ID NO: 108988 - DNA, 25 bp, S. pombe
tgcgctttgatcagggtcattttca

SEQ ID NO: 108989 - DNA, 25 bp, S. pombe
tgccagtaaagaaaccagcaactct

SEQ ID NO: 108990 - DNA, 25 bp, S. pombe
tgccaatatcactgttcaacgtcct

SEQ ID NO: 108991 - DNA, 25 bp, S. pombe
tgcgtgcaatcttttcaacatactt

SEQ ID NO: 108992 - DNA, 25 bp, S. pombe
tgcggaatgctgtcaatctacaagt

SEQ ID NO: 108993 - DNA, 25 bp, S. pombe
tgcggcaatgcatacgccatcaatt

SEQ ID NO: 108994 - DNA, 25 bp, S. pombe
tgctgcatcaattaagtcaatcgtt

SEQ ID NO: 108995 - DNA, 25 bp, S. pombe
tgctgcacagcatttccctggaatg

SEQ ID NO: 108996 - DNA, 25 bp, S. pombe
tgctgagcagcatttacaaaagata

SEQ ID NO: 108997 - DNA, 25 bp, S. pombe
tgctggcatctccttcattagaatt

SEQ ID NO: 108998 - DNA, 25 bp, S. pombe
tgctgtctcatcctggagggctcat

SEQ ID NO: 108999 - DNA, 25 bp, S. pombe
tgctcttgctgaaggagtgcctgct

SEQ ID NO: 109000 - DNA, 25 bp, S. pombe
tgctgctcctgttgctggcggtgct

SEQ ID NO: 109001 - DNA, 25 bp, S. pombe
tgcgttgtgctgcttgcatggatta

SEQ ID NO: 109002 - DNA, 25 bp, S. pombe
tgcgtttcagcggtatgagtctacg

SEQ ID NO: 109003 - DNA, 25 bp, S. pombe
tgcgatgttgacagcttgcggtctt

SEQ ID NO: 109004 - DNA, 25 bp, S. pombe
tgcgatgttgatatccgtgcttctt

SEQ ID NO: 109005 - DNA, 25 bp, S. pombe
tgcggtgtatatgcgcttgcgaagc

SEQ ID NO: 109006 - DNA, 25 bp, S. pombe
tcgttgatcaatacgcactcgttgg

SEQ ID NO: 109007 - DNA, 25 bp, S. pombe
tgcgctgttacagatgcttcctgag

SEQ ID NO: 109008 - DNA, 25 bp, S. pombe
tgctgttctcaagctcttcttagaa

SEQ ID NO: 109009 - DNA, 25 bp, S. pombe
tgctgttccaacctatttgcttgat

SEQ ID NO: 109010 - DNA, 25 bp, S. pombe
tgctggcaagcaactcgaggacgga

SEQ ID NO: 109011 - DNA, 25 bp, S. pombe
tgctgccatgaaagctcgggacatt

SEQ ID NO: 109012 - DNA, 25 bp, S. pombe
tgctggcaagtgtgctttgtcagta

SEQ ID NO: 109013 - DNA, 25 bp, S. pombe
tgctcgcagaggtgtagttcaatta

SEQ ID NO: 109014 - DNA, 25 bp, S. pombe
tgcgcatgaaggtctacgagcctat

SEQ ID NO: 109015 - DNA, 25 bp, S. pombe
tgcgccatgccgaaaaagtctcagt

SEQ ID NO: 109016 - DNA, 25 bp, S. pombe
tgcgttctcttctttgggcgaatga

SEQ ID NO: 109017 - DNA, 25 bp, S. pombe
tgctgcatttctcgattgaacccta

SEQ ID NO: 109018 - DNA, 25 bp, S. pombe
tgctccatcatcttctataaaccta

SEQ ID NO: 109019 - DNA, 25 bp, S. pombe
tgctcgctcttactggtttatgtta

SEQ ID NO: 109020 - DNA, 25 bp, S. pombe
tgcccttttgttgttttggatcctt

SEQ ID NO: 109021 - DNA, 25 bp, S. pombe
tgctgcttctttcctcgtttatgga

SEQ ID NO: 109022 - DNA, 25 bp, S. pombe
tgcgtcctcctttcgatatttatga

SEQ ID NO: 109023 - DNA, 25 bp, S. pombe
tgctcccgtgctaactgtatatttg

SEQ ID NO: 109024 - DNA, 25 bp, S. pombe
tgccccaggctgaagaggtcattga

SEQ ID NO: 109025 - DNA, 25 bp, S. pombe
tcctatcggttggtggatcattgcc

SEQ ID NO: 109026 - DNA, 25 bp, S. pombe
tccttggtcagccatgtggtcaatt

SEQ ID NO: 109027 - DNA, 25 bp, S. pombe
tgccttttccaggtcggtgttagaa

SEQ ID NO: 109028 - DNA, 25 bp, S. pombe
tcgtacctaccgtgtattctttcta

SEQ ID NO: 109029 - DNA, 25 bp, S. pombe
tcgtacgtaccggtttagttgatgc

SEQ ID NO: 109030 - DNA, 25 bp, S. pombe
taggacgtacccgtttggatgttga

SEQ ID NO: 109031 - DNA, 25 bp, S. pombe
tccactggtaccaccaacggtacta

SEQ ID NO: 109032 - DNA, 25 bp, S. pombe
tccaggtgccgctaaagcagcagtt

SEQ ID NO: 109033 - DNA, 25 bp, S. pombe
tgcctgttgaactgagatgcccttt

SEQ ID NO: 109034 - DNA, 25 bp, S. pombe
tcctgctgcgaataagtcatccttt

SEQ ID NO: 109035 - DNA, 25 bp, S. pombe
tccattgaagagaaagttgacggtg

SEQ ID NO: 109036 - DNA, 25 bp, S. pombe
tgccggtgaagctcgtggtgtctac

SEQ ID NO: 109037 - DNA, 25 bp, S. pombe
tccacttctttacatttctggcagt

SEQ ID NO: 109038 - DNA, 25 bp, S. pombe
tgctgctggcgtttcatgtgttaaa

SEQ ID NO: 109039 - DNA, 25 bp, S. pombe
tgcctgatcgctttcattcgagaaa

SEQ ID NO: 109040 - DNA, 25 bp, S. pombe
tgccatggcgcatactttacttgta

SEQ ID NO: 109041 - DNA, 25 bp, S. pombe
tgccgcagtcaaatcgttacgtgat

SEQ ID NO: 109042 - DNA, 25 bp, S. pombe
tgccatgactacacaaggacgcgat

SEQ ID NO: 109043 - DNA, 25 bp, S. pombe
tgccatagatatcaacgaccctcgt

SEQ ID NO: 109044 - DNA, 25 bp, S. pombe
tgccctgggatttggtgatcgacaa

SEQ ID NO: 109045 - DNA, 25 bp, S. pombe
tgcgctattccctttactttctaaa

SEQ ID NO: 109046 - DNA, 25 bp, S. pombe
tcctaaagttatttcagctcgccca

SEQ ID NO: 109047 - DNA, 25 bp, S. pombe
tcctgcaacttattttgttccccaa

SEQ ID NO: 109048 - DNA, 25 bp, S. pombe
tgccgaccttattgctagtgatcca

SEQ ID NO: 109049 - DNA, 25 bp, S. pombe
tgccgcttcggaggttcccaaaaag

SEQ ID NO: 109050 - DNA, 25 bp, S. pombe
tcctttgcaaaggtcttcccgaaga

SEQ ID NO: 109051 - DNA, 25 bp, S. pombe
tgcctctcgtgtaactttgggtaag

SEQ ID NO: 109052 - DNA, 25 bp, S. pombe
tgcctgctgaggacaacgttcgttg

SEQ ID NO: 109053 - DNA, 25 bp, S. pombe
tgccacgcgcacaaaaaggcttact

SEQ ID NO: 109054 - DNA, 25 bp, S. pombe
tccctccacgttaatccaagatttg

SEQ ID NO: 109055 - DNA, 25 bp, S. pombe
tccttcactttctggcgtatttaca

SEQ ID NO: 109056 - DNA, 25 bp, S. pombe
tgctgaaagcatcaaacgcgccctt

SEQ ID NO: 109057 - DNA, 25 bp, S. pombe
tctcaaatgatcaagtcccgcagtc

SEQ ID NO: 109058 - DNA, 25 bp, S. pombe
tctcctgacggctccgagagtaaaa

SEQ ID NO: 109059 - DNA, 25 bp, S. pombe
tgctgcttctcatgttcttgttgaa

SEQ ID NO: 109060 - DNA, 25 bp, S. pombe
tgctgcttctcattgcttcttaaaa

SEQ ID NO: 109061 - DNA, 25 bp, S. pombe
tgcctccaagggtgctgttacagat

SEQ ID NO: 109062 - DNA, 25 bp, S. pombe
tcctccacggtgtgcttaatcgaaa

SEQ ID NO: 109063 - DNA, 25 bp, S. pombe
tgcgccagatctctcacatgtaaaa

SEQ ID NO: 109064 - DNA, 25 bp, S. pombe
tgcgcccgttttcgagtattttcat

SEQ ID NO: 109065 - DNA, 25 bp, S. pombe
tgctgacgatttccccgtaaatggt

SEQ ID NO: 109066 - DNA, 25 bp, S. pombe
tgcgccctccaagctgttaaggaaa

SEQ ID NO: 109067 - DNA, 25 bp, S. pombe
tgccggcttcaactcttctaaaaag

SEQ ID NO: 109068 - DNA, 25 bp, S. pombe
tgctgatcccaccaaacctagtgat

SEQ ID NO: 109069 - DNA, 25 bp, S. pombe
tgctgaaccatctaatcccgagttg

SEQ ID NO: 109070 - DNA, 25 bp, S. pombe
tgctgaacgtatgatcacccttgtc

SEQ ID NO: 109071 - DNA, 25 bp, S. pombe
tgctggcacgtttatcacttgctat

SEQ ID NO: 109072 - DNA, 25 bp, S. pombe
tgcggcactgtatcacgttgcatga

SEQ ID NO: 109073 - DNA, 25 bp, S. pombe
tgccctcaatgcacaagtcctggag

SEQ ID NO: 109074 - DNA, 25 bp, S. pombe
tgcgcgctcagttcaagacattacg

SEQ ID NO: 109075 - DNA, 25 bp, S. pombe
tgccttttcgcaacacattatcatg

SEQ ID NO: 109076 - DNA, 25 bp, S. pombe
tgcgattcccagacaacattgacga

SEQ ID NO: 109077 - DNA, 25 bp, S. pombe
tacttcgtggcattctgacatggca

SEQ ID NO: 109078 - DNA, 25 bp, S. pombe
ttcgtaagccatctagctgcagcat

SEQ ID NO: 109079 - DNA, 25 bp, S. pombe
tcctttgagccgcaatgctgagttc

SEQ ID NO: 109080 - DNA, 25 bp, S. pombe
tcctttacctgttcatcatggcgta

SEQ ID NO: 109081 - DNA, 25 bp, S. pombe
tccaaaggctggttcccaaggtagt

SEQ ID NO: 109082 - DNA, 25 bp, S. pombe
tccaatggttgtgtcctaggcgttt

SEQ ID NO: 109083 - DNA, 25 bp, S. pombe
tcccgtttatcgatattcctcattc

SEQ ID NO: 109084 - DNA, 25 bp, S. pombe
tgcgtatttgattgcgttcttccca

SEQ ID NO: 109085 - DNA, 25 bp, S. pombe
tgcgattgttcatgaggtttcctcc

SEQ ID NO: 109086 - DNA, 25 bp, S. pombe
tgcgccgagctattgcaagcttttt

SEQ ID NO: 109087 - DNA, 25 bp, S. pombe
tgccattaatcccaactattcgaga

SEQ ID NO: 109088 - DNA, 25 bp, S. pombe
tgccctgcgtccaaagcttgtaaga

SEQ ID NO: 109089 - DNA, 25 bp, S. pombe
tgccgccatgtcacatattctacat

SEQ ID NO: 109090 - DNA, 25 bp, S. pombe
tgcccgcagtctcgtagagctacaa

SEQ ID NO: 109091 - DNA, 25 bp, S. pombe
tgcccgtggtgagtctgttgagtat

SEQ ID NO: 109092 - DNA, 25 bp, S. pombe
tgcgcaccttaatttgactctttgt

SEQ ID NO: 109093 - DNA, 25 bp, S. pombe
tcctagccagcgaactcaacttgag

SEQ ID NO: 109094 - DNA, 25 bp, S. pombe
tgcgtactcgtgactctaatcctag

SEQ ID NO: 109095 - DNA, 25 bp, S. pombe
tccatgaccccgatatccaaaagaa

SEQ ID NO: 109096 - DNA, 25 bp, S. pombe
taatagtcccgaggcattactgaaa

SEQ ID NO: 109097 - DNA, 25 bp, S. pombe
tactggacccgattcttggaactac

SEQ ID NO: 109098 - DNA, 25 bp, S. pombe
tctcggacccgaattcgtttagcaa

SEQ ID NO: 109099 - DNA, 25 bp, S. pombe
tccgacggttgattcccatctgtga

SEQ ID NO: 109100 - DNA, 25 bp, S. pombe
tgccccagttgttatcccttggata

SEQ ID NO: 109101 - DNA, 25 bp, S. pombe
tcctgccgctgctgtagagattgaa

SEQ ID NO: 109102 - DNA, 25 bp, S. pombe
tcctctcctcctaaagtggtacgta

SEQ ID NO: 109103 - DNA, 25 bp, S. pombe
tccgctcctcctaagggttcaaaga

SEQ ID NO: 109104 - DNA, 25 bp, S. pombe
tgcggaactccttttgtttatgaaa

SEQ ID NO: 109105 - DNA, 25 bp, S. pombe
tgcgcgaactctctcgtttattaaa

SEQ ID NO: 109106 - DNA, 25 bp, S. pombe
tccgtctacgttttgatttgcctga

SEQ ID NO: 109107 - DNA, 25 bp, S. pombe
tgccgtaacgcttttatttggttct

SEQ ID NO: 109108 - DNA, 25 bp, S. pombe
tcaaaggtgcctttttcgtgggtct

SEQ ID NO: 109109 - DNA, 25 bp, S. pombe
tgcgcccttgcagatgattttatga

SEQ ID NO: 109110 - DNA, 25 bp, S. pombe
tgccgtttactttcctctattcaaa

SEQ ID NO: 109111 - DNA, 25 bp, S. pombe
tgccaacattactgaagccgctatc

SEQ ID NO: 109112 - DNA, 25 bp, S. pombe
tccaggttttcgtcagcaaatgcgt

SEQ ID NO: 109113 - DNA, 25 bp, S. pombe
tcccgtattttcaccaaagcagttc

SEQ ID NO: 109114 - DNA, 25 bp, S. pombe
tctgagcccgttctttttattacaa

SEQ ID NO: 109115 - DNA, 25 bp, S. pombe
tgctggcgccggctttttaacaaca

SEQ ID NO: 109116 - DNA, 25 bp, S. pombe
tcccgactggagcttctttagctaa

SEQ ID NO: 109117 - DNA, 25 bp, S. pombe
tcccttcgtaaacttcttgatccaa

SEQ ID NO: 109118 - DNA, 25 bp, S. pombe
tgccatttgactaacagctaccctg

SEQ ID NO: 109119 - DNA, 25 bp, S. pombe
tcgggcctacagagaaaaccttggt

SEQ ID NO: 109120 - DNA, 25 bp, S. pombe
tattgtacgtggtacaaagcccttt

SEQ ID NO: 109121 - DNA, 25 bp, S. pombe
ttttacggagcaccaaacacctcaa

SEQ ID NO: 109122 - DNA, 25 bp, S. pombe
ttacattactgctcgttttcaaggt

SEQ ID NO: 109123 - DNA, 25 bp, S. pombe
taacattccgcaactttttgggctc

SEQ ID NO: 109124 - DNA, 25 bp, S. pombe
taactttcatttctatttcgggact

SEQ ID NO: 109125 - DNA, 25 bp, S. pombe
taagcgtcttttatacgtccgccgt

SEQ ID NO: 109126 - DNA, 25 bp, S. pombe
taagcgtcttttatacgtccgccgt

SEQ ID NO: 109127 - DNA, 25 bp, S. pombe
taaagttttggtcacttatcccgct

SEQ ID NO: 109128 - DNA, 25 bp, S. pombe
taaggtttgtctcaactttacgaca

SEQ ID NO: 109129 - DNA, 25 bp, S. pombe
tcggtactacctcaagcttcttgga

SEQ ID NO: 109130 - DNA, 25 bp, S. pombe
tccggcctacctcaagtagtgtaga

SEQ ID NO: 109131 - DNA, 25 bp, S. pombe
taaggaaaacctcgatccgtcgaag

SEQ ID NO: 109132 - DNA, 25 bp, S. pombe
taatgaaaggatgtcgccggccgaa

SEQ ID NO: 109133 - DNA, 25 bp, S. pombe
tcctaactatggttgctggctttca

SEQ ID NO: 109134 - DNA, 25 bp, S. pombe
tccaagacatttttgctcagctgtt

SEQ ID NO: 109135 - DNA, 25 bp, S. pombe
tcgcaagcatttcccttcaatattg

SEQ ID NO: 109136 - DNA, 25 bp, S. pombe
tgccaagatgaacctattcccgatg

SEQ ID NO: 109137 - DNA, 25 bp, S. pombe
tgcgccgtatgtttattcgtcaagt

SEQ ID NO: 109138 - DNA, 25 bp, S. pombe
tccttcctggacgtggtgtgaacat

SEQ ID NO: 109139 - DNA, 25 bp, S. pombe
tccttcctggcagcgttgcaaaaat

SEQ ID NO: 109140 - DNA, 25 bp, S. pombe
tcctttgcgacatccttgacgaaat

SEQ ID NO: 109141 - DNA, 25 bp, S. pombe
tgccagtatggctcaattcctattg

SEQ ID NO: 109142 - DNA, 25 bp, S. pombe
tgccaagtactctttcgatcaggga

SEQ ID NO: 109143 - DNA, 25 bp, S. pombe
tgccgactactatttcgtgcgcaaa

SEQ ID NO: 109144 - DNA, 25 bp, S. pombe
tccacatcttcttcttcgggtataa

SEQ ID NO: 109145 - DNA, 25 bp, S. pombe
tgccaagcgtcacgttcgtttcaaa

SEQ ID NO: 109146 - DNA, 25 bp, S. pombe
tccgttctaaacttgccgcaggtat

SEQ ID NO: 109147 - DNA, 25 bp, S. pombe
tccattcgatgaccttcaggcggaa

SEQ ID NO: 109148 - DNA, 25 bp, S. pombe
tccggtccattattcggcctaatat

SEQ ID NO: 109149 - DNA, 25 bp, S. pombe
tccggcgcactttcatccgaagaaa

SEQ ID NO: 109150 - DNA, 25 bp, S. pombe
tccgtcgcctcagcaaatgtacaat

SEQ ID NO: 109151 - DNA, 25 bp, S. pombe
tcgcttccgcattcgtaagacccat

SEQ ID NO: 109152 - DNA, 25 bp, S. pombe
tccggcctgctctgtaaacaaacaa

SEQ ID NO: 109153 - DNA, 25 bp, S. pombe
tgcccattcctggaggcgagtaaat

SEQ ID NO: 109154 - DNA, 25 bp, S. pombe
tccaattttaactactgctgtcaga

SEQ ID NO: 109155 - DNA, 25 bp, S. pombe
tccaacgtgaagaagtagccgacat

SEQ ID NO: 109156 - DNA, 25 bp, S. pombe
tccaccagttgatttgaagctcgat

SEQ ID NO: 109157 - DNA, 25 bp, S. pombe
tgccgctgctgcttctgaaaacgaa

SEQ ID NO: 109158 - DNA, 25 bp, S. pombe
tgccactgatgctcacaggttcgaa

SEQ ID NO: 109159 - DNA, 25 bp, S. pombe
tgccagtgctcaacttgtttctaac

SEQ ID NO: 109160 - DNA, 25 bp, S. pombe
tgcgagcgtcgatttcattatgatt

SEQ ID NO: 109161 - DNA, 25 bp, S. pombe
tgcgatcagccgtttttgcagatat

SEQ ID NO: 109162 - DNA, 25 bp, S. pombe
tgcgacactgcctctttagataaca

SEQ ID NO: 109163 - DNA, 25 bp, S. pombe
tgcgaactgtggtctttggaggaac

SEQ ID NO: 109164 - DNA, 25 bp, S. pombe
tcggatgttgatgtttcggtaccta

SEQ ID NO: 109165 - DNA, 25 bp, S. pombe
tcgtaggcagaaacttcggttcgtt

SEQ ID NO: 109166 - DNA, 25 bp, S. pombe
tcgatgaaacaacaaccgctgcctg

SEQ ID NO: 109167 - DNA, 25 bp, S. pombe
tcaaaggtagagagccagtgcctgt

SEQ ID NO: 109168 - DNA, 25 bp, S. pombe
tgccattgaagcccttcgccgttgt

SEQ ID NO: 109169 - DNA, 25 bp, S. pombe
tgccttcaagttcatctcggtttca

SEQ ID NO: 109170 - DNA, 25 bp, S. pombe
tgccttcaagttcatttctgtctcg

SEQ ID NO: 109171 - DNA, 25 bp, S. pombe
tccatggcaatgaccgttcgttaga

SEQ ID NO: 109172 - DNA, 25 bp, S. pombe
tgccatggcggaagctcattgcagt

SEQ ID NO: 109173 - DNA, 25 bp, S. pombe
tcctcccatcataaacaaacctttt

SEQ ID NO: 109174 - DNA, 25 bp, S. pombe
tgccctcttctagaacattttcgac

SEQ ID NO: 109175 - DNA, 25 bp, S. pombe
tcccagttaagttggctaaagtcat

SEQ ID NO: 109176 - DNA, 25 bp, S. pombe
tccacgttcaagaggctattcgcaa

SEQ ID NO: 109177 - DNA, 25 bp, S. pombe
tcctcctttgcaattggctgacatt

SEQ ID NO: 109178 - DNA, 25 bp, S. pombe
tcctcgtctaaaccatatcagctta

SEQ ID NO: 109179 - DNA, 25 bp, S. pombe
tattcgtaacgtcaagggtcctgtt

SEQ ID NO: 109180 - DNA, 25 bp, S. pombe
tcattcgtaacgttaagggacctgt

SEQ ID NO: 109181 - DNA, 25 bp, S. pombe
tcttctttgaactttcggataccgg

SEQ ID NO: 109182 - DNA, 25 bp, S. pombe
tcctcgtaaacgtcttttagctctg

SEQ ID NO: 109183 - DNA, 25 bp, S. pombe
tccttggtccaatcttttacatcat

SEQ ID NO: 109184 - DNA, 25 bp, S. pombe
tgccttttcaaatcttttacactgt

SEQ ID NO: 109185 - DNA, 25 bp, S. pombe
tccccgtcaaggtttctggcaagtg

SEQ ID NO: 109186 - DNA, 25 bp, S. pombe
tgcccacgtcaaagcttcagctgta

SEQ ID NO: 109187 - DNA, 25 bp, S. pombe
tgcccggtccagttgatgacgttaa

SEQ ID NO: 109188 - DNA, 25 bp, S. pombe
tgccctttccagttgtatcgtgaca

SEQ ID NO: 109189 - DNA, 25 bp, S. pombe
tgccgctcttatgcttattgcttaa

SEQ ID NO: 109190 - DNA, 25 bp, S. pombe
tgcgctcattcgatcgcgacagaaa

SEQ ID NO: 109191 - DNA, 25 bp, S. pombe
tgcgccttgctattcgtgtcaataa

SEQ ID NO: 109192 - DNA, 25 bp, S. pombe
tgcccttctggccatttgaataagt

SEQ ID NO: 109193 - DNA, 25 bp, S. pombe
tgccattttcgctgatgttgctact

SEQ ID NO: 109194 - DNA, 25 bp, S. pombe
tgccctgattgctctttacgccaaa

SEQ ID NO: 109195 - DNA, 25 bp, S. pombe
tcctctcactcttcagactatggag

SEQ ID NO: 109196 - DNA, 25 bp, S. pombe
tccgttctctacgattctggattag

SEQ ID NO: 109197 - DNA, 25 bp, S. pombe
tgcctgaatctgcaactggtattta

SEQ ID NO: 109198 - DNA, 25 bp, S. pombe
tcgctaattgatcacggctttgcca

SEQ ID NO: 109199 - DNA, 25 bp, S. pombe
tctcaaatctgaaaccgcatctctt

SEQ ID NO: 109200 - DNA, 25 bp, S. pombe
tcgcagcaatcgaaagtccttttgt

SEQ ID NO: 109201 - DNA, 25 bp, S. pombe
tccgcaagagattcagtcctgggtt

SEQ ID NO: 109202 - DNA, 25 bp, S. pombe
tgccgactttcatgtttccgttaat

SEQ ID NO: 109203 - DNA, 25 bp, S. pombe
tcagcaagcgagaagacgttcctat

SEQ ID NO: 109204 - DNA, 25 bp, S. pombe
tgcgcgtgctacaactactttaatc

SEQ ID NO: 109205 - DNA, 25 bp, S. pombe
tgccgctcaggatgttgcagcttta

SEQ ID NO: 109206 - DNA, 25 bp, S. pombe
tgcccatcagggttgtcagtgtagt

SEQ ID NO: 109207 - DNA, 25 bp, S. pombe
tcccaacggtcgcacttttgagagt

SEQ ID NO: 109208 - DNA, 25 bp, S. pombe
tgccaacagggcacgactcgaaaga

SEQ ID NO: 109209 - DNA, 25 bp, S. pombe
tcgttttactctttaccctcaactg

SEQ ID NO: 109210 - DNA, 25 bp, S. pombe
tcggtgccttctacattaagcctaa

SEQ ID NO: 109211 - DNA, 25 bp, S. pombe
tccaatttggacactttgccgtgca

SEQ ID NO: 109212 - DNA, 25 bp, S. pombe
tccacggaagtgacgccactgaact

SEQ ID NO: 109213 - DNA, 25 bp, S. pombe
tgccctaatcttccaacttgcattt

SEQ ID NO: 109214 - DNA, 25 bp, S. pombe
tccacttgtcttcttgatcgatttc

SEQ ID NO: 109215 - DNA, 25 bp, S. pombe
tccacattgtcttgattgcagctct

SEQ ID NO: 109216 - DNA, 25 bp, S. pombe
tgcctaggactaataccactgctca

SEQ ID NO: 109217 - DNA, 25 bp, S. pombe
tgcctgctgaagaactgtatccttt

SEQ ID NO: 109218 - DNA, 25 bp, S. pombe
tgcctgctcagggacacagattgta

SEQ ID NO: 109219 - DNA, 25 bp, S. pombe
tgccatgaccagctttgttcatcat

SEQ ID NO: 109220 - DNA, 25 bp, S. pombe
tccaatccgcttgtatgcaacatca

SEQ ID NO: 109221 - DNA, 25 bp, S. pombe
tgccactgccgttcttgtatatact

SEQ ID NO: 109222 - DNA, 25 bp, S. pombe
tcgcccgatagccagggatctaggt

SEQ ID NO: 109223 - DNA, 25 bp, S. pombe
tgcctctcatcagcgtagtttatcg

SEQ ID NO: 109224 - DNA, 25 bp, S. pombe
tgccatgttaccttcgttttctaat

SEQ ID NO: 109225 - DNA, 25 bp, S. pombe
tcgatggtactgtcgcgctttacga

SEQ ID NO: 109226 - DNA, 25 bp, S. pombe
tcctgttactgctgctgctaatgaa

SEQ ID NO: 109227 - DNA, 25 bp, S. pombe
tcgctttcaagctgtcatggacatg

SEQ ID NO: 109228 - DNA, 25 bp, S. pombe
tctcttaaagtcattcggctggctc

SEQ ID NO: 109229 - DNA, 25 bp, S. pombe
tcgctacaaattttgcgggctgcgc

SEQ ID NO: 109230 - DNA, 25 bp, S. pombe
tcgctacaacgataaatgggccaag

SEQ ID NO: 109231 - DNA, 25 bp, S. pombe
tctgcttccaacgttttggataact

SEQ ID NO: 109232 - DNA, 25 bp, S. pombe
tcctacacttccacttgcgataaat

SEQ ID NO: 109233 - DNA, 25 bp, S. pombe
tctctgcgaagtcaccggaatctaa

SEQ ID NO: 109234 - DNA, 25 bp, S. pombe
tgccgcatttgctggagacgatcac

SEQ ID NO: 109235 - DNA, 25 bp, S. pombe
tcccatgccattagcgatagtgaat

SEQ ID NO: 109236 - DNA, 25 bp, S. pombe
tcccttcattaccaactccattgga

SEQ ID NO: 109237 - DNA, 25 bp, S. pombe
tccttttctcgtcacccatgatgga

SEQ ID NO: 109238 - DNA, 25 bp, S. pombe
tcccttccttgtcacccatgatgga

SEQ ID NO: 109239 - DNA, 25 bp, S. pombe
tgcccgccgtcttacaaactatgaa

SEQ ID NO: 109240 - DNA, 25 bp, S. pombe
tgcctccctctttatgaacctatta

SEQ ID NO: 109241 - DNA, 25 bp, S. pombe
tcccgtcttagtggtgattcttttg

SEQ ID NO: 109242 - DNA, 25 bp, S. pombe
tgcccctcttgacggtatgatctta

SEQ ID NO: 109243 - DNA, 25 bp, S. pombe
tgccgcacctgcaggagttgactta

SEQ ID NO: 109244 - DNA, 25 bp, S. pombe
tgccgaggtgctaatctgttgactt

SEQ ID NO: 109245 - DNA, 25 bp, S. pombe
tcctgggatagatttttacctcaat

SEQ ID NO: 109246 - DNA, 25 bp, S. pombe
tgccgccggaatttttcatcgacaa

SEQ ID NO: 109247 - DNA, 25 bp, S. pombe
tgccgtcggcttattattcacaaac

SEQ ID NO: 109248 - DNA, 25 bp, S. pombe
tcctcgctttgggtcgttcaagtac

SEQ ID NO: 109249 - DNA, 25 bp, S. pombe
tcaaacgatcggtcaactaggacga

SEQ ID NO: 109250 - DNA, 25 bp, S. pombe
tctaaagatcaaccctctgaggagg

SEQ ID NO: 109251 - DNA, 25 bp, S. pombe
tcggagactataccctcaagtactg

SEQ ID NO: 109252 - DNA, 25 bp, S. pombe
tccgtcttctaccaaaccgtttatg

SEQ ID NO: 109253 - DNA, 25 bp, S. pombe
tccactcccgaagctaagtttgtca

SEQ ID NO: 109254 - DNA, 25 bp, S. pombe
tccacgtctggatatttgactacga

SEQ ID NO: 109255 - DNA, 25 bp, S. pombe
tccattgcttggtccgagggtcatc

SEQ ID NO: 109256 - DNA, 25 bp, S. pombe
tgccttgtactatttattcgccatt

SEQ ID NO: 109257 - DNA, 25 bp, S. pombe
tccgatggcctttgggacactatgt

SEQ ID NO: 109258 - DNA, 25 bp, S. pombe
tgcctgaacatcaatccgcgttttt

SEQ ID NO: 109259 - DNA, 25 bp, S. pombe
tccagaattgcttccagcagaagtt

SEQ ID NO: 109260 - DNA, 25 bp, S. pombe
tccacacgtagttattgccagcatc

SEQ ID NO: 109261 - DNA, 25 bp, S. pombe
tccaatgcggtctttagcacgtgtt

SEQ ID NO: 109262 - DNA, 25 bp, S. pombe
tccagtctcgttttacacttctttg

SEQ ID NO: 109263 - DNA, 25 bp, S. pombe
tcctactggcatcccgattgtttaa

SEQ ID NO: 109264 - DNA, 25 bp, S. pombe
tcctattaaatcgagatatgttcct

SEQ ID NO: 109265 - DNA, 25 bp, S. pombe
tgcctgatgtgttgccgaattttcc

SEQ ID NO: 109266 - DNA, 25 bp, S. pombe
tcctgtggttgctatgcttcggaaa

SEQ ID NO: 109267 - DNA, 25 bp, S. pombe
tgccttttcgcatatctcggaacaa

SEQ ID NO: 109268 - DNA, 25 bp, S. pombe
tcctgttcccatgatttcgcgagaa

SEQ ID NO: 109269 - DNA, 25 bp, S. pombe
tgcctttattttcgttgctgtcata

SEQ ID NO: 109270 - DNA, 25 bp, S. pombe
tcctcagtaactcataagcgtcctt

SEQ ID NO: 109271 - DNA, 25 bp, S. pombe
tccaccatactctctaatgcttttt

SEQ ID NO: 109272 - DNA, 25 bp, S. pombe
tgccacctcggtttaagtatgactt

SEQ ID NO: 109273 - DNA, 25 bp, S. pombe
tccagtctcctatgtccattaaggt

SEQ ID NO: 109274 - DNA, 25 bp, S. pombe
tctactccgcaaaaccctagatggt

SEQ ID NO: 109275 - DNA, 25 bp, S. pombe
tccagtcacagattctaccctaagg

SEQ ID NO: 109276 - DNA, 25 bp, S. pombe
tccaccagaattacctccttttgag

SEQ ID NO: 109277 - DNA, 25 bp, S. pombe
tcgtagcgtttacttcgcgtggtaa

SEQ ID NO: 109278 - DNA, 25 bp, S. pombe
tcgaaggtattctcccaatgtgtaa

SEQ ID NO: 109279 - DNA, 25 bp, S. pombe
tccagcggcttactccaaggaaatg

SEQ ID NO: 109280 - DNA, 25 bp, S. pombe
tccctatgagcgtcgtgtcatggaa

SEQ ID NO: 109281 - DNA, 25 bp, S. pombe
tgccactcatacactcgactataaa

SEQ ID NO: 109282 - DNA, 25 bp, S. pombe
tccactattcctgctgatcaactga

SEQ ID NO: 109283 - DNA, 25 bp, S. pombe
tccactactacgacagaagctgctg

SEQ ID NO: 109284 - DNA, 25 bp, S. pombe
tgccaccggcattaaagaagaagat

SEQ ID NO: 109285 - DNA, 25 bp, S. pombe
tcccggttctcttcacgagtatatg

SEQ ID NO: 109286 - DNA, 25 bp, S. pombe
ttctcgtttccttgaccaaactgta

SEQ ID NO: 109287 - DNA, 25 bp, S. pombe
tcctcatttttctacccaattctta

SEQ ID NO: 109288 - DNA, 25 bp, S. pombe
tccttcttatttccttaatccacaa

SEQ ID NO: 109289 - DNA, 25 bp, S. pombe
tccaccgattttgatgccactgaga

SEQ ID NO: 109290 - DNA, 25 bp, S. pombe
tccaccgttgttgagatcagctaca

SEQ ID NO: 109291 - DNA, 25 bp, S. pombe
tcctactttccctgcaagcgaggaa

SEQ ID NO: 109292 - DNA, 25 bp, S. pombe
tgcctttcttccctagagatgctga

SEQ ID NO: 109293 - DNA, 25 bp, S. pombe
tgccttcatcccctagagaatggta

SEQ ID NO: 109294 - DNA, 25 bp, S. pombe
tcctcctctcacacgtaatggtaaa

SEQ ID NO: 109295 - DNA, 25 bp, S. pombe
tccacctcgcagtacttgaacgaaa

SEQ ID NO: 109296 - DNA, 25 bp, S. pombe
tccaagcatgcacgtagaccttcaa

SEQ ID NO: 109297 - DNA, 25 bp, S. pombe
tccactcctgtatcttccaatgaat

SEQ ID NO: 109298 - DNA, 25 bp, S. pombe
tccactggtgtgttcgtcttagacg

SEQ ID NO: 109299 - DNA, 25 bp, S. pombe
tgcctgctcgtgaatttgtctgtaa

SEQ ID NO: 109300 - DNA, 25 bp, S. pombe
tgcctatcctcaattaatcttccat

SEQ ID NO: 109301 - DNA, 25 bp, S. pombe
tcgaatgaagcttcctatgttgaga

SEQ ID NO: 109302 - DNA, 25 bp, S. pombe
tcgggcaagctctctgatctgatag

SEQ ID NO: 109303 - DNA, 25 bp, S. pombe
tcctctccaggcgttagcagattta

SEQ ID NO: 109304 - DNA, 25 bp, S. pombe
tcctcatcagctacagttaccattg

SEQ ID NO: 109305 - DNA, 25 bp, S. pombe
tcgtcgcagcattagagtctcgtct

SEQ ID NO: 109306 - DNA, 25 bp, S. pombe
tccagtgggagtgttccagctcaga

SEQ ID NO: 109307 - DNA, 25 bp, S. pombe
taacagtttggaattttgcggttca

SEQ ID NO: 109308 - DNA, 25 bp, S. pombe
tcaaaattcgggatttcacgcccac

SEQ ID NO: 109309 - DNA, 25 bp, S. pombe
tccaaggtcctgtgttcgatgctca

SEQ ID NO: 109310 - DNA, 25 bp, S. pombe
tgccattggccgtattgctggtcaa

SEQ ID NO: 109311 - DNA, 25 bp, S. pombe
tgcctatcgtcctgactttgaacag

SEQ ID NO: 109312 - DNA, 25 bp, S. pombe
tgccaaccatccttgagttagcaga

SEQ ID NO: 109313 - DNA, 25 bp, S. pombe
tgccaagtttggctcactcatgata

SEQ ID NO: 109314 - DNA, 25 bp, S. pombe
tgccacgtcttttaactgcttctga

SEQ ID NO: 109315 - DNA, 25 bp, S. pombe
tccaatgctttctgtatctgccaaa

SEQ ID NO: 109316 - DNA, 25 bp, S. pombe
tccttgctggtctggcatttcagaa

SEQ ID NO: 109317 - DNA, 25 bp, S. pombe
tccatgcttggtttcacattcttca

SEQ ID NO: 109318 - DNA, 25 bp, S. pombe
tgccatcaaggtcagcaatgctctt

SEQ ID NO: 109319 - DNA, 25 bp, S. pombe
tcctcatgagcccaagttgatcttt

SEQ ID NO: 109320 - DNA, 25 bp, S. pombe
tcccaagcccagtcggatgatttta

SEQ ID NO: 109321 - DNA, 25 bp, S. pombe
tcctgggaagtcgtgtttttaacat

SEQ ID NO: 109322 - DNA, 25 bp, S. pombe
tccgtcgaagacgtgattctatcat

SEQ ID NO: 109323 - DNA, 25 bp, S. pombe
tccaacctttgtcttttctctaatt

SEQ ID NO: 109324 - DNA, 25 bp, S. pombe
tccatacctttgtggcttttgctag

SEQ ID NO: 109325 - DNA, 25 bp, S. pombe
tgccatacgttcaaggtgtgttttt

SEQ ID NO: 109326 - DNA, 25 bp, S. pombe
tcgcaccaattcacggtttctgtat

SEQ ID NO: 109327 - DNA, 25 bp, S. pombe
tcccggattctctgcgttattgtta

SEQ ID NO: 109328 - DNA, 25 bp, S. pombe
tacgggattccgactgtttcagttt

SEQ ID NO: 109329 - DNA, 25 bp, S. pombe
tcacgggttcttgttttgggtgcta

SEQ ID NO: 109330 - DNA, 25 bp, S. pombe
tcctccttggcagattccttaaagc

SEQ ID NO: 109331 - DNA, 25 bp, S. pombe
tcctcgttatcgtccaaatttcagc

SEQ ID NO: 109332 - DNA, 25 bp, S. pombe
tctgactttttgtcccgtttaggat

SEQ ID NO: 109333 - DNA, 25 bp, S. pombe
tcggtaatatttcagcccatggcca

SEQ ID NO: 109334 - DNA, 25 bp, S. pombe
tcggtctactttaccacagcgagta

SEQ ID NO: 109335 - DNA, 25 bp, S. pombe
tccctaaattttaagctccgacctg

SEQ ID NO: 109336 - DNA, 25 bp, S. pombe
tctccgaaaatttgtgggccgtccg

SEQ ID NO: 109337 - DNA, 25 bp, S. pombe
tccacgatcgtttctttgccaaggt

SEQ ID NO: 109338 - DNA, 25 bp, S. pombe
tcgaacttcctcctcacaattatag

SEQ ID NO: 109339 - DNA, 25 bp, S. pombe
tccaccttcatgtcctacaaatgtt

SEQ ID NO: 109340 - DNA, 25 bp, S. pombe
tcgcgtttctctactacaagggttg

SEQ ID NO: 109341 - DNA, 25 bp, S. pombe
tcacgtcttacggatcaacaggttt

SEQ ID NO: 109342 - DNA, 25 bp, S. pombe
tttcctaggaggtcaaacgtgtcag

SEQ ID NO: 109343 - DNA, 25 bp, S. pombe
tctaaactttggtgaatgggccttt

SEQ ID NO: 109344 - DNA, 25 bp, S. pombe
tccaaatctcctgggtttcccaaag

SEQ ID NO: 109345 - DNA, 25 bp, S. pombe
tccaaactcgcgacttttctaaact

SEQ ID NO: 109346 - DNA, 25 bp, S. pombe
tccaaatcgcctttattgtttacct

SEQ ID NO: 109347 - DNA, 25 bp, S. pombe
ttacttttaaaaccggtcactgatg

SEQ ID NO: 109348 - DNA, 25 bp, S. pombe
tcgcagctttaagaacggattccgt

SEQ ID NO: 109349 - DNA, 25 bp, S. pombe
tcacgatttgaataccgagctatgt

SEQ ID NO: 109350 - DNA, 25 bp, S. pombe
tcggtggtttactttgggttgctga

SEQ ID NO: 109351 - DNA, 25 bp, S. pombe
tccggactttccaattggccattga

SEQ ID NO: 109352 - DNA, 25 bp, S. pombe
tccgtactggtgatgttggcgaatt

SEQ ID NO: 109353 - DNA, 25 bp, S. pombe
tccaaggtgttgatgcagtccagtc

SEQ ID NO: 109354 - DNA, 25 bp, S. pombe
tccaatggtgttgatggtgcctcat

SEQ ID NO: 109355 - DNA, 25 bp, S. pombe
tcctatgcgtcttccgaagtatctt

SEQ ID NO: 109356 - DNA, 25 bp, S. pombe
tcctgaggcattcccgttggatgtg

SEQ ID NO: 109357 - DNA, 25 bp, S. pombe
tccaagtgcctccattttaaatctc

SEQ ID NO: 109358 - DNA, 25 bp, S. pombe
tccagcgtttccgtatgtcaagtat

SEQ ID NO: 109359 - DNA, 25 bp, S. pombe
tccagatgctttcccatttatcgaa

SEQ ID NO: 109360 - DNA, 25 bp, S. pombe
tccagtcgttcgcatgtctaatgaa

SEQ ID NO: 109361 - DNA, 25 bp, S. pombe
tccagctagttcgaccgctaagaat

SEQ ID NO: 109362 - DNA, 25 bp, S. pombe
tcgcagtattacgagctttataggc

SEQ ID NO: 109363 - DNA, 25 bp, S. pombe
tcgcagttaccgcagctcgtagaaa

SEQ ID NO: 109364 - DNA, 25 bp, S. pombe
tccgattccgcgtgctttaaagcag

SEQ ID NO: 109365 - DNA, 25 bp, S. pombe
ttcatttcgaggtgccgtcaaacag

SEQ ID NO: 109366 - DNA, 25 bp, S. pombe
tccacctctaccacatgttgatgat

SEQ ID NO: 109367 - DNA, 25 bp, S. pombe
tcacgataccccaaatacgattcag

SEQ ID NO: 109368 - DNA, 25 bp, S. pombe
tccaaatcccaaaataccatctctt

SEQ ID NO: 109369 - DNA, 25 bp, S. pombe
tccaatttaccaactaccgatcttt

SEQ ID NO: 109370 - DNA, 25 bp, S. pombe
tcccattacacatttctaccgtttt

SEQ ID NO: 109371 - DNA, 25 bp, S. pombe
tctggctggaatgttaccggctatt

SEQ ID NO: 109372 - DNA, 25 bp, S. pombe
tcgcctggaagagtatcaacgtcaa

SEQ ID NO: 109373 - DNA, 25 bp, S. pombe
tccgctggaccacaaatcgtaattt

SEQ ID NO: 109374 - DNA, 25 bp, S. pombe
tctaaagccttttccgacatacgta

SEQ ID NO: 109375 - DNA, 25 bp, S. pombe
tccttcgtcaagtcttagctcagaa

SEQ ID NO: 109376 - DNA, 25 bp, S. pombe
tccttggtactgtcctacatgcaaa

SEQ ID NO: 109377 - DNA, 25 bp, S. pombe
tcctctttctaccagcagggagatg

SEQ ID NO: 109378 - DNA, 25 bp, S. pombe
tcctcatcttcagacgacgagcaga

SEQ ID NO: 109379 - DNA, 25 bp, S. pombe
tccttctgtcaagctacgtggcatg

SEQ ID NO: 109380 - DNA, 25 bp, S. pombe
tcctctttcgagtttatgggcgtct

SEQ ID NO: 109381 - DNA, 25 bp, S. pombe
tccgctgtattaaggctaagggtga

SEQ ID NO: 109382 - DNA, 25 bp, S. pombe
tccgctctggtaaggctaagctcat

SEQ ID NO: 109383 - DNA, 25 bp, S. pombe
tcctgctcctctacaaaatgtctat

SEQ ID NO: 109384 - DNA, 25 bp, S. pombe
tcgcatttctgctcaaaaagatatt

SEQ ID NO: 109385 - DNA, 25 bp, S. pombe
tccagtcacgattcacgcaagcaat

SEQ ID NO: 109386 - DNA, 25 bp, S. pombe
tccactagccctttgcatgttgaat

SEQ ID NO: 109387 - DNA, 25 bp, S. pombe
tccaactgagtgttttaaataacca

SEQ ID NO: 109388 - DNA, 25 bp, S. pombe
tccaactgagtgttttaaataacca

SEQ ID NO: 109389 - DNA, 25 bp, S. pombe
tcccttttttgtttggtgcagctca

SEQ ID NO: 109390 - DNA, 25 bp, S. pombe
tcgaattatcagaaccgcttggctt

SEQ ID NO: 109391 - DNA, 25 bp, S. pombe
tcgaatctccaagcctttactaagt

SEQ ID NO: 109392 - DNA, 25 bp, S. pombe
tcccgttccggaagatgctgacagt

SEQ ID NO: 109393 - DNA, 25 bp, S. pombe
tccttctttgggaatgtctgtgaat

SEQ ID NO: 109394 - DNA, 25 bp, S. pombe
tccatatcttctggctcttcaagta

SEQ ID NO: 109395 - DNA, 25 bp, S. pombe
tctaggcgctccaatcgtaaaatta

SEQ ID NO: 109396 - DNA, 25 bp, S. pombe
tccgcagcctttatccaaacagttg

SEQ ID NO: 109397 - DNA, 25 bp, S. pombe
tccacaatctttctccactaatatt

SEQ ID NO: 109398 - DNA, 25 bp, S. pombe
tcctcttcttcattgccctagaaag

SEQ ID NO: 109399 - DNA, 25 bp, S. pombe
tcctcgtttaatccctagcaacata

SEQ ID NO: 109400 - DNA, 25 bp, S. pombe
tcgttcgttatactcctaatccaga

SEQ ID NO: 109401 - DNA, 25 bp, S. pombe
tcgagtccccatacacgtagtccag

SEQ ID NO: 109402 - DNA, 25 bp, S. pombe
tccatctcccgaacgagttgtcaat

SEQ ID NO: 109403 - DNA, 25 bp, S. pombe
tccactggcggtaccgctttcaatc

SEQ ID NO: 109404 - DNA, 25 bp, S. pombe
tcccatgggcgtactcgaatttgta

SEQ ID NO: 109405 - DNA, 25 bp, S. pombe
tcctcactggctgctctagtaaatg

SEQ ID NO: 109406 - DNA, 25 bp, S. pombe
tccatcacttgcttctccagaaaaa

SEQ ID NO: 109407 - DNA, 25 bp, S. pombe
tcctcactccatttgctcgtgaaaa

SEQ ID NO: 109408 - DNA, 25 bp, S. pombe
tcctgccaacaatcctctgaataag

SEQ ID NO: 109409 - DNA, 25 bp, S. pombe
tcttcccaacttccttcaaaatggc

SEQ ID NO: 109410 - DNA, 25 bp, S. pombe
tattcaaaactacaagcacggcccc

SEQ ID NO: 109411 - DNA, 25 bp, S. pombe
tactcgttcaaggtcctggtacttt

SEQ ID NO: 109412 - DNA, 25 bp, S. pombe
tcctccttctgatggtttgtactat

SEQ ID NO: 109413 - DNA, 25 bp, S. pombe
tccaccttcaattcttttgatcctg

SEQ ID NO: 109414 - DNA, 25 bp, S. pombe
tccaccatattgttttcactgtcca

SEQ ID NO: 109415 - DNA, 25 bp, S. pombe
tccggttaccttatcttaaagcgat

SEQ ID NO: 109416 - DNA, 25 bp, S. pombe
tcctgtcttgattcttcaccttaaa

SEQ ID NO: 109417 - DNA, 25 bp, S. pombe
tccgttcattgacttacgctacaac

SEQ ID NO: 109418 - DNA, 25 bp, S. pombe
tcctctgtcgtcaacgctggcaaca

SEQ ID NO: 109419 - DNA, 25 bp, S. pombe
tcctctgtcgtcaacgctggcaaca

SEQ ID NO: 109420 - DNA, 25 bp, S. pombe
tcctcttcgccttttcaattcatat

SEQ ID NO: 109421 - DNA, 25 bp, S. pombe
tcgtcttcgcggtgaacgctcataa

SEQ ID NO: 109422 - DNA, 25 bp, S. pombe
tcgtctcaaccatctactttctaat

SEQ ID NO: 109423 - DNA, 25 bp, S. pombe
tccttcaaccaggtatatcgattaa

SEQ ID NO: 109424 - DNA, 25 bp, S. pombe
tccttcctgccacggattgatatta

SEQ ID NO: 109425 - DNA, 25 bp, S. pombe
tcctgactcagtttgggctattgct

SEQ ID NO: 109426 - DNA, 25 bp, S. pombe
tcgtgacatcgttgaggcccattac

SEQ ID NO: 109427 - DNA, 25 bp, S. pombe
tcctctcaaacctatcgcattaaat

SEQ ID NO: 109428 - DNA, 25 bp, S. pombe
tccgactccccagtttgtaagtaat

SEQ ID NO: 109429 - DNA, 25 bp, S. pombe
tcctgacgcccaagttttgcaaaag

SEQ ID NO: 109430 - DNA, 25 bp, S. pombe
tcctcaagtgctcttttcctataga

SEQ ID NO: 109431 - DNA, 25 bp, S. pombe
tcagtagtgctttgatggcccctat

SEQ ID NO: 109432 - DNA, 25 bp, S. pombe
tcgagttgcagatgacacccttgat

SEQ ID NO: 109433 - DNA, 25 bp, S. pombe
tccattcgcggatttgcctgaaata

SEQ ID NO: 109434 - DNA, 25 bp, S. pombe
tcctatagccgatttgagtgaaagc

SEQ ID NO: 109435 - DNA, 25 bp, S. pombe
tcctctagctggtagctggtcaagc

SEQ ID NO: 109436 - DNA, 25 bp, S. pombe
tccggatttgttgccttttgctgaa

SEQ ID NO: 109437 - DNA, 25 bp, S. pombe
tccgagcgatggattcttcgtacaa

SEQ ID NO: 109438 - DNA, 25 bp, S. pombe
tccgaagtgtcattcccttggaaaa

SEQ ID NO: 109439 - DNA, 25 bp, S. pombe
tcggaattcttactccttgcggaag

SEQ ID NO: 109440 - DNA, 25 bp, S. pombe
tcctgcttgttatgtcctcgggaag

SEQ ID NO: 109441 - DNA, 25 bp, S. pombe
tcttttgtacttgagccgggaatcc

SEQ ID NO: 109442 - DNA, 25 bp, S. pombe
tccgttatactttagcaccctgaaa

SEQ ID NO: 109443 - DNA, 25 bp, S. pombe
tccggcaccgagttttctactttat

SEQ ID NO: 109444 - DNA, 25 bp, S. pombe
tcgcttcccgaatattagactgtta

SEQ ID NO: 109445 - DNA, 25 bp, S. pombe
tcgtgtttctggtggtggacatgtt

SEQ ID NO: 109446 - DNA, 25 bp, S. pombe
tcctttcttgatttcgtgtctgttc

SEQ ID NO: 109447 - DNA, 25 bp, S. pombe
tcgctctacgttttcagagtttttt

SEQ ID NO: 109448 - DNA, 25 bp, S. pombe
tcctcggtgttattgatcgtcattt

SEQ ID NO: 109449 - DNA, 25 bp, S. pombe
tccccttcaagtttctcatgtttta

SEQ ID NO: 109450 - DNA, 25 bp, S. pombe
tccatcttatgcagttccgctttat

SEQ ID NO: 109451 - DNA, 25 bp, S. pombe
tccattgtgctcagattcctctaaa

SEQ ID NO: 109452 - DNA, 25 bp, S. pombe
tcctaagactcttgacacatctatt

SEQ ID NO: 109453 - DNA, 25 bp, S. pombe
tcctggtcaatctggacgttgtgat

SEQ ID NO: 109454 - DNA, 25 bp, S. pombe
tccgcgcctgtttagagagtcctga

SEQ ID NO: 109455 - DNA, 25 bp, S. pombe
tcctctcctttgtatatagtccttc

SEQ ID NO: 109456 - DNA, 25 bp, S. pombe
tccgatgccgtcgaatttgtatctt

SEQ ID NO: 109457 - DNA, 25 bp, S. pombe
tccttccttttactacgactcatta

SEQ ID NO: 109458 - DNA, 25 bp, S. pombe
tccttcgctctgatagtggaactca

SEQ ID NO: 109459 - DNA, 25 bp, S. pombe
tcgctgcccctgagagaagaaccat

SEQ ID NO: 109460 - DNA, 25 bp, S. pombe
tccatgcctgctaccgatgaagtat

SEQ ID NO: 109461 - DNA, 25 bp, S. pombe
tcctgctcagcaacctatgtatgtt

SEQ ID NO: 109462 - DNA, 25 bp, S. pombe
tccatgatggacttgctcgcggtat

SEQ ID NO: 109463 - DNA, 25 bp, S. pombe
tccgttgcaccagcgatgtcatgaa

SEQ ID NO: 109464 - DNA, 25 bp, S. pombe
tcgggtacacgcaggtcgcaaggaa

SEQ ID NO: 109465 - DNA, 25 bp, S. pombe
tcctcgtacccttcagtatggaaat

SEQ ID NO: 109466 - DNA, 25 bp, S. pombe
tcctgggtccgacgctgatacaaaa

SEQ ID NO: 109467 - DNA, 25 bp, S. pombe
tccattggcttttgcccgtcggaaa

SEQ ID NO: 109468 - DNA, 25 bp, S. pombe
tccgtgtatttctaccctctggaaa

SEQ ID NO: 109469 - DNA, 25 bp, S. pombe
tccgctgttgtggaaaccgctatca

SEQ ID NO: 109470 - DNA, 25 bp, S. pombe
tccttggatgaaactggacatatca

SEQ ID NO: 109471 - DNA, 25 bp, S. pombe
tccgttcttttctccgtatttgtga

SEQ ID NO: 109472 - DNA, 25 bp, S. pombe
tccgtcactttttactcctatttca

SEQ ID NO: 109473 - DNA, 25 bp, S. pombe
tctgtcctggagctgagtcacatgg

SEQ ID NO: 109474 - DNA, 25 bp, S. pombe
tcgtcctggtgacagcactatgtgt

SEQ ID NO: 109475 - DNA, 25 bp, S. pombe
tcctgattcagatgaggctcccgaa

SEQ ID NO: 109476 - DNA, 25 bp, S. pombe
tcctgatgcggtagatgttgcccat

SEQ ID NO: 109477 - DNA, 25 bp, S. pombe
tcctgttgcatactgatcgttctat

SEQ ID NO: 109478 - DNA, 25 bp, S. pombe
tcccacttatttacttccctgaaga

SEQ ID NO: 109479 - DNA, 25 bp, S. pombe
tcctccgtgtgtttttcgtcaaaga

SEQ ID NO: 109480 - DNA, 25 bp, S. pombe
tcctccgtcgttaacactggcaaca

SEQ ID NO: 109481 - DNA, 25 bp, S. pombe
tcctccgtcgttaacactggcaaca

SEQ ID NO: 109482 - DNA, 25 bp, S. pombe
tccttctcatttctcctttaaacaa

SEQ ID NO: 109483 - DNA, 25 bp, S. pombe
tcctacgtcttttccttctatgaaa

SEQ ID NO: 109484 - DNA, 25 bp, S. pombe
tcgttcagactaccaccggagagtt

SEQ ID NO: 109485 - DNA, 25 bp, S. pombe
tcgtaaggcgcaaccccatgaagtt

SEQ ID NO: 109486 - DNA, 25 bp, S. pombe
tcctctacctcctgatacatattta

SEQ ID NO: 109487 - DNA, 25 bp, S. pombe
tcctttgtctgctcaatctactgat

SEQ ID NO: 109488 - DNA, 25 bp, S. pombe
tcctttgttgatcgtgtcacctata

SEQ ID NO: 109489 - DNA, 25 bp, S. pombe
tcgcattcttcgttggtcaggtcta

SEQ ID NO: 109490 - DNA, 25 bp, S. pombe
tcgactttgagcatgctactaccac

SEQ ID NO: 109491 - DNA, 25 bp, S. pombe
tcccttctagccatgattactcaga

SEQ ID NO: 109492 - DNA, 25 bp, S. pombe
tccgatttgcttttgagacttcctc

SEQ ID NO: 109493 - DNA, 25 bp, S. pombe
tcctcatggacttttgcgactgttt

SEQ ID NO: 109494 - DNA, 25 bp, S. pombe
tcccggacattttggatccatctac

SEQ ID NO: 109495 - DNA, 25 bp, S. pombe
tcctcaatctcatcacgtcgaaagt

SEQ ID NO: 109496 - DNA, 25 bp, S. pombe
tcgtgtctcacatcttactattggt

SEQ ID NO: 109497 - DNA, 25 bp, S. pombe
tccgtgctacatccggcagtattta

SEQ ID NO: 109498 - DNA, 25 bp, S. pombe
tccgcatacacacttacagagcacg

SEQ ID NO: 109499 - DNA, 25 bp, S. pombe
tccgcaattagctcaagaactcgtg

SEQ ID NO: 109500 - DNA, 25 bp, S. pombe
tcgtcagctaggattcggttctctt

SEQ ID NO: 109501 - DNA, 25 bp, S. pombe
tcgtactggtgatttgggctttctc

SEQ ID NO: 109502 - DNA, 25 bp, S. pombe
tcccgcttcggcacaagatgttcaa

SEQ ID NO: 109503 - DNA, 25 bp, S. pombe
tccggctctcagtgtcagtgatgat

SEQ ID NO: 109504 - DNA, 25 bp, S. pombe
tcctgtttattctcgtgctggtcaa

SEQ ID NO: 109505 - DNA, 25 bp, S. pombe
tcccgttggatgtggttgatgcgaa

SEQ ID NO: 109506 - DNA, 25 bp, S. pombe
tccggaaggcagtcgtttaagcact

SEQ ID NO: 109507 - DNA, 25 bp, S. pombe
tccggaatcgcctgttctgaaatgg

SEQ ID NO: 109508 - DNA, 25 bp, S. pombe
tcccaataatggtgcttgcgaacat

SEQ ID NO: 109509 - DNA, 25 bp, S. pombe
tcccgatgactcctctgttaaaatt

SEQ ID NO: 109510 - DNA, 25 bp, S. pombe
tcgacgtcgcccttgaaaaacttca

SEQ ID NO: 109511 - DNA, 25 bp, S. pombe
tcgtcgttcctctttaacagacact

SEQ ID NO: 109512 - DNA, 25 bp, S. pombe
tcctccgtcgtgttagaaagatcat

SEQ ID NO: 109513 - DNA, 25 bp, S. pombe
tcccaccgcatgacgaaactcaaga

SEQ ID NO: 109514 - DNA, 25 bp, S. pombe
tcccgtctttcctaatttactgttg

SEQ ID NO: 109515 - DNA, 25 bp, S. pombe
tcccgagttttcttacgctactgag

SEQ ID NO: 109516 - DNA, 25 bp, S. pombe
tcctgcaggtattttttggctagct

SEQ ID NO: 109517 - DNA, 25 bp, S. pombe
tcctgcctatgtccctattatggaa

SEQ ID NO: 109518 - DNA, 25 bp, S. pombe
tcctgcatattcaccttctatcgat

SEQ ID NO: 109519 - DNA, 25 bp, S. pombe
tctctgaagagaccaagcaacgcga

SEQ ID NO: 109520 - DNA, 25 bp, S. pombe
tcctccgtttattacacagtgcgat

SEQ ID NO: 109521 - DNA, 25 bp, S. pombe
tcctccttttcttacaatactgtcg

SEQ ID NO: 109522 - DNA, 25 bp, S. pombe
tccgccgtatgtaagcctatcgaaa

SEQ ID NO: 109523 - DNA, 25 bp, S. pombe
tcccaagctttatgcctatctcaaa

SEQ ID NO: 109524 - DNA, 25 bp, S. pombe
tccgctgccttagtccttgaggaat

SEQ ID NO: 109525 - DNA, 25 bp, S. pombe
taatacccctggtcccaatcaaaat

SEQ ID NO: 109526 - DNA, 25 bp, S. pombe
tactaccacttctcctaacaatgaa

SEQ ID NO: 109527 - DNA, 25 bp, S. pombe
tcgcttggcttactctacaacgaag

SEQ ID NO: 109528 - DNA, 25 bp, S. pombe
tcccatgccgcaatgttactacgaa

SEQ ID NO: 109529 - DNA, 25 bp, S. pombe
tcctccatcttctatcaaacacaaa

SEQ ID NO: 109530 - DNA, 25 bp, S. pombe
tcccaatcactgttgaaggcagcaa

SEQ ID NO: 109531 - DNA, 25 bp, S. pombe
tctcaccctcgcaagtacggaaagg

SEQ ID NO: 109532 - DNA, 25 bp, S. pombe
tccgcctctggcatggacgaagaac

SEQ ID NO: 109533 - DNA, 25 bp, S. pombe
tcgaatcccttctacctgatgagaa

SEQ ID NO: 109534 - DNA, 25 bp, S. pombe
tcgaccgtcattcatgtcctatggg

SEQ ID NO: 109535 - DNA, 25 bp, S. pombe
tcgcattcgtttcagtccttatagt

SEQ ID NO: 109536 - DNA, 25 bp, S. pombe
tcgataccgcttctgcttttatgga

SEQ ID NO: 109537 - DNA, 25 bp, S. pombe
tcgatatccgtgttcgtgtttctgg

SEQ ID NO: 109538 - DNA, 25 bp, S. pombe
tcctctcctcttacagtttatcgta

SEQ ID NO: 109539 - DNA, 25 bp, S. pombe
tcgtccctcaaacatgcattacatt

SEQ ID NO: 109540 - DNA, 25 bp, S. pombe
tcctccccgagaacatcatttcaaa

SEQ ID NO: 109541 - DNA, 25 bp, S. pombe
tcctctcctaattcttttctcaaga

SEQ ID NO: 109542 - DNA, 25 bp, S. pombe
tcctcgtaagcaacttgcctctaag

SEQ ID NO: 109543 - DNA, 25 bp, S. pombe
tccgccttggaagctgccattatag

SEQ ID NO: 109544 - DNA, 25 bp, S. pombe
tcctggctcggatgacatgctaata

SEQ ID NO: 109545 - DNA, 25 bp, S. pombe
tcgcgctgctctcgaaacaatacag

SEQ ID NO: 109546 - DNA, 25 bp, S. pombe
ttcctgctaggacaattgacgtttt

SEQ ID NO: 109547 - DNA, 25 bp, S. pombe
tcccttggtgggaaatctcgtgcca

SEQ ID NO: 109548 - DNA, 25 bp, S. pombe
tcgtgggcaaaaagccgacgctgat

SEQ ID NO: 109549 - DNA, 25 bp, S. pombe
tctaatgtagatgctatcccgcctg

SEQ ID NO: 109550 - DNA, 25 bp, S. pombe
tcaaagtaacgttttgccacgagtt

SEQ ID NO: 109551 - DNA, 25 bp, S. pombe
tctaactttcgtattcccgacttag

SEQ ID NO: 109552 - DNA, 25 bp, S. pombe
ttttctttaggatacgccgagcctc

SEQ ID NO: 109553 - DNA, 25 bp, S. pombe
tttaacttaggatgtccaccaccgc

SEQ ID NO: 109554 - DNA, 25 bp, S. pombe
ttaaacttggtttgcccacggcgag

SEQ ID NO: 109555 - DNA, 25 bp, S. pombe
tcacaagatttaaagtcccgccctg

SEQ ID NO: 109556 - DNA, 25 bp, S. pombe
tctaaagatccaaaggtccgacctg

SEQ ID NO: 109557 - DNA, 25 bp, S. pombe
tcgttctccatcttacgttcaacaa

SEQ ID NO: 109558 - DNA, 25 bp, S. pombe
tcgctaatcccagactttcaacagt

SEQ ID NO: 109559 - DNA, 25 bp, S. pombe
tcccacatactatcagcgtctaaag

SEQ ID NO: 109560 - DNA, 25 bp, S. pombe
tctccagcccaatttaatgccttaa

SEQ ID NO: 109561 - DNA, 25 bp, S. pombe
tcgaagctacgtttttgcctgttac

SEQ ID NO: 109562 - DNA, 25 bp, S. pombe
tcgaaatttctcttacccaagctgt

SEQ ID NO: 109563 - DNA, 25 bp, S. pombe
tcgagactattgacactaccattag

SEQ ID NO: 109564 - DNA, 25 bp, S. pombe
tcggactacttggatgtgacataca

SEQ ID NO: 109565 - DNA, 25 bp, S. pombe
tatggatgcggctggtgaactcaac

SEQ ID NO: 109566 - DNA, 25 bp, S. pombe
tctggatcgcgaatgggcaattaca

SEQ ID NO: 109567 - DNA, 25 bp, S. pombe
tcgcgaccttgctagtgaatcttct

SEQ ID NO: 109568 - DNA, 25 bp, S. pombe
tcgtcggcgctgatgtgaaaacttt

SEQ ID NO: 109569 - DNA, 25 bp, S. pombe
tcgagcgatagagccggacaacatt

SEQ ID NO: 109570 - DNA, 25 bp, S. pombe
tcggcgatttgcgatggcgatccac

SEQ ID NO: 109571 - DNA, 25 bp, S. pombe
tcgtggtttggctcagctttcagaa

SEQ ID NO: 109572 - DNA, 25 bp, S. pombe
tcctggttgcttttcatgttttgat

SEQ ID NO: 109573 - DNA, 25 bp, S. pombe
tcctccgtttgcaattggcgattta

SEQ ID NO: 109574 - DNA, 25 bp, S. pombe
tcccgcttttgcaaatcgcttagta

SEQ ID NO: 109575 - DNA, 25 bp, S. pombe
tccgttctttaattccttcgtatat

SEQ ID NO: 109576 - DNA, 25 bp, S. pombe
tccgttccgtcttccttaaggatat

SEQ ID NO: 109577 - DNA, 25 bp, S. pombe
tccgttccgtctattctatcattaa

SEQ ID NO: 109578 - DNA, 25 bp, S. pombe
tcgcgtcttttatcgcatctcaaaa

SEQ ID NO: 109579 - DNA, 25 bp, S. pombe
tccgttgtctccaccataataacta

SEQ ID NO: 109580 - DNA, 25 bp, S. pombe
tcggctctttaaggactttacacag

SEQ ID NO: 109581 - DNA, 25 bp, S. pombe
tccggtctctctgactacgataatg

SEQ ID NO: 109582 - DNA, 25 bp, S. pombe
tcctgcgttggtcgttcgatcaaaa

SEQ ID NO: 109583 - DNA, 25 bp, S. pombe
tccgcagccatgcttttggtcaaga

SEQ ID NO: 109584 - DNA, 25 bp, S. pombe
tcgagctacatgtttttgccacaaa

SEQ ID NO: 109585 - DNA, 25 bp, S. pombe
tcgccatacagtccatttgtgcgta

SEQ ID NO: 109586 - DNA, 25 bp, S. pombe
tccgacaagtattcttctgcactac

SEQ ID NO: 109587 - DNA, 25 bp, S. pombe
tcccaaactgttcgtcaagccttaa

SEQ ID NO: 109588 - DNA, 25 bp, S. pombe
tttaatgatcgtccccaaggttctg

SEQ ID NO: 109589 - DNA, 25 bp, S. pombe
tactgaagtcgacccaaatttccca

SEQ ID NO: 109590 - DNA, 25 bp, S. pombe
tcctgaagaatatccaactcgtccc

SEQ ID NO: 109591 - DNA, 25 bp, S. pombe
tcctgaagcgatgatgccaactctt

SEQ ID NO: 109592 - DNA, 25 bp, S. pombe
tcgccaacatcgcactcaaagattg

SEQ ID NO: 109593 - DNA, 25 bp, S. pombe
tcgtcgtctcggcataaaaaggtct

SEQ ID NO: 109594 - DNA, 25 bp, S. pombe
tcccgttcctatcatcaatggtggt

SEQ ID NO: 109595 - DNA, 25 bp, S. pombe
tttgctggtcgattgaaaaggcggt

SEQ ID NO: 109596 - DNA, 25 bp, S. pombe
tttccgtcgcttcaacggcggtgtt

SEQ ID NO: 109597 - DNA, 25 bp, S. pombe
tctctacttcgtttaagcgggcctt

SEQ ID NO: 109598 - DNA, 25 bp, S. pombe
tcacgtataccttttggccttcgaa

SEQ ID NO: 109599 - DNA, 25 bp, S. pombe
tcgtttatcgttcttttttcatgta

SEQ ID NO: 109600 - DNA, 25 bp, S. pombe
tcctggtattgtttttccttctagt

SEQ ID NO: 109601 - DNA, 25 bp, S. pombe
tcctgtccgtggtatttccttcaag

SEQ ID NO: 109602 - DNA, 25 bp, S. pombe
tccgggtggtgatttttctgatcct

SEQ ID NO: 109603 - DNA, 25 bp, S. pombe
tccctgaatcttagagtgcgcgtgt

SEQ ID NO: 109604 - DNA, 25 bp, S. pombe
tccctattcttcagagagcagtgca

SEQ ID NO: 109605 - DNA, 25 bp, S. pombe
tcctggatgggtactgttgactcgt

SEQ ID NO: 109606 - DNA, 25 bp, S. pombe
tcctgagaggccatcatgttgcttt

SEQ ID NO: 109607 - DNA, 25 bp, S. pombe
tcgatggtttcctttgggtattcgt

SEQ ID NO: 109608 - DNA, 25 bp, S. pombe
tcgggtttccgtatcattttcagta

SEQ ID NO: 109609 - DNA, 25 bp, S. pombe
tcggttggtccttcattttattggc

SEQ ID NO: 109610 - DNA, 25 bp, S. pombe
tcgcgttattcccaatttcatgatt

SEQ ID NO: 109611 - DNA, 25 bp, S. pombe
tcggatttatcgctcttggcatgat

SEQ ID NO: 109612 - DNA, 25 bp, S. pombe
tcgctttggcggtcttgttcataaa

SEQ ID NO: 109613 - DNA, 25 bp, S. pombe
tccgtttgcggtgccgtatatcata

SEQ ID NO: 109614 - DNA, 25 bp, S. pombe
tcgcccatctaatcctaatcaattg

SEQ ID NO: 109615 - DNA, 25 bp, S. pombe
tcccctgtacaatcgcaactttgat

SEQ ID NO: 109616 - DNA, 25 bp, S. pombe
tccgccgatcaattcacagagtcta

SEQ ID NO: 109617 - DNA, 25 bp, S. pombe
tttgtagcaaagttcgttccgatga

SEQ ID NO: 109618 - DNA, 25 bp, S. pombe
tttggaccgagcaccttccgaagag

SEQ ID NO: 109619 - DNA, 25 bp, S. pombe
tcgttacatcgacacctacttgaag

SEQ ID NO: 109620 - DNA, 25 bp, S. pombe
tcgttaccaaaagtctactgaattg

SEQ ID NO: 109621 - DNA, 25 bp, S. pombe
tcgtatttctcctccaccagatgtt

SEQ ID NO: 109622 - DNA, 25 bp, S. pombe
tcgactagtccctccacaaaggata

SEQ ID NO: 109623 - DNA, 25 bp, S. pombe
tctggaggcctaaaaaaccgcgtgt

SEQ ID NO: 109624 - DNA, 25 bp, S. pombe
tcgtaatcctattccgagaccgggt

SEQ ID NO: 109625 - DNA, 25 bp, S. pombe
tccgacatccatttgctctttatta

SEQ ID NO: 109626 - DNA, 25 bp, S. pombe
tccgaagcaatgttttatctgatca

SEQ ID NO: 109627 - DNA, 25 bp, S. pombe
tcgcgagcagttctttgccgatgaa

SEQ ID NO: 109628 - DNA, 25 bp, S. pombe
tcctggtgtcacttcatctattgca

SEQ ID NO: 109629 - DNA, 25 bp, S. pombe
tccggcttcccagttgaggaggata

SEQ ID NO: 109630 - DNA, 25 bp, S. pombe
tcccactaaacactcgcttgacgaa

SEQ ID NO: 109631 - DNA, 25 bp, S. pombe
tcccacatggaattcgtttgatcga

SEQ ID NO: 109632 - DNA, 25 bp, S. pombe
tcgccggtgctgcttatagactaag

SEQ ID NO: 109633 - DNA, 25 bp, S. pombe
tcgcctgcggctggttcattgggaa

SEQ ID NO: 109634 - DNA, 25 bp, S. pombe
tcccgacggtcttgcatggattgat

SEQ ID NO: 109635 - DNA, 25 bp, S. pombe
tccgctccgctgtcttgatgaattt

SEQ ID NO: 109636 - DNA, 25 bp, S. pombe
tcgcatgctgcccattcgaataatg

SEQ ID NO: 109637 - DNA, 25 bp, S. pombe
tcgatgacatcgctcaagtggataa

SEQ ID NO: 109638 - DNA, 25 bp, S. pombe
tcgttacgtccatatgtcaagtgca

SEQ ID NO: 109639 - DNA, 25 bp, S. pombe
tcgttacgcaccttcatgatgattc

SEQ ID NO: 109640 - DNA, 25 bp, S. pombe
tcaagaagggcgagctcgactctct

SEQ ID NO: 109641 - DNA, 25 bp, S. pombe
tcggtcatgatgtcggtacttggat

SEQ ID NO: 109642 - DNA, 25 bp, S. pombe
tcgcactgttgctagaatcgttgga

SEQ ID NO: 109643 - DNA, 25 bp, S. pombe
tcgacgtatcgaccactgatgtgag

SEQ ID NO: 109644 - DNA, 25 bp, S. pombe
tcgagcgattcgacaccgagatgat

SEQ ID NO: 109645 - DNA, 25 bp, S. pombe
tcgtgtttatcttcctggtgaccaa

SEQ ID NO: 109646 - DNA, 25 bp, S. pombe
tcagcctgcttctatgtttggtaca

SEQ ID NO: 109647 - DNA, 25 bp, S. pombe
tctgctttttggcttcgattgcaaa

SEQ ID NO: 109648 - DNA, 25 bp, S. pombe
tcgctactttcacttctggttacag

SEQ ID NO: 109649 - DNA, 25 bp, S. pombe
tcgtgcggcaattcttatgttccag

SEQ ID NO: 109650 - DNA, 25 bp, S. pombe
tcgcgctcgcatcttgaaggctggt

SEQ ID NO: 109651 - DNA, 25 bp, S. pombe
tcgttgatgttgagtccatgggact

SEQ ID NO: 109652 - DNA, 25 bp, S. pombe
tcggctatgccgatgacggaagcac

SEQ ID NO: 109653 - DNA, 25 bp, S. pombe
tccgctgtccgaatggccgaggaaa

SEQ ID NO: 109654 - DNA, 25 bp, S. pombe
tccctgccgcagattccaatggaaa

SEQ ID NO: 109655 - DNA, 25 bp, S. pombe
tcccttagcgattttcaatggtcaa

SEQ ID NO: 109656 - DNA, 25 bp, S. pombe
tcgccggactttttagcatggtgca

SEQ ID NO: 109657 - DNA, 25 bp, S. pombe
tcgccggccgaatttgagctagaaa

SEQ ID NO: 109658 - DNA, 25 bp, S. pombe
tcgtagttagtgatggtgccccaga

SEQ ID NO: 109659 - DNA, 25 bp, S. pombe
tcttacaaacctccgcgaaaattct

SEQ ID NO: 109660 - DNA, 25 bp, S. pombe
tattcccgtgaagcgtggtactttc

SEQ ID NO: 109661 - DNA, 25 bp, S. pombe
ttgacctcggaaacgatcgtacggt

SEQ ID NO: 109662 - DNA, 25 bp, S. pombe
tcgaccgtactatttacttcctagc

SEQ ID NO: 109663 - DNA, 25 bp, S. pombe
tcgctctggtacgtcttatcagttt

SEQ ID NO: 109664 - DNA, 25 bp, S. pombe
tcgcgctttggactctcagtgttat

SEQ ID NO: 109665 - DNA, 25 bp, S. pombe
tcgccaattcgcatatcgatctcag

SEQ ID NO: 109666 - DNA, 25 bp, S. pombe
tcatccagtgtctatcattcgtcga

SEQ ID NO: 109667 - DNA, 25 bp, S. pombe
tcccagttatccatcgctcgaagag

SEQ ID NO: 109668 - DNA, 25 bp, S. pombe
tctccgattactcttccaagcaata

SEQ ID NO: 109669 - DNA, 25 bp, S. pombe
tcgtcgttttggtatccgccgtaat

SEQ ID NO: 109670 - DNA, 25 bp, S. pombe
tcgtcgtaccggtttcgttgacaag

SEQ ID NO: 109671 - DNA, 25 bp, S. pombe
tcgttctgagccagtttcaactaca

SEQ ID NO: 109672 - DNA, 25 bp, S. pombe
tcgatcaccgcctgtattcaattaa

SEQ ID NO: 109673 - DNA, 25 bp, S. pombe
tcgatcccacctcttcaaataaaaa

SEQ ID NO: 109674 - DNA, 25 bp, S. pombe
tcgtcctcagcctctatagaaaagc

SEQ ID NO: 109675 - DNA, 25 bp, S. pombe
tcgtcatgctcaggcagttgccaaa

SEQ ID NO: 109676 - DNA, 25 bp, S. pombe
tcggtgtgcgaggtgcccatatgac

SEQ ID NO: 109677 - DNA, 25 bp, S. pombe
tcgttggcgcaattgcactctgcaa

SEQ ID NO: 109678 - DNA, 25 bp, S. pombe
tcgtgaggagcatgatcttcttaag

SEQ ID NO: 109679 - DNA, 25 bp, S. pombe
tcgtgccttggttctcgacaaagat

SEQ ID NO: 109680 - DNA, 25 bp, S. pombe
tcgctcggcagaacacgtcgatata

SEQ ID NO: 109681 - DNA, 25 bp, S. pombe
tcatgcttatgcgtgaggctgctaa

SEQ ID NO: 109682 - DNA, 25 bp, S. pombe
tcgctgcagtcggagcatcgatgta

SEQ ID NO: 109683 - DNA, 25 bp, S. pombe
tctctcgtcgatcgcctggtaaaat

SEQ ID NO: 109684 - DNA, 25 bp, S. pombe
tccgcgtcttcttatttactatacc

SEQ ID NO: 109685 - DNA, 25 bp, S. pombe
tcccgtttcttcatttgctgatcaa

SEQ ID NO: 109686 - DNA, 25 bp, S. pombe
tccgcggttgcatcgttggtcaaga

SEQ ID NO: 109687 - DNA, 25 bp, S. pombe
tcccggtatgattcgtgagcccaaa

SEQ ID NO: 109688 - DNA, 25 bp, S. pombe
tcccgatgttcatgctttgccaaaa

SEQ ID NO: 109689 - DNA, 25 bp, S. pombe
tcgccgtttccagtcttttagaagt

SEQ ID NO: 109690 - DNA, 25 bp, S. pombe
tccgaacgatcttcccaagcaggag

SEQ ID NO: 109691 - DNA, 25 bp, S. pombe
tcgcgtacctgaaagtgttgccaat

SEQ ID NO: 109692 - DNA, 25 bp, S. pombe
tccctgtcttggaggtatggctcat

SEQ ID NO: 109693 - DNA, 25 bp, S. pombe
tcgccgtattggatggactggttta

SEQ ID NO: 109694 - DNA, 25 bp, S. pombe
tcaccttcgggtaatagtcctctta

SEQ ID NO: 109695 - DNA, 25 bp, S. pombe
tccgccacgggaatattgttgctta

SEQ ID NO: 109696 - DNA, 25 bp, S. pombe
tccgcgcctgttcgaatagcttgct

SEQ ID NO: 109697 - DNA, 25 bp, S. pombe
tccctcccatattaagtgcttgcat

SEQ ID NO: 109698 - DNA, 25 bp, S. pombe
tcccgcttctgcgaaagtcattttt

SEQ ID NO: 109699 - DNA, 25 bp, S. pombe
tcgccgatgtgccaattcagtcatt

SEQ ID NO: 109700 - DNA, 25 bp, S. pombe
tcgcgagttgcgtatgccattcaat

SEQ ID NO: 109701 - DNA, 25 bp, S. pombe
tcgctggtgcctctgacattaaaca

SEQ ID NO: 109702 - DNA, 25 bp, S. pombe
tcccagagcttcttgacttgctaaa

SEQ ID NO: 109703 - DNA, 25 bp, S. pombe
tccctacttgcagtcagtctttgaa

SEQ ID NO: 109704 - DNA, 25 bp, S. pombe
tccctccattgctcactattgttaa

SEQ ID NO: 109705 - DNA, 25 bp, S. pombe
tccgccttacgcgaatgcttgttaa

SEQ ID NO: 109706 - DNA, 25 bp, S. pombe
tcagctgccccaaggtttggtcaaa

SEQ ID NO: 109707 - DNA, 25 bp, S. pombe
tcgccatcccaactttttagcagaa

SEQ ID NO: 109708 - DNA, 25 bp, S. pombe
tcgctccctcgggtgtacaaaagga

SEQ ID NO: 109709 - DNA, 25 bp, S. pombe
tcgaccttcgtgttcgtggtcaaca

SEQ ID NO: 109710 - DNA, 25 bp, S. pombe
tcgatgccttccaattcgttgagga

SEQ ID NO: 109711 - DNA, 25 bp, S. pombe
tcgatttgaacttggcttgcttgat

SEQ ID NO: 109712 - DNA, 25 bp, S. pombe
tcgtgccaaaccagatcccaaaaga

SEQ ID NO: 109713 - DNA, 25 bp, S. pombe
tcgtttacccaaatgccccaaatga

SEQ ID NO: 109714 - DNA, 25 bp, S. pombe
tcgtttagccgaaatgactgcccac

SEQ ID NO: 109715 - DNA, 25 bp, S. pombe
tcgtttaccacccatgatgatcgga

SEQ ID NO: 109716 - DNA, 25 bp, S. pombe
tcaggttacctattacgccggaaat

SEQ ID NO: 109717 - DNA, 25 bp, S. pombe
tcgtcgttctgtgggcaaccgtgaa

SEQ ID NO: 109718 - DNA, 25 bp, S. pombe
tcgtgattcttcagccaaccgttaa

SEQ ID NO: 109719 - DNA, 25 bp, S. pombe
tcgaattagtgcatcccaacatttg

SEQ ID NO: 109720 - DNA, 25 bp, S. pombe
tcgacatcgaatactgcaccaacat

SEQ ID NO: 109721 - DNA, 25 bp, S. pombe
tcgagctctgatattcacccaattt

SEQ ID NO: 109722 - DNA, 25 bp, S. pombe
tcgattttaaatacccctttccatg

SEQ ID NO: 109723 - DNA, 25 bp, S. pombe
tcgcttactccttatttccttatga

SEQ ID NO: 109724 - DNA, 25 bp, S. pombe
tcgtcaagtcggtgtcattgttttg

SEQ ID NO: 109725 - DNA, 25 bp, S. pombe
tcgtacaaccgagacatgggctgtt

SEQ ID NO: 109726 - DNA, 25 bp, S. pombe
tcgtgatcccagtatgcaagtccag

SEQ ID NO: 109727 - DNA, 25 bp, S. pombe
tcgacgctccaattggtgtcacaat

SEQ ID NO: 109728 - DNA, 25 bp, S. pombe
tcagtttgccaagtattgcccagta

SEQ ID NO: 109729 - DNA, 25 bp, S. pombe
tcgtttgcagcattttgatccggct

SEQ ID NO: 109730 - DNA, 25 bp, S. pombe
tcgctggctaatcatcctgtggagt

SEQ ID NO: 109731 - DNA, 25 bp, S. pombe
tcgcggcttcatcatttttactaac

SEQ ID NO: 109732 - DNA, 25 bp, S. pombe
tcgcggatttgatctatttcctcaa

SEQ ID NO: 109733 - DNA, 25 bp, S. pombe
tcggccacctatttatactcggaag

SEQ ID NO: 109734 - DNA, 25 bp, S. pombe
tctattggccttttcaacataagaa

SEQ ID NO: 109735 - DNA, 25 bp, S. pombe
tccctccgatgctaaacgttcaaga

SEQ ID NO: 109736 - DNA, 25 bp, S. pombe
tccctgtcgtccaaacttctgaaga

SEQ ID NO: 109737 - DNA, 25 bp, S. pombe
tcccgtcgtttaggccttgctagaa

SEQ ID NO: 109738 - DNA, 25 bp, S. pombe
tcttcccgttgttggcgtcgcgaaa

SEQ ID NO: 109739 - DNA, 25 bp, S. pombe
tcgtccttggcttaggtgctggaat

SEQ ID NO: 109740 - DNA, 25 bp, S. pombe
tcgtccttggcgtcgtattaacatg

SEQ ID NO: 109741 - DNA, 25 bp, S. pombe
tcgtctttgacggtgttcatagcag

SEQ ID NO: 109742 - DNA, 25 bp, S. pombe
tcgttatacccgctattgtcagaag

SEQ ID NO: 109743 - DNA, 25 bp, S. pombe
tcgtcttcccaccaagatcttgaaa

SEQ ID NO: 109744 - DNA, 25 bp, S. pombe
tcgcgttccccagatattgtggcaa

SEQ ID NO: 109745 - DNA, 25 bp, S. pombe
tcgagttcgctcaaacatggctgtt

SEQ ID NO: 109746 - DNA, 25 bp, S. pombe
tcggcttcgaggtttcgccaagagg

SEQ ID NO: 109747 - DNA, 25 bp, S. pombe
tcggttcgggtgttagccttaatga

SEQ ID NO: 109748 - DNA, 25 bp, S. pombe
tcgttttgggtggtagctttgctac

SEQ ID NO: 109749 - DNA, 25 bp, S. pombe
tcgcgctgtcttcgtaaactttgta

SEQ ID NO: 109750 - DNA, 25 bp, S. pombe
tcgcccatcattttaaagcccgtag

SEQ ID NO: 109751 - DNA, 25 bp, S. pombe
tcgactctctttttaatactgccta

SEQ ID NO: 109752 - DNA, 25 bp, S. pombe
tcgtctacttctactactactagca

SEQ ID NO: 109753 - DNA, 25 bp, S. pombe
tcccattgttggtcatatcacttct

SEQ ID NO: 109754 - DNA, 25 bp, S. pombe
tcgcacggcactcaaagcatttttg

SEQ ID NO: 109755 - DNA, 25 bp, S. pombe
tcgctcgtggaggaactgcagtttt

SEQ ID NO: 109756 - DNA, 25 bp, S. pombe
tcgctcgtgccggaaaggtcaaatc

SEQ ID NO: 109757 - DNA, 25 bp, S. pombe
tcgcgcttggcgtatacacgaatat

SEQ ID NO: 109758 - DNA, 25 bp, S. pombe
tcgtgctcgagccactgaacaattt

SEQ ID NO: 109759 - DNA, 25 bp, S. pombe
tcgcatgcgcatacctatatcaaaa

SEQ ID NO: 109760 - DNA, 25 bp, S. pombe
tcgagcgtaacgttcaagcactaag

SEQ ID NO: 109761 - DNA, 25 bp, S. pombe
tcgtgctttacttcgcaaggctgaa

SEQ ID NO: 109762 - DNA, 25 bp, S. pombe
tcggtggctagaaacggcgcattta

SEQ ID NO: 109763 - DNA, 25 bp, S. pombe
tcgtgtgttataaaagggcatccct

SEQ ID NO: 109764 - DNA, 25 bp, S. pombe
tcgtagcttcaaaaatggtttccgt

SEQ ID NO: 109765 - DNA, 25 bp, S. pombe
tcgccgtcgctattgaaggtttgtc

SEQ ID NO: 109766 - DNA, 25 bp, S. pombe
tagccgacatgttggagagcgttga

SEQ ID NO: 109767 - DNA, 25 bp, S. pombe
tcgtttcttctcagaggctgcgaaa

SEQ ID NO: 109768 - DNA, 25 bp, S. pombe
tcccaaggtggagccgctcaatcat

SEQ ID NO: 109769 - DNA, 25 bp, S. pombe
tcgccgttcaacgtgtttcaacttt

SEQ ID NO: 109770 - DNA, 25 bp, S. pombe
tcccacttcacatatctgtcattag

SEQ ID NO: 109771 - DNA, 25 bp, S. pombe
tcacgcgagtgcctacagatgacta

SEQ ID NO: 109772 - DNA, 25 bp, S. pombe
tcgaatgttcgacgttggtggtcaa

SEQ ID NO: 109773 - DNA, 25 bp, S. pombe
tttagcgaatgacccggttgttcct

SEQ ID NO: 109774 - DNA, 25 bp, S. pombe
tcgccaacttctcggtaatggtgtt

SEQ ID NO: 109775 - DNA, 25 bp, S. pombe
tctccatggaactctgtgcatctgc

SEQ ID NO: 109776 - DNA, 25 bp, S. pombe
tctccatgcttgatcctgaatctga

SEQ ID NO: 109777 - DNA, 25 bp, S. pombe
tcgtcaaattgatctctctaccttt

SEQ ID NO: 109778 - DNA, 25 bp, S. pombe
tcgacataatttctctctacatcat

SEQ ID NO: 109779 - DNA, 25 bp, S. pombe
tcgcctactgttcgagctgtaaatc

SEQ ID NO: 109780 - DNA, 25 bp, S. pombe
tcgacgatatttgcgttgagcccaa

SEQ ID NO: 109781 - DNA, 25 bp, S. pombe
tcgccgtgttgttcgtgtgaccaaa

SEQ ID NO: 109782 - DNA, 25 bp, S. pombe
tcacggtagttttcttgacctaaat

SEQ ID NO: 109783 - DNA, 25 bp, S. pombe
tcccacggtacatcgttcaacatta

SEQ ID NO: 109784 - DNA, 25 bp, S. pombe
tcgctcaaggaaaacgtctgcaaat

SEQ ID NO: 109785 - DNA, 25 bp, S. pombe
tcgtgcttggaagacagctcatcaa

SEQ ID NO: 109786 - DNA, 25 bp, S. pombe
tcgcactgtggatccaattcctgaa

SEQ ID NO: 109787 - DNA, 25 bp, S. pombe
tcgcgtacctcttcatgttaacaag

SEQ ID NO: 109788 - DNA, 25 bp, S. pombe
tcgcctacacccgatgttacaatta

SEQ ID NO: 109789 - DNA, 25 bp, S. pombe
tcgccttctcccatatcaatgaaaa

SEQ ID NO: 109790 - DNA, 25 bp, S. pombe
tctcgaccccaaagtcttttcatag

SEQ ID NO: 109791 - DNA, 25 bp, S. pombe
tcgtatccccattcaacatgttttg

SEQ ID NO: 109792 - DNA, 25 bp, S. pombe
tcgcttcgttgtctgttttactttt

SEQ ID NO: 109793 - DNA, 25 bp, S. pombe
tcacaattttggctttctttcgttt

SEQ ID NO: 109794 - DNA, 25 bp, S. pombe
tcgccgctcttttattatctttgtt

SEQ ID NO: 109795 - DNA, 25 bp, S. pombe
tcgacagcctgtaatcatttttatg

SEQ ID NO: 109796 - DNA, 25 bp, S. pombe
tcgccgtgcctgaatctattcttaa

SEQ ID NO: 109797 - DNA, 25 bp, S. pombe
tcgccgtgcctcttctttgaaaaag

SEQ ID NO: 109798 - DNA, 25 bp, S. pombe
tcgcccatttttccttaaaccagat

SEQ ID NO: 109799 - DNA, 25 bp, S. pombe
tcgcgatgctttacccgtgaaactt

SEQ ID NO: 109800 - DNA, 25 bp, S. pombe
tcgcgcttattaccctggaatttat

SEQ ID NO: 109801 - DNA, 25 bp, S. pombe
tcgcgcttttgagcaaggtcatgtt

SEQ ID NO: 109802 - DNA, 25 bp, S. pombe
tcgaatctgatgaattgcgggctaa

SEQ ID NO: 109803 - DNA, 25 bp, S. pombe
tctgatcctgaaattcgacgctcac

SEQ ID NO: 109804 - DNA, 25 bp, S. pombe
tctgaagaatcaaaggaacgcctag

SEQ ID NO: 109805 - DNA, 25 bp, S. pombe
tctgaagcttcaaaggacccatctt

SEQ ID NO: 109806 - DNA, 25 bp, S. pombe
tctaacttctaactttgcttcgtcc

SEQ ID NO: 109807 - DNA, 25 bp, S. pombe
tcttgggttagacacgttggctttc

SEQ ID NO: 109808 - DNA, 25 bp, S. pombe
tcgcttctgctcgattacttaagtt

SEQ ID NO: 109809 - DNA, 25 bp, S. pombe
tcgcttctgccgagacttcgaagaa

SEQ ID NO: 109810 - DNA, 25 bp, S. pombe
tcaccaacggctttaacacctaacg

SEQ ID NO: 109811 - DNA, 25 bp, S. pombe
tctcaatggcctgtttcgattttca

SEQ ID NO: 109812 - DNA, 25 bp, S. pombe
tctcaaatgcctacttcttctttta

SEQ ID NO: 109813 - DNA, 25 bp, S. pombe
tcgacaaatctcttttcaccatggg

SEQ ID NO: 109814 - DNA, 25 bp, S. pombe
tcgaacaacttcatccaacatctgg

SEQ ID NO: 109815 - DNA, 25 bp, S. pombe
tagcgggtgcaggtggtcaattttc

SEQ ID NO: 109816 - DNA, 25 bp, S. pombe
tcagcaggaggagcgttcacagatt

SEQ ID NO: 109817 - DNA, 25 bp, S. pombe
tcgcttctggctatgtatctcttga

SEQ ID NO: 109818 - DNA, 25 bp, S. pombe
tctccttggccttgtatatctagtc

SEQ ID NO: 109819 - DNA, 25 bp, S. pombe
tcgatgcttggattgtttactgaac

SEQ ID NO: 109820 - DNA, 25 bp, S. pombe
tcgcatgtcgattatttgtgaagaa

SEQ ID NO: 109821 - DNA, 25 bp, S. pombe
tcgctgtctgcatgttggtgatcaa

SEQ ID NO: 109822 - DNA, 25 bp, S. pombe
tcaaatttacggtcgaccctgtggc

SEQ ID NO: 109823 - DNA, 25 bp, S. pombe
tcgaaattactagcagaccaccaat

SEQ ID NO: 109824 - DNA, 25 bp, S. pombe
tcgacctgctaatgggactcccata

SEQ ID NO: 109825 - DNA, 25 bp, S. pombe
tcgtttttgaagctgatcctcctaa

SEQ ID NO: 109826 - DNA, 25 bp, S. pombe
tcgttattttggaaagcctctggct

SEQ ID NO: 109827 - DNA, 25 bp, S. pombe
tcttctttgttgtcttggttacgtt

SEQ ID NO: 109828 - DNA, 25 bp, S. pombe
tcgttatgctgcttggatttcccaa

SEQ ID NO: 109829 - DNA, 25 bp, S. pombe
tcgtcaatgcttctaatgccaccaa

SEQ ID NO: 109830 - DNA, 25 bp, S. pombe
tcgtcgctgcttctaagtaccaaat

SEQ ID NO: 109831 - DNA, 25 bp, S. pombe
tcgttctgcttcatcgaaatccaat

SEQ ID NO: 109832 - DNA, 25 bp, S. pombe
tcgctggccggaagccctggtaaag

SEQ ID NO: 109833 - DNA, 25 bp, S. pombe
tcatggcgacgttgaatttcctaaa

SEQ ID NO: 109834 - DNA, 25 bp, S. pombe
tcgcatggtcgattctgttctcaaa

SEQ ID NO: 109835 - DNA, 25 bp, S. pombe
tcggttcgtttgtcactcatgaatc

SEQ ID NO: 109836 - DNA, 25 bp, S. pombe
tcggttcgtgttaattctacctcta

SEQ ID NO: 109837 - DNA, 25 bp, S. pombe
tcggttcaatttatggtcgctcctc

SEQ ID NO: 109838 - DNA, 25 bp, S. pombe
tcaggaaaacttttgtccgctatat

SEQ ID NO: 109839 - DNA, 25 bp, S. pombe
tcgacttgagtcgtcacaacacttt

SEQ ID NO: 109840 - DNA, 25 bp, S. pombe
tctcacgtagctgtgtaccaatttg

SEQ ID NO: 109841 - DNA, 25 bp, S. pombe
tctccagctacggttactacattac

SEQ ID NO: 109842 - DNA, 25 bp, S. pombe
tcggcgtccggaattacaactacag

SEQ ID NO: 109843 - DNA, 25 bp, S. pombe
tctggccttttaacgggtgctggaa

SEQ ID NO: 109844 - DNA, 25 bp, S. pombe
tcgaaactcttatcgtccatctagg

SEQ ID NO: 109845 - DNA, 25 bp, S. pombe
tcgaaacctttgctgatatccataa

SEQ ID NO: 109846 - DNA, 25 bp, S. pombe
tcgtgtaccttatgcctgccaagga

SEQ ID NO: 109847 - DNA, 25 bp, S. pombe
tcggtacccttaagcgtgccaaggg

SEQ ID NO: 109848 - DNA, 25 bp, S. pombe
tcggaaactgctaaggcgtgctcaa

SEQ ID NO: 109849 - DNA, 25 bp, S. pombe
tctccgtcaattacaaggtctcttc

SEQ ID NO: 109850 - DNA, 25 bp, S. pombe
tcgttctcaccttgataccttatga

SEQ ID NO: 109851 - DNA, 25 bp, S. pombe
tcgctatgccactttgtacttttca

SEQ ID NO: 109852 - DNA, 25 bp, S. pombe
tctaatgccgatgttactcgtctca

SEQ ID NO: 109853 - DNA, 25 bp, S. pombe
tctactgttgtagaccctttcggaa

SEQ ID NO: 109854 - DNA, 25 bp, S. pombe
tcgaggtttcaggatctcttgcttc

SEQ ID NO: 109855 - DNA, 25 bp, S. pombe
tcggttattcaggtgctgctgtcaa

SEQ ID NO: 109856 - DNA, 25 bp, S. pombe
tcgagtatcactcgctgatcgtgat

SEQ ID NO: 109857 - DNA, 25 bp, S. pombe
tcgatgctacttatggctgtgatgc

SEQ ID NO: 109858 - DNA, 25 bp, S. pombe
tcgatgctagcgttttgcgtcagat

SEQ ID NO: 109859 - DNA, 25 bp, S. pombe
tcggagcctttgtttgatcagcatt

SEQ ID NO: 109860 - DNA, 25 bp, S. pombe
tcagggctttcttttccaataggtt

SEQ ID NO: 109861 - DNA, 25 bp, S. pombe
tcgggtttacattagcgtcttggaa

SEQ ID NO: 109862 - DNA, 25 bp, S. pombe
tctgttatctcattgtttggtgcca

SEQ ID NO: 109863 - DNA, 25 bp, S. pombe
tctgctggttgggacaaggccgtta

SEQ ID NO: 109864 - DNA, 25 bp, S. pombe
tctgctactttaccaaggacgcttt

SEQ ID NO: 109865 - DNA, 25 bp, S. pombe
tcgcaactttgaatatcggacactg

SEQ ID NO: 109866 - DNA, 25 bp, S. pombe
tcgatagccttggtacggagcgtac

SEQ ID NO: 109867 - DNA, 25 bp, S. pombe
tctcctcaggaagccaaggtgctgt

SEQ ID NO: 109868 - DNA, 25 bp, S. pombe
tcgtcatcggaagctcgcaggttga

SEQ ID NO: 109869 - DNA, 25 bp, S. pombe
tcgtcaaggaatgtgtcgcgtggaa

SEQ ID NO: 109870 - DNA, 25 bp, S. pombe
tcattattgggtctgccgtttgcaa

SEQ ID NO: 109871 - DNA, 25 bp, S. pombe
tcattactcacgacttccgtttaat

SEQ ID NO: 109872 - DNA, 25 bp, S. pombe
tctcgacaccacttttcgggtatta

SEQ ID NO: 109873 - DNA, 25 bp, S. pombe
tctggcttcaaagtttactggtctt

SEQ ID NO: 109874 - DNA, 25 bp, S. pombe
tctggtagatacttgacgagcggtc

SEQ ID NO: 109875 - DNA, 25 bp, S. pombe
tctgagaggaggacctcgctcggca

SEQ ID NO: 109876 - DNA, 25 bp, S. pombe
tcgataagactgacacacgtagtac

SEQ ID NO: 109877 - DNA, 25 bp, S. pombe
tcgagaagcagccaccacggaatat

SEQ ID NO: 109878 - DNA, 25 bp, S. pombe
tcgggtgcctcctatcagaatgaat

SEQ ID NO: 109879 - DNA, 25 bp, S. pombe
tcggtggtctgcgattgatgccaat

SEQ ID NO: 109880 - DNA, 25 bp, S. pombe
tcgacgtgttgcttcttttatggga

SEQ ID NO: 109881 - DNA, 25 bp, S. pombe
tcgagctttcgagtttcttatttaa

SEQ ID NO: 109882 - DNA, 25 bp, S. pombe
tcgacttcccgatttgcttgaatta

SEQ ID NO: 109883 - DNA, 25 bp, S. pombe
tcgactttgacgcttgcattgttta

SEQ ID NO: 109884 - DNA, 25 bp, S. pombe
tcgtcatgattgtcggctcttttat

SEQ ID NO: 109885 - DNA, 25 bp, S. pombe
tcgtgcagcttttgagtcttttcct

SEQ ID NO: 109886 - DNA, 25 bp, S. pombe
tcttatgctcgtcttgtaggtccaa

SEQ ID NO: 109887 - DNA, 25 bp, S. pombe
tcgataatcgtcctttctggcttaa

SEQ ID NO: 109888 - DNA, 25 bp, S. pombe
tcgaatgcgcctgatgttgagaaca

SEQ ID NO: 109889 - DNA, 25 bp, S. pombe
tcgtgatttctcgtgcaatgccaaa

SEQ ID NO: 109890 - DNA, 25 bp, S. pombe
tcgtctatcctctgctagaagtgca

SEQ ID NO: 109891 - DNA, 25 bp, S. pombe
tcgagagatgttttacttggcctat

SEQ ID NO: 109892 - DNA, 25 bp, S. pombe
tcgagcctttctccattgacagaga

SEQ ID NO: 109893 - DNA, 25 bp, S. pombe
tcgatccttttcgttggcaacttgg

SEQ ID NO: 109894 - DNA, 25 bp, S. pombe
tcgatactttcgacctggaactagt

SEQ ID NO: 109895 - DNA, 25 bp, S. pombe
tcggcttcttgcaccagtaactagt

SEQ ID NO: 109896 - DNA, 25 bp, S. pombe
tcggtttcgtgagcagagttctact

SEQ ID NO: 109897 - DNA, 25 bp, S. pombe
tctgccttgcttcttggagttccat

SEQ ID NO: 109898 - DNA, 25 bp, S. pombe
tctgccttaaaacctgacccaattg

SEQ ID NO: 109899 - DNA, 25 bp, S. pombe
tctgcttttacctctgacgaggaca

SEQ ID NO: 109900 - DNA, 25 bp, S. pombe
tcgttcatctgtacaattccttcgt

SEQ ID NO: 109901 - DNA, 25 bp, S. pombe
tcgtcctggcaatgatcctgttgta

SEQ ID NO: 109902 - DNA, 25 bp, S. pombe
tcgtttccttatccttcgagaacaa

SEQ ID NO: 109903 - DNA, 25 bp, S. pombe
tcgttcacctatttctattgctgca

SEQ ID NO: 109904 - DNA, 25 bp, S. pombe
tcgtgtcaccgaacttcattcagaa

SEQ ID NO: 109905 - DNA, 25 bp, S. pombe
tcaggtccgagtatttgcgcaaatg

SEQ ID NO: 109906 - DNA, 25 bp, S. pombe
tcggatcttagtatgcattgccaaa

SEQ ID NO: 109907 - DNA, 25 bp, S. pombe
tcggcatggctagtgttattcccaa

SEQ ID NO: 109908 - DNA, 25 bp, S. pombe
ttcgttgatgagcttaagaccaagt

SEQ ID NO: 109909 - DNA, 25 bp, S. pombe
tctcggactacgaagacgcctttta

SEQ ID NO: 109910 - DNA, 25 bp, S. pombe
tctcggacaccgatgatccaaggtt

SEQ ID NO: 109911 - DNA, 25 bp, S. pombe
tctctggtcactttttccgtaacaa

SEQ ID NO: 109912 - DNA, 25 bp, S. pombe
tctcgggccatgttttcttgttaac

SEQ ID NO: 109913 - DNA, 25 bp, S. pombe
tctgtgtcgggtactttggttgaac

SEQ ID NO: 109914 - DNA, 25 bp, S. pombe
tcgttcgcaggtggcttacagtcaa

SEQ ID NO: 109915 - DNA, 25 bp, S. pombe
tcgttcctcgttctgacattaatgc

SEQ ID NO: 109916 - DNA, 25 bp, S. pombe
tcgtcgcgggcttttatatgtaatc

SEQ ID NO: 109917 - DNA, 25 bp, S. pombe
tcgtgaccgcgattctaatagatat

SEQ ID NO: 109918 - DNA, 25 bp, S. pombe
tcgtcccgatttggtggtcattcaa

SEQ ID NO: 109919 - DNA, 25 bp, S. pombe
tcgttacgttcaggcttgttttcaa

SEQ ID NO: 109920 - DNA, 25 bp, S. pombe
tcgtttcttgacgtcctttattgaa

SEQ ID NO: 109921 - DNA, 25 bp, S. pombe
tctgcttttgcgatgtagtttcttt

SEQ ID NO: 109922 - DNA, 25 bp, S. pombe
tcttttgctgctccgaaatcttctt

SEQ ID NO: 109923 - DNA, 25 bp, S. pombe
tctttgcgtcccgattatcatgagt

SEQ ID NO: 109924 - DNA, 25 bp, S. pombe
tcttctgttacccatgcattcaagt

SEQ ID NO: 109925 - DNA, 25 bp, S. pombe
tctacagttggctctctttctaaag

SEQ ID NO: 109926 - DNA, 25 bp, S. pombe
tcttgcagtttctctaccttgatga

SEQ ID NO: 109927 - DNA, 25 bp, S. pombe
tcggatgctaacatgttcgctgaca

SEQ ID NO: 109928 - DNA, 25 bp, S. pombe
tcgtgcagtacgatcctcctgatga

SEQ ID NO: 109929 - DNA, 25 bp, S. pombe
tcgtcacattgtttttgcagtcttg

SEQ ID NO: 109930 - DNA, 25 bp, S. pombe
tcgttcattcgagtttagacattgt

SEQ ID NO: 109931 - DNA, 25 bp, S. pombe
tcttttcacagtttaccacattcct

SEQ ID NO: 109932 - DNA, 25 bp, S. pombe
tcgtggctctgttcggtatacacat

SEQ ID NO: 109933 - DNA, 25 bp, S. pombe
tctgctcgccgttctgttaacaaag

SEQ ID NO: 109934 - DNA, 25 bp, S. pombe
tcgtccaagctccagtcaagatcaa

SEQ ID NO: 109935 - DNA, 25 bp, S. pombe
tctattcaatccatccaactaactc

SEQ ID NO: 109936 - DNA, 25 bp, S. pombe
tctccaaggcttgacgtacgaatat

SEQ ID NO: 109937 - DNA, 25 bp, S. pombe
tctccaaggatagagcgtcgctgct

SEQ ID NO: 109938 - DNA, 25 bp, S. pombe
tcgttatctttaatcgtctgcgtcg

SEQ ID NO: 109939 - DNA, 25 bp, S. pombe
tcttttcgacctccgtatggaattc

SEQ ID NO: 109940 - DNA, 25 bp, S. pombe
tctattggcgacaggcggtggcaca

SEQ ID NO: 109941 - DNA, 25 bp, S. pombe
tctaatgttactacgtctcctgttc

SEQ ID NO: 109942 - DNA, 25 bp, S. pombe
tcgattgagtacacgattgcagcaa

SEQ ID NO: 109943 - DNA, 25 bp, S. pombe
tcgtctcgtatggtgcgtttgtcaa

SEQ ID NO: 109944 - DNA, 25 bp, S. pombe
tctcctcgtaccatgactcgtgaat

SEQ ID NO: 109945 - DNA, 25 bp, S. pombe
tctcccgttacactcattggaaaca

SEQ ID NO: 109946 - DNA, 25 bp, S. pombe
tcattagcggagtcagcctggtcga

SEQ ID NO: 109947 - DNA, 25 bp, S. pombe
tctgcagaattattacgctcccgat

SEQ ID NO: 109948 - DNA, 25 bp, S. pombe
tctgtatggctcacaagtccttcat

SEQ ID NO: 109949 - DNA, 25 bp, S. pombe
tcgttcatgctaatcgtgtccttaa

SEQ ID NO: 109950 - DNA, 25 bp, S. pombe
tctgatttcgaagcttgtctgggtg

SEQ ID NO: 109951 - DNA, 25 bp, S. pombe
tctctcttccgaggttggctggaaa

SEQ ID NO: 109952 - DNA, 25 bp, S. pombe
tctccttccgagattgtcaagcaaa

SEQ ID NO: 109953 - DNA, 25 bp, S. pombe
tctgttcccgaaactgacaagtctc

SEQ ID NO: 109954 - DNA, 25 bp, S. pombe
tctggtcagccgaatggtcacattg

SEQ ID NO: 109955 - DNA, 25 bp, S. pombe
tctggtattcgaaagtcatgcacat

SEQ ID NO: 109956 - DNA, 25 bp, S. pombe
tcgtgcctatcatccatacggtatg

SEQ ID NO: 109957 - DNA, 25 bp, S. pombe
tctggaacatgcaagcgcgattctt

SEQ ID NO: 109958 - DNA, 25 bp, S. pombe
tctccgcttctacgattgttggtaa

SEQ ID NO: 109959 - DNA, 25 bp, S. pombe
tcggtccattacctgtttggccaag

SEQ ID NO: 109960 - DNA, 25 bp, S. pombe
tcggttgctccattttctgggaaca

SEQ ID NO: 109961 - DNA, 25 bp, S. pombe
tcgttatgactctcgctctggtacc

SEQ ID NO: 109962 - DNA, 25 bp, S. pombe
tcgatttatttgtctgcgctagcca

SEQ ID NO: 109963 - DNA, 25 bp, S. pombe
tcgtgtattctattctgctctcaat

SEQ ID NO: 109964 - DNA, 25 bp, S. pombe
tcgtattctgtatatgctcttcact

SEQ ID NO: 109965 - DNA, 25 bp, S. pombe
tctgatcaaagcatcgttcgcgctg

SEQ ID NO: 109966 - DNA, 25 bp, S. pombe
tcggaatttctgttggcctatttgc

SEQ ID NO: 109967 - DNA, 25 bp, S. pombe
tcagcttcctatcgatatgggtggt

SEQ ID NO: 109968 - DNA, 25 bp, S. pombe
tcgttgcctgcattggtgagacttt

SEQ ID NO: 109969 - DNA, 25 bp, S. pombe
tcgtggtgcctatttgagaactcat

SEQ ID NO: 109970 - DNA, 25 bp, S. pombe
tcttgagcgccttaagaagatccaa

SEQ ID NO: 109971 - DNA, 25 bp, S. pombe
tctggcccttctttcaaactgtgaa

SEQ ID NO: 109972 - DNA, 25 bp, S. pombe
tctgcctctgctttggtcattaagg

SEQ ID NO: 109973 - DNA, 25 bp, S. pombe
tctccggtctttcatcagtttttag

SEQ ID NO: 109974 - DNA, 25 bp, S. pombe
tctacggtgttttacgaatgtcctc

SEQ ID NO: 109975 - DNA, 25 bp, S. pombe
ttacttttaatcttggactcgagga

SEQ ID NO: 109976 - DNA, 25 bp, S. pombe
tcatctcgtcttcaaaaactgcgtg

SEQ ID NO: 109977 - DNA, 25 bp, S. pombe
tcgtcatcaccaaatcctgttttta

SEQ ID NO: 109978 - DNA, 25 bp, S. pombe
tcgtcatcaactgtcttctcttgtt

SEQ ID NO: 109979 - DNA, 25 bp, S. pombe
tcgttcctcgatattctttgttcta

SEQ ID NO: 109980 - DNA, 25 bp, S. pombe
tcgtcgcacgtgatgtttactttat

SEQ ID NO: 109981 - DNA, 25 bp, S. pombe
tcgtgccgttgagtggtttactggt

SEQ ID NO: 109982 - DNA, 25 bp, S. pombe
tcgtatcctccgttgtactgattat

SEQ ID NO: 109983 - DNA, 25 bp, S. pombe
tcgtcctggtcgtctagatcgtaaa

SEQ ID NO: 109984 - DNA, 25 bp, S. pombe
tcgtcgctggtgctgtattttacaa

SEQ ID NO: 109985 - DNA, 25 bp, S. pombe
tcgtccggtggtctttctagtaatt

SEQ ID NO: 109986 - DNA, 25 bp, S. pombe
taggacgagtgggatttttattaat

SEQ ID NO: 109987 - DNA, 25 bp, S. pombe
ttggacgcaggtatctctttaaaat

SEQ ID NO: 109988 - DNA, 25 bp, S. pombe
tcttaccggtcgtcttttcacacaa

SEQ ID NO: 109989 - DNA, 25 bp, S. pombe
tcgtgccgccgtaggttttatcaaa

SEQ ID NO: 109990 - DNA, 25 bp, S. pombe
tcgggagccttttcttgtatatcaa

SEQ ID NO: 109991 - DNA, 25 bp, S. pombe
tctagcattccgtttccgtttgaaa

SEQ ID NO: 109992 - DNA, 25 bp, S. pombe
tcttttccgaaaccagctagtagcc

SEQ ID NO: 109993 - DNA, 25 bp, S. pombe
tcgtctctcgcacaaccagaagaag

SEQ ID NO: 109994 - DNA, 25 bp, S. pombe
tcgtcgattccggtcactgatataa

SEQ ID NO: 109995 - DNA, 25 bp, S. pombe
tcggtctctcagctgaacatggtag

SEQ ID NO: 109996 - DNA, 25 bp, S. pombe
tctgcgctatcccacttattggaag

SEQ ID NO: 109997 - DNA, 25 bp, S. pombe
tctctgaagccctgattgtgcgcaa

SEQ ID NO: 109998 - DNA, 25 bp, S. pombe
tctggaagccaaaactgtgtcacct

SEQ ID NO: 109999 - DNA, 25 bp, S. pombe
tctgagttcaacttcgttacccttt

SEQ ID NO: 110000 - DNA, 25 bp, S. pombe
tctgattgtaactacgttcctccta

SEQ ID NO: 110001 - DNA, 25 bp, S. pombe
tctgttatcgtggaagtcccgacta

SEQ ID NO: 110002 - DNA, 25 bp, S. pombe
tcatctggttccatacgaagcccat

SEQ ID NO: 110003 - DNA, 25 bp, S. pombe
tcttcgaatcctaaggagcctccat

SEQ ID NO: 110004 - DNA, 25 bp, S. pombe
tctatatactcaaacgacgtccctg

SEQ ID NO: 110005 - DNA, 25 bp, S. pombe
tctccgatcctgctgaagctttaga

SEQ ID NO: 110006 - DNA, 25 bp, S. pombe
tctctcaattctcatgctactctaa

SEQ ID NO: 110007 - DNA, 25 bp, S. pombe
tcggctcatttattgcttaccacag

SEQ ID NO: 110008 - DNA, 25 bp, S. pombe
tctggcctcgtattgcttcaaatgc

SEQ ID NO: 110009 - DNA, 25 bp, S. pombe
tcggcgtcaactatctcgtttatgt

SEQ ID NO: 110010 - DNA, 25 bp, S. pombe
tcgtgttaatcccactggcttttaa

SEQ ID NO: 110011 - DNA, 25 bp, S. pombe
tctattcccaagactctgcaagcta

SEQ ID NO: 110012 - DNA, 25 bp, S. pombe
tctactgccactcaatctagcgctg

SEQ ID NO: 110013 - DNA, 25 bp, S. pombe
tctaatcttaaacaaggcactcatc

SEQ ID NO: 110014 - DNA, 25 bp, S. pombe
tctactttacccaaggatgcttctt

SEQ ID NO: 110015 - DNA, 25 bp, S. pombe
tctcctgtaggacgcaatgccaata

SEQ ID NO: 110016 - DNA, 25 bp, S. pombe
tcttatgctgagttgcgaggaccta

SEQ ID NO: 110017 - DNA, 25 bp, S. pombe
tcgtgcagccgcgtataatcagcta

SEQ ID NO: 110018 - DNA, 25 bp, S. pombe
tcgtttacatcaaatccggcgatct

SEQ ID NO: 110019 - DNA, 25 bp, S. pombe
tcgtgttactcaaaagcgtcctcgt

SEQ ID NO: 110020 - DNA, 25 bp, S. pombe
tatggttaccaatgtcctccagtgg

SEQ ID NO: 110021 - DNA, 25 bp, S. pombe
tcttttgatcaactgtcgcatgctc

SEQ ID NO: 110022 - DNA, 25 bp, S. pombe
tcttgcatgaggacgggctccaatt

SEQ ID NO: 110023 - DNA, 25 bp, S. pombe
tctacaagtgtctatggcccaagct

SEQ ID NO: 110024 - DNA, 25 bp, S. pombe
tctcgagagtgtgatgccccataac

SEQ ID NO: 110025 - DNA, 25 bp, S. pombe
tcttgagactttacagcccaaccaa

SEQ ID NO: 110026 - DNA, 25 bp, S. pombe
tctcgcagcggttattttgggtcca

SEQ ID NO: 110027 - DNA, 25 bp, S. pombe
tctcccgatgaattattgttggctt

SEQ ID NO: 110028 - DNA, 25 bp, S. pombe
tctcctggattgcttcttctgtctc

SEQ ID NO: 110029 - DNA, 25 bp, S. pombe
tctcctgagctttttgtgttgtctt

SEQ ID NO: 110030 - DNA, 25 bp, S. pombe
tcggctttgacatcgtttcggataa

SEQ ID NO: 110031 - DNA, 25 bp, S. pombe
tcgtgcttttgctcgatttactaaa

SEQ ID NO: 110032 - DNA, 25 bp, S. pombe
tcgtgctctttctcgagattggata

SEQ ID NO: 110033 - DNA, 25 bp, S. pombe
tcgtgcctcttctccagatatgaag

SEQ ID NO: 110034 - DNA, 25 bp, S. pombe
tcgtgccactaactgccgtaagaag

SEQ ID NO: 110035 - DNA, 25 bp, S. pombe
tcgtccctatgatgcctgctgtaaa

SEQ ID NO: 110036 - DNA, 25 bp, S. pombe
tcgtcacaactatcctcatatcaat

SEQ ID NO: 110037 - DNA, 25 bp, S. pombe
tcgtgctgcctatgtgatctcaaac

SEQ ID NO: 110038 - DNA, 25 bp, S. pombe
tcttgccagccttgtgatgcacaaa

SEQ ID NO: 110039 - DNA, 25 bp, S. pombe
tctgtctcgattagctgccacaaaa

SEQ ID NO: 110040 - DNA, 25 bp, S. pombe
tctgcttatacgaactgccatggag

SEQ ID NO: 110041 - DNA, 25 bp, S. pombe
tctgctaatcccaaagccttaagtt

SEQ ID NO: 110042 - DNA, 25 bp, S. pombe
tctcgttcctcctacaaagcaaaat

SEQ ID NO: 110043 - DNA, 25 bp, S. pombe
tctgcaactctcgaagaagccaata

SEQ ID NO: 110044 - DNA, 25 bp, S. pombe
tctgcccgcatcaagaagaacacta

SEQ ID NO: 110045 - DNA, 25 bp, S. pombe
tcgtcaggcatcttccagattggaa

SEQ ID NO: 110046 - DNA, 25 bp, S. pombe
tctgccgatgcttcttacgatgaaa

SEQ ID NO: 110047 - DNA, 25 bp, S. pombe
tctgccgagcactttggtatgactg

SEQ ID NO: 110048 - DNA, 25 bp, S. pombe
tctccttgggagaattggctctttt

SEQ ID NO: 110049 - DNA, 25 bp, S. pombe
tctttggcatgcgtatattggttca

SEQ ID NO: 110050 - DNA, 25 bp, S. pombe
ttcaaactggtgttgctcgtaccgg

SEQ ID NO: 110051 - DNA, 25 bp, S. pombe
tcttacactagttttcttcgtcgcg

SEQ ID NO: 110052 - DNA, 25 bp, S. pombe
tctgtcgtctgttatattctatccc

SEQ ID NO: 110053 - DNA, 25 bp, S. pombe
tctggccttttgtccttggcaaaaa

SEQ ID NO: 110054 - DNA, 25 bp, S. pombe
tctggatctagttaccctgtctcaa

SEQ ID NO: 110055 - DNA, 25 bp, S. pombe
tacgtgccaaactgaaagctgctga

SEQ ID NO: 110056 - DNA, 25 bp, S. pombe
tcatcccgatgactcagcgtggaat

SEQ ID NO: 110057 - DNA, 25 bp, S. pombe
tcttatcgagcaatctcagcgcgaa

SEQ ID NO: 110058 - DNA, 25 bp, S. pombe
tctgatgccattcctgaaagccttg

SEQ ID NO: 110059 - DNA, 25 bp, S. pombe
tcgtgccgttctcaagcttttcttg

SEQ ID NO: 110060 - DNA, 25 bp, S. pombe
tcggcttgcttccaaaggttcgttt

SEQ ID NO: 110061 - DNA, 25 bp, S. pombe
tctttggtattctaaggctccgtaa

SEQ ID NO: 110062 - DNA, 25 bp, S. pombe
tcattatttttctgcccttcctaaa

SEQ ID NO: 110063 - DNA, 25 bp, S. pombe
tctcttgttttaacccaatccttct

SEQ ID NO: 110064 - DNA, 25 bp, S. pombe
tctttggccgttgttcagggtgatt

SEQ ID NO: 110065 - DNA, 25 bp, S. pombe
tctttgtaagtggatcttcgggcaa

SEQ ID NO: 110066 - DNA, 25 bp, S. pombe
tctagcttttctgatttggaggcaa

SEQ ID NO: 110067 - DNA, 25 bp, S. pombe
tcactggtaattttgttgggctaac

SEQ ID NO: 110068 - DNA, 25 bp, S. pombe
tctgctgatcccgtttttggatggg

SEQ ID NO: 110069 - DNA, 25 bp, S. pombe
tctgccataccacattgtctacatg

SEQ ID NO: 110070 - DNA, 25 bp, S. pombe
tcagcctcacacttgcattggtaat

SEQ ID NO: 110071 - DNA, 25 bp, S. pombe
tctcattcgcttccgtagagcaatt

SEQ ID NO: 110072 - DNA, 25 bp, S. pombe
tctcccgatgagttgtacacctatg

SEQ ID NO: 110073 - DNA, 25 bp, S. pombe
tctcccggtgataattctcgtcaac

SEQ ID NO: 110074 - DNA, 25 bp, S. pombe
tctcccgttgcaaaacatgcttcag

SEQ ID NO: 110075 - DNA, 25 bp, S. pombe
tctcgtcttcaaaagggacccctga

SEQ ID NO: 110076 - DNA, 25 bp, S. pombe
tcatcgtctgaacatgaggccaccg

SEQ ID NO: 110077 - DNA, 25 bp, S. pombe
tcactctttgtgaagctggcaatgc

SEQ ID NO: 110078 - DNA, 25 bp, S. pombe
tcattggcttcttacaggactgcac

SEQ ID NO: 110079 - DNA, 25 bp, S. pombe
tctaaaattacttgaccctcgctgg

SEQ ID NO: 110080 - DNA, 25 bp, S. pombe
tcttttttacttgctttcgcggctt

SEQ ID NO: 110081 - DNA, 25 bp, S. pombe
tcttatgcgcgttggccttgattca

SEQ ID NO: 110082 - DNA, 25 bp, S. pombe
tcattacagtgtttgcttcagcgta

SEQ ID NO: 110083 - DNA, 25 bp, S. pombe
tctgaattttctattgctggcgcaa

SEQ ID NO: 110084 - DNA, 25 bp, S. pombe
tcggtgctcctttaactgattttgc

SEQ ID NO: 110085 - DNA, 25 bp, S. pombe
tcggctgctttatttttcattttat

SEQ ID NO: 110086 - DNA, 25 bp, S. pombe
tctggtgtcttctttctctatttaa

SEQ ID NO: 110087 - DNA, 25 bp, S. pombe
tcgggtctggttacactgacggcaa

SEQ ID NO: 110088 - DNA, 25 bp, S. pombe
tcaggcttctggcttaggatccgga

SEQ ID NO: 110089 - DNA, 25 bp, S. pombe
tcggcgtctatggtttggtaatgtc

SEQ ID NO: 110090 - DNA, 25 bp, S. pombe
tcggctgtctgttcattgcatttaa

SEQ ID NO: 110091 - DNA, 25 bp, S. pombe
tctccaactgccaaagtgctacttt

SEQ ID NO: 110092 - DNA, 25 bp, S. pombe
tctgaccgcccaattgaacctttaa

SEQ ID NO: 110093 - DNA, 25 bp, S. pombe
tcttggctcgacatgtaactgcatt

SEQ ID NO: 110094 - DNA, 25 bp, S. pombe
tctcaccactagctctaacaaatct

SEQ ID NO: 110095 - DNA, 25 bp, S. pombe
tctcagcaagctcctttaatccaat

SEQ ID NO: 110096 - DNA, 25 bp, S. pombe
tctcctttatcgaaactggttcctc

SEQ ID NO: 110097 - DNA, 25 bp, S. pombe
tttcctttggtctacatgggttcta

SEQ ID NO: 110098 - DNA, 25 bp, S. pombe
ttttcaggttggatcggcacggtca

SEQ ID NO: 110099 - DNA, 25 bp, S. pombe
tcttaaagtgttttccgattggcca

SEQ ID NO: 110100 - DNA, 25 bp, S. pombe
tcttaacgttaagccggtagtcagc

SEQ ID NO: 110101 - DNA, 25 bp, S. pombe
tctaccaccaaaagtgggccctaag

SEQ ID NO: 110102 - DNA, 25 bp, S. pombe
tctctcccttaaagttgccgacgaa

SEQ ID NO: 110103 - DNA, 25 bp, S. pombe
tctcctactttaaatatcccttcgg

SEQ ID NO: 110104 - DNA, 25 bp, S. pombe
tctcccactttacaactgcactatt

SEQ ID NO: 110105 - DNA, 25 bp, S. pombe
tcttccctaaatccaacgtatcatt

SEQ ID NO: 110106 - DNA, 25 bp, S. pombe
tctaaccataccagaacgtccaggt

SEQ ID NO: 110107 - DNA, 25 bp, S. pombe
tcataccaaacccaaactgtctacg

SEQ ID NO: 110108 - DNA, 25 bp, S. pombe
tctaccagctggacgattactacta

SEQ ID NO: 110109 - DNA, 25 bp, S. pombe
tctgaagcttcctattctttacctc

SEQ ID NO: 110110 - DNA, 25 bp, S. pombe
tctgctatgctcacaggtggtcata

SEQ ID NO: 110111 - DNA, 25 bp, S. pombe
tctgcttgcgcatatttggaatcca

SEQ ID NO: 110112 - DNA, 25 bp, S. pombe
tctgcatcttatgaaccaagccctg

SEQ ID NO: 110113 - DNA, 25 bp, S. pombe
tctgctcttcacacattaactcaat

SEQ ID NO: 110114 - DNA, 25 bp, S. pombe
tctgatctctttacttttcgcttga

SEQ ID NO: 110115 - DNA, 25 bp, S. pombe
tctgtttagttcctgatggccttaa

SEQ ID NO: 110116 - DNA, 25 bp, S. pombe
tctgcttttgtcttcaattggccta

SEQ ID NO: 110117 - DNA, 25 bp, S. pombe
tctgctgttgatcactatgttggac

SEQ ID NO: 110118 - DNA, 25 bp, S. pombe
tcggaacatccctatggtggtctag

SEQ ID NO: 110119 - DNA, 25 bp, S. pombe
tcaggccagtgatcctggtggcgat

SEQ ID NO: 110120 - DNA, 25 bp, S. pombe
tcatactagtgctatccgcgaacgt

SEQ ID NO: 110121 - DNA, 25 bp, S. pombe
tacggtcacttctcatgaggacgat

SEQ ID NO: 110122 - DNA, 25 bp, S. pombe
tcatcgcgtctcatcctaaggaaat

SEQ ID NO: 110123 - DNA, 25 bp, S. pombe
tctggcaatgtctctcttgacgaaa

SEQ ID NO: 110124 - DNA, 25 bp, S. pombe
tctggcaatgctctcctagtagaaa

SEQ ID NO: 110125 - DNA, 25 bp, S. pombe
tctggcaatgcctattctcaagcgc

SEQ ID NO: 110126 - DNA, 25 bp, S. pombe
tctcaaaaatgcaacccagtggatg

SEQ ID NO: 110127 - DNA, 25 bp, S. pombe
tctagaaacagaatcagggccttta

SEQ ID NO: 110128 - DNA, 25 bp, S. pombe
tcagagaaacgagtagccccttatt

SEQ ID NO: 110129 - DNA, 25 bp, S. pombe
tcggcaatgccacctgatgtatttt

SEQ ID NO: 110130 - DNA, 25 bp, S. pombe
tatttttccggacttattgaacgag

SEQ ID NO: 110131 - DNA, 25 bp, S. pombe
tctgtgcttggaggtgtcgttttag

SEQ ID NO: 110132 - DNA, 25 bp, S. pombe
tttgcaatggcaggaggctttttcc

SEQ ID NO: 110133 - DNA, 25 bp, S. pombe
tcttatgagcctgagttgtttcccg

SEQ ID NO: 110134 - DNA, 25 bp, S. pombe
tctctatgttcgtcgttttgtcaac

SEQ ID NO: 110135 - DNA, 25 bp, S. pombe
tctctatgttcgtcgttttgtcaac

SEQ ID NO: 110136 - DNA, 25 bp, S. pombe
tctgcaatttccactttactcaaac

SEQ ID NO: 110137 - DNA, 25 bp, S. pombe
tctcaatctcccttttatagtcaca

SEQ ID NO: 110138 - DNA, 25 bp, S. pombe
tctcaccgccctaattgaagatcga

SEQ ID NO: 110139 - DNA, 25 bp, S. pombe
tctgtctaccctgttgatgattatt

SEQ ID NO: 110140 - DNA, 25 bp, S. pombe
ttttaaggtcctttgatcaatttgc

SEQ ID NO: 110141 - DNA, 25 bp, S. pombe
tctaccggatccagttctcaatttg

SEQ ID NO: 110142 - DNA, 25 bp, S. pombe
tcatcgtatcggtcgaactgggcgt

SEQ ID NO: 110143 - DNA, 25 bp, S. pombe
tctgtacctcccgatattttgaatg

SEQ ID NO: 110144 - DNA, 25 bp, S. pombe
tcttctcctttcctttagttactga

SEQ ID NO: 110145 - DNA, 25 bp, S. pombe
tctactacttttacttcttcaacca

SEQ ID NO: 110146 - DNA, 25 bp, S. pombe
tctccttttcctctcatttaaatgc

SEQ ID NO: 110147 - DNA, 25 bp, S. pombe
tctcctttaaagtcgcaattcatgg

SEQ ID NO: 110148 - DNA, 25 bp, S. pombe
tctgcttcagttttaatccgtgcta

SEQ ID NO: 110149 - DNA, 25 bp, S. pombe
tcttccgttataaatgccgcagcat

SEQ ID NO: 110150 - DNA, 25 bp, S. pombe
tctaccggcgatgaaggctatagct

SEQ ID NO: 110151 - DNA, 25 bp, S. pombe
tctccgcggcttggatgggatcaaa

SEQ ID NO: 110152 - DNA, 25 bp, S. pombe
tctcccgagatgctgacttacttaa

SEQ ID NO: 110153 - DNA, 25 bp, S. pombe
tcatcatctcgaagcagtccatttt

SEQ ID NO: 110154 - DNA, 25 bp, S. pombe
tctactccctgaagcttcaaaagcc

SEQ ID NO: 110155 - DNA, 25 bp, S. pombe
tctccccttgatattgccagaacaa

SEQ ID NO: 110156 - DNA, 25 bp, S. pombe
tctggctcttttacttctcaaatca

SEQ ID NO: 110157 - DNA, 25 bp, S. pombe
tcagggtgaccatttctgtacttca

SEQ ID NO: 110158 - DNA, 25 bp, S. pombe
tctcatgaagtattgtctccagccc

SEQ ID NO: 110159 - DNA, 25 bp, S. pombe
tctatgccaagattgatcgcccagc

SEQ ID NO: 110160 - DNA, 25 bp, S. pombe
tctcctacaaagtctgcagccgtat

SEQ ID NO: 110161 - DNA, 25 bp, S. pombe
tctacgaaagatttgctccggattt

SEQ ID NO: 110162 - DNA, 25 bp, S. pombe
tcttggaccagtttctcttgattca

SEQ ID NO: 110163 - DNA, 25 bp, S. pombe
tctggtgctcctgaagtagttttgc

SEQ ID NO: 110164 - DNA, 25 bp, S. pombe
tcggcgctgttgacaagtctcttga

SEQ ID NO: 110165 - DNA, 25 bp, S. pombe
tctgttgccttgaacctttctagat

SEQ ID NO: 110166 - DNA, 25 bp, S. pombe
tctgttccttctacctctttattaa

SEQ ID NO: 110167 - DNA, 25 bp, S. pombe
tcttactatggcaaatccttcctgc

SEQ ID NO: 110168 - DNA, 25 bp, S. pombe
tctgccgtgggtaagcttcattgga

SEQ ID NO: 110169 - DNA, 25 bp, S. pombe
tctcctactgttactcttcttggaa

SEQ ID NO: 110170 - DNA, 25 bp, S. pombe
tctcctcaggtcttcttttacgaaa

SEQ ID NO: 110171 - DNA, 25 bp, S. pombe
tctaccttccttttctgtcgatgat

SEQ ID NO: 110172 - DNA, 25 bp, S. pombe
tctaccttcgctttttgctgagaga

SEQ ID NO: 110173 - DNA, 25 bp, S. pombe
tctcaccttggctcttgtagattgg

SEQ ID NO: 110174 - DNA, 25 bp, S. pombe
tctaatctaggctctgaacagttgg

SEQ ID NO: 110175 - DNA, 25 bp, S. pombe
tctttcacctgctcaaattaccgat

SEQ ID NO: 110176 - DNA, 25 bp, S. pombe
tctgcccctctcgatgttattaaaa

SEQ ID NO: 110177 - DNA, 25 bp, S. pombe
tctatcaccgttcctgaagcttata

SEQ ID NO: 110178 - DNA, 25 bp, S. pombe
tcatgaaccgttccgatttccagga

SEQ ID NO: 110179 - DNA, 25 bp, S. pombe
tcatcaacgactcaggtttccgaac

SEQ ID NO: 110180 - DNA, 25 bp, S. pombe
tctctatcgattcaagttctgccca

SEQ ID NO: 110181 - DNA, 25 bp, S. pombe
tcactatatactcaacgacgggcgt

SEQ ID NO: 110182 - DNA, 25 bp, S. pombe
tcttttgcccaaaacttctggtcgc

SEQ ID NO: 110183 - DNA, 25 bp, S. pombe
tctttgccggagaaacgatcagctt

SEQ ID NO: 110184 - DNA, 25 bp, S. pombe
tctttcggagcaaaagcgtcttctt

SEQ ID NO: 110185 - DNA, 25 bp, S. pombe
tcttccccactgagattggtgttga

SEQ ID NO: 110186 - DNA, 25 bp, S. pombe
tcttcgcactcattttggtggtggc

SEQ ID NO: 110187 - DNA, 25 bp, S. pombe
tctactagttttggttcagctaaaa

SEQ ID NO: 110188 - DNA, 25 bp, S. pombe
tctcgatactgttcgtgcttggcaa

SEQ ID NO: 110189 - DNA, 25 bp, S. pombe
tctagatgactatgtggatgccgac

SEQ ID NO: 110190 - DNA, 25 bp, S. pombe
tctcagtcctatcctggagcaaaca

SEQ ID NO: 110191 - DNA, 25 bp, S. pombe
tctagtgcagcattccagggtaaaa

SEQ ID NO: 110192 - DNA, 25 bp, S. pombe
tcaaatctcaaacccctaaagtgga

SEQ ID NO: 110193 - DNA, 25 bp, S. pombe
tcaaatctcaaacccctaaagtgga

SEQ ID NO: 110194 - DNA, 25 bp, S. pombe
tctaatccaagaacgctccaacagt

SEQ ID NO: 110195 - DNA, 25 bp, S. pombe
tcttgatacaggaatccccaccaat

SEQ ID NO: 110196 - DNA, 25 bp, S. pombe
tctctctacttccaatactcatatt

SEQ ID NO: 110197 - DNA, 25 bp, S. pombe
tctcgctccttatgatattcttgtc

SEQ ID NO: 110198 - DNA, 25 bp, S. pombe
tctaggcgccgctaagagtgctggt

SEQ ID NO: 110199 - DNA, 25 bp, S. pombe
tcagctgctagatcatacgttggaa

SEQ ID NO: 110200 - DNA, 25 bp, S. pombe
tcaggacagtccagaggcactaagt

SEQ ID NO: 110201 - DNA, 25 bp, S. pombe
tctgcacaatcatcagcggctgtta

SEQ ID NO: 110202 - DNA, 25 bp, S. pombe
tttaaatgaggctgatctaagtatt

SEQ ID NO: 110203 - DNA, 25 bp, S. pombe
tcacctggtgaaacgtctccggaag

SEQ ID NO: 110204 - DNA, 25 bp, S. pombe
taatctgtggtacacctggtactgg

SEQ ID NO: 110205 - DNA, 25 bp, S. pombe
tcttaattctatttgcccggatgct

SEQ ID NO: 110206 - DNA, 25 bp, S. pombe
tcttaatgcctaacgatccgacttc

SEQ ID NO: 110207 - DNA, 25 bp, S. pombe
tcttaaatacatcttcgccaacttc

SEQ ID NO: 110208 - DNA, 25 bp, S. pombe
tcatgtaaaattctctcccaatcct

SEQ ID NO: 110209 - DNA, 25 bp, S. pombe
taagggcattggataccgtgctccc

SEQ ID NO: 110210 - DNA, 25 bp, S. pombe
taattgtttggaacccggctactgg

SEQ ID NO: 110211 - DNA, 25 bp, S. pombe
tcagccatgccagaatttcaacttg

SEQ ID NO: 110212 - DNA, 25 bp, S. pombe
tctccagctgctacaattcatcaat

SEQ ID NO: 110213 - DNA, 25 bp, S. pombe
tctgcaaccttctacacaaactgat

SEQ ID NO: 110214 - DNA, 25 bp, S. pombe
tctgcatacgttcctgcaactgtat

SEQ ID NO: 110215 - DNA, 25 bp, S. pombe
tctgacattgtccattgcaacttac

SEQ ID NO: 110216 - DNA, 25 bp, S. pombe
tctagcatggactattgaacctcat

SEQ ID NO: 110217 - DNA, 25 bp, S. pombe
tctactcttgaattgcgacgccttg

SEQ ID NO: 110218 - DNA, 25 bp, S. pombe
tctctgtgatattgtttagcggctc

SEQ ID NO: 110219 - DNA, 25 bp, S. pombe
tctctgctatgcttgtttatgaccc

SEQ ID NO: 110220 - DNA, 25 bp, S. pombe
tcttgctaccgtaattactccgaac

SEQ ID NO: 110221 - DNA, 25 bp, S. pombe
tcatgttcccagctttagtgtgttc

SEQ ID NO: 110222 - DNA, 25 bp, S. pombe
tctttcccagttttgcatttttgca

SEQ ID NO: 110223 - DNA, 25 bp, S. pombe
tctcctcgcgattgttgttgtattt

SEQ ID NO: 110224 - DNA, 25 bp, S. pombe
tcaggtcccatctcggaatttttag

SEQ ID NO: 110225 - DNA, 25 bp, S. pombe
tactagtcaagcacaggcagcgttc

SEQ ID NO: 110226 - DNA, 25 bp, S. pombe
tctcgagtaaggtgcgcagcgtttt

SEQ ID NO: 110227 - DNA, 25 bp, S. pombe
tcttcctactcatgcgatagccgaa

SEQ ID NO: 110228 - DNA, 25 bp, S. pombe
tcattcgacctctccaatgggaaga

SEQ ID NO: 110229 - DNA, 25 bp, S. pombe
tcttgccccttacagatgtctggga

SEQ ID NO: 110230 - DNA, 25 bp, S. pombe
tcttgctgtacatccggacggtaac

SEQ ID NO: 110231 - DNA, 25 bp, S. pombe
tcttctttcagttcccacgagtaag

SEQ ID NO: 110232 - DNA, 25 bp, S. pombe
taattcagtctcctgccggaggtaa

SEQ ID NO: 110233 - DNA, 25 bp, S. pombe
tcttcaagcgctagttctggaggta

SEQ ID NO: 110234 - DNA, 25 bp, S. pombe
tcttaacatttgatgccatgcggca

SEQ ID NO: 110235 - DNA, 25 bp, S. pombe
tctttgtattcagtggatcctccta

SEQ ID NO: 110236 - DNA, 25 bp, S. pombe
tttttagtacgacttccgcctggca

SEQ ID NO: 110237 - DNA, 25 bp, S. pombe
tcttttggctaaacttcccgatggg

SEQ ID NO: 110238 - DNA, 25 bp, S. pombe
tctttttctagttcatcctcccaga

SEQ ID NO: 110239 - DNA, 25 bp, S. pombe
tctttctttgggaaatctcctcagg

SEQ ID NO: 110240 - DNA, 25 bp, S. pombe
tcttctattttgcatggtcacccat

SEQ ID NO: 110241 - DNA, 25 bp, S. pombe
tctttttatgatcagtgccaccgct

SEQ ID NO: 110242 - DNA, 25 bp, S. pombe
tcttattcttctgagtccaatcctg

SEQ ID NO: 110243 - DNA, 25 bp, S. pombe
tcttttcacctttgtcaacttctgg

SEQ ID NO: 110244 - DNA, 25 bp, S. pombe
tcttcttccgattctgacaatgcta

SEQ ID NO: 110245 - DNA, 25 bp, S. pombe
tcttttatactgttgcgagcatcat

SEQ ID NO: 110246 - DNA, 25 bp, S. pombe
tctttatcgttttcatgatcatata

SEQ ID NO: 110247 - DNA, 25 bp, S. pombe
tcttcttctgaaggccgtgctaagc

SEQ ID NO: 110248 - DNA, 25 bp, S. pombe
tctcttctctcttcagcacataaaa

SEQ ID NO: 110249 - DNA, 25 bp, S. pombe
tctctcttctgttcgacgcaatgta

SEQ ID NO: 110250 - DNA, 25 bp, S. pombe
tctcatatctttttcttgcaccgta

SEQ ID NO: 110251 - DNA, 25 bp, S. pombe
tctttgctgcaggagatttcatctc

SEQ ID NO: 110252 - DNA, 25 bp, S. pombe
tcttctctcagtggcatggctagta

SEQ ID NO: 110253 - DNA, 25 bp, S. pombe
tcttctactagcttgcaccaacaat

SEQ ID NO: 110254 - DNA, 25 bp, S. pombe
tcttctgacaaattccccaatcttt

SEQ ID NO: 110255 - DNA, 25 bp, S. pombe
tctacctcctattgaacttccttat

SEQ ID NO: 110256 - DNA, 25 bp, S. pombe
tcttccattgctgtagacaccttga

SEQ ID NO: 110257 - DNA, 25 bp, S. pombe
tcttcccgagataaatcacctttag

SEQ ID NO: 110258 - DNA, 25 bp, S. pombe
tcttccggagcatcacaacaattcg

SEQ ID NO: 110259 - DNA, 25 bp, S. pombe
tcttccaagacatccgcacagttag

SEQ ID NO: 110260 - DNA, 25 bp, S. pombe
tcattttacaaaacggtcgcctgcg

SEQ ID NO: 110261 - DNA, 25 bp, S. pombe
tcatccctaaagaagtttccttgga

SEQ ID NO: 110262 - DNA, 25 bp, S. pombe
tcaggtgctcaatgcgttttcgaaa

SEQ ID NO: 110263 - DNA, 25 bp, S. pombe
tcacgtgtagcatcgcagtatccta

SEQ ID NO: 110264 - DNA, 25 bp, S. pombe
tcttgtggacgtacacgatcctgat

SEQ ID NO: 110265 - DNA, 25 bp, S. pombe
tcttcatcatttcctaccgtggtta

SEQ ID NO: 110266 - DNA, 25 bp, S. pombe
tcatcatggtggtcacggtggcttt

SEQ ID NO: 110267 - DNA, 25 bp, S. pombe
ttattcggcatgaacgttccagtcc

SEQ ID NO: 110268 - DNA, 25 bp, S. pombe
tctagtgggagcaactactgccgtc

SEQ ID NO: 110269 - DNA, 25 bp, S. pombe
tctcggtggacttcattctgacagc

SEQ ID NO: 110270 - DNA, 25 bp, S. pombe
tctcctttctactctttgcattgaa

SEQ ID NO: 110271 - DNA, 25 bp, S. pombe
tctgccaatctttcttgtacacatc

SEQ ID NO: 110272 - DNA, 25 bp, S. pombe
tctatcaccaacttcagctctggtg

SEQ ID NO: 110273 - DNA, 25 bp, S. pombe
tcttcgatatcattcacgtgctctt

SEQ ID NO: 110274 - DNA, 25 bp, S. pombe
tctcctgatgttgctcccattaaat

SEQ ID NO: 110275 - DNA, 25 bp, S. pombe
tctactggaactacgagctgggagc

SEQ ID NO: 110276 - DNA, 25 bp, S. pombe
tcttcgcaagtatcgtgagtctggc

SEQ ID NO: 110277 - DNA, 25 bp, S. pombe
tcttcgcaagagtcctgaacttctt

SEQ ID NO: 110278 - DNA, 25 bp, S. pombe
tcattcccgaacgtcttctttgtaa

SEQ ID NO: 110279 - DNA, 25 bp, S. pombe
tcttgatacgtattctctcgattgt

SEQ ID NO: 110280 - DNA, 25 bp, S. pombe
tcatttacgttaacgcgtggtccaa

SEQ ID NO: 110281 - DNA, 25 bp, S. pombe
tcatttactggatcccttgattcaa

SEQ ID NO: 110282 - DNA, 25 bp, S. pombe
tctacgcttgagaatcctttggcct

SEQ ID NO: 110283 - DNA, 25 bp, S. pombe
tcttccttggttctttgagcacttt

SEQ ID NO: 110284 - DNA, 25 bp, S. pombe
tcttctgacgcgtttcttactaaca

SEQ ID NO: 110285 - DNA, 25 bp, S. pombe
tctattgaccaacgatttgactcta

SEQ ID NO: 110286 - DNA, 25 bp, S. pombe
tctattgtcgaagatcctagcataa

SEQ ID NO: 110287 - DNA, 25 bp, S. pombe
tttccctcttattgccataaacacg

SEQ ID NO: 110288 - DNA, 25 bp, S. pombe
tctctctgcccttttccatgaaaag

SEQ ID NO: 110289 - DNA, 25 bp, S. pombe
tctttgccctatgcttcgaggagaa

SEQ ID NO: 110290 - DNA, 25 bp, S. pombe
tacttggtacgcatgcaatcttggg

SEQ ID NO: 110291 - DNA, 25 bp, S. pombe
tatttcgtaccggtgcaattgtggc

SEQ ID NO: 110292 - DNA, 25 bp, S. pombe
tcttttgtagatttgcccagttttt

SEQ ID NO: 110293 - DNA, 25 bp, S. pombe
taattgcccctttcggaggattctt

SEQ ID NO: 110294 - DNA, 25 bp, S. pombe
tcattttttgttttggcagcgtcct

SEQ ID NO: 110295 - DNA, 25 bp, S. pombe
tcttttgctttgagtcaccgtgaca

SEQ ID NO: 110296 - DNA, 25 bp, S. pombe
tctttcgcattgttaggcaccgtaa

SEQ ID NO: 110297 - DNA, 25 bp, S. pombe
tctttgacaattgagcgcagccagt

SEQ ID NO: 110298 - DNA, 25 bp, S. pombe
tcatggtgaccatactcggacgatt

SEQ ID NO: 110299 - DNA, 25 bp, S. pombe
tctcgtctcgaatctcggatagcta

SEQ ID NO: 110300 - DNA, 25 bp, S. pombe
tctcctcttatacgccattgaacta

SEQ ID NO: 110301 - DNA, 25 bp, S. pombe
tctcccagcctatgatctcaatttt

SEQ ID NO: 110302 - DNA, 25 bp, S. pombe
tctccgcttcagatggttatcctta

SEQ ID NO: 110303 - DNA, 25 bp, S. pombe
tcactgctttggctggtggtcaaat

SEQ ID NO: 110304 - DNA, 25 bp, S. pombe
tcacttcttgtttgggtggccgtaa

SEQ ID NO: 110305 - DNA, 25 bp, S. pombe
tcacctttttgacaccgagcgtaaa

SEQ ID NO: 110306 - DNA, 25 bp, S. pombe
tcatttacgcgattggtgagcccaa

SEQ ID NO: 110307 - DNA, 25 bp, S. pombe
tcatcttcaacgttatatccccaaa

SEQ ID NO: 110308 - DNA, 25 bp, S. pombe
tctcttcaagcgaattgtctggcct

SEQ ID NO: 110309 - DNA, 25 bp, S. pombe
tctcatgtgcactcttgtttgttat

SEQ ID NO: 110310 - DNA, 25 bp, S. pombe
tcttggcattgctagctgtgttgca

SEQ ID NO: 110311 - DNA, 25 bp, S. pombe
tcttgcaattgctagtggtgactta

SEQ ID NO: 110312 - DNA, 25 bp, S. pombe
tcagctgcaaatactccttcttggg

SEQ ID NO: 110313 - DNA, 25 bp, S. pombe
tcaacaagttcccttttgagggcgt

SEQ ID NO: 110314 - DNA, 25 bp, S. pombe
tcaagcaatttctgtaacccgggtt

SEQ ID NO: 110315 - DNA, 25 bp, S. pombe
tcagccgccttttaaaccgaatgtt

SEQ ID NO: 110316 - DNA, 25 bp, S. pombe
tctacgcgtttatgaatcccttggt

SEQ ID NO: 110317 - DNA, 25 bp, S. pombe
tctacctttctatgagtcccgatgg

SEQ ID NO: 110318 - DNA, 25 bp, S. pombe
tcatccctttcttggagtccctaaa

SEQ ID NO: 110319 - DNA, 25 bp, S. pombe
taaggttcctgttaaattggcaaag

SEQ ID NO: 110320 - DNA, 25 bp, S. pombe
tacgccagtgtctggtaaaacttaa

SEQ ID NO: 110321 - DNA, 25 bp, S. pombe
tcttgccgtcttttcattcttgtgt

SEQ ID NO: 110322 - DNA, 25 bp, S. pombe
tcttggtttactactactgttcccg

SEQ ID NO: 110323 - DNA, 25 bp, S. pombe
tctcgcgtcttgtctactaatggaa

SEQ ID NO: 110324 - DNA, 25 bp, S. pombe
tcttcctgctgttgctttacacggg

SEQ ID NO: 110325 - DNA, 25 bp, S. pombe
tcatctatgcctattgttgttcaag

SEQ ID NO: 110326 - DNA, 25 bp, S. pombe
tctttacatgacgttcctggcttaa

SEQ ID NO: 110327 - DNA, 25 bp, S. pombe
tctatgcaaagtatggccgttccaa

SEQ ID NO: 110328 - DNA, 25 bp, S. pombe
tcacctgccattctatcttggaggt

SEQ ID NO: 110329 - DNA, 25 bp, S. pombe
tctcgtcacttaaactccggatttt

SEQ ID NO: 110330 - DNA, 25 bp, S. pombe
tcatataccgattcctacagtccta

SEQ ID NO: 110331 - DNA, 25 bp, S. pombe
taggactggaaagctgttacgtttt

SEQ ID NO: 110332 - DNA, 25 bp, S. pombe
tcattgagtcgggtgctggacaacc

SEQ ID NO: 110333 - DNA, 25 bp, S. pombe
tataatacctcttcccctaaatttg

SEQ ID NO: 110334 - DNA, 25 bp, S. pombe
taatttagccgcgttggttccaatt

SEQ ID NO: 110335 - DNA, 25 bp, S. pombe
ttttcggaggccttggttctgaatt

SEQ ID NO: 110336 - DNA, 25 bp, S. pombe
tttgttggcatcactggaggtcgtc

SEQ ID NO: 110337 - DNA, 25 bp, S. pombe
tcagtgtaactgctcgagatggtcg

SEQ ID NO: 110338 - DNA, 25 bp, S. pombe
tcagttctcgcaagctcaacgttga

SEQ ID NO: 110339 - DNA, 25 bp, S. pombe
tcatcggcacctgtcaagggttttg

SEQ ID NO: 110340 - DNA, 25 bp, S. pombe
tctacgtgcctctcgcaaaacaaat

SEQ ID NO: 110341 - DNA, 25 bp, S. pombe
tcttggccccaagtcagagaagcaa

SEQ ID NO: 110342 - DNA, 25 bp, S. pombe
tcttggcgtccatgcataaatcagg

SEQ ID NO: 110343 - DNA, 25 bp, S. pombe
taatttatcgccagtacgctactct

SEQ ID NO: 110344 - DNA, 25 bp, S. pombe
taattaaatcccctatcgcacttga

SEQ ID NO: 110345 - DNA, 25 bp, S. pombe
taattaaccgccaactcgcttcgaa

SEQ ID NO: 110346 - DNA, 25 bp, S. pombe
taaggcaaccctcttatcaaggaat

SEQ ID NO: 110347 - DNA, 25 bp, S. pombe
tatccggcaacccttggtagtaaga

SEQ ID NO: 110348 - DNA, 25 bp, S. pombe
tacgggtaccactgttcttgatgac

SEQ ID NO: 110349 - DNA, 25 bp, S. pombe
ttcgtggtcaacaattttctccgga

SEQ ID NO: 110350 - DNA, 25 bp, S. pombe
tcacgtggtcaactgcatcgttcga

SEQ ID NO: 110351 - DNA, 25 bp, S. pombe
tcttctgccatctactcatttttga

SEQ ID NO: 110352 - DNA, 25 bp, S. pombe
tcttgattcatctccacatctgtta

SEQ ID NO: 110353 - DNA, 25 bp, S. pombe
tctacaacacccattcttcatgaag

SEQ ID NO: 110354 - DNA, 25 bp, S. pombe
tctatgaccgagacgaacgctgtag

SEQ ID NO: 110355 - DNA, 25 bp, S. pombe
tcagacgcggactcaacaacagggt

SEQ ID NO: 110356 - DNA, 25 bp, S. pombe
tcaacgccgctctaacaaacgtgga

SEQ ID NO: 110357 - DNA, 25 bp, S. pombe
tcatacgacgtctaatcagccaagt

SEQ ID NO: 110358 - DNA, 25 bp, S. pombe
tcttctaacgctcctgttgtggata

SEQ ID NO: 110359 - DNA, 25 bp, S. pombe
tctatctcaagctcctgttgctaat

SEQ ID NO: 110360 - DNA, 25 bp, S. pombe
tcatggtcgtcagcaggactcgtat

SEQ ID NO: 110361 - DNA, 25 bp, S. pombe
tcagctggagctcttgaagtcttca

SEQ ID NO: 110362 - DNA, 25 bp, S. pombe
tcagtcacgcctttgaagtcttcaa

SEQ ID NO: 110363 - DNA, 25 bp, S. pombe
tcattccgcgatgtgccgacattaa

SEQ ID NO: 110364 - DNA, 25 bp, S. pombe
tattctcaagttcgcggtcctaaag

SEQ ID NO: 110365 - DNA, 25 bp, S. pombe
tctcacaagagtttccgtaccaagc

SEQ ID NO: 110366 - DNA, 25 bp, S. pombe
tctacatctagttcttccactcaag

SEQ ID NO: 110367 - DNA, 25 bp, S. pombe
tcaaccatatgctacttaccttact

SEQ ID NO: 110368 - DNA, 25 bp, S. pombe
tcatccagttcatcttccaattatc

SEQ ID NO: 110369 - DNA, 25 bp, S. pombe
tctcaacactcattcttccaattaa

SEQ ID NO: 110370 - DNA, 25 bp, S. pombe
tctaccattccctcaatttctaaat

SEQ ID NO: 110371 - DNA, 25 bp, S. pombe
tctacctccctatcagttcgaaata

SEQ ID NO: 110372 - DNA, 25 bp, S. pombe
tcaacccgccgatactgctaaaata

SEQ ID NO: 110373 - DNA, 25 bp, S. pombe
tctttcctggcctattgctaataca

SEQ ID NO: 110374 - DNA, 25 bp, S. pombe
tcattgcatcgtttgggagtatccc

SEQ ID NO: 110375 - DNA, 25 bp, S. pombe
tcaaatggacattacacctaccgct

SEQ ID NO: 110376 - DNA, 25 bp, S. pombe
tctatagggctatcttctagtccgc

SEQ ID NO: 110377 - DNA, 25 bp, S. pombe
tctacggtgcaactggactcatgga

SEQ ID NO: 110378 - DNA, 25 bp, S. pombe
tctacatggctaccttgttctgcag

SEQ ID NO: 110379 - DNA, 25 bp, S. pombe
tcagctgtggactatcttcatcttc

SEQ ID NO: 110380 - DNA, 25 bp, S. pombe
tcatggtgtgacactactgcctcaa

SEQ ID NO: 110381 - DNA, 25 bp, S. pombe
tcttgtaaagtcaacgccttcacgc

SEQ ID NO: 110382 - DNA, 25 bp, S. pombe
tcattggaagagctacctcctcagt

SEQ ID NO: 110383 - DNA, 25 bp, S. pombe
tcattgccaagaacgacactcctaa

SEQ ID NO: 110384 - DNA, 25 bp, S. pombe
tcatgatccgagtgcagaaccctac

SEQ ID NO: 110385 - DNA, 25 bp, S. pombe
tcagaagcagctcgtgtactacaaa

SEQ ID NO: 110386 - DNA, 25 bp, S. pombe
tcttcaagccgcattttctcaaatt

SEQ ID NO: 110387 - DNA, 25 bp, S. pombe
tctttcctctcttgtattcgttcat

SEQ ID NO: 110388 - DNA, 25 bp, S. pombe
tcttgtccactcagttggtgtttct

SEQ ID NO: 110389 - DNA, 25 bp, S. pombe
tcacttctacttctttgctttttca

SEQ ID NO: 110390 - DNA, 25 bp, S. pombe
tcacgtcaaattcatggtcttctcc

SEQ ID NO: 110391 - DNA, 25 bp, S. pombe
tcaagtccaaatatcgttttcacgt

SEQ ID NO: 110392 - DNA, 25 bp, S. pombe
tctaccaatatttctcacctgtcaa

SEQ ID NO: 110393 - DNA, 25 bp, S. pombe
tctaccagtgttcccattttatcag

SEQ ID NO: 110394 - DNA, 25 bp, S. pombe
tcttcaattccttctcctgatgatt

SEQ ID NO: 110395 - DNA, 25 bp, S. pombe
tcatgccatggtttgaagcgccttc

SEQ ID NO: 110396 - DNA, 25 bp, S. pombe
tcatgctcactgtattcaaaactgg

SEQ ID NO: 110397 - DNA, 25 bp, S. pombe
tctagcttcgccagttatccattga

SEQ ID NO: 110398 - DNA, 25 bp, S. pombe
tctaccttgcgcagattagctgctt

SEQ ID NO: 110399 - DNA, 25 bp, S. pombe
tcttctgtgtttcgttatgctggtc

SEQ ID NO: 110400 - DNA, 25 bp, S. pombe
tcttattactctccttcttattctg

SEQ ID NO: 110401 - DNA, 25 bp, S. pombe
tctttccactccttattgtattcga

SEQ ID NO: 110402 - DNA, 25 bp, S. pombe
tcatttcgactcacatttggacaca

SEQ ID NO: 110403 - DNA, 25 bp, S. pombe
tctttggtccttcgtttgcattata

SEQ ID NO: 110404 - DNA, 25 bp, S. pombe
tcatttgctggccttggatttctag

SEQ ID NO: 110405 - DNA, 25 bp, S. pombe
tcatcttggcgcttttggtgttagt

SEQ ID NO: 110406 - DNA, 25 bp, S. pombe
tcatcattgttggtcgtggagtcta

SEQ ID NO: 110407 - DNA, 25 bp, S. pombe
tcatttgtgctggtgtagggctcat

SEQ ID NO: 110408 - DNA, 25 bp, S. pombe
tcttttttctaacgttgcttctctc

SEQ ID NO: 110409 - DNA, 25 bp, S. pombe
tcttttgttcgaaacttgacttcta

SEQ ID NO: 110410 - DNA, 25 bp, S. pombe
tcttttcttttcacttcacttcatt

SEQ ID NO: 110411 - DNA, 25 bp, S. pombe
tcttcttctccaccgcataatgatg

SEQ ID NO: 110412 - DNA, 25 bp, S. pombe
tcttcttgctttcctgtggatgtta

SEQ ID NO: 110413 - DNA, 25 bp, S. pombe
tctttatgtttttggcgcgactggt

SEQ ID NO: 110414 - DNA, 25 bp, S. pombe
tcagctcaacggatcttgttctcag

SEQ ID NO: 110415 - DNA, 25 bp, S. pombe
tcttctgccatgactgagttctaca

SEQ ID NO: 110416 - DNA, 25 bp, S. pombe
tctagctccatttgattatctgcca

SEQ ID NO: 110417 - DNA, 25 bp, S. pombe
tctagaactctatttgcaacccacg

SEQ ID NO: 110418 - DNA, 25 bp, S. pombe
tcaaacctgtcgatatgcctactat

SEQ ID NO: 110419 - DNA, 25 bp, S. pombe
tcaccatccttcagctaatctatta

SEQ ID NO: 110420 - DNA, 25 bp, S. pombe
tcttcccttcaagtcaatctgctta

SEQ ID NO: 110421 - DNA, 25 bp, S. pombe
tcttcctcttcaactatttcatcat

SEQ ID NO: 110422 - DNA, 25 bp, S. pombe
tcttgcaccaccaactgtttggctc

SEQ ID NO: 110423 - DNA, 25 bp, S. pombe
tcttgcagcccatgatgcgattgtg

SEQ ID NO: 110424 - DNA, 25 bp, S. pombe
tcaggtgctcaaataggcgctaagt

SEQ ID NO: 110425 - DNA, 25 bp, S. pombe
tcatgcggctcggataagcttctga

SEQ ID NO: 110426 - DNA, 25 bp, S. pombe
taagttggccagctcggcaatactc

SEQ ID NO: 110427 - DNA, 25 bp, S. pombe
tcaggcatgcttcaggattcgcaaa

SEQ ID NO: 110428 - DNA, 25 bp, S. pombe
tcagtagcaacgtccatgtctcaaa

SEQ ID NO: 110429 - DNA, 25 bp, S. pombe
tcttgaaggcgatagtgctacacat

SEQ ID NO: 110430 - DNA, 25 bp, S. pombe
tcttcaccgccagtagatagcacag

SEQ ID NO: 110431 - DNA, 25 bp, S. pombe
tactaagttcgatcctaccactagg

SEQ ID NO: 110432 - DNA, 25 bp, S. pombe
taccaaaaagttcaagccctccttg

SEQ ID NO: 110433 - DNA, 25 bp, S. pombe
tcatgtcacgcctcggtataggtta

SEQ ID NO: 110434 - DNA, 25 bp, S. pombe
tcttgtcttggcatcccctcttact

SEQ ID NO: 110435 - DNA, 25 bp, S. pombe
tcttgccttggcattccttcttatt

SEQ ID NO: 110436 - DNA, 25 bp, S. pombe
tcttgccaatggacttgccgttgat

SEQ ID NO: 110437 - DNA, 25 bp, S. pombe
tcttgctaaggttggccttgctgat

SEQ ID NO: 110438 - DNA, 25 bp, S. pombe
tcttgtatgcacactgttctagtca

SEQ ID NO: 110439 - DNA, 25 bp, S. pombe
tcttctggacatttgttgccgattt

SEQ ID NO: 110440 - DNA, 25 bp, S. pombe
tcatctccgacttcaatggctttta

SEQ ID NO: 110441 - DNA, 25 bp, S. pombe
tcattccccttctagatcaatttct

SEQ ID NO: 110442 - DNA, 25 bp, S. pombe
tcttgctccctgtcgaatagaattc

SEQ ID NO: 110443 - DNA, 25 bp, S. pombe
tcatcgtgccgttcgattgcaaatt

SEQ ID NO: 110444 - DNA, 25 bp, S. pombe
tcaccctcgccgatttattttttgg

SEQ ID NO: 110445 - DNA, 25 bp, S. pombe
tcaacaatggccttttcttttttgg

SEQ ID NO: 110446 - DNA, 25 bp, S. pombe
tcttgtgtatagtcgatggaccctc

SEQ ID NO: 110447 - DNA, 25 bp, S. pombe
tcttatgatttgtcgcgtactctac

SEQ ID NO: 110448 - DNA, 25 bp, S. pombe
tcatcaaagttctcggacgtactgg

SEQ ID NO: 110449 - DNA, 25 bp, S. pombe
tcaacttttgactgcagggtcccaa

SEQ ID NO: 110450 - DNA, 25 bp, S. pombe
tcatactgctgtcgaatctccaaga

SEQ ID NO: 110451 - DNA, 25 bp, S. pombe
tcacacttttgttaccagagactaa

SEQ ID NO: 110452 - DNA, 25 bp, S. pombe
tcactttcaacctatgcttgtggaa

SEQ ID NO: 110453 - DNA, 25 bp, S. pombe
tcattatgtttcaattcccggcggt

SEQ ID NO: 110454 - DNA, 25 bp, S. pombe
tcttacttgaatcgtgacctgtctc

SEQ ID NO: 110455 - DNA, 25 bp, S. pombe
tctattgttcgctttaatccacgct

SEQ ID NO: 110456 - DNA, 25 bp, S. pombe
tcttctttctgactataagcgcctc

SEQ ID NO: 110457 - DNA, 25 bp, S. pombe
tcattttgatccatttcacttccca

SEQ ID NO: 110458 - DNA, 25 bp, S. pombe
tcatttggcggattgttacttccca

SEQ ID NO: 110459 - DNA, 25 bp, S. pombe
tactataccctactgctgaaattcc

SEQ ID NO: 110460 - DNA, 25 bp, S. pombe
tcatttatccgctagctgctgaaat

SEQ ID NO: 110461 - DNA, 25 bp, S. pombe
tcttcattccgcgatcgtgtaaggg

SEQ ID NO: 110462 - DNA, 25 bp, S. pombe
tcatccatttcaagagcctcctaaa

SEQ ID NO: 110463 - DNA, 25 bp, S. pombe
tcttcctgcattaacccgtgatgaa

SEQ ID NO: 110464 - DNA, 25 bp, S. pombe
tcacgcctataatgttgcaaagcaa

SEQ ID NO: 110465 - DNA, 25 bp, S. pombe
tcatctcttagtgtttgcctacgca

SEQ ID NO: 110466 - DNA, 25 bp, S. pombe
tcttgtccaagatttccagcgatta

SEQ ID NO: 110467 - DNA, 25 bp, S. pombe
tctttcatcaaattcgacacctctg

SEQ ID NO: 110468 - DNA, 25 bp, S. pombe
tctttcacggaaaactgcaggcggt

SEQ ID NO: 110469 - DNA, 25 bp, S. pombe
tcagttactgttttaccgcgcacga

SEQ ID NO: 110470 - DNA, 25 bp, S. pombe
tcagtacagccttcacaaattctcg

SEQ ID NO: 110471 - DNA, 25 bp, S. pombe
tcaaagaaggcaaccgacccgctag

SEQ ID NO: 110472 - DNA, 25 bp, S. pombe
tcaagcaaacgagccgttccgggaa

SEQ ID NO: 110473 - DNA, 25 bp, S. pombe
taagcaacaacgaggttccaaggaa

SEQ ID NO: 110474 - DNA, 25 bp, S. pombe
taatgttatacaaacctttggtagt

SEQ ID NO: 110475 - DNA, 25 bp, S. pombe
taattggacctagcgattctggaaa

SEQ ID NO: 110476 - DNA, 25 bp, S. pombe
taatgttactttccccttgactata

SEQ ID NO: 110477 - DNA, 25 bp, S. pombe
tcatgggtactttactcttttctta

SEQ ID NO: 110478 - DNA, 25 bp, S. pombe
tactggaggagatacgtttttacgc

SEQ ID NO: 110479 - DNA, 25 bp, S. pombe
tcaggacatcgccaaagctctttct

SEQ ID NO: 110480 - DNA, 25 bp, S. pombe
tcatggtcacagtatcacggttcct

SEQ ID NO: 110481 - DNA, 25 bp, S. pombe
tcatgtttgatgttacttcccgtat

SEQ ID NO: 110482 - DNA, 25 bp, S. pombe
tcatgcgtcgtttatttttcgtatc

SEQ ID NO: 110483 - DNA, 25 bp, S. pombe
tcagcgttcctatattgttcagtac

SEQ ID NO: 110484 - DNA, 25 bp, S. pombe
tcatccttcctttatagttgcttcg

SEQ ID NO: 110485 - DNA, 25 bp, S. pombe
tcatgcctttgttacgtcctttaaa

SEQ ID NO: 110486 - DNA, 25 bp, S. pombe
tcacgcgaattagcatggaccctca

SEQ ID NO: 110487 - DNA, 25 bp, S. pombe
tcagcgcgaagtgccggatgtcgaa

SEQ ID NO: 110488 - DNA, 25 bp, S. pombe
tcagcacagcagcagcgtgagtttc

SEQ ID NO: 110489 - DNA, 25 bp, S. pombe
tcatcgatagaagcaccgcctagtg

SEQ ID NO: 110490 - DNA, 25 bp, S. pombe
tcactgtcagaagcctcgtcaagag

SEQ ID NO: 110491 - DNA, 25 bp, S. pombe
tcactcctgattatggctatggccc

SEQ ID NO: 110492 - DNA, 25 bp, S. pombe
tcacttctgatattcttgccgagca

SEQ ID NO: 110493 - DNA, 25 bp, S. pombe
tcatcttctgaattccctccaaaaa

SEQ ID NO: 110494 - DNA, 25 bp, S. pombe
tcatcgtctgtagtcatcgttcaaa

SEQ ID NO: 110495 - DNA, 25 bp, S. pombe
tcttccagttcgtcgtgatgaccaa

SEQ ID NO: 110496 - DNA, 25 bp, S. pombe
tcatcggatgactcttgtttgctag

SEQ ID NO: 110497 - DNA, 25 bp, S. pombe
tcttccacagagacatgcttcattc

SEQ ID NO: 110498 - DNA, 25 bp, S. pombe
tcttcgacagctacggatattccac

SEQ ID NO: 110499 - DNA, 25 bp, S. pombe
tcatcttcacttctaacttcttcaa

SEQ ID NO: 110500 - DNA, 25 bp, S. pombe
tcatccctctggtgaactcggtgaa

SEQ ID NO: 110501 - DNA, 25 bp, S. pombe
ttaaccgaattgctcgctatccgat

SEQ ID NO: 110502 - DNA, 25 bp, S. pombe
tcttcctttcattccactaaacagt

SEQ ID NO: 110503 - DNA, 25 bp, S. pombe
tcttcccctgcatctagtaaacaaa

SEQ ID NO: 110504 - DNA, 25 bp, S. pombe
tcttccgacgctgtttcaattcata

SEQ ID NO: 110505 - DNA, 25 bp, S. pombe
tcattatgcaacaccttttgattaa

SEQ ID NO: 110506 - DNA, 25 bp, S. pombe
tcttctctttctcggtcaaaaacac

SEQ ID NO: 110507 - DNA, 25 bp, S. pombe
tttactatatagattcccaaacact

SEQ ID NO: 110508 - DNA, 25 bp, S. pombe
tcatatcctactttttccctaacaa

SEQ ID NO: 110509 - DNA, 25 bp, S. pombe
tcttcattcgtttgttcgtcgcaga

SEQ ID NO: 110510 - DNA, 25 bp, S. pombe
tcatattctgcgttttatcgtccgt

SEQ ID NO: 110511 - DNA, 25 bp, S. pombe
taatttagttgttcacgagccgtgg

SEQ ID NO: 110512 - DNA, 25 bp, S. pombe
taacttgaccgcctgcaataggagt

SEQ ID NO: 110513 - DNA, 25 bp, S. pombe
taatccgtccaacaacgatggtgcc

SEQ ID NO: 110514 - DNA, 25 bp, S. pombe
tcagtttcgaaacatcacggttgga

SEQ ID NO: 110515 - DNA, 25 bp, S. pombe
tcatggttcgtatcgctcaaggttt

SEQ ID NO: 110516 - DNA, 25 bp, S. pombe
tcaggatattgccttcagtatagta

SEQ ID NO: 110517 - DNA, 25 bp, S. pombe
tcaaccacgattccgagcgacgagg

SEQ ID NO: 110518 - DNA, 25 bp, S. pombe
ttatgtaaacttgctcccgaaacct

SEQ ID NO: 110519 - DNA, 25 bp, S. pombe
tcatttattgatactccactgcctc

SEQ ID NO: 110520 - DNA, 25 bp, S. pombe
tcattttcgaaaggcatccacccaa

SEQ ID NO: 110521 - DNA, 25 bp, S. pombe
tcatttttacaagaccacggctatt

SEQ ID NO: 110522 - DNA, 25 bp, S. pombe
tcagtatcttcatgggtatggtgtt

SEQ ID NO: 110523 - DNA, 25 bp, S. pombe
tcatcttctcctcgaactattgttt

SEQ ID NO: 110524 - DNA, 25 bp, S. pombe
tcatctcttgcccaaacaatctggt

SEQ ID NO: 110525 - DNA, 25 bp, S. pombe
tcacctcctcagttggacgatgatg

SEQ ID NO: 110526 - DNA, 25 bp, S. pombe
tcatttattccattacgctgcgcaa

SEQ ID NO: 110527 - DNA, 25 bp, S. pombe
tcagcttttgtgtatatcccgatca

SEQ ID NO: 110528 - DNA, 25 bp, S. pombe
tcatgctatgccttgggttcgatat

SEQ ID NO: 110529 - DNA, 25 bp, S. pombe
tcagccagaacggtatgagctcatt

SEQ ID NO: 110530 - DNA, 25 bp, S. pombe
taccaagacccctggtcctggtgct

SEQ ID NO: 110531 - DNA, 25 bp, S. pombe
tcactcatcagttccctaaacaggg

SEQ ID NO: 110532 - DNA, 25 bp, S. pombe
taatcgcagcccgtgttactaaggg

SEQ ID NO: 110533 - DNA, 25 bp, S. pombe
tcagccggatgtcttggatcgatac

SEQ ID NO: 110534 - DNA, 25 bp, S. pombe
tcagtcttctgttttgcaatcctca

SEQ ID NO: 110535 - DNA, 25 bp, S. pombe
tcagcacattcgtcttaaatcccaa

SEQ ID NO: 110536 - DNA, 25 bp, S. pombe
tcatccttttctagcaaatcctcaa

SEQ ID NO: 110537 - DNA, 25 bp, S. pombe
tcatcctcgttatccaatatctcaa

SEQ ID NO: 110538 - DNA, 25 bp, S. pombe
tacgcgttcagcaccaaaatcgagt

SEQ ID NO: 110539 - DNA, 25 bp, S. pombe
tcagagctgctttgttcctttgaac

SEQ ID NO: 110540 - DNA, 25 bp, S. pombe
tcagcggtttgattcctactaaaga

SEQ ID NO: 110541 - DNA, 25 bp, S. pombe
tcacgtgtttgaatgtctgcctacc

SEQ ID NO: 110542 - DNA, 25 bp, S. pombe
tcaaacttttcttcttaccgcttga

SEQ ID NO: 110543 - DNA, 25 bp, S. pombe
tcagggttcttacctttggcttcaa

SEQ ID NO: 110544 - DNA, 25 bp, S. pombe
tcattggttgtgtgttatccgttaa

SEQ ID NO: 110545 - DNA, 25 bp, S. pombe
tcactggttgtgttgtcgccggtac

SEQ ID NO: 110546 - DNA, 25 bp, S. pombe
tcacggcattcctttttcagtatga

SEQ ID NO: 110547 - DNA, 25 bp, S. pombe
tcttgcgtctcttgcttttatgaat

SEQ ID NO: 110548 - DNA, 25 bp, S. pombe
tcttcggcactagcatttacactga

SEQ ID NO: 110549 - DNA, 25 bp, S. pombe
tcttgacctcttgctttattctgaa

SEQ ID NO: 110550 - DNA, 25 bp, S. pombe
tcagcgttggtcttcgtaggtctaa

SEQ ID NO: 110551 - DNA, 25 bp, S. pombe
tcacgttgctgatgttgttggtcct

SEQ ID NO: 110552 - DNA, 25 bp, S. pombe
tcattgcttatgagcctgtctgggc

SEQ ID NO: 110553 - DNA, 25 bp, S. pombe
tcaccgatgctgctttgcgttttat

SEQ ID NO: 110554 - DNA, 25 bp, S. pombe
tcaccagttcgtaggccatcattaa

SEQ ID NO: 110555 - DNA, 25 bp, S. pombe
tcatttggtaggttctgctctttct

SEQ ID NO: 110556 - DNA, 25 bp, S. pombe
tcattagctgtacgacctgtttcac

SEQ ID NO: 110557 - DNA, 25 bp, S. pombe
tcactactatcactgactcgctata

SEQ ID NO: 110558 - DNA, 25 bp, S. pombe
tcacccattcatcggctgcgtaaga

SEQ ID NO: 110559 - DNA, 25 bp, S. pombe
tcaccctctagtccgattgatcagg

SEQ ID NO: 110560 - DNA, 25 bp, S. pombe
tcaggaaagcactcccgcgatttat

SEQ ID NO: 110561 - DNA, 25 bp, S. pombe
tcaagaaagcaaccccgagcgtgtt

SEQ ID NO: 110562 - DNA, 25 bp, S. pombe
taaaatcaaagtgccgtcgggttgt

SEQ ID NO: 110563 - DNA, 25 bp, S. pombe
tcaaaacgaggccttacttcctaat

SEQ ID NO: 110564 - DNA, 25 bp, S. pombe
tcaaagacgtgctgcttacttccga

SEQ ID NO: 110565 - DNA, 25 bp, S. pombe
tcataattcggagtttcctgctgcc

SEQ ID NO: 110566 - DNA, 25 bp, S. pombe
tcaccctttgagacgatatttggaa

SEQ ID NO: 110567 - DNA, 25 bp, S. pombe
tcacccttgggacgatttcttgtat

SEQ ID NO: 110568 - DNA, 25 bp, S. pombe
tcaggcgcttggcagaactatattg

SEQ ID NO: 110569 - DNA, 25 bp, S. pombe
tcatctttcctatgctgattctgaa

SEQ ID NO: 110570 - DNA, 25 bp, S. pombe
taattattttactctcccctctagt

SEQ ID NO: 110571 - DNA, 25 bp, S. pombe
ttagttttctaacatccgcttctgg

SEQ ID NO: 110572 - DNA, 25 bp, S. pombe
taagtttaaacacattccaactgag

SEQ ID NO: 110573 - DNA, 25 bp, S. pombe
taagtttaaacacattccaactgag

SEQ ID NO: 110574 - DNA, 25 bp, S. pombe
taatcttttcaactggacgtcaacc

SEQ ID NO: 110575 - DNA, 25 bp, S. pombe
taaggagcactggtcgcgtttttta

SEQ ID NO: 110576 - DNA, 25 bp, S. pombe
tcatggttgacggttgctgttttgg

SEQ ID NO: 110577 - DNA, 25 bp, S. pombe
tcaggttacggttcatgctgttcgc

SEQ ID NO: 110578 - DNA, 25 bp, S. pombe
tcacgtaacggctaactgtcattca

SEQ ID NO: 110579 - DNA, 25 bp, S. pombe
tcatctggagtctgctatccgttta

SEQ ID NO: 110580 - DNA, 25 bp, S. pombe
tcactgtcaccatctatccgaaata

SEQ ID NO: 110581 - DNA, 25 bp, S. pombe
tcaccgtcccagcactttttactaa

SEQ ID NO: 110582 - DNA, 25 bp, S. pombe
tcagcttcaccctctagtattgatg

SEQ ID NO: 110583 - DNA, 25 bp, S. pombe
tagttccgtacctcctgttgaaata

SEQ ID NO: 110584 - DNA, 25 bp, S. pombe
tagtcccggtcctcgtggtcaaaag

SEQ ID NO: 110585 - DNA, 25 bp, S. pombe
taatcccgtttctcgtttgactcaa

SEQ ID NO: 110586 - DNA, 25 bp, S. pombe
ttatccggacttgaacgttgacata

SEQ ID NO: 110587 - DNA, 25 bp, S. pombe
taatcgttcccgttctggtattaag

SEQ ID NO: 110588 - DNA, 25 bp, S. pombe
tcaacgagttccgtactggtatcaa

SEQ ID NO: 110589 - DNA, 25 bp, S. pombe
tcaacggtcctcagtttattgggaa

SEQ ID NO: 110590 - DNA, 25 bp, S. pombe
tcaagatttccccatttttacacga

SEQ ID NO: 110591 - DNA, 25 bp, S. pombe
tcatcggctgtggtggtatttcttc

SEQ ID NO: 110592 - DNA, 25 bp, S. pombe
tcacggaccgtattttacagcaaga

SEQ ID NO: 110593 - DNA, 25 bp, S. pombe
tcaagcgcccgttggtttggcagga

SEQ ID NO: 110594 - DNA, 25 bp, S. pombe
tcatcacccgtctgtcttatttaaa

SEQ ID NO: 110595 - DNA, 25 bp, S. pombe
tcaacgcttgtctgattcggttaaa

SEQ ID NO: 110596 - DNA, 25 bp, S. pombe
tcatcaagtgtttgcctggcgttac

SEQ ID NO: 110597 - DNA, 25 bp, S. pombe
tcacatctcaacagtcgtccgaatt

SEQ ID NO: 110598 - DNA, 25 bp, S. pombe
tcatgcatcatcaactttagtcctt

SEQ ID NO: 110599 - DNA, 25 bp, S. pombe
tcatgccaacactactagcttcgta

SEQ ID NO: 110600 - DNA, 25 bp, S. pombe
tcatcaaacgcttgcttgtgctaaa

SEQ ID NO: 110601 - DNA, 25 bp, S. pombe
tcatgcaacatccttacttctcaaa

SEQ ID NO: 110602 - DNA, 25 bp, S. pombe
tcaaacctctcaacatcctaaataa

SEQ ID NO: 110603 - DNA, 25 bp, S. pombe
tcaaagctcctccaacgtaacgagt

SEQ ID NO: 110604 - DNA, 25 bp, S. pombe
tcagacctacaccaacctaattaat

SEQ ID NO: 110605 - DNA, 25 bp, S. pombe
tcacccttccagtacttcgaattgg

SEQ ID NO: 110606 - DNA, 25 bp, S. pombe
tcatcttcttccaattcttccaaat

SEQ ID NO: 110607 - DNA, 25 bp, S. pombe
tcatggatccttttcgcgtgtggaa

SEQ ID NO: 110608 - DNA, 25 bp, S. pombe
tcaggacactattatcggttcgcag

SEQ ID NO: 110609 - DNA, 25 bp, S. pombe
tcagtacaattatccggtcgagccg

SEQ ID NO: 110610 - DNA, 25 bp, S. pombe
taaaccgtacaaccttggagtcgct

SEQ ID NO: 110611 - DNA, 25 bp, S. pombe
taagaccgtaaatcctgaaggcctt

SEQ ID NO: 110612 - DNA, 25 bp, S. pombe
tcataaccccaacgtctctgaagag

SEQ ID NO: 110613 - DNA, 25 bp, S. pombe
tcacacgggctcaaagtcgctgaaa

SEQ ID NO: 110614 - DNA, 25 bp, S. pombe
tcaacgctggcaacaagcctgctga

SEQ ID NO: 110615 - DNA, 25 bp, S. pombe
tcaacgctggcaacaagcctgctga

SEQ ID NO: 110616 - DNA, 25 bp, S. pombe
tattcaaccaactgtatgaatgatt

SEQ ID NO: 110617 - DNA, 25 bp, S. pombe
tcaactagaagttcctcccgatttt

SEQ ID NO: 110618 - DNA, 25 bp, S. pombe
tcaacggaactagtcgtcccatttt

SEQ ID NO: 110619 - DNA, 25 bp, S. pombe
tcaacgtcatttttagctacccttc

SEQ ID NO: 110620 - DNA, 25 bp, S. pombe
tcactccctttattagcaactcaat

SEQ ID NO: 110621 - DNA, 25 bp, S. pombe
tcacgcgcttcttttatccatagat

SEQ ID NO: 110622 - DNA, 25 bp, S. pombe
tcacggttgcatgatatcccatttt

SEQ ID NO: 110623 - DNA, 25 bp, S. pombe
tcaaggtcagccaaacttttttcgt

SEQ ID NO: 110624 - DNA, 25 bp, S. pombe
tcaagaaattccaccgtttctggtt

SEQ ID NO: 110625 - DNA, 25 bp, S. pombe
tcagaaaatttctcactttcgccct

SEQ ID NO: 110626 - DNA, 25 bp, S. pombe
tagcaaacgggcaccttctgaaatt

SEQ ID NO: 110627 - DNA, 25 bp, S. pombe
tcacgggcgcgaaagccagcttatg

SEQ ID NO: 110628 - DNA, 25 bp, S. pombe
tcatccgatgggtcaacgcacttaa

SEQ ID NO: 110629 - DNA, 25 bp, S. pombe
tcaccgctcaagtcatcattcttaa

SEQ ID NO: 110630 - DNA, 25 bp, S. pombe
tcatgcaattactccgtcttattca

SEQ ID NO: 110631 - DNA, 25 bp, S. pombe
tcatatgttgttttgttggcaggaa

SEQ ID NO: 110632 - DNA, 25 bp, S. pombe
tcatcttcctatttgtcttcagctt

SEQ ID NO: 110633 - DNA, 25 bp, S. pombe
tcatgtccggatttcttagcttcaa

SEQ ID NO: 110634 - DNA, 25 bp, S. pombe
tcagtttggcccgtttcttatagaa

SEQ ID NO: 110635 - DNA, 25 bp, S. pombe
tcaacaccgcatctcaactttggat

SEQ ID NO: 110636 - DNA, 25 bp, S. pombe
tcatgagttgattgattggaatgtt

SEQ ID NO: 110637 - DNA, 25 bp, S. pombe
tcatggctggcaggtttgttgcctc

SEQ ID NO: 110638 - DNA, 25 bp, S. pombe
tcagcgattctaatttcttactata

SEQ ID NO: 110639 - DNA, 25 bp, S. pombe
tcatatgctgatttccttcgtgttt

SEQ ID NO: 110640 - DNA, 25 bp, S. pombe
taattgctttcacctcagtttactc

SEQ ID NO: 110641 - DNA, 25 bp, S. pombe
tcacctccgtctaccgtaagaagtt

SEQ ID NO: 110642 - DNA, 25 bp, S. pombe
tcacactttaggtacgctgcgatct

SEQ ID NO: 110643 - DNA, 25 bp, S. pombe
tcagcgatataacgaacttgtcaga

SEQ ID NO: 110644 - DNA, 25 bp, S. pombe
tcagcctctgccgatacatttaaaa

SEQ ID NO: 110645 - DNA, 25 bp, S. pombe
tcataactcaccctgtaacacaatt

SEQ ID NO: 110646 - DNA, 25 bp, S. pombe
tcacgctggttttcgatatcaagtt

SEQ ID NO: 110647 - DNA, 25 bp, S. pombe
tcacgtcctatgaacctacttgttg

SEQ ID NO: 110648 - DNA, 25 bp, S. pombe
tcacagttggcattcgttgaacgtt

SEQ ID NO: 110649 - DNA, 25 bp, S. pombe
tcacacttctgatggttggtcctat

SEQ ID NO: 110650 - DNA, 25 bp, S. pombe
tcaacctgttcaaatccttctgagc

SEQ ID NO: 110651 - DNA, 25 bp, S. pombe
tcacacctctcgtaaggctttggag

SEQ ID NO: 110652 - DNA, 25 bp, S. pombe
tcatggacttgcttgttcaccgaaa

SEQ ID NO: 110653 - DNA, 25 bp, S. pombe
tcataggatctgctgacgaccgtac

SEQ ID NO: 110654 - DNA, 25 bp, S. pombe
taactgaccaacatggaatggtgct

SEQ ID NO: 110655 - DNA, 25 bp, S. pombe
taagtcgtcgggttacaagtgctac

SEQ ID NO: 110656 - DNA, 25 bp, S. pombe
taattaccggcccttagatatttgg

SEQ ID NO: 110657 - DNA, 25 bp, S. pombe
tcagcagaagacctttttacaattc

SEQ ID NO: 110658 - DNA, 25 bp, S. pombe
tcaaaatcctccttgtaacaccatt

SEQ ID NO: 110659 - DNA, 25 bp, S. pombe
tcagaaacgtcttagggcacctctt

SEQ ID NO: 110660 - DNA, 25 bp, S. pombe
taaaggaatcagtctttcccacggg

SEQ ID NO: 110661 - DNA, 25 bp, S. pombe
tacagggtacaatgtttccccgctg

SEQ ID NO: 110662 - DNA, 25 bp, S. pombe
tcaagaagtacgtatggttcccggt

SEQ ID NO: 110663 - DNA, 25 bp, S. pombe
tcaaaaggtcggtcttattgccgcc

SEQ ID NO: 110664 - DNA, 25 bp, S. pombe
tattaccctatctttcaattcctgc

SEQ ID NO: 110665 - DNA, 25 bp, S. pombe
tcaaatcggtactttccaacttgcc

SEQ ID NO: 110666 - DNA, 25 bp, S. pombe
tcaaatccagattcattcgcacaat

SEQ ID NO: 110667 - DNA, 25 bp, S. pombe
tcaaggccaacgaacagctcagctg

SEQ ID NO: 110668 - DNA, 25 bp, S. pombe
tcaattgtgcttgtagcgtgcagct

SEQ ID NO: 110669 - DNA, 25 bp, S. pombe
tcaattgctgctgaatccggtgctg

SEQ ID NO: 110670 - DNA, 25 bp, S. pombe
tcaggacatgttcgcattcgttcaa

SEQ ID NO: 110671 - DNA, 25 bp, S. pombe
tatgggattttcttcggtcaacacc

SEQ ID NO: 110672 - DNA, 25 bp, S. pombe
tcacccgtctacattggagctgaaa

SEQ ID NO: 110673 - DNA, 25 bp, S. pombe
tcacccgtcgataagttggagcatt

SEQ ID NO: 110674 - DNA, 25 bp, S. pombe
tcacgtcgtcttggcatcttggaaa

SEQ ID NO: 110675 - DNA, 25 bp, S. pombe
tacaagatagggatgctgctgagaa

SEQ ID NO: 110676 - DNA, 25 bp, S. pombe
tcaaggttgcggtggaactgatctt

SEQ ID NO: 110677 - DNA, 25 bp, S. pombe
tcaagagttcagcaatcgaccgatt

SEQ ID NO: 110678 - DNA, 25 bp, S. pombe
tcaaagcattgtcaaggccgctggt

SEQ ID NO: 110679 - DNA, 25 bp, S. pombe
tcaaatgattctcaaggcccggcaa

SEQ ID NO: 110680 - DNA, 25 bp, S. pombe
tcacaattttgttcctcgttgggtt

SEQ ID NO: 110681 - DNA, 25 bp, S. pombe
tcatgactttatacccacgaatcga

SEQ ID NO: 110682 - DNA, 25 bp, S. pombe
tcagtctctgaatccctcaagtcta

SEQ ID NO: 110683 - DNA, 25 bp, S. pombe
tcagctttgctgattgcctgtaagt

SEQ ID NO: 110684 - DNA, 25 bp, S. pombe
tcagatattctgacgtccgctaatc

SEQ ID NO: 110685 - DNA, 25 bp, S. pombe
tcagtaattcacatctcatcgacga

SEQ ID NO: 110686 - DNA, 25 bp, S. pombe
tttgaatttttatcgccttggtggg

SEQ ID NO: 110687 - DNA, 25 bp, S. pombe
taagttttctcttgaccgtaggtgg

SEQ ID NO: 110688 - DNA, 25 bp, S. pombe
tcaagtaccttgttgagccctacgt

SEQ ID NO: 110689 - DNA, 25 bp, S. pombe
tcaagttccgttaattcctcctttg

SEQ ID NO: 110690 - DNA, 25 bp, S. pombe
tcaccttcgatgctagttctgcatt

SEQ ID NO: 110691 - DNA, 25 bp, S. pombe
tcaccgtggatgactttattgatct

SEQ ID NO: 110692 - DNA, 25 bp, S. pombe
tcaagccgtggccattgtgtttatg

SEQ ID NO: 110693 - DNA, 25 bp, S. pombe
tcacaacttcttttcggtaacgcta

SEQ ID NO: 110694 - DNA, 25 bp, S. pombe
taatgcaccttctagtcccaagact

SEQ ID NO: 110695 - DNA, 25 bp, S. pombe
tcacgttgacagttacaccggagca

SEQ ID NO: 110696 - DNA, 25 bp, S. pombe
taccttggaggttcatacggacaga

SEQ ID NO: 110697 - DNA, 25 bp, S. pombe
taaacccacggaagcgctgttcttt

SEQ ID NO: 110698 - DNA, 25 bp, S. pombe
taattattgcagaccctggaccttc

SEQ ID NO: 110699 - DNA, 25 bp, S. pombe
taataagcctatctagtgaccttgc

SEQ ID NO: 110700 - DNA, 25 bp, S. pombe
tcaaaagcttgtcctaggccacgat

SEQ ID NO: 110701 - DNA, 25 bp, S. pombe
tcatgaaaagtgaacgcgaatttgc

SEQ ID NO: 110702 - DNA, 25 bp, S. pombe
tcagatatcaaggatgtcgtcgaga

SEQ ID NO: 110703 - DNA, 25 bp, S. pombe
tcaaaaaggttctcacgtcgcagct

SEQ ID NO: 110704 - DNA, 25 bp, S. pombe
taactctcgagtaccgggacgttga

SEQ ID NO: 110705 - DNA, 25 bp, S. pombe
tcaagccttacaacctttacgtcga

SEQ ID NO: 110706 - DNA, 25 bp, S. pombe
taagtggaggaagaaacgcgtgaga

SEQ ID NO: 110707 - DNA, 25 bp, S. pombe
tcaggtattcgatggcatgcgtttt

SEQ ID NO: 110708 - DNA, 25 bp, S. pombe
tcagcgtcaacgtgagagagtatgt

SEQ ID NO: 110709 - DNA, 25 bp, S. pombe
tcactgtcgatggtggtggatgcca

SEQ ID NO: 110710 - DNA, 25 bp, S. pombe
tcagctttttatatggtgtgcccgt

SEQ ID NO: 110711 - DNA, 25 bp, S. pombe
tcacggccaaagaaaatgtaccaac

SEQ ID NO: 110712 - DNA, 25 bp, S. pombe
tcacggaaaacgtgttacgattcaa

SEQ ID NO: 110713 - DNA, 25 bp, S. pombe
tcacggaaaacgtgttacgattcaa

SEQ ID NO: 110714 - DNA, 25 bp, S. pombe
tcacggccaaacctctgaatgacga

SEQ ID NO: 110715 - DNA, 25 bp, S. pombe
tcaattaccgcagtttattcttggg

SEQ ID NO: 110716 - DNA, 25 bp, S. pombe
tcagttgccgcagcttctaatgtag

SEQ ID NO: 110717 - DNA, 25 bp, S. pombe
tcatgatatgacagtgctcccacag

SEQ ID NO: 110718 - DNA, 25 bp, S. pombe
tcatgaatgacttgcctgttagaga

SEQ ID NO: 110719 - DNA, 25 bp, S. pombe
tcagcatggctgttgttggtctaaa

SEQ ID NO: 110720 - DNA, 25 bp, S. pombe
tcagattgtgatatcgctgcctaca

SEQ ID NO: 110721 - DNA, 25 bp, S. pombe
tcacttgcattcacttctcttagat

SEQ ID NO: 110722 - DNA, 25 bp, S. pombe
tcagcatccattcactcttttcaaa

SEQ ID NO: 110723 - DNA, 25 bp, S. pombe
tcagctacaacctcttttcaacaag

SEQ ID NO: 110724 - DNA, 25 bp, S. pombe
taatcccactgctctttctaaagat

SEQ ID NO: 110725 - DNA, 25 bp, S. pombe
taatggcgctttgtttacggaggga

SEQ ID NO: 110726 - DNA, 25 bp, S. pombe
tcaagctccttgaaaccctcagtga

SEQ ID NO: 110727 - DNA, 25 bp, S. pombe
tcaaattccgacaagcagccatcaa

SEQ ID NO: 110728 - DNA, 25 bp, S. pombe
tcaaagtgcctgtctaccccaaaag

SEQ ID NO: 110729 - DNA, 25 bp, S. pombe
taatcaacttatcagacgtcgccgt

SEQ ID NO: 110730 - DNA, 25 bp, S. pombe
taatcctaacgccaattctgtacac

SEQ ID NO: 110731 - DNA, 25 bp, S. pombe
taatcgacctctttggctctgaaaa

SEQ ID NO: 110732 - DNA, 25 bp, S. pombe
tcagccgatgcgttttctctaaaaa

SEQ ID NO: 110733 - DNA, 25 bp, S. pombe
tcagtcgtcgttgcctctgaaaagg

SEQ ID NO: 110734 - DNA, 25 bp, S. pombe
tcagtccttgttgaccgcatgaaga

SEQ ID NO: 110735 - DNA, 25 bp, S. pombe
taatcttccttcttccgacaaagct

SEQ ID NO: 110736 - DNA, 25 bp, S. pombe
tcaagcttggactattgccgacggc

SEQ ID NO: 110737 - DNA, 25 bp, S. pombe
tcaaatttggctttcatccccagta

SEQ ID NO: 110738 - DNA, 25 bp, S. pombe
tcacatcatactccacttcataaaa

SEQ ID NO: 110739 - DNA, 25 bp, S. pombe
tcaactgcagctccttctaagaaag

SEQ ID NO: 110740 - DNA, 25 bp, S. pombe
tcaactcctccatctgtaaatcgga

SEQ ID NO: 110741 - DNA, 25 bp, S. pombe
tcagtattccaaaagccaacgtgtt

SEQ ID NO: 110742 - DNA, 25 bp, S. pombe
tcagcttccgccaaaccaaagttat

SEQ ID NO: 110743 - DNA, 25 bp, S. pombe
tcaaatatcctttccctactactga

SEQ ID NO: 110744 - DNA, 25 bp, S. pombe
tcacaatcatgcgtttctttaccac

SEQ ID NO: 110745 - DNA, 25 bp, S. pombe
tcaacatcgcgtttgctgttaccaa

SEQ ID NO: 110746 - DNA, 25 bp, S. pombe
tcaagagtcttgttcgttacctatt

SEQ ID NO: 110747 - DNA, 25 bp, S. pombe
tcaagtttgaaatccccgttatcca

SEQ ID NO: 110748 - DNA, 25 bp, S. pombe
tcaactttagatgcttcgtcgtcaa

SEQ ID NO: 110749 - DNA, 25 bp, S. pombe
tcaacctcgtagtccaagtcgtaga

SEQ ID NO: 110750 - DNA, 25 bp, S. pombe
ttatgtcaacttctaacaggtcagt

SEQ ID NO: 110751 - DNA, 25 bp, S. pombe
tcagagcttccgtcgcgaggacaat

SEQ ID NO: 110752 - DNA, 25 bp, S. pombe
tcaacttctcgcttcaatgtgggaa

SEQ ID NO: 110753 - DNA, 25 bp, S. pombe
tcagcgctttcctatatcatgcaag

SEQ ID NO: 110754 - DNA, 25 bp, S. pombe
taattgctgctaccaatcgaccgga

SEQ ID NO: 110755 - DNA, 25 bp, S. pombe
taatagaccattagacgatcgggag

SEQ ID NO: 110756 - DNA, 25 bp, S. pombe
tcaattactgatacgactactggaa

SEQ ID NO: 110757 - DNA, 25 bp, S. pombe
tcagttccctcttctgttgaaaaca

SEQ ID NO: 110758 - DNA, 25 bp, S. pombe
tcacttccccatttcttaaggcgat

SEQ ID NO: 110759 - DNA, 25 bp, S. pombe
tcacttgaagtgttggcgtctcttt

SEQ ID NO: 110760 - DNA, 25 bp, S. pombe
tcaaaacaccatatgcggccgttac

SEQ ID NO: 110761 - DNA, 25 bp, S. pombe
tcaactcgccatccgtaacgatgaa

SEQ ID NO: 110762 - DNA, 25 bp, S. pombe
tcacagcgtcttcttgaatcacaac

SEQ ID NO: 110763 - DNA, 25 bp, S. pombe
taatccctgcgccttggaaaactgc

SEQ ID NO: 110764 - DNA, 25 bp, S. pombe
taaatcccttttgtagaccgtcagc

SEQ ID NO: 110765 - DNA, 25 bp, S. pombe
taaggttaaagtttccgatcgcaca

SEQ ID NO: 110766 - DNA, 25 bp, S. pombe
taaggttgaacagccaccgaagcca

SEQ ID NO: 110767 - DNA, 25 bp, S. pombe
taagattaagactacccgcaaggac

SEQ ID NO: 110768 - DNA, 25 bp, S. pombe
tcaagattttgatgcccgccaaggt

SEQ ID NO: 110769 - DNA, 25 bp, S. pombe
tcaacactttgattcgtcctaacgg

SEQ ID NO: 110770 - DNA, 25 bp, S. pombe
taatcctgaaatttttggtcggctc

SEQ ID NO: 110771 - DNA, 25 bp, S. pombe
taatcccaattccacttcttcggtt

SEQ ID NO: 110772 - DNA, 25 bp, S. pombe
taattctccttccttattatcggtt

SEQ ID NO: 110773 - DNA, 25 bp, S. pombe
tcagttggtgtatttttcgccctca

SEQ ID NO: 110774 - DNA, 25 bp, S. pombe
tacgggattgcagtacttctggctc

SEQ ID NO: 110775 - DNA, 25 bp, S. pombe
taattgtccggtcgttgatcctgaa

SEQ ID NO: 110776 - DNA, 25 bp, S. pombe
tcaactatcgttgtgttcgtgcccg

SEQ ID NO: 110777 - DNA, 25 bp, S. pombe
tcaagctgggtttttagctgcaaac

SEQ ID NO: 110778 - DNA, 25 bp, S. pombe
tcaacctggtgttttgcagacgaag

SEQ ID NO: 110779 - DNA, 25 bp, S. pombe
tcaccctggttttctgcttgtagag

SEQ ID NO: 110780 - DNA, 25 bp, S. pombe
tcacgcccgtgtctctaatgtaatg

SEQ ID NO: 110781 - DNA, 25 bp, S. pombe
tcacacattatctctagcggttgta

SEQ ID NO: 110782 - DNA, 25 bp, S. pombe
tcaccattgatgaagccgtgcgaat

SEQ ID NO: 110783 - DNA, 25 bp, S. pombe
tcaaattcatccaattcctttcctg

SEQ ID NO: 110784 - DNA, 25 bp, S. pombe
tcaacgtcaaattcctcctttggag

SEQ ID NO: 110785 - DNA, 25 bp, S. pombe
tcaaggacgacttttcttttgagaa

SEQ ID NO: 110786 - DNA, 25 bp, S. pombe
tcaagtcctacgctttctttacaaa

SEQ ID NO: 110787 - DNA, 25 bp, S. pombe
tcaagattctgtacacgacctctgg

SEQ ID NO: 110788 - DNA, 25 bp, S. pombe
taattccttacagtgctttgccgtt

SEQ ID NO: 110789 - DNA, 25 bp, S. pombe
taatcatcctttaccattacctttc

SEQ ID NO: 110790 - DNA, 25 bp, S. pombe
tcaagtgttcttcttttcgcctaga

SEQ ID NO: 110791 - DNA, 25 bp, S. pombe
tcaagttttagctgcgatggccaaa

SEQ ID NO: 110792 - DNA, 25 bp, S. pombe
tcaacgtatcaaggccgacaccaaa

SEQ ID NO: 110793 - DNA, 25 bp, S. pombe
taactacatagacccgaggcttact

SEQ ID NO: 110794 - DNA, 25 bp, S. pombe
tcaactatccattcgacccttaaaa

SEQ ID NO: 110795 - DNA, 25 bp, S. pombe
taagtgatgccaccgacccatttaa

SEQ ID NO: 110796 - DNA, 25 bp, S. pombe
tcaagatgagcttcggatcgccaat

SEQ ID NO: 110797 - DNA, 25 bp, S. pombe
tcaatatcgcagtcggaggctcatt

SEQ ID NO: 110798 - DNA, 25 bp, S. pombe
tacagctgtgcaaaggcaggcattt

SEQ ID NO: 110799 - DNA, 25 bp, S. pombe
tcacctgcatacaaggcggctttgg

SEQ ID NO: 110800 - DNA, 25 bp, S. pombe
tcagcctaatccttcgagcgatttg

SEQ ID NO: 110801 - DNA, 25 bp, S. pombe
tcagccttcacctgtagcgatacat

SEQ ID NO: 110802 - DNA, 25 bp, S. pombe
taatacctacatcaagcgcggtgcc

SEQ ID NO: 110803 - DNA, 25 bp, S. pombe
tcaatgcatccttcccaaggtggag

SEQ ID NO: 110804 - DNA, 25 bp, S. pombe
taatgacgtgcctcaaaccgatggt

SEQ ID NO: 110805 - DNA, 25 bp, S. pombe
taattcgtcttctcaatcacttgga

SEQ ID NO: 110806 - DNA, 25 bp, S. pombe
taagcaaatccctcgtttgttgggt

SEQ ID NO: 110807 - DNA, 25 bp, S. pombe
taaaaatgcctctcgattcgggtcc

SEQ ID NO: 110808 - DNA, 25 bp, S. pombe
tcaagaaacccatcagttcgacctc

SEQ ID NO: 110809 - DNA, 25 bp, S. pombe
tacaaatcccgccaaattcgtacca

SEQ ID NO: 110810 - DNA, 25 bp, S. pombe
taatgcgttcgtcttacccggaggg

SEQ ID NO: 110811 - DNA, 25 bp, S. pombe
taacgattttacattcctggaacta

SEQ ID NO: 110812 - DNA, 25 bp, S. pombe
tcaagacacttttttggcaagagat

SEQ ID NO: 110813 - DNA, 25 bp, S. pombe
tcaagcaactcttgtcttggcatcc

SEQ ID NO: 110814 - DNA, 25 bp, S. pombe
tcaactcctttgactgacagtgaat

SEQ ID NO: 110815 - DNA, 25 bp, S. pombe
tcaacccgtaattgatgagcggact

SEQ ID NO: 110816 - DNA, 25 bp, S. pombe
tcaacccgaaattttgcgcatgaag

SEQ ID NO: 110817 - DNA, 25 bp, S. pombe
tcaacccgagatcttgcgcatgaaa

SEQ ID NO: 110818 - DNA, 25 bp, S. pombe
tcacgggactgatcacattaacatt

SEQ ID NO: 110819 - DNA, 25 bp, S. pombe
tcaacaactctcagccgaacataat

SEQ ID NO: 110820 - DNA, 25 bp, S. pombe
tcaacaatttgacgccgccgataaa

SEQ ID NO: 110821 - DNA, 25 bp, S. pombe
tcaaagcagaattcctttcccttgg

SEQ ID NO: 110822 - DNA, 25 bp, S. pombe
taaaatgggacctttacgtctggct

SEQ ID NO: 110823 - DNA, 25 bp, S. pombe
taaacagccttggtgtccaacggtt

SEQ ID NO: 110824 - DNA, 25 bp, S. pombe
tcaaacatccccatttgcaactgat

SEQ ID NO: 110825 - DNA, 25 bp, S. pombe
tcaaagactctccatgtctggcaac

SEQ ID NO: 110826 - DNA, 25 bp, S. pombe
taattgttggttccggtttccgcat

SEQ ID NO: 110827 - DNA, 25 bp, S. pombe
taatagttttgctgggtttccgaca

SEQ ID NO: 110828 - DNA, 25 bp, S. pombe
taatgcagtattacccggaaaccga

SEQ ID NO: 110829 - DNA, 25 bp, S. pombe
tcaattggaaactgccgctggtgcc

SEQ ID NO: 110830 - DNA, 25 bp, S. pombe
taattggaacacctcaccattctgt

SEQ ID NO: 110831 - DNA, 25 bp, S. pombe
tcaaaccgaaagtcagccgctcaaa

SEQ ID NO: 110832 - DNA, 25 bp, S. pombe
taatggacagaacactcggacgaat

SEQ ID NO: 110833 - DNA, 25 bp, S. pombe
tcacaacacctatcgccaaaataac

SEQ ID NO: 110834 - DNA, 25 bp, S. pombe
tcaagccaaggttcgcaatgtcaat

SEQ ID NO: 110835 - DNA, 25 bp, S. pombe
tcaatcgtatctccgctaatgctaa

SEQ ID NO: 110836 - DNA, 25 bp, S. pombe
taattagccaacacctgttccctta

SEQ ID NO: 110837 - DNA, 25 bp, S. pombe
taataatccggaccctgatttgcct

SEQ ID NO: 110838 - DNA, 25 bp, S. pombe
tcaaagacgctttagctgctgttga

SEQ ID NO: 110839 - DNA, 25 bp, S. pombe
tcaaatgaactttatgcgcaccgca

SEQ ID NO: 110840 - DNA, 25 bp, S. pombe
taaggatatcgacgagctcatcgct

SEQ ID NO: 110841 - DNA, 25 bp, S. pombe
tcaagcagatgtcagcggtccgtat

SEQ ID NO: 110842 - DNA, 25 bp, S. pombe
tcaaatcaatcactccttcactgga

SEQ ID NO: 110843 - DNA, 25 bp, S. pombe
tcaaacattgatcccttcgcagcag

SEQ ID NO: 110844 - DNA, 25 bp, S. pombe
tcaaaattgctgacggcgccaagac

SEQ ID NO: 110845 - DNA, 25 bp, S. pombe
tcaaatgcttggacacactggctaa

SEQ ID NO: 110846 - DNA, 25 bp, S. pombe
tcacacttcattacactcggagcta

SEQ ID NO: 110847 - DNA, 25 bp, S. pombe
tcaccttctttcttcacaacatatt

SEQ ID NO: 110848 - DNA, 25 bp, S. pombe
taatcttaattttacacgcatcata

SEQ ID NO: 110849 - DNA, 25 bp, S. pombe
tcaatattatcctcccgctaatgag

SEQ ID NO: 110850 - DNA, 25 bp, S. pombe
tcaagatcaacctcctcactatgag

SEQ ID NO: 110851 - DNA, 25 bp, S. pombe
tcacagtcccaaccagaagctttag

SEQ ID NO: 110852 - DNA, 25 bp, S. pombe
tcaagctacacgttcaagacagttt

SEQ ID NO: 110853 - DNA, 25 bp, S. pombe
tcaagctaccactcttcaattctat

SEQ ID NO: 110854 - DNA, 25 bp, S. pombe
taatttactgctccaagattgttgt

SEQ ID NO: 110855 - DNA, 25 bp, S. pombe
taatttcagcttcaaccgttgttgc

SEQ ID NO: 110856 - DNA, 25 bp, S. pombe
taattccagctttaatcttaatttt

SEQ ID NO: 110857 - DNA, 25 bp, S. pombe
taataccgagcatttccttcaatat

SEQ ID NO: 110858 - DNA, 25 bp, S. pombe
taatcccggctgtggtttggtgtat

SEQ ID NO: 110859 - DNA, 25 bp, S. pombe
taatcagactgcaattgggttcgtt

SEQ ID NO: 110860 - DNA, 25 bp, S. pombe
tcaactggtcagtgagcttccgcaa

SEQ ID NO: 110861 - DNA, 25 bp, S. pombe
taattgccagcagatccttacaggg

SEQ ID NO: 110862 - DNA, 25 bp, S. pombe
tcaatttctggacgctgttcacctg

SEQ ID NO: 110863 - DNA, 25 bp, S. pombe
taattgctcttcgtgctattaccac

SEQ ID NO: 110864 - DNA, 25 bp, S. pombe
taatacttacttctctgcgcaatcg

SEQ ID NO: 110865 - DNA, 25 bp, S. pombe
tcaaagtgctttgctcatcccaact

SEQ ID NO: 110866 - DNA, 25 bp, S. pombe
tcaaaactcttttatcccaggtctc

SEQ ID NO: 110867 - DNA, 25 bp, S. pombe
taatattttcgccttacctgttcct

SEQ ID NO: 110868 - DNA, 25 bp, S. pombe
taatcattctttgcccaacgttcga

SEQ ID NO: 110869 - DNA, 25 bp, S. pombe
taatcttgcttacccgaatcctatg

SEQ ID NO: 110870 - DNA, 25 bp, S. pombe
taacttgttgcatgttccccttaat

SEQ ID NO: 110871 - DNA, 25 bp, S. pombe
tatcccgtcgaaatatccctttagt

SEQ ID NO: 110872 - DNA, 25 bp, S. pombe
tactttgcaccacggtattgcgttt

SEQ ID NO: 110873 - DNA, 25 bp, S. pombe
taatattgcgcgtggtgctatgggc

SEQ ID NO: 110874 - DNA, 25 bp, S. pombe
taaatccggtcgctctaggtcaaaa

SEQ ID NO: 110875 - DNA, 25 bp, S. pombe
taagaccacgttcgtcaagcgtcat

SEQ ID NO: 110876 - DNA, 25 bp, S. pombe
tcaagacattcagttcgtgctagct

SEQ ID NO: 110877 - DNA, 25 bp, S. pombe
tcaagacttcctgttgctggtacaa

SEQ ID NO: 110878 - DNA, 25 bp, S. pombe
tcaaggcttaatgctaccgaaccag

SEQ ID NO: 110879 - DNA, 25 bp, S. pombe
taaggaaaactcttccattttcgtg

SEQ ID NO: 110880 - DNA, 25 bp, S. pombe
tagtaccggacgtggtgttgtccac

SEQ ID NO: 110881 - DNA, 25 bp, S. pombe
taatcacactgaaaggccgttggaa

SEQ ID NO: 110882 - DNA, 25 bp, S. pombe
taatcgcattataacccggtcgcag

SEQ ID NO: 110883 - DNA, 25 bp, S. pombe
taatctgccacgcattccaagtgat

SEQ ID NO: 110884 - DNA, 25 bp, S. pombe
taattcacaagtttccaagctggtt

SEQ ID NO: 110885 - DNA, 25 bp, S. pombe
tcaattcccagcgtaagcgagagaa

SEQ ID NO: 110886 - DNA, 25 bp, S. pombe
taattggcaacacttggctgctctg

SEQ ID NO: 110887 - DNA, 25 bp, S. pombe
taatgtcggtggaacgtttccgtca

SEQ ID NO: 110888 - DNA, 25 bp, S. pombe
taatttcaatggtgcgtttgccgct

SEQ ID NO: 110889 - DNA, 25 bp, S. pombe
taacgtctcgttccttacaatttga

SEQ ID NO: 110890 - DNA, 25 bp, S. pombe
taaattccgatcctttacatttgga

SEQ ID NO: 110891 - DNA, 25 bp, S. pombe
taatagcccttcctttggcaattgg

SEQ ID NO: 110892 - DNA, 25 bp, S. pombe
taatacctctaaaccgacttccatg

SEQ ID NO: 110893 - DNA, 25 bp, S. pombe
tcaaaaatatttggcactcagtata

SEQ ID NO: 110894 - DNA, 25 bp, S. pombe
tcaagactgttcgtgagctccttta

SEQ ID NO: 110895 - DNA, 25 bp, S. pombe
tcaaaactttcatcttcgagctcct

SEQ ID NO: 110896 - DNA, 25 bp, S. pombe
tcaaccattttatcttccgggctat

SEQ ID NO: 110897 - DNA, 25 bp, S. pombe
taaggcattttatccgtccaagaaa

SEQ ID NO: 110898 - DNA, 25 bp, S. pombe
tcaacggtcttttcttggctcaata

SEQ ID NO: 110899 - DNA, 25 bp, S. pombe
tcaacggctcttcgatttggcgata

SEQ ID NO: 110900 - DNA, 25 bp, S. pombe
taatcagtactacttctgccttggc

SEQ ID NO: 110901 - DNA, 25 bp, S. pombe
tcaaaatttgccttccacgttgctt

SEQ ID NO: 110902 - DNA, 25 bp, S. pombe
tcaaaatatcgttaccacctttggt

SEQ ID NO: 110903 - DNA, 25 bp, S. pombe
tcaaagatatctctaccgccagtac

SEQ ID NO: 110904 - DNA, 25 bp, S. pombe
tcaagagtttatggaagttcctccc

SEQ ID NO: 110905 - DNA, 25 bp, S. pombe
tcaatgagagtctaggacctcccta

SEQ ID NO: 110906 - DNA, 25 bp, S. pombe
tcaattgcctgcaaaaccttactga

SEQ ID NO: 110907 - DNA, 25 bp, S. pombe
tcaatggcctggaaagccttttcaa

SEQ ID NO: 110908 - DNA, 25 bp, S. pombe
taattcccgatatcactttgcctga

SEQ ID NO: 110909 - DNA, 25 bp, S. pombe
tcaattacttattacccttcgcgac

SEQ ID NO: 110910 - DNA, 25 bp, S. pombe
taatttcaatgatatcccctcgacc

SEQ ID NO: 110911 - DNA, 25 bp, S. pombe
taatcttaaacgtatggcccgacga

SEQ ID NO: 110912 - DNA, 25 bp, S. pombe
taattcgaaatgctttgcgccaacg

SEQ ID NO: 110913 - DNA, 25 bp, S. pombe
taagtctgaagagctttcgcaaaca

SEQ ID NO: 110914 - DNA, 25 bp, S. pombe
tcaagttattgaaccttcggcgccg

SEQ ID NO: 110915 - DNA, 25 bp, S. pombe
tcaaactcatcattattccacgctt

SEQ ID NO: 110916 - DNA, 25 bp, S. pombe
tcaagttctttgcatcatccctaat

SEQ ID NO: 110917 - DNA, 25 bp, S. pombe
tcaatgcttcctttttcacctaata

SEQ ID NO: 110918 - DNA, 25 bp, S. pombe
tcacatgttggttctttctctttgg

SEQ ID NO: 110919 - DNA, 25 bp, S. pombe
tcaagggagcatactgtttacatct

SEQ ID NO: 110920 - DNA, 25 bp, S. pombe
tcacagggtctggagctttactact

SEQ ID NO: 110921 - DNA, 25 bp, S. pombe
taagggcccgaaagacatcttcaat

SEQ ID NO: 110922 - DNA, 25 bp, S. pombe
taaggcaacgctgatgactcgtact

SEQ ID NO: 110923 - DNA, 25 bp, S. pombe
taagcgccagtccaggttcagtatc

SEQ ID NO: 110924 - DNA, 25 bp, S. pombe
taatgccactgactcaacttcatgt

SEQ ID NO: 110925 - DNA, 25 bp, S. pombe
taatcattggtggtcccgatgcgta

SEQ ID NO: 110926 - DNA, 25 bp, S. pombe
taagcaaggtttcccaatgttccag

SEQ ID NO: 110927 - DNA, 25 bp, S. pombe
taataacactgctaccagcgttcct

SEQ ID NO: 110928 - DNA, 25 bp, S. pombe
taaggctatgggatcagtgactgct

SEQ ID NO: 110929 - DNA, 25 bp, S. pombe
tcacaaggtgttttggttgccaaga

SEQ ID NO: 110930 - DNA, 25 bp, S. pombe
tcacactgtcaaatctcgccgaaaa

SEQ ID NO: 110931 - DNA, 25 bp, S. pombe
tcacatgtgaaatctcccgaaaata

SEQ ID NO: 110932 - DNA, 25 bp, S. pombe
tcaagcgaatatgtctcccgaagat

SEQ ID NO: 110933 - DNA, 25 bp, S. pombe
taagcttgctgctgagaaaaatgca

SEQ ID NO: 110934 - DNA, 25 bp, S. pombe
tcaatgtcagtactcccaatatctc

SEQ ID NO: 110935 - DNA, 25 bp, S. pombe
tcaatatgccactttgcgttcgagc

SEQ ID NO: 110936 - DNA, 25 bp, S. pombe
taattgccactgttcatgtctgcgt

SEQ ID NO: 110937 - DNA, 25 bp, S. pombe
tcaagtatcttctttggctggtcgc

SEQ ID NO: 110938 - DNA, 25 bp, S. pombe
taattatatactttggccggccgta

SEQ ID NO: 110939 - DNA, 25 bp, S. pombe
taatctctaaaaccctcgaccttga

SEQ ID NO: 110940 - DNA, 25 bp, S. pombe
taatggctaaactcccggctcatag

SEQ ID NO: 110941 - DNA, 25 bp, S. pombe
taatggtgaaatgccgttcctctat

SEQ ID NO: 110942 - DNA, 25 bp, S. pombe
taattgcccaattttatgtcgcggt

SEQ ID NO: 110943 - DNA, 25 bp, S. pombe
taatgtcttacaatctggttacggt

SEQ ID NO: 110944 - DNA, 25 bp, S. pombe
tcaattcttcacatctcgtttcgga

SEQ ID NO: 110945 - DNA, 25 bp, S. pombe
taagtgttgccttgatcggttacgg

SEQ ID NO: 110946 - DNA, 25 bp, S. pombe
taatgttgcaacgtctcatggctgc

SEQ ID NO: 110947 - DNA, 25 bp, S. pombe
taattgatcaacatgccagcgatga

SEQ ID NO: 110948 - DNA, 25 bp, S. pombe
tcaatcgtttgtatgctgaagcaca

SEQ ID NO: 110949 - DNA, 25 bp, S. pombe
tcaagttcttctgcagctacaacgg

SEQ ID NO: 110950 - DNA, 25 bp, S. pombe
tcaagtatcttttcgcatggacaac

SEQ ID NO: 110951 - DNA, 25 bp, S. pombe
taatgatttttatcgtacaacgttg

SEQ ID NO: 110952 - DNA, 25 bp, S. pombe
tagttcgttatgacgtttctcccgc

SEQ ID NO: 110953 - DNA, 25 bp, S. pombe
tatgtttgcgttaaagttccccagt

SEQ ID NO: 110954 - DNA, 25 bp, S. pombe
tatttgaaattaccctcggcaccgt

SEQ ID NO: 110955 - DNA, 25 bp, S. pombe
tttaggtattcgaccttcgacggat

SEQ ID NO: 110956 - DNA, 25 bp, S. pombe
tattaatgaacctttttcgacggat

SEQ ID NO: 110957 - DNA, 25 bp, S. pombe
taatcgaaatccctcttttgacgaa

SEQ ID NO: 110958 - DNA, 25 bp, S. pombe
tttctactattctggtgggactcgt

SEQ ID NO: 110959 - DNA, 25 bp, S. pombe
tttttccttctaccatcggacaagt

SEQ ID NO: 110960 - DNA, 25 bp, S. pombe
ttacttctgattcaacgggtccact

SEQ ID NO: 110961 - DNA, 25 bp, S. pombe
taacgttgtccgaaatcgtcccgat

SEQ ID NO: 110962 - DNA, 25 bp, S. pombe
tttccttatccgaaagcgaccgagt

SEQ ID NO: 110963 - DNA, 25 bp, S. pombe
taagctttctcctgaggcgatccga

SEQ ID NO: 110964 - DNA, 25 bp, S. pombe
tacacttgtcggttttgggcaaaca

SEQ ID NO: 110965 - DNA, 25 bp, S. pombe
tcaagttgtcttctacggaggtcca

SEQ ID NO: 110966 - DNA, 25 bp, S. pombe
taatcgctgggtttacggccgcaag

SEQ ID NO: 110967 - DNA, 25 bp, S. pombe
tcaaggctgctggtgtttctcgtcg

SEQ ID NO: 110968 - DNA, 25 bp, S. pombe
tcaacatgtcagtcattcccgaagc

SEQ ID NO: 110969 - DNA, 25 bp, S. pombe
tcaagtgtcgaaaacctgggctttt

SEQ ID NO: 110970 - DNA, 25 bp, S. pombe
taatttgcgaaatcccggtgtgtat

SEQ ID NO: 110971 - DNA, 25 bp, S. pombe
tcaattcaagattccttcctggttc

SEQ ID NO: 110972 - DNA, 25 bp, S. pombe
taatggccgttattatccggttcgc

SEQ ID NO: 110973 - DNA, 25 bp, S. pombe
taagccgcgttttattcgtttcaga

SEQ ID NO: 110974 - DNA, 25 bp, S. pombe
taaccggtttccatccatcaataga

SEQ ID NO: 110975 - DNA, 25 bp, S. pombe
tcaagtttctcctcctgtgttaata

SEQ ID NO: 110976 - DNA, 25 bp, S. pombe
taattatcatttgctatcttctaaa

SEQ ID NO: 110977 - DNA, 25 bp, S. pombe
tcaaaatcattacttcgtcaccctg

SEQ ID NO: 110978 - DNA, 25 bp, S. pombe
tcaagtatttagctccttctccata

SEQ ID NO: 110979 - DNA, 25 bp, S. pombe
tcaaacgtgttctaggagtcctcga

SEQ ID NO: 110980 - DNA, 25 bp, S. pombe
taattcgggtctgagagccctcgat

SEQ ID NO: 110981 - DNA, 25 bp, S. pombe
tagatgccagcgtgcgaaaacccgt

SEQ ID NO: 110982 - DNA, 25 bp, S. pombe
taatcttcctcccaagacctttggt

SEQ ID NO: 110983 - DNA, 25 bp, S. pombe
taacatttcccgcatgccgtttcgt

SEQ ID NO: 110984 - DNA, 25 bp, S. pombe
taagcttaccggtatggctttccgt

SEQ ID NO: 110985 - DNA, 25 bp, S. pombe
taatttatacgttgccagccttcgc

SEQ ID NO: 110986 - DNA, 25 bp, S. pombe
taattttcctgagttagcctggcgc

SEQ ID NO: 110987 - DNA, 25 bp, S. pombe
taagaatatcggcttcagtagtggt

SEQ ID NO: 110988 - DNA, 25 bp, S. pombe
taattactcactcattaccagccga

SEQ ID NO: 110989 - DNA, 25 bp, S. pombe
taataactgttcattccgcttgggc

SEQ ID NO: 110990 - DNA, 25 bp, S. pombe
taattcagcctgatgtcgccgttga

SEQ ID NO: 110991 - DNA, 25 bp, S. pombe
tcaatacagcacttttcccgttaaa

SEQ ID NO: 110992 - DNA, 25 bp, S. pombe
taaccgtgttggcagacgcgtccca

SEQ ID NO: 110993 - DNA, 25 bp, S. pombe
tattaacccgtctcaggaagcgcaa

SEQ ID NO: 110994 - DNA, 25 bp, S. pombe
taacaaacaaacaaaccctctgcca

SEQ ID NO: 110995 - DNA, 25 bp, S. pombe
taagactccaaaaaagcgcgctgcc

SEQ ID NO: 110996 - DNA, 25 bp, S. pombe
taatagtactactgtcttcccgaca

SEQ ID NO: 110997 - DNA, 25 bp, S. pombe
taatttacatgagccggacgacgaa

SEQ ID NO: 110998 - DNA, 25 bp, S. pombe
taacgacatcaatcctgcaggtttt

SEQ ID NO: 110999 - DNA, 25 bp, S. pombe
taagggacgtccttgcaagattgtc

SEQ ID NO: 111000 - DNA, 25 bp, S. pombe
taatgtcccttcgtttactgtttct

SEQ ID NO: 111001 - DNA, 25 bp, S. pombe
taattagccttgctttgggctttcc

SEQ ID NO: 111002 - DNA, 25 bp, S. pombe
taaataccttgctcataggcctcat

SEQ ID NO: 111003 - DNA, 25 bp, S. pombe
tcaatacagtggtggatccggaatt

SEQ ID NO: 111004 - DNA, 25 bp, S. pombe
tcaacaaatgggtgctgccggtatt

SEQ ID NO: 111005 - DNA, 25 bp, S. pombe
tacacccagggtcgttggagttcca

SEQ ID NO: 111006 - DNA, 25 bp, S. pombe
tacagccccagtatgttcgagttcg

SEQ ID NO: 111007 - DNA, 25 bp, S. pombe
taattgcggtgctattcgtacccac

SEQ ID NO: 111008 - DNA, 25 bp, S. pombe
tcaacagctgccaactttattcgtg

SEQ ID NO: 111009 - DNA, 25 bp, S. pombe
taaacgctgccaggctattgccgat

SEQ ID NO: 111010 - DNA, 25 bp, S. pombe
tagcaaaaacccgtgctgcacatga

SEQ ID NO: 111011 - DNA, 25 bp, S. pombe
tcaagaatatcgtcgctgtcgctgc

SEQ ID NO: 111012 - DNA, 25 bp, S. pombe
tcaagtaactcttgccttggcattc

SEQ ID NO: 111013 - DNA, 25 bp, S. pombe
tcaagggaccacacagctcgagtat

SEQ ID NO: 111014 - DNA, 25 bp, S. pombe
taagcggtaccgtcctcaagtaggc

SEQ ID NO: 111015 - DNA, 25 bp, S. pombe
taacgggatcggtttactgtgcctt

SEQ ID NO: 111016 - DNA, 25 bp, S. pombe
taagggaccggtttctgaagcccag

SEQ ID NO: 111017 - DNA, 25 bp, S. pombe
tacgataaaacgactacgcccggcg

SEQ ID NO: 111018 - DNA, 25 bp, S. pombe
tactaaaccagctctacgatcgcag

SEQ ID NO: 111019 - DNA, 25 bp, S. pombe
tagtaatcctcctcaacctcaagga

SEQ ID NO: 111020 - DNA, 25 bp, S. pombe
taataattctcctgaccatccaagt

SEQ ID NO: 111021 - DNA, 25 bp, S. pombe
taatagatggccttcttgcaatccc

SEQ ID NO: 111022 - DNA, 25 bp, S. pombe
taaggcatggattgtttgtactacc

SEQ ID NO: 111023 - DNA, 25 bp, S. pombe
taaggctggtactctttcaaccgga

SEQ ID NO: 111024 - DNA, 25 bp, S. pombe
taaaagctaatcctcgtgtaaatcg

SEQ ID NO: 111025 - DNA, 25 bp, S. pombe
tcaacgactttccaccttaaagcag

SEQ ID NO: 111026 - DNA, 25 bp, S. pombe
taacatcaaattacaacttaaacgt

SEQ ID NO: 111027 - DNA, 25 bp, S. pombe
taacgtttatagacccttaccagat

SEQ ID NO: 111028 - DNA, 25 bp, S. pombe
taatattgttagcacgccttgtcgt

SEQ ID NO: 111029 - DNA, 25 bp, S. pombe
taattgcacttctggatgccttccg

SEQ ID NO: 111030 - DNA, 25 bp, S. pombe
taattatcctcatgatcctcctaag

SEQ ID NO: 111031 - DNA, 25 bp, S. pombe
taattatcagcctaagcgtcagcaa

SEQ ID NO: 111032 - DNA, 25 bp, S. pombe
taatatgcctgatttaactgtgcca

SEQ ID NO: 111033 - DNA, 25 bp, S. pombe
tatattaccgatgctagtcccgaat

SEQ ID NO: 111034 - DNA, 25 bp, S. pombe
taatctacctagcattgtttcgaaa

SEQ ID NO: 111035 - DNA, 25 bp, S. pombe
tacagctacacccttattttcgaaa

SEQ ID NO: 111036 - DNA, 25 bp, S. pombe
tacggacccgttctctaataagcga

SEQ ID NO: 111037 - DNA, 25 bp, S. pombe
taaacaacccgaagatgctcctagc

SEQ ID NO: 111038 - DNA, 25 bp, S. pombe
taaaagaaacggctgctcccatcaa

SEQ ID NO: 111039 - DNA, 25 bp, S. pombe
taatccaagccggttagacgcccaa

SEQ ID NO: 111040 - DNA, 25 bp, S. pombe
taacgttttggtatacgctgataaa

SEQ ID NO: 111041 - DNA, 25 bp, S. pombe
taatgccaaaaaacctgcccagatt

SEQ ID NO: 111042 - DNA, 25 bp, S. pombe
taatgcccgacaaagcgtctctcaa

SEQ ID NO: 111043 - DNA, 25 bp, S. pombe
ttagccaactcttatcgtgttcaag

SEQ ID NO: 111044 - DNA, 25 bp, S. pombe
taaccaacttttgcttgatcccaac

SEQ ID NO: 111045 - DNA, 25 bp, S. pombe
tcaacctaccaattcgtttcctaat

SEQ ID NO: 111046 - DNA, 25 bp, S. pombe
taattcaactcagcagtcgaccact

SEQ ID NO: 111047 - DNA, 25 bp, S. pombe
taatccgagttgacgatccatcacc

SEQ ID NO: 111048 - DNA, 25 bp, S. pombe
taatttttctgcagtctattccgac

SEQ ID NO: 111049 - DNA, 25 bp, S. pombe
tacttctttggtcatctcattcgga

SEQ ID NO: 111050 - DNA, 25 bp, S. pombe
taatgctggacgaggccgatttgct

SEQ ID NO: 111051 - DNA, 25 bp, S. pombe
tcaaggcatggatagctctcagatt

SEQ ID NO: 111052 - DNA, 25 bp, S. pombe
tatgacgcattgtcagcggctaggc

SEQ ID NO: 111053 - DNA, 25 bp, S. pombe
taaccatcctcacagtagcaactat

SEQ ID NO: 111054 - DNA, 25 bp, S. pombe
taatgcgtcggaccctctaaatgga

SEQ ID NO: 111055 - DNA, 25 bp, S. pombe
taatcgcagccaaaattcggacaga

SEQ ID NO: 111056 - DNA, 25 bp, S. pombe
taagtcctctaaattcggtgaatca

SEQ ID NO: 111057 - DNA, 25 bp, S. pombe
taatcaacccttttttggagcaaat

SEQ ID NO: 111058 - DNA, 25 bp, S. pombe
taatttgcgatgctccgttacttac

SEQ ID NO: 111059 - DNA, 25 bp, S. pombe
tcaaggtgttttccctggtgacaac

SEQ ID NO: 111060 - DNA, 25 bp, S. pombe
taaggtgcaattaggccgcgtacgc

SEQ ID NO: 111061 - DNA, 25 bp, S. pombe
taaggtttcggcactccaacaaatg

SEQ ID NO: 111062 - DNA, 25 bp, S. pombe
taaggttaaatttcgctcgcttctt

SEQ ID NO: 111063 - DNA, 25 bp, S. pombe
taatgcatttaacttgtccccttct

SEQ ID NO: 111064 - DNA, 25 bp, S. pombe
taaccagcagttacgtgtagcagta

SEQ ID NO: 111065 - DNA, 25 bp, S. pombe
taattatagaccctccatggccgaa

SEQ ID NO: 111066 - DNA, 25 bp, S. pombe
taattacatgaacctcacactgcgc

SEQ ID NO: 111067 - DNA, 25 bp, S. pombe
tcaatcgatgttggtctttgctcaa

SEQ ID NO: 111068 - DNA, 25 bp, S. pombe
taatcagcaatctccttctgctcaa

SEQ ID NO: 111069 - DNA, 25 bp, S. pombe
tcaatcagcgcattacctctttaaa

SEQ ID NO: 111070 - DNA, 25 bp, S. pombe
taatgcgctcactccacagttaaaa

SEQ ID NO: 111071 - DNA, 25 bp, S. pombe
taattctactcttcaggttcctact

SEQ ID NO: 111072 - DNA, 25 bp, S. pombe
taattaacttcgaccttcctcgtga

SEQ ID NO: 111073 - DNA, 25 bp, S. pombe
tcaatcaatgctcttttgctcacac

SEQ ID NO: 111074 - DNA, 25 bp, S. pombe
taatgcctgcattgatcttataaca

SEQ ID NO: 111075 - DNA, 25 bp, S. pombe
taatgccgcatctcagtctaacttg

SEQ ID NO: 111076 - DNA, 25 bp, S. pombe
taaccgcatcatccaagccaaagat

SEQ ID NO: 111077 - DNA, 25 bp, S. pombe
tcaagatcctctgcctatactgaat

SEQ ID NO: 111078 - DNA, 25 bp, S. pombe
taattgctatgatcgatgctgtcgt

SEQ ID NO: 111079 - DNA, 25 bp, S. pombe
taattgctatgtgcgtttcttgcgt

SEQ ID NO: 111080 - DNA, 25 bp, S. pombe
taatttatctggctctggttggaat

SEQ ID NO: 111081 - DNA, 25 bp, S. pombe
tcaagttttgtcttgctggctcttt

SEQ ID NO: 111082 - DNA, 25 bp, S. pombe
taatttgtttcttcgctctttttgt

SEQ ID NO: 111083 - DNA, 25 bp, S. pombe
taagttcgttgatcctttcataggt

SEQ ID NO: 111084 - DNA, 25 bp, S. pombe
taagtcacgtatcgcccattttaaa

SEQ ID NO: 111085 - DNA, 25 bp, S. pombe
taattacacccatcatcctttatct

SEQ ID NO: 111086 - DNA, 25 bp, S. pombe
taatcctccggcttatacttatact

SEQ ID NO: 111087 - DNA, 25 bp, S. pombe
taaccgctaaatcttctttccacta

SEQ ID NO: 111088 - DNA, 25 bp, S. pombe
taatcggtccttcatttgttcactt

SEQ ID NO: 111089 - DNA, 25 bp, S. pombe
tacatacgtcctcaatggttataca

SEQ ID NO: 111090 - DNA, 25 bp, S. pombe
taatatcggcttcactgacttccaa

SEQ ID NO: 111091 - DNA, 25 bp, S. pombe
taattcgcatatgcgtcgggctctt

SEQ ID NO: 111092 - DNA, 25 bp, S. pombe
taattactgttcatggtcgcactcg

SEQ ID NO: 111093 - DNA, 25 bp, S. pombe
tcaatgctgaggttatgccttccca

SEQ ID NO: 111094 - DNA, 25 bp, S. pombe
taatggacagcgtaccttgaccgtt

SEQ ID NO: 111095 - DNA, 25 bp, S. pombe
taatgtgcctgaagtttcacccgca

SEQ ID NO: 111096 - DNA, 25 bp, S. pombe
taatctttgtgcgagaccttcgtct

SEQ ID NO: 111097 - DNA, 25 bp, S. pombe
ttaagggtctttatcgtggtgccgt

SEQ ID NO: 111098 - DNA, 25 bp, S. pombe
tacagggcctttcaaaggcttcctt

SEQ ID NO: 111099 - DNA, 25 bp, S. pombe
taatgcgccgatttgggacgttcag

SEQ ID NO: 111100 - DNA, 25 bp, S. pombe
taatggctcgcctaggaatggtgat

SEQ ID NO: 111101 - DNA, 25 bp, S. pombe
taatgttccccacgagtcaagtttt

SEQ ID NO: 111102 - DNA, 25 bp, S. pombe
ttggacatatccctgctactaagtt

SEQ ID NO: 111103 - DNA, 25 bp, S. pombe
taagaacgaagcttggtccaaacaa

SEQ ID NO: 111104 - DNA, 25 bp, S. pombe
taaggtactcaactagggctggaac

SEQ ID NO: 111105 - DNA, 25 bp, S. pombe
taatttcagaatcactccagcggct

SEQ ID NO: 111106 - DNA, 25 bp, S. pombe
taatcaacaaggcttccagctggct

SEQ ID NO: 111107 - DNA, 25 bp, S. pombe
taatcctcctattattcctgcagat

SEQ ID NO: 111108 - DNA, 25 bp, S. pombe
taattcgccatttatctgcctatgc

SEQ ID NO: 111109 - DNA, 25 bp, S. pombe
tcaatgctgctaagggctcttccaa

SEQ ID NO: 111110 - DNA, 25 bp, S. pombe
taagcggaaggactctgcactcgat

SEQ ID NO: 111111 - DNA, 25 bp, S. pombe
taatgcggacgctatgcttgcttta

SEQ ID NO: 111112 - DNA, 25 bp, S. pombe
taacggcgtttgtgttcccatcgaa

SEQ ID NO: 111113 - DNA, 25 bp, S. pombe
taaacgtgtccgtgaatccgaggaa

SEQ ID NO: 111114 - DNA, 25 bp, S. pombe
taatgagcacatttctcctccaagt

SEQ ID NO: 111115 - DNA, 25 bp, S. pombe
taatgggcctcaacaatcgatagat

SEQ ID NO: 111116 - DNA, 25 bp, S. pombe
taagttttacatttccagcaggcgc

SEQ ID NO: 111117 - DNA, 25 bp, S. pombe
taaggctcgtaatgctcccaaggaa

SEQ ID NO: 111118 - DNA, 25 bp, S. pombe
taatcttgggatcacctcctggaaa

SEQ ID NO: 111119 - DNA, 25 bp, S. pombe
taattgatggttcttcgcctgctaa

SEQ ID NO: 111120 - DNA, 25 bp, S. pombe
taatggtcacttctcttgatcctta

SEQ ID NO: 111121 - DNA, 25 bp, S. pombe
taatgctgctccatacttcttctat

SEQ ID NO: 111122 - DNA, 25 bp, S. pombe
taaggaggttcattctactccgctc

SEQ ID NO: 111123 - DNA, 25 bp, S. pombe
taatggtggtatttttggctccctc

SEQ ID NO: 111124 - DNA, 25 bp, S. pombe
taattgtcgtgttttgtctcgtccc

SEQ ID NO: 111125 - DNA, 25 bp, S. pombe
taattattgtgtgtcttcttggccg

SEQ ID NO: 111126 - DNA, 25 bp, S. pombe
taatctttcgtccttttcgaggtga

SEQ ID NO: 111127 - DNA, 25 bp, S. pombe
taataattcgtcgtctcccgagtta

SEQ ID NO: 111128 - DNA, 25 bp, S. pombe
taataactcgaattcctcttcttct

SEQ ID NO: 111129 - DNA, 25 bp, S. pombe
taatgctcgttaccatgaccttcat

SEQ ID NO: 111130 - DNA, 25 bp, S. pombe
taattctgttatggatgcacttgac

SEQ ID NO: 111131 - DNA, 25 bp, S. pombe
taattctttggctaattccgagcaa

SEQ ID NO: 111132 - DNA, 25 bp, S. pombe
taattctttggacgcttcagataaa

SEQ ID NO: 111133 - DNA, 25 bp, S. pombe
taatttttggctggtccgtctggaa

SEQ ID NO: 111134 - DNA, 25 bp, S. pombe
taatgttatcgagccatcctttgga

SEQ ID NO: 111135 - DNA, 25 bp, S. pombe
taatttcatcaactcctatttccgc

SEQ ID NO: 111136 - DNA, 25 bp, S. pombe
taatattcaaccctccatatgttcc

SEQ ID NO: 111137 - DNA, 25 bp, S. pombe
taatgatacattcgttcacatcact

SEQ ID NO: 111138 - DNA, 25 bp, S. pombe
taatgtgagatctgcttctgctcct

SEQ ID NO: 111139 - DNA, 25 bp, S. pombe
taatgttactgcgtatctcccatac

SEQ ID NO: 111140 - DNA, 25 bp, S. pombe
taatctttatcgttttcatgatcat

SEQ ID NO: 111141 - DNA, 25 bp, S. pombe
taatgcgtgctatgactcctctata

SEQ ID NO: 111142 - DNA, 25 bp, S. pombe
taatcggctttcgttctcgagagtt

SEQ ID NO: 111143 - DNA, 25 bp, S. pombe
taagggttatcgttctcgttcttct

SEQ ID NO: 111144 - DNA, 25 bp, S. pombe
taagggtttcgtccatggagtctct

SEQ ID NO: 111145 - DNA, 25 bp, S. pombe
taacggtgcaattgaggaaatccct

SEQ ID NO: 111146 - DNA, 25 bp, S. pombe
taagtctacggatgctgttgataca

SEQ ID NO: 111147 - DNA, 25 bp, S. pombe
taattcgtcaaatcactgctacagt

SEQ ID NO: 111148 - DNA, 25 bp, S. pombe
taagtcgctcatttacagcatctcc

SEQ ID NO: 111149 - DNA, 25 bp, S. pombe
taattcgctatcctccattgatcaa

SEQ ID NO: 111150 - DNA, 25 bp, S. pombe
taaggattcccagcacgttgttgat

SEQ ID NO: 111151 - DNA, 25 bp, S. pombe
taaggccgttgcaactggttttgtt

SEQ ID NO: 111152 - DNA, 25 bp, S. pombe
taagggcggtgaagcatactgtctt

SEQ ID NO: 111153 - DNA, 25 bp, S. pombe
taatgggtcgtgcagaatctttctt

SEQ ID NO: 111154 - DNA, 25 bp, S. pombe
tagcagtgagggttctccggttgaa

SEQ ID NO: 111155 - DNA, 25 bp, S. pombe
taaatgcgatagtttcccaattgaa

SEQ ID NO: 111156 - DNA, 25 bp, S. pombe
taagtgcgtttcctaccaattcatg

SEQ ID NO: 111157 - DNA, 25 bp, S. pombe
taattagcatccgtccctctgaaag

SEQ ID NO: 111158 - DNA, 25 bp, S. pombe
taatcgtacatctcctacagctgct

SEQ ID NO: 111159 - DNA, 25 bp, S. pombe
taagtgggctcaatcgttacataga

SEQ ID NO: 111160 - DNA, 25 bp, S. pombe
taagggtgctgctatccaattctaa

SEQ ID NO: 111161 - DNA, 25 bp, S. pombe
taatgctggtgcctacttatccgaa

SEQ ID NO: 111162 - DNA, 25 bp, S. pombe
taatccttggctattctgcgtgaca

SEQ ID NO: 111163 - DNA, 25 bp, S. pombe
taattattcatccattcccttacct

SEQ ID NO: 111164 - DNA, 25 bp, S. pombe
taatggttaccaaccgttgcgcaaa

SEQ ID NO: 111165 - DNA, 25 bp, S. pombe
taattatcaggcattttgtcgctcc

SEQ ID NO: 111166 - DNA, 25 bp, S. pombe
taagatatgtccaaactgttcgcag

SEQ ID NO: 111167 - DNA, 25 bp, S. pombe
tactctgttactgccaagctggaag

SEQ ID NO: 111168 - DNA, 25 bp, S. pombe
tactcggtaccatcattgctggtga

SEQ ID NO: 111169 - DNA, 25 bp, S. pombe
taataggcgttatcttcatagctgc

SEQ ID NO: 111170 - DNA, 25 bp, S. pombe
taatgacggattcgtggctgctgct

SEQ ID NO: 111171 - DNA, 25 bp, S. pombe
taatgtcatggattcgctgtctggg

SEQ ID NO: 111172 - DNA, 25 bp, S. pombe
taatgctctggaagcccatgctaga

SEQ ID NO: 111173 - DNA, 25 bp, S. pombe
taatctctgtttctgctgctagcaa

SEQ ID NO: 111174 - DNA, 25 bp, S. pombe
taatcgtgttctcgctggcaagaaa

SEQ ID NO: 111175 - DNA, 25 bp, S. pombe
taatgctgctgtaccgtcgtcaaaa

SEQ ID NO: 111176 - DNA, 25 bp, S. pombe
taatgacaaatttcgcgggcctcac

SEQ ID NO: 111177 - DNA, 25 bp, S. pombe
taatatcaccagttgggtcatcccc

SEQ ID NO: 111178 - DNA, 25 bp, S. pombe
taatcaccctgatgaagttccgcct

SEQ ID NO: 111179 - DNA, 25 bp, S. pombe
taatccgtccaattttcatccagtg

SEQ ID NO: 111180 - DNA, 25 bp, S. pombe
taaccagcccaattattcacctttt

SEQ ID NO: 111181 - DNA, 25 bp, S. pombe
taacggaacaccgacttctggaaat

SEQ ID NO: 111182 - DNA, 25 bp, S. pombe
taacttcctgcatcacgtttgttga

SEQ ID NO: 111183 - DNA, 25 bp, S. pombe
taatcttcctgctaaactcggtgga

SEQ ID NO: 111184 - DNA, 25 bp, S. pombe
taatgcttactgtttataccggaaa

SEQ ID NO: 111185 - DNA, 25 bp, S. pombe
taagttgcactcttggtaacccaga

SEQ ID NO: 111186 - DNA, 25 bp, S. pombe
taaggtgacttggaggaaccctgaa

SEQ ID NO: 111187 - DNA, 25 bp, S. pombe
taaggttaccccaagagcagtttat

SEQ ID NO: 111188 - DNA, 25 bp, S. pombe
taaggatctcactgtaaaggccggt

SEQ ID NO: 111189 - DNA, 25 bp, S. pombe
taagtcgccggaaagctgtcgaaaa

SEQ ID NO: 111190 - DNA, 25 bp, S. pombe
taagtccctatgatactgtcgagaa

SEQ ID NO: 111191 - DNA, 25 bp, S. pombe
tagactggacgttcatgactgtgca

SEQ ID NO: 111192 - DNA, 25 bp, S. pombe
taatcgctggctggtgtgaacactt

SEQ ID NO: 111193 - DNA, 25 bp, S. pombe
taatcatgtcaccagctgcaattcc

SEQ ID NO: 111194 - DNA, 25 bp, S. pombe
taatatttgcagatctacccgcctt

SEQ ID NO: 111195 - DNA, 25 bp, S. pombe
taatttggccagatcctgtgtgtct

SEQ ID NO: 111196 - DNA, 25 bp, S. pombe
taaccaggcttgttcacgaatcgat

SEQ ID NO: 111197 - DNA, 25 bp, S. pombe
taatccattgtattatcccaccggt

SEQ ID NO: 111198 - DNA, 25 bp, S. pombe
taaccgctcaacctctattttttca

SEQ ID NO: 111199 - DNA, 25 bp, S. pombe
tatattcctaccactactttaacct

SEQ ID NO: 111200 - DNA, 25 bp, S. pombe
taattattgaccactcgttttccct

SEQ ID NO: 111201 - DNA, 25 bp, S. pombe
taattttactcttcagccttttcct

SEQ ID NO: 111202 - DNA, 25 bp, S. pombe
taaatgaaaagctctctccttccca

SEQ ID NO: 111203 - DNA, 25 bp, S. pombe
taatagaaatcggtcatctcccctc

SEQ ID NO: 111204 - DNA, 25 bp, S. pombe
taacgctggtgcacgtaacgcttgt

SEQ ID NO: 111205 - DNA, 25 bp, S. pombe
taatacgcggtttcaacctcgcgtg

SEQ ID NO: 111206 - DNA, 25 bp, S. pombe
taatcatggctcctctttcggtcaa

SEQ ID NO: 111207 - DNA, 25 bp, S. pombe
taatatggtgtcttctacgcgtccg

SEQ ID NO: 111208 - DNA, 25 bp, S. pombe
taagggtgatattcccggtgtccgt

SEQ ID NO: 111209 - DNA, 25 bp, S. pombe
taagggtgccattaccgcatttact

SEQ ID NO: 111210 - DNA, 25 bp, S. pombe
taagtagtgccttacacgttggcct

SEQ ID NO: 111211 - DNA, 25 bp, S. pombe
taagcttgctcttgaatgggttggc

SEQ ID NO: 111212 - DNA, 25 bp, S. pombe
taactggcttaatgcggttgctcct

SEQ ID NO: 111213 - DNA, 25 bp, S. pombe
taatgctacttctggcggtctcggt

SEQ ID NO: 111214 - DNA, 25 bp, S. pombe
taatgatcaccccaagttaccaatc

SEQ ID NO: 111215 - DNA, 25 bp, S. pombe
taatgtcccctttatttcagcaact

SEQ ID NO: 111216 - DNA, 25 bp, S. pombe
taatgaacgtgcctcttttccaagg

SEQ ID NO: 111217 - DNA, 25 bp, S. pombe
taatggacgctgcattggcttgcac

SEQ ID NO: 111218 - DNA, 25 bp, S. pombe
taatgattctatcactcctggcact

SEQ ID NO: 111219 - DNA, 25 bp, S. pombe
taaacgctttaatgtcgccttaccg

SEQ ID NO: 111220 - DNA, 25 bp, S. pombe
ttgggagcgccttattaccggtaag

SEQ ID NO: 111221 - DNA, 25 bp, S. pombe
tacaaaagacgaggtggccccacta

SEQ ID NO: 111222 - DNA, 25 bp, S. pombe
taatagagcagacccggtacccagt

SEQ ID NO: 111223 - DNA, 25 bp, S. pombe
taagaacgaccgagaagcccgtatt

SEQ ID NO: 111224 - DNA, 25 bp, S. pombe
taatggtcagattgaggccgctccc

SEQ ID NO: 111225 - DNA, 25 bp, S. pombe
taagccgtcgtccttttagcaagtc

SEQ ID NO: 111226 - DNA, 25 bp, S. pombe
taaccttcaagctttatgtggccct

SEQ ID NO: 111227 - DNA, 25 bp, S. pombe
ttgagagtccggaatctaccttgcg

SEQ ID NO: 111228 - DNA, 25 bp, S. pombe
tttgacgccggtacgaacttgtaca

SEQ ID NO: 111229 - DNA, 25 bp, S. pombe
taatgttgaagctgcacgtgcctcc

SEQ ID NO: 111230 - DNA, 25 bp, S. pombe
taatactcttcgcatcgagtccttt

SEQ ID NO: 111231 - DNA, 25 bp, S. pombe
taagactctattgtgcgatccgact

SEQ ID NO: 111232 - DNA, 25 bp, S. pombe
taatacaaaggctcccgttttcaag

SEQ ID NO: 111233 - DNA, 25 bp, S. pombe
ttcaggtggagaaactcggccaact

SEQ ID NO: 111234 - DNA, 25 bp, S. pombe
ttcaagtggtgaatccgtcccgact

SEQ ID NO: 111235 - DNA, 25 bp, S. pombe
taagcgctgttacttctgattcggc

SEQ ID NO: 111236 - DNA, 25 bp, S. pombe
taatgagctgtaccaggctttctgg

SEQ ID NO: 111237 - DNA, 25 bp, S. pombe
taatcatccgagtaatgtgcacctt

SEQ ID NO: 111238 - DNA, 25 bp, S. pombe
taatcaacgcttaatgccacaatgg

SEQ ID NO: 111239 - DNA, 25 bp, S. pombe
taaggagtcctttcactatgcttgg

SEQ ID NO: 111240 - DNA, 25 bp, S. pombe
taatcgtttcttatgtcactgttgt

SEQ ID NO: 111241 - DNA, 25 bp, S. pombe
taatcaaggtggtcttgccgagtac

SEQ ID NO: 111242 - DNA, 25 bp, S. pombe
taatacaggtccttcatatgcccca

SEQ ID NO: 111243 - DNA, 25 bp, S. pombe
taataactccttccaatatcaccat

SEQ ID NO: 111244 - DNA, 25 bp, S. pombe
taatgcaattgcctaccgaaccaat

SEQ ID NO: 111245 - DNA, 25 bp, S. pombe
taacaattggtagccattcctctgc

SEQ ID NO: 111246 - DNA, 25 bp, S. pombe
taaaattgtggctcgtatccctcgt

SEQ ID NO: 111247 - DNA, 25 bp, S. pombe
taaggagtatgctttgcgcctacgt

SEQ ID NO: 111248 - DNA, 25 bp, S. pombe
taacgagaagcttgctactgtcccc

SEQ ID NO: 111249 - DNA, 25 bp, S. pombe
taatccagaacatgccgtatctcct

SEQ ID NO: 111250 - DNA, 25 bp, S. pombe
taatgcgtaattacacccttcctga

SEQ ID NO: 111251 - DNA, 25 bp, S. pombe
taatcagtgctgtggctaccttgtg

SEQ ID NO: 111252 - DNA, 25 bp, S. pombe
taatcgtcttccgtatccttgtaaa

SEQ ID NO: 111253 - DNA, 25 bp, S. pombe
taatcccttgattgttcctcttaag

SEQ ID NO: 111254 - DNA, 25 bp, S. pombe
taatgagacggctggcgcacctgaa

SEQ ID NO: 111255 - DNA, 25 bp, S. pombe
taataatgctcctactgatgcccat

SEQ ID NO: 111256 - DNA, 25 bp, S. pombe
taaggacatctccttggttgattac

SEQ ID NO: 111257 - DNA, 25 bp, S. pombe
taagaaacccatgtacgtcccagaa

SEQ ID NO: 111258 - DNA, 25 bp, S. pombe
taagtacacctatgatcgcggcacc

SEQ ID NO: 111259 - DNA, 25 bp, S. pombe
taaccggtcaaatagttcctaagct

SEQ ID NO: 111260 - DNA, 25 bp, S. pombe
taactcggtcaatcctttcactaaa

SEQ ID NO: 111261 - DNA, 25 bp, S. pombe
taagctttcttcctactcattttac

SEQ ID NO: 111262 - DNA, 25 bp, S. pombe
taactgcactggagaacctgttttc

SEQ ID NO: 111263 - DNA, 25 bp, S. pombe
taacgcaggatgtggacgctttttt

SEQ ID NO: 111264 - DNA, 25 bp, S. pombe
taatcctactgacgaacgccattgt

SEQ ID NO: 111265 - DNA, 25 bp, S. pombe
taagcactacttttaccagtctcgc

SEQ ID NO: 111266 - DNA, 25 bp, S. pombe
taaccaacgttgtcatccaatctag

SEQ ID NO: 111267 - DNA, 25 bp, S. pombe
taagcgccatcgtaagatccttcgt

SEQ ID NO: 111268 - DNA, 25 bp, S. pombe
taaggcctcttattgacattgttga

SEQ ID NO: 111269 - DNA, 25 bp, S. pombe
taagtggatctttcccaatgctcca

SEQ ID NO: 111270 - DNA, 25 bp, S. pombe
tagtcgacgtagactggcacccagt

SEQ ID NO: 111271 - DNA, 25 bp, S. pombe
taagcgtcgtagagaagcccgtact

SEQ ID NO: 111272 - DNA, 25 bp, S. pombe
tatacagccgaacctgaagcccgtt

SEQ ID NO: 111273 - DNA, 25 bp, S. pombe
taaccgcaaagaggccaagtcccat

SEQ ID NO: 111274 - DNA, 25 bp, S. pombe
taatcggatcttgctttggaggaaa

SEQ ID NO: 111275 - DNA, 25 bp, S. pombe
taaggcgctgggttcctagcaggaa

SEQ ID NO: 111276 - DNA, 25 bp, S. pombe
taatgtcccttttcgtgctggtgat

SEQ ID NO: 111277 - DNA, 25 bp, S. pombe
taatgtcactgccatttcttctgtg

SEQ ID NO: 111278 - DNA, 25 bp, S. pombe
tacagtttctcttttggtagcccca

SEQ ID NO: 111279 - DNA, 25 bp, S. pombe
taaagaactacatccgtacacgccg

SEQ ID NO: 111280 - DNA, 25 bp, S. pombe
taaggctactcctttagctacccga

SEQ ID NO: 111281 - DNA, 25 bp, S. pombe
taagttactaagcttcggtgtccgt

SEQ ID NO: 111282 - DNA, 25 bp, S. pombe
taatgttcctaacgattctgcggcc

SEQ ID NO: 111283 - DNA, 25 bp, S. pombe
taagtatcctaacgtgcctgttcac

SEQ ID NO: 111284 - DNA, 25 bp, S. pombe
taagaatgcttctactggccgctat

SEQ ID NO: 111285 - DNA, 25 bp, S. pombe
taatgcttatcctcatcctactgga

SEQ ID NO: 111286 - DNA, 25 bp, S. pombe
taatgatgtttcaactcctgccgga

SEQ ID NO: 111287 - DNA, 25 bp, S. pombe
taatgattctcctactgccatgcat

SEQ ID NO: 111288 - DNA, 25 bp, S. pombe
tactgtctggactagtgccactgta

SEQ ID NO: 111289 - DNA, 25 bp, S. pombe
taaggagcatccgatcgttcatgcc

SEQ ID NO: 111290 - DNA, 25 bp, S. pombe
taatccctcgtcagctgtgtgataa

SEQ ID NO: 111291 - DNA, 25 bp, S. pombe
taatcctgacgaccatttacgtact

SEQ ID NO: 111292 - DNA, 25 bp, S. pombe
taaccgactttctttacctgcatat

SEQ ID NO: 111293 - DNA, 25 bp, S. pombe
taatgcagccatgattacttgccct

SEQ ID NO: 111294 - DNA, 25 bp, S. pombe
taatgcaacatcctttctttactgg

SEQ ID NO: 111295 - DNA, 25 bp, S. pombe
taaacagcatccttttttccgacac

SEQ ID NO: 111296 - DNA, 25 bp, S. pombe
taaaacttcattctggtgtcaacaa

SEQ ID NO: 111297 - DNA, 25 bp, S. pombe
taaaacttcctcctagatcaaccga

SEQ ID NO: 111298 - DNA, 25 bp, S. pombe
taaaagttcgcgctaaggctcacga

SEQ ID NO: 111299 - DNA, 25 bp, S. pombe
taactgcctccatgactttgggtat

SEQ ID NO: 111300 - DNA, 25 bp, S. pombe
taatgcatcatggtctttggcaaaa

SEQ ID NO: 111301 - DNA, 25 bp, S. pombe
taagtattttccttggtccagctgc

SEQ ID NO: 111302 - DNA, 25 bp, S. pombe
taagctcgtctaacattcctttagg

SEQ ID NO: 111303 - DNA, 25 bp, S. pombe
taagtcttctgtccttcctttaggg

SEQ ID NO: 111304 - DNA, 25 bp, S. pombe
taatggctaacttttatgctttcag

SEQ ID NO: 111305 - DNA, 25 bp, S. pombe
taaccagccaatgcagtattccaaa

SEQ ID NO: 111306 - DNA, 25 bp, S. pombe
taagcggtctacctcaggtctatta

SEQ ID NO: 111307 - DNA, 25 bp, S. pombe
taatgctggtctattcgtctttaag

SEQ ID NO: 111308 - DNA, 25 bp, S. pombe
taatgctgctgtcaaccgtgtttat

SEQ ID NO: 111309 - DNA, 25 bp, S. pombe
taaccttcactctggttccatgaat

SEQ ID NO: 111310 - DNA, 25 bp, S. pombe
taacctcatatcgtcaagcttccta

SEQ ID NO: 111311 - DNA, 25 bp, S. pombe
taacttgcaactgaatgcgctcgat

SEQ ID NO: 111312 - DNA, 25 bp, S. pombe
taatgcttgcattcgtaccgcctat

SEQ ID NO: 111313 - DNA, 25 bp, S. pombe
taatgcttctgacgttgttgccgat

SEQ ID NO: 111314 - DNA, 25 bp, S. pombe
taagctgtcatgctctagtccagaa

SEQ ID NO: 111315 - DNA, 25 bp, S. pombe
taaggttcatcattattcccagaag

SEQ ID NO: 111316 - DNA, 25 bp, S. pombe
taagcagtacacttcttccttgaaa

SEQ ID NO: 111317 - DNA, 25 bp, S. pombe
taaggatagcagcagtctcgctcaa

SEQ ID NO: 111318 - DNA, 25 bp, S. pombe
taatgcccttagtagctgctttcca

SEQ ID NO: 111319 - DNA, 25 bp, S. pombe
taacaatgtcacgtaccgttttccg

SEQ ID NO: 111320 - DNA, 25 bp, S. pombe
taatgcatttctctccttgtgtttc

SEQ ID NO: 111321 - DNA, 25 bp, S. pombe
taagcgggcatttccttttgtgtgc

SEQ ID NO: 111322 - DNA, 25 bp, S. pombe
taagggagctgttcgtctgtttatc

SEQ ID NO: 111323 - DNA, 25 bp, S. pombe
taaggcctcttcttcaagccattat

SEQ ID NO: 111324 - DNA, 25 bp, S. pombe
taaggatcctgcaagcttgactttg

SEQ ID NO: 111325 - DNA, 25 bp, S. pombe
taatgactttgccagcttaccatcg

SEQ ID NO: 111326 - DNA, 25 bp, S. pombe
taatgcacttgtccgcgaacgattt

SEQ ID NO: 111327 - DNA, 25 bp, S. pombe
taatgaacctcaatccaccgatttc

SEQ ID NO: 111328 - DNA, 25 bp, S. pombe
taaggaaccaactgctcctgaacca

SEQ ID NO: 111329 - DNA, 25 bp, S. pombe
taaggacaacttaggcccagatgcc

SEQ ID NO: 111330 - DNA, 25 bp, S. pombe
taatggacatccaacttcccacgat

SEQ ID NO: 111331 - DNA, 25 bp, S. pombe
taaggacatgcctcttctcaactat

SEQ ID NO: 111332 - DNA, 25 bp, S. pombe
taagcgtgcaactgccttggcggat

SEQ ID NO: 111333 - DNA, 25 bp, S. pombe
taacttacacggtatcggcggcatt

SEQ ID NO: 111334 - DNA, 25 bp, S. pombe
taaacttcccggtagattgcagcgg

SEQ ID NO: 111335 - DNA, 25 bp, S. pombe
taaaccggcacttgcaagtctcagc

SEQ ID NO: 111336 - DNA, 25 bp, S. pombe
taaaccgggttttgctcatagcgaa

SEQ ID NO: 111337 - DNA, 25 bp, S. pombe
tagtaccgacgattatttgcataga

SEQ ID NO: 111338 - DNA, 25 bp, S. pombe
taatgaccccgatttgcgcgacaga

SEQ ID NO: 111339 - DNA, 25 bp, S. pombe
taaggccactaccaaatgctgtact

SEQ ID NO: 111340 - DNA, 25 bp, S. pombe
taagtgtttcaccaagtctgtctct

SEQ ID NO: 111341 - DNA, 25 bp, S. pombe
taatgttcatcaatggcgcagtcat

SEQ ID NO: 111342 - DNA, 25 bp, S. pombe
taatgactcttcctaccctgatgat

SEQ ID NO: 111343 - DNA, 25 bp, S. pombe
taagcaaaggtcttgcggctcctgt

SEQ ID NO: 111344 - DNA, 25 bp, S. pombe
taagcctacgagtctggaatcctgt

SEQ ID NO: 111345 - DNA, 25 bp, S. pombe
taagccaaggtggttcgcttgcttt

SEQ ID NO: 111346 - DNA, 25 bp, S. pombe
taagtgtgccattgagtttccgcct

SEQ ID NO: 111347 - DNA, 25 bp, S. pombe
taagtttgtggctttttccatcctt

SEQ ID NO: 111348 - DNA, 25 bp, S. pombe
taaggatttgggtcttcctcaacct

SEQ ID NO: 111349 - DNA, 25 bp, S. pombe
taaagatgggtgctgccccaagcac

SEQ ID NO: 111350 - DNA, 25 bp, S. pombe
taatggttctcatcatccttacgct

SEQ ID NO: 111351 - DNA, 25 bp, S. pombe
taagcgttgctggatcacctgtacg

SEQ ID NO: 111352 - DNA, 25 bp, S. pombe
taaggactatccaaacggcatcaat

SEQ ID NO: 111353 - DNA, 25 bp, S. pombe
taaggcagattccacaacgccgaat

SEQ ID NO: 111354 - DNA, 25 bp, S. pombe
taatggcgatattcctgaccctaat

SEQ ID NO: 111355 - DNA, 25 bp, S. pombe
taaggccttgcaggaatgcccatct

SEQ ID NO: 111356 - DNA, 25 bp, S. pombe
ttacgaccgcgaagtcccaaattag

SEQ ID NO: 111357 - DNA, 25 bp, S. pombe
taacgactcgcggtggtcaaacatg

SEQ ID NO: 111358 - DNA, 25 bp, S. pombe
taatgttttagctgcctctactgct

SEQ ID NO: 111359 - DNA, 25 bp, S. pombe
taatgtttgtacttctcctgacggt

SEQ ID NO: 111360 - DNA, 25 bp, S. pombe
taagcattcaataccccttcatttc

SEQ ID NO: 111361 - DNA, 25 bp, S. pombe
taacataacatcaccgtctcctagt

SEQ ID NO: 111362 - DNA, 25 bp, S. pombe
taagaaagcacgtccgcttgccaaa

SEQ ID NO: 111363 - DNA, 25 bp, S. pombe
taacactgacctgccagcaagacaa

SEQ ID NO: 111364 - DNA, 25 bp, S. pombe
tatacttcgcctgccgaaaaacgtc

SEQ ID NO: 111365 - DNA, 25 bp, S. pombe
taacttcgcatagtcctgaaagcat

SEQ ID NO: 111366 - DNA, 25 bp, S. pombe
taagcgctggactatccgtaacatg

SEQ ID NO: 111367 - DNA, 25 bp, S. pombe
taacgttgctatggcttgtgatggc

SEQ ID NO: 111368 - DNA, 25 bp, S. pombe
taacgatgctgtgcgggctgagaac

SEQ ID NO: 111369 - DNA, 25 bp, S. pombe
taactcaacgcagaatgacatgaat

SEQ ID NO: 111370 - DNA, 25 bp, S. pombe
taagttacttgcgtcaacctcgctt

SEQ ID NO: 111371 - DNA, 25 bp, S. pombe
taacgttttcttctgttggtggtgc

SEQ ID NO: 111372 - DNA, 25 bp, S. pombe
taaccctactttctttggctgcgat

SEQ ID NO: 111373 - DNA, 25 bp, S. pombe
taaggcatccgattttactttccga

SEQ ID NO: 111374 - DNA, 25 bp, S. pombe
taacgtccgatcttgtacttttctg

SEQ ID NO: 111375 - DNA, 25 bp, S. pombe
taatgggtctcctgattctcattgt

SEQ ID NO: 111376 - DNA, 25 bp, S. pombe
taaggagattctcggtactgccttc

SEQ ID NO: 111377 - DNA, 25 bp, S. pombe
taagcagaaaccacagcactcgttc

SEQ ID NO: 111378 - DNA, 25 bp, S. pombe
taatgggtattcttcctctacactc

SEQ ID NO: 111379 - DNA, 25 bp, S. pombe
taatggtattactcctcttggtgcc

SEQ ID NO: 111380 - DNA, 25 bp, S. pombe
taaggatagtttccaccttcgtgtc

SEQ ID NO: 111381 - DNA, 25 bp, S. pombe
taagcgcaatgtggtagttttcgtt

SEQ ID NO: 111382 - DNA, 25 bp, S. pombe
ttaatatgattgctccgggaaccct

SEQ ID NO: 111383 - DNA, 25 bp, S. pombe
taaactgattgctccaggaacccgc

SEQ ID NO: 111384 - DNA, 25 bp, S. pombe
taaagccatgtgcactgttcagcgc

SEQ ID NO: 111385 - DNA, 25 bp, S. pombe
tagaagctatcgcactttgcacggc

SEQ ID NO: 111386 - DNA, 25 bp, S. pombe
taagacagatcctcgctatacggct

SEQ ID NO: 111387 - DNA, 25 bp, S. pombe
taagaagatccaaacccaccgtggt

SEQ ID NO: 111388 - DNA, 25 bp, S. pombe
taaggcgagcgcttcttcacctaat

SEQ ID NO: 111389 - DNA, 25 bp, S. pombe
taatggttgcagatgctcgtggaaa

SEQ ID NO: 111390 - DNA, 25 bp, S. pombe
taaggttgcagcatctcctgctaac

SEQ ID NO: 111391 - DNA, 25 bp, S. pombe
taacttatggatcaattgtcgcaca

SEQ ID NO: 111392 - DNA, 25 bp, S. pombe
tacagctgccattgcatcgaatctg

SEQ ID NO: 111393 - DNA, 25 bp, S. pombe
taagcatccatccatccaatttttg

SEQ ID NO: 111394 - DNA, 25 bp, S. pombe
taacagttctctcccttatttagta

SEQ ID NO: 111395 - DNA, 25 bp, S. pombe
taaggcgcgaactcagatatctcaa

SEQ ID NO: 111396 - DNA, 25 bp, S. pombe
taaccgtgaattacagctatctgca

SEQ ID NO: 111397 - DNA, 25 bp, S. pombe
taactctggttcgtggcaatctgat

SEQ ID NO: 111398 - DNA, 25 bp, S. pombe
taagaatgtcttggctcagctcgag

SEQ ID NO: 111399 - DNA, 25 bp, S. pombe
taaggctgctggaactgcttctgaa

SEQ ID NO: 111400 - DNA, 25 bp, S. pombe
taaggcatccgtttcttaagcaagc

SEQ ID NO: 111401 - DNA, 25 bp, S. pombe
taaggattctgttctcgaacccagc

SEQ ID NO: 111402 - DNA, 25 bp, S. pombe
tacatggaacgtttcgaacttgccc

SEQ ID NO: 111403 - DNA, 25 bp, S. pombe
ttaaagcacttaccgaacttcgcgc

SEQ ID NO: 111404 - DNA, 25 bp, S. pombe
taagcgtcaccgtaaaattcttcgt

SEQ ID NO: 111405 - DNA, 25 bp, S. pombe
taagcgtcaccgtaaaattcttcgt

SEQ ID NO: 111406 - DNA, 25 bp, S. pombe
taagtggtcacctacttcagctgtt

SEQ ID NO: 111407 - DNA, 25 bp, S. pombe
taagtggacctctgcgtatcttctt

SEQ ID NO: 111408 - DNA, 25 bp, S. pombe
tacttcgaccctgctcaaaatttga

SEQ ID NO: 111409 - DNA, 25 bp, S. pombe
tactttgcccctcaagaagtttggg

SEQ ID NO: 111410 - DNA, 25 bp, S. pombe
tacatatatctcttcctaaaccgtc

SEQ ID NO: 111411 - DNA, 25 bp, S. pombe
taagcagcttcctcgtaaaacattg

SEQ ID NO: 111412 - DNA, 25 bp, S. pombe
taagactctccgtcgtcaaaacgag

SEQ ID NO: 111413 - DNA, 25 bp, S. pombe
taagccctccggcatactgaaggaa

SEQ ID NO: 111414 - DNA, 25 bp, S. pombe
ttatccccgttctcgtaaaattatg

SEQ ID NO: 111415 - DNA, 25 bp, S. pombe
taacctaccctctcgtatcaaattt

SEQ ID NO: 111416 - DNA, 25 bp, S. pombe
taaccgcccttatcgtacaaatatc

SEQ ID NO: 111417 - DNA, 25 bp, S. pombe
taagccctctcttaactgctaaact

SEQ ID NO: 111418 - DNA, 25 bp, S. pombe
taagctgccttctaaatatgctgaa

SEQ ID NO: 111419 - DNA, 25 bp, S. pombe
taagtagccctttgaacgagacaga

SEQ ID NO: 111420 - DNA, 25 bp, S. pombe
taagcgtgtcctatggtccttgaaa

SEQ ID NO: 111421 - DNA, 25 bp, S. pombe
taaccactcctgttcacctaatata

SEQ ID NO: 111422 - DNA, 25 bp, S. pombe
taaggacttcctttcgctctaatag

SEQ ID NO: 111423 - DNA, 25 bp, S. pombe
taacgttatccgtcttggctttacg

SEQ ID NO: 111424 - DNA, 25 bp, S. pombe
taagcgctcaatcccttgtggtaaa

SEQ ID NO: 111425 - DNA, 25 bp, S. pombe
taagcgctcagaaccttcgatggat

SEQ ID NO: 111426 - DNA, 25 bp, S. pombe
taagcgccgttcaaccgatcatgat

SEQ ID NO: 111427 - DNA, 25 bp, S. pombe
taagttaacttctctccaagcttcc

SEQ ID NO: 111428 - DNA, 25 bp, S. pombe
taaatgcttggctcttcaagggaat

SEQ ID NO: 111429 - DNA, 25 bp, S. pombe
taagcacaaggctccttatgtccgt

SEQ ID NO: 111430 - DNA, 25 bp, S. pombe
taaaatcgcagcttctaccgtcact

SEQ ID NO: 111431 - DNA, 25 bp, S. pombe
taaaatcagaattccccgtactctc

SEQ ID NO: 111432 - DNA, 25 bp, S. pombe
taaaatcgttcgtccaggtacttct

SEQ ID NO: 111433 - DNA, 25 bp, S. pombe
tagagctacttacatccggtactca

SEQ ID NO: 111434 - DNA, 25 bp, S. pombe
taagctctttattaccggctcatcc

SEQ ID NO: 111435 - DNA, 25 bp, S. pombe
taaacttcctgagtttactcctctc

SEQ ID NO: 111436 - DNA, 25 bp, S. pombe
taaagcgcgctttaatgtcccaatc

SEQ ID NO: 111437 - DNA, 25 bp, S. pombe
taagaaggtttttgctcctcatcgc

SEQ ID NO: 111438 - DNA, 25 bp, S. pombe
taagagattctgttgccgtgttcca

SEQ ID NO: 111439 - DNA, 25 bp, S. pombe
taagagattcgttctccgttgccac

SEQ ID NO: 111440 - DNA, 25 bp, S. pombe
taaactggcgagtcttgcgatgtgt

SEQ ID NO: 111441 - DNA, 25 bp, S. pombe
taaagcaggctccacattcggttta

SEQ ID NO: 111442 - DNA, 25 bp, S. pombe
taaaggccttaaatctcgtcctaag

SEQ ID NO: 111443 - DNA, 25 bp, S. pombe
taaaggccttagactcctcgttagg

SEQ ID NO: 111444 - DNA, 25 bp, S. pombe
taaaggtttaagctgtccgactggt

SEQ ID NO: 111445 - DNA, 25 bp, S. pombe
taagggtcctgttcgagatccattt

SEQ ID NO: 111446 - DNA, 25 bp, S. pombe
taactatcgcgccattagagctcgg

SEQ ID NO: 111447 - DNA, 25 bp, S. pombe
taaaatctgagctaacggacttcct

SEQ ID NO: 111448 - DNA, 25 bp, S. pombe
taaaaagtaatcgacgcgctccgtc

SEQ ID NO: 111449 - DNA, 25 bp, S. pombe
taagtatcccgaagctttccctgat

SEQ ID NO: 111450 - DNA, 25 bp, S. pombe
taagtaccgatctcttgctatgcga

SEQ ID NO: 111451 - DNA, 25 bp, S. pombe
taagacctcggaccccaatgtatgg

SEQ ID NO: 111452 - DNA, 25 bp, S. pombe
taagtccaagcgactgcacctatgt

SEQ ID NO: 111453 - DNA, 25 bp, S. pombe
taactctccaacttcggctggttta

SEQ ID NO: 111454 - DNA, 25 bp, S. pombe
taacatcaatatcgttcctcctttg

SEQ ID NO: 111455 - DNA, 25 bp, S. pombe
taacgcagtatgatgccttcctctt

SEQ ID NO: 111456 - DNA, 25 bp, S. pombe
taagtgcggtgctattcttgcatca

SEQ ID NO: 111457 - DNA, 25 bp, S. pombe
taagccatggtgtcactgcttctca

SEQ ID NO: 111458 - DNA, 25 bp, S. pombe
taagctctttgtgcagctttcgact

SEQ ID NO: 111459 - DNA, 25 bp, S. pombe
taagctctcgtgaccctgattcaga

SEQ ID NO: 111460 - DNA, 25 bp, S. pombe
taacagcatgcttcaattagaccag

SEQ ID NO: 111461 - DNA, 25 bp, S. pombe
taactgccggtatgcctctactgtt

SEQ ID NO: 111462 - DNA, 25 bp, S. pombe
taacggtcgctatcttgctactggt

SEQ ID NO: 111463 - DNA, 25 bp, S. pombe
taagtgtttgcctggtgtcactgtc

SEQ ID NO: 111464 - DNA, 25 bp, S. pombe
taagggttgctcttatgctgccgag

SEQ ID NO: 111465 - DNA, 25 bp, S. pombe
taaacattggctctggtgctggtgc

SEQ ID NO: 111466 - DNA, 25 bp, S. pombe
taagaaagctgctcgtgctgcacgt

SEQ ID NO: 111467 - DNA, 25 bp, S. pombe
taaaaactcttcttctgctggcatg

SEQ ID NO: 111468 - DNA, 25 bp, S. pombe
taagcatcgccagttacgtgagcca

SEQ ID NO: 111469 - DNA, 25 bp, S. pombe
taaacctagaggtccttgagccaaa

SEQ ID NO: 111470 - DNA, 25 bp, S. pombe
taaatgatgctacgaccccgaacga

SEQ ID NO: 111471 - DNA, 25 bp, S. pombe
taagcactacaaaacctatcgaagg

SEQ ID NO: 111472 - DNA, 25 bp, S. pombe
taagcgtttatccatctgcggtgaa

SEQ ID NO: 111473 - DNA, 25 bp, S. pombe
taagatacatttttggcgacagatg

SEQ ID NO: 111474 - DNA, 25 bp, S. pombe
taagcttactcttcatggtctccaa

SEQ ID NO: 111475 - DNA, 25 bp, S. pombe
tttctaactctatgtcgtctacgtc

SEQ ID NO: 111476 - DNA, 25 bp, S. pombe
taagaaactcactttcctttcccat

SEQ ID NO: 111477 - DNA, 25 bp, S. pombe
taaaaaggcactcggtcatttccca

SEQ ID NO: 111478 - DNA, 25 bp, S. pombe
taaaagccatccttttggtcacgcc

SEQ ID NO: 111479 - DNA, 25 bp, S. pombe
taacgccctgcttgctagaattcaa

SEQ ID NO: 111480 - DNA, 25 bp, S. pombe
taactctttgatcagtatgcccgct

SEQ ID NO: 111481 - DNA, 25 bp, S. pombe
taacatatttggtggagcattgcga

SEQ ID NO: 111482 - DNA, 25 bp, S. pombe
taccttttccggcacatattaactg

SEQ ID NO: 111483 - DNA, 25 bp, S. pombe
taccgatttactttcctttcttcat

SEQ ID NO: 111484 - DNA, 25 bp, S. pombe
taaccttttgagtggtcctggacgt

SEQ ID NO: 111485 - DNA, 25 bp, S. pombe
taaacttttaactgatggccgaggg

SEQ ID NO: 111486 - DNA, 25 bp, S. pombe
taaagcccgtcaacatgcgtagtgt

SEQ ID NO: 111487 - DNA, 25 bp, S. pombe
taaatggccgtcttcatgcctatga

SEQ ID NO: 111488 - DNA, 25 bp, S. pombe
taagctggttgttccatctctctaa

SEQ ID NO: 111489 - DNA, 25 bp, S. pombe
taagcatgacttggataatccttaa

SEQ ID NO: 111490 - DNA, 25 bp, S. pombe
taactgcctatgctgctttcttaaa

SEQ ID NO: 111491 - DNA, 25 bp, S. pombe
taacaaatatttactggcgggtgaa

SEQ ID NO: 111492 - DNA, 25 bp, S. pombe
taacgatggtccagtcacgagtact

SEQ ID NO: 111493 - DNA, 25 bp, S. pombe
tacggtgtgcccaaaacgaggattt

SEQ ID NO: 111494 - DNA, 25 bp, S. pombe
tttcatacgaacatacacttgggac

SEQ ID NO: 111495 - DNA, 25 bp, S. pombe
tacgaccgctgactttaaaatccaa

SEQ ID NO: 111496 - DNA, 25 bp, S. pombe
taaactcttccttactaaccaatgg

SEQ ID NO: 111497 - DNA, 25 bp, S. pombe
taagcaagttctcaacttaccccga

SEQ ID NO: 111498 - DNA, 25 bp, S. pombe
taagagatactcgtaatgtggacct

SEQ ID NO: 111499 - DNA, 25 bp, S. pombe
taaaatggccgttggtgaacctatg

SEQ ID NO: 111500 - DNA, 25 bp, S. pombe
taagctctagcgatggtgaacccga

SEQ ID NO: 111501 - DNA, 25 bp, S. pombe
taactttggttgttcaccctgctga

SEQ ID NO: 111502 - DNA, 25 bp, S. pombe
taagagcttctactactctctcaga

SEQ ID NO: 111503 - DNA, 25 bp, S. pombe
taagacttcaagtatctcaccagaa

SEQ ID NO: 111504 - DNA, 25 bp, S. pombe
taagacttacgctgccattactgca

SEQ ID NO: 111505 - DNA, 25 bp, S. pombe
taacggagatgaacctagagactat

SEQ ID NO: 111506 - DNA, 25 bp, S. pombe
tacttggccgccgttttggaatatt

SEQ ID NO: 111507 - DNA, 25 bp, S. pombe
tttggtgccgacgtttctgaagttt

SEQ ID NO: 111508 - DNA, 25 bp, S. pombe
tttcgacacggttcaactggagttt

SEQ ID NO: 111509 - DNA, 25 bp, S. pombe
taaacgaaggtttccgggcagatca

SEQ ID NO: 111510 - DNA, 25 bp, S. pombe
taaaaatggcgtcgtcctcggtgaa

SEQ ID NO: 111511 - DNA, 25 bp, S. pombe
taaaaggtcctgttgcgtcggttga

SEQ ID NO: 111512 - DNA, 25 bp, S. pombe
taaacggtccagttcagacgctggt

SEQ ID NO: 111513 - DNA, 25 bp, S. pombe
taaccttgtccgtgatggcgctgtt

SEQ ID NO: 111514 - DNA, 25 bp, S. pombe
taaccgttgcaactcgtgctgaggt

SEQ ID NO: 111515 - DNA, 25 bp, S. pombe
taaccgtgctgctgcctatctgaag

SEQ ID NO: 111516 - DNA, 25 bp, S. pombe
taagcaagctactatcccagaaatt

SEQ ID NO: 111517 - DNA, 25 bp, S. pombe
taagctaattgcttcctcgaacgct

SEQ ID NO: 111518 - DNA, 25 bp, S. pombe
taaatcatcttctcccaaaccttta

SEQ ID NO: 111519 - DNA, 25 bp, S. pombe
taacgagggtactactgcccgttgg

SEQ ID NO: 111520 - DNA, 25 bp, S. pombe
taagctaggacttcattctcttcgt

SEQ ID NO: 111521 - DNA, 25 bp, S. pombe
taagcacgtcaattcttctcgtcag

SEQ ID NO: 111522 - DNA, 25 bp, S. pombe
taagacccaagctttgctcgctaag

SEQ ID NO: 111523 - DNA, 25 bp, S. pombe
taaccgccgaagctgctcttgaaga

SEQ ID NO: 111524 - DNA, 25 bp, S. pombe
taaaactggcaagggctacttacaa

SEQ ID NO: 111525 - DNA, 25 bp, S. pombe
taagaacttctgacggctctcctaa

SEQ ID NO: 111526 - DNA, 25 bp, S. pombe
taagccggtagtcagctttgctgaa

SEQ ID NO: 111527 - DNA, 25 bp, S. pombe
taacactggcaacaagccttctgaa

SEQ ID NO: 111528 - DNA, 25 bp, S. pombe
taacactggcaacaagccttctgaa

SEQ ID NO: 111529 - DNA, 25 bp, S. pombe
taacacttgcttcaatggcacccaa

SEQ ID NO: 111530 - DNA, 25 bp, S. pombe
taagcacggtgttgaatgcgcccca

SEQ ID NO: 111531 - DNA, 25 bp, S. pombe
taagcgttggtttcattgccagtgt

SEQ ID NO: 111532 - DNA, 25 bp, S. pombe
taacgcttgatgatgtgacaccgaa

SEQ ID NO: 111533 - DNA, 25 bp, S. pombe
taagcgtgttctacgtcgtctcgga

SEQ ID NO: 111534 - DNA, 25 bp, S. pombe
taaccgtgtcgagttacttgccaaa

SEQ ID NO: 111535 - DNA, 25 bp, S. pombe
taaccgtgagcgttctacttctaga

SEQ ID NO: 111536 - DNA, 25 bp, S. pombe
taacaagtgcggtgttatctctccc

SEQ ID NO: 111537 - DNA, 25 bp, S. pombe
taagccagtcgttattgtcaacccc

SEQ ID NO: 111538 - DNA, 25 bp, S. pombe
taacgggatctctatttcaaacaat

SEQ ID NO: 111539 - DNA, 25 bp, S. pombe
taaactgagctgctttagcgattct

SEQ ID NO: 111540 - DNA, 25 bp, S. pombe
taacctttcacgtatcactattcca

SEQ ID NO: 111541 - DNA, 25 bp, S. pombe
tacacgtaccctaaactatccaatg

SEQ ID NO: 111542 - DNA, 25 bp, S. pombe
taaagaaccctcaaaccccatagag

SEQ ID NO: 111543 - DNA, 25 bp, S. pombe
taaaaaggcttccaacactcctcgt

SEQ ID NO: 111544 - DNA, 25 bp, S. pombe
taaaatatacaccaaacccactcgc

SEQ ID NO: 111545 - DNA, 25 bp, S. pombe
taaaaatatgccacccggaccaagg

SEQ ID NO: 111546 - DNA, 25 bp, S. pombe
taaaaattccctctcgtacagcaaa

SEQ ID NO: 111547 - DNA, 25 bp, S. pombe
taaagaagccaatcctcgcggtagt

SEQ ID NO: 111548 - DNA, 25 bp, S. pombe
taaagtcggtttatcacgcgcttct

SEQ ID NO: 111549 - DNA, 25 bp, S. pombe
tacaaccgagttatatccccatgac

SEQ ID NO: 111550 - DNA, 25 bp, S. pombe
taaaccatgcttcattttctcctga

SEQ ID NO: 111551 - DNA, 25 bp, S. pombe
taaatgctatgctcgtcttcctcct

SEQ ID NO: 111552 - DNA, 25 bp, S. pombe
taactctcatcatctggattccgtt

SEQ ID NO: 111553 - DNA, 25 bp, S. pombe
taactcttcaattggtagcggtatc

SEQ ID NO: 111554 - DNA, 25 bp, S. pombe
taacttgtcaaaatgcccggcttct

SEQ ID NO: 111555 - DNA, 25 bp, S. pombe
taaactgcagcacgaggccgttgtt

SEQ ID NO: 111556 - DNA, 25 bp, S. pombe
taaaccctcagacggttgcctttga

SEQ ID NO: 111557 - DNA, 25 bp, S. pombe
taaactctcgcgaggtttccgtgaa

SEQ ID NO: 111558 - DNA, 25 bp, S. pombe
taaacctgacgctggattgcattcg

SEQ ID NO: 111559 - DNA, 25 bp, S. pombe
ttatggctcttgacggtgtaggcac

SEQ ID NO: 111560 - DNA, 25 bp, S. pombe
tatgatggattctgcggagtatcgc

SEQ ID NO: 111561 - DNA, 25 bp, S. pombe
taacaggcattactgctcttctcat

SEQ ID NO: 111562 - DNA, 25 bp, S. pombe
taacgacattacatcttctacctct

SEQ ID NO: 111563 - DNA, 25 bp, S. pombe
taaacgattaaagcattttacatgg

SEQ ID NO: 111564 - DNA, 25 bp, S. pombe
taaatcgttcagtagccagcttttt

SEQ ID NO: 111565 - DNA, 25 bp, S. pombe
taaacaatccacgtgccaagacttc

SEQ ID NO: 111566 - DNA, 25 bp, S. pombe
taaagcatttgctggcgacgatgtt

SEQ ID NO: 111567 - DNA, 25 bp, S. pombe
taaacgcttattcacctccaaaatc

SEQ ID NO: 111568 - DNA, 25 bp, S. pombe
taaaacgttgccttcgcttaatata

SEQ ID NO: 111569 - DNA, 25 bp, S. pombe
taagcccaagggtccttctaacaat

SEQ ID NO: 111570 - DNA, 25 bp, S. pombe
taacggccggtaattcttctcaaat

SEQ ID NO: 111571 - DNA, 25 bp, S. pombe
taaccgtgggcaatttccgtcaaat

SEQ ID NO: 111572 - DNA, 25 bp, S. pombe
tacaccattagaagcgccagcgcat

SEQ ID NO: 111573 - DNA, 25 bp, S. pombe
taaacttcaagtggctcacgagcgc

SEQ ID NO: 111574 - DNA, 25 bp, S. pombe
tagacaatgtcgtgcgtttaccaac

SEQ ID NO: 111575 - DNA, 25 bp, S. pombe
taacaattcgcctttatcttccaac

SEQ ID NO: 111576 - DNA, 25 bp, S. pombe
taaacctgtagcaacgtcgaccccg

SEQ ID NO: 111577 - DNA, 25 bp, S. pombe
taacgtcgtcaaaagccgcaaaccg

SEQ ID NO: 111578 - DNA, 25 bp, S. pombe
taaaccctgcaattactcatggaat

SEQ ID NO: 111579 - DNA, 25 bp, S. pombe
tacatcgtttcgtttcacaattttg

SEQ ID NO: 111580 - DNA, 25 bp, S. pombe
taaattcgttcgctgcatcaactgc

SEQ ID NO: 111581 - DNA, 25 bp, S. pombe
taacattccaacatcatccagctga

SEQ ID NO: 111582 - DNA, 25 bp, S. pombe
taactggtgtccctgttgcatggta

SEQ ID NO: 111583 - DNA, 25 bp, S. pombe
taacagcgagtcctgcggtatcgga

SEQ ID NO: 111584 - DNA, 25 bp, S. pombe
taacaaaccttcaagtgttcctgaa

SEQ ID NO: 111585 - DNA, 25 bp, S. pombe
taacgcttctgattcacataacccg

SEQ ID NO: 111586 - DNA, 25 bp, S. pombe
taacgtgtctgattctactgagccc

SEQ ID NO: 111587 - DNA, 25 bp, S. pombe
taacgtactgcgactacaatgccaa

SEQ ID NO: 111588 - DNA, 25 bp, S. pombe
taaatactatcctgcctaccgtgaa

SEQ ID NO: 111589 - DNA, 25 bp, S. pombe
taaagaatagagtccgtcctacctt

SEQ ID NO: 111590 - DNA, 25 bp, S. pombe
taaacagtatatccggtcccttcct

SEQ ID NO: 111591 - DNA, 25 bp, S. pombe
taaaggtttccgttcctcgtgacag

SEQ ID NO: 111592 - DNA, 25 bp, S. pombe
taaagaacttcgtactaggcctcct

SEQ ID NO: 111593 - DNA, 25 bp, S. pombe
taaagtggcttccaacctaggtcct

SEQ ID NO: 111594 - DNA, 25 bp, S. pombe
taacgttgcttttgcgttcgagtaa

SEQ ID NO: 111595 - DNA, 25 bp, S. pombe
taaaaagcttttcttctggtacagt

SEQ ID NO: 111596 - DNA, 25 bp, S. pombe
taaatttttattctcctggtgacac

SEQ ID NO: 111597 - DNA, 25 bp, S. pombe
tatagcatactttaccgtgaacggc

SEQ ID NO: 111598 - DNA, 25 bp, S. pombe
ttggagtcggtatcgctgcaacggc

SEQ ID NO: 111599 - DNA, 25 bp, S. pombe
taaactcatcggctcgtgaagcagt

SEQ ID NO: 111600 - DNA, 25 bp, S. pombe
taaactatctggcttggtctggaat

SEQ ID NO: 111601 - DNA, 25 bp, S. pombe
taaacgatgctctgtatcctatgga

SEQ ID NO: 111602 - DNA, 25 bp, S. pombe
taaagctacaggtcatctacaaaga

SEQ ID NO: 111603 - DNA, 25 bp, S. pombe
taaccatccagctcacgaaatcaga

SEQ ID NO: 111604 - DNA, 25 bp, S. pombe
taaatccattgagcgctctttggct

SEQ ID NO: 111605 - DNA, 25 bp, S. pombe
taacacccttggttctattgttcaa

SEQ ID NO: 111606 - DNA, 25 bp, S. pombe
taacggagttcatttgcattggcaa

SEQ ID NO: 111607 - DNA, 25 bp, S. pombe
tacgggtcttcctgctacagaatga

SEQ ID NO: 111608 - DNA, 25 bp, S. pombe
ttcggcgattaccaccaaagcattg

SEQ ID NO: 111609 - DNA, 25 bp, S. pombe
taaaagccccagtataatttccgag

SEQ ID NO: 111610 - DNA, 25 bp, S. pombe
taaacatgtagctaaaacgattgca

SEQ ID NO: 111611 - DNA, 25 bp, S. pombe
taaaggtactaaggctccccaggct

SEQ ID NO: 111612 - DNA, 25 bp, S. pombe
taaactttcgtccttgtgctgtcta

SEQ ID NO: 111613 - DNA, 25 bp, S. pombe
taacctgtttgcatttatctgtcat

SEQ ID NO: 111614 - DNA, 25 bp, S. pombe
taacaaggccgcatttactgaagat

SEQ ID NO: 111615 - DNA, 25 bp, S. pombe
tacagccctgccttgaaaaatgttt

SEQ ID NO: 111616 - DNA, 25 bp, S. pombe
tagcatggccggtgtactaggtttt

SEQ ID NO: 111617 - DNA, 25 bp, S. pombe
taaagcccgagaagaatacctccga

SEQ ID NO: 111618 - DNA, 25 bp, S. pombe
taaatctccggaaatttcagcccct

SEQ ID NO: 111619 - DNA, 25 bp, S. pombe
taaattcccgatggtattcccaaag

SEQ ID NO: 111620 - DNA, 25 bp, S. pombe
taacggccgtatgcttgtctccaag

SEQ ID NO: 111621 - DNA, 25 bp, S. pombe
taaaccattctacggttcgcacgat

SEQ ID NO: 111622 - DNA, 25 bp, S. pombe
taaaagcgtggtcccaactcagcaa

SEQ ID NO: 111623 - DNA, 25 bp, S. pombe
taacaagtttggacagccccagcaa

SEQ ID NO: 111624 - DNA, 25 bp, S. pombe
taaaggacttggtcatcccgaaaat

SEQ ID NO: 111625 - DNA, 25 bp, S. pombe
taaagattttccgtcgatcattcga

SEQ ID NO: 111626 - DNA, 25 bp, S. pombe
taaagatacctcaagcccactttgg

SEQ ID NO: 111627 - DNA, 25 bp, S. pombe
taaagaactctaggccgcttaacta

SEQ ID NO: 111628 - DNA, 25 bp, S. pombe
taacggtgttatagccgcctacaaa

SEQ ID NO: 111629 - DNA, 25 bp, S. pombe
taacgatttctctgcatcccagtta

SEQ ID NO: 111630 - DNA, 25 bp, S. pombe
taacgatttctctcccgatgattta

SEQ ID NO: 111631 - DNA, 25 bp, S. pombe
taaagttttctttcacgagttgcca

SEQ ID NO: 111632 - DNA, 25 bp, S. pombe
tacacttaaattcactaccgccaaa

SEQ ID NO: 111633 - DNA, 25 bp, S. pombe
taactctaatcaatcacctaactcc

SEQ ID NO: 111634 - DNA, 25 bp, S. pombe
tatccccaacctgtggaactttttg

SEQ ID NO: 111635 - DNA, 25 bp, S. pombe
taacaccctctttcgatggatcaga

SEQ ID NO: 111636 - DNA, 25 bp, S. pombe
taaagcgcgctccttgtcggtggca

SEQ ID NO: 111637 - DNA, 25 bp, S. pombe
taaagccagcatgcctgtcgtcgaa

SEQ ID NO: 111638 - DNA, 25 bp, S. pombe
taaagcagcataaacttcctcccat

SEQ ID NO: 111639 - DNA, 25 bp, S. pombe
tagaaaagactttaccgcctccagc

SEQ ID NO: 111640 - DNA, 25 bp, S. pombe
taacaaaactctatccaccatcaat

SEQ ID NO: 111641 - DNA, 25 bp, S. pombe
tacaataatccccatttccagtcaa

SEQ ID NO: 111642 - DNA, 25 bp, S. pombe
tacagtaatgttttctcccgacggt

SEQ ID NO: 111643 - DNA, 25 bp, S. pombe
taactgctattttgtaccctgacgg

SEQ ID NO: 111644 - DNA, 25 bp, S. pombe
taaagttctttctactcgtaagccg

SEQ ID NO: 111645 - DNA, 25 bp, S. pombe
taaagggttggctagtcgctctctc

SEQ ID NO: 111646 - DNA, 25 bp, S. pombe
taaaagctgctttgggtcgtcttcc

SEQ ID NO: 111647 - DNA, 25 bp, S. pombe
taaaatgcccttctatttcaacgca

SEQ ID NO: 111648 - DNA, 25 bp, S. pombe
taaaagccctgcagttgctataccc

SEQ ID NO: 111649 - DNA, 25 bp, S. pombe
taaaatgctccaaactcgctgtacc

SEQ ID NO: 111650 - DNA, 25 bp, S. pombe
taaattaccatctggctaggctcgg

SEQ ID NO: 111651 - DNA, 25 bp, S. pombe
taaagcatgcatttaccaagccctc

SEQ ID NO: 111652 - DNA, 25 bp, S. pombe
taaagcagcaatccacactagaacg

SEQ ID NO: 111653 - DNA, 25 bp, S. pombe
taaagagcacattcagcacgagttg

SEQ ID NO: 111654 - DNA, 25 bp, S. pombe
taacactcctgttacaagctccgag

SEQ ID NO: 111655 - DNA, 25 bp, S. pombe
taaaagctggtattcctgccacact

SEQ ID NO: 111656 - DNA, 25 bp, S. pombe
taacactttaattcgtcccaatggt

SEQ ID NO: 111657 - DNA, 25 bp, S. pombe
taaacagtgctagtcggtctcgaag

SEQ ID NO: 111658 - DNA, 25 bp, S. pombe
taaacgatgctagccgaactcgact

SEQ ID NO: 111659 - DNA, 25 bp, S. pombe
taaatgaggtctgccgacttcgatc

SEQ ID NO: 111660 - DNA, 25 bp, S. pombe
taaacagcagcgtctgggctctgaa

SEQ ID NO: 111661 - DNA, 25 bp, S. pombe
taacaacgccggtatcgctttgatg

SEQ ID NO: 111662 - DNA, 25 bp, S. pombe
taaaaagacgacctcgcttccttgg

SEQ ID NO: 111663 - DNA, 25 bp, S. pombe
taaagatgcaactacgtcgtgacct

SEQ ID NO: 111664 - DNA, 25 bp, S. pombe
taaagcacaagatctcgcctaccta

SEQ ID NO: 111665 - DNA, 25 bp, S. pombe
taacatctacaggatctgccttcac

SEQ ID NO: 111666 - DNA, 25 bp, S. pombe
taactgcaaagcttcctgatccagc

SEQ ID NO: 111667 - DNA, 25 bp, S. pombe
taactgagaatcttccttctggctc

SEQ ID NO: 111668 - DNA, 25 bp, S. pombe
taacttttgttgaccctgtttctgc

SEQ ID NO: 111669 - DNA, 25 bp, S. pombe
taaagagtctttacctcccattcgt

SEQ ID NO: 111670 - DNA, 25 bp, S. pombe
taaacagtcgtttttggctcaaggt

SEQ ID NO: 111671 - DNA, 25 bp, S. pombe
tacatccgacgttgatgattcctcg

SEQ ID NO: 111672 - DNA, 25 bp, S. pombe
tacatccccatggtatgaatcctgc

SEQ ID NO: 111673 - DNA, 25 bp, S. pombe
taaagctcttggctacgactctatc

SEQ ID NO: 111674 - DNA, 25 bp, S. pombe
taaaagcgtgtcttactgagatcta

SEQ ID NO: 111675 - DNA, 25 bp, S. pombe
taaatcctattcctacttatgctcg

SEQ ID NO: 111676 - DNA, 25 bp, S. pombe
taacatcatctttctcgagtacagt

SEQ ID NO: 111677 - DNA, 25 bp, S. pombe
taacatgcctgtttgccttcaagta

SEQ ID NO: 111678 - DNA, 25 bp, S. pombe
taactctttttcaacgtggctacat

SEQ ID NO: 111679 - DNA, 25 bp, S. pombe
tatcaaggccatctcaaccgactaa

SEQ ID NO: 111680 - DNA, 25 bp, S. pombe
taaaggccaaattaccgacgattat

SEQ ID NO: 111681 - DNA, 25 bp, S. pombe
taaagggttacctctcacactcgat

SEQ ID NO: 111682 - DNA, 25 bp, S. pombe
taaatggcagtttaccccaggccga

SEQ ID NO: 111683 - DNA, 25 bp, S. pombe
taacattacatttcaccctggttcc

SEQ ID NO: 111684 - DNA, 25 bp, S. pombe
taaatataccgatcgtcttggtcgt

SEQ ID NO: 111685 - DNA, 25 bp, S. pombe
taaatagcaccgaactgcccttttg

SEQ ID NO: 111686 - DNA, 25 bp, S. pombe
taaaaacgtctatgcatccgcactc

SEQ ID NO: 111687 - DNA, 25 bp, S. pombe
taaaattcgtatcagcagacaggct

SEQ ID NO: 111688 - DNA, 25 bp, S. pombe
taaagagctcgaatcaggccaggtg

SEQ ID NO: 111689 - DNA, 25 bp, S. pombe
taacagaagtgtcgtcccatgcatg

SEQ ID NO: 111690 - DNA, 25 bp, S. pombe
taaagaatgtctcttccttgccgca

SEQ ID NO: 111691 - DNA, 25 bp, S. pombe
taaaaggatcctctcacttgcacct

SEQ ID NO: 111692 - DNA, 25 bp, S. pombe
taaaattgtaccgattcttggcccg

SEQ ID NO: 111693 - DNA, 25 bp, S. pombe
tacataattctagcgttcgtcgacg

SEQ ID NO: 111694 - DNA, 25 bp, S. pombe
taaagctttacacttggcccgattt

SEQ ID NO: 111695 - DNA, 25 bp, S. pombe
taaacgttcgtttgtgccaggattt

SEQ ID NO: 111696 - DNA, 25 bp, S. pombe
taacactgatttcatgggccgcact

SEQ ID NO: 111697 - DNA, 25 bp, S. pombe
taacttttgtttggtctgctcgttc

SEQ ID NO: 111698 - DNA, 25 bp, S. pombe
taactattcgttactttctacttca

SEQ ID NO: 111699 - DNA, 25 bp, S. pombe
tacctcaccgttttaattccggatg

SEQ ID NO: 111700 - DNA, 25 bp, S. pombe
tactaccaccttttcaattgccttg

SEQ ID NO: 111701 - DNA, 25 bp, S. pombe
taaacgtgccccattttcatcaaat

SEQ ID NO: 111702 - DNA, 25 bp, S. pombe
tacaagggtccgaattctcgacgaa

SEQ ID NO: 111703 - DNA, 25 bp, S. pombe
taaagcgtggcctaaagtcgttatt

SEQ ID NO: 111704 - DNA, 25 bp, S. pombe
tacaatccaagcgaaagaagttatt

SEQ ID NO: 111705 - DNA, 25 bp, S. pombe
tactcagctctcgactatatggcag

SEQ ID NO: 111706 - DNA, 25 bp, S. pombe
taactgatgttggtcgatgcgcttt

SEQ ID NO: 111707 - DNA, 25 bp, S. pombe
taactttgtcttggatcctgcttta

SEQ ID NO: 111708 - DNA, 25 bp, S. pombe
taactactgttcaaggtcttcctcg

SEQ ID NO: 111709 - DNA, 25 bp, S. pombe
tacacttctttgaaccttaccaagc

SEQ ID NO: 111710 - DNA, 25 bp, S. pombe
taacttccgtttacttactcgtgct

SEQ ID NO: 111711 - DNA, 25 bp, S. pombe
taacttcctttctctttcatctttg

SEQ ID NO: 111712 - DNA, 25 bp, S. pombe
taacttccggatcacttattgcatt

SEQ ID NO: 111713 - DNA, 25 bp, S. pombe
taactctacggtcaggtctaattct

SEQ ID NO: 111714 - DNA, 25 bp, S. pombe
taaatgatccgcgagctacgctctt

SEQ ID NO: 111715 - DNA, 25 bp, S. pombe
tagaaatcctgagctacctcttcgg

SEQ ID NO: 111716 - DNA, 25 bp, S. pombe
taaaacagctgacagtgcctctctg

SEQ ID NO: 111717 - DNA, 25 bp, S. pombe
taaacactgataccgatgcttgctt

SEQ ID NO: 111718 - DNA, 25 bp, S. pombe
taacatatgctgagccttcttctgc

SEQ ID NO: 111719 - DNA, 25 bp, S. pombe
taacattcgctaccttcatattaag

SEQ ID NO: 111720 - DNA, 25 bp, S. pombe
taactttgcgtgctgtctatgtaca

SEQ ID NO: 111721 - DNA, 25 bp, S. pombe
taacacctggtgctcctgaatatca

SEQ ID NO: 111722 - DNA, 25 bp, S. pombe
taactgcgcattccttttgacgaac

SEQ ID NO: 111723 - DNA, 25 bp, S. pombe
taaaggtccgttcaattgctagaag

SEQ ID NO: 111724 - DNA, 25 bp, S. pombe
tttacgcccttcacaatcgtctaaa

SEQ ID NO: 111725 - DNA, 25 bp, S. pombe
ttttcgccgttccaaagtgcctata

SEQ ID NO: 111726 - DNA, 25 bp, S. pombe
tactgttaatgatccccaagtttta

SEQ ID NO: 111727 - DNA, 25 bp, S. pombe
tacagttacagttccaaaaaccttg

SEQ ID NO: 111728 - DNA, 25 bp, S. pombe
taaacatcttgaccttttgcagcct

SEQ ID NO: 111729 - DNA, 25 bp, S. pombe
taacaatcgtactctttgcacctgt

SEQ ID NO: 111730 - DNA, 25 bp, S. pombe
taacagagggactcttgctctcgat

SEQ ID NO: 111731 - DNA, 25 bp, S. pombe
taccaagggcgatgtttccgttacg

SEQ ID NO: 111732 - DNA, 25 bp, S. pombe
taccaacagtggtcgtttccgtgat

SEQ ID NO: 111733 - DNA, 25 bp, S. pombe
tacaattgtttccttcgttctgggc

SEQ ID NO: 111734 - DNA, 25 bp, S. pombe
taaaattcgcctcactcatttggtg

SEQ ID NO: 111735 - DNA, 25 bp, S. pombe
tacaaaccgccctgatatgattgat

SEQ ID NO: 111736 - DNA, 25 bp, S. pombe
taaatctaggcgaccactgggctac

SEQ ID NO: 111737 - DNA, 25 bp, S. pombe
taaacgtctctgtgagcgctggcta

SEQ ID NO: 111738 - DNA, 25 bp, S. pombe
tacacgatggaatgagcttggagat

SEQ ID NO: 111739 - DNA, 25 bp, S. pombe
taacactgaatatgcatttgcagaa

SEQ ID NO: 111740 - DNA, 25 bp, S. pombe
taacattgattctctcctgcatcaa

SEQ ID NO: 111741 - DNA, 25 bp, S. pombe
taaacagattgtccccacagctaag

SEQ ID NO: 111742 - DNA, 25 bp, S. pombe
tacccaattgctctaactacattcg

SEQ ID NO: 111743 - DNA, 25 bp, S. pombe
taaatcgttctgtcctttctgcaaa

SEQ ID NO: 111744 - DNA, 25 bp, S. pombe
taaatcctatgtgggctagtgctgc

SEQ ID NO: 111745 - DNA, 25 bp, S. pombe
taaagaccagtttagggctgctcct

SEQ ID NO: 111746 - DNA, 25 bp, S. pombe
taaagcccctggtggtctctcgtaa

SEQ ID NO: 111747 - DNA, 25 bp, S. pombe
taaaattgccggtggtgctctgaat

SEQ ID NO: 111748 - DNA, 25 bp, S. pombe
taaaagctcctctcgtcatgaatca

SEQ ID NO: 111749 - DNA, 25 bp, S. pombe
taaaacttcattgctccatgcttgc

SEQ ID NO: 111750 - DNA, 25 bp, S. pombe
taaaggtatgcttttcgatccctcc

SEQ ID NO: 111751 - DNA, 25 bp, S. pombe
taaatccgtcaacttcttctacgac

SEQ ID NO: 111752 - DNA, 25 bp, S. pombe
taaacgaacagtcttgcttcctcat

SEQ ID NO: 111753 - DNA, 25 bp, S. pombe
taccgcaaaaggcactaatgtcatg

SEQ ID NO: 111754 - DNA, 25 bp, S. pombe
tacggagaccgggactcatttcagt

SEQ ID NO: 111755 - DNA, 25 bp, S. pombe
tacggaaccggaacttattgcaatt

SEQ ID NO: 111756 - DNA, 25 bp, S. pombe
tacaagaaccccttctttaggcatt

SEQ ID NO: 111757 - DNA, 25 bp, S. pombe
taaacaatgcctctctctttatggg

SEQ ID NO: 111758 - DNA, 25 bp, S. pombe
taaatcgagatatgttccttattgc

SEQ ID NO: 111759 - DNA, 25 bp, S. pombe
taacactgtttcttcctccgtcgtt

SEQ ID NO: 111760 - DNA, 25 bp, S. pombe
taacactgtttcttcctccgtcgtt

SEQ ID NO: 111761 - DNA, 25 bp, S. pombe
taaatcttcttcttttgccgtggta

SEQ ID NO: 111762 - DNA, 25 bp, S. pombe
tacagttttgtctgtcacctctgag

SEQ ID NO: 111763 - DNA, 25 bp, S. pombe
taacaacccatctttgcagtggcat

SEQ ID NO: 111764 - DNA, 25 bp, S. pombe
tacaccgtcgcgatggatatctcat

SEQ ID NO: 111765 - DNA, 25 bp, S. pombe
taacactgtaaagcgtactgctgct

SEQ ID NO: 111766 - DNA, 25 bp, S. pombe
taaactctcagtaccttatctctgc

SEQ ID NO: 111767 - DNA, 25 bp, S. pombe
taaaggtgtttcatgttcccgtcga

SEQ ID NO: 111768 - DNA, 25 bp, S. pombe
taccagtttggtcttgccggaagta

SEQ ID NO: 111769 - DNA, 25 bp, S. pombe
taaactttgagttccagcgctacca

SEQ ID NO: 111770 - DNA, 25 bp, S. pombe
taaatacttacttacgccgcatgaa

SEQ ID NO: 111771 - DNA, 25 bp, S. pombe
taaatgagaaagttacgcccgtatt

SEQ ID NO: 111772 - DNA, 25 bp, S. pombe
taaatatgggatttacgcccctttg

SEQ ID NO: 111773 - DNA, 25 bp, S. pombe
taaatgaggacccttccgtcagcga

SEQ ID NO: 111774 - DNA, 25 bp, S. pombe
taaatctagggacctctcgagccat

SEQ ID NO: 111775 - DNA, 25 bp, S. pombe
taaaaagtctctcatattctccgga

SEQ ID NO: 111776 - DNA, 25 bp, S. pombe
taaatctgatggtgggtcccttagt

SEQ ID NO: 111777 - DNA, 25 bp, S. pombe
taaatagtgggccaggtccgttcgt

SEQ ID NO: 111778 - DNA, 25 bp, S. pombe
taaatagacggctgggctctgcatt

SEQ ID NO: 111779 - DNA, 25 bp, S. pombe
taaatctgtccgtggttgcatcgtc

SEQ ID NO: 111780 - DNA, 25 bp, S. pombe
taaagttccaaaggccgcattgact

SEQ ID NO: 111781 - DNA, 25 bp, S. pombe
taaagacccatttgttcctgctaga

SEQ ID NO: 111782 - DNA, 25 bp, S. pombe
taaacacgctgttgagtggcctgct

SEQ ID NO: 111783 - DNA, 25 bp, S. pombe
taaacattggattggctcgccatgt

SEQ ID NO: 111784 - DNA, 25 bp, S. pombe
taaagattggcaaggctcgcccttt

SEQ ID NO: 111785 - DNA, 25 bp, S. pombe
taaagcgagagctgctgctaccact

SEQ ID NO: 111786 - DNA, 25 bp, S. pombe
taaagtgcatacctcatcttctcct

SEQ ID NO: 111787 - DNA, 25 bp, S. pombe
taaagatcaggccttcgcttcgatg

SEQ ID NO: 111788 - DNA, 25 bp, S. pombe
taaagatcagcctttttctcgtctc

SEQ ID NO: 111789 - DNA, 25 bp, S. pombe
taaacaacactttttctcccactat

SEQ ID NO: 111790 - DNA, 25 bp, S. pombe
taaatacactttgctagccgctcgt

SEQ ID NO: 111791 - DNA, 25 bp, S. pombe
taaaacttccatttcagcgacgtcc

SEQ ID NO: 111792 - DNA, 25 bp, S. pombe
taaacatcttccttctcttgagcgt

SEQ ID NO: 111793 - DNA, 25 bp, S. pombe
taaacagcctgctccatctgagaat

SEQ ID NO: 111794 - DNA, 25 bp, S. pombe
taaaagcacatccaagtcgcccaaa

SEQ ID NO: 111795 - DNA, 25 bp, S. pombe
taaagatggaccgttttcacccgat

SEQ ID NO: 111796 - DNA, 25 bp, S. pombe
tacggtcctggtggttatcctattc

SEQ ID NO: 111797 - DNA, 25 bp, S. pombe
tactaggacaaattaccgcttcggg

SEQ ID NO: 111798 - DNA, 25 bp, S. pombe
tacatttagaaatccggcctgacga

SEQ ID NO: 111799 - DNA, 25 bp, S. pombe
tattttcgaaaagcacacccacgcg

SEQ ID NO: 111800 - DNA, 25 bp, S. pombe
tatttttacgaatctcccagaccca

SEQ ID NO: 111801 - DNA, 25 bp, S. pombe
tacctttccgtcaagtaaaccacag

SEQ ID NO: 111802 - DNA, 25 bp, S. pombe
taaatttcgctaccaacaggtcgcc

SEQ ID NO: 111803 - DNA, 25 bp, S. pombe
taaatgcttttcacgaaggtccgga

SEQ ID NO: 111804 - DNA, 25 bp, S. pombe
taaagcttttcaatcgccgttccaa

SEQ ID NO: 111805 - DNA, 25 bp, S. pombe
taaagtatttttccctgttcctgat

SEQ ID NO: 111806 - DNA, 25 bp, S. pombe
taaaccgttgattccggctatgaag

SEQ ID NO: 111807 - DNA, 25 bp, S. pombe
taaatcctaggttccgttctaagcg

SEQ ID NO: 111808 - DNA, 25 bp, S. pombe
tacacaacttccttctcaatgcatt

SEQ ID NO: 111809 - DNA, 25 bp, S. pombe
tacaaaattctcttgctcagcagcc

SEQ ID NO: 111810 - DNA, 25 bp, S. pombe
taaaaatcctcaatccacatctgcg

SEQ ID NO: 111811 - DNA, 25 bp, S. pombe
taaagctattacaacttctgcattg

SEQ ID NO: 111812 - DNA, 25 bp, S. pombe
tagagacgtacagtgcattgtgcaa

SEQ ID NO: 111813 - DNA, 25 bp, S. pombe
tacagtcatgaaccgcacagtcaat

SEQ ID NO: 111814 - DNA, 25 bp, S. pombe
tacagtgatatctcttctccgaatg

SEQ ID NO: 111815 - DNA, 25 bp, S. pombe
taaattgcagcattcttcctccaat

SEQ ID NO: 111816 - DNA, 25 bp, S. pombe
tacttgtactactatgcctctgatt

SEQ ID NO: 111817 - DNA, 25 bp, S. pombe
tacttttctctacagtcgtcacgaa

SEQ ID NO: 111818 - DNA, 25 bp, S. pombe
tacatttactcggaagtaccatcgg

SEQ ID NO: 111819 - DNA, 25 bp, S. pombe
tactttagcaacatcagtcctccgg

SEQ ID NO: 111820 - DNA, 25 bp, S. pombe
tactttgagtgcttgtactgcccca

SEQ ID NO: 111821 - DNA, 25 bp, S. pombe
tactttgcgatgtttggtggaaccc

SEQ ID NO: 111822 - DNA, 25 bp, S. pombe
tagggttggctcgatgcttccggtc

SEQ ID NO: 111823 - DNA, 25 bp, S. pombe
taaagttggccaatcctcctgagtc

SEQ ID NO: 111824 - DNA, 25 bp, S. pombe
taaagttgtcaaacgcgcatcgccc

SEQ ID NO: 111825 - DNA, 25 bp, S. pombe
tacgacttactacgtggcattcggg

SEQ ID NO: 111826 - DNA, 25 bp, S. pombe
tacttttaccttgggactgtggctt

SEQ ID NO: 111827 - DNA, 25 bp, S. pombe
tactcgttactcaccgatcaagtca

SEQ ID NO: 111828 - DNA, 25 bp, S. pombe
tactcatttaatagaccgtccggat

SEQ ID NO: 111829 - DNA, 25 bp, S. pombe
tactttgtgcaaaacgcgattccga

SEQ ID NO: 111830 - DNA, 25 bp, S. pombe
taaactgctttggtactcttcacac

SEQ ID NO: 111831 - DNA, 25 bp, S. pombe
taaatgtccatcgtcttgcattgat

SEQ ID NO: 111832 - DNA, 25 bp, S. pombe
tacattgtctccgtttttggtactg

SEQ ID NO: 111833 - DNA, 25 bp, S. pombe
tacttgcgcattcatttccggttct

SEQ ID NO: 111834 - DNA, 25 bp, S. pombe
tacagagggcatcggttttacctat

SEQ ID NO: 111835 - DNA, 25 bp, S. pombe
tactaatgcatgatactcccgaaga

SEQ ID NO: 111836 - DNA, 25 bp, S. pombe
tacagtatcccaaacggccagcaaa

SEQ ID NO: 111837 - DNA, 25 bp, S. pombe
tacgttcccttacccgatgaagaag

SEQ ID NO: 111838 - DNA, 25 bp, S. pombe
tatacaaccgttgccggcatcgata

SEQ ID NO: 111839 - DNA, 25 bp, S. pombe
taaacgtgctttattaggatcccaa

SEQ ID NO: 111840 - DNA, 25 bp, S. pombe
ttcaattggtttatccgcgtccgag

SEQ ID NO: 111841 - DNA, 25 bp, S. pombe
tacagttggtattttccgcttccga

SEQ ID NO: 111842 - DNA, 25 bp, S. pombe
tacacttccttcaatttcattaccg

SEQ ID NO: 111843 - DNA, 25 bp, S. pombe
tacaccttcaaaaaatctcccagtc

SEQ ID NO: 111844 - DNA, 25 bp, S. pombe
tacccgtctcttgaattcccagtta

SEQ ID NO: 111845 - DNA, 25 bp, S. pombe
tatcccgtccatctcaaaagtcgat

SEQ ID NO: 111846 - DNA, 25 bp, S. pombe
ttccttgcccagcacaaatactttg

SEQ ID NO: 111847 - DNA, 25 bp, S. pombe
ttcgtctaccatccagcaaagagtt

SEQ ID NO: 111848 - DNA, 25 bp, S. pombe
tacagctcgcgtgtataactataca

SEQ ID NO: 111849 - DNA, 25 bp, S. pombe
tactcttcgtcctgaacttttcaaa

SEQ ID NO: 111850 - DNA, 25 bp, S. pombe
tactttagtacccaattatccagat

SEQ ID NO: 111851 - DNA, 25 bp, S. pombe
tactttgcaggcgaacagttcaccg

SEQ ID NO: 111852 - DNA, 25 bp, S. pombe
tacaaatgcctttaacgtctccgga

SEQ ID NO: 111853 - DNA, 25 bp, S. pombe
tacaagacgtggtaacttccgccgt

SEQ ID NO: 111854 - DNA, 25 bp, S. pombe
tacaatccttggtctttcaaaccca

SEQ ID NO: 111855 - DNA, 25 bp, S. pombe
tacaatcgcttgtgctttggaacag

SEQ ID NO: 111856 - DNA, 25 bp, S. pombe
tacaacttcaaggtgatcaacgtat

SEQ ID NO: 111857 - DNA, 25 bp, S. pombe
taaatgctgccgtccgaaatcttat

SEQ ID NO: 111858 - DNA, 25 bp, S. pombe
taaagagctcgaggcccaggattcc

SEQ ID NO: 111859 - DNA, 25 bp, S. pombe
taaatactccttatgcaaatgcggt

SEQ ID NO: 111860 - DNA, 25 bp, S. pombe
tacaaaccctgtacgccgatggagt

SEQ ID NO: 111861 - DNA, 25 bp, S. pombe
taaagaggttgtacagccgataaag

SEQ ID NO: 111862 - DNA, 25 bp, S. pombe
taaaggaaccttgcagtctgtagat

SEQ ID NO: 111863 - DNA, 25 bp, S. pombe
tacagttaactgtgccccatatcaa

SEQ ID NO: 111864 - DNA, 25 bp, S. pombe
taaactctactgtgcccatctttaa

SEQ ID NO: 111865 - DNA, 25 bp, S. pombe
taaagtcattcgaaacctccattaa

SEQ ID NO: 111866 - DNA, 25 bp, S. pombe
taaagagttttcttccaccaaccag

SEQ ID NO: 111867 - DNA, 25 bp, S. pombe
taaacgcttttggaatcaccctgcc

SEQ ID NO: 111868 - DNA, 25 bp, S. pombe
taaactcttttcattaccttggcct

SEQ ID NO: 111869 - DNA, 25 bp, S. pombe
taaaccgcaccaagcttctgttgaa

SEQ ID NO: 111870 - DNA, 25 bp, S. pombe
tacaaatccacctccttttgatggg

SEQ ID NO: 111871 - DNA, 25 bp, S. pombe
tacatactcctccaaccagttggtt

SEQ ID NO: 111872 - DNA, 25 bp, S. pombe
tacaacaaacaccacgggcttctat

SEQ ID NO: 111873 - DNA, 25 bp, S. pombe
tacaatttcggaagccgctgcgtaa

SEQ ID NO: 111874 - DNA, 25 bp, S. pombe
tacaacattcctcacctggtattat

SEQ ID NO: 111875 - DNA, 25 bp, S. pombe
taaagatccttatcctgttcctcat

SEQ ID NO: 111876 - DNA, 25 bp, S. pombe
taaagtccttgttggatccactcgg

SEQ ID NO: 111877 - DNA, 25 bp, S. pombe
taaagagccgtctcttcacacgaaa

SEQ ID NO: 111878 - DNA, 25 bp, S. pombe
taaagaccgctctcttccaaaagtt

SEQ ID NO: 111879 - DNA, 25 bp, S. pombe
tacaagactcccttattcgacaaag

SEQ ID NO: 111880 - DNA, 25 bp, S. pombe
tacaggctcgaagaatgctcgggaa

SEQ ID NO: 111881 - DNA, 25 bp, S. pombe
tacattcggttagcggcaatgccat

SEQ ID NO: 111882 - DNA, 25 bp, S. pombe
taaatatggttcctgccgatcacgt

SEQ ID NO: 111883 - DNA, 25 bp, S. pombe
tacttcatcttctaatccggtcact

SEQ ID NO: 111884 - DNA, 25 bp, S. pombe
tacaacatcttatgacctggccact

SEQ ID NO: 111885 - DNA, 25 bp, S. pombe
tacaatatctactacaacctcggcg

SEQ ID NO: 111886 - DNA, 25 bp, S. pombe
tacaaagctgccaaattccctacaa

SEQ ID NO: 111887 - DNA, 25 bp, S. pombe
taaagaggccagacgatgccgttga

SEQ ID NO: 111888 - DNA, 25 bp, S. pombe
taaatgggccaacgtctctgtgcgt

SEQ ID NO: 111889 - DNA, 25 bp, S. pombe
tacaagagtctctatccttttcgtc

SEQ ID NO: 111890 - DNA, 25 bp, S. pombe
taaaggtgctgctactcaagctctc

SEQ ID NO: 111891 - DNA, 25 bp, S. pombe
taaatcccaagtcctatcgtctcat

SEQ ID NO: 111892 - DNA, 25 bp, S. pombe
tacattcctaaaacttgcggctcct

SEQ ID NO: 111893 - DNA, 25 bp, S. pombe
taggtttgggttctcttcatttgca

SEQ ID NO: 111894 - DNA, 25 bp, S. pombe
taaaccttgctctttcttcttatag

SEQ ID NO: 111895 - DNA, 25 bp, S. pombe
taaacctcctgtactttcacatgat

SEQ ID NO: 111896 - DNA, 25 bp, S. pombe
taaacgccgattgtgtagcatctat

SEQ ID NO: 111897 - DNA, 25 bp, S. pombe
taaacgccttcttgatctcgcatta

SEQ ID NO: 111898 - DNA, 25 bp, S. pombe
taaagcgcctatcttctcagatgtc

SEQ ID NO: 111899 - DNA, 25 bp, S. pombe
taggacattctacgcctcataattc

SEQ ID NO: 111900 - DNA, 25 bp, S. pombe
tactacatctgctacatccactaat

SEQ ID NO: 111901 - DNA, 25 bp, S. pombe
tacatctggtgctttgtacgccatt

SEQ ID NO: 111902 - DNA, 25 bp, S. pombe
tagtaaaagcgtgtcttactgagat

SEQ ID NO: 111903 - DNA, 25 bp, S. pombe
tattcgccggtctcttttcttcaat

SEQ ID NO: 111904 - DNA, 25 bp, S. pombe
taaaggcactttccgtgttttcgct

SEQ ID NO: 111905 - DNA, 25 bp, S. pombe
tacaatctgcgcgagaacgttattt

SEQ ID NO: 111906 - DNA, 25 bp, S. pombe
tacaatccggtttcgaacgtcagct

SEQ ID NO: 111907 - DNA, 25 bp, S. pombe
tacaatcaaatactccgcaatccac

SEQ ID NO: 111908 - DNA, 25 bp, S. pombe
tagaaaatgcacctctacaatcccc

SEQ ID NO: 111909 - DNA, 25 bp, S. pombe
taaagtcgtgcattgtcatccacct

SEQ ID NO: 111910 - DNA, 25 bp, S. pombe
tacaggctcgtcaatttcgcaactt

SEQ ID NO: 111911 - DNA, 25 bp, S. pombe
taaagcgtgcacttgtccatgatgg

SEQ ID NO: 111912 - DNA, 25 bp, S. pombe
taaagagagcagaattcctgggtgt

SEQ ID NO: 111913 - DNA, 25 bp, S. pombe
taaagaagagcaagcccgctggcgt

SEQ ID NO: 111914 - DNA, 25 bp, S. pombe
taaagaatgtgctgacctctggcct

SEQ ID NO: 111915 - DNA, 25 bp, S. pombe
tacagaatcgtctctctatgcttgc

SEQ ID NO: 111916 - DNA, 25 bp, S. pombe
tacagacagtgtttggaagcgtgcc

SEQ ID NO: 111917 - DNA, 25 bp, S. pombe
tacaacgtgttttactcagtgcatt

SEQ ID NO: 111918 - DNA, 25 bp, S. pombe
tacaatggttacacttcatgcccgc

SEQ ID NO: 111919 - DNA, 25 bp, S. pombe
taaatgtgctttattgttgtctcgc

SEQ ID NO: 111920 - DNA, 25 bp, S. pombe
tacaatgtccttctttttcttcttt

SEQ ID NO: 111921 - DNA, 25 bp, S. pombe
tatgttctgtatcttcggttggttc

SEQ ID NO: 111922 - DNA, 25 bp, S. pombe
tacgtaacctatccttttctttcat

SEQ ID NO: 111923 - DNA, 25 bp, S. pombe
tacgttacaagtcggtatttagcca

SEQ ID NO: 111924 - DNA, 25 bp, S. pombe
taccttacatagaggcaactccgcc

SEQ ID NO: 111925 - DNA, 25 bp, S. pombe
tacaatgtttcagcttatctccctt

SEQ ID NO: 111926 - DNA, 25 bp, S. pombe
tacaactttaccatgtcccgtagag

SEQ ID NO: 111927 - DNA, 25 bp, S. pombe
taaaggtcttccatttcgccaaact

SEQ ID NO: 111928 - DNA, 25 bp, S. pombe
taaattctcttcctttactccaaca

SEQ ID NO: 111929 - DNA, 25 bp, S. pombe
taaattggttctcttcctaccaaag

SEQ ID NO: 111930 - DNA, 25 bp, S. pombe
taaattggttcttgttgctctaaaa

SEQ ID NO: 111931 - DNA, 25 bp, S. pombe
tacatactcgtattgggcatcagtt

SEQ ID NO: 111932 - DNA, 25 bp, S. pombe
tacacaccgatattagagttgcttt

SEQ ID NO: 111933 - DNA, 25 bp, S. pombe
tactaccaaactttcgattccgatc

SEQ ID NO: 111934 - DNA, 25 bp, S. pombe
tttgcaaattactactggaagcggg

SEQ ID NO: 111935 - DNA, 25 bp, S. pombe
ttggatttaacccttgaccctattg

SEQ ID NO: 111936 - DNA, 25 bp, S. pombe
taggtagtttccgttacgcccatgg

SEQ ID NO: 111937 - DNA, 25 bp, S. pombe
tatggcgtttaagcacccttattcc

SEQ ID NO: 111938 - DNA, 25 bp, S. pombe
tacggcattgtatccctttttcaaa

SEQ ID NO: 111939 - DNA, 25 bp, S. pombe
tactccggtataggctttttatgca

SEQ ID NO: 111940 - DNA, 25 bp, S. pombe
tacccgttatgctctcgaacttgac

SEQ ID NO: 111941 - DNA, 25 bp, S. pombe
taccggtagagaaacgcgccgcaat

SEQ ID NO: 111942 - DNA, 25 bp, S. pombe
tacgaactaagacacagccttcctt

SEQ ID NO: 111943 - DNA, 25 bp, S. pombe
tacgatacgtttcactcttttttgg

SEQ ID NO: 111944 - DNA, 25 bp, S. pombe
tacgaacttgtacacttttccctgt

SEQ ID NO: 111945 - DNA, 25 bp, S. pombe
tacgaactttttgtattgagacctt

SEQ ID NO: 111946 - DNA, 25 bp, S. pombe
tacaatagtgccgtctccttatgaa

SEQ ID NO: 111947 - DNA, 25 bp, S. pombe
taaatccgctgctctcatcttatta

SEQ ID NO: 111948 - DNA, 25 bp, S. pombe
tacatcccctcgctgatttagataa

SEQ ID NO: 111949 - DNA, 25 bp, S. pombe
tacagctacagtcgaatttatggat

SEQ ID NO: 111950 - DNA, 25 bp, S. pombe
tagcagctatcgtgtctttggtaag

SEQ ID NO: 111951 - DNA, 25 bp, S. pombe
tacagttctttgtgtcttcgagatc

SEQ ID NO: 111952 - DNA, 25 bp, S. pombe
tacaatcttttgatggtcccagcgg

SEQ ID NO: 111953 - DNA, 25 bp, S. pombe
taaatgtccctcaatcatggtcaag

SEQ ID NO: 111954 - DNA, 25 bp, S. pombe
tacttttgggactttgcacgtgcta

SEQ ID NO: 111955 - DNA, 25 bp, S. pombe
tacaccggccaatctatattgcaag

SEQ ID NO: 111956 - DNA, 25 bp, S. pombe
taaatgcatcgccaaacttactcca

SEQ ID NO: 111957 - DNA, 25 bp, S. pombe
taaatctgtcgagtacgtctgccca

SEQ ID NO: 111958 - DNA, 25 bp, S. pombe
taaattctgctagacgtgctggcgc

SEQ ID NO: 111959 - DNA, 25 bp, S. pombe
taaatactctcagcacagtgccgat

SEQ ID NO: 111960 - DNA, 25 bp, S. pombe
tacaattggtgttagtggtgctggt

SEQ ID NO: 111961 - DNA, 25 bp, S. pombe
tacaaaactacgtcttgcagctcgc

SEQ ID NO: 111962 - DNA, 25 bp, S. pombe
tacaaaacgcaaactgtggccacag

SEQ ID NO: 111963 - DNA, 25 bp, S. pombe
tataagggtgctcagtctcccaatg

SEQ ID NO: 111964 - DNA, 25 bp, S. pombe
taaagatggatccaactctccgtct

SEQ ID NO: 111965 - DNA, 25 bp, S. pombe
taccatgggtaagcctcacagactt

SEQ ID NO: 111966 - DNA, 25 bp, S. pombe
tagttcgatctacagttaccaggat

SEQ ID NO: 111967 - DNA, 25 bp, S. pombe
taaatcgtcgtccacttacaagaat

SEQ ID NO: 111968 - DNA, 25 bp, S. pombe
tacaacgtcgtcctctacaagaatt

SEQ ID NO: 111969 - DNA, 25 bp, S. pombe
tactcggaccagctctactatgaat

SEQ ID NO: 111970 - DNA, 25 bp, S. pombe
tacatcgagtgctaggtttttcaat

SEQ ID NO: 111971 - DNA, 25 bp, S. pombe
tacatgctggacttgataggtttca

SEQ ID NO: 111972 - DNA, 25 bp, S. pombe
tagctgctggactgttcttgtcgaa

SEQ ID NO: 111973 - DNA, 25 bp, S. pombe
tacctggtgagtctggatcccgaaa

SEQ ID NO: 111974 - DNA, 25 bp, S. pombe
tacatctttgaatggcgaccctaaa

SEQ ID NO: 111975 - DNA, 25 bp, S. pombe
tacatgttaacatctgcggccactt

SEQ ID NO: 111976 - DNA, 25 bp, S. pombe
taaattgtcagcaacgcagcgctca

SEQ ID NO: 111977 - DNA, 25 bp, S. pombe
taaatcgtcaatatgcagcagctgt

SEQ ID NO: 111978 - DNA, 25 bp, S. pombe
taaaggacgtcgatgctcagcagtt

SEQ ID NO: 111979 - DNA, 25 bp, S. pombe
taaaggatcccgttcatagtgttaa

SEQ ID NO: 111980 - DNA, 25 bp, S. pombe
tacaaggatccggttctttctcgag

SEQ ID NO: 111981 - DNA, 25 bp, S. pombe
tacagcagttcagtcgtactcgatc

SEQ ID NO: 111982 - DNA, 25 bp, S. pombe
taaatttcccgttggccagcagtat

SEQ ID NO: 111983 - DNA, 25 bp, S. pombe
taaatatttcggatggagaggctac

SEQ ID NO: 111984 - DNA, 25 bp, S. pombe
tacaaattcctctttatgacctcca

SEQ ID NO: 111985 - DNA, 25 bp, S. pombe
tacaaaccgttaattggctctccac

SEQ ID NO: 111986 - DNA, 25 bp, S. pombe
tacggactcggtacgtgaagttgct

SEQ ID NO: 111987 - DNA, 25 bp, S. pombe
tacctgattcggttttgcaaatatt

SEQ ID NO: 111988 - DNA, 25 bp, S. pombe
tacggctacgcgcatttcaaataga

SEQ ID NO: 111989 - DNA, 25 bp, S. pombe
tacaccactgcttgcatctggtaga

SEQ ID NO: 111990 - DNA, 25 bp, S. pombe
tacaatgttatctcctgctttcttt

SEQ ID NO: 111991 - DNA, 25 bp, S. pombe
tacgatcaaattcccgtccgtgtgc

SEQ ID NO: 111992 - DNA, 25 bp, S. pombe
tactgtaaatctccttttcggctca

SEQ ID NO: 111993 - DNA, 25 bp, S. pombe
taaatcagcttcttcctgagagcaa

SEQ ID NO: 111994 - DNA, 25 bp, S. pombe
tacagacactagtttgctccaaagg

SEQ ID NO: 111995 - DNA, 25 bp, S. pombe
tacagccgctgaatctttaatcaat

SEQ ID NO: 111996 - DNA, 25 bp, S. pombe
tacagtctgtatctgctgctagagg

SEQ ID NO: 111997 - DNA, 25 bp, S. pombe
tacagcacggctttgcttgagcaag

SEQ ID NO: 111998 - DNA, 25 bp, S. pombe
tacacaggctgtttcaatccatcac

SEQ ID NO: 111999 - DNA, 25 bp, S. pombe
tacaagatcttgttcaacccaccga

SEQ ID NO: 112000 - DNA, 25 bp, S. pombe
tatcgagctttacaacgtgcaggag

SEQ ID NO: 112001 - DNA, 25 bp, S. pombe
tacgcactttagctcatcaacatga

SEQ ID NO: 112002 - DNA, 25 bp, S. pombe
taccattttatgcaaaccgacccta

SEQ ID NO: 112003 - DNA, 25 bp, S. pombe
tagaatacctttccaggttcctcca

SEQ ID NO: 112004 - DNA, 25 bp, S. pombe
tacaagaacttgaaccggtcctcca

SEQ ID NO: 112005 - DNA, 25 bp, S. pombe
tacaagcctactaagcacggtcgtc

SEQ ID NO: 112006 - DNA, 25 bp, S. pombe
tacgatggtactgagtccgtcgatc

SEQ ID NO: 112007 - DNA, 25 bp, S. pombe
tacttggtattttgtccggcgggat

SEQ ID NO: 112008 - DNA, 25 bp, S. pombe
tactttgtctccttctgtcgaagaa

SEQ ID NO: 112009 - DNA, 25 bp, S. pombe
tacttccatccttcttcacgaagat

SEQ ID NO: 112010 - DNA, 25 bp, S. pombe
tacatttgagcatggacctccggtt

SEQ ID NO: 112011 - DNA, 25 bp, S. pombe
taaatttcaaataccctcttcctca

SEQ ID NO: 112012 - DNA, 25 bp, S. pombe
tacaatttacaatccctcatcttct

SEQ ID NO: 112013 - DNA, 25 bp, S. pombe
tacagcttcttctaacactcaactt

SEQ ID NO: 112014 - DNA, 25 bp, S. pombe
taaattttctatacctactgctcaa

SEQ ID NO: 112015 - DNA, 25 bp, S. pombe
taaatgtggcgctattcttgcatca

SEQ ID NO: 112016 - DNA, 25 bp, S. pombe
tacaatcatgggtcctgctgacagc

SEQ ID NO: 112017 - DNA, 25 bp, S. pombe
tacatacctggactatctacgctat

SEQ ID NO: 112018 - DNA, 25 bp, S. pombe
tacatgacgctccaatcacttgtga

SEQ ID NO: 112019 - DNA, 25 bp, S. pombe
tacaaacatccacccgttcttatta

SEQ ID NO: 112020 - DNA, 25 bp, S. pombe
tacaaaaccctcacattcttattct

SEQ ID NO: 112021 - DNA, 25 bp, S. pombe
tactgcaaaccctcctaattattct

SEQ ID NO: 112022 - DNA, 25 bp, S. pombe
tacactttcttatactggcggttcc

SEQ ID NO: 112023 - DNA, 25 bp, S. pombe
taggacgagcaattcttttagacga

SEQ ID NO: 112024 - DNA, 25 bp, S. pombe
tacatacgtgctatcttttcaacta

SEQ ID NO: 112025 - DNA, 25 bp, S. pombe
tacaagttagtttgtgccggtcctc

SEQ ID NO: 112026 - DNA, 25 bp, S. pombe
tacttagaagtgtccatcctagccc

SEQ ID NO: 112027 - DNA, 25 bp, S. pombe
ttctattcaagtatctccaaccacg

SEQ ID NO: 112028 - DNA, 25 bp, S. pombe
tactcctgaagtagtttcacccgca

SEQ ID NO: 112029 - DNA, 25 bp, S. pombe
tacggtaaatcgtttcactgctcca

SEQ ID NO: 112030 - DNA, 25 bp, S. pombe
tacatttcctacattctcccaaatt

SEQ ID NO: 112031 - DNA, 25 bp, S. pombe
tacttcttccaatgacctttaccaa

SEQ ID NO: 112032 - DNA, 25 bp, S. pombe
tacttcttcctcttactttatcact

SEQ ID NO: 112033 - DNA, 25 bp, S. pombe
tagttttcctgctccgatagtaatt

SEQ ID NO: 112034 - DNA, 25 bp, S. pombe
tagagcttttttctggaaggctttc

SEQ ID NO: 112035 - DNA, 25 bp, S. pombe
tacagtggttttcatggaccggttt

SEQ ID NO: 112036 - DNA, 25 bp, S. pombe
tacaatggctccatctacgggtggt

SEQ ID NO: 112037 - DNA, 25 bp, S. pombe
tacaatggcccaacttgctgtgagc

SEQ ID NO: 112038 - DNA, 25 bp, S. pombe
tacaattcggcaaagtctgctgata

SEQ ID NO: 112039 - DNA, 25 bp, S. pombe
tacaacttgaggtagctgctttaga

SEQ ID NO: 112040 - DNA, 25 bp, S. pombe
tacaagcggcggtttacgtgacaaa

SEQ ID NO: 112041 - DNA, 25 bp, S. pombe
tacttataggtattcggcggctgga

SEQ ID NO: 112042 - DNA, 25 bp, S. pombe
tacatatattttctcttcacggaag

SEQ ID NO: 112043 - DNA, 25 bp, S. pombe
tacaatgttgtcaatgccttgccat

SEQ ID NO: 112044 - DNA, 25 bp, S. pombe
tacaattcaaatcctatgtgatcaa

SEQ ID NO: 112045 - DNA, 25 bp, S. pombe
tacttgctcagatttcagagttcct

SEQ ID NO: 112046 - DNA, 25 bp, S. pombe
tacagtgacagatttcgaccgctat

SEQ ID NO: 112047 - DNA, 25 bp, S. pombe
tacatttttggcgacagatggggat

SEQ ID NO: 112048 - DNA, 25 bp, S. pombe
tactggtggccgtaacatgggtcgt

SEQ ID NO: 112049 - DNA, 25 bp, S. pombe
tacgtccatcttctaagggctctga

SEQ ID NO: 112050 - DNA, 25 bp, S. pombe
tactgtgcccggagataagtctgct

SEQ ID NO: 112051 - DNA, 25 bp, S. pombe
tactgtccccactggtggtgctgct

SEQ ID NO: 112052 - DNA, 25 bp, S. pombe
tactcatccagctttgacgggtcgt

SEQ ID NO: 112053 - DNA, 25 bp, S. pombe
tactcatccaaatgtcggttcgctg

SEQ ID NO: 112054 - DNA, 25 bp, S. pombe
tactctctaaatttcccaatctggc

SEQ ID NO: 112055 - DNA, 25 bp, S. pombe
tacctccaagactggcaagcacgga

SEQ ID NO: 112056 - DNA, 25 bp, S. pombe
tactcccaagaagatcaagcacaag

SEQ ID NO: 112057 - DNA, 25 bp, S. pombe
tacagtcctgatgatgttgcacctc

SEQ ID NO: 112058 - DNA, 25 bp, S. pombe
tacagggttcttcagggccatacgt

SEQ ID NO: 112059 - DNA, 25 bp, S. pombe
tacagcggagccttgggagcccata

SEQ ID NO: 112060 - DNA, 25 bp, S. pombe
tacgtgaagcagttcgtggtcaccc

SEQ ID NO: 112061 - DNA, 25 bp, S. pombe
tacttcgattgtctcttatgttccc

SEQ ID NO: 112062 - DNA, 25 bp, S. pombe
tactagagatttcagcctcgtctcc

SEQ ID NO: 112063 - DNA, 25 bp, S. pombe
tacataactatgtcccctggtatcg

SEQ ID NO: 112064 - DNA, 25 bp, S. pombe
tacagctatcctttctcgtggtatc

SEQ ID NO: 112065 - DNA, 25 bp, S. pombe
tactgttcgtcgtcaagccgttgat

SEQ ID NO: 112066 - DNA, 25 bp, S. pombe
tactcttgtcggtactggttctgaa

SEQ ID NO: 112067 - DNA, 25 bp, S. pombe
tacctacgatcctactgtttgcgat

SEQ ID NO: 112068 - DNA, 25 bp, S. pombe
tacgacaataagttcagtttcccag

SEQ ID NO: 112069 - DNA, 25 bp, S. pombe
tagtacattcaagttccgtttccgc

SEQ ID NO: 112070 - DNA, 25 bp, S. pombe
tactagattcatccttaccttacgc

SEQ ID NO: 112071 - DNA, 25 bp, S. pombe
tactactaatccgttctcttttgct

SEQ ID NO: 112072 - DNA, 25 bp, S. pombe
tactatctgaagctttcctatggaa

SEQ ID NO: 112073 - DNA, 25 bp, S. pombe
tacaaggtgcggtcatgtctttctt

SEQ ID NO: 112074 - DNA, 25 bp, S. pombe
tactatgcgtcgaaatgctcttctt

SEQ ID NO: 112075 - DNA, 25 bp, S. pombe
tactatagaaggtggcgctgccgcg

SEQ ID NO: 112076 - DNA, 25 bp, S. pombe
tactatcgttggaaagctgcccgtc

SEQ ID NO: 112077 - DNA, 25 bp, S. pombe
tactgattttttctggccgtattcc

SEQ ID NO: 112078 - DNA, 25 bp, S. pombe
tactagtcttattgccaccggcatt

SEQ ID NO: 112079 - DNA, 25 bp, S. pombe
taccctcaggattcgacatcatctt

SEQ ID NO: 112080 - DNA, 25 bp, S. pombe
tacatcacactggagctggcatttt

SEQ ID NO: 112081 - DNA, 25 bp, S. pombe
tacatctaatggctgctgcaattgc

SEQ ID NO: 112082 - DNA, 25 bp, S. pombe
tacagcatatcatcgactaccagca

SEQ ID NO: 112083 - DNA, 25 bp, S. pombe
tacactctagcccatcaatcaaaag

SEQ ID NO: 112084 - DNA, 25 bp, S. pombe
tactgccgccgaattacaagatatg

SEQ ID NO: 112085 - DNA, 25 bp, S. pombe
tactcaaggcgttctgaattaccca

SEQ ID NO: 112086 - DNA, 25 bp, S. pombe
tactcctaagcatccgtttgttctc

SEQ ID NO: 112087 - DNA, 25 bp, S. pombe
tagtaccccattgcaattgtttcct

SEQ ID NO: 112088 - DNA, 25 bp, S. pombe
tagttggcgaggaagccctttctca

SEQ ID NO: 112089 - DNA, 25 bp, S. pombe
tagttccgggagtcgcttttgatga

SEQ ID NO: 112090 - DNA, 25 bp, S. pombe
tatgtatctcggtgagcttttccgc

SEQ ID NO: 112091 - DNA, 25 bp, S. pombe
tatgtaccgttaactgactcaccag

SEQ ID NO: 112092 - DNA, 25 bp, S. pombe
tactcccatgtctggacgtgaacat

SEQ ID NO: 112093 - DNA, 25 bp, S. pombe
tactcctgcagtcccgaaagaagat

SEQ ID NO: 112094 - DNA, 25 bp, S. pombe
tactcgatggaaaaatggcgctcag

SEQ ID NO: 112095 - DNA, 25 bp, S. pombe
tacaccgcggtttcttatgaaatga

SEQ ID NO: 112096 - DNA, 25 bp, S. pombe
tacttcggtatctagcagcacttct

SEQ ID NO: 112097 - DNA, 25 bp, S. pombe
tactatcgtgtacttctcatgtccg

SEQ ID NO: 112098 - DNA, 25 bp, S. pombe
tactgggtgtggtatccttacgatt

SEQ ID NO: 112099 - DNA, 25 bp, S. pombe
tactagtgttgcttcccgtgttgac

SEQ ID NO: 112100 - DNA, 25 bp, S. pombe
tacaatgtgtttcctgctcttacag

SEQ ID NO: 112101 - DNA, 25 bp, S. pombe
tacaaaggctctctgcatgcttaaa

SEQ ID NO: 112102 - DNA, 25 bp, S. pombe
tagcaaacaactctcgccaattcaa

SEQ ID NO: 112103 - DNA, 25 bp, S. pombe
tacaacaaatttaccaccgtctcga

SEQ ID NO: 112104 - DNA, 25 bp, S. pombe
tacaacaaactcattcatcgcgacc

SEQ ID NO: 112105 - DNA, 25 bp, S. pombe
tatattaactctctcgccaattacg

SEQ ID NO: 112106 - DNA, 25 bp, S. pombe
tatattattcctcgtcccttaaatg

SEQ ID NO: 112107 - DNA, 25 bp, S. pombe
tagatttacgtcctcttactattcg

SEQ ID NO: 112108 - DNA, 25 bp, S. pombe
tacatttcccttagttactcttgag

SEQ ID NO: 112109 - DNA, 25 bp, S. pombe
tacagaagccttttgattaccccga

SEQ ID NO: 112110 - DNA, 25 bp, S. pombe
tacggacatgctcttgattaccact

SEQ ID NO: 112111 - DNA, 25 bp, S. pombe
tacaagcccatcatattctcctact

SEQ ID NO: 112112 - DNA, 25 bp, S. pombe
tacacgagacattagacccgacttt

SEQ ID NO: 112113 - DNA, 25 bp, S. pombe
tagcaagcaatctaggtcctatggt

SEQ ID NO: 112114 - DNA, 25 bp, S. pombe
tacagatcaattgctctcgtctcta

SEQ ID NO: 112115 - DNA, 25 bp, S. pombe
tacaagctcattttcctcaagcgaa

SEQ ID NO: 112116 - DNA, 25 bp, S. pombe
tacaagcttgttgctctcgttgaag

SEQ ID NO: 112117 - DNA, 25 bp, S. pombe
tacacagtcccttggcttagaagat

SEQ ID NO: 112118 - DNA, 25 bp, S. pombe
tacgcctcgaggatttcaacagaag

SEQ ID NO: 112119 - DNA, 25 bp, S. pombe
tactggtcccgctgctaagaaagaa

SEQ ID NO: 112120 - DNA, 25 bp, S. pombe
tacatgtttaactctcgcgaacgcg

SEQ ID NO: 112121 - DNA, 25 bp, S. pombe
tactgcttactgctacacgggaggg

SEQ ID NO: 112122 - DNA, 25 bp, S. pombe
tacagatgtttcagatcgtcatgct

SEQ ID NO: 112123 - DNA, 25 bp, S. pombe
tacagaattttttagctcgcatagc

SEQ ID NO: 112124 - DNA, 25 bp, S. pombe
tacaactttttctatcatccgacca

SEQ ID NO: 112125 - DNA, 25 bp, S. pombe
tacaacatcttttcaacgctcgagc

SEQ ID NO: 112126 - DNA, 25 bp, S. pombe
tacagcaacttcctcaacctataat

SEQ ID NO: 112127 - DNA, 25 bp, S. pombe
tacaaatggtactgcgtggccggaa

SEQ ID NO: 112128 - DNA, 25 bp, S. pombe
tacagtctattttattcgtcacagg

SEQ ID NO: 112129 - DNA, 25 bp, S. pombe
tacacctacatcaacgtctcatata

SEQ ID NO: 112130 - DNA, 25 bp, S. pombe
tacaccaagccaatgcattgccttt

SEQ ID NO: 112131 - DNA, 25 bp, S. pombe
tacacctactgcttctctgtattta

SEQ ID NO: 112132 - DNA, 25 bp, S. pombe
tacttgctagcctttcttgatttaa

SEQ ID NO: 112133 - DNA, 25 bp, S. pombe
tacttgctacttgctcgttttatga

SEQ ID NO: 112134 - DNA, 25 bp, S. pombe
tacttctccaagtctcgttatgttg

SEQ ID NO: 112135 - DNA, 25 bp, S. pombe
tacacccatccatcagaactgtttt

SEQ ID NO: 112136 - DNA, 25 bp, S. pombe
tagttcccaacttaatctcctttag

SEQ ID NO: 112137 - DNA, 25 bp, S. pombe
tactagcccaacaatatcttccttt

SEQ ID NO: 112138 - DNA, 25 bp, S. pombe
tacttctccaaatacttcttctact

SEQ ID NO: 112139 - DNA, 25 bp, S. pombe
tactcctcctaattcgttgttgcta

SEQ ID NO: 112140 - DNA, 25 bp, S. pombe
tactcacggctctacttatggtggt

SEQ ID NO: 112141 - DNA, 25 bp, S. pombe
tactgtccctgctcatttgttagat

SEQ ID NO: 112142 - DNA, 25 bp, S. pombe
tacttctcttctggcatttgttggt

SEQ ID NO: 112143 - DNA, 25 bp, S. pombe
tactaagtcactggctgttttggat

SEQ ID NO: 112144 - DNA, 25 bp, S. pombe
tacttcgtcgtgtgtgccttgaaat

SEQ ID NO: 112145 - DNA, 25 bp, S. pombe
tactgaatgtacctactctccggag

SEQ ID NO: 112146 - DNA, 25 bp, S. pombe
tactcgttggaagctttctgcaggt

SEQ ID NO: 112147 - DNA, 25 bp, S. pombe
tacggattgcgatgctgctttttgc

SEQ ID NO: 112148 - DNA, 25 bp, S. pombe
tagcggatttgctccttctttccgt

SEQ ID NO: 112149 - DNA, 25 bp, S. pombe
tacagcagtttatagcctcacgacc

SEQ ID NO: 112150 - DNA, 25 bp, S. pombe
tacacagtatggtgggctacgtcca

SEQ ID NO: 112151 - DNA, 25 bp, S. pombe
tatccaatggacctgggtacgtctg

SEQ ID NO: 112152 - DNA, 25 bp, S. pombe
taccatttgcaggttggccaagctt

SEQ ID NO: 112153 - DNA, 25 bp, S. pombe
tacagcattgtggatttcgctacaa

SEQ ID NO: 112154 - DNA, 25 bp, S. pombe
tagctttggtgctgcctatggtaca

SEQ ID NO: 112155 - DNA, 25 bp, S. pombe
tagaggtggtgctcgctctggaaac

SEQ ID NO: 112156 - DNA, 25 bp, S. pombe
tacactggttcttcttcatctgagt

SEQ ID NO: 112157 - DNA, 25 bp, S. pombe
taccggtactttatgggctcacgag

SEQ ID NO: 112158 - DNA, 25 bp, S. pombe
tacatcgagcgactttacttgtccc

SEQ ID NO: 112159 - DNA, 25 bp, S. pombe
tacttgacggcggaacttactgcta

SEQ ID NO: 112160 - DNA, 25 bp, S. pombe
tactctgccgttcaaaattctgtgt

SEQ ID NO: 112161 - DNA, 25 bp, S. pombe
tacacccagatataaagcgcaccat

SEQ ID NO: 112162 - DNA, 25 bp, S. pombe
tacacgatcttataaacgcgccaaa

SEQ ID NO: 112163 - DNA, 25 bp, S. pombe
tactttctgcatgtgtttatcctaa

SEQ ID NO: 112164 - DNA, 25 bp, S. pombe
tacatggcccattatcgtcctttaa

SEQ ID NO: 112165 - DNA, 25 bp, S. pombe
tacagcactctgattcctcgtttaa

SEQ ID NO: 112166 - DNA, 25 bp, S. pombe
tacagcttcaagttcgtcgtcaaaa

SEQ ID NO: 112167 - DNA, 25 bp, S. pombe
tactcctaaaatttcctcctgttcg

SEQ ID NO: 112168 - DNA, 25 bp, S. pombe
tactacaaaactttcccgcattact

SEQ ID NO: 112169 - DNA, 25 bp, S. pombe
tacctaaaatgttgcgcccttactt

SEQ ID NO: 112170 - DNA, 25 bp, S. pombe
tacctaaattggtgcctgtctcttt

SEQ ID NO: 112171 - DNA, 25 bp, S. pombe
tacacctgtctctgtttcatctaaa

SEQ ID NO: 112172 - DNA, 25 bp, S. pombe
tacacctactgctgttctcgatgaa

SEQ ID NO: 112173 - DNA, 25 bp, S. pombe
tacactttggttgttgctgatgcaa

SEQ ID NO: 112174 - DNA, 25 bp, S. pombe
taccctcttttctttggatccataa

SEQ ID NO: 112175 - DNA, 25 bp, S. pombe
tacccgcccaatgtgtggattttca

SEQ ID NO: 112176 - DNA, 25 bp, S. pombe
tactcctgctctttactttacttta

SEQ ID NO: 112177 - DNA, 25 bp, S. pombe
tactgttttacctgaagctgctgca

SEQ ID NO: 112178 - DNA, 25 bp, S. pombe
tacttaatgacacacgatatgccgt

SEQ ID NO: 112179 - DNA, 25 bp, S. pombe
tacagttaacttccgatctctcaat

SEQ ID NO: 112180 - DNA, 25 bp, S. pombe
tacagcttcgtaagccgctattgga

SEQ ID NO: 112181 - DNA, 25 bp, S. pombe
tacatgattcttacaccgctttttc

SEQ ID NO: 112182 - DNA, 25 bp, S. pombe
tacagttttagtcgctatctcttta

SEQ ID NO: 112183 - DNA, 25 bp, S. pombe
tacagtattgtccatcagatccatc

SEQ ID NO: 112184 - DNA, 25 bp, S. pombe
tacaggctgtttccgattctattga

SEQ ID NO: 112185 - DNA, 25 bp, S. pombe
tacttctttgctttcttcatcattg

SEQ ID NO: 112186 - DNA, 25 bp, S. pombe
tacatcttgttcttcgtcttcgtgg

SEQ ID NO: 112187 - DNA, 25 bp, S. pombe
tacatcctgttttcgagttgctagt

SEQ ID NO: 112188 - DNA, 25 bp, S. pombe
tacattcgttctcctgaggctgata

SEQ ID NO: 112189 - DNA, 25 bp, S. pombe
tactcctgtaccaagcagcgctgaa

SEQ ID NO: 112190 - DNA, 25 bp, S. pombe
tactcgggagtcaacagcagaacct

SEQ ID NO: 112191 - DNA, 25 bp, S. pombe
tacgggtgacgcttcgaaggactct

SEQ ID NO: 112192 - DNA, 25 bp, S. pombe
tacagcattttccaagcgacgccaa

SEQ ID NO: 112193 - DNA, 25 bp, S. pombe
tacatttcttctaatcattccagca

SEQ ID NO: 112194 - DNA, 25 bp, S. pombe
tacgagtttgttatccacggtcatg

SEQ ID NO: 112195 - DNA, 25 bp, S. pombe
tacattttggtgcacatcgctgcca

SEQ ID NO: 112196 - DNA, 25 bp, S. pombe
tacttactcttgcagctcctatatt

SEQ ID NO: 112197 - DNA, 25 bp, S. pombe
tacttggttgtccatctctcaaaac

SEQ ID NO: 112198 - DNA, 25 bp, S. pombe
tactcggaggcagcatctctttacg

SEQ ID NO: 112199 - DNA, 25 bp, S. pombe
tacaggcattaatgggtgctcccaa

SEQ ID NO: 112200 - DNA, 25 bp, S. pombe
tacatggcttctcttggtcacgtta

SEQ ID NO: 112201 - DNA, 25 bp, S. pombe
tacttccttccgctatgcaacatta

SEQ ID NO: 112202 - DNA, 25 bp, S. pombe
tacttgcactcaaagcttcttacca

SEQ ID NO: 112203 - DNA, 25 bp, S. pombe
tacttcacatatcctttgcttcatc

SEQ ID NO: 112204 - DNA, 25 bp, S. pombe
tacttacgtgtcctgtgtgttcaaa

SEQ ID NO: 112205 - DNA, 25 bp, S. pombe
tacttcttgcttctgttgtcccaaa

SEQ ID NO: 112206 - DNA, 25 bp, S. pombe
tacttttttagtccagctgttccaa

SEQ ID NO: 112207 - DNA, 25 bp, S. pombe
tactcgttcgattgggaggcttaca

SEQ ID NO: 112208 - DNA, 25 bp, S. pombe
tactggatctcgtggtggtgttact

SEQ ID NO: 112209 - DNA, 25 bp, S. pombe
tacagagtcatgtcacagggattca

SEQ ID NO: 112210 - DNA, 25 bp, S. pombe
tactttgcaatccaatcgctcacaa

SEQ ID NO: 112211 - DNA, 25 bp, S. pombe
tagccttgtccgaatcaatcctaac

SEQ ID NO: 112212 - DNA, 25 bp, S. pombe
tagcgacttgcccagacatgatcgt

SEQ ID NO: 112213 - DNA, 25 bp, S. pombe
tagcttcttcgatgaatgatatggc

SEQ ID NO: 112214 - DNA, 25 bp, S. pombe
tactcatgattggaggaaatgtaca

SEQ ID NO: 112215 - DNA, 25 bp, S. pombe
tacggttccagccttgcagattatt

SEQ ID NO: 112216 - DNA, 25 bp, S. pombe
tactgcgctgataggtctggataaa

SEQ ID NO: 112217 - DNA, 25 bp, S. pombe
tacagtctattgctgctacatcaga

SEQ ID NO: 112218 - DNA, 25 bp, S. pombe
tacgttaagggttcgagagctgaca

SEQ ID NO: 112219 - DNA, 25 bp, S. pombe
taccaaacgtctttaggagagtaca

SEQ ID NO: 112220 - DNA, 25 bp, S. pombe
tactacggcgttttgaccaagtgcg

SEQ ID NO: 112221 - DNA, 25 bp, S. pombe
tactacgaccgttggctcaagtgga

SEQ ID NO: 112222 - DNA, 25 bp, S. pombe
tactcagtggtgctcagtccgatat

SEQ ID NO: 112223 - DNA, 25 bp, S. pombe
tactcagcggatttcttcttgtcat

SEQ ID NO: 112224 - DNA, 25 bp, S. pombe
tacaggagccagacttgctgcgggt

SEQ ID NO: 112225 - DNA, 25 bp, S. pombe
tactatgattagcactcctgtcggt

SEQ ID NO: 112226 - DNA, 25 bp, S. pombe
tatgctgctgggtagcaacagcgat

SEQ ID NO: 112227 - DNA, 25 bp, S. pombe
tactcttggatacagcagcgacgac

SEQ ID NO: 112228 - DNA, 25 bp, S. pombe
tacagtctatattgcatcctcctag

SEQ ID NO: 112229 - DNA, 25 bp, S. pombe
tacagttgcatgttgtgcctcacca

SEQ ID NO: 112230 - DNA, 25 bp, S. pombe
tacatgggctgcttactgtgccaaa

SEQ ID NO: 112231 - DNA, 25 bp, S. pombe
tacagtgcgcatctatcattccaaa

SEQ ID NO: 112232 - DNA, 25 bp, S. pombe
tacagtaacctttacacctggcatg

SEQ ID NO: 112233 - DNA, 25 bp, S. pombe
tacgtggttatatagcccggctttg

SEQ ID NO: 112234 - DNA, 25 bp, S. pombe
tacttagctggttttattctcgtca

SEQ ID NO: 112235 - DNA, 25 bp, S. pombe
tacttggccttaactaccgtagcaa

SEQ ID NO: 112236 - DNA, 25 bp, S. pombe
tacttgctcctttactacggacgaa

SEQ ID NO: 112237 - DNA, 25 bp, S. pombe
tactggattctctgcctacggtcag

SEQ ID NO: 112238 - DNA, 25 bp, S. pombe
taccattacttctatttcgaccact

SEQ ID NO: 112239 - DNA, 25 bp, S. pombe
tacttgtcttctttcgttatccact

SEQ ID NO: 112240 - DNA, 25 bp, S. pombe
tacttgctttcatgatcagcctcac

SEQ ID NO: 112241 - DNA, 25 bp, S. pombe
tactatgcatatgccttcaactcct

SEQ ID NO: 112242 - DNA, 25 bp, S. pombe
tacatagatgcatcttacctgcgcc

SEQ ID NO: 112243 - DNA, 25 bp, S. pombe
tatattggacaatgctactgccggt

SEQ ID NO: 112244 - DNA, 25 bp, S. pombe
tacgtccctgacgaaaccaagttgg

SEQ ID NO: 112245 - DNA, 25 bp, S. pombe
tactgtctcactacgaaaccactgg

SEQ ID NO: 112246 - DNA, 25 bp, S. pombe
tacgtttctcatagacggcgtcatg

SEQ ID NO: 112247 - DNA, 25 bp, S. pombe
tacgggatgggcttgttctacaaag

SEQ ID NO: 112248 - DNA, 25 bp, S. pombe
tacttcgccgagactatactgctaa

SEQ ID NO: 112249 - DNA, 25 bp, S. pombe
tacgacccaattctcagtaccagga

SEQ ID NO: 112250 - DNA, 25 bp, S. pombe
tacgacctccatatgcatttacttg

SEQ ID NO: 112251 - DNA, 25 bp, S. pombe
tacgacgcatcctcttattattgtg

SEQ ID NO: 112252 - DNA, 25 bp, S. pombe
tactattcctgctacctcattattt

SEQ ID NO: 112253 - DNA, 25 bp, S. pombe
tactttacttatcccgaacttgcag

SEQ ID NO: 112254 - DNA, 25 bp, S. pombe
tacctttcttatttatggacttcag

SEQ ID NO: 112255 - DNA, 25 bp, S. pombe
tactctatcttgtctatcgaggatt

SEQ ID NO: 112256 - DNA, 25 bp, S. pombe
tactcattctcccttccttttttgg

SEQ ID NO: 112257 - DNA, 25 bp, S. pombe
tactcaactcaccattttctatctt

SEQ ID NO: 112258 - DNA, 25 bp, S. pombe
tagctagcatccagcatttttccta

SEQ ID NO: 112259 - DNA, 25 bp, S. pombe
tagctacagccatcgttttattaag

SEQ ID NO: 112260 - DNA, 25 bp, S. pombe
tactccagctgccattgtcagtgaa

SEQ ID NO: 112261 - DNA, 25 bp, S. pombe
tactggattcacttggctgctgtca

SEQ ID NO: 112262 - DNA, 25 bp, S. pombe
tactgatgattcacgccgttttcac

SEQ ID NO: 112263 - DNA, 25 bp, S. pombe
tactgtgatacatgtccctgtctta

SEQ ID NO: 112264 - DNA, 25 bp, S. pombe
tacgtatctgattgcacttccctta

SEQ ID NO: 112265 - DNA, 25 bp, S. pombe
tactattgctatttttcccttacca

SEQ ID NO: 112266 - DNA, 25 bp, S. pombe
tactcaagtacttcttcaccttaca

SEQ ID NO: 112267 - DNA, 25 bp, S. pombe
tactcgaaatccgttatgcctgctg

SEQ ID NO: 112268 - DNA, 25 bp, S. pombe
tactcgtgatcccagatttgactct

SEQ ID NO: 112269 - DNA, 25 bp, S. pombe
tactgcggaggctatacttgactct

SEQ ID NO: 112270 - DNA, 25 bp, S. pombe
taccggcatggcaatacctcatttg

SEQ ID NO: 112271 - DNA, 25 bp, S. pombe
tacttcgctgaccattactcatgtt

SEQ ID NO: 112272 - DNA, 25 bp, S. pombe
tactaaggcctcttcatctgttcaa

SEQ ID NO: 112273 - DNA, 25 bp, S. pombe
tactaattccactcattctgctcaa

SEQ ID NO: 112274 - DNA, 25 bp, S. pombe
tacttttgtcgaaatctctgataac

SEQ ID NO: 112275 - DNA, 25 bp, S. pombe
taccgttggacctgaactactgcaa

SEQ ID NO: 112276 - DNA, 25 bp, S. pombe
ttcgcgtgcccgtagtggtttaaag

SEQ ID NO: 112277 - DNA, 25 bp, S. pombe
tactcgtgccgccaaggttttggaa

SEQ ID NO: 112278 - DNA, 25 bp, S. pombe
tactgacggtgctttgtatgcggtt

SEQ ID NO: 112279 - DNA, 25 bp, S. pombe
tactaaggtgctttctttcgttcgt

SEQ ID NO: 112280 - DNA, 25 bp, S. pombe
tactgttgggttccgtatggcttta

SEQ ID NO: 112281 - DNA, 25 bp, S. pombe
tacatttttgttgcagtagctttta

SEQ ID NO: 112282 - DNA, 25 bp, S. pombe
tactttgttggcagcgtacatcatg

SEQ ID NO: 112283 - DNA, 25 bp, S. pombe
tactttgcactccatggctgaacaa

SEQ ID NO: 112284 - DNA, 25 bp, S. pombe
tactttgtctcagccgcagcaagag

SEQ ID NO: 112285 - DNA, 25 bp, S. pombe
tactattcttagttcgcctgaaggg

SEQ ID NO: 112286 - DNA, 25 bp, S. pombe
tacatattctctggttccgatgata

SEQ ID NO: 112287 - DNA, 25 bp, S. pombe
tactggcgcataatctcgaacctat

SEQ ID NO: 112288 - DNA, 25 bp, S. pombe
tacttgttggacgaggatcctcttt

SEQ ID NO: 112289 - DNA, 25 bp, S. pombe
tactggagtcttttggaaatgcgca

SEQ ID NO: 112290 - DNA, 25 bp, S. pombe
tacctcttcgggtgcgtttagaagc

SEQ ID NO: 112291 - DNA, 25 bp, S. pombe
taccgcttcgggttgttcattggga

SEQ ID NO: 112292 - DNA, 25 bp, S. pombe
tactccttactgttggtggaaagca

SEQ ID NO: 112293 - DNA, 25 bp, S. pombe
tactgctccaagattgttgtaaaag

SEQ ID NO: 112294 - DNA, 25 bp, S. pombe
tactgctccaatttgcgtgttttga

SEQ ID NO: 112295 - DNA, 25 bp, S. pombe
tactgctcttgatctggctgtgaat

SEQ ID NO: 112296 - DNA, 25 bp, S. pombe
tacggagtctttaatggcagttctt

SEQ ID NO: 112297 - DNA, 25 bp, S. pombe
tacggtggtttagctcaacttctcg

SEQ ID NO: 112298 - DNA, 25 bp, S. pombe
tacgcgagcgtcaatcactgaacat

SEQ ID NO: 112299 - DNA, 25 bp, S. pombe
tacttgcgtgagtatttgcaccttc

SEQ ID NO: 112300 - DNA, 25 bp, S. pombe
tactaatcgttgtgtttctcctcag

SEQ ID NO: 112301 - DNA, 25 bp, S. pombe
tactaactctaatcttttgcgcttg

SEQ ID NO: 112302 - DNA, 25 bp, S. pombe
tatcgttcgtactagtcttggtcaa

SEQ ID NO: 112303 - DNA, 25 bp, S. pombe
tacgtttgtacatttgctggttgca

SEQ ID NO: 112304 - DNA, 25 bp, S. pombe
tactccgaggttttgtcgtttcaca

SEQ ID NO: 112305 - DNA, 25 bp, S. pombe
tactcggttttattgtcttcctcaa

SEQ ID NO: 112306 - DNA, 25 bp, S. pombe
taccggtcttgttggtttcttagat

SEQ ID NO: 112307 - DNA, 25 bp, S. pombe
tatccggaccgtatgtttgcttttg

SEQ ID NO: 112308 - DNA, 25 bp, S. pombe
tactaggactcctttgttttctggg

SEQ ID NO: 112309 - DNA, 25 bp, S. pombe
tactcagagacttcccttttatttg

SEQ ID NO: 112310 - DNA, 25 bp, S. pombe
tactcagcagacaacctcttttcaa

SEQ ID NO: 112311 - DNA, 25 bp, S. pombe
tactacatatcatctgccttttcaa

SEQ ID NO: 112312 - DNA, 25 bp, S. pombe
tacggcactgcaatgtcttcaggaa

SEQ ID NO: 112313 - DNA, 25 bp, S. pombe
tactacaatcggtttgccaatcatg

SEQ ID NO: 112314 - DNA, 25 bp, S. pombe
tacttgattttctttggcacgccta

SEQ ID NO: 112315 - DNA, 25 bp, S. pombe
tactatggccttttgggcattgcct

SEQ ID NO: 112316 - DNA, 25 bp, S. pombe
tactggtcgcatcaaggagcttgtt

SEQ ID NO: 112317 - DNA, 25 bp, S. pombe
tactggatccagcaaaccttgctag

SEQ ID NO: 112318 - DNA, 25 bp, S. pombe
tactgagataccatgcaattgctaa

SEQ ID NO: 112319 - DNA, 25 bp, S. pombe
tactgaagaagccactgtcgtcacc

SEQ ID NO: 112320 - DNA, 25 bp, S. pombe
tactgactattccacttcgcaagag

SEQ ID NO: 112321 - DNA, 25 bp, S. pombe
tactggccattctactgtcgaggat

SEQ ID NO: 112322 - DNA, 25 bp, S. pombe
tactgaacacactggatcggctgat

SEQ ID NO: 112323 - DNA, 25 bp, S. pombe
tacggctactgaattggctgtctgt

SEQ ID NO: 112324 - DNA, 25 bp, S. pombe
taggacccgtttggcatttttggat

SEQ ID NO: 112325 - DNA, 25 bp, S. pombe
tagtagccctgttaccttttcagaa

SEQ ID NO: 112326 - DNA, 25 bp, S. pombe
tactgatcttaaattccttcctggc

SEQ ID NO: 112327 - DNA, 25 bp, S. pombe
tactcacttattactatcttcccga

SEQ ID NO: 112328 - DNA, 25 bp, S. pombe
tactcatcctttgggactctacaaa

SEQ ID NO: 112329 - DNA, 25 bp, S. pombe
tactatcgctttctcaaccacaaat

SEQ ID NO: 112330 - DNA, 25 bp, S. pombe
tacttctggaggttgtgtcacccaa

SEQ ID NO: 112331 - DNA, 25 bp, S. pombe
tagctcttcagacttttgttcccaa

SEQ ID NO: 112332 - DNA, 25 bp, S. pombe
tacctatcaaatattggccggcaac

SEQ ID NO: 112333 - DNA, 25 bp, S. pombe
tacctgatagactttggacgtggca

SEQ ID NO: 112334 - DNA, 25 bp, S. pombe
tactgaacgcaaatacgtctcccag

SEQ ID NO: 112335 - DNA, 25 bp, S. pombe
tacgggttcatctacagtatcttgg

SEQ ID NO: 112336 - DNA, 25 bp, S. pombe
tacggagttatctagctacctggtg

SEQ ID NO: 112337 - DNA, 25 bp, S. pombe
tacgggctctactgcatactcggtg

SEQ ID NO: 112338 - DNA, 25 bp, S. pombe
tacggaccaccatgatgacacggtt

SEQ ID NO: 112339 - DNA, 25 bp, S. pombe
tacgagtctgacattaagccatggg

SEQ ID NO: 112340 - DNA, 25 bp, S. pombe
tacgaaggtttctgagccagctcct

SEQ ID NO: 112341 - DNA, 25 bp, S. pombe
tacgttgcatctaactggcgttcca

SEQ ID NO: 112342 - DNA, 25 bp, S. pombe
tactttggcgtattgcttgacagga

SEQ ID NO: 112343 - DNA, 25 bp, S. pombe
tacgttctggtcgtctggaccgaaa

SEQ ID NO: 112344 - DNA, 25 bp, S. pombe
tacgaagtagctccggaatccaaat

SEQ ID NO: 112345 - DNA, 25 bp, S. pombe
tacgctgggactcctggcaatatta

SEQ ID NO: 112346 - DNA, 25 bp, S. pombe
tacctggagctacccctgtaataga

SEQ ID NO: 112347 - DNA, 25 bp, S. pombe
tacttataccttgcttccgatgcta

SEQ ID NO: 112348 - DNA, 25 bp, S. pombe
tagctttcaagttaccatacacgag

SEQ ID NO: 112349 - DNA, 25 bp, S. pombe
tagaattcgttatgactggtcccaa

SEQ ID NO: 112350 - DNA, 25 bp, S. pombe
tagcgtaggcatatttctgccccag

SEQ ID NO: 112351 - DNA, 25 bp, S. pombe
tacgcagttatttacttggcaccag

SEQ ID NO: 112352 - DNA, 25 bp, S. pombe
taccgactattatcttgctttgcgt

SEQ ID NO: 112353 - DNA, 25 bp, S. pombe
tacccactggtatcactgttagcat

SEQ ID NO: 112354 - DNA, 25 bp, S. pombe
taccaagcgtaatcaccaggagact

SEQ ID NO: 112355 - DNA, 25 bp, S. pombe
taccacatcggaaactacggcgact

SEQ ID NO: 112356 - DNA, 25 bp, S. pombe
tacctacactgaacacgccaagcgt

SEQ ID NO: 112357 - DNA, 25 bp, S. pombe
tacgcaacctgacgacactattttc

SEQ ID NO: 112358 - DNA, 25 bp, S. pombe
tacgaactgtatctcactctttatg

SEQ ID NO: 112359 - DNA, 25 bp, S. pombe
tactaaagtctttcgccattttgaa

SEQ ID NO: 112360 - DNA, 25 bp, S. pombe
tacgacaagtctacactgttttatg

SEQ ID NO: 112361 - DNA, 25 bp, S. pombe
tagctactagcggttctcaaggtca

SEQ ID NO: 112362 - DNA, 25 bp, S. pombe
tactacgccgttgttatgcttacat

SEQ ID NO: 112363 - DNA, 25 bp, S. pombe
tactatgccatcgtaccttacagga

SEQ ID NO: 112364 - DNA, 25 bp, S. pombe
tactcccatggttaattcactcaga

SEQ ID NO: 112365 - DNA, 25 bp, S. pombe
tacccgtccctggttcaaagattgt

SEQ ID NO: 112366 - DNA, 25 bp, S. pombe
tactcgccgccctgttaaatatgag

SEQ ID NO: 112367 - DNA, 25 bp, S. pombe
tactcgccaggcatttacaattaag

SEQ ID NO: 112368 - DNA, 25 bp, S. pombe
tacggccgcgtctaaagaagaactg

SEQ ID NO: 112369 - DNA, 25 bp, S. pombe
tagcgattccgcatccaacgaaaag

SEQ ID NO: 112370 - DNA, 25 bp, S. pombe
tagcgatcttaaacctacgaatttt

SEQ ID NO: 112371 - DNA, 25 bp, S. pombe
tatccttttcaactacgggaggctt

SEQ ID NO: 112372 - DNA, 25 bp, S. pombe
tagttttgattggaccgtgcgtctc

SEQ ID NO: 112373 - DNA, 25 bp, S. pombe
tagtcttttaactcccttctttgat

SEQ ID NO: 112374 - DNA, 25 bp, S. pombe
taccttttcaaacctatttcgctgc

SEQ ID NO: 112375 - DNA, 25 bp, S. pombe
taccttttggttcccatattcgtgg

SEQ ID NO: 112376 - DNA, 25 bp, S. pombe
tacgagtatcttcaaggagcgacaa

SEQ ID NO: 112377 - DNA, 25 bp, S. pombe
tactgcttccatgtctggtgttgtt

SEQ ID NO: 112378 - DNA, 25 bp, S. pombe
taccccagcaactcacgatttaata

SEQ ID NO: 112379 - DNA, 25 bp, S. pombe
tactacgttgtctcgtctatgccaa

SEQ ID NO: 112380 - DNA, 25 bp, S. pombe
tactacctattctctggcttctaaa

SEQ ID NO: 112381 - DNA, 25 bp, S. pombe
tactcacgctattgacatctggtct

SEQ ID NO: 112382 - DNA, 25 bp, S. pombe
tactcccatctatattcctttactt

SEQ ID NO: 112383 - DNA, 25 bp, S. pombe
tactacactcctgattcactttcaa

SEQ ID NO: 112384 - DNA, 25 bp, S. pombe
taccaagccctcgtttcagttagaa

SEQ ID NO: 112385 - DNA, 25 bp, S. pombe
taccgtcttctggtaaacctagcca

SEQ ID NO: 112386 - DNA, 25 bp, S. pombe
taccgtttcttttattcatcttcct

SEQ ID NO: 112387 - DNA, 25 bp, S. pombe
tacctttcctttcttctcatttaag

SEQ ID NO: 112388 - DNA, 25 bp, S. pombe
taccgttccactatgtttttctaca

SEQ ID NO: 112389 - DNA, 25 bp, S. pombe
tacgccggtacgaagacagttttag

SEQ ID NO: 112390 - DNA, 25 bp, S. pombe
tacccggtcagcctacatttttgtt

SEQ ID NO: 112391 - DNA, 25 bp, S. pombe
tacccggattcttttttagtgtctg

SEQ ID NO: 112392 - DNA, 25 bp, S. pombe
tacctcgaccctttcttataatttg

SEQ ID NO: 112393 - DNA, 25 bp, S. pombe
tacctacaccctagtcgttaacaat

SEQ ID NO: 112394 - DNA, 25 bp, S. pombe
tacctactgggcgtgtcggacaaaa

SEQ ID NO: 112395 - DNA, 25 bp, S. pombe
tactcgggattgcatttcgtgaaat

SEQ ID NO: 112396 - DNA, 25 bp, S. pombe
tactccagatggttggttccgtact

SEQ ID NO: 112397 - DNA, 25 bp, S. pombe
tactccgagggacgttcctatacat

SEQ ID NO: 112398 - DNA, 25 bp, S. pombe
taccctggtggtctagcattaactc

SEQ ID NO: 112399 - DNA, 25 bp, S. pombe
tactctttgtttcctttctacagct

SEQ ID NO: 112400 - DNA, 25 bp, S. pombe
tactctcttttattctttttccctg

SEQ ID NO: 112401 - DNA, 25 bp, S. pombe
taccgccgttattttattctcgcca

SEQ ID NO: 112402 - DNA, 25 bp, S. pombe
taccggcctgtaaattattagctgc

SEQ ID NO: 112403 - DNA, 25 bp, S. pombe
tacccagtgttacagtatctcttcc

SEQ ID NO: 112404 - DNA, 25 bp, S. pombe
tactcattatgttttgcctaccttg

SEQ ID NO: 112405 - DNA, 25 bp, S. pombe
tactgccatttatttgcttcaactt

SEQ ID NO: 112406 - DNA, 25 bp, S. pombe
tacgtgctttagatgctgtgaaaca

SEQ ID NO: 112407 - DNA, 25 bp, S. pombe
tacggctttggcagcacatgaaatc

SEQ ID NO: 112408 - DNA, 25 bp, S. pombe
tacggctgtctcaggccaaaatgac

SEQ ID NO: 112409 - DNA, 25 bp, S. pombe
tacgctattttaatcccggaggtgc

SEQ ID NO: 112410 - DNA, 25 bp, S. pombe
taccgagaggatttctttgacaccc

SEQ ID NO: 112411 - DNA, 25 bp, S. pombe
taccgacggctttacttgacacaag

SEQ ID NO: 112412 - DNA, 25 bp, S. pombe
tactccactgcctcatagttgtgaa

SEQ ID NO: 112413 - DNA, 25 bp, S. pombe
tactccatctgcgttctttattcaa

SEQ ID NO: 112414 - DNA, 25 bp, S. pombe
tactcccttcgcatcaattacaaaa

SEQ ID NO: 112415 - DNA, 25 bp, S. pombe
tactcttttcaagtatactcccgct

SEQ ID NO: 112416 - DNA, 25 bp, S. pombe
tactcgcgttcaatatttccctcat

SEQ ID NO: 112417 - DNA, 25 bp, S. pombe
tacgcggaatcaatggccctagcat

SEQ ID NO: 112418 - DNA, 25 bp, S. pombe
tacgcaaagaacaaccgggcctccg

SEQ ID NO: 112419 - DNA, 25 bp, S. pombe
tacgatgatcgattgggacctacca

SEQ ID NO: 112420 - DNA, 25 bp, S. pombe
tactgctattgaggcccttcgtcgt

SEQ ID NO: 112421 - DNA, 25 bp, S. pombe
tactgccattgaagcccttcgccgt

SEQ ID NO: 112422 - DNA, 25 bp, S. pombe
tactcctttgttactacagctgcag

SEQ ID NO: 112423 - DNA, 25 bp, S. pombe
taccccgtatgtcttgcacattttg

SEQ ID NO: 112424 - DNA, 25 bp, S. pombe
tactgggtcaaccaagacgcaacct

SEQ ID NO: 112425 - DNA, 25 bp, S. pombe
tacctggattctctcaaacctattt

SEQ ID NO: 112426 - DNA, 25 bp, S. pombe
tatcgtgtttatcttccccaatttt

SEQ ID NO: 112427 - DNA, 25 bp, S. pombe
tagagatttgttcttcccaacttcc

SEQ ID NO: 112428 - DNA, 25 bp, S. pombe
tacgatcttattcacctgctagtca

SEQ ID NO: 112429 - DNA, 25 bp, S. pombe
tacgtgtttgctcactcatttgaaa

SEQ ID NO: 112430 - DNA, 25 bp, S. pombe
taccgagtccgaggcttctagaaat

SEQ ID NO: 112431 - DNA, 25 bp, S. pombe
tatcgggtatcggacttctctaaac

SEQ ID NO: 112432 - DNA, 25 bp, S. pombe
tactgattccttagtcgtgctcaat

SEQ ID NO: 112433 - DNA, 25 bp, S. pombe
tactgatttcggttgcctccagata

SEQ ID NO: 112434 - DNA, 25 bp, S. pombe
tactcttctgggtatgtctcacaac

SEQ ID NO: 112435 - DNA, 25 bp, S. pombe
tactgatactaatctctcccatatg

SEQ ID NO: 112436 - DNA, 25 bp, S. pombe
tagctctaactcgaataacctctct

SEQ ID NO: 112437 - DNA, 25 bp, S. pombe
tactgtaatcatccattcaatccta

SEQ ID NO: 112438 - DNA, 25 bp, S. pombe
tactgatgatatagcttgggacccc

SEQ ID NO: 112439 - DNA, 25 bp, S. pombe
tactgtatatcctcttgcaagcacg

SEQ ID NO: 112440 - DNA, 25 bp, S. pombe
tactgtttgtctgttgttctcgatg

SEQ ID NO: 112441 - DNA, 25 bp, S. pombe
tactgtctttctttacttatcggga

SEQ ID NO: 112442 - DNA, 25 bp, S. pombe
tacgtcttcgtactgatcctttttg

SEQ ID NO: 112443 - DNA, 25 bp, S. pombe
tacgtatctctgtggtccgacaagg

SEQ ID NO: 112444 - DNA, 25 bp, S. pombe
tacgtacacatttggacgcagaaat

SEQ ID NO: 112445 - DNA, 25 bp, S. pombe
tactgtacttgttcctgccatgaaa

SEQ ID NO: 112446 - DNA, 25 bp, S. pombe
tacggagtgtgttggctatgctaaa

SEQ ID NO: 112447 - DNA, 25 bp, S. pombe
tacggagtttctggcggtattcaat

SEQ ID NO: 112448 - DNA, 25 bp, S. pombe
tacggaatactcaggttcacaccat

SEQ ID NO: 112449 - DNA, 25 bp, S. pombe
tacggaatgagtctgttccacctct

SEQ ID NO: 112450 - DNA, 25 bp, S. pombe
taggcggacaggtgtatcctcagtc

SEQ ID NO: 112451 - DNA, 25 bp, S. pombe
tactccgccttggttatcatttcaa

SEQ ID NO: 112452 - DNA, 25 bp, S. pombe
tactgacgtttgatgattctttgca

SEQ ID NO: 112453 - DNA, 25 bp, S. pombe
tactggcttattttgattcttcgaa

SEQ ID NO: 112454 - DNA, 25 bp, S. pombe
tactgccgtgttttgtgtggtcaac

SEQ ID NO: 112455 - DNA, 25 bp, S. pombe
tactctcctgttttggattgccaca

SEQ ID NO: 112456 - DNA, 25 bp, S. pombe
tactgctattgctgatgctctgggt

SEQ ID NO: 112457 - DNA, 25 bp, S. pombe
tactgagcccaaagcatctgaggtt

SEQ ID NO: 112458 - DNA, 25 bp, S. pombe
tactgagcccatagagcctgcttct

SEQ ID NO: 112459 - DNA, 25 bp, S. pombe
tactggcaacaggagctggctctca

SEQ ID NO: 112460 - DNA, 25 bp, S. pombe
tagtcctgacaacgatgccttcata

SEQ ID NO: 112461 - DNA, 25 bp, S. pombe
tacgcctcacattgctatccttgat

SEQ ID NO: 112462 - DNA, 25 bp, S. pombe
tactgctatgcagtgtccaccttaa

SEQ ID NO: 112463 - DNA, 25 bp, S. pombe
tactcttcatgctatggccgctaaa

SEQ ID NO: 112464 - DNA, 25 bp, S. pombe
tactgcgatgtgcatggatcctaat

SEQ ID NO: 112465 - DNA, 25 bp, S. pombe
tacctccatactctacttgttttga

SEQ ID NO: 112466 - DNA, 25 bp, S. pombe
taccattatttccaacgttgaggag

SEQ ID NO: 112467 - DNA, 25 bp, S. pombe
tagcaatccgaaagcaacagccttc

SEQ ID NO: 112468 - DNA, 25 bp, S. pombe
tactgaccagacttgcaacaacttg

SEQ ID NO: 112469 - DNA, 25 bp, S. pombe
tagctcgaaggacaccagactactt

SEQ ID NO: 112470 - DNA, 25 bp, S. pombe
tacgccaaggaaaaggagcctccaa

SEQ ID NO: 112471 - DNA, 25 bp, S. pombe
taccgctgtcgaggaagtttcattt

SEQ ID NO: 112472 - DNA, 25 bp, S. pombe
tacccatggtttactgcgtatgctt

SEQ ID NO: 112473 - DNA, 25 bp, S. pombe
tacgcgatgccgaaactgctgttgt

SEQ ID NO: 112474 - DNA, 25 bp, S. pombe
tacgaggccgtttagctgttgctac

SEQ ID NO: 112475 - DNA, 25 bp, S. pombe
tactgctgaaaatacgtccgaccat

SEQ ID NO: 112476 - DNA, 25 bp, S. pombe
tacccgcacagttgtttatccgaag

SEQ ID NO: 112477 - DNA, 25 bp, S. pombe
tactccgccaaagttcgtcaagatc

SEQ ID NO: 112478 - DNA, 25 bp, S. pombe
taccatactcgacttgctacaacaa

SEQ ID NO: 112479 - DNA, 25 bp, S. pombe
tacgtatgcagccatgtttgcgaca

SEQ ID NO: 112480 - DNA, 25 bp, S. pombe
taccattgcgctcgtgattgtgccg

SEQ ID NO: 112481 - DNA, 25 bp, S. pombe
taccttgttcctggtgtcggtgaca

SEQ ID NO: 112482 - DNA, 25 bp, S. pombe
tagcggctgggaacttttcgggcaa

SEQ ID NO: 112483 - DNA, 25 bp, S. pombe
taccgcgggctcattttcaggtgaa

SEQ ID NO: 112484 - DNA, 25 bp, S. pombe
tacggtgcgtcgacttttgagctta

SEQ ID NO: 112485 - DNA, 25 bp, S. pombe
tactgttttattatatatttcatca

SEQ ID NO: 112486 - DNA, 25 bp, S. pombe
tactgtctacttaatttttcactaa

SEQ ID NO: 112487 - DNA, 25 bp, S. pombe
tactgtcaactttttcttggccatc

SEQ ID NO: 112488 - DNA, 25 bp, S. pombe
taggcctcgttacgtaccgaagcta

SEQ ID NO: 112489 - DNA, 25 bp, S. pombe
tacggctcgttcttcaactaacgta

SEQ ID NO: 112490 - DNA, 25 bp, S. pombe
tacgcgtaacttcttcgacaactta

SEQ ID NO: 112491 - DNA, 25 bp, S. pombe
tacgcgtcccttttaaatgaactat

SEQ ID NO: 112492 - DNA, 25 bp, S. pombe
tacctcctcgccagaaacaattgat

SEQ ID NO: 112493 - DNA, 25 bp, S. pombe
tacgctactacacaaatccacattt

SEQ ID NO: 112494 - DNA, 25 bp, S. pombe
tacgctggcggacacgatcctgaaa

SEQ ID NO: 112495 - DNA, 25 bp, S. pombe
tactggtgaggctttagctcttgaa

SEQ ID NO: 112496 - DNA, 25 bp, S. pombe
tactgaggaggatttttctgccaat

SEQ ID NO: 112497 - DNA, 25 bp, S. pombe
tacggagatggctcttcatacatga

SEQ ID NO: 112498 - DNA, 25 bp, S. pombe
tactggccgctatttctctgaaaac

SEQ ID NO: 112499 - DNA, 25 bp, S. pombe
tacgtcttcttttttggaaacgcag

SEQ ID NO: 112500 - DNA, 25 bp, S. pombe
tacgcttcctttttggagcttttca

SEQ ID NO: 112501 - DNA, 25 bp, S. pombe
tagccttctaccttggaacttttca

SEQ ID NO: 112502 - DNA, 25 bp, S. pombe
taggttctaccgatcaacgttacaa

SEQ ID NO: 112503 - DNA, 25 bp, S. pombe
tagaacacttccttttcgttcctca

SEQ ID NO: 112504 - DNA, 25 bp, S. pombe
taccagtcaccgtttttgttgttgt

SEQ ID NO: 112505 - DNA, 25 bp, S. pombe
taccattctctgctttgttttgttg

SEQ ID NO: 112506 - DNA, 25 bp, S. pombe
tactgcttctggcattgctgtatta

SEQ ID NO: 112507 - DNA, 25 bp, S. pombe
taccatttgccgtcgttgtggaaaa

SEQ ID NO: 112508 - DNA, 25 bp, S. pombe
tacctcttgctcacctggttgaaga

SEQ ID NO: 112509 - DNA, 25 bp, S. pombe
tacgctcgacttgaacgacttcagg

SEQ ID NO: 112510 - DNA, 25 bp, S. pombe
tatcccggcactttacgtgttaaat

SEQ ID NO: 112511 - DNA, 25 bp, S. pombe
taccaaaagcgagctgctgctgctg

SEQ ID NO: 112512 - DNA, 25 bp, S. pombe
taccgcctttgagagcattcctgag

SEQ ID NO: 112513 - DNA, 25 bp, S. pombe
taccgttactgggatgcttttagct

SEQ ID NO: 112514 - DNA, 25 bp, S. pombe
tactgcagccatttggaacacctca

SEQ ID NO: 112515 - DNA, 25 bp, S. pombe
tacgacccactcttgctgaatgaat

SEQ ID NO: 112516 - DNA, 25 bp, S. pombe
taccaagccgctaacttctcaaaag

SEQ ID NO: 112517 - DNA, 25 bp, S. pombe
taccatctgcagttgccttggcaat

SEQ ID NO: 112518 - DNA, 25 bp, S. pombe
tagtcatatgtttccgcagttcctt

SEQ ID NO: 112519 - DNA, 25 bp, S. pombe
tagcagccagtgtgccggagtcctt

SEQ ID NO: 112520 - DNA, 25 bp, S. pombe
tacggtcagtccaaggcagcaatca

SEQ ID NO: 112521 - DNA, 25 bp, S. pombe
tagcggcgcgtcgtgagcctgaaac

SEQ ID NO: 112522 - DNA, 25 bp, S. pombe
taggtacccgctacgccaaggatgg

SEQ ID NO: 112523 - DNA, 25 bp, S. pombe
tacgtacccgtcatcgcgaaatgaa

SEQ ID NO: 112524 - DNA, 25 bp, S. pombe
tactgatacagtgctcgcggtgtcc

SEQ ID NO: 112525 - DNA, 25 bp, S. pombe
tagtgattcggactcggattcctct

SEQ ID NO: 112526 - DNA, 25 bp, S. pombe
tagcgaacgaagaccgtgctcctga

SEQ ID NO: 112527 - DNA, 25 bp, S. pombe
tacctgccctacttttgctgagtat

SEQ ID NO: 112528 - DNA, 25 bp, S. pombe
tagcgctcccaaggactttgagttg

SEQ ID NO: 112529 - DNA, 25 bp, S. pombe
tacctcccaagtggctttacgagaa

SEQ ID NO: 112530 - DNA, 25 bp, S. pombe
tacgcttcgcactctggatttaaat

SEQ ID NO: 112531 - DNA, 25 bp, S. pombe
tacgcattgggcacgcgattttaat

SEQ ID NO: 112532 - DNA, 25 bp, S. pombe
tacgttggctcagtacttctgtgta

SEQ ID NO: 112533 - DNA, 25 bp, S. pombe
tacgttggttgttttcagttctagg

SEQ ID NO: 112534 - DNA, 25 bp, S. pombe
taccacgtttgttcattcagttcat

SEQ ID NO: 112535 - DNA, 25 bp, S. pombe
tacccagcctttacgacaattcgaa

SEQ ID NO: 112536 - DNA, 25 bp, S. pombe
tacctatcgtagtgttttagccaac

SEQ ID NO: 112537 - DNA, 25 bp, S. pombe
tagttatcttcatcgtgtcggtcgt

SEQ ID NO: 112538 - DNA, 25 bp, S. pombe
tagaatccttcgtactttccttaag

SEQ ID NO: 112539 - DNA, 25 bp, S. pombe
tagaaaactctatcctcgtcaatcg

SEQ ID NO: 112540 - DNA, 25 bp, S. pombe
tagataaacatttacccgtgcctcc

SEQ ID NO: 112541 - DNA, 25 bp, S. pombe
tagaagcgtattcgcctttaaccca

SEQ ID NO: 112542 - DNA, 25 bp, S. pombe
tagtagcgtttatctttgggaccaa

SEQ ID NO: 112543 - DNA, 25 bp, S. pombe
taccattgtgccaactagtcgaaca

SEQ ID NO: 112544 - DNA, 25 bp, S. pombe
taccaatgtggcaatcttcgtgaat

SEQ ID NO: 112545 - DNA, 25 bp, S. pombe
tacccagggctgttgatcgagccat

SEQ ID NO: 112546 - DNA, 25 bp, S. pombe
tacggtgcacgtattgctgccgaaa

SEQ ID NO: 112547 - DNA, 25 bp, S. pombe
tacgggtgcctactgaagacgcaaa

SEQ ID NO: 112548 - DNA, 25 bp, S. pombe
tacgcagaagactaacaatccgcat

SEQ ID NO: 112549 - DNA, 25 bp, S. pombe
tatcgtacaacgttgaatgttggag

SEQ ID NO: 112550 - DNA, 25 bp, S. pombe
tacgaaccatggtgaatgtggtgat

SEQ ID NO: 112551 - DNA, 25 bp, S. pombe
tacgacgtcgttcgatatgccgtga

SEQ ID NO: 112552 - DNA, 25 bp, S. pombe
tatcgacagttgctcagactcgtgt

SEQ ID NO: 112553 - DNA, 25 bp, S. pombe
tacgcttgtccgttatgcagctagt

SEQ ID NO: 112554 - DNA, 25 bp, S. pombe
taccaatttcgattagctccgcagt

SEQ ID NO: 112555 - DNA, 25 bp, S. pombe
taccgtactcagtatgccatctggt

SEQ ID NO: 112556 - DNA, 25 bp, S. pombe
taccaacctcttagacacttctatg

SEQ ID NO: 112557 - DNA, 25 bp, S. pombe
tacgtgttgcttatactcttctaaa

SEQ ID NO: 112558 - DNA, 25 bp, S. pombe
taccccttttaccattcgtgatgac

SEQ ID NO: 112559 - DNA, 25 bp, S. pombe
taccacccattttcaaatcgcttag

SEQ ID NO: 112560 - DNA, 25 bp, S. pombe
tacctgcattatttacaaccttgtg

SEQ ID NO: 112561 - DNA, 25 bp, S. pombe
tacctcctcagttgaaagcctttgt

SEQ ID NO: 112562 - DNA, 25 bp, S. pombe
tacgttgcaggaactgaacccgctt

SEQ ID NO: 112563 - DNA, 25 bp, S. pombe
tacgtggcatggtgatctatcccca

SEQ ID NO: 112564 - DNA, 25 bp, S. pombe
tacgctgacagcatggcatttccaa

SEQ ID NO: 112565 - DNA, 25 bp, S. pombe
tagtccagaacgtagctcctatagg

SEQ ID NO: 112566 - DNA, 25 bp, S. pombe
tacgacacaatgctcttaccttttg

SEQ ID NO: 112567 - DNA, 25 bp, S. pombe
tagccagccaatctggagaagcttt

SEQ ID NO: 112568 - DNA, 25 bp, S. pombe
tacccggttctggagcaatttcata

SEQ ID NO: 112569 - DNA, 25 bp, S. pombe
taccacttctgacggtcaatctcaa

SEQ ID NO: 112570 - DNA, 25 bp, S. pombe
tatcgcctactgtggtgcaaactac

SEQ ID NO: 112571 - DNA, 25 bp, S. pombe
tataccctggtcagcttgtagcagt

SEQ ID NO: 112572 - DNA, 25 bp, S. pombe
tatgaagctcaacaacccgatggaa

SEQ ID NO: 112573 - DNA, 25 bp, S. pombe
tatgcaacaaatgtccagtcccgct

SEQ ID NO: 112574 - DNA, 25 bp, S. pombe
tagattatttgcttacggaaccgga

SEQ ID NO: 112575 - DNA, 25 bp, S. pombe
tagcgaggaaacattcggcccactc

SEQ ID NO: 112576 - DNA, 25 bp, S. pombe
taggtggaaaccctcggatcgcaac

SEQ ID NO: 112577 - DNA, 25 bp, S. pombe
tagcgttgaaaaatccgtctccggt

SEQ ID NO: 112578 - DNA, 25 bp, S. pombe
tacgcgctaaaatcttatcctcggg

SEQ ID NO: 112579 - DNA, 25 bp, S. pombe
tacctccattgatccttccttaaaa

SEQ ID NO: 112580 - DNA, 25 bp, S. pombe
taccactcgactttctttgcggaaa

SEQ ID NO: 112581 - DNA, 25 bp, S. pombe
taccttagatctttcctcagagagt

SEQ ID NO: 112582 - DNA, 25 bp, S. pombe
tagccataaggtttcccgtgactat

SEQ ID NO: 112583 - DNA, 25 bp, S. pombe
tagccataacagtcttccgtattct

SEQ ID NO: 112584 - DNA, 25 bp, S. pombe
tacgcaaatcaagtttcagctcctc

SEQ ID NO: 112585 - DNA, 25 bp, S. pombe
tacgagattatcttttccatcagat

SEQ ID NO: 112586 - DNA, 25 bp, S. pombe
tacgagacactctttcattctggat

SEQ ID NO: 112587 - DNA, 25 bp, S. pombe
tagcggtaccagacctttgttattt

SEQ ID NO: 112588 - DNA, 25 bp, S. pombe
tacgtgctatccattctgctacttt

SEQ ID NO: 112589 - DNA, 25 bp, S. pombe
taccacctttggtatctccatgatg

SEQ ID NO: 112590 - DNA, 25 bp, S. pombe
tacccctcaatcaccacaaataaat

SEQ ID NO: 112591 - DNA, 25 bp, S. pombe
tagctctcctagtcccgaaaatcaa

SEQ ID NO: 112592 - DNA, 25 bp, S. pombe
tagtgacacgagctggaaccaaccc

SEQ ID NO: 112593 - DNA, 25 bp, S. pombe
taggttttggtgtaactgctcgctc

SEQ ID NO: 112594 - DNA, 25 bp, S. pombe
tagttttgacaaaagggccaatctg

SEQ ID NO: 112595 - DNA, 25 bp, S. pombe
tatcgttttagctccagtccaagaa

SEQ ID NO: 112596 - DNA, 25 bp, S. pombe
tacgttttgagagccatgttgcccc

SEQ ID NO: 112597 - DNA, 25 bp, S. pombe
tacgcttttgaacccatgattctgc

SEQ ID NO: 112598 - DNA, 25 bp, S. pombe
tagccctttggtcgcggagtctaca

SEQ ID NO: 112599 - DNA, 25 bp, S. pombe
tacgctcctcttgttcatggtgaaa

SEQ ID NO: 112600 - DNA, 25 bp, S. pombe
tacgctttgcgtgatttcgatcaga

SEQ ID NO: 112601 - DNA, 25 bp, S. pombe
taccttcacgcgttgcttgagtaga

SEQ ID NO: 112602 - DNA, 25 bp, S. pombe
taccaggaccacctcatgaagtgtt

SEQ ID NO: 112603 - DNA, 25 bp, S. pombe
tagcaagcgctttctttgggttttc

SEQ ID NO: 112604 - DNA, 25 bp, S. pombe
tagccccttcatgattggttctctt

SEQ ID NO: 112605 - DNA, 25 bp, S. pombe
tacccgttcctgaatgtgttccctt

SEQ ID NO: 112606 - DNA, 25 bp, S. pombe
tacgttgtctagtcttcgatcttca

SEQ ID NO: 112607 - DNA, 25 bp, S. pombe
tacgttgtcgacattgtgtgttatg

SEQ ID NO: 112608 - DNA, 25 bp, S. pombe
ttggtcgtttggtgtcatgtttgct

SEQ ID NO: 112609 - DNA, 25 bp, S. pombe
tagccctgtttacccttatgactta

SEQ ID NO: 112610 - DNA, 25 bp, S. pombe
tagccgttggtctcagtcttaatat

SEQ ID NO: 112611 - DNA, 25 bp, S. pombe
taccgaatggcccttcgttctattt

SEQ ID NO: 112612 - DNA, 25 bp, S. pombe
taccggtaccgttgtatggcgaata

SEQ ID NO: 112613 - DNA, 25 bp, S. pombe
tacccgttcctgacgataggccaaa

SEQ ID NO: 112614 - DNA, 25 bp, S. pombe
tacccgctttttcatctggtcaaga

SEQ ID NO: 112615 - DNA, 25 bp, S. pombe
tacccgtcttgccaatgatgccaaa

SEQ ID NO: 112616 - DNA, 25 bp, S. pombe
taccaagatttccagatgacccaaa

SEQ ID NO: 112617 - DNA, 25 bp, S. pombe
taccaccattgagggttcagccaaa

SEQ ID NO: 112618 - DNA, 25 bp, S. pombe
taccacgatgtactcagcttactac

SEQ ID NO: 112619 - DNA, 25 bp, S. pombe
tagccgcaggtacgaatgtcactac

SEQ ID NO: 112620 - DNA, 25 bp, S. pombe
tagccgggctttaatgggaacctca

SEQ ID NO: 112621 - DNA, 25 bp, S. pombe
taccgtggctttgtttctgcttcaa

SEQ ID NO: 112622 - DNA, 25 bp, S. pombe
taccaagcagtcattgttacgttct

SEQ ID NO: 112623 - DNA, 25 bp, S. pombe
taccaagtgcctttcggacagttta

SEQ ID NO: 112624 - DNA, 25 bp, S. pombe
taccgctttttggaactgattactt

SEQ ID NO: 112625 - DNA, 25 bp, S. pombe
taccgtttattgtacgcaacccatc

SEQ ID NO: 112626 - DNA, 25 bp, S. pombe
taccgtttcatcatcccaagcaaat

SEQ ID NO: 112627 - DNA, 25 bp, S. pombe
taccgtctgactttgcgtatcgaga

SEQ ID NO: 112628 - DNA, 25 bp, S. pombe
tacgtttaacacacatacccactgg

SEQ ID NO: 112629 - DNA, 25 bp, S. pombe
tacctattcaaaatgttcccgcacg

SEQ ID NO: 112630 - DNA, 25 bp, S. pombe
tatctccaaacatatttccctcatc

SEQ ID NO: 112631 - DNA, 25 bp, S. pombe
tacgctgagatatacttcccttgtc

SEQ ID NO: 112632 - DNA, 25 bp, S. pombe
tagctggtagtctaacacttcccga

SEQ ID NO: 112633 - DNA, 25 bp, S. pombe
tagggctagtatgtcgcttgcaggc

SEQ ID NO: 112634 - DNA, 25 bp, S. pombe
tacgccgtacttttgtttgacgaat

SEQ ID NO: 112635 - DNA, 25 bp, S. pombe
tacgcacgttttatgcctctactga

SEQ ID NO: 112636 - DNA, 25 bp, S. pombe
tacgaccatttatttccccgatgaa

SEQ ID NO: 112637 - DNA, 25 bp, S. pombe
tatcccctgattctgaagcactagt

SEQ ID NO: 112638 - DNA, 25 bp, S. pombe
tacccaccattgataccatctgagg

SEQ ID NO: 112639 - DNA, 25 bp, S. pombe
tagcgtcccacgattagcacaatgg

SEQ ID NO: 112640 - DNA, 25 bp, S. pombe
tacgcattatttaagcaagccactg

SEQ ID NO: 112641 - DNA, 25 bp, S. pombe
tagcgaatttaacccgccaatctga

SEQ ID NO: 112642 - DNA, 25 bp, S. pombe
tacgagcctatcttggtcgctggtg

SEQ ID NO: 112643 - DNA, 25 bp, S. pombe
tacgagccttcgtcgtctgaagaga

SEQ ID NO: 112644 - DNA, 25 bp, S. pombe
tacctttatatactgcatttcgcga

SEQ ID NO: 112645 - DNA, 25 bp, S. pombe
tagttcttaatagcgctgctgccga

SEQ ID NO: 112646 - DNA, 25 bp, S. pombe
tacgaagtggtactcttgctccatc

SEQ ID NO: 112647 - DNA, 25 bp, S. pombe
tatcgtagatcccacaattgcacca

SEQ ID NO: 112648 - DNA, 25 bp, S. pombe
tatcgacgtctcaaagatggcactt

SEQ ID NO: 112649 - DNA, 25 bp, S. pombe
tacccagccatgaagcgtatcactt

SEQ ID NO: 112650 - DNA, 25 bp, S. pombe
tagttgttttagcttttacccagat

SEQ ID NO: 112651 - DNA, 25 bp, S. pombe
tagcaatttttctgtttacacccgt

SEQ ID NO: 112652 - DNA, 25 bp, S. pombe
tagctattttgtcgtttaaaccgcg

SEQ ID NO: 112653 - DNA, 25 bp, S. pombe
tagctatttattccgttgaaaccag

SEQ ID NO: 112654 - DNA, 25 bp, S. pombe
tagcttctgttacacttaaactaaa

SEQ ID NO: 112655 - DNA, 25 bp, S. pombe
tacgcattaaactatacggatccta

SEQ ID NO: 112656 - DNA, 25 bp, S. pombe
tacgatgtctacaagctggccagat

SEQ ID NO: 112657 - DNA, 25 bp, S. pombe
tagccgtgctacagctgcagtcgta

SEQ ID NO: 112658 - DNA, 25 bp, S. pombe
tatcggtgtagcagctgccggacaa

SEQ ID NO: 112659 - DNA, 25 bp, S. pombe
tacctggcattgtatcgtaggcaga

SEQ ID NO: 112660 - DNA, 25 bp, S. pombe
tagcgcgagctttacgggacaataa

SEQ ID NO: 112661 - DNA, 25 bp, S. pombe
tagcaagggaccaatcaccaccgat

SEQ ID NO: 112662 - DNA, 25 bp, S. pombe
taccagcgctgcatataaccccaat

SEQ ID NO: 112663 - DNA, 25 bp, S. pombe
tacctctcatctttataactactcc

SEQ ID NO: 112664 - DNA, 25 bp, S. pombe
tagagtgctatttcagaacccctcc

SEQ ID NO: 112665 - DNA, 25 bp, S. pombe
tagagactatgaactcccaccgctt

SEQ ID NO: 112666 - DNA, 25 bp, S. pombe
tagcattcgtggagatctcatcccg

SEQ ID NO: 112667 - DNA, 25 bp, S. pombe
tacgctcttgtacgcatttactcgt

SEQ ID NO: 112668 - DNA, 25 bp, S. pombe
tagctattcttctgctttagagcgt

SEQ ID NO: 112669 - DNA, 25 bp, S. pombe
tagcttccctcttgctgataagtgg

SEQ ID NO: 112670 - DNA, 25 bp, S. pombe
tagttgcacgtcatccattagcatt

SEQ ID NO: 112671 - DNA, 25 bp, S. pombe
tagctgctgaccaagctgttagcat

SEQ ID NO: 112672 - DNA, 25 bp, S. pombe
tacgcaggatgcttcttcatgtttt

SEQ ID NO: 112673 - DNA, 25 bp, S. pombe
tacccagtcaatttgtgatctcgca

SEQ ID NO: 112674 - DNA, 25 bp, S. pombe
tatgtgtgccggtgttgtaactaat

SEQ ID NO: 112675 - DNA, 25 bp, S. pombe
tagccccggcggtttacagcaaatt

SEQ ID NO: 112676 - DNA, 25 bp, S. pombe
taccccagctagtgtttgttcagaa

SEQ ID NO: 112677 - DNA, 25 bp, S. pombe
taccccgtgctgacggattggtaga

SEQ ID NO: 112678 - DNA, 25 bp, S. pombe
taccgtcctcgtcgtgatggtgagc

SEQ ID NO: 112679 - DNA, 25 bp, S. pombe
tagctcaacaccttggactgactga

SEQ ID NO: 112680 - DNA, 25 bp, S. pombe
tagctcgcgtcagcaggatcaatgc

SEQ ID NO: 112681 - DNA, 25 bp, S. pombe
tagccagcctgcaccatatatgaaa

SEQ ID NO: 112682 - DNA, 25 bp, S. pombe
tacctgctactgctcaagttgctaa

SEQ ID NO: 112683 - DNA, 25 bp, S. pombe
ttgacttttgttgactatgctaagc

SEQ ID NO: 112684 - DNA, 25 bp, S. pombe
ttggtccttggtcacctgtaagtat

SEQ ID NO: 112685 - DNA, 25 bp, S. pombe
taggtcctactcctgagcgattcac

SEQ ID NO: 112686 - DNA, 25 bp, S. pombe
tagctgttgctattcgtgattggga

SEQ ID NO: 112687 - DNA, 25 bp, S. pombe
taccactgtcaatatttagggcaaa

SEQ ID NO: 112688 - DNA, 25 bp, S. pombe
taccaccaaacccaaagtatccaag

SEQ ID NO: 112689 - DNA, 25 bp, S. pombe
taccccataccccatgaggatttaa

SEQ ID NO: 112690 - DNA, 25 bp, S. pombe
taccgaagaggatctggagctgatt

SEQ ID NO: 112691 - DNA, 25 bp, S. pombe
taccgctcagcgcaacttcaagaaa

SEQ ID NO: 112692 - DNA, 25 bp, S. pombe
tacgcgcttggcaagacgtcgcaga

SEQ ID NO: 112693 - DNA, 25 bp, S. pombe
tacctttgggatgctgctcatgcaa

SEQ ID NO: 112694 - DNA, 25 bp, S. pombe
taccgcattggtcagcttgtggata

SEQ ID NO: 112695 - DNA, 25 bp, S. pombe
tagccaggcggttcttattcatcag

SEQ ID NO: 112696 - DNA, 25 bp, S. pombe
tagctgagatcatgtcaccgctgac

SEQ ID NO: 112697 - DNA, 25 bp, S. pombe
ttcggtagaaccagagctctcagaa

SEQ ID NO: 112698 - DNA, 25 bp, S. pombe
tacgctggcactaacattgatcttg

SEQ ID NO: 112699 - DNA, 25 bp, S. pombe
tacctgccatttcctctgatattga

SEQ ID NO: 112700 - DNA, 25 bp, S. pombe
tagccatccttctgctccaaataaa

SEQ ID NO: 112701 - DNA, 25 bp, S. pombe
taccaacgcatctgctacggagcaa

SEQ ID NO: 112702 - DNA, 25 bp, S. pombe
tacctggtgctcctgtaatgccaaa

SEQ ID NO: 112703 - DNA, 25 bp, S. pombe
taccttttccttgcatgctcagatg

SEQ ID NO: 112704 - DNA, 25 bp, S. pombe
tagcctcaattcctttactcgttaa

SEQ ID NO: 112705 - DNA, 25 bp, S. pombe
taccgcatatacctatttcacttcg

SEQ ID NO: 112706 - DNA, 25 bp, S. pombe
taccctagcagccatacttactatg

SEQ ID NO: 112707 - DNA, 25 bp, S. pombe
taccctatcctatcactacttgttt

SEQ ID NO: 112708 - DNA, 25 bp, S. pombe
tacctcttgggttttgtggcttgat

SEQ ID NO: 112709 - DNA, 25 bp, S. pombe
tagactcttttgcttttcgtttact

SEQ ID NO: 112710 - DNA, 25 bp, S. pombe
tagcattcttttctctcttcatgtc

SEQ ID NO: 112711 - DNA, 25 bp, S. pombe
tagtgttcgtgaatggcgttctaac

SEQ ID NO: 112712 - DNA, 25 bp, S. pombe
tagcgacgctgtttcgtttatcacc

SEQ ID NO: 112713 - DNA, 25 bp, S. pombe
tagccatcggtaggcttttaagccc

SEQ ID NO: 112714 - DNA, 25 bp, S. pombe
taccagctccacttttgttaaaccg

SEQ ID NO: 112715 - DNA, 25 bp, S. pombe
tagccactgccatttttggtcaaac

SEQ ID NO: 112716 - DNA, 25 bp, S. pombe
tagcttcccagagtatcatggcgcc

SEQ ID NO: 112717 - DNA, 25 bp, S. pombe
taccgacatctactacaacagcttt

SEQ ID NO: 112718 - DNA, 25 bp, S. pombe
tatccgtcctggcaataagctgttt

SEQ ID NO: 112719 - DNA, 25 bp, S. pombe
tatcctgaacggtgtacgtcttctg

SEQ ID NO: 112720 - DNA, 25 bp, S. pombe
tacctcaacggtcgcaatcttttta

SEQ ID NO: 112721 - DNA, 25 bp, S. pombe
tagctcgtaggttgcgggttaattc

SEQ ID NO: 112722 - DNA, 25 bp, S. pombe
tatactatgggcatccagaccgctt

SEQ ID NO: 112723 - DNA, 25 bp, S. pombe
tagactctgggccactgaaactgtc

SEQ ID NO: 112724 - DNA, 25 bp, S. pombe
tatagtggccatttttaaccctagc

SEQ ID NO: 112725 - DNA, 25 bp, S. pombe
taggtttagtctatgcaactcccgc

SEQ ID NO: 112726 - DNA, 25 bp, S. pombe
tagtgtgttccgtaattggcccacc

SEQ ID NO: 112727 - DNA, 25 bp, S. pombe
taggcttcttcgtagtggttcccaa

SEQ ID NO: 112728 - DNA, 25 bp, S. pombe
tagggtctttgatattttgctcaga

SEQ ID NO: 112729 - DNA, 25 bp, S. pombe
tagttctgttaattccttatcccct

SEQ ID NO: 112730 - DNA, 25 bp, S. pombe
taccctgtgaatcgctcatctttat

SEQ ID NO: 112731 - DNA, 25 bp, S. pombe
taccgctggcattcgtactttagac

SEQ ID NO: 112732 - DNA, 25 bp, S. pombe
taccgctgcagttgctttctttaga

SEQ ID NO: 112733 - DNA, 25 bp, S. pombe
tacccgagtcacactttcaatgagc

SEQ ID NO: 112734 - DNA, 25 bp, S. pombe
tacccttattgctggattcgacgtt

SEQ ID NO: 112735 - DNA, 25 bp, S. pombe
tagcgcttgtatgcacggattcgaa

SEQ ID NO: 112736 - DNA, 25 bp, S. pombe
taccttctaccctcactggaaaaga

SEQ ID NO: 112737 - DNA, 25 bp, S. pombe
tagccctgctacaccaactggtaaa

SEQ ID NO: 112738 - DNA, 25 bp, S. pombe
taccgctacacaaccggctgttaaa

SEQ ID NO: 112739 - DNA, 25 bp, S. pombe
taccgctcgcaaaactgatcatgtc

SEQ ID NO: 112740 - DNA, 25 bp, S. pombe
tagcagctcaatgtgcgcatgcagc

SEQ ID NO: 112741 - DNA, 25 bp, S. pombe
tagcagtcatccatcagcagctgat

SEQ ID NO: 112742 - DNA, 25 bp, S. pombe
tagcctgtgatattgcgaatgttcc

SEQ ID NO: 112743 - DNA, 25 bp, S. pombe
tagccagtcatcagcagaagtccat

SEQ ID NO: 112744 - DNA, 25 bp, S. pombe
taccgccagcacaagagagtctatt

SEQ ID NO: 112745 - DNA, 25 bp, S. pombe
tacctgtcagcaaaagtgtccctac

SEQ ID NO: 112746 - DNA, 25 bp, S. pombe
taccattccaatcactgttcgtcaa

SEQ ID NO: 112747 - DNA, 25 bp, S. pombe
tacctcctgagacatctggtcgaaa

SEQ ID NO: 112748 - DNA, 25 bp, S. pombe
taccttcggatatgcggtggatgaa

SEQ ID NO: 112749 - DNA, 25 bp, S. pombe
tacctcgcgtgccttggatgaaatg

SEQ ID NO: 112750 - DNA, 25 bp, S. pombe
taccccagtgccttgtaaaattact

SEQ ID NO: 112751 - DNA, 25 bp, S. pombe
tagccacaggctccactgatagagt

SEQ ID NO: 112752 - DNA, 25 bp, S. pombe
tagcagtatgtatgccggtcttcct

SEQ ID NO: 112753 - DNA, 25 bp, S. pombe
tagctgtgacactaccaatcctaac

SEQ ID NO: 112754 - DNA, 25 bp, S. pombe
tagcgatgaccatgcgaatgccaaa

SEQ ID NO: 112755 - DNA, 25 bp, S. pombe
tagcggatcaacgagcaagcctgga

SEQ ID NO: 112756 - DNA, 25 bp, S. pombe
tataggtaacgttgacgctttgtca

SEQ ID NO: 112757 - DNA, 25 bp, S. pombe
tagaggcttctattaaggcgaacct

SEQ ID NO: 112758 - DNA, 25 bp, S. pombe
tagcgattctgggtcagcttctgat

SEQ ID NO: 112759 - DNA, 25 bp, S. pombe
tagacgaatatcctcccgatgcaaa

SEQ ID NO: 112760 - DNA, 25 bp, S. pombe
tatgaagaatcatctcctctggagt

SEQ ID NO: 112761 - DNA, 25 bp, S. pombe
tagcagcccctattacttttggaag

SEQ ID NO: 112762 - DNA, 25 bp, S. pombe
tagcgcctctcaaatactctttatt

SEQ ID NO: 112763 - DNA, 25 bp, S. pombe
taccactgcttcagcggtgtcatct

SEQ ID NO: 112764 - DNA, 25 bp, S. pombe
taccattgccctacggatgtacagt

SEQ ID NO: 112765 - DNA, 25 bp, S. pombe
tacctatgaccaatactttccgttc

SEQ ID NO: 112766 - DNA, 25 bp, S. pombe
tagcggagaccaaaccttacacttt

SEQ ID NO: 112767 - DNA, 25 bp, S. pombe
tagcaaccctattaactcaaccttt

SEQ ID NO: 112768 - DNA, 25 bp, S. pombe
tacctccttcttctaatgacacgaa

SEQ ID NO: 112769 - DNA, 25 bp, S. pombe
tttcgtcggcttttaattacttcag

SEQ ID NO: 112770 - DNA, 25 bp, S. pombe
tagccggcagtgttcttcgtggtca

SEQ ID NO: 112771 - DNA, 25 bp, S. pombe
tagccgtccagcattaatttccaac

SEQ ID NO: 112772 - DNA, 25 bp, S. pombe
tagtttgcgcgagtttttgcggttt

SEQ ID NO: 112773 - DNA, 25 bp, S. pombe
tagatttgcaggtttaccggccgtc

SEQ ID NO: 112774 - DNA, 25 bp, S. pombe
tagatttgatcgtgagcccgaccgt

SEQ ID NO: 112775 - DNA, 25 bp, S. pombe
tagaagttcaaccaggcctgtccgt

SEQ ID NO: 112776 - DNA, 25 bp, S. pombe
tagtagttctactgccacttcgtct

SEQ ID NO: 112777 - DNA, 25 bp, S. pombe
tagttctcccaggtgttactatcgg

SEQ ID NO: 112778 - DNA, 25 bp, S. pombe
tagcttccccagacgttaatgattc

SEQ ID NO: 112779 - DNA, 25 bp, S. pombe
tagagtaatccaagccaagcatcct

SEQ ID NO: 112780 - DNA, 25 bp, S. pombe
tagaaatatctacccaggctatgga

SEQ ID NO: 112781 - DNA, 25 bp, S. pombe
tagcgataccgatccaacattggca

SEQ ID NO: 112782 - DNA, 25 bp, S. pombe
tagacacttcgcaacaaccgacagt

SEQ ID NO: 112783 - DNA, 25 bp, S. pombe
tagaccgtctgcgaactcacagaat

SEQ ID NO: 112784 - DNA, 25 bp, S. pombe
tagctacccttctttaacttgtcaa

SEQ ID NO: 112785 - DNA, 25 bp, S. pombe
tagtactacgtctagccaaccttat

SEQ ID NO: 112786 - DNA, 25 bp, S. pombe
tagccgtacttgtgctcccaagtat

SEQ ID NO: 112787 - DNA, 25 bp, S. pombe
tagcccattcttttatcccgattct

SEQ ID NO: 112788 - DNA, 25 bp, S. pombe
tagcacctagttttgcaggaccgtt

SEQ ID NO: 112789 - DNA, 25 bp, S. pombe
tagctcaggcgttggactcgtacaa

SEQ ID NO: 112790 - DNA, 25 bp, S. pombe
tagcgaagcgtgctgaccctgaaat

SEQ ID NO: 112791 - DNA, 25 bp, S. pombe
taccagattgtgctggaccgacaat

SEQ ID NO: 112792 - DNA, 25 bp, S. pombe
tagacaatctttttggccgaccatt

SEQ ID NO: 112793 - DNA, 25 bp, S. pombe
taccaattatatatcccgcactctt

SEQ ID NO: 112794 - DNA, 25 bp, S. pombe
tagcccaatagctgcattttcaagt

SEQ ID NO: 112795 - DNA, 25 bp, S. pombe
tagaacgcccgatgctgacgcaaaa

SEQ ID NO: 112796 - DNA, 25 bp, S. pombe
tagattatgactgccttgacgccaa

SEQ ID NO: 112797 - DNA, 25 bp, S. pombe
tagctggagaatcctcttacggctc

SEQ ID NO: 112798 - DNA, 25 bp, S. pombe
tatgctgggcttcctaataccggtc

SEQ ID NO: 112799 - DNA, 25 bp, S. pombe
tagcccactttcaaaagccgcttca

SEQ ID NO: 112800 - DNA, 25 bp, S. pombe
tagccctaatttcggacctgctata

SEQ ID NO: 112801 - DNA, 25 bp, S. pombe
tagatcaccctaatcgtaacgccaa

SEQ ID NO: 112802 - DNA, 25 bp, S. pombe
tagaactcctgttttagacgctggg

SEQ ID NO: 112803 - DNA, 25 bp, S. pombe
taccggcatgccacttgacaataaa

SEQ ID NO: 112804 - DNA, 25 bp, S. pombe
tagagccactcctgacattaaagaa

SEQ ID NO: 112805 - DNA, 25 bp, S. pombe
ttacctttcacgtcctcaagcataa

SEQ ID NO: 112806 - DNA, 25 bp, S. pombe
tagctcgattccgtctttatggcaa

SEQ ID NO: 112807 - DNA, 25 bp, S. pombe
tagctcgtcaccgtcttgtgaatca

SEQ ID NO: 112808 - DNA, 25 bp, S. pombe
tagagcgcgaagtcttggtcaccga

SEQ ID NO: 112809 - DNA, 25 bp, S. pombe
tagcttggatggtcttgttaacgat

SEQ ID NO: 112810 - DNA, 25 bp, S. pombe
tacctgctggatttggttcaccgat

SEQ ID NO: 112811 - DNA, 25 bp, S. pombe
tagacatataatttttcacaacgat

SEQ ID NO: 112812 - DNA, 25 bp, S. pombe
tagattgtacactttcccaacggat

SEQ ID NO: 112813 - DNA, 25 bp, S. pombe
tattgcctccggtcctggtaaggaa

SEQ ID NO: 112814 - DNA, 25 bp, S. pombe
taggcctcccgtacaggttgaaaca

SEQ ID NO: 112815 - DNA, 25 bp, S. pombe
tatggcgaaggcacccgaacagttt

SEQ ID NO: 112816 - DNA, 25 bp, S. pombe
tagagaaaagctctccggccatttt

SEQ ID NO: 112817 - DNA, 25 bp, S. pombe
tagaaaaccttgcatccgccgtatt

SEQ ID NO: 112818 - DNA, 25 bp, S. pombe
taccttactttgttcttgcttgcat

SEQ ID NO: 112819 - DNA, 25 bp, S. pombe
tagcaattactactggtcttttccc

SEQ ID NO: 112820 - DNA, 25 bp, S. pombe
tagaagcagcaccagcagcggtcat

SEQ ID NO: 112821 - DNA, 25 bp, S. pombe
tagacctcgtaactcacgcattggt

SEQ ID NO: 112822 - DNA, 25 bp, S. pombe
tagagaatcaactagcggctgcaaa

SEQ ID NO: 112823 - DNA, 25 bp, S. pombe
tagtcatctatggtggcaggtcgca

SEQ ID NO: 112824 - DNA, 25 bp, S. pombe
tagaggattaactccccgtcgacct

SEQ ID NO: 112825 - DNA, 25 bp, S. pombe
taggagaatcgatgttcctcggccc

SEQ ID NO: 112826 - DNA, 25 bp, S. pombe
tagaataccttcattcacgcggcat

SEQ ID NO: 112827 - DNA, 25 bp, S. pombe
taggaactcctctcagtgtaggcag

SEQ ID NO: 112828 - DNA, 25 bp, S. pombe
tagtgaacttcacccagcagtactg

SEQ ID NO: 112829 - DNA, 25 bp, S. pombe
tagagcaacaaccaagccgtagatg

SEQ ID NO: 112830 - DNA, 25 bp, S. pombe
tatgcagcatggtccaaacggaaat

SEQ ID NO: 112831 - DNA, 25 bp, S. pombe
tagccacgactaattcagcagcaaa

SEQ ID NO: 112832 - DNA, 25 bp, S. pombe
tagttcgactaacgcagagccacca

SEQ ID NO: 112833 - DNA, 25 bp, S. pombe
ttcgcaagtatgctcttaaggccta

SEQ ID NO: 112834 - DNA, 25 bp, S. pombe
tagagcctttgccttcattggaagc

SEQ ID NO: 112835 - DNA, 25 bp, S. pombe
tacctcatttggttgagttaagcga

SEQ ID NO: 112836 - DNA, 25 bp, S. pombe
taccaattgggctcatgcttaccag

SEQ ID NO: 112837 - DNA, 25 bp, S. pombe
tagccattagacgtgccttgaacca

SEQ ID NO: 112838 - DNA, 25 bp, S. pombe
tagatgttataaactcccacccgga

SEQ ID NO: 112839 - DNA, 25 bp, S. pombe
tagctgcttctattatatctgtcga

SEQ ID NO: 112840 - DNA, 25 bp, S. pombe
tagctgctcttctcaattctggaaa

SEQ ID NO: 112841 - DNA, 25 bp, S. pombe
tagcctgctatttcgtattcctgta

SEQ ID NO: 112842 - DNA, 25 bp, S. pombe
tagccctattcaggtcttagcagat

SEQ ID NO: 112843 - DNA, 25 bp, S. pombe
tagcccttgtctttgctctacataa

SEQ ID NO: 112844 - DNA, 25 bp, S. pombe
tagcggctcaggctgtctaatgacg

SEQ ID NO: 112845 - DNA, 25 bp, S. pombe
ttgcccaaggtcgagaagtcccaaa

SEQ ID NO: 112846 - DNA, 25 bp, S. pombe
tatgtccaaacggtagccccaatta

SEQ ID NO: 112847 - DNA, 25 bp, S. pombe
tagtgtcacaactgataccccaagc

SEQ ID NO: 112848 - DNA, 25 bp, S. pombe
tagctcaccttttgtcaccgaagca

SEQ ID NO: 112849 - DNA, 25 bp, S. pombe
tagctgctcctaagaatgacccatc

SEQ ID NO: 112850 - DNA, 25 bp, S. pombe
tagcctattcacagatctccagcaa

SEQ ID NO: 112851 - DNA, 25 bp, S. pombe
tagccgatctccaggttccaatata

SEQ ID NO: 112852 - DNA, 25 bp, S. pombe
tagccaaccgcattggcttccttta

SEQ ID NO: 112853 - DNA, 25 bp, S. pombe
taccaaagcgttcggtcactgttta

SEQ ID NO: 112854 - DNA, 25 bp, S. pombe
tagccaacatctatccttacgggat

SEQ ID NO: 112855 - DNA, 25 bp, S. pombe
tagcatgcggagtcctttgcagcaa

SEQ ID NO: 112856 - DNA, 25 bp, S. pombe
tagctatcattccttcttcaacatc

SEQ ID NO: 112857 - DNA, 25 bp, S. pombe
tagcttctagcgcatctttattaaa

SEQ ID NO: 112858 - DNA, 25 bp, S. pombe
tagctttgaagcatcctttctttat

SEQ ID NO: 112859 - DNA, 25 bp, S. pombe
tagctttgaacatccctttgaacat

SEQ ID NO: 112860 - DNA, 25 bp, S. pombe
tagcgtatcaaaacccttagcaaat

SEQ ID NO: 112861 - DNA, 25 bp, S. pombe
tatgtgtcaaaaaccctccgatact

SEQ ID NO: 112862 - DNA, 25 bp, S. pombe
tagaagtgaatcgagcacccctgct

SEQ ID NO: 112863 - DNA, 25 bp, S. pombe
tagaagatgaaatccctcctcttgc

SEQ ID NO: 112864 - DNA, 25 bp, S. pombe
tagcaaggtgtatccagctcctttg

SEQ ID NO: 112865 - DNA, 25 bp, S. pombe
tagcggttgtatcctcacttctttc

SEQ ID NO: 112866 - DNA, 25 bp, S. pombe
tagtgatggtagttctcgcttttaa

SEQ ID NO: 112867 - DNA, 25 bp, S. pombe
tagctccgcgtcttgaagttactga

SEQ ID NO: 112868 - DNA, 25 bp, S. pombe
tagtagcactccctgaattccaaga

SEQ ID NO: 112869 - DNA, 25 bp, S. pombe
tagtattgatccctccctgtatgtt

SEQ ID NO: 112870 - DNA, 25 bp, S. pombe
tagctttacgcgatactggtgttaa

SEQ ID NO: 112871 - DNA, 25 bp, S. pombe
tagcgacattgatacggcaccattg

SEQ ID NO: 112872 - DNA, 25 bp, S. pombe
tagagacgctgtacctgctagtgca

SEQ ID NO: 112873 - DNA, 25 bp, S. pombe
tagaagctgatatccgtcgtgcaag

SEQ ID NO: 112874 - DNA, 25 bp, S. pombe
tagcgagctgcatcaccgtttaaag

SEQ ID NO: 112875 - DNA, 25 bp, S. pombe
tagagtctatacacgccctagaggt

SEQ ID NO: 112876 - DNA, 25 bp, S. pombe
tagcagggtcaatatctcgcatact

SEQ ID NO: 112877 - DNA, 25 bp, S. pombe
taggcgtcatgcaaaggaactactt

SEQ ID NO: 112878 - DNA, 25 bp, S. pombe
tagctggtacagaacgagcgcctct

SEQ ID NO: 112879 - DNA, 25 bp, S. pombe
tagtagttcgcttgtagccactgca

SEQ ID NO: 112880 - DNA, 25 bp, S. pombe
tagaatcgttgagactggcacacac

SEQ ID NO: 112881 - DNA, 25 bp, S. pombe
tagtcctcttgagactgtcaagttg

SEQ ID NO: 112882 - DNA, 25 bp, S. pombe
tagccgtttagagacgtctgcgcgc

SEQ ID NO: 112883 - DNA, 25 bp, S. pombe
tagaagtatttgtcccgtgtgccgc

SEQ ID NO: 112884 - DNA, 25 bp, S. pombe
tagaagtttttgtcctgttcatggg

SEQ ID NO: 112885 - DNA, 25 bp, S. pombe
tagagatctttgattccgccttgac

SEQ ID NO: 112886 - DNA, 25 bp, S. pombe
tagcctcgatgtcttcttcgctgaa

SEQ ID NO: 112887 - DNA, 25 bp, S. pombe
taccacttgctgacagtctagcgaa

SEQ ID NO: 112888 - DNA, 25 bp, S. pombe
tagaagccgagcctgttgcacgaag

SEQ ID NO: 112889 - DNA, 25 bp, S. pombe
tagctacaatgggtgtcgccgacaa

SEQ ID NO: 112890 - DNA, 25 bp, S. pombe
tagataccatgtgcttgctactgcc

SEQ ID NO: 112891 - DNA, 25 bp, S. pombe
tagaagccattgattctcctgacca

SEQ ID NO: 112892 - DNA, 25 bp, S. pombe
tagcctgctttcatttcctatctga

SEQ ID NO: 112893 - DNA, 25 bp, S. pombe
tagcttcctttatctactctcgaat

SEQ ID NO: 112894 - DNA, 25 bp, S. pombe
tagctctcttctttgacatacttct

SEQ ID NO: 112895 - DNA, 25 bp, S. pombe
tagcttccatatttgccattcttga

SEQ ID NO: 112896 - DNA, 25 bp, S. pombe
tatgtctactcctagtcaatgctct

SEQ ID NO: 112897 - DNA, 25 bp, S. pombe
tatgcatgcaggtctatcaccagag

SEQ ID NO: 112898 - DNA, 25 bp, S. pombe
tagcactttatgaacgtgatgccag

SEQ ID NO: 112899 - DNA, 25 bp, S. pombe
tagactctattgacagcggccataa

SEQ ID NO: 112900 - DNA, 25 bp, S. pombe
tagccctgcagttcgtttagacaaa

SEQ ID NO: 112901 - DNA, 25 bp, S. pombe
tagcccgcagttactttcagatttg

SEQ ID NO: 112902 - DNA, 25 bp, S. pombe
tatgccccgtggtcaagctgagttg

SEQ ID NO: 112903 - DNA, 25 bp, S. pombe
tagcacgccgctaacgaatggtgta

SEQ ID NO: 112904 - DNA, 25 bp, S. pombe
tagccgtggcttggttatggttcat

SEQ ID NO: 112905 - DNA, 25 bp, S. pombe
tagccagttttctttatttatcaaa

SEQ ID NO: 112906 - DNA, 25 bp, S. pombe
tagccgtggatactcttgatcgcaa

SEQ ID NO: 112907 - DNA, 25 bp, S. pombe
tagctcgtggaacttctcgcatgaa

SEQ ID NO: 112908 - DNA, 25 bp, S. pombe
tagctcctgaagttgcttctcgcaa

SEQ ID NO: 112909 - DNA, 25 bp, S. pombe
tagcttactgtggttattgctctaa

SEQ ID NO: 112910 - DNA, 25 bp, S. pombe
tagcgtttctgattgttcgttataa

SEQ ID NO: 112911 - DNA, 25 bp, S. pombe
tagcgtgcttggttgtgatcctgaa

SEQ ID NO: 112912 - DNA, 25 bp, S. pombe
tagcggcattacttgacgcgatggt

SEQ ID NO: 112913 - DNA, 25 bp, S. pombe
tagcggcgctattacagcagctgtt

SEQ ID NO: 112914 - DNA, 25 bp, S. pombe
tagcaggcagctttgaaactttcac

SEQ ID NO: 112915 - DNA, 25 bp, S. pombe
tagcatggactcttggacttggtat

SEQ ID NO: 112916 - DNA, 25 bp, S. pombe
tagctgaatccggtacattggttgc

SEQ ID NO: 112917 - DNA, 25 bp, S. pombe
tagccaatgacgtaacttgtgggcg

SEQ ID NO: 112918 - DNA, 25 bp, S. pombe
tagcctccaaaaacttgtgggcagc

SEQ ID NO: 112919 - DNA, 25 bp, S. pombe
tagctctctatatacctcgtgttgg

SEQ ID NO: 112920 - DNA, 25 bp, S. pombe
tagtcttaaaagctccgtatggaaa

SEQ ID NO: 112921 - DNA, 25 bp, S. pombe
tagcattccaaaaagcccgtagtaa

SEQ ID NO: 112922 - DNA, 25 bp, S. pombe
tagtaccaactcaacttcgtccgaa

SEQ ID NO: 112923 - DNA, 25 bp, S. pombe
tagtacttaatgcacgcggactccg

SEQ ID NO: 112924 - DNA, 25 bp, S. pombe
tagtatctggaagggcgaggcacat

SEQ ID NO: 112925 - DNA, 25 bp, S. pombe
tagtatgccagctactccgttagaa

SEQ ID NO: 112926 - DNA, 25 bp, S. pombe
tagcgggagctgtaccatataacat

SEQ ID NO: 112927 - DNA, 25 bp, S. pombe
tatccagatgaagtgcccgacgtta

SEQ ID NO: 112928 - DNA, 25 bp, S. pombe
tatcttcaatggtcgcaagtacgaa

SEQ ID NO: 112929 - DNA, 25 bp, S. pombe
tagagcaacttcagcccttgatttt

SEQ ID NO: 112930 - DNA, 25 bp, S. pombe
tagcgcagcaaggaacccaagtttt

SEQ ID NO: 112931 - DNA, 25 bp, S. pombe
tagcggacaatctcatacatccttc

SEQ ID NO: 112932 - DNA, 25 bp, S. pombe
tagaccacaacagatccatgcctat

SEQ ID NO: 112933 - DNA, 25 bp, S. pombe
tagttcaactgcatctggacgctgt

SEQ ID NO: 112934 - DNA, 25 bp, S. pombe
tagcttcctctggtcatgttttgat

SEQ ID NO: 112935 - DNA, 25 bp, S. pombe
tagcctctttgcaatgtgttcttca

SEQ ID NO: 112936 - DNA, 25 bp, S. pombe
tagcattgctgtttcgttgttcgct

SEQ ID NO: 112937 - DNA, 25 bp, S. pombe
tagacatgtatctggctcctcaatt

SEQ ID NO: 112938 - DNA, 25 bp, S. pombe
tagagccccaatttcaccatttgaa

SEQ ID NO: 112939 - DNA, 25 bp, S. pombe
tagagaccactatatcatactttgt

SEQ ID NO: 112940 - DNA, 25 bp, S. pombe
tagcagttgcagtttacctcttggt

SEQ ID NO: 112941 - DNA, 25 bp, S. pombe
tagacagcccgattcttggttgaga

SEQ ID NO: 112942 - DNA, 25 bp, S. pombe
tagcttggaatgtctgcactgatgc

SEQ ID NO: 112943 - DNA, 25 bp, S. pombe
ttagatagttctacggcaattgaga

SEQ ID NO: 112944 - DNA, 25 bp, S. pombe
ttcgtaggcactccggaatataccg

SEQ ID NO: 112945 - DNA, 25 bp, S. pombe
tttgcgggccgctagagaacttaag

SEQ ID NO: 112946 - DNA, 25 bp, S. pombe
tagtctccgagacagtggactctga

SEQ ID NO: 112947 - DNA, 25 bp, S. pombe
tagatttggatgttcttgcccgggc

SEQ ID NO: 112948 - DNA, 25 bp, S. pombe
tagtccggttctttccgaagagttg

SEQ ID NO: 112949 - DNA, 25 bp, S. pombe
tagcagctgctgttagtgatttcca

SEQ ID NO: 112950 - DNA, 25 bp, S. pombe
tagctgatgatcttggtagtctgcc

SEQ ID NO: 112951 - DNA, 25 bp, S. pombe
tagaggtcgaggaatgccccgctaa

SEQ ID NO: 112952 - DNA, 25 bp, S. pombe
tagaggacgaggttcaccagccgat

SEQ ID NO: 112953 - DNA, 25 bp, S. pombe
tagggacgattggtactgacggttc

SEQ ID NO: 112954 - DNA, 25 bp, S. pombe
tagggattttttgctggcggcccaa

SEQ ID NO: 112955 - DNA, 25 bp, S. pombe
tagcaaatttaaacctggccctcct

SEQ ID NO: 112956 - DNA, 25 bp, S. pombe
tagcaactagtttaccggtctcctc

SEQ ID NO: 112957 - DNA, 25 bp, S. pombe
tagtatcttttcgaacggttcctgc

SEQ ID NO: 112958 - DNA, 25 bp, S. pombe
tagtactccttctcctagttattac

SEQ ID NO: 112959 - DNA, 25 bp, S. pombe
tagaactagtcctccttggttgaac

SEQ ID NO: 112960 - DNA, 25 bp, S. pombe
tagaacaagcagtttcctccttctt

SEQ ID NO: 112961 - DNA, 25 bp, S. pombe
tagtcaaaatcagcgcgaccgtgcg

SEQ ID NO: 112962 - DNA, 25 bp, S. pombe
tatatctcgtcaacactggaccggg

SEQ ID NO: 112963 - DNA, 25 bp, S. pombe
tattctctccaacgttaccgaggac

SEQ ID NO: 112964 - DNA, 25 bp, S. pombe
ttggcccgaattgctaccgaacaat

SEQ ID NO: 112965 - DNA, 25 bp, S. pombe
tagacttccatcttcgtttcctgaa

SEQ ID NO: 112966 - DNA, 25 bp, S. pombe
tagcgtcaccttatgatgttcatgc

SEQ ID NO: 112967 - DNA, 25 bp, S. pombe
tagctactcctaattatgttacggg

SEQ ID NO: 112968 - DNA, 25 bp, S. pombe
tagctgcctgcattactcttgtttt

SEQ ID NO: 112969 - DNA, 25 bp, S. pombe
tagctggttatcgtgaggccactat

SEQ ID NO: 112970 - DNA, 25 bp, S. pombe
tagcttatctacgagaggccatcaa

SEQ ID NO: 112971 - DNA, 25 bp, S. pombe
tagttcatcgacagacagttccggg

SEQ ID NO: 112972 - DNA, 25 bp, S. pombe
tatgagacctaccaaacgacaccta

SEQ ID NO: 112973 - DNA, 25 bp, S. pombe
tagaacgtcgtcatccgagctcgaa

SEQ ID NO: 112974 - DNA, 25 bp, S. pombe
tagaaaatcgtcttcctcagtggaa

SEQ ID NO: 112975 - DNA, 25 bp, S. pombe
tagaaactctccctcttcaatggag

SEQ ID NO: 112976 - DNA, 25 bp, S. pombe
taggaattacctcttatgctgcgaa

SEQ ID NO: 112977 - DNA, 25 bp, S. pombe
tagtgtttacctcttcgccgaggat

SEQ ID NO: 112978 - DNA, 25 bp, S. pombe
ttttttacctgaacctgagggcgat

SEQ ID NO: 112979 - DNA, 25 bp, S. pombe
tagtttcccctactcaatgggtctt

SEQ ID NO: 112980 - DNA, 25 bp, S. pombe
tagtgtatcccgagtcaatgcctta

SEQ ID NO: 112981 - DNA, 25 bp, S. pombe
tagagcgttctcattaccagtttga

SEQ ID NO: 112982 - DNA, 25 bp, S. pombe
tatgggttccttaactgcaggttcc

SEQ ID NO: 112983 - DNA, 25 bp, S. pombe
tagctattctatctcttgttggtaa

SEQ ID NO: 112984 - DNA, 25 bp, S. pombe
tagctattgcttcttctttgttacc

SEQ ID NO: 112985 - DNA, 25 bp, S. pombe
tagttgtgagtgctaccttgcctca

SEQ ID NO: 112986 - DNA, 25 bp, S. pombe
tatgagcgtaatttgcccgggaccc

SEQ ID NO: 112987 - DNA, 25 bp, S. pombe
tagaagtaccttccctgtcaaattg

SEQ ID NO: 112988 - DNA, 25 bp, S. pombe
tagaagctgttcgtgcccatatgca

SEQ ID NO: 112989 - DNA, 25 bp, S. pombe
tagaagcagacctcatttctccagt

SEQ ID NO: 112990 - DNA, 25 bp, S. pombe
tagcatacaacctcaatcttctcaa

SEQ ID NO: 112991 - DNA, 25 bp, S. pombe
tagcaagtccgaattgaagcccaat

SEQ ID NO: 112992 - DNA, 25 bp, S. pombe
tagaagttcgtttggcgcggcattt

SEQ ID NO: 112993 - DNA, 25 bp, S. pombe
tagacgttcgttggcataccctttg

SEQ ID NO: 112994 - DNA, 25 bp, S. pombe
tagcaagtactcatcgatggctttc

SEQ ID NO: 112995 - DNA, 25 bp, S. pombe
tagcaagtcccttcatcaagtattg

SEQ ID NO: 112996 - DNA, 25 bp, S. pombe
tagaggtccacttgtaaatcatcga

SEQ ID NO: 112997 - DNA, 25 bp, S. pombe
tagaggcatcgcttttatcacatat

SEQ ID NO: 112998 - DNA, 25 bp, S. pombe
tagttctactcgcatgggtgggcac

SEQ ID NO: 112999 - DNA, 25 bp, S. pombe
tagtctctacttgtgtggccggcat

SEQ ID NO: 113000 - DNA, 25 bp, S. pombe
tagtttattacttttcacatgttgg

SEQ ID NO: 113001 - DNA, 25 bp, S. pombe
tagtttttgcaattcttcctcgtgg

SEQ ID NO: 113002 - DNA, 25 bp, S. pombe
tagtacctctacgaagacgggtggt

SEQ ID NO: 113003 - DNA, 25 bp, S. pombe
tagtcctttacaaagccgcgggatt

SEQ ID NO: 113004 - DNA, 25 bp, S. pombe
tagattttttacaaccagcggagac

SEQ ID NO: 113005 - DNA, 25 bp, S. pombe
tagctttattctacggcatcacgag

SEQ ID NO: 113006 - DNA, 25 bp, S. pombe
tagctttactccagtgtatcgcttc

SEQ ID NO: 113007 - DNA, 25 bp, S. pombe
tagtgtttctccatttttggcgcga

SEQ ID NO: 113008 - DNA, 25 bp, S. pombe
tagtatcttcttctcctttaacaac

SEQ ID NO: 113009 - DNA, 25 bp, S. pombe
tatgaaggtcgttcccgtccaaaag

SEQ ID NO: 113010 - DNA, 25 bp, S. pombe
tagtgcatcttcaggccattaccaa

SEQ ID NO: 113011 - DNA, 25 bp, S. pombe
tagtctaacgcacccggattcaaaa

SEQ ID NO: 113012 - DNA, 25 bp, S. pombe
tagtccagcacaaatccgaatccaa

SEQ ID NO: 113013 - DNA, 25 bp, S. pombe
tatggctcaaacgatgcaaaaaatt

SEQ ID NO: 113014 - DNA, 25 bp, S. pombe
tagagccgcaaaatccagccgtaaa

SEQ ID NO: 113015 - DNA, 25 bp, S. pombe
tagatgcactcttttgcacccgtat

SEQ ID NO: 113016 - DNA, 25 bp, S. pombe
tagaatccccggtcttcacatatat

SEQ ID NO: 113017 - DNA, 25 bp, S. pombe
tagaaactcgtggtctgacgcttgc

SEQ ID NO: 113018 - DNA, 25 bp, S. pombe
tagtaatcgcgtgatccgttctttt

SEQ ID NO: 113019 - DNA, 25 bp, S. pombe
tagttatccgctgatctggctgatc

SEQ ID NO: 113020 - DNA, 25 bp, S. pombe
tatgggttggtgtttccgaatacgt

SEQ ID NO: 113021 - DNA, 25 bp, S. pombe
ttagcagttggttttccaagccctt

SEQ ID NO: 113022 - DNA, 25 bp, S. pombe
ttgggtaacagtccgcaagcgttta

SEQ ID NO: 113023 - DNA, 25 bp, S. pombe
tagtcaggaacatcaccatgagcat

SEQ ID NO: 113024 - DNA, 25 bp, S. pombe
tatgtcaacgggaagctatatgcta

SEQ ID NO: 113025 - DNA, 25 bp, S. pombe
tagcacttcaagtccttcatctgat

SEQ ID NO: 113026 - DNA, 25 bp, S. pombe
tagacttgctggacgctaatcgaat

SEQ ID NO: 113027 - DNA, 25 bp, S. pombe
tagcatcggtggatctgattcggtc

SEQ ID NO: 113028 - DNA, 25 bp, S. pombe
tagtcctgtttcttcaagggctagt

SEQ ID NO: 113029 - DNA, 25 bp, S. pombe
tagaccgcctctatataccgcgaga

SEQ ID NO: 113030 - DNA, 25 bp, S. pombe
tagaccgcacttcttggactgggag

SEQ ID NO: 113031 - DNA, 25 bp, S. pombe
tagtgctaaggtcgacgtctggtcc

SEQ ID NO: 113032 - DNA, 25 bp, S. pombe
taggaaatcgcctgctaaattgccg

SEQ ID NO: 113033 - DNA, 25 bp, S. pombe
taggtgttccttctattctaaaagc

SEQ ID NO: 113034 - DNA, 25 bp, S. pombe
tagggttgtctttcgatactagcaa

SEQ ID NO: 113035 - DNA, 25 bp, S. pombe
taggcgtttatttattacgtggaga

SEQ ID NO: 113036 - DNA, 25 bp, S. pombe
tagtcgaacactatcctcactttgt

SEQ ID NO: 113037 - DNA, 25 bp, S. pombe
tagatcggctacttctgctggactt

SEQ ID NO: 113038 - DNA, 25 bp, S. pombe
tagaatgctgttttctgctgcagaa

SEQ ID NO: 113039 - DNA, 25 bp, S. pombe
tagagcacgttcttcttcagtatct

SEQ ID NO: 113040 - DNA, 25 bp, S. pombe
tagagggttctctcgctgtatcatc

SEQ ID NO: 113041 - DNA, 25 bp, S. pombe
tagtgtggatttcttttgcgacctc

SEQ ID NO: 113042 - DNA, 25 bp, S. pombe
tagcaggttatctcttctccaaaga

SEQ ID NO: 113043 - DNA, 25 bp, S. pombe
tagcagtctcaccttttcaaagaat

SEQ ID NO: 113044 - DNA, 25 bp, S. pombe
tagagtctcctccttttgaagtaat

SEQ ID NO: 113045 - DNA, 25 bp, S. pombe
tagagcttgatgttgttcccggcac

SEQ ID NO: 113046 - DNA, 25 bp, S. pombe
tagcacttggcttgtacaacgtcaa

SEQ ID NO: 113047 - DNA, 25 bp, S. pombe
tatggcgtccttcacaaaacaaatt

SEQ ID NO: 113048 - DNA, 25 bp, S. pombe
taggagcactggcaactcgattgaa

SEQ ID NO: 113049 - DNA, 25 bp, S. pombe
tagagcctacactaatctgtgcaga

SEQ ID NO: 113050 - DNA, 25 bp, S. pombe
tagtcttatccttggttccttgcta

SEQ ID NO: 113051 - DNA, 25 bp, S. pombe
tagatcttactcgagttcgctttcc

SEQ ID NO: 113052 - DNA, 25 bp, S. pombe
tagatgttcaacctgatgactcccg

SEQ ID NO: 113053 - DNA, 25 bp, S. pombe
tagcaagttaaagttttcctcgacg

SEQ ID NO: 113054 - DNA, 25 bp, S. pombe
tatccggttaagttctggtgtcgac

SEQ ID NO: 113055 - DNA, 25 bp, S. pombe
ttaccatggtaagactggtgtcgtt

SEQ ID NO: 113056 - DNA, 25 bp, S. pombe
tatgcactttgttcggatgcggtcc

SEQ ID NO: 113057 - DNA, 25 bp, S. pombe
tagcatcgtttttggagtcttacat

SEQ ID NO: 113058 - DNA, 25 bp, S. pombe
tagatcgtgttcatcggcttggaca

SEQ ID NO: 113059 - DNA, 25 bp, S. pombe
tagacgattatcacggcatcaggat

SEQ ID NO: 113060 - DNA, 25 bp, S. pombe
tagtcagattgcatcccttagcgat

SEQ ID NO: 113061 - DNA, 25 bp, S. pombe
tagtgtgaagctccccgaatggttg

SEQ ID NO: 113062 - DNA, 25 bp, S. pombe
tagggccatgtgtaagtgttcagtt

SEQ ID NO: 113063 - DNA, 25 bp, S. pombe
tagtgactcaatgcaatctgttctt

SEQ ID NO: 113064 - DNA, 25 bp, S. pombe
tagtgttaactctcgctcatttttt

SEQ ID NO: 113065 - DNA, 25 bp, S. pombe
tagtgtcctccctcaaccgaaatat

SEQ ID NO: 113066 - DNA, 25 bp, S. pombe
tagtgccaacaagggcggacgtgtt

SEQ ID NO: 113067 - DNA, 25 bp, S. pombe
tatctttctggtgggaacccttgca

SEQ ID NO: 113068 - DNA, 25 bp, S. pombe
ttcggtttcccaccagaattgacaa

SEQ ID NO: 113069 - DNA, 25 bp, S. pombe
tttgcagtttcctcctgaagttcag

SEQ ID NO: 113070 - DNA, 25 bp, S. pombe
ttatccttggccatcggaggaccag

SEQ ID NO: 113071 - DNA, 25 bp, S. pombe
tatacactttttcttcgcgccaaat

SEQ ID NO: 113072 - DNA, 25 bp, S. pombe
tatagttttggtcacattgccgaaa

SEQ ID NO: 113073 - DNA, 25 bp, S. pombe
ttccgaaactatgccatttcctagc

SEQ ID NO: 113074 - DNA, 25 bp, S. pombe
tagatgtaccaggtttcgcttccag

SEQ ID NO: 113075 - DNA, 25 bp, S. pombe
tagagatcaccgtttttgctgtcgt

SEQ ID NO: 113076 - DNA, 25 bp, S. pombe
tagaaatgctgctcgtgtcttgttt

SEQ ID NO: 113077 - DNA, 25 bp, S. pombe
tagtaatcttcattttttctttctt

SEQ ID NO: 113078 - DNA, 25 bp, S. pombe
taggactcctcggttattccttcga

SEQ ID NO: 113079 - DNA, 25 bp, S. pombe
tattatccgtaggtctttacttggt

SEQ ID NO: 113080 - DNA, 25 bp, S. pombe
tatcaacgcgttccttttacgtggt

SEQ ID NO: 113081 - DNA, 25 bp, S. pombe
tattcacggccgttgaaccaagcag

SEQ ID NO: 113082 - DNA, 25 bp, S. pombe
tatcgccgttttgaagcagctcaac

SEQ ID NO: 113083 - DNA, 25 bp, S. pombe
tatcgccgttttctattacaggtga

SEQ ID NO: 113084 - DNA, 25 bp, S. pombe
tatcccgtttgtccttatgaaccta

SEQ ID NO: 113085 - DNA, 25 bp, S. pombe
tataacactgtgaaggcaaacgtcc

SEQ ID NO: 113086 - DNA, 25 bp, S. pombe
tagatggttttcgtccaaggcttcc

SEQ ID NO: 113087 - DNA, 25 bp, S. pombe
tagtggttttacgacaagcagtaca

SEQ ID NO: 113088 - DNA, 25 bp, S. pombe
tagagccttcccgtgatgaacagta

SEQ ID NO: 113089 - DNA, 25 bp, S. pombe
tagagcagctgcttactgttaagaa

SEQ ID NO: 113090 - DNA, 25 bp, S. pombe
tagactgtcgtcttgatctcaaaac

SEQ ID NO: 113091 - DNA, 25 bp, S. pombe
tagagttccctaaacctcgacgtgg

SEQ ID NO: 113092 - DNA, 25 bp, S. pombe
taggtacttttccaccacgaagaag

SEQ ID NO: 113093 - DNA, 25 bp, S. pombe
tagatgttttttcctcaccgttaat

SEQ ID NO: 113094 - DNA, 25 bp, S. pombe
tagtttgtctattggtccttctctt

SEQ ID NO: 113095 - DNA, 25 bp, S. pombe
tatggtagatgcaatgggtccgaca

SEQ ID NO: 113096 - DNA, 25 bp, S. pombe
tatggtactgtaaagcttcgtgatg

SEQ ID NO: 113097 - DNA, 25 bp, S. pombe
taggtgttgcaagactccttcaaaa

SEQ ID NO: 113098 - DNA, 25 bp, S. pombe
tatggtgatgatcggatgcctcttt

SEQ ID NO: 113099 - DNA, 25 bp, S. pombe
ttggctgccgtcttggagtatttag

SEQ ID NO: 113100 - DNA, 25 bp, S. pombe
tagacttcacagttgaggatgcatc

SEQ ID NO: 113101 - DNA, 25 bp, S. pombe
tagacttccagttgacgatgtcgaa

SEQ ID NO: 113102 - DNA, 25 bp, S. pombe
tagatcgaccagttacgttgagaga

SEQ ID NO: 113103 - DNA, 25 bp, S. pombe
tagtgaatatccatctctcgtaaaa

SEQ ID NO: 113104 - DNA, 25 bp, S. pombe
tagtgctgacaaagttaccgtcgtt

SEQ ID NO: 113105 - DNA, 25 bp, S. pombe
tagtggtacgtttggccgatggttt

SEQ ID NO: 113106 - DNA, 25 bp, S. pombe
tagtgagtcagctgttggccgagct

SEQ ID NO: 113107 - DNA, 25 bp, S. pombe
tagatggaattaccgctctttcaca

SEQ ID NO: 113108 - DNA, 25 bp, S. pombe
tagaagcttctcaaagttctcttga

SEQ ID NO: 113109 - DNA, 25 bp, S. pombe
tagacagtttacttcttctcctatc

SEQ ID NO: 113110 - DNA, 25 bp, S. pombe
tagacagtgatttctttcctcccat

SEQ ID NO: 113111 - DNA, 25 bp, S. pombe
tagactgcgttacctttcatccaaa

SEQ ID NO: 113112 - DNA, 25 bp, S. pombe
tagacgctgtttgcgatctcatcga

SEQ ID NO: 113113 - DNA, 25 bp, S. pombe
tagagctactttgcgacctgatgag

SEQ ID NO: 113114 - DNA, 25 bp, S. pombe
tagaggtcttcgcttgactgagctt

SEQ ID NO: 113115 - DNA, 25 bp, S. pombe
taggcggtctgcaaggtatgtgaaa

SEQ ID NO: 113116 - DNA, 25 bp, S. pombe
taggtgaatctgcaggtggtacatt

SEQ ID NO: 113117 - DNA, 25 bp, S. pombe
taggcgttgctgtcggtcatgtcga

SEQ ID NO: 113118 - DNA, 25 bp, S. pombe
tagtcacttttatccatgtctgcaa

SEQ ID NO: 113119 - DNA, 25 bp, S. pombe
tagtattttagatctcgctcatgct

SEQ ID NO: 113120 - DNA, 25 bp, S. pombe
tagattcttgtcgtacggctgagct

SEQ ID NO: 113121 - DNA, 25 bp, S. pombe
tagtctctttcttagccaaaatggt

SEQ ID NO: 113122 - DNA, 25 bp, S. pombe
tagtccttcttactctccaactagt

SEQ ID NO: 113123 - DNA, 25 bp, S. pombe
tagtgaaaggcctattccccaatca

SEQ ID NO: 113124 - DNA, 25 bp, S. pombe
tagtgaatcctgctaatcgtcatcg

SEQ ID NO: 113125 - DNA, 25 bp, S. pombe
tatgtcgtggttgtcaagtccttaa

SEQ ID NO: 113126 - DNA, 25 bp, S. pombe
tatgttgacggtttcagaggccaaa

SEQ ID NO: 113127 - DNA, 25 bp, S. pombe
tagttactcgttacagcgtccagtt

SEQ ID NO: 113128 - DNA, 25 bp, S. pombe
tatggcggtcctttcgttcctggtt

SEQ ID NO: 113129 - DNA, 25 bp, S. pombe
tatgtctccgacacctattcaaagt

SEQ ID NO: 113130 - DNA, 25 bp, S. pombe
tagtccccaagttctttctacatta

SEQ ID NO: 113131 - DNA, 25 bp, S. pombe
tagttcaccttctacttcattgtca

SEQ ID NO: 113132 - DNA, 25 bp, S. pombe
tagtaatcctactgccaatggccaa

SEQ ID NO: 113133 - DNA, 25 bp, S. pombe
tagtccttctgagctacatttggcc

SEQ ID NO: 113134 - DNA, 25 bp, S. pombe
tagtgccgacgatgctactttgtct

SEQ ID NO: 113135 - DNA, 25 bp, S. pombe
tagagctcaagctatccaggcctta

SEQ ID NO: 113136 - DNA, 25 bp, S. pombe
tagatcagaagccacctgtcgcatt

SEQ ID NO: 113137 - DNA, 25 bp, S. pombe
tagatgctcctgttagcgtgcaaag

SEQ ID NO: 113138 - DNA, 25 bp, S. pombe
tagagcaggcatttcaaggagatat

SEQ ID NO: 113139 - DNA, 25 bp, S. pombe
tagtcccataccgatttggcatgtt

SEQ ID NO: 113140 - DNA, 25 bp, S. pombe
tagacgcctggtactttggttacat

SEQ ID NO: 113141 - DNA, 25 bp, S. pombe
tagtcgtttctattatgggcattat

SEQ ID NO: 113142 - DNA, 25 bp, S. pombe
tagtcgcattcatacattagggctt

SEQ ID NO: 113143 - DNA, 25 bp, S. pombe
tagtcctggaatccttcacggtttt

SEQ ID NO: 113144 - DNA, 25 bp, S. pombe
tagtcacatggcatcctacagaaga

SEQ ID NO: 113145 - DNA, 25 bp, S. pombe
tagtataacacctatgaccagcatt

SEQ ID NO: 113146 - DNA, 25 bp, S. pombe
tagtttcaccagattccgttgcaag

SEQ ID NO: 113147 - DNA, 25 bp, S. pombe
tagtgttacgagatgcccagtctga

SEQ ID NO: 113148 - DNA, 25 bp, S. pombe
tttagcatcaaacttgccgaggcga

SEQ ID NO: 113149 - DNA, 25 bp, S. pombe
tagacttcgggctactcctggaatt

SEQ ID NO: 113150 - DNA, 25 bp, S. pombe
tagtctatgcaacctggcaggcggt

SEQ ID NO: 113151 - DNA, 25 bp, S. pombe
tagtgtattaacctgcaacgatttg

SEQ ID NO: 113152 - DNA, 25 bp, S. pombe
tagttctttcacctgcatttgacgg

SEQ ID NO: 113153 - DNA, 25 bp, S. pombe
tatacgctggacctttggcagggta

SEQ ID NO: 113154 - DNA, 25 bp, S. pombe
ttaccggagtctgtgcgtcgtgtac

SEQ ID NO: 113155 - DNA, 25 bp, S. pombe
ttcaaaaggttcgtggtcgcggtct

SEQ ID NO: 113156 - DNA, 25 bp, S. pombe
tagatggacggtaagcactgtagat

SEQ ID NO: 113157 - DNA, 25 bp, S. pombe
tagaggacctgctaacactcgtgtt

SEQ ID NO: 113158 - DNA, 25 bp, S. pombe
tagatgccacttgaccctcaaattg

SEQ ID NO: 113159 - DNA, 25 bp, S. pombe
taggctccctgaaaactccagtatg

SEQ ID NO: 113160 - DNA, 25 bp, S. pombe
taggctcttcaatcggacacatggc

SEQ ID NO: 113161 - DNA, 25 bp, S. pombe
tagtatctcttgttcggcttctgta

SEQ ID NO: 113162 - DNA, 25 bp, S. pombe
tagagatacttcatcggtccgttct

SEQ ID NO: 113163 - DNA, 25 bp, S. pombe
tatcgtgtcaatctcgttccagttc

SEQ ID NO: 113164 - DNA, 25 bp, S. pombe
tttgtctaaaaacgcattctcctca

SEQ ID NO: 113165 - DNA, 25 bp, S. pombe
tagtggctaataaatgcgaccttga

SEQ ID NO: 113166 - DNA, 25 bp, S. pombe
tagtcgtccattcgcaaaccttgaa

SEQ ID NO: 113167 - DNA, 25 bp, S. pombe
tagtggtcacatgccttactgttca

SEQ ID NO: 113168 - DNA, 25 bp, S. pombe
tagtaatgcctgtgctgttggcggc

SEQ ID NO: 113169 - DNA, 25 bp, S. pombe
tagtggatcctgatgtgtctgacgg

SEQ ID NO: 113170 - DNA, 25 bp, S. pombe
tagtttctgctgacatggctcatgc

SEQ ID NO: 113171 - DNA, 25 bp, S. pombe
tagtttctgctgctgaggctcaaga

SEQ ID NO: 113172 - DNA, 25 bp, S. pombe
tagtttcatctcttgggctgacaga

SEQ ID NO: 113173 - DNA, 25 bp, S. pombe
tagagttccatcttggatcgccaat

SEQ ID NO: 113174 - DNA, 25 bp, S. pombe
tagtagatctagtaccgggccttca

SEQ ID NO: 113175 - DNA, 25 bp, S. pombe
tatcctcctgacatggttacctttt

SEQ ID NO: 113176 - DNA, 25 bp, S. pombe
ttaccacgccagctggtttaggtat

SEQ ID NO: 113177 - DNA, 25 bp, S. pombe
ttcccataggcgcttggtacggtaa

SEQ ID NO: 113178 - DNA, 25 bp, S. pombe
tataccaaggtgttgtttccggtga

SEQ ID NO: 113179 - DNA, 25 bp, S. pombe
tagtatgcatttccaggtcgccgaa

SEQ ID NO: 113180 - DNA, 25 bp, S. pombe
tatgttcgtcgttttgtcaacgtta

SEQ ID NO: 113181 - DNA, 25 bp, S. pombe
tatgttcgtcgttttgtcaacgtta

SEQ ID NO: 113182 - DNA, 25 bp, S. pombe
tatgccgctcaaatgggatatgccc

SEQ ID NO: 113183 - DNA, 25 bp, S. pombe
taggaacttttgtcaaactgcccct

SEQ ID NO: 113184 - DNA, 25 bp, S. pombe
tatgaaatttttgtcgaccctcgta

SEQ ID NO: 113185 - DNA, 25 bp, S. pombe
tataatattacctctcggtcctctt

SEQ ID NO: 113186 - DNA, 25 bp, S. pombe
ttaaacagcaacctccttcaaattc

SEQ ID NO: 113187 - DNA, 25 bp, S. pombe
ttatagaagggcatccccgttgtcc

SEQ ID NO: 113188 - DNA, 25 bp, S. pombe
ttccggaggaaccattgggagaatt

SEQ ID NO: 113189 - DNA, 25 bp, S. pombe
ttccggagcaaagcatttctcgtct

SEQ ID NO: 113190 - DNA, 25 bp, S. pombe
tagggcagcaactcgatttacttac

SEQ ID NO: 113191 - DNA, 25 bp, S. pombe
tagagtccagaattcgtgccttgtt

SEQ ID NO: 113192 - DNA, 25 bp, S. pombe
tatgagtctcaatctcctcagcatt

SEQ ID NO: 113193 - DNA, 25 bp, S. pombe
taggtccataacacatgccatcatg

SEQ ID NO: 113194 - DNA, 25 bp, S. pombe
tagattgtctcttcatgatggtcat

SEQ ID NO: 113195 - DNA, 25 bp, S. pombe
tagatctggccactacgactgtaga

SEQ ID NO: 113196 - DNA, 25 bp, S. pombe
tagtttgctccaaggacttcggtag

SEQ ID NO: 113197 - DNA, 25 bp, S. pombe
tagttgatgactcgcgtttggtttt

SEQ ID NO: 113198 - DNA, 25 bp, S. pombe
tatggttacgtcctaatggttcttt

SEQ ID NO: 113199 - DNA, 25 bp, S. pombe
taggttgtcccttagctagtcaaga

SEQ ID NO: 113200 - DNA, 25 bp, S. pombe
taggcaagcgtatttgcttcgtcta

SEQ ID NO: 113201 - DNA, 25 bp, S. pombe
tagagtatgagtctgcttccactcc

SEQ ID NO: 113202 - DNA, 25 bp, S. pombe
tagatgtctatgctgtcatgtccct

SEQ ID NO: 113203 - DNA, 25 bp, S. pombe
tagatgcccagctatctgttttcca

SEQ ID NO: 113204 - DNA, 25 bp, S. pombe
tagttcgcactgttgactgttcaag

SEQ ID NO: 113205 - DNA, 25 bp, S. pombe
tagttcagcaggctattgatccaat

SEQ ID NO: 113206 - DNA, 25 bp, S. pombe
tagttagcgcgacgattcccattat

SEQ ID NO: 113207 - DNA, 25 bp, S. pombe
tagtgaatctggtgcattgcttaat

SEQ ID NO: 113208 - DNA, 25 bp, S. pombe
tagtgtttctgctgatggcttgctt

SEQ ID NO: 113209 - DNA, 25 bp, S. pombe
taggatttccatcgatgccattgct

SEQ ID NO: 113210 - DNA, 25 bp, S. pombe
tagtagatacctgctcgatttccac

SEQ ID NO: 113211 - DNA, 25 bp, S. pombe
tagtagcagatcacggttacaccat

SEQ ID NO: 113212 - DNA, 25 bp, S. pombe
tagtcccaatccattgctttcaatg

SEQ ID NO: 113213 - DNA, 25 bp, S. pombe
taggagcaagcgttcttcggctgta

SEQ ID NO: 113214 - DNA, 25 bp, S. pombe
tttactcagatgttcgtgaccagca

SEQ ID NO: 113215 - DNA, 25 bp, S. pombe
tagtaaaactgcttcacgtcctcaa

SEQ ID NO: 113216 - DNA, 25 bp, S. pombe
tagtaacacactttccgctgtacaa

SEQ ID NO: 113217 - DNA, 25 bp, S. pombe
tagtactcctggctgcacgaaacaa

SEQ ID NO: 113218 - DNA, 25 bp, S. pombe
tagtctatcatcaagaggacgaata

SEQ ID NO: 113219 - DNA, 25 bp, S. pombe
tatgtgcctaatcggtgccggtgta

SEQ ID NO: 113220 - DNA, 25 bp, S. pombe
taggtgtttctggattactcacaaa

SEQ ID NO: 113221 - DNA, 25 bp, S. pombe
tagggtgattcgcattatgcccaat

SEQ ID NO: 113222 - DNA, 25 bp, S. pombe
taggcgtttccatatcatcctcaat

SEQ ID NO: 113223 - DNA, 25 bp, S. pombe
taggatatccccttatgttgctgca

SEQ ID NO: 113224 - DNA, 25 bp, S. pombe
tagtactcacgtctacattgccaaa

SEQ ID NO: 113225 - DNA, 25 bp, S. pombe
tagtactctcctgttcttgtatcaa

SEQ ID NO: 113226 - DNA, 25 bp, S. pombe
taggagtctctagtcccgtgaggac

SEQ ID NO: 113227 - DNA, 25 bp, S. pombe
tagtgactcctttcacacggtagca

SEQ ID NO: 113228 - DNA, 25 bp, S. pombe
taggtcctatgtactttgagcccac

SEQ ID NO: 113229 - DNA, 25 bp, S. pombe
tagttgccttggattctgacagaaa

SEQ ID NO: 113230 - DNA, 25 bp, S. pombe
tagatttgctttgcctgatcagaca

SEQ ID NO: 113231 - DNA, 25 bp, S. pombe
tagtcctgttcgaccgatgcttaaa

SEQ ID NO: 113232 - DNA, 25 bp, S. pombe
tagatccgatctccttcgtctaaag

SEQ ID NO: 113233 - DNA, 25 bp, S. pombe
tagatgccacttcccattttgaaac

SEQ ID NO: 113234 - DNA, 25 bp, S. pombe
tataccgaattttcagcctccaaaa

SEQ ID NO: 113235 - DNA, 25 bp, S. pombe
tataccctgtatttaccgtgacgac

SEQ ID NO: 113236 - DNA, 25 bp, S. pombe
tatggccgaaattgtatcctccgtt

SEQ ID NO: 113237 - DNA, 25 bp, S. pombe
taggcaagaatctactaccccgtgc

SEQ ID NO: 113238 - DNA, 25 bp, S. pombe
tagatgcacaatatcgctcggccat

SEQ ID NO: 113239 - DNA, 25 bp, S. pombe
tagatgcgtctgtccactattccaa

SEQ ID NO: 113240 - DNA, 25 bp, S. pombe
tagtcgtagatcaactcactccaac

SEQ ID NO: 113241 - DNA, 25 bp, S. pombe
tagtactaagagcaagtccgccgcc

SEQ ID NO: 113242 - DNA, 25 bp, S. pombe
tttatcgtcaggcaagtacccgttc

SEQ ID NO: 113243 - DNA, 25 bp, S. pombe
tatgtagcgccgttcaaaccttttt

SEQ ID NO: 113244 - DNA, 25 bp, S. pombe
ttctaaccgtcgtaccactttatgt

SEQ ID NO: 113245 - DNA, 25 bp, S. pombe
tatgcgcggtaaaatcccttggttt

SEQ ID NO: 113246 - DNA, 25 bp, S. pombe
tagatgccgaacaagcagccgcaga

SEQ ID NO: 113247 - DNA, 25 bp, S. pombe
tattcccgaacccttgagagaacga

SEQ ID NO: 113248 - DNA, 25 bp, S. pombe
tagtcgccataattcatgcttctcc

SEQ ID NO: 113249 - DNA, 25 bp, S. pombe
tatgtcctgtaattgtctagccctc

SEQ ID NO: 113250 - DNA, 25 bp, S. pombe
tagtctgcgacgaattcttgggccc

SEQ ID NO: 113251 - DNA, 25 bp, S. pombe
ttacgacacgtttcgagggcaccga

SEQ ID NO: 113252 - DNA, 25 bp, S. pombe
tagtacgaaatcacggccacagcct

SEQ ID NO: 113253 - DNA, 25 bp, S. pombe
tagtgtagccagagctcggtcagtc

SEQ ID NO: 113254 - DNA, 25 bp, S. pombe
tatgggaaaccctatgtccttattt

SEQ ID NO: 113255 - DNA, 25 bp, S. pombe
taggtgctaagggtgttccttttct

SEQ ID NO: 113256 - DNA, 25 bp, S. pombe
tatctattagttttccttccgactt

SEQ ID NO: 113257 - DNA, 25 bp, S. pombe
tatctcctccacctgggttttgtta

SEQ ID NO: 113258 - DNA, 25 bp, S. pombe
tatggcagctggtttaggtgttcgt

SEQ ID NO: 113259 - DNA, 25 bp, S. pombe
taggtcttgtagtcgttcgtggaac

SEQ ID NO: 113260 - DNA, 25 bp, S. pombe
tatgatcctggatatcgtcgtgatg

SEQ ID NO: 113261 - DNA, 25 bp, S. pombe
tagttgctggaacctctcttgagaa

SEQ ID NO: 113262 - DNA, 25 bp, S. pombe
tatgtgtggttagctctcaggatac

SEQ ID NO: 113263 - DNA, 25 bp, S. pombe
tatggtggtgcttgcatcagccaaa

SEQ ID NO: 113264 - DNA, 25 bp, S. pombe
taggcctgcatgtcgaattgctgct

SEQ ID NO: 113265 - DNA, 25 bp, S. pombe
taggtgctgcattggtcagtgctct

SEQ ID NO: 113266 - DNA, 25 bp, S. pombe
tagtattcctcattattcccacaac

SEQ ID NO: 113267 - DNA, 25 bp, S. pombe
tagtaatcctaacgcatcaccacag

SEQ ID NO: 113268 - DNA, 25 bp, S. pombe
tatgcagaattacttgctaatttaa

SEQ ID NO: 113269 - DNA, 25 bp, S. pombe
ttgcaagaattgtacgaacgatcag

SEQ ID NO: 113270 - DNA, 25 bp, S. pombe
tatggcagactttacgatacgctta

SEQ ID NO: 113271 - DNA, 25 bp, S. pombe
tatgatccattttccagctccggaa

SEQ ID NO: 113272 - DNA, 25 bp, S. pombe
tagtgtctgcaatcaagctttcaaa

SEQ ID NO: 113273 - DNA, 25 bp, S. pombe
taggcctcaacgattgtctcttatc

SEQ ID NO: 113274 - DNA, 25 bp, S. pombe
ttggtacgccaagtgatcctaattc

SEQ ID NO: 113275 - DNA, 25 bp, S. pombe
tagtagctcgctgtcaaggccataa

SEQ ID NO: 113276 - DNA, 25 bp, S. pombe
tatgataccagagttagacgcgtta

SEQ ID NO: 113277 - DNA, 25 bp, S. pombe
tatgctacaagatccacacgctttg

SEQ ID NO: 113278 - DNA, 25 bp, S. pombe
tatgtgctaagcgacatggctcaga

SEQ ID NO: 113279 - DNA, 25 bp, S. pombe
tatgctatgcacctcaatggatcgt

SEQ ID NO: 113280 - DNA, 25 bp, S. pombe
tatggcttcattgcagggtcttttt

SEQ ID NO: 113281 - DNA, 25 bp, S. pombe
tatggatgtacttcatgctggcctt

SEQ ID NO: 113282 - DNA, 25 bp, S. pombe
tatccgtttttccacgttgacgttg

SEQ ID NO: 113283 - DNA, 25 bp, S. pombe
ttccttttgaaggtgttgaagtgaa

SEQ ID NO: 113284 - DNA, 25 bp, S. pombe
tatcctttgattttgtacgactgtg

SEQ ID NO: 113285 - DNA, 25 bp, S. pombe
tatcacttgggtttctgaaggcgcc

SEQ ID NO: 113286 - DNA, 25 bp, S. pombe
tatcgtcaactcttacctggtgatt

SEQ ID NO: 113287 - DNA, 25 bp, S. pombe
tatgctgatcagacgttaagaccca

SEQ ID NO: 113288 - DNA, 25 bp, S. pombe
tagtgtgcgtcttcgcaaggcacta

SEQ ID NO: 113289 - DNA, 25 bp, S. pombe
tatccaacctttatactactgccga

SEQ ID NO: 113290 - DNA, 25 bp, S. pombe
tatcaacggtgacttcaactccagt

SEQ ID NO: 113291 - DNA, 25 bp, S. pombe
tatcaacaggccattcagacgtcgt

SEQ ID NO: 113292 - DNA, 25 bp, S. pombe
tataagcgtcttttatacgtccgcc

SEQ ID NO: 113293 - DNA, 25 bp, S. pombe
tatccaccatgctatcattgttcgg

SEQ ID NO: 113294 - DNA, 25 bp, S. pombe
tatcgcatctcattacttggtacgg

SEQ ID NO: 113295 - DNA, 25 bp, S. pombe
tatcacgccctgtatatgtaaccaa

SEQ ID NO: 113296 - DNA, 25 bp, S. pombe
tatcgccacctttattcaacaactt

SEQ ID NO: 113297 - DNA, 25 bp, S. pombe
tatctctccccgtttcaacgttaag

SEQ ID NO: 113298 - DNA, 25 bp, S. pombe
tatcatccaccttttgagcaacttc

SEQ ID NO: 113299 - DNA, 25 bp, S. pombe
tatgtcccttcttggatcaatcttc

SEQ ID NO: 113300 - DNA, 25 bp, S. pombe
tatgctactcatcctacgattactc

SEQ ID NO: 113301 - DNA, 25 bp, S. pombe
tatgcgcaggagttcgtccaacggt

SEQ ID NO: 113302 - DNA, 25 bp, S. pombe
tatgcacgtattttgctcccaaggt

SEQ ID NO: 113303 - DNA, 25 bp, S. pombe
taggccctaattgtcctggtatcat

SEQ ID NO: 113304 - DNA, 25 bp, S. pombe
taggccctaattgcccagatgctca

SEQ ID NO: 113305 - DNA, 25 bp, S. pombe
tagtgtgctcagtcgatacatacag

SEQ ID NO: 113306 - DNA, 25 bp, S. pombe
tagtgctggcggatctgcgattatt

SEQ ID NO: 113307 - DNA, 25 bp, S. pombe
tagtgcggtcagatactcatcaaat

SEQ ID NO: 113308 - DNA, 25 bp, S. pombe
tagtgcgaatgctttacctcatgtt

SEQ ID NO: 113309 - DNA, 25 bp, S. pombe
tagtgagcaagccttgactcgcttt

SEQ ID NO: 113310 - DNA, 25 bp, S. pombe
tagtatcaagccttttcttctttta

SEQ ID NO: 113311 - DNA, 25 bp, S. pombe
tatgtatccctcttattccgtttat

SEQ ID NO: 113312 - DNA, 25 bp, S. pombe
tagtcttctctattatcccgtatgg

SEQ ID NO: 113313 - DNA, 25 bp, S. pombe
tatgcatttttatccaccgttgttg

SEQ ID NO: 113314 - DNA, 25 bp, S. pombe
tattcagaagtgcaccgttttggat

SEQ ID NO: 113315 - DNA, 25 bp, S. pombe
ttaacgcctaagcagtcttcggaag

SEQ ID NO: 113316 - DNA, 25 bp, S. pombe
tatggtgccgctagatgtcactcat

SEQ ID NO: 113317 - DNA, 25 bp, S. pombe
tatgcggcacctacgagcgtttgaa

SEQ ID NO: 113318 - DNA, 25 bp, S. pombe
tatgaccgtcttcaactaggagatg

SEQ ID NO: 113319 - DNA, 25 bp, S. pombe
taggtacaccgtccgtatgaaggct

SEQ ID NO: 113320 - DNA, 25 bp, S. pombe
taggtcgcagccgtgttgttaaact

SEQ ID NO: 113321 - DNA, 25 bp, S. pombe
tatggtatcgatcctagttttcccc

SEQ ID NO: 113322 - DNA, 25 bp, S. pombe
tagtctacgttttctttacccatca

SEQ ID NO: 113323 - DNA, 25 bp, S. pombe
tagtcgtggtttttcgttccagtca

SEQ ID NO: 113324 - DNA, 25 bp, S. pombe
tagtgggcgtttttcaaggctcgac

SEQ ID NO: 113325 - DNA, 25 bp, S. pombe
tagtacaggctttttcaccgctaac

SEQ ID NO: 113326 - DNA, 25 bp, S. pombe
tagtaagtgttcttgctcctgctgc

SEQ ID NO: 113327 - DNA, 25 bp, S. pombe
taggtatggctttccagcttcgctc

SEQ ID NO: 113328 - DNA, 25 bp, S. pombe
tatggctcccttcgaatgtttcctt

SEQ ID NO: 113329 - DNA, 25 bp, S. pombe
tatggctgttgctctgtttttactt

SEQ ID NO: 113330 - DNA, 25 bp, S. pombe
taggctttcatctggtggccatcct

SEQ ID NO: 113331 - DNA, 25 bp, S. pombe
tatgcgttacatttcgtcgaactat

SEQ ID NO: 113332 - DNA, 25 bp, S. pombe
tatgggtgccaagcgcattgctagg

SEQ ID NO: 113333 - DNA, 25 bp, S. pombe
tatggaatggtcgtttgcgtccgat

SEQ ID NO: 113334 - DNA, 25 bp, S. pombe
tatggatatggtaccttgccacctt

SEQ ID NO: 113335 - DNA, 25 bp, S. pombe
tagtctttcttattctggtacagga

SEQ ID NO: 113336 - DNA, 25 bp, S. pombe
tatgttcaccatttcggataccacg

SEQ ID NO: 113337 - DNA, 25 bp, S. pombe
tatgttgcctgtatctggatgccac

SEQ ID NO: 113338 - DNA, 25 bp, S. pombe
tatgtacggtgttttctgcccctaa

SEQ ID NO: 113339 - DNA, 25 bp, S. pombe
taggatccggaagtcttgcagcaat

SEQ ID NO: 113340 - DNA, 25 bp, S. pombe
tatcgttgaggccactggtgttgtc

SEQ ID NO: 113341 - DNA, 25 bp, S. pombe
ttcacgtcctctcattcgttcgttt

SEQ ID NO: 113342 - DNA, 25 bp, S. pombe
tatacgtttctttatggtcccttat

SEQ ID NO: 113343 - DNA, 25 bp, S. pombe
ttagttgatttagagcccaccttat

SEQ ID NO: 113344 - DNA, 25 bp, S. pombe
tataagtcatggtaccacccacgtt

SEQ ID NO: 113345 - DNA, 25 bp, S. pombe
tataccctacaaatcgcaccaagtt

SEQ ID NO: 113346 - DNA, 25 bp, S. pombe
tataccgtacaaatctcaaactgga

SEQ ID NO: 113347 - DNA, 25 bp, S. pombe
tatacacgcttctcttaacaatggt

SEQ ID NO: 113348 - DNA, 25 bp, S. pombe
tatggccgcggctatttcaactaga

SEQ ID NO: 113349 - DNA, 25 bp, S. pombe
tatggctcccattgaagtgactgta

SEQ ID NO: 113350 - DNA, 25 bp, S. pombe
taggttcactcatagcatgcttggc

SEQ ID NO: 113351 - DNA, 25 bp, S. pombe
tatggcgccacatacttcaattctg

SEQ ID NO: 113352 - DNA, 25 bp, S. pombe
tatggattcctacctaacttctgtt

SEQ ID NO: 113353 - DNA, 25 bp, S. pombe
tatggattctcatcgctggactgtc

SEQ ID NO: 113354 - DNA, 25 bp, S. pombe
tatgtgcattcctctgtgtacgacg

SEQ ID NO: 113355 - DNA, 25 bp, S. pombe
tagtcattcgttcatttgctggatc

SEQ ID NO: 113356 - DNA, 25 bp, S. pombe
tagtcttgcctcttataggtgtcac

SEQ ID NO: 113357 - DNA, 25 bp, S. pombe
tttccccacgaatgggtaccactga

SEQ ID NO: 113358 - DNA, 25 bp, S. pombe
tagtggaggctctcatgcagcgcat

SEQ ID NO: 113359 - DNA, 25 bp, S. pombe
tagtctactctggtctgtctcgaag

SEQ ID NO: 113360 - DNA, 25 bp, S. pombe
tagtctgattgtggctctacctgac

SEQ ID NO: 113361 - DNA, 25 bp, S. pombe
tataggcactgcaacttacgcggct

SEQ ID NO: 113362 - DNA, 25 bp, S. pombe
tatagccctaaattacccgattttg

SEQ ID NO: 113363 - DNA, 25 bp, S. pombe
tatggtcatgccgtacttcgtaaga

SEQ ID NO: 113364 - DNA, 25 bp, S. pombe
tagtgctatgcttcgtgctcagaaa

SEQ ID NO: 113365 - DNA, 25 bp, S. pombe
tatgtacttgcccatttgaatgaca

SEQ ID NO: 113366 - DNA, 25 bp, S. pombe
tattactctcgcctttagcagtgaa

SEQ ID NO: 113367 - DNA, 25 bp, S. pombe
tatggccgtatcgaggcttccagaa

SEQ ID NO: 113368 - DNA, 25 bp, S. pombe
taggccgataaaagtcattgcagga

SEQ ID NO: 113369 - DNA, 25 bp, S. pombe
taggccctactaatgtctctgagca

SEQ ID NO: 113370 - DNA, 25 bp, S. pombe
tataccccactgttgccttaaacat

SEQ ID NO: 113371 - DNA, 25 bp, S. pombe
tataccaccaggagctcgttacgat

SEQ ID NO: 113372 - DNA, 25 bp, S. pombe
ttactacgacgtttggctgctactt

SEQ ID NO: 113373 - DNA, 25 bp, S. pombe
tagtgtgccgtctgctccatatgga

SEQ ID NO: 113374 - DNA, 25 bp, S. pombe
tagtggctcctctatagacattgat

SEQ ID NO: 113375 - DNA, 25 bp, S. pombe
tagtggccgcttttgatattgctaa

SEQ ID NO: 113376 - DNA, 25 bp, S. pombe
tagggatcctgcacaaccaaagcgc

SEQ ID NO: 113377 - DNA, 25 bp, S. pombe
tatggtgctttagaggctgccttaa

SEQ ID NO: 113378 - DNA, 25 bp, S. pombe
taggtaatgctgtttcttcccttaa

SEQ ID NO: 113379 - DNA, 25 bp, S. pombe
tatccgcttcttttgaatcagtcaa

SEQ ID NO: 113380 - DNA, 25 bp, S. pombe
ttcgccctgttagcaatcaaccaaa

SEQ ID NO: 113381 - DNA, 25 bp, S. pombe
tatgggcctttaggaatccgcgtta

SEQ ID NO: 113382 - DNA, 25 bp, S. pombe
tatggtgcttttcatcaaccggcta

SEQ ID NO: 113383 - DNA, 25 bp, S. pombe
taggctttagtgttgacggcggaca

SEQ ID NO: 113384 - DNA, 25 bp, S. pombe
taggtcttgcttctgacggcgttca

SEQ ID NO: 113385 - DNA, 25 bp, S. pombe
tatggctcatttacctgaaggctgt

SEQ ID NO: 113386 - DNA, 25 bp, S. pombe
tagtgtctctttcctattcacaatt

SEQ ID NO: 113387 - DNA, 25 bp, S. pombe
tatggtctctaatctcttcctaaag

SEQ ID NO: 113388 - DNA, 25 bp, S. pombe
tatggtcgctctttgtactactaca

SEQ ID NO: 113389 - DNA, 25 bp, S. pombe
tagtgtgtcctgttgctatgctaca

SEQ ID NO: 113390 - DNA, 25 bp, S. pombe
tatacaacccacgtactcgggagtt

SEQ ID NO: 113391 - DNA, 25 bp, S. pombe
tattaactggaagccggcggacttt

SEQ ID NO: 113392 - DNA, 25 bp, S. pombe
tatgtaatcggatcgccgacctatc

SEQ ID NO: 113393 - DNA, 25 bp, S. pombe
tatgttgacttgaaagcgcgcactt

SEQ ID NO: 113394 - DNA, 25 bp, S. pombe
tatcggaatgttttgcgtacgcgtg

SEQ ID NO: 113395 - DNA, 25 bp, S. pombe
tatccgcccggagctgaaaagcgtt

SEQ ID NO: 113396 - DNA, 25 bp, S. pombe
tttgcccacggaaacattcaaggtt

SEQ ID NO: 113397 - DNA, 25 bp, S. pombe
tatgacccgcggtaacctcaagtgt

SEQ ID NO: 113398 - DNA, 25 bp, S. pombe
ttgacggcggcttacgacgaaagct

SEQ ID NO: 113399 - DNA, 25 bp, S. pombe
tatgaagggtgttccgatcggcgaa

SEQ ID NO: 113400 - DNA, 25 bp, S. pombe
tatggagtgcttgtgtcgctattct

SEQ ID NO: 113401 - DNA, 25 bp, S. pombe
tatgttgatgatccggactggtccg

SEQ ID NO: 113402 - DNA, 25 bp, S. pombe
tatgtagcttcctgagtttgcccaa

SEQ ID NO: 113403 - DNA, 25 bp, S. pombe
tatgcaacgttctgtttctcccaat

SEQ ID NO: 113404 - DNA, 25 bp, S. pombe
tataatcgacgatgcttcacccgac

SEQ ID NO: 113405 - DNA, 25 bp, S. pombe
tatgtgtattcaaccaactgtatga

SEQ ID NO: 113406 - DNA, 25 bp, S. pombe
tatgagcaacgcaacactatcttga

SEQ ID NO: 113407 - DNA, 25 bp, S. pombe
ttatgaaccacccttatccgttact

SEQ ID NO: 113408 - DNA, 25 bp, S. pombe
ttttgacgaactacttcctggtaat

SEQ ID NO: 113409 - DNA, 25 bp, S. pombe
ttttccgtactcctacacgggagat

SEQ ID NO: 113410 - DNA, 25 bp, S. pombe
tttctgatgaggaccgttttcggca

SEQ ID NO: 113411 - DNA, 25 bp, S. pombe
tttcttggaaaacgttatccgtgat

SEQ ID NO: 113412 - DNA, 25 bp, S. pombe
tatctcccgaaatgtttgaccgtat

SEQ ID NO: 113413 - DNA, 25 bp, S. pombe
ttcccgtcgaatcttctactacaaa

SEQ ID NO: 113414 - DNA, 25 bp, S. pombe
ttgcccgtgaactggccttttataa

SEQ ID NO: 113415 - DNA, 25 bp, S. pombe
tatgctgctgactttccggtcatag

SEQ ID NO: 113416 - DNA, 25 bp, S. pombe
tatccttccacttctacttcaatgt

SEQ ID NO: 113417 - DNA, 25 bp, S. pombe
tatctttcccttattatcctttact

SEQ ID NO: 113418 - DNA, 25 bp, S. pombe
tattttcccttggagttgcctttga

SEQ ID NO: 113419 - DNA, 25 bp, S. pombe
tatgacattcctgacgagttcgcta

SEQ ID NO: 113420 - DNA, 25 bp, S. pombe
tatgtccgccatcttgttaacgagg

SEQ ID NO: 113421 - DNA, 25 bp, S. pombe
tatggctactcgaactttaactggg

SEQ ID NO: 113422 - DNA, 25 bp, S. pombe
tatggcccacgtggtttccctggat

SEQ ID NO: 113423 - DNA, 25 bp, S. pombe
tatgatatctctggtcgtattcgcc

SEQ ID NO: 113424 - DNA, 25 bp, S. pombe
tatggtcatgtttgtatttccgttg

SEQ ID NO: 113425 - DNA, 25 bp, S. pombe
tatgtttggctcgttatctactctt

SEQ ID NO: 113426 - DNA, 25 bp, S. pombe
taggcacagccaaattcgctctttc

SEQ ID NO: 113427 - DNA, 25 bp, S. pombe
tatggtcatcggttctaagccaaac

SEQ ID NO: 113428 - DNA, 25 bp, S. pombe
taggctacagcttttaggcatcaaa

SEQ ID NO: 113429 - DNA, 25 bp, S. pombe
tatggctcctgaactcttcgataat

SEQ ID NO: 113430 - DNA, 25 bp, S. pombe
taggctatgctattgctttgagtgc

SEQ ID NO: 113431 - DNA, 25 bp, S. pombe
tatgactatgcgtttctcgatgccg

SEQ ID NO: 113432 - DNA, 25 bp, S. pombe
tatgctgctgcaggtgcttcatatc

SEQ ID NO: 113433 - DNA, 25 bp, S. pombe
tatgcatgcttctggaggagccgac

SEQ ID NO: 113434 - DNA, 25 bp, S. pombe
taggtatcatcaagatcgcccagat

SEQ ID NO: 113435 - DNA, 25 bp, S. pombe
tatgctacattggagcaagcccaga

SEQ ID NO: 113436 - DNA, 25 bp, S. pombe
tattaaaggctgcaccaagaccccg

SEQ ID NO: 113437 - DNA, 25 bp, S. pombe
tattcgaatgtcctttttcgccgaa

SEQ ID NO: 113438 - DNA, 25 bp, S. pombe
tatggcccgaatggttgctccaaac

SEQ ID NO: 113439 - DNA, 25 bp, S. pombe
tatgtatcctgaagggtctcctgga

SEQ ID NO: 113440 - DNA, 25 bp, S. pombe
tatctaccgatttcaatgcccgttg

SEQ ID NO: 113441 - DNA, 25 bp, S. pombe
tatgcaacccactaatacccttgta

SEQ ID NO: 113442 - DNA, 25 bp, S. pombe
tatggttggcatggtatacgcggta

SEQ ID NO: 113443 - DNA, 25 bp, S. pombe
tatcgttgccattgtttctggtgct

SEQ ID NO: 113444 - DNA, 25 bp, S. pombe
tttttgccaagtcttactgccctta

SEQ ID NO: 113445 - DNA, 25 bp, S. pombe
tttgcagctacagaaaacctttgga

SEQ ID NO: 113446 - DNA, 25 bp, S. pombe
tatggaaactcctgggccttttaag

SEQ ID NO: 113447 - DNA, 25 bp, S. pombe
tatgggaactccagtcgttacttaa

SEQ ID NO: 113448 - DNA, 25 bp, S. pombe
taggatgtatagttcgtgttctcaa

SEQ ID NO: 113449 - DNA, 25 bp, S. pombe
taggcagctctacatacgactccaa

SEQ ID NO: 113450 - DNA, 25 bp, S. pombe
tatggagtcgtatacagcgttcaag

SEQ ID NO: 113451 - DNA, 25 bp, S. pombe
tatggcagccgttttcctgatgaaa

SEQ ID NO: 113452 - DNA, 25 bp, S. pombe
tatctggcggtggtatctctgaaaa

SEQ ID NO: 113453 - DNA, 25 bp, S. pombe
tatggactcttggtcgcttgctaca

SEQ ID NO: 113454 - DNA, 25 bp, S. pombe
taggcttattgaccctgttaaaaca

SEQ ID NO: 113455 - DNA, 25 bp, S. pombe
taggcttgagccacctttggatgaa

SEQ ID NO: 113456 - DNA, 25 bp, S. pombe
tatacatgcacagcctggaatccgt

SEQ ID NO: 113457 - DNA, 25 bp, S. pombe
tatacggcgctgtcgagcaacggat

SEQ ID NO: 113458 - DNA, 25 bp, S. pombe
tatgcaccggtgtcgatgaatctcg

SEQ ID NO: 113459 - DNA, 25 bp, S. pombe
tatccagctggttcagatggtcctg

SEQ ID NO: 113460 - DNA, 25 bp, S. pombe
tatgcctctgattcttgtccaaaag

SEQ ID NO: 113461 - DNA, 25 bp, S. pombe
taggtttcttaaaggatcccgcttg

SEQ ID NO: 113462 - DNA, 25 bp, S. pombe
ttttgtccctaaagtactccgtctg

SEQ ID NO: 113463 - DNA, 25 bp, S. pombe
ttgaagagcccatgaaaacgtactg

SEQ ID NO: 113464 - DNA, 25 bp, S. pombe
tatgatagcgggtttctccaagtcc

SEQ ID NO: 113465 - DNA, 25 bp, S. pombe
tattccaaagttcgatatcccacct

SEQ ID NO: 113466 - DNA, 25 bp, S. pombe
tatggaatacacaacgcggatcgat

SEQ ID NO: 113467 - DNA, 25 bp, S. pombe
tatgtgttcagttccttctactttg

SEQ ID NO: 113468 - DNA, 25 bp, S. pombe
taggatacagtttactccctcttgt

SEQ ID NO: 113469 - DNA, 25 bp, S. pombe
tatgaatccaagttcactacctcct

SEQ ID NO: 113470 - DNA, 25 bp, S. pombe
tatgaactcgttcgacttgcacctt

SEQ ID NO: 113471 - DNA, 25 bp, S. pombe
tatcaaccatctactacttacactt

SEQ ID NO: 113472 - DNA, 25 bp, S. pombe
tatgactggtcccaaacgtcttttt

SEQ ID NO: 113473 - DNA, 25 bp, S. pombe
tatgactggtactagcgaccctttg

SEQ ID NO: 113474 - DNA, 25 bp, S. pombe
tatgactcgtcaatgggccttcttt

SEQ ID NO: 113475 - DNA, 25 bp, S. pombe
tatggcacatttctctgctaactgt

SEQ ID NO: 113476 - DNA, 25 bp, S. pombe
tatgcccttcatttcttaactatag

SEQ ID NO: 113477 - DNA, 25 bp, S. pombe
ttaaggctcaggacgtttggaataa

SEQ ID NO: 113478 - DNA, 25 bp, S. pombe
tatgtggcgccatgtcgtttggaat

SEQ ID NO: 113479 - DNA, 25 bp, S. pombe
tatggatgctacttcacctgttgac

SEQ ID NO: 113480 - DNA, 25 bp, S. pombe
taggcgcaggtattgtgagctctgt

SEQ ID NO: 113481 - DNA, 25 bp, S. pombe
tatcttttccccacattttcttagg

SEQ ID NO: 113482 - DNA, 25 bp, S. pombe
ttttttccctataatgagttcacca

SEQ ID NO: 113483 - DNA, 25 bp, S. pombe
tatcgaacattcttttccaactcct

SEQ ID NO: 113484 - DNA, 25 bp, S. pombe
tatgacttacacagattacccaccc

SEQ ID NO: 113485 - DNA, 25 bp, S. pombe
tatggcccatccgtactttcaagta

SEQ ID NO: 113486 - DNA, 25 bp, S. pombe
tatgaccctcatgtttcagctgaag

SEQ ID NO: 113487 - DNA, 25 bp, S. pombe
tatgacgcttacgaagatgccgaag

SEQ ID NO: 113488 - DNA, 25 bp, S. pombe
tatgcctcgtatcgcacatgctaaa

SEQ ID NO: 113489 - DNA, 25 bp, S. pombe
tatcggttcaacaagcaagacagga

SEQ ID NO: 113490 - DNA, 25 bp, S. pombe
taggctatacctaggcgtcgactat

SEQ ID NO: 113491 - DNA, 25 bp, S. pombe
taggctccacatcttcgtcgagaaa

SEQ ID NO: 113492 - DNA, 25 bp, S. pombe
tatggttcaagggacgctagcaaat

SEQ ID NO: 113493 - DNA, 25 bp, S. pombe
tatgaggccagacagtacgcgagca

SEQ ID NO: 113494 - DNA, 25 bp, S. pombe
tatggtatggctcttgactctgtca

SEQ ID NO: 113495 - DNA, 25 bp, S. pombe
tatggattggttacgcactggctct

SEQ ID NO: 113496 - DNA, 25 bp, S. pombe
tatcttcaatctctgcaaacgctag

SEQ ID NO: 113497 - DNA, 25 bp, S. pombe
tatccaatatggaaggcctgcattg

SEQ ID NO: 113498 - DNA, 25 bp, S. pombe
tatcgcagatactatgggctctgtt

SEQ ID NO: 113499 - DNA, 25 bp, S. pombe
tatcgaatactaccctcgttttatt

SEQ ID NO: 113500 - DNA, 25 bp, S. pombe
tatccagactctcacgtcgttttga

SEQ ID NO: 113501 - DNA, 25 bp, S. pombe
tataagtcatctcccttcggtggct

SEQ ID NO: 113502 - DNA, 25 bp, S. pombe
tatggtcatttgtttcatcctccta

SEQ ID NO: 113503 - DNA, 25 bp, S. pombe
tatggctctttaatttggcatccgc

SEQ ID NO: 113504 - DNA, 25 bp, S. pombe
tatgcttggtctttattcacttcga

SEQ ID NO: 113505 - DNA, 25 bp, S. pombe
tatgcgtcgttttcagcctttggaa

SEQ ID NO: 113506 - DNA, 25 bp, S. pombe
tatggtatttccaacgtctgataga

SEQ ID NO: 113507 - DNA, 25 bp, S. pombe
tatgcgttttcgtacgacgttggat

SEQ ID NO: 113508 - DNA, 25 bp, S. pombe
tatcgcttattcctacgcacgtgat

SEQ ID NO: 113509 - DNA, 25 bp, S. pombe
tatactgcagcaggcggcaacggta

SEQ ID NO: 113510 - DNA, 25 bp, S. pombe
tatcgcagagagtttcgtcagttat

SEQ ID NO: 113511 - DNA, 25 bp, S. pombe
tatcctcgggcattgtggagcacat

SEQ ID NO: 113512 - DNA, 25 bp, S. pombe
tatcgtgcagtgttatggagaccat

SEQ ID NO: 113513 - DNA, 25 bp, S. pombe
tatcagctacacttggtcagcgtcg

SEQ ID NO: 113514 - DNA, 25 bp, S. pombe
tatcgctgaagctggtactcatgcc

SEQ ID NO: 113515 - DNA, 25 bp, S. pombe
tatcgtcaagctcgcggtttcaata

SEQ ID NO: 113516 - DNA, 25 bp, S. pombe
tatcccatggcttgctgactttaat

SEQ ID NO: 113517 - DNA, 25 bp, S. pombe
tatcgccgagcaactgcacttggat

SEQ ID NO: 113518 - DNA, 25 bp, S. pombe
tatggccgcacgaaactctggagtc

SEQ ID NO: 113519 - DNA, 25 bp, S. pombe
tatcccgctgccaagactcgtagtt

SEQ ID NO: 113520 - DNA, 25 bp, S. pombe
tatgcccgctgcgtattcctcatag

SEQ ID NO: 113521 - DNA, 25 bp, S. pombe
tataccaagactaagcctcacagtg

SEQ ID NO: 113522 - DNA, 25 bp, S. pombe
tatccgatatgactagagcccgcaa

SEQ ID NO: 113523 - DNA, 25 bp, S. pombe
tatcgtcaacagttagtcctgccac

SEQ ID NO: 113524 - DNA, 25 bp, S. pombe
tatggtagcaacaaacctctctctc

SEQ ID NO: 113525 - DNA, 25 bp, S. pombe
tatgctggtctggatgttgtgcaca

SEQ ID NO: 113526 - DNA, 25 bp, S. pombe
tatgctgttcggtatctgcctgata

SEQ ID NO: 113527 - DNA, 25 bp, S. pombe
tatgccccttcatttgatcatgcaa

SEQ ID NO: 113528 - DNA, 25 bp, S. pombe
tatgcgcatggctgacggtttattt

SEQ ID NO: 113529 - DNA, 25 bp, S. pombe
tatgacttccaaccaacctgtattt

SEQ ID NO: 113530 - DNA, 25 bp, S. pombe
tatgttcacctctttacttcatggg

SEQ ID NO: 113531 - DNA, 25 bp, S. pombe
tatggttccatccttagctacatca

SEQ ID NO: 113532 - DNA, 25 bp, S. pombe
tatggtagctgcttcacccacgata

SEQ ID NO: 113533 - DNA, 25 bp, S. pombe
tatggtcagtctaaagcagctcgat

SEQ ID NO: 113534 - DNA, 25 bp, S. pombe
ttggttgggctccaggtcatactag

SEQ ID NO: 113535 - DNA, 25 bp, S. pombe
tttttgttcgccgtcgacaggcaag

SEQ ID NO: 113536 - DNA, 25 bp, S. pombe
tatggattggaaccgcacatcatgc

SEQ ID NO: 113537 - DNA, 25 bp, S. pombe
tatgtcttttatctccttcatcgtg

SEQ ID NO: 113538 - DNA, 25 bp, S. pombe
tatgtctccttatttccaatcggtg

SEQ ID NO: 113539 - DNA, 25 bp, S. pombe
tattaccatttttctagtttcgttg

SEQ ID NO: 113540 - DNA, 25 bp, S. pombe
tatgcgtactttaaccaggtctgcg

SEQ ID NO: 113541 - DNA, 25 bp, S. pombe
tatgggttgtgttcttatggctttc

SEQ ID NO: 113542 - DNA, 25 bp, S. pombe
tatgggtgtttggttatggctcttt

SEQ ID NO: 113543 - DNA, 25 bp, S. pombe
tatggagttattggctcttcctgct

SEQ ID NO: 113544 - DNA, 25 bp, S. pombe
tatggtcctagtggtgcttcagatg

SEQ ID NO: 113545 - DNA, 25 bp, S. pombe
tatggtccttggcatgctaacgatt

SEQ ID NO: 113546 - DNA, 25 bp, S. pombe
tatgcagttggctcgtcgtctccgt

SEQ ID NO: 113547 - DNA, 25 bp, S. pombe
tatgcagttggctcgtcgtctccgt

SEQ ID NO: 113548 - DNA, 25 bp, S. pombe
tatcatgttgagtaccggtcccctt

SEQ ID NO: 113549 - DNA, 25 bp, S. pombe
tattttggagtatcgtagccttcac

SEQ ID NO: 113550 - DNA, 25 bp, S. pombe
tatgtttaacgatttgaccccagaa

SEQ ID NO: 113551 - DNA, 25 bp, S. pombe
tatgtcttacttttggaccccatgc

SEQ ID NO: 113552 - DNA, 25 bp, S. pombe
tatgatcttacctggtgtcactcgt

SEQ ID NO: 113553 - DNA, 25 bp, S. pombe
tatgttcgtgttggagaggccctct

SEQ ID NO: 113554 - DNA, 25 bp, S. pombe
tatagtcgttgaggatacacgccct

SEQ ID NO: 113555 - DNA, 25 bp, S. pombe
ttcaagcccgcagcctacggaggaa

SEQ ID NO: 113556 - DNA, 25 bp, S. pombe
tatcgacaaagctccttcggatggg

SEQ ID NO: 113557 - DNA, 25 bp, S. pombe
tatcaaaaggacgtgcctcgctctt

SEQ ID NO: 113558 - DNA, 25 bp, S. pombe
tatcgaaagtgagtctgagcgtgtt

SEQ ID NO: 113559 - DNA, 25 bp, S. pombe
ttcacttgaatcatctacggcacag

SEQ ID NO: 113560 - DNA, 25 bp, S. pombe
tatccctgaacaaagcggtgcgcgc

SEQ ID NO: 113561 - DNA, 25 bp, S. pombe
tatggcttgcggaatcctacgagtt

SEQ ID NO: 113562 - DNA, 25 bp, S. pombe
tatcgcctgtcatgtttatcaaccg

SEQ ID NO: 113563 - DNA, 25 bp, S. pombe
tatgcgcctgctgatgttcaaaaga

SEQ ID NO: 113564 - DNA, 25 bp, S. pombe
tatccctccctgtctcaaaggaaaa

SEQ ID NO: 113565 - DNA, 25 bp, S. pombe
tatcccctccggaagaggtacaaat

SEQ ID NO: 113566 - DNA, 25 bp, S. pombe
tatgtttacctagcctttgtagcct

SEQ ID NO: 113567 - DNA, 25 bp, S. pombe
tatggtttcgtatccttcagtcatc

SEQ ID NO: 113568 - DNA, 25 bp, S. pombe
tatggcatttgcacaaccttgttcc

SEQ ID NO: 113569 - DNA, 25 bp, S. pombe
tatgattattggtccccttgttgca

SEQ ID NO: 113570 - DNA, 25 bp, S. pombe
tatgaagatccgttcaccttctgtt

SEQ ID NO: 113571 - DNA, 25 bp, S. pombe
tatgaacttcatttaccctctggta

SEQ ID NO: 113572 - DNA, 25 bp, S. pombe
tatcactgatatttgggtcccttgg

SEQ ID NO: 113573 - DNA, 25 bp, S. pombe
tatcagtatctttagggctcgcgct

SEQ ID NO: 113574 - DNA, 25 bp, S. pombe
tatcgatatttctagctgccaagga

SEQ ID NO: 113575 - DNA, 25 bp, S. pombe
tatgttatcctttcccagcaatgag

SEQ ID NO: 113576 - DNA, 25 bp, S. pombe
tatgttctatcatcagctacacaga

SEQ ID NO: 113577 - DNA, 25 bp, S. pombe
tatgtatcattcaacgcttagcgtc

SEQ ID NO: 113578 - DNA, 25 bp, S. pombe
tatctcactttgtgcactagcgtgc

SEQ ID NO: 113579 - DNA, 25 bp, S. pombe
tatactcatgttttgcctgcaggac

SEQ ID NO: 113580 - DNA, 25 bp, S. pombe
tatgcattagttcctttccgagcta

SEQ ID NO: 113581 - DNA, 25 bp, S. pombe
tatctatatggccatgcgtaccggt

SEQ ID NO: 113582 - DNA, 25 bp, S. pombe
tatccatcataccacgataccgtag

SEQ ID NO: 113583 - DNA, 25 bp, S. pombe
tatctcgtccccaaactgtgaagaa

SEQ ID NO: 113584 - DNA, 25 bp, S. pombe
ttccgagtgctataccggtgaaact

SEQ ID NO: 113585 - DNA, 25 bp, S. pombe
tattcatcgcaggagtggccacgga

SEQ ID NO: 113586 - DNA, 25 bp, S. pombe
tatatcctatgcaaggtggccgtga

SEQ ID NO: 113587 - DNA, 25 bp, S. pombe
tatgaagggctctgctcagcgcgaa

SEQ ID NO: 113588 - DNA, 25 bp, S. pombe
tatgatcgccttaccatgtgggagc

SEQ ID NO: 113589 - DNA, 25 bp, S. pombe
tatgagcgctgtttccatgattgga

SEQ ID NO: 113590 - DNA, 25 bp, S. pombe
tatgacgctcaaaccattccatgga

SEQ ID NO: 113591 - DNA, 25 bp, S. pombe
tatgaaatccttgactctccagaaa

SEQ ID NO: 113592 - DNA, 25 bp, S. pombe
tatgatttccgtcccattgctataa

SEQ ID NO: 113593 - DNA, 25 bp, S. pombe
tatgcttctgctcggtcaaaaccaa

SEQ ID NO: 113594 - DNA, 25 bp, S. pombe
tatctctttgggactaaacactcgt

SEQ ID NO: 113595 - DNA, 25 bp, S. pombe
tatgctcatcttctggctatggaca

SEQ ID NO: 113596 - DNA, 25 bp, S. pombe
tatcgccgctatgtccaagttgtaa

SEQ ID NO: 113597 - DNA, 25 bp, S. pombe
tatcgtccacaccaatctcgtgaat

SEQ ID NO: 113598 - DNA, 25 bp, S. pombe
tatcgtcacaaccttgctctttatg

SEQ ID NO: 113599 - DNA, 25 bp, S. pombe
tattacacagacctagctcgtcgac

SEQ ID NO: 113600 - DNA, 25 bp, S. pombe
tatcgaccaatgctacttgtaggct

SEQ ID NO: 113601 - DNA, 25 bp, S. pombe
tatcgtgtctgagcagcacaatgtc

SEQ ID NO: 113602 - DNA, 25 bp, S. pombe
tatgggcttctcaagatactgctcc

SEQ ID NO: 113603 - DNA, 25 bp, S. pombe
tatgggtcattctaatttgcttgaa

SEQ ID NO: 113604 - DNA, 25 bp, S. pombe
tatgcgactatgttactggtgctta

SEQ ID NO: 113605 - DNA, 25 bp, S. pombe
tatgcagagttagttcgagcctttg

SEQ ID NO: 113606 - DNA, 25 bp, S. pombe
tatcagtctgcttctggtacaccta

SEQ ID NO: 113607 - DNA, 25 bp, S. pombe
tatatgatctaactggttcccaacg

SEQ ID NO: 113608 - DNA, 25 bp, S. pombe
tatccttgtatctgattccggtgaa

SEQ ID NO: 113609 - DNA, 25 bp, S. pombe
tatgttggttctagcgatcgacctc

SEQ ID NO: 113610 - DNA, 25 bp, S. pombe
tatcattggtggctctttcctttat

SEQ ID NO: 113611 - DNA, 25 bp, S. pombe
tatccggttgttgttccatctttaa

SEQ ID NO: 113612 - DNA, 25 bp, S. pombe
tatcccttttgcaatttttccttct

SEQ ID NO: 113613 - DNA, 25 bp, S. pombe
tatctcccagttgcttatttcctaa

SEQ ID NO: 113614 - DNA, 25 bp, S. pombe
tattcccgaggatcacaacatccaa

SEQ ID NO: 113615 - DNA, 25 bp, S. pombe
tatgctgacttatcgtcacttctgt

SEQ ID NO: 113616 - DNA, 25 bp, S. pombe
tatggtggtcttatgccgtctttac

SEQ ID NO: 113617 - DNA, 25 bp, S. pombe
tatgtgttcattttgctgggtgctt

SEQ ID NO: 113618 - DNA, 25 bp, S. pombe
tatgggcgtgaaatgctactcttgt

SEQ ID NO: 113619 - DNA, 25 bp, S. pombe
tatgctggccatgattcttctgtta

SEQ ID NO: 113620 - DNA, 25 bp, S. pombe
tatggtcgcacaaccaatgctgtct

SEQ ID NO: 113621 - DNA, 25 bp, S. pombe
tatgagcctcccaattatgctgttc

SEQ ID NO: 113622 - DNA, 25 bp, S. pombe
tatcaatcatcccattgccggaact

SEQ ID NO: 113623 - DNA, 25 bp, S. pombe
tatccctgacgagctttatcatgag

SEQ ID NO: 113624 - DNA, 25 bp, S. pombe
tatcactgctgacaccttcaaggag

SEQ ID NO: 113625 - DNA, 25 bp, S. pombe
tatgttccagataaacgcactctat

SEQ ID NO: 113626 - DNA, 25 bp, S. pombe
tatgattcacaatttacgcaggcaa

SEQ ID NO: 113627 - DNA, 25 bp, S. pombe
tattccagaacagcaacagacggtg

SEQ ID NO: 113628 - DNA, 25 bp, S. pombe
ttcaggcaaacctagcgggtggtat

SEQ ID NO: 113629 - DNA, 25 bp, S. pombe
tatgaggaaacctcgtcgccgtgat

SEQ ID NO: 113630 - DNA, 25 bp, S. pombe
tatgcggaaaccactttcgcgagat

SEQ ID NO: 113631 - DNA, 25 bp, S. pombe
tatgtcttcaaagtatcgcgctcct

SEQ ID NO: 113632 - DNA, 25 bp, S. pombe
tatgagttctccatttgaccctaca

SEQ ID NO: 113633 - DNA, 25 bp, S. pombe
tatgaggctcccatttctcctgaaa

SEQ ID NO: 113634 - DNA, 25 bp, S. pombe
tatgaaccccatttctttcgatgaa

SEQ ID NO: 113635 - DNA, 25 bp, S. pombe
tatgtgaacccgaatatcctccaga

SEQ ID NO: 113636 - DNA, 25 bp, S. pombe
tatgctgccactataatccctaagg

SEQ ID NO: 113637 - DNA, 25 bp, S. pombe
tatgtgaccttggttctgcttcaga

SEQ ID NO: 113638 - DNA, 25 bp, S. pombe
tatgttcatgctaggtgtctcttct

SEQ ID NO: 113639 - DNA, 25 bp, S. pombe
tataaccgcacgatagggaaacttc

SEQ ID NO: 113640 - DNA, 25 bp, S. pombe
tatcttgtggtcgactttttgccgt

SEQ ID NO: 113641 - DNA, 25 bp, S. pombe
tatcctcgtcaatcgtttatatcgt

SEQ ID NO: 113642 - DNA, 25 bp, S. pombe
ttcgtcgtcaaatagttcttcgcta

SEQ ID NO: 113643 - DNA, 25 bp, S. pombe
ttactctaaccataccagaacgtcc

SEQ ID NO: 113644 - DNA, 25 bp, S. pombe
tatgatgctgcaatacccgaagaga

SEQ ID NO: 113645 - DNA, 25 bp, S. pombe
tatgataattatccccgatggcggc

SEQ ID NO: 113646 - DNA, 25 bp, S. pombe
tatgatgtttcacttcctttgccag

SEQ ID NO: 113647 - DNA, 25 bp, S. pombe
tatcctccaattctttccatactga

SEQ ID NO: 113648 - DNA, 25 bp, S. pombe
tatgcgttacataggtcgtcttact

SEQ ID NO: 113649 - DNA, 25 bp, S. pombe
tatgcagttgcgtcggttttgaaca

SEQ ID NO: 113650 - DNA, 25 bp, S. pombe
tatgttccctttgcctttaatgcag

SEQ ID NO: 113651 - DNA, 25 bp, S. pombe
tatgcttccttgttttttgtttgtg

SEQ ID NO: 113652 - DNA, 25 bp, S. pombe
tatcatgcctttactttgcctgctc

SEQ ID NO: 113653 - DNA, 25 bp, S. pombe
tatgccttatcgactttcactgcag

SEQ ID NO: 113654 - DNA, 25 bp, S. pombe
tatcgtcctctgatcaagtcacaaa

SEQ ID NO: 113655 - DNA, 25 bp, S. pombe
tatgcgtgcacgaaccatctaaggt

SEQ ID NO: 113656 - DNA, 25 bp, S. pombe
tatgctcccgtgatatttggtgcta

SEQ ID NO: 113657 - DNA, 25 bp, S. pombe
tatgctcgtcggattgctgatggcg

SEQ ID NO: 113658 - DNA, 25 bp, S. pombe
tatcatgagctcagggctgcgatgc

SEQ ID NO: 113659 - DNA, 25 bp, S. pombe
tatctatgaagctgtacgcgccgtt

SEQ ID NO: 113660 - DNA, 25 bp, S. pombe
tatgaactcgattcgtggcttcttc

SEQ ID NO: 113661 - DNA, 25 bp, S. pombe
tatgacactaaacttctctacttga

SEQ ID NO: 113662 - DNA, 25 bp, S. pombe
tatgcttttcccatccaattttgac

SEQ ID NO: 113663 - DNA, 25 bp, S. pombe
tatcattcctccttcttaagtctta

SEQ ID NO: 113664 - DNA, 25 bp, S. pombe
tatcttgcttccttttcacgacaga

SEQ ID NO: 113665 - DNA, 25 bp, S. pombe
tatcattctactgtgactcctcaaa

SEQ ID NO: 113666 - DNA, 25 bp, S. pombe
tatgcttctattttaccccaactgg

SEQ ID NO: 113667 - DNA, 25 bp, S. pombe
tatctgagcttttagagcccaccgt

SEQ ID NO: 113668 - DNA, 25 bp, S. pombe
tatgtagctgcttatcatgatgcca

SEQ ID NO: 113669 - DNA, 25 bp, S. pombe
tatgcttcatggtatctgtccacgc

SEQ ID NO: 113670 - DNA, 25 bp, S. pombe
ttgggtttaatctattccggttcag

SEQ ID NO: 113671 - DNA, 25 bp, S. pombe
ttggagtttagacgtatcgccgctt

SEQ ID NO: 113672 - DNA, 25 bp, S. pombe
ttaggtattgaacaatcccgccgtg

SEQ ID NO: 113673 - DNA, 25 bp, S. pombe
tttggtgactgtaaaaggccctcgt

SEQ ID NO: 113674 - DNA, 25 bp, S. pombe
tatccgtatctaaatgggtgcatct

SEQ ID NO: 113675 - DNA, 25 bp, S. pombe
tatgctctttaaagtgcggtgctct

SEQ ID NO: 113676 - DNA, 25 bp, S. pombe
tatcgttatacgtgagttgctcttc

SEQ ID NO: 113677 - DNA, 25 bp, S. pombe
tatcgttcaacgtgtgatgcagcac

SEQ ID NO: 113678 - DNA, 25 bp, S. pombe
tatcgtgaggctcgatcagccgcaa

SEQ ID NO: 113679 - DNA, 25 bp, S. pombe
ttagatactggtacgttgcaaacga

SEQ ID NO: 113680 - DNA, 25 bp, S. pombe
tttgcatttaattcgagctataaga

SEQ ID NO: 113681 - DNA, 25 bp, S. pombe
tatgctgctttatgtcgcgtagaac

SEQ ID NO: 113682 - DNA, 25 bp, S. pombe
tatgctgctattatccgcgttaact

SEQ ID NO: 113683 - DNA, 25 bp, S. pombe
tatcgtgttttggaggcgtctgaaa

SEQ ID NO: 113684 - DNA, 25 bp, S. pombe
ttgcccaacttttaatcccggtgct

SEQ ID NO: 113685 - DNA, 25 bp, S. pombe
tatgctactgataccactgctgaag

SEQ ID NO: 113686 - DNA, 25 bp, S. pombe
tatgccagcttggttgcttcagaat

SEQ ID NO: 113687 - DNA, 25 bp, S. pombe
tatgcgtgtagctcgtcgtaaggcc

SEQ ID NO: 113688 - DNA, 25 bp, S. pombe
tatcaagtcgttggccgtaaggtcc

SEQ ID NO: 113689 - DNA, 25 bp, S. pombe
ttgaactcgacaaccttaagggcct

SEQ ID NO: 113690 - DNA, 25 bp, S. pombe
tttgcaatccacacgaaagggtttt

SEQ ID NO: 113691 - DNA, 25 bp, S. pombe
tttggaaaccgatgctgacgaacat

SEQ ID NO: 113692 - DNA, 25 bp, S. pombe
tatgccggtcgtttgggttttgagc

SEQ ID NO: 113693 - DNA, 25 bp, S. pombe
tatgacggtttcttctggtttctac

SEQ ID NO: 113694 - DNA, 25 bp, S. pombe
tatacggtcatttaggtctttcaag

SEQ ID NO: 113695 - DNA, 25 bp, S. pombe
tataagagaccctcgtttctccgaa

SEQ ID NO: 113696 - DNA, 25 bp, S. pombe
tataaaacccgcattcattcccgaa

SEQ ID NO: 113697 - DNA, 25 bp, S. pombe
tatattgaacaacgccttttccctc

SEQ ID NO: 113698 - DNA, 25 bp, S. pombe
tatcttcgaaactggttgaccgcta

SEQ ID NO: 113699 - DNA, 25 bp, S. pombe
ttggatcacctctcccataattaga

SEQ ID NO: 113700 - DNA, 25 bp, S. pombe
ttgcgaccagtatgcccaatttacg

SEQ ID NO: 113701 - DNA, 25 bp, S. pombe
ttgcgatacatcttgacacaccggt

SEQ ID NO: 113702 - DNA, 25 bp, S. pombe
tatagtaccaggtcaagccgctgtt

SEQ ID NO: 113703 - DNA, 25 bp, S. pombe
tatcactcctatagacatcgtcctt

SEQ ID NO: 113704 - DNA, 25 bp, S. pombe
tatcatctcctaaaactcctttacg

SEQ ID NO: 113705 - DNA, 25 bp, S. pombe
tataatgcctcaagacctcctagta

SEQ ID NO: 113706 - DNA, 25 bp, S. pombe
tatagagttcaacgccctctacaac

SEQ ID NO: 113707 - DNA, 25 bp, S. pombe
tatcaaagcatttcccttcttacgg

SEQ ID NO: 113708 - DNA, 25 bp, S. pombe
tatcatctttttgggcgccgttgtc

SEQ ID NO: 113709 - DNA, 25 bp, S. pombe
tatgctattctctttctggttacct

SEQ ID NO: 113710 - DNA, 25 bp, S. pombe
tatctattcatcctgctcatcgtaa

SEQ ID NO: 113711 - DNA, 25 bp, S. pombe
tatgaagctgtctcttttcctcaca

SEQ ID NO: 113712 - DNA, 25 bp, S. pombe
tatgatggcttctggatttcctcca

SEQ ID NO: 113713 - DNA, 25 bp, S. pombe
tatgctgcatcttctgtgttttcta

SEQ ID NO: 113714 - DNA, 25 bp, S. pombe
tatttccacgcaatctgttcgaacg

SEQ ID NO: 113715 - DNA, 25 bp, S. pombe
tatccttccaaactcttagtgcggg

SEQ ID NO: 113716 - DNA, 25 bp, S. pombe
tatccgctcaactatctattcaatc

SEQ ID NO: 113717 - DNA, 25 bp, S. pombe
tatgcctgccaagtacgatgttcca

SEQ ID NO: 113718 - DNA, 25 bp, S. pombe
tatgaaactttcctcggtcctatat

SEQ ID NO: 113719 - DNA, 25 bp, S. pombe
tatgcttcttttccctagttaccaa

SEQ ID NO: 113720 - DNA, 25 bp, S. pombe
tataacttttacagcgactcctctc

SEQ ID NO: 113721 - DNA, 25 bp, S. pombe
tataaacctgaactggcttccgatc

SEQ ID NO: 113722 - DNA, 25 bp, S. pombe
tataaacgctgctcatactttctcc

SEQ ID NO: 113723 - DNA, 25 bp, S. pombe
tatagtttcgcatcttgtcacatac

SEQ ID NO: 113724 - DNA, 25 bp, S. pombe
tatcgttgtccctttctttgcagaa

SEQ ID NO: 113725 - DNA, 25 bp, S. pombe
tatgccatttgcgttgttttttgac

SEQ ID NO: 113726 - DNA, 25 bp, S. pombe
tatacctgttcgagtactatcacaa

SEQ ID NO: 113727 - DNA, 25 bp, S. pombe
tatcacccattccaagtgtacctga

SEQ ID NO: 113728 - DNA, 25 bp, S. pombe
tatcaatcctactctgttatgccga

SEQ ID NO: 113729 - DNA, 25 bp, S. pombe
tatcacttgctatcgtgccttgaag

SEQ ID NO: 113730 - DNA, 25 bp, S. pombe
tatccttatgcaacgtctcattaag

SEQ ID NO: 113731 - DNA, 25 bp, S. pombe
tatgcacttgtcactagtatctgga

SEQ ID NO: 113732 - DNA, 25 bp, S. pombe
tatgccttatcttctggttgctact

SEQ ID NO: 113733 - DNA, 25 bp, S. pombe
tatgcctggacattgttcgctgcta

SEQ ID NO: 113734 - DNA, 25 bp, S. pombe
tatgcttgctaatggccagctcgac

SEQ ID NO: 113735 - DNA, 25 bp, S. pombe
tatgcttctacatcagtcgctgtga

SEQ ID NO: 113736 - DNA, 25 bp, S. pombe
tatgcctgctaataatcgtgctgcg

SEQ ID NO: 113737 - DNA, 25 bp, S. pombe
tatgctttaaaatctgctgctcaaa

SEQ ID NO: 113738 - DNA, 25 bp, S. pombe
tatgcctcatcaaaacttgctgcca

SEQ ID NO: 113739 - DNA, 25 bp, S. pombe
tatccctcattgctctatgtgcaca

SEQ ID NO: 113740 - DNA, 25 bp, S. pombe
tatgcctatggttatcgatgctgat

SEQ ID NO: 113741 - DNA, 25 bp, S. pombe
tatgcgcttgggtttggctctcaac

SEQ ID NO: 113742 - DNA, 25 bp, S. pombe
tatgcttgtgttgtatgccttcgag

SEQ ID NO: 113743 - DNA, 25 bp, S. pombe
tatcatgctatttcttggcctatgc

SEQ ID NO: 113744 - DNA, 25 bp, S. pombe
tatctcaagatctattataagttct

SEQ ID NO: 113745 - DNA, 25 bp, S. pombe
tatgcacttggcaatttgctcgctc

SEQ ID NO: 113746 - DNA, 25 bp, S. pombe
tatgcatcgtacatttctccttttc

SEQ ID NO: 113747 - DNA, 25 bp, S. pombe
tatccgtgcatacatttgcgtttgc

SEQ ID NO: 113748 - DNA, 25 bp, S. pombe
tatcgtgtcaccaatttcgtcttca

SEQ ID NO: 113749 - DNA, 25 bp, S. pombe
tatcttgataagcttgccgtctcac

SEQ ID NO: 113750 - DNA, 25 bp, S. pombe
tattgcttcaatctttcgcttgacc

SEQ ID NO: 113751 - DNA, 25 bp, S. pombe
tatcggtctcactcttccatgggaa

SEQ ID NO: 113752 - DNA, 25 bp, S. pombe
ttcggtttcagcattaacgggcctt

SEQ ID NO: 113753 - DNA, 25 bp, S. pombe
tatttttgactaacggcccaggtga

SEQ ID NO: 113754 - DNA, 25 bp, S. pombe
tattttctgtttgtggcgttttcgg

SEQ ID NO: 113755 - DNA, 25 bp, S. pombe
tattttaacttctccctttatcgca

SEQ ID NO: 113756 - DNA, 25 bp, S. pombe
tttagtaggccctctgttaaatcct

SEQ ID NO: 113757 - DNA, 25 bp, S. pombe
tatcgtcacggtttttgtttctctt

SEQ ID NO: 113758 - DNA, 25 bp, S. pombe
tatagcctcttctcctttgaataac

SEQ ID NO: 113759 - DNA, 25 bp, S. pombe
tataccattgtctccgctgataaaa

SEQ ID NO: 113760 - DNA, 25 bp, S. pombe
tatccagacttttccaatgacaacg

SEQ ID NO: 113761 - DNA, 25 bp, S. pombe
tatccgaacggattcatctgaccgc

SEQ ID NO: 113762 - DNA, 25 bp, S. pombe
tatcggaagctccaatcttagacgg

SEQ ID NO: 113763 - DNA, 25 bp, S. pombe
tatcggccgctccacaaggaacaga

SEQ ID NO: 113764 - DNA, 25 bp, S. pombe
tatcccaatgtttcagcatctgctg

SEQ ID NO: 113765 - DNA, 25 bp, S. pombe
tatccgcttaggtcttgctcttaat

SEQ ID NO: 113766 - DNA, 25 bp, S. pombe
tatgcccacagacaatgccaagcag

SEQ ID NO: 113767 - DNA, 25 bp, S. pombe
tatcttacacagtccattcttccaa

SEQ ID NO: 113768 - DNA, 25 bp, S. pombe
tatgcttggacagtcaacctccgag

SEQ ID NO: 113769 - DNA, 25 bp, S. pombe
tatcgtctgatagtgcaacccctgg

SEQ ID NO: 113770 - DNA, 25 bp, S. pombe
tatcatgtgtactggctgtacccca

SEQ ID NO: 113771 - DNA, 25 bp, S. pombe
tttgggcagctttacgaccgaattg

SEQ ID NO: 113772 - DNA, 25 bp, S. pombe
tttgtgtccttgaccgtgacggtaa

SEQ ID NO: 113773 - DNA, 25 bp, S. pombe
tatagctctcactagtgccggagga

SEQ ID NO: 113774 - DNA, 25 bp, S. pombe
tatgcatgtccatattccggaggag

SEQ ID NO: 113775 - DNA, 25 bp, S. pombe
tatgctgtccatgattgctcggaaa

SEQ ID NO: 113776 - DNA, 25 bp, S. pombe
tatcgccattacatttgctgctaga

SEQ ID NO: 113777 - DNA, 25 bp, S. pombe
tatcgcctaacacgtctgtggaatt

SEQ ID NO: 113778 - DNA, 25 bp, S. pombe
tatcaagagctgttacggcagactt

SEQ ID NO: 113779 - DNA, 25 bp, S. pombe
tatcaatccttcaaccaggtatatc

SEQ ID NO: 113780 - DNA, 25 bp, S. pombe
tatcaatccttcaacgagtatattg

SEQ ID NO: 113781 - DNA, 25 bp, S. pombe
tatcaatccttcaacgagtatattg

SEQ ID NO: 113782 - DNA, 25 bp, S. pombe
tatcgatcccaacttcatgaacttc

SEQ ID NO: 113783 - DNA, 25 bp, S. pombe
tatcgaaccttcttcagagcctgaa

SEQ ID NO: 113784 - DNA, 25 bp, S. pombe
tatgctgaagtcatcttcggcgaaa

SEQ ID NO: 113785 - DNA, 25 bp, S. pombe
tttgttaccatacggcgaagcccat

SEQ ID NO: 113786 - DNA, 25 bp, S. pombe
tttgttgactcttgccgtaaggcca

SEQ ID NO: 113787 - DNA, 25 bp, S. pombe
tttgttgaccgacctactagtgtag

SEQ ID NO: 113788 - DNA, 25 bp, S. pombe
tattttggacgaccctatagaggca

SEQ ID NO: 113789 - DNA, 25 bp, S. pombe
tattcccgattctcaaaaggcttgg

SEQ ID NO: 113790 - DNA, 25 bp, S. pombe
tatacattgcacttttggcagcctc

SEQ ID NO: 113791 - DNA, 25 bp, S. pombe
tatgccgctgatttgttggatgccc

SEQ ID NO: 113792 - DNA, 25 bp, S. pombe
tatctggcatatttggtgggcacct

SEQ ID NO: 113793 - DNA, 25 bp, S. pombe
tatcatcgcccattggatggtttta

SEQ ID NO: 113794 - DNA, 25 bp, S. pombe
tatcatctgaattacggtcgctggc

SEQ ID NO: 113795 - DNA, 25 bp, S. pombe
tatactggacaacttttgacgctca

SEQ ID NO: 113796 - DNA, 25 bp, S. pombe
tttgggtggtttgtcttccatgtca

SEQ ID NO: 113797 - DNA, 25 bp, S. pombe
tttgaggtttttcttccacagctac

SEQ ID NO: 113798 - DNA, 25 bp, S. pombe
tattgttgcttacggcaaatcccgt

SEQ ID NO: 113799 - DNA, 25 bp, S. pombe
tatcttacttggctaacttcatggg

SEQ ID NO: 113800 - DNA, 25 bp, S. pombe
tatctttttcgagccacttctggtg

SEQ ID NO: 113801 - DNA, 25 bp, S. pombe
tatcattctttaggcttcgatttag

SEQ ID NO: 113802 - DNA, 25 bp, S. pombe
tttgccgcatgttcttggtaattct

SEQ ID NO: 113803 - DNA, 25 bp, S. pombe
tatataagcaaatcggtcctaccct

SEQ ID NO: 113804 - DNA, 25 bp, S. pombe
ttaatattgagtttcggtcccgact

SEQ ID NO: 113805 - DNA, 25 bp, S. pombe
tatcaagttgatccttcgggcacct

SEQ ID NO: 113806 - DNA, 25 bp, S. pombe
ttgcggatgaagtacttggcggctt

SEQ ID NO: 113807 - DNA, 25 bp, S. pombe
tatcctatcaaaccacaagcagtcc

SEQ ID NO: 113808 - DNA, 25 bp, S. pombe
tttctgtatccaaaaactgtgccga

SEQ ID NO: 113809 - DNA, 25 bp, S. pombe
tttccttccaatatgccacttcaat

SEQ ID NO: 113810 - DNA, 25 bp, S. pombe
ttttggaccaaattcgcacttcgca

SEQ ID NO: 113811 - DNA, 25 bp, S. pombe
tatttagtgtggcaccttcttctcc

SEQ ID NO: 113812 - DNA, 25 bp, S. pombe
ttagagttttggtcatcctcgggtc

SEQ ID NO: 113813 - DNA, 25 bp, S. pombe
tatcatgtactttgtggacacactc

SEQ ID NO: 113814 - DNA, 25 bp, S. pombe
tatctgatacttcctcgagcaagca

SEQ ID NO: 113815 - DNA, 25 bp, S. pombe
tattcctcgcgctcaacgaaatatg

SEQ ID NO: 113816 - DNA, 25 bp, S. pombe
tatcatgagctggtactatgcgggc

SEQ ID NO: 113817 - DNA, 25 bp, S. pombe
tatcctagccatgccgtaatgagtt

SEQ ID NO: 113818 - DNA, 25 bp, S. pombe
tatatttatcgctttcaccggtacc

SEQ ID NO: 113819 - DNA, 25 bp, S. pombe
tatattataccaagctaccggcatg

SEQ ID NO: 113820 - DNA, 25 bp, S. pombe
tatacgaatgcaacgcttgtcgcga

SEQ ID NO: 113821 - DNA, 25 bp, S. pombe
tataaatcatgctatccttgccgag

SEQ ID NO: 113822 - DNA, 25 bp, S. pombe
tatcaagtgctgaatcgcctgggaa

SEQ ID NO: 113823 - DNA, 25 bp, S. pombe
tatcatgggctgtatttcttggaat

SEQ ID NO: 113824 - DNA, 25 bp, S. pombe
tatcggtgctggtctagttgtgaac

SEQ ID NO: 113825 - DNA, 25 bp, S. pombe
tatcctgtcaggttttctcatgaag

SEQ ID NO: 113826 - DNA, 25 bp, S. pombe
tatcctgtcgctgttccacaaaata

SEQ ID NO: 113827 - DNA, 25 bp, S. pombe
tatccagtcttttaccatccaacat

SEQ ID NO: 113828 - DNA, 25 bp, S. pombe
tatactatggttatctcttttgcag

SEQ ID NO: 113829 - DNA, 25 bp, S. pombe
tatatttggatcacccttcgtctat

SEQ ID NO: 113830 - DNA, 25 bp, S. pombe
tatttgggtttctctacgcttacga

SEQ ID NO: 113831 - DNA, 25 bp, S. pombe
ttttatcggttctactactgctgga

SEQ ID NO: 113832 - DNA, 25 bp, S. pombe
tatagtttggttcgcacgatccgtc

SEQ ID NO: 113833 - DNA, 25 bp, S. pombe
tatcaagtgttgtctgttccatccg

SEQ ID NO: 113834 - DNA, 25 bp, S. pombe
tatccatcgattttgttcgcttcct

SEQ ID NO: 113835 - DNA, 25 bp, S. pombe
tatccctcgatatccatcatttggt

SEQ ID NO: 113836 - DNA, 25 bp, S. pombe
tatatcacgcttactccaacatttt

SEQ ID NO: 113837 - DNA, 25 bp, S. pombe
tatccgttatgcactctgttgtcaa

SEQ ID NO: 113838 - DNA, 25 bp, S. pombe
tttcgagttcgtgatgcgtcaggat

SEQ ID NO: 113839 - DNA, 25 bp, S. pombe
tttaaggatcgtcttgctcaagcat

SEQ ID NO: 113840 - DNA, 25 bp, S. pombe
tatcggatctgttaacggccacatt

SEQ ID NO: 113841 - DNA, 25 bp, S. pombe
tatcggtgctgttaacttccctgag

SEQ ID NO: 113842 - DNA, 25 bp, S. pombe
tatacgccgtctacgttgaggatgc

SEQ ID NO: 113843 - DNA, 25 bp, S. pombe
tatcagctttcaatggactccggtt

SEQ ID NO: 113844 - DNA, 25 bp, S. pombe
tatcctttcagcagcatttggtgtt

SEQ ID NO: 113845 - DNA, 25 bp, S. pombe
tatcctttcgtggttatgcgttgaa

SEQ ID NO: 113846 - DNA, 25 bp, S. pombe
tatacaattcctttcttccttcaag

SEQ ID NO: 113847 - DNA, 25 bp, S. pombe
tatacaatttcctctgctcagcgta

SEQ ID NO: 113848 - DNA, 25 bp, S. pombe
tatcatctcttaatgggcgctcctg

SEQ ID NO: 113849 - DNA, 25 bp, S. pombe
tatcctattactgtgcgtcatctgg

SEQ ID NO: 113850 - DNA, 25 bp, S. pombe
tttgtccgatgtcagctataagcca

SEQ ID NO: 113851 - DNA, 25 bp, S. pombe
ttgtgaggatcagcgtcaggtctcc

SEQ ID NO: 113852 - DNA, 25 bp, S. pombe
tataggtccttgttgtggtcgtctt

SEQ ID NO: 113853 - DNA, 25 bp, S. pombe
tattacgcactctcgacttatacaa

SEQ ID NO: 113854 - DNA, 25 bp, S. pombe
tatcaatggcccttccttttagcaa

SEQ ID NO: 113855 - DNA, 25 bp, S. pombe
tatcgtatgccttctcaaattcttg

SEQ ID NO: 113856 - DNA, 25 bp, S. pombe
tatcgtcgccgtaaaggtcttgtta

SEQ ID NO: 113857 - DNA, 25 bp, S. pombe
tatcttcaccgtataggtcgtaccg

SEQ ID NO: 113858 - DNA, 25 bp, S. pombe
tatcgtctctcgtgctggtgacagt

SEQ ID NO: 113859 - DNA, 25 bp, S. pombe
tatccttcctgttggcgagtcagtc

SEQ ID NO: 113860 - DNA, 25 bp, S. pombe
tatcgtgctcctgaagtattgttgg

SEQ ID NO: 113861 - DNA, 25 bp, S. pombe
tataccctccaattgtatcgtgtgg

SEQ ID NO: 113862 - DNA, 25 bp, S. pombe
tataacgcaacatccaacttgtccg

SEQ ID NO: 113863 - DNA, 25 bp, S. pombe
tataacactacattcactaccggct

SEQ ID NO: 113864 - DNA, 25 bp, S. pombe
tatcgaaacggcacaatccattgtt

SEQ ID NO: 113865 - DNA, 25 bp, S. pombe
tattcaaaaccgtcaagccgctgtc

SEQ ID NO: 113866 - DNA, 25 bp, S. pombe
ttttataaggctctatcacagtggg

SEQ ID NO: 113867 - DNA, 25 bp, S. pombe
tttgttccaacaaggtgtcctcgtt

SEQ ID NO: 113868 - DNA, 25 bp, S. pombe
tatactatacaatttgggtcctaat

SEQ ID NO: 113869 - DNA, 25 bp, S. pombe
tatactcccgaatgttgtcagccaa

SEQ ID NO: 113870 - DNA, 25 bp, S. pombe
tttaccttttggcatgctcgatggc

SEQ ID NO: 113871 - DNA, 25 bp, S. pombe
tattagtcttttttggatccggcgg

SEQ ID NO: 113872 - DNA, 25 bp, S. pombe
tttatgacttcgtttgctgtgttag

SEQ ID NO: 113873 - DNA, 25 bp, S. pombe
tttgacactatccaagcagctgatg

SEQ ID NO: 113874 - DNA, 25 bp, S. pombe
tatcttgcacttggaatgctcctgc

SEQ ID NO: 113875 - DNA, 25 bp, S. pombe
tatcatagatttcactctcctgctg

SEQ ID NO: 113876 - DNA, 25 bp, S. pombe
tatcatgaatcttagcgctcctttc

SEQ ID NO: 113877 - DNA, 25 bp, S. pombe
tatcatatttataccaggcttcgca

SEQ ID NO: 113878 - DNA, 25 bp, S. pombe
tatcatgctcagttagggcgcgaat

SEQ ID NO: 113879 - DNA, 25 bp, S. pombe
tatctctcgatgaacctcaaaggct

SEQ ID NO: 113880 - DNA, 25 bp, S. pombe
tatctttccttacgttatctccaca

SEQ ID NO: 113881 - DNA, 25 bp, S. pombe
tataattcccagatcgttcttcgct

SEQ ID NO: 113882 - DNA, 25 bp, S. pombe
tataatctacccaaggttcgacctt

SEQ ID NO: 113883 - DNA, 25 bp, S. pombe
tattgattacccaggctctaacttg

SEQ ID NO: 113884 - DNA, 25 bp, S. pombe
ttttcggccacttttattcgtgctc

SEQ ID NO: 113885 - DNA, 25 bp, S. pombe
tattgtgggccggattttccagccc

SEQ ID NO: 113886 - DNA, 25 bp, S. pombe
tatttggaccctagctttgaagccc

SEQ ID NO: 113887 - DNA, 25 bp, S. pombe
tattggaatcccttgttggcaacaa

SEQ ID NO: 113888 - DNA, 25 bp, S. pombe
tatatgaaatcctctgggcccgata

SEQ ID NO: 113889 - DNA, 25 bp, S. pombe
tatcttcttacgtttccaattcttc

SEQ ID NO: 113890 - DNA, 25 bp, S. pombe
tatcttgtaacggtgtattttccca

SEQ ID NO: 113891 - DNA, 25 bp, S. pombe
tatacttagaccgttgctttccaaa

SEQ ID NO: 113892 - DNA, 25 bp, S. pombe
tatactttgaccgtgcttcttctaa

SEQ ID NO: 113893 - DNA, 25 bp, S. pombe
tattctcgtcgtttccttaaaggtg

SEQ ID NO: 113894 - DNA, 25 bp, S. pombe
tttccgcatggctctttttgaaggt

SEQ ID NO: 113895 - DNA, 25 bp, S. pombe
tatcgcggctcttgtgtcaacatat

SEQ ID NO: 113896 - DNA, 25 bp, S. pombe
tataccttttgctatagtgggtgcc

SEQ ID NO: 113897 - DNA, 25 bp, S. pombe
tattttgctcctttgtgcgttgtta

SEQ ID NO: 113898 - DNA, 25 bp, S. pombe
tatcttggtcttttcggatctctta

SEQ ID NO: 113899 - DNA, 25 bp, S. pombe
ttctagggctatccgaagggctcga

SEQ ID NO: 113900 - DNA, 25 bp, S. pombe
tataaccgctgttcctatatggtca

SEQ ID NO: 113901 - DNA, 25 bp, S. pombe
tataatcccggctatccatatatgg

SEQ ID NO: 113902 - DNA, 25 bp, S. pombe
tatttcccggtgactctgagatcga

SEQ ID NO: 113903 - DNA, 25 bp, S. pombe
tattgatcccgcagagtcttacgtt

SEQ ID NO: 113904 - DNA, 25 bp, S. pombe
tataagcgtcgtaatgatcctcatt

SEQ ID NO: 113905 - DNA, 25 bp, S. pombe
tatacatgactcgtgtttcctggct

SEQ ID NO: 113906 - DNA, 25 bp, S. pombe
tatacaaacgcctattcgcagactt

SEQ ID NO: 113907 - DNA, 25 bp, S. pombe
tataggaagcgcttgccgcatagcc

SEQ ID NO: 113908 - DNA, 25 bp, S. pombe
tatagcactaaaggccttccctgga

SEQ ID NO: 113909 - DNA, 25 bp, S. pombe
ttagctattacccacttacacgaga

SEQ ID NO: 113910 - DNA, 25 bp, S. pombe
ttgttattacccctgaatccgaatc

SEQ ID NO: 113911 - DNA, 25 bp, S. pombe
tatttttcaaactggccgcttttct

SEQ ID NO: 113912 - DNA, 25 bp, S. pombe
tttgtcttcagacctcaagtcgtat

SEQ ID NO: 113913 - DNA, 25 bp, S. pombe
tatttcttacatcaccgtcgtatgc

SEQ ID NO: 113914 - DNA, 25 bp, S. pombe
tatagctttaacaacctctggtatg

SEQ ID NO: 113915 - DNA, 25 bp, S. pombe
ttggcgtctcaaaactatcggaatg

SEQ ID NO: 113916 - DNA, 25 bp, S. pombe
tattttcgagttttgacggcgcatc

SEQ ID NO: 113917 - DNA, 25 bp, S. pombe
tatcattatcgtagtcttccaggga

SEQ ID NO: 113918 - DNA, 25 bp, S. pombe
tatcaggatccatttgttgccgttg

SEQ ID NO: 113919 - DNA, 25 bp, S. pombe
tttgttgacccttacacctatgcat

SEQ ID NO: 113920 - DNA, 25 bp, S. pombe
tatcattagcactccaacgccttgg

SEQ ID NO: 113921 - DNA, 25 bp, S. pombe
tattcttaaatttgtcgagcgccac

SEQ ID NO: 113922 - DNA, 25 bp, S. pombe
tatcagtttttcaagctagcgccct

SEQ ID NO: 113923 - DNA, 25 bp, S. pombe
tatcaagttgttccagccatctttc

SEQ ID NO: 113924 - DNA, 25 bp, S. pombe
tatcaagtcgcttacagttgcctct

SEQ ID NO: 113925 - DNA, 25 bp, S. pombe
tatatctgtggttgaacctgccgct

SEQ ID NO: 113926 - DNA, 25 bp, S. pombe
tattgctcgtaagcgtggtcgtcta

SEQ ID NO: 113927 - DNA, 25 bp, S. pombe
ttactttatagcagcaggtgccgct

SEQ ID NO: 113928 - DNA, 25 bp, S. pombe
tatacttttcatcagcagcggcatc

SEQ ID NO: 113929 - DNA, 25 bp, S. pombe
tatcgatgcttttcttgggtttctc

SEQ ID NO: 113930 - DNA, 25 bp, S. pombe
tatcgatgctttttcacgagccttt

SEQ ID NO: 113931 - DNA, 25 bp, S. pombe
tatcgacttttttcacgttctttgt

SEQ ID NO: 113932 - DNA, 25 bp, S. pombe
tattaattgttctctccttctttgt

SEQ ID NO: 113933 - DNA, 25 bp, S. pombe
tattaattgcttttgtttccttccg

SEQ ID NO: 113934 - DNA, 25 bp, S. pombe
ttaaagactttatccctagcacaaa

SEQ ID NO: 113935 - DNA, 25 bp, S. pombe
tattactcgcattagccacggatac

SEQ ID NO: 113936 - DNA, 25 bp, S. pombe
tatcttgctgcgcttgccaatgaat

SEQ ID NO: 113937 - DNA, 25 bp, S. pombe
tattctgttgcgtgaaatgaaccct

SEQ ID NO: 113938 - DNA, 25 bp, S. pombe
tattttgctagatggcttaacgcct

SEQ ID NO: 113939 - DNA, 25 bp, S. pombe
tataattgtgtaggccatcctcacc

SEQ ID NO: 113940 - DNA, 25 bp, S. pombe
tataataaatatgccacctcccctt

SEQ ID NO: 113941 - DNA, 25 bp, S. pombe
tatttatcgacggtcaacccagcgt

SEQ ID NO: 113942 - DNA, 25 bp, S. pombe
tttggaagccaagaaacgccgtatt

SEQ ID NO: 113943 - DNA, 25 bp, S. pombe
ttgacgggccctgattaccaaaagt

SEQ ID NO: 113944 - DNA, 25 bp, S. pombe
tataccgccccggaaatccaaagat

SEQ ID NO: 113945 - DNA, 25 bp, S. pombe
tattttctccctgaaatcccaggtt

SEQ ID NO: 113946 - DNA, 25 bp, S. pombe
tatcttcgtataactctgagcccaa

SEQ ID NO: 113947 - DNA, 25 bp, S. pombe
tatactcttgtaatcctgatgccaa

SEQ ID NO: 113948 - DNA, 25 bp, S. pombe
tatatggcttgaacctcgcgcacag

SEQ ID NO: 113949 - DNA, 25 bp, S. pombe
tatatgcagctgtatccactaggcc

SEQ ID NO: 113950 - DNA, 25 bp, S. pombe
tataggtaacatggcgcggtcagat

SEQ ID NO: 113951 - DNA, 25 bp, S. pombe
tatcttcatgaaccctcttgtgcag

SEQ ID NO: 113952 - DNA, 25 bp, S. pombe
tttctaaaatccgtcgtgctgctcg

SEQ ID NO: 113953 - DNA, 25 bp, S. pombe
tttgaaaaagctgccggctgcttac

SEQ ID NO: 113954 - DNA, 25 bp, S. pombe
tatatacttctacccctgtttttcg

SEQ ID NO: 113955 - DNA, 25 bp, S. pombe
ttagatccattaccaccttatcatc

SEQ ID NO: 113956 - DNA, 25 bp, S. pombe
tatagtccatcgtacctgcttaatc

SEQ ID NO: 113957 - DNA, 25 bp, S. pombe
tatagtaatcgctcacaggctctcc

SEQ ID NO: 113958 - DNA, 25 bp, S. pombe
tatagagccgtctcaagttcctggg

SEQ ID NO: 113959 - DNA, 25 bp, S. pombe
tataagtgattctgccctttcggac

SEQ ID NO: 113960 - DNA, 25 bp, S. pombe
tattagtgattctaccccttcagac

SEQ ID NO: 113961 - DNA, 25 bp, S. pombe
tatctgtggattctacttctaccct

SEQ ID NO: 113962 - DNA, 25 bp, S. pombe
tatatttcctttttctaactgccgg

SEQ ID NO: 113963 - DNA, 25 bp, S. pombe
tatattccttttcggtagcagctgg

SEQ ID NO: 113964 - DNA, 25 bp, S. pombe
tatttctgctgccttgggtaagtgc

SEQ ID NO: 113965 - DNA, 25 bp, S. pombe
ttctgggctcagtggttgcgtaagt

SEQ ID NO: 113966 - DNA, 25 bp, S. pombe
tatctgctgggcattgtctctgtaa

SEQ ID NO: 113967 - DNA, 25 bp, S. pombe
tatctgcttggtgtgtttgttctaa

SEQ ID NO: 113968 - DNA, 25 bp, S. pombe
tatcttctgggcgtactttagctaa

SEQ ID NO: 113969 - DNA, 25 bp, S. pombe
tatttgtacctttgcgtcggtcaca

SEQ ID NO: 113970 - DNA, 25 bp, S. pombe
tatcttgcccaaatctcatgtacca

SEQ ID NO: 113971 - DNA, 25 bp, S. pombe
tatttcatggacaatcacttactca

SEQ ID NO: 113972 - DNA, 25 bp, S. pombe
tattcctggatctacaactgttcaa

SEQ ID NO: 113973 - DNA, 25 bp, S. pombe
tatttcgggcacaaccttgctaagg

SEQ ID NO: 113974 - DNA, 25 bp, S. pombe
tatttacggacgtcgtgctgcaaat

SEQ ID NO: 113975 - DNA, 25 bp, S. pombe
tatttacagcgggttcggcaaacga

SEQ ID NO: 113976 - DNA, 25 bp, S. pombe
tatttccttgtcgacggtgtcagac

SEQ ID NO: 113977 - DNA, 25 bp, S. pombe
tatagtcctttggtgccttgaacgc

SEQ ID NO: 113978 - DNA, 25 bp, S. pombe
tataatccttgtatgccttgctgtc

SEQ ID NO: 113979 - DNA, 25 bp, S. pombe
ttttattcccgctttggatgagcta

SEQ ID NO: 113980 - DNA, 25 bp, S. pombe
tttgttacgccctcattgatgacat

SEQ ID NO: 113981 - DNA, 25 bp, S. pombe
tatctttctcaggtgcaatcttttt

SEQ ID NO: 113982 - DNA, 25 bp, S. pombe
tattagttccgccaattctgatatt

SEQ ID NO: 113983 - DNA, 25 bp, S. pombe
tatttcggtagctaactccaggttg

SEQ ID NO: 113984 - DNA, 25 bp, S. pombe
tttaccatgggatcgaggctattct

SEQ ID NO: 113985 - DNA, 25 bp, S. pombe
ttactctcgtcgtggtgactcgtac

SEQ ID NO: 113986 - DNA, 25 bp, S. pombe
tatactgtggtgaagctggcgatac

SEQ ID NO: 113987 - DNA, 25 bp, S. pombe
tatttcgatctttacctgctgacac

SEQ ID NO: 113988 - DNA, 25 bp, S. pombe
tatttagagattccctcgcattctt

SEQ ID NO: 113989 - DNA, 25 bp, S. pombe
tatcattggatgctgacgctccttt

SEQ ID NO: 113990 - DNA, 25 bp, S. pombe
tatcttggaggaatcgccccatgtt

SEQ ID NO: 113991 - DNA, 25 bp, S. pombe
tattcactcgtgattcctcaatgga

SEQ ID NO: 113992 - DNA, 25 bp, S. pombe
tatcaggaattgacctttctgcaga

SEQ ID NO: 113993 - DNA, 25 bp, S. pombe
tatatggcagcactactaatacaag

SEQ ID NO: 113994 - DNA, 25 bp, S. pombe
ttatgacggagccatgtatgcctaa

SEQ ID NO: 113995 - DNA, 25 bp, S. pombe
tttgatcttacttttacccttcgct

SEQ ID NO: 113996 - DNA, 25 bp, S. pombe
tttcacgtacgataacccttcctca

SEQ ID NO: 113997 - DNA, 25 bp, S. pombe
tttccttccggagagccatttaaca

SEQ ID NO: 113998 - DNA, 25 bp, S. pombe
tattatacccgacttttattccctg

SEQ ID NO: 113999 - DNA, 25 bp, S. pombe
tatttattctttctttttcgcctca

SEQ ID NO: 114000 - DNA, 25 bp, S. pombe
tatttttgtttcctttaccgctgct

SEQ ID NO: 114001 - DNA, 25 bp, S. pombe
tattgtttacctttttgcaacgcgt

SEQ ID NO: 114002 - DNA, 25 bp, S. pombe
tattttgtacttgttccccagttgt

SEQ ID NO: 114003 - DNA, 25 bp, S. pombe
tattattttggttacaccccagtcg

SEQ ID NO: 114004 - DNA, 25 bp, S. pombe
tataatttcttctacccaacgtcca

SEQ ID NO: 114005 - DNA, 25 bp, S. pombe
tataaggctcttttcactcaacgtg

SEQ ID NO: 114006 - DNA, 25 bp, S. pombe
ttagggcttatcaaacctaccgctc

SEQ ID NO: 114007 - DNA, 25 bp, S. pombe
tatttggattctcaatccgacccct

SEQ ID NO: 114008 - DNA, 25 bp, S. pombe
tatatggctatagacgcaaatgcgc

SEQ ID NO: 114009 - DNA, 25 bp, S. pombe
tatacgctcaactagtgccatctgg

SEQ ID NO: 114010 - DNA, 25 bp, S. pombe
tattgcatatttcccaaccacattc

SEQ ID NO: 114011 - DNA, 25 bp, S. pombe
tatcttgtacaagctccaaactgaa

SEQ ID NO: 114012 - DNA, 25 bp, S. pombe
tattttacagaagccatgaccgaag

SEQ ID NO: 114013 - DNA, 25 bp, S. pombe
tatttttggaaatggccgcgagcag

SEQ ID NO: 114014 - DNA, 25 bp, S. pombe
tttcgtcattttcgaccacgttaag

SEQ ID NO: 114015 - DNA, 25 bp, S. pombe
tttcgccaatcgtcgagaagcgtta

SEQ ID NO: 114016 - DNA, 25 bp, S. pombe
tatttgcaccttcccgctgaggttg

SEQ ID NO: 114017 - DNA, 25 bp, S. pombe
tattacagcctatctggcgaagccc

SEQ ID NO: 114018 - DNA, 25 bp, S. pombe
tattctctggttaggtatggctttc

SEQ ID NO: 114019 - DNA, 25 bp, S. pombe
tatagcatgccgtctggtgaacctt

SEQ ID NO: 114020 - DNA, 25 bp, S. pombe
tataatgcatcgttttcgtcttccc

SEQ ID NO: 114021 - DNA, 25 bp, S. pombe
tatcataccttcatctgcttcttta

SEQ ID NO: 114022 - DNA, 25 bp, S. pombe
tatcataccatgcattttcctctgt

SEQ ID NO: 114023 - DNA, 25 bp, S. pombe
tatagacactatcattcccttacac

SEQ ID NO: 114024 - DNA, 25 bp, S. pombe
tatttgttagcttgctgcagcaccc

SEQ ID NO: 114025 - DNA, 25 bp, S. pombe
tattttcaagcttcggcatccagac

SEQ ID NO: 114026 - DNA, 25 bp, S. pombe
tattcagtccctgcaggatttgcct

SEQ ID NO: 114027 - DNA, 25 bp, S. pombe
tattaagccctggaacactggtgct

SEQ ID NO: 114028 - DNA, 25 bp, S. pombe
ttctgttgcagtcgaaagtccggct

SEQ ID NO: 114029 - DNA, 25 bp, S. pombe
tttggtcatgatggccgaatccggt

SEQ ID NO: 114030 - DNA, 25 bp, S. pombe
tttgcctctgtaccgaagggtgttg

SEQ ID NO: 114031 - DNA, 25 bp, S. pombe
tattatgccgctcaaggtaccgact

SEQ ID NO: 114032 - DNA, 25 bp, S. pombe
tattagcactcttagggatcctcaa

SEQ ID NO: 114033 - DNA, 25 bp, S. pombe
tatttatgtgcggattgcggagcgc

SEQ ID NO: 114034 - DNA, 25 bp, S. pombe
tatattgcgatcagccttgggcatt

SEQ ID NO: 114035 - DNA, 25 bp, S. pombe
tatactgatcgagttggccgtcctt

SEQ ID NO: 114036 - DNA, 25 bp, S. pombe
tttgatcgattcagtccatcctctt

SEQ ID NO: 114037 - DNA, 25 bp, S. pombe
ttagccgtattcatggtggcccagc

SEQ ID NO: 114038 - DNA, 25 bp, S. pombe
tttactgtgcattgggtttcggcat

SEQ ID NO: 114039 - DNA, 25 bp, S. pombe
tattcactctcgtgtggtccgtgtt

SEQ ID NO: 114040 - DNA, 25 bp, S. pombe
tattattcacattcgggtcagcctg

SEQ ID NO: 114041 - DNA, 25 bp, S. pombe
tatagattccatagggcgtcgacgc

SEQ ID NO: 114042 - DNA, 25 bp, S. pombe
tattatttccgatggcgctactgca

SEQ ID NO: 114043 - DNA, 25 bp, S. pombe
tatttaatcgcgaaagcctttgaaa

SEQ ID NO: 114044 - DNA, 25 bp, S. pombe
tattatttcctggaccgctttgaac

SEQ ID NO: 114045 - DNA, 25 bp, S. pombe
tatttttgccgcctacttgttgaaa

SEQ ID NO: 114046 - DNA, 25 bp, S. pombe
tatttctccgtcctggttttatgta

SEQ ID NO: 114047 - DNA, 25 bp, S. pombe
ttgggttgagcactgtcgacgtatc

SEQ ID NO: 114048 - DNA, 25 bp, S. pombe
tttggttgagcccattcacggtagc

SEQ ID NO: 114049 - DNA, 25 bp, S. pombe
tttggttgcgtcaaggatggtagac

SEQ ID NO: 114050 - DNA, 25 bp, S. pombe
tttggttgcaacaaggtcactcctc

SEQ ID NO: 114051 - DNA, 25 bp, S. pombe
tatatttacacatacccgcttgcat

SEQ ID NO: 114052 - DNA, 25 bp, S. pombe
tttcatctaccaaaccactttcaag

SEQ ID NO: 114053 - DNA, 25 bp, S. pombe
tttctcgaccaacacttcttaacaa

SEQ ID NO: 114054 - DNA, 25 bp, S. pombe
tattcacaaatcattctccttcgtc

SEQ ID NO: 114055 - DNA, 25 bp, S. pombe
tattagatgctagcgccacaatgga

SEQ ID NO: 114056 - DNA, 25 bp, S. pombe
tatatagatccagacgctcaacgtg

SEQ ID NO: 114057 - DNA, 25 bp, S. pombe
tattagttcatgacaaccaggcaga

SEQ ID NO: 114058 - DNA, 25 bp, S. pombe
tattgctgtcagtcgctagaggaaa

SEQ ID NO: 114059 - DNA, 25 bp, S. pombe
tattgttgctgccactcacagagat

SEQ ID NO: 114060 - DNA, 25 bp, S. pombe
tattgtgagctaccatcagccatct

SEQ ID NO: 114061 - DNA, 25 bp, S. pombe
tattgctggctcctccgtatattat

SEQ ID NO: 114062 - DNA, 25 bp, S. pombe
tatatgtcgtcgtgcgtcagagctt

SEQ ID NO: 114063 - DNA, 25 bp, S. pombe
tatacgcatacctctatcctcttga

SEQ ID NO: 114064 - DNA, 25 bp, S. pombe
tatatcgaatccgacttctatccca

SEQ ID NO: 114065 - DNA, 25 bp, S. pombe
tatagtggcacttactgcttctagc

SEQ ID NO: 114066 - DNA, 25 bp, S. pombe
tatattggtccattgcatctttaca

SEQ ID NO: 114067 - DNA, 25 bp, S. pombe
tattgatgatctcgtccactttacc

SEQ ID NO: 114068 - DNA, 25 bp, S. pombe
tattatgatcttgctactccgacac

SEQ ID NO: 114069 - DNA, 25 bp, S. pombe
tataccttcatctatacccaattgc

SEQ ID NO: 114070 - DNA, 25 bp, S. pombe
tatacagttctttaccgactatgaa

SEQ ID NO: 114071 - DNA, 25 bp, S. pombe
tatttggccttcttccgtcgtgaaa

SEQ ID NO: 114072 - DNA, 25 bp, S. pombe
ttttggccgtccacgattctaaaga

SEQ ID NO: 114073 - DNA, 25 bp, S. pombe
tatatttgggttcccgtactcaaag

SEQ ID NO: 114074 - DNA, 25 bp, S. pombe
tattttggaattttcctcactcggg

SEQ ID NO: 114075 - DNA, 25 bp, S. pombe
tattttatggattttctgccgcctg

SEQ ID NO: 114076 - DNA, 25 bp, S. pombe
tattatcattgatccgcactctgcc

SEQ ID NO: 114077 - DNA, 25 bp, S. pombe
tattaattcttaccctgttggccag

SEQ ID NO: 114078 - DNA, 25 bp, S. pombe
tattaatatcttctgccttgcaacc

SEQ ID NO: 114079 - DNA, 25 bp, S. pombe
ttgctggtggtgctagtcgtaacat

SEQ ID NO: 114080 - DNA, 25 bp, S. pombe
tattttgactcctcacattggtggt

SEQ ID NO: 114081 - DNA, 25 bp, S. pombe
ttcgttgtagcctccaaggatgctt

SEQ ID NO: 114082 - DNA, 25 bp, S. pombe
ttggtgtggaccttgcaaggccatt

SEQ ID NO: 114083 - DNA, 25 bp, S. pombe
tatttgccgtccttgcaaggcgata

SEQ ID NO: 114084 - DNA, 25 bp, S. pombe
tattcatccagtgccgacggaggag

SEQ ID NO: 114085 - DNA, 25 bp, S. pombe
tataaccctttgaagctgccattgg

SEQ ID NO: 114086 - DNA, 25 bp, S. pombe
tataaaccgctcaaagtggcatatg

SEQ ID NO: 114087 - DNA, 25 bp, S. pombe
tatagttttgtcacttcattggaaa

SEQ ID NO: 114088 - DNA, 25 bp, S. pombe
tatactacctacacttcttctgaag

SEQ ID NO: 114089 - DNA, 25 bp, S. pombe
tatacaggctctattcttttccaac

SEQ ID NO: 114090 - DNA, 25 bp, S. pombe
tattgaattaactgccggaggaggc

SEQ ID NO: 114091 - DNA, 25 bp, S. pombe
tttggactttcggtggactcttata

SEQ ID NO: 114092 - DNA, 25 bp, S. pombe
tttggctcattctctcgtaccatta

SEQ ID NO: 114093 - DNA, 25 bp, S. pombe
tattggcatcatttaccttacagtg

SEQ ID NO: 114094 - DNA, 25 bp, S. pombe
tatactcacttttcacattcttctg

SEQ ID NO: 114095 - DNA, 25 bp, S. pombe
tatacctatggttcgaagcctttcc

SEQ ID NO: 114096 - DNA, 25 bp, S. pombe
tatttcgtggatttagcagtctttc

SEQ ID NO: 114097 - DNA, 25 bp, S. pombe
tatttgcgggtcttgtgcgatgaat

SEQ ID NO: 114098 - DNA, 25 bp, S. pombe
tatttgcggttcttgtgcctctgtc

SEQ ID NO: 114099 - DNA, 25 bp, S. pombe
tatttggactcggtggtctctgatc

SEQ ID NO: 114100 - DNA, 25 bp, S. pombe
tattttttcggtagtgttgctgccc

SEQ ID NO: 114101 - DNA, 25 bp, S. pombe
tattttggctacttgttcgactgac

SEQ ID NO: 114102 - DNA, 25 bp, S. pombe
tatagcaatgtcgatacccttcact

SEQ ID NO: 114103 - DNA, 25 bp, S. pombe
tataaatacgcactccaacctttgt

SEQ ID NO: 114104 - DNA, 25 bp, S. pombe
tattagaagaccttgagccccttgg

SEQ ID NO: 114105 - DNA, 25 bp, S. pombe
ttttaaaaatcgaagctcctctgag

SEQ ID NO: 114106 - DNA, 25 bp, S. pombe
tttctaaaactaccgctcctgataa

SEQ ID NO: 114107 - DNA, 25 bp, S. pombe
tattgcttacgataacgctccttac

SEQ ID NO: 114108 - DNA, 25 bp, S. pombe
tttagcttctttgggagtccttcga

SEQ ID NO: 114109 - DNA, 25 bp, S. pombe
tttggtctcttttggtatggcttcc

SEQ ID NO: 114110 - DNA, 25 bp, S. pombe
tattggtctttttgggaatctccct

SEQ ID NO: 114111 - DNA, 25 bp, S. pombe
tattgaccttttacggagacgactt

SEQ ID NO: 114112 - DNA, 25 bp, S. pombe
tattaccttggaattgttgcctttt

SEQ ID NO: 114113 - DNA, 25 bp, S. pombe
tattatctatctcgttggtgggctc

SEQ ID NO: 114114 - DNA, 25 bp, S. pombe
tataacatgtctcttgctgcttcca

SEQ ID NO: 114115 - DNA, 25 bp, S. pombe
tatatgatggtattcctctgcttcc

SEQ ID NO: 114116 - DNA, 25 bp, S. pombe
tataccgatgtgtcgctcaagcgat

SEQ ID NO: 114117 - DNA, 25 bp, S. pombe
tataccatttgctccaaggtgctgg

SEQ ID NO: 114118 - DNA, 25 bp, S. pombe
tattcagcttgcaaccgaccggata

SEQ ID NO: 114119 - DNA, 25 bp, S. pombe
tattcgaatggaccgccagctggta

SEQ ID NO: 114120 - DNA, 25 bp, S. pombe
tattttcgtacttatctgcggcaga

SEQ ID NO: 114121 - DNA, 25 bp, S. pombe
tattcttacctctttttgtttgctg

SEQ ID NO: 114122 - DNA, 25 bp, S. pombe
tatttatacctctttggctttccgg

SEQ ID NO: 114123 - DNA, 25 bp, S. pombe
tattttggtccttttttagcacgca

SEQ ID NO: 114124 - DNA, 25 bp, S. pombe
tatattctgtgcatctccaatgttg

SEQ ID NO: 114125 - DNA, 25 bp, S. pombe
tattatcgtcattcactcgtgtttg

SEQ ID NO: 114126 - DNA, 25 bp, S. pombe
tattacatctacacatcacccattt

SEQ ID NO: 114127 - DNA, 25 bp, S. pombe
ttaagttatcgcgttgttcaagtag

SEQ ID NO: 114128 - DNA, 25 bp, S. pombe
tattgctattgccatggttcctcaa

SEQ ID NO: 114129 - DNA, 25 bp, S. pombe
tattgactactctgatcctaatgca

SEQ ID NO: 114130 - DNA, 25 bp, S. pombe
tttggctactggttcctacacagag

SEQ ID NO: 114131 - DNA, 25 bp, S. pombe
tttggctaccagtcttttagctcag

SEQ ID NO: 114132 - DNA, 25 bp, S. pombe
tattgggcccagcttttcgaaagca

SEQ ID NO: 114133 - DNA, 25 bp, S. pombe
ttagtctcaattttttccctgtaag

SEQ ID NO: 114134 - DNA, 25 bp, S. pombe
tatttcctttaattgtggccgctac

SEQ ID NO: 114135 - DNA, 25 bp, S. pombe
tattacttggcttgttgttgctcgt

SEQ ID NO: 114136 - DNA, 25 bp, S. pombe
tttagttcctagtcgtgatcttgtg

SEQ ID NO: 114137 - DNA, 25 bp, S. pombe
tattaacgcaatagacttggtctgg

SEQ ID NO: 114138 - DNA, 25 bp, S. pombe
tattaacgcgtcgtcgtggtcatgt

SEQ ID NO: 114139 - DNA, 25 bp, S. pombe
tttgacaccttcagagttgacggat

SEQ ID NO: 114140 - DNA, 25 bp, S. pombe
tatatgccatccttcgaagtagacg

SEQ ID NO: 114141 - DNA, 25 bp, S. pombe
tattctacagcgtgaaacttctgaa

SEQ ID NO: 114142 - DNA, 25 bp, S. pombe
tattgatatacctttaccttctgaa

SEQ ID NO: 114143 - DNA, 25 bp, S. pombe
tatttactcgtttctgcattcctag

SEQ ID NO: 114144 - DNA, 25 bp, S. pombe
tattgctattcaggcttctgtacct

SEQ ID NO: 114145 - DNA, 25 bp, S. pombe
tattctgcttccgattatcttcctg

SEQ ID NO: 114146 - DNA, 25 bp, S. pombe
tatattgcattctctgttatcccgg

SEQ ID NO: 114147 - DNA, 25 bp, S. pombe
ttaccagtcaagtgtacccatcgca

SEQ ID NO: 114148 - DNA, 25 bp, S. pombe
tattgtacgaaacgtcccagcacct

SEQ ID NO: 114149 - DNA, 25 bp, S. pombe
tatttagcgaatagtgcccgaccac

SEQ ID NO: 114150 - DNA, 25 bp, S. pombe
tttcattccgaaagggtggtctgca

SEQ ID NO: 114151 - DNA, 25 bp, S. pombe
ttgtcttccaaaacgtcaaacgcgc

SEQ ID NO: 114152 - DNA, 25 bp, S. pombe
tatattactgattcctacccatcgg

SEQ ID NO: 114153 - DNA, 25 bp, S. pombe
tatatggactttttcctgccacgag

SEQ ID NO: 114154 - DNA, 25 bp, S. pombe
tatatggatcctaattactcttctg

SEQ ID NO: 114155 - DNA, 25 bp, S. pombe
tatttgcctctaattacctttcttg

SEQ ID NO: 114156 - DNA, 25 bp, S. pombe
ttaggccgcgttaagggtcatttcg

SEQ ID NO: 114157 - DNA, 25 bp, S. pombe
tttgccggcgttaccaagtatttga

SEQ ID NO: 114158 - DNA, 25 bp, S. pombe
tttcaaccttgctatagggctcttt

SEQ ID NO: 114159 - DNA, 25 bp, S. pombe
tattttgccttggagcgtacatacc

SEQ ID NO: 114160 - DNA, 25 bp, S. pombe
tattgacgatgctacccaatggtac

SEQ ID NO: 114161 - DNA, 25 bp, S. pombe
tatattggctgtttcttgcggcgat

SEQ ID NO: 114162 - DNA, 25 bp, S. pombe
tattatggtgtttcgctattcagca

SEQ ID NO: 114163 - DNA, 25 bp, S. pombe
tattctatttgtttcaacgcttgga

SEQ ID NO: 114164 - DNA, 25 bp, S. pombe
tatttctgttctttcacctcgggaa

SEQ ID NO: 114165 - DNA, 25 bp, S. pombe
tatttcatgttcctcgacctaacga

SEQ ID NO: 114166 - DNA, 25 bp, S. pombe
tatattctattcttcgattgctcga

SEQ ID NO: 114167 - DNA, 25 bp, S. pombe
tatattgatttctctgctcccgata

SEQ ID NO: 114168 - DNA, 25 bp, S. pombe
tatattaattctacctcccagccta

SEQ ID NO: 114169 - DNA, 25 bp, S. pombe
tttcaacagcgtgcctctcaattaa

SEQ ID NO: 114170 - DNA, 25 bp, S. pombe
tttgaaagtgtaggacccgctccgc

SEQ ID NO: 114171 - DNA, 25 bp, S. pombe
tttcatgtcgaaggctagcgatacc

SEQ ID NO: 114172 - DNA, 25 bp, S. pombe
tttcctggcaatttaaacaccctga

SEQ ID NO: 114173 - DNA, 25 bp, S. pombe
ttttacgatccttaatcacccattc

SEQ ID NO: 114174 - DNA, 25 bp, S. pombe
ttttatggtccacaaggcccttata

SEQ ID NO: 114175 - DNA, 25 bp, S. pombe
tttgcttctccctgaaaccaagatg

SEQ ID NO: 114176 - DNA, 25 bp, S. pombe
tattcatggatcttcttctaacccc

SEQ ID NO: 114177 - DNA, 25 bp, S. pombe
tattttctcaacttctcaatcgcac

SEQ ID NO: 114178 - DNA, 25 bp, S. pombe
tatattctcctgactgtcctacgaa

SEQ ID NO: 114179 - DNA, 25 bp, S. pombe
tattttgcaagccttactccatcaa

SEQ ID NO: 114180 - DNA, 25 bp, S. pombe
tatagtgtcaatggcatcctctcct

SEQ ID NO: 114181 - DNA, 25 bp, S. pombe
tatatggtgaacgtgctggctgctt

SEQ ID NO: 114182 - DNA, 25 bp, S. pombe
tatttggaatccttgcgttgtcagg

SEQ ID NO: 114183 - DNA, 25 bp, S. pombe
tatattcatcaagtcctttctccgc

SEQ ID NO: 114184 - DNA, 25 bp, S. pombe
tatatatgataaacctccacctcct

SEQ ID NO: 114185 - DNA, 25 bp, S. pombe
tattggacctaaaggcctttcctca

SEQ ID NO: 114186 - DNA, 25 bp, S. pombe
ttttacctagaatggttggtgctca

SEQ ID NO: 114187 - DNA, 25 bp, S. pombe
ttaacacccgtgatggtcagtcttt

SEQ ID NO: 114188 - DNA, 25 bp, S. pombe
ttaatgaaccctatggtgcccagtc

SEQ ID NO: 114189 - DNA, 25 bp, S. pombe
tttacagacacattttgggcccagc

SEQ ID NO: 114190 - DNA, 25 bp, S. pombe
tatttgcgccttcaaactcactagt

SEQ ID NO: 114191 - DNA, 25 bp, S. pombe
tatttagcctttcatcccgtggatt

SEQ ID NO: 114192 - DNA, 25 bp, S. pombe
ttttggccattgattcgtcgggatc

SEQ ID NO: 114193 - DNA, 25 bp, S. pombe
tattgctggcgctgtcaatgctaca

SEQ ID NO: 114194 - DNA, 25 bp, S. pombe
tttggatgatgctacacgcgctaaa

SEQ ID NO: 114195 - DNA, 25 bp, S. pombe
tatttatgctcttcgatatgctcag

SEQ ID NO: 114196 - DNA, 25 bp, S. pombe
tattcccgccgtttggtccaagatg

SEQ ID NO: 114197 - DNA, 25 bp, S. pombe
tattcagctgaacggccgtatcaac

SEQ ID NO: 114198 - DNA, 25 bp, S. pombe
tattccatccaaaccagagtccaag

SEQ ID NO: 114199 - DNA, 25 bp, S. pombe
tattcccatcaacccgaatgctgag

SEQ ID NO: 114200 - DNA, 25 bp, S. pombe
tattactatcatatccgtcatcatg

SEQ ID NO: 114201 - DNA, 25 bp, S. pombe
tattttaataatcgtcatctgctaa

SEQ ID NO: 114202 - DNA, 25 bp, S. pombe
tatatacctcaagcagtgttcctcc

SEQ ID NO: 114203 - DNA, 25 bp, S. pombe
tattcaccagttttttcagcatccc

SEQ ID NO: 114204 - DNA, 25 bp, S. pombe
tatattgccgcatcatttctctctg

SEQ ID NO: 114205 - DNA, 25 bp, S. pombe
tatattcctttgttctctgtctaaa

SEQ ID NO: 114206 - DNA, 25 bp, S. pombe
tatttgacttcttcatctcttctca

SEQ ID NO: 114207 - DNA, 25 bp, S. pombe
tatttattcccatcttctgtgccat

SEQ ID NO: 114208 - DNA, 25 bp, S. pombe
tattcttttcccgttatggcaaggc

SEQ ID NO: 114209 - DNA, 25 bp, S. pombe
tatttctgcttagctgtctcaggca

SEQ ID NO: 114210 - DNA, 25 bp, S. pombe
tattttctcaatactgctgtcaaca

SEQ ID NO: 114211 - DNA, 25 bp, S. pombe
tattcattctccaacacatgtccat

SEQ ID NO: 114212 - DNA, 25 bp, S. pombe
tattacccctgtggcattatcgcaa

SEQ ID NO: 114213 - DNA, 25 bp, S. pombe
tattaatccagttcgtgttttgcac

SEQ ID NO: 114214 - DNA, 25 bp, S. pombe
tattacccatctccgtgtttaagca

SEQ ID NO: 114215 - DNA, 25 bp, S. pombe
tatttgctgctgatgaagccctctt

SEQ ID NO: 114216 - DNA, 25 bp, S. pombe
tattggtggtgtcacgcatctcatt

SEQ ID NO: 114217 - DNA, 25 bp, S. pombe
tttgattcgattcacactcctgttg

SEQ ID NO: 114218 - DNA, 25 bp, S. pombe
tttgtgctcgtccaaacactttttt

SEQ ID NO: 114219 - DNA, 25 bp, S. pombe
tttatcctggcgctggaagactttt

SEQ ID NO: 114220 - DNA, 25 bp, S. pombe
ttaccgaacggaactgatccttcat

SEQ ID NO: 114221 - DNA, 25 bp, S. pombe
tattcctttccacgcatagcttatt

SEQ ID NO: 114222 - DNA, 25 bp, S. pombe
tattccgttcggtcatatgtagcag

SEQ ID NO: 114223 - DNA, 25 bp, S. pombe
tatatgacctccagacatccaatgc

SEQ ID NO: 114224 - DNA, 25 bp, S. pombe
tattgaccccactaacatcatgtgc

SEQ ID NO: 114225 - DNA, 25 bp, S. pombe
tattgcgttccatatctcatgtgat

SEQ ID NO: 114226 - DNA, 25 bp, S. pombe
tttgtcgtcgattaccggttgtatt

SEQ ID NO: 114227 - DNA, 25 bp, S. pombe
ttggtagtaaaagcgtgtcttactg

SEQ ID NO: 114228 - DNA, 25 bp, S. pombe
tttggtagtaaaagcgtgtcttact

SEQ ID NO: 114229 - DNA, 25 bp, S. pombe
ttgtgcgtcgcaaaggtaggttgta

SEQ ID NO: 114230 - DNA, 25 bp, S. pombe
tttgttccgttcgtcaggcttgcta

SEQ ID NO: 114231 - DNA, 25 bp, S. pombe
tttgctatgcaggttcctaaggtta

SEQ ID NO: 114232 - DNA, 25 bp, S. pombe
tattttaggtgctgccctgattgct

SEQ ID NO: 114233 - DNA, 25 bp, S. pombe
tattggttagcgctgtctttttgac

SEQ ID NO: 114234 - DNA, 25 bp, S. pombe
tattctgctgcctctctagaaatga

SEQ ID NO: 114235 - DNA, 25 bp, S. pombe
tttcgctgcgaagtcttgtttaggc

SEQ ID NO: 114236 - DNA, 25 bp, S. pombe
ttttttggagttctttcaggcgctt

SEQ ID NO: 114237 - DNA, 25 bp, S. pombe
tttgtttggtttttgccgaggctgt

SEQ ID NO: 114238 - DNA, 25 bp, S. pombe
tatatcggacgctttttctttccaa

SEQ ID NO: 114239 - DNA, 25 bp, S. pombe
tatatcagcagtacccttttcttct

SEQ ID NO: 114240 - DNA, 25 bp, S. pombe
tattcaatgaatccactcttcgctc

SEQ ID NO: 114241 - DNA, 25 bp, S. pombe
tattcatttatttatctgtcgctaa

SEQ ID NO: 114242 - DNA, 25 bp, S. pombe
tattcttatgtttaccagctccggt

SEQ ID NO: 114243 - DNA, 25 bp, S. pombe
tttcatctactttatctactactgg

SEQ ID NO: 114244 - DNA, 25 bp, S. pombe
ttgggatttatcgacagggacttgt

SEQ ID NO: 114245 - DNA, 25 bp, S. pombe
tttgagacttatggcgcagcggaat

SEQ ID NO: 114246 - DNA, 25 bp, S. pombe
tttggccccagcagcgtgaaatata

SEQ ID NO: 114247 - DNA, 25 bp, S. pombe
tttggtatcacatcgttagctggta

SEQ ID NO: 114248 - DNA, 25 bp, S. pombe
tttggcttccaaatacaactgcgaa

SEQ ID NO: 114249 - DNA, 25 bp, S. pombe
tttgaccgccatagccaaactggta

SEQ ID NO: 114250 - DNA, 25 bp, S. pombe
tattgacctacaactcatcacagcg

SEQ ID NO: 114251 - DNA, 25 bp, S. pombe
tattgctaatgctgctatcaacggc

SEQ ID NO: 114252 - DNA, 25 bp, S. pombe
tattgcaaattagtatcagccgatg

SEQ ID NO: 114253 - DNA, 25 bp, S. pombe
tattcaccagctttatcacctttag

SEQ ID NO: 114254 - DNA, 25 bp, S. pombe
tattaatgatgcgtcgttcgagcca

SEQ ID NO: 114255 - DNA, 25 bp, S. pombe
tattagtggctttgttcgctccaag

SEQ ID NO: 114256 - DNA, 25 bp, S. pombe
tattcgttgcaacatgacggcgcat

SEQ ID NO: 114257 - DNA, 25 bp, S. pombe
tatttcctccaacagtgcagcaatt

SEQ ID NO: 114258 - DNA, 25 bp, S. pombe
tattcatacaactcagggcgacatt

SEQ ID NO: 114259 - DNA, 25 bp, S. pombe
tatttcacaagttcgtgcagccctt

SEQ ID NO: 114260 - DNA, 25 bp, S. pombe
tatttctaccatacttcatgcacct

SEQ ID NO: 114261 - DNA, 25 bp, S. pombe
tattatggccctacttatctctctt

SEQ ID NO: 114262 - DNA, 25 bp, S. pombe
tatttggtgctgtcgcagtggttct

SEQ ID NO: 114263 - DNA, 25 bp, S. pombe
tattgcatggtcctgggaggttctc

SEQ ID NO: 114264 - DNA, 25 bp, S. pombe
tattttgtgtgcctgttgttctacc

SEQ ID NO: 114265 - DNA, 25 bp, S. pombe
tattctctattccagcgtctttatg

SEQ ID NO: 114266 - DNA, 25 bp, S. pombe
tattcgtatggctttactcgcttgt

SEQ ID NO: 114267 - DNA, 25 bp, S. pombe
tattgctgttgacgtataccccgag

SEQ ID NO: 114268 - DNA, 25 bp, S. pombe
tatttcccgtcattattttccatca

SEQ ID NO: 114269 - DNA, 25 bp, S. pombe
tattcttacgatggcaccttctact

SEQ ID NO: 114270 - DNA, 25 bp, S. pombe
tattctccaacaagtccttcatact

SEQ ID NO: 114271 - DNA, 25 bp, S. pombe
tattagagcaccctaactcatctcg

SEQ ID NO: 114272 - DNA, 25 bp, S. pombe
tattgggcttcaaacgttacgctta

SEQ ID NO: 114273 - DNA, 25 bp, S. pombe
tattcaggcttcaaatcagtcccgc

SEQ ID NO: 114274 - DNA, 25 bp, S. pombe
tttccctaagtctcacgtcgtaatt

SEQ ID NO: 114275 - DNA, 25 bp, S. pombe
tttccgtaaccactcaaatcctagt

SEQ ID NO: 114276 - DNA, 25 bp, S. pombe
tttggcctaatgaaacttcccattt

SEQ ID NO: 114277 - DNA, 25 bp, S. pombe
tattggcctaaagagtttgcagatg

SEQ ID NO: 114278 - DNA, 25 bp, S. pombe
tattcccctgaagcagcttatgagg

SEQ ID NO: 114279 - DNA, 25 bp, S. pombe
tattttccatcaggcctttgaaggt

SEQ ID NO: 114280 - DNA, 25 bp, S. pombe
tattgttccattggcagctggtgca

SEQ ID NO: 114281 - DNA, 25 bp, S. pombe
tattcattcctttcagcagctgctg

SEQ ID NO: 114282 - DNA, 25 bp, S. pombe
tattattcctgtttctgctgctgca

SEQ ID NO: 114283 - DNA, 25 bp, S. pombe
tattttccatgctattccttcagtg

SEQ ID NO: 114284 - DNA, 25 bp, S. pombe
tatttgtttgctctgcctctaggaa

SEQ ID NO: 114285 - DNA, 25 bp, S. pombe
tattatgtttctcgctccagtagga

SEQ ID NO: 114286 - DNA, 25 bp, S. pombe
tattagtgactaccctctgagtgca

SEQ ID NO: 114287 - DNA, 25 bp, S. pombe
tattggcatgtcaccaccggtcaaa

SEQ ID NO: 114288 - DNA, 25 bp, S. pombe
tattttctcttgatgtacgtcctgc

SEQ ID NO: 114289 - DNA, 25 bp, S. pombe
tatttttcttcgtatacctcttcct

SEQ ID NO: 114290 - DNA, 25 bp, S. pombe
tattccttttgttaaatcctccact

SEQ ID NO: 114291 - DNA, 25 bp, S. pombe
ttccgctactttaactatacccaat

SEQ ID NO: 114292 - DNA, 25 bp, S. pombe
tattcttacgagtgttttcctatga

SEQ ID NO: 114293 - DNA, 25 bp, S. pombe
tattttacgtgcgtttccgtctaga

SEQ ID NO: 114294 - DNA, 25 bp, S. pombe
tttcattagtcgcttctccgggaac

SEQ ID NO: 114295 - DNA, 25 bp, S. pombe
tattcattggttcttttcggagcat

SEQ ID NO: 114296 - DNA, 25 bp, S. pombe
tattattggtcctctttctgaagaa

SEQ ID NO: 114297 - DNA, 25 bp, S. pombe
tttggctgggcgtgtttctgaagaa

SEQ ID NO: 114298 - DNA, 25 bp, S. pombe
tttgtctggcgttcgttctgttaac

SEQ ID NO: 114299 - DNA, 25 bp, S. pombe
tatttccggcaatgagtttaccacc

SEQ ID NO: 114300 - DNA, 25 bp, S. pombe
tattgttatagctttggccggcaac

SEQ ID NO: 114301 - DNA, 25 bp, S. pombe
tttggtgatcaacctggtcaggcta

SEQ ID NO: 114302 - DNA, 25 bp, S. pombe
tattttatgcatatggtcctgggac

SEQ ID NO: 114303 - DNA, 25 bp, S. pombe
tattatttatcaatggcccggctgg

SEQ ID NO: 114304 - DNA, 25 bp, S. pombe
tttgagtaatcaagcagcaccgcct

SEQ ID NO: 114305 - DNA, 25 bp, S. pombe
tttcgctacgacatttcctcaagat

SEQ ID NO: 114306 - DNA, 25 bp, S. pombe
tttcgaaatcgcctgaagctgttca

SEQ ID NO: 114307 - DNA, 25 bp, S. pombe
tttgtttatagctgatcctccgact

SEQ ID NO: 114308 - DNA, 25 bp, S. pombe
tttaaagacgcctctgtccgtattg

SEQ ID NO: 114309 - DNA, 25 bp, S. pombe
tttgctggtcaaatgcgattgcttt

SEQ ID NO: 114310 - DNA, 25 bp, S. pombe
tattgctggtgtaatgcgttcatca

SEQ ID NO: 114311 - DNA, 25 bp, S. pombe
tttgaagcgcaatcttcagtccctt

SEQ ID NO: 114312 - DNA, 25 bp, S. pombe
tattcaatttctaccttaccatccc

SEQ ID NO: 114313 - DNA, 25 bp, S. pombe
tattaattctattccttctccagtc

SEQ ID NO: 114314 - DNA, 25 bp, S. pombe
tttgcaaggtattcccgctctgcgt

SEQ ID NO: 114315 - DNA, 25 bp, S. pombe
tttggatggctcaacatctcgacgc

SEQ ID NO: 114316 - DNA, 25 bp, S. pombe
tattgcttttaaacgcggttgctat

SEQ ID NO: 114317 - DNA, 25 bp, S. pombe
tatttttgcttgttcggttatcttg

SEQ ID NO: 114318 - DNA, 25 bp, S. pombe
tattgtttctctttccgttcaagga

SEQ ID NO: 114319 - DNA, 25 bp, S. pombe
tattgtttataacctcgtcttggga

SEQ ID NO: 114320 - DNA, 25 bp, S. pombe
tatttcttggaaaccgcttgtgtaa

SEQ ID NO: 114321 - DNA, 25 bp, S. pombe
tttgttgtctcatcaatttcatgga

SEQ ID NO: 114322 - DNA, 25 bp, S. pombe
ttgcgggataacgaccttgaggaat

SEQ ID NO: 114323 - DNA, 25 bp, S. pombe
tttggtgtaaactctcttgcggatt

SEQ ID NO: 114324 - DNA, 25 bp, S. pombe
tttggagagcaaaacccttgtggaa

SEQ ID NO: 114325 - DNA, 25 bp, S. pombe
tattatattctctatcctgctggct

SEQ ID NO: 114326 - DNA, 25 bp, S. pombe
tattcttctggatcatctcgtcgga

SEQ ID NO: 114327 - DNA, 25 bp, S. pombe
tattctctatcattacggcggcgta

SEQ ID NO: 114328 - DNA, 25 bp, S. pombe
tattgctcttgttcaggacggcgat

SEQ ID NO: 114329 - DNA, 25 bp, S. pombe
tattgtatcttaaatgagcgagcgt

SEQ ID NO: 114330 - DNA, 25 bp, S. pombe
tttgcttggcatcgcattgactgga

SEQ ID NO: 114331 - DNA, 25 bp, S. pombe
tttgttgcgcgccatggatattgaa

SEQ ID NO: 114332 - DNA, 25 bp, S. pombe
tttggctactgctgctgttcaagat

SEQ ID NO: 114333 - DNA, 25 bp, S. pombe
tttggtcctctacgcttaaattgtg

SEQ ID NO: 114334 - DNA, 25 bp, S. pombe
ttcgacccacttaagccaaatactg

SEQ ID NO: 114335 - DNA, 25 bp, S. pombe
tattgaccccttttccaaagtctga

SEQ ID NO: 114336 - DNA, 25 bp, S. pombe
ttttcgtggcgttactacagtggtt

SEQ ID NO: 114337 - DNA, 25 bp, S. pombe
ttactcgtgggctttttacgcgaat

SEQ ID NO: 114338 - DNA, 25 bp, S. pombe
ttagtcgcgtcctttttccgaatat

SEQ ID NO: 114339 - DNA, 25 bp, S. pombe
tattgcggttcgtttttctccaatt

SEQ ID NO: 114340 - DNA, 25 bp, S. pombe
tttggctttcggctttaaaattgtg

SEQ ID NO: 114341 - DNA, 25 bp, S. pombe
tattttacaagcgatgccacctccg

SEQ ID NO: 114342 - DNA, 25 bp, S. pombe
tttggatacactaagggccctggaa

SEQ ID NO: 114343 - DNA, 25 bp, S. pombe
tttggaaactccatggccttggtaa

SEQ ID NO: 114344 - DNA, 25 bp, S. pombe
tttgaggaacgtttggcccatgagt

SEQ ID NO: 114345 - DNA, 25 bp, S. pombe
tatttttgcacatccttactcagag

SEQ ID NO: 114346 - DNA, 25 bp, S. pombe
tattgcctctaatgccggtactgta

SEQ ID NO: 114347 - DNA, 25 bp, S. pombe
tattcgtgtgaatgccgttgctcct

SEQ ID NO: 114348 - DNA, 25 bp, S. pombe
tattttctgttgtatggctcttcgc

SEQ ID NO: 114349 - DNA, 25 bp, S. pombe
tattttggtcattgggctctttaca

SEQ ID NO: 114350 - DNA, 25 bp, S. pombe
tattgactcagcattggacctcgtg

SEQ ID NO: 114351 - DNA, 25 bp, S. pombe
tattcccgaagaagatcccctattt

SEQ ID NO: 114352 - DNA, 25 bp, S. pombe
tattcctaaagctcatcccatgcat

SEQ ID NO: 114353 - DNA, 25 bp, S. pombe
tttgtaccaatttccttcactttct

SEQ ID NO: 114354 - DNA, 25 bp, S. pombe
tattcccagaagcagtcttcctcta

SEQ ID NO: 114355 - DNA, 25 bp, S. pombe
tattgccgatattgaagttccctgg

SEQ ID NO: 114356 - DNA, 25 bp, S. pombe
tttggcgatgtacgactttcctggc

SEQ ID NO: 114357 - DNA, 25 bp, S. pombe
tttgatcttgaaccctattccgagg

SEQ ID NO: 114358 - DNA, 25 bp, S. pombe
tattgcaattgttatggctccttcc

SEQ ID NO: 114359 - DNA, 25 bp, S. pombe
tattgcattatttatttcctgacga

SEQ ID NO: 114360 - DNA, 25 bp, S. pombe
tttgcacttgagcatcttcctaaag

SEQ ID NO: 114361 - DNA, 25 bp, S. pombe
tattacgttattgttccctgcagga

SEQ ID NO: 114362 - DNA, 25 bp, S. pombe
tattatcaggtcatccttcccttaa

SEQ ID NO: 114363 - DNA, 25 bp, S. pombe
tattagagggtcgtcttccctttga

SEQ ID NO: 114364 - DNA, 25 bp, S. pombe
tttgggagtgattctgcacctcatc

SEQ ID NO: 114365 - DNA, 25 bp, S. pombe
ttttagcagtttcaagtgtcggcga

SEQ ID NO: 114366 - DNA, 25 bp, S. pombe
tttccatactttcagagcgtcgtgc

SEQ ID NO: 114367 - DNA, 25 bp, S. pombe
tttccttctgttcaagtctggttag

SEQ ID NO: 114368 - DNA, 25 bp, S. pombe
tattcgttggtatagagctgctgct

SEQ ID NO: 114369 - DNA, 25 bp, S. pombe
tattctctgcttcccacaatttaga

SEQ ID NO: 114370 - DNA, 25 bp, S. pombe
tattttcgctggtaagcagttagaa

SEQ ID NO: 114371 - DNA, 25 bp, S. pombe
tttgcctcactacacatgcgaatga

SEQ ID NO: 114372 - DNA, 25 bp, S. pombe
tttgcctgagcatgcagccacattc

SEQ ID NO: 114373 - DNA, 25 bp, S. pombe
tttgacgatgctccaccagttcagc

SEQ ID NO: 114374 - DNA, 25 bp, S. pombe
tattcgggtcatcacaaagctgctg

SEQ ID NO: 114375 - DNA, 25 bp, S. pombe
ttacggcttacgaattggctactgg

SEQ ID NO: 114376 - DNA, 25 bp, S. pombe
ttacgtttatcctacttctggcaaa

SEQ ID NO: 114377 - DNA, 25 bp, S. pombe
ttaagttcttcttcttccgggatat

SEQ ID NO: 114378 - DNA, 25 bp, S. pombe
ttagacgtcttctcttcggtgaaaa

SEQ ID NO: 114379 - DNA, 25 bp, S. pombe
tattagcccttggtttggtgtgcaa

SEQ ID NO: 114380 - DNA, 25 bp, S. pombe
tattgaccggtcttgcttgctgttg

SEQ ID NO: 114381 - DNA, 25 bp, S. pombe
tattgtcaggactcgcaactgcttt

SEQ ID NO: 114382 - DNA, 25 bp, S. pombe
tattctatggtcctgttgttgccga

SEQ ID NO: 114383 - DNA, 25 bp, S. pombe
tattctcatcttctttcaccatgta

SEQ ID NO: 114384 - DNA, 25 bp, S. pombe
tattcctatactgtccttttacacc

SEQ ID NO: 114385 - DNA, 25 bp, S. pombe
tattcctttatgactgccttcttga

SEQ ID NO: 114386 - DNA, 25 bp, S. pombe
ttatcgcttccgctttggtatatgc

SEQ ID NO: 114387 - DNA, 25 bp, S. pombe
tttggtcatcgtggtttggctatta

SEQ ID NO: 114388 - DNA, 25 bp, S. pombe
tttgcagcacacttcgtaatcactt

SEQ ID NO: 114389 - DNA, 25 bp, S. pombe
tttggacacatcacatatacgcata

SEQ ID NO: 114390 - DNA, 25 bp, S. pombe
ttagtcgtcattctagtgccactta

SEQ ID NO: 114391 - DNA, 25 bp, S. pombe
tattgtcgtttttagtgccggcttc

SEQ ID NO: 114392 - DNA, 25 bp, S. pombe
tattccctattttgttccctcttgt

SEQ ID NO: 114393 - DNA, 25 bp, S. pombe
tattctccacttatgggaccgtggt

SEQ ID NO: 114394 - DNA, 25 bp, S. pombe
ttttggatttccagggcaccatggt

SEQ ID NO: 114395 - DNA, 25 bp, S. pombe
tttgctaattttgtgggccctgtta

SEQ ID NO: 114396 - DNA, 25 bp, S. pombe
ttgttaacgtttcttccactggtga

SEQ ID NO: 114397 - DNA, 25 bp, S. pombe
ttattaatttgctggttccgccgga

SEQ ID NO: 114398 - DNA, 25 bp, S. pombe
ttttaattgctctgcgttatgcctg

SEQ ID NO: 114399 - DNA, 25 bp, S. pombe
tattgtccaaattgatgctgctcct

SEQ ID NO: 114400 - DNA, 25 bp, S. pombe
tattgctaagtccttcgctttgcga

SEQ ID NO: 114401 - DNA, 25 bp, S. pombe
tattctcgacaacgttatactctga

SEQ ID NO: 114402 - DNA, 25 bp, S. pombe
ttaccggaacttgagcatcttgaga

SEQ ID NO: 114403 - DNA, 25 bp, S. pombe
ttaaacggactagcgctcttcaacc

SEQ ID NO: 114404 - DNA, 25 bp, S. pombe
tttgcatgggaagcctgctcttgta

SEQ ID NO: 114405 - DNA, 25 bp, S. pombe
tttgctgggtaggatcgtgttacaa

SEQ ID NO: 114406 - DNA, 25 bp, S. pombe
tttgcggcggatgtttcggcagaac

SEQ ID NO: 114407 - DNA, 25 bp, S. pombe
tattgccgccgaatctgggtggaaa

SEQ ID NO: 114408 - DNA, 25 bp, S. pombe
tattcctgtaatttactctaaccat

SEQ ID NO: 114409 - DNA, 25 bp, S. pombe
tttgcgaaagtgctgaaccgcttca

SEQ ID NO: 114410 - DNA, 25 bp, S. pombe
ttagcgaagtgtccgcaaccttgga

SEQ ID NO: 114411 - DNA, 25 bp, S. pombe
ttagtcatatttcccaactctttga

SEQ ID NO: 114412 - DNA, 25 bp, S. pombe
tattccctgccaaaagacggctctt

SEQ ID NO: 114413 - DNA, 25 bp, S. pombe
tattgcctccgatgttgacgacttt

SEQ ID NO: 114414 - DNA, 25 bp, S. pombe
tattgcccaaagcttcaagtgattc

SEQ ID NO: 114415 - DNA, 25 bp, S. pombe
tttgcttctttcaacgatactttcg

SEQ ID NO: 114416 - DNA, 25 bp, S. pombe
tttgttgctactgcacgaagccttt

SEQ ID NO: 114417 - DNA, 25 bp, S. pombe
tttgtatcgctaccaagacgccatt

SEQ ID NO: 114418 - DNA, 25 bp, S. pombe
tttggcatgcgatcaaaagcgctat

SEQ ID NO: 114419 - DNA, 25 bp, S. pombe
tttggcagctgcatatccgaagtat

SEQ ID NO: 114420 - DNA, 25 bp, S. pombe
tattgatgacatgttccgccgtagc

SEQ ID NO: 114421 - DNA, 25 bp, S. pombe
tattcagtccattttctcacctaga

SEQ ID NO: 114422 - DNA, 25 bp, S. pombe
tattcttcactttctgagtcgcaag

SEQ ID NO: 114423 - DNA, 25 bp, S. pombe
tattctatactttcataccgccaag

SEQ ID NO: 114424 - DNA, 25 bp, S. pombe
tattgctcaagtttctacccaacgt

SEQ ID NO: 114425 - DNA, 25 bp, S. pombe
tattccaagtggtcattaccgacaa

SEQ ID NO: 114426 - DNA, 25 bp, S. pombe
tattcctttggaatttccgccactg

SEQ ID NO: 114427 - DNA, 25 bp, S. pombe
tttctcgtgattttggcaccccaag

SEQ ID NO: 114428 - DNA, 25 bp, S. pombe
tttgatcaaggttgccgaccccaag

SEQ ID NO: 114429 - DNA, 25 bp, S. pombe
tttgcagaaggcactcgttcctata

SEQ ID NO: 114430 - DNA, 25 bp, S. pombe
tattaaatcgagatatgttccttat

SEQ ID NO: 114431 - DNA, 25 bp, S. pombe
tattgaaacggactcttctccttcg

SEQ ID NO: 114432 - DNA, 25 bp, S. pombe
tattctaccggaatttgctgcgctc

SEQ ID NO: 114433 - DNA, 25 bp, S. pombe
tattccttttgcatcttcgtcacaa

SEQ ID NO: 114434 - DNA, 25 bp, S. pombe
tattccgtctattctccacttgaaa

SEQ ID NO: 114435 - DNA, 25 bp, S. pombe
tttctgaccgctataattcccttac

SEQ ID NO: 114436 - DNA, 25 bp, S. pombe
tttaagctttccaacatcacaacaa

SEQ ID NO: 114437 - DNA, 25 bp, S. pombe
tttgaagctcttgaacagtccccta

SEQ ID NO: 114438 - DNA, 25 bp, S. pombe
tattgcgcacgtcttaaggagccga

SEQ ID NO: 114439 - DNA, 25 bp, S. pombe
tattgagccacttcatgtctagaga

SEQ ID NO: 114440 - DNA, 25 bp, S. pombe
tattctctcattacaggctcgtgac

SEQ ID NO: 114441 - DNA, 25 bp, S. pombe
tattccagtattcatctccatcatc

SEQ ID NO: 114442 - DNA, 25 bp, S. pombe
tattcttcaattctcatctcaactc

SEQ ID NO: 114443 - DNA, 25 bp, S. pombe
tattctcaaattggcattctccctc

SEQ ID NO: 114444 - DNA, 25 bp, S. pombe
tattcgtcaagaacattcctcccga

SEQ ID NO: 114445 - DNA, 25 bp, S. pombe
tattcgtcaagctaaggcctctgct

SEQ ID NO: 114446 - DNA, 25 bp, S. pombe
tattcgtgatatttgctgggctccg

SEQ ID NO: 114447 - DNA, 25 bp, S. pombe
tattgtgatatcactctcttccacc

SEQ ID NO: 114448 - DNA, 25 bp, S. pombe
tattggaataccttcttcgtctctg

SEQ ID NO: 114449 - DNA, 25 bp, S. pombe
ttagtaaatcaccacttcctccttt

SEQ ID NO: 114450 - DNA, 25 bp, S. pombe
tttggagctcatacacttggttctg

SEQ ID NO: 114451 - DNA, 25 bp, S. pombe
tattgtttccggacttgttgctgtc

SEQ ID NO: 114452 - DNA, 25 bp, S. pombe
tattacaagcgcgtttgctccttcc

SEQ ID NO: 114453 - DNA, 25 bp, S. pombe
tattcatcacatgggtactccacca

SEQ ID NO: 114454 - DNA, 25 bp, S. pombe
tattgatgccctttatgacacccat

SEQ ID NO: 114455 - DNA, 25 bp, S. pombe
tattgagctcgttttgaccgctatc

SEQ ID NO: 114456 - DNA, 25 bp, S. pombe
tttggtcgtctttgaagcctatgcc

SEQ ID NO: 114457 - DNA, 25 bp, S. pombe
tttgggcggagtttacctacatcaa

SEQ ID NO: 114458 - DNA, 25 bp, S. pombe
tttgggcgacgtgctgctgcaaaaa

SEQ ID NO: 114459 - DNA, 25 bp, S. pombe
tttggacagacttcctcgtgtacaa

SEQ ID NO: 114460 - DNA, 25 bp, S. pombe
tattgagtctaattacagcgctgat

SEQ ID NO: 114461 - DNA, 25 bp, S. pombe
tattcatgctcaaccgaacgctgtt

SEQ ID NO: 114462 - DNA, 25 bp, S. pombe
ttggaccgccaattcaacctatgaa

SEQ ID NO: 114463 - DNA, 25 bp, S. pombe
tttgggcgccagtaaacccgagcaa

SEQ ID NO: 114464 - DNA, 25 bp, S. pombe
ttcgaggaactacttattctgcccc

SEQ ID NO: 114465 - DNA, 25 bp, S. pombe
ttgggagaattacagtttccacgct

SEQ ID NO: 114466 - DNA, 25 bp, S. pombe
tattggtttcttacctattacagtt

SEQ ID NO: 114467 - DNA, 25 bp, S. pombe
tttgtttgtctcctttttgacgctt

SEQ ID NO: 114468 - DNA, 25 bp, S. pombe
tttggccgacactcataagagcttt

SEQ ID NO: 114469 - DNA, 25 bp, S. pombe
tattcccaaattctgtaccgtcgag

SEQ ID NO: 114470 - DNA, 25 bp, S. pombe
tttgactgacgaattactcgccctt

SEQ ID NO: 114471 - DNA, 25 bp, S. pombe
tttgcgctgaatctgagactccttt

SEQ ID NO: 114472 - DNA, 25 bp, S. pombe
tattgtacaccgatagcgctgctga

SEQ ID NO: 114473 - DNA, 25 bp, S. pombe
tattggatctgccttttatactaca

SEQ ID NO: 114474 - DNA, 25 bp, S. pombe
tttggatcaatcctctttactgaag

SEQ ID NO: 114475 - DNA, 25 bp, S. pombe
tttggcaagagcctcgcttagcgag

SEQ ID NO: 114476 - DNA, 25 bp, S. pombe
tattggatccagactctcttagcgg

SEQ ID NO: 114477 - DNA, 25 bp, S. pombe
tattcagacagttcctcgtattgcc

SEQ ID NO: 114478 - DNA, 25 bp, S. pombe
tattgaccaacgatttgactctatg

SEQ ID NO: 114479 - DNA, 25 bp, S. pombe
tattcacctgacgattgggagcttt

SEQ ID NO: 114480 - DNA, 25 bp, S. pombe
tttggatcgtctttggaccttggtt

SEQ ID NO: 114481 - DNA, 25 bp, S. pombe
tttactgctgttccttacgattctt

SEQ ID NO: 114482 - DNA, 25 bp, S. pombe
ttctactttgggtctgaaatccgta

SEQ ID NO: 114483 - DNA, 25 bp, S. pombe
tttcggatggcggtcaaaacacttg

SEQ ID NO: 114484 - DNA, 25 bp, S. pombe
tttccgtgtctggtatgaaacccat

SEQ ID NO: 114485 - DNA, 25 bp, S. pombe
tttccggtctctgctcaaaaatttg

SEQ ID NO: 114486 - DNA, 25 bp, S. pombe
ttcccgtactgagcgaattcgttgg

SEQ ID NO: 114487 - DNA, 25 bp, S. pombe
tttccctactcagcagacatttttg

SEQ ID NO: 114488 - DNA, 25 bp, S. pombe
tattcccctccaactatcattttta

SEQ ID NO: 114489 - DNA, 25 bp, S. pombe
tttggcagtgctagttccttgggaa

SEQ ID NO: 114490 - DNA, 25 bp, S. pombe
tttggagatggagttcccgtccagc

SEQ ID NO: 114491 - DNA, 25 bp, S. pombe
tattgtcgttgaggatccggatccc

SEQ ID NO: 114492 - DNA, 25 bp, S. pombe
tattgctgctcgtagaaccggtctt

SEQ ID NO: 114493 - DNA, 25 bp, S. pombe
tattggaggatatttctggcgactt

SEQ ID NO: 114494 - DNA, 25 bp, S. pombe
tttgcggcgtattgtctgaagtcta

SEQ ID NO: 114495 - DNA, 25 bp, S. pombe
tattcgacgtctcggttttcagcaa

SEQ ID NO: 114496 - DNA, 25 bp, S. pombe
tttcatggttggagctttagccggc

SEQ ID NO: 114497 - DNA, 25 bp, S. pombe
tattgtctacaatcctacttgccgt

SEQ ID NO: 114498 - DNA, 25 bp, S. pombe
tttgctttgtcagtgctcctcataa

SEQ ID NO: 114499 - DNA, 25 bp, S. pombe
tttgtttcatttcctcgacacgaac

SEQ ID NO: 114500 - DNA, 25 bp, S. pombe
tttgggctattctccagaagggact

SEQ ID NO: 114501 - DNA, 25 bp, S. pombe
tttgtgctttctttcccggagaaat

SEQ ID NO: 114502 - DNA, 25 bp, S. pombe
tttgtggcttactcactcgttggaa

SEQ ID NO: 114503 - DNA, 25 bp, S. pombe
tattcgggatctcttttggtgctag

SEQ ID NO: 114504 - DNA, 25 bp, S. pombe
tattcggctagtctttgcagctgac

SEQ ID NO: 114505 - DNA, 25 bp, S. pombe
tattctcctattgtcagtgcagcta

SEQ ID NO: 114506 - DNA, 25 bp, S. pombe
tattccacttatggccatgtcgtca

SEQ ID NO: 114507 - DNA, 25 bp, S. pombe
tttggaagttggtatcgctgccgcg

SEQ ID NO: 114508 - DNA, 25 bp, S. pombe
tttggatgatcctcgtactcagcgt

SEQ ID NO: 114509 - DNA, 25 bp, S. pombe
tttggtcctcatcacatccaggaat

SEQ ID NO: 114510 - DNA, 25 bp, S. pombe
tattggctcatctagtacccggaat

SEQ ID NO: 114511 - DNA, 25 bp, S. pombe
tattgtacagaaactcgcccttata

SEQ ID NO: 114512 - DNA, 25 bp, S. pombe
tttgccaatgactttccccgtatgg

SEQ ID NO: 114513 - DNA, 25 bp, S. pombe
tttggaatcgcatctccgggaattt

SEQ ID NO: 114514 - DNA, 25 bp, S. pombe
tattgctgttactgccctggtgaat

SEQ ID NO: 114515 - DNA, 25 bp, S. pombe
tattggttcacttgctgttgtcgat

SEQ ID NO: 114516 - DNA, 25 bp, S. pombe
tattggtgtactttctagctctgag

SEQ ID NO: 114517 - DNA, 25 bp, S. pombe
tattcccctgcttatggtgcaagac

SEQ ID NO: 114518 - DNA, 25 bp, S. pombe
tttcccaggaacagcgcatttctta

SEQ ID NO: 114519 - DNA, 25 bp, S. pombe
tattcgaaactatcaagcatctctt

SEQ ID NO: 114520 - DNA, 25 bp, S. pombe
tttgcggtctagtatggagtcctcc

SEQ ID NO: 114521 - DNA, 25 bp, S. pombe
ttcactggttggaaggaccctgcct

SEQ ID NO: 114522 - DNA, 25 bp, S. pombe
ttcagttgctggctagtattccggc

SEQ ID NO: 114523 - DNA, 25 bp, S. pombe
tttgccattgatactgctaacccta

SEQ ID NO: 114524 - DNA, 25 bp, S. pombe
ttatgcttccatgttagaccgtcaa

SEQ ID NO: 114525 - DNA, 25 bp, S. pombe
tattgtcaccatggccttggccgtc

SEQ ID NO: 114526 - DNA, 25 bp, S. pombe
tattgttcagatgcctcgaggtgtc

SEQ ID NO: 114527 - DNA, 25 bp, S. pombe
tttggagccgcatcagtcttaattt

SEQ ID NO: 114528 - DNA, 25 bp, S. pombe
tattcgagaccgttactatcctctg

SEQ ID NO: 114529 - DNA, 25 bp, S. pombe
tattcgcgacctttggatacgtgtt

SEQ ID NO: 114530 - DNA, 25 bp, S. pombe
tttgctcgaagcactagtacgctgt

SEQ ID NO: 114531 - DNA, 25 bp, S. pombe
tttccgaagtatccagcaaaccgtc

SEQ ID NO: 114532 - DNA, 25 bp, S. pombe
tttggcgattactccactcttagta

SEQ ID NO: 114533 - DNA, 25 bp, S. pombe
tattgcttcccagcgacctaggcgg

SEQ ID NO: 114534 - DNA, 25 bp, S. pombe
tttgaactcatcttctgggaacagt

SEQ ID NO: 114535 - DNA, 25 bp, S. pombe
tttgcttgcctcctgtaaaacttca

SEQ ID NO: 114536 - DNA, 25 bp, S. pombe
tttgctccttctcctgatgaaattg

SEQ ID NO: 114537 - DNA, 25 bp, S. pombe
tattgcttcctcactcaaagatgct

SEQ ID NO: 114538 - DNA, 25 bp, S. pombe
tattgttggatcaccctagtgctca

SEQ ID NO: 114539 - DNA, 25 bp, S. pombe
tattcgctctgccttggatacttat

SEQ ID NO: 114540 - DNA, 25 bp, S. pombe
tattcctcattcatctgcaatttcc

SEQ ID NO: 114541 - DNA, 25 bp, S. pombe
tttctctcatttttgcaaaggcccc

SEQ ID NO: 114542 - DNA, 25 bp, S. pombe
tttttcaatcactccaaggccaaac

SEQ ID NO: 114543 - DNA, 25 bp, S. pombe
tttatgctctataccttacggacca

SEQ ID NO: 114544 - DNA, 25 bp, S. pombe
tttattactgtccttatcgctaccc

SEQ ID NO: 114545 - DNA, 25 bp, S. pombe
tattgtttcattgttgtcgcggctt

SEQ ID NO: 114546 - DNA, 25 bp, S. pombe
tattggttgcttcttgttgcctata

SEQ ID NO: 114547 - DNA, 25 bp, S. pombe
tttggctgccagacggactaccgaa

SEQ ID NO: 114548 - DNA, 25 bp, S. pombe
tttgggctggctaaacactgtgtgc

SEQ ID NO: 114549 - DNA, 25 bp, S. pombe
tattgtttccaatctcctgtgtctc

SEQ ID NO: 114550 - DNA, 25 bp, S. pombe
tattggaccatctgctagcgtgatt

SEQ ID NO: 114551 - DNA, 25 bp, S. pombe
tttggatgctacttggcagccggtc

SEQ ID NO: 114552 - DNA, 25 bp, S. pombe
tttacatcaggctgtggtcgctttt

SEQ ID NO: 114553 - DNA, 25 bp, S. pombe
tttcgaattcggcttttttggcgct

SEQ ID NO: 114554 - DNA, 25 bp, S. pombe
ttttgtttcgcgattttcttactga

SEQ ID NO: 114555 - DNA, 25 bp, S. pombe
tttaaatttcgtcctccttctgttg

SEQ ID NO: 114556 - DNA, 25 bp, S. pombe
ttgtaaaagtcctattttttgcttg

SEQ ID NO: 114557 - DNA, 25 bp, S. pombe
ttctaaacccgttcgtaagcgtgct

SEQ ID NO: 114558 - DNA, 25 bp, S. pombe
tttcggcacccatcgacgtatacag

SEQ ID NO: 114559 - DNA, 25 bp, S. pombe
tttggagcaccttcaagccgttgag

SEQ ID NO: 114560 - DNA, 25 bp, S. pombe
tttgaagcacagaccaggccgcaag

SEQ ID NO: 114561 - DNA, 25 bp, S. pombe
tttgaagacgcttcatcgccgcaat

SEQ ID NO: 114562 - DNA, 25 bp, S. pombe
tttgaagttgcttgcgctgctcatc

SEQ ID NO: 114563 - DNA, 25 bp, S. pombe
tttgatgctgctgacattgctgctt

SEQ ID NO: 114564 - DNA, 25 bp, S. pombe
tattgatgaggctgctcgacgccga

SEQ ID NO: 114565 - DNA, 25 bp, S. pombe
tttgcatgagcctgtgcgtcgtgaa

SEQ ID NO: 114566 - DNA, 25 bp, S. pombe
tttcgcactgatggccgtcattata

SEQ ID NO: 114567 - DNA, 25 bp, S. pombe
tttcagatgctgatgctagttttca

SEQ ID NO: 114568 - DNA, 25 bp, S. pombe
tttgcaacatgtcaacttggctcat

SEQ ID NO: 114569 - DNA, 25 bp, S. pombe
tttgcaaccttaccattgtccatta

SEQ ID NO: 114570 - DNA, 25 bp, S. pombe
tattgagtcctttacattgcccaca

SEQ ID NO: 114571 - DNA, 25 bp, S. pombe
tattgcagttgctttaatccccatg

SEQ ID NO: 114572 - DNA, 25 bp, S. pombe
tttgctttgctgttgattctcccga

SEQ ID NO: 114573 - DNA, 25 bp, S. pombe
tttcgaagaaacttacctctgcccg

SEQ ID NO: 114574 - DNA, 25 bp, S. pombe
tttgacttagaatctcaccttcctc

SEQ ID NO: 114575 - DNA, 25 bp, S. pombe
tttggctcagtatatcctatttcga

SEQ ID NO: 114576 - DNA, 25 bp, S. pombe
tttggattattcttaccttctggta

SEQ ID NO: 114577 - DNA, 25 bp, S. pombe
tattgtgattgtatcctctggcgct

SEQ ID NO: 114578 - DNA, 25 bp, S. pombe
tattgtcatcttttccatctttgcc

SEQ ID NO: 114579 - DNA, 25 bp, S. pombe
tttgagctgaaccatacacttgtcg

SEQ ID NO: 114580 - DNA, 25 bp, S. pombe
tttagcaactcctccgtttggattg

SEQ ID NO: 114581 - DNA, 25 bp, S. pombe
tattgaaacttctgctcgttatgtt

SEQ ID NO: 114582 - DNA, 25 bp, S. pombe
tttggaatcttctcatgctgtgtat

SEQ ID NO: 114583 - DNA, 25 bp, S. pombe
tttgatcaaggtggctcctggcgat

SEQ ID NO: 114584 - DNA, 25 bp, S. pombe
tttgtttaattctctgtcggcacga

SEQ ID NO: 114585 - DNA, 25 bp, S. pombe
ttttttacatatcaagcccacccaa

SEQ ID NO: 114586 - DNA, 25 bp, S. pombe
ttttattatcaacaggtgccgccca

SEQ ID NO: 114587 - DNA, 25 bp, S. pombe
tttctatttaacaagcgtgccgcgg

SEQ ID NO: 114588 - DNA, 25 bp, S. pombe
tttctctggaggtggcgctacaatc

SEQ ID NO: 114589 - DNA, 25 bp, S. pombe
tttgcttccatttcacatcagttaa

SEQ ID NO: 114590 - DNA, 25 bp, S. pombe
tttgcatcctttcccggtcaaagaa

SEQ ID NO: 114591 - DNA, 25 bp, S. pombe
tttgattgctccacctcgtaattaa

SEQ ID NO: 114592 - DNA, 25 bp, S. pombe
tattgaggcccttcgtcgttgtcaa

SEQ ID NO: 114593 - DNA, 25 bp, S. pombe
tattgggccactcctgaacttgtaa

SEQ ID NO: 114594 - DNA, 25 bp, S. pombe
tttggctcgtttgattctcagtggt

SEQ ID NO: 114595 - DNA, 25 bp, S. pombe
ttcgtttttatcatactccgggagg

SEQ ID NO: 114596 - DNA, 25 bp, S. pombe
ttccttgttgttatgaaaccactga

SEQ ID NO: 114597 - DNA, 25 bp, S. pombe
tattgttgtcgttttggaccccaag

SEQ ID NO: 114598 - DNA, 25 bp, S. pombe
tttgttgtccgtttggatactcaaa

SEQ ID NO: 114599 - DNA, 25 bp, S. pombe
tttggtgtccctttgcggaactata

SEQ ID NO: 114600 - DNA, 25 bp, S. pombe
tttgaaccctgtattcctgaactgg

SEQ ID NO: 114601 - DNA, 25 bp, S. pombe
tttgatactacgcatcttccagaga

SEQ ID NO: 114602 - DNA, 25 bp, S. pombe
tttgaataaccgctgtcgtatgaca

SEQ ID NO: 114603 - DNA, 25 bp, S. pombe
tttgaatggccttggtgtaccgaat

SEQ ID NO: 114604 - DNA, 25 bp, S. pombe
tttcctcttggaagcgtgcagcacg

SEQ ID NO: 114605 - DNA, 25 bp, S. pombe
tttccgttgagacgcctgagacaat

SEQ ID NO: 114606 - DNA, 25 bp, S. pombe
ttttcagttatgtcccaacgctaca

SEQ ID NO: 114607 - DNA, 25 bp, S. pombe
tttgtgcatgctaatacccttggtc

SEQ ID NO: 114608 - DNA, 25 bp, S. pombe
tttattgatggctagcccttctgtc

SEQ ID NO: 114609 - DNA, 25 bp, S. pombe
tttgtatgggtcatcagcttctcgc

SEQ ID NO: 114610 - DNA, 25 bp, S. pombe
tttgttgagttattgcgtcctgcac

SEQ ID NO: 114611 - DNA, 25 bp, S. pombe
tttggcttcatcatcgagtgcttac

SEQ ID NO: 114612 - DNA, 25 bp, S. pombe
tttgatgctttcttgggtgttgtcc

SEQ ID NO: 114613 - DNA, 25 bp, S. pombe
tttccagactgcagcctacatagtt

SEQ ID NO: 114614 - DNA, 25 bp, S. pombe
tttgctcagaatgcggtaacttgtt

SEQ ID NO: 114615 - DNA, 25 bp, S. pombe
tttctcagcgccaggtaagctcgtg

SEQ ID NO: 114616 - DNA, 25 bp, S. pombe
tttctcacgaacaggaggcatttga

SEQ ID NO: 114617 - DNA, 25 bp, S. pombe
ttatgtcagtgagccttgcaagcct

SEQ ID NO: 114618 - DNA, 25 bp, S. pombe
tattggacctgttgatgagcctccc

SEQ ID NO: 114619 - DNA, 25 bp, S. pombe
tttgcgctggcaatctacggcactg

SEQ ID NO: 114620 - DNA, 25 bp, S. pombe
tttgcagggaattgtcggccacacc

SEQ ID NO: 114621 - DNA, 25 bp, S. pombe
tttgcatcctaaagttggcccgcca

SEQ ID NO: 114622 - DNA, 25 bp, S. pombe
tattgtctctctagatttcctaccc

SEQ ID NO: 114623 - DNA, 25 bp, S. pombe
tttgaagtgccgacctgcgaaacga

SEQ ID NO: 114624 - DNA, 25 bp, S. pombe
tttgaaggtgataccggcccatacc

SEQ ID NO: 114625 - DNA, 25 bp, S. pombe
tttgacgtcgatgcctgtgatccaa

SEQ ID NO: 114626 - DNA, 25 bp, S. pombe
tttgggagctgtttcgtcaactaac

SEQ ID NO: 114627 - DNA, 25 bp, S. pombe
tattgttggtggttgcttcgactga

SEQ ID NO: 114628 - DNA, 25 bp, S. pombe
tattgttggtggtctcctatatctc

SEQ ID NO: 114629 - DNA, 25 bp, S. pombe
tttgttaatggtccctattctctgc

SEQ ID NO: 114630 - DNA, 25 bp, S. pombe
tttttcaggtgtcaaagtctctccc

SEQ ID NO: 114631 - DNA, 25 bp, S. pombe
ttaaattggtgtcaacctccttcct

SEQ ID NO: 114632 - DNA, 25 bp, S. pombe
ttgtccttggttgaagcagtccttc

SEQ ID NO: 114633 - DNA, 25 bp, S. pombe
tttcggtttaaaagttgagccatcg

SEQ ID NO: 114634 - DNA, 25 bp, S. pombe
tttaccttgccaaacttgctgacat

SEQ ID NO: 114635 - DNA, 25 bp, S. pombe
tttggccgtctgcaatgcgcaatat

SEQ ID NO: 114636 - DNA, 25 bp, S. pombe
tttcgtgggcacaaaattcctcttg

SEQ ID NO: 114637 - DNA, 25 bp, S. pombe
tttccattaacgatctctgcgactt

SEQ ID NO: 114638 - DNA, 25 bp, S. pombe
ttaccactaaccctgttcgaatatt

SEQ ID NO: 114639 - DNA, 25 bp, S. pombe
tttggccttcttgcgtttatgaaca

SEQ ID NO: 114640 - DNA, 25 bp, S. pombe
tttgaccttcaatgctttggatgat

SEQ ID NO: 114641 - DNA, 25 bp, S. pombe
tttgtcagacattcagctcaggcta

SEQ ID NO: 114642 - DNA, 25 bp, S. pombe
tattgtcacacaaggctcagagtcc

SEQ ID NO: 114643 - DNA, 25 bp, S. pombe
tttgctgctggcgtcgttgaaatgc

SEQ ID NO: 114644 - DNA, 25 bp, S. pombe
tttcgcttacggatgctcttgatga

SEQ ID NO: 114645 - DNA, 25 bp, S. pombe
tttggatgtcgtctttgacttgcct

SEQ ID NO: 114646 - DNA, 25 bp, S. pombe
tttggtcgcaagtttcgcagtttct

SEQ ID NO: 114647 - DNA, 25 bp, S. pombe
tttgttgtttttgcaagcgcctgtt

SEQ ID NO: 114648 - DNA, 25 bp, S. pombe
tttggctatttttcccgacctgagt

SEQ ID NO: 114649 - DNA, 25 bp, S. pombe
tttgcctgtttttacggacttgatt

SEQ ID NO: 114650 - DNA, 25 bp, S. pombe
tttcctgaagtttacgtccctactg

SEQ ID NO: 114651 - DNA, 25 bp, S. pombe
ttaccttactcttgatttacctccg

SEQ ID NO: 114652 - DNA, 25 bp, S. pombe
ttaccaatttgggtggctatcctcc

SEQ ID NO: 114653 - DNA, 25 bp, S. pombe
ttactagcaatttccggtctttcca

SEQ ID NO: 114654 - DNA, 25 bp, S. pombe
ttaggagcagcatcccggaaggagc

SEQ ID NO: 114655 - DNA, 25 bp, S. pombe
tttggatgaaatctctcccgctgga

SEQ ID NO: 114656 - DNA, 25 bp, S. pombe
tttgcctatagtacaaccatatcgt

SEQ ID NO: 114657 - DNA, 25 bp, S. pombe
tttcctaatggctttacaccgacta

SEQ ID NO: 114658 - DNA, 25 bp, S. pombe
ttcaccaaaggtttactcggacaat

SEQ ID NO: 114659 - DNA, 25 bp, S. pombe
ttaccaaagcgttccgtccaacata

SEQ ID NO: 114660 - DNA, 25 bp, S. pombe
ttccgtggtccgaagcattgctaaa

SEQ ID NO: 114661 - DNA, 25 bp, S. pombe
ttcgctgggtacaaactctggcaat

SEQ ID NO: 114662 - DNA, 25 bp, S. pombe
tttcccgatggatcagtcgtacatt

SEQ ID NO: 114663 - DNA, 25 bp, S. pombe
ttgtcctttgtgtggccgaatatga

SEQ ID NO: 114664 - DNA, 25 bp, S. pombe
tttactatactacagtcggccctat

SEQ ID NO: 114665 - DNA, 25 bp, S. pombe
tttcaacctggagacctagttatgg

SEQ ID NO: 114666 - DNA, 25 bp, S. pombe
tttccaccgtgtgatcctacaatgg

SEQ ID NO: 114667 - DNA, 25 bp, S. pombe
tttcccggctatacacctgatattg

SEQ ID NO: 114668 - DNA, 25 bp, S. pombe
tttccgacctacctagcagatttac

SEQ ID NO: 114669 - DNA, 25 bp, S. pombe
tttccccactaaaacagcatgttcc

SEQ ID NO: 114670 - DNA, 25 bp, S. pombe
tttgcgcctcaggatatttccaggt

SEQ ID NO: 114671 - DNA, 25 bp, S. pombe
tttggcaccctaatgttcatccgaa

SEQ ID NO: 114672 - DNA, 25 bp, S. pombe
ttgctcaaaacctcagaacttaccc

SEQ ID NO: 114673 - DNA, 25 bp, S. pombe
tttatttactgctcgaggcttaccc

SEQ ID NO: 114674 - DNA, 25 bp, S. pombe
tttgtctcttcgcagataccgttag

SEQ ID NO: 114675 - DNA, 25 bp, S. pombe
tttctgccttggtagctaactgtaa

SEQ ID NO: 114676 - DNA, 25 bp, S. pombe
tttggctcttgacctgcttgctaag

SEQ ID NO: 114677 - DNA, 25 bp, S. pombe
tttggcttctgattctctcaataaa

SEQ ID NO: 114678 - DNA, 25 bp, S. pombe
tttggctgtccctttctataatgag

SEQ ID NO: 114679 - DNA, 25 bp, S. pombe
tttggctcttcctatgttgcgtaaa

SEQ ID NO: 114680 - DNA, 25 bp, S. pombe
tttgtcctgatccaatgcttcggaa

SEQ ID NO: 114681 - DNA, 25 bp, S. pombe
tttgcctaggcctatttaccatcaa

SEQ ID NO: 114682 - DNA, 25 bp, S. pombe
tttgcaggatggatggatacacaca

SEQ ID NO: 114683 - DNA, 25 bp, S. pombe
tttgatccatcattgtctcgaaagg

SEQ ID NO: 114684 - DNA, 25 bp, S. pombe
tttcgctcaactcctacaaagtcat

SEQ ID NO: 114685 - DNA, 25 bp, S. pombe
tttgcttccaccactatgatgctat

SEQ ID NO: 114686 - DNA, 25 bp, S. pombe
ttttctgcgtcgctcttttaagaac

SEQ ID NO: 114687 - DNA, 25 bp, S. pombe
tttagccgctacctctttaaaggca

SEQ ID NO: 114688 - DNA, 25 bp, S. pombe
tttcaccccacttacctaaatagcg

SEQ ID NO: 114689 - DNA, 25 bp, S. pombe
tttgcatcccgctttacttactaaa

SEQ ID NO: 114690 - DNA, 25 bp, S. pombe
tttctcccggttacactactagtga

SEQ ID NO: 114691 - DNA, 25 bp, S. pombe
ttcatacttcgtgtacaaaccgtag

SEQ ID NO: 114692 - DNA, 25 bp, S. pombe
ttgattcctggtggaaaacccgaat

SEQ ID NO: 114693 - DNA, 25 bp, S. pombe
ttctaactcctcatctcaaaggtca

SEQ ID NO: 114694 - DNA, 25 bp, S. pombe
tttcgtcgtctgcatcctgatgaag

SEQ ID NO: 114695 - DNA, 25 bp, S. pombe
tttggatttctgcttccagagcgtg

SEQ ID NO: 114696 - DNA, 25 bp, S. pombe
tttggatcatgtcttacgcgagcgt

SEQ ID NO: 114697 - DNA, 25 bp, S. pombe
tttctacatctttctgattcgacgt

SEQ ID NO: 114698 - DNA, 25 bp, S. pombe
tttggaaagcaatgccacggccttc

SEQ ID NO: 114699 - DNA, 25 bp, S. pombe
tttcttgcaagcgaacccaatggtt

SEQ ID NO: 114700 - DNA, 25 bp, S. pombe
tttgaaattcctatctgcccgttgt

SEQ ID NO: 114701 - DNA, 25 bp, S. pombe
tttgaatctttcttactccctttgt

SEQ ID NO: 114702 - DNA, 25 bp, S. pombe
tttgttcaattccttctcactctga

SEQ ID NO: 114703 - DNA, 25 bp, S. pombe
tttgaatcacgtccttgctgcttta

SEQ ID NO: 114704 - DNA, 25 bp, S. pombe
tttgactcctagcattctctttgaa

SEQ ID NO: 114705 - DNA, 25 bp, S. pombe
ttcgggcacctattttgcttggaaa

SEQ ID NO: 114706 - DNA, 25 bp, S. pombe
tttgttgacctgtttgtgcgtgcca

SEQ ID NO: 114707 - DNA, 25 bp, S. pombe
tttgtatacgcttatcatggccgcc

SEQ ID NO: 114708 - DNA, 25 bp, S. pombe
tttggatacgctatcggagcaccta

SEQ ID NO: 114709 - DNA, 25 bp, S. pombe
tttgaagacggtactccagccacta

SEQ ID NO: 114710 - DNA, 25 bp, S. pombe
tttgaatactgggactcgctggccg

SEQ ID NO: 114711 - DNA, 25 bp, S. pombe
tttgaatttgggtatgctgcttggc

SEQ ID NO: 114712 - DNA, 25 bp, S. pombe
ttgctggaatggctgaatctcttag

SEQ ID NO: 114713 - DNA, 25 bp, S. pombe
tttggaacctattcgctggatgcag

SEQ ID NO: 114714 - DNA, 25 bp, S. pombe
tttggttgcctttgctgctgtagaa

SEQ ID NO: 114715 - DNA, 25 bp, S. pombe
tttggcttaccttcatcgggcaatg

SEQ ID NO: 114716 - DNA, 25 bp, S. pombe
tttggtagccactgacgttgcaagc

SEQ ID NO: 114717 - DNA, 25 bp, S. pombe
tttgagcttcagtcataacggtcgc

SEQ ID NO: 114718 - DNA, 25 bp, S. pombe
ttgtacccagaggaatcggcttatg

SEQ ID NO: 114719 - DNA, 25 bp, S. pombe
tttatcccatacgaacccattatac

SEQ ID NO: 114720 - DNA, 25 bp, S. pombe
tttagccacttgtgttcgtgtacct

SEQ ID NO: 114721 - DNA, 25 bp, S. pombe
ttgccaccttttgtttttgacgaag

SEQ ID NO: 114722 - DNA, 25 bp, S. pombe
tttggtcgtgactatgctctattcg

SEQ ID NO: 114723 - DNA, 25 bp, S. pombe
tttacccaacgttgtaccattgagt

SEQ ID NO: 114724 - DNA, 25 bp, S. pombe
ttattgcctcaatgggtacgtcgcc

SEQ ID NO: 114725 - DNA, 25 bp, S. pombe
tttgatcccgattggaatccagccg

SEQ ID NO: 114726 - DNA, 25 bp, S. pombe
tttacgatcgcttgagaatccaact

SEQ ID NO: 114727 - DNA, 25 bp, S. pombe
tttggtcttcgtacccattatggtg

SEQ ID NO: 114728 - DNA, 25 bp, S. pombe
tttggtcttcctgctctttagaaaa

SEQ ID NO: 114729 - DNA, 25 bp, S. pombe
tttggtatctccatgatgctcttaa

SEQ ID NO: 114730 - DNA, 25 bp, S. pombe
tttggagcatgcacgtcagcttgaa

SEQ ID NO: 114731 - DNA, 25 bp, S. pombe
tttcaatatactcctttcctttacg

SEQ ID NO: 114732 - DNA, 25 bp, S. pombe
ttttcaattatgcttccccatgtac

SEQ ID NO: 114733 - DNA, 25 bp, S. pombe
tttcgaatctaacgtcacccattga

SEQ ID NO: 114734 - DNA, 25 bp, S. pombe
tttcgaactcaactctacgctttaa

SEQ ID NO: 114735 - DNA, 25 bp, S. pombe
tttgatgccatttacctactcgatt

SEQ ID NO: 114736 - DNA, 25 bp, S. pombe
ttccacgcttggaaaaccagtctaa

SEQ ID NO: 114737 - DNA, 25 bp, S. pombe
tttcgctttggaatgaaccgtctgt

SEQ ID NO: 114738 - DNA, 25 bp, S. pombe
ttcttctaatcgtccaaaagttgct

SEQ ID NO: 114739 - DNA, 25 bp, S. pombe
tttcttacccattcgaagtttgtcg

SEQ ID NO: 114740 - DNA, 25 bp, S. pombe
tttccaatgttgtaggcttgcctat

SEQ ID NO: 114741 - DNA, 25 bp, S. pombe
tttacgattcattagccagtgcccc

SEQ ID NO: 114742 - DNA, 25 bp, S. pombe
tttgtcagatttagacccttccctg

SEQ ID NO: 114743 - DNA, 25 bp, S. pombe
tttgcatcaacttggcacacctgat

SEQ ID NO: 114744 - DNA, 25 bp, S. pombe
tttgcatgcaacctatcgagcttgt

SEQ ID NO: 114745 - DNA, 25 bp, S. pombe
tttccaggaggtggtttcccaggcg

SEQ ID NO: 114746 - DNA, 25 bp, S. pombe
tttgtcagttggtgtttctcgccga

SEQ ID NO: 114747 - DNA, 25 bp, S. pombe
tttcgaattcagacagcaccttcaa

SEQ ID NO: 114748 - DNA, 25 bp, S. pombe
tttgttgtgatgctttctcgtgcaa

SEQ ID NO: 114749 - DNA, 25 bp, S. pombe
tttggtgtgcactcttctggaaagc

SEQ ID NO: 114750 - DNA, 25 bp, S. pombe
tttggttgctgctcttgctatgtaa

SEQ ID NO: 114751 - DNA, 25 bp, S. pombe
tttggtggtgctacttgccgtaata

SEQ ID NO: 114752 - DNA, 25 bp, S. pombe
tttggtggttacaatctggctcgca

SEQ ID NO: 114753 - DNA, 25 bp, S. pombe
tttggtggtttgtatctgctcgtaa

SEQ ID NO: 114754 - DNA, 25 bp, S. pombe
ttatccggcacttactttcttaatg

SEQ ID NO: 114755 - DNA, 25 bp, S. pombe
tttgggccagtattctttcttgttg

SEQ ID NO: 114756 - DNA, 25 bp, S. pombe
tttgggctaccattttcgctaaggc

SEQ ID NO: 114757 - DNA, 25 bp, S. pombe
tttgcgacctaaaaagcctacatgg

SEQ ID NO: 114758 - DNA, 25 bp, S. pombe
tttaaagattaatacacatactgtt

SEQ ID NO: 114759 - DNA, 25 bp, S. pombe
tttctgcatgcaactggtactcaaa

SEQ ID NO: 114760 - DNA, 25 bp, S. pombe
tttgcaatccaaggcaccgagttgt

SEQ ID NO: 114761 - DNA, 25 bp, S. pombe
tttagatcctatggagcgcgctttt

SEQ ID NO: 114762 - DNA, 25 bp, S. pombe
tttgaacggacgacagccagatgtt

SEQ ID NO: 114763 - DNA, 25 bp, S. pombe
tttaactacataccccacattgtgg

SEQ ID NO: 114764 - DNA, 25 bp, S. pombe
tttacctacagacccgaaagcttct

SEQ ID NO: 114765 - DNA, 25 bp, S. pombe
ttccttgtactgaaccgactacttc

SEQ ID NO: 114766 - DNA, 25 bp, S. pombe
tttccgttcatcacagcagcaaatt

SEQ ID NO: 114767 - DNA, 25 bp, S. pombe
tttgctcacgagtccaagggtctta

SEQ ID NO: 114768 - DNA, 25 bp, S. pombe
tttgcgcctgcaattgttgacgttt

SEQ ID NO: 114769 - DNA, 25 bp, S. pombe
ttactggttctgtggattggcgttc

SEQ ID NO: 114770 - DNA, 25 bp, S. pombe
tttatgatgcatacgacgccttgga

SEQ ID NO: 114771 - DNA, 25 bp, S. pombe
tttctgatgttgctcctttggagtc

SEQ ID NO: 114772 - DNA, 25 bp, S. pombe
tttcttgtcccaaccatttgcagtt

SEQ ID NO: 114773 - DNA, 25 bp, S. pombe
tttccttcttttgttcttctttatg

SEQ ID NO: 114774 - DNA, 25 bp, S. pombe
ttatcgagctcctgaacttgtgttt

SEQ ID NO: 114775 - DNA, 25 bp, S. pombe
tttcgacatcgagactgctttgcct

SEQ ID NO: 114776 - DNA, 25 bp, S. pombe
tttccagtcaaggtcttacgcctga

SEQ ID NO: 114777 - DNA, 25 bp, S. pombe
ttatccgtaggcgtaatgtccgaat

SEQ ID NO: 114778 - DNA, 25 bp, S. pombe
tttccttgcgtggtttgacatcgaa

SEQ ID NO: 114779 - DNA, 25 bp, S. pombe
tttacctctgctactgttgacattg

SEQ ID NO: 114780 - DNA, 25 bp, S. pombe
tttgcatctgtattgaccggttctc

SEQ ID NO: 114781 - DNA, 25 bp, S. pombe
tttcatctaatgcacctaacgccgt

SEQ ID NO: 114782 - DNA, 25 bp, S. pombe
ttttaccgccagagaagtcgccagg

SEQ ID NO: 114783 - DNA, 25 bp, S. pombe
tttaatcagcccgagacaagtccca

SEQ ID NO: 114784 - DNA, 25 bp, S. pombe
tttttcgtcgagctcctgatgaatg

SEQ ID NO: 114785 - DNA, 25 bp, S. pombe
tttgctgcttccgacatcgaacgaa

SEQ ID NO: 114786 - DNA, 25 bp, S. pombe
tttcgccctcaagcaatgacgacag

SEQ ID NO: 114787 - DNA, 25 bp, S. pombe
tttcgacacaaaagcattccctacg

SEQ ID NO: 114788 - DNA, 25 bp, S. pombe
tttcgtcctatttattcctcttcat

SEQ ID NO: 114789 - DNA, 25 bp, S. pombe
tttgttcctgatggctttactccta

SEQ ID NO: 114790 - DNA, 25 bp, S. pombe
tttgcttcggtgcattgggctacat

SEQ ID NO: 114791 - DNA, 25 bp, S. pombe
ttctttcttgaatttaccccgtctg

SEQ ID NO: 114792 - DNA, 25 bp, S. pombe
tttttattcaacataccccaacgct

SEQ ID NO: 114793 - DNA, 25 bp, S. pombe
tttcttcattctcttaccaaacacc

SEQ ID NO: 114794 - DNA, 25 bp, S. pombe
tttgtccgttcactttctcaagaca

SEQ ID NO: 114795 - DNA, 25 bp, S. pombe
tttccgcctcacatgctattgcaat

SEQ ID NO: 114796 - DNA, 25 bp, S. pombe
tttgttcgggtgttggtcagctaac

SEQ ID NO: 114797 - DNA, 25 bp, S. pombe
tttgttcccaaactgttcgtcaagc

SEQ ID NO: 114798 - DNA, 25 bp, S. pombe
tttttccgcaaccagtacggtacat

SEQ ID NO: 114799 - DNA, 25 bp, S. pombe
ttcttttgcgccagaaacgcgacaa

SEQ ID NO: 114800 - DNA, 25 bp, S. pombe
tttacctacatcgaaaacgctgcct

SEQ ID NO: 114801 - DNA, 25 bp, S. pombe
tttaggtacatcgtttcaccccgag

SEQ ID NO: 114802 - DNA, 25 bp, S. pombe
tttaggtacttttgccaggcttcca

SEQ ID NO: 114803 - DNA, 25 bp, S. pombe
tttgagttactattggccaggcgat

SEQ ID NO: 114804 - DNA, 25 bp, S. pombe
tttgatttactggattcaccgcgct

SEQ ID NO: 114805 - DNA, 25 bp, S. pombe
tttgattaacattttcgccgctatt

SEQ ID NO: 114806 - DNA, 25 bp, S. pombe
tttctactcttccaggcgatagcat

SEQ ID NO: 114807 - DNA, 25 bp, S. pombe
tttgacctagattgggctgcagagc

SEQ ID NO: 114808 - DNA, 25 bp, S. pombe
ttccaacgcctctggttatacaaag

SEQ ID NO: 114809 - DNA, 25 bp, S. pombe
tttccctcgtccgatgtttacagaa

SEQ ID NO: 114810 - DNA, 25 bp, S. pombe
tttcttttgtgttttaccgtgatgc

SEQ ID NO: 114811 - DNA, 25 bp, S. pombe
tttccttagcttctgttgttcttgt

SEQ ID NO: 114812 - DNA, 25 bp, S. pombe
tttcttcctccgtcgttaacactgg

SEQ ID NO: 114813 - DNA, 25 bp, S. pombe
tttcttcctccgtcgttaacactgg

SEQ ID NO: 114814 - DNA, 25 bp, S. pombe
tttcttcacccgtcaattaaacgat

SEQ ID NO: 114815 - DNA, 25 bp, S. pombe
ttttagctcccttcttggtaatcgt

SEQ ID NO: 114816 - DNA, 25 bp, S. pombe
tttgttgtcccaaggcggtgttgaa

SEQ ID NO: 114817 - DNA, 25 bp, S. pombe
ttttagatccaaagggagcctcagg

SEQ ID NO: 114818 - DNA, 25 bp, S. pombe
tttgtattccaatccaatgcctgca

SEQ ID NO: 114819 - DNA, 25 bp, S. pombe
tttgattcttcaatgcatccttccc

SEQ ID NO: 114820 - DNA, 25 bp, S. pombe
tttaattccatagacgacccctcta

SEQ ID NO: 114821 - DNA, 25 bp, S. pombe
tttatattgccttcgacggaaccca

SEQ ID NO: 114822 - DNA, 25 bp, S. pombe
tttcaattttaagtcgtgcaaccga

SEQ ID NO: 114823 - DNA, 25 bp, S. pombe
tttaatttccgctcttgtacacgaa

SEQ ID NO: 114824 - DNA, 25 bp, S. pombe
tttacagtgcttcttctttagcctc

SEQ ID NO: 114825 - DNA, 25 bp, S. pombe
tttactggcttcttccttgggaact

SEQ ID NO: 114826 - DNA, 25 bp, S. pombe
tttacccttgagaccttcggtgaca

SEQ ID NO: 114827 - DNA, 25 bp, S. pombe
tttcactacgtttccattctccaat

SEQ ID NO: 114828 - DNA, 25 bp, S. pombe
tttagtaaatcttcgttcccctgct

SEQ ID NO: 114829 - DNA, 25 bp, S. pombe
tttaatttgcttactcggcggtttg

SEQ ID NO: 114830 - DNA, 25 bp, S. pombe
tttcgtgagacctaataccgtgcat

SEQ ID NO: 114831 - DNA, 25 bp, S. pombe
tttgatgcctttaagaccgtctctg

SEQ ID NO: 114832 - DNA, 25 bp, S. pombe
tttgacgtatttttcccatctctag

SEQ ID NO: 114833 - DNA, 25 bp, S. pombe
tttacgtattcctcttgctattgca

SEQ ID NO: 114834 - DNA, 25 bp, S. pombe
ttatacgctttcctacgtgtgcgag

SEQ ID NO: 114835 - DNA, 25 bp, S. pombe
tttacctatagggagtgttcagatg

SEQ ID NO: 114836 - DNA, 25 bp, S. pombe
tttgcagccttcacgaatgtttgtc

SEQ ID NO: 114837 - DNA, 25 bp, S. pombe
tttctgccgcagttaagtttgtgca

SEQ ID NO: 114838 - DNA, 25 bp, S. pombe
ttttgggttctctctattggttata

SEQ ID NO: 114839 - DNA, 25 bp, S. pombe
tttgcttgcgttttggcatgtcgaa

SEQ ID NO: 114840 - DNA, 25 bp, S. pombe
tttgctccggtcaagctgctgttaa

SEQ ID NO: 114841 - DNA, 25 bp, S. pombe
tttgctcatgcatttatccactctc

SEQ ID NO: 114842 - DNA, 25 bp, S. pombe
ttctgctttgtatactgaggtcgac

SEQ ID NO: 114843 - DNA, 25 bp, S. pombe
ttttcttggaacgtggctgtggtgc

SEQ ID NO: 114844 - DNA, 25 bp, S. pombe
tttcctgacattactccgcaaaatc

SEQ ID NO: 114845 - DNA, 25 bp, S. pombe
tttgcttacgtcttccctagaaaag

SEQ ID NO: 114846 - DNA, 25 bp, S. pombe
tttcgtattatattcactcaccgcc

SEQ ID NO: 114847 - DNA, 25 bp, S. pombe
tttctcttgtttttccatatcgcca

SEQ ID NO: 114848 - DNA, 25 bp, S. pombe
ttcttttttctgctttcgacgacaa

SEQ ID NO: 114849 - DNA, 25 bp, S. pombe
tttgactcttctttttatcccgaat

SEQ ID NO: 114850 - DNA, 25 bp, S. pombe
tttactcgatttctttactcatgga

SEQ ID NO: 114851 - DNA, 25 bp, S. pombe
tttacttttcggttggactgcaaga

SEQ ID NO: 114852 - DNA, 25 bp, S. pombe
tttgatctttttgacgtgacacaca

SEQ ID NO: 114853 - DNA, 25 bp, S. pombe
tttccgtatccgtaaaactcatgct

SEQ ID NO: 114854 - DNA, 25 bp, S. pombe
tttctcgctattcaaaactctctcg

SEQ ID NO: 114855 - DNA, 25 bp, S. pombe
tttctcgccctataagacatctgtt

SEQ ID NO: 114856 - DNA, 25 bp, S. pombe
ttttacctttaaatgccatcggcag

SEQ ID NO: 114857 - DNA, 25 bp, S. pombe
ttctttcagttttttgcgtcgtcga

SEQ ID NO: 114858 - DNA, 25 bp, S. pombe
ttttatcagactcattctcgtcggg

SEQ ID NO: 114859 - DNA, 25 bp, S. pombe
tttgctatacactttttcttcgcgc

SEQ ID NO: 114860 - DNA, 25 bp, S. pombe
ttatcattcaactctgtgtcttctg

SEQ ID NO: 114861 - DNA, 25 bp, S. pombe
tttatccaagcaaccttctactgtg

SEQ ID NO: 114862 - DNA, 25 bp, S. pombe
tttgaactcaaattcctccttggat

SEQ ID NO: 114863 - DNA, 25 bp, S. pombe
tttactgggaaaccttggcttcaag

SEQ ID NO: 114864 - DNA, 25 bp, S. pombe
tttcattactgcgaggatcccgaat

SEQ ID NO: 114865 - DNA, 25 bp, S. pombe
tttgcattttgttggctggacgctt

SEQ ID NO: 114866 - DNA, 25 bp, S. pombe
tttcatgttttttgatggacctcta

SEQ ID NO: 114867 - DNA, 25 bp, S. pombe
ttgctgccaagggtcgtcatgatcc

SEQ ID NO: 114868 - DNA, 25 bp, S. pombe
tttccaacatggtcgtgcaatccgg

SEQ ID NO: 114869 - DNA, 25 bp, S. pombe
tttctaagcatgtttggcacagcct

SEQ ID NO: 114870 - DNA, 25 bp, S. pombe
tttgctcaaaatccataactccttt

SEQ ID NO: 114871 - DNA, 25 bp, S. pombe
ttcccaaattcgtcaaatgccctat

SEQ ID NO: 114872 - DNA, 25 bp, S. pombe
tttaaatttcgccaattgcccgagc

SEQ ID NO: 114873 - DNA, 25 bp, S. pombe
tttgaattttcgcaagctcaccggc

SEQ ID NO: 114874 - DNA, 25 bp, S. pombe
tttaaccctgagacaaacatgctgc

SEQ ID NO: 114875 - DNA, 25 bp, S. pombe
tttgcacggccttaaatcacatggg

SEQ ID NO: 114876 - DNA, 25 bp, S. pombe
tttacccttttatccattcgacagt

SEQ ID NO: 114877 - DNA, 25 bp, S. pombe
tttagagtcacaaccaaccgatagt

SEQ ID NO: 114878 - DNA, 25 bp, S. pombe
tttcatgagctctaagtctttcgta

SEQ ID NO: 114879 - DNA, 25 bp, S. pombe
tttatggtcgattggctttgccttg

SEQ ID NO: 114880 - DNA, 25 bp, S. pombe
ttggatgaacgtaacttagccttta

SEQ ID NO: 114881 - DNA, 25 bp, S. pombe
ttctgatgaacgaaagcttcccggt

SEQ ID NO: 114882 - DNA, 25 bp, S. pombe
tttgaacaagaaatcgtccccgtcg

SEQ ID NO: 114883 - DNA, 25 bp, S. pombe
tttcaaaacgcgctgaacctcagaa

SEQ ID NO: 114884 - DNA, 25 bp, S. pombe
tttccccatttgattttggcgatgc

SEQ ID NO: 114885 - DNA, 25 bp, S. pombe
ttaccctttccaagattcgtcgtgc

SEQ ID NO: 114886 - DNA, 25 bp, S. pombe
tttaccttgttaactttgctcgtgc

SEQ ID NO: 114887 - DNA, 25 bp, S. pombe
tttaccctttgctcatgttgctcct

SEQ ID NO: 114888 - DNA, 25 bp, S. pombe
tttgcatacgctcatatacctggtg

SEQ ID NO: 114889 - DNA, 25 bp, S. pombe
tttctactcaggacaaatctcgatg

SEQ ID NO: 114890 - DNA, 25 bp, S. pombe
tttgctcagcccctaaattagatcc

SEQ ID NO: 114891 - DNA, 25 bp, S. pombe
ttttcagaacctgactttcatccct

SEQ ID NO: 114892 - DNA, 25 bp, S. pombe
tttacaaatccatcgttatgaccct

SEQ ID NO: 114893 - DNA, 25 bp, S. pombe
tttcccattttcctttgctacacat

SEQ ID NO: 114894 - DNA, 25 bp, S. pombe
tttgcgtctttttggttgctctcac

SEQ ID NO: 114895 - DNA, 25 bp, S. pombe
tttcgctgcttcgtacttagctgaa

SEQ ID NO: 114896 - DNA, 25 bp, S. pombe
tttccagccccacttgaaaagaagg

SEQ ID NO: 114897 - DNA, 25 bp, S. pombe
tttgccttacggtttattcttcaca

SEQ ID NO: 114898 - DNA, 25 bp, S. pombe
tttgccttgggtatacttgcttgaa

SEQ ID NO: 114899 - DNA, 25 bp, S. pombe
ttatgcctagtctttaccttgtacg

SEQ ID NO: 114900 - DNA, 25 bp, S. pombe
tttccatagccgttcctcaatgtaa

SEQ ID NO: 114901 - DNA, 25 bp, S. pombe
ttatgcctgtgggttcctcaattaa

SEQ ID NO: 114902 - DNA, 25 bp, S. pombe
tttcccattttccactcgtaatatt

SEQ ID NO: 114903 - DNA, 25 bp, S. pombe
ttcacccaatttttcgtactacgct

SEQ ID NO: 114904 - DNA, 25 bp, S. pombe
ttgccccaacttacaagtacgacgt

SEQ ID NO: 114905 - DNA, 25 bp, S. pombe
ttgcaacaaactttcggtatcccca

SEQ ID NO: 114906 - DNA, 25 bp, S. pombe
ttaaaaatgtatctggtctccctgc

SEQ ID NO: 114907 - DNA, 25 bp, S. pombe
ttttaagcactaacggtcaccctgg

SEQ ID NO: 114908 - DNA, 25 bp, S. pombe
tttaaaacacctggcgcaacctatc

SEQ ID NO: 114909 - DNA, 25 bp, S. pombe
tttcagataaacttggccgagccgt

SEQ ID NO: 114910 - DNA, 25 bp, S. pombe
tttgcggaaagtttcgccagctggc

SEQ ID NO: 114911 - DNA, 25 bp, S. pombe
tttcccaaagttccagcaactgctg

SEQ ID NO: 114912 - DNA, 25 bp, S. pombe
tttctatcaacctaaccaacctatt

SEQ ID NO: 114913 - DNA, 25 bp, S. pombe
ttttcacaacgataccaatcccagt

SEQ ID NO: 114914 - DNA, 25 bp, S. pombe
tttcaaacttgatactttcgccctc

SEQ ID NO: 114915 - DNA, 25 bp, S. pombe
tttcggcgttgctcacatcttcgcc

SEQ ID NO: 114916 - DNA, 25 bp, S. pombe
tttcggtgttgctcacatctttgct

SEQ ID NO: 114917 - DNA, 25 bp, S. pombe
ttccgacgggaattatcgttcgatc

SEQ ID NO: 114918 - DNA, 25 bp, S. pombe
tttcccttggaacacggcatctgat

SEQ ID NO: 114919 - DNA, 25 bp, S. pombe
ttttttgatggaacctcggcttcga

SEQ ID NO: 114920 - DNA, 25 bp, S. pombe
tttagattatctcccaccttaccaa

SEQ ID NO: 114921 - DNA, 25 bp, S. pombe
ttctagttttactcctgtccaagac

SEQ ID NO: 114922 - DNA, 25 bp, S. pombe
tttatttttgcatccgctttcagct

SEQ ID NO: 114923 - DNA, 25 bp, S. pombe
tttgctggcacgtaatcctgagctt

SEQ ID NO: 114924 - DNA, 25 bp, S. pombe
ttttggcacaaaagcgagcagcagt

SEQ ID NO: 114925 - DNA, 25 bp, S. pombe
ttttggattggttgcggccagtgct

SEQ ID NO: 114926 - DNA, 25 bp, S. pombe
ttctaccaacacatggcttgcaggc

SEQ ID NO: 114927 - DNA, 25 bp, S. pombe
ttttatttcatttcggccttaggtg

SEQ ID NO: 114928 - DNA, 25 bp, S. pombe
tttcctcctcacaaatacctgattg

SEQ ID NO: 114929 - DNA, 25 bp, S. pombe
tttcctaccatctacattcctgtta

SEQ ID NO: 114930 - DNA, 25 bp, S. pombe
tttcctggccctgatgctggtgatt

SEQ ID NO: 114931 - DNA, 25 bp, S. pombe
ttttgccgacttgcatgatcgtgtt

SEQ ID NO: 114932 - DNA, 25 bp, S. pombe
tttgcctctctttaacaatgccttt

SEQ ID NO: 114933 - DNA, 25 bp, S. pombe
tttcactgttactgagactgccggt

SEQ ID NO: 114934 - DNA, 25 bp, S. pombe
tttagctttactcatatctgtcttg

SEQ ID NO: 114935 - DNA, 25 bp, S. pombe
tttacgtgatgacccttctgtgcaa

SEQ ID NO: 114936 - DNA, 25 bp, S. pombe
tttcacgcgggttttgcatctgcaa

SEQ ID NO: 114937 - DNA, 25 bp, S. pombe
tttcacgcagtgatgtaccattgga

SEQ ID NO: 114938 - DNA, 25 bp, S. pombe
tttctcaaagtgttccaaagggcaa

SEQ ID NO: 114939 - DNA, 25 bp, S. pombe
tttccaaagccagtaccaggtccaa

SEQ ID NO: 114940 - DNA, 25 bp, S. pombe
ttgttgaaagccatcaccggacttc

SEQ ID NO: 114941 - DNA, 25 bp, S. pombe
ttttcaaccgatttcagctttccag

SEQ ID NO: 114942 - DNA, 25 bp, S. pombe
ttttccaacgactcttatttcacct

SEQ ID NO: 114943 - DNA, 25 bp, S. pombe
ttttgcccaagatccttttgtcaag

SEQ ID NO: 114944 - DNA, 25 bp, S. pombe
tttctccccacttgttacttcaaag

SEQ ID NO: 114945 - DNA, 25 bp, S. pombe
tttcactccacctctaatgttagca

SEQ ID NO: 114946 - DNA, 25 bp, S. pombe
tttactccacgtctgaatgttcaaa

SEQ ID NO: 114947 - DNA, 25 bp, S. pombe
tttccgcctgaaaatccaaatgcat

SEQ ID NO: 114948 - DNA, 25 bp, S. pombe
ttatgaatctcctgcagaacccgat

SEQ ID NO: 114949 - DNA, 25 bp, S. pombe
tttaagcatgacttggataatcctt

SEQ ID NO: 114950 - DNA, 25 bp, S. pombe
tttcgaagcatcctcactcatagaa

SEQ ID NO: 114951 - DNA, 25 bp, S. pombe
ttctcaggagccctttcgaacaagt

SEQ ID NO: 114952 - DNA, 25 bp, S. pombe
tttcagaccttgatttggatcccaa

SEQ ID NO: 114953 - DNA, 25 bp, S. pombe
tttctacctttcttcgaatcagcac

SEQ ID NO: 114954 - DNA, 25 bp, S. pombe
ttttacggcgacttggattctgcac

SEQ ID NO: 114955 - DNA, 25 bp, S. pombe
tttttagtcgtcctggatgtcctta

SEQ ID NO: 114956 - DNA, 25 bp, S. pombe
tttttaaagatccaggtgccgctct

SEQ ID NO: 114957 - DNA, 25 bp, S. pombe
tttttaatatttcccatccttctcg

SEQ ID NO: 114958 - DNA, 25 bp, S. pombe
tttcagactttctcctagccttcta

SEQ ID NO: 114959 - DNA, 25 bp, S. pombe
ttttgcctttcagcgtatccttaaa

SEQ ID NO: 114960 - DNA, 25 bp, S. pombe
ttttttcttccgatgcctcttataa

SEQ ID NO: 114961 - DNA, 25 bp, S. pombe
tttttgcatttttcttcttcctata

SEQ ID NO: 114962 - DNA, 25 bp, S. pombe
tttccgatgtttcttctgttctata

SEQ ID NO: 114963 - DNA, 25 bp, S. pombe
tttcgcgatcttaattcctggtcaa

SEQ ID NO: 114964 - DNA, 25 bp, S. pombe
tttccctccttatcctgtgacaaag

SEQ ID NO: 114965 - DNA, 25 bp, S. pombe
tttcctctccttttacaagatccaa

SEQ ID NO: 114966 - DNA, 25 bp, S. pombe
tttgcgtcttcttttaaccaccaga

SEQ ID NO: 114967 - DNA, 25 bp, S. pombe
tttcgtcgagtatgctaagctgcct

SEQ ID NO: 114968 - DNA, 25 bp, S. pombe
tttttactgtcccatatttgcgcac

SEQ ID NO: 114969 - DNA, 25 bp, S. pombe
tttcgtacagctttgtcggagcttc

SEQ ID NO: 114970 - DNA, 25 bp, S. pombe
tttcgaagcgttttctggatttcaa

SEQ ID NO: 114971 - DNA, 25 bp, S. pombe
tttctttcttttttggctgcttaat

SEQ ID NO: 114972 - DNA, 25 bp, S. pombe
tttacttcctttggcaggtcctgaa

SEQ ID NO: 114973 - DNA, 25 bp, S. pombe
tttccttctgttgcgcggtattaaa

SEQ ID NO: 114974 - DNA, 25 bp, S. pombe
tttccatttgttaagctcgtttccg

SEQ ID NO: 114975 - DNA, 25 bp, S. pombe
tttcgaccaattgaccttgttccag

SEQ ID NO: 114976 - DNA, 25 bp, S. pombe
tttaactttgtatccctgttgccag

SEQ ID NO: 114977 - DNA, 25 bp, S. pombe
tttaactttgacttctcttcttcca

SEQ ID NO: 114978 - DNA, 25 bp, S. pombe
tttacagctttttggtctcttcttg

SEQ ID NO: 114979 - DNA, 25 bp, S. pombe
tttacgcctgtatcttctttttgac

SEQ ID NO: 114980 - DNA, 25 bp, S. pombe
ttattacgaccgatttaaccccatg

SEQ ID NO: 114981 - DNA, 25 bp, S. pombe
ttttagcgggctttttcactcgagc

SEQ ID NO: 114982 - DNA, 25 bp, S. pombe
tttccgtcgctgctattgtcaccat

SEQ ID NO: 114983 - DNA, 25 bp, S. pombe
ttttcgctagttcagtacactctcg

SEQ ID NO: 114984 - DNA, 25 bp, S. pombe
ttttctctggtttagcttcaatcgc

SEQ ID NO: 114985 - DNA, 25 bp, S. pombe
tttagcttctgttacacttaaacta

SEQ ID NO: 114986 - DNA, 25 bp, S. pombe
ttttactcaaggcacattcgtctca

SEQ ID NO: 114987 - DNA, 25 bp, S. pombe
tttattcccgtcgaactttgttcag

SEQ ID NO: 114988 - DNA, 25 bp, S. pombe
tttcgtactcgcagtatcgtagcaa

SEQ ID NO: 114989 - DNA, 25 bp, S. pombe
tttcagaatcctcttcatttgacag

SEQ ID NO: 114990 - DNA, 25 bp, S. pombe
tttacacattctggctatctttacg

SEQ ID NO: 114991 - DNA, 25 bp, S. pombe
tttctcaatttggtcctgtgctacg

SEQ ID NO: 114992 - DNA, 25 bp, S. pombe
tttacaagctcttatccgtgatacg

SEQ ID NO: 114993 - DNA, 25 bp, S. pombe
tttcacagatgctttctgcacagtt

SEQ ID NO: 114994 - DNA, 25 bp, S. pombe
tttacagacactagcatctatgcgt

SEQ ID NO: 114995 - DNA, 25 bp, S. pombe
tttaccaccaatcattcagttcgca

SEQ ID NO: 114996 - DNA, 25 bp, S. pombe
tttcatctaaaccttccagttcgac

SEQ ID NO: 114997 - DNA, 25 bp, S. pombe
ttttctcaacaacttcaactactcc

SEQ ID NO: 114998 - DNA, 25 bp, S. pombe
tttactgaccagacttgcaacaact

SEQ ID NO: 114999 - DNA, 25 bp, S. pombe
ttatctgatgcacagtcgtcaacag

SEQ ID NO: 115000 - DNA, 25 bp, S. pombe
tttctggcaagaacgctcaacgctt

SEQ ID NO: 115001 - DNA, 25 bp, S. pombe
ttttatgcaacaacctcaaggccct

SEQ ID NO: 115002 - DNA, 25 bp, S. pombe
tttattcttacttagccggtggcat

SEQ ID NO: 115003 - DNA, 25 bp, S. pombe
ttttccgtgcaacaggtagcgtcat

SEQ ID NO: 115004 - DNA, 25 bp, S. pombe
ttttgcgtccaagcggaagcggcat

SEQ ID NO: 115005 - DNA, 25 bp, S. pombe
tttagttcatagcatccaggatttt

SEQ ID NO: 115006 - DNA, 25 bp, S. pombe
tttacgttacgaccaggagcatttc

SEQ ID NO: 115007 - DNA, 25 bp, S. pombe
tttaaattctaggtgctgtgcagca

SEQ ID NO: 115008 - DNA, 25 bp, S. pombe
tttcgaactttggactatgcagccc

SEQ ID NO: 115009 - DNA, 25 bp, S. pombe
tttcgaaatttgttgcatcctgcca

SEQ ID NO: 115010 - DNA, 25 bp, S. pombe
tttcgtatatttttgcagggccttt

SEQ ID NO: 115011 - DNA, 25 bp, S. pombe
tttcgtctttgtctggttgcagcat

SEQ ID NO: 115012 - DNA, 25 bp, S. pombe
ttatctcgttttgacatccttcagg

SEQ ID NO: 115013 - DNA, 25 bp, S. pombe
tttctcgtctttccactttgaagtg

SEQ ID NO: 115014 - DNA, 25 bp, S. pombe
tttctctgccattaccacttaaagt

SEQ ID NO: 115015 - DNA, 25 bp, S. pombe
tttccgccaggatctcatcgatcaa

SEQ ID NO: 115016 - DNA, 25 bp, S. pombe
tttcgatgccgatgatcttcgctac

SEQ ID NO: 115017 - DNA, 25 bp, S. pombe
tttagagcgcgtccaatccgtcaag

SEQ ID NO: 115018 - DNA, 25 bp, S. pombe
tttctgcggccgtttgactgtcaag

SEQ ID NO: 115019 - DNA, 25 bp, S. pombe
ttttggaccagacgattttcagagt

SEQ ID NO: 115020 - DNA, 25 bp, S. pombe
tttctctcacttactagtccttgta

SEQ ID NO: 115021 - DNA, 25 bp, S. pombe
tttactcctatactcattcctaact

SEQ ID NO: 115022 - DNA, 25 bp, S. pombe
tttcgccccataatattgcctgata

SEQ ID NO: 115023 - DNA, 25 bp, S. pombe
tttcgtccgatctattgtgcgtgaa

SEQ ID NO: 115024 - DNA, 25 bp, S. pombe
tttcgtcgtgctgcttggccagtat

SEQ ID NO: 115025 - DNA, 25 bp, S. pombe
tttttggcaatgtcgaacactgtcg

SEQ ID NO: 115026 - DNA, 25 bp, S. pombe
ttatttttcactcgaaccgtcagcg

SEQ ID NO: 115027 - DNA, 25 bp, S. pombe
tttttattcctttcactccagaggt

SEQ ID NO: 115028 - DNA, 25 bp, S. pombe
tttctttataattgtcgccgcatcc

SEQ ID NO: 115029 - DNA, 25 bp, S. pombe
ttgaattgcttaaagtcctcccctc

SEQ ID NO: 115030 - DNA, 25 bp, S. pombe
tttaatcgcgctaatgacctttcat

SEQ ID NO: 115031 - DNA, 25 bp, S. pombe
tttaagtcagctatggccatcccag

SEQ ID NO: 115032 - DNA, 25 bp, S. pombe
ttatgagcggtattatcggcgtcta

SEQ ID NO: 115033 - DNA, 25 bp, S. pombe
tttagatttgaagccgtgaccgatg

SEQ ID NO: 115034 - DNA, 25 bp, S. pombe
ttctactcgtaagccgccagggaaa

SEQ ID NO: 115035 - DNA, 25 bp, S. pombe
tttcgcttctactttggcatcggaa

SEQ ID NO: 115036 - DNA, 25 bp, S. pombe
tttccttcaactcgctggtatcgaa

SEQ ID NO: 115037 - DNA, 25 bp, S. pombe
tttctgctgctcttgatactggtac

SEQ ID NO: 115038 - DNA, 25 bp, S. pombe
tttcctgctctgcagatgtcagcat

SEQ ID NO: 115039 - DNA, 25 bp, S. pombe
tttcctggctcaagttcgcaacaaa

SEQ ID NO: 115040 - DNA, 25 bp, S. pombe
tttccggtgttcttggtctattcaa

SEQ ID NO: 115041 - DNA, 25 bp, S. pombe
tttttggctgtgtggtggatgtatt

SEQ ID NO: 115042 - DNA, 25 bp, S. pombe
tttatttctgtagcgatggttccca

SEQ ID NO: 115043 - DNA, 25 bp, S. pombe
tttctctgtccccaaaatctacata

SEQ ID NO: 115044 - DNA, 25 bp, S. pombe
tttcctcctcttctatgtatctttt

SEQ ID NO: 115045 - DNA, 25 bp, S. pombe
tttcggctgctttatttttcatttt

SEQ ID NO: 115046 - DNA, 25 bp, S. pombe
tttcccgctgcttcatctaatatat

SEQ ID NO: 115047 - DNA, 25 bp, S. pombe
tttaccctgcattcattagtccaca

SEQ ID NO: 115048 - DNA, 25 bp, S. pombe
tttccgtctatcaattcattccaac

SEQ ID NO: 115049 - DNA, 25 bp, S. pombe
tttcatcagtatatgtattaccaag

SEQ ID NO: 115050 - DNA, 25 bp, S. pombe
tttcaagacacttttttggcaagag

SEQ ID NO: 115051 - DNA, 25 bp, S. pombe
tttaagatacatttttggcgacaga

SEQ ID NO: 115052 - DNA, 25 bp, S. pombe
tttcacctccatctttggcaggaaa

SEQ ID NO: 115053 - DNA, 25 bp, S. pombe
tttccctgcttgcatcgatgacgga

SEQ ID NO: 115054 - DNA, 25 bp, S. pombe
tttacgcgctcttcaggatagtcga

SEQ ID NO: 115055 - DNA, 25 bp, S. pombe
tttactccaatgtcggtagctctac

SEQ ID NO: 115056 - DNA, 25 bp, S. pombe
tttcatttaatgacggctcctccat

SEQ ID NO: 115057 - DNA, 25 bp, S. pombe
tttcaattactgatgcggcactcgt

SEQ ID NO: 115058 - DNA, 25 bp, S. pombe
tttcttgttccttcgagagatgccc

SEQ ID NO: 115059 - DNA, 25 bp, S. pombe
tttttgttcctctagcaatggccta

SEQ ID NO: 115060 - DNA, 25 bp, S. pombe
ttttaatccctaaagatcgccctgt

SEQ ID NO: 115061 - DNA, 25 bp, S. pombe
ttttcttctttatgtcaacgactag

SEQ ID NO: 115062 - DNA, 25 bp, S. pombe
ttttcatacttatcactcccggttt

SEQ ID NO: 115063 - DNA, 25 bp, S. pombe
tttcccatgctgattgcgggactga

SEQ ID NO: 115064 - DNA, 25 bp, S. pombe
tttaacgctcacgaattttcctcac

SEQ ID NO: 115065 - DNA, 25 bp, S. pombe
tttactcgtccagatgatttccatt

SEQ ID NO: 115066 - DNA, 25 bp, S. pombe
tttctttccctttgaaccagctgaa

SEQ ID NO: 115067 - DNA, 25 bp, S. pombe
tttctgttcctgttagcacctttga

SEQ ID NO: 115068 - DNA, 25 bp, S. pombe
tttcttggcttatttcacctttgag

SEQ ID NO: 115069 - DNA, 25 bp, S. pombe
tttcgacttggtgtagcatctttca

SEQ ID NO: 115070 - DNA, 25 bp, S. pombe
tttagccctttccatgccaggtaaa

SEQ ID NO: 115071 - DNA, 25 bp, S. pombe
tttagccattgttctgattcaggta

SEQ ID NO: 115072 - DNA, 25 bp, S. pombe
tttacattggattctgcgagcgtta

SEQ ID NO: 115073 - DNA, 25 bp, S. pombe
tttaattcatctccttacgaccgct

SEQ ID NO: 115074 - DNA, 25 bp, S. pombe
tttaatttccaaagagcgacctcaa

SEQ ID NO: 115075 - DNA, 25 bp, S. pombe
tttcgcacacccaagagcaggaatt

SEQ ID NO: 115076 - DNA, 25 bp, S. pombe
tttacgctcgtacaccagtcatggt

SEQ ID NO: 115077 - DNA, 25 bp, S. pombe
tttaccacgctccttatttacgcaa

SEQ ID NO: 115078 - DNA, 25 bp, S. pombe
tttaccagttggagattgaatcgaa

SEQ ID NO: 115079 - DNA, 25 bp, S. pombe
ttttccctagttttagaagctctct

SEQ ID NO: 115080 - DNA, 25 bp, S. pombe
ttttccacggttcctgaagcgttat

SEQ ID NO: 115081 - DNA, 25 bp, S. pombe
tttcgcgtcggtgtattagcagtta

SEQ ID NO: 115082 - DNA, 25 bp, S. pombe
tttcccatcgtgagtttagcttcta

SEQ ID NO: 115083 - DNA, 25 bp, S. pombe
ttgttaccgacagatttccactttt

SEQ ID NO: 115084 - DNA, 25 bp, S. pombe
ttttaatcaccctcttcgctatgtt

SEQ ID NO: 115085 - DNA, 25 bp, S. pombe
ttttattgagcttcctttcctttct

SEQ ID NO: 115086 - DNA, 25 bp, S. pombe
tttctcttcttctcttttcttactt

SEQ ID NO: 115087 - DNA, 25 bp, S. pombe
tttcttccgctattacaatgccatg

SEQ ID NO: 115088 - DNA, 25 bp, S. pombe
tttcttctactgctgtcaatcctaa

SEQ ID NO: 115089 - DNA, 25 bp, S. pombe
tttcttcattccctgtatactctaa

SEQ ID NO: 115090 - DNA, 25 bp, S. pombe
ttttatcattcgcttgtaattgcca

SEQ ID NO: 115091 - DNA, 25 bp, S. pombe
ttaataattcctcccgatgtatctg

SEQ ID NO: 115092 - DNA, 25 bp, S. pombe
ttaaatcttacatgcgtcctcgaac

SEQ ID NO: 115093 - DNA, 25 bp, S. pombe
ttaaacttactcactgccaaaccgg

SEQ ID NO: 115094 - DNA, 25 bp, S. pombe
ttttcatttaccatggctcaaaccc

SEQ ID NO: 115095 - DNA, 25 bp, S. pombe
ttttgagttaccacctgatcaaccc

SEQ ID NO: 115096 - DNA, 25 bp, S. pombe
tttaactttggtaccggcagcagcc

SEQ ID NO: 115097 - DNA, 25 bp, S. pombe
tttacaaatcggttcttagcaagct

SEQ ID NO: 115098 - DNA, 25 bp, S. pombe
ttatatatggtcagcccgggcacag

SEQ ID NO: 115099 - DNA, 25 bp, S. pombe
tttcgtcagacctaactctgcaagg

SEQ ID NO: 115100 - DNA, 25 bp, S. pombe
tttctcgtatttgccctgtatcaga

SEQ ID NO: 115101 - DNA, 25 bp, S. pombe
ttatgcctgttttaccttgtcaagc

SEQ ID NO: 115102 - DNA, 25 bp, S. pombe
tttaggcactggtggtgtcttcatc

SEQ ID NO: 115103 - DNA, 25 bp, S. pombe
tttatggatttgtgtgttgctctac

SEQ ID NO: 115104 - DNA, 25 bp, S. pombe
tttcggcatacatggtattgctcta

SEQ ID NO: 115105 - DNA, 25 bp, S. pombe
tttctactgtcttctttgtctgata

SEQ ID NO: 115106 - DNA, 25 bp, S. pombe
tttcaacgcatttagctggctcgaa

SEQ ID NO: 115107 - DNA, 25 bp, S. pombe
tttcttcaatgatacgcacgcgtca

SEQ ID NO: 115108 - DNA, 25 bp, S. pombe
ttttcttacaaacgactctctatgg

SEQ ID NO: 115109 - DNA, 25 bp, S. pombe
ttttttatgaaacccctgctgaagg

SEQ ID NO: 115110 - DNA, 25 bp, S. pombe
tttcttgtcgaaacatccgcttaaa

SEQ ID NO: 115111 - DNA, 25 bp, S. pombe
tttttgctgaaatctcctgttgaag

SEQ ID NO: 115112 - DNA, 25 bp, S. pombe
tttctctccaaacatcttcacgata

SEQ ID NO: 115113 - DNA, 25 bp, S. pombe
ttttgtaactactggcaacctgcta

SEQ ID NO: 115114 - DNA, 25 bp, S. pombe
ttaaggttgtagagcgtccaccacc

SEQ ID NO: 115115 - DNA, 25 bp, S. pombe
ttacaggtcgaaacagctaccccaa

SEQ ID NO: 115116 - DNA, 25 bp, S. pombe
ttatcgtccgtttaccaaacgtgag

SEQ ID NO: 115117 - DNA, 25 bp, S. pombe
tttcgttctgtttatccccaaatgt

SEQ ID NO: 115118 - DNA, 25 bp, S. pombe
tttattactgttttgcccacggact

SEQ ID NO: 115119 - DNA, 25 bp, S. pombe
ttttttgttctgattcccgtgattc

SEQ ID NO: 115120 - DNA, 25 bp, S. pombe
tttctttttctgacttccatccaaa

SEQ ID NO: 115121 - DNA, 25 bp, S. pombe
tttctccttctaaacaatccgacga

SEQ ID NO: 115122 - DNA, 25 bp, S. pombe
ttttatcgctgtgaaaccggacgca

SEQ ID NO: 115123 - DNA, 25 bp, S. pombe
tttcttccttacattttggtgctag

SEQ ID NO: 115124 - DNA, 25 bp, S. pombe
ttttatccctccattttcgattcaa

SEQ ID NO: 115125 - DNA, 25 bp, S. pombe
ttatctccacgtgcttttgttgact

SEQ ID NO: 115126 - DNA, 25 bp, S. pombe
ttttcctcgaaatctctcttactga

SEQ ID NO: 115127 - DNA, 25 bp, S. pombe
tttatttgctaatcactcgctggag

SEQ ID NO: 115128 - DNA, 25 bp, S. pombe
tttcatttggaattacggcgcgctc

SEQ ID NO: 115129 - DNA, 25 bp, S. pombe
tttcttgttgttctggctccaatga

SEQ ID NO: 115130 - DNA, 25 bp, S. pombe
tttttcaagcttctggccaaggcat

SEQ ID NO: 115131 - DNA, 25 bp, S. pombe
tttttcaagccaactgtccaaacgg

SEQ ID NO: 115132 - DNA, 25 bp, S. pombe
ttttgttgactatgctaagctgcct

SEQ ID NO: 115133 - DNA, 25 bp, S. pombe
ttttggctacatccgtttggcgtaa

SEQ ID NO: 115134 - DNA, 25 bp, S. pombe
ttttcgctaaggctcttgagggcaa

SEQ ID NO: 115135 - DNA, 25 bp, S. pombe
ttttgcgcatcagcggtcgtgcaga

SEQ ID NO: 115136 - DNA, 25 bp, S. pombe
tttattctcacttgctgctgcctca

SEQ ID NO: 115137 - DNA, 25 bp, S. pombe
tttctctgcgacaagagcatgcctt

SEQ ID NO: 115138 - DNA, 25 bp, S. pombe
ttatggagcggtgtcagcgtaacgt

SEQ ID NO: 115139 - DNA, 25 bp, S. pombe
tttaacggaagatcagctgcaacct

SEQ ID NO: 115140 - DNA, 25 bp, S. pombe
ttacgcccgtggtagaaattccctg

SEQ ID NO: 115141 - DNA, 25 bp, S. pombe
tttatgggctctcaaactgcttcaa

SEQ ID NO: 115142 - DNA, 25 bp, S. pombe
tttatgtgcgtgatccagttgctcg

SEQ ID NO: 115143 - DNA, 25 bp, S. pombe
tttacacagtttccgatccatcaaa

SEQ ID NO: 115144 - DNA, 25 bp, S. pombe
tttctacactatgcctgatcctgaa

SEQ ID NO: 115145 - DNA, 25 bp, S. pombe
tttctcgcaactcgaaatcctcaga

SEQ ID NO: 115146 - DNA, 25 bp, S. pombe
ttttccatcccattcattgtggtga

SEQ ID NO: 115147 - DNA, 25 bp, S. pombe
tttctattctcccatcttgtgttat

SEQ ID NO: 115148 - DNA, 25 bp, S. pombe
tttaattccttcagctgtctcgtca

SEQ ID NO: 115149 - DNA, 25 bp, S. pombe
tttcaaatgtgataaccctgccgcc

SEQ ID NO: 115150 - DNA, 25 bp, S. pombe
tttctaatcgtaaagcccgctatgc

SEQ ID NO: 115151 - DNA, 25 bp, S. pombe
tttctattcgtcaatatgccgcctt

SEQ ID NO: 115152 - DNA, 25 bp, S. pombe
tttctatagcggcaaccgtcgtaga

SEQ ID NO: 115153 - DNA, 25 bp, S. pombe
ttttttcgcctctgtagacacaagc

SEQ ID NO: 115154 - DNA, 25 bp, S. pombe
ttttgtactctttggttgcatcaaa

SEQ ID NO: 115155 - DNA, 25 bp, S. pombe
ttatgagatcttcttgtgggagaca

SEQ ID NO: 115156 - DNA, 25 bp, S. pombe
tttatcagctgtcattcgtgccaaa

SEQ ID NO: 115157 - DNA, 25 bp, S. pombe
tttcaccatggcctacgatacataa

SEQ ID NO: 115158 - DNA, 25 bp, S. pombe
tttagctgatggtcgtctcgttaac

SEQ ID NO: 115159 - DNA, 25 bp, S. pombe
tttaattgcactggtctctgggctt

SEQ ID NO: 115160 - DNA, 25 bp, S. pombe
tttctttcactttctgctcttgtaa

SEQ ID NO: 115161 - DNA, 25 bp, S. pombe
ttatatgccatcgagtccttcctat

SEQ ID NO: 115162 - DNA, 25 bp, S. pombe
ttagctcttgctgattcgcgattgt

SEQ ID NO: 115163 - DNA, 25 bp, S. pombe
ttaggcgtaacattcaccggcaatt

SEQ ID NO: 115164 - DNA, 25 bp, S. pombe
ttatacgttacataccgggtgcatt

SEQ ID NO: 115165 - DNA, 25 bp, S. pombe
ttacccatttaccaacgccgaggat

SEQ ID NO: 115166 - DNA, 25 bp, S. pombe
ttgtcccaaaatttaaccgccactg

SEQ ID NO: 115167 - DNA, 25 bp, S. pombe
ttgtatcctagtattattccggagg

SEQ ID NO: 115168 - DNA, 25 bp, S. pombe
tttacttcctttaattcttcgatgg

SEQ ID NO: 115169 - DNA, 25 bp, S. pombe
tttaactactagtacagccgcctgt

SEQ ID NO: 115170 - DNA, 25 bp, S. pombe
tttacaaagtactatgcaccgccgc

SEQ ID NO: 115171 - DNA, 25 bp, S. pombe
tttttgaagttggtcagctcccgta

SEQ ID NO: 115172 - DNA, 25 bp, S. pombe
ttttgaagaggtatcgccgacggat

SEQ ID NO: 115173 - DNA, 25 bp, S. pombe
tttacaatgaatctgccgcacgacg

SEQ ID NO: 115174 - DNA, 25 bp, S. pombe
ttttgaccgtcaccatttgtatacc

SEQ ID NO: 115175 - DNA, 25 bp, S. pombe
ttttgacattccactactttcactc

SEQ ID NO: 115176 - DNA, 25 bp, S. pombe
ttttagatttctttgccttgccagt

SEQ ID NO: 115177 - DNA, 25 bp, S. pombe
tttaaaccctttgccatcctatttg

SEQ ID NO: 115178 - DNA, 25 bp, S. pombe
tttattagttcatttcattccctgt

SEQ ID NO: 115179 - DNA, 25 bp, S. pombe
ttttgacgctcataagttaccgaat

SEQ ID NO: 115180 - DNA, 25 bp, S. pombe
ttttgattctgggtcctgttaagga

SEQ ID NO: 115181 - DNA, 25 bp, S. pombe
ttgttcctttggaccttgtaagtga

SEQ ID NO: 115182 - DNA, 25 bp, S. pombe
ttttggagaaatcgccggaaccgct

SEQ ID NO: 115183 - DNA, 25 bp, S. pombe
ttttgacattagttggccagggccc

SEQ ID NO: 115184 - DNA, 25 bp, S. pombe
ttttctttggtttcaccgtcctgat

SEQ ID NO: 115185 - DNA, 25 bp, S. pombe
ttttatttggtttcaccctcagcca

SEQ ID NO: 115186 - DNA, 25 bp, S. pombe
ttttagttgccttaaccattctcct

SEQ ID NO: 115187 - DNA, 25 bp, S. pombe
tttttctggcagaggatctttttcc

SEQ ID NO: 115188 - DNA, 25 bp, S. pombe
ttttttggccgtatcatttctgaac

SEQ ID NO: 115189 - DNA, 25 bp, S. pombe
tttttacccactttgcttgttgatg

SEQ ID NO: 115190 - DNA, 25 bp, S. pombe
tttatttcctccttcgatggttgaa

SEQ ID NO: 115191 - DNA, 25 bp, S. pombe
ttttgcttcgtggtgtgttttgtca

SEQ ID NO: 115192 - DNA, 25 bp, S. pombe
ttagatcttggtcttttcgttcaaa

SEQ ID NO: 115193 - DNA, 25 bp, S. pombe
tttcaacaaactcacactctcttta

SEQ ID NO: 115194 - DNA, 25 bp, S. pombe
tttacaaaacttcccgctcatatta

SEQ ID NO: 115195 - DNA, 25 bp, S. pombe
tttacagtcgttgtcgcgctcatat

SEQ ID NO: 115196 - DNA, 25 bp, S. pombe
tttaccatgtgggtgcctgcatcta

SEQ ID NO: 115197 - DNA, 25 bp, S. pombe
tttacttgtgtggtcctacatggcc

SEQ ID NO: 115198 - DNA, 25 bp, S. pombe
ttttcggtattttcgtggctagctg

SEQ ID NO: 115199 - DNA, 25 bp, S. pombe
ttttctgtttttcagcattgtcccc

SEQ ID NO: 115200 - DNA, 25 bp, S. pombe
ttttcttttcttccgtattgccata

SEQ ID NO: 115201 - DNA, 25 bp, S. pombe
tttatctcctgattctccgttatac

SEQ ID NO: 115202 - DNA, 25 bp, S. pombe
tttagcgccaatttaaacgccttga

SEQ ID NO: 115203 - DNA, 25 bp, S. pombe
tttcaagcccaaatgtaacctcaga

SEQ ID NO: 115204 - DNA, 25 bp, S. pombe
tttcaggcatatatggctgcaccca

SEQ ID NO: 115205 - DNA, 25 bp, S. pombe
tttaagcagcagaggcgtcgccatg

SEQ ID NO: 115206 - DNA, 25 bp, S. pombe
tttaaccaactggatttgcctgaat

SEQ ID NO: 115207 - DNA, 25 bp, S. pombe
tttagagccgtctattccaaccata

SEQ ID NO: 115208 - DNA, 25 bp, S. pombe
ttgtgcgatccgactcttaaacgag

SEQ ID NO: 115209 - DNA, 25 bp, S. pombe
tttttcaccgattatacctggcgcg

SEQ ID NO: 115210 - DNA, 25 bp, S. pombe
tttttactgtgtttcacgggctcgt

SEQ ID NO: 115211 - DNA, 25 bp, S. pombe
tttttaaggttccagctcgagctct

SEQ ID NO: 115212 - DNA, 25 bp, S. pombe
tttatcatacgccttccgtgaagtc

SEQ ID NO: 115213 - DNA, 25 bp, S. pombe
ttattactgggaccctgggcatgtc

SEQ ID NO: 115214 - DNA, 25 bp, S. pombe
ttattcactggtgtccttacttcac

SEQ ID NO: 115215 - DNA, 25 bp, S. pombe
ttttcactggtcctggcaatattcc

SEQ ID NO: 115216 - DNA, 25 bp, S. pombe
ttttccctctccaaaatgttcttgt

SEQ ID NO: 115217 - DNA, 25 bp, S. pombe
ttttccgttggttcaggttctacat

SEQ ID NO: 115218 - DNA, 25 bp, S. pombe
ttttccagtatgtttcgtgtcccaa

SEQ ID NO: 115219 - DNA, 25 bp, S. pombe
ttttccgtcaaaccgttgcaggcaa

SEQ ID NO: 115220 - DNA, 25 bp, S. pombe
ttttccccaatgttcgttacgcata

SEQ ID NO: 115221 - DNA, 25 bp, S. pombe
ttttcccgagagatatgtgcctaca

SEQ ID NO: 115222 - DNA, 25 bp, S. pombe
ttaatcctcaggtgtattggcgcct

SEQ ID NO: 115223 - DNA, 25 bp, S. pombe
tttttacgaactatggcacagcctt

SEQ ID NO: 115224 - DNA, 25 bp, S. pombe
tttatgatacgaaacacggccgccg

SEQ ID NO: 115225 - DNA, 25 bp, S. pombe
ttttcaacgtttccggcttagccat

SEQ ID NO: 115226 - DNA, 25 bp, S. pombe
ttttcttcgttttctggatcttcca

SEQ ID NO: 115227 - DNA, 25 bp, S. pombe
ttcttttgtgttcccgtttgtcgca

SEQ ID NO: 115228 - DNA, 25 bp, S. pombe
tttactggtgttcctcttttcccag

SEQ ID NO: 115229 - DNA, 25 bp, S. pombe
tttcaatgggttagccgacttctcc

SEQ ID NO: 115230 - DNA, 25 bp, S. pombe
tttaatgggattcttccttcgcttc

SEQ ID NO: 115231 - DNA, 25 bp, S. pombe
tttaattcatttctctcctttctca

SEQ ID NO: 115232 - DNA, 25 bp, S. pombe
tttacttttattccatcctttctca

SEQ ID NO: 115233 - DNA, 25 bp, S. pombe
tttacctttgtttgtcccactgaga

SEQ ID NO: 115234 - DNA, 25 bp, S. pombe
tttaaacgatggctctctcttcgag

SEQ ID NO: 115235 - DNA, 25 bp, S. pombe
tttatctactgcagattccatcctc

SEQ ID NO: 115236 - DNA, 25 bp, S. pombe
ttttggcagctggtggtgactcgac

SEQ ID NO: 115237 - DNA, 25 bp, S. pombe
tttactgatcggcttgactctgaat

SEQ ID NO: 115238 - DNA, 25 bp, S. pombe
ttattcttcgagcttgtccaaatct

SEQ ID NO: 115239 - DNA, 25 bp, S. pombe
ttattcttctgctgcttctgtaaac

SEQ ID NO: 115240 - DNA, 25 bp, S. pombe
ttttttccttcatcttctacagcac

SEQ ID NO: 115241 - DNA, 25 bp, S. pombe
ttttggaatgctgccactggtgcaa

SEQ ID NO: 115242 - DNA, 25 bp, S. pombe
tttatgctcaacaggccgtgtcaat

SEQ ID NO: 115243 - DNA, 25 bp, S. pombe
ttcttgttgatttggccggtcgtga

SEQ ID NO: 115244 - DNA, 25 bp, S. pombe
ttttgtcgattgtcccagtcggaga

SEQ ID NO: 115245 - DNA, 25 bp, S. pombe
tttttcacccgaagatactgaggag

SEQ ID NO: 115246 - DNA, 25 bp, S. pombe
ttgtttgcacccaaggtcgtaggca

SEQ ID NO: 115247 - DNA, 25 bp, S. pombe
ttttagcactcaaagcgacggacgc

SEQ ID NO: 115248 - DNA, 25 bp, S. pombe
ttataagagctccaaggccgtccgt

SEQ ID NO: 115249 - DNA, 25 bp, S. pombe
tttcaagaatcacttcgtcgtcgcg

SEQ ID NO: 115250 - DNA, 25 bp, S. pombe
tttcaagagtcttcgccatctgttg

SEQ ID NO: 115251 - DNA, 25 bp, S. pombe
ttttcagcgtggtttcagggagcat

SEQ ID NO: 115252 - DNA, 25 bp, S. pombe
ttatgttcatctccagttccaagtc

SEQ ID NO: 115253 - DNA, 25 bp, S. pombe
ttttttcgcatcatcccaagtcaca

SEQ ID NO: 115254 - DNA, 25 bp, S. pombe
ttttgtccccagtcgacgagtatat

SEQ ID NO: 115255 - DNA, 25 bp, S. pombe
tttttgccctcactcgcagagaaaa

SEQ ID NO: 115256 - DNA, 25 bp, S. pombe
tttttgattctgacgctgcggaact

SEQ ID NO: 115257 - DNA, 25 bp, S. pombe
ttttgatgattcacgggtcactcct

SEQ ID NO: 115258 - DNA, 25 bp, S. pombe
tttaatcatctcatttccagctgcc

SEQ ID NO: 115259 - DNA, 25 bp, S. pombe
ttttacatctttactgtcagccgcc

SEQ ID NO: 115260 - DNA, 25 bp, S. pombe
ttttacatcagccttaatagccgcc

SEQ ID NO: 115261 - DNA, 25 bp, S. pombe
ttttaatcacttcaatgctgccggc

SEQ ID NO: 115262 - DNA, 25 bp, S. pombe
ttgttacacattcgaaagtcccgtt

SEQ ID NO: 115263 - DNA, 25 bp, S. pombe
tttatcctttagcagcagccatatc

SEQ ID NO: 115264 - DNA, 25 bp, S. pombe
ttatttgcattgatcccagtaccgg

SEQ ID NO: 115265 - DNA, 25 bp, S. pombe
ttatgtctgccaatgttccaattcc

SEQ ID NO: 115266 - DNA, 25 bp, S. pombe
ttatatctctgaatgctgctctgga

SEQ ID NO: 115267 - DNA, 25 bp, S. pombe
tttaccacaagcctctgcgaacaag

SEQ ID NO: 115268 - DNA, 25 bp, S. pombe
ttttgaggctgctcgacaagctacc

SEQ ID NO: 115269 - DNA, 25 bp, S. pombe
ttttgcgatcgctcatgtgaatcat

SEQ ID NO: 115270 - DNA, 25 bp, S. pombe
ttattctcagttatgcaccttggtg

SEQ ID NO: 115271 - DNA, 25 bp, S. pombe
tttaccacatggtctacctcatagg

SEQ ID NO: 115272 - DNA, 25 bp, S. pombe
ttttccctgaaaagcctcatagtgc

SEQ ID NO: 115273 - DNA, 25 bp, S. pombe
ttttgggatacattaggcctgagct

SEQ ID NO: 115274 - DNA, 25 bp, S. pombe
ttttcggaagcatcgtctctgacat

SEQ ID NO: 115275 - DNA, 25 bp, S. pombe
ttttccgaagcatccattccaattg

SEQ ID NO: 115276 - DNA, 25 bp, S. pombe
tttatccttaattctgcttccaacg

SEQ ID NO: 115277 - DNA, 25 bp, S. pombe
tttattatttactcgcagccagcgg

SEQ ID NO: 115278 - DNA, 25 bp, S. pombe
tttttgcatacttttctggcggatt

SEQ ID NO: 115279 - DNA, 25 bp, S. pombe
ttttgcatgcgttgtacgaccgttt

SEQ ID NO: 115280 - DNA, 25 bp, S. pombe
tttacatgccggtagagcgagccac

SEQ ID NO: 115281 - DNA, 25 bp, S. pombe
tttaccatctttactcttgccaata

SEQ ID NO: 115282 - DNA, 25 bp, S. pombe
tttactggccttactttgcttgatc

SEQ ID NO: 115283 - DNA, 25 bp, S. pombe
tttagcggccttacgggtcttctga

SEQ ID NO: 115284 - DNA, 25 bp, S. pombe
ttttttggtgctacttttcctcatc

SEQ ID NO: 115285 - DNA, 25 bp, S. pombe
tttactctaactggcccatttccaa

SEQ ID NO: 115286 - DNA, 25 bp, S. pombe
ttttactttatttttgtcgcggcag

SEQ ID NO: 115287 - DNA, 25 bp, S. pombe
tttattcgcctcaatgtttatcgcc

SEQ ID NO: 115288 - DNA, 25 bp, S. pombe
ttgttcccattgagtttacacccga

SEQ ID NO: 115289 - DNA, 25 bp, S. pombe
tttatcctcatcttcagattctcac

SEQ ID NO: 115290 - DNA, 25 bp, S. pombe
tttaccgactatcagcttcacgaaa

SEQ ID NO: 115291 - DNA, 25 bp, S. pombe
tttacagcgactcttcttccagaaa

SEQ ID NO: 115292 - DNA, 25 bp, S. pombe
tttaccgcctgattctgtccgagaa

SEQ ID NO: 115293 - DNA, 25 bp, S. pombe
tttacgtcgcgcttttactggaatc

SEQ ID NO: 115294 - DNA, 25 bp, S. pombe
tttactatccagattctctaccagc

SEQ ID NO: 115295 - DNA, 25 bp, S. pombe
tttaccttttttcgcatgatccatc

SEQ ID NO: 115296 - DNA, 25 bp, S. pombe
tttactttgactttggcgtgccaca

SEQ ID NO: 115297 - DNA, 25 bp, S. pombe
tttagttgttcttttgcgtgctctt

SEQ ID NO: 115298 - DNA, 25 bp, S. pombe
ttttatttctcttttgtggcacctt

SEQ ID NO: 115299 - DNA, 25 bp, S. pombe
tttatttctcgtcttgcttcacaat

SEQ ID NO: 115300 - DNA, 25 bp, S. pombe
ttttttcatcggtggttgcacgtac

SEQ ID NO: 115301 - DNA, 25 bp, S. pombe
ttttttccaagatgcgacccgtaca

SEQ ID NO: 115302 - DNA, 25 bp, S. pombe
ttttcttcgccgcaggaagctcaaa

SEQ ID NO: 115303 - DNA, 25 bp, S. pombe
ttttttgtcaatcgcaggacctaaa

SEQ ID NO: 115304 - DNA, 25 bp, S. pombe
ttttggctaatcaggccgatgcagc

SEQ ID NO: 115305 - DNA, 25 bp, S. pombe
ttataggtgcaatgtccgcgatagc

SEQ ID NO: 115306 - DNA, 25 bp, S. pombe
ttatgacgccaattctcgggaagtt

SEQ ID NO: 115307 - DNA, 25 bp, S. pombe
ttacaactgccgtctcaggtgaaga

SEQ ID NO: 115308 - DNA, 25 bp, S. pombe
tttaggtgcctctcagactacagac

SEQ ID NO: 115309 - DNA, 25 bp, S. pombe
tttatcctatcctcaaacagacgtc

SEQ ID NO: 115310 - DNA, 25 bp, S. pombe
ttgattggtttgttacgacttcgcc

SEQ ID NO: 115311 - DNA, 25 bp, S. pombe
ttttgggttttgtgctcagatcgac

SEQ ID NO: 115312 - DNA, 25 bp, S. pombe
tttattcgtttttatgctcaccgta

SEQ ID NO: 115313 - DNA, 25 bp, S. pombe
ttttgatttgttgtggccctggtaa

SEQ ID NO: 115314 - DNA, 25 bp, S. pombe
tttaccctcttttcccacatggaat

SEQ ID NO: 115315 - DNA, 25 bp, S. pombe
tttagactttctctcggcaagggat

SEQ ID NO: 115316 - DNA, 25 bp, S. pombe
tttaggctttgcatgcccgaaggct

SEQ ID NO: 115317 - DNA, 25 bp, S. pombe
ttttccttccagcaccagaggagtg

SEQ ID NO: 115318 - DNA, 25 bp, S. pombe
tttatcaatccatccttgcttgcga

SEQ ID NO: 115319 - DNA, 25 bp, S. pombe
ttttttgccctcgaatggattgaaa

SEQ ID NO: 115320 - DNA, 25 bp, S. pombe
ttattttacggcatttacgctctcg

SEQ ID NO: 115321 - DNA, 25 bp, S. pombe
ttttttggctgtgtggtggatgtat

SEQ ID NO: 115322 - DNA, 25 bp, S. pombe
tttttcccaggtcgatgtgcagcag

SEQ ID NO: 115323 - DNA, 25 bp, S. pombe
ttttccccaagaagcaagcgattgc

SEQ ID NO: 115324 - DNA, 25 bp, S. pombe
tttacgccagaagagcatcgctttg

SEQ ID NO: 115325 - DNA, 25 bp, S. pombe
tttactctcaaacatgatcgccctg

SEQ ID NO: 115326 - DNA, 25 bp, S. pombe
tttactgacttacttggttggcaac

SEQ ID NO: 115327 - DNA, 25 bp, S. pombe
ttcttcccttgttttacagcggacg

SEQ ID NO: 115328 - DNA, 25 bp, S. pombe
tttttcattgttgttcatcatcgga

SEQ ID NO: 115329 - DNA, 25 bp, S. pombe
ttgttccccttgtggccaatgttta

SEQ ID NO: 115330 - DNA, 25 bp, S. pombe
ttttctggtctttcgttagtcttct

SEQ ID NO: 115331 - DNA, 25 bp, S. pombe
ttttccttggagtcgttagtcttat

SEQ ID NO: 115332 - DNA, 25 bp, S. pombe
ttttccctagagttgtctactgcat

SEQ ID NO: 115333 - DNA, 25 bp, S. pombe
tttttctccaaacccagttgttgag

SEQ ID NO: 115334 - DNA, 25 bp, S. pombe
ttttttaccacactcctttgcacta

SEQ ID NO: 115335 - DNA, 25 bp, S. pombe
ttataatgcctgatccttcatcgct

SEQ ID NO: 115336 - DNA, 25 bp, S. pombe
ttatcaccatctaaagcttcatccc

SEQ ID NO: 115337 - DNA, 25 bp, S. pombe
ttagcctttacattgtccaactcgg

SEQ ID NO: 115338 - DNA, 25 bp, S. pombe
ttaggtattcctgctccaaatgggc

SEQ ID NO: 115339 - DNA, 25 bp, S. pombe
ttatgtttggcctcccaattggtaa

SEQ ID NO: 115340 - DNA, 25 bp, S. pombe
ttatttcttccggtttgttgcttag

SEQ ID NO: 115341 - DNA, 25 bp, S. pombe
ttagccctatacgttcattttttat

SEQ ID NO: 115342 - DNA, 25 bp, S. pombe
ttacgccttacacacagtcttttaa

SEQ ID NO: 115343 - DNA, 25 bp, S. pombe
ttctgtgagttagggacgtcttgca

SEQ ID NO: 115344 - DNA, 25 bp, S. pombe
ttatgcatacgttggatacccgaaa

SEQ ID NO: 115345 - DNA, 25 bp, S. pombe
ttttccatttggactgctaccgaat

SEQ ID NO: 115346 - DNA, 25 bp, S. pombe
tttttggtcaagatctcgcccagat

SEQ ID NO: 115347 - DNA, 25 bp, S. pombe
tttttctcatgccaagtcccaatta

SEQ ID NO: 115348 - DNA, 25 bp, S. pombe
tttttcgcgtgattccaacgatcct

SEQ ID NO: 115349 - DNA, 25 bp, S. pombe
tttatacgcctatccaagtgtttat

SEQ ID NO: 115350 - DNA, 25 bp, S. pombe
ttttgccgttatccccaaagagcat

SEQ ID NO: 115351 - DNA, 25 bp, S. pombe
ttattctttattcgcccaactggac

SEQ ID NO: 115352 - DNA, 25 bp, S. pombe
ttatatttgtacctccgatcactgg

SEQ ID NO: 115353 - DNA, 25 bp, S. pombe
ttatcttctgtatgccgatttcgaa

SEQ ID NO: 115354 - DNA, 25 bp, S. pombe
ttatcatttgctttcggatcctaaa

SEQ ID NO: 115355 - DNA, 25 bp, S. pombe
tttttatgagctagacggccgccaa

SEQ ID NO: 115356 - DNA, 25 bp, S. pombe
ttatttaggctttcaggtcccaatg

SEQ ID NO: 115357 - DNA, 25 bp, S. pombe
ttatgtcaatggcaagtggtcactt

SEQ ID NO: 115358 - DNA, 25 bp, S. pombe
ttattttgactatgggctccttcgc

SEQ ID NO: 115359 - DNA, 25 bp, S. pombe
tttttggattaacccgcattgtgaa

SEQ ID NO: 115360 - DNA, 25 bp, S. pombe
ttcggcagcgtgtcttagctacagc

SEQ ID NO: 115361 - DNA, 25 bp, S. pombe
ttcagccttggatctcagtatgcac

SEQ ID NO: 115362 - DNA, 25 bp, S. pombe
ttttagtgcagatcagggccctgtc

SEQ ID NO: 115363 - DNA, 25 bp, S. pombe
ttatttgcagattttggaccggtca

SEQ ID NO: 115364 - DNA, 25 bp, S. pombe
ttaacgctgaaagtggaccgtattg

SEQ ID NO: 115365 - DNA, 25 bp, S. pombe
ttagcagctgccgaacgtgaccgta

SEQ ID NO: 115366 - DNA, 25 bp, S. pombe
tttatttcacagtattgcctcgaga

SEQ ID NO: 115367 - DNA, 25 bp, S. pombe
tttattctcacatcactcgtcaaag

SEQ ID NO: 115368 - DNA, 25 bp, S. pombe
tttattctgctttttggcctgtcat

SEQ ID NO: 115369 - DNA, 25 bp, S. pombe
ttttcacttgctattctagcgtccg

SEQ ID NO: 115370 - DNA, 25 bp, S. pombe
ttgttccgcctaatactacttttga

SEQ ID NO: 115371 - DNA, 25 bp, S. pombe
tttatctcggatatcatcagacact

SEQ ID NO: 115372 - DNA, 25 bp, S. pombe
ttaagagtgccgctttctaccaagc

SEQ ID NO: 115373 - DNA, 25 bp, S. pombe
ttatcatcctaacgtttcttcccaa

SEQ ID NO: 115374 - DNA, 25 bp, S. pombe
tttatactctgacgttagcttccca

SEQ ID NO: 115375 - DNA, 25 bp, S. pombe
ttttactgatacaactcgatcccgc

SEQ ID NO: 115376 - DNA, 25 bp, S. pombe
tttttgtataactaggccagctgca

SEQ ID NO: 115377 - DNA, 25 bp, S. pombe
ttttttgagacttatggcgcagcgg

SEQ ID NO: 115378 - DNA, 25 bp, S. pombe
ttttctcaaagatatgcccgctgcg

SEQ ID NO: 115379 - DNA, 25 bp, S. pombe
tttttgcaaagctttgaccctcgtt

SEQ ID NO: 115380 - DNA, 25 bp, S. pombe
ttatttgcactacttttcggcctga

SEQ ID NO: 115381 - DNA, 25 bp, S. pombe
ttttgtgctgtcttttaagccctct

SEQ ID NO: 115382 - DNA, 25 bp, S. pombe
ttttgggtactgtcgaagcgcctgc

SEQ ID NO: 115383 - DNA, 25 bp, S. pombe
ttttggtgcatttggtggacgcgcc

SEQ ID NO: 115384 - DNA, 25 bp, S. pombe
ttttgctgatatgtggtctaccgct

SEQ ID NO: 115385 - DNA, 25 bp, S. pombe
ttattattactgaagtcgtccgact

SEQ ID NO: 115386 - DNA, 25 bp, S. pombe
ttattttacttcctcctatcgattc

SEQ ID NO: 115387 - DNA, 25 bp, S. pombe
ttatctaatatcacgacgcttctaa

SEQ ID NO: 115388 - DNA, 25 bp, S. pombe
ttattaatagcagcccgcatcttcg

SEQ ID NO: 115389 - DNA, 25 bp, S. pombe
ttttgactcaacaacgccaattcca

SEQ ID NO: 115390 - DNA, 25 bp, S. pombe
ttaccacctggtcaagcaattgtta

SEQ ID NO: 115391 - DNA, 25 bp, S. pombe
ttaccaccgactttgggatctttat

SEQ ID NO: 115392 - DNA, 25 bp, S. pombe
ttatcccgccatcaacgaagtttac

SEQ ID NO: 115393 - DNA, 25 bp, S. pombe
ttaccggctcatctacttgttttaa

SEQ ID NO: 115394 - DNA, 25 bp, S. pombe
ttatcttggcccgattttgtcttta

SEQ ID NO: 115395 - DNA, 25 bp, S. pombe
tttattcccaaccagctattcagtt

SEQ ID NO: 115396 - DNA, 25 bp, S. pombe
tttattcctcacgttgctcaatggt

SEQ ID NO: 115397 - DNA, 25 bp, S. pombe
ttagctccgcagtcttaattgaacg

SEQ ID NO: 115398 - DNA, 25 bp, S. pombe
ttatcctgcttccaaagttcctgaa

SEQ ID NO: 115399 - DNA, 25 bp, S. pombe
tttatcaaacctccatacccagttg

SEQ ID NO: 115400 - DNA, 25 bp, S. pombe
tttttgatgcttgcacacgtctagc

SEQ ID NO: 115401 - DNA, 25 bp, S. pombe
tttttatcattgcacggtcgttctc

SEQ ID NO: 115402 - DNA, 25 bp, S. pombe
ttttttgaatcctatgcttgcactg

SEQ ID NO: 115403 - DNA, 25 bp, S. pombe
tttattcatcagcaggatgccccgg

SEQ ID NO: 115404 - DNA, 25 bp, S. pombe
tttatcttacaagcgccagtcaggt

SEQ ID NO: 115405 - DNA, 25 bp, S. pombe
ttatcattctaaagccgacgtcgtg

SEQ ID NO: 115406 - DNA, 25 bp, S. pombe
ttatctttcaaacagccgctttgcc

SEQ ID NO: 115407 - DNA, 25 bp, S. pombe
tttttgttaggttcaggaccgcgat

SEQ ID NO: 115408 - DNA, 25 bp, S. pombe
ttttgcagggtatcttgccaacgtt

SEQ ID NO: 115409 - DNA, 25 bp, S. pombe
ttttagttcattacgccaaccgagc

SEQ ID NO: 115410 - DNA, 25 bp, S. pombe
ttcatcctgatgaccatatctgtga

SEQ ID NO: 115411 - DNA, 25 bp, S. pombe
ttatggcctgagcatgatcgcgtta

SEQ ID NO: 115412 - DNA, 25 bp, S. pombe
ttcacctgtgaacggctgcattgga

SEQ ID NO: 115413 - DNA, 25 bp, S. pombe
ttctgctttgaacgttcgcggaaat

SEQ ID NO: 115414 - DNA, 25 bp, S. pombe
ttgtgcgctttaggcattcctggaa

SEQ ID NO: 115415 - DNA, 25 bp, S. pombe
ttatatttgctagcttcctggaccg

SEQ ID NO: 115416 - DNA, 25 bp, S. pombe
ttttgcatttcataactcctctacc

SEQ ID NO: 115417 - DNA, 25 bp, S. pombe
ttttcacttgcaacaatgcccttac

SEQ ID NO: 115418 - DNA, 25 bp, S. pombe
ttttcattatgcaacaccttttgat

SEQ ID NO: 115419 - DNA, 25 bp, S. pombe
ttagccatttacctgctcaatctgt

SEQ ID NO: 115420 - DNA, 25 bp, S. pombe
ttggacttgctatcccaatcgtatc

SEQ ID NO: 115421 - DNA, 25 bp, S. pombe
ttagacgttcttcacaaggttcgcg

SEQ ID NO: 115422 - DNA, 25 bp, S. pombe
ttaacgtaattttccgcgctcttgg

SEQ ID NO: 115423 - DNA, 25 bp, S. pombe
ttatcacgtcaaaatcggaggcttt

SEQ ID NO: 115424 - DNA, 25 bp, S. pombe
tttatcaaaacttgggcatcccgct

SEQ ID NO: 115425 - DNA, 25 bp, S. pombe
ttgttagcggtttacagccacccga

SEQ ID NO: 115426 - DNA, 25 bp, S. pombe
ttttcagaattttcagctccaggct

SEQ ID NO: 115427 - DNA, 25 bp, S. pombe
ttattaaagttccagatgcccgctt

SEQ ID NO: 115428 - DNA, 25 bp, S. pombe
ttattggaattgacgcttctgccac

SEQ ID NO: 115429 - DNA, 25 bp, S. pombe
ttaggaattactggaggccgcccac

SEQ ID NO: 115430 - DNA, 25 bp, S. pombe
ttactgaattactggctgatcgctt

SEQ ID NO: 115431 - DNA, 25 bp, S. pombe
ttttatgggatttggcactcgcgac

SEQ ID NO: 115432 - DNA, 25 bp, S. pombe
ttttgatgccgaatcaggccttgct

SEQ ID NO: 115433 - DNA, 25 bp, S. pombe
ttttgaccgtgttctccttgacgcc

SEQ ID NO: 115434 - DNA, 25 bp, S. pombe
ttttaagttgctctcatccgttgca

SEQ ID NO: 115435 - DNA, 25 bp, S. pombe
ttttcaagtacaccgaccgtctggg

SEQ ID NO: 115436 - DNA, 25 bp, S. pombe
ttatttcctaaagtccccgcgaatg

SEQ ID NO: 115437 - DNA, 25 bp, S. pombe
ttttgccaataaaccctcatacggg

SEQ ID NO: 115438 - DNA, 25 bp, S. pombe
ttttgctacaagtacgccggacacc

SEQ ID NO: 115439 - DNA, 25 bp, S. pombe
ttagacccgatgttaacttccgata

SEQ ID NO: 115440 - DNA, 25 bp, S. pombe
ttaaccttatttccagttccgtcag

SEQ ID NO: 115441 - DNA, 25 bp, S. pombe
ttttacccgcaattggcattcctga

SEQ ID NO: 115442 - DNA, 25 bp, S. pombe
ttttcttcctcattgtcgctcgttt

SEQ ID NO: 115443 - DNA, 25 bp, S. pombe
ttttatacatctttgcagcgccgtg

SEQ ID NO: 115444 - DNA, 25 bp, S. pombe
ttagcagcgttgaacttcccaagtt

SEQ ID NO: 115445 - DNA, 25 bp, S. pombe
ttacatcctagtttgaccgaagctt

SEQ ID NO: 115446 - DNA, 25 bp, S. pombe
ttataaaacggcttgctcgccttgc

SEQ ID NO: 115447 - DNA, 25 bp, S. pombe
ttatacaaacttctgcacctcttgg

SEQ ID NO: 115448 - DNA, 25 bp, S. pombe
ttatggagccagaacgacgggtgct

SEQ ID NO: 115449 - DNA, 25 bp, S. pombe
ttaattaggcaatacgggactctcg

SEQ ID NO: 115450 - DNA, 25 bp, S. pombe
ttagtggttctcttccttttctaga

SEQ ID NO: 115451 - DNA, 25 bp, S. pombe
ttttgttctctttccaagttcatga

SEQ ID NO: 115452 - DNA, 25 bp, S. pombe
ttttgactcaacagcttggtttgca

SEQ ID NO: 115453 - DNA, 25 bp, S. pombe
ttttgagcacgtcttatcccttttt

SEQ ID NO: 115454 - DNA, 25 bp, S. pombe
ttttgcagctagtaacgaccctgat

SEQ ID NO: 115455 - DNA, 25 bp, S. pombe
ttattagcaaactccctcctgaaaa

SEQ ID NO: 115456 - DNA, 25 bp, S. pombe
ttttagaacactacccagcatctgt

SEQ ID NO: 115457 - DNA, 25 bp, S. pombe
ttttctacgatcttacccactattt

SEQ ID NO: 115458 - DNA, 25 bp, S. pombe
ttttctgttcaattacaagcagagt

SEQ ID NO: 115459 - DNA, 25 bp, S. pombe
tttttggtcctttcagagctgctgc

SEQ ID NO: 115460 - DNA, 25 bp, S. pombe
ttttatggtccttacgatgctcagt

SEQ ID NO: 115461 - DNA, 25 bp, S. pombe
ttatctgggatgctacaagtgttgg

SEQ ID NO: 115462 - DNA, 25 bp, S. pombe
ttattagtgctcctcacagtggtgt

SEQ ID NO: 115463 - DNA, 25 bp, S. pombe
ttttcagactccaacgatttctcgt

SEQ ID NO: 115464 - DNA, 25 bp, S. pombe
ttttcggctacaccaattgtcccag

SEQ ID NO: 115465 - DNA, 25 bp, S. pombe
ttattctggtatctacttccctgac

SEQ ID NO: 115466 - DNA, 25 bp, S. pombe
ttattctcgttgctctcgtatacta

SEQ ID NO: 115467 - DNA, 25 bp, S. pombe
ttatcccgctgaggttttccctgca

SEQ ID NO: 115468 - DNA, 25 bp, S. pombe
ttatccccagattgaattaccgtga

SEQ ID NO: 115469 - DNA, 25 bp, S. pombe
ttattcaccagctgtatctcaatcg

SEQ ID NO: 115470 - DNA, 25 bp, S. pombe
ttcatttgccaaactatcgaccgac

SEQ ID NO: 115471 - DNA, 25 bp, S. pombe
ttttcataactacgacaggcgccca

SEQ ID NO: 115472 - DNA, 25 bp, S. pombe
ttttcagcaacttctatgggacctc

SEQ ID NO: 115473 - DNA, 25 bp, S. pombe
ttttcatggactacgcagcagctca

SEQ ID NO: 115474 - DNA, 25 bp, S. pombe
ttttcgcggcaactttcacttgtaa

SEQ ID NO: 115475 - DNA, 25 bp, S. pombe
ttttgcatcccttttatcctcttaa

SEQ ID NO: 115476 - DNA, 25 bp, S. pombe
ttttgaatgcatctttccgcctgga

SEQ ID NO: 115477 - DNA, 25 bp, S. pombe
ttttaacgtacttgcactcttcgac

SEQ ID NO: 115478 - DNA, 25 bp, S. pombe
ttatttacctgaacctccttccaag

SEQ ID NO: 115479 - DNA, 25 bp, S. pombe
ttatttggtttgtcactccctctca

SEQ ID NO: 115480 - DNA, 25 bp, S. pombe
ttatcttactttgtcccgtctaaag

SEQ ID NO: 115481 - DNA, 25 bp, S. pombe
ttttactccttgttgcacgcagaca

SEQ ID NO: 115482 - DNA, 25 bp, S. pombe
ttttgttccatatttaccccatcag

SEQ ID NO: 115483 - DNA, 25 bp, S. pombe
ttatggcttgattcgggagcttcca

SEQ ID NO: 115484 - DNA, 25 bp, S. pombe
ttttactgatcattgcgttgtcggc

SEQ ID NO: 115485 - DNA, 25 bp, S. pombe
ttttatcatgattcccttgtccctt

SEQ ID NO: 115486 - DNA, 25 bp, S. pombe
ttttgaagaagctgctggaccctcc

SEQ ID NO: 115487 - DNA, 25 bp, S. pombe
ttattcaaccaagcgtcgatcctga

SEQ ID NO: 115488 - DNA, 25 bp, S. pombe
ttttgagcggctagtcttggacaca

SEQ ID NO: 115489 - DNA, 25 bp, S. pombe
ttttggctcgatctctgcgtcagta

SEQ ID NO: 115490 - DNA, 25 bp, S. pombe
ttttagctctgtcactcttcatcat

SEQ ID NO: 115491 - DNA, 25 bp, S. pombe
ttattaactgtcgacccggaatctc

SEQ ID NO: 115492 - DNA, 25 bp, S. pombe
ttttatactctcgaaccagcaggat

SEQ ID NO: 115493 - DNA, 25 bp, S. pombe
ttatgtatccctgaatcctggttaa

SEQ ID NO: 115494 - DNA, 25 bp, S. pombe
ttattaccccgaattgagcaatgca

SEQ ID NO: 115495 - DNA, 25 bp, S. pombe
ttatggactcccgtatagatgcaat

SEQ ID NO: 115496 - DNA, 25 bp, S. pombe
ttttactctcagtgcctgcaattga

SEQ ID NO: 115497 - DNA, 25 bp, S. pombe
ttttcacggcgtatgcatagcttat

SEQ ID NO: 115498 - DNA, 25 bp, S. pombe
tttttacgctggaagaactcgataa

SEQ ID NO: 115499 - DNA, 25 bp, S. pombe
ttttgtacctcatgagtcatctccc

SEQ ID NO: 115500 - DNA, 25 bp, S. pombe
ttttgctccgttaagtctcatcccg

SEQ ID NO: 115501 - DNA, 25 bp, S. pombe
ttattcctggtgtcttgttcatcga

SEQ ID NO: 115502 - DNA, 25 bp, S. pombe
ttattccttcggttgttgctcaaga

SEQ ID NO: 115503 - DNA, 25 bp, S. pombe
ttttgccttcgccttgcataacaaa

SEQ ID NO: 115504 - DNA, 25 bp, S. pombe
ttttcgcaatgtccgtcagcagtat

SEQ ID NO: 115505 - DNA, 25 bp, S. pombe
ttatgattactgtcgaccgttgaat

SEQ ID NO: 115506 - DNA, 25 bp, S. pombe
ttattcatcggctaggacccaaatt

SEQ ID NO: 115507 - DNA, 25 bp, S. pombe
ttaccaccgctgtagacacatctaa

SEQ ID NO: 115508 - DNA, 25 bp, S. pombe
ttcgccagggcattcgacagttaaa

SEQ ID NO: 115509 - DNA, 25 bp, S. pombe
ttatgccaagtcttccttcgaaaca

SEQ ID NO: 115510 - DNA, 25 bp, S. pombe
ttttcaggcagatcatgtgtccaaa

SEQ ID NO: 115511 - DNA, 25 bp, S. pombe
ttacctgcgccttagagataccgac

SEQ ID NO: 115512 - DNA, 25 bp, S. pombe
ttagcggccatttagatttagacac

SEQ ID NO: 115513 - DNA, 25 bp, S. pombe
ttagggctcttgcactgttcaataa

SEQ ID NO: 115514 - DNA, 25 bp, S. pombe
ttttgttcatcaactcgtccgtcaa

SEQ ID NO: 115515 - DNA, 25 bp, S. pombe
ttatggttactcgttgccctcaaag

SEQ ID NO: 115516 - DNA, 25 bp, S. pombe
ttttgtctaccactactcagccgaa

SEQ ID NO: 115517 - DNA, 25 bp, S. pombe
ttttgtatacaagttccgggccata

SEQ ID NO: 115518 - DNA, 25 bp, S. pombe
ttttctacccttcgccaatgagtat

SEQ ID NO: 115519 - DNA, 25 bp, S. pombe
ttttcaacgccctcactatgatgat

SEQ ID NO: 115520 - DNA, 25 bp, S. pombe
ttttgatgacatccgcaacgacctt

SEQ ID NO: 115521 - DNA, 25 bp, S. pombe
ttttcgcccgattggagatgctgta

SEQ ID NO: 115522 - DNA, 25 bp, S. pombe
ttttatctcgcgatggaggctctat

SEQ ID NO: 115523 - DNA, 25 bp, S. pombe
ttttagttgtccctgtttgcgataa

SEQ ID NO: 115524 - DNA, 25 bp, S. pombe
ttattcacctgcttcctttgaggta

SEQ ID NO: 115525 - DNA, 25 bp, S. pombe
ttatcaacccatttctggagcgctt

SEQ ID NO: 115526 - DNA, 25 bp, S. pombe
ttcaaacattgtacggaggtccgcc

SEQ ID NO: 115527 - DNA, 25 bp, S. pombe
ttcagtggttagtgctagcttgccc

SEQ ID NO: 115528 - DNA, 25 bp, S. pombe
ttatgtcactggatcgttttctcgt

SEQ ID NO: 115529 - DNA, 25 bp, S. pombe
ttattacgcatttcgttcgcttcgt

SEQ ID NO: 115530 - DNA, 25 bp, S. pombe
ttatttgacttttgtttccgcagcc

SEQ ID NO: 115531 - DNA, 25 bp, S. pombe
ttttatcttttcttttccatcgcgc

SEQ ID NO: 115532 - DNA, 25 bp, S. pombe
ttttgctgctttttgtttactgtgg

SEQ ID NO: 115533 - DNA, 25 bp, S. pombe
ttttcctcaactatttccagaccaa

SEQ ID NO: 115534 - DNA, 25 bp, S. pombe
ttttggccagctcttcatctggaaa

SEQ ID NO: 115535 - DNA, 25 bp, S. pombe
ttttgcgttctgctttcggtaagga

SEQ ID NO: 115536 - DNA, 25 bp, S. pombe
ttttcttgtcttttctgcgtgtgaa

SEQ ID NO: 115537 - DNA, 25 bp, S. pombe
ttttctcctttcttcgctacgatga

SEQ ID NO: 115538 - DNA, 25 bp, S. pombe
ttttatctgggctttgggcactcaa

SEQ ID NO: 115539 - DNA, 25 bp, S. pombe
ttggcgatctagttatacgtccatc

SEQ ID NO: 115540 - DNA, 25 bp, S. pombe
ttctttcttctataggagtctccag

SEQ ID NO: 115541 - DNA, 25 bp, S. pombe
ttcttttttaacagcgtctccacgg

SEQ ID NO: 115542 - DNA, 25 bp, S. pombe
ttttgattttaaccgagccctctag

SEQ ID NO: 115543 - DNA, 25 bp, S. pombe
ttattataaaaaccggcctcctcag

SEQ ID NO: 115544 - DNA, 25 bp, S. pombe
ttatgcttacactttccttgcggaa

SEQ ID NO: 115545 - DNA, 25 bp, S. pombe
ttatgcaacaagtcgctcgtggtga

SEQ ID NO: 115546 - DNA, 25 bp, S. pombe
ttatgcaatgccatcatctgcgttg

SEQ ID NO: 115547 - DNA, 25 bp, S. pombe
ttagcaagcctcttcgcaagtggtc

SEQ ID NO: 115548 - DNA, 25 bp, S. pombe
ttagccgtatgcgtggtagacccgt

SEQ ID NO: 115549 - DNA, 25 bp, S. pombe
ttaacgctcagcatctatagacggg

SEQ ID NO: 115550 - DNA, 25 bp, S. pombe
ttgagggaattgatgacacagcaga

SEQ ID NO: 115551 - DNA, 25 bp, S. pombe
ttatcaggtgatttggacatgccat

SEQ ID NO: 115552 - DNA, 25 bp, S. pombe
ttacaggagttcaatcaggccgggc

SEQ ID NO: 115553 - DNA, 25 bp, S. pombe
ttaaacgacccatagctcttggaaa

SEQ ID NO: 115554 - DNA, 25 bp, S. pombe
ttttgctcagcatctttccgaaggt

SEQ ID NO: 115555 - DNA, 25 bp, S. pombe
ttatctgcacgctctttactgagga

SEQ ID NO: 115556 - DNA, 25 bp, S. pombe
ttctttattactaccgttccttgcg

SEQ ID NO: 115557 - DNA, 25 bp, S. pombe
ttatgtcttggcacttcgtatcgaa

SEQ ID NO: 115558 - DNA, 25 bp, S. pombe
ttatttcttggcctatcctagcgac

SEQ ID NO: 115559 - DNA, 25 bp, S. pombe
ttttgttttgtatcatctgggccca

SEQ ID NO: 115560 - DNA, 25 bp, S. pombe
ttttccaggctaaaggtgcgtctca

SEQ ID NO: 115561 - DNA, 25 bp, S. pombe
ttttccgtgaaggagttcgtccaga

SEQ ID NO: 115562 - DNA, 25 bp, S. pombe
ttttcacgaacagagtcgcgcgtta

SEQ ID NO: 115563 - DNA, 25 bp, S. pombe
ttttcctgacagtatttagcgccaa

SEQ ID NO: 115564 - DNA, 25 bp, S. pombe
ttttaatccgtggttactcagcaga

SEQ ID NO: 115565 - DNA, 25 bp, S. pombe
ttttaatccggaaatgcccacgact

SEQ ID NO: 115566 - DNA, 25 bp, S. pombe
ttttcccctttaactcctaatcatg

SEQ ID NO: 115567 - DNA, 25 bp, S. pombe
ttattcccgctcttaacggtaagct

SEQ ID NO: 115568 - DNA, 25 bp, S. pombe
ttttccttgcccaataccgtgaagt

SEQ ID NO: 115569 - DNA, 25 bp, S. pombe
ttttcccgtccaattccagatggaa

SEQ ID NO: 115570 - DNA, 25 bp, S. pombe
ttccccacctgtattactatttacg

SEQ ID NO: 115571 - DNA, 25 bp, S. pombe
ttacgtcctggaactcagcgtttta

SEQ ID NO: 115572 - DNA, 25 bp, S. pombe
ttatagctcgtgtatggccacatcc

SEQ ID NO: 115573 - DNA, 25 bp, S. pombe
ttaagatgcgagtcgcgcctaccat

SEQ ID NO: 115574 - DNA, 25 bp, S. pombe
ttatcaaggatatgcgcctcccaat

SEQ ID NO: 115575 - DNA, 25 bp, S. pombe
ttatggatcggcaggcactaacgcg

SEQ ID NO: 115576 - DNA, 25 bp, S. pombe
ttttgaattatacctcagccagaga

SEQ ID NO: 115577 - DNA, 25 bp, S. pombe
ttttgctcatttagacattgccgga

SEQ ID NO: 115578 - DNA, 25 bp, S. pombe
ttttggcatctcaagaggctcggga

SEQ ID NO: 115579 - DNA, 25 bp, S. pombe
ttttgttgctttactgacacgctcg

SEQ ID NO: 115580 - DNA, 25 bp, S. pombe
ttgtccattcctcttgtagctcatt

SEQ ID NO: 115581 - DNA, 25 bp, S. pombe
ttttctctgcctttgatgctactat

SEQ ID NO: 115582 - DNA, 25 bp, S. pombe
ttatttatgccgttgctgctggaaa

SEQ ID NO: 115583 - DNA, 25 bp, S. pombe
ttattcatggccgtgttgcgagtaa

SEQ ID NO: 115584 - DNA, 25 bp, S. pombe
ttcaagctgagctggttgagcaata

SEQ ID NO: 115585 - DNA, 25 bp, S. pombe
ttagcttccgcctctcaagataaaa

SEQ ID NO: 115586 - DNA, 25 bp, S. pombe
ttggcttccgtctcgacacaagcta

SEQ ID NO: 115587 - DNA, 25 bp, S. pombe
ttttctctttctccagaacaagctg

SEQ ID NO: 115588 - DNA, 25 bp, S. pombe
ttacttaccgttgcaaccgctgaaa

SEQ ID NO: 115589 - DNA, 25 bp, S. pombe
ttaggtggttgtgcagttctggctc

SEQ ID NO: 115590 - DNA, 25 bp, S. pombe
ttatgggagttatctcgtgctgcct

SEQ ID NO: 115591 - DNA, 25 bp, S. pombe
ttatgggcagagcttttgctgtccc

SEQ ID NO: 115592 - DNA, 25 bp, S. pombe
ttatggtaggcggtctagcttcttg

SEQ ID NO: 115593 - DNA, 25 bp, S. pombe
ttatgcttgggcacatggagcctct

SEQ ID NO: 115594 - DNA, 25 bp, S. pombe
ttatggctcgtcgactcggaaatct

SEQ ID NO: 115595 - DNA, 25 bp, S. pombe
ttgtggtcgagcaatcctggataac

SEQ ID NO: 115596 - DNA, 25 bp, S. pombe
ttggaaaccgacgtgctgatccttc

SEQ ID NO: 115597 - DNA, 25 bp, S. pombe
ttagaaggctcgtttgtgcgccgac

SEQ ID NO: 115598 - DNA, 25 bp, S. pombe
ttaactggatcgatctacccatggt

SEQ ID NO: 115599 - DNA, 25 bp, S. pombe
ttatacatgtaccttgctaccgcat

SEQ ID NO: 115600 - DNA, 25 bp, S. pombe
ttatacctatcactactacctcaaa

SEQ ID NO: 115601 - DNA, 25 bp, S. pombe
ttttgctcctagcattcagcgtcaa

SEQ ID NO: 115602 - DNA, 25 bp, S. pombe
ttattacccgctttcagtttactct

SEQ ID NO: 115603 - DNA, 25 bp, S. pombe
ttttccctcgtaattgctttagcac

SEQ ID NO: 115604 - DNA, 25 bp, S. pombe
ttttctctttcttttgttgttgcaa

SEQ ID NO: 115605 - DNA, 25 bp, S. pombe
ttttcgtgtctttgctgcatttgta

SEQ ID NO: 115606 - DNA, 25 bp, S. pombe
ttattcggtcctttgattgcagcat

SEQ ID NO: 115607 - DNA, 25 bp, S. pombe
ttttgcctgtactttgatctcgatt

SEQ ID NO: 115608 - DNA, 25 bp, S. pombe
ttttgctcgtgatgcttatgccact

SEQ ID NO: 115609 - DNA, 25 bp, S. pombe
ttatgtccgctatctatctgcacaa

SEQ ID NO: 115610 - DNA, 25 bp, S. pombe
ttatatgggctatgcttccgaaggg

SEQ ID NO: 115611 - DNA, 25 bp, S. pombe
ttatagcggtgctgtttccaacggc

SEQ ID NO: 115612 - DNA, 25 bp, S. pombe
ttatcaacagcttctggtcggttcc

SEQ ID NO: 115613 - DNA, 25 bp, S. pombe
ttgaagacgcttgggcctgggacaa

SEQ ID NO: 115614 - DNA, 25 bp, S. pombe
ttttcgttccaaagtcacagcggct

SEQ ID NO: 115615 - DNA, 25 bp, S. pombe
ttacctcagcttattaccgtggtgc

SEQ ID NO: 115616 - DNA, 25 bp, S. pombe
ttttgtacgacgttcatccgttgca

SEQ ID NO: 115617 - DNA, 25 bp, S. pombe
ttttgctacagcttctaccaatggc

SEQ ID NO: 115618 - DNA, 25 bp, S. pombe
ttatgcttcgattgtcgcagccaat

SEQ ID NO: 115619 - DNA, 25 bp, S. pombe
ttttgacataatccaccgagacatc

SEQ ID NO: 115620 - DNA, 25 bp, S. pombe
ttttgagctcaaacctctggcaatc

SEQ ID NO: 115621 - DNA, 25 bp, S. pombe
ttatgccaacgaaagatccaacctt

SEQ ID NO: 115622 - DNA, 25 bp, S. pombe
ttatagaggcgcaacttccaaccgt

SEQ ID NO: 115623 - DNA, 25 bp, S. pombe
ttaggatccgcctattttcttacgc

SEQ ID NO: 115624 - DNA, 25 bp, S. pombe
ttatttcagctagcaggctttcccg

SEQ ID NO: 115625 - DNA, 25 bp, S. pombe
ttcattgcccatgctttaattaccc

SEQ ID NO: 115626 - DNA, 25 bp, S. pombe
ttatcatccttggattcccttgcaa

SEQ ID NO: 115627 - DNA, 25 bp, S. pombe
ttatgatccagaagtgcaggcacct

SEQ ID NO: 115628 - DNA, 25 bp, S. pombe
ttactctacactgcaccttgttaaa

SEQ ID NO: 115629 - DNA, 25 bp, S. pombe
ttatttcgcagtatacacggaggtt

SEQ ID NO: 115630 - DNA, 25 bp, S. pombe
ttagcttcaaggttcgacgggagtt

SEQ ID NO: 115631 - DNA, 25 bp, S. pombe
ttacttctaggttggacagcgtcga

SEQ ID NO: 115632 - DNA, 25 bp, S. pombe
ttatcatttagaaggaggcagcgtc

SEQ ID NO: 115633 - DNA, 25 bp, S. pombe
ttacttgtcccttctctaaacttag

SEQ ID NO: 115634 - DNA, 25 bp, S. pombe
ttattacccaattccgttatccagt

SEQ ID NO: 115635 - DNA, 25 bp, S. pombe
ttattgagtctcgtatccaccgtct

SEQ ID NO: 115636 - DNA, 25 bp, S. pombe
ttatgtggcttttacgcccagacat

SEQ ID NO: 115637 - DNA, 25 bp, S. pombe
ttatgccgcatccaaagctgctgtt

SEQ ID NO: 115638 - DNA, 25 bp, S. pombe
ttattgctgacttagactctgatgt

SEQ ID NO: 115639 - DNA, 25 bp, S. pombe
ttatcctcagtgttcagcttgcagt

SEQ ID NO: 115640 - DNA, 25 bp, S. pombe
ttatcccaggaggtgagtctactac

SEQ ID NO: 115641 - DNA, 25 bp, S. pombe
ttacctttgataagtggctctgaaa

SEQ ID NO: 115642 - DNA, 25 bp, S. pombe
ttatcaccctgcagcagactgtgga

SEQ ID NO: 115643 - DNA, 25 bp, S. pombe
ttatatccctgcaaagctctactat

SEQ ID NO: 115644 - DNA, 25 bp, S. pombe
ttattcgattgttactcatacttga

SEQ ID NO: 115645 - DNA, 25 bp, S. pombe
ttatccatattgctaccagtgccgc

SEQ ID NO: 115646 - DNA, 25 bp, S. pombe
ttatcctggccgtaaaagctcttat

SEQ ID NO: 115647 - DNA, 25 bp, S. pombe
ttatccggttttagatcctcgtttg

SEQ ID NO: 115648 - DNA, 25 bp, S. pombe
ttacctggttgaaaagccctgattt

SEQ ID NO: 115649 - DNA, 25 bp, S. pombe
ttcaactgcgttgacaagcggcgag

SEQ ID NO: 115650 - DNA, 25 bp, S. pombe
ttacctggccactcaaggaggtgca

SEQ ID NO: 115651 - DNA, 25 bp, S. pombe
ttccgccgcaaccaaaagtttgcca

SEQ ID NO: 115652 - DNA, 25 bp, S. pombe
ttctactgagaataacgagcccgtc

SEQ ID NO: 115653 - DNA, 25 bp, S. pombe
ttattcagaagttggcccctcttac

SEQ ID NO: 115654 - DNA, 25 bp, S. pombe
ttattcaacttgttcttcctcacta

SEQ ID NO: 115655 - DNA, 25 bp, S. pombe
ttatgtccgaaaagttgctcccaac

SEQ ID NO: 115656 - DNA, 25 bp, S. pombe
ttatagctctgaaaaggtgcccatc

SEQ ID NO: 115657 - DNA, 25 bp, S. pombe
ttagcatgtttgagaggcccacttc

SEQ ID NO: 115658 - DNA, 25 bp, S. pombe
ttactgctacatttgccgtgctcta

SEQ ID NO: 115659 - DNA, 25 bp, S. pombe
ttattgcaatgtcttctggctctga

SEQ ID NO: 115660 - DNA, 25 bp, S. pombe
ttattgatcctcttagcagtcgctg

SEQ ID NO: 115661 - DNA, 25 bp, S. pombe
ttagctgaacgcaatgacattcctg

SEQ ID NO: 115662 - DNA, 25 bp, S. pombe
ttacagagcccatacttccttttga

SEQ ID NO: 115663 - DNA, 25 bp, S. pombe
ttatccccttcttcaattctatttt

SEQ ID NO: 115664 - DNA, 25 bp, S. pombe
ttattgactcttttggattctccac

SEQ ID NO: 115665 - DNA, 25 bp, S. pombe
ttatactgcgtatctggcgtcttct

SEQ ID NO: 115666 - DNA, 25 bp, S. pombe
ttatcgcgtgaaattgcacctccgg

SEQ ID NO: 115667 - DNA, 25 bp, S. pombe
ttttgacatactaagcccggcaggt

SEQ ID NO: 115668 - DNA, 25 bp, S. pombe
ttgcctaaagtgaacccggagcggt

SEQ ID NO: 115669 - DNA, 25 bp, S. pombe
ttactaaatgatgagcccggcagca

SEQ ID NO: 115670 - DNA, 25 bp, S. pombe
ttagatgaaattgacgcggcgctcg

SEQ ID NO: 115671 - DNA, 25 bp, S. pombe
ttattggcttgcaaaacgcgtcgtt

SEQ ID NO: 115672 - DNA, 25 bp, S. pombe
ttaatgtctcctttacgcgtcgtaa

SEQ ID NO: 115673 - DNA, 25 bp, S. pombe
ttattactttgcttctgcggacttg

SEQ ID NO: 115674 - DNA, 25 bp, S. pombe
ttatgtttcaagaatctgccgactt

SEQ ID NO: 115675 - DNA, 25 bp, S. pombe
ttatttgttgcatggctctctgatc

SEQ ID NO: 115676 - DNA, 25 bp, S. pombe
ttatcatatgtttcctgtctcgaga

SEQ ID NO: 115677 - DNA, 25 bp, S. pombe
ttatcatcgatttcattcacctgtg

SEQ ID NO: 115678 - DNA, 25 bp, S. pombe
ttatatcaatcttctgctactcctc

SEQ ID NO: 115679 - DNA, 25 bp, S. pombe
ttatactatctattcacaccccaat

SEQ ID NO: 115680 - DNA, 25 bp, S. pombe
ttattccttcgttacacccgtgata

SEQ ID NO: 115681 - DNA, 25 bp, S. pombe
ttatacagctatcttgactcccgag

SEQ ID NO: 115682 - DNA, 25 bp, S. pombe
ttatcaggcttgcatcgaatcccga

SEQ ID NO: 115683 - DNA, 25 bp, S. pombe
ttacagctggctcaactaatggttc

SEQ ID NO: 115684 - DNA, 25 bp, S. pombe
ttaagcggccgatcagaacgtcctg

SEQ ID NO: 115685 - DNA, 25 bp, S. pombe
ttaagcaagccgttccagtttcatc

SEQ ID NO: 115686 - DNA, 25 bp, S. pombe
ttatggcgttgacattcttgtttca

SEQ ID NO: 115687 - DNA, 25 bp, S. pombe
ttaggtggtacttttctcacttctc

SEQ ID NO: 115688 - DNA, 25 bp, S. pombe
ttactcttttctttgggcttatctc

SEQ ID NO: 115689 - DNA, 25 bp, S. pombe
ttatccttatgttgcttgggttgaa

SEQ ID NO: 115690 - DNA, 25 bp, S. pombe
ttatgacttctaacttgggcgctga

SEQ ID NO: 115691 - DNA, 25 bp, S. pombe
ttacggaatctcattacccaacctt

SEQ ID NO: 115692 - DNA, 25 bp, S. pombe
ttacgagacattgttcccgaacctg

SEQ ID NO: 115693 - DNA, 25 bp, S. pombe
ttattccaaagtccacatccaattc

SEQ ID NO: 115694 - DNA, 25 bp, S. pombe
ttagatggcctacaagctgctccga

SEQ ID NO: 115695 - DNA, 25 bp, S. pombe
ttaaagcctagcaacgttgtcgtca

SEQ ID NO: 115696 - DNA, 25 bp, S. pombe
ttatgtacgagtttgggctccttct

SEQ ID NO: 115697 - DNA, 25 bp, S. pombe
ttttgtgcgagtttccagatctttc

SEQ ID NO: 115698 - DNA, 25 bp, S. pombe
ttatctcaacttcaactagctccac

SEQ ID NO: 115699 - DNA, 25 bp, S. pombe
ttatgctatacttgaaacctccctc

SEQ ID NO: 115700 - DNA, 25 bp, S. pombe
ttattgcatgagtttcttttcccct

SEQ ID NO: 115701 - DNA, 25 bp, S. pombe
ttacctcatgttgttttaagctgca

SEQ ID NO: 115702 - DNA, 25 bp, S. pombe
ttaccacggtttctctggagccaag

SEQ ID NO: 115703 - DNA, 25 bp, S. pombe
ttaccgatcgaatgccctagttgtt

SEQ ID NO: 115704 - DNA, 25 bp, S. pombe
ttattccctgaattccctaatgtgt

SEQ ID NO: 115705 - DNA, 25 bp, S. pombe
ttattctccgaattctgcgtatgcg

SEQ ID NO: 115706 - DNA, 25 bp, S. pombe
ttaattccttgttgctggtagctga

SEQ ID NO: 115707 - DNA, 25 bp, S. pombe
ttatcctcgttttgcggaagctcat

SEQ ID NO: 115708 - DNA, 25 bp, S. pombe
ttatatcttttgtgatcggagccac

SEQ ID NO: 115709 - DNA, 25 bp, S. pombe
ttattagtttgtcgcttgtggccac

SEQ ID NO: 115710 - DNA, 25 bp, S. pombe
ttattttgttatcggtgggctctgc

SEQ ID NO: 115711 - DNA, 25 bp, S. pombe
ttatgttgtgtaatcgggcggctgc

SEQ ID NO: 115712 - DNA, 25 bp, S. pombe
ttttgtgtgccaagcttggcgccaa

SEQ ID NO: 115713 - DNA, 25 bp, S. pombe
ttttggtacgctctctatctatatc

SEQ ID NO: 115714 - DNA, 25 bp, S. pombe
ttttggtactggtgctcgtcttaac

SEQ ID NO: 115715 - DNA, 25 bp, S. pombe
ttttggctgcttaatttcattttat

SEQ ID NO: 115716 - DNA, 25 bp, S. pombe
ttattactaatacccatctttccct

SEQ ID NO: 115717 - DNA, 25 bp, S. pombe
ttattaatcttcatccagctcttcc

SEQ ID NO: 115718 - DNA, 25 bp, S. pombe
ttattagtttcacccacgccaatta

SEQ ID NO: 115719 - DNA, 25 bp, S. pombe
ttattttgcccaattgcatgccgca

SEQ ID NO: 115720 - DNA, 25 bp, S. pombe
ttatggtctgacttactgcattcat

SEQ ID NO: 115721 - DNA, 25 bp, S. pombe
ttatgcgtgctaaacaacgtgcagc

SEQ ID NO: 115722 - DNA, 25 bp, S. pombe
ttatgcgctcttgcagaagcctatg

SEQ ID NO: 115723 - DNA, 25 bp, S. pombe
ttaatgttgaccttgcttcttgggc

SEQ ID NO: 115724 - DNA, 25 bp, S. pombe
ttattgtttcacctttttcgctcca

SEQ ID NO: 115725 - DNA, 25 bp, S. pombe
ttattgtttaccgttcttctcatcc

SEQ ID NO: 115726 - DNA, 25 bp, S. pombe
ttattttacactcatgctctttccc

SEQ ID NO: 115727 - DNA, 25 bp, S. pombe
ttatgtccgcccaaactgtttatca

SEQ ID NO: 115728 - DNA, 25 bp, S. pombe
ttattctcccacaagtccttcttat

SEQ ID NO: 115729 - DNA, 25 bp, S. pombe
ttatttgcaccccaacgtcacttat

SEQ ID NO: 115730 - DNA, 25 bp, S. pombe
ttatttcaactgtaacgatcgtctg

SEQ ID NO: 115731 - DNA, 25 bp, S. pombe
ttatcttttgatgctcctactgttc

SEQ ID NO: 115732 - DNA, 25 bp, S. pombe
ttatcttcgagatccctatcagtac

SEQ ID NO: 115733 - DNA, 25 bp, S. pombe
ttaatatgcaaggttcgtcgcgtaa

SEQ ID NO: 115734 - DNA, 25 bp, S. pombe
ttgtcgctattgctggtgtaactga

SEQ ID NO: 115735 - DNA, 25 bp, S. pombe
ttatccgattgcttgcgtgctaaca

SEQ ID NO: 115736 - DNA, 25 bp, S. pombe
ttatcattattgctccatgctagga

SEQ ID NO: 115737 - DNA, 25 bp, S. pombe
ttagttccactttgtctgaggcatg

SEQ ID NO: 115738 - DNA, 25 bp, S. pombe
ttattgctgctcttgtttctatggt

SEQ ID NO: 115739 - DNA, 25 bp, S. pombe
ttatgctgctcttatatcgttaggc

SEQ ID NO: 115740 - DNA, 25 bp, S. pombe
ttatggcctatagtctttcggaagc

SEQ ID NO: 115741 - DNA, 25 bp, S. pombe
ttatcagaatccagtcttctaccgc

SEQ ID NO: 115742 - DNA, 25 bp, S. pombe
ttatccacaatcctgtctgttcaag

SEQ ID NO: 115743 - DNA, 25 bp, S. pombe
ttatactcggctttcctccaaagta

SEQ ID NO: 115744 - DNA, 25 bp, S. pombe
ttacttcaagctctcttacatccat

SEQ ID NO: 115745 - DNA, 25 bp, S. pombe
ttacctcgcgtggtcttacaggatt

SEQ ID NO: 115746 - DNA, 25 bp, S. pombe
ttacgcccctgtcattgaaagtcta

SEQ ID NO: 115747 - DNA, 25 bp, S. pombe
ttatgggcgttgtcgttagcacaca

SEQ ID NO: 115748 - DNA, 25 bp, S. pombe
ttaggcctaatgacttctgtcctca

SEQ ID NO: 115749 - DNA, 25 bp, S. pombe
ttatggccattcactttgactccag

SEQ ID NO: 115750 - DNA, 25 bp, S. pombe
ttccccgttcagtgaattccatcta

SEQ ID NO: 115751 - DNA, 25 bp, S. pombe
ttacccgtctaattcaactacctat

SEQ ID NO: 115752 - DNA, 25 bp, S. pombe
ttattcctcatttttacagtcttgg

SEQ ID NO: 115753 - DNA, 25 bp, S. pombe
ttatttgttgttttagctgctgcga

SEQ ID NO: 115754 - DNA, 25 bp, S. pombe
ttacggagcataaacttgtcaccag

SEQ ID NO: 115755 - DNA, 25 bp, S. pombe
ttattcaagcatcaggcacggacct

SEQ ID NO: 115756 - DNA, 25 bp, S. pombe
ttaccacttgccgtatctgtgagtt

SEQ ID NO: 115757 - DNA, 25 bp, S. pombe
ttatccgagccgttttgaagcccga

SEQ ID NO: 115758 - DNA, 25 bp, S. pombe
ttaccccttcttttatcacaacgat

SEQ ID NO: 115759 - DNA, 25 bp, S. pombe
ttaccaagcttcacctcgacaagga

SEQ ID NO: 115760 - DNA, 25 bp, S. pombe
ttacgaacttcctacttgtcaattg

SEQ ID NO: 115761 - DNA, 25 bp, S. pombe
ttatgtgtccaagttcggtgcttca

SEQ ID NO: 115762 - DNA, 25 bp, S. pombe
ttattgttactgatcctcgtgctga

SEQ ID NO: 115763 - DNA, 25 bp, S. pombe
ttacgtgtgcctttacccagtgaga

SEQ ID NO: 115764 - DNA, 25 bp, S. pombe
ttagcgttgacatttacccacctat

SEQ ID NO: 115765 - DNA, 25 bp, S. pombe
ttcagagccgaataccccaactaag

SEQ ID NO: 115766 - DNA, 25 bp, S. pombe
ttcaaggtgtagtcgacccagcggt

SEQ ID NO: 115767 - DNA, 25 bp, S. pombe
ttactggcgctatcgaatcatcgtt

SEQ ID NO: 115768 - DNA, 25 bp, S. pombe
ttagaattattggtcactgcggaat

SEQ ID NO: 115769 - DNA, 25 bp, S. pombe
ttatggcatgtggtcgtcctcaggc

SEQ ID NO: 115770 - DNA, 25 bp, S. pombe
ttattttgtcttacttcgtggtgag

SEQ ID NO: 115771 - DNA, 25 bp, S. pombe
ttacgaactcgcacttggaaagact

SEQ ID NO: 115772 - DNA, 25 bp, S. pombe
ttacgaacccatcttggttgctggt

SEQ ID NO: 115773 - DNA, 25 bp, S. pombe
ttagcaaagaacatgcgtcgttggg

SEQ ID NO: 115774 - DNA, 25 bp, S. pombe
ttagttcgaactttgcttgggcagc

SEQ ID NO: 115775 - DNA, 25 bp, S. pombe
ttacaaagctagtgtttgggcgatt

SEQ ID NO: 115776 - DNA, 25 bp, S. pombe
ttaccacctcgtttattactagctc

SEQ ID NO: 115777 - DNA, 25 bp, S. pombe
ttattactttctttactcccttcat

SEQ ID NO: 115778 - DNA, 25 bp, S. pombe
ttatttcctttttcactcccttcat

SEQ ID NO: 115779 - DNA, 25 bp, S. pombe
ttagatttcttcagccctcctttat

SEQ ID NO: 115780 - DNA, 25 bp, S. pombe
ttacaaacctttggatcacccacag

SEQ ID NO: 115781 - DNA, 25 bp, S. pombe
ttaaaacctgttgatcccaacgctc

SEQ ID NO: 115782 - DNA, 25 bp, S. pombe
ttaaaacggcttccacttctagcgg

SEQ ID NO: 115783 - DNA, 25 bp, S. pombe
ttaggctttccttattcgtgtccaa

SEQ ID NO: 115784 - DNA, 25 bp, S. pombe
ttattccttttatttgcctgtcgca

SEQ ID NO: 115785 - DNA, 25 bp, S. pombe
ttatactctcgtttttccgtccata

SEQ ID NO: 115786 - DNA, 25 bp, S. pombe
ttatttattgctgttgttcctcctc

SEQ ID NO: 115787 - DNA, 25 bp, S. pombe
ttatgctttatcagttttcccgctt

SEQ ID NO: 115788 - DNA, 25 bp, S. pombe
ttagctgttatcacttcttccttag

SEQ ID NO: 115789 - DNA, 25 bp, S. pombe
ttcggttccttcttttgtagccaca

SEQ ID NO: 115790 - DNA, 25 bp, S. pombe
ttaggaaacttattttgtgggccag

SEQ ID NO: 115791 - DNA, 25 bp, S. pombe
ttatcgaaatacacttttccccaag

SEQ ID NO: 115792 - DNA, 25 bp, S. pombe
ttagtaaacactgcttcttctccga

SEQ ID NO: 115793 - DNA, 25 bp, S. pombe
ttagtatcagccgatgcgttttctc

SEQ ID NO: 115794 - DNA, 25 bp, S. pombe
ttatgaattgcgctcgtacttgtcc

SEQ ID NO: 115795 - DNA, 25 bp, S. pombe
ttatcacctgatcgcactatggctg

SEQ ID NO: 115796 - DNA, 25 bp, S. pombe
ttcatcgagctcttgactattgcaa

SEQ ID NO: 115797 - DNA, 25 bp, S. pombe
ttgcaggtgaaatcccagaactttg

SEQ ID NO: 115798 - DNA, 25 bp, S. pombe
ttatcaattactcctcaagtcaccg

SEQ ID NO: 115799 - DNA, 25 bp, S. pombe
ttagaattacttccaagaccccttg

SEQ ID NO: 115800 - DNA, 25 bp, S. pombe
ttacgaaagagttacccagcgcgct

SEQ ID NO: 115801 - DNA, 25 bp, S. pombe
ttacgaaatggaacgtccaggtgct

SEQ ID NO: 115802 - DNA, 25 bp, S. pombe
ttaccgcatggaccagctcctaaaa

SEQ ID NO: 115803 - DNA, 25 bp, S. pombe
ttacccaggcatcgaccaggttgtt

SEQ ID NO: 115804 - DNA, 25 bp, S. pombe
ttatgcgtctttgatggctcttggt

SEQ ID NO: 115805 - DNA, 25 bp, S. pombe
ttaccgctcttattggctttcttga

SEQ ID NO: 115806 - DNA, 25 bp, S. pombe
ttcccctcgacaaagtttcgctaga

SEQ ID NO: 115807 - DNA, 25 bp, S. pombe
ttctccctctaaagtttcggctaca

SEQ ID NO: 115808 - DNA, 25 bp, S. pombe
ttcaccctcaccatttcaaggtaag

SEQ ID NO: 115809 - DNA, 25 bp, S. pombe
ttaccacccggctggccagaagaga

SEQ ID NO: 115810 - DNA, 25 bp, S. pombe
ttacgttcctggtggtttgcaataa

SEQ ID NO: 115811 - DNA, 25 bp, S. pombe
ttaccagttcgtcatttttccattg

SEQ ID NO: 115812 - DNA, 25 bp, S. pombe
ttacaactcccgctacgtatgagat

SEQ ID NO: 115813 - DNA, 25 bp, S. pombe
ttaatgagcccgcttactttggttc

SEQ ID NO: 115814 - DNA, 25 bp, S. pombe
ttactggtgcctacgacaaggtcgc

SEQ ID NO: 115815 - DNA, 25 bp, S. pombe
ttacgggctcctgggatgggactat

SEQ ID NO: 115816 - DNA, 25 bp, S. pombe
ttacatcccaccagacctagtagat

SEQ ID NO: 115817 - DNA, 25 bp, S. pombe
ttaccttcaggagagcaacgagttc

SEQ ID NO: 115818 - DNA, 25 bp, S. pombe
ttggcttccaactgataacttcctg

SEQ ID NO: 115819 - DNA, 25 bp, S. pombe
ttggtggagcattgcgaataatttc

SEQ ID NO: 115820 - DNA, 25 bp, S. pombe
ttgagagcgcaagccacaaatttgg

SEQ ID NO: 115821 - DNA, 25 bp, S. pombe
ttcaacgcaatccttcagcatattc

SEQ ID NO: 115822 - DNA, 25 bp, S. pombe
ttagcacttgccttgtctactgaca

SEQ ID NO: 115823 - DNA, 25 bp, S. pombe
ttacatcgtgaattggcttctgccc

SEQ ID NO: 115824 - DNA, 25 bp, S. pombe
ttacctatgactttcttgagcccga

SEQ ID NO: 115825 - DNA, 25 bp, S. pombe
ttacctgagcctattcttcctaaat

SEQ ID NO: 115826 - DNA, 25 bp, S. pombe
ttacctggcacatctttgcttcaaa

SEQ ID NO: 115827 - DNA, 25 bp, S. pombe
ttatgcactcctttccgaatcaaaa

SEQ ID NO: 115828 - DNA, 25 bp, S. pombe
ttaccacctgtttctgttaagccaa

SEQ ID NO: 115829 - DNA, 25 bp, S. pombe
ttgactcccttagaacaaacgcctt

SEQ ID NO: 115830 - DNA, 25 bp, S. pombe
ttagtgacaatcctcgcgccagaga

SEQ ID NO: 115831 - DNA, 25 bp, S. pombe
ttatggccactaaccgtatcgacat

SEQ ID NO: 115832 - DNA, 25 bp, S. pombe
ttatggtggtaaccctcttggtgca

SEQ ID NO: 115833 - DNA, 25 bp, S. pombe
ttagctctgggtttcgcaagtgcat

SEQ ID NO: 115834 - DNA, 25 bp, S. pombe
ttagacggtattgcacgtggtcaat

SEQ ID NO: 115835 - DNA, 25 bp, S. pombe
ttcagagggcaaccacggaacttat

SEQ ID NO: 115836 - DNA, 25 bp, S. pombe
ttatggacggtttggcgatcacttc

SEQ ID NO: 115837 - DNA, 25 bp, S. pombe
ttacgactagttgctggacatcctc

SEQ ID NO: 115838 - DNA, 25 bp, S. pombe
ttatctttattagctggtctcctga

SEQ ID NO: 115839 - DNA, 25 bp, S. pombe
ttatcattttcttcctgcagacacc

SEQ ID NO: 115840 - DNA, 25 bp, S. pombe
ttatgcaatttcgtatccccattca

SEQ ID NO: 115841 - DNA, 25 bp, S. pombe
ttatggattcttgtacgcctgtacc

SEQ ID NO: 115842 - DNA, 25 bp, S. pombe
ttagtatcgactttgcagcatcctg

SEQ ID NO: 115843 - DNA, 25 bp, S. pombe
ttagtatatctttctgctgattcag

SEQ ID NO: 115844 - DNA, 25 bp, S. pombe
ttagtagatcttccagggcatccca

SEQ ID NO: 115845 - DNA, 25 bp, S. pombe
ttagtactttccatggcattgccat

SEQ ID NO: 115846 - DNA, 25 bp, S. pombe
ttagaagtttagtttcctccctcat

SEQ ID NO: 115847 - DNA, 25 bp, S. pombe
ttaggagcttatccgtatccacctg

SEQ ID NO: 115848 - DNA, 25 bp, S. pombe
ttatgctccagacgtccaacaaatg

SEQ ID NO: 115849 - DNA, 25 bp, S. pombe
ttatccgaagctcttaccatatggg

SEQ ID NO: 115850 - DNA, 25 bp, S. pombe
ttatgtcgcggtattcccaattgga

SEQ ID NO: 115851 - DNA, 25 bp, S. pombe
ttataacacttgatgcctcttcctc

SEQ ID NO: 115852 - DNA, 25 bp, S. pombe
ttatctaatcccatcgaccagcaaa

SEQ ID NO: 115853 - DNA, 25 bp, S. pombe
ttatgcttatgcgtttcctcccaaa

SEQ ID NO: 115854 - DNA, 25 bp, S. pombe
ttacagtagcgccaaattcccgtcg

SEQ ID NO: 115855 - DNA, 25 bp, S. pombe
ttacttcacccatgatttgcacttg

SEQ ID NO: 115856 - DNA, 25 bp, S. pombe
ttactgtagcatccattcaggcatg

SEQ ID NO: 115857 - DNA, 25 bp, S. pombe
ttaatggcacatcctcatcaacttg

SEQ ID NO: 115858 - DNA, 25 bp, S. pombe
ttaggtctacacaagctccaaaata

SEQ ID NO: 115859 - DNA, 25 bp, S. pombe
ttacgccgacaacgagcacttagga

SEQ ID NO: 115860 - DNA, 25 bp, S. pombe
ttacggcaaccagagcattccagga

SEQ ID NO: 115861 - DNA, 25 bp, S. pombe
ttagataaaccacgtcttgcctcat

SEQ ID NO: 115862 - DNA, 25 bp, S. pombe
ttataatcaagctccactcgacctg

SEQ ID NO: 115863 - DNA, 25 bp, S. pombe
ttcgaactcgtaaaacctatcctgg

SEQ ID NO: 115864 - DNA, 25 bp, S. pombe
ttaaaaataccacaatccccatcat

SEQ ID NO: 115865 - DNA, 25 bp, S. pombe
ttaaagttcctacattcccaagcga

SEQ ID NO: 115866 - DNA, 25 bp, S. pombe
ttatgtataccctcgtcttcacaaa

SEQ ID NO: 115867 - DNA, 25 bp, S. pombe
ttatgaaattcacacgctgcgtaga

SEQ ID NO: 115868 - DNA, 25 bp, S. pombe
ttagatgtatcagttgctcccgcat

SEQ ID NO: 115869 - DNA, 25 bp, S. pombe
ttatccttgttggtcttgtgcagaa

SEQ ID NO: 115870 - DNA, 25 bp, S. pombe
ttcacgttggtgtcattcatggaga

SEQ ID NO: 115871 - DNA, 25 bp, S. pombe
ttatctctggcagttgtatcttcag

SEQ ID NO: 115872 - DNA, 25 bp, S. pombe
ttatcactggagatgaccctcgatt

SEQ ID NO: 115873 - DNA, 25 bp, S. pombe
ttaggaggtgcacctgccttgtcag

SEQ ID NO: 115874 - DNA, 25 bp, S. pombe
ttatggacgagaaccctgcttaccg

SEQ ID NO: 115875 - DNA, 25 bp, S. pombe
ttatggatcaatggagcctcgtttc

SEQ ID NO: 115876 - DNA, 25 bp, S. pombe
ttatggatttgatgccgccagcttc

SEQ ID NO: 115877 - DNA, 25 bp, S. pombe
ttagttgcttatagccgccacaatc

SEQ ID NO: 115878 - DNA, 25 bp, S. pombe
ttatggccattaatgcccaaatgca

SEQ ID NO: 115879 - DNA, 25 bp, S. pombe
ttatgagctctctgcagcctcaaaa

SEQ ID NO: 115880 - DNA, 25 bp, S. pombe
ttatcatggcattttctctcaggaa

SEQ ID NO: 115881 - DNA, 25 bp, S. pombe
ttacactacatcaagcttcccgaag

SEQ ID NO: 115882 - DNA, 25 bp, S. pombe
ttatcccaatggtaagcactagctt

SEQ ID NO: 115883 - DNA, 25 bp, S. pombe
ttaacttgtgattgcgtacgacctg

SEQ ID NO: 115884 - DNA, 25 bp, S. pombe
ttacggagtatctgcaacccctgaa

SEQ ID NO: 115885 - DNA, 25 bp, S. pombe
ttagcctgttttttccaaccttcag

SEQ ID NO: 115886 - DNA, 25 bp, S. pombe
ttgggcgttttcttggaacgtggct

SEQ ID NO: 115887 - DNA, 25 bp, S. pombe
ttagagcagaagtctcttcccaaat

SEQ ID NO: 115888 - DNA, 25 bp, S. pombe
ttatgccgaagaccgtcccagacat

SEQ ID NO: 115889 - DNA, 25 bp, S. pombe
ttagcccatggacttttacagacac

SEQ ID NO: 115890 - DNA, 25 bp, S. pombe
ttgaagcctggtcgcaagtactgca

SEQ ID NO: 115891 - DNA, 25 bp, S. pombe
ttagcgattggtggatactactcaa

SEQ ID NO: 115892 - DNA, 25 bp, S. pombe
ttagctgcttggacgatcgcaactg

SEQ ID NO: 115893 - DNA, 25 bp, S. pombe
ttaagtctgctgctaagtggagtat

SEQ ID NO: 115894 - DNA, 25 bp, S. pombe
ttatctgctcctgtaattctagttt

SEQ ID NO: 115895 - DNA, 25 bp, S. pombe
ttactctcccttaattccagatgtg

SEQ ID NO: 115896 - DNA, 25 bp, S. pombe
ttacctccttatatatgcatccttc

SEQ ID NO: 115897 - DNA, 25 bp, S. pombe
ttacttgcgtagtgtgcttttgcct

SEQ ID NO: 115898 - DNA, 25 bp, S. pombe
ttacgtggtatggagctgcgttcat

SEQ ID NO: 115899 - DNA, 25 bp, S. pombe
ttagctctggtatatcatcctgata

SEQ ID NO: 115900 - DNA, 25 bp, S. pombe
ttatctagcattctcactcctgtat

SEQ ID NO: 115901 - DNA, 25 bp, S. pombe
ttactaataccaaagcattcccctc

SEQ ID NO: 115902 - DNA, 25 bp, S. pombe
ttacgatatacctagagcacttcct

SEQ ID NO: 115903 - DNA, 25 bp, S. pombe
ttatctgacaatgcgagcgatcttt

SEQ ID NO: 115904 - DNA, 25 bp, S. pombe
ttagcatggctaacgctggacccga

SEQ ID NO: 115905 - DNA, 25 bp, S. pombe
ttatggtttcattcttcactccttt

SEQ ID NO: 115906 - DNA, 25 bp, S. pombe
ttatggtgttgtatctccttcttca

SEQ ID NO: 115907 - DNA, 25 bp, S. pombe
ttaagctaatctttcacggccagtc

SEQ ID NO: 115908 - DNA, 25 bp, S. pombe
ttatgaatcattacctgctccgcaa

SEQ ID NO: 115909 - DNA, 25 bp, S. pombe
ttatgcccatattactcagtctgcg

SEQ ID NO: 115910 - DNA, 25 bp, S. pombe
ttacctcatctgtaaagaccggttt

SEQ ID NO: 115911 - DNA, 25 bp, S. pombe
ttaccatcaaactcaagcgacgctt

SEQ ID NO: 115912 - DNA, 25 bp, S. pombe
ttactaacaattacaggccgcgaat

SEQ ID NO: 115913 - DNA, 25 bp, S. pombe
ttatcgacacagatcgcggcgggaa

SEQ ID NO: 115914 - DNA, 25 bp, S. pombe
ttacagaggcgtgctcgtgggcata

SEQ ID NO: 115915 - DNA, 25 bp, S. pombe
ttgaaggccaaggtcttcggtatct

SEQ ID NO: 115916 - DNA, 25 bp, S. pombe
ttatgaggccgtgcttgggttatct

SEQ ID NO: 115917 - DNA, 25 bp, S. pombe
ttaggcgatcgtgttgtttatgttc

SEQ ID NO: 115918 - DNA, 25 bp, S. pombe
ttaggtactgtgcatttcctttctc

SEQ ID NO: 115919 - DNA, 25 bp, S. pombe
ttatgtcaacttctttcaccttcga

SEQ ID NO: 115920 - DNA, 25 bp, S. pombe
ttaaaacaaatgctccctggtcctt

SEQ ID NO: 115921 - DNA, 25 bp, S. pombe
ttaaagacacattggtcgccggcct

SEQ ID NO: 115922 - DNA, 25 bp, S. pombe
ttagacaatcacttcgtgctgccga

SEQ ID NO: 115923 - DNA, 25 bp, S. pombe
ttaaagcctcatttgaccactatcc

SEQ ID NO: 115924 - DNA, 25 bp, S. pombe
ttacacgatctataattgacccttt

SEQ ID NO: 115925 - DNA, 25 bp, S. pombe
ttagccgactatgaaatacacgatg

SEQ ID NO: 115926 - DNA, 25 bp, S. pombe
ttaagcctgctagtgtaccgaagac

SEQ ID NO: 115927 - DNA, 25 bp, S. pombe
ttaccgcgtagacattcgaaatcct

SEQ ID NO: 115928 - DNA, 25 bp, S. pombe
ttcttccctattccaaccaggtaat

SEQ ID NO: 115929 - DNA, 25 bp, S. pombe
ttcttcccgccgaaacaatggtaat

SEQ ID NO: 115930 - DNA, 25 bp, S. pombe
ttccttcctccgagaacaggtgtta

SEQ ID NO: 115931 - DNA, 25 bp, S. pombe
ttaggtcgtctcttaggacacgttt

SEQ ID NO: 115932 - DNA, 25 bp, S. pombe
ttaggtggtaatataggctatcgaa

SEQ ID NO: 115933 - DNA, 25 bp, S. pombe
ttacgcctgctcaaaagactgctgc

SEQ ID NO: 115934 - DNA, 25 bp, S. pombe
ttatccagctgaagacctgtctgct

SEQ ID NO: 115935 - DNA, 25 bp, S. pombe
ttacgatgatgatatgcgctttgat

SEQ ID NO: 115936 - DNA, 25 bp, S. pombe
ttacgatatgtctcgttgctccgat

SEQ ID NO: 115937 - DNA, 25 bp, S. pombe
ttaccattgatgtttgttctccctg

SEQ ID NO: 115938 - DNA, 25 bp, S. pombe
ttaatcgttgtcctatttgcgggtc

SEQ ID NO: 115939 - DNA, 25 bp, S. pombe
ttaactatggtaggccttggcgatt

SEQ ID NO: 115940 - DNA, 25 bp, S. pombe
ttagaaagttcatccctgcagctgc

SEQ ID NO: 115941 - DNA, 25 bp, S. pombe
ttatgaattgtctcaccctagctgg

SEQ ID NO: 115942 - DNA, 25 bp, S. pombe
ttagatgtttctacacaccgccatg

SEQ ID NO: 115943 - DNA, 25 bp, S. pombe
ttatgatttgtcttccactgtctct

SEQ ID NO: 115944 - DNA, 25 bp, S. pombe
ttatggtggcatgctccatttcttt

SEQ ID NO: 115945 - DNA, 25 bp, S. pombe
ttatgagcggctggcaaattccttc

SEQ ID NO: 115946 - DNA, 25 bp, S. pombe
ttagctgcagctactctagttcgct

SEQ ID NO: 115947 - DNA, 25 bp, S. pombe
ttacggcggttactgattttcttca

SEQ ID NO: 115948 - DNA, 25 bp, S. pombe
ttagcggtggtatttactcttctac

SEQ ID NO: 115949 - DNA, 25 bp, S. pombe
ttatgggtggtgtttccatcttcgc

SEQ ID NO: 115950 - DNA, 25 bp, S. pombe
ttaagaaggctgtttccgtccgcaa

SEQ ID NO: 115951 - DNA, 25 bp, S. pombe
ttaaaagtgctgtcttccgtgaaga

SEQ ID NO: 115952 - DNA, 25 bp, S. pombe
ttaaaatcgctgtacccgtgaaaca

SEQ ID NO: 115953 - DNA, 25 bp, S. pombe
ttaaagtccgtacccagaacacagc

SEQ ID NO: 115954 - DNA, 25 bp, S. pombe
ttcaagaatacttccaacgtcccat

SEQ ID NO: 115955 - DNA, 25 bp, S. pombe
ttaagcaattcctcaactatcctac

SEQ ID NO: 115956 - DNA, 25 bp, S. pombe
ttacacaagtcctcgaagtctgctc

SEQ ID NO: 115957 - DNA, 25 bp, S. pombe
ttacctagtcctgctgctgatttga

SEQ ID NO: 115958 - DNA, 25 bp, S. pombe
ttacgtgaaaccgatgctgatattg

SEQ ID NO: 115959 - DNA, 25 bp, S. pombe
ttacgggatcaccagattgtcatat

SEQ ID NO: 115960 - DNA, 25 bp, S. pombe
ttagcagccgactatagaggtgatt

SEQ ID NO: 115961 - DNA, 25 bp, S. pombe
ttacagcttgcccatagaggcgatg

SEQ ID NO: 115962 - DNA, 25 bp, S. pombe
ttatgaggccagacagtacgcgagc

SEQ ID NO: 115963 - DNA, 25 bp, S. pombe
ttaggtactttcaatccggctgcac

SEQ ID NO: 115964 - DNA, 25 bp, S. pombe
ttacctatagatccggatttgccag

SEQ ID NO: 115965 - DNA, 25 bp, S. pombe
ttaccttacgctatcatttccagtg

SEQ ID NO: 115966 - DNA, 25 bp, S. pombe
ttaaaaccgccaatcccactgaata

SEQ ID NO: 115967 - DNA, 25 bp, S. pombe
ttagaagacagtgctgccgccagta

SEQ ID NO: 115968 - DNA, 25 bp, S. pombe
ttcaaaaagaatcccgacctgtcga

SEQ ID NO: 115969 - DNA, 25 bp, S. pombe
ttaaccaaagactctactcctctat

SEQ ID NO: 115970 - DNA, 25 bp, S. pombe
ttacacctaacattgctaacgccat

SEQ ID NO: 115971 - DNA, 25 bp, S. pombe
ttacacgctcttctgctctaaagaa

SEQ ID NO: 115972 - DNA, 25 bp, S. pombe
ttcctcgtcgtcctggagacaaaac

SEQ ID NO: 115973 - DNA, 25 bp, S. pombe
ttagctgtcgcccttggacaagcaa

SEQ ID NO: 115974 - DNA, 25 bp, S. pombe
ttagacactgtgcttgctgtgctac

SEQ ID NO: 115975 - DNA, 25 bp, S. pombe
ttatgagcgtgtcgttgctgcccaa

SEQ ID NO: 115976 - DNA, 25 bp, S. pombe
ttacagttggttactgctcagcaga

SEQ ID NO: 115977 - DNA, 25 bp, S. pombe
ttacagttacagaagcagctcgcaa

SEQ ID NO: 115978 - DNA, 25 bp, S. pombe
ttaatttgagtcgtgcccaagcaga

SEQ ID NO: 115979 - DNA, 25 bp, S. pombe
ttccctgcccgacatcaaaaattta

SEQ ID NO: 115980 - DNA, 25 bp, S. pombe
ttaaacgctcaggtgtcgattcgca

SEQ ID NO: 115981 - DNA, 25 bp, S. pombe
ttacatgaagttccgtcacaggcct

SEQ ID NO: 115982 - DNA, 25 bp, S. pombe
ttacatgtggtctcctaaagctcta

SEQ ID NO: 115983 - DNA, 25 bp, S. pombe
ttagctgctgttgagcttaaactaa

SEQ ID NO: 115984 - DNA, 25 bp, S. pombe
ttagtcttctctggctttatttcac

SEQ ID NO: 115985 - DNA, 25 bp, S. pombe
ttactcttctcacgcttttcattat

SEQ ID NO: 115986 - DNA, 25 bp, S. pombe
ttacctatttgcgtcgtatcatcga

SEQ ID NO: 115987 - DNA, 25 bp, S. pombe
ttacgcccttgttacagtcttcaag

SEQ ID NO: 115988 - DNA, 25 bp, S. pombe
ttagaagacctaacactgcgccagc

SEQ ID NO: 115989 - DNA, 25 bp, S. pombe
ttactaagctcatttactgccacgc

SEQ ID NO: 115990 - DNA, 25 bp, S. pombe
ttaccaactgctatgccttcagatg

SEQ ID NO: 115991 - DNA, 25 bp, S. pombe
ttaccaagagatgttcggcctcgtc

SEQ ID NO: 115992 - DNA, 25 bp, S. pombe
ttagccaggaggattcgtggtgctt

SEQ ID NO: 115993 - DNA, 25 bp, S. pombe
ttagacacgggacttcgtacctatc

SEQ ID NO: 115994 - DNA, 25 bp, S. pombe
ttacaggccctatgcgttcactaaa

SEQ ID NO: 115995 - DNA, 25 bp, S. pombe
ttactggaatttagcctctcctaat

SEQ ID NO: 115996 - DNA, 25 bp, S. pombe
ttacgacaatcttcctcttctagaa

SEQ ID NO: 115997 - DNA, 25 bp, S. pombe
ttaggatcacctacctctctagtgt

SEQ ID NO: 115998 - DNA, 25 bp, S. pombe
ttagtgatgacccttatcgcgatct

SEQ ID NO: 115999 - DNA, 25 bp, S. pombe
ttaggcgtttgaatgctggttgctt

SEQ ID NO: 116000 - DNA, 25 bp, S. pombe
ttagaagtttgcttccgcacttgtt

SEQ ID NO: 116001 - DNA, 25 bp, S. pombe
ttgctcaaagcgtgggtcccggtat

SEQ ID NO: 116002 - DNA, 25 bp, S. pombe
ttaacaaccctgatcgggcagtgga

SEQ ID NO: 116003 - DNA, 25 bp, S. pombe
ttaacaatattcctcccaaggctcg

SEQ ID NO: 116004 - DNA, 25 bp, S. pombe
ttcaagctttcttctcctttgggag

SEQ ID NO: 116005 - DNA, 25 bp, S. pombe
ttacgttcctgctgatttggtgcga

SEQ ID NO: 116006 - DNA, 25 bp, S. pombe
ttaagggccttatcactgctgacac

SEQ ID NO: 116007 - DNA, 25 bp, S. pombe
ttaataggcgttcactcgtacatgc

SEQ ID NO: 116008 - DNA, 25 bp, S. pombe
ttaaagtcgccaactctcgtaagct

SEQ ID NO: 116009 - DNA, 25 bp, S. pombe
ttacgcgtcaaattagtcgagcccg

SEQ ID NO: 116010 - DNA, 25 bp, S. pombe
ttaaggactctttggctggaacgaa

SEQ ID NO: 116011 - DNA, 25 bp, S. pombe
ttaaatctttttcctgagcagccga

SEQ ID NO: 116012 - DNA, 25 bp, S. pombe
ttaaaatttatgcttcccctgaacg

SEQ ID NO: 116013 - DNA, 25 bp, S. pombe
ttctgaaaccatttattcccttccg

SEQ ID NO: 116014 - DNA, 25 bp, S. pombe
ttaccagttctttctacgaatccca

SEQ ID NO: 116015 - DNA, 25 bp, S. pombe
ttacgtgagtgcaactttccatcaa

SEQ ID NO: 116016 - DNA, 25 bp, S. pombe
ttcatccgggcttcgatctaagcaa

SEQ ID NO: 116017 - DNA, 25 bp, S. pombe
ttagacaacccgttatttcacctct

SEQ ID NO: 116018 - DNA, 25 bp, S. pombe
ttagaaatgcccttttttgccctct

SEQ ID NO: 116019 - DNA, 25 bp, S. pombe
ttacagtcgtcctttacagtcacaa

SEQ ID NO: 116020 - DNA, 25 bp, S. pombe
ttcgcgtggttcgtgtatctggtac

SEQ ID NO: 116021 - DNA, 25 bp, S. pombe
ttacgtgcgaggctgtttggctaca

SEQ ID NO: 116022 - DNA, 25 bp, S. pombe
ttacggatctctacgcagtcgtgat

SEQ ID NO: 116023 - DNA, 25 bp, S. pombe
ttacgatactcgtgctaagcttgat

SEQ ID NO: 116024 - DNA, 25 bp, S. pombe
ttagagctacctacgctaagcgctg

SEQ ID NO: 116025 - DNA, 25 bp, S. pombe
ttgagagcatgatccccaagggcgc

SEQ ID NO: 116026 - DNA, 25 bp, S. pombe
ttcggatgacaaaaccctcttggca

SEQ ID NO: 116027 - DNA, 25 bp, S. pombe
ttagaagaaagctaccccattgccc

SEQ ID NO: 116028 - DNA, 25 bp, S. pombe
ttagtgcctgccgtgaaatctggct

SEQ ID NO: 116029 - DNA, 25 bp, S. pombe
ttactcctgatcctgaaactccttt

SEQ ID NO: 116030 - DNA, 25 bp, S. pombe
ttagctactatcattgcgaccatta

SEQ ID NO: 116031 - DNA, 25 bp, S. pombe
ttactcgccataatcggaagcttaa

SEQ ID NO: 116032 - DNA, 25 bp, S. pombe
ttaccaccctacaatcagaatcctg

SEQ ID NO: 116033 - DNA, 25 bp, S. pombe
ttacccaccatcgtatgcaaactgt

SEQ ID NO: 116034 - DNA, 25 bp, S. pombe
ttaccttccaaatcacagtcttcga

SEQ ID NO: 116035 - DNA, 25 bp, S. pombe
ttaccgtccctttcaatgttcgatt

SEQ ID NO: 116036 - DNA, 25 bp, S. pombe
ttgccggtggttctggttctaaatt

SEQ ID NO: 116037 - DNA, 25 bp, S. pombe
ttaccggaatgtgtgcttttaccca

SEQ ID NO: 116038 - DNA, 25 bp, S. pombe
ttaccaggcaactctttttacacaa

SEQ ID NO: 116039 - DNA, 25 bp, S. pombe
ttaccctgatcctgctttaatcgat

SEQ ID NO: 116040 - DNA, 25 bp, S. pombe
ttagctctcttcctttgcctagaaa

SEQ ID NO: 116041 - DNA, 25 bp, S. pombe
ttacttcttcttctcgtgaaacacc

SEQ ID NO: 116042 - DNA, 25 bp, S. pombe
ttagcttttgcttgttccttaacgc

SEQ ID NO: 116043 - DNA, 25 bp, S. pombe
ttacattttcttctccttctacgga

SEQ ID NO: 116044 - DNA, 25 bp, S. pombe
ttacaaatccacatttcctcgttgg

SEQ ID NO: 116045 - DNA, 25 bp, S. pombe
ttactaatcggttgtctctttgctt

SEQ ID NO: 116046 - DNA, 25 bp, S. pombe
ttagccactcctgttcctttgatgt

SEQ ID NO: 116047 - DNA, 25 bp, S. pombe
ttagcactcatcgttttgcctgttc

SEQ ID NO: 116048 - DNA, 25 bp, S. pombe
ttacctctttttgtcatgttctcag

SEQ ID NO: 116049 - DNA, 25 bp, S. pombe
ttacccttggacttttttcagcagt

SEQ ID NO: 116050 - DNA, 25 bp, S. pombe
ttactttcctcctcaagtgcaagca

SEQ ID NO: 116051 - DNA, 25 bp, S. pombe
ttaccgctgcctcatggaagtacaa

SEQ ID NO: 116052 - DNA, 25 bp, S. pombe
ttaccgctctttcacaagaatggat

SEQ ID NO: 116053 - DNA, 25 bp, S. pombe
ttaccgcattttcccgtgagcaaga

SEQ ID NO: 116054 - DNA, 25 bp, S. pombe
ttaccaacttttcacgacagcgctt

SEQ ID NO: 116055 - DNA, 25 bp, S. pombe
ttgaccctttttctaggatcgtctt

SEQ ID NO: 116056 - DNA, 25 bp, S. pombe
ttactccttggatatttggtcgttt

SEQ ID NO: 116057 - DNA, 25 bp, S. pombe
ttgttcagcctcaacagcttaattg

SEQ ID NO: 116058 - DNA, 25 bp, S. pombe
ttcttcacctgcttcacgtaagtat

SEQ ID NO: 116059 - DNA, 25 bp, S. pombe
ttctcatcccattacatcagtcaag

SEQ ID NO: 116060 - DNA, 25 bp, S. pombe
ttaccttcgcttcctgtttgataat

SEQ ID NO: 116061 - DNA, 25 bp, S. pombe
ttagcacccggaactgtttgcattt

SEQ ID NO: 116062 - DNA, 25 bp, S. pombe
ttagatcccaaatcagctcgtgcta

SEQ ID NO: 116063 - DNA, 25 bp, S. pombe
ttaccgcactaaacgccttcatgaa

SEQ ID NO: 116064 - DNA, 25 bp, S. pombe
ttactggcacttcgtccaattctaa

SEQ ID NO: 116065 - DNA, 25 bp, S. pombe
ttaaatcctgtgatcgcaattcgac

SEQ ID NO: 116066 - DNA, 25 bp, S. pombe
ttacgacttgctttcgtcagacgag

SEQ ID NO: 116067 - DNA, 25 bp, S. pombe
ttacgactcactttcgattccggac

SEQ ID NO: 116068 - DNA, 25 bp, S. pombe
ttaagagccctggtaaagcccgtgg

SEQ ID NO: 116069 - DNA, 25 bp, S. pombe
ttaatgaccgtagcagaaccctgtt

SEQ ID NO: 116070 - DNA, 25 bp, S. pombe
ttaatacgattgacgcgaagccgcg

SEQ ID NO: 116071 - DNA, 25 bp, S. pombe
ttaagcacagccaaccgtatgagcc

SEQ ID NO: 116072 - DNA, 25 bp, S. pombe
ttagcagccattaaggcccttttcg

SEQ ID NO: 116073 - DNA, 25 bp, S. pombe
ttaccagcattaattcgccatcttc

SEQ ID NO: 116074 - DNA, 25 bp, S. pombe
ttagctagaaggatcgcctctacct

SEQ ID NO: 116075 - DNA, 25 bp, S. pombe
ttcgctataataccttcctaatcct

SEQ ID NO: 116076 - DNA, 25 bp, S. pombe
ttaccagcggatcctctaaaaactc

SEQ ID NO: 116077 - DNA, 25 bp, S. pombe
ttagaccatgaagccgtgaccattg

SEQ ID NO: 116078 - DNA, 25 bp, S. pombe
ttaaacgtggtccttggcatttggg

SEQ ID NO: 116079 - DNA, 25 bp, S. pombe
ttaaacctttccttacaagctgagg

SEQ ID NO: 116080 - DNA, 25 bp, S. pombe
ttaaaccttacttgtgccaaccatg

SEQ ID NO: 116081 - DNA, 25 bp, S. pombe
ttaatatttcgtatgcagcccaccg

SEQ ID NO: 116082 - DNA, 25 bp, S. pombe
ttacgattcttgtttacctgcacca

SEQ ID NO: 116083 - DNA, 25 bp, S. pombe
ttaaaatcgtcaccgttcgtgcatc

SEQ ID NO: 116084 - DNA, 25 bp, S. pombe
ttacaatcctactcgtgctcgtatt

SEQ ID NO: 116085 - DNA, 25 bp, S. pombe
ttagctactggtgctttgtctgtat

SEQ ID NO: 116086 - DNA, 25 bp, S. pombe
ttagcgacgcgtttatgactccatt

SEQ ID NO: 116087 - DNA, 25 bp, S. pombe
ttacgatctcgttgatagacatcac

SEQ ID NO: 116088 - DNA, 25 bp, S. pombe
ttaagttggtttttctcggtgagca

SEQ ID NO: 116089 - DNA, 25 bp, S. pombe
ttaattgggttttcgcttggtgcac

SEQ ID NO: 116090 - DNA, 25 bp, S. pombe
ttcagaagccctaccgcgattaaaa

SEQ ID NO: 116091 - DNA, 25 bp, S. pombe
ttaagtgggttgctcctgacaaggc

SEQ ID NO: 116092 - DNA, 25 bp, S. pombe
ttaaaggctctaactcatcccaaag

SEQ ID NO: 116093 - DNA, 25 bp, S. pombe
ttaccggccttaatgctaccaattt

SEQ ID NO: 116094 - DNA, 25 bp, S. pombe
ttagcaaatgcccataatccccaat

SEQ ID NO: 116095 - DNA, 25 bp, S. pombe
ttagcaaaagctacatgtcctcctc

SEQ ID NO: 116096 - DNA, 25 bp, S. pombe
ttaccggttgtcacacatgctcaag

SEQ ID NO: 116097 - DNA, 25 bp, S. pombe
ttacattttcatcccatacattcca

SEQ ID NO: 116098 - DNA, 25 bp, S. pombe
ttgtctactaaataccagcttggag

SEQ ID NO: 116099 - DNA, 25 bp, S. pombe
ttacttccaaaccaacagctagcaa

SEQ ID NO: 116100 - DNA, 25 bp, S. pombe
ttaagtcctccaaagcagcgtgtag

SEQ ID NO: 116101 - DNA, 25 bp, S. pombe
ttcaaagagtccaaaacacctgtct

SEQ ID NO: 116102 - DNA, 25 bp, S. pombe
ttaagcgtcctcaaaagcaccgtta

SEQ ID NO: 116103 - DNA, 25 bp, S. pombe
ttaagtccaccatacgatcgatgtt

SEQ ID NO: 116104 - DNA, 25 bp, S. pombe
ttacgcaacccattagttcgttatg

SEQ ID NO: 116105 - DNA, 25 bp, S. pombe
ttaagcaatccacctcctagtcaaa

SEQ ID NO: 116106 - DNA, 25 bp, S. pombe
ttgcaaatgatccaccgactttact

SEQ ID NO: 116107 - DNA, 25 bp, S. pombe
ttcacatgattccaactacgcctat

SEQ ID NO: 116108 - DNA, 25 bp, S. pombe
ttagctgatgcttgtcgtagagact

SEQ ID NO: 116109 - DNA, 25 bp, S. pombe
ttagctagtcagtcattcatcgcct

SEQ ID NO: 116110 - DNA, 25 bp, S. pombe
ttactagtcatggtcttgcgctcaa

SEQ ID NO: 116111 - DNA, 25 bp, S. pombe
ttacttctgacagtcttcctacaca

SEQ ID NO: 116112 - DNA, 25 bp, S. pombe
ttcaattgggctgctgatacacctc

SEQ ID NO: 116113 - DNA, 25 bp, S. pombe
ttcatttggactttaattccagctt

SEQ ID NO: 116114 - DNA, 25 bp, S. pombe
ttactaggcataactccgagctttt

SEQ ID NO: 116115 - DNA, 25 bp, S. pombe
ttactccaaagacccattattatta

SEQ ID NO: 116116 - DNA, 25 bp, S. pombe
ttcccaatttagctctttaccaact

SEQ ID NO: 116117 - DNA, 25 bp, S. pombe
ttccccttgttgcactcattaatat

SEQ ID NO: 116118 - DNA, 25 bp, S. pombe
ttagcagcatcctctccattatata

SEQ ID NO: 116119 - DNA, 25 bp, S. pombe
ttagctcagaatcctcctttgaagc

SEQ ID NO: 116120 - DNA, 25 bp, S. pombe
ttaagtgatcagaacccggacgtcc

SEQ ID NO: 116121 - DNA, 25 bp, S. pombe
ttaagatgctcgagcttcctgatgc

SEQ ID NO: 116122 - DNA, 25 bp, S. pombe
ttcttgcaagtcgatgatgctaaca

SEQ ID NO: 116123 - DNA, 25 bp, S. pombe
ttctcctagtgtcgcatctacaaaa

SEQ ID NO: 116124 - DNA, 25 bp, S. pombe
ttaacgttgctgtcgctaaggctct

SEQ ID NO: 116125 - DNA, 25 bp, S. pombe
ttcaaccgttagtgccttggctaat

SEQ ID NO: 116126 - DNA, 25 bp, S. pombe
ttcgaccttaatcctttgggcttat

SEQ ID NO: 116127 - DNA, 25 bp, S. pombe
ttacactcttttcccgggtattatg

SEQ ID NO: 116128 - DNA, 25 bp, S. pombe
ttaccgctattttgttgggctttat

SEQ ID NO: 116129 - DNA, 25 bp, S. pombe
ttcaccggtttcgttggagtcgtat

SEQ ID NO: 116130 - DNA, 25 bp, S. pombe
ttaacaggatcactcggtcgaacgt

SEQ ID NO: 116131 - DNA, 25 bp, S. pombe
ttcaacagagaacccgctagctatc

SEQ ID NO: 116132 - DNA, 25 bp, S. pombe
ttcagagtctaatggaccctggctc

SEQ ID NO: 116133 - DNA, 25 bp, S. pombe
ttactcttgaaaatgtgcccacctc

SEQ ID NO: 116134 - DNA, 25 bp, S. pombe
ttacgcttgatttatggtcctcctc

SEQ ID NO: 116135 - DNA, 25 bp, S. pombe
ttacgtgctcaacttcaaacttggt

SEQ ID NO: 116136 - DNA, 25 bp, S. pombe
ttacgactcaagctccacggatggt

SEQ ID NO: 116137 - DNA, 25 bp, S. pombe
ttacgacgcagccaatcgacagttt

SEQ ID NO: 116138 - DNA, 25 bp, S. pombe
ttacttctcaatcaacctatctttc

SEQ ID NO: 116139 - DNA, 25 bp, S. pombe
ttacttccttttcccaattctattg

SEQ ID NO: 116140 - DNA, 25 bp, S. pombe
ttacctagggtttgctcctgcttta

SEQ ID NO: 116141 - DNA, 25 bp, S. pombe
ttccttcctttcattcttactttat

SEQ ID NO: 116142 - DNA, 25 bp, S. pombe
ttccaaatcgccagcttttacttta

SEQ ID NO: 116143 - DNA, 25 bp, S. pombe
ttacttcatctaccacttcttttta

SEQ ID NO: 116144 - DNA, 25 bp, S. pombe
ttactagcagtacctcgattccttt

SEQ ID NO: 116145 - DNA, 25 bp, S. pombe
ttacaagtcttcattttccgcacat

SEQ ID NO: 116146 - DNA, 25 bp, S. pombe
ttaaattgctctacttaccacgcac

SEQ ID NO: 116147 - DNA, 25 bp, S. pombe
ttaaatctggattgcctactcctgc

SEQ ID NO: 116148 - DNA, 25 bp, S. pombe
ttaaatcggttgctactgtctctgc

SEQ ID NO: 116149 - DNA, 25 bp, S. pombe
ttaaatactcttcgcacacttcgta

SEQ ID NO: 116150 - DNA, 25 bp, S. pombe
ttacaacgttataaccaccagctgg

SEQ ID NO: 116151 - DNA, 25 bp, S. pombe
ttgtgactattgtgaacctattcgg

SEQ ID NO: 116152 - DNA, 25 bp, S. pombe
ttgtgactacgaacacccgaacggt

SEQ ID NO: 116153 - DNA, 25 bp, S. pombe
ttgtcccctgtaaacagttttggca

SEQ ID NO: 116154 - DNA, 25 bp, S. pombe
ttgtccctcgtatgcaatttttggc

SEQ ID NO: 116155 - DNA, 25 bp, S. pombe
ttgtcttcgagtaccaacttgttag

SEQ ID NO: 116156 - DNA, 25 bp, S. pombe
ttccaagatactttcaagcgggttt

SEQ ID NO: 116157 - DNA, 25 bp, S. pombe
ttaagggcttggacttgctgggact

SEQ ID NO: 116158 - DNA, 25 bp, S. pombe
ttaagcgtcttcgtcgtgagtgtcc

SEQ ID NO: 116159 - DNA, 25 bp, S. pombe
ttaaacggtcttttcactctgatga

SEQ ID NO: 116160 - DNA, 25 bp, S. pombe
ttaaacctccaatttctgccgatgc

SEQ ID NO: 116161 - DNA, 25 bp, S. pombe
ttaaggcattacaataccagcggat

SEQ ID NO: 116162 - DNA, 25 bp, S. pombe
ttcaaccttcatgggattccttggg

SEQ ID NO: 116163 - DNA, 25 bp, S. pombe
ttactcctcgtggtaatcctttgga

SEQ ID NO: 116164 - DNA, 25 bp, S. pombe
ttacaagcatttggcgttctggtgt

SEQ ID NO: 116165 - DNA, 25 bp, S. pombe
ttaacacaattcctttcggtctcgg

SEQ ID NO: 116166 - DNA, 25 bp, S. pombe
ttaaataaatgccttccacctacca

SEQ ID NO: 116167 - DNA, 25 bp, S. pombe
ttactcccggaatctatgcgactcg

SEQ ID NO: 116168 - DNA, 25 bp, S. pombe
ttacgcaccttgttattcagcagag

SEQ ID NO: 116169 - DNA, 25 bp, S. pombe
ttaacacctctgcatttcgcaaagg

SEQ ID NO: 116170 - DNA, 25 bp, S. pombe
ttacacattgtactagcactctcag

SEQ ID NO: 116171 - DNA, 25 bp, S. pombe
ttacctggctaatgcatcctacaca

SEQ ID NO: 116172 - DNA, 25 bp, S. pombe
ttaccatgcctaattgctccagaaa

SEQ ID NO: 116173 - DNA, 25 bp, S. pombe
ttaacatgccaagctcatccaaagt

SEQ ID NO: 116174 - DNA, 25 bp, S. pombe
ttaacccaccgatctcatgagtctt

SEQ ID NO: 116175 - DNA, 25 bp, S. pombe
ttaaagtcaccgttccagaggattt

SEQ ID NO: 116176 - DNA, 25 bp, S. pombe
ttaagatacatttttggcgacagat

SEQ ID NO: 116177 - DNA, 25 bp, S. pombe
ttaagatacatttttggcgacagat

SEQ ID NO: 116178 - DNA, 25 bp, S. pombe
ttaccattttattccagcgatcgtg

SEQ ID NO: 116179 - DNA, 25 bp, S. pombe
ttcaaatttctctacgacgtcgtgg

SEQ ID NO: 116180 - DNA, 25 bp, S. pombe
ttacgtgttttttgtctcgctgaac

SEQ ID NO: 116181 - DNA, 25 bp, S. pombe
ttacatctgttgttcaagtgcatcg

SEQ ID NO: 116182 - DNA, 25 bp, S. pombe
ttaaccatgctgttcgcgagttgcc

SEQ ID NO: 116183 - DNA, 25 bp, S. pombe
ttacaaattggatccctctacgctt

SEQ ID NO: 116184 - DNA, 25 bp, S. pombe
ttaaacaaggtagctgctgctcccg

SEQ ID NO: 116185 - DNA, 25 bp, S. pombe
ttaatattgcagatacctccgtccg

SEQ ID NO: 116186 - DNA, 25 bp, S. pombe
ttgcaatttagctgatcacccgcag

SEQ ID NO: 116187 - DNA, 25 bp, S. pombe
ttcaatctggacagcattcttccgt

SEQ ID NO: 116188 - DNA, 25 bp, S. pombe
ttacactgagtcatctttagccact

SEQ ID NO: 116189 - DNA, 25 bp, S. pombe
ttctggcgactttgagaccctacaa

SEQ ID NO: 116190 - DNA, 25 bp, S. pombe
ttcggcgaatactatgcaactccta

SEQ ID NO: 116191 - DNA, 25 bp, S. pombe
ttcacggtgccttatccagattatt

SEQ ID NO: 116192 - DNA, 25 bp, S. pombe
ttaactgagcacgttcctcaatcac

SEQ ID NO: 116193 - DNA, 25 bp, S. pombe
ttaagtgacaattctcgacgagctc

SEQ ID NO: 116194 - DNA, 25 bp, S. pombe
ttaaataactcactcagtccagccg

SEQ ID NO: 116195 - DNA, 25 bp, S. pombe
ttaaaggcccgcgatctcaatttcc

SEQ ID NO: 116196 - DNA, 25 bp, S. pombe
ttacgttcccggtattattcacgct

SEQ ID NO: 116197 - DNA, 25 bp, S. pombe
ttacgccccaaattctggcctcaaa

SEQ ID NO: 116198 - DNA, 25 bp, S. pombe
ttacccgccatatttcgcaagctaa

SEQ ID NO: 116199 - DNA, 25 bp, S. pombe
ttacgcatgcacctttatcttattc

SEQ ID NO: 116200 - DNA, 25 bp, S. pombe
ttacctatcttattgtctcttccac

SEQ ID NO: 116201 - DNA, 25 bp, S. pombe
ttacagtccttgagttgtgctcgca

SEQ ID NO: 116202 - DNA, 25 bp, S. pombe
ttactccaccgttatttcatccaaa

SEQ ID NO: 116203 - DNA, 25 bp, S. pombe
ttaccgatccggaatttgctgaaaa

SEQ ID NO: 116204 - DNA, 25 bp, S. pombe
ttccctgaccttgtttgcgttcaaa

SEQ ID NO: 116205 - DNA, 25 bp, S. pombe
ttcaacgtccttgccctttataagt

SEQ ID NO: 116206 - DNA, 25 bp, S. pombe
ttaagggcgattgctcctgttaaga

SEQ ID NO: 116207 - DNA, 25 bp, S. pombe
ttacacccatattctgttcccgaaa

SEQ ID NO: 116208 - DNA, 25 bp, S. pombe
ttacctccagattcgattctaagaa

SEQ ID NO: 116209 - DNA, 25 bp, S. pombe
ttactctccttctgctggtatagat

SEQ ID NO: 116210 - DNA, 25 bp, S. pombe
ttacattacgcttttgcttgccatg

SEQ ID NO: 116211 - DNA, 25 bp, S. pombe
ttactttcactatacatactcctcc

SEQ ID NO: 116212 - DNA, 25 bp, S. pombe
ttaccgtcctaaagatgttcctcct

SEQ ID NO: 116213 - DNA, 25 bp, S. pombe
ttaccgcggctctataatgttttcg

SEQ ID NO: 116214 - DNA, 25 bp, S. pombe
ttaacgacctttcgcatgcttttca

SEQ ID NO: 116215 - DNA, 25 bp, S. pombe
ttacactaccattatcgccgttttg

SEQ ID NO: 116216 - DNA, 25 bp, S. pombe
ttaagcttacttacggcgcattttc

SEQ ID NO: 116217 - DNA, 25 bp, S. pombe
ttacagcaaattgtgcgaggcgttt

SEQ ID NO: 116218 - DNA, 25 bp, S. pombe
ttacatgcagaatgcgtgccggctc

SEQ ID NO: 116219 - DNA, 25 bp, S. pombe
ttaatgatcgtcctttcacaggcgc

SEQ ID NO: 116220 - DNA, 25 bp, S. pombe
ttaatatcgcccctaccatgaatga

SEQ ID NO: 116221 - DNA, 25 bp, S. pombe
ttacttcccgagtttctgatgcgta

SEQ ID NO: 116222 - DNA, 25 bp, S. pombe
ttacttctttgagtctcttggctgg

SEQ ID NO: 116223 - DNA, 25 bp, S. pombe
ttacatttcccaatgtccctgatga

SEQ ID NO: 116224 - DNA, 25 bp, S. pombe
ttcacattttctggattctacgcga

SEQ ID NO: 116225 - DNA, 25 bp, S. pombe
ttaatctcgttttcgctaccaacat

SEQ ID NO: 116226 - DNA, 25 bp, S. pombe
ttgaccctagtctttattccaagtg

SEQ ID NO: 116227 - DNA, 25 bp, S. pombe
ttaccccgtcatatactccaagttt

SEQ ID NO: 116228 - DNA, 25 bp, S. pombe
ttaacatcactttaccttccgaggt

SEQ ID NO: 116229 - DNA, 25 bp, S. pombe
ttcccaaagccaccgttcagaaaat

SEQ ID NO: 116230 - DNA, 25 bp, S. pombe
ttcccaaacggatgcttctgactat

SEQ ID NO: 116231 - DNA, 25 bp, S. pombe
ttacaaagggtgctgcttctccata

SEQ ID NO: 116232 - DNA, 25 bp, S. pombe
ttaaaatgtgatcccgcttctctta

SEQ ID NO: 116233 - DNA, 25 bp, S. pombe
ttaaatcatcttcaggcttccttca

SEQ ID NO: 116234 - DNA, 25 bp, S. pombe
ttcaaatttgcgtcgtgcctctaaa

SEQ ID NO: 116235 - DNA, 25 bp, S. pombe
ttaaagacactatcccgcacagcaa

SEQ ID NO: 116236 - DNA, 25 bp, S. pombe
ttaaacacattttctacgcctgcta

SEQ ID NO: 116237 - DNA, 25 bp, S. pombe
ttctaggtttcattctcgggttcta

SEQ ID NO: 116238 - DNA, 25 bp, S. pombe
ttcagaattccagttaccctttcca

SEQ ID NO: 116239 - DNA, 25 bp, S. pombe
ttggaaagaagtgtccgctgcctta

SEQ ID NO: 116240 - DNA, 25 bp, S. pombe
ttctaaaaggtcatgccgctcgtgt

SEQ ID NO: 116241 - DNA, 25 bp, S. pombe
ttcagagaagtttgtccggcaccta

SEQ ID NO: 116242 - DNA, 25 bp, S. pombe
ttcacacttgttccccgatgttgtt

SEQ ID NO: 116243 - DNA, 25 bp, S. pombe
ttccaatttctcacatcggtctagt

SEQ ID NO: 116244 - DNA, 25 bp, S. pombe
ttacaaatatccctctttgcgcatc

SEQ ID NO: 116245 - DNA, 25 bp, S. pombe
ttaagaaaaccgactctgccaccaa

SEQ ID NO: 116246 - DNA, 25 bp, S. pombe
ttaatggttcgtgttgcagccccta

SEQ ID NO: 116247 - DNA, 25 bp, S. pombe
ttgctagtgttcgttttcaggcctc

SEQ ID NO: 116248 - DNA, 25 bp, S. pombe
ttacccttactaatactgactcgga

SEQ ID NO: 116249 - DNA, 25 bp, S. pombe
ttaacacgttacaccaatcctccaa

SEQ ID NO: 116250 - DNA, 25 bp, S. pombe
ttaaatcgtttaccgcaatcccaca

SEQ ID NO: 116251 - DNA, 25 bp, S. pombe
ttaattcgtttccttgacaccgaca

SEQ ID NO: 116252 - DNA, 25 bp, S. pombe
ttcataatactaccgtttcccaaag

SEQ ID NO: 116253 - DNA, 25 bp, S. pombe
ttctttcagtagctgtttcacccga

SEQ ID NO: 116254 - DNA, 25 bp, S. pombe
ttcaacttgacgacttgttgtcccc

SEQ ID NO: 116255 - DNA, 25 bp, S. pombe
ttaacattggttctgctggtgccgc

SEQ ID NO: 116256 - DNA, 25 bp, S. pombe
ttactagtttatcgactgcggccac

SEQ ID NO: 116257 - DNA, 25 bp, S. pombe
ttactattgtttcagctcaccgcac

SEQ ID NO: 116258 - DNA, 25 bp, S. pombe
ttaacatggtcatcacattcctctc

SEQ ID NO: 116259 - DNA, 25 bp, S. pombe
ttgctaatgcctttgaattcagcgg

SEQ ID NO: 116260 - DNA, 25 bp, S. pombe
ttctgaccactgttgatgttgacgg

SEQ ID NO: 116261 - DNA, 25 bp, S. pombe
ttctccccttagaattaagccctgg

SEQ ID NO: 116262 - DNA, 25 bp, S. pombe
ttgatacccttgcaaacaatcccga

SEQ ID NO: 116263 - DNA, 25 bp, S. pombe
ttgaacccaatgcaaactctcccaa

SEQ ID NO: 116264 - DNA, 25 bp, S. pombe
ttaaatcgcgccatgaatcttccta

SEQ ID NO: 116265 - DNA, 25 bp, S. pombe
ttacaagaacttggtcgctgtctct

SEQ ID NO: 116266 - DNA, 25 bp, S. pombe
ttcctattaaatcgagatatgttcc

SEQ ID NO: 116267 - DNA, 25 bp, S. pombe
ttaactctactctctgtgctactga

SEQ ID NO: 116268 - DNA, 25 bp, S. pombe
ttgcagtattactaccttcgtgtcc

SEQ ID NO: 116269 - DNA, 25 bp, S. pombe
ttaattgtaactctgctttgcgcac

SEQ ID NO: 116270 - DNA, 25 bp, S. pombe
ttactttcaacttctttccgatgct

SEQ ID NO: 116271 - DNA, 25 bp, S. pombe
ttcatttatacagacgttcgccgtg

SEQ ID NO: 116272 - DNA, 25 bp, S. pombe
ttacttcatcaatggctgcgtgcat

SEQ ID NO: 116273 - DNA, 25 bp, S. pombe
ttaaccattctcctgaagctcaaac

SEQ ID NO: 116274 - DNA, 25 bp, S. pombe
ttactcgctatattgtatgacaaat

SEQ ID NO: 116275 - DNA, 25 bp, S. pombe
ttccctgcctacttacaacaattga

SEQ ID NO: 116276 - DNA, 25 bp, S. pombe
ttcctggcctccattcaagagttga

SEQ ID NO: 116277 - DNA, 25 bp, S. pombe
ttccggctcattgctacggtcaaaa

SEQ ID NO: 116278 - DNA, 25 bp, S. pombe
ttcgggtcctgtacctgcaaatgaa

SEQ ID NO: 116279 - DNA, 25 bp, S. pombe
ttgcgggaggcactactttcagtga

SEQ ID NO: 116280 - DNA, 25 bp, S. pombe
ttcaaactcttcactttcttttcca

SEQ ID NO: 116281 - DNA, 25 bp, S. pombe
ttacgttctttttcttcgatttcag

SEQ ID NO: 116282 - DNA, 25 bp, S. pombe
ttccggtattgttacttcagtttca

SEQ ID NO: 116283 - DNA, 25 bp, S. pombe
ttaaagcgtgtgtctacttcctctc

SEQ ID NO: 116284 - DNA, 25 bp, S. pombe
ttcaatacgttggtgatcctcctca

SEQ ID NO: 116285 - DNA, 25 bp, S. pombe
ttaatgatgctgctgttttccctca

SEQ ID NO: 116286 - DNA, 25 bp, S. pombe
ttaatatgtctgatgttccctccac

SEQ ID NO: 116287 - DNA, 25 bp, S. pombe
ttaattgcacggttatgcccttcac

SEQ ID NO: 116288 - DNA, 25 bp, S. pombe
ttacttctcagttgtctccgttgac

SEQ ID NO: 116289 - DNA, 25 bp, S. pombe
ttacatctttggtcctcctgaatac

SEQ ID NO: 116290 - DNA, 25 bp, S. pombe
ttaacttaaatcctgctctggcatt

SEQ ID NO: 116291 - DNA, 25 bp, S. pombe
ttaatcctcagaacattgctatggc

SEQ ID NO: 116292 - DNA, 25 bp, S. pombe
ttcatcacccctgaaagaactatga

SEQ ID NO: 116293 - DNA, 25 bp, S. pombe
ttccacttccacctgtagttttgaa

SEQ ID NO: 116294 - DNA, 25 bp, S. pombe
ttcctcttcgtcagtagacttgtgg

SEQ ID NO: 116295 - DNA, 25 bp, S. pombe
ttcctctacttctgctaaacggcgt

SEQ ID NO: 116296 - DNA, 25 bp, S. pombe
ttgctcccgttgtattccaaaagtt

SEQ ID NO: 116297 - DNA, 25 bp, S. pombe
ttcacccgtgggatttggcaatgta

SEQ ID NO: 116298 - DNA, 25 bp, S. pombe
ttcccgttgggcctttgcagccgta

SEQ ID NO: 116299 - DNA, 25 bp, S. pombe
ttaacagctatgtcgcttgttctcc

SEQ ID NO: 116300 - DNA, 25 bp, S. pombe
ttacatgcgccttgatgggtcagtt

SEQ ID NO: 116301 - DNA, 25 bp, S. pombe
ttacagccgctgtagaggccaagca

SEQ ID NO: 116302 - DNA, 25 bp, S. pombe
ttaagcaatcagtcagtcaccaagg

SEQ ID NO: 116303 - DNA, 25 bp, S. pombe
ttaatgacatcagcttcccacagtg

SEQ ID NO: 116304 - DNA, 25 bp, S. pombe
ttaaagccgttgactcctattcaca

SEQ ID NO: 116305 - DNA, 25 bp, S. pombe
ttaactgccatcaaaggttctatat

SEQ ID NO: 116306 - DNA, 25 bp, S. pombe
ttaacgcctgcacaagtccaatttt

SEQ ID NO: 116307 - DNA, 25 bp, S. pombe
ttaacgcccagtacaacgcacattg

SEQ ID NO: 116308 - DNA, 25 bp, S. pombe
ttaagaccaattccctctatagatg

SEQ ID NO: 116309 - DNA, 25 bp, S. pombe
ttaaatcgagatatgttccttattg

SEQ ID NO: 116310 - DNA, 25 bp, S. pombe
ttctctaatgagaccttttcggcct

SEQ ID NO: 116311 - DNA, 25 bp, S. pombe
ttactattggtatgatcccggttaa

SEQ ID NO: 116312 - DNA, 25 bp, S. pombe
ttactgatggaaatcttcgccccgt

SEQ ID NO: 116313 - DNA, 25 bp, S. pombe
ttacaagccgtatacacccaagata

SEQ ID NO: 116314 - DNA, 25 bp, S. pombe
ttacttcccatttatcacgtcgatg

SEQ ID NO: 116315 - DNA, 25 bp, S. pombe
ttcctcttagagcttctagcctagg

SEQ ID NO: 116316 - DNA, 25 bp, S. pombe
ttcagttttacgctccatccttgga

SEQ ID NO: 116317 - DNA, 25 bp, S. pombe
ttcgagttttcgctataccttcagg

SEQ ID NO: 116318 - DNA, 25 bp, S. pombe
ttaatcgtctaccagctgcaagctg

SEQ ID NO: 116319 - DNA, 25 bp, S. pombe
ttaaagcacttcactatagcatgga

SEQ ID NO: 116320 - DNA, 25 bp, S. pombe
ttaacacctgtcatagtagcggcat

SEQ ID NO: 116321 - DNA, 25 bp, S. pombe
ttactcccttcattagtgactccat

SEQ ID NO: 116322 - DNA, 25 bp, S. pombe
ttaactcgcaatgtcaggcgcattc

SEQ ID NO: 116323 - DNA, 25 bp, S. pombe
ttgtatccgcattcaattgggcatg

SEQ ID NO: 116324 - DNA, 25 bp, S. pombe
ttacttcgagttaatgcgccatgcc

SEQ ID NO: 116325 - DNA, 25 bp, S. pombe
ttaatccagagaaacgcgtaccgcc

SEQ ID NO: 116326 - DNA, 25 bp, S. pombe
ttactctcgagtctagcttaaccac

SEQ ID NO: 116327 - DNA, 25 bp, S. pombe
ttacaccgagtgctatgttcattgc

SEQ ID NO: 116328 - DNA, 25 bp, S. pombe
ttacaccgtgctttgattctgctaa

SEQ ID NO: 116329 - DNA, 25 bp, S. pombe
ttcacgatgggttttccaatgctgt

SEQ ID NO: 116330 - DNA, 25 bp, S. pombe
ttcacctagacgttcccaatggtta

SEQ ID NO: 116331 - DNA, 25 bp, S. pombe
ttcaagtaactcttgccttggcatt

SEQ ID NO: 116332 - DNA, 25 bp, S. pombe
ttctggcttaatttggcctgcgaag

SEQ ID NO: 116333 - DNA, 25 bp, S. pombe
ttctacttctgttcgtcagggacat

SEQ ID NO: 116334 - DNA, 25 bp, S. pombe
ttaacgtgtgtttggcggtgaatac

SEQ ID NO: 116335 - DNA, 25 bp, S. pombe
ttaacggtgttctgcagcctaatag

SEQ ID NO: 116336 - DNA, 25 bp, S. pombe
ttaaacacgttccttacatcacagt

SEQ ID NO: 116337 - DNA, 25 bp, S. pombe
ttaaagccggctatgttgcacctct

SEQ ID NO: 116338 - DNA, 25 bp, S. pombe
ttggtatgactacgatgccacccac

SEQ ID NO: 116339 - DNA, 25 bp, S. pombe
ttggctaaccaaagtcctcgacaac

SEQ ID NO: 116340 - DNA, 25 bp, S. pombe
ttcaattccaccacttccaggaaag

SEQ ID NO: 116341 - DNA, 25 bp, S. pombe
ttcaattcccaacgtaagcgaaaag

SEQ ID NO: 116342 - DNA, 25 bp, S. pombe
ttcgtgtcgtttccaccaagaaggg

SEQ ID NO: 116343 - DNA, 25 bp, S. pombe
ttcactatcgcctttaaccaacatt

SEQ ID NO: 116344 - DNA, 25 bp, S. pombe
ttacttttctgttccccgaatgtga

SEQ ID NO: 116345 - DNA, 25 bp, S. pombe
ttgacttttatgcaacccgtgattg

SEQ ID NO: 116346 - DNA, 25 bp, S. pombe
ttaagacccacgtacagccttctat

SEQ ID NO: 116347 - DNA, 25 bp, S. pombe
ttaagacacctatcaagccttctct

SEQ ID NO: 116348 - DNA, 25 bp, S. pombe
ttaactaccgtgacaatgccttctt

SEQ ID NO: 116349 - DNA, 25 bp, S. pombe
ttggacttccggagagactgctttt

SEQ ID NO: 116350 - DNA, 25 bp, S. pombe
ttaatgcttacccaaggacccatgg

SEQ ID NO: 116351 - DNA, 25 bp, S. pombe
ttacagccactccaaaggtcgtgat

SEQ ID NO: 116352 - DNA, 25 bp, S. pombe
ttaacaatcgtacctctcgtgactg

SEQ ID NO: 116353 - DNA, 25 bp, S. pombe
ttacaaagttctccaagcgctggcg

SEQ ID NO: 116354 - DNA, 25 bp, S. pombe
ttcgatccgatctcaaagtgtttgt

SEQ ID NO: 116355 - DNA, 25 bp, S. pombe
ttcggatatggctcgtactttcaat

SEQ ID NO: 116356 - DNA, 25 bp, S. pombe
ttctcagtatggttggtctccccaa

SEQ ID NO: 116357 - DNA, 25 bp, S. pombe
ttctttggaaacttaggcgcctcca

SEQ ID NO: 116358 - DNA, 25 bp, S. pombe
ttcagttggcgatagtaagtcctct

SEQ ID NO: 116359 - DNA, 25 bp, S. pombe
ttcagtttgggtatcacagtcttcg

SEQ ID NO: 116360 - DNA, 25 bp, S. pombe
ttacttctggagacgaactgctgtt

SEQ ID NO: 116361 - DNA, 25 bp, S. pombe
ttcctccgaaacctcaatgtctatt

SEQ ID NO: 116362 - DNA, 25 bp, S. pombe
ttgtatcgtgagatcccttcttttt

SEQ ID NO: 116363 - DNA, 25 bp, S. pombe
ttcagacctgacacgtttctttcta

SEQ ID NO: 116364 - DNA, 25 bp, S. pombe
ttaatggctactccctctttattta

SEQ ID NO: 116365 - DNA, 25 bp, S. pombe
ttaaggtcagatcccgttgctattg

SEQ ID NO: 116366 - DNA, 25 bp, S. pombe
ttaattgtcgattccatcatggcac

SEQ ID NO: 116367 - DNA, 25 bp, S. pombe
ttaatcttcaattaccagcgcctcg

SEQ ID NO: 116368 - DNA, 25 bp, S. pombe
ttccaattcaaaaccctgtcgttgc

SEQ ID NO: 116369 - DNA, 25 bp, S. pombe
ttcgatcctcaagtagtcacgggtt

SEQ ID NO: 116370 - DNA, 25 bp, S. pombe
ttcgtccgaagaatctactagcgtt

SEQ ID NO: 116371 - DNA, 25 bp, S. pombe
ttctttcgaagtcctgcatacacag

SEQ ID NO: 116372 - DNA, 25 bp, S. pombe
ttgctcgccctgatgctgaaaaacg

SEQ ID NO: 116373 - DNA, 25 bp, S. pombe
ttaactctcttgttccacagtcaat

SEQ ID NO: 116374 - DNA, 25 bp, S. pombe
ttacacctccatcatcatcaggatt

SEQ ID NO: 116375 - DNA, 25 bp, S. pombe
ttaaccatgcagctgactcgagatg

SEQ ID NO: 116376 - DNA, 25 bp, S. pombe
ttctattcctaaaccagatgctgag

SEQ ID NO: 116377 - DNA, 25 bp, S. pombe
ttctgttcccaatccaggagatcgt

SEQ ID NO: 116378 - DNA, 25 bp, S. pombe
ttcactcttttggtttggttggaca

SEQ ID NO: 116379 - DNA, 25 bp, S. pombe
ttcacacttttgcttcctgaaacaa

SEQ ID NO: 116380 - DNA, 25 bp, S. pombe
ttcaccgtttccatcgagaacacga

SEQ ID NO: 116381 - DNA, 25 bp, S. pombe
ttccaatcgcaacaagctaccggat

SEQ ID NO: 116382 - DNA, 25 bp, S. pombe
ttctaccacaagaccagctacgggt

SEQ ID NO: 116383 - DNA, 25 bp, S. pombe
ttgatccttgaagttgcaccctttg

SEQ ID NO: 116384 - DNA, 25 bp, S. pombe
ttgatccccaagagtcccaattgaa

SEQ ID NO: 116385 - DNA, 25 bp, S. pombe
ttctcgtccaagtaccgcaaatggt

SEQ ID NO: 116386 - DNA, 25 bp, S. pombe
ttctgcgaagggtccaaacgtgatc

SEQ ID NO: 116387 - DNA, 25 bp, S. pombe
ttgggccttactacttggagtcctg

SEQ ID NO: 116388 - DNA, 25 bp, S. pombe
ttcagtggctctgctactttagttt

SEQ ID NO: 116389 - DNA, 25 bp, S. pombe
ttcagttgatgctccttcttcatgg

SEQ ID NO: 116390 - DNA, 25 bp, S. pombe
ttcactaatcaaacccactgttctt

SEQ ID NO: 116391 - DNA, 25 bp, S. pombe
ttcctcaatctcttaccacgttaat

SEQ ID NO: 116392 - DNA, 25 bp, S. pombe
ttcctcaacttgaacactcgtttta

SEQ ID NO: 116393 - DNA, 25 bp, S. pombe
ttgcgtgtcagttaccttttccgaa

SEQ ID NO: 116394 - DNA, 25 bp, S. pombe
ttcggactttactattattcttcaa

SEQ ID NO: 116395 - DNA, 25 bp, S. pombe
ttggcgatcctgtacttttacttac

SEQ ID NO: 116396 - DNA, 25 bp, S. pombe
ttacaagcgtcttctctatgttcgt

SEQ ID NO: 116397 - DNA, 25 bp, S. pombe
ttacaagcgtcttctctatgttcgt

SEQ ID NO: 116398 - DNA, 25 bp, S. pombe
ttgtcaagcggttcctttttcataa

SEQ ID NO: 116399 - DNA, 25 bp, S. pombe
ttggcaccggttcttttgacatatt

SEQ ID NO: 116400 - DNA, 25 bp, S. pombe
ttgatcaccggtcttgtcttacaat

SEQ ID NO: 116401 - DNA, 25 bp, S. pombe
ttaatagcgcctctatgtcttccaa

SEQ ID NO: 116402 - DNA, 25 bp, S. pombe
ttaatactgcttctcgatcttccag

SEQ ID NO: 116403 - DNA, 25 bp, S. pombe
ttgattcccgaagacatcagggcac

SEQ ID NO: 116404 - DNA, 25 bp, S. pombe
ttcacttcctagtcgaccagggagt

SEQ ID NO: 116405 - DNA, 25 bp, S. pombe
ttcttacctgacttaccgggaatct

SEQ ID NO: 116406 - DNA, 25 bp, S. pombe
ttcaaaatttgtcgctaccaccgtg

SEQ ID NO: 116407 - DNA, 25 bp, S. pombe
ttctcaaattcgtgccattcaccaa

SEQ ID NO: 116408 - DNA, 25 bp, S. pombe
ttcattaactcttccttgtactcaa

SEQ ID NO: 116409 - DNA, 25 bp, S. pombe
ttcaagcaactcttgtcttggcatc

SEQ ID NO: 116410 - DNA, 25 bp, S. pombe
ttcaggaggcttaagcgctgctgct

SEQ ID NO: 116411 - DNA, 25 bp, S. pombe
ttaaagctggtcgtgctgacgtctt

SEQ ID NO: 116412 - DNA, 25 bp, S. pombe
ttaaagctcctcatgttcctcttag

SEQ ID NO: 116413 - DNA, 25 bp, S. pombe
ttaaattcgctgcttacaacactga

SEQ ID NO: 116414 - DNA, 25 bp, S. pombe
ttacacctctgcagttacggagctt

SEQ ID NO: 116415 - DNA, 25 bp, S. pombe
ttcagctcaccaagcagttacggtt

SEQ ID NO: 116416 - DNA, 25 bp, S. pombe
ttcaccccttgactgagacggattt

SEQ ID NO: 116417 - DNA, 25 bp, S. pombe
ttaactgcattacttagccgtgtcc

SEQ ID NO: 116418 - DNA, 25 bp, S. pombe
ttacactgatacttctacttcttcc

SEQ ID NO: 116419 - DNA, 25 bp, S. pombe
ttaagccctaaactcgatgtatccg

SEQ ID NO: 116420 - DNA, 25 bp, S. pombe
ttcgaagatcttgcgctcaactagg

SEQ ID NO: 116421 - DNA, 25 bp, S. pombe
ttaaatgtgttgacccacgcttaaa

SEQ ID NO: 116422 - DNA, 25 bp, S. pombe
ttaaatgtgtctaaccacgcctctc

SEQ ID NO: 116423 - DNA, 25 bp, S. pombe
ttaatcttaattttacacgcatcat

SEQ ID NO: 116424 - DNA, 25 bp, S. pombe
ttaacgtcgctcacatatacagata

SEQ ID NO: 116425 - DNA, 25 bp, S. pombe
ttcaatgccaaatacatgggtcagt

SEQ ID NO: 116426 - DNA, 25 bp, S. pombe
ttcaaatacgttgtggagcctgggt

SEQ ID NO: 116427 - DNA, 25 bp, S. pombe
ttcaatatcaacttgggtggccggg

SEQ ID NO: 116428 - DNA, 25 bp, S. pombe
ttctcttcaagaatgccagcggtcg

SEQ ID NO: 116429 - DNA, 25 bp, S. pombe
ttaagctgtctttctggtttgcgac

SEQ ID NO: 116430 - DNA, 25 bp, S. pombe
ttcatctcgatcaaacagtgccata

SEQ ID NO: 116431 - DNA, 25 bp, S. pombe
ttcaccaagctatagtccatcatct

SEQ ID NO: 116432 - DNA, 25 bp, S. pombe
ttcacacgcacttggcaatctcttt

SEQ ID NO: 116433 - DNA, 25 bp, S. pombe
ttcaacagacatcgatgcggctctt

SEQ ID NO: 116434 - DNA, 25 bp, S. pombe
ttaatatcctcgaaggctcctttgg

SEQ ID NO: 116435 - DNA, 25 bp, S. pombe
ttaaatcctctgagtctcctagtct

SEQ ID NO: 116436 - DNA, 25 bp, S. pombe
ttcaaatactacgatcagctcctct

SEQ ID NO: 116437 - DNA, 25 bp, S. pombe
ttcctagatctttgtttgtcgccga

SEQ ID NO: 116438 - DNA, 25 bp, S. pombe
ttcagtttcctgtcttatatcgatc

SEQ ID NO: 116439 - DNA, 25 bp, S. pombe
ttctctttacgacttcgacgatcag

SEQ ID NO: 116440 - DNA, 25 bp, S. pombe
ttctattgacactgaatctggcgat

SEQ ID NO: 116441 - DNA, 25 bp, S. pombe
ttcgttgatcaagagcctggcttca

SEQ ID NO: 116442 - DNA, 25 bp, S. pombe
ttgcaggtatgcgacggcgttttca

SEQ ID NO: 116443 - DNA, 25 bp, S. pombe
ttaatcggtttgactgccactactt

SEQ ID NO: 116444 - DNA, 25 bp, S. pombe
ttccgggaagatctcagccatacga

SEQ ID NO: 116445 - DNA, 25 bp, S. pombe
ttcattgaagaaataatagcctacg

SEQ ID NO: 116446 - DNA, 25 bp, S. pombe
ttcaccttcctcaaatcctggtaaa

SEQ ID NO: 116447 - DNA, 25 bp, S. pombe
ttcaactgcatcgtcaactcggagt

SEQ ID NO: 116448 - DNA, 25 bp, S. pombe
ttgaccgtcggtacttggaagcatt

SEQ ID NO: 116449 - DNA, 25 bp, S. pombe
ttgacctccgtgttcgtggtcagca

SEQ ID NO: 116450 - DNA, 25 bp, S. pombe
ttaattccgttagtgctgttgagca

SEQ ID NO: 116451 - DNA, 25 bp, S. pombe
ttaatgctactcaacctggtgtacg

SEQ ID NO: 116452 - DNA, 25 bp, S. pombe
ttaactgaccaacatggaatggtgc

SEQ ID NO: 116453 - DNA, 25 bp, S. pombe
ttaattgaccaacatggactgatgc

SEQ ID NO: 116454 - DNA, 25 bp, S. pombe
ttcaccttccaacatttctgatgct

SEQ ID NO: 116455 - DNA, 25 bp, S. pombe
ttgcggcgcatgtttttgggtttac

SEQ ID NO: 116456 - DNA, 25 bp, S. pombe
ttcgtagtggtttatggcgccttaa

SEQ ID NO: 116457 - DNA, 25 bp, S. pombe
ttcagcccataaagttccgaccgag

SEQ ID NO: 116458 - DNA, 25 bp, S. pombe
ttcgccgtaacattatccgtcgtag

SEQ ID NO: 116459 - DNA, 25 bp, S. pombe
ttcttctgaagaaacgcccgtcaac

SEQ ID NO: 116460 - DNA, 25 bp, S. pombe
ttctccttatttattggcatctggc

SEQ ID NO: 116461 - DNA, 25 bp, S. pombe
ttaactggttctacgatgctcttgc

SEQ ID NO: 116462 - DNA, 25 bp, S. pombe
ttcgggagtgtcaaggcctcttcta

SEQ ID NO: 116463 - DNA, 25 bp, S. pombe
ttcgtgttggtcaagctgagcctat

SEQ ID NO: 116464 - DNA, 25 bp, S. pombe
ttcaatgttctgacgatccgctgta

SEQ ID NO: 116465 - DNA, 25 bp, S. pombe
ttaattcagtggtcttcgcttgcaa

SEQ ID NO: 116466 - DNA, 25 bp, S. pombe
ttaattcagggcatacgcttcgcac

SEQ ID NO: 116467 - DNA, 25 bp, S. pombe
ttgctgaatcagcagtccatctggg

SEQ ID NO: 116468 - DNA, 25 bp, S. pombe
ttgctttcgacaacgttagcgtatc

SEQ ID NO: 116469 - DNA, 25 bp, S. pombe
ttctcttcgtcatcgtcaatggtac

SEQ ID NO: 116470 - DNA, 25 bp, S. pombe
ttcattttctcaaacttgggcccct

SEQ ID NO: 116471 - DNA, 25 bp, S. pombe
ttcaattttcactcttgcggagcca

SEQ ID NO: 116472 - DNA, 25 bp, S. pombe
ttcaactattactcctcgtgtcaac

SEQ ID NO: 116473 - DNA, 25 bp, S. pombe
ttaatctttatcgttttcatgatca

SEQ ID NO: 116474 - DNA, 25 bp, S. pombe
ttaactatgttttgtctgtcgatga

SEQ ID NO: 116475 - DNA, 25 bp, S. pombe
ttcctttatggttggctcttgagct

SEQ ID NO: 116476 - DNA, 25 bp, S. pombe
ttccgttctggaaagcctgctgccg

SEQ ID NO: 116477 - DNA, 25 bp, S. pombe
ttccgttctggaaagcctgctgccg

SEQ ID NO: 116478 - DNA, 25 bp, S. pombe
ttaattcttccaagcagttcacctc

SEQ ID NO: 116479 - DNA, 25 bp, S. pombe
ttaattcttcctacagcttcttctt

SEQ ID NO: 116480 - DNA, 25 bp, S. pombe
ttaattgttcttacgcttgctggtc

SEQ ID NO: 116481 - DNA, 25 bp, S. pombe
ttctattatttagcgctggcggatc

SEQ ID NO: 116482 - DNA, 25 bp, S. pombe
ttgctagtactcacccttcaagtaa

SEQ ID NO: 116483 - DNA, 25 bp, S. pombe
ttctgaattcgatcccgccaagtta

SEQ ID NO: 116484 - DNA, 25 bp, S. pombe
ttcaagtatttacgtgccctggctg

SEQ ID NO: 116485 - DNA, 25 bp, S. pombe
ttcaacttttgacggctcctcggaa

SEQ ID NO: 116486 - DNA, 25 bp, S. pombe
ttcaacattttgagcctgaccaaga

SEQ ID NO: 116487 - DNA, 25 bp, S. pombe
ttctacgttcgttcacgtccaaaag

SEQ ID NO: 116488 - DNA, 25 bp, S. pombe
ttcatacgttcggagatgcctctca

SEQ ID NO: 116489 - DNA, 25 bp, S. pombe
ttgcatcagcatctagtggtggttc

SEQ ID NO: 116490 - DNA, 25 bp, S. pombe
ttccgtcaaggatattcgccgtggt

SEQ ID NO: 116491 - DNA, 25 bp, S. pombe
ttctcgttcagcgacaattcgggtt

SEQ ID NO: 116492 - DNA, 25 bp, S. pombe
ttctcgttctttcaagcgcgtatat

SEQ ID NO: 116493 - DNA, 25 bp, S. pombe
ttcttggctctttaaccgctgttat

SEQ ID NO: 116494 - DNA, 25 bp, S. pombe
ttcttcgctttttaccttatctcta

SEQ ID NO: 116495 - DNA, 25 bp, S. pombe
ttgcctcggtggctaaccttacgaa

SEQ ID NO: 116496 - DNA, 25 bp, S. pombe
ttctttgcgagtcctgtgaccaaga

SEQ ID NO: 116497 - DNA, 25 bp, S. pombe
ttcacagcaacaactgaggaccata

SEQ ID NO: 116498 - DNA, 25 bp, S. pombe
ttgcacacagagatgcttggccgtt

SEQ ID NO: 116499 - DNA, 25 bp, S. pombe
ttcaccatctgttcttggaagtttt

SEQ ID NO: 116500 - DNA, 25 bp, S. pombe
ttctgctttgactcttgttgtttct

SEQ ID NO: 116501 - DNA, 25 bp, S. pombe
ttcctttgccagttttgtacgatct

SEQ ID NO: 116502 - DNA, 25 bp, S. pombe
ttcctgttctcattgtttgggctag

SEQ ID NO: 116503 - DNA, 25 bp, S. pombe
ttctttgttcctttcatcgtggtag

SEQ ID NO: 116504 - DNA, 25 bp, S. pombe
ttcattcacctgctttatctggcgg

SEQ ID NO: 116505 - DNA, 25 bp, S. pombe
ttaatcacactgttcctctaactca

SEQ ID NO: 116506 - DNA, 25 bp, S. pombe
ttcaagtcctttactttcaccaatc

SEQ ID NO: 116507 - DNA, 25 bp, S. pombe
ttctattgaccaacgatttgactct

SEQ ID NO: 116508 - DNA, 25 bp, S. pombe
ttctgagcttgaggtcgatcgtgtt

SEQ ID NO: 116509 - DNA, 25 bp, S. pombe
ttcctcacctttgaatgaccagacg

SEQ ID NO: 116510 - DNA, 25 bp, S. pombe
ttctgacttgcgagaacaccctatt

SEQ ID NO: 116511 - DNA, 25 bp, S. pombe
ttgaaaagtcggtctgccccgctaa

SEQ ID NO: 116512 - DNA, 25 bp, S. pombe
ttgataaagtgcagggccgcgagaa

SEQ ID NO: 116513 - DNA, 25 bp, S. pombe
ttgtcaggccatgtggtccaaccaa

SEQ ID NO: 116514 - DNA, 25 bp, S. pombe
ttcaacattcagtgggataatcccg

SEQ ID NO: 116515 - DNA, 25 bp, S. pombe
ttctacatctaacggttttcctgcc

SEQ ID NO: 116516 - DNA, 25 bp, S. pombe
ttcttacacgaatccattaccttgc

SEQ ID NO: 116517 - DNA, 25 bp, S. pombe
ttcgcttccctttaatgaacgcatc

SEQ ID NO: 116518 - DNA, 25 bp, S. pombe
ttcaattcctgcttatgtccaactc

SEQ ID NO: 116519 - DNA, 25 bp, S. pombe
ttgagcctcctgttgaatcggcatt

SEQ ID NO: 116520 - DNA, 25 bp, S. pombe
ttcagctgctcaattatggtctcgc

SEQ ID NO: 116521 - DNA, 25 bp, S. pombe
ttcaggttgatactcagtctcgcgt

SEQ ID NO: 116522 - DNA, 25 bp, S. pombe
ttaatgctgttgctcttcgtcagat

SEQ ID NO: 116523 - DNA, 25 bp, S. pombe
ttgccggtcatgatgccagtcgtgg

SEQ ID NO: 116524 - DNA, 25 bp, S. pombe
ttctttgtatgattgccgatttctg

SEQ ID NO: 116525 - DNA, 25 bp, S. pombe
ttccgctattgattgcactttactg

SEQ ID NO: 116526 - DNA, 25 bp, S. pombe
ttctcgtttaatccatattcctctg

SEQ ID NO: 116527 - DNA, 25 bp, S. pombe
ttctttttagcgcaattcctctctg

SEQ ID NO: 116528 - DNA, 25 bp, S. pombe
ttctttactggaaacctgccttctt

SEQ ID NO: 116529 - DNA, 25 bp, S. pombe
ttctttactagcaactggcccttaa

SEQ ID NO: 116530 - DNA, 25 bp, S. pombe
ttcctgtactactattggtgttcca

SEQ ID NO: 116531 - DNA, 25 bp, S. pombe
ttcatttattcagctgtcggttctc

SEQ ID NO: 116532 - DNA, 25 bp, S. pombe
ttcttcctatcaacgcttggtttca

SEQ ID NO: 116533 - DNA, 25 bp, S. pombe
ttcggttcgtgttaggccatttgac

SEQ ID NO: 116534 - DNA, 25 bp, S. pombe
ttcgtgcttcggtccattttattaa

SEQ ID NO: 116535 - DNA, 25 bp, S. pombe
ttaatcccaatcttcctttttctca

SEQ ID NO: 116536 - DNA, 25 bp, S. pombe
ttgcctcccaactctatttatgttt

SEQ ID NO: 116537 - DNA, 25 bp, S. pombe
ttccccgtgatcaattttttgttag

SEQ ID NO: 116538 - DNA, 25 bp, S. pombe
ttcctctcgttcatttccgtgttta

SEQ ID NO: 116539 - DNA, 25 bp, S. pombe
ttggcatttggcgtgtttcctaatt

SEQ ID NO: 116540 - DNA, 25 bp, S. pombe
ttgaatcttggcgttataggtataa

SEQ ID NO: 116541 - DNA, 25 bp, S. pombe
ttcaatctctcgtcttatccgtaga

SEQ ID NO: 116542 - DNA, 25 bp, S. pombe
ttcaatgctttttctaccatggtga

SEQ ID NO: 116543 - DNA, 25 bp, S. pombe
ttctatccgatctttatgctgtcca

SEQ ID NO: 116544 - DNA, 25 bp, S. pombe
ttctactgcgtctacaactggtcaa

SEQ ID NO: 116545 - DNA, 25 bp, S. pombe
ttctctcccactatggtgctttgga

SEQ ID NO: 116546 - DNA, 25 bp, S. pombe
ttgtccccgttttgcattataccat

SEQ ID NO: 116547 - DNA, 25 bp, S. pombe
ttcgtccctttggtcttacaggtga

SEQ ID NO: 116548 - DNA, 25 bp, S. pombe
ttcagtgccctgatgagtgttatca

SEQ ID NO: 116549 - DNA, 25 bp, S. pombe
ttcaatggcctgaccttgcaacaaa

SEQ ID NO: 116550 - DNA, 25 bp, S. pombe
ttgcaaggcctattttcgaaagtcc

SEQ ID NO: 116551 - DNA, 25 bp, S. pombe
ttgcaaagcctatttccgaagttgg

SEQ ID NO: 116552 - DNA, 25 bp, S. pombe
ttgcaaacgcgtttccttggcttac

SEQ ID NO: 116553 - DNA, 25 bp, S. pombe
ttaagcatcgccttctaacttttca

SEQ ID NO: 116554 - DNA, 25 bp, S. pombe
ttgaagaggccactcaatcccttta

SEQ ID NO: 116555 - DNA, 25 bp, S. pombe
ttcaccagtacacgaacacgcattt

SEQ ID NO: 116556 - DNA, 25 bp, S. pombe
ttctggcgccaacaacaactttatt

SEQ ID NO: 116557 - DNA, 25 bp, S. pombe
ttctggtcgcactggaaagcctagt

SEQ ID NO: 116558 - DNA, 25 bp, S. pombe
ttgggtcgcaaagacatcgtcaaat

SEQ ID NO: 116559 - DNA, 25 bp, S. pombe
ttgggtcgggtgtcagcattcttaa

SEQ ID NO: 116560 - DNA, 25 bp, S. pombe
ttcggtcctaacaacattgcttcaa

SEQ ID NO: 116561 - DNA, 25 bp, S. pombe
ttcggactacgcaagctttctagat

SEQ ID NO: 116562 - DNA, 25 bp, S. pombe
ttctgaatttgtcccatttgctggt

SEQ ID NO: 116563 - DNA, 25 bp, S. pombe
ttctctctagtgatcccgacaagta

SEQ ID NO: 116564 - DNA, 25 bp, S. pombe
ttggtttaacctacaggcctgctga

SEQ ID NO: 116565 - DNA, 25 bp, S. pombe
ttcgtttacaactgcaagcgcttca

SEQ ID NO: 116566 - DNA, 25 bp, S. pombe
ttcgctttcacaactaacatcactt

SEQ ID NO: 116567 - DNA, 25 bp, S. pombe
ttcacgatgctctttgcgttatccg

SEQ ID NO: 116568 - DNA, 25 bp, S. pombe
ttcgctgctgtattgcctgctatat

SEQ ID NO: 116569 - DNA, 25 bp, S. pombe
ttggatctgctaccgcttagtaact

SEQ ID NO: 116570 - DNA, 25 bp, S. pombe
ttctacttctctcgtgcaatcaaat

SEQ ID NO: 116571 - DNA, 25 bp, S. pombe
ttcaatgctgttcgtactgctcaac

SEQ ID NO: 116572 - DNA, 25 bp, S. pombe
ttcgcgggttcctaatagctatgaa

SEQ ID NO: 116573 - DNA, 25 bp, S. pombe
ttcgcctgggttttatggtacacct

SEQ ID NO: 116574 - DNA, 25 bp, S. pombe
ttgctgcccgaacttctagtaattc

SEQ ID NO: 116575 - DNA, 25 bp, S. pombe
ttcttccgtgtccatgagtagttca

SEQ ID NO: 116576 - DNA, 25 bp, S. pombe
ttcggacacgagttcttggaattcg

SEQ ID NO: 116577 - DNA, 25 bp, S. pombe
ttcggatctggttttctttttctgc

SEQ ID NO: 116578 - DNA, 25 bp, S. pombe
ttcattatgcagtccaaccgttgtt

SEQ ID NO: 116579 - DNA, 25 bp, S. pombe
ttcagtgtgtgacaacgctgtttca

SEQ ID NO: 116580 - DNA, 25 bp, S. pombe
ttcatgtttcataagacgccatctt

SEQ ID NO: 116581 - DNA, 25 bp, S. pombe
ttcgcagggcgcaacgagtactaca

SEQ ID NO: 116582 - DNA, 25 bp, S. pombe
ttccatcgccggtttgaacaacagt

SEQ ID NO: 116583 - DNA, 25 bp, S. pombe
ttcgtccacggaattcacagcaaag

SEQ ID NO: 116584 - DNA, 25 bp, S. pombe
ttggtgtaccgcttgtcaacaaact

SEQ ID NO: 116585 - DNA, 25 bp, S. pombe
ttcaggtccatcaagcaatcagcaa

SEQ ID NO: 116586 - DNA, 25 bp, S. pombe
ttctgtctccatgcactatgcagaa

SEQ ID NO: 116587 - DNA, 25 bp, S. pombe
ttcgttcttcccaacaaacctattg

SEQ ID NO: 116588 - DNA, 25 bp, S. pombe
ttctttctttcccaataagcccatg

SEQ ID NO: 116589 - DNA, 25 bp, S. pombe
ttctcgtcttgttagaatctgagcg

SEQ ID NO: 116590 - DNA, 25 bp, S. pombe
ttcgcgtagtcgtagtcctgatgga

SEQ ID NO: 116591 - DNA, 25 bp, S. pombe
ttcatgctggcattcgtactcctat

SEQ ID NO: 116592 - DNA, 25 bp, S. pombe
ttcacgcgcaacctactactataag

SEQ ID NO: 116593 - DNA, 25 bp, S. pombe
ttctcgcaagcatctggtagttttt

SEQ ID NO: 116594 - DNA, 25 bp, S. pombe
ttgactgcatctgccgatcaagtat

SEQ ID NO: 116595 - DNA, 25 bp, S. pombe
ttcgtactatgcctgatggtgataa

SEQ ID NO: 116596 - DNA, 25 bp, S. pombe
ttccaaagatctgcgttgccactaa

SEQ ID NO: 116597 - DNA, 25 bp, S. pombe
ttcaactagatttcctggccatcga

SEQ ID NO: 116598 - DNA, 25 bp, S. pombe
ttctttatacatgccctccgattat

SEQ ID NO: 116599 - DNA, 25 bp, S. pombe
ttcttaaccaagcatgtccgactga

SEQ ID NO: 116600 - DNA, 25 bp, S. pombe
ttctctgaacttgatggtcggtcct

SEQ ID NO: 116601 - DNA, 25 bp, S. pombe
ttctatgtagttatggaccgtcctg

SEQ ID NO: 116602 - DNA, 25 bp, S. pombe
ttcatatgtaccttctaggccttcc

SEQ ID NO: 116603 - DNA, 25 bp, S. pombe
ttctgatttatctaccggctctata

SEQ ID NO: 116604 - DNA, 25 bp, S. pombe
ttcttcttctcttacggctaaagct

SEQ ID NO: 116605 - DNA, 25 bp, S. pombe
ttaatctcggaactgtccaatcctc

SEQ ID NO: 116606 - DNA, 25 bp, S. pombe
ttcaatttggatgtggctcgccttc

SEQ ID NO: 116607 - DNA, 25 bp, S. pombe
ttcttcgtgcaacagtcagctttta

SEQ ID NO: 116608 - DNA, 25 bp, S. pombe
ttgtttgtcgaacgtgtgcccttag

SEQ ID NO: 116609 - DNA, 25 bp, S. pombe
ttcttagtgaatttgccggtgctgc

SEQ ID NO: 116610 - DNA, 25 bp, S. pombe
ttctaatgtgaaaaccctgagcagg

SEQ ID NO: 116611 - DNA, 25 bp, S. pombe
ttcggatgtgaagcctcctagcgct

SEQ ID NO: 116612 - DNA, 25 bp, S. pombe
ttctgaagagaagccttcggccgct

SEQ ID NO: 116613 - DNA, 25 bp, S. pombe
ttctcaaagagttgctgcccaagcc

SEQ ID NO: 116614 - DNA, 25 bp, S. pombe
ttgctgaacagattggtgctacacc

SEQ ID NO: 116615 - DNA, 25 bp, S. pombe
ttgcgtcaagtatctctgaaggcgc

SEQ ID NO: 116616 - DNA, 25 bp, S. pombe
ttcagctcctgaactcttgcaaggg

SEQ ID NO: 116617 - DNA, 25 bp, S. pombe
ttcatacacgatactgctcaacagg

SEQ ID NO: 116618 - DNA, 25 bp, S. pombe
ttctcaacgctctgctgcaaagaag

SEQ ID NO: 116619 - DNA, 25 bp, S. pombe
ttcagccgctccttctgaagagaaa

SEQ ID NO: 116620 - DNA, 25 bp, S. pombe
ttcagtctttattcagtgggctata

SEQ ID NO: 116621 - DNA, 25 bp, S. pombe
ttcgcatttgtttgaatcggccatt

SEQ ID NO: 116622 - DNA, 25 bp, S. pombe
ttctcattgttatgggcggctgttc

SEQ ID NO: 116623 - DNA, 25 bp, S. pombe
ttcgattcttaaaccgtgcgttgct

SEQ ID NO: 116624 - DNA, 25 bp, S. pombe
ttcggttgtttattcgtcgtggcat

SEQ ID NO: 116625 - DNA, 25 bp, S. pombe
ttcggttccttctttgggtgatatt

SEQ ID NO: 116626 - DNA, 25 bp, S. pombe
ttctcgttcttttgcttcggtattt

SEQ ID NO: 116627 - DNA, 25 bp, S. pombe
ttcggaagcagcaagaatcccttaa

SEQ ID NO: 116628 - DNA, 25 bp, S. pombe
ttcctgtctgaaaagcgtcccgcaa

SEQ ID NO: 116629 - DNA, 25 bp, S. pombe
ttcgcaagcttttccgagatctttt

SEQ ID NO: 116630 - DNA, 25 bp, S. pombe
ttggaccgttgctgcggatgttagt

SEQ ID NO: 116631 - DNA, 25 bp, S. pombe
ttgttacagttcttcctgactttgt

SEQ ID NO: 116632 - DNA, 25 bp, S. pombe
ttctcccgaagctcgtgattttgta

SEQ ID NO: 116633 - DNA, 25 bp, S. pombe
ttctcccgacagttggttttctaat

SEQ ID NO: 116634 - DNA, 25 bp, S. pombe
ttctgtcaaccgttcccaaggaagt

SEQ ID NO: 116635 - DNA, 25 bp, S. pombe
ttctcccgagtcaaataacgctgct

SEQ ID NO: 116636 - DNA, 25 bp, S. pombe
ttcggcgcaggtgtatgaatcgttt

SEQ ID NO: 116637 - DNA, 25 bp, S. pombe
ttcgtgccggtcttatcaatgattc

SEQ ID NO: 116638 - DNA, 25 bp, S. pombe
ttctggacgttcttgctctaattgc

SEQ ID NO: 116639 - DNA, 25 bp, S. pombe
ttcggaggcctctatctctaaggat

SEQ ID NO: 116640 - DNA, 25 bp, S. pombe
ttcctacctctttcaattcggtgat

SEQ ID NO: 116641 - DNA, 25 bp, S. pombe
ttcacttccatttatatcaccggct

SEQ ID NO: 116642 - DNA, 25 bp, S. pombe
ttctcttctcaatttcgccagttat

SEQ ID NO: 116643 - DNA, 25 bp, S. pombe
ttctgcaactcaacagtcgggtttg

SEQ ID NO: 116644 - DNA, 25 bp, S. pombe
ttctgcctccgacattgaatcagtt

SEQ ID NO: 116645 - DNA, 25 bp, S. pombe
ttctgcctctgctgaattgttggct

SEQ ID NO: 116646 - DNA, 25 bp, S. pombe
ttcacccatccgttctgatatgagt

SEQ ID NO: 116647 - DNA, 25 bp, S. pombe
ttcagcaccatcttccttgatatat

SEQ ID NO: 116648 - DNA, 25 bp, S. pombe
ttctccgctaactcagcctataata

SEQ ID NO: 116649 - DNA, 25 bp, S. pombe
ttctcctgtttctcacagtgacgat

SEQ ID NO: 116650 - DNA, 25 bp, S. pombe
ttctctctttcttgtcagggtacat

SEQ ID NO: 116651 - DNA, 25 bp, S. pombe
ttcttcgatgtcaactcgggatcca

SEQ ID NO: 116652 - DNA, 25 bp, S. pombe
ttcgtggtgctatcatcatgggcaa

SEQ ID NO: 116653 - DNA, 25 bp, S. pombe
ttcgcaagtcttcctatgagcatga

SEQ ID NO: 116654 - DNA, 25 bp, S. pombe
ttgcccatgatcaggctcaagcatt

SEQ ID NO: 116655 - DNA, 25 bp, S. pombe
ttcgccttacagactcagagcttga

SEQ ID NO: 116656 - DNA, 25 bp, S. pombe
ttcttccaggagatgcgagctttct

SEQ ID NO: 116657 - DNA, 25 bp, S. pombe
ttcttccggccaagagactggtgat

SEQ ID NO: 116658 - DNA, 25 bp, S. pombe
ttctcccgagtcagcaggtgaagat

SEQ ID NO: 116659 - DNA, 25 bp, S. pombe
ttccgacacattcaatgggcgctgt

SEQ ID NO: 116660 - DNA, 25 bp, S. pombe
ttcttagcctctaccgttgatacgg

SEQ ID NO: 116661 - DNA, 25 bp, S. pombe
ttcagcaagtgcgtgttcgtgtaac

SEQ ID NO: 116662 - DNA, 25 bp, S. pombe
ttctgcaactgacgttagtgctaat

SEQ ID NO: 116663 - DNA, 25 bp, S. pombe
ttcagaacttggatgtgatcattgt

SEQ ID NO: 116664 - DNA, 25 bp, S. pombe
ttcgaatcatcgtgctggtgccgtt

SEQ ID NO: 116665 - DNA, 25 bp, S. pombe
ttcatagttcgtgcatggatccaga

SEQ ID NO: 116666 - DNA, 25 bp, S. pombe
ttgtacccgtattagttcgtgctgc

SEQ ID NO: 116667 - DNA, 25 bp, S. pombe
ttctctctaaacgagcatcctttac

SEQ ID NO: 116668 - DNA, 25 bp, S. pombe
ttcatgtttcacgtacaccttcaaa

SEQ ID NO: 116669 - DNA, 25 bp, S. pombe
ttccccgtcatctctgaaattggtg

SEQ ID NO: 116670 - DNA, 25 bp, S. pombe
ttgaagtgcaggatccagaaccgga

SEQ ID NO: 116671 - DNA, 25 bp, S. pombe
ttgatgaatcttatactcccagtac

SEQ ID NO: 116672 - DNA, 25 bp, S. pombe
ttcacactggccgtattctaggaat

SEQ ID NO: 116673 - DNA, 25 bp, S. pombe
ttcgcgtcgcctacaggtgcaggag

SEQ ID NO: 116674 - DNA, 25 bp, S. pombe
ttcttttctcttgtcgcaattacga

SEQ ID NO: 116675 - DNA, 25 bp, S. pombe
ttcttcttctcattcggcccctaaa

SEQ ID NO: 116676 - DNA, 25 bp, S. pombe
ttcttttcatgcttaggccctcgaa

SEQ ID NO: 116677 - DNA, 25 bp, S. pombe
ttcattttatgatacccgcagcaga

SEQ ID NO: 116678 - DNA, 25 bp, S. pombe
ttcaacagttgattcggtgctcgcg

SEQ ID NO: 116679 - DNA, 25 bp, S. pombe
ttcaacacactaaagggctcggcag

SEQ ID NO: 116680 - DNA, 25 bp, S. pombe
ttcacaaagtcaacacggctcatcg

SEQ ID NO: 116681 - DNA, 25 bp, S. pombe
ttctctcaatccttatacgctgtac

SEQ ID NO: 116682 - DNA, 25 bp, S. pombe
ttctgacaaattgaaccgcacctct

SEQ ID NO: 116683 - DNA, 25 bp, S. pombe
ttcagaactttcaacacctcaggtc

SEQ ID NO: 116684 - DNA, 25 bp, S. pombe
ttcactctttaaacttcactcacta

SEQ ID NO: 116685 - DNA, 25 bp, S. pombe
ttcactcccttcatttgatggacga

SEQ ID NO: 116686 - DNA, 25 bp, S. pombe
ttcctggccatcgatttgtaatccg

SEQ ID NO: 116687 - DNA, 25 bp, S. pombe
ttcagcttgctactcataatcggtc

SEQ ID NO: 116688 - DNA, 25 bp, S. pombe
ttcgttgctatgattgtcgttccct

SEQ ID NO: 116689 - DNA, 25 bp, S. pombe
ttcggcatgctgttcttgttttaca

SEQ ID NO: 116690 - DNA, 25 bp, S. pombe
ttcgcgagcgagtctatggtgatct

SEQ ID NO: 116691 - DNA, 25 bp, S. pombe
ttcacagcaagaagattcctcatct

SEQ ID NO: 116692 - DNA, 25 bp, S. pombe
ttcagagtatgtatatccactgcta

SEQ ID NO: 116693 - DNA, 25 bp, S. pombe
ttctctctatatattgcccatcaac

SEQ ID NO: 116694 - DNA, 25 bp, S. pombe
ttccttcttatttccttaatccaca

SEQ ID NO: 116695 - DNA, 25 bp, S. pombe
ttcactcacttcttccaattaatct

SEQ ID NO: 116696 - DNA, 25 bp, S. pombe
ttcgtaccaacttacagactgtctt

SEQ ID NO: 116697 - DNA, 25 bp, S. pombe
ttcatctacattgccagtctctttg

SEQ ID NO: 116698 - DNA, 25 bp, S. pombe
ttcattaattccaagtcctcgctgt

SEQ ID NO: 116699 - DNA, 25 bp, S. pombe
ttctgtttcttcagctactagcgta

SEQ ID NO: 116700 - DNA, 25 bp, S. pombe
ttgctcttcacgtgtttggtcatta

SEQ ID NO: 116701 - DNA, 25 bp, S. pombe
ttggcttccgctgtattttatttta

SEQ ID NO: 116702 - DNA, 25 bp, S. pombe
ttggttctccttgcttgttaactac

SEQ ID NO: 116703 - DNA, 25 bp, S. pombe
ttccgcttctgatatcgagtctgtt

SEQ ID NO: 116704 - DNA, 25 bp, S. pombe
ttcccgtgaaatccagactgctgtt

SEQ ID NO: 116705 - DNA, 25 bp, S. pombe
ttcccgcaacattgatagcctcgtt

SEQ ID NO: 116706 - DNA, 25 bp, S. pombe
ttctgccgacgatttagccaatgtt

SEQ ID NO: 116707 - DNA, 25 bp, S. pombe
ttgcgtccccacaagcctaaaaatg

SEQ ID NO: 116708 - DNA, 25 bp, S. pombe
ttcagtctccgagcctgttcaaaag

SEQ ID NO: 116709 - DNA, 25 bp, S. pombe
ttccctccaacttcgttttcaagag

SEQ ID NO: 116710 - DNA, 25 bp, S. pombe
ttcccctagtctttcttcttataag

SEQ ID NO: 116711 - DNA, 25 bp, S. pombe
ttcttttcttttttctctatctcac

SEQ ID NO: 116712 - DNA, 25 bp, S. pombe
ttctattatcttttcgttcctctac

SEQ ID NO: 116713 - DNA, 25 bp, S. pombe
ttctgtttatggtgctagtttctat

SEQ ID NO: 116714 - DNA, 25 bp, S. pombe
ttctggtactcctactcctttaatt

SEQ ID NO: 116715 - DNA, 25 bp, S. pombe
ttctggaaagcctgctgccgctgtt

SEQ ID NO: 116716 - DNA, 25 bp, S. pombe
ttctggaaagcctgctgccgctgtt

SEQ ID NO: 116717 - DNA, 25 bp, S. pombe
ttcggtaaggatgccactgctgctt

SEQ ID NO: 116718 - DNA, 25 bp, S. pombe
ttgagtttaggagctgccggcatgt

SEQ ID NO: 116719 - DNA, 25 bp, S. pombe
ttggttgaaggtgtctccgaggaaa

SEQ ID NO: 116720 - DNA, 25 bp, S. pombe
ttgttgaatgggtttcgcgcggaaa

SEQ ID NO: 116721 - DNA, 25 bp, S. pombe
ttgttagcgggctttctgtgtgcaa

SEQ ID NO: 116722 - DNA, 25 bp, S. pombe
ttctttgcgccctattgatattgct

SEQ ID NO: 116723 - DNA, 25 bp, S. pombe
ttcttcatccaatactgcagcatcg

SEQ ID NO: 116724 - DNA, 25 bp, S. pombe
ttcttttgcatattcctgacatcca

SEQ ID NO: 116725 - DNA, 25 bp, S. pombe
ttctctggtacatcctgcactaaat

SEQ ID NO: 116726 - DNA, 25 bp, S. pombe
ttcttttgcctcgttgcgcttatcc

SEQ ID NO: 116727 - DNA, 25 bp, S. pombe
ttcgtctattacttatatgccgctc

SEQ ID NO: 116728 - DNA, 25 bp, S. pombe
ttcattctcctcttaactcgattag

SEQ ID NO: 116729 - DNA, 25 bp, S. pombe
ttgccattctttgcagtttaccgac

SEQ ID NO: 116730 - DNA, 25 bp, S. pombe
ttctctttcagtgcttcttttgtat

SEQ ID NO: 116731 - DNA, 25 bp, S. pombe
ttgtcgttcagttcttttacatgct

SEQ ID NO: 116732 - DNA, 25 bp, S. pombe
ttgttatcggccaattagtcggatt

SEQ ID NO: 116733 - DNA, 25 bp, S. pombe
ttgaaatcacatcctcttcagtcgg

SEQ ID NO: 116734 - DNA, 25 bp, S. pombe
ttgaacctgctgactatgatcgttg

SEQ ID NO: 116735 - DNA, 25 bp, S. pombe
ttgctactggtgacatgttgcgctc

SEQ ID NO: 116736 - DNA, 25 bp, S. pombe
ttcagccggtttttattcatcctaa

SEQ ID NO: 116737 - DNA, 25 bp, S. pombe
ttcaccgttgttaatagatcctcta

SEQ ID NO: 116738 - DNA, 25 bp, S. pombe
ttcgcaattagcacagatggtctct

SEQ ID NO: 116739 - DNA, 25 bp, S. pombe
ttccattattccgagtggcttcata

SEQ ID NO: 116740 - DNA, 25 bp, S. pombe
ttcctttctcgaggtgtcttacagt

SEQ ID NO: 116741 - DNA, 25 bp, S. pombe
ttcgcatttcgcaagggatctcttc

SEQ ID NO: 116742 - DNA, 25 bp, S. pombe
ttccgtccggagatgttagagccta

SEQ ID NO: 116743 - DNA, 25 bp, S. pombe
ttcttcaactactaattctctctct

SEQ ID NO: 116744 - DNA, 25 bp, S. pombe
ttcaccggcttctatatatttctat

SEQ ID NO: 116745 - DNA, 25 bp, S. pombe
ttcagcctcgctacattaattgttg

SEQ ID NO: 116746 - DNA, 25 bp, S. pombe
ttcagcttctcttctaaatctcaat

SEQ ID NO: 116747 - DNA, 25 bp, S. pombe
ttctgctcctcgtaagcaatccaag

SEQ ID NO: 116748 - DNA, 25 bp, S. pombe
ttctgctcgctcaaggaaactctaa

SEQ ID NO: 116749 - DNA, 25 bp, S. pombe
ttcagcttgcatgtctccagatagt

SEQ ID NO: 116750 - DNA, 25 bp, S. pombe
ttcgcttcagccatccatgattttg

SEQ ID NO: 116751 - DNA, 25 bp, S. pombe
ttccttctccttatttgtctactta

SEQ ID NO: 116752 - DNA, 25 bp, S. pombe
ttgctcacacctgaaacttttctac

SEQ ID NO: 116753 - DNA, 25 bp, S. pombe
ttcccaccgatgaaactgcagttat

SEQ ID NO: 116754 - DNA, 25 bp, S. pombe
ttctctttcgaaattcagccggatg

SEQ ID NO: 116755 - DNA, 25 bp, S. pombe
ttccgccttgacttttactgctaaa

SEQ ID NO: 116756 - DNA, 25 bp, S. pombe
ttcgtcctcggattgttttgtacaa

SEQ ID NO: 116757 - DNA, 25 bp, S. pombe
ttctactctctattctttttataag

SEQ ID NO: 116758 - DNA, 25 bp, S. pombe
ttctactttcccttttcaatgtcaa

SEQ ID NO: 116759 - DNA, 25 bp, S. pombe
ttcttccaatcgcttttcaatgtca

SEQ ID NO: 116760 - DNA, 25 bp, S. pombe
ttcttactgattctggcttcgacca

SEQ ID NO: 116761 - DNA, 25 bp, S. pombe
ttcgtactttttcctgaagcagcgc

SEQ ID NO: 116762 - DNA, 25 bp, S. pombe
ttcgctatttatttctcaaaaccgt

SEQ ID NO: 116763 - DNA, 25 bp, S. pombe
ttcctgatgtttctcctaatgccaa

SEQ ID NO: 116764 - DNA, 25 bp, S. pombe
ttcgtgaagtcaaccctagtgctaa

SEQ ID NO: 116765 - DNA, 25 bp, S. pombe
ttcgaattcctcttccgatactaat

SEQ ID NO: 116766 - DNA, 25 bp, S. pombe
ttgagaaactgctgtcgaaccggaa

SEQ ID NO: 116767 - DNA, 25 bp, S. pombe
ttgcaaaggctttcacgtaccgaaa

SEQ ID NO: 116768 - DNA, 25 bp, S. pombe
ttctcgattcgtcttgatggatccc

SEQ ID NO: 116769 - DNA, 25 bp, S. pombe
ttcggactttggatgtcgactccat

SEQ ID NO: 116770 - DNA, 25 bp, S. pombe
ttcggaattccgacgtcaatctttc

SEQ ID NO: 116771 - DNA, 25 bp, S. pombe
ttcccctgctcttgagacaaagtgc

SEQ ID NO: 116772 - DNA, 25 bp, S. pombe
ttgctatacgtttaggccatactgt

SEQ ID NO: 116773 - DNA, 25 bp, S. pombe
ttcgatgccattcatgtgggtgcct

SEQ ID NO: 116774 - DNA, 25 bp, S. pombe
ttgcgcgtatttagctggaatcatc

SEQ ID NO: 116775 - DNA, 25 bp, S. pombe
ttgcggcttcatatctggcaactgc

SEQ ID NO: 116776 - DNA, 25 bp, S. pombe
ttcgccatacatattacaacccagc

SEQ ID NO: 116777 - DNA, 25 bp, S. pombe
ttcagccgttcaatttcttctcaaa

SEQ ID NO: 116778 - DNA, 25 bp, S. pombe
ttcagggagccaatacgcatttcaa

SEQ ID NO: 116779 - DNA, 25 bp, S. pombe
ttcaggctattctattcgagatatt

SEQ ID NO: 116780 - DNA, 25 bp, S. pombe
ttcggctgtcattcttatggtcatg

SEQ ID NO: 116781 - DNA, 25 bp, S. pombe
ttctgtgttatacttctgtgctcgt

SEQ ID NO: 116782 - DNA, 25 bp, S. pombe
ttcttgtctaagcttgccggtgtac

SEQ ID NO: 116783 - DNA, 25 bp, S. pombe
ttcttctacgttttgccgatgacac

SEQ ID NO: 116784 - DNA, 25 bp, S. pombe
ttcttctaactcttctcttggacac

SEQ ID NO: 116785 - DNA, 25 bp, S. pombe
ttcttttgaccgactttatgtccgc

SEQ ID NO: 116786 - DNA, 25 bp, S. pombe
ttcctttgaccccatttgttaagag

SEQ ID NO: 116787 - DNA, 25 bp, S. pombe
ttccttttcctcaattacgttgtcg

SEQ ID NO: 116788 - DNA, 25 bp, S. pombe
ttcgttttctccgttaagtgctatg

SEQ ID NO: 116789 - DNA, 25 bp, S. pombe
ttctttacgcccattatacattctc

SEQ ID NO: 116790 - DNA, 25 bp, S. pombe
ttcgcctcctttaatgatacattcg

SEQ ID NO: 116791 - DNA, 25 bp, S. pombe
ttcggttcattctttattcccattg

SEQ ID NO: 116792 - DNA, 25 bp, S. pombe
ttcaggttattctattagagatata

SEQ ID NO: 116793 - DNA, 25 bp, S. pombe
ttcggtgtcaacgttcagcaatgta

SEQ ID NO: 116794 - DNA, 25 bp, S. pombe
ttcctcggattcttcttcagatgta

SEQ ID NO: 116795 - DNA, 25 bp, S. pombe
ttcgaccagttctagttcaggcacg

SEQ ID NO: 116796 - DNA, 25 bp, S. pombe
ttcagtccgatttaatgtccgcagc

SEQ ID NO: 116797 - DNA, 25 bp, S. pombe
ttcgtcgcaaagtcacattccaaca

SEQ ID NO: 116798 - DNA, 25 bp, S. pombe
ttctgtctgctctaagcttccaaat

SEQ ID NO: 116799 - DNA, 25 bp, S. pombe
ttcgtctgttttcggcttccaaaat

SEQ ID NO: 116800 - DNA, 25 bp, S. pombe
ttcctgttctttcgccgtgaaaatt

SEQ ID NO: 116801 - DNA, 25 bp, S. pombe
ttcccctttgttccgtcatgaaatt

SEQ ID NO: 116802 - DNA, 25 bp, S. pombe
ttctcggtcacgacttgcatggcaa

SEQ ID NO: 116803 - DNA, 25 bp, S. pombe
ttgctccgatcatgtcttgtttcac

SEQ ID NO: 116804 - DNA, 25 bp, S. pombe
ttccgcgctggaattgttcgacttg

SEQ ID NO: 116805 - DNA, 25 bp, S. pombe
ttcctctctccattgctggtttttt

SEQ ID NO: 116806 - DNA, 25 bp, S. pombe
ttgacgttaacggtgagctgccttt

SEQ ID NO: 116807 - DNA, 25 bp, S. pombe
ttccgatgttaccattagcgccatt

SEQ ID NO: 116808 - DNA, 25 bp, S. pombe
ttccgagttcatccaacagtacatg

SEQ ID NO: 116809 - DNA, 25 bp, S. pombe
ttccgtgttctggagacagcaccat

SEQ ID NO: 116810 - DNA, 25 bp, S. pombe
ttctcttggatggacaacagcctct

SEQ ID NO: 116811 - DNA, 25 bp, S. pombe
ttgatggtgcaagaggccgatccta

SEQ ID NO: 116812 - DNA, 25 bp, S. pombe
ttcatgttcacgaagggtatcctat

SEQ ID NO: 116813 - DNA, 25 bp, S. pombe
ttcgtgtcctgaaagtctacctcaa

SEQ ID NO: 116814 - DNA, 25 bp, S. pombe
ttctttctcgaggactttcatcatc

SEQ ID NO: 116815 - DNA, 25 bp, S. pombe
ttcttccactgacacttatgctgca

SEQ ID NO: 116816 - DNA, 25 bp, S. pombe
ttctgtatcgtgtcaagctttgctg

SEQ ID NO: 116817 - DNA, 25 bp, S. pombe
ttccttttttccctacagcgtgaat

SEQ ID NO: 116818 - DNA, 25 bp, S. pombe
ttctcgtggtgctagtgttaccgtt

SEQ ID NO: 116819 - DNA, 25 bp, S. pombe
ttgcccagagctttgctgaaaccat

SEQ ID NO: 116820 - DNA, 25 bp, S. pombe
ttccctatgttgcatggactcgcat

SEQ ID NO: 116821 - DNA, 25 bp, S. pombe
ttccttgtggtgttgctactcagca

SEQ ID NO: 116822 - DNA, 25 bp, S. pombe
ttggctagcatccttcagatcgaca

SEQ ID NO: 116823 - DNA, 25 bp, S. pombe
ttctgttgcatccatgtcacttgaa

SEQ ID NO: 116824 - DNA, 25 bp, S. pombe
ttctgttgcggctaccaatgctaat

SEQ ID NO: 116825 - DNA, 25 bp, S. pombe
ttctgtggcttctgagacatcgtca

SEQ ID NO: 116826 - DNA, 25 bp, S. pombe
ttctctattctttgcaagctcgcta

SEQ ID NO: 116827 - DNA, 25 bp, S. pombe
ttctttttagtgtcgctcctgcata

SEQ ID NO: 116828 - DNA, 25 bp, S. pombe
ttccttgtgggttcgcaatgtgcaa

SEQ ID NO: 116829 - DNA, 25 bp, S. pombe
ttcgctgggcaactacggatccaaa

SEQ ID NO: 116830 - DNA, 25 bp, S. pombe
ttgccggagcttccgattattctac

SEQ ID NO: 116831 - DNA, 25 bp, S. pombe
ttgccaggaccttcagctttattga

SEQ ID NO: 116832 - DNA, 25 bp, S. pombe
ttccctgacactgaatctgtacgac

SEQ ID NO: 116833 - DNA, 25 bp, S. pombe
ttcccgaaggcgaactcggcaacga

SEQ ID NO: 116834 - DNA, 25 bp, S. pombe
ttccctgaagggattcgatcacacg

SEQ ID NO: 116835 - DNA, 25 bp, S. pombe
ttccttgtaggtgctgtcgtttcag

SEQ ID NO: 116836 - DNA, 25 bp, S. pombe
ttcttagtcggttctgtagctggta

SEQ ID NO: 116837 - DNA, 25 bp, S. pombe
ttcttcaccggaatctgttgctagt

SEQ ID NO: 116838 - DNA, 25 bp, S. pombe
ttcttcaccggaatcgtcgaaatgc

SEQ ID NO: 116839 - DNA, 25 bp, S. pombe
ttcgtcctcgtgtactaggtggatc

SEQ ID NO: 116840 - DNA, 25 bp, S. pombe
ttcgttccgatgagcttggtttcaa

SEQ ID NO: 116841 - DNA, 25 bp, S. pombe
ttcgcaccggaaacactgttcatta

SEQ ID NO: 116842 - DNA, 25 bp, S. pombe
ttcgcaccgggagccagatttctga

SEQ ID NO: 116843 - DNA, 25 bp, S. pombe
ttccctactggcttcatggatgtaa

SEQ ID NO: 116844 - DNA, 25 bp, S. pombe
ttccaccctagtccgatgatgatta

SEQ ID NO: 116845 - DNA, 25 bp, S. pombe
ttcatcatcatcagcagttcgtgga

SEQ ID NO: 116846 - DNA, 25 bp, S. pombe
ttctcgctctcctgctaggaataaa

SEQ ID NO: 116847 - DNA, 25 bp, S. pombe
ttgcccaaatcgctttgtggaccga

SEQ ID NO: 116848 - DNA, 25 bp, S. pombe
ttgccttcaattcttcttcgactgg

SEQ ID NO: 116849 - DNA, 25 bp, S. pombe
ttccttccattgtttctgcttttga

SEQ ID NO: 116850 - DNA, 25 bp, S. pombe
ttccttacggaggttgatcgctcgt

SEQ ID NO: 116851 - DNA, 25 bp, S. pombe
ttgcgtgtcgttggttctgaactta

SEQ ID NO: 116852 - DNA, 25 bp, S. pombe
ttcccatcgattcttctgatactgt

SEQ ID NO: 116853 - DNA, 25 bp, S. pombe
ttcccatcggtggtgccattactaa

SEQ ID NO: 116854 - DNA, 25 bp, S. pombe
ttccgccgtgctgctaattacaaaa

SEQ ID NO: 116855 - DNA, 25 bp, S. pombe
ttcggtgcccttacaaatccaaact

SEQ ID NO: 116856 - DNA, 25 bp, S. pombe
ttctcgtcaatcactgaggccatgt

SEQ ID NO: 116857 - DNA, 25 bp, S. pombe
ttgcttgatcaaacctagacgcgta

SEQ ID NO: 116858 - DNA, 25 bp, S. pombe
ttcgtagcaatgtgtcaggccgtga

SEQ ID NO: 116859 - DNA, 25 bp, S. pombe
ttctgtatcgagttgattccttcca

SEQ ID NO: 116860 - DNA, 25 bp, S. pombe
ttcttacggtcacttcactgatcaa

SEQ ID NO: 116861 - DNA, 25 bp, S. pombe
ttcttcacaagctctctattcgtag

SEQ ID NO: 116862 - DNA, 25 bp, S. pombe
ttctatacaactcatgcttccgatc

SEQ ID NO: 116863 - DNA, 25 bp, S. pombe
ttcttgatacatctcttctgcaacc

SEQ ID NO: 116864 - DNA, 25 bp, S. pombe
ttgctttggctgctttggaggctat

SEQ ID NO: 116865 - DNA, 25 bp, S. pombe
ttcgttcctctacttgcttttaata

SEQ ID NO: 116866 - DNA, 25 bp, S. pombe
ttctgtgtttcttcttgctattgtg

SEQ ID NO: 116867 - DNA, 25 bp, S. pombe
ttcggtgttatgtcttttgttgcta

SEQ ID NO: 116868 - DNA, 25 bp, S. pombe
ttctttgatgtcctcgttttagcga

SEQ ID NO: 116869 - DNA, 25 bp, S. pombe
ttctttgcataccttgttccatact

SEQ ID NO: 116870 - DNA, 25 bp, S. pombe
ttgtagccaatccaacagctggtga

SEQ ID NO: 116871 - DNA, 25 bp, S. pombe
ttgctaccaacgatacgggctccta

SEQ ID NO: 116872 - DNA, 25 bp, S. pombe
ttgtacgcatcaaggttcagcggat

SEQ ID NO: 116873 - DNA, 25 bp, S. pombe
ttcccgaaagcattcaaggctcctt

SEQ ID NO: 116874 - DNA, 25 bp, S. pombe
ttccggcaacaatcataactccttt

SEQ ID NO: 116875 - DNA, 25 bp, S. pombe
ttcccgctatcatactttaccttat

SEQ ID NO: 116876 - DNA, 25 bp, S. pombe
ttggccgtatggtagttgttcctct

SEQ ID NO: 116877 - DNA, 25 bp, S. pombe
ttgatcgtcctaagagcgtttcctc

SEQ ID NO: 116878 - DNA, 25 bp, S. pombe
ttctatcgccgaaagggtatctcct

SEQ ID NO: 116879 - DNA, 25 bp, S. pombe
ttcttcgtggtgatggtgtcgttct

SEQ ID NO: 116880 - DNA, 25 bp, S. pombe
ttgtatcaatggaggcggtcagctt

SEQ ID NO: 116881 - DNA, 25 bp, S. pombe
ttctgaaatgtgtttcgccgactct

SEQ ID NO: 116882 - DNA, 25 bp, S. pombe
ttgcgaaatgcgtttgatgcctggc

SEQ ID NO: 116883 - DNA, 25 bp, S. pombe
ttgcgcaacgtatcaccatcagaga

SEQ ID NO: 116884 - DNA, 25 bp, S. pombe
ttgcgtacaccatcgcgtcagatat

SEQ ID NO: 116885 - DNA, 25 bp, S. pombe
ttcgctgaagccaaagccggagcat

SEQ ID NO: 116886 - DNA, 25 bp, S. pombe
ttctgccgatgccaagaccgtaagt

SEQ ID NO: 116887 - DNA, 25 bp, S. pombe
ttcgtcctaaaaaccgcacatacag

SEQ ID NO: 116888 - DNA, 25 bp, S. pombe
ttcgccatcttcaagtaaccctaaa

SEQ ID NO: 116889 - DNA, 25 bp, S. pombe
ttccgcatttcaacacaagccagta

SEQ ID NO: 116890 - DNA, 25 bp, S. pombe
ttgtcgatattcatcaacccactgc

SEQ ID NO: 116891 - DNA, 25 bp, S. pombe
ttccgttgccttttactgagacttt

SEQ ID NO: 116892 - DNA, 25 bp, S. pombe
ttgggttgctttttccaggaattgt

SEQ ID NO: 116893 - DNA, 25 bp, S. pombe
ttggtacttttaaccgaggcactct

SEQ ID NO: 116894 - DNA, 25 bp, S. pombe
ttcctactgaatatgttccgactgt

SEQ ID NO: 116895 - DNA, 25 bp, S. pombe
ttccaatggtattcttttcttccga

SEQ ID NO: 116896 - DNA, 25 bp, S. pombe
ttcgcactcaattacttcgtttctg

SEQ ID NO: 116897 - DNA, 25 bp, S. pombe
ttctccgcaatccattcgtttttat

SEQ ID NO: 116898 - DNA, 25 bp, S. pombe
ttctacaaggcccatcacatggagt

SEQ ID NO: 116899 - DNA, 25 bp, S. pombe
ttccgcacatgtgtcttctgaagtt

SEQ ID NO: 116900 - DNA, 25 bp, S. pombe
ttctggccgtgtactggtagattct

SEQ ID NO: 116901 - DNA, 25 bp, S. pombe
ttcgtgcgcgtgtacttacatactt

SEQ ID NO: 116902 - DNA, 25 bp, S. pombe
ttcggtgttcgagttgatccagcaa

SEQ ID NO: 116903 - DNA, 25 bp, S. pombe
ttccggtgatcgttctttattatga

SEQ ID NO: 116904 - DNA, 25 bp, S. pombe
ttgcccgtcacgttattaatcttca

SEQ ID NO: 116905 - DNA, 25 bp, S. pombe
ttcccgacatctgttcctattgtaa

SEQ ID NO: 116906 - DNA, 25 bp, S. pombe
ttctcaccgccttttagtttgtcta

SEQ ID NO: 116907 - DNA, 25 bp, S. pombe
ttctaaaactctttccgtatctcgc

SEQ ID NO: 116908 - DNA, 25 bp, S. pombe
ttctaaacctttccccgacattgat

SEQ ID NO: 116909 - DNA, 25 bp, S. pombe
ttgcaaaaccgaactccacgtcttt

SEQ ID NO: 116910 - DNA, 25 bp, S. pombe
ttcgcaaaaagtcgctactcagcaa

SEQ ID NO: 116911 - DNA, 25 bp, S. pombe
ttctatcatgatttggctcttcgtc

SEQ ID NO: 116912 - DNA, 25 bp, S. pombe
ttcgcacaatttactttggtcacag

SEQ ID NO: 116913 - DNA, 25 bp, S. pombe
ttcgggttctattcagaggctccac

SEQ ID NO: 116914 - DNA, 25 bp, S. pombe
ttcgttgtccgtttggatgcccaaa

SEQ ID NO: 116915 - DNA, 25 bp, S. pombe
ttcgtcgtcgcgctcatggagaaaa

SEQ ID NO: 116916 - DNA, 25 bp, S. pombe
ttctgtcttaccttcgtggagcaaa

SEQ ID NO: 116917 - DNA, 25 bp, S. pombe
ttcctcactggttgggctgctaaat

SEQ ID NO: 116918 - DNA, 25 bp, S. pombe
ttcctactgtttacatccttcatgg

SEQ ID NO: 116919 - DNA, 25 bp, S. pombe
ttctcttctttctacttcatcttta

SEQ ID NO: 116920 - DNA, 25 bp, S. pombe
ttctcgtctgatgaagtctgccatt

SEQ ID NO: 116921 - DNA, 25 bp, S. pombe
ttctgcgtcgtcttcaaatgcctat

SEQ ID NO: 116922 - DNA, 25 bp, S. pombe
ttgcaggaccgttctatgtgttaca

SEQ ID NO: 116923 - DNA, 25 bp, S. pombe
ttggcagagcccttgttaattacag

SEQ ID NO: 116924 - DNA, 25 bp, S. pombe
ttctttgatgcgacgctgtgatcat

SEQ ID NO: 116925 - DNA, 25 bp, S. pombe
ttcgtgctggcgactgggtcatgaa

SEQ ID NO: 116926 - DNA, 25 bp, S. pombe
ttcccatgaacttggtcaccggttt

SEQ ID NO: 116927 - DNA, 25 bp, S. pombe
ttctgctcaacaaacgactcgttct

SEQ ID NO: 116928 - DNA, 25 bp, S. pombe
ttcgtctctctcgtaagcgtagtga

SEQ ID NO: 116929 - DNA, 25 bp, S. pombe
ttcgttttcctcgtcgcaaaaagca

SEQ ID NO: 116930 - DNA, 25 bp, S. pombe
ttctccttttctttcggatcacaaa

SEQ ID NO: 116931 - DNA, 25 bp, S. pombe
ttgtccggcttctctgaataacgtt

SEQ ID NO: 116932 - DNA, 25 bp, S. pombe
ttgatcctggcttggtcgaaaccga

SEQ ID NO: 116933 - DNA, 25 bp, S. pombe
ttgactccgctgatttaacaccact

SEQ ID NO: 116934 - DNA, 25 bp, S. pombe
ttccacctgcgcacacaaaaaattt

SEQ ID NO: 116935 - DNA, 25 bp, S. pombe
ttccatcgcccgcaatacatatgat

SEQ ID NO: 116936 - DNA, 25 bp, S. pombe
ttcgcagtctggtcacgttgtgaag

SEQ ID NO: 116937 - DNA, 25 bp, S. pombe
ttctggaggtgctggctttgtcaaa

SEQ ID NO: 116938 - DNA, 25 bp, S. pombe
ttctaggcgtcgtcgtctttcataa

SEQ ID NO: 116939 - DNA, 25 bp, S. pombe
ttgaatcgcttgcaggtcttccaaa

SEQ ID NO: 116940 - DNA, 25 bp, S. pombe
ttgcagaagctttgggtcttccgca

SEQ ID NO: 116941 - DNA, 25 bp, S. pombe
ttgcatatatttgatcggtaccgag

SEQ ID NO: 116942 - DNA, 25 bp, S. pombe
ttgcacattattcgacggctaagga

SEQ ID NO: 116943 - DNA, 25 bp, S. pombe
ttgcctcttattgcgcgtagacgat

SEQ ID NO: 116944 - DNA, 25 bp, S. pombe
ttctcccttggttcgtgatgcgcaa

SEQ ID NO: 116945 - DNA, 25 bp, S. pombe
ttccccttgggacgctatcgaagaa

SEQ ID NO: 116946 - DNA, 25 bp, S. pombe
ttcccacgatgtccggtattgaagt

SEQ ID NO: 116947 - DNA, 25 bp, S. pombe
ttctcgacgcgataggtctgcgcaa

SEQ ID NO: 116948 - DNA, 25 bp, S. pombe
ttgcccagtgcttcagtgtcggatg

SEQ ID NO: 116949 - DNA, 25 bp, S. pombe
ttcggtagcttcctcaacaaatctt

SEQ ID NO: 116950 - DNA, 25 bp, S. pombe
ttcgcaaccttcctaatccaattat

SEQ ID NO: 116951 - DNA, 25 bp, S. pombe
ttccaagattccttctgaccagtta

SEQ ID NO: 116952 - DNA, 25 bp, S. pombe
ttcgtttatgattactcttccctaa

SEQ ID NO: 116953 - DNA, 25 bp, S. pombe
ttccttctctattgtctttacctta

SEQ ID NO: 116954 - DNA, 25 bp, S. pombe
ttcctttccttatttccacacaata

SEQ ID NO: 116955 - DNA, 25 bp, S. pombe
ttcgttccagtcatttcagtaccat

SEQ ID NO: 116956 - DNA, 25 bp, S. pombe
ttcgttttgcgggacatttctcaag

SEQ ID NO: 116957 - DNA, 25 bp, S. pombe
ttggattttcgggtcaagtctcaaa

SEQ ID NO: 116958 - DNA, 25 bp, S. pombe
ttcgggctgcatgttccatttgcaa

SEQ ID NO: 116959 - DNA, 25 bp, S. pombe
ttctcgtgcaattctatccttcaat

SEQ ID NO: 116960 - DNA, 25 bp, S. pombe
ttctcctcaattgctccttacaaaa

SEQ ID NO: 116961 - DNA, 25 bp, S. pombe
ttctcacactcttcaaacaactagc

SEQ ID NO: 116962 - DNA, 25 bp, S. pombe
ttccatacttacaaagcgactcctc

SEQ ID NO: 116963 - DNA, 25 bp, S. pombe
ttgctattctttgcgggtatgccaa

SEQ ID NO: 116964 - DNA, 25 bp, S. pombe
ttgtttctgcaagccggtagccaaa

SEQ ID NO: 116965 - DNA, 25 bp, S. pombe
ttctctcatgctcaaaccgttgtta

SEQ ID NO: 116966 - DNA, 25 bp, S. pombe
ttctgctattggtaatccggctgtt

SEQ ID NO: 116967 - DNA, 25 bp, S. pombe
ttctaatatgcctatcaccccattt

SEQ ID NO: 116968 - DNA, 25 bp, S. pombe
ttgctaaaactattccccgtgtcca

SEQ ID NO: 116969 - DNA, 25 bp, S. pombe
ttctaaatcaaaacactccgcttcc

SEQ ID NO: 116970 - DNA, 25 bp, S. pombe
ttccttaaatgaacaacctgccgcc

SEQ ID NO: 116971 - DNA, 25 bp, S. pombe
ttgagtgtcactattcctgagcgcc

SEQ ID NO: 116972 - DNA, 25 bp, S. pombe
ttcgttcacaacttgcctgctaaaa

SEQ ID NO: 116973 - DNA, 25 bp, S. pombe
ttcgtatgccaaccttcgtggaaat

SEQ ID NO: 116974 - DNA, 25 bp, S. pombe
ttcggctgccaaccgtttacaagat

SEQ ID NO: 116975 - DNA, 25 bp, S. pombe
ttgggcgaaccaggagtgtctctat

SEQ ID NO: 116976 - DNA, 25 bp, S. pombe
ttccgtcgctttggtggtattcaac

SEQ ID NO: 116977 - DNA, 25 bp, S. pombe
ttccctctgttaagcgtgttgtcaa

SEQ ID NO: 116978 - DNA, 25 bp, S. pombe
ttctgctgctgtatatcctttgttc

SEQ ID NO: 116979 - DNA, 25 bp, S. pombe
ttcctttttaccttctgatgttcca

SEQ ID NO: 116980 - DNA, 25 bp, S. pombe
ttccttttttccttctaacgctgat

SEQ ID NO: 116981 - DNA, 25 bp, S. pombe
ttcctatttttcgtgtatcccgtca

SEQ ID NO: 116982 - DNA, 25 bp, S. pombe
ttgggtatacgtttggttgtgctta

SEQ ID NO: 116983 - DNA, 25 bp, S. pombe
ttgacatgggaggtgctgtcccttc

SEQ ID NO: 116984 - DNA, 25 bp, S. pombe
ttgtcggcctgagagctctggtaat

SEQ ID NO: 116985 - DNA, 25 bp, S. pombe
ttgctactgcctacaatgctgatgg

SEQ ID NO: 116986 - DNA, 25 bp, S. pombe
ttgcatcctgccatgaagggagcca

SEQ ID NO: 116987 - DNA, 25 bp, S. pombe
ttgttcgtcaatacatgggtcataa

SEQ ID NO: 116988 - DNA, 25 bp, S. pombe
ttgtacgtcgatcctttgtgccata

SEQ ID NO: 116989 - DNA, 25 bp, S. pombe
ttgatcagcagttgtgtttcggaaa

SEQ ID NO: 116990 - DNA, 25 bp, S. pombe
ttccagttactgcatgcggtgagaa

SEQ ID NO: 116991 - DNA, 25 bp, S. pombe
ttccacttcatcctcattggtaaga

SEQ ID NO: 116992 - DNA, 25 bp, S. pombe
ttgcacattagctgacttgtggtca

SEQ ID NO: 116993 - DNA, 25 bp, S. pombe
ttgcttgcaagcctttactcaaatg

SEQ ID NO: 116994 - DNA, 25 bp, S. pombe
ttgacgattcctgcaaaattcgctg

SEQ ID NO: 116995 - DNA, 25 bp, S. pombe
ttgaaatcacctgcaaaaccccaag

SEQ ID NO: 116996 - DNA, 25 bp, S. pombe
ttcctatttattggtctcggcgttt

SEQ ID NO: 116997 - DNA, 25 bp, S. pombe
ttcgcatcgttctttttctttcgca

SEQ ID NO: 116998 - DNA, 25 bp, S. pombe
ttctgctattgccttgtttctttaa

SEQ ID NO: 116999 - DNA, 25 bp, S. pombe
ttctctctttgggatttctttaatg

SEQ ID NO: 117000 - DNA, 25 bp, S. pombe
ttccctcagaggtacttcttataag

SEQ ID NO: 117001 - DNA, 25 bp, S. pombe
ttgtgaaagtccctatactctctct

SEQ ID NO: 117002 - DNA, 25 bp, S. pombe
ttgggaaacgtattacttctccgag

SEQ ID NO: 117003 - DNA, 25 bp, S. pombe
ttcccgagcttttcaatgcctgtaa

SEQ ID NO: 117004 - DNA, 25 bp, S. pombe
ttcctccaatgctttcaatcctgaa

SEQ ID NO: 117005 - DNA, 25 bp, S. pombe
ttcctctattatccgcattcctgaa

SEQ ID NO: 117006 - DNA, 25 bp, S. pombe
ttcctccatctttgccagtattgaa

SEQ ID NO: 117007 - DNA, 25 bp, S. pombe
ttcgctccagcaacccaaattgaag

SEQ ID NO: 117008 - DNA, 25 bp, S. pombe
ttcgcactctgcctgatggatcatg

SEQ ID NO: 117009 - DNA, 25 bp, S. pombe
ttctcgcaccatcaggatctttgaa

SEQ ID NO: 117010 - DNA, 25 bp, S. pombe
ttctcgacgattcgcaacttctttg

SEQ ID NO: 117011 - DNA, 25 bp, S. pombe
ttccgccgctagcaacatttttgaa

SEQ ID NO: 117012 - DNA, 25 bp, S. pombe
ttccattgcgtgagatgaactccga

SEQ ID NO: 117013 - DNA, 25 bp, S. pombe
ttccattgcgtgaaatgaatcctga

SEQ ID NO: 117014 - DNA, 25 bp, S. pombe
ttccttcatcttttgaaacgccttc

SEQ ID NO: 117015 - DNA, 25 bp, S. pombe
ttctcccatcgttcatgaagagcag

SEQ ID NO: 117016 - DNA, 25 bp, S. pombe
ttcccatcatggcagttaagcggtg

SEQ ID NO: 117017 - DNA, 25 bp, S. pombe
ttcgtggcggtgctgatcagtttat

SEQ ID NO: 117018 - DNA, 25 bp, S. pombe
ttcgtcacaggaagcgatcgcattc

SEQ ID NO: 117019 - DNA, 25 bp, S. pombe
ttctgcttgcgattccgatgttaat

SEQ ID NO: 117020 - DNA, 25 bp, S. pombe
ttgccttggcattccttcttatttc

SEQ ID NO: 117021 - DNA, 25 bp, S. pombe
ttgcttttatccttggtcgtggtga

SEQ ID NO: 117022 - DNA, 25 bp, S. pombe
ttcgttattcgaattgccggagtca

SEQ ID NO: 117023 - DNA, 25 bp, S. pombe
ttcgctctttggatagccctagata

SEQ ID NO: 117024 - DNA, 25 bp, S. pombe
ttcgcaattgcgttctcagcatgat

SEQ ID NO: 117025 - DNA, 25 bp, S. pombe
ttcgatgttgagttgcttgctatca

SEQ ID NO: 117026 - DNA, 25 bp, S. pombe
ttcgattgacgagtgctgctgccca

SEQ ID NO: 117027 - DNA, 25 bp, S. pombe
ttgaatggcatccaggtcgtcccga

SEQ ID NO: 117028 - DNA, 25 bp, S. pombe
ttgcaaggctgatctccgtaacgac

SEQ ID NO: 117029 - DNA, 25 bp, S. pombe
ttgcaagagctcttctacggaaccc

SEQ ID NO: 117030 - DNA, 25 bp, S. pombe
ttgaaacccttacgagagatcctcc

SEQ ID NO: 117031 - DNA, 25 bp, S. pombe
ttgaagacccttgcgactgaactca

SEQ ID NO: 117032 - DNA, 25 bp, S. pombe
ttggaaccctcgatggtgggctatt

SEQ ID NO: 117033 - DNA, 25 bp, S. pombe
ttgtagaacctcgactttcggtagt

SEQ ID NO: 117034 - DNA, 25 bp, S. pombe
ttccgcagtctctgatactgacgaa

SEQ ID NO: 117035 - DNA, 25 bp, S. pombe
ttcgcaaattgcatggagagtcaga

SEQ ID NO: 117036 - DNA, 25 bp, S. pombe
ttcgtagtccgcttgagattcgtga

SEQ ID NO: 117037 - DNA, 25 bp, S. pombe
ttcgtcgtctccgtgagatggttga

SEQ ID NO: 117038 - DNA, 25 bp, S. pombe
ttgcgctcccatcttgaatggacta

SEQ ID NO: 117039 - DNA, 25 bp, S. pombe
ttgccggcgatcgtcagattgttac

SEQ ID NO: 117040 - DNA, 25 bp, S. pombe
ttgctcgctcgttggaagtaatccc

SEQ ID NO: 117041 - DNA, 25 bp, S. pombe
ttgccttggatcctgacaattactg

SEQ ID NO: 117042 - DNA, 25 bp, S. pombe
ttgttatgccacctacacttagttc

SEQ ID NO: 117043 - DNA, 25 bp, S. pombe
ttgtttgtcaacattgcccttcagt

SEQ ID NO: 117044 - DNA, 25 bp, S. pombe
ttgatttaaagcatggcgcgccaag

SEQ ID NO: 117045 - DNA, 25 bp, S. pombe
ttgttctcaaactttgccgctcaaa

SEQ ID NO: 117046 - DNA, 25 bp, S. pombe
ttgtgctcctacctttcagtagcaa

SEQ ID NO: 117047 - DNA, 25 bp, S. pombe
ttgttcctgatccttacatttcacg

SEQ ID NO: 117048 - DNA, 25 bp, S. pombe
ttcggtcattctttgttcttttatt

SEQ ID NO: 117049 - DNA, 25 bp, S. pombe
ttcggttcatccaactgtcttttta

SEQ ID NO: 117050 - DNA, 25 bp, S. pombe
ttcgattatcccctgattcttcaag

SEQ ID NO: 117051 - DNA, 25 bp, S. pombe
ttccttcacgccctgtatttgacag

SEQ ID NO: 117052 - DNA, 25 bp, S. pombe
ttcgttcttctacctattgctatat

SEQ ID NO: 117053 - DNA, 25 bp, S. pombe
ttccagctgcgataggctctacagt

SEQ ID NO: 117054 - DNA, 25 bp, S. pombe
ttgtttctacaattgccggaccgaa

SEQ ID NO: 117055 - DNA, 25 bp, S. pombe
ttgtttctggttcccgtgacaagac

SEQ ID NO: 117056 - DNA, 25 bp, S. pombe
ttccttccgattcaggcgcacagaa

SEQ ID NO: 117057 - DNA, 25 bp, S. pombe
ttggattctcttatagcggccattc

SEQ ID NO: 117058 - DNA, 25 bp, S. pombe
ttcgatgtggcttttactcgcaaca

SEQ ID NO: 117059 - DNA, 25 bp, S. pombe
ttccttgcgttcttgactccaaaat

SEQ ID NO: 117060 - DNA, 25 bp, S. pombe
ttgcctcacctgctttacgagacaa

SEQ ID NO: 117061 - DNA, 25 bp, S. pombe
ttgcctgctacttattgtttgctaa

SEQ ID NO: 117062 - DNA, 25 bp, S. pombe
ttctgttctgtgctattgccttttt

SEQ ID NO: 117063 - DNA, 25 bp, S. pombe
ttctggatattcttctgacgctcga

SEQ ID NO: 117064 - DNA, 25 bp, S. pombe
ttcgtcctggcatttacactagtgg

SEQ ID NO: 117065 - DNA, 25 bp, S. pombe
ttcgctcctggacttaacattttgt

SEQ ID NO: 117066 - DNA, 25 bp, S. pombe
ttcctctctggatttgcaacacatt

SEQ ID NO: 117067 - DNA, 25 bp, S. pombe
ttcctcctggaatttatcatcgttt

SEQ ID NO: 117068 - DNA, 25 bp, S. pombe
ttcccggctcacaagataaggctga

SEQ ID NO: 117069 - DNA, 25 bp, S. pombe
ttgcgcgaaagccagaagccgtctt

SEQ ID NO: 117070 - DNA, 25 bp, S. pombe
ttctgtagaagttcagctctcggaa

SEQ ID NO: 117071 - DNA, 25 bp, S. pombe
ttgccgctcttttccgtggtaaagt

SEQ ID NO: 117072 - DNA, 25 bp, S. pombe
ttcgctgctcttttaccggtaaagg

SEQ ID NO: 117073 - DNA, 25 bp, S. pombe
ttccaatttccttaacagtagggtg

SEQ ID NO: 117074 - DNA, 25 bp, S. pombe
ttgcccttattttaccgttatcgtg

SEQ ID NO: 117075 - DNA, 25 bp, S. pombe
ttgcggaaatgcatgccgacaattt

SEQ ID NO: 117076 - DNA, 25 bp, S. pombe
ttccgctgatccgagtcttagtaaa

SEQ ID NO: 117077 - DNA, 25 bp, S. pombe
ttgcttctgctgtatgggtattcgt

SEQ ID NO: 117078 - DNA, 25 bp, S. pombe
ttgcatcaaattcggtaacctgaac

SEQ ID NO: 117079 - DNA, 25 bp, S. pombe
ttgtctatatcggtgattcccctac

SEQ ID NO: 117080 - DNA, 25 bp, S. pombe
ttgccttacgagtttgaccctgatt

SEQ ID NO: 117081 - DNA, 25 bp, S. pombe
ttcctggaggaatcgatgcttctaa

SEQ ID NO: 117082 - DNA, 25 bp, S. pombe
ttcctcaaggtattcgtgcttccat

SEQ ID NO: 117083 - DNA, 25 bp, S. pombe
ttcccagcagcgtatgtcttctata

SEQ ID NO: 117084 - DNA, 25 bp, S. pombe
ttgcctagtcgaggtatgctctcat

SEQ ID NO: 117085 - DNA, 25 bp, S. pombe
ttcgcatgctgttccaatatcttca

SEQ ID NO: 117086 - DNA, 25 bp, S. pombe
ttcctttcatcctatgtctatgcag

SEQ ID NO: 117087 - DNA, 25 bp, S. pombe
ttcgctctacacgtggtcttgaaaa

SEQ ID NO: 117088 - DNA, 25 bp, S. pombe
ttccttgcaatcgttgctcctaaag

SEQ ID NO: 117089 - DNA, 25 bp, S. pombe
ttcgcttttggcaatccctaaggat

SEQ ID NO: 117090 - DNA, 25 bp, S. pombe
ttgcctcttggtcatcctctaaaag

SEQ ID NO: 117091 - DNA, 25 bp, S. pombe
ttggcccggtgttgagctcgaataa

SEQ ID NO: 117092 - DNA, 25 bp, S. pombe
ttggcttgggtgttaccgcaatgct

SEQ ID NO: 117093 - DNA, 25 bp, S. pombe
ttcgtcttatgatcttcctgcgtat

SEQ ID NO: 117094 - DNA, 25 bp, S. pombe
ttcgataccaactttcctgcgctaa

SEQ ID NO: 117095 - DNA, 25 bp, S. pombe
ttgcgaatcggtcttcctgtgagaa

SEQ ID NO: 117096 - DNA, 25 bp, S. pombe
ttcgcctgataccatccataaacgt

SEQ ID NO: 117097 - DNA, 25 bp, S. pombe
ttcgccctcaataatccatcaataa

SEQ ID NO: 117098 - DNA, 25 bp, S. pombe
ttccgcagctgccaaggttgttata

SEQ ID NO: 117099 - DNA, 25 bp, S. pombe
ttccgccggagcaggttgttgatac

SEQ ID NO: 117100 - DNA, 25 bp, S. pombe
ttgccccggagtagcttggtgtaat

SEQ ID NO: 117101 - DNA, 25 bp, S. pombe
ttgccgtgccaacgacttgggtaat

SEQ ID NO: 117102 - DNA, 25 bp, S. pombe
ttgctcgtcacatttaccttcgtaa

SEQ ID NO: 117103 - DNA, 25 bp, S. pombe
ttggttcccttcctggaatggagac

SEQ ID NO: 117104 - DNA, 25 bp, S. pombe
ttcgttttcttccttacatgcgcaa

SEQ ID NO: 117105 - DNA, 25 bp, S. pombe
ttgggctttcctagtgtgggatatc

SEQ ID NO: 117106 - DNA, 25 bp, S. pombe
ttggcgcctttgcttgatagagata

SEQ ID NO: 117107 - DNA, 25 bp, S. pombe
ttgtgacccttgctgagatcatgcg

SEQ ID NO: 117108 - DNA, 25 bp, S. pombe
ttcccatcctttttactacagtcta

SEQ ID NO: 117109 - DNA, 25 bp, S. pombe
ttccctcttctttgtttcacagtaa

SEQ ID NO: 117110 - DNA, 25 bp, S. pombe
ttgctaactttcctccctaatgaat

SEQ ID NO: 117111 - DNA, 25 bp, S. pombe
ttcctggcgcttttaacggtattca

SEQ ID NO: 117112 - DNA, 25 bp, S. pombe
ttcggtgcagcttttaacctgtgtt

SEQ ID NO: 117113 - DNA, 25 bp, S. pombe
ttccctgcagatttagtcatccttg

SEQ ID NO: 117114 - DNA, 25 bp, S. pombe
ttccgaaaattctatctccgcatga

SEQ ID NO: 117115 - DNA, 25 bp, S. pombe
ttcgcaacagaaaattggcctatga

SEQ ID NO: 117116 - DNA, 25 bp, S. pombe
ttcgaacgattttgccgccattagc

SEQ ID NO: 117117 - DNA, 25 bp, S. pombe
ttccaccagatttatgccgcgtaag

SEQ ID NO: 117118 - DNA, 25 bp, S. pombe
ttcgcatctcaactttgtcgcttaa

SEQ ID NO: 117119 - DNA, 25 bp, S. pombe
ttcctctcaatctacgtctgcaaaa

SEQ ID NO: 117120 - DNA, 25 bp, S. pombe
ttcgctgaaacgtcttgctgaaaag

SEQ ID NO: 117121 - DNA, 25 bp, S. pombe
ttgttgcaaacccttctgaaattcg

SEQ ID NO: 117122 - DNA, 25 bp, S. pombe
ttgtcttcaaccgttcttagttttg

SEQ ID NO: 117123 - DNA, 25 bp, S. pombe
ttgaagatcactctcctgttaggga

SEQ ID NO: 117124 - DNA, 25 bp, S. pombe
ttgcaaaattgcgtcctggccagga

SEQ ID NO: 117125 - DNA, 25 bp, S. pombe
ttgcaaaacccgttggatccgaact

SEQ ID NO: 117126 - DNA, 25 bp, S. pombe
ttcgatttgcttattcccttgctga

SEQ ID NO: 117127 - DNA, 25 bp, S. pombe
ttgctttcagcaaatcttcccaaat

SEQ ID NO: 117128 - DNA, 25 bp, S. pombe
ttgcatatccaaccagtccagaaga

SEQ ID NO: 117129 - DNA, 25 bp, S. pombe
ttgcatgtccattccacttaaagat

SEQ ID NO: 117130 - DNA, 25 bp, S. pombe
ttgattctcaatccctatcgtacat

SEQ ID NO: 117131 - DNA, 25 bp, S. pombe
ttgataccatccgtcgtcgtatgat

SEQ ID NO: 117132 - DNA, 25 bp, S. pombe
ttgatcccaaagacgctcctgatga

SEQ ID NO: 117133 - DNA, 25 bp, S. pombe
ttgcacccagaattggctacgccaa

SEQ ID NO: 117134 - DNA, 25 bp, S. pombe
ttgatattcctctggcatggtcacc

SEQ ID NO: 117135 - DNA, 25 bp, S. pombe
ttgataatctctttgtgggtccctt

SEQ ID NO: 117136 - DNA, 25 bp, S. pombe
ttgcattactgctgtcatcgtgcgc

SEQ ID NO: 117137 - DNA, 25 bp, S. pombe
ttgcattatgatcggctacacagct

SEQ ID NO: 117138 - DNA, 25 bp, S. pombe
ttgagaagccaactctgtcagcgac

SEQ ID NO: 117139 - DNA, 25 bp, S. pombe
ttgcgagcagcctttcgcagacgaa

SEQ ID NO: 117140 - DNA, 25 bp, S. pombe
ttcgccgagccatacagctggaatt

SEQ ID NO: 117141 - DNA, 25 bp, S. pombe
ttggcctggctattaacttaacttc

SEQ ID NO: 117142 - DNA, 25 bp, S. pombe
ttggcttgtggtcaaaaggacacga

SEQ ID NO: 117143 - DNA, 25 bp, S. pombe
ttggctcttccacaagtagaaccca

SEQ ID NO: 117144 - DNA, 25 bp, S. pombe
ttgcctacccaaaagctagtactcc

SEQ ID NO: 117145 - DNA, 25 bp, S. pombe
ttgccgtctaattcaggctacatta

SEQ ID NO: 117146 - DNA, 25 bp, S. pombe
ttgacgttattgtgtgctcctccag

SEQ ID NO: 117147 - DNA, 25 bp, S. pombe
ttgacggagacgttgagtcccctca

SEQ ID NO: 117148 - DNA, 25 bp, S. pombe
ttgggagtgaatcctcgaccctact

SEQ ID NO: 117149 - DNA, 25 bp, S. pombe
ttgaagattgtcaccgatcctgtcc

SEQ ID NO: 117150 - DNA, 25 bp, S. pombe
ttgtttcaagcgatgcattaccggc

SEQ ID NO: 117151 - DNA, 25 bp, S. pombe
ttgtcatatccttttttaccgtgtt

SEQ ID NO: 117152 - DNA, 25 bp, S. pombe
ttgaacttcctttttggctggcaga

SEQ ID NO: 117153 - DNA, 25 bp, S. pombe
ttgataaccctttccgacggcagaa

SEQ ID NO: 117154 - DNA, 25 bp, S. pombe
ttgattcaccttctcttgacgcaga

SEQ ID NO: 117155 - DNA, 25 bp, S. pombe
ttgctaactctttacctggtcttgt

SEQ ID NO: 117156 - DNA, 25 bp, S. pombe
ttgtccacgctggtgcttagagttt

SEQ ID NO: 117157 - DNA, 25 bp, S. pombe
ttggagcacggcacttaagtcatat

SEQ ID NO: 117158 - DNA, 25 bp, S. pombe
ttggaatgcgtctcttgcaaataca

SEQ ID NO: 117159 - DNA, 25 bp, S. pombe
ttcgcaatggctttcactacgtaca

SEQ ID NO: 117160 - DNA, 25 bp, S. pombe
ttgcgcaagcgtttggtcacttatc

SEQ ID NO: 117161 - DNA, 25 bp, S. pombe
ttgcccggattgctgttccaaggaa

SEQ ID NO: 117162 - DNA, 25 bp, S. pombe
ttgctcttaacgcttacactcagga

SEQ ID NO: 117163 - DNA, 25 bp, S. pombe
ttgtcattaacgtttcctctcctaa

SEQ ID NO: 117164 - DNA, 25 bp, S. pombe
ttgctcaaaaggttggccgtcttcg

SEQ ID NO: 117165 - DNA, 25 bp, S. pombe
ttgctagaacgtttggctttgcctc

SEQ ID NO: 117166 - DNA, 25 bp, S. pombe
ttgataaaatcgcttccttcggctc

SEQ ID NO: 117167 - DNA, 25 bp, S. pombe
ttcccagatgcccagtttgatttgg

SEQ ID NO: 117168 - DNA, 25 bp, S. pombe
ttgaatatcaattggctcagcctat

SEQ ID NO: 117169 - DNA, 25 bp, S. pombe
ttgactgtcagttagctgctcacgt

SEQ ID NO: 117170 - DNA, 25 bp, S. pombe
ttgctggtcatttcaggctatgcgt

SEQ ID NO: 117171 - DNA, 25 bp, S. pombe
ttccgaattggctgtatggtcccac

SEQ ID NO: 117172 - DNA, 25 bp, S. pombe
ttccgaattggttgaatccgtccct

SEQ ID NO: 117173 - DNA, 25 bp, S. pombe
ttgccgaattattgggaccgtctcc

SEQ ID NO: 117174 - DNA, 25 bp, S. pombe
ttgattccacccaactggtagtgta

SEQ ID NO: 117175 - DNA, 25 bp, S. pombe
ttgagcattatgtggatctccattt

SEQ ID NO: 117176 - DNA, 25 bp, S. pombe
ttcgatgggcgttcattcattcaac

SEQ ID NO: 117177 - DNA, 25 bp, S. pombe
ttgcgatgtcgcgaattctttagaa

SEQ ID NO: 117178 - DNA, 25 bp, S. pombe
ttgcgcatgtcacaagtcgtatctg

SEQ ID NO: 117179 - DNA, 25 bp, S. pombe
ttgcattgtcccgttttcttgaaaa

SEQ ID NO: 117180 - DNA, 25 bp, S. pombe
ttcctgtccgtcgtctaatgagcaa

SEQ ID NO: 117181 - DNA, 25 bp, S. pombe
ttgcctgtgccgttgttaagcgtac

SEQ ID NO: 117182 - DNA, 25 bp, S. pombe
ttgccaatgctctggttcagggcta

SEQ ID NO: 117183 - DNA, 25 bp, S. pombe
ttgctagctctatgggacgggatac

SEQ ID NO: 117184 - DNA, 25 bp, S. pombe
ttccgctaattgtcgtggctggctt

SEQ ID NO: 117185 - DNA, 25 bp, S. pombe
ttccgcaagatattccgagctggct

SEQ ID NO: 117186 - DNA, 25 bp, S. pombe
ttcgctttccagatctccagaagaa

SEQ ID NO: 117187 - DNA, 25 bp, S. pombe
ttcgacgtatggttcctctgcaaag

SEQ ID NO: 117188 - DNA, 25 bp, S. pombe
ttgcgacggctacatccttgaaggt

SEQ ID NO: 117189 - DNA, 25 bp, S. pombe
ttgaaacggcttttctgcacactgc

SEQ ID NO: 117190 - DNA, 25 bp, S. pombe
ttgcgctcatccaaacttggtgggt

SEQ ID NO: 117191 - DNA, 25 bp, S. pombe
ttgccgagcccatcaggttgtggaa

SEQ ID NO: 117192 - DNA, 25 bp, S. pombe
ttggagccttccgaatttgttaata

SEQ ID NO: 117193 - DNA, 25 bp, S. pombe
ttggaccttccctatttaagctcga

SEQ ID NO: 117194 - DNA, 25 bp, S. pombe
ttgaggcactttctactgtacagct

SEQ ID NO: 117195 - DNA, 25 bp, S. pombe
ttgacactgtttaccaaaaagcgac

SEQ ID NO: 117196 - DNA, 25 bp, S. pombe
ttgccggtttaccttcatcaggaga

SEQ ID NO: 117197 - DNA, 25 bp, S. pombe
ttcctcccatgatgcgtctagtgaa

SEQ ID NO: 117198 - DNA, 25 bp, S. pombe
ttgccttgcttactccttatgataa

SEQ ID NO: 117199 - DNA, 25 bp, S. pombe
ttccgctgccaacgttcgatataga

SEQ ID NO: 117200 - DNA, 25 bp, S. pombe
ttccttccaacgttgcagctgtata

SEQ ID NO: 117201 - DNA, 25 bp, S. pombe
ttcctttcttggttgagctttgcag

SEQ ID NO: 117202 - DNA, 25 bp, S. pombe
ttccaattcctgctaactcattcaa

SEQ ID NO: 117203 - DNA, 25 bp, S. pombe
ttccaagttggcgttgactatgaaa

SEQ ID NO: 117204 - DNA, 25 bp, S. pombe
ttccaatttggcaccgactctaaaa

SEQ ID NO: 117205 - DNA, 25 bp, S. pombe
ttccttttgagcacacacacacttt

SEQ ID NO: 117206 - DNA, 25 bp, S. pombe
ttccttcgctgtttaccaagacgtt

SEQ ID NO: 117207 - DNA, 25 bp, S. pombe
ttgcctttcgtaacccttatcatta

SEQ ID NO: 117208 - DNA, 25 bp, S. pombe
ttgagtaccgttaccactttcttag

SEQ ID NO: 117209 - DNA, 25 bp, S. pombe
ttgggaaactttcacttctgctgtc

SEQ ID NO: 117210 - DNA, 25 bp, S. pombe
ttggcggatacctcgatgatagtta

SEQ ID NO: 117211 - DNA, 25 bp, S. pombe
ttggatgtaatccatcgccttcagc

SEQ ID NO: 117212 - DNA, 25 bp, S. pombe
ttgctcctagctccatgaaggtcaa

SEQ ID NO: 117213 - DNA, 25 bp, S. pombe
ttgtcacttggcgatgcagcagcgg

SEQ ID NO: 117214 - DNA, 25 bp, S. pombe
ttgaagctcctgaagacgcatctgc

SEQ ID NO: 117215 - DNA, 25 bp, S. pombe
ttgattggcgtactcacacagcatt

SEQ ID NO: 117216 - DNA, 25 bp, S. pombe
ttgtcttcatttgttcgagggcagc

SEQ ID NO: 117217 - DNA, 25 bp, S. pombe
ttgcatgttttgtcattgcccaatt

SEQ ID NO: 117218 - DNA, 25 bp, S. pombe
ttgctctcgctgaagatgctccaga

SEQ ID NO: 117219 - DNA, 25 bp, S. pombe
ttgctgtgcgacaaagccgatgcat

SEQ ID NO: 117220 - DNA, 25 bp, S. pombe
ttggattcctccgacagcaatgtat

SEQ ID NO: 117221 - DNA, 25 bp, S. pombe
ttccttccctgttggtttcaagaat

SEQ ID NO: 117222 - DNA, 25 bp, S. pombe
ttcgcttccaggttggtaccagaga

SEQ ID NO: 117223 - DNA, 25 bp, S. pombe
ttgacatattcacccctgtagtcga

SEQ ID NO: 117224 - DNA, 25 bp, S. pombe
ttgccttctctcctgacggaaaata

SEQ ID NO: 117225 - DNA, 25 bp, S. pombe
ttcctccctcatcacggtagaagag

SEQ ID NO: 117226 - DNA, 25 bp, S. pombe
ttgcccgagatcaccagtgttttag

SEQ ID NO: 117227 - DNA, 25 bp, S. pombe
ttgctccgttcctggtggtcttaaa

SEQ ID NO: 117228 - DNA, 25 bp, S. pombe
ttgcccctcacctagagttgtttta

SEQ ID NO: 117229 - DNA, 25 bp, S. pombe
ttgttttacattccattctttcccg

SEQ ID NO: 117230 - DNA, 25 bp, S. pombe
ttgttgtttcttctcatttccatcg

SEQ ID NO: 117231 - DNA, 25 bp, S. pombe
ttgatggttttcctttttggctctc

SEQ ID NO: 117232 - DNA, 25 bp, S. pombe
ttgcggcctgttctttttggaccaa

SEQ ID NO: 117233 - DNA, 25 bp, S. pombe
ttggcacctttggagctagattcta

SEQ ID NO: 117234 - DNA, 25 bp, S. pombe
ttccctttctaattcagctgcatca

SEQ ID NO: 117235 - DNA, 25 bp, S. pombe
ttgacatttgtccaccagttgctgg

SEQ ID NO: 117236 - DNA, 25 bp, S. pombe
ttgacatctcggactccattgtgcg

SEQ ID NO: 117237 - DNA, 25 bp, S. pombe
ttgatgccgtcgtaccaactggaga

SEQ ID NO: 117238 - DNA, 25 bp, S. pombe
ttgacgaagctaccagccttggcta

SEQ ID NO: 117239 - DNA, 25 bp, S. pombe
ttggcattgcactttcgaaataccg

SEQ ID NO: 117240 - DNA, 25 bp, S. pombe
ttggattcactcacggaagacgcta

SEQ ID NO: 117241 - DNA, 25 bp, S. pombe
ttgcagttcctccaagaaatctctc

SEQ ID NO: 117242 - DNA, 25 bp, S. pombe
ttgtgtctttcttaaaccggcggct

SEQ ID NO: 117243 - DNA, 25 bp, S. pombe
ttgtctactatttacgaacgtgccg

SEQ ID NO: 117244 - DNA, 25 bp, S. pombe
ttgcctgccgtagtatttcctgtga

SEQ ID NO: 117245 - DNA, 25 bp, S. pombe
ttgcgctcaggtctatttcctacaa

SEQ ID NO: 117246 - DNA, 25 bp, S. pombe
ttccacatcggtgatttccccagat

SEQ ID NO: 117247 - DNA, 25 bp, S. pombe
ttgctcccgaagttcttactcagaa

SEQ ID NO: 117248 - DNA, 25 bp, S. pombe
ttgaacactaccttgaactctttcc

SEQ ID NO: 117249 - DNA, 25 bp, S. pombe
ttgccgagtacgttggattttcacc

SEQ ID NO: 117250 - DNA, 25 bp, S. pombe
ttccgatttggatgctgaatttact

SEQ ID NO: 117251 - DNA, 25 bp, S. pombe
ttccgtccattgtcgataagcagct

SEQ ID NO: 117252 - DNA, 25 bp, S. pombe
ttgccgctgccattgcttataattg

SEQ ID NO: 117253 - DNA, 25 bp, S. pombe
ttgcgctcgcacttctcaaaaatgg

SEQ ID NO: 117254 - DNA, 25 bp, S. pombe
ttgctcagcgcttgcatccagaata

SEQ ID NO: 117255 - DNA, 25 bp, S. pombe
ttgctgccgctactgctggacaagt

SEQ ID NO: 117256 - DNA, 25 bp, S. pombe
ttccacctgcgaatatgtccttatt

SEQ ID NO: 117257 - DNA, 25 bp, S. pombe
ttgccaaccatgttatgtcgctttt

SEQ ID NO: 117258 - DNA, 25 bp, S. pombe
ttgtcaaccatgtgaacgccatcgt

SEQ ID NO: 117259 - DNA, 25 bp, S. pombe
ttgcaatcccagatgctgagacttt

SEQ ID NO: 117260 - DNA, 25 bp, S. pombe
ttgcttctatccgatgaccgatggg

SEQ ID NO: 117261 - DNA, 25 bp, S. pombe
ttgctttctgcagagacggcgggat

SEQ ID NO: 117262 - DNA, 25 bp, S. pombe
ttgtggtcagtgtagcggcgctttt

SEQ ID NO: 117263 - DNA, 25 bp, S. pombe
ttgcttgcaagttcgctgagctcat

SEQ ID NO: 117264 - DNA, 25 bp, S. pombe
ttgcgatgtgtgtacgagctgcctc

SEQ ID NO: 117265 - DNA, 25 bp, S. pombe
ttggagattccgatagccctaagca

SEQ ID NO: 117266 - DNA, 25 bp, S. pombe
ttggagcttcggctgcattttagca

SEQ ID NO: 117267 - DNA, 25 bp, S. pombe
ttgccatgcttggtcttgtcaacaa

SEQ ID NO: 117268 - DNA, 25 bp, S. pombe
ttgctttgggcggtgcactcaagaa

SEQ ID NO: 117269 - DNA, 25 bp, S. pombe
ttgctcctggacgatctactcaaaa

SEQ ID NO: 117270 - DNA, 25 bp, S. pombe
ttgccctgctgctgattgcaacaaa

SEQ ID NO: 117271 - DNA, 25 bp, S. pombe
ttggagacctactttcaatgttgaa

SEQ ID NO: 117272 - DNA, 25 bp, S. pombe
ttgggcatcaacatcttttttacct

SEQ ID NO: 117273 - DNA, 25 bp, S. pombe
ttggccaactcgacccagtaaattg

SEQ ID NO: 117274 - DNA, 25 bp, S. pombe
ttggatcgtgagtttgctacccgac

SEQ ID NO: 117275 - DNA, 25 bp, S. pombe
ttggttggacagactgctatcccga

SEQ ID NO: 117276 - DNA, 25 bp, S. pombe
ttggattggacattctctctcaacc

SEQ ID NO: 117277 - DNA, 25 bp, S. pombe
ttggaatggcgcttcatcacatgaa

SEQ ID NO: 117278 - DNA, 25 bp, S. pombe
ttgcgcggccatttgaacaacatcc

SEQ ID NO: 117279 - DNA, 25 bp, S. pombe
ttgcctggcattttgaacaaccttg

SEQ ID NO: 117280 - DNA, 25 bp, S. pombe
ttgccgttcttacaatgactccaac

SEQ ID NO: 117281 - DNA, 25 bp, S. pombe
ttgcgcgtgctcaagaaattcccca

SEQ ID NO: 117282 - DNA, 25 bp, S. pombe
ttgttggtcgtatattccccactgg

SEQ ID NO: 117283 - DNA, 25 bp, S. pombe
ttgttggcttgggttctcgtgttaa

SEQ ID NO: 117284 - DNA, 25 bp, S. pombe
ttgtttgtttttgctcggtctatga

SEQ ID NO: 117285 - DNA, 25 bp, S. pombe
ttgtgagaacgttaagctgctttta

SEQ ID NO: 117286 - DNA, 25 bp, S. pombe
ttgctagcagtgacggtgacttctc

SEQ ID NO: 117287 - DNA, 25 bp, S. pombe
ttgatacctgtctttgtcttcatgc

SEQ ID NO: 117288 - DNA, 25 bp, S. pombe
ttgatgcacctttgcttattgcgca

SEQ ID NO: 117289 - DNA, 25 bp, S. pombe
ttgctcacatctttgcttctttcaa

SEQ ID NO: 117290 - DNA, 25 bp, S. pombe
ttgtcacatcatttatttgctggtc

SEQ ID NO: 117291 - DNA, 25 bp, S. pombe
ttgttcgctaagtttgctgctgtct

SEQ ID NO: 117292 - DNA, 25 bp, S. pombe
ttgcatgctttaacgttgacttacg

SEQ ID NO: 117293 - DNA, 25 bp, S. pombe
ttgctgctttttgtcattttcacgg

SEQ ID NO: 117294 - DNA, 25 bp, S. pombe
ttgccattgcatatcccaactacaa

SEQ ID NO: 117295 - DNA, 25 bp, S. pombe
ttgctctgtgtgtctacctaatttt

SEQ ID NO: 117296 - DNA, 25 bp, S. pombe
ttgcctgccatttaccctaatattt

SEQ ID NO: 117297 - DNA, 25 bp, S. pombe
ttgacgcggctgaaaaccatagttt

SEQ ID NO: 117298 - DNA, 25 bp, S. pombe
ttccgatcaagcaaagccccatgaa

SEQ ID NO: 117299 - DNA, 25 bp, S. pombe
ttgcgcaatcaacaagcctctcaat

SEQ ID NO: 117300 - DNA, 25 bp, S. pombe
ttgtttctcacattaccgaatctcc

SEQ ID NO: 117301 - DNA, 25 bp, S. pombe
ttgtttcaagcatggcgcgaacccg

SEQ ID NO: 117302 - DNA, 25 bp, S. pombe
ttgtcttcacaatgccggcaacgat

SEQ ID NO: 117303 - DNA, 25 bp, S. pombe
ttgtctccaaattcggaagacgtcc

SEQ ID NO: 117304 - DNA, 25 bp, S. pombe
ttgttcgcaatttcgtaagccctcg

SEQ ID NO: 117305 - DNA, 25 bp, S. pombe
ttccgaatcttccttatccgatgat

SEQ ID NO: 117306 - DNA, 25 bp, S. pombe
ttgcagtaacttctctaccgatcat

SEQ ID NO: 117307 - DNA, 25 bp, S. pombe
ttgtcgctgttattcgcatttggat

SEQ ID NO: 117308 - DNA, 25 bp, S. pombe
ttgacagtgataactctctcttgag

SEQ ID NO: 117309 - DNA, 25 bp, S. pombe
ttgagtatgataactggcccggttt

SEQ ID NO: 117310 - DNA, 25 bp, S. pombe
ttgtagtatcaattgcttcaccccg

SEQ ID NO: 117311 - DNA, 25 bp, S. pombe
ttgttgcgtcaatcttaccctatga

SEQ ID NO: 117312 - DNA, 25 bp, S. pombe
ttgcgcccacaaattcatgtccttt

SEQ ID NO: 117313 - DNA, 25 bp, S. pombe
ttgcccgccaagatccatttaatga

SEQ ID NO: 117314 - DNA, 25 bp, S. pombe
ttgcctcgcccatattcaatttaga

SEQ ID NO: 117315 - DNA, 25 bp, S. pombe
ttcctcgcttccaattcaattcatt

SEQ ID NO: 117316 - DNA, 25 bp, S. pombe
ttgcgcttcaaaaagtatccatggg

SEQ ID NO: 117317 - DNA, 25 bp, S. pombe
ttgtctaagagcacacttcccatag

SEQ ID NO: 117318 - DNA, 25 bp, S. pombe
ttgattaagcgtacctttcctgacc

SEQ ID NO: 117319 - DNA, 25 bp, S. pombe
ttgcatgcctcatttccaaattcag

SEQ ID NO: 117320 - DNA, 25 bp, S. pombe
ttgctcatgctcttttacagcctga

SEQ ID NO: 117321 - DNA, 25 bp, S. pombe
ttgaagctcttcttagcgcctggag

SEQ ID NO: 117322 - DNA, 25 bp, S. pombe
ttgccggctatgctactgcagaatt

SEQ ID NO: 117323 - DNA, 25 bp, S. pombe
ttggaccaaggcagtcaagcacttt

SEQ ID NO: 117324 - DNA, 25 bp, S. pombe
ttggaacgcagtctccaaagccttc

SEQ ID NO: 117325 - DNA, 25 bp, S. pombe
ttgagcaatccgctgtcattaatga

SEQ ID NO: 117326 - DNA, 25 bp, S. pombe
ttggcttccgccagtatagatgaaa

SEQ ID NO: 117327 - DNA, 25 bp, S. pombe
ttgtagcccaagacgaagtgcccga

SEQ ID NO: 117328 - DNA, 25 bp, S. pombe
ttgataatgatacgcctccattgcc

SEQ ID NO: 117329 - DNA, 25 bp, S. pombe
ttgatccattagaggctgcgcaggc

SEQ ID NO: 117330 - DNA, 25 bp, S. pombe
ttgacgataagacgtacggccctta

SEQ ID NO: 117331 - DNA, 25 bp, S. pombe
ttgccacacaattttactcttccat

SEQ ID NO: 117332 - DNA, 25 bp, S. pombe
ttgccatgacctacaacgcttatgt

SEQ ID NO: 117333 - DNA, 25 bp, S. pombe
ttgacggcagcctcatgattgtggg

SEQ ID NO: 117334 - DNA, 25 bp, S. pombe
ttgacttagactacactctgtggcc

SEQ ID NO: 117335 - DNA, 25 bp, S. pombe
ttgatgcttaactgcctatgggaat

SEQ ID NO: 117336 - DNA, 25 bp, S. pombe
ttgatgtctctacttcaccattaag

SEQ ID NO: 117337 - DNA, 25 bp, S. pombe
ttgcgtgcatcttcgtcatacttaa

SEQ ID NO: 117338 - DNA, 25 bp, S. pombe
ttgctggcactgactcttacggaat

SEQ ID NO: 117339 - DNA, 25 bp, S. pombe
ttgcgctcaatgttagtacggatct

SEQ ID NO: 117340 - DNA, 25 bp, S. pombe
ttgctaatagttctcctccgtggaa

SEQ ID NO: 117341 - DNA, 25 bp, S. pombe
ttgcaaaacctgtctcttcttggga

SEQ ID NO: 117342 - DNA, 25 bp, S. pombe
ttgaagaagcactctctccgtgact

SEQ ID NO: 117343 - DNA, 25 bp, S. pombe
ttgataccagcagagcacatcgcgt

SEQ ID NO: 117344 - DNA, 25 bp, S. pombe
ttggacacgttgatcccgaagcaca

SEQ ID NO: 117345 - DNA, 25 bp, S. pombe
ttggaatcgtctctcatgccgaaaa

SEQ ID NO: 117346 - DNA, 25 bp, S. pombe
ttgcggcctgcaatcgcttaacaaa

SEQ ID NO: 117347 - DNA, 25 bp, S. pombe
ttgacatctcatccggacaattctt

SEQ ID NO: 117348 - DNA, 25 bp, S. pombe
ttgtttctgccttaaattctgctcc

SEQ ID NO: 117349 - DNA, 25 bp, S. pombe
ttgaatgtcggctttggtcttggaa

SEQ ID NO: 117350 - DNA, 25 bp, S. pombe
ttgacattcgtgtccgtgtctctgg

SEQ ID NO: 117351 - DNA, 25 bp, S. pombe
ttggactcgatctcgttcaatggct

SEQ ID NO: 117352 - DNA, 25 bp, S. pombe
ttgggttagcccgttcaattggaat

SEQ ID NO: 117353 - DNA, 25 bp, S. pombe
ttgggtaatgccgtttctctcgaaa

SEQ ID NO: 117354 - DNA, 25 bp, S. pombe
ttgggcttatgggtatgtctcggat

SEQ ID NO: 117355 - DNA, 25 bp, S. pombe
ttggatttagcgttggttcggctcc

SEQ ID NO: 117356 - DNA, 25 bp, S. pombe
ttgtgatttagtttggtccgaccct

SEQ ID NO: 117357 - DNA, 25 bp, S. pombe
ttgctaatttggtttcttccaccct

SEQ ID NO: 117358 - DNA, 25 bp, S. pombe
ttgtaacttgcctatttcccttgat

SEQ ID NO: 117359 - DNA, 25 bp, S. pombe
ttgtaactccttgttctcctggtga

SEQ ID NO: 117360 - DNA, 25 bp, S. pombe
ttgtaccttttattcactgcctttg

SEQ ID NO: 117361 - DNA, 25 bp, S. pombe
ttggtggcattaacattcccctttt

SEQ ID NO: 117362 - DNA, 25 bp, S. pombe
ttgcatcaaaacttcttcgtcttcc

SEQ ID NO: 117363 - DNA, 25 bp, S. pombe
ttgcgcaacgacagcatgggacttg

SEQ ID NO: 117364 - DNA, 25 bp, S. pombe
ttgcgcaccgatcattcgaagcttt

SEQ ID NO: 117365 - DNA, 25 bp, S. pombe
ttggtccaaagcgtgcctctaagat

SEQ ID NO: 117366 - DNA, 25 bp, S. pombe
ttgtctataaatcctgcttctacta

SEQ ID NO: 117367 - DNA, 25 bp, S. pombe
ttgtttcaacatcgccttctgggaa

SEQ ID NO: 117368 - DNA, 25 bp, S. pombe
ttgcccaaacctcagcctaaaaatg

SEQ ID NO: 117369 - DNA, 25 bp, S. pombe
ttgccgcgcaaccaagaggtacaaa

SEQ ID NO: 117370 - DNA, 25 bp, S. pombe
ttgacgctcaccctggtggtgaaga

SEQ ID NO: 117371 - DNA, 25 bp, S. pombe
ttgaagatctcccttctcgtacaat

SEQ ID NO: 117372 - DNA, 25 bp, S. pombe
ttgagggattcgtttcttccagcat

SEQ ID NO: 117373 - DNA, 25 bp, S. pombe
ttgcttgtttgtttccctacacaga

SEQ ID NO: 117374 - DNA, 25 bp, S. pombe
ttgtgtgattgactacttccctgca

SEQ ID NO: 117375 - DNA, 25 bp, S. pombe
ttgcggatagcatacgttctctcag

SEQ ID NO: 117376 - DNA, 25 bp, S. pombe
ttgctggattccaacgatacatcgt

SEQ ID NO: 117377 - DNA, 25 bp, S. pombe
ttgtcggcgaaacctttccaatacg

SEQ ID NO: 117378 - DNA, 25 bp, S. pombe
ttgagcgtctaaaccttttccatac

SEQ ID NO: 117379 - DNA, 25 bp, S. pombe
ttggctttcggcagctatttgggaa

SEQ ID NO: 117380 - DNA, 25 bp, S. pombe
ttggcttctccctatgcaattttag

SEQ ID NO: 117381 - DNA, 25 bp, S. pombe
ttgttcacatagctccaggtgctga

SEQ ID NO: 117382 - DNA, 25 bp, S. pombe
ttgcctctcaaactatcgcattgtt

SEQ ID NO: 117383 - DNA, 25 bp, S. pombe
ttgcagttatgcacctgacatgagt

SEQ ID NO: 117384 - DNA, 25 bp, S. pombe
ttggcgcgtcgacatgacaatgatt

SEQ ID NO: 117385 - DNA, 25 bp, S. pombe
ttggccactcgcattgtcaagcatg

SEQ ID NO: 117386 - DNA, 25 bp, S. pombe
ttggcgatgttatccatgcacttgg

SEQ ID NO: 117387 - DNA, 25 bp, S. pombe
ttggcaactgttttggagatcctag

SEQ ID NO: 117388 - DNA, 25 bp, S. pombe
ttggacgcatttgactatcgctggc

SEQ ID NO: 117389 - DNA, 25 bp, S. pombe
ttgttgccagagatcgcttccttgc

SEQ ID NO: 117390 - DNA, 25 bp, S. pombe
ttgttccaggagactttcacgatgt

SEQ ID NO: 117391 - DNA, 25 bp, S. pombe
ttgttacacacgagcttccatggat

SEQ ID NO: 117392 - DNA, 25 bp, S. pombe
ttgcattcttcgactacatatccac

SEQ ID NO: 117393 - DNA, 25 bp, S. pombe
ttgatgttatccttcctaaacaccc

SEQ ID NO: 117394 - DNA, 25 bp, S. pombe
ttgttaatgcatttgccattcccct

SEQ ID NO: 117395 - DNA, 25 bp, S. pombe
ttgttggtgcatttcgagagccctg

SEQ ID NO: 117396 - DNA, 25 bp, S. pombe
ttggctggtgcttgtgcgattacta

SEQ ID NO: 117397 - DNA, 25 bp, S. pombe
ttgtgagggtgctgtttttggaaac

SEQ ID NO: 117398 - DNA, 25 bp, S. pombe
ttgtcatgggtgcttctttccgtaa

SEQ ID NO: 117399 - DNA, 25 bp, S. pombe
ttgtcaatacttacggcacttcttc

SEQ ID NO: 117400 - DNA, 25 bp, S. pombe
ttgtaatactttcttcgtctcctta

SEQ ID NO: 117401 - DNA, 25 bp, S. pombe
ttggaatccttgttttctggtgctc

SEQ ID NO: 117402 - DNA, 25 bp, S. pombe
ttgaaaactcatctacctctgacac

SEQ ID NO: 117403 - DNA, 25 bp, S. pombe
ttgaaaatgccgctgttgctgctac

SEQ ID NO: 117404 - DNA, 25 bp, S. pombe
ttgaacaatcggctactctgtattt

SEQ ID NO: 117405 - DNA, 25 bp, S. pombe
ttgaaaacagctcgcagaaccttcc

SEQ ID NO: 117406 - DNA, 25 bp, S. pombe
ttgtaaaagcatgcgcacctctgtt

SEQ ID NO: 117407 - DNA, 25 bp, S. pombe
ttgaaagtgtcgattttcccggctc

SEQ ID NO: 117408 - DNA, 25 bp, S. pombe
ttgcaaaattttatgtccctctccc

SEQ ID NO: 117409 - DNA, 25 bp, S. pombe
ttgcccaagacctttcaactggatg

SEQ ID NO: 117410 - DNA, 25 bp, S. pombe
ttgactcaaacccttcctatagatg

SEQ ID NO: 117411 - DNA, 25 bp, S. pombe
ttgttacacctttctctgctaaaac

SEQ ID NO: 117412 - DNA, 25 bp, S. pombe
ttgtctacactccttcgatgctcag

SEQ ID NO: 117413 - DNA, 25 bp, S. pombe
ttgtcactgaagtcgatcccatcaa

SEQ ID NO: 117414 - DNA, 25 bp, S. pombe
ttgcagaacctgtcaagattcccgt

SEQ ID NO: 117415 - DNA, 25 bp, S. pombe
ttgcaggtgccgtagatagatcttc

SEQ ID NO: 117416 - DNA, 25 bp, S. pombe
ttgcttctgctcctaatggatcttt

SEQ ID NO: 117417 - DNA, 25 bp, S. pombe
ttgctttaccgaagtgtctttacac

SEQ ID NO: 117418 - DNA, 25 bp, S. pombe
ttccaaatcgccttcataactcaaa

SEQ ID NO: 117419 - DNA, 25 bp, S. pombe
ttgctcacaactgcgttaggccaaa

SEQ ID NO: 117420 - DNA, 25 bp, S. pombe
ttgtcactccctggttagatggcaa

SEQ ID NO: 117421 - DNA, 25 bp, S. pombe
ttgggatacgctggctacttggtaa

SEQ ID NO: 117422 - DNA, 25 bp, S. pombe
ttggcagtcaactttcacttggctt

SEQ ID NO: 117423 - DNA, 25 bp, S. pombe
ttgaaagtccagatgccgcaggcgt

SEQ ID NO: 117424 - DNA, 25 bp, S. pombe
ttgacaagtatcgtccccaactgta

SEQ ID NO: 117425 - DNA, 25 bp, S. pombe
ttgaccgtcaagttggccaagccta

SEQ ID NO: 117426 - DNA, 25 bp, S. pombe
ttgaccagtacacttgctgctgcta

SEQ ID NO: 117427 - DNA, 25 bp, S. pombe
ttgcatctgcatcatgagcgtccta

SEQ ID NO: 117428 - DNA, 25 bp, S. pombe
ttgcttgctcctgcagattctgata

SEQ ID NO: 117429 - DNA, 25 bp, S. pombe
ttgcttgcctcttgacatctcggac

SEQ ID NO: 117430 - DNA, 25 bp, S. pombe
ttgtgcgagcatcatttggttcctt

SEQ ID NO: 117431 - DNA, 25 bp, S. pombe
ttgaaccactttcatcttcttcaga

SEQ ID NO: 117432 - DNA, 25 bp, S. pombe
ttgatctcccgcagttctttattga

SEQ ID NO: 117433 - DNA, 25 bp, S. pombe
ttgttcctgcccttgttgtaaaaca

SEQ ID NO: 117434 - DNA, 25 bp, S. pombe
ttggtccccttttatgaaagcttag

SEQ ID NO: 117435 - DNA, 25 bp, S. pombe
ttggccctcactgctttaaagcgaa

SEQ ID NO: 117436 - DNA, 25 bp, S. pombe
ttgtccttcttcctttgaaccagaa

SEQ ID NO: 117437 - DNA, 25 bp, S. pombe
ttgcccatgtttcctttgctactat

SEQ ID NO: 117438 - DNA, 25 bp, S. pombe
ttgcttgggcattggtacgctcaga

SEQ ID NO: 117439 - DNA, 25 bp, S. pombe
ttgctttgcgcaaggcctgtgataa

SEQ ID NO: 117440 - DNA, 25 bp, S. pombe
ttgtgcgttcttgaccgtgatggaa

SEQ ID NO: 117441 - DNA, 25 bp, S. pombe
ttgtttttgctaatccgacgcccaa

SEQ ID NO: 117442 - DNA, 25 bp, S. pombe
ttgacgttcgccaaagccacggagg

SEQ ID NO: 117443 - DNA, 25 bp, S. pombe
ttgacttacccaaagccacgaattt

SEQ ID NO: 117444 - DNA, 25 bp, S. pombe
ttggtcgactcttcgcccttatact

SEQ ID NO: 117445 - DNA, 25 bp, S. pombe
ttgcttgggcctttgatccttataa

SEQ ID NO: 117446 - DNA, 25 bp, S. pombe
ttgttggagattatccacgccctca

SEQ ID NO: 117447 - DNA, 25 bp, S. pombe
ttgtttttctgcttcctcgagaagt

SEQ ID NO: 117448 - DNA, 25 bp, S. pombe
ttgcgtttccaatcctccgcaattg

SEQ ID NO: 117449 - DNA, 25 bp, S. pombe
ttggctttacaatctcatcgtcctt

SEQ ID NO: 117450 - DNA, 25 bp, S. pombe
ttgatttatcgtccaactcttcttg

SEQ ID NO: 117451 - DNA, 25 bp, S. pombe
ttgctcgccttctagcaaacgaagt

SEQ ID NO: 117452 - DNA, 25 bp, S. pombe
ttgtatccttcttggacttggcaaa

SEQ ID NO: 117453 - DNA, 25 bp, S. pombe
ttgaaagttcaacgacgagtcacaa

SEQ ID NO: 117454 - DNA, 25 bp, S. pombe
ttgaaggtgctcaaccacagtggga

SEQ ID NO: 117455 - DNA, 25 bp, S. pombe
ttgaaggtatcattcccgctttgga

SEQ ID NO: 117456 - DNA, 25 bp, S. pombe
ttgcaactagttacgccgctcttat

SEQ ID NO: 117457 - DNA, 25 bp, S. pombe
ttgcaccgaatgaatccctcttaaa

SEQ ID NO: 117458 - DNA, 25 bp, S. pombe
ttgattctgctattcgccgacgttt

SEQ ID NO: 117459 - DNA, 25 bp, S. pombe
ttgttcctcatacgctgctaatgtt

SEQ ID NO: 117460 - DNA, 25 bp, S. pombe
ttgtgtatcatcaacagctaatagt

SEQ ID NO: 117461 - DNA, 25 bp, S. pombe
ttggcatatccaacacttgatcaga

SEQ ID NO: 117462 - DNA, 25 bp, S. pombe
ttggcatgtttcagcttctcccgaa

SEQ ID NO: 117463 - DNA, 25 bp, S. pombe
ttggagattctcactgttcactgtg

SEQ ID NO: 117464 - DNA, 25 bp, S. pombe
ttgaagtgtctcctccttacgatga

SEQ ID NO: 117465 - DNA, 25 bp, S. pombe
ttgaagctgcacagcccttaactat

SEQ ID NO: 117466 - DNA, 25 bp, S. pombe
ttgcgtctcaacaagtgggcaagtt

SEQ ID NO: 117467 - DNA, 25 bp, S. pombe
ttgcgctctcaagtagctcgtcaaa

SEQ ID NO: 117468 - DNA, 25 bp, S. pombe
ttgctgcctgtggtcctcgtgaaga

SEQ ID NO: 117469 - DNA, 25 bp, S. pombe
ttgctgctctttgctatctggataa

SEQ ID NO: 117470 - DNA, 25 bp, S. pombe
ttgtgatgctgctcgcaactggtaa

SEQ ID NO: 117471 - DNA, 25 bp, S. pombe
ttggctgtcacagaagctgttatgg

SEQ ID NO: 117472 - DNA, 25 bp, S. pombe
ttgtggtcagagtcatcaatgtcta

SEQ ID NO: 117473 - DNA, 25 bp, S. pombe
ttgggactacgacctttctatagcg

SEQ ID NO: 117474 - DNA, 25 bp, S. pombe
ttggtatctacgcatcttcctgaag

SEQ ID NO: 117475 - DNA, 25 bp, S. pombe
ttgcgcgcccttatttccgaaaatg

SEQ ID NO: 117476 - DNA, 25 bp, S. pombe
ttgaccttttttgtgtatgaatgga

SEQ ID NO: 117477 - DNA, 25 bp, S. pombe
ttgacccttctactttgtctggtaa

SEQ ID NO: 117478 - DNA, 25 bp, S. pombe
ttgactccgttcgaatgtggcttga

SEQ ID NO: 117479 - DNA, 25 bp, S. pombe
ttgctgtcttgataccttgctttat

SEQ ID NO: 117480 - DNA, 25 bp, S. pombe
ttgcgtctatgatttccggctttaa

SEQ ID NO: 117481 - DNA, 25 bp, S. pombe
ttggtttggtcttcaagctcctgaa

SEQ ID NO: 117482 - DNA, 25 bp, S. pombe
ttgttacaggatctccttggagcct

SEQ ID NO: 117483 - DNA, 25 bp, S. pombe
ttgttgacggatgccgatcgtacct

SEQ ID NO: 117484 - DNA, 25 bp, S. pombe
ttggaacaccctctttgtcatagtg

SEQ ID NO: 117485 - DNA, 25 bp, S. pombe
ttggtcctcctgaaaatacccgcga

SEQ ID NO: 117486 - DNA, 25 bp, S. pombe
ttgattgttgatactcctccgggaa

SEQ ID NO: 117487 - DNA, 25 bp, S. pombe
ttgctgcttggatttacgaacactc

SEQ ID NO: 117488 - DNA, 25 bp, S. pombe
ttgccttgtgtgatactgactccat

SEQ ID NO: 117489 - DNA, 25 bp, S. pombe
ttgtcacgagtttccaaatcctggg

SEQ ID NO: 117490 - DNA, 25 bp, S. pombe
ttgctccgttctttcacaacgatga

SEQ ID NO: 117491 - DNA, 25 bp, S. pombe
ttgccctcgcctaatactgaagaga

SEQ ID NO: 117492 - DNA, 25 bp, S. pombe
ttggcacctgccgattacgaaggag

SEQ ID NO: 117493 - DNA, 25 bp, S. pombe
ttgacaacgctctaaatcttcctac

SEQ ID NO: 117494 - DNA, 25 bp, S. pombe
ttgtggttgcaagagcagcgctgtt

SEQ ID NO: 117495 - DNA, 25 bp, S. pombe
ttggtttctgagaagctggccactt

SEQ ID NO: 117496 - DNA, 25 bp, S. pombe
ttgggtagtagttctggaagctgct

SEQ ID NO: 117497 - DNA, 25 bp, S. pombe
ttgggtggccttgcatcgaagcttc

SEQ ID NO: 117498 - DNA, 25 bp, S. pombe
ttgtttggactcgagcatgcttata

SEQ ID NO: 117499 - DNA, 25 bp, S. pombe
ttgattgctagaggccgcgtctata

SEQ ID NO: 117500 - DNA, 25 bp, S. pombe
ttgcgtctctttttactgtctcatc

SEQ ID NO: 117501 - DNA, 25 bp, S. pombe
ttgctgtgtccggtattgattccac

SEQ ID NO: 117502 - DNA, 25 bp, S. pombe
ttgttgactatgctaagctgcctcc

SEQ ID NO: 117503 - DNA, 25 bp, S. pombe
ttgtcattcaggtggagctctcgat

SEQ ID NO: 117504 - DNA, 25 bp, S. pombe
ttgtttgggagcctagcaccgtcaa

SEQ ID NO: 117505 - DNA, 25 bp, S. pombe
ttggttgctgcatcgtagaacgtac

SEQ ID NO: 117506 - DNA, 25 bp, S. pombe
ttgcttgttgatttaccggatgctc

SEQ ID NO: 117507 - DNA, 25 bp, S. pombe
ttggttatggattctttcggctctc

SEQ ID NO: 117508 - DNA, 25 bp, S. pombe
ttgcgctctaatgatttgtctataa

SEQ ID NO: 117509 - DNA, 25 bp, S. pombe
ttgcgctgcatgtaaagagcttctt

SEQ ID NO: 117510 - DNA, 25 bp, S. pombe
ttggtggaaatccagccgcagctct

SEQ ID NO: 117511 - DNA, 25 bp, S. pombe
ttgatggtgttcatcgcggcgcaaa

SEQ ID NO: 117512 - DNA, 25 bp, S. pombe
ttgggatacttggtaccatgctcct

SEQ ID NO: 117513 - DNA, 25 bp, S. pombe
ttgaatggaccacatgctacagctg

SEQ ID NO: 117514 - DNA, 25 bp, S. pombe
ttggcgatacgcaatgtggcttcaa

SEQ ID NO: 117515 - DNA, 25 bp, S. pombe
ttgtacacctacattggcaagccca

SEQ ID NO: 117516 - DNA, 25 bp, S. pombe
ttgaacaaatcagccgaaaccctct

SEQ ID NO: 117517 - DNA, 25 bp, S. pombe
ttgaagcaaagatccccgacatttt

SEQ ID NO: 117518 - DNA, 25 bp, S. pombe
ttgatcgattaatgcctgtggacac

SEQ ID NO: 117519 - DNA, 25 bp, S. pombe
ttgtctgattcaggacctttgccac

SEQ ID NO: 117520 - DNA, 25 bp, S. pombe
ttgccgttgatggtcctgtagtacc

SEQ ID NO: 117521 - DNA, 25 bp, S. pombe
ttggaatgtctggtctctgtattac

SEQ ID NO: 117522 - DNA, 25 bp, S. pombe
ttgcggcagactttacagatcctat

SEQ ID NO: 117523 - DNA, 25 bp, S. pombe
ttgacctatgccaaaaactccttgc

SEQ ID NO: 117524 - DNA, 25 bp, S. pombe
ttgtcagctcctaaagacactccgg

SEQ ID NO: 117525 - DNA, 25 bp, S. pombe
ttgtcagtcgttcaaatgcccgtga

SEQ ID NO: 117526 - DNA, 25 bp, S. pombe
ttgtttgctcttcagaatccactag

SEQ ID NO: 117527 - DNA, 25 bp, S. pombe
ttgtttcttctgtctttctattcat

SEQ ID NO: 117528 - DNA, 25 bp, S. pombe
ttgtcgtttctacttcgtttcatga

SEQ ID NO: 117529 - DNA, 25 bp, S. pombe
ttgtggttgtctatcttctcttcaa

SEQ ID NO: 117530 - DNA, 25 bp, S. pombe
ttgctcgtcttggtatgaacttcac

SEQ ID NO: 117531 - DNA, 25 bp, S. pombe
ttgctagatcccttattggctacgg

SEQ ID NO: 117532 - DNA, 25 bp, S. pombe
ttgtcaaaccaatttctgtgccatt

SEQ ID NO: 117533 - DNA, 25 bp, S. pombe
ttgttcgcccaattttcagactgtt

SEQ ID NO: 117534 - DNA, 25 bp, S. pombe
ttgcttccttgacgatgctaccaaa

SEQ ID NO: 117535 - DNA, 25 bp, S. pombe
ttgctgctacttttctctacactaa

SEQ ID NO: 117536 - DNA, 25 bp, S. pombe
ttgctcccttctactaaacatactt

SEQ ID NO: 117537 - DNA, 25 bp, S. pombe
ttgtcttcttctcctataactgttt

SEQ ID NO: 117538 - DNA, 25 bp, S. pombe
ttgtttctctttgcgcagactattt

SEQ ID NO: 117539 - DNA, 25 bp, S. pombe
ttgttgtccttctccaaatatgtgg

SEQ ID NO: 117540 - DNA, 25 bp, S. pombe
ttggatttccaaaccgatcgttcat

SEQ ID NO: 117541 - DNA, 25 bp, S. pombe
ttggcctacgaaatcgcccgtaata

SEQ ID NO: 117542 - DNA, 25 bp, S. pombe
ttggccaacaagttcgcgaccggag

SEQ ID NO: 117543 - DNA, 25 bp, S. pombe
ttgtcatccaactaatagccccgat

SEQ ID NO: 117544 - DNA, 25 bp, S. pombe
ttggttgtttacatgcccaacactc

SEQ ID NO: 117545 - DNA, 25 bp, S. pombe
ttgttattgtgtttggctcgtacct

SEQ ID NO: 117546 - DNA, 25 bp, S. pombe
ttgctggattttttcgtcgccattt

SEQ ID NO: 117547 - DNA, 25 bp, S. pombe
ttgaatctcctcctgtatacgttga

SEQ ID NO: 117548 - DNA, 25 bp, S. pombe
ttgaacttgctttctatgggaatgt

SEQ ID NO: 117549 - DNA, 25 bp, S. pombe
ttgacatgcgtatctgcctctgtat

SEQ ID NO: 117550 - DNA, 25 bp, S. pombe
ttggcatggttcatcctcagtatca

SEQ ID NO: 117551 - DNA, 25 bp, S. pombe
ttgagaggagatgtcgcgcgtcttc

SEQ ID NO: 117552 - DNA, 25 bp, S. pombe
ttgttgcaacaacatactcctgttt

SEQ ID NO: 117553 - DNA, 25 bp, S. pombe
ttggtcaaaagcttgagccggcctc

SEQ ID NO: 117554 - DNA, 25 bp, S. pombe
ttggtacaacagtcgatcctactct

SEQ ID NO: 117555 - DNA, 25 bp, S. pombe
ttgtggacagggattcctctcctga

SEQ ID NO: 117556 - DNA, 25 bp, S. pombe
ttgagcgcgcagttgattggatttt

SEQ ID NO: 117557 - DNA, 25 bp, S. pombe
ttgtgatcaccatttcaggtcgtgg

SEQ ID NO: 117558 - DNA, 25 bp, S. pombe
ttgcttcaacaattcgtatgcgagg

SEQ ID NO: 117559 - DNA, 25 bp, S. pombe
ttgctacttcacttcgttcgagaaa

SEQ ID NO: 117560 - DNA, 25 bp, S. pombe
ttgctaaatgcacttcgtattcgaa

SEQ ID NO: 117561 - DNA, 25 bp, S. pombe
ttgcaggcttgcgtacggattgttt

SEQ ID NO: 117562 - DNA, 25 bp, S. pombe
ttgcacttttcaccgctgttattat

SEQ ID NO: 117563 - DNA, 25 bp, S. pombe
ttgacacccacacgcgtattattat

SEQ ID NO: 117564 - DNA, 25 bp, S. pombe
ttgaagctgctcgtatctgtgccaa

SEQ ID NO: 117565 - DNA, 25 bp, S. pombe
ttgaagagctaattgctgcaggcaa

SEQ ID NO: 117566 - DNA, 25 bp, S. pombe
ttggacactctattgctgcagatga

SEQ ID NO: 117567 - DNA, 25 bp, S. pombe
ttgaggctcctaccgctgatgaaaa

SEQ ID NO: 117568 - DNA, 25 bp, S. pombe
ttggtgatcctcaactttggcttgc

SEQ ID NO: 117569 - DNA, 25 bp, S. pombe
ttggatgcgcctaaccaggaggttc

SEQ ID NO: 117570 - DNA, 25 bp, S. pombe
ttgcgactgccaatccaagtgcggt

SEQ ID NO: 117571 - DNA, 25 bp, S. pombe
ttgaccaaaagcgtatcttgcgtgc

SEQ ID NO: 117572 - DNA, 25 bp, S. pombe
ttgaccaacgtcttcaatctcgtat

SEQ ID NO: 117573 - DNA, 25 bp, S. pombe
ttgaccaacgatttgactctatgga

SEQ ID NO: 117574 - DNA, 25 bp, S. pombe
ttgacccacttgactcagactgtga

SEQ ID NO: 117575 - DNA, 25 bp, S. pombe
ttggcctcagccgtcataaagtgac

SEQ ID NO: 117576 - DNA, 25 bp, S. pombe
ttgctgccattttctatccttatat

SEQ ID NO: 117577 - DNA, 25 bp, S. pombe
ttgctaaaaatcttccattcctcca

SEQ ID NO: 117578 - DNA, 25 bp, S. pombe
ttgctaaatgtctactcacttcctc

SEQ ID NO: 117579 - DNA, 25 bp, S. pombe
ttgtactacacttcatgcatccgga

SEQ ID NO: 117580 - DNA, 25 bp, S. pombe
ttgggataacaaaaccgcatacgaa

SEQ ID NO: 117581 - DNA, 25 bp, S. pombe
ttgggattacaacagcgctctagca

SEQ ID NO: 117582 - DNA, 25 bp, S. pombe
ttgggcgtgccgaatctgctgaaaa

SEQ ID NO: 117583 - DNA, 25 bp, S. pombe
ttgggcggcgcgcaaattgcatcaa

SEQ ID NO: 117584 - DNA, 25 bp, S. pombe
ttgtccctgtgcgagaaattcttca

SEQ ID NO: 117585 - DNA, 25 bp, S. pombe
ttgtctacgctgttgagttttctca

SEQ ID NO: 117586 - DNA, 25 bp, S. pombe
ttgtctactatcaacgtcttcgcca

SEQ ID NO: 117587 - DNA, 25 bp, S. pombe
ttgtttgcattcacttgtcatccac

SEQ ID NO: 117588 - DNA, 25 bp, S. pombe
ttgatttcttgcaagctctttcctc

SEQ ID NO: 117589 - DNA, 25 bp, S. pombe
ttggtgtcatgaaggcttgccgcga

SEQ ID NO: 117590 - DNA, 25 bp, S. pombe
ttggcgttgacgatgctgtctcaga

SEQ ID NO: 117591 - DNA, 25 bp, S. pombe
ttgtcaattagcgttttctcccgat

SEQ ID NO: 117592 - DNA, 25 bp, S. pombe
ttgataattcaccttctttcccaga

SEQ ID NO: 117593 - DNA, 25 bp, S. pombe
ttgttatgtcctgctctttcactaa

SEQ ID NO: 117594 - DNA, 25 bp, S. pombe
ttgtcaactccagacttctagatga

SEQ ID NO: 117595 - DNA, 25 bp, S. pombe
ttgtaatctctctaccatttcagga

SEQ ID NO: 117596 - DNA, 25 bp, S. pombe
ttgttgcctttgacttttgccgatc

SEQ ID NO: 117597 - DNA, 25 bp, S. pombe
ttgcttcttgtaatttgaccggtgc

SEQ ID NO: 117598 - DNA, 25 bp, S. pombe
ttgctactgatgtttttggccgtgg

SEQ ID NO: 117599 - DNA, 25 bp, S. pombe
ttgtcactgagaaccttggccgtat

SEQ ID NO: 117600 - DNA, 25 bp, S. pombe
ttgaacattggctctgctgctgccg

SEQ ID NO: 117601 - DNA, 25 bp, S. pombe
ttgacctctggctattttgcgatga

SEQ ID NO: 117602 - DNA, 25 bp, S. pombe
ttgacgacattcttgctactggtgg

SEQ ID NO: 117603 - DNA, 25 bp, S. pombe
ttgagcccatgcaattgcccgagta

SEQ ID NO: 117604 - DNA, 25 bp, S. pombe
ttgctaccacaattcgccgattaga

SEQ ID NO: 117605 - DNA, 25 bp, S. pombe
ttgctcaagcaatctccactggtaa

SEQ ID NO: 117606 - DNA, 25 bp, S. pombe
ttgctcaacaaattccaccgtcaga

SEQ ID NO: 117607 - DNA, 25 bp, S. pombe
ttggcgttccattcgacgatgcaaa

SEQ ID NO: 117608 - DNA, 25 bp, S. pombe
ttggtggtccaaagcatcgcagcaa

SEQ ID NO: 117609 - DNA, 25 bp, S. pombe
ttgggttccagatgctgccatcaaa

SEQ ID NO: 117610 - DNA, 25 bp, S. pombe
ttgggttccgtcaatgaatcagaat

SEQ ID NO: 117611 - DNA, 25 bp, S. pombe
ttggtcctatgttagctcacaaggc

SEQ ID NO: 117612 - DNA, 25 bp, S. pombe
ttgatgttttgttagcccttgagcc

SEQ ID NO: 117613 - DNA, 25 bp, S. pombe
ttgtgccatttccaagctgatcgtg

SEQ ID NO: 117614 - DNA, 25 bp, S. pombe
ttgctgacattctcaaggctccttt

SEQ ID NO: 117615 - DNA, 25 bp, S. pombe
ttgacccattttcaagcccattatc

SEQ ID NO: 117616 - DNA, 25 bp, S. pombe
ttgctccgattttaattcccttact

SEQ ID NO: 117617 - DNA, 25 bp, S. pombe
ttggcatcgcaatcaacctttggtt

SEQ ID NO: 117618 - DNA, 25 bp, S. pombe
ttggattccaactcgcattttagta

SEQ ID NO: 117619 - DNA, 25 bp, S. pombe
ttgggtccacactactctttatgag

SEQ ID NO: 117620 - DNA, 25 bp, S. pombe
ttgtggatggtctgcctttcaatga

SEQ ID NO: 117621 - DNA, 25 bp, S. pombe
ttgggctgcttctgctggattcaat

SEQ ID NO: 117622 - DNA, 25 bp, S. pombe
ttgattcttcaagtcctgcaggatg

SEQ ID NO: 117623 - DNA, 25 bp, S. pombe
ttgaatctcatatccgcagcagtag

SEQ ID NO: 117624 - DNA, 25 bp, S. pombe
ttgaattgctaaccggcgattacct

SEQ ID NO: 117625 - DNA, 25 bp, S. pombe
ttggtttgcatatagcgctggcttt

SEQ ID NO: 117626 - DNA, 25 bp, S. pombe
ttggagtccacatcagcgcggaatt

SEQ ID NO: 117627 - DNA, 25 bp, S. pombe
ttggaatcccatcacgtatgagcag

SEQ ID NO: 117628 - DNA, 25 bp, S. pombe
ttgtgttttcaaatcccatgctggg

SEQ ID NO: 117629 - DNA, 25 bp, S. pombe
ttgaaatttcattctcaccagagga

SEQ ID NO: 117630 - DNA, 25 bp, S. pombe
ttgacgatttcttctcacaatgcga

SEQ ID NO: 117631 - DNA, 25 bp, S. pombe
ttgagatatttccttccaacctttc

SEQ ID NO: 117632 - DNA, 25 bp, S. pombe
ttgagtttgttgatcctaccattaa

SEQ ID NO: 117633 - DNA, 25 bp, S. pombe
ttggtttttgtcctctacagcttga

SEQ ID NO: 117634 - DNA, 25 bp, S. pombe
ttggtctttgaagctactgcgttag

SEQ ID NO: 117635 - DNA, 25 bp, S. pombe
ttggtcggtatgtgtatcgcttctc

SEQ ID NO: 117636 - DNA, 25 bp, S. pombe
ttggttgcgttggttgatgccttac

SEQ ID NO: 117637 - DNA, 25 bp, S. pombe
ttgatctcatccttttatggccttt

SEQ ID NO: 117638 - DNA, 25 bp, S. pombe
ttgctctatctctttggagaccgtt

SEQ ID NO: 117639 - DNA, 25 bp, S. pombe
ttgctctacgcatttactgaccaga

SEQ ID NO: 117640 - DNA, 25 bp, S. pombe
ttgtctctctcttcgaagataccaa

SEQ ID NO: 117641 - DNA, 25 bp, S. pombe
ttgtttactccgaagacaccgcaaa

SEQ ID NO: 117642 - DNA, 25 bp, S. pombe
ttgtttactcctatgttcctcatga

SEQ ID NO: 117643 - DNA, 25 bp, S. pombe
ttgtcattagtacccgttcccgagg

SEQ ID NO: 117644 - DNA, 25 bp, S. pombe
ttgttgggatactgcgtttcctgag

SEQ ID NO: 117645 - DNA, 25 bp, S. pombe
ttgctctttatatcgcttattccgg

SEQ ID NO: 117646 - DNA, 25 bp, S. pombe
ttgtatttcatgttcggtttctcgt

SEQ ID NO: 117647 - DNA, 25 bp, S. pombe
ttgtcttccattccttggttatcgt

SEQ ID NO: 117648 - DNA, 25 bp, S. pombe
ttggcttgctcatgttggttaacgt

SEQ ID NO: 117649 - DNA, 25 bp, S. pombe
ttggctgatgcctgctggtatattt

SEQ ID NO: 117650 - DNA, 25 bp, S. pombe
ttggtacctatccttttaactcatt

SEQ ID NO: 117651 - DNA, 25 bp, S. pombe
ttggtgacctttgtgctttcactga

SEQ ID NO: 117652 - DNA, 25 bp, S. pombe
ttggccgtcgatattcttgctacta

SEQ ID NO: 117653 - DNA, 25 bp, S. pombe
ttgaacgtcgtaatttagtcgctcg

SEQ ID NO: 117654 - DNA, 25 bp, S. pombe
ttgaagccacgaactttgactcctc

SEQ ID NO: 117655 - DNA, 25 bp, S. pombe
ttgcaactaacactcattcttcatc

SEQ ID NO: 117656 - DNA, 25 bp, S. pombe
ttgagcacgaactatcatccattcc

SEQ ID NO: 117657 - DNA, 25 bp, S. pombe
ttgtgcaagactaccgctccttaaa

SEQ ID NO: 117658 - DNA, 25 bp, S. pombe
ttgctacaagttactctgctctcat

SEQ ID NO: 117659 - DNA, 25 bp, S. pombe
ttgcatgagcatggtttccctgtac

SEQ ID NO: 117660 - DNA, 25 bp, S. pombe
ttgatgatatctatgctcccttcac

SEQ ID NO: 117661 - DNA, 25 bp, S. pombe
ttgactatgctaagctgcctcccaa

SEQ ID NO: 117662 - DNA, 25 bp, S. pombe
ttggcaatgcaaacgcttcactcaa

SEQ ID NO: 117663 - DNA, 25 bp, S. pombe
ttggccatggatacctctgtgctca

SEQ ID NO: 117664 - DNA, 25 bp, S. pombe
ttgtcgctactcttaatgcctctta

SEQ ID NO: 117665 - DNA, 25 bp, S. pombe
ttggtttcttctaacttcgagcgtt

SEQ ID NO: 117666 - DNA, 25 bp, S. pombe
ttgagtttccccaacattgagcagc

SEQ ID NO: 117667 - DNA, 25 bp, S. pombe
ttggaagtggccttactggaaaaca

SEQ ID NO: 117668 - DNA, 25 bp, S. pombe
ttggattggcaaaccgaactctgtt

SEQ ID NO: 117669 - DNA, 25 bp, S. pombe
ttggtcttccaagtctgaaactgtt

SEQ ID NO: 117670 - DNA, 25 bp, S. pombe
ttgttcctcatgttgcagtcgcaat

SEQ ID NO: 117671 - DNA, 25 bp, S. pombe
ttgcttgccttcttgagcctgaaaa

SEQ ID NO: 117672 - DNA, 25 bp, S. pombe
ttgtctcgttcctgccaaaaattca

SEQ ID NO: 117673 - DNA, 25 bp, S. pombe
ttggtctagatctttacgtaaaaat

SEQ ID NO: 117674 - DNA, 25 bp, S. pombe
ttgtccgcagtcttttctaaaaaat

SEQ ID NO: 117675 - DNA, 25 bp, S. pombe
ttgtcgatcgctttccctattaaaa

SEQ ID NO: 117676 - DNA, 25 bp, S. pombe
ttgcttggcagtttcctcatttcaa

SEQ ID NO: 117677 - DNA, 25 bp, S. pombe
ttgactggcttctttccatttccaa

SEQ ID NO: 117678 - DNA, 25 bp, S. pombe
ttgagtctcacttacatacgtttga

SEQ ID NO: 117679 - DNA, 25 bp, S. pombe
ttgttggatcttctgtagcttctga

SEQ ID NO: 117680 - DNA, 25 bp, S. pombe
ttgttgaattcatttggactttaat

SEQ ID NO: 117681 - DNA, 25 bp, S. pombe
ttgttacattcatttctccttcatc

SEQ ID NO: 117682 - DNA, 25 bp, S. pombe
ttgtcttcctcaatttccttcaaag

SEQ ID NO: 117683 - DNA, 25 bp, S. pombe
ttgtctatgcacatttccccatcaa

SEQ ID NO: 117684 - DNA, 25 bp, S. pombe
ttgatcgtgcacaagttgccatcca

SEQ ID NO: 117685 - DNA, 25 bp, S. pombe
ttgcaacgactatgtggcccttgtt

SEQ ID NO: 117686 - DNA, 25 bp, S. pombe
ttggctgttatatgacgaccggctt

SEQ ID NO: 117687 - DNA, 25 bp, S. pombe
ttggtgccttgcgaaaacggtgctt

SEQ ID NO: 117688 - DNA, 25 bp, S. pombe
ttgattcctctaataaccctggtct

SEQ ID NO: 117689 - DNA, 25 bp, S. pombe
ttgtcgcggcttaaacgcctagttt

SEQ ID NO: 117690 - DNA, 25 bp, S. pombe
ttgttcgtgccgttactcactataa

SEQ ID NO: 117691 - DNA, 25 bp, S. pombe
ttgttactgcatccttttaccatac

SEQ ID NO: 117692 - DNA, 25 bp, S. pombe
ttgtatgctgtagtttcctctcgcc

SEQ ID NO: 117693 - DNA, 25 bp, S. pombe
ttgtatgctgttgtatcctctcgtc

SEQ ID NO: 117694 - DNA, 25 bp, S. pombe
ttgatattgctctttcatcagcctc

SEQ ID NO: 117695 - DNA, 25 bp, S. pombe
ttgcatatgttcatccatggctcct

SEQ ID NO: 117696 - DNA, 25 bp, S. pombe
ttgaatgcttttcctagctctgcta

SEQ ID NO: 117697 - DNA, 25 bp, S. pombe
ttgattctgtttgctgactctgttc

SEQ ID NO: 117698 - DNA, 25 bp, S. pombe
ttgactgctgttcacaacgctattc

SEQ ID NO: 117699 - DNA, 25 bp, S. pombe
ttgacgttgtttacacagctataca

SEQ ID NO: 117700 - DNA, 25 bp, S. pombe
ttgcatcgttgctttaccgcaatca

SEQ ID NO: 117701 - DNA, 25 bp, S. pombe
ttgatcctttcactgacacgcaaat

SEQ ID NO: 117702 - DNA, 25 bp, S. pombe
ttggattttctgcacaagcgctaat

SEQ ID NO: 117703 - DNA, 25 bp, S. pombe
ttgtcactttcaaaccttggctcaa

SEQ ID NO: 117704 - DNA, 25 bp, S. pombe
ttgacacctttttgcctgatcttgc

SEQ ID NO: 117705 - DNA, 25 bp, S. pombe
ttgcaacacattttcgcctttatca

SEQ ID NO: 117706 - DNA, 25 bp, S. pombe
ttggtatgctacttctcctgattta

SEQ ID NO: 117707 - DNA, 25 bp, S. pombe
ttggtggctcaattcttgctagttt

SEQ ID NO: 117708 - DNA, 25 bp, S. pombe
ttgagcaaatcttcgttgtcgtccg

SEQ ID NO: 117709 - DNA, 25 bp, S. pombe
ttggcaattgctccgtttcgaatag

SEQ ID NO: 117710 - DNA, 25 bp, S. pombe
ttggatctgcctccgttgtagagaa

SEQ ID NO: 117711 - DNA, 25 bp, S. pombe
ttggttctgctgtgttttggcaagc

SEQ ID NO: 117712 - DNA, 25 bp, S. pombe
ttggtactcttcttcgtattaagaa

SEQ ID NO: 117713 - DNA, 25 bp, S. pombe
ttggttctcttgctcttgcattata

SEQ ID NO: 117714 - DNA, 25 bp, S. pombe
ttggcattctcctgcgttcaatata

SEQ ID NO: 117715 - DNA, 25 bp, S. pombe
ttggcttccgtacgtacacatttgg

SEQ ID NO: 117716 - DNA, 25 bp, S. pombe
ttggccgatcatttcgtttgttatc

SEQ ID NO: 117717 - DNA, 25 bp, S. pombe
ttggcctgactcctcagtctgtaaa

SEQ ID NO: 117718 - DNA, 25 bp, S. pombe
ttgagcgcgaccaagagcttcgaaa

SEQ ID NO: 117719 - DNA, 25 bp, S. pombe
ttggcgcgtacgtcgttcaagaggt

SEQ ID NO: 117720 - DNA, 25 bp, S. pombe
ttggcgtgcctgtcgaattcaaaga

SEQ ID NO: 117721 - DNA, 25 bp, S. pombe
ttgacccctcttatctaactagtga

SEQ ID NO: 117722 - DNA, 25 bp, S. pombe
ttgaccccttctttcgagacagaaa

SEQ ID NO: 117723 - DNA, 25 bp, S. pombe
ttggtgccgttttcgcggtcgatga

SEQ ID NO: 117724 - DNA, 25 bp, S. pombe
ttggctctcgtttgactggttggaa

SEQ ID NO: 117725 - DNA, 25 bp, S. pombe
ttggcttcgatccaccaagttggaa

SEQ ID NO: 117726 - DNA, 25 bp, S. pombe
ttggcatttatcttccggttttcat

SEQ ID NO: 117727 - DNA, 25 bp, S. pombe
ttggctttccttgatattgctccta

SEQ ID NO: 117728 - DNA, 25 bp, S. pombe
ttggaccacctgatcattcgttgat

SEQ ID NO: 117729 - DNA, 25 bp, S. pombe
ttgacactgatacccaattcgccta

SEQ ID NO: 117730 - DNA, 25 bp, S. pombe
ttgaacgattcccaatttgccgctg

SEQ ID NO: 117731 - DNA, 25 bp, S. pombe
ttggtcgtaccttcattatgccagg

SEQ ID NO: 117732 - DNA, 25 bp, S. pombe
ttggtcgttaattatctctgcctcg

SEQ ID NO: 117733 - DNA, 25 bp, S. pombe
ttgatgtactttgccataacccgct

SEQ ID NO: 117734 - DNA, 25 bp, S. pombe
ttgttggtttccctaacgcacactt

SEQ ID NO: 117735 - DNA, 25 bp, S. pombe
ttggtgtttaccttgaacgtcgtct

SEQ ID NO: 117736 - DNA, 25 bp, S. pombe
ttgggttttccatggatgccgcgac

SEQ ID NO: 117737 - DNA, 25 bp, S. pombe
ttgttcctcttgtgtattcctcgaa

SEQ ID NO: 117738 - DNA, 25 bp, S. pombe
ttgattcctcttgggctgttcgcat

SEQ ID NO: 117739 - DNA, 25 bp, S. pombe
ttgaaactgctacggctgagctcgt

SEQ ID NO: 117740 - DNA, 25 bp, S. pombe
ttgaacttgctcgtaaggctcgtgc

SEQ ID NO: 117741 - DNA, 25 bp, S. pombe
ttgaactctgaaaaagctgccgctt

SEQ ID NO: 117742 - DNA, 25 bp, S. pombe
ttggtctactgcttatgtgtcggat

SEQ ID NO: 117743 - DNA, 25 bp, S. pombe
ttggtgttcctgttcatttgatgtc

SEQ ID NO: 117744 - DNA, 25 bp, S. pombe
ttggacagtcgtttcatttgatgct

SEQ ID NO: 117745 - DNA, 25 bp, S. pombe
ttgatggtgggtttggactctgtcc

SEQ ID NO: 117746 - DNA, 25 bp, S. pombe
ttggtcacactattcggtactgtcg

SEQ ID NO: 117747 - DNA, 25 bp, S. pombe
ttgtttgcactattggcgttggtca

SEQ ID NO: 117748 - DNA, 25 bp, S. pombe
ttgttcatcctgctattttgtgcgt

SEQ ID NO: 117749 - DNA, 25 bp, S. pombe
ttgtctgataatgtacgttgtcgat

SEQ ID NO: 117750 - DNA, 25 bp, S. pombe
ttgtcttccaactagactctgcgga

SEQ ID NO: 117751 - DNA, 25 bp, S. pombe
ttgtttctaacttacctactgacgt

SEQ ID NO: 117752 - DNA, 25 bp, S. pombe
ttggttctatagcatacttcactga

SEQ ID NO: 117753 - DNA, 25 bp, S. pombe
ttgggcttattcttacttcactcag

SEQ ID NO: 117754 - DNA, 25 bp, S. pombe
ttggtcttaatcttactggtgctga

SEQ ID NO: 117755 - DNA, 25 bp, S. pombe
ttgggttctaactctggtgctactc

SEQ ID NO: 117756 - DNA, 25 bp, S. pombe
ttggtttcgacctccagagctatta

SEQ ID NO: 117757 - DNA, 25 bp, S. pombe
ttggaaatctcccttggcaacaatc

SEQ ID NO: 117758 - DNA, 25 bp, S. pombe
ttggtaaagccggtcgttcacgttg

SEQ ID NO: 117759 - DNA, 25 bp, S. pombe
ttggaacatggctacgaccgtgata

SEQ ID NO: 117760 - DNA, 25 bp, S. pombe
ttggactatccatttcagcctccta

SEQ ID NO: 117761 - DNA, 25 bp, S. pombe
ttggagtacacatgattggccctat

SEQ ID NO: 117762 - DNA, 25 bp, S. pombe
ttggaaagtcaagtgcttcagccgc

SEQ ID NO: 117763 - DNA, 25 bp, S. pombe
ttgtacaagtaacgtctaccgctcc

SEQ ID NO: 117764 - DNA, 25 bp, S. pombe
ttgacaaatctttaccttcttcgga

SEQ ID NO: 117765 - DNA, 25 bp, S. pombe
ttgaagaaatttcccttcctccatg

SEQ ID NO: 117766 - DNA, 25 bp, S. pombe
ttgagcgaaatattcccttcaccgt

SEQ ID NO: 117767 - DNA, 25 bp, S. pombe
ttggccatatttacgcttggtccta

SEQ ID NO: 117768 - DNA, 25 bp, S. pombe
ttggaatgtctgaccgcattggccc

SEQ ID NO: 117769 - DNA, 25 bp, S. pombe
ttgtgtgaatcttgtcgaggactcc

SEQ ID NO: 117770 - DNA, 25 bp, S. pombe
ttgggcgattttggcagacctagaa

SEQ ID NO: 117771 - DNA, 25 bp, S. pombe
ttggctgctattttccaacctggaa

SEQ ID NO: 117772 - DNA, 25 bp, S. pombe
ttggccgattgatgaataccttgat

SEQ ID NO: 117773 - DNA, 25 bp, S. pombe
ttgtcccaggcactaaacccatgat

SEQ ID NO: 117774 - DNA, 25 bp, S. pombe
ttgatcctcgtactaaacagccttg

SEQ ID NO: 117775 - DNA, 25 bp, S. pombe
ttgtctcctgatgtcaaacaccttg

SEQ ID NO: 117776 - DNA, 25 bp, S. pombe
ttggactttaattccagctttaatc

SEQ ID NO: 117777 - DNA, 25 bp, S. pombe
ttggagttttctaccacttctcaac

SEQ ID NO: 117778 - DNA, 25 bp, S. pombe
ttgaagctgttcatggtactgcccc

SEQ ID NO: 117779 - DNA, 25 bp, S. pombe
ttgaagccactcattgaatctgccc

SEQ ID NO: 117780 - DNA, 25 bp, S. pombe
ttgaacccgcacttgagagcttgaa

SEQ ID NO: 117781 - DNA, 25 bp, S. pombe
ttgacaaccccaaaggcttactaca

SEQ ID NO: 117782 - DNA, 25 bp, S. pombe
ttggcacccctaaagactactctaa

SEQ ID NO: 117783 - DNA, 25 bp, S. pombe
ttggtgccaagaagagcccctgaat

SEQ ID NO: 117784 - DNA, 25 bp, S. pombe
ttggcagctcaatacacccctataa

SEQ ID NO: 117785 - DNA, 25 bp, S. pombe
ttgattccaaccaaccccgaagaag

SEQ ID NO: 117786 - DNA, 25 bp, S. pombe
ttggtatgcgtcgattccacctcat

SEQ ID NO: 117787 - DNA, 25 bp, S. pombe
ttgggacctccgtaatccatatcaa

SEQ ID NO: 117788 - DNA, 25 bp, S. pombe
ttgaggaccccttcgaccaagatga

SEQ ID NO: 117789 - DNA, 25 bp, S. pombe
ttgggattaccagccagcaatagaa

SEQ ID NO: 117790 - DNA, 25 bp, S. pombe
ttggagttacgcgaccttgatgaaa

SEQ ID NO: 117791 - DNA, 25 bp, S. pombe
ttggctttacgctcctttgcataag

SEQ ID NO: 117792 - DNA, 25 bp, S. pombe
ttggcttcagaagaccgtcgcaagg

SEQ ID NO: 117793 - DNA, 25 bp, S. pombe
ttgtcaatacaagttccccggtcaa

SEQ ID NO: 117794 - DNA, 25 bp, S. pombe
ttggcaatacaacttccaccttttg

SEQ ID NO: 117795 - DNA, 25 bp, S. pombe
ttgagaatccaacgccaaccagctt

SEQ ID NO: 117796 - DNA, 25 bp, S. pombe
ttggatatggcaatccttcctccta

SEQ ID NO: 117797 - DNA, 25 bp, S. pombe
ttggttggctattcacatccccaaa

SEQ ID NO: 117798 - DNA, 25 bp, S. pombe
ttggtcttgctttaactcctattat

SEQ ID NO: 117799 - DNA, 25 bp, S. pombe
ttgggtcctggtttatctaaagccg

SEQ ID NO: 117800 - DNA, 25 bp, S. pombe
ttggttttctattttgttggcttgg

SEQ ID NO: 117801 - DNA, 25 bp, S. pombe
ttggatctcttcttacttgttcagt

SEQ ID NO: 117802 - DNA, 25 bp, S. pombe
ttggattgctatctactttggcctc

SEQ ID NO: 117803 - DNA, 25 bp, S. pombe
ttggattcttttgtctgtggcacac

SEQ ID NO: 117804 - DNA, 25 bp, S. pombe
ttgggtatttatcctgctgtcgatc

SEQ ID NO: 117805 - DNA, 25 bp, S. pombe
ttgggtttgattcctgttgctttaa

SEQ ID NO: 117806 - DNA, 25 bp, S. pombe
ttgagcctatctttaacatctgcga

SEQ ID NO: 117807 - DNA, 25 bp, S. pombe
ttggctcgtattcaagaccctcaaa

SEQ ID NO: 117808 - DNA, 25 bp, S. pombe
ttggtcgtagtcatggtacctcaca

SEQ ID NO: 117809 - DNA, 25 bp, S. pombe
ttggtactcagtatcgttccgcaat

SEQ ID NO: 117810 - DNA, 25 bp, S. pombe
ttggtatccagtatcagccctttat

SEQ ID NO: 117811 - DNA, 25 bp, S. pombe
ttggctgatttacgaggcttgtctc

SEQ ID NO: 117812 - DNA, 25 bp, S. pombe
ttggctgctgatgaactcgttactc

SEQ ID NO: 117813 - DNA, 25 bp, S. pombe
ttggttgcatggaactcgctttcat

SEQ ID NO: 117814 - DNA, 25 bp, S. pombe
ttggttgcagcctctcgtgtaaaag

SEQ ID NO: 117815 - DNA, 25 bp, S. pombe
ttggtggccctgtcatctataaaaa

SEQ ID NO: 117816 - DNA, 25 bp, S. pombe
ttggctccccatcttctgaaaataa

SEQ ID NO: 117817 - DNA, 25 bp, S. pombe
ttgagccctcacatttccaagatga

SEQ ID NO: 117818 - DNA, 25 bp, S. pombe
ttggtccagatattggcgcagccat

SEQ ID NO: 117819 - DNA, 25 bp, S. pombe
ttgtgctcaaccttcaatggctgaa

SEQ ID NO: 117820 - DNA, 25 bp, S. pombe
ttggctcatatttcgctgcatacta

SEQ ID NO: 117821 - DNA, 25 bp, S. pombe
ttgatgccacaaacgctgaagcttt

SEQ ID NO: 117822 - DNA, 25 bp, S. pombe
ttgatccagattgcgcttatgcttt

SEQ ID NO: 117823 - DNA, 25 bp, S. pombe
ttgatccaatagacgcttctgatat

SEQ ID NO: 117824 - DNA, 25 bp, S. pombe
ttgaccaacatggactgatgctatt

SEQ ID NO: 117825 - DNA, 25 bp, S. pombe
ttggcacctcaaactatggctgctt

SEQ ID NO: 117826 - DNA, 25 bp, S. pombe
ttggcgccgcaaggatggtgtctat

SEQ ID NO: 117827 - DNA, 25 bp, S. pombe
ttgtcaactgggtctttgcactcac

SEQ ID NO: 117828 - DNA, 25 bp, S. pombe
ttgacaacagtgttctagcctctgc

SEQ ID NO: 117829 - DNA, 25 bp, S. pombe
ttgacacaagatttgctcatcccgc

SEQ ID NO: 117830 - DNA, 25 bp, S. pombe
ttggaagagctttgcgccatccgaa

SEQ ID NO: 117831 - DNA, 25 bp, S. pombe
ttggagacaggctcaggcttcggca

SEQ ID NO: 117832 - DNA, 25 bp, S. pombe
ttggagccagagtatacctcgccag

SEQ ID NO: 117833 - DNA, 25 bp, S. pombe
ttgatgacagcgtcgaagcctacga

SEQ ID NO: 117834 - DNA, 25 bp, S. pombe
ttggagggtccaaaagacgaacaat

SEQ ID NO: 117835 - DNA, 25 bp, S. pombe
ttgggttggcgagagtactgtttaa

SEQ ID NO: 117836 - DNA, 25 bp, S. pombe
ttggcagattggcaacctcctgttt

SEQ ID NO: 117837 - DNA, 25 bp, S. pombe
ttgttcaaattgtcgttctcctggt

SEQ ID NO: 117838 - DNA, 25 bp, S. pombe
ttggtactttgcttgttcccatgaa

SEQ ID NO: 117839 - DNA, 25 bp, S. pombe
ttggaacttgcttgatttgcctgcc

SEQ ID NO: 117840 - DNA, 25 bp, S. pombe
ttggctacaatttctgctcaggctg

SEQ ID NO: 117841 - DNA, 25 bp, S. pombe
ttgtgctgacaactctggtgctaag

SEQ ID NO: 117842 - DNA, 25 bp, S. pombe
ttggaacttctgtcatctgtaacga

SEQ ID NO: 117843 - DNA, 25 bp, S. pombe
ttgggtcttccaattatacgagtag

SEQ ID NO: 117844 - DNA, 25 bp, S. pombe
ttgggcatcttctactttacaggtc

SEQ ID NO: 117845 - DNA, 25 bp, S. pombe
ttggaactacaaccttggcggtctt

SEQ ID NO: 117846 - DNA, 25 bp, S. pombe
ttgtggaaactgtcctgtctctgac

SEQ ID NO: 117847 - DNA, 25 bp, S. pombe
ttggctacggcttcaattgactgga

SEQ ID NO: 117848 - DNA, 25 bp, S. pombe
ttggctaccatcaccacatgtattg

SEQ ID NO: 117849 - DNA, 25 bp, S. pombe
ttggatactgcaatacccgtcacat

SEQ ID NO: 117850 - DNA, 25 bp, S. pombe
ttgtgacacgtttaccttcatgggt

SEQ ID NO: 117851 - DNA, 25 bp, S. cerevisiae
gggtactgccatccaaacaatgatt

SEQ ID NO: 117852 - DNA, 25 bp, S. cerevisiae
gtgccgcggacctattgatgtcttt

SEQ ID NO: 117853 - DNA, 25 bp, S. cerevisiae
aaagtactcaggcagcgcgagttgc

SEQ ID NO: 117854 - DNA, 25 bp, S. cerevisiae
acggattctcagtttcagttgttca

SEQ ID NO: 117855 - DNA, 25 bp, S. cerevisiae
taagttagggcttccactcgtgttt

SEQ ID NO: 117856 - DNA, 25 bp, S. cerevisiae
gacacaagctgacgctgctggtcaa

SEQ ID NO: 117857 - DNA, 25 bp, S. cerevisiae
gaatacgccggtttgtaccacgaag

SEQ ID NO: 117858 - DNA, 25 bp, S. cerevisiae
gctgttgtcagaaaatgccatcggt

SEQ ID NO: 117859 - DNA, 25 bp, S. cerevisiae
gaaggcggtcctgcgcaatttgtga

SEQ ID NO: 117860 - DNA, 25 bp, S. cerevisiae
atgatgcattcactactgggtactg

SEQ ID NO: 117861 - DNA, 25 bp, S. cerevisiae
agttgctcaggcacatggtgtcgat

SEQ ID NO: 117862 - DNA, 25 bp, S. cerevisiae
ggtacgactcatacgtgaatgccac

SEQ ID NO: 117863 - DNA, 25 bp, S. cerevisiae
gagtgtatcgcgattatccagcaag

SEQ ID NO: 117864 - DNA, 25 bp, S. cerevisiae
gatttttgacgactctgaccaaaca

SEQ ID NO: 117865 - DNA, 25 bp, S. cerevisiae
aatcaacccagtagggacgcctgaa

SEQ ID NO: 117866 - DNA, 25 bp, S. cerevisiae
tgaccactgtttgtcttacatcacc

SEQ ID NO: 117867 - DNA, 25 bp, S. cerevisiae
tcctgtttatgtcgtcgcggagtca

SEQ ID NO: 117868 - DNA, 25 bp, S. cerevisiae
cagagcgtggcctaccaatgattct

SEQ ID NO: 117869 - DNA, 25 bp, S. cerevisiae
gaatccatcggcttacacacaaggt

SEQ ID NO: 117870 - DNA, 25 bp, S. cerevisiae
gcatctatgaagctattccagtctg

SEQ ID NO: 117871 - DNA, 25 bp, S. cerevisiae
acctccgtcgatcatgactcaaata

SEQ ID NO: 117872 - DNA, 25 bp, S. cerevisiae
agctggatcatcaacactcacgaga

SEQ ID NO: 117873 - DNA, 25 bp, S. cerevisiae
gttgatctttacaatgaagttgcga

SEQ ID NO: 117874 - DNA, 25 bp, S. cerevisiae
acgttgatctttacaatgaagttgc

SEQ ID NO: 117875 - DNA, 25 bp, S. cerevisiae
aagcgcacgttgatctttacaatga

SEQ ID NO: 117876 - DNA, 25 bp, S. cerevisiae
cgcacgttgatctttacaatgaagt

SEQ ID NO: 117877 - DNA, 25 bp, S. cerevisiae
cacgttgatctttacaatgaagttg

SEQ ID NO: 117878 - DNA, 25 bp, S. cerevisiae
cgttgatctttacaatgaagttgcg

SEQ ID NO: 117879 - DNA, 25 bp, S. cerevisiae
gcacgttgatctttacaatgaagtt

SEQ ID NO: 117880 - DNA, 25 bp, S. cerevisiae
gcgcacgttgatctttacaatgaag

SEQ ID NO: 117881 - DNA, 25 bp, S. cerevisiae
agcgcacgttgatctttacaatgaa

SEQ ID NO: 117882 - DNA, 25 bp, S. cerevisiae
tagttgccaactgtcattatcgcgc

SEQ ID NO: 117883 - DNA, 25 bp, S. cerevisiae
ggtcgctggcgtttctatgacgaga

SEQ ID NO: 117884 - DNA, 25 bp, S. cerevisiae
gggtttgatcgtgatagttgccaac

SEQ ID NO: 117885 - DNA, 25 bp, S. cerevisiae
ggcgtttctatgacgagaaccataa

SEQ ID NO: 117886 - DNA, 25 bp, S. cerevisiae
tgagcttgagaaaaaccgtggttac

SEQ ID NO: 117887 - DNA, 25 bp, S. cerevisiae
gatattcaactgctaaagtgtccac

SEQ ID NO: 117888 - DNA, 25 bp, S. cerevisiae
aaaatagaacgcacgcgcggtcgct

SEQ ID NO: 117889 - DNA, 25 bp, S. cerevisiae
aactgtcattatcgcgcggtgaaga

SEQ ID NO: 117890 - DNA, 25 bp, S. cerevisiae
aagtgtccactcatcttgagcttga

SEQ ID NO: 117891 - DNA, 25 bp, S. cerevisiae
tactggcgggcaaaagggtttgatc

SEQ ID NO: 117892 - DNA, 25 bp, S. cerevisiae
ataaacaggtaaaggcagagccgat

SEQ ID NO: 117893 - DNA, 25 bp, S. cerevisiae
gggacgagctccacttagacggcga

SEQ ID NO: 117894 - DNA, 25 bp, S. cerevisiae
acgagctccacttagacggcgagga

SEQ ID NO: 117895 - DNA, 25 bp, S. cerevisiae
acgatttcgatctggacatgttggg

SEQ ID NO: 117896 - DNA, 25 bp, S. cerevisiae
gacgcgctagacgatttcgatctgg

SEQ ID NO: 117897 - DNA, 25 bp, S. cerevisiae
gccgacgcgctagacgatttcgatc

SEQ ID NO: 117898 - DNA, 25 bp, S. cerevisiae
ctagacgatttcgatctggacatgt

SEQ ID NO: 117899 - DNA, 25 bp, S. cerevisiae
cggcgaggacgtggcgatggcgcat

SEQ ID NO: 117900 - DNA, 25 bp, S. cerevisiae
gcgctagacgatttcgatctggaca

SEQ ID NO: 117901 - DNA, 25 bp, S. cerevisiae
atgccgacgcgctagacgatttcga

SEQ ID NO: 117902 - DNA, 25 bp, S. cerevisiae
atggcgcatgccgacgcgctagacg

SEQ ID NO: 117903 - DNA, 25 bp, S. cerevisiae
agctccacttagacggcgaggacgt

SEQ ID NO: 117904 - DNA, 25 bp, S. cerevisiae
tatggccgacttcgagtttgagcag

SEQ ID NO: 117905 - DNA, 25 bp, S. cerevisiae
tacggcgctctggatatggccgact

SEQ ID NO: 117906 - DNA, 25 bp, S. cerevisiae
tggccgacttcgagtttgagcagat

SEQ ID NO: 117907 - DNA, 25 bp, S. cerevisiae
gatatggccgacttcgagtttgagc

SEQ ID NO: 117908 - DNA, 25 bp, S. cerevisiae
acttcgagtttgagcagatgtttac

SEQ ID NO: 117909 - DNA, 25 bp, S. cerevisiae
ctggatatggccgacttcgagtttg

SEQ ID NO: 117910 - DNA, 25 bp, S. cerevisiae
cgacttcgagtttgagcagatgttt

SEQ ID NO: 117911 - DNA, 25 bp, S. cerevisiae
gccgacttcgagtttgagcagatgt

SEQ ID NO: 117912 - DNA, 25 bp, S. cerevisiae
cctacggcgctctggatatggccga

SEQ ID NO: 117913 - DNA, 25 bp, S. cerevisiae
cgctctggatatggccgacttcgag

SEQ ID NO: 117914 - DNA, 25 bp, S. cerevisiae
gcgctctggatatggccgacttcga

SEQ ID NO: 117915 - DNA, 25 bp, S. cerevisiae
gtggcggaccgctatcaggacatag

SEQ ID NO: 117916 - DNA, 25 bp, S. cerevisiae
tggctacccgtgatattgctgaaga

SEQ ID NO: 117917 - DNA, 25 bp, S. cerevisiae
aaaatggccgcttttctggattcat

SEQ ID NO: 117918 - DNA, 25 bp, S. cerevisiae
aatgcggcggctgcatacgcttgat

SEQ ID NO: 117919 - DNA, 25 bp, S. cerevisiae
aagccggtcttgtcgatcaggatga

SEQ ID NO: 117920 - DNA, 25 bp, S. cerevisiae
tctggattcatcgactgtggccggc

SEQ ID NO: 117921 - DNA, 25 bp, S. cerevisiae
tgcctgcttgccgaatatcatggtg

SEQ ID NO: 117922 - DNA, 25 bp, S. cerevisiae
gctcctgccgagaaagtatccatca

SEQ ID NO: 117923 - DNA, 25 bp, S. cerevisiae
aggacatagcgttggctacccgtga

SEQ ID NO: 117924 - DNA, 25 bp, S. cerevisiae
agctgtgctcgacgttgtcactgaa

SEQ ID NO: 117925 - DNA, 25 bp, S. cerevisiae
aggatctcgtcgtgacccatggcga

SEQ ID NO: 117926 - DNA, 25 bp, S. cerevisiae
tgaattcccggggatctcgacggcc

SEQ ID NO: 117927 - DNA, 25 bp, S. cerevisiae
gatccgcggccgctaacatggctga

SEQ ID NO: 117928 - DNA, 25 bp, S. cerevisiae
acaaggacgacgatgacaagtccat

SEQ ID NO: 117929 - DNA, 25 bp, S. cerevisiae
cgacgatgacaagtccatggctcgc

SEQ ID NO: 117930 - DNA, 25 bp, S. cerevisiae
aagcatgcccaaaaaagaagagaaa

SEQ ID NO: 117931 - DNA, 25 bp, S. cerevisiae
gacgacgatgacaagtccatggctc

SEQ ID NO: 117932 - DNA, 25 bp, S. cerevisiae
ctaacatggctgactacaaggacga

SEQ ID NO: 117933 - DNA, 25 bp, S. cerevisiae
ccgctaacatggctgactacaagga

SEQ ID NO: 117934 - DNA, 25 bp, S. cerevisiae
gcggccgctaacatggctgactaca

SEQ ID NO: 117935 - DNA, 25 bp, S. cerevisiae
agagaaaggtagatgaattcccggg

SEQ ID NO: 117936 - DNA, 25 bp, S. cerevisiae
atcgaacaagcatgcccaaaaaaga

SEQ ID NO: 117937 - DNA, 25 bp, S. cerevisiae
gtacaaaggctatcaggtggctccc

SEQ ID NO: 117938 - DNA, 25 bp, S. cerevisiae
ggcgttaatcaaagaggcgaactgt

SEQ ID NO: 117939 - DNA, 25 bp, S. cerevisiae
aactgtgtgtgagaggtcctatgat

SEQ ID NO: 117940 - DNA, 25 bp, S. cerevisiae
caacatcttcgacgcaggtgtcgca

SEQ ID NO: 117941 - DNA, 25 bp, S. cerevisiae
gcgaactgtgtgtgagaggtcctat

SEQ ID NO: 117942 - DNA, 25 bp, S. cerevisiae
gctgaattggaatccatcttgctcc

SEQ ID NO: 117943 - DNA, 25 bp, S. cerevisiae
gaagtctctgattaagtacaaaggc

SEQ ID NO: 117944 - DNA, 25 bp, S. cerevisiae
atcgttgaccgcctgaagtctctga

SEQ ID NO: 117945 - DNA, 25 bp, S. cerevisiae
attggaatccatcttgctccaacac

SEQ ID NO: 117946 - DNA, 25 bp, S. cerevisiae
accgcctgaagtctctgattaagta

SEQ ID NO: 117947 - DNA, 25 bp, S. cerevisiae
acgcaggtgtcgcaggtcttcccga

SEQ ID NO: 117948 - DNA, 25 bp, S. cerevisiae
gtggccaggacaacgtatactcatc

SEQ ID NO: 117949 - DNA, 25 bp, S. cerevisiae
ggaagacatttgatgacctcatttc

SEQ ID NO: 117950 - DNA, 25 bp, S. cerevisiae
gtttctcggtactatgcatatgatc

SEQ ID NO: 117951 - DNA, 25 bp, S. cerevisiae
actacttcgcactagtttctcggta

SEQ ID NO: 117952 - DNA, 25 bp, S. cerevisiae
aatgcgccttattcaatctttgcta

SEQ ID NO: 117953 - DNA, 25 bp, S. cerevisiae
aataggaccggcaattcttcaagca

SEQ ID NO: 117954 - DNA, 25 bp, S. cerevisiae
gagcgataagcgtgcttctgccgtg

SEQ ID NO: 117955 - DNA, 25 bp, S. cerevisiae
gaaggaagcatacgataccccgcat

SEQ ID NO: 117956 - DNA, 25 bp, S. cerevisiae
attctgaaccagtcctaaaacgagt

SEQ ID NO: 117957 - DNA, 25 bp, S. cerevisiae
atgaagggcctaacggagttgacta

SEQ ID NO: 117958 - DNA, 25 bp, S. cerevisiae
agcaatacctgatcactacttcgca

SEQ ID NO: 117959 - DNA, 25 bp, S. cerevisiae
tacggcaagctgaccctgaagttca

SEQ ID NO: 117960 - DNA, 25 bp, S. cerevisiae
gtcctgctggagttcgtgaccgccg

SEQ ID NO: 117961 - DNA, 25 bp, S. cerevisiae
gttcatctgcaccaccggcaagctg

SEQ ID NO: 117962 - DNA, 25 bp, S. cerevisiae
gagggcgatgccacctacggcaagc

SEQ ID NO: 117963 - DNA, 25 bp, S. cerevisiae
aagaccccaacgagaagcgcgatca

SEQ ID NO: 117964 - DNA, 25 bp, S. cerevisiae
acgagaagcgcgatcacatggtcct

SEQ ID NO: 117965 - DNA, 25 bp, S. cerevisiae
aagctgaccctgaagttcatctgca

SEQ ID NO: 117966 - DNA, 25 bp, S. cerevisiae
tgaagttcatctgcaccaccggcaa

SEQ ID NO: 117967 - DNA, 25 bp, S. cerevisiae
gaagcgcgatcacatggtcctgctg

SEQ ID NO: 117968 - DNA, 25 bp, S. cerevisiae
cctgagcaaagaccccaacgagaag

SEQ ID NO: 117969 - DNA, 25 bp, S. cerevisiae
cgcgatcacatggtcctgctggagt

SEQ ID NO: 117970 - DNA, 25 bp, S. cerevisiae
gtatcatccctctagctattatcat

SEQ ID NO: 117971 - DNA, 25 bp, S. cerevisiae
gtgctcatgatcacctgctgtatca

SEQ ID NO: 117972 - DNA, 25 bp, S. cerevisiae
ggtggttgtcatgatcttcgcctac

SEQ ID NO: 117973 - DNA, 25 bp, S. cerevisiae
tgtggccctgatgtcttcagtggaa

SEQ ID NO: 117974 - DNA, 25 bp, S. cerevisiae
gttcagtcctacatggtggtgctca

SEQ ID NO: 117975 - DNA, 25 bp, S. cerevisiae
gatgatggctctgaggtgtccacat

SEQ ID NO: 117976 - DNA, 25 bp, S. cerevisiae
gatactggcctcatggtctgaagac

SEQ ID NO: 117977 - DNA, 25 bp, S. cerevisiae
aaatgggcttctgctggcattatct

SEQ ID NO: 117978 - DNA, 25 bp, S. cerevisiae
tacaaccccgtcatttatgtcttca

SEQ ID NO: 117979 - DNA, 25 bp, S. cerevisiae
gacagttccgcgtatgcatcatgca

SEQ ID NO: 117980 - DNA, 25 bp, S. cerevisiae
atcattctctgctacattgctgtgt

SEQ ID NO: 117981 - DNA, 25 bp, S. cerevisiae
tttaccagacaaccattacctgtcc

SEQ ID NO: 117982 - DNA, 25 bp, S. cerevisiae
gtgccatgcccgaaggttatgtaca

SEQ ID NO: 117983 - DNA, 25 bp, S. cerevisiae
ggaatacaactataactcacacaat

SEQ ID NO: 117984 - DNA, 25 bp, S. cerevisiae
acaatgtatacatcatggcagacaa

SEQ ID NO: 117985 - DNA, 25 bp, S. cerevisiae
aaatactccaattggcgatggccct

SEQ ID NO: 117986 - DNA, 25 bp, S. cerevisiae
gacacgtgctgaagtcaagtttgaa

SEQ ID NO: 117987 - DNA, 25 bp, S. cerevisiae
gactttttcaagagtgccatgcccg

SEQ ID NO: 117988 - DNA, 25 bp, S. cerevisiae
gaagatggaaacattcttggacaca

SEQ ID NO: 117989 - DNA, 25 bp, S. cerevisiae
gaagcgttcaactagcagaccatta

SEQ ID NO: 117990 - DNA, 25 bp, S. cerevisiae
atggccaacacttgtcactactttc

SEQ ID NO: 117991 - DNA, 25 bp, S. cerevisiae
atggccctgtccttttaccagacaa

SEQ ID NO: 117992 - DNA, 25 bp, S. cerevisiae
ttctcttatggtgttcaatgctttt

SEQ ID NO: 117993 - DNA, 25 bp, S. cerevisiae
ttgtcactactttctcttatggtgt

SEQ ID NO: 117994 - DNA, 25 bp, S. cerevisiae
gtcactactttctcttatggtgttc

SEQ ID NO: 117995 - DNA, 25 bp, S. cerevisiae
actactttctcttatggtgttcaat

SEQ ID NO: 117996 - DNA, 25 bp, S. cerevisiae
aaccattacctgtccacacaatctg

SEQ ID NO: 117997 - DNA, 25 bp, S. cerevisiae
tactttctcttatggtgttcaatgc

SEQ ID NO: 117998 - DNA, 25 bp, S. cerevisiae
cttgtcactactttctcttatggtg

SEQ ID NO: 117999 - DNA, 25 bp, S. cerevisiae
cttatggtgttcaatgcttttcaag

SEQ ID NO: 118000 - DNA, 25 bp, S. cerevisiae
ctttctcttatggtgttcaatgctt

SEQ ID NO: 118001 - DNA, 25 bp, S. cerevisiae
ctcttatggtgttcaatgcttttca

SEQ ID NO: 118002 - DNA, 25 bp, S. cerevisiae
attacctgtccacacaatctgccct

SEQ ID NO: 118003 - DNA, 25 bp, S. cerevisiae
ttaccgacgtcagcctgggagacga

SEQ ID NO: 118004 - DNA, 25 bp, S. cerevisiae
tatgctgctgatccgggccaagttg

SEQ ID NO: 118005 - DNA, 25 bp, S. cerevisiae
tggacgacttcgacttggagatgct

SEQ ID NO: 118006 - DNA, 25 bp, S. cerevisiae
acggatcgacaatcgagggcctgct

SEQ ID NO: 118007 - DNA, 25 bp, S. cerevisiae
aagttggactcgtactccagcgtcg

SEQ ID NO: 118008 - DNA, 25 bp, S. cerevisiae
tcctctgggtactttatgctgctga

SEQ ID NO: 118009 - DNA, 25 bp, S. cerevisiae
tgaacctcccgctggtgcgaagtgc

SEQ ID NO: 118010 - DNA, 25 bp, S. cerevisiae
tcatgcgggagcacgcgtatagccg

SEQ ID NO: 118011 - DNA, 25 bp, S. cerevisiae
gcgactgcgggagctaaaccacatt

SEQ ID NO: 118012 - DNA, 25 bp, S. cerevisiae
agccgcgggcggaccagaaacaatt

SEQ ID NO: 118013 - DNA, 25 bp, S. cerevisiae
atgtcgtttctctccgcgggacaac

SEQ ID NO: 118014 - DNA, 25 bp, S. cerevisiae
gtcttaccggaaaactcgacgcaag

SEQ ID NO: 118015 - DNA, 25 bp, S. cerevisiae
ggcgcggtcggtaaagttgttccat

SEQ ID NO: 118016 - DNA, 25 bp, S. cerevisiae
tggagacatagcttactgggacgaa

SEQ ID NO: 118017 - DNA, 25 bp, S. cerevisiae
gatcgtggattacgtcgccagtcaa

SEQ ID NO: 118018 - DNA, 25 bp, S. cerevisiae
gatggatggctacattctggagaca

SEQ ID NO: 118019 - DNA, 25 bp, S. cerevisiae
gtaaacaatccggaagcgaccaacg

SEQ ID NO: 118020 - DNA, 25 bp, S. cerevisiae
cagctattctgattacacccgaggg

SEQ ID NO: 118021 - DNA, 25 bp, S. cerevisiae
gccagtcaagtaacaaccgcgaaaa

SEQ ID NO: 118022 - DNA, 25 bp, S. cerevisiae
cgccgccgttgttgttttggagcac

SEQ ID NO: 118023 - DNA, 25 bp, S. cerevisiae
agcgaccaacgccttgattgacaag

SEQ ID NO: 118024 - DNA, 25 bp, S. cerevisiae
aggtcttcccgacgatgacgccggt

SEQ ID NO: 118025 - DNA, 25 bp, S. cerevisiae
ggcgttaatcagagaggcgaattat

SEQ ID NO: 118026 - DNA, 25 bp, S. cerevisiae
gatattgttacaacaccccaacatc

SEQ ID NO: 118027 - DNA, 25 bp, S. cerevisiae
gaggcgaattatgtgtcagaggacc

SEQ ID NO: 118028 - DNA, 25 bp, S. cerevisiae
aatacaaaggatatcaggtggcccc

SEQ ID NO: 118029 - DNA, 25 bp, S. cerevisiae
caacatcttcgacgcgggcgtggca

SEQ ID NO: 118030 - DNA, 25 bp, S. cerevisiae
catagttgaccgcttgaagtcttta

SEQ ID NO: 118031 - DNA, 25 bp, S. cerevisiae
cgctgaattggaatcgatattgtta

SEQ ID NO: 118032 - DNA, 25 bp, S. cerevisiae
gaatcgatattgttacaacacccca

SEQ ID NO: 118033 - DNA, 25 bp, S. cerevisiae
acgcgggcgtggcaggtcttcccga

SEQ ID NO: 118034 - DNA, 25 bp, S. cerevisiae
agttgaccgcttgaagtctttaatt

SEQ ID NO: 118035 - DNA, 25 bp, S. cerevisiae
atgtgtcagaggacctatgattatg

SEQ ID NO: 118036 - DNA, 25 bp, S. cerevisiae
ttatatcaccattcttttcgccgat

SEQ ID NO: 118037 - DNA, 25 bp, S. cerevisiae
gggcatatcaataccattaccacaa

SEQ ID NO: 118038 - DNA, 25 bp, S. cerevisiae
aaaaacagctgacatctcgccttgt

SEQ ID NO: 118039 - DNA, 25 bp, S. cerevisiae
aagcaggaaaacatcgcagcgagca

SEQ ID NO: 118040 - DNA, 25 bp, S. cerevisiae
tcttttcgccgatagcgctaactaa

SEQ ID NO: 118041 - DNA, 25 bp, S. cerevisiae
tcatgggaactcctcagcaatggtc

SEQ ID NO: 118042 - DNA, 25 bp, S. cerevisiae
gacttgattttcatgggaactcctc

SEQ ID NO: 118043 - DNA, 25 bp, S. cerevisiae
gaagatctcaacgatatccccgttt

SEQ ID NO: 118044 - DNA, 25 bp, S. cerevisiae
gcagcgagcacagaaatcgatgact

SEQ ID NO: 118045 - DNA, 25 bp, S. cerevisiae
attatcgtcagttctgcgagaggct

SEQ ID NO: 118046 - DNA, 25 bp, S. cerevisiae
atggacgtactttcagcggttaagc

SEQ ID NO: 118047 - DNA, 25 bp, S. cerevisiae
aagcgcagcttgatctttacaacga

SEQ ID NO: 118048 - DNA, 25 bp, S. cerevisiae
cgcagcttgatctttacaacgaagt

SEQ ID NO: 118049 - DNA, 25 bp, S. cerevisiae
cagcttgatctttacaacgaagtcg

SEQ ID NO: 118050 - DNA, 25 bp, S. cerevisiae
cttgatctttacaacgaagtcgcga

SEQ ID NO: 118051 - DNA, 25 bp, S. cerevisiae
gcttgatctttacaacgaagtcgcg

SEQ ID NO: 118052 - DNA, 25 bp, S. cerevisiae
gcagcttgatctttacaacgaagtc

SEQ ID NO: 118053 - DNA, 25 bp, S. cerevisiae
gcgcagcttgatctttacaacgaag

SEQ ID NO: 118054 - DNA, 25 bp, S. cerevisiae
agcttgatctttacaacgaagtcgc

SEQ ID NO: 118055 - DNA, 25 bp, S. cerevisiae
agcgcagcttgatctttacaacgaa

SEQ ID NO: 118056 - DNA, 25 bp, S. cerevisiae
tagccaatacctcggttcctttaat

SEQ ID NO: 118057 - DNA, 25 bp, S. cerevisiae
gggataccttagattctactctcga

SEQ ID NO: 118058 - DNA, 25 bp, S. cerevisiae
ggtagctctcatgacttgggcgaaa

SEQ ID NO: 118059 - DNA, 25 bp, S. cerevisiae
ggttctgaagtgttcgttcgcgact

SEQ ID NO: 118060 - DNA, 25 bp, S. cerevisiae
gttatctctgatctggagctgtctt

SEQ ID NO: 118061 - DNA, 25 bp, S. cerevisiae
gattacctcagtttgcctatcgatg

SEQ ID NO: 118062 - DNA, 25 bp, S. cerevisiae
gattttgaacaactcaccatcgcga

SEQ ID NO: 118063 - DNA, 25 bp, S. cerevisiae
gactgcttcgagcatcactgggata

SEQ ID NO: 118064 - DNA, 25 bp, S. cerevisiae
gacgtcgactttatcgagcctgatt

SEQ ID NO: 118065 - DNA, 25 bp, S. cerevisiae
gagctgtcttttctgattactgcgg

SEQ ID NO: 118066 - DNA, 25 bp, S. cerevisiae
agctcgtgtcgcctatgaagttatc

SEQ ID NO: 118067 - DNA, 25 bp, S. cerevisiae
taccctactcttccggaggaaaatg

SEQ ID NO: 118068 - DNA, 25 bp, S. cerevisiae
ttgcctcctctaacgttcatgataa

SEQ ID NO: 118069 - DNA, 25 bp, S. cerevisiae
gtcaagctgttatctaaccgtccac

SEQ ID NO: 118070 - DNA, 25 bp, S. cerevisiae
ggtccgaacctcataacaactcaaa

SEQ ID NO: 118071 - DNA, 25 bp, S. cerevisiae
gttaaatatgtttctcctggctcag

SEQ ID NO: 118072 - DNA, 25 bp, S. cerevisiae
aattctcaagcgctttcacaaccaa

SEQ ID NO: 118073 - DNA, 25 bp, S. cerevisiae
cgtctgctttgtttggtggcgccaa

SEQ ID NO: 118074 - DNA, 25 bp, S. cerevisiae
actgtcacctggttggacggaccaa

SEQ ID NO: 118075 - DNA, 25 bp, S. cerevisiae
attgtccttcactttcactaacagt

SEQ ID NO: 118076 - DNA, 25 bp, S. cerevisiae
attgctgatagctcattgtccttca

SEQ ID NO: 118077 - DNA, 25 bp, S. cerevisiae
agtcacgccttttctagggcaacag

SEQ ID NO: 118078 - DNA, 25 bp, S. cerevisiae
ttccttgtcgggttattcgcgaaat

SEQ ID NO: 118079 - DNA, 25 bp, S. cerevisiae
tttaatcactcgcatccatcagaag

SEQ ID NO: 118080 - DNA, 25 bp, S. cerevisiae
ggttattaatccaggcgtcaccatc

SEQ ID NO: 118081 - DNA, 25 bp, S. cerevisiae
ggcgagatgtactcttttccgataa

SEQ ID NO: 118082 - DNA, 25 bp, S. cerevisiae
ggacaccctgtacaccatgaattga

SEQ ID NO: 118083 - DNA, 25 bp, S. cerevisiae
gttccaacatccatataggccgcaa

SEQ ID NO: 118084 - DNA, 25 bp, S. cerevisiae
tgataacgtactgattgcacccaac

SEQ ID NO: 118085 - DNA, 25 bp, S. cerevisiae
gaaaacgcctgggtagaaccgcctg

SEQ ID NO: 118086 - DNA, 25 bp, S. cerevisiae
ctgtctatttctcttacggttccaa

SEQ ID NO: 118087 - DNA, 25 bp, S. cerevisiae
attggcgcgggtagtatcgtcacaa

SEQ ID NO: 118088 - DNA, 25 bp, S. cerevisiae
agcaggcaagctatttaccgatatg

SEQ ID NO: 118089 - DNA, 25 bp, S. cerevisiae
tacttcgttctttgctaccggtgaa

SEQ ID NO: 118090 - DNA, 25 bp, S. cerevisiae
tttcctgcacctacgatgtttttga

SEQ ID NO: 118091 - DNA, 25 bp, S. cerevisiae
ttttatgtctgtactggcgggcaat

SEQ ID NO: 118092 - DNA, 25 bp, S. cerevisiae
ggcttcaccttaatttccgtgttca

SEQ ID NO: 118093 - DNA, 25 bp, S. cerevisiae
tgtctgtacgtattattggctcatc

SEQ ID NO: 118094 - DNA, 25 bp, S. cerevisiae
aaagcatcggtttccagggcgctta

SEQ ID NO: 118095 - DNA, 25 bp, S. cerevisiae
tcgattatgttctttgcgccactga

SEQ ID NO: 118096 - DNA, 25 bp, S. cerevisiae
gcgaattacttaacgcctcgattat

SEQ ID NO: 118097 - DNA, 25 bp, S. cerevisiae
gctggctggcactattatgtctgta

SEQ ID NO: 118098 - DNA, 25 bp, S. cerevisiae
atctggtctgtttctgcttctttaa

SEQ ID NO: 118099 - DNA, 25 bp, S. cerevisiae
atgtttgaagtaccgttcctgctgg

SEQ ID NO: 118100 - DNA, 25 bp, S. cerevisiae
ttttctcccatgaagacggtacgcg

SEQ ID NO: 118101 - DNA, 25 bp, S. cerevisiae
ttagcgggcccattaagttctgtct

SEQ ID NO: 118102 - DNA, 25 bp, S. cerevisiae
gtgccatgtccggttttcaacaaac

SEQ ID NO: 118103 - DNA, 25 bp, S. cerevisiae
ggcataaatatctcactcgcaatca

SEQ ID NO: 118104 - DNA, 25 bp, S. cerevisiae
tggagcatctggtcgcattgggtca

SEQ ID NO: 118105 - DNA, 25 bp, S. cerevisiae
gttgcccgtctcactggtgaaaaga

SEQ ID NO: 118106 - DNA, 25 bp, S. cerevisiae
actgcgatgctggttgccaacgatc

SEQ ID NO: 118107 - DNA, 25 bp, S. cerevisiae
aagacagctcatgttatatcccgcc

SEQ ID NO: 118108 - DNA, 25 bp, S. cerevisiae
tgaatgagggcatcgttcccactgc

SEQ ID NO: 118109 - DNA, 25 bp, S. cerevisiae
gcgtctggctggctggcataaatat

SEQ ID NO: 118110 - DNA, 25 bp, S. cerevisiae
gcgcgttggccgattcattaatgca

SEQ ID NO: 118111 - DNA, 25 bp, S. cerevisiae
ttactttagttccaccagatcgtca

SEQ ID NO: 118112 - DNA, 25 bp, S. cerevisiae
ggtgatttattcatcccggaatctc

SEQ ID NO: 118113 - DNA, 25 bp, S. cerevisiae
gtacacagttattagtcccaccagc

SEQ ID NO: 118114 - DNA, 25 bp, S. cerevisiae
gtcaggctgccatagatttgatgct

SEQ ID NO: 118115 - DNA, 25 bp, S. cerevisiae
gtcgttacccaattgcttactttag

SEQ ID NO: 118116 - DNA, 25 bp, S. cerevisiae
ggcggcagagaatcgtttacagcaa

SEQ ID NO: 118117 - DNA, 25 bp, S. cerevisiae
ggactgaagtgaaccatgctaatac

SEQ ID NO: 118118 - DNA, 25 bp, S. cerevisiae
gttatgaagctcgtaagcgtcgtta

SEQ ID NO: 118119 - DNA, 25 bp, S. cerevisiae
aaaacaccatcactgagggccctaa

SEQ ID NO: 118120 - DNA, 25 bp, S. cerevisiae
aatgaagaagttccctccaggcgaa

SEQ ID NO: 118121 - DNA, 25 bp, S. cerevisiae
gaaatggtatgctctcttcacaaga

SEQ ID NO: 118122 - DNA, 25 bp, S. cerevisiae
tattatccgatgtgacgctgcagct

SEQ ID NO: 118123 - DNA, 25 bp, S. cerevisiae
tagtatactccgtctactgtacgat

SEQ ID NO: 118124 - DNA, 25 bp, S. cerevisiae
gatcgtacttgttacccatcattga

SEQ ID NO: 118125 - DNA, 25 bp, S. cerevisiae
gttactctattgatccagctcagca

SEQ ID NO: 118126 - DNA, 25 bp, S. cerevisiae
tgaattttgaacatccgaacctggg

SEQ ID NO: 118127 - DNA, 25 bp, S. cerevisiae
taacgaggccttaccactcttttgt

SEQ ID NO: 118128 - DNA, 25 bp, S. cerevisiae
gacgctgcagcttctcaatgatatt

SEQ ID NO: 118129 - DNA, 25 bp, S. cerevisiae
tcaggtccttgtcctttaacgaggc

SEQ ID NO: 118130 - DNA, 25 bp, S. cerevisiae
gctggcacttagaattccacggact

SEQ ID NO: 118131 - DNA, 25 bp, S. cerevisiae
atggctgccatcattattatccgat

SEQ ID NO: 118132 - DNA, 25 bp, S. cerevisiae
atgtgtctactttcaggcgggtctg

SEQ ID NO: 118133 - DNA, 25 bp, S. cerevisiae
tataggagatcaggagctaccgcct

SEQ ID NO: 118134 - DNA, 25 bp, S. cerevisiae
tatcgcggtagtagtttttcacacg

SEQ ID NO: 118135 - DNA, 25 bp, S. cerevisiae
tgtcaagcatattgggcatctggcc

SEQ ID NO: 118136 - DNA, 25 bp, S. cerevisiae
gaggacccttctcgtgaactaaaca

SEQ ID NO: 118137 - DNA, 25 bp, S. cerevisiae
gttattaggtgctccataattcatg

SEQ ID NO: 118138 - DNA, 25 bp, S. cerevisiae
aaacttctccgccttgaagaatgtt

SEQ ID NO: 118139 - DNA, 25 bp, S. cerevisiae
acagccgtatgggtctacttgacag

SEQ ID NO: 118140 - DNA, 25 bp, S. cerevisiae
gatggcgaacctcaaaattcgtcgt

SEQ ID NO: 118141 - DNA, 25 bp, S. cerevisiae
gagctaccgcctgaagaggaccctt

SEQ ID NO: 118142 - DNA, 25 bp, S. cerevisiae
gaagagcagcatattacagccgtat

SEQ ID NO: 118143 - DNA, 25 bp, S. cerevisiae
attctcacgttttcatgtcaagcat

SEQ ID NO: 118144 - DNA, 25 bp, S. cerevisiae
tataccaattcctcttcctagctac

SEQ ID NO: 118145 - DNA, 25 bp, S. cerevisiae
ttcctagctactttcatcaattgtg

SEQ ID NO: 118146 - DNA, 25 bp, S. cerevisiae
ttgcaattacagttcgaatcatcgg

SEQ ID NO: 118147 - DNA, 25 bp, S. cerevisiae
gatgattacacataacggaacagca

SEQ ID NO: 118148 - DNA, 25 bp, S. cerevisiae
taaagaaattgattcctgcttggga

SEQ ID NO: 118149 - DNA, 25 bp, S. cerevisiae
taatactatcataagcaattcgctg

SEQ ID NO: 118150 - DNA, 25 bp, S. cerevisiae
gagagccacattcatgagctataat

SEQ ID NO: 118151 - DNA, 25 bp, S. cerevisiae
gaacagcaatcaagagagccacatt

SEQ ID NO: 118152 - DNA, 25 bp, S. cerevisiae
gaaagcatctgggagatcactgaga

SEQ ID NO: 118153 - DNA, 25 bp, S. cerevisiae
gcaacaattctggaagcctcattaa

SEQ ID NO: 118154 - DNA, 25 bp, S. cerevisiae
aggcacatatacttctttagcgcaa

SEQ ID NO: 118155 - DNA, 25 bp, S. cerevisiae
ttgtcaataaatcactccagtttaa

SEQ ID NO: 118156 - DNA, 25 bp, S. cerevisiae
tattgtcaataaatcactccagttt

SEQ ID NO: 118157 - DNA, 25 bp, S. cerevisiae
gtcaataaatcactccagtttaaat

SEQ ID NO: 118158 - DNA, 25 bp, S. cerevisiae
tgtcaataaatcactccagtttaaa

SEQ ID NO: 118159 - DNA, 25 bp, S. cerevisiae
gatattgtcaataaatcactccagt

SEQ ID NO: 118160 - DNA, 25 bp, S. cerevisiae
aataaatcactccagtttaaataca

SEQ ID NO: 118161 - DNA, 25 bp, S. cerevisiae
taaatcactccagtttaaatacaag

SEQ ID NO: 118162 - DNA, 25 bp, S. cerevisiae
ctgagtttcgatattgtcaataaat

SEQ ID NO: 118163 - DNA, 25 bp, S. cerevisiae
gctgagtttcgatattgtcaataaa

SEQ ID NO: 118164 - DNA, 25 bp, S. cerevisiae
atattgtcaataaatcactccagtt

SEQ ID NO: 118165 - DNA, 25 bp, S. cerevisiae
attgtcaataaatcactccagttta

SEQ ID NO: 118166 - DNA, 25 bp, S. cerevisiae
gtataatgtatgttatccgaaacat

SEQ ID NO: 118167 - DNA, 25 bp, S. cerevisiae
gttatccgaaacatatcactcactt

SEQ ID NO: 118168 - DNA, 25 bp, S. cerevisiae
acccttaatataacttcgtataatg

SEQ ID NO: 118169 - DNA, 25 bp, S. cerevisiae
aacttcgtataatgtatgttatccg

SEQ ID NO: 118170 - DNA, 25 bp, S. cerevisiae
acttcgtataatgtatgttatccga

SEQ ID NO: 118171 - DNA, 25 bp, S. cerevisiae
tcgtataatgtatgttatccgaaac

SEQ ID NO: 118172 - DNA, 25 bp, S. cerevisiae
tcaataacccttaatataacttcgt

SEQ ID NO: 118173 - DNA, 25 bp, S. cerevisiae
ttcaataacccttaatataacttcg

SEQ ID NO: 118174 - DNA, 25 bp, S. cerevisiae
cttcgtataatgtatgttatccgaa

SEQ ID NO: 118175 - DNA, 25 bp, S. cerevisiae
cgtataatgtatgttatccgaaaca

SEQ ID NO: 118176 - DNA, 25 bp, S. cerevisiae
atccgaaacatatcactcactttgg

SEQ ID NO: 118177 - DNA, 25 bp, S. cerevisiae
gtataatgtatgttatccgaaacat

SEQ ID NO: 118178 - DNA, 25 bp, S. cerevisiae
acccttaatataacttcgtataatg

SEQ ID NO: 118179 - DNA, 25 bp, S. cerevisiae
aacttcgtataatgtatgttatccg

SEQ ID NO: 118180 - DNA, 25 bp, S. cerevisiae
acttcgtataatgtatgttatccga

SEQ ID NO: 118181 - DNA, 25 bp, S. cerevisiae
tcgtataatgtatgttatccgaaac

SEQ ID NO: 118182 - DNA, 25 bp, S. cerevisiae
tcaataacccttaatataacttcgt

SEQ ID NO: 118183 - DNA, 25 bp, S. cerevisiae
ttcaataacccttaatataacttcg

SEQ ID NO: 118184 - DNA, 25 bp, S. cerevisiae
cgtataatgtatgttatccgaaaca

SEQ ID NO: 118185 - DNA, 25 bp, S. cerevisiae
ccttaatataacttcgtataatgta

SEQ ID NO: 118186 - DNA, 25 bp, S. cerevisiae
cccttaatataacttcgtataatgt

SEQ ID NO: 118187 - DNA, 25 bp, S. cerevisiae
cttcgtataatgtatgttatccgaa

SEQ ID NO: 118188 - DNA, 25 bp, S. cerevisiae
gataacttcctgttatccgaaacat

SEQ ID NO: 118189 - DNA, 25 bp, S. cerevisiae
actctcatcgcttcggataacttcc

SEQ ID NO: 118190 - DNA, 25 bp, S. cerevisiae
aactctcatcgcttcggataacttc

SEQ ID NO: 118191 - DNA, 25 bp, S. cerevisiae
tcatcgcttcggataacttcctgtt

SEQ ID NO: 118192 - DNA, 25 bp, S. cerevisiae
tcgcttcggataacttcctgttatc

SEQ ID NO: 118193 - DNA, 25 bp, S. cerevisiae
ctcatcgcttcggataacttcctgt

SEQ ID NO: 118194 - DNA, 25 bp, S. cerevisiae
ctctcatcgcttcggataacttcct

SEQ ID NO: 118195 - DNA, 25 bp, S. cerevisiae
catcgcttcggataacttcctgtta

SEQ ID NO: 118196 - DNA, 25 bp, S. cerevisiae
cgcttcggataacttcctgttatcc

SEQ ID NO: 118197 - DNA, 25 bp, S. cerevisiae
gcttcggataacttcctgttatccg

SEQ ID NO: 118198 - DNA, 25 bp, S. cerevisiae
atcgcttcggataacttcctgttat

SEQ ID NO: 118199 - DNA, 25 bp, S. cerevisiae
ttgtcagacatgtataccccgtacg

SEQ ID NO: 118200 - DNA, 25 bp, S. cerevisiae
ttgctgatgcggtgctgattacgac

SEQ ID NO: 118201 - DNA, 25 bp, S. cerevisiae
gtgcacggcagatacacttgctgat

SEQ ID NO: 118202 - DNA, 25 bp, S. cerevisiae
ggcacatggctgaatatcgacggtt

SEQ ID NO: 118203 - DNA, 25 bp, S. cerevisiae
tgttttgaccgctgggatctgccat

SEQ ID NO: 118204 - DNA, 25 bp, S. cerevisiae
aaactggctcggattagggccgcaa

SEQ ID NO: 118205 - DNA, 25 bp, S. cerevisiae
aagcagcgttgttgcagtgcacggc

SEQ ID NO: 118206 - DNA, 25 bp, S. cerevisiae
gaagtggcgagcgatacaccgcatc

SEQ ID NO: 118207 - DNA, 25 bp, S. cerevisiae
gcgaattgaattatggcccacacca

SEQ ID NO: 118208 - DNA, 25 bp, S. cerevisiae
agtggcgcggcgacttccagttcaa

SEQ ID NO: 118209 - DNA, 25 bp, S. cerevisiae
agttcaacatcagccgctacagtca

SEQ ID NO: 118210 - DNA, 25 bp, S. cerevisiae
gttcaagtccatctacatggccaag

SEQ ID NO: 118211 - DNA, 25 bp, S. cerevisiae
gaggactacaccatcgtggagcagt

SEQ ID NO: 118212 - DNA, 25 bp, S. cerevisiae
gttccagtacggctccaaggtgtac

SEQ ID NO: 118213 - DNA, 25 bp, S. cerevisiae
aacggccacgagttcgagatcgagg

SEQ ID NO: 118214 - DNA, 25 bp, S. cerevisiae
tgaagctgaaggacggcggccacta

SEQ ID NO: 118215 - DNA, 25 bp, S. cerevisiae
gacggctgcttcatctacaaggtga

SEQ ID NO: 118216 - DNA, 25 bp, S. cerevisiae
cggctactactacgtggactccaag

SEQ ID NO: 118217 - DNA, 25 bp, S. cerevisiae
gcggccactacctggtggagttcaa

SEQ ID NO: 118218 - DNA, 25 bp, S. cerevisiae
cgacggccccgtaatgcagaagaag

SEQ ID NO: 118219 - DNA, 25 bp, S. cerevisiae
gacatccccgactacaagaagctgt

SEQ ID NO: 118220 - DNA, 25 bp, S. cerevisiae
agaccgccaagctgaaggtgaccaa

SEQ ID NO: 118221 - DNA, 25 bp, S. cerevisiae
gtgtgtccatccctgaaatcatgca

SEQ ID NO: 118222 - DNA, 25 bp, S. cerevisiae
ggcctttgaacgcactgactttgac

SEQ ID NO: 118223 - DNA, 25 bp, S. cerevisiae
tggtgtggctgatgaccccaacaac

SEQ ID NO: 118224 - DNA, 25 bp, S. cerevisiae
ggaagggatctttgaggccacccac

SEQ ID NO: 118225 - DNA, 25 bp, S. cerevisiae
accgcctgatctatggtgccaagga

SEQ ID NO: 118226 - DNA, 25 bp, S. cerevisiae
actctgccagagtgggtgctgccag

SEQ ID NO: 118227 - DNA, 25 bp, S. cerevisiae
aatgctgatccacattggcaggacc

SEQ ID NO: 118228 - DNA, 25 bp, S. cerevisiae
aagaccctggtgtccacagctggtg

SEQ ID NO: 118229 - DNA, 25 bp, S. cerevisiae
tcagagtgaaggacatctcccgcac

SEQ ID NO: 118230 - DNA, 25 bp, S. cerevisiae
gaaagaatggtgtggctgccccttc

SEQ ID NO: 118231 - DNA, 25 bp, S. cerevisiae
atggatctctgtgtctggtgtggct

SEQ ID NO: 118232 - DNA, 25 bp, S. cerevisiae
gggatagtgttcacccttgttacac

SEQ ID NO: 118233 - DNA, 25 bp, S. cerevisiae
tgttacaccgttttccatgagcaaa

SEQ ID NO: 118234 - DNA, 25 bp, S. cerevisiae
gatttccggcagtttctacacatat

SEQ ID NO: 118235 - DNA, 25 bp, S. cerevisiae
gatggcttccatgtcggcagaatgc

SEQ ID NO: 118236 - DNA, 25 bp, S. cerevisiae
gttcagctggatattacggcctttt

SEQ ID NO: 118237 - DNA, 25 bp, S. cerevisiae
gaggcatttcagtcagttgctcaat

SEQ ID NO: 118238 - DNA, 25 bp, S. cerevisiae
acaaggtgctgatgccgctggcgat

SEQ ID NO: 118239 - DNA, 25 bp, S. cerevisiae
aaacgttttcatcgctctggagtga

SEQ ID NO: 118240 - DNA, 25 bp, S. cerevisiae
aatatgtttttcgtctcagccaatc

SEQ ID NO: 118241 - DNA, 25 bp, S. cerevisiae
agcacaagttttatccggcctttat

SEQ ID NO: 118242 - DNA, 25 bp, S. cerevisiae
agtgaataccacgacgatttccggc

SEQ ID NO: 118243 - DNA, 25 bp, S. cerevisiae
gtaagccctcccgtatcgtagttat

SEQ ID NO: 118244 - DNA, 25 bp, S. cerevisiae
gtaactcgccttgatcgttgggaac
